United States Patent 7,888,497 (BIOINFORMATICALLY DETECTABLE GROUP OF NOVEL REGULATORY OLIGONUCLEOTIDES AND USES THEREOF) - sequence listing, part 96

SEQ ID NO: 4058131 - DNA, 22 bp, Homo sapiens
atggtgtagaacactaattcat

SEQ ID NO: 4058132 - DNA, 20 bp, Homo sapiens
atggtgttgccctgagtgga

SEQ ID NO: 4058133 - DNA, 18 bp, Homo sapiens
atggttacttcttctctt

SEQ ID NO: 4058134 - DNA, 16 bp, Homo sapiens
atggttatgaaagaat

SEQ ID NO: 4058135 - DNA, 19 bp, Homo sapiens
atggttatgaaagaatata

SEQ ID NO: 4058136 - DNA, 20 bp, Homo sapiens
atggttccatgcctgagggt

SEQ ID NO: 4058137 - DNA, 22 bp, Homo sapiens
atggttccatgcctgagggtgg

SEQ ID NO: 4058138 - DNA, 16 bp, Homo sapiens
atggttgagaaatgaa

SEQ ID NO: 4058139 - DNA, 14 bp, Homo sapiens
atggttgatggaaa

SEQ ID NO: 4058140 - DNA, 16 bp, Homo sapiens
atggttgatggaaaat

SEQ ID NO: 4058141 - DNA, 18 bp, Homo sapiens
atggttgatggaaaataa

SEQ ID NO: 4058142 - DNA, 13 bp, Homo sapiens
atggttggtttta

SEQ ID NO: 4058143 - DNA, 15 bp, Homo sapiens
atggtttctgaaaat

SEQ ID NO: 4058144 - DNA, 12 bp, Homo sapiens
atggtttggttt

SEQ ID NO: 4058145 - DNA, 14 bp, Homo sapiens
atggttttaaactt

SEQ ID NO: 4058146 - DNA, 15 bp, Homo sapiens
atggttttaaacttt

SEQ ID NO: 4058147 - DNA, 13 bp, Homo sapiens
atgtaaaatgatt

SEQ ID NO: 4058148 - DNA, 17 bp, Homo sapiens
atgtaaactatttgtgg

SEQ ID NO: 4058149 - DNA, 17 bp, Homo sapiens
atgtaaagaaatgtctt

SEQ ID NO: 4058150 - DNA, 17 bp, Homo sapiens
atgtaacacataaacaa

SEQ ID NO: 4058151 - DNA, 19 bp, Homo sapiens
atgtaacacataaacaatt

SEQ ID NO: 4058152 - DNA, 17 bp, Homo sapiens
atgtaactccagataga

SEQ ID NO: 4058153 - DNA, 20 bp, Homo sapiens
atgtaactccagatagagaa

SEQ ID NO: 4058154 - DNA, 19 bp, Homo sapiens
atgtaagaattcagaagac

SEQ ID NO: 4058155 - DNA, 20 bp, Homo sapiens
atgtaagagcaccttcctca

SEQ ID NO: 4058156 - DNA, 17 bp, Homo sapiens
atgtaataactgtgaag

SEQ ID NO: 4058157 - DNA, 21 bp, Homo sapiens
atgtaatactggaataatttg

SEQ ID NO: 4058158 - DNA, 16 bp, Homo sapiens
atgtaatcaatgtttc

SEQ ID NO: 4058159 - DNA, 18 bp, Homo sapiens
atgtaatgttaatgttat

SEQ ID NO: 4058160 - DNA, 23 bp, Homo sapiens
atgtaattaagtactatgtatca

SEQ ID NO: 4058161 - DNA, 15 bp, Homo sapiens
atgtaattgaataaa

SEQ ID NO: 4058162 - DNA, 14 bp, Homo sapiens
atgtaatttagaaa

SEQ ID NO: 4058163 - DNA, 15 bp, Homo sapiens
atgtaatttatgcaa

SEQ ID NO: 4058164 - DNA, 21 bp, Homo sapiens
atgtacatagttatttttctc

SEQ ID NO: 4058165 - DNA, 15 bp, Homo sapiens
atgtacatgagaagg

SEQ ID NO: 4058166 - DNA, 14 bp, Homo sapiens
atgtacattaatta

SEQ ID NO: 4058167 - DNA, 16 bp, Homo sapiens
atgtacatttgtcttt

SEQ ID NO: 4058168 - DNA, 15 bp, Homo sapiens
atgtaccatttgcat

SEQ ID NO: 4058169 - DNA, 18 bp, Homo sapiens
atgtacggattttcagtt

SEQ ID NO: 4058170 - DNA, 20 bp, Homo sapiens
atgtactcctctttacactg

SEQ ID NO: 4058171 - DNA, 18 bp, Homo sapiens
atgtactgagccttgtaa

SEQ ID NO: 4058172 - DNA, 16 bp, Homo sapiens
atgtactgtagttttt

SEQ ID NO: 4058173 - DNA, 19 bp, Homo sapiens
atgtactgtagtttttctt

SEQ ID NO: 4058174 - DNA, 17 bp, Homo sapiens
atgtagactgtgccaga

SEQ ID NO: 4058175 - DNA, 22 bp, Homo sapiens
atgtagatattgtgaagtacat

SEQ ID NO: 4058176 - DNA, 17 bp, Homo sapiens
atgtagcaaaacgcatg

SEQ ID NO: 4058177 - DNA, 18 bp, Homo sapiens
atgtagcattatgcaatt

SEQ ID NO: 4058178 - DNA, 21 bp, Homo sapiens
atgtagccccctggcctctgt

SEQ ID NO: 4058179 - DNA, 23 bp, Homo sapiens
atgtagccccctggcctctgtgc

SEQ ID NO: 4058180 - DNA, 16 bp, Homo sapiens
atgtagcgtgtttaca

SEQ ID NO: 4058181 - DNA, 21 bp, Homo sapiens
atgtagcgtgtttacatgtgt

SEQ ID NO: 4058182 - DNA, 15 bp, Homo sapiens
atgtagctggtttcc

SEQ ID NO: 4058183 - DNA, 18 bp, Homo sapiens
atgtagcttcttctgaaa

SEQ ID NO: 4058184 - DNA, 23 bp, Homo sapiens
atgtaggagctgccttggctcag

SEQ ID NO: 4058185 - DNA, 14 bp, Homo sapiens
atgtaggtaaattc

SEQ ID NO: 4058186 - DNA, 13 bp, Homo sapiens
atgtagtaattga

SEQ ID NO: 4058187 - DNA, 17 bp, Homo sapiens
atgtagtataaagaaaa

SEQ ID NO: 4058188 - DNA, 15 bp, Homo sapiens
atgtatataagtact

SEQ ID NO: 4058189 - DNA, 21 bp, Homo sapiens
atgtatatcattctacagaat

SEQ ID NO: 4058190 - DNA, 18 bp, Homo sapiens
atgtgaggaggaaaagga

SEQ ID NO: 4058191 - DNA, 18 bp, Homo sapiens
atgtgagtgccttttgca

SEQ ID NO: 4058192 - DNA, 21 bp, Homo sapiens
atgtgatacccatagcttcca

SEQ ID NO: 4058193 - DNA, 15 bp, Homo sapiens
atgtgatatataagt

SEQ ID NO: 4058194 - DNA, 16 bp, Homo sapiens
atgtgatatataagtg

SEQ ID NO: 4058195 - DNA, 19 bp, Homo sapiens
atgtgatatataagtgtac

SEQ ID NO: 4058196 - DNA, 21 bp, Homo sapiens
atgtgatatataagtgtacat

SEQ ID NO: 4058197 - DNA, 18 bp, Homo sapiens
atgtgatcacgcctggct

SEQ ID NO: 4058198 - DNA, 15 bp, Homo sapiens
atgtgattacaaggc

SEQ ID NO: 4058199 - DNA, 21 bp, Homo sapiens
atgtgattttcctttgtagct

SEQ ID NO: 4058200 - DNA, 14 bp, Homo sapiens
atgtgatttttctg

SEQ ID NO: 4058201 - DNA, 20 bp, Homo sapiens
atgtgcaagcgacgacagat

SEQ ID NO: 4058202 - DNA, 13 bp, Homo sapiens
atgtgcaattgtg

SEQ ID NO: 4058203 - DNA, 16 bp, Homo sapiens
atgtgcacccatgggc

SEQ ID NO: 4058204 - DNA, 19 bp, Homo sapiens
atgtgcacccggcctggat

SEQ ID NO: 4058205 - DNA, 22 bp, Homo sapiens
atgtgcactgtcactttgctct

SEQ ID NO: 4058206 - DNA, 17 bp, Homo sapiens
atgtgcaggtttgttac

SEQ ID NO: 4058207 - DNA, 23 bp, Homo sapiens
atgtgcagtgtagcccacacttg

SEQ ID NO: 4058208 - DNA, 16 bp, Homo sapiens
atgtgccaataaccaa

SEQ ID NO: 4058209 - DNA, 20 bp, Homo sapiens
atgtgccagggcaatgatga

SEQ ID NO: 4058210 - DNA, 22 bp, Homo sapiens
atgtgcctttctttgcctctgc

SEQ ID NO: 4058211 - DNA, 18 bp, Homo sapiens
atgtgctgggtgcctccc

SEQ ID NO: 4058212 - DNA, 18 bp, Homo sapiens
atgtggaccttagaatac

SEQ ID NO: 4058213 - DNA, 14 bp, Homo sapiens
atgtggccccaccc

SEQ ID NO: 4058214 - DNA, 15 bp, Homo sapiens
atgtgggcacggagg

SEQ ID NO: 4058215 - DNA, 18 bp, Homo sapiens
atgtgggcactggcccag

SEQ ID NO: 4058216 - DNA, 16 bp, Homo sapiens
atgtggggccaggtca

SEQ ID NO: 4058217 - DNA, 13 bp, Homo sapiens
atgtggtctcagg

SEQ ID NO: 4058218 - DNA, 13 bp, Homo sapiens
atgtggtgcctga

SEQ ID NO: 4058219 - DNA, 22 bp, Homo sapiens
atgtggtggcacaggccccctt

SEQ ID NO: 4058220 - DNA, 19 bp, Homo sapiens
atgtgtatgcacagtaaaa

SEQ ID NO: 4058221 - DNA, 20 bp, Homo sapiens
atgtgtatgcacagtaaaaa

SEQ ID NO: 4058222 - DNA, 14 bp, Homo sapiens
atgtgtatttatac

SEQ ID NO: 4058223 - DNA, 14 bp, Homo sapiens
atgtgtcacttgtg

SEQ ID NO: 4058224 - DNA, 15 bp, Homo sapiens
atgtgtcacttgtgc

SEQ ID NO: 4058225 - DNA, 17 bp, Homo sapiens
atgtgtcacttgtgctt

SEQ ID NO: 4058226 - DNA, 15 bp, Homo sapiens
atgtgtccatttcct

SEQ ID NO: 4058227 - DNA, 11 bp, Homo sapiens
atgtgtcccct

SEQ ID NO: 4058228 - DNA, 15 bp, Homo sapiens
atgtgtcccctcact

SEQ ID NO: 4058229 - DNA, 18 bp, Homo sapiens
atgtgtcccctcactctg

SEQ ID NO: 4058230 - DNA, 20 bp, Homo sapiens
atgtgtcccgaatccacagt

SEQ ID NO: 4058231 - DNA, 22 bp, Homo sapiens
atgtgtcctatctatcttccaa

SEQ ID NO: 4058232 - DNA, 18 bp, Homo sapiens
atgtgtcctcagggagca

SEQ ID NO: 4058233 - DNA, 21 bp, Homo sapiens
atgtgtctgtatttcatgtgg

SEQ ID NO: 4058234 - DNA, 19 bp, Homo sapiens
atgtgtctttatagatgta

SEQ ID NO: 4058235 - DNA, 15 bp, Homo sapiens
atgtgtgaggagctg

SEQ ID NO: 4058236 - DNA, 19 bp, Homo sapiens
atgtgtgaggagctgctgg

SEQ ID NO: 4058237 - DNA, 22 bp, Homo sapiens
atgtgtgaggagctgctggctt

SEQ ID NO: 4058238 - DNA, 17 bp, Homo sapiens
atgtgtggtggcctcag

SEQ ID NO: 4058239 - DNA, 21 bp, Homo sapiens
atgtgtgtgtatgtttgcaca

SEQ ID NO: 4058240 - DNA, 18 bp, Homo sapiens
atgtgtgtgtgtggcagg

SEQ ID NO: 4058241 - DNA, 14 bp, Homo sapiens
atgtgtgttttttc

SEQ ID NO: 4058242 - DNA, 14 bp, Homo sapiens
atgtgttgaaaaaa

SEQ ID NO: 4058243 - DNA, 13 bp, Homo sapiens
atgtgttgccact

SEQ ID NO: 4058244 - DNA, 19 bp, Homo sapiens
atgtgttgccactttccaa

SEQ ID NO: 4058245 - DNA, 15 bp, Homo sapiens
atgtgtttactttaa

SEQ ID NO: 4058246 - DNA, 14 bp, Homo sapiens
atgtgttttctgaa

SEQ ID NO: 4058247 - DNA, 13 bp, Homo sapiens
atgttaaatactg

SEQ ID NO: 4058248 - DNA, 21 bp, Homo sapiens
atgttaaatactgtgcagaat

SEQ ID NO: 4058249 - DNA, 14 bp, Homo sapiens
atgttaaatttgta

SEQ ID NO: 4058250 - DNA, 15 bp, Homo sapiens
atgttaaatttgtaa

SEQ ID NO: 4058251 - DNA, 20 bp, Homo sapiens
atgttaaatttgtaagtttc

SEQ ID NO: 4058252 - DNA, 22 bp, Homo sapiens
atgttaaatttgtaagtttcag

SEQ ID NO: 4058253 - DNA, 23 bp, Homo sapiens
atgttaaccagaataaagttctg

SEQ ID NO: 4058254 - DNA, 19 bp, Homo sapiens
atgttaaggaaactcttat

SEQ ID NO: 4058255 - DNA, 20 bp, Homo sapiens
atgttaatggatttcagaag

SEQ ID NO: 4058256 - DNA, 20 bp, Homo sapiens
atgttacatctgttttaaat

SEQ ID NO: 4058257 - DNA, 14 bp, Homo sapiens
atgttacattatta

SEQ ID NO: 4058258 - DNA, 21 bp, Homo sapiens
atgttaccatcttacttgagc

SEQ ID NO: 4058259 - DNA, 18 bp, Homo sapiens
atgttactcagtgttaga

SEQ ID NO: 4058260 - DNA, 23 bp, Homo sapiens
atgttactcagtgttagagaaat

SEQ ID NO: 4058261 - DNA, 13 bp, Homo sapiens
atgttactgatca

SEQ ID NO: 4058262 - DNA, 18 bp, Homo sapiens
atgttactgatcatgcat

SEQ ID NO: 4058263 - DNA, 21 bp, Homo sapiens
atgttactgatcatgcattgt

SEQ ID NO: 4058264 - DNA, 16 bp, Homo sapiens
atgttagggtgctctg

SEQ ID NO: 4058265 - DNA, 19 bp, Homo sapiens
atgttagtattttaatcct

SEQ ID NO: 4058266 - DNA, 11 bp, Homo sapiens
atgttagttct

SEQ ID NO: 4058267 - DNA, 16 bp, Homo sapiens
atgttatatcatatgt

SEQ ID NO: 4058268 - DNA, 18 bp, Homo sapiens
atgttatgactatgtaaa

SEQ ID NO: 4058269 - DNA, 18 bp, Homo sapiens
atgttatgatattgttta

SEQ ID NO: 4058270 - DNA, 18 bp, Homo sapiens
atgttattttctgttgaa

SEQ ID NO: 4058271 - DNA, 17 bp, Homo sapiens
atgttcaaagccacatt

SEQ ID NO: 4058272 - DNA, 19 bp, Homo sapiens
atgttcacgcaacttgaaa

SEQ ID NO: 4058273 - DNA, 15 bp, Homo sapiens
atgttcactgtgagt

SEQ ID NO: 4058274 - DNA, 21 bp, Homo sapiens
atgttcatcatcctaagctat

SEQ ID NO: 4058275 - DNA, 20 bp, Homo sapiens
atgttctatggttatgaaag

SEQ ID NO: 4058276 - DNA, 14 bp, Homo sapiens
atgttctattgtgg

SEQ ID NO: 4058277 - DNA, 20 bp, Homo sapiens
atgttctgacattaacagtt

SEQ ID NO: 4058278 - DNA, 21 bp, Homo sapiens
atgttctgtgcctgtaaacat

SEQ ID NO: 4058279 - DNA, 13 bp, Homo sapiens
atgttctgtttgc

SEQ ID NO: 4058280 - DNA, 18 bp, Homo sapiens
atgttcttatagaataaa

SEQ ID NO: 4058281 - DNA, 22 bp, Homo sapiens
atgttcttatagaataaaagct

SEQ ID NO: 4058282 - DNA, 20 bp, Homo sapiens
atgttcttatgcaaaatgga

SEQ ID NO: 4058283 - DNA, 13 bp, Homo sapiens
atgttcttccagt

SEQ ID NO: 4058284 - DNA, 16 bp, Homo sapiens
atgttgaaaagtaatt

SEQ ID NO: 4058285 - DNA, 18 bp, Homo sapiens
atgttgaaagatcaaaag

SEQ ID NO: 4058286 - DNA, 18 bp, Homo sapiens
atgttgaagaatacagtt

SEQ ID NO: 4058287 - DNA, 19 bp, Homo sapiens
atgttgaatactttttaca

SEQ ID NO: 4058288 - DNA, 22 bp, Homo sapiens
atgttgcccctttctcttttcc

SEQ ID NO: 4058289 - DNA, 17 bp, Homo sapiens
atgttgctataataaag

SEQ ID NO: 4058290 - DNA, 19 bp, Homo sapiens
atgttgctcagtctccctt

SEQ ID NO: 4058291 - DNA, 20 bp, Homo sapiens
atgttgctcagtctcccttt

SEQ ID NO: 4058292 - DNA, 15 bp, Homo sapiens
attacaggcttgagc

SEQ ID NO: 4058293 - DNA, 19 bp, Homo sapiens
attacattgctttttcttg

SEQ ID NO: 4058294 - DNA, 21 bp, Homo sapiens
attaccagtggcgttgttgca

SEQ ID NO: 4058295 - DNA, 19 bp, Homo sapiens
attacccacccgacctggc

SEQ ID NO: 4058296 - DNA, 21 bp, Homo sapiens
attacccacccgacctggctg

SEQ ID NO: 4058297 - DNA, 20 bp, Homo sapiens
attacctccatccatccttc

SEQ ID NO: 4058298 - DNA, 13 bp, Homo sapiens
attaccttactgt

SEQ ID NO: 4058299 - DNA, 17 bp, Homo sapiens
attactctcacccataa

SEQ ID NO: 4058300 - DNA, 13 bp, Homo sapiens
attactgggcctt

SEQ ID NO: 4058301 - DNA, 14 bp, Homo sapiens
attactgggcctta

SEQ ID NO: 4058302 - DNA, 23 bp, Homo sapiens
attactgggccttagtgggccag

SEQ ID NO: 4058303 - DNA, 13 bp, Homo sapiens
attactgtcaata

SEQ ID NO: 4058304 - DNA, 15 bp, Homo sapiens
attactgtcaataaa

SEQ ID NO: 4058305 - DNA, 20 bp, Homo sapiens
attactgttgcatttacttt

SEQ ID NO: 4058306 - DNA, 16 bp, Homo sapiens
attagaaaaaaattac

SEQ ID NO: 4058307 - DNA, 22 bp, Homo sapiens
attagaaaaaaattactaattt

SEQ ID NO: 4058308 - DNA, 17 bp, Homo sapiens
attagaaaaattcctaa

SEQ ID NO: 4058309 - DNA, 19 bp, Homo sapiens
attagaaaatgttatttaa

SEQ ID NO: 4058310 - DNA, 16 bp, Homo sapiens
attagaaatagacagt

SEQ ID NO: 4058311 - DNA, 15 bp, Homo sapiens
attagaagacaacag

SEQ ID NO: 4058312 - DNA, 22 bp, Homo sapiens
attagaatagtgttctgcaaaa

SEQ ID NO: 4058313 - DNA, 21 bp, Homo sapiens
attagaattagtgccagaatt

SEQ ID NO: 4058314 - DNA, 16 bp, Homo sapiens
attagatggcttattt

SEQ ID NO: 4058315 - DNA, 16 bp, Homo sapiens
attagcaaggctgggt

SEQ ID NO: 4058316 - DNA, 15 bp, Homo sapiens
attagccaggatcat

SEQ ID NO: 4058317 - DNA, 15 bp, Homo sapiens
attagccaggtaatg

SEQ ID NO: 4058318 - DNA, 18 bp, Homo sapiens
attagccgggcatggtgg

SEQ ID NO: 4058319 - DNA, 16 bp, Homo sapiens
attagctgtgtgaaat

SEQ ID NO: 4058320 - DNA, 21 bp, Homo sapiens
attagctttgtgtttggttta

SEQ ID NO: 4058321 - DNA, 23 bp, Homo sapiens
attaggaatgggataagaaggtg

SEQ ID NO: 4058322 - DNA, 16 bp, Homo sapiens
attaggcatggttttg

SEQ ID NO: 4058323 - DNA, 18 bp, Homo sapiens
attagggagaaaattcaa

SEQ ID NO: 4058324 - DNA, 20 bp, Homo sapiens
attagggagaaaattcaatt

SEQ ID NO: 4058325 - DNA, 22 bp, Homo sapiens
attaggggttgctaagaagcga

SEQ ID NO: 4058326 - DNA, 13 bp, Homo sapiens
attaggtattttg

SEQ ID NO: 4058327 - DNA, 16 bp, Homo sapiens
attagtaaatgcttat

SEQ ID NO: 4058328 - DNA, 16 bp, Homo sapiens
attagtaaatgtcttt

SEQ ID NO: 4058329 - DNA, 23 bp, Homo sapiens
attagtaaatgtctttgtaagtc

SEQ ID NO: 4058330 - DNA, 23 bp, Homo sapiens
attagtatttatttaatgttatg

SEQ ID NO: 4058331 - DNA, 15 bp, Homo sapiens
attagtctgaaactg

SEQ ID NO: 4058332 - DNA, 22 bp, Homo sapiens
attagtgccagaattttaggaa

SEQ ID NO: 4058333 - DNA, 13 bp, Homo sapiens
attagtggatttt

SEQ ID NO: 4058334 - DNA, 23 bp, Homo sapiens
attataaaaagccactagactct

SEQ ID NO: 4058335 - DNA, 17 bp, Homo sapiens
attataaactcattttg

SEQ ID NO: 4058336 - DNA, 15 bp, Homo sapiens
attataaatgaaatt

SEQ ID NO: 4058337 - DNA, 13 bp, Homo sapiens
attataaatgtta

SEQ ID NO: 4058338 - DNA, 15 bp, Homo sapiens
attataaatgttagt

SEQ ID NO: 4058339 - DNA, 19 bp, Homo sapiens
attataaatgttagttcta

SEQ ID NO: 4058340 - DNA, 20 bp, Homo sapiens
attataaatgttagttctag

SEQ ID NO: 4058341 - DNA, 15 bp, Homo sapiens
attataacttaaaaa

SEQ ID NO: 4058342 - DNA, 17 bp, Homo sapiens
attataagcattgaaat

SEQ ID NO: 4058343 - DNA, 18 bp, Homo sapiens
attataatcaccagggcc

SEQ ID NO: 4058344 - DNA, 19 bp, Homo sapiens
attataatcctcaagagaa

SEQ ID NO: 4058345 - DNA, 20 bp, Homo sapiens
attatagacaacgatgaatt

SEQ ID NO: 4058346 - DNA, 21 bp, Homo sapiens
attataggtaatcaatgaata

SEQ ID NO: 4058347 - DNA, 15 bp, Homo sapiens
attatagtttcaagc

SEQ ID NO: 4058348 - DNA, 23 bp, Homo sapiens
attatatcattggaacaactgat

SEQ ID NO: 4058349 - DNA, 16 bp, Homo sapiens
attatatctaattatt

SEQ ID NO: 4058350 - DNA, 18 bp, Homo sapiens
attatatctgtggtcttc

SEQ ID NO: 4058351 - DNA, 22 bp, Homo sapiens
attatatgtggactaaatatct

SEQ ID NO: 4058352 - DNA, 18 bp, Homo sapiens
attatatgttcagattat

SEQ ID NO: 4058353 - DNA, 15 bp, Homo sapiens
attatcataagaatt

SEQ ID NO: 4058354 - DNA, 17 bp, Homo sapiens
attatccatattgagtc

SEQ ID NO: 4058355 - DNA, 19 bp, Homo sapiens
attatcgggaacagtgttt

SEQ ID NO: 4058356 - DNA, 17 bp, Homo sapiens
attatcgggagcagtgt

SEQ ID NO: 4058357 - DNA, 19 bp, Homo sapiens
attatcgggagcagtgtct

SEQ ID NO: 4058358 - DNA, 17 bp, Homo sapiens
attatctaaagtgtgtt

SEQ ID NO: 4058359 - DNA, 23 bp, Homo sapiens
attatctaaagtgtgttgttgct

SEQ ID NO: 4058360 - DNA, 19 bp, Homo sapiens
attatctatacatatcttt

SEQ ID NO: 4058361 - DNA, 22 bp, Homo sapiens
attatcttgggatagttcccaa

SEQ ID NO: 4058362 - DNA, 14 bp, Homo sapiens
attatgaaatttca

SEQ ID NO: 4058363 - DNA, 16 bp, Homo sapiens
attatgaaatttcact

SEQ ID NO: 4058364 - DNA, 13 bp, Homo sapiens
attatgaagaatt

SEQ ID NO: 4058365 - DNA, 14 bp, Homo sapiens
attatgacagttat

SEQ ID NO: 4058366 - DNA, 17 bp, Homo sapiens
attatggaagattttaa

SEQ ID NO: 4058367 - DNA, 20 bp, Homo sapiens
attatggaagattttaaatt

SEQ ID NO: 4058368 - DNA, 15 bp, Homo sapiens
attatgggtcctgca

SEQ ID NO: 4058369 - DNA, 19 bp, Homo sapiens
attatgtgacattttacat

SEQ ID NO: 4058370 - DNA, 16 bp, Homo sapiens
attatgttttttaaaa

SEQ ID NO: 4058371 - DNA, 20 bp, Homo sapiens
attattaaagtctaaacaaa

SEQ ID NO: 4058372 - DNA, 14 bp, Homo sapiens
attattaactacat

SEQ ID NO: 4058373 - DNA, 12 bp, Homo sapiens
attattagaaat

SEQ ID NO: 4058374 - DNA, 15 bp, Homo sapiens
attattataaaaggg

SEQ ID NO: 4058375 - DNA, 16 bp, Homo sapiens
attattatcgctttat

SEQ ID NO: 4058376 - DNA, 14 bp, Homo sapiens
attattatctttaa

SEQ ID NO: 4058377 - DNA, 17 bp, Homo sapiens
attattattaaaaatat

SEQ ID NO: 4058378 - DNA, 15 bp, Homo sapiens
attattatttgtgtt

SEQ ID NO: 4058379 - DNA, 14 bp, Homo sapiens
attattcatttaaa

SEQ ID NO: 4058380 - DNA, 21 bp, Homo sapiens
attattcatttaaaatgatta

SEQ ID NO: 4058381 - DNA, 15 bp, Homo sapiens
attattcatttagtg

SEQ ID NO: 4058382 - DNA, 18 bp, Homo sapiens
attattctcttttatctg

SEQ ID NO: 4058383 - DNA, 12 bp, Homo sapiens
attattgacact

SEQ ID NO: 4058384 - DNA, 18 bp, Homo sapiens
attattgacactgaactt

SEQ ID NO: 4058385 - DNA, 14 bp, Homo sapiens
attattggaattaa

SEQ ID NO: 4058386 - DNA, 13 bp, Homo sapiens
attattgtaagtt

SEQ ID NO: 4058387 - DNA, 20 bp, Homo sapiens
attattgtaagttgtacaaa

SEQ ID NO: 4058388 - DNA, 22 bp, Homo sapiens
attattgtaagttgtacaaatg

SEQ ID NO: 4058389 - DNA, 20 bp, Homo sapiens
attatttaaataaaatcacc

SEQ ID NO: 4058390 - DNA, 14 bp, Homo sapiens
attatttaataaca

SEQ ID NO: 4058391 - DNA, 15 bp, Homo sapiens
attatttaataacat

SEQ ID NO: 4058392 - DNA, 20 bp, Homo sapiens
attatttatttctggtaact

SEQ ID NO: 4058393 - DNA, 22 bp, Homo sapiens
attatttgtgttttaatttaaa

SEQ ID NO: 4058394 - DNA, 22 bp, Homo sapiens
attcgtgagctggggactcagg

SEQ ID NO: 4058395 - DNA, 20 bp, Homo sapiens
attcgtgcatttttggatca

SEQ ID NO: 4058396 - DNA, 17 bp, Homo sapiens
attcgtggcatgttttg

SEQ ID NO: 4058397 - DNA, 23 bp, Homo sapiens
attctaaagagcacttactgtaa

SEQ ID NO: 4058398 - DNA, 15 bp, Homo sapiens
attctaaatgaatgt

SEQ ID NO: 4058399 - DNA, 18 bp, Homo sapiens
attctaagccagttttca

SEQ ID NO: 4058400 - DNA, 20 bp, Homo sapiens
attctaagccagttttcatt

SEQ ID NO: 4058401 - DNA, 22 bp, Homo sapiens
attctaagccagttttcatttt

SEQ ID NO: 4058402 - DNA, 21 bp, Homo sapiens
attctaagttatttactttta

SEQ ID NO: 4058403 - DNA, 20 bp, Homo sapiens
attctacagaataatccagt

SEQ ID NO: 4058404 - DNA, 17 bp, Homo sapiens
attctactttaagcact

SEQ ID NO: 4058405 - DNA, 13 bp, Homo sapiens
attctactttgag

SEQ ID NO: 4058406 - DNA, 16 bp, Homo sapiens
attctactttgagtgc

SEQ ID NO: 4058407 - DNA, 18 bp, Homo sapiens
attctagctaatgtaata

SEQ ID NO: 4058408 - DNA, 17 bp, Homo sapiens
attctaggacctgtgtc

SEQ ID NO: 4058409 - DNA, 17 bp, Homo sapiens
attctagttcagagcca

SEQ ID NO: 4058410 - DNA, 17 bp, Homo sapiens
attctagttttgtcaaa

SEQ ID NO: 4058411 - DNA, 13 bp, Homo sapiens
attctatatgaat

SEQ ID NO: 4058412 - DNA, 17 bp, Homo sapiens
attctatatgaatttaa

SEQ ID NO: 4058413 - DNA, 23 bp, Homo sapiens
attctatatgaatttaaatataa

SEQ ID NO: 4058414 - DNA, 19 bp, Homo sapiens
attctatccccaatcagct

SEQ ID NO: 4058415 - DNA, 21 bp, Homo sapiens
attctatccccaatcagctcc

SEQ ID NO: 4058416 - DNA, 22 bp, Homo sapiens
attctatccccaatcagctcct

SEQ ID NO: 4058417 - DNA, 15 bp, Homo sapiens
attctatcgttatta

SEQ ID NO: 4058418 - DNA, 14 bp, Homo sapiens
attctatgttaaat

SEQ ID NO: 4058419 - DNA, 14 bp, Homo sapiens
attctattaacttt

SEQ ID NO: 4058420 - DNA, 18 bp, Homo sapiens
attctattacattttcag

SEQ ID NO: 4058421 - DNA, 20 bp, Homo sapiens
attctattgccttctttgaa

SEQ ID NO: 4058422 - DNA, 18 bp, Homo sapiens
attctattgtattatttg

SEQ ID NO: 4058423 - DNA, 22 bp, Homo sapiens
attctatttatatgtacatgag

SEQ ID NO: 4058424 - DNA, 16 bp, Homo sapiens
attctattttagaata

SEQ ID NO: 4058425 - DNA, 14 bp, Homo sapiens
attctcaaagcagg

SEQ ID NO: 4058426 - DNA, 19 bp, Homo sapiens
attctcaaagtttcctaat

SEQ ID NO: 4058427 - DNA, 15 bp, Homo sapiens
attctcaccagctgt

SEQ ID NO: 4058428 - DNA, 18 bp, Homo sapiens
attctcaccagctgtgtc

SEQ ID NO: 4058429 - DNA, 18 bp, Homo sapiens
attctcagaatctcaaat

SEQ ID NO: 4058430 - DNA, 20 bp, Homo sapiens
attctcagaatctcaaataa

SEQ ID NO: 4058431 - DNA, 17 bp, Homo sapiens
attctcagagcatgtgt

SEQ ID NO: 4058432 - DNA, 16 bp, Homo sapiens
attctcataattccta

SEQ ID NO: 4058433 - DNA, 18 bp, Homo sapiens
attctcattgcagaataa

SEQ ID NO: 4058434 - DNA, 16 bp, Homo sapiens
attctccacagcaacc

SEQ ID NO: 4058435 - DNA, 22 bp, Homo sapiens
attctcccaggtaccagctgcg

SEQ ID NO: 4058436 - DNA, 15 bp, Homo sapiens
attctcctgcctcag

SEQ ID NO: 4058437 - DNA, 14 bp, Homo sapiens
attctcctgtgcta

SEQ ID NO: 4058438 - DNA, 13 bp, Homo sapiens
attctctgcaatt

SEQ ID NO: 4058439 - DNA, 16 bp, Homo sapiens
attctctgcaatttgt

SEQ ID NO: 4058440 - DNA, 23 bp, Homo sapiens
attctctgcaatttgtttaaaga

SEQ ID NO: 4058441 - DNA, 15 bp, Homo sapiens
attctcttatccaac

SEQ ID NO: 4058442 - DNA, 16 bp, Homo sapiens
attctcttttatctgt

SEQ ID NO: 4058443 - DNA, 13 bp, Homo sapiens
attctgaatgtac

SEQ ID NO: 4058444 - DNA, 15 bp, Homo sapiens
attctgaggccctgc

SEQ ID NO: 4058445 - DNA, 20 bp, Homo sapiens
attctgattcttctaaatta

SEQ ID NO: 4058446 - DNA, 13 bp, Homo sapiens
attctgcagcatg

SEQ ID NO: 4058447 - DNA, 22 bp, Homo sapiens
attctgcagcatgacctgtgac

SEQ ID NO: 4058448 - DNA, 17 bp, Homo sapiens
attctgccctccttaat

SEQ ID NO: 4058449 - DNA, 14 bp, Homo sapiens
attctgcctctctg

SEQ ID NO: 4058450 - DNA, 19 bp, Homo sapiens
attctgggaggcaagaaaa

SEQ ID NO: 4058451 - DNA, 21 bp, Homo sapiens
attctgggctcctggaaccaa

SEQ ID NO: 4058452 - DNA, 23 bp, Homo sapiens
attctgtgtatcttttttataac

SEQ ID NO: 4058453 - DNA, 23 bp, Homo sapiens
attctgtgtgttttcataataaa

SEQ ID NO: 4058454 - DNA, 14 bp, Homo sapiens
attctgtgttgcat

SEQ ID NO: 4058455 - DNA, 20 bp, Homo sapiens
attctgtttattcttccaga

SEQ ID NO: 4058456 - DNA, 12 bp, Homo sapiens
attctgttttgc

SEQ ID NO: 4058457 - DNA, 13 bp, Homo sapiens
attctgttttgca

SEQ ID NO: 4058458 - DNA, 20 bp, Homo sapiens
attcttaaaattcaagaaaa

SEQ ID NO: 4058459 - DNA, 15 bp, Homo sapiens
attcttatacacatt

SEQ ID NO: 4058460 - DNA, 14 bp, Homo sapiens
attcttattaattc

SEQ ID NO: 4058461 - DNA, 17 bp, Homo sapiens
attcttcacctgttatg

SEQ ID NO: 4058462 - DNA, 21 bp, Homo sapiens
attcttccaagctgagagtct

SEQ ID NO: 4058463 - DNA, 22 bp, Homo sapiens
attcttccaagctgagagtcta

SEQ ID NO: 4058464 - DNA, 15 bp, Homo sapiens
attcttccagaatgc

SEQ ID NO: 4058465 - DNA, 16 bp, Homo sapiens
attcttctctgttgtc

SEQ ID NO: 4058466 - DNA, 14 bp, Homo sapiens
attcttctgtattt

SEQ ID NO: 4058467 - DNA, 16 bp, Homo sapiens
attcttctgtatttct

SEQ ID NO: 4058468 - DNA, 18 bp, Homo sapiens
attcttctgtatttctag

SEQ ID NO: 4058469 - DNA, 13 bp, Homo sapiens
attcttctgtcct

SEQ ID NO: 4058470 - DNA, 15 bp, Homo sapiens
attcttctgtcctga

SEQ ID NO: 4058471 - DNA, 16 bp, Homo sapiens
attcttgaaagctgtg

SEQ ID NO: 4058472 - DNA, 21 bp, Homo sapiens
attcttggaccatgccagatt

SEQ ID NO: 4058473 - DNA, 12 bp, Homo sapiens
attcttgtgctt

SEQ ID NO: 4058474 - DNA, 18 bp, Homo sapiens
attcttgtgcttttcctg

SEQ ID NO: 4058475 - DNA, 17 bp, Homo sapiens
attctttatcttgacat

SEQ ID NO: 4058476 - DNA, 21 bp, Homo sapiens
attctttccattatgattctt

SEQ ID NO: 4058477 - DNA, 22 bp, Homo sapiens
attctttccattatgattcttt

SEQ ID NO: 4058478 - DNA, 17 bp, Homo sapiens
attctttggttgtgaat

SEQ ID NO: 4058479 - DNA, 14 bp, Homo sapiens
attcttttgtttcc

SEQ ID NO: 4058480 - DNA, 17 bp, Homo sapiens
attgaaaaactctttat

SEQ ID NO: 4058481 - DNA, 15 bp, Homo sapiens
attgaaaatcttgtg

SEQ ID NO: 4058482 - DNA, 20 bp, Homo sapiens
attgaaactagttattttat

SEQ ID NO: 4058483 - DNA, 18 bp, Homo sapiens
attgaacacaaactgtaa

SEQ ID NO: 4058484 - DNA, 15 bp, Homo sapiens
attgaaccagctcat

SEQ ID NO: 4058485 - DNA, 18 bp, Homo sapiens
attgaaccagctcatctc

SEQ ID NO: 4058486 - DNA, 14 bp, Homo sapiens
attgaacttttgta

SEQ ID NO: 4058487 - DNA, 17 bp, Homo sapiens
attgaacttttgtactg

SEQ ID NO: 4058488 - DNA, 18 bp, Homo sapiens
attgaacttttgtactga

SEQ ID NO: 4058489 - DNA, 19 bp, Homo sapiens
attgaacttttgtactgaa

SEQ ID NO: 4058490 - DNA, 13 bp, Homo sapiens
attgaagacaatt

SEQ ID NO: 4058491 - DNA, 19 bp, Homo sapiens
attgaagagagatatatct

SEQ ID NO: 4058492 - DNA, 18 bp, Homo sapiens
attgaagccgactctggc

SEQ ID NO: 4058493 - DNA, 20 bp, Homo sapiens
attgaaggaagccaaattta

SEQ ID NO: 4058494 - DNA, 21 bp, Homo sapiens
attgaaggaagccaaatttat

SEQ ID NO: 4058495 - DNA, 16 bp, Homo sapiens
attgaagtaatgaatt

SEQ ID NO: 4058496 - DNA, 20 bp, Homo sapiens
attggcacctaatccaggca

SEQ ID NO: 4058497 - DNA, 21 bp, Homo sapiens
attggccacctgtagccatct

SEQ ID NO: 4058498 - DNA, 17 bp, Homo sapiens
attgggcacagtccaga

SEQ ID NO: 4058499 - DNA, 18 bp, Homo sapiens
attgggtgggtaaattca

SEQ ID NO: 4058500 - DNA, 21 bp, Homo sapiens
attggtaaaactcactgtgat

SEQ ID NO: 4058501 - DNA, 17 bp, Homo sapiens
attggtggttctcagca

SEQ ID NO: 4058502 - DNA, 14 bp, Homo sapiens
attggtttctcttc

SEQ ID NO: 4058503 - DNA, 16 bp, Homo sapiens
attggtttctcttctc

SEQ ID NO: 4058504 - DNA, 18 bp, Homo sapiens
attgtaacctgcattttt

SEQ ID NO: 4058505 - DNA, 19 bp, Homo sapiens
attgtaagttgtacaaatg

SEQ ID NO: 4058506 - DNA, 16 bp, Homo sapiens
attgtaatctgaataa

SEQ ID NO: 4058507 - DNA, 13 bp, Homo sapiens
attgtaatctttc

SEQ ID NO: 4058508 - DNA, 13 bp, Homo sapiens
attgtaatgttac

SEQ ID NO: 4058509 - DNA, 23 bp, Homo sapiens
attgtacatttatttattactgt

SEQ ID NO: 4058510 - DNA, 18 bp, Homo sapiens
attgtagggctttagctt

SEQ ID NO: 4058511 - DNA, 15 bp, Homo sapiens
attgtaggtgcaagc

SEQ ID NO: 4058512 - DNA, 14 bp, Homo sapiens
attgtagttaatga

SEQ ID NO: 4058513 - DNA, 20 bp, Homo sapiens
attgtataagcatgctttct

SEQ ID NO: 4058514 - DNA, 17 bp, Homo sapiens
attgtatattgtgtttg

SEQ ID NO: 4058515 - DNA, 19 bp, Homo sapiens
attgtatctagtgcagctg

SEQ ID NO: 4058516 - DNA, 16 bp, Homo sapiens
attgtattgctgctgt

SEQ ID NO: 4058517 - DNA, 16 bp, Homo sapiens
attgtcacctctgtta

SEQ ID NO: 4058518 - DNA, 23 bp, Homo sapiens
attgtcacctctgttaaggttga

SEQ ID NO: 4058519 - DNA, 19 bp, Homo sapiens
attgtcacctgcttctctg

SEQ ID NO: 4058520 - DNA, 15 bp, Homo sapiens
attgtcattaaaggt

SEQ ID NO: 4058521 - DNA, 13 bp, Homo sapiens
attgtccagagct

SEQ ID NO: 4058522 - DNA, 23 bp, Homo sapiens
attgtccagagctgcttccccgt

SEQ ID NO: 4058523 - DNA, 17 bp, Homo sapiens
attgtctaaaatgtcag

SEQ ID NO: 4058524 - DNA, 13 bp, Homo sapiens
attgtctatttat

SEQ ID NO: 4058525 - DNA, 14 bp, Homo sapiens
attgtctcaacgcc

SEQ ID NO: 4058526 - DNA, 15 bp, Homo sapiens
attgtctcccttcca

SEQ ID NO: 4058527 - DNA, 16 bp, Homo sapiens
attgtctgaacttgca

SEQ ID NO: 4058528 - DNA, 17 bp, Homo sapiens
attgtcttgcaacttca

SEQ ID NO: 4058529 - DNA, 14 bp, Homo sapiens
attgtgaagtacat

SEQ ID NO: 4058530 - DNA, 16 bp, Homo sapiens
attgtgagccaccacg

SEQ ID NO: 4058531 - DNA, 15 bp, Homo sapiens
attgtgattggcctg

SEQ ID NO: 4058532 - DNA, 18 bp, Homo sapiens
attgtggtgtgagcttca

SEQ ID NO: 4058533 - DNA, 17 bp, Homo sapiens
attgtgtaaaaaatgga

SEQ ID NO: 4058534 - DNA, 19 bp, Homo sapiens
attgtgtattatgttgttc

SEQ ID NO: 4058535 - DNA, 17 bp, Homo sapiens
attgtgttgtcttcagc

SEQ ID NO: 4058536 - DNA, 17 bp, Homo sapiens
attgtgttgtgaatgtt

SEQ ID NO: 4058537 - DNA, 13 bp, Homo sapiens
attgtgtttgtgt

SEQ ID NO: 4058538 - DNA, 20 bp, Homo sapiens
attgttacattatgtggaaa

SEQ ID NO: 4058539 - DNA, 16 bp, Homo sapiens
attgttagaaaatgac

SEQ ID NO: 4058540 - DNA, 20 bp, Homo sapiens
attgttagaaaatgacttat

SEQ ID NO: 4058541 - DNA, 21 bp, Homo sapiens
attgttagaaaatgacttatt

SEQ ID NO: 4058542 - DNA, 18 bp, Homo sapiens
attgttagcttccttaag

SEQ ID NO: 4058543 - DNA, 12 bp, Homo sapiens
attgttagttta

SEQ ID NO: 4058544 - DNA, 20 bp, Homo sapiens
attgttccaagacattgtca

SEQ ID NO: 4058545 - DNA, 22 bp, Homo sapiens
attgttccaagacattgtcaat

SEQ ID NO: 4058546 - DNA, 24 bp, Homo sapiens
attgttccagcagttttcaagtca

SEQ ID NO: 4058547 - DNA, 16 bp, Homo sapiens
attgttcccagtgaca

SEQ ID NO: 4058548 - DNA, 21 bp, Homo sapiens
attgttcccagtgacacttca

SEQ ID NO: 4058549 - DNA, 18 bp, Homo sapiens
attgttcttattctggca

SEQ ID NO: 4058550 - DNA, 18 bp, Homo sapiens
attgttgaacatacttca

SEQ ID NO: 4058551 - DNA, 17 bp, Homo sapiens
attgttgaatctatttc

SEQ ID NO: 4058552 - DNA, 18 bp, Homo sapiens
attgttgacaactgtgac

SEQ ID NO: 4058553 - DNA, 20 bp, Homo sapiens
attgttgacaactgtgactg

SEQ ID NO: 4058554 - DNA, 21 bp, Homo sapiens
attgttgaggtggtctgaatg

SEQ ID NO: 4058555 - DNA, 22 bp, Homo sapiens
attgttgaggtggtctgaatgt

SEQ ID NO: 4058556 - DNA, 21 bp, Homo sapiens
attgttgatgggcacttgaga

SEQ ID NO: 4058557 - DNA, 18 bp, Homo sapiens
attgttggcgctgaggtg

SEQ ID NO: 4058558 - DNA, 16 bp, Homo sapiens
attgttggctatttga

SEQ ID NO: 4058559 - DNA, 15 bp, Homo sapiens
attgttgtataattt

SEQ ID NO: 4058560 - DNA, 14 bp, Homo sapiens
attgtttaaaattc

SEQ ID NO: 4058561 - DNA, 18 bp, Homo sapiens
attgtttaaaattcagtt

SEQ ID NO: 4058562 - DNA, 20 bp, Homo sapiens
attgtttacgtttgatacaa

SEQ ID NO: 4058563 - DNA, 13 bp, Homo sapiens
attgtttatgtaa

SEQ ID NO: 4058564 - DNA, 18 bp, Homo sapiens
attgtttatttatcagtg

SEQ ID NO: 4058565 - DNA, 21 bp, Homo sapiens
attgtttatttatcagtgaca

SEQ ID NO: 4058566 - DNA, 20 bp, Homo sapiens
attgtttcctcttccaaagt

SEQ ID NO: 4058567 - DNA, 17 bp, Homo sapiens
attgtttctgcattcat

SEQ ID NO: 4058568 - DNA, 16 bp, Homo sapiens
attgtttgcttattgt

SEQ ID NO: 4058569 - DNA, 22 bp, Homo sapiens
attgtttgcttattgttccaag

SEQ ID NO: 4058570 - DNA, 18 bp, Homo sapiens
attgttttaatctgaaat

SEQ ID NO: 4058571 - DNA, 17 bp, Homo sapiens
attgttttcagtgtaca

SEQ ID NO: 4058572 - DNA, 18 bp, Homo sapiens
attgttttctatttatgc

SEQ ID NO: 4058573 - DNA, 12 bp, Homo sapiens
attgttttctgt

SEQ ID NO: 4058574 - DNA, 17 bp, Homo sapiens
attgttttctgtaaata

SEQ ID NO: 4058575 - DNA, 15 bp, Homo sapiens
attgtttttgtattt

SEQ ID NO: 4058576 - DNA, 20 bp, Homo sapiens
atttaaaaacaaaaggcaat

SEQ ID NO: 4058577 - DNA, 23 bp, Homo sapiens
atttaaaaagtgagaaagaaagt

SEQ ID NO: 4058578 - DNA, 13 bp, Homo sapiens
atttaaaaatatt

SEQ ID NO: 4058579 - DNA, 14 bp, Homo sapiens
atttaaaaatattt

SEQ ID NO: 4058580 - DNA, 19 bp, Homo sapiens
atttaaaaatatttcagat

SEQ ID NO: 4058581 - DNA, 18 bp, Homo sapiens
atttaaaaatatttttgg

SEQ ID NO: 4058582 - DNA, 13 bp, Homo sapiens
atttaaaatgatt

SEQ ID NO: 4058583 - DNA, 14 bp, Homo sapiens
atttaaaatgatta

SEQ ID NO: 4058584 - DNA, 16 bp, Homo sapiens
atttaaaatgattaga

SEQ ID NO: 4058585 - DNA, 15 bp, Homo sapiens
atttaaaattccatt

SEQ ID NO: 4058586 - DNA, 16 bp, Homo sapiens
atttaaaattccatta

SEQ ID NO: 4058587 - DNA, 19 bp, Homo sapiens
atttaaaattccattatct

SEQ ID NO: 4058588 - DNA, 21 bp, Homo sapiens
atttaaaattccattatctta

SEQ ID NO: 4058589 - DNA, 22 bp, Homo sapiens
atttaaaattccattatcttat

SEQ ID NO: 4058590 - DNA, 17 bp, Homo sapiens
atttaaaattgctatgt

SEQ ID NO: 4058591 - DNA, 19 bp, Homo sapiens
atttaaacatttgttcctg

SEQ ID NO: 4058592 - DNA, 11 bp, Homo sapiens
atttaaacctt

SEQ ID NO: 4058593 - DNA, 12 bp, Homo sapiens
atttaaagcatt

SEQ ID NO: 4058594 - DNA, 16 bp, Homo sapiens
atttaaagcattgctt

SEQ ID NO: 4058595 - DNA, 22 bp, Homo sapiens
atttaaaggcttaggcatgttc

SEQ ID NO: 4058596 - DNA, 20 bp, Homo sapiens
atttaaagggtgtacttata

SEQ ID NO: 4058597 - DNA, 18 bp, Homo sapiens
atttaaatataattctgt

SEQ ID NO: 4058598 - DNA, 22 bp, Homo sapiens
atttatgtttgcacttgtgatt

SEQ ID NO: 4058599 - DNA, 17 bp, Homo sapiens
atttattaaataaaatc

SEQ ID NO: 4058600 - DNA, 15 bp, Homo sapiens
atttattaagatgga

SEQ ID NO: 4058601 - DNA, 23 bp, Homo sapiens
atttattaatatttaacattatt

SEQ ID NO: 4058602 - DNA, 14 bp, Homo sapiens
atttattattttca

SEQ ID NO: 4058603 - DNA, 22 bp, Homo sapiens
atttattgcagaggatgttcat

SEQ ID NO: 4058604 - DNA, 17 bp, Homo sapiens
atttattgtttatgtaa

SEQ ID NO: 4058605 - DNA, 19 bp, Homo sapiens
atttattgtttatgtaaat

SEQ ID NO: 4058606 - DNA, 15 bp, Homo sapiens
atttatttaaagcat

SEQ ID NO: 4058607 - DNA, 12 bp, Homo sapiens
atttatttaaat

SEQ ID NO: 4058608 - DNA, 13 bp, Homo sapiens
atttatttaattt

SEQ ID NO: 4058609 - DNA, 24 bp, Homo sapiens
atttatttactgagcttctctgtg

SEQ ID NO: 4058610 - DNA, 17 bp, Homo sapiens
atttatttattaagatg

SEQ ID NO: 4058611 - DNA, 15 bp, Homo sapiens
atttatttattactg

SEQ ID NO: 4058612 - DNA, 14 bp, Homo sapiens
atttatttatttaa

SEQ ID NO: 4058613 - DNA, 22 bp, Homo sapiens
atttatttccactaaaaatatt

SEQ ID NO: 4058614 - DNA, 17 bp, Homo sapiens
atttatttcctccctct

SEQ ID NO: 4058615 - DNA, 22 bp, Homo sapiens
atttatttctagttctttcctc

SEQ ID NO: 4058616 - DNA, 14 bp, Homo sapiens
atttattttgtaat

SEQ ID NO: 4058617 - DNA, 16 bp, Homo sapiens
atttattttgtaatta

SEQ ID NO: 4058618 - DNA, 14 bp, Homo sapiens
atttattttttaca

SEQ ID NO: 4058619 - DNA, 15 bp, Homo sapiens
atttcaaaaatataa

SEQ ID NO: 4058620 - DNA, 17 bp, Homo sapiens
atttcaaaaatataact

SEQ ID NO: 4058621 - DNA, 19 bp, Homo sapiens
atttcaaaaatataactta

SEQ ID NO: 4058622 - DNA, 13 bp, Homo sapiens
atttcaaaatata

SEQ ID NO: 4058623 - DNA, 21 bp, Homo sapiens
atttcaaaatgctttttatta

SEQ ID NO: 4058624 - DNA, 23 bp, Homo sapiens
atttcaaacagtctcccttccta

SEQ ID NO: 4058625 - DNA, 19 bp, Homo sapiens
atttcaaaccattgctctt

SEQ ID NO: 4058626 - DNA, 18 bp, Homo sapiens
atttcaagcagctgaaga

SEQ ID NO: 4058627 - DNA, 21 bp, Homo sapiens
atttcaagcagctgaagaaaa

SEQ ID NO: 4058628 - DNA, 20 bp, Homo sapiens
atttcacaacagatcaattt

SEQ ID NO: 4058629 - DNA, 15 bp, Homo sapiens
atttcacaagctatt

SEQ ID NO: 4058630 - DNA, 18 bp, Homo sapiens
atttcactatcttcttca

SEQ ID NO: 4058631 - DNA, 20 bp, Homo sapiens
atttcactatcttcttcaaa

SEQ ID NO: 4058632 - DNA, 13 bp, Homo sapiens
atttcactgtctt

SEQ ID NO: 4058633 - DNA, 16 bp, Homo sapiens
atttcacttttgttct

SEQ ID NO: 4058634 - DNA, 18 bp, Homo sapiens
atttcagactcccattcc

SEQ ID NO: 4058635 - DNA, 19 bp, Homo sapiens
atttcaggatactctgtca

SEQ ID NO: 4058636 - DNA, 20 bp, Homo sapiens
atttcagtaaacctgtctga

SEQ ID NO: 4058637 - DNA, 17 bp, Homo sapiens
atttcagtatcatctcc

SEQ ID NO: 4058638 - DNA, 14 bp, Homo sapiens
atttcagtggcttc

SEQ ID NO: 4058639 - DNA, 21 bp, Homo sapiens
atttcagtgtagttaatttat

SEQ ID NO: 4058640 - DNA, 21 bp, Homo sapiens
atttcagtgttacctgtgtgc

SEQ ID NO: 4058641 - DNA, 21 bp, Homo sapiens
atttcatacctcagaatgtaa

SEQ ID NO: 4058642 - DNA, 16 bp, Homo sapiens
atttcatagttcagaa

SEQ ID NO: 4058643 - DNA, 14 bp, Homo sapiens
atttcatcattgtt

SEQ ID NO: 4058644 - DNA, 17 bp, Homo sapiens
atttcatcattgtttct

SEQ ID NO: 4058645 - DNA, 22 bp, Homo sapiens
atttcatcctttcacttctttc

SEQ ID NO: 4058646 - DNA, 18 bp, Homo sapiens
atttcattccattgccta

SEQ ID NO: 4058647 - DNA, 21 bp, Homo sapiens
atttcattcgggccccacctg

SEQ ID NO: 4058648 - DNA, 22 bp, Homo sapiens
atttccaacaccacagacacac

SEQ ID NO: 4058649 - DNA, 22 bp, Homo sapiens
atttccactgtaattaaaacta

SEQ ID NO: 4058650 - DNA, 13 bp, Homo sapiens
atttccagtacct

SEQ ID NO: 4058651 - DNA, 15 bp, Homo sapiens
atttccattccagaa

SEQ ID NO: 4058652 - DNA, 16 bp, Homo sapiens
atttccatttcttcct

SEQ ID NO: 4058653 - DNA, 17 bp, Homo sapiens
atttccatttcttcctc

SEQ ID NO: 4058654 - DNA, 18 bp, Homo sapiens
atttccatttcttcctca

SEQ ID NO: 4058655 - DNA, 20 bp, Homo sapiens
atttccccaggggaaaatga

SEQ ID NO: 4058656 - DNA, 18 bp, Homo sapiens
atttcccctcttctgcta

SEQ ID NO: 4058657 - DNA, 18 bp, Homo sapiens
atttccctaaaatacatt

SEQ ID NO: 4058658 - DNA, 11 bp, Homo sapiens
atttccctgca

SEQ ID NO: 4058659 - DNA, 15 bp, Homo sapiens
atttcctgacttgag

SEQ ID NO: 4058660 - DNA, 16 bp, Homo sapiens
atttcctgacttgagt

SEQ ID NO: 4058661 - DNA, 18 bp, Homo sapiens
atttccttaaactgtgtg

SEQ ID NO: 4058662 - DNA, 11 bp, Homo sapiens
atttccttcca

SEQ ID NO: 4058663 - DNA, 12 bp, Homo sapiens
atttccttggag

SEQ ID NO: 4058664 - DNA, 13 bp, Homo sapiens
atttccttggagg

SEQ ID NO: 4058665 - DNA, 20 bp, Homo sapiens
atttccttggattttcctga

SEQ ID NO: 4058666 - DNA, 14 bp, Homo sapiens
atttcctttatgtg

SEQ ID NO: 4058667 - DNA, 16 bp, Homo sapiens
atttcctttatgtgaa

SEQ ID NO: 4058668 - DNA, 18 bp, Homo sapiens
atttcctttatgtgaatt

SEQ ID NO: 4058669 - DNA, 20 bp, Homo sapiens
atttcctttatgtgaatttt

SEQ ID NO: 4058670 - DNA, 20 bp, Homo sapiens
atttcctttttgacactgaa

SEQ ID NO: 4058671 - DNA, 17 bp, Homo sapiens
atttcggattttttcca

SEQ ID NO: 4058672 - DNA, 20 bp, Homo sapiens
atttcggattttttccaaaa

SEQ ID NO: 4058673 - DNA, 20 bp, Homo sapiens
atttctaaaaaacagaggcc

SEQ ID NO: 4058674 - DNA, 21 bp, Homo sapiens
atttctaaaaaacagaggcca

SEQ ID NO: 4058675 - DNA, 18 bp, Homo sapiens
atttctaatccttttcct

SEQ ID NO: 4058676 - DNA, 20 bp, Homo sapiens
atttctaatccttttcctta

SEQ ID NO: 4058677 - DNA, 15 bp, Homo sapiens
atttctactgtgact

SEQ ID NO: 4058678 - DNA, 17 bp, Homo sapiens
atttctactgtgactga

SEQ ID NO: 4058679 - DNA, 20 bp, Homo sapiens
atttctagtccaaaattaca

SEQ ID NO: 4058680 - DNA, 20 bp, Homo sapiens
atttctatcagtacttttat

SEQ ID NO: 4058681 - DNA, 11 bp, Homo sapiens
atttctattaa

SEQ ID NO: 4058682 - DNA, 14 bp, Homo sapiens
atttctcactagtg

SEQ ID NO: 4058683 - DNA, 19 bp, Homo sapiens
atttctcataattttgcaa

SEQ ID NO: 4058684 - DNA, 16 bp, Homo sapiens
atttctccagttggga

SEQ ID NO: 4058685 - DNA, 15 bp, Homo sapiens
atttctccatacgca

SEQ ID NO: 4058686 - DNA, 12 bp, Homo sapiens
atttctcctccc

SEQ ID NO: 4058687 - DNA, 17 bp, Homo sapiens
atttctcctcccttcct

SEQ ID NO: 4058688 - DNA, 12 bp, Homo sapiens
atttctcctttt

SEQ ID NO: 4058689 - DNA, 23 bp, Homo sapiens
atttctgagagtgaaaccatgac

SEQ ID NO: 4058690 - DNA, 22 bp, Homo sapiens
atttctgcatatgttgaatact

SEQ ID NO: 4058691 - DNA, 23 bp, Homo sapiens
atttctgcatatgttgaatactt

SEQ ID NO: 4058692 - DNA, 14 bp, Homo sapiens
atttctgctctgga

SEQ ID NO: 4058693 - DNA, 18 bp, Homo sapiens
atttctgggtcttttgct

SEQ ID NO: 4058694 - DNA, 14 bp, Homo sapiens
atttctgtttctca

SEQ ID NO: 4058695 - DNA, 15 bp, Homo sapiens
atttctgtttctcat

SEQ ID NO: 4058696 - DNA, 23 bp, Homo sapiens
atttcttaaataatgcttcagat

SEQ ID NO: 4058697 - DNA, 20 bp, Homo sapiens
atttcttcagtcagaaaact

SEQ ID NO: 4058698 - DNA, 22 bp, Homo sapiens
atttcttccctgctttgcatct

SEQ ID NO: 4058699 - DNA, 16 bp, Homo sapiens
atttcttcctcagctg

SEQ ID NO: 4058700 - DNA, 18 bp, Homo sapiens
attttaatcaagttgaat

SEQ ID NO: 4058701 - DNA, 13 bp, Homo sapiens
attttaatcctgt

SEQ ID NO: 4058702 - DNA, 14 bp, Homo sapiens
attttaatcctgta

SEQ ID NO: 4058703 - DNA, 12 bp, Homo sapiens
attttaatgtga

SEQ ID NO: 4058704 - DNA, 19 bp, Homo sapiens
attttacacattagatttt

SEQ ID NO: 4058705 - DNA, 22 bp, Homo sapiens
attttacagctcattaaacttt

SEQ ID NO: 4058706 - DNA, 20 bp, Homo sapiens
attttaccaagagtaacttt

SEQ ID NO: 4058707 - DNA, 21 bp, Homo sapiens
attttaccaagagtaacttta

SEQ ID NO: 4058708 - DNA, 13 bp, Homo sapiens
attttacttccat

SEQ ID NO: 4058709 - DNA, 14 bp, Homo sapiens
attttacttccatt

SEQ ID NO: 4058710 - DNA, 17 bp, Homo sapiens
attttacttccattata

SEQ ID NO: 4058711 - DNA, 16 bp, Homo sapiens
attttagaataaattc

SEQ ID NO: 4058712 - DNA, 23 bp, Homo sapiens
attttagctctattgatactctt

SEQ ID NO: 4058713 - DNA, 15 bp, Homo sapiens
attttaggaacttca

SEQ ID NO: 4058714 - DNA, 16 bp, Homo sapiens
attttagtattcattc

SEQ ID NO: 4058715 - DNA, 14 bp, Homo sapiens
attttagtccaaat

SEQ ID NO: 4058716 - DNA, 18 bp, Homo sapiens
attttataaggacttcct

SEQ ID NO: 4058717 - DNA, 14 bp, Homo sapiens
attttataatcaat

SEQ ID NO: 4058718 - DNA, 19 bp, Homo sapiens
attttataatcaatgaatt

SEQ ID NO: 4058719 - DNA, 12 bp, Homo sapiens
attttataattt

SEQ ID NO: 4058720 - DNA, 22 bp, Homo sapiens
attttatagctcagtttatcca

SEQ ID NO: 4058721 - DNA, 17 bp, Homo sapiens
attttatattcagtgaa

SEQ ID NO: 4058722 - DNA, 15 bp, Homo sapiens
attttatcattaatt

SEQ ID NO: 4058723 - DNA, 15 bp, Homo sapiens
attttatgagacagg

SEQ ID NO: 4058724 - DNA, 18 bp, Homo sapiens
attttatgatcagtgttg

SEQ ID NO: 4058725 - DNA, 15 bp, Homo sapiens
attttattgtataaa

SEQ ID NO: 4058726 - DNA, 17 bp, Homo sapiens
attttatttagacaaga

SEQ ID NO: 4058727 - DNA, 22 bp, Homo sapiens
attttatttagacaagagatgg

SEQ ID NO: 4058728 - DNA, 17 bp, Homo sapiens
attttatttatttaatt

SEQ ID NO: 4058729 - DNA, 16 bp, Homo sapiens
attttatttccatcat

SEQ ID NO: 4058730 - DNA, 18 bp, Homo sapiens
attttcaaattgtatcta

SEQ ID NO: 4058731 - DNA, 16 bp, Homo sapiens
attttcaactgctttg

SEQ ID NO: 4058732 - DNA, 16 bp, Homo sapiens
attttcaccccaccct

SEQ ID NO: 4058733 - DNA, 21 bp, Homo sapiens
attttcacctgtttttaagct

SEQ ID NO: 4058734 - DNA, 17 bp, Homo sapiens
attttcagaaaatatta

SEQ ID NO: 4058735 - DNA, 22 bp, Homo sapiens
attttcagtagggctacaaaac

SEQ ID NO: 4058736 - DNA, 17 bp, Homo sapiens
attttcatgtatatgtg

SEQ ID NO: 4058737 - DNA, 12 bp, Homo sapiens
attttcattaaa

SEQ ID NO: 4058738 - DNA, 19 bp, Homo sapiens
attttcattaaacttgaag

SEQ ID NO: 4058739 - DNA, 19 bp, Homo sapiens
attttccacgcagttcttt

SEQ ID NO: 4058740 - DNA, 23 bp, Homo sapiens
attttccacgcagttctttccat

SEQ ID NO: 4058741 - DNA, 17 bp, Homo sapiens
attttccagggcaatca

SEQ ID NO: 4058742 - DNA, 22 bp, Homo sapiens
attttccagggcaatcaatgtt

SEQ ID NO: 4058743 - DNA, 21 bp, Homo sapiens
attttccatttttatttcaaa

SEQ ID NO: 4058744 - DNA, 15 bp, Homo sapiens
attttcccatcatcc

SEQ ID NO: 4058745 - DNA, 21 bp, Homo sapiens
attttcccccactactgcagc

SEQ ID NO: 4058746 - DNA, 14 bp, Homo sapiens
attttccccccact

SEQ ID NO: 4058747 - DNA, 17 bp, Homo sapiens
attttcccctatcattt

SEQ ID NO: 4058748 - DNA, 18 bp, Homo sapiens
attttcctcctctgccta

SEQ ID NO: 4058749 - DNA, 15 bp, Homo sapiens
attttcctgttcagt

SEQ ID NO: 4058750 - DNA, 20 bp, Homo sapiens
attttcctgttcagtgagat

SEQ ID NO: 4058751 - DNA, 14 bp, Homo sapiens
attttctacagtgg

SEQ ID NO: 4058752 - DNA, 19 bp, Homo sapiens
attttctcaaaagcattta

SEQ ID NO: 4058753 - DNA, 15 bp, Homo sapiens
attttctcaatctcc

SEQ ID NO: 4058754 - DNA, 21 bp, Homo sapiens
attttctccctttatgtatct

SEQ ID NO: 4058755 - DNA, 18 bp, Homo sapiens
attttctgacatgcattg

SEQ ID NO: 4058756 - DNA, 13 bp, Homo sapiens
attttctggattc

SEQ ID NO: 4058757 - DNA, 21 bp, Homo sapiens
attttcttacccaatttccca

SEQ ID NO: 4058758 - DNA, 19 bp, Homo sapiens
attttcttattgcgctgct

SEQ ID NO: 4058759 - DNA, 21 bp, Homo sapiens
attttcttccaagcaaaggtg

SEQ ID NO: 4058760 - DNA, 15 bp, Homo sapiens
attttctttgaaatt

SEQ ID NO: 4058761 - DNA, 20 bp, Homo sapiens
attttgaaaagcttcttaat

SEQ ID NO: 4058762 - DNA, 13 bp, Homo sapiens
attttgaagaata

SEQ ID NO: 4058763 - DNA, 14 bp, Homo sapiens
attttgaagaatat

SEQ ID NO: 4058764 - DNA, 16 bp, Homo sapiens
attttgaagaatattt

SEQ ID NO: 4058765 - DNA, 18 bp, Homo sapiens
attttgaagaatatttaa

SEQ ID NO: 4058766 - DNA, 17 bp, Homo sapiens
attttgaagtttacatt

SEQ ID NO: 4058767 - DNA, 19 bp, Homo sapiens
attttgacttaatgtgatt

SEQ ID NO: 4058768 - DNA, 14 bp, Homo sapiens
attttgagaaactg

SEQ ID NO: 4058769 - DNA, 13 bp, Homo sapiens
attttgagtgact

SEQ ID NO: 4058770 - DNA, 14 bp, Homo sapiens
attttgagttgcca

SEQ ID NO: 4058771 - DNA, 17 bp, Homo sapiens
attttgataataaattg

SEQ ID NO: 4058772 - DNA, 19 bp, Homo sapiens
attttgcaaaatttccagt

SEQ ID NO: 4058773 - DNA, 14 bp, Homo sapiens
attttgcaaatata

SEQ ID NO: 4058774 - DNA, 19 bp, Homo sapiens
attttgcaaatataaacat

SEQ ID NO: 4058775 - DNA, 14 bp, Homo sapiens
attttgcattcaaa

SEQ ID NO: 4058776 - DNA, 15 bp, Homo sapiens
attttgcattcaaat

SEQ ID NO: 4058777 - DNA, 23 bp, Homo sapiens
attttgctaagtaaatctcttct

SEQ ID NO: 4058778 - DNA, 19 bp, Homo sapiens
attttgctattgtaaatat

SEQ ID NO: 4058779 - DNA, 19 bp, Homo sapiens
attttgctggaattcctaa

SEQ ID NO: 4058780 - DNA, 12 bp, Homo sapiens
attttggaaact

SEQ ID NO: 4058781 - DNA, 20 bp, Homo sapiens
attttggaagattttcagtc

SEQ ID NO: 4058782 - DNA, 14 bp, Homo sapiens
attttggaatttgc

SEQ ID NO: 4058783 - DNA, 20 bp, Homo sapiens
attttggagagtttcctgaa

SEQ ID NO: 4058784 - DNA, 22 bp, Homo sapiens
attttggagagtttcctgaaac

SEQ ID NO: 4058785 - DNA, 12 bp, Homo sapiens
attttggatata

SEQ ID NO: 4058786 - DNA, 21 bp, Homo sapiens
attttgggacaattgttttaa

SEQ ID NO: 4058787 - DNA, 11 bp, Homo sapiens
attttggggtc

SEQ ID NO: 4058788 - DNA, 13 bp, Homo sapiens
attttggggtctc

SEQ ID NO: 4058789 - DNA, 22 bp, Homo sapiens
attttggtaaaatacttcttga

SEQ ID NO: 4058790 - DNA, 21 bp, Homo sapiens
attttggtgagaaatgggact

SEQ ID NO: 4058791 - DNA, 17 bp, Homo sapiens
attttggtgtctttctc

SEQ ID NO: 4058792 - DNA, 15 bp, Homo sapiens
attttgtaattatga

SEQ ID NO: 4058793 - DNA, 15 bp, Homo sapiens
attttgtagatgtga

SEQ ID NO: 4058794 - DNA, 20 bp, Homo sapiens
attttgtctgcttagtatct

SEQ ID NO: 4058795 - DNA, 13 bp, Homo sapiens
attttgtgaatgg

SEQ ID NO: 4058796 - DNA, 15 bp, Homo sapiens
attttgtgaatggat

SEQ ID NO: 4058797 - DNA, 16 bp, Homo sapiens
attttgtgatgatgct

SEQ ID NO: 4058798 - DNA, 22 bp, Homo sapiens
attttgtgatgatgctgtgaca

SEQ ID NO: 4058799 - DNA, 20 bp, Homo sapiens
attttgtgtaaatttctcaa

SEQ ID NO: 4058800 - DNA, 16 bp, Homo sapiens
attttgtttcttttaa

SEQ ID NO: 4058801 - DNA, 16 bp, Homo sapiens
attttgttttgttgga

SEQ ID NO: 4058802 - DNA, 20 bp, Homo sapiens
attttgtttttattttcaag

SEQ ID NO: 4058803 - DNA, 18 bp, Homo sapiens
caaaagattgctgaaaaa

SEQ ID NO: 4058804 - DNA, 23 bp, Homo sapiens
caaaagattggagctgaagacct

SEQ ID NO: 4058805 - DNA, 23 bp, Homo sapiens
caaaagcaagactgttgctcaaa

SEQ ID NO: 4058806 - DNA, 14 bp, Homo sapiens
caaaagcacccttg

SEQ ID NO: 4058807 - DNA, 20 bp, Homo sapiens
caaaagcagtaaatttgcta

SEQ ID NO: 4058808 - DNA, 13 bp, Homo sapiens
caaaagccttgtg

SEQ ID NO: 4058809 - DNA, 14 bp, Homo sapiens
caaaagccttgtgt

SEQ ID NO: 4058810 - DNA, 19 bp, Homo sapiens
caaaagccttgtgtatatt

SEQ ID NO: 4058811 - DNA, 22 bp, Homo sapiens
caaaagccttgtgtatatttgt

SEQ ID NO: 4058812 - DNA, 23 bp, Homo sapiens
caaaagccttgtgtatatttgta

SEQ ID NO: 4058813 - DNA, 21 bp, Homo sapiens
caaaagcgccctcactattct

SEQ ID NO: 4058814 - DNA, 13 bp, Homo sapiens
caaaagcttccct

SEQ ID NO: 4058815 - DNA, 13 bp, Homo sapiens
caaaaggaagtct

SEQ ID NO: 4058816 - DNA, 22 bp, Homo sapiens
caaaaggcagctcacccctggg

SEQ ID NO: 4058817 - DNA, 23 bp, Homo sapiens
caaaaggcctcttgtaaagactg

SEQ ID NO: 4058818 - DNA, 14 bp, Homo sapiens
caaaagggaaaaga

SEQ ID NO: 4058819 - DNA, 17 bp, Homo sapiens
caaaagtaaatgggagg

SEQ ID NO: 4058820 - DNA, 16 bp, Homo sapiens
caaaagtccctccctg

SEQ ID NO: 4058821 - DNA, 14 bp, Homo sapiens
caaaagtctatttt

SEQ ID NO: 4058822 - DNA, 19 bp, Homo sapiens
caaaagtctgtctttcctg

SEQ ID NO: 4058823 - DNA, 19 bp, Homo sapiens
caaaataaaaagtgacaca

SEQ ID NO: 4058824 - DNA, 11 bp, Homo sapiens
caaaataattc

SEQ ID NO: 4058825 - DNA, 18 bp, Homo sapiens
caaaataattttaagaaa

SEQ ID NO: 4058826 - DNA, 13 bp, Homo sapiens
caaaatagagaat

SEQ ID NO: 4058827 - DNA, 21 bp, Homo sapiens
caaaatattttttgcaagtta

SEQ ID NO: 4058828 - DNA, 16 bp, Homo sapiens
caaaatcattttaatg

SEQ ID NO: 4058829 - DNA, 14 bp, Homo sapiens
caaaatccaaaact

SEQ ID NO: 4058830 - DNA, 21 bp, Homo sapiens
caaaatccaaaacttctcttg

SEQ ID NO: 4058831 - DNA, 21 bp, Homo sapiens
caaaatcgatgcagtgcttcc

SEQ ID NO: 4058832 - DNA, 18 bp, Homo sapiens
caaaatctgaactctcaa

SEQ ID NO: 4058833 - DNA, 13 bp, Homo sapiens
caaaatctgtcca

SEQ ID NO: 4058834 - DNA, 17 bp, Homo sapiens
caaaatctgttctaaca

SEQ ID NO: 4058835 - DNA, 14 bp, Homo sapiens
caaaatggaacgct

SEQ ID NO: 4058836 - DNA, 18 bp, Homo sapiens
caaaatgtctcagttttc

SEQ ID NO: 4058837 - DNA, 10 bp, Homo sapiens
caaaatgtga

SEQ ID NO: 4058838 - DNA, 16 bp, Homo sapiens
caaaatgtgtatttct

SEQ ID NO: 4058839 - DNA, 20 bp, Homo sapiens
caaaattaccaaaaatcttg

SEQ ID NO: 4058840 - DNA, 20 bp, Homo sapiens
caaaattcttatttttccta

SEQ ID NO: 4058841 - DNA, 16 bp, Homo sapiens
caaaattgcaaatctt

SEQ ID NO: 4058842 - DNA, 22 bp, Homo sapiens
caaaattgcaaatcttgaaatt

SEQ ID NO: 4058843 - DNA, 15 bp, Homo sapiens
caaaattgcaatttc

SEQ ID NO: 4058844 - DNA, 18 bp, Homo sapiens
caaaatttccagtacctt

SEQ ID NO: 4058845 - DNA, 12 bp, Homo sapiens
caaaatttgaaa

SEQ ID NO: 4058846 - DNA, 11 bp, Homo sapiens
caaaatttgtt

SEQ ID NO: 4058847 - DNA, 13 bp, Homo sapiens
caaaatttgtttg

SEQ ID NO: 4058848 - DNA, 20 bp, Homo sapiens
caaaattttagtccaaataa

SEQ ID NO: 4058849 - DNA, 21 bp, Homo sapiens
caaaattttatagctcagttt

SEQ ID NO: 4058850 - DNA, 19 bp, Homo sapiens
caaaattttattttgtgct

SEQ ID NO: 4058851 - DNA, 17 bp, Homo sapiens
caaaattttctcatttt

SEQ ID NO: 4058852 - DNA, 16 bp, Homo sapiens
caaacaaaaaggttct

SEQ ID NO: 4058853 - DNA, 21 bp, Homo sapiens
caaacaaaaaggttctcaggt

SEQ ID NO: 4058854 - DNA, 14 bp, Homo sapiens
caaacaaatatgca

SEQ ID NO: 4058855 - DNA, 13 bp, Homo sapiens
caaacacacacac

SEQ ID NO: 4058856 - DNA, 14 bp, Homo sapiens
caaacaccttccag

SEQ ID NO: 4058857 - DNA, 18 bp, Homo sapiens
caaacactgaggcagcct

SEQ ID NO: 4058858 - DNA, 16 bp, Homo sapiens
caaacagaacagggtc

SEQ ID NO: 4058859 - DNA, 14 bp, Homo sapiens
caaacagtaggttg

SEQ ID NO: 4058860 - DNA, 12 bp, Homo sapiens
caaacagtgcca

SEQ ID NO: 4058861 - DNA, 15 bp, Homo sapiens
caaacagtgccaaat

SEQ ID NO: 4058862 - DNA, 20 bp, Homo sapiens
caaacatagcccctgccccg

SEQ ID NO: 4058863 - DNA, 22 bp, Homo sapiens
caaacatcagacctgtcttcca

SEQ ID NO: 4058864 - DNA, 19 bp, Homo sapiens
caaacatgaggttctctct

SEQ ID NO: 4058865 - DNA, 14 bp, Homo sapiens
caaaccaaataaaa

SEQ ID NO: 4058866 - DNA, 13 bp, Homo sapiens
caaaccaacatct

SEQ ID NO: 4058867 - DNA, 19 bp, Homo sapiens
caaaccaacatctttgcga

SEQ ID NO: 4058868 - DNA, 22 bp, Homo sapiens
caaaccaagtcggaacagcaga

SEQ ID NO: 4058869 - DNA, 22 bp, Homo sapiens
caaaccaatggtgatcctctat

SEQ ID NO: 4058870 - DNA, 23 bp, Homo sapiens
caaaccccctccttacgctttgt

SEQ ID NO: 4058871 - DNA, 15 bp, Homo sapiens
caaaccctagccttg

SEQ ID NO: 4058872 - DNA, 20 bp, Homo sapiens
caaaccctagccttgcttgt

SEQ ID NO: 4058873 - DNA, 22 bp, Homo sapiens
caaacccttgctttcctgggcc

SEQ ID NO: 4058874 - DNA, 15 bp, Homo sapiens
caaacctgggacccc

SEQ ID NO: 4058875 - DNA, 20 bp, Homo sapiens
caaacctttattttagaatt

SEQ ID NO: 4058876 - DNA, 12 bp, Homo sapiens
caaacctttccc

SEQ ID NO: 4058877 - DNA, 13 bp, Homo sapiens
caaacctttcccc

SEQ ID NO: 4058878 - DNA, 16 bp, Homo sapiens
caaacgacagaggagc

SEQ ID NO: 4058879 - DNA, 22 bp, Homo sapiens
caaacgccctttcctcctcagg

SEQ ID NO: 4058880 - DNA, 17 bp, Homo sapiens
caaacgcctagattgct

SEQ ID NO: 4058881 - DNA, 19 bp, Homo sapiens
caaactcactgctcaagaa

SEQ ID NO: 4058882 - DNA, 11 bp, Homo sapiens
caaactcatct

SEQ ID NO: 4058883 - DNA, 21 bp, Homo sapiens
caaactggggcctccagaact

SEQ ID NO: 4058884 - DNA, 16 bp, Homo sapiens
caaactggtattctgt

SEQ ID NO: 4058885 - DNA, 20 bp, Homo sapiens
caaactgtaaataaaaagaa

SEQ ID NO: 4058886 - DNA, 21 bp, Homo sapiens
caaactgtaaataaaaagaaa

SEQ ID NO: 4058887 - DNA, 20 bp, Homo sapiens
caaactgtccctcccttgct

SEQ ID NO: 4058888 - DNA, 21 bp, Homo sapiens
caaacttaatgttcttatgca

SEQ ID NO: 4058889 - DNA, 15 bp, Homo sapiens
caaacttactatttt

SEQ ID NO: 4058890 - DNA, 13 bp, Homo sapiens
caaacttgcttta

SEQ ID NO: 4058891 - DNA, 17 bp, Homo sapiens
caaacttttttatatct

SEQ ID NO: 4058892 - DNA, 19 bp, Homo sapiens
caaacttttttatatcttt

SEQ ID NO: 4058893 - DNA, 19 bp, Homo sapiens
caaagaacttgatttgcat

SEQ ID NO: 4058894 - DNA, 23 bp, Homo sapiens
caaagaggcagttgcccagcctc

SEQ ID NO: 4058895 - DNA, 13 bp, Homo sapiens
caaagaggctgcc

SEQ ID NO: 4058896 - DNA, 14 bp, Homo sapiens
caaagagggcttcc

SEQ ID NO: 4058897 - DNA, 16 bp, Homo sapiens
caaagagggcttcctc

SEQ ID NO: 4058898 - DNA, 14 bp, Homo sapiens
caaagagtagaatt

SEQ ID NO: 4058899 - DNA, 22 bp, Homo sapiens
caaagagtgggctgcatctggg

SEQ ID NO: 4058900 - DNA, 19 bp, Homo sapiens
caaagataatttatttcaa

SEQ ID NO: 4058901 - DNA, 13 bp, Homo sapiens
caaagatcaaaat

SEQ ID NO: 4058902 - DNA, 12 bp, Homo sapiens
caaagcaaagaa

SEQ ID NO: 4058903 - DNA, 13 bp, Homo sapiens
caaagcaaagaaa

SEQ ID NO: 4058904 - DNA, 12 bp, Homo sapiens
caaagcaccagc

SEQ ID NO: 4058905 - DNA, 19 bp, Homo sapiens
caaagcagacagctccacc

SEQ ID NO: 4058906 - DNA, 18 bp, Homo sapiens
caagaagacatggagact

SEQ ID NO: 4058907 - DNA, 15 bp, Homo sapiens
caagaataaaggcag

SEQ ID NO: 4058908 - DNA, 17 bp, Homo sapiens
caagaataaaggcagct

SEQ ID NO: 4058909 - DNA, 13 bp, Homo sapiens
caagaatacttga

SEQ ID NO: 4058910 - DNA, 13 bp, Homo sapiens
caagaatggatca

SEQ ID NO: 4058911 - DNA, 23 bp, Homo sapiens
caagaatttcttggtaagaagcc

SEQ ID NO: 4058912 - DNA, 14 bp, Homo sapiens
caagacaaaccaag

SEQ ID NO: 4058913 - DNA, 18 bp, Homo sapiens
caagacagaagctgaagt

SEQ ID NO: 4058914 - DNA, 18 bp, Homo sapiens
caagacagagacgcagga

SEQ ID NO: 4058915 - DNA, 21 bp, Homo sapiens
caagacagagacgcaggaatg

SEQ ID NO: 4058916 - DNA, 16 bp, Homo sapiens
caagacagatgcccca

SEQ ID NO: 4058917 - DNA, 14 bp, Homo sapiens
caagacattgtcaa

SEQ ID NO: 4058918 - DNA, 14 bp, Homo sapiens
caagacccccagca

SEQ ID NO: 4058919 - DNA, 16 bp, Homo sapiens
caagacccccagcact

SEQ ID NO: 4058920 - DNA, 17 bp, Homo sapiens
caagactgttgctcaaa

SEQ ID NO: 4058921 - DNA, 22 bp, Homo sapiens
caagactttagcttttccttcc

SEQ ID NO: 4058922 - DNA, 15 bp, Homo sapiens
caagagaagggctta

SEQ ID NO: 4058923 - DNA, 12 bp, Homo sapiens
caagagaagggg

SEQ ID NO: 4058924 - DNA, 17 bp, Homo sapiens
caagagcagagtctggg

SEQ ID NO: 4058925 - DNA, 17 bp, Homo sapiens
caagagcagcctgtggc

SEQ ID NO: 4058926 - DNA, 18 bp, Homo sapiens
caagagcagcctgtggca

SEQ ID NO: 4058927 - DNA, 19 bp, Homo sapiens
caagagcccagcagggcct

SEQ ID NO: 4058928 - DNA, 22 bp, Homo sapiens
caagagcccccttgacaccggg

SEQ ID NO: 4058929 - DNA, 22 bp, Homo sapiens
caagaggccacttagggaaaga

SEQ ID NO: 4058930 - DNA, 13 bp, Homo sapiens
caagagggcactg

SEQ ID NO: 4058931 - DNA, 15 bp, Homo sapiens
caagagggcactggt

SEQ ID NO: 4058932 - DNA, 19 bp, Homo sapiens
caagagggcactggtggcc

SEQ ID NO: 4058933 - DNA, 20 bp, Homo sapiens
caagaggtttggctcctgcc

SEQ ID NO: 4058934 - DNA, 22 bp, Homo sapiens
caagaggtttggctcctgccca

SEQ ID NO: 4058935 - DNA, 23 bp, Homo sapiens
caagaggtttggctcctgcccac

SEQ ID NO: 4058936 - DNA, 16 bp, Homo sapiens
caagagtaactttact

SEQ ID NO: 4058937 - DNA, 16 bp, Homo sapiens
caagatcaattccctc

SEQ ID NO: 4058938 - DNA, 18 bp, Homo sapiens
caagatcaattccctctc

SEQ ID NO: 4058939 - DNA, 21 bp, Homo sapiens
caagatcaattccctctctca

SEQ ID NO: 4058940 - DNA, 13 bp, Homo sapiens
caagatccatttg

SEQ ID NO: 4058941 - DNA, 18 bp, Homo sapiens
caagatccatttgccttt

SEQ ID NO: 4058942 - DNA, 16 bp, Homo sapiens
caagatcttgtctcca

SEQ ID NO: 4058943 - DNA, 21 bp, Homo sapiens
caagatcttgtctccactaaa

SEQ ID NO: 4058944 - DNA, 13 bp, Homo sapiens
caagatctttcag

SEQ ID NO: 4058945 - DNA, 14 bp, Homo sapiens
caagatctttcagg

SEQ ID NO: 4058946 - DNA, 15 bp, Homo sapiens
caagatctttcagga

SEQ ID NO: 4058947 - DNA, 16 bp, Homo sapiens
caagatgaaataattt

SEQ ID NO: 4058948 - DNA, 16 bp, Homo sapiens
caagatgactggggtg

SEQ ID NO: 4058949 - DNA, 13 bp, Homo sapiens
caagatgcttggt

SEQ ID NO: 4058950 - DNA, 19 bp, Homo sapiens
caagatggaatttatcaaa

SEQ ID NO: 4058951 - DNA, 23 bp, Homo sapiens
caagatggcgccaccgcactcca

SEQ ID NO: 4058952 - DNA, 21 bp, Homo sapiens
caagattttagggcttttatt

SEQ ID NO: 4058953 - DNA, 22 bp, Homo sapiens
caagattttagggcttttattt

SEQ ID NO: 4058954 - DNA, 15 bp, Homo sapiens
caagatttttttcct

SEQ ID NO: 4058955 - DNA, 18 bp, Homo sapiens
caagcaacacagaggaat

SEQ ID NO: 4058956 - DNA, 22 bp, Homo sapiens
caagcaacatttgtatggattt

SEQ ID NO: 4058957 - DNA, 14 bp, Homo sapiens
caagcaatcctcct

SEQ ID NO: 4058958 - DNA, 20 bp, Homo sapiens
caagcaatcctcctgcctca

SEQ ID NO: 4058959 - DNA, 16 bp, Homo sapiens
caagcacagagcctgg

SEQ ID NO: 4058960 - DNA, 18 bp, Homo sapiens
caagcacagagcctggcc

SEQ ID NO: 4058961 - DNA, 21 bp, Homo sapiens
caagcacagagcctggcccca

SEQ ID NO: 4058962 - DNA, 17 bp, Homo sapiens
caagcacatctgcattt

SEQ ID NO: 4058963 - DNA, 18 bp, Homo sapiens
caagcactgctaggcgag

SEQ ID NO: 4058964 - DNA, 21 bp, Homo sapiens
caagcactttaatggcctgga

SEQ ID NO: 4058965 - DNA, 17 bp, Homo sapiens
caagcaggaattatgtc

SEQ ID NO: 4058966 - DNA, 13 bp, Homo sapiens
caagcaggcactg

SEQ ID NO: 4058967 - DNA, 14 bp, Homo sapiens
caagcaggcactgt

SEQ ID NO: 4058968 - DNA, 23 bp, Homo sapiens
caagcattgcttcagaatgaatt

SEQ ID NO: 4058969 - DNA, 23 bp, Homo sapiens
caagccaaagtggcatgttttgt

SEQ ID NO: 4058970 - DNA, 15 bp, Homo sapiens
caagccaacttgtaa

SEQ ID NO: 4058971 - DNA, 21 bp, Homo sapiens
caagccaacttgtaaatacac

SEQ ID NO: 4058972 - DNA, 19 bp, Homo sapiens
caagccacaagtcttccag

SEQ ID NO: 4058973 - DNA, 15 bp, Homo sapiens
caagccagacctagc

SEQ ID NO: 4058974 - DNA, 12 bp, Homo sapiens
caagccagcaag

SEQ ID NO: 4058975 - DNA, 13 bp, Homo sapiens
caagccagggatg

SEQ ID NO: 4058976 - DNA, 21 bp, Homo sapiens
caagccatgtataaatgtgat

SEQ ID NO: 4058977 - DNA, 22 bp, Homo sapiens
caagcccaggtgccagcctgag

SEQ ID NO: 4058978 - DNA, 13 bp, Homo sapiens
caagccccagcag

SEQ ID NO: 4058979 - DNA, 21 bp, Homo sapiens
caagccccagcagccctcaac

SEQ ID NO: 4058980 - DNA, 17 bp, Homo sapiens
caagccctacagagctg

SEQ ID NO: 4058981 - DNA, 21 bp, Homo sapiens
caagccctccccatcccatgt

SEQ ID NO: 4058982 - DNA, 18 bp, Homo sapiens
caagccgtggcttcccgc

SEQ ID NO: 4058983 - DNA, 14 bp, Homo sapiens
caagcctgtctgag

SEQ ID NO: 4058984 - DNA, 17 bp, Homo sapiens
caagctagtgtttctag

SEQ ID NO: 4058985 - DNA, 21 bp, Homo sapiens
caagctatctaaagtttgtta

SEQ ID NO: 4058986 - DNA, 14 bp, Homo sapiens
caagctgagtttcc

SEQ ID NO: 4058987 - DNA, 15 bp, Homo sapiens
caagctgagtttcct

SEQ ID NO: 4058988 - DNA, 18 bp, Homo sapiens
caagctgcctctgggcca

SEQ ID NO: 4058989 - DNA, 21 bp, Homo sapiens
caagctgctctgagccacagt

SEQ ID NO: 4058990 - DNA, 22 bp, Homo sapiens
caagctgctctgagccacagtg

SEQ ID NO: 4058991 - DNA, 13 bp, Homo sapiens
caagctggaagca

SEQ ID NO: 4058992 - DNA, 11 bp, Homo sapiens
caagctggcct

SEQ ID NO: 4058993 - DNA, 13 bp, Homo sapiens
caagctggcctct

SEQ ID NO: 4058994 - DNA, 20 bp, Homo sapiens
caagctgttatttcttccct

SEQ ID NO: 4058995 - DNA, 23 bp, Homo sapiens
caagctgttatttcttccctgct

SEQ ID NO: 4058996 - DNA, 18 bp, Homo sapiens
caagcttaatagccctcc

SEQ ID NO: 4058997 - DNA, 19 bp, Homo sapiens
caagcttaatagccctccc

SEQ ID NO: 4058998 - DNA, 17 bp, Homo sapiens
caaggaaagccccagca

SEQ ID NO: 4058999 - DNA, 19 bp, Homo sapiens
caaggaaaggggagaaggg

SEQ ID NO: 4059000 - DNA, 16 bp, Homo sapiens
caaggaagatatacat

SEQ ID NO: 4059001 - DNA, 13 bp, Homo sapiens
caaggaagcagcc

SEQ ID NO: 4059002 - DNA, 13 bp, Homo sapiens
caaggaaggaaag

SEQ ID NO: 4059003 - DNA, 16 bp, Homo sapiens
caaggaaggaaagaaa

SEQ ID NO: 4059004 - DNA, 17 bp, Homo sapiens
caaggaaggaaagaaag

SEQ ID NO: 4059005 - DNA, 14 bp, Homo sapiens
caaggaataaatga

SEQ ID NO: 4059006 - DNA, 19 bp, Homo sapiens
caaggaatgcctgtgccaa

SEQ ID NO: 4059007 - DNA, 12 bp, Homo sapiens
caaggacattgc

SEQ ID NO: 4059008 - DNA, 17 bp, Homo sapiens
caaggacattgccccaa

SEQ ID NO: 4059009 - DNA, 22 bp, Homo sapiens
caagttcacacctgcagattct

SEQ ID NO: 4059010 - DNA, 15 bp, Homo sapiens
caagttcgtctgttg

SEQ ID NO: 4059011 - DNA, 16 bp, Homo sapiens
caagttctagagaaga

SEQ ID NO: 4059012 - DNA, 19 bp, Homo sapiens
caagttctagagaagaggc

SEQ ID NO: 4059013 - DNA, 21 bp, Homo sapiens
caagttctagagaagaggctg

SEQ ID NO: 4059014 - DNA, 14 bp, Homo sapiens
caagttcttcacct

SEQ ID NO: 4059015 - DNA, 19 bp, Homo sapiens
caagttgagatttttaaga

SEQ ID NO: 4059016 - DNA, 22 bp, Homo sapiens
caagttgagatttttaagaact

SEQ ID NO: 4059017 - DNA, 16 bp, Homo sapiens
caagttgtaaaaatga

SEQ ID NO: 4059018 - DNA, 12 bp, Homo sapiens
caagttgtaaat

SEQ ID NO: 4059019 - DNA, 16 bp, Homo sapiens
caagttgttattgttg

SEQ ID NO: 4059020 - DNA, 18 bp, Homo sapiens
caagttgttattgttgaa

SEQ ID NO: 4059021 - DNA, 20 bp, Homo sapiens
caagttgttattgttgaaca

SEQ ID NO: 4059022 - DNA, 23 bp, Homo sapiens
caagtttctagctagaaatatga

SEQ ID NO: 4059023 - DNA, 13 bp, Homo sapiens
caagttttgtgta

SEQ ID NO: 4059024 - DNA, 13 bp, Homo sapiens
caataaaaagttc

SEQ ID NO: 4059025 - DNA, 19 bp, Homo sapiens
caataaaaagttcagagtt

SEQ ID NO: 4059026 - DNA, 14 bp, Homo sapiens
caataaaacattaa

SEQ ID NO: 4059027 - DNA, 15 bp, Homo sapiens
caataaaatgtgatt

SEQ ID NO: 4059028 - DNA, 18 bp, Homo sapiens
caataaaatttctaagag

SEQ ID NO: 4059029 - DNA, 11 bp, Homo sapiens
caataaactat

SEQ ID NO: 4059030 - DNA, 18 bp, Homo sapiens
caataaacttagaggaaa

SEQ ID NO: 4059031 - DNA, 20 bp, Homo sapiens
caataaacttagaggaaaat

SEQ ID NO: 4059032 - DNA, 15 bp, Homo sapiens
caataaagcactgag

SEQ ID NO: 4059033 - DNA, 16 bp, Homo sapiens
caataaagcactgagc

SEQ ID NO: 4059034 - DNA, 14 bp, Homo sapiens
caataaagcattta

SEQ ID NO: 4059035 - DNA, 14 bp, Homo sapiens
caataaatccacac

SEQ ID NO: 4059036 - DNA, 14 bp, Homo sapiens
caataaatctttca

SEQ ID NO: 4059037 - DNA, 15 bp, Homo sapiens
caataaatgtattca

SEQ ID NO: 4059038 - DNA, 13 bp, Homo sapiens
caataacactgtc

SEQ ID NO: 4059039 - DNA, 12 bp, Homo sapiens
caataacttcta

SEQ ID NO: 4059040 - DNA, 22 bp, Homo sapiens
caataacttctatattttaata

SEQ ID NO: 4059041 - DNA, 23 bp, Homo sapiens
caataacttctatattttaatag

SEQ ID NO: 4059042 - DNA, 13 bp, Homo sapiens
caataacttctga

SEQ ID NO: 4059043 - DNA, 21 bp, Homo sapiens
caataagtacttatctttatt

SEQ ID NO: 4059044 - DNA, 23 bp, Homo sapiens
caataagtgtgtggtagaaacaa

SEQ ID NO: 4059045 - DNA, 21 bp, Homo sapiens
caataagtttgaacctttttt

SEQ ID NO: 4059046 - DNA, 21 bp, Homo sapiens
caataatattgttgtataatt

SEQ ID NO: 4059047 - DNA, 22 bp, Homo sapiens
caataatattgttgtataattt

SEQ ID NO: 4059048 - DNA, 19 bp, Homo sapiens
caatacactagttgtttct

SEQ ID NO: 4059049 - DNA, 18 bp, Homo sapiens
caatacagataacattag

SEQ ID NO: 4059050 - DNA, 16 bp, Homo sapiens
caatacgcctttaaag

SEQ ID NO: 4059051 - DNA, 15 bp, Homo sapiens
caatagagactgtag

SEQ ID NO: 4059052 - DNA, 18 bp, Homo sapiens
caatagctttaccctcag

SEQ ID NO: 4059053 - DNA, 21 bp, Homo sapiens
caatagctttaccctcaggca

SEQ ID NO: 4059054 - DNA, 19 bp, Homo sapiens
caatatccctcttgtaagt

SEQ ID NO: 4059055 - DNA, 21 bp, Homo sapiens
caatatgtatgctttttacct

SEQ ID NO: 4059056 - DNA, 18 bp, Homo sapiens
caatatgtgtttacttta

SEQ ID NO: 4059057 - DNA, 22 bp, Homo sapiens
caatattaaatacagacactaa

SEQ ID NO: 4059058 - DNA, 24 bp, Homo sapiens
caatattaacctaatcaccatgta

SEQ ID NO: 4059059 - DNA, 21 bp, Homo sapiens
caatattatactaagaaaaga

SEQ ID NO: 4059060 - DNA, 22 bp, Homo sapiens
caatattatactaagaaaagat

SEQ ID NO: 4059061 - DNA, 16 bp, Homo sapiens
caatattgtctccctt

SEQ ID NO: 4059062 - DNA, 14 bp, Homo sapiens
caatatttatggat

SEQ ID NO: 4059063 - DNA, 19 bp, Homo sapiens
caatatttgaattttaaat

SEQ ID NO: 4059064 - DNA, 20 bp, Homo sapiens
caatattttctttaatgctt

SEQ ID NO: 4059065 - DNA, 14 bp, Homo sapiens
caatatttttagat

SEQ ID NO: 4059066 - DNA, 22 bp, Homo sapiens
caatatttttatatcatgcaaa

SEQ ID NO: 4059067 - DNA, 17 bp, Homo sapiens
caatcaaataagtattt

SEQ ID NO: 4059068 - DNA, 14 bp, Homo sapiens
caatcaaatctgct

SEQ ID NO: 4059069 - DNA, 18 bp, Homo sapiens
caatcaaggttataattt

SEQ ID NO: 4059070 - DNA, 19 bp, Homo sapiens
caatcaaggttataatttt

SEQ ID NO: 4059071 - DNA, 21 bp, Homo sapiens
caatcagtagcttaagaaaaa

SEQ ID NO: 4059072 - DNA, 19 bp, Homo sapiens
caatcagtatgtattcttt

SEQ ID NO: 4059073 - DNA, 15 bp, Homo sapiens
caatcattgctgaaa

SEQ ID NO: 4059074 - DNA, 18 bp, Homo sapiens
caatcatttctcactgtg

SEQ ID NO: 4059075 - DNA, 22 bp, Homo sapiens
caatcccagggctggctctgca

SEQ ID NO: 4059076 - DNA, 13 bp, Homo sapiens
caatccccatcag

SEQ ID NO: 4059077 - DNA, 20 bp, Homo sapiens
caatccctttattaccccct

SEQ ID NO: 4059078 - DNA, 22 bp, Homo sapiens
caatcctaacacattatcggga

SEQ ID NO: 4059079 - DNA, 19 bp, Homo sapiens
caatcctaatttctcctcc

SEQ ID NO: 4059080 - DNA, 16 bp, Homo sapiens
caatcctcctgcctca

SEQ ID NO: 4059081 - DNA, 17 bp, Homo sapiens
caatcctcctgcctcag

SEQ ID NO: 4059082 - DNA, 20 bp, Homo sapiens
caatcctgggcaatcagaca

SEQ ID NO: 4059083 - DNA, 19 bp, Homo sapiens
caatccttccctgctcttg

SEQ ID NO: 4059084 - DNA, 15 bp, Homo sapiens
caatcgcaaatcaaa

SEQ ID NO: 4059085 - DNA, 24 bp, Homo sapiens
caatctgattcagcatcactaaac

SEQ ID NO: 4059086 - DNA, 21 bp, Homo sapiens
caatctgcacactccaggcct

SEQ ID NO: 4059087 - DNA, 18 bp, Homo sapiens
caatctggcccttacaca

SEQ ID NO: 4059088 - DNA, 20 bp, Homo sapiens
caatctggcccttacacact

SEQ ID NO: 4059089 - DNA, 21 bp, Homo sapiens
caatctggcccttacacactc

SEQ ID NO: 4059090 - DNA, 22 bp, Homo sapiens
caatctggcccttacacactca

SEQ ID NO: 4059091 - DNA, 13 bp, Homo sapiens
caatcttgctttg

SEQ ID NO: 4059092 - DNA, 19 bp, Homo sapiens
caatcttgttttaagcaaa

SEQ ID NO: 4059093 - DNA, 16 bp, Homo sapiens
caatgaaaactctttg

SEQ ID NO: 4059094 - DNA, 14 bp, Homo sapiens
caatgaagccagct

SEQ ID NO: 4059095 - DNA, 21 bp, Homo sapiens
caatgagactctagggtccag

SEQ ID NO: 4059096 - DNA, 18 bp, Homo sapiens
caatgaggtctgaaatgg

SEQ ID NO: 4059097 - DNA, 21 bp, Homo sapiens
caatgatgaatgagaatctac

SEQ ID NO: 4059098 - DNA, 22 bp, Homo sapiens
caatgatgattaaacacctgac

SEQ ID NO: 4059099 - DNA, 13 bp, Homo sapiens
caatgatggtcac

SEQ ID NO: 4059100 - DNA, 22 bp, Homo sapiens
caatgattgttaatttacagct

SEQ ID NO: 4059101 - DNA, 16 bp, Homo sapiens
caatgcacatggtgca

SEQ ID NO: 4059102 - DNA, 13 bp, Homo sapiens
caatgcagaactc

SEQ ID NO: 4059103 - DNA, 13 bp, Homo sapiens
caatgcagcaagg

SEQ ID NO: 4059104 - DNA, 15 bp, Homo sapiens
caatgcccagcaggg

SEQ ID NO: 4059105 - DNA, 21 bp, Homo sapiens
caatgctgatttggtgaccaa

SEQ ID NO: 4059106 - DNA, 16 bp, Homo sapiens
caatgcttaaactaaa

SEQ ID NO: 4059107 - DNA, 21 bp, Homo sapiens
caatgcttttatatggcccag

SEQ ID NO: 4059108 - DNA, 21 bp, Homo sapiens
caatggcctaaaactggcctg

SEQ ID NO: 4059109 - DNA, 16 bp, Homo sapiens
caatggctaattccca

SEQ ID NO: 4059110 - DNA, 18 bp, Homo sapiens
caatggctaattcccaga

SEQ ID NO: 4059111 - DNA, 23 bp, Homo sapiens
cacacagcagccccccagcacta

SEQ ID NO: 4059112 - DNA, 18 bp, Homo sapiens
cacacagctactctcccc

SEQ ID NO: 4059113 - DNA, 12 bp, Homo sapiens
cacacagctgcc

SEQ ID NO: 4059114 - DNA, 12 bp, Homo sapiens
cacacagggcag

SEQ ID NO: 4059115 - DNA, 19 bp, Homo sapiens
cacacaggtggggactggg

SEQ ID NO: 4059116 - DNA, 22 bp, Homo sapiens
cacacaggtggggactgggcac

SEQ ID NO: 4059117 - DNA, 23 bp, Homo sapiens
cacacattcccccaccagctgca

SEQ ID NO: 4059118 - DNA, 14 bp, Homo sapiens
cacacatttcactg

SEQ ID NO: 4059119 - DNA, 19 bp, Homo sapiens
cacacatttcactgtctgt

SEQ ID NO: 4059120 - DNA, 13 bp, Homo sapiens
cacaccaggctgt

SEQ ID NO: 4059121 - DNA, 20 bp, Homo sapiens
cacaccaggctgtgggcctc

SEQ ID NO: 4059122 - DNA, 14 bp, Homo sapiens
cacacccactccct

SEQ ID NO: 4059123 - DNA, 20 bp, Homo sapiens
cacaccccagcccaccctgc

SEQ ID NO: 4059124 - DNA, 18 bp, Homo sapiens
cacacccctgtcccaccc

SEQ ID NO: 4059125 - DNA, 13 bp, Homo sapiens
cacacctcagttc

SEQ ID NO: 4059126 - DNA, 20 bp, Homo sapiens
cacacctcagttcccttggc

SEQ ID NO: 4059127 - DNA, 15 bp, Homo sapiens
cacacctccgagaca

SEQ ID NO: 4059128 - DNA, 17 bp, Homo sapiens
cacacctccgagacagt

SEQ ID NO: 4059129 - DNA, 20 bp, Homo sapiens
cacacctccgagacagtcca

SEQ ID NO: 4059130 - DNA, 21 bp, Homo sapiens
cacacctccgagacagtccag

SEQ ID NO: 4059131 - DNA, 12 bp, Homo sapiens
cacacctctgcc

SEQ ID NO: 4059132 - DNA, 13 bp, Homo sapiens
cacacctctgcca

SEQ ID NO: 4059133 - DNA, 17 bp, Homo sapiens
cacacctgaacttgcct

SEQ ID NO: 4059134 - DNA, 14 bp, Homo sapiens
cacaccttccaggg

SEQ ID NO: 4059135 - DNA, 15 bp, Homo sapiens
cacaccttccagggc

SEQ ID NO: 4059136 - DNA, 17 bp, Homo sapiens
cacaccttccagggccc

SEQ ID NO: 4059137 - DNA, 23 bp, Homo sapiens
cacaccttttattgacacagaaa

SEQ ID NO: 4059138 - DNA, 13 bp, Homo sapiens
cacacgcacgcac

SEQ ID NO: 4059139 - DNA, 14 bp, Homo sapiens
cacacgcacgcaca

SEQ ID NO: 4059140 - DNA, 17 bp, Homo sapiens
cacacgcacgcacacac

SEQ ID NO: 4059141 - DNA, 15 bp, Homo sapiens
cacacgcactggtgc

SEQ ID NO: 4059142 - DNA, 21 bp, Homo sapiens
cacacggactcccgggccacg

SEQ ID NO: 4059143 - DNA, 17 bp, Homo sapiens
cacacgtacttaaatga

SEQ ID NO: 4059144 - DNA, 21 bp, Homo sapiens
cacactaacctgggttccctt

SEQ ID NO: 4059145 - DNA, 18 bp, Homo sapiens
cacactagcctctccagg

SEQ ID NO: 4059146 - DNA, 13 bp, Homo sapiens
cacactcaggcct

SEQ ID NO: 4059147 - DNA, 18 bp, Homo sapiens
cacactcaggcctgtgcc

SEQ ID NO: 4059148 - DNA, 14 bp, Homo sapiens
cacactccaggcct

SEQ ID NO: 4059149 - DNA, 20 bp, Homo sapiens
cacactccatctcctgctca

SEQ ID NO: 4059150 - DNA, 23 bp, Homo sapiens
cacactcccaaggttggagccca

SEQ ID NO: 4059151 - DNA, 12 bp, Homo sapiens
cacactccctgc

SEQ ID NO: 4059152 - DNA, 18 bp, Homo sapiens
cacactccctgcttgcag

SEQ ID NO: 4059153 - DNA, 23 bp, Homo sapiens
cacactccctgcttgcaggaggc

SEQ ID NO: 4059154 - DNA, 23 bp, Homo sapiens
cacactgcctcccatccttccct

SEQ ID NO: 4059155 - DNA, 22 bp, Homo sapiens
cacactggtacttagagtttct

SEQ ID NO: 4059156 - DNA, 20 bp, Homo sapiens
cacactgtcatgcttcatca

SEQ ID NO: 4059157 - DNA, 20 bp, Homo sapiens
cacacttcaggctcttctcc

SEQ ID NO: 4059158 - DNA, 21 bp, Homo sapiens
cacacttcaggctcttctcct

SEQ ID NO: 4059159 - DNA, 22 bp, Homo sapiens
cacacttcaggctcttctcctt

SEQ ID NO: 4059160 - DNA, 17 bp, Homo sapiens
cacacttgagaggatga

SEQ ID NO: 4059161 - DNA, 22 bp, Homo sapiens
cacacttgtcggctccagtccc

SEQ ID NO: 4059162 - DNA, 13 bp, Homo sapiens
cacacttgtgtgt

SEQ ID NO: 4059163 - DNA, 19 bp, Homo sapiens
cacacttgtgtgtgggctg

SEQ ID NO: 4059164 - DNA, 23 bp, Homo sapiens
cacacttgtgtgtgggctgtgag

SEQ ID NO: 4059165 - DNA, 15 bp, Homo sapiens
cacacttgttccagc

SEQ ID NO: 4059166 - DNA, 16 bp, Homo sapiens
cacactttttatttaa

SEQ ID NO: 4059167 - DNA, 18 bp, Homo sapiens
cacagaaacacaatattt

SEQ ID NO: 4059168 - DNA, 21 bp, Homo sapiens
cacagaaacacaatattttgt

SEQ ID NO: 4059169 - DNA, 17 bp, Homo sapiens
cacagaaatcagaggag

SEQ ID NO: 4059170 - DNA, 17 bp, Homo sapiens
cacagaaatgctgctgg

SEQ ID NO: 4059171 - DNA, 21 bp, Homo sapiens
cacagaaatgctgctggccaa

SEQ ID NO: 4059172 - DNA, 22 bp, Homo sapiens
cacagaaatgctgctggccaaa

SEQ ID NO: 4059173 - DNA, 21 bp, Homo sapiens
cacagaaccttcaacccagtg

SEQ ID NO: 4059174 - DNA, 15 bp, Homo sapiens
cacagaagcctagga

SEQ ID NO: 4059175 - DNA, 19 bp, Homo sapiens
cacagacacaatatgtatg

SEQ ID NO: 4059176 - DNA, 12 bp, Homo sapiens
cacagacacaca

SEQ ID NO: 4059177 - DNA, 14 bp, Homo sapiens
cacagacagatccc

SEQ ID NO: 4059178 - DNA, 15 bp, Homo sapiens
cacagacagatccca

SEQ ID NO: 4059179 - DNA, 21 bp, Homo sapiens
cacagacccaggacccccgag

SEQ ID NO: 4059180 - DNA, 22 bp, Homo sapiens
cacagagagggagagcagagaa

SEQ ID NO: 4059181 - DNA, 19 bp, Homo sapiens
cacagagcctggccccagg

SEQ ID NO: 4059182 - DNA, 21 bp, Homo sapiens
cacagaggcagcccgcacacc

SEQ ID NO: 4059183 - DNA, 22 bp, Homo sapiens
cacagagtggtctttctggaga

SEQ ID NO: 4059184 - DNA, 14 bp, Homo sapiens
cacagatatttcca

SEQ ID NO: 4059185 - DNA, 17 bp, Homo sapiens
cacagatggatttgcct

SEQ ID NO: 4059186 - DNA, 19 bp, Homo sapiens
cacagatggatttgcctgt

SEQ ID NO: 4059187 - DNA, 14 bp, Homo sapiens
cacagcaaccccag

SEQ ID NO: 4059188 - DNA, 18 bp, Homo sapiens
cacagcaaccccaggctg

SEQ ID NO: 4059189 - DNA, 19 bp, Homo sapiens
cacagcaagtacagcggct

SEQ ID NO: 4059190 - DNA, 20 bp, Homo sapiens
cacagcagccccccagcact

SEQ ID NO: 4059191 - DNA, 16 bp, Homo sapiens
cacagcagctgaacag

SEQ ID NO: 4059192 - DNA, 19 bp, Homo sapiens
cacagcagcttcaccagag

SEQ ID NO: 4059193 - DNA, 21 bp, Homo sapiens
cacagcagcttcaccagagca

SEQ ID NO: 4059194 - DNA, 13 bp, Homo sapiens
cacagcaggtcct

SEQ ID NO: 4059195 - DNA, 12 bp, Homo sapiens
cacagcagtgag

SEQ ID NO: 4059196 - DNA, 13 bp, Homo sapiens
cacagcagtgagt

SEQ ID NO: 4059197 - DNA, 23 bp, Homo sapiens
cacagcagtgtgaatagcctggc

SEQ ID NO: 4059198 - DNA, 23 bp, Homo sapiens
cacagcatcattttgcattcaaa

SEQ ID NO: 4059199 - DNA, 13 bp, Homo sapiens
cacagccagagga

SEQ ID NO: 4059200 - DNA, 21 bp, Homo sapiens
cacagcctataggccaatgca

SEQ ID NO: 4059201 - DNA, 13 bp, Homo sapiens
cacagcctccagg

SEQ ID NO: 4059202 - DNA, 14 bp, Homo sapiens
cacagcctcctctg

SEQ ID NO: 4059203 - DNA, 20 bp, Homo sapiens
cacagcctcctctgtctgcc

SEQ ID NO: 4059204 - DNA, 13 bp, Homo sapiens
cacagcctggact

SEQ ID NO: 4059205 - DNA, 17 bp, Homo sapiens
cacagcggaggagacca

SEQ ID NO: 4059206 - DNA, 23 bp, Homo sapiens
cacagcggagtctgtcctgtgac

SEQ ID NO: 4059207 - DNA, 14 bp, Homo sapiens
cacagcggcccctg

SEQ ID NO: 4059208 - DNA, 16 bp, Homo sapiens
cacagcggcccctgca

SEQ ID NO: 4059209 - DNA, 22 bp, Homo sapiens
cacagcgtccctggcgcaggtg

SEQ ID NO: 4059210 - DNA, 15 bp, Homo sapiens
cacagctacctgaga

SEQ ID NO: 4059211 - DNA, 16 bp, Homo sapiens
cacagctacctgagac

SEQ ID NO: 4059212 - DNA, 13 bp, Homo sapiens
cacagctcccttc

SEQ ID NO: 4059213 - DNA, 17 bp, Homo sapiens
cacatttctgatcagag

SEQ ID NO: 4059214 - DNA, 18 bp, Homo sapiens
cacatttctgatcagagg

SEQ ID NO: 4059215 - DNA, 16 bp, Homo sapiens
cacatttggaatactt

SEQ ID NO: 4059216 - DNA, 17 bp, Homo sapiens
cacatttggaatacttt

SEQ ID NO: 4059217 - DNA, 11 bp, Homo sapiens
cacatttgtac

SEQ ID NO: 4059218 - DNA, 20 bp, Homo sapiens
caccaaaaaaatccagaaac

SEQ ID NO: 4059219 - DNA, 18 bp, Homo sapiens
caccaagcacagcagcct

SEQ ID NO: 4059220 - DNA, 14 bp, Homo sapiens
caccaagcagtggc

SEQ ID NO: 4059221 - DNA, 22 bp, Homo sapiens
caccaagttggaacatccttgg

SEQ ID NO: 4059222 - DNA, 16 bp, Homo sapiens
caccaatgcccagcag

SEQ ID NO: 4059223 - DNA, 16 bp, Homo sapiens
caccacagacacacac

SEQ ID NO: 4059224 - DNA, 15 bp, Homo sapiens
caccacatctgccag

SEQ ID NO: 4059225 - DNA, 13 bp, Homo sapiens
caccacctctgtg

SEQ ID NO: 4059226 - DNA, 13 bp, Homo sapiens
caccacctgcctc

SEQ ID NO: 4059227 - DNA, 20 bp, Homo sapiens
caccacggcgtttttttaca

SEQ ID NO: 4059228 - DNA, 13 bp, Homo sapiens
caccactgcactc

SEQ ID NO: 4059229 - DNA, 15 bp, Homo sapiens
caccagacacccagg

SEQ ID NO: 4059230 - DNA, 17 bp, Homo sapiens
caccagacacccaggac

SEQ ID NO: 4059231 - DNA, 18 bp, Homo sapiens
caccagacacccaggact

SEQ ID NO: 4059232 - DNA, 16 bp, Homo sapiens
caccagacatcaccct

SEQ ID NO: 4059233 - DNA, 20 bp, Homo sapiens
caccagacatcaccctttgc

SEQ ID NO: 4059234 - DNA, 18 bp, Homo sapiens
caccagagcaacctctca

SEQ ID NO: 4059235 - DNA, 20 bp, Homo sapiens
caccagagcaacctctcact

SEQ ID NO: 4059236 - DNA, 12 bp, Homo sapiens
caccagagcaga

SEQ ID NO: 4059237 - DNA, 20 bp, Homo sapiens
caccagagcagatgcagaga

SEQ ID NO: 4059238 - DNA, 23 bp, Homo sapiens
caccagaggccgaaggtgcctca

SEQ ID NO: 4059239 - DNA, 15 bp, Homo sapiens
caccagatgtgacag

SEQ ID NO: 4059240 - DNA, 11 bp, Homo sapiens
caccagccagc

SEQ ID NO: 4059241 - DNA, 20 bp, Homo sapiens
caccagcccccgccccagag

SEQ ID NO: 4059242 - DNA, 22 bp, Homo sapiens
caccagcccccgccccagagtg

SEQ ID NO: 4059243 - DNA, 17 bp, Homo sapiens
caccagcccggcctgct

SEQ ID NO: 4059244 - DNA, 15 bp, Homo sapiens
caccagccgccccag

SEQ ID NO: 4059245 - DNA, 19 bp, Homo sapiens
caccagccgccccagcccc

SEQ ID NO: 4059246 - DNA, 23 bp, Homo sapiens
caccagctcgtttttcagcaccc

SEQ ID NO: 4059247 - DNA, 12 bp, Homo sapiens
caccagctgcag

SEQ ID NO: 4059248 - DNA, 14 bp, Homo sapiens
caccagctgtgtcc

SEQ ID NO: 4059249 - DNA, 11 bp, Homo sapiens
caccaggaagg

SEQ ID NO: 4059250 - DNA, 16 bp, Homo sapiens
caccaggagaaccact

SEQ ID NO: 4059251 - DNA, 21 bp, Homo sapiens
caccaggatggcccttcccac

SEQ ID NO: 4059252 - DNA, 13 bp, Homo sapiens
caccaggccgggc

SEQ ID NO: 4059253 - DNA, 14 bp, Homo sapiens
caccaggccgggct

SEQ ID NO: 4059254 - DNA, 15 bp, Homo sapiens
caccaggctgtgggc

SEQ ID NO: 4059255 - DNA, 22 bp, Homo sapiens
caccagggccaaaagcttccct

SEQ ID NO: 4059256 - DNA, 14 bp, Homo sapiens
caccagtgacctgg

SEQ ID NO: 4059257 - DNA, 17 bp, Homo sapiens
caccagtggcctcgtgg

SEQ ID NO: 4059258 - DNA, 14 bp, Homo sapiens
caccagtgtcccct

SEQ ID NO: 4059259 - DNA, 18 bp, Homo sapiens
caccagtgtcccctccac

SEQ ID NO: 4059260 - DNA, 14 bp, Homo sapiens
caccataacctctg

SEQ ID NO: 4059261 - DNA, 15 bp, Homo sapiens
caccataacctctgg

SEQ ID NO: 4059262 - DNA, 23 bp, Homo sapiens
caccatacgagcacctccagcct

SEQ ID NO: 4059263 - DNA, 21 bp, Homo sapiens
caccatattggccagtctggt

SEQ ID NO: 4059264 - DNA, 11 bp, Homo sapiens
caccatccctg

SEQ ID NO: 4059265 - DNA, 18 bp, Homo sapiens
caccatctgattaaaaca

SEQ ID NO: 4059266 - DNA, 16 bp, Homo sapiens
caccatggccagccaa

SEQ ID NO: 4059267 - DNA, 21 bp, Homo sapiens
cacccaaatcacatctcacct

SEQ ID NO: 4059268 - DNA, 23 bp, Homo sapiens
cacccaaatcacatctcacctcc

SEQ ID NO: 4059269 - DNA, 16 bp, Homo sapiens
cacccaagcccaaact

SEQ ID NO: 4059270 - DNA, 16 bp, Homo sapiens
cacccacccctgcaca

SEQ ID NO: 4059271 - DNA, 14 bp, Homo sapiens
cacccaccctgtgc

SEQ ID NO: 4059272 - DNA, 15 bp, Homo sapiens
cacccacctcttgtg

SEQ ID NO: 4059273 - DNA, 10 bp, Homo sapiens
cacccagccc

SEQ ID NO: 4059274 - DNA, 14 bp, Homo sapiens
cacccagcccctgg

SEQ ID NO: 4059275 - DNA, 11 bp, Homo sapiens
cacccagcctg

SEQ ID NO: 4059276 - DNA, 15 bp, Homo sapiens
cacccagctccaggg

SEQ ID NO: 4059277 - DNA, 11 bp, Homo sapiens
cacccaggagg

SEQ ID NO: 4059278 - DNA, 21 bp, Homo sapiens
cacccagggaactaggaaggc

SEQ ID NO: 4059279 - DNA, 21 bp, Homo sapiens
cacccaggggaaggccctgag

SEQ ID NO: 4059280 - DNA, 23 bp, Homo sapiens
cacccaggggaaggccctgaggc

SEQ ID NO: 4059281 - DNA, 17 bp, Homo sapiens
cacccataatcctttct

SEQ ID NO: 4059282 - DNA, 13 bp, Homo sapiens
cacccatgggctc

SEQ ID NO: 4059283 - DNA, 13 bp, Homo sapiens
cacccatgtgcca

SEQ ID NO: 4059284 - DNA, 15 bp, Homo sapiens
caccccaccctccct

SEQ ID NO: 4059285 - DNA, 20 bp, Homo sapiens
caccccaccctccctggagt

SEQ ID NO: 4059286 - DNA, 16 bp, Homo sapiens
caccccacctccactc

SEQ ID NO: 4059287 - DNA, 18 bp, Homo sapiens
caccccagcccaccctgc

SEQ ID NO: 4059288 - DNA, 13 bp, Homo sapiens
caccccagcctcg

SEQ ID NO: 4059289 - DNA, 12 bp, Homo sapiens
caccccatccca

SEQ ID NO: 4059290 - DNA, 12 bp, Homo sapiens
caccccatcctc

SEQ ID NO: 4059291 - DNA, 12 bp, Homo sapiens
cacccccagctc

SEQ ID NO: 4059292 - DNA, 14 bp, Homo sapiens
cacccccagctcaa

SEQ ID NO: 4059293 - DNA, 18 bp, Homo sapiens
caccccccacacacacta

SEQ ID NO: 4059294 - DNA, 21 bp, Homo sapiens
caccccctcaagccccagcag

SEQ ID NO: 4059295 - DNA, 13 bp, Homo sapiens
caccccctgccct

SEQ ID NO: 4059296 - DNA, 17 bp, Homo sapiens
caccccctgccctgcac

SEQ ID NO: 4059297 - DNA, 22 bp, Homo sapiens
caccccctgctccaccagcagc

SEQ ID NO: 4059298 - DNA, 14 bp, Homo sapiens
cacccccttccccc

SEQ ID NO: 4059299 - DNA, 13 bp, Homo sapiens
cacccccttctct

SEQ ID NO: 4059300 - DNA, 12 bp, Homo sapiens
caccccctttcc

SEQ ID NO: 4059301 - DNA, 14 bp, Homo sapiens
caccccctttcctg

SEQ ID NO: 4059302 - DNA, 15 bp, Homo sapiens
caccccggcctcagg

SEQ ID NO: 4059303 - DNA, 19 bp, Homo sapiens
caccccggggaccctgtga

SEQ ID NO: 4059304 - DNA, 14 bp, Homo sapiens
cacccctaaagaga

SEQ ID NO: 4059305 - DNA, 22 bp, Homo sapiens
cacccctaatgagggtgtgaga

SEQ ID NO: 4059306 - DNA, 13 bp, Homo sapiens
cacccctacacac

SEQ ID NO: 4059307 - DNA, 16 bp, Homo sapiens
cacccctacacacaca

SEQ ID NO: 4059308 - DNA, 12 bp, Homo sapiens
cacccctcactc

SEQ ID NO: 4059309 - DNA, 14 bp, Homo sapiens
cacccctcactccc

SEQ ID NO: 4059310 - DNA, 20 bp, Homo sapiens
cacccctcactccccaggga

SEQ ID NO: 4059311 - DNA, 19 bp, Homo sapiens
cacccctgcccccagcccc

SEQ ID NO: 4059312 - DNA, 20 bp, Homo sapiens
cacccctggaagagcccagt

SEQ ID NO: 4059313 - DNA, 13 bp, Homo sapiens
cacccctgggcag

SEQ ID NO: 4059314 - DNA, 14 bp, Homo sapiens
cacccctgggcagg

SEQ ID NO: 4059315 - DNA, 18 bp, Homo sapiens
cacccctgggcaggcggt

SEQ ID NO: 4059316 - DNA, 14 bp, Homo sapiens
cacccctgggccag

SEQ ID NO: 4059317 - DNA, 15 bp, Homo sapiens
cacctctgttaaggt

SEQ ID NO: 4059318 - DNA, 21 bp, Homo sapiens
cacctctgttaaggttgaact

SEQ ID NO: 4059319 - DNA, 14 bp, Homo sapiens
cacctcttcacccc

SEQ ID NO: 4059320 - DNA, 18 bp, Homo sapiens
cacctgacagcccctccc

SEQ ID NO: 4059321 - DNA, 11 bp, Homo sapiens
cacctgcacac

SEQ ID NO: 4059322 - DNA, 14 bp, Homo sapiens
cacctgcacactcc

SEQ ID NO: 4059323 - DNA, 21 bp, Homo sapiens
cacctgcacactccatctcct

SEQ ID NO: 4059324 - DNA, 11 bp, Homo sapiens
cacctgcagct

SEQ ID NO: 4059325 - DNA, 14 bp, Homo sapiens
cacctgcctcagga

SEQ ID NO: 4059326 - DNA, 21 bp, Homo sapiens
cacctgcctctaatctgagct

SEQ ID NO: 4059327 - DNA, 16 bp, Homo sapiens
cacctgccttggcctc

SEQ ID NO: 4059328 - DNA, 13 bp, Homo sapiens
cacctgctccaga

SEQ ID NO: 4059329 - DNA, 12 bp, Homo sapiens
cacctgctctgc

SEQ ID NO: 4059330 - DNA, 13 bp, Homo sapiens
cacctgctctgct

SEQ ID NO: 4059331 - DNA, 13 bp, Homo sapiens
cacctgcttctga

SEQ ID NO: 4059332 - DNA, 14 bp, Homo sapiens
cacctgcttctgaa

SEQ ID NO: 4059333 - DNA, 16 bp, Homo sapiens
cacctggcaaaggacc

SEQ ID NO: 4059334 - DNA, 18 bp, Homo sapiens
cacctggctgagcagttc

SEQ ID NO: 4059335 - DNA, 20 bp, Homo sapiens
cacctggctgaggttcctct

SEQ ID NO: 4059336 - DNA, 15 bp, Homo sapiens
cacctgtagcagcca

SEQ ID NO: 4059337 - DNA, 20 bp, Homo sapiens
cacctgtccccaccctccac

SEQ ID NO: 4059338 - DNA, 17 bp, Homo sapiens
cacctgtctcagcctcc

SEQ ID NO: 4059339 - DNA, 18 bp, Homo sapiens
cacctgtctcagcctccc

SEQ ID NO: 4059340 - DNA, 14 bp, Homo sapiens
cacctgtctgctcc

SEQ ID NO: 4059341 - DNA, 13 bp, Homo sapiens
cacctgtgctgga

SEQ ID NO: 4059342 - DNA, 20 bp, Homo sapiens
cacctgtgctggagccctgt

SEQ ID NO: 4059343 - DNA, 16 bp, Homo sapiens
cacctgttatgtatga

SEQ ID NO: 4059344 - DNA, 23 bp, Homo sapiens
cacctgttcacagaaaaagcatg

SEQ ID NO: 4059345 - DNA, 19 bp, Homo sapiens
cacctgtttttaagctgtt

SEQ ID NO: 4059346 - DNA, 14 bp, Homo sapiens
caccttcaggcccc

SEQ ID NO: 4059347 - DNA, 19 bp, Homo sapiens
caccttcagtttttgtgtt

SEQ ID NO: 4059348 - DNA, 16 bp, Homo sapiens
caccttccagctcctg

SEQ ID NO: 4059349 - DNA, 13 bp, Homo sapiens
caccttcctcact

SEQ ID NO: 4059350 - DNA, 20 bp, Homo sapiens
caccttcctcacttccatac

SEQ ID NO: 4059351 - DNA, 17 bp, Homo sapiens
caccttctgtccccagc

SEQ ID NO: 4059352 - DNA, 17 bp, Homo sapiens
caccttggctctgccag

SEQ ID NO: 4059353 - DNA, 20 bp, Homo sapiens
caccttggctctgccagtgg

SEQ ID NO: 4059354 - DNA, 16 bp, Homo sapiens
caccttggctgggaag

SEQ ID NO: 4059355 - DNA, 17 bp, Homo sapiens
caccttgggctggggga

SEQ ID NO: 4059356 - DNA, 16 bp, Homo sapiens
caccttttctgtggct

SEQ ID NO: 4059357 - DNA, 20 bp, Homo sapiens
caccttttgggaatgtttta

SEQ ID NO: 4059358 - DNA, 19 bp, Homo sapiens
cacgaagccttaagccata

SEQ ID NO: 4059359 - DNA, 18 bp, Homo sapiens
cacgaatttgctggggaa

SEQ ID NO: 4059360 - DNA, 18 bp, Homo sapiens
cacgaccggggccagcac

SEQ ID NO: 4059361 - DNA, 15 bp, Homo sapiens
cacgagagcgcagca

SEQ ID NO: 4059362 - DNA, 22 bp, Homo sapiens
cacgaggaatctgtgggtctgg

SEQ ID NO: 4059363 - DNA, 23 bp, Homo sapiens
cacgaggaatctgtgggtctggg

SEQ ID NO: 4059364 - DNA, 21 bp, Homo sapiens
cacgagggctggctggcctca

SEQ ID NO: 4059365 - DNA, 22 bp, Homo sapiens
cacgagggctggctggcctcac

SEQ ID NO: 4059366 - DNA, 18 bp, Homo sapiens
cacgagtcagtcgccttt

SEQ ID NO: 4059367 - DNA, 16 bp, Homo sapiens
cacgattggagaatac

SEQ ID NO: 4059368 - DNA, 13 bp, Homo sapiens
cacgattggccac

SEQ ID NO: 4059369 - DNA, 17 bp, Homo sapiens
cacgattggccacctgt

SEQ ID NO: 4059370 - DNA, 15 bp, Homo sapiens
cacgcaacttgaaat

SEQ ID NO: 4059371 - DNA, 23 bp, Homo sapiens
cacgcacaaacacacacactatg

SEQ ID NO: 4059372 - DNA, 12 bp, Homo sapiens
cacgcacacaca

SEQ ID NO: 4059373 - DNA, 16 bp, Homo sapiens
cacgcacctgcctcag

SEQ ID NO: 4059374 - DNA, 13 bp, Homo sapiens
cacgcacgcacac

SEQ ID NO: 4059375 - DNA, 15 bp, Homo sapiens
cacgcacgcacacac

SEQ ID NO: 4059376 - DNA, 15 bp, Homo sapiens
cacgcactgggccac

SEQ ID NO: 4059377 - DNA, 20 bp, Homo sapiens
cacgcactgggccacggagg

SEQ ID NO: 4059378 - DNA, 16 bp, Homo sapiens
cacgcaggaactccca

SEQ ID NO: 4059379 - DNA, 20 bp, Homo sapiens
cacgcaggaactcccagcaa

SEQ ID NO: 4059380 - DNA, 13 bp, Homo sapiens
cacgcaggaccag

SEQ ID NO: 4059381 - DNA, 16 bp, Homo sapiens
cacgcaggctgagtcc

SEQ ID NO: 4059382 - DNA, 13 bp, Homo sapiens
cacgcagttcttt

SEQ ID NO: 4059383 - DNA, 21 bp, Homo sapiens
cacgccgggaaccaagcagga

SEQ ID NO: 4059384 - DNA, 15 bp, Homo sapiens
cacgcctcctggcca

SEQ ID NO: 4059385 - DNA, 17 bp, Homo sapiens
cacgcctcctggccaga

SEQ ID NO: 4059386 - DNA, 17 bp, Homo sapiens
cacgcctgtaatcccag

SEQ ID NO: 4059387 - DNA, 19 bp, Homo sapiens
cacgcctgtaatcccagca

SEQ ID NO: 4059388 - DNA, 20 bp, Homo sapiens
cacgcctgtaatcccagcac

SEQ ID NO: 4059389 - DNA, 21 bp, Homo sapiens
cacgcctgtaatcccagcact

SEQ ID NO: 4059390 - DNA, 22 bp, Homo sapiens
cacgcctgtaatcccagcactt

SEQ ID NO: 4059391 - DNA, 17 bp, Homo sapiens
cacgctcacccagtcac

SEQ ID NO: 4059392 - DNA, 16 bp, Homo sapiens
cacgctggggctctct

SEQ ID NO: 4059393 - DNA, 20 bp, Homo sapiens
cacgctggggctctctgaga

SEQ ID NO: 4059394 - DNA, 13 bp, Homo sapiens
cacgctgtcctct

SEQ ID NO: 4059395 - DNA, 22 bp, Homo sapiens
cacgctgtcctctcgagcccag

SEQ ID NO: 4059396 - DNA, 20 bp, Homo sapiens
cacgctgtggccctggaggg

SEQ ID NO: 4059397 - DNA, 15 bp, Homo sapiens
cacgctttgctgcta

SEQ ID NO: 4059398 - DNA, 19 bp, Homo sapiens
cacgcttttaattctcatt

SEQ ID NO: 4059399 - DNA, 21 bp, Homo sapiens
cacgcttttaattctcatttg

SEQ ID NO: 4059400 - DNA, 18 bp, Homo sapiens
cacggaggagggatgctg

SEQ ID NO: 4059401 - DNA, 22 bp, Homo sapiens
cacggaggagggatgctgctcc

SEQ ID NO: 4059402 - DNA, 16 bp, Homo sapiens
cacggccacccgcccc

SEQ ID NO: 4059403 - DNA, 14 bp, Homo sapiens
cacggcctcctttc

SEQ ID NO: 4059404 - DNA, 15 bp, Homo sapiens
cacggcgttgtacct

SEQ ID NO: 4059405 - DNA, 17 bp, Homo sapiens
cacggcgtttttttaca

SEQ ID NO: 4059406 - DNA, 13 bp, Homo sapiens
cacggctgagcct

SEQ ID NO: 4059407 - DNA, 20 bp, Homo sapiens
cacggctgcctgacactgag

SEQ ID NO: 4059408 - DNA, 23 bp, Homo sapiens
cacggctgcctgacactgagccc

SEQ ID NO: 4059409 - DNA, 16 bp, Homo sapiens
cacgtacttaaatgaa

SEQ ID NO: 4059410 - DNA, 14 bp, Homo sapiens
cacgtcccagcatc

SEQ ID NO: 4059411 - DNA, 20 bp, Homo sapiens
cacgtcccagcatccctgga

SEQ ID NO: 4059412 - DNA, 19 bp, Homo sapiens
cacgtcttcttgctgcagc

SEQ ID NO: 4059413 - DNA, 16 bp, Homo sapiens
cacgtgcaaggactcc

SEQ ID NO: 4059414 - DNA, 15 bp, Homo sapiens
cacgttcataaccaa

SEQ ID NO: 4059415 - DNA, 20 bp, Homo sapiens
cactaaagccagcctgacct

SEQ ID NO: 4059416 - DNA, 13 bp, Homo sapiens
cactaaagcttca

SEQ ID NO: 4059417 - DNA, 19 bp, Homo sapiens
cactaagagggcagactgt

SEQ ID NO: 4059418 - DNA, 17 bp, Homo sapiens
cactacataaactgact

SEQ ID NO: 4059419 - DNA, 21 bp, Homo sapiens
cactacatgcagcccatgccc

SEQ ID NO: 4059420 - DNA, 19 bp, Homo sapiens
cactgcagcctcatactcc

SEQ ID NO: 4059421 - DNA, 18 bp, Homo sapiens
cactgcagtcttatttcc

SEQ ID NO: 4059422 - DNA, 12 bp, Homo sapiens
cactgccaggcc

SEQ ID NO: 4059423 - DNA, 14 bp, Homo sapiens
cactgccaggccag

SEQ ID NO: 4059424 - DNA, 19 bp, Homo sapiens
cactgccaggccagcctcc

SEQ ID NO: 4059425 - DNA, 21 bp, Homo sapiens
cactgccaggccagcctccga

SEQ ID NO: 4059426 - DNA, 17 bp, Homo sapiens
cactgccatctgatgcc

SEQ ID NO: 4059427 - DNA, 18 bp, Homo sapiens
cactgcccatggacaggc

SEQ ID NO: 4059428 - DNA, 21 bp, Homo sapiens
cactgccctgttcatgtgcct

SEQ ID NO: 4059429 - DNA, 18 bp, Homo sapiens
cactgcccttttcaggaa

SEQ ID NO: 4059430 - DNA, 13 bp, Homo sapiens
cactgcctgcacc

SEQ ID NO: 4059431 - DNA, 21 bp, Homo sapiens
cactgctaggcgagtgccagg

SEQ ID NO: 4059432 - DNA, 22 bp, Homo sapiens
cactgctaggcgagtgccagga

SEQ ID NO: 4059433 - DNA, 15 bp, Homo sapiens
cactgctggctgcct

SEQ ID NO: 4059434 - DNA, 14 bp, Homo sapiens
cactgctggtgcca

SEQ ID NO: 4059435 - DNA, 18 bp, Homo sapiens
cactgctggtgccagggt

SEQ ID NO: 4059436 - DNA, 22 bp, Homo sapiens
cactgctggtgccagggtgggt

SEQ ID NO: 4059437 - DNA, 16 bp, Homo sapiens
cactgctgtacccaga

SEQ ID NO: 4059438 - DNA, 23 bp, Homo sapiens
cactgcttgatgaagcaaggaag

SEQ ID NO: 4059439 - DNA, 16 bp, Homo sapiens
cactggaaaggggaga

SEQ ID NO: 4059440 - DNA, 19 bp, Homo sapiens
cactggaaaggggagagcc

SEQ ID NO: 4059441 - DNA, 24 bp, Homo sapiens
cactggaaaggggagagcctgctg

SEQ ID NO: 4059442 - DNA, 14 bp, Homo sapiens
cactggaaggaaca

SEQ ID NO: 4059443 - DNA, 12 bp, Homo sapiens
cactggagcatg

SEQ ID NO: 4059444 - DNA, 18 bp, Homo sapiens
cactggaggttgaagcca

SEQ ID NO: 4059445 - DNA, 18 bp, Homo sapiens
cactggagtgcagggagg

SEQ ID NO: 4059446 - DNA, 13 bp, Homo sapiens
cactggcccctca

SEQ ID NO: 4059447 - DNA, 11 bp, Homo sapiens
cactggctggc

SEQ ID NO: 4059448 - DNA, 18 bp, Homo sapiens
cactggctggcctgagca

SEQ ID NO: 4059449 - DNA, 14 bp, Homo sapiens
cactggctggctcc

SEQ ID NO: 4059450 - DNA, 19 bp, Homo sapiens
cactggctggctcctaggg

SEQ ID NO: 4059451 - DNA, 18 bp, Homo sapiens
cactgggccacggaggag

SEQ ID NO: 4059452 - DNA, 15 bp, Homo sapiens
cactgggccagccct

SEQ ID NO: 4059453 - DNA, 18 bp, Homo sapiens
cactggggactttattta

SEQ ID NO: 4059454 - DNA, 16 bp, Homo sapiens
cactggggcctacagc

SEQ ID NO: 4059455 - DNA, 20 bp, Homo sapiens
cactgggggaacagatgcta

SEQ ID NO: 4059456 - DNA, 15 bp, Homo sapiens
cactgggtggggtga

SEQ ID NO: 4059457 - DNA, 19 bp, Homo sapiens
cactgggtggggtgaggac

SEQ ID NO: 4059458 - DNA, 23 bp, Homo sapiens
cactgggtgttgatcttacaaga

SEQ ID NO: 4059459 - DNA, 21 bp, Homo sapiens
cactggtacttagagtttctg

SEQ ID NO: 4059460 - DNA, 22 bp, Homo sapiens
cactggtgactgcgatcttcag

SEQ ID NO: 4059461 - DNA, 20 bp, Homo sapiens
cactggtgccaaaaccaggc

SEQ ID NO: 4059462 - DNA, 21 bp, Homo sapiens
cactggtggcccgacagcctg

SEQ ID NO: 4059463 - DNA, 23 bp, Homo sapiens
cactggtggcccgacagcctggc

SEQ ID NO: 4059464 - DNA, 18 bp, Homo sapiens
cactggtttgttccctgt

SEQ ID NO: 4059465 - DNA, 18 bp, Homo sapiens
cactgtaaaatgaaatta

SEQ ID NO: 4059466 - DNA, 13 bp, Homo sapiens
cactgtataaata

SEQ ID NO: 4059467 - DNA, 22 bp, Homo sapiens
cactgtatttttttattcgcca

SEQ ID NO: 4059468 - DNA, 19 bp, Homo sapiens
cactgtcactgtttctctg

SEQ ID NO: 4059469 - DNA, 22 bp, Homo sapiens
cactgtcactgtttctctgctg

SEQ ID NO: 4059470 - DNA, 16 bp, Homo sapiens
cactgtcactttgctc

SEQ ID NO: 4059471 - DNA, 19 bp, Homo sapiens
cactgtccccctacccacc

SEQ ID NO: 4059472 - DNA, 13 bp, Homo sapiens
cactgtccctctt

SEQ ID NO: 4059473 - DNA, 18 bp, Homo sapiens
cactgtcccttgcctcaa

SEQ ID NO: 4059474 - DNA, 13 bp, Homo sapiens
cactgtctgtctg

SEQ ID NO: 4059475 - DNA, 20 bp, Homo sapiens
cactgtgaagacccagcagg

SEQ ID NO: 4059476 - DNA, 14 bp, Homo sapiens
cactgtgaccccca

SEQ ID NO: 4059477 - DNA, 20 bp, Homo sapiens
cactgtgacccccagctccg

SEQ ID NO: 4059478 - DNA, 17 bp, Homo sapiens
cactgtgcactgccctg

SEQ ID NO: 4059479 - DNA, 17 bp, Homo sapiens
cactgtgcccagcccgg

SEQ ID NO: 4059480 - DNA, 22 bp, Homo sapiens
cactgtgcccagcccggacctt

SEQ ID NO: 4059481 - DNA, 22 bp, Homo sapiens
cactgtgcgtcttggtgtaatt

SEQ ID NO: 4059482 - DNA, 23 bp, Homo sapiens
cactgtggccagtaaaatactat

SEQ ID NO: 4059483 - DNA, 15 bp, Homo sapiens
cactgttatcaaaac

SEQ ID NO: 4059484 - DNA, 12 bp, Homo sapiens
cactgtttctct

SEQ ID NO: 4059485 - DNA, 23 bp, Homo sapiens
cacttaaccaagacaaaaagcca

SEQ ID NO: 4059486 - DNA, 21 bp, Homo sapiens
cacttaagttagcctccacca

SEQ ID NO: 4059487 - DNA, 16 bp, Homo sapiens
cacttacactttatgc

SEQ ID NO: 4059488 - DNA, 19 bp, Homo sapiens
cacttactggtccttacca

SEQ ID NO: 4059489 - DNA, 21 bp, Homo sapiens
cacttagctggagatgtctct

SEQ ID NO: 4059490 - DNA, 12 bp, Homo sapiens
cacttagtcctt

SEQ ID NO: 4059491 - DNA, 12 bp, Homo sapiens
cacttatttcac

SEQ ID NO: 4059492 - DNA, 21 bp, Homo sapiens
cacttatttcactatcttctt

SEQ ID NO: 4059493 - DNA, 15 bp, Homo sapiens
cacttcaatgcacat

SEQ ID NO: 4059494 - DNA, 16 bp, Homo sapiens
cacttcaggctcttct

SEQ ID NO: 4059495 - DNA, 16 bp, Homo sapiens
cacttccctacatgga

SEQ ID NO: 4059496 - DNA, 17 bp, Homo sapiens
cacttccgtcacatccc

SEQ ID NO: 4059497 - DNA, 17 bp, Homo sapiens
cacttcctacaagagca

SEQ ID NO: 4059498 - DNA, 15 bp, Homo sapiens
cacttcctgctacag

SEQ ID NO: 4059499 - DNA, 16 bp, Homo sapiens
cacttcctgctacagg

SEQ ID NO: 4059500 - DNA, 17 bp, Homo sapiens
cacttcctgctacagga

SEQ ID NO: 4059501 - DNA, 21 bp, Homo sapiens
cacttcgcgtgccctcgctgc

SEQ ID NO: 4059502 - DNA, 16 bp, Homo sapiens
cacttctccccagaaa

SEQ ID NO: 4059503 - DNA, 12 bp, Homo sapiens
cacttcttcctt

SEQ ID NO: 4059504 - DNA, 14 bp, Homo sapiens
cacttcttctgtcc

SEQ ID NO: 4059505 - DNA, 20 bp, Homo sapiens
cacttcttctgtccaagcag

SEQ ID NO: 4059506 - DNA, 21 bp, Homo sapiens
cacttctttcccttcctccat

SEQ ID NO: 4059507 - DNA, 12 bp, Homo sapiens
cacttgaaagat

SEQ ID NO: 4059508 - DNA, 16 bp, Homo sapiens
cacttgacctcatctc

SEQ ID NO: 4059509 - DNA, 11 bp, Homo sapiens
cacttgagttt

SEQ ID NO: 4059510 - DNA, 23 bp, Homo sapiens
cacttgatgatacaatgaacact

SEQ ID NO: 4059511 - DNA, 15 bp, Homo sapiens
cacttgctggggctc

SEQ ID NO: 4059512 - DNA, 20 bp, Homo sapiens
cacttgggggttcaggcccg

SEQ ID NO: 4059513 - DNA, 14 bp, Homo sapiens
cacttgtagagcag

SEQ ID NO: 4059514 - DNA, 14 bp, Homo sapiens
cacttgtaggataa

SEQ ID NO: 4059515 - DNA, 23 bp, Homo sapiens
cacttgtaggataagtgaaatgg

SEQ ID NO: 4059516 - DNA, 15 bp, Homo sapiens
cacttgtgtgtgggc

SEQ ID NO: 4059517 - DNA, 17 bp, Homo sapiens
cacttgtgtgtgggctg

SEQ ID NO: 4059518 - DNA, 22 bp, Homo sapiens
cacttgtgtgtgggctgtgagt

SEQ ID NO: 4059519 - DNA, 13 bp, Homo sapiens
cacttgttccagc

SEQ ID NO: 4059520 - DNA, 16 bp, Homo sapiens
cacttgttccagctct

SEQ ID NO: 4059521 - DNA, 20 bp, Homo sapiens
cactttaatggcctggaggg

SEQ ID NO: 4059522 - DNA, 17 bp, Homo sapiens
cagaatctcaaataact

SEQ ID NO: 4059523 - DNA, 18 bp, Homo sapiens
cagaatctcaaataacta

SEQ ID NO: 4059524 - DNA, 17 bp, Homo sapiens
cagaatcttgactttct

SEQ ID NO: 4059525 - DNA, 19 bp, Homo sapiens
cagaatggtgatcactcca

SEQ ID NO: 4059526 - DNA, 15 bp, Homo sapiens
cagaattccttttct

SEQ ID NO: 4059527 - DNA, 17 bp, Homo sapiens
cagaattttaatgtgaa

SEQ ID NO: 4059528 - DNA, 18 bp, Homo sapiens
cagaattttaatgtgaag

SEQ ID NO: 4059529 - DNA, 19 bp, Homo sapiens
cagaattttaatgtgaaga

SEQ ID NO: 4059530 - DNA, 23 bp, Homo sapiens
cagaattttaatgtgaagacatt

SEQ ID NO: 4059531 - DNA, 16 bp, Homo sapiens
cagaattttggaagat

SEQ ID NO: 4059532 - DNA, 19 bp, Homo sapiens
cagacaaaaaaatttaaaa

SEQ ID NO: 4059533 - DNA, 21 bp, Homo sapiens
cagacaaaacaatccccatca

SEQ ID NO: 4059534 - DNA, 22 bp, Homo sapiens
cagacaaaacaatccccatcag

SEQ ID NO: 4059535 - DNA, 13 bp, Homo sapiens
cagacaacagaag

SEQ ID NO: 4059536 - DNA, 14 bp, Homo sapiens
cagacaacagaagt

SEQ ID NO: 4059537 - DNA, 16 bp, Homo sapiens
cagacaacagaagtca

SEQ ID NO: 4059538 - DNA, 22 bp, Homo sapiens
cagacaacagaagtcatgaagc

SEQ ID NO: 4059539 - DNA, 23 bp, Homo sapiens
cagacaagcaacaggttttataa

SEQ ID NO: 4059540 - DNA, 19 bp, Homo sapiens
cagacaagctgttgaccag

SEQ ID NO: 4059541 - DNA, 15 bp, Homo sapiens
cagacaaggttctgc

SEQ ID NO: 4059542 - DNA, 16 bp, Homo sapiens
cagacacaatatgtat

SEQ ID NO: 4059543 - DNA, 17 bp, Homo sapiens
cagacacaatatgtatg

SEQ ID NO: 4059544 - DNA, 19 bp, Homo sapiens
cagacacaatatgtatgct

SEQ ID NO: 4059545 - DNA, 13 bp, Homo sapiens
cagacacacacac

SEQ ID NO: 4059546 - DNA, 16 bp, Homo sapiens
cagacacacacacgca

SEQ ID NO: 4059547 - DNA, 21 bp, Homo sapiens
cagacaccctcaacctcttct

SEQ ID NO: 4059548 - DNA, 18 bp, Homo sapiens
cagacacgccttcccctc

SEQ ID NO: 4059549 - DNA, 19 bp, Homo sapiens
cagacacgctcgcgggcag

SEQ ID NO: 4059550 - DNA, 20 bp, Homo sapiens
cagacacgctcgcgggcagc

SEQ ID NO: 4059551 - DNA, 18 bp, Homo sapiens
cagacacttaactcaatt

SEQ ID NO: 4059552 - DNA, 14 bp, Homo sapiens
cagacagaaactgg

SEQ ID NO: 4059553 - DNA, 20 bp, Homo sapiens
cagacagaacttgaatgtgt

SEQ ID NO: 4059554 - DNA, 13 bp, Homo sapiens
cagacagaagtct

SEQ ID NO: 4059555 - DNA, 18 bp, Homo sapiens
cagacagaagtctcctca

SEQ ID NO: 4059556 - DNA, 16 bp, Homo sapiens
cagacagacacacaca

SEQ ID NO: 4059557 - DNA, 13 bp, Homo sapiens
cagacagatccca

SEQ ID NO: 4059558 - DNA, 19 bp, Homo sapiens
cagacagcaggcagcgcca

SEQ ID NO: 4059559 - DNA, 19 bp, Homo sapiens
cagacagccgtttgttcta

SEQ ID NO: 4059560 - DNA, 20 bp, Homo sapiens
cagacaggccatgtgagcca

SEQ ID NO: 4059561 - DNA, 21 bp, Homo sapiens
cagacaggccatgtgagccac

SEQ ID NO: 4059562 - DNA, 15 bp, Homo sapiens
cagacaggccccgtg

SEQ ID NO: 4059563 - DNA, 18 bp, Homo sapiens
cagacatatgggatattc

SEQ ID NO: 4059564 - DNA, 17 bp, Homo sapiens
cagacatctctgcaccc

SEQ ID NO: 4059565 - DNA, 18 bp, Homo sapiens
cagacatgccacaaggac

SEQ ID NO: 4059566 - DNA, 12 bp, Homo sapiens
cagacatgtttt

SEQ ID NO: 4059567 - DNA, 22 bp, Homo sapiens
cagacatgttttccgtgaaaac

SEQ ID NO: 4059568 - DNA, 14 bp, Homo sapiens
cagacattggcacc

SEQ ID NO: 4059569 - DNA, 16 bp, Homo sapiens
cagaccacattgcttt

SEQ ID NO: 4059570 - DNA, 19 bp, Homo sapiens
cagaccaccccgcctgccc

SEQ ID NO: 4059571 - DNA, 16 bp, Homo sapiens
cagaccacctgcttct

SEQ ID NO: 4059572 - DNA, 18 bp, Homo sapiens
cagaccacctgcttctga

SEQ ID NO: 4059573 - DNA, 14 bp, Homo sapiens
cagaccacttgcca

SEQ ID NO: 4059574 - DNA, 17 bp, Homo sapiens
cagaccagagctgtctg

SEQ ID NO: 4059575 - DNA, 17 bp, Homo sapiens
cagaccagtgaccccag

SEQ ID NO: 4059576 - DNA, 22 bp, Homo sapiens
cagaccatgaagtaaattatgt

SEQ ID NO: 4059577 - DNA, 13 bp, Homo sapiens
cagaccccagggc

SEQ ID NO: 4059578 - DNA, 17 bp, Homo sapiens
cagacccctctggccag

SEQ ID NO: 4059579 - DNA, 12 bp, Homo sapiens
cagacccctgcc

SEQ ID NO: 4059580 - DNA, 13 bp, Homo sapiens
cagacccctggct

SEQ ID NO: 4059581 - DNA, 14 bp, Homo sapiens
cagacccctggctt

SEQ ID NO: 4059582 - DNA, 22 bp, Homo sapiens
cagacccctggcttttcactgc

SEQ ID NO: 4059583 - DNA, 22 bp, Homo sapiens
cagacccctttgagagacgcca

SEQ ID NO: 4059584 - DNA, 14 bp, Homo sapiens
cagaccctggagga

SEQ ID NO: 4059585 - DNA, 22 bp, Homo sapiens
cagacccttcttgcctgctggg

SEQ ID NO: 4059586 - DNA, 23 bp, Homo sapiens
cagacccttcttgcctgctgggc

SEQ ID NO: 4059587 - DNA, 17 bp, Homo sapiens
cagacctagcaggctgt

SEQ ID NO: 4059588 - DNA, 20 bp, Homo sapiens
cagacctagcaggctgttcc

SEQ ID NO: 4059589 - DNA, 14 bp, Homo sapiens
cagacctgtcttcc

SEQ ID NO: 4059590 - DNA, 16 bp, Homo sapiens
cagacctgtcttccaa

SEQ ID NO: 4059591 - DNA, 19 bp, Homo sapiens
cagacctgtcttccaagga

SEQ ID NO: 4059592 - DNA, 23 bp, Homo sapiens
cagacgccggggacagaggcctg

SEQ ID NO: 4059593 - DNA, 14 bp, Homo sapiens
cagacggcggccag

SEQ ID NO: 4059594 - DNA, 17 bp, Homo sapiens
cagacggcggccaggca

SEQ ID NO: 4059595 - DNA, 18 bp, Homo sapiens
cagacggcggccaggcac

SEQ ID NO: 4059596 - DNA, 18 bp, Homo sapiens
cagacgggcacagacacg

SEQ ID NO: 4059597 - DNA, 16 bp, Homo sapiens
cagacgttgcctgaga

SEQ ID NO: 4059598 - DNA, 20 bp, Homo sapiens
cagactaaaggatccagaga

SEQ ID NO: 4059599 - DNA, 16 bp, Homo sapiens
cagactacacaggatg

SEQ ID NO: 4059600 - DNA, 19 bp, Homo sapiens
cagactactattttctttt

SEQ ID NO: 4059601 - DNA, 16 bp, Homo sapiens
cagactcagtttgtca

SEQ ID NO: 4059602 - DNA, 22 bp, Homo sapiens
cagactccatctcttctgcaag

SEQ ID NO: 4059603 - DNA, 18 bp, Homo sapiens
cagactcccattcctgaa

SEQ ID NO: 4059604 - DNA, 18 bp, Homo sapiens
cagactccgccctcctcg

SEQ ID NO: 4059605 - DNA, 18 bp, Homo sapiens
cagactctgagctgctca

SEQ ID NO: 4059606 - DNA, 24 bp, Homo sapiens
cagactgttagaaaatggacactg

SEQ ID NO: 4059607 - DNA, 14 bp, Homo sapiens
cagacttaccagga

SEQ ID NO: 4059608 - DNA, 20 bp, Homo sapiens
cagacttcccagctaggaag

SEQ ID NO: 4059609 - DNA, 13 bp, Homo sapiens
cagacttgagaac

SEQ ID NO: 4059610 - DNA, 18 bp, Homo sapiens
cagacttgcccaggtcac

SEQ ID NO: 4059611 - DNA, 15 bp, Homo sapiens
cagactttaaagaat

SEQ ID NO: 4059612 - DNA, 20 bp, Homo sapiens
cagagaaaaatgctccccac

SEQ ID NO: 4059613 - DNA, 23 bp, Homo sapiens
cagagaaaaatgctccccacagc

SEQ ID NO: 4059614 - DNA, 19 bp, Homo sapiens
cagagaaacttaagcaaag

SEQ ID NO: 4059615 - DNA, 20 bp, Homo sapiens
cagagaaacttaagcaaagg

SEQ ID NO: 4059616 - DNA, 22 bp, Homo sapiens
cagagaaagaagagacaggagg

SEQ ID NO: 4059617 - DNA, 18 bp, Homo sapiens
cagagaaaggggagccca

SEQ ID NO: 4059618 - DNA, 11 bp, Homo sapiens
cagagaacagc

SEQ ID NO: 4059619 - DNA, 14 bp, Homo sapiens
cagagaagctggac

SEQ ID NO: 4059620 - DNA, 18 bp, Homo sapiens
cagagaagctggacttct

SEQ ID NO: 4059621 - DNA, 22 bp, Homo sapiens
cagagaaggaaaagactgaatc

SEQ ID NO: 4059622 - DNA, 11 bp, Homo sapiens
cagagaatata

SEQ ID NO: 4059623 - DNA, 22 bp, Homo sapiens
cagagacaggaagtcttcaggg

SEQ ID NO: 4059624 - DNA, 17 bp, Homo sapiens
cagattttgctgtatat

SEQ ID NO: 4059625 - DNA, 11 bp, Homo sapiens
cagcaaaccat

SEQ ID NO: 4059626 - DNA, 16 bp, Homo sapiens
cagcaacacaagctgg

SEQ ID NO: 4059627 - DNA, 17 bp, Homo sapiens
cagcaacacaagctgga

SEQ ID NO: 4059628 - DNA, 12 bp, Homo sapiens
cagcaaccccag

SEQ ID NO: 4059629 - DNA, 13 bp, Homo sapiens
cagcaaccccagg

SEQ ID NO: 4059630 - DNA, 18 bp, Homo sapiens
cagcaacgcccctccaaa

SEQ ID NO: 4059631 - DNA, 17 bp, Homo sapiens
cagcaacgcttgtagaa

SEQ ID NO: 4059632 - DNA, 18 bp, Homo sapiens
cagcaacgcttgtagaac

SEQ ID NO: 4059633 - DNA, 15 bp, Homo sapiens
cagcaacttgtcttt

SEQ ID NO: 4059634 - DNA, 18 bp, Homo sapiens
cagcaacttgtctttttc

SEQ ID NO: 4059635 - DNA, 19 bp, Homo sapiens
cagcaacttgtctttttct

SEQ ID NO: 4059636 - DNA, 20 bp, Homo sapiens
cagcaacttgtctttttctg

SEQ ID NO: 4059637 - DNA, 21 bp, Homo sapiens
cagcaagccctacagagctgt

SEQ ID NO: 4059638 - DNA, 20 bp, Homo sapiens
cagcaagcgggagcccgtgg

SEQ ID NO: 4059639 - DNA, 14 bp, Homo sapiens
cagcaaggcaggtt

SEQ ID NO: 4059640 - DNA, 12 bp, Homo sapiens
cagcaaggccct

SEQ ID NO: 4059641 - DNA, 15 bp, Homo sapiens
cagcaaggtcttgct

SEQ ID NO: 4059642 - DNA, 18 bp, Homo sapiens
cagcaaggtcttgctctc

SEQ ID NO: 4059643 - DNA, 19 bp, Homo sapiens
cagcaagtacagcggctcc

SEQ ID NO: 4059644 - DNA, 23 bp, Homo sapiens
cagcaagtacagcggctcccctc

SEQ ID NO: 4059645 - DNA, 18 bp, Homo sapiens
cagcaatgacatctcagg

SEQ ID NO: 4059646 - DNA, 21 bp, Homo sapiens
cagcaatgacatctcaggggc

SEQ ID NO: 4059647 - DNA, 20 bp, Homo sapiens
cagcaatgatgtccagaaga

SEQ ID NO: 4059648 - DNA, 13 bp, Homo sapiens
cagcacaaggcca

SEQ ID NO: 4059649 - DNA, 15 bp, Homo sapiens
cagcacacagggcag

SEQ ID NO: 4059650 - DNA, 12 bp, Homo sapiens
cagcacagagcg

SEQ ID NO: 4059651 - DNA, 13 bp, Homo sapiens
cagcacagccaac

SEQ ID NO: 4059652 - DNA, 14 bp, Homo sapiens
cagcacagcctggg

SEQ ID NO: 4059653 - DNA, 17 bp, Homo sapiens
cagcacagcttagattt

SEQ ID NO: 4059654 - DNA, 19 bp, Homo sapiens
cagcaccaccctccttccc

SEQ ID NO: 4059655 - DNA, 13 bp, Homo sapiens
cagcacccccacc

SEQ ID NO: 4059656 - DNA, 15 bp, Homo sapiens
cagcacccccaccca

SEQ ID NO: 4059657 - DNA, 11 bp, Homo sapiens
cagcaccctcc

SEQ ID NO: 4059658 - DNA, 12 bp, Homo sapiens
cagcaccctccc

SEQ ID NO: 4059659 - DNA, 19 bp, Homo sapiens
cagcaccctcccccgcagc

SEQ ID NO: 4059660 - DNA, 18 bp, Homo sapiens
cagcaccctctcctgggg

SEQ ID NO: 4059661 - DNA, 23 bp, Homo sapiens
cagcacctgtaagaaacagagca

SEQ ID NO: 4059662 - DNA, 16 bp, Homo sapiens
cagcacgtctcagaga

SEQ ID NO: 4059663 - DNA, 22 bp, Homo sapiens
cagcactaaggccgtgtctctg

SEQ ID NO: 4059664 - DNA, 15 bp, Homo sapiens
cagcactactgggtg

SEQ ID NO: 4059665 - DNA, 21 bp, Homo sapiens
cagcactctctaaatcttcct

SEQ ID NO: 4059666 - DNA, 22 bp, Homo sapiens
cagcactctctaaatcttcctt

SEQ ID NO: 4059667 - DNA, 14 bp, Homo sapiens
cagcactgtccctt

SEQ ID NO: 4059668 - DNA, 16 bp, Homo sapiens
cagcactgtcccttgc

SEQ ID NO: 4059669 - DNA, 14 bp, Homo sapiens
cagcactgtctcag

SEQ ID NO: 4059670 - DNA, 12 bp, Homo sapiens
cagcacttccat

SEQ ID NO: 4059671 - DNA, 15 bp, Homo sapiens
cagcactttgggagg

SEQ ID NO: 4059672 - DNA, 18 bp, Homo sapiens
cagcactttgggaggcct

SEQ ID NO: 4059673 - DNA, 19 bp, Homo sapiens
cagcactttgggaggctga

SEQ ID NO: 4059674 - DNA, 15 bp, Homo sapiens
cagcagaagcctcca

SEQ ID NO: 4059675 - DNA, 23 bp, Homo sapiens
cagcagaagcctccaagcacaga

SEQ ID NO: 4059676 - DNA, 23 bp, Homo sapiens
cagcagaattgaccgacagcttt

SEQ ID NO: 4059677 - DNA, 13 bp, Homo sapiens
cagcagacacaca

SEQ ID NO: 4059678 - DNA, 23 bp, Homo sapiens
cagcagacacacatgggcagccc

SEQ ID NO: 4059679 - DNA, 16 bp, Homo sapiens
cagcagaggcaggctg

SEQ ID NO: 4059680 - DNA, 23 bp, Homo sapiens
cagcagagggggagtagccaagc

SEQ ID NO: 4059681 - DNA, 18 bp, Homo sapiens
cagcagcaccaaccacag

SEQ ID NO: 4059682 - DNA, 19 bp, Homo sapiens
cagcagcaccaaccacagc

SEQ ID NO: 4059683 - DNA, 16 bp, Homo sapiens
cagcagccccccagca

SEQ ID NO: 4059684 - DNA, 22 bp, Homo sapiens
cagcagccctcaacaggcccag

SEQ ID NO: 4059685 - DNA, 21 bp, Homo sapiens
cagcagccgccttaagctgat

SEQ ID NO: 4059686 - DNA, 17 bp, Homo sapiens
cagcagcttttaataca

SEQ ID NO: 4059687 - DNA, 13 bp, Homo sapiens
cagcaggaagcca

SEQ ID NO: 4059688 - DNA, 21 bp, Homo sapiens
cagcaggagtggtgcagacag

SEQ ID NO: 4059689 - DNA, 22 bp, Homo sapiens
cagcaggagtggtgcagacaga

SEQ ID NO: 4059690 - DNA, 11 bp, Homo sapiens
cagcagggcag

SEQ ID NO: 4059691 - DNA, 21 bp, Homo sapiens
cagcagggcatcttggaaaag

SEQ ID NO: 4059692 - DNA, 22 bp, Homo sapiens
cagcaggtcctccatcccaaca

SEQ ID NO: 4059693 - DNA, 21 bp, Homo sapiens
cagcagtcccagtattctcag

SEQ ID NO: 4059694 - DNA, 17 bp, Homo sapiens
cagcagtcttatgcttc

SEQ ID NO: 4059695 - DNA, 22 bp, Homo sapiens
cagcagtcttatgcttccagaa

SEQ ID NO: 4059696 - DNA, 19 bp, Homo sapiens
cagcagtgatctcagggca

SEQ ID NO: 4059697 - DNA, 21 bp, Homo sapiens
cagcagtgtgaatagcctggc

SEQ ID NO: 4059698 - DNA, 22 bp, Homo sapiens
cagcagtgtgaatagcctggcc

SEQ ID NO: 4059699 - DNA, 17 bp, Homo sapiens
cagcagtgtggagaccc

SEQ ID NO: 4059700 - DNA, 18 bp, Homo sapiens
cagcagtgtggagaccct

SEQ ID NO: 4059701 - DNA, 12 bp, Homo sapiens
cagcagtgttcc

SEQ ID NO: 4059702 - DNA, 22 bp, Homo sapiens
cagcagtgttccccatctgggt

SEQ ID NO: 4059703 - DNA, 14 bp, Homo sapiens
cagcagtgttctca

SEQ ID NO: 4059704 - DNA, 17 bp, Homo sapiens
cagcagtgttctcacag

SEQ ID NO: 4059705 - DNA, 19 bp, Homo sapiens
cagcagtgttctcacagtg

SEQ ID NO: 4059706 - DNA, 15 bp, Homo sapiens
cagcagtgttgctca

SEQ ID NO: 4059707 - DNA, 16 bp, Homo sapiens
cagcagtgttgctcag

SEQ ID NO: 4059708 - DNA, 21 bp, Homo sapiens
cagcagtgttgctcagctcct

SEQ ID NO: 4059709 - DNA, 12 bp, Homo sapiens
cagcatatttat

SEQ ID NO: 4059710 - DNA, 14 bp, Homo sapiens
cagcatatttatag

SEQ ID NO: 4059711 - DNA, 13 bp, Homo sapiens
cagcatcactccc

SEQ ID NO: 4059712 - DNA, 23 bp, Homo sapiens
cagcatcattttgcattcaaatt

SEQ ID NO: 4059713 - DNA, 12 bp, Homo sapiens
cagcatccctgg

SEQ ID NO: 4059714 - DNA, 16 bp, Homo sapiens
cagcatccctggagca

SEQ ID NO: 4059715 - DNA, 19 bp, Homo sapiens
cagcatccctggagcagga

SEQ ID NO: 4059716 - DNA, 16 bp, Homo sapiens
cagcatcccttcccac

SEQ ID NO: 4059717 - DNA, 20 bp, Homo sapiens
cagcatcgggagcacccaga

SEQ ID NO: 4059718 - DNA, 22 bp, Homo sapiens
cagcatcgggagcacccagagc

SEQ ID NO: 4059719 - DNA, 24 bp, Homo sapiens
cagcatcgggagcacccagagcac

SEQ ID NO: 4059720 - DNA, 13 bp, Homo sapiens
cagcatctggctg

SEQ ID NO: 4059721 - DNA, 14 bp, Homo sapiens
cagcatctggctgt

SEQ ID NO: 4059722 - DNA, 15 bp, Homo sapiens
cagcatctggctgtc

SEQ ID NO: 4059723 - DNA, 22 bp, Homo sapiens
cagcatctggctgtctagaatg

SEQ ID NO: 4059724 - DNA, 18 bp, Homo sapiens
cagcatgaggtgttgtgc

SEQ ID NO: 4059725 - DNA, 22 bp, Homo sapiens
cagcatgaggtgttgtgcattt

SEQ ID NO: 4059726 - DNA, 13 bp, Homo sapiens
cagcccttgggca

SEQ ID NO: 4059727 - DNA, 15 bp, Homo sapiens
cagcccttgggcagt

SEQ ID NO: 4059728 - DNA, 14 bp, Homo sapiens
cagccgagccgggc

SEQ ID NO: 4059729 - DNA, 18 bp, Homo sapiens
cagccgccagctgggagc

SEQ ID NO: 4059730 - DNA, 19 bp, Homo sapiens
cagccgccattgccaccag

SEQ ID NO: 4059731 - DNA, 21 bp, Homo sapiens
cagccgccattgccaccagga

SEQ ID NO: 4059732 - DNA, 22 bp, Homo sapiens
cagccgccattgccaccaggag

SEQ ID NO: 4059733 - DNA, 13 bp, Homo sapiens
cagccgccccagc

SEQ ID NO: 4059734 - DNA, 18 bp, Homo sapiens
cagccgccccagcccctt

SEQ ID NO: 4059735 - DNA, 15 bp, Homo sapiens
cagccgccctgggct

SEQ ID NO: 4059736 - DNA, 14 bp, Homo sapiens
cagccgcttctgac

SEQ ID NO: 4059737 - DNA, 18 bp, Homo sapiens
cagccgcttctgactgct

SEQ ID NO: 4059738 - DNA, 17 bp, Homo sapiens
cagccggcacagggtct

SEQ ID NO: 4059739 - DNA, 18 bp, Homo sapiens
cagccggcacagggtctg

SEQ ID NO: 4059740 - DNA, 15 bp, Homo sapiens
cagccgtccttctaa

SEQ ID NO: 4059741 - DNA, 16 bp, Homo sapiens
cagccgtcgtctccct

SEQ ID NO: 4059742 - DNA, 16 bp, Homo sapiens
cagccgtgatgctcag

SEQ ID NO: 4059743 - DNA, 14 bp, Homo sapiens
cagccgtgccttca

SEQ ID NO: 4059744 - DNA, 20 bp, Homo sapiens
cagcctaaagtacagcctgg

SEQ ID NO: 4059745 - DNA, 21 bp, Homo sapiens
cagcctaaagtacagcctgga

SEQ ID NO: 4059746 - DNA, 21 bp, Homo sapiens
cagcctatgggggctctcgga

SEQ ID NO: 4059747 - DNA, 15 bp, Homo sapiens
cagcctcagagtggt

SEQ ID NO: 4059748 - DNA, 21 bp, Homo sapiens
cagcctcatactcctgggctc

SEQ ID NO: 4059749 - DNA, 20 bp, Homo sapiens
cagcctccaacacaaggctc

SEQ ID NO: 4059750 - DNA, 20 bp, Homo sapiens
cagcctcccaattagcttgg

SEQ ID NO: 4059751 - DNA, 14 bp, Homo sapiens
cagcctcccacccc

SEQ ID NO: 4059752 - DNA, 14 bp, Homo sapiens
cagcctcccatcca

SEQ ID NO: 4059753 - DNA, 19 bp, Homo sapiens
cagcctcccatccagggcc

SEQ ID NO: 4059754 - DNA, 23 bp, Homo sapiens
cagcctcccatccagggccccca

SEQ ID NO: 4059755 - DNA, 16 bp, Homo sapiens
cagcctccccacccag

SEQ ID NO: 4059756 - DNA, 16 bp, Homo sapiens
cagcctccctgaagcc

SEQ ID NO: 4059757 - DNA, 18 bp, Homo sapiens
cagcctccctgaagcctt

SEQ ID NO: 4059758 - DNA, 12 bp, Homo sapiens
cagcctccctgt

SEQ ID NO: 4059759 - DNA, 15 bp, Homo sapiens
cagcctccctgtctc

SEQ ID NO: 4059760 - DNA, 20 bp, Homo sapiens
cagcctccgagagggagaga

SEQ ID NO: 4059761 - DNA, 21 bp, Homo sapiens
cagcctcctctggacggcagg

SEQ ID NO: 4059762 - DNA, 23 bp, Homo sapiens
cagcctcctctggacggcaggct

SEQ ID NO: 4059763 - DNA, 17 bp, Homo sapiens
cagcctcctctgtctgc

SEQ ID NO: 4059764 - DNA, 23 bp, Homo sapiens
cagcctcctctgtctgcccttca

SEQ ID NO: 4059765 - DNA, 15 bp, Homo sapiens
cagcctcctgagcct

SEQ ID NO: 4059766 - DNA, 18 bp, Homo sapiens
cagcctcctgagcctgtg

SEQ ID NO: 4059767 - DNA, 19 bp, Homo sapiens
cagcctcgcaggcctccct

SEQ ID NO: 4059768 - DNA, 21 bp, Homo sapiens
cagcctcgcaggcctccctgc

SEQ ID NO: 4059769 - DNA, 14 bp, Homo sapiens
cagcctcgcctgtc

SEQ ID NO: 4059770 - DNA, 12 bp, Homo sapiens
cagcctctggac

SEQ ID NO: 4059771 - DNA, 18 bp, Homo sapiens
cagcctctggacagccag

SEQ ID NO: 4059772 - DNA, 13 bp, Homo sapiens
cagcctcttactt

SEQ ID NO: 4059773 - DNA, 18 bp, Homo sapiens
cagcctcttggccccaga

SEQ ID NO: 4059774 - DNA, 18 bp, Homo sapiens
cagcctgaacagaagctc

SEQ ID NO: 4059775 - DNA, 16 bp, Homo sapiens
cagcctgacctgagac

SEQ ID NO: 4059776 - DNA, 22 bp, Homo sapiens
cagcctgacctgagactgtcgg

SEQ ID NO: 4059777 - DNA, 14 bp, Homo sapiens
cagcctgagtctcc

SEQ ID NO: 4059778 - DNA, 19 bp, Homo sapiens
cagcctgagtctcctgtgc

SEQ ID NO: 4059779 - DNA, 15 bp, Homo sapiens
cagcctgcccctaga

SEQ ID NO: 4059780 - DNA, 17 bp, Homo sapiens
cagcctgcccctagaca

SEQ ID NO: 4059781 - DNA, 23 bp, Homo sapiens
cagcctgctctagtgggacagcc

SEQ ID NO: 4059782 - DNA, 15 bp, Homo sapiens
cagcctgctgagagc

SEQ ID NO: 4059783 - DNA, 20 bp, Homo sapiens
cagcctgctgagagccccca

SEQ ID NO: 4059784 - DNA, 22 bp, Homo sapiens
cagcctgctgagagcccccacc

SEQ ID NO: 4059785 - DNA, 15 bp, Homo sapiens
cagcctgctgcccag

SEQ ID NO: 4059786 - DNA, 20 bp, Homo sapiens
cagcctggaaacctgtctga

SEQ ID NO: 4059787 - DNA, 20 bp, Homo sapiens
cagcctggcacagggcagtg

SEQ ID NO: 4059788 - DNA, 13 bp, Homo sapiens
cagcctggccaga

SEQ ID NO: 4059789 - DNA, 17 bp, Homo sapiens
cagcctggccagacaca

SEQ ID NO: 4059790 - DNA, 16 bp, Homo sapiens
cagcctggcctgcccg

SEQ ID NO: 4059791 - DNA, 22 bp, Homo sapiens
cagcctggcctgcccgtgccct

SEQ ID NO: 4059792 - DNA, 17 bp, Homo sapiens
cagcctggctggtcctc

SEQ ID NO: 4059793 - DNA, 20 bp, Homo sapiens
cagcctggctggtcctccca

SEQ ID NO: 4059794 - DNA, 19 bp, Homo sapiens
cagcctgggagcccagagg

SEQ ID NO: 4059795 - DNA, 20 bp, Homo sapiens
cagcctgggataggggcaga

SEQ ID NO: 4059796 - DNA, 17 bp, Homo sapiens
cagcctgggcagccagg

SEQ ID NO: 4059797 - DNA, 18 bp, Homo sapiens
cagcctgggcagccaggc

SEQ ID NO: 4059798 - DNA, 19 bp, Homo sapiens
cagcctgggcagccaggct

SEQ ID NO: 4059799 - DNA, 21 bp, Homo sapiens
cagcctgggcagccaggctgc

SEQ ID NO: 4059800 - DNA, 20 bp, Homo sapiens
cagcctgggccatctcttag

SEQ ID NO: 4059801 - DNA, 17 bp, Homo sapiens
cagcctggggctggcct

SEQ ID NO: 4059802 - DNA, 21 bp, Homo sapiens
cagcctggggctggcctccca

SEQ ID NO: 4059803 - DNA, 20 bp, Homo sapiens
cagcctggtcaacatggtga

SEQ ID NO: 4059804 - DNA, 21 bp, Homo sapiens
cagccttagctgccagtgctg

SEQ ID NO: 4059805 - DNA, 14 bp, Homo sapiens
cagccttgccagag

SEQ ID NO: 4059806 - DNA, 17 bp, Homo sapiens
cagccttggtgccacca

SEQ ID NO: 4059807 - DNA, 18 bp, Homo sapiens
cagcctttttgtttcaat

SEQ ID NO: 4059808 - DNA, 18 bp, Homo sapiens
cagcgaagtagcttgctc

SEQ ID NO: 4059809 - DNA, 14 bp, Homo sapiens
cagcgccagcctgt

SEQ ID NO: 4059810 - DNA, 12 bp, Homo sapiens
cagcgccaggct

SEQ ID NO: 4059811 - DNA, 14 bp, Homo sapiens
cagcgcccctgctg

SEQ ID NO: 4059812 - DNA, 15 bp, Homo sapiens
cagcgcccctgctgt

SEQ ID NO: 4059813 - DNA, 16 bp, Homo sapiens
cagcgcccctgctgtc

SEQ ID NO: 4059814 - DNA, 14 bp, Homo sapiens
cagcgcggccagcg

SEQ ID NO: 4059815 - DNA, 20 bp, Homo sapiens
cagcgcggccagcgtcccag

SEQ ID NO: 4059816 - DNA, 15 bp, Homo sapiens
cagcggaggagacca

SEQ ID NO: 4059817 - DNA, 21 bp, Homo sapiens
cagcggaggagaccagctcag

SEQ ID NO: 4059818 - DNA, 15 bp, Homo sapiens
cagcggcccctgcat

SEQ ID NO: 4059819 - DNA, 16 bp, Homo sapiens
cagcggcccctgcatc

SEQ ID NO: 4059820 - DNA, 16 bp, Homo sapiens
cagcggctcccctctg

SEQ ID NO: 4059821 - DNA, 12 bp, Homo sapiens
cagcgggcacag

SEQ ID NO: 4059822 - DNA, 14 bp, Homo sapiens
cagcgggcacaggg

SEQ ID NO: 4059823 - DNA, 15 bp, Homo sapiens
cagcgggcacagggc

SEQ ID NO: 4059824 - DNA, 16 bp, Homo sapiens
cagcgggcacagggca

SEQ ID NO: 4059825 - DNA, 15 bp, Homo sapiens
cagcggtttggggag

SEQ ID NO: 4059826 - DNA, 14 bp, Homo sapiens
cagcgtaaaatggt

SEQ ID NO: 4059827 - DNA, 15 bp, Homo sapiens
cagcgtaaaatggtg

SEQ ID NO: 4059828 - DNA, 12 bp, Homo sapiens
cagctaagaaaa

SEQ ID NO: 4059829 - DNA, 22 bp, Homo sapiens
cagctggggccagaggctggga

SEQ ID NO: 4059830 - DNA, 14 bp, Homo sapiens
cagctgggtcaggc

SEQ ID NO: 4059831 - DNA, 19 bp, Homo sapiens
cagctggttactcagggtt

SEQ ID NO: 4059832 - DNA, 22 bp, Homo sapiens
cagctggttactcagggttcat

SEQ ID NO: 4059833 - DNA, 20 bp, Homo sapiens
cagctgtaagaagagactgg

SEQ ID NO: 4059834 - DNA, 22 bp, Homo sapiens
cagctgtaagaagagactggga

SEQ ID NO: 4059835 - DNA, 16 bp, Homo sapiens
cagctgtctgtggctt

SEQ ID NO: 4059836 - DNA, 20 bp, Homo sapiens
cagctgtgtccttcgggggc

SEQ ID NO: 4059837 - DNA, 23 bp, Homo sapiens
cagctgtgtgacatttggagagg

SEQ ID NO: 4059838 - DNA, 23 bp, Homo sapiens
cagctgttgcagatgaaatgttc

SEQ ID NO: 4059839 - DNA, 21 bp, Homo sapiens
cagctgttgtctcttctcctt

SEQ ID NO: 4059840 - DNA, 21 bp, Homo sapiens
cagctgtttctcatgaagcta

SEQ ID NO: 4059841 - DNA, 17 bp, Homo sapiens
cagcttaaatcctagca

SEQ ID NO: 4059842 - DNA, 22 bp, Homo sapiens
cagcttatctcttttatatttg

SEQ ID NO: 4059843 - DNA, 15 bp, Homo sapiens
cagcttcaagtgcct

SEQ ID NO: 4059844 - DNA, 16 bp, Homo sapiens
cagcttcaccctgtca

SEQ ID NO: 4059845 - DNA, 17 bp, Homo sapiens
cagcttcaccctgtcaa

SEQ ID NO: 4059846 - DNA, 16 bp, Homo sapiens
cagcttcacttctgac

SEQ ID NO: 4059847 - DNA, 22 bp, Homo sapiens
cagcttcacttctgactcttcc

SEQ ID NO: 4059848 - DNA, 14 bp, Homo sapiens
cagcttcaggcacc

SEQ ID NO: 4059849 - DNA, 15 bp, Homo sapiens
cagcttcaggcacca

SEQ ID NO: 4059850 - DNA, 21 bp, Homo sapiens
cagcttcaggcaccagcatcc

SEQ ID NO: 4059851 - DNA, 22 bp, Homo sapiens
cagcttcaggcaccagcatcca

SEQ ID NO: 4059852 - DNA, 14 bp, Homo sapiens
cagcttcctaccca

SEQ ID NO: 4059853 - DNA, 16 bp, Homo sapiens
cagcttcctcacaccc

SEQ ID NO: 4059854 - DNA, 21 bp, Homo sapiens
cagcttcctcacacccctgtc

SEQ ID NO: 4059855 - DNA, 23 bp, Homo sapiens
cagcttcggagggcccctgcgtg

SEQ ID NO: 4059856 - DNA, 12 bp, Homo sapiens
cagcttctccag

SEQ ID NO: 4059857 - DNA, 14 bp, Homo sapiens
cagcttctccaggc

SEQ ID NO: 4059858 - DNA, 15 bp, Homo sapiens
cagcttctccaggct

SEQ ID NO: 4059859 - DNA, 16 bp, Homo sapiens
cagcttctctctccag

SEQ ID NO: 4059860 - DNA, 19 bp, Homo sapiens
cagcttctctctccagggt

SEQ ID NO: 4059861 - DNA, 15 bp, Homo sapiens
cagcttcttcctagg

SEQ ID NO: 4059862 - DNA, 12 bp, Homo sapiens
cagcttgagttt

SEQ ID NO: 4059863 - DNA, 18 bp, Homo sapiens
cagctttaaactcaggga

SEQ ID NO: 4059864 - DNA, 20 bp, Homo sapiens
cagctttaaactcagggaca

SEQ ID NO: 4059865 - DNA, 19 bp, Homo sapiens
cagctttcttgctcccttc

SEQ ID NO: 4059866 - DNA, 17 bp, Homo sapiens
cagctttgatccctgac

SEQ ID NO: 4059867 - DNA, 12 bp, Homo sapiens
cagcttttgcaa

SEQ ID NO: 4059868 - DNA, 11 bp, Homo sapiens
caggaaagagc

SEQ ID NO: 4059869 - DNA, 21 bp, Homo sapiens
caggaaagagcagtcagagtc

SEQ ID NO: 4059870 - DNA, 14 bp, Homo sapiens
caggaaagccctcc

SEQ ID NO: 4059871 - DNA, 22 bp, Homo sapiens
caggaaagtggcacctgtctgc

SEQ ID NO: 4059872 - DNA, 18 bp, Homo sapiens
caggaaagtgttattttt

SEQ ID NO: 4059873 - DNA, 15 bp, Homo sapiens
caggaaatatatatg

SEQ ID NO: 4059874 - DNA, 23 bp, Homo sapiens
caggaaatatatatgtgtgtgta

SEQ ID NO: 4059875 - DNA, 18 bp, Homo sapiens
caggaacagaaggatgaa

SEQ ID NO: 4059876 - DNA, 14 bp, Homo sapiens
caggaacagctatg

SEQ ID NO: 4059877 - DNA, 19 bp, Homo sapiens
caggaacagtggctgggtg

SEQ ID NO: 4059878 - DNA, 14 bp, Homo sapiens
caggaactcccagc

SEQ ID NO: 4059879 - DNA, 16 bp, Homo sapiens
caggaactcccagcaa

SEQ ID NO: 4059880 - DNA, 15 bp, Homo sapiens
caggaagcaggggtg

SEQ ID NO: 4059881 - DNA, 13 bp, Homo sapiens
caggaagccagag

SEQ ID NO: 4059882 - DNA, 17 bp, Homo sapiens
caggaagccagagcccc

SEQ ID NO: 4059883 - DNA, 17 bp, Homo sapiens
caggaagccaggctgag

SEQ ID NO: 4059884 - DNA, 13 bp, Homo sapiens
caggaagcctgca

SEQ ID NO: 4059885 - DNA, 16 bp, Homo sapiens
caggaagctctcttaa

SEQ ID NO: 4059886 - DNA, 18 bp, Homo sapiens
caggaaggacaggaagct

SEQ ID NO: 4059887 - DNA, 20 bp, Homo sapiens
caggaaggacaggaagctgg

SEQ ID NO: 4059888 - DNA, 16 bp, Homo sapiens
caggaaggagagcctg

SEQ ID NO: 4059889 - DNA, 22 bp, Homo sapiens
caggaaggtagcccagcactgt

SEQ ID NO: 4059890 - DNA, 15 bp, Homo sapiens
caggaagtacttcca

SEQ ID NO: 4059891 - DNA, 19 bp, Homo sapiens
caggaagtacttccacctc

SEQ ID NO: 4059892 - DNA, 17 bp, Homo sapiens
caggaatgtgtggcctg

SEQ ID NO: 4059893 - DNA, 21 bp, Homo sapiens
caggaatgtgtggcctgcaca

SEQ ID NO: 4059894 - DNA, 23 bp, Homo sapiens
caggaatgtgtggcctgcacagt

SEQ ID NO: 4059895 - DNA, 13 bp, Homo sapiens
caggaattatgtc

SEQ ID NO: 4059896 - DNA, 17 bp, Homo sapiens
caggaatttcccaggac

SEQ ID NO: 4059897 - DNA, 16 bp, Homo sapiens
caggacaccagtccag

SEQ ID NO: 4059898 - DNA, 12 bp, Homo sapiens
caggacagagtt

SEQ ID NO: 4059899 - DNA, 19 bp, Homo sapiens
caggacagagttcacagga

SEQ ID NO: 4059900 - DNA, 20 bp, Homo sapiens
caggacagagttcacaggag

SEQ ID NO: 4059901 - DNA, 13 bp, Homo sapiens
caggacagatgcc

SEQ ID NO: 4059902 - DNA, 17 bp, Homo sapiens
caggacagatgccacac

SEQ ID NO: 4059903 - DNA, 22 bp, Homo sapiens
caggacatgcggtagccagcac

SEQ ID NO: 4059904 - DNA, 23 bp, Homo sapiens
caggacatgcggtagccagcaca

SEQ ID NO: 4059905 - DNA, 15 bp, Homo sapiens
caggacattaaaaat

SEQ ID NO: 4059906 - DNA, 17 bp, Homo sapiens
caggaccagctcaggac

SEQ ID NO: 4059907 - DNA, 19 bp, Homo sapiens
caggaccagctcaggacag

SEQ ID NO: 4059908 - DNA, 15 bp, Homo sapiens
caggacccccgaggg

SEQ ID NO: 4059909 - DNA, 15 bp, Homo sapiens
caggaccctgaaggg

SEQ ID NO: 4059910 - DNA, 16 bp, Homo sapiens
caggaccctgaagggg

SEQ ID NO: 4059911 - DNA, 20 bp, Homo sapiens
caggacctctgtaggcagca

SEQ ID NO: 4059912 - DNA, 14 bp, Homo sapiens
caggacctggcatc

SEQ ID NO: 4059913 - DNA, 15 bp, Homo sapiens
caggacctggcatca

SEQ ID NO: 4059914 - DNA, 14 bp, Homo sapiens
caggacgcttctga

SEQ ID NO: 4059915 - DNA, 15 bp, Homo sapiens
caggacgcttctgaa

SEQ ID NO: 4059916 - DNA, 16 bp, Homo sapiens
caggacgcttctgaat

SEQ ID NO: 4059917 - DNA, 13 bp, Homo sapiens
caggacggctcct

SEQ ID NO: 4059918 - DNA, 20 bp, Homo sapiens
caggactatatttgggcctg

SEQ ID NO: 4059919 - DNA, 18 bp, Homo sapiens
caggactccaggcccaag

SEQ ID NO: 4059920 - DNA, 14 bp, Homo sapiens
caggactccctcct

SEQ ID NO: 4059921 - DNA, 15 bp, Homo sapiens
caggactccctcctc

SEQ ID NO: 4059922 - DNA, 19 bp, Homo sapiens
caggactccctcctcacct

SEQ ID NO: 4059923 - DNA, 20 bp, Homo sapiens
caggactccctcctcacctc

SEQ ID NO: 4059924 - DNA, 22 bp, Homo sapiens
caggactccctcctcacctctg

SEQ ID NO: 4059925 - DNA, 23 bp, Homo sapiens
caggactccctcctcacctctgg

SEQ ID NO: 4059926 - DNA, 14 bp, Homo sapiens
caggactgtgactc

SEQ ID NO: 4059927 - DNA, 11 bp, Homo sapiens
caggagaacca

SEQ ID NO: 4059928 - DNA, 12 bp, Homo sapiens
caggagacatcc

SEQ ID NO: 4059929 - DNA, 22 bp, Homo sapiens
caggagagaggctctggggcag

SEQ ID NO: 4059930 - DNA, 18 bp, Homo sapiens
caggagaggatggcccag

SEQ ID NO: 4059931 - DNA, 20 bp, Homo sapiens
caggagatggagggcttggc

SEQ ID NO: 4059932 - DNA, 16 bp, Homo sapiens
caggcataggcctggg

SEQ ID NO: 4059933 - DNA, 17 bp, Homo sapiens
caggcataggcctgggt

SEQ ID NO: 4059934 - DNA, 19 bp, Homo sapiens
caggcataggcctgggtgc

SEQ ID NO: 4059935 - DNA, 15 bp, Homo sapiens
caggcatctacacag

SEQ ID NO: 4059936 - DNA, 20 bp, Homo sapiens
caggcatctacacagcctgg

SEQ ID NO: 4059937 - DNA, 20 bp, Homo sapiens
caggcatgaaattcttccta

SEQ ID NO: 4059938 - DNA, 22 bp, Homo sapiens
caggcatgtcccatgtgagctg

SEQ ID NO: 4059939 - DNA, 15 bp, Homo sapiens
caggcattgaggaag

SEQ ID NO: 4059940 - DNA, 20 bp, Homo sapiens
caggcattgaggaagagtct

SEQ ID NO: 4059941 - DNA, 19 bp, Homo sapiens
caggccaaggccttctcct

SEQ ID NO: 4059942 - DNA, 13 bp, Homo sapiens
caggccaccagga

SEQ ID NO: 4059943 - DNA, 16 bp, Homo sapiens
caggccaccctgtgca

SEQ ID NO: 4059944 - DNA, 17 bp, Homo sapiens
caggccagcccagccag

SEQ ID NO: 4059945 - DNA, 18 bp, Homo sapiens
caggccagcccagccagg

SEQ ID NO: 4059946 - DNA, 11 bp, Homo sapiens
caggccagcct

SEQ ID NO: 4059947 - DNA, 16 bp, Homo sapiens
caggccaggccaccag

SEQ ID NO: 4059948 - DNA, 12 bp, Homo sapiens
caggccagtgtc

SEQ ID NO: 4059949 - DNA, 11 bp, Homo sapiens
caggcccagcg

SEQ ID NO: 4059950 - DNA, 17 bp, Homo sapiens
caggcccagcgcggcca

SEQ ID NO: 4059951 - DNA, 18 bp, Homo sapiens
caggcccagcgcggccag

SEQ ID NO: 4059952 - DNA, 19 bp, Homo sapiens
caggcccagcgcggccagc

SEQ ID NO: 4059953 - DNA, 20 bp, Homo sapiens
caggcccagcgcggccagcg

SEQ ID NO: 4059954 - DNA, 21 bp, Homo sapiens
caggcccagcgcggccagcgt

SEQ ID NO: 4059955 - DNA, 16 bp, Homo sapiens
caggcccaggcctcac

SEQ ID NO: 4059956 - DNA, 17 bp, Homo sapiens
caggcccaggcctcacc

SEQ ID NO: 4059957 - DNA, 13 bp, Homo sapiens
caggcccagggag

SEQ ID NO: 4059958 - DNA, 16 bp, Homo sapiens
caggcccagggaggga

SEQ ID NO: 4059959 - DNA, 17 bp, Homo sapiens
caggcccatgccaaggc

SEQ ID NO: 4059960 - DNA, 14 bp, Homo sapiens
caggccccagacag

SEQ ID NO: 4059961 - DNA, 15 bp, Homo sapiens
caggccccctgcatc

SEQ ID NO: 4059962 - DNA, 16 bp, Homo sapiens
caggccccctgcatct

SEQ ID NO: 4059963 - DNA, 21 bp, Homo sapiens
caggccccgtgaggcaatggg

SEQ ID NO: 4059964 - DNA, 22 bp, Homo sapiens
caggccctccctgttccccaga

SEQ ID NO: 4059965 - DNA, 23 bp, Homo sapiens
caggccctccctgttccccagag

SEQ ID NO: 4059966 - DNA, 14 bp, Homo sapiens
caggccctcctctc

SEQ ID NO: 4059967 - DNA, 18 bp, Homo sapiens
caggccctgactcctctg

SEQ ID NO: 4059968 - DNA, 20 bp, Homo sapiens
caggccctgactcctctggc

SEQ ID NO: 4059969 - DNA, 14 bp, Homo sapiens
caggccctgagagt

SEQ ID NO: 4059970 - DNA, 14 bp, Homo sapiens
caggccctgctcct

SEQ ID NO: 4059971 - DNA, 15 bp, Homo sapiens
caggccctgctcctg

SEQ ID NO: 4059972 - DNA, 11 bp, Homo sapiens
caggccctggc

SEQ ID NO: 4059973 - DNA, 22 bp, Homo sapiens
caggccctggctgagggcagct

SEQ ID NO: 4059974 - DNA, 19 bp, Homo sapiens
caggcccttcctctccact

SEQ ID NO: 4059975 - DNA, 19 bp, Homo sapiens
caggccctttgaagcctca

SEQ ID NO: 4059976 - DNA, 21 bp, Homo sapiens
caggccctttgaagcctcagc

SEQ ID NO: 4059977 - DNA, 13 bp, Homo sapiens
caggccggcccag

SEQ ID NO: 4059978 - DNA, 15 bp, Homo sapiens
caggccggcccagat

SEQ ID NO: 4059979 - DNA, 17 bp, Homo sapiens
caggccgggcagagcac

SEQ ID NO: 4059980 - DNA, 21 bp, Homo sapiens
caggccgggcttgggccctgc

SEQ ID NO: 4059981 - DNA, 22 bp, Homo sapiens
caggccgggcttgggccctgca

SEQ ID NO: 4059982 - DNA, 18 bp, Homo sapiens
caggcctaagacatgtga

SEQ ID NO: 4059983 - DNA, 18 bp, Homo sapiens
caggcctacagccacatc

SEQ ID NO: 4059984 - DNA, 19 bp, Homo sapiens
caggcctacagccacatcc

SEQ ID NO: 4059985 - DNA, 15 bp, Homo sapiens
caggcctcaccacct

SEQ ID NO: 4059986 - DNA, 16 bp, Homo sapiens
caggcctcaccacctg

SEQ ID NO: 4059987 - DNA, 12 bp, Homo sapiens
caggcctccctc

SEQ ID NO: 4059988 - DNA, 14 bp, Homo sapiens
caggcctctgctgc

SEQ ID NO: 4059989 - DNA, 13 bp, Homo sapiens
caggcctgcctcc

SEQ ID NO: 4059990 - DNA, 17 bp, Homo sapiens
caggcctggcaagtggg

SEQ ID NO: 4059991 - DNA, 18 bp, Homo sapiens
caggcctgggtctgtgtc

SEQ ID NO: 4059992 - DNA, 12 bp, Homo sapiens
caggcctgggtt

SEQ ID NO: 4059993 - DNA, 12 bp, Homo sapiens
caggcctgtgcc

SEQ ID NO: 4059994 - DNA, 18 bp, Homo sapiens
caggcctgtgcccactcc

SEQ ID NO: 4059995 - DNA, 12 bp, Homo sapiens
caggcctgtggc

SEQ ID NO: 4059996 - DNA, 16 bp, Homo sapiens
caggcctgtggcccca

SEQ ID NO: 4059997 - DNA, 12 bp, Homo sapiens
caggcctgtgtg

SEQ ID NO: 4059998 - DNA, 17 bp, Homo sapiens
caggcggggtgctgtgg

SEQ ID NO: 4059999 - DNA, 19 bp, Homo sapiens
caggcggggtgctgtggtg

SEQ ID NO: 4060000 - DNA, 21 bp, Homo sapiens
caggctaaatgcaccaagaaa

SEQ ID NO: 4060001 - DNA, 20 bp, Homo sapiens
caggctcactgccaggccag

SEQ ID NO: 4060002 - DNA, 23 bp, Homo sapiens
caggctcactgccaggccagcct

SEQ ID NO: 4060003 - DNA, 15 bp, Homo sapiens
caggctctctgggct

SEQ ID NO: 4060004 - DNA, 12 bp, Homo sapiens
caggctcttagc

SEQ ID NO: 4060005 - DNA, 22 bp, Homo sapiens
caggctcttagcagcttccaga

SEQ ID NO: 4060006 - DNA, 23 bp, Homo sapiens
caggctctttggggtcagccagg

SEQ ID NO: 4060007 - DNA, 14 bp, Homo sapiens
caggctgaccacag

SEQ ID NO: 4060008 - DNA, 21 bp, Homo sapiens
caggctgaccacagcacagcc

SEQ ID NO: 4060009 - DNA, 11 bp, Homo sapiens
caggctgaggt

SEQ ID NO: 4060010 - DNA, 19 bp, Homo sapiens
caggctgagtgagccacag

SEQ ID NO: 4060011 - DNA, 20 bp, Homo sapiens
caggctgcagaggcacctca

SEQ ID NO: 4060012 - DNA, 21 bp, Homo sapiens
caggctgccaaggccagagtg

SEQ ID NO: 4060013 - DNA, 22 bp, Homo sapiens
caggctgccaaggccagagtgg

SEQ ID NO: 4060014 - DNA, 15 bp, Homo sapiens
caggctgcttgggat

SEQ ID NO: 4060015 - DNA, 20 bp, Homo sapiens
caggctggctccagatgcag

SEQ ID NO: 4060016 - DNA, 12 bp, Homo sapiens
caggctgggaac

SEQ ID NO: 4060017 - DNA, 14 bp, Homo sapiens
caggctgggacgga

SEQ ID NO: 4060018 - DNA, 18 bp, Homo sapiens
caggctgggcagccccag

SEQ ID NO: 4060019 - DNA, 19 bp, Homo sapiens
caggctgggcagccccaga

SEQ ID NO: 4060020 - DNA, 11 bp, Homo sapiens
caggctgggcc

SEQ ID NO: 4060021 - DNA, 20 bp, Homo sapiens
caggctgggccatgtccaaa

SEQ ID NO: 4060022 - DNA, 17 bp, Homo sapiens
caggctgtgggcctcaa

SEQ ID NO: 4060023 - DNA, 19 bp, Homo sapiens
caggctgtgggtagatgtg

SEQ ID NO: 4060024 - DNA, 22 bp, Homo sapiens
caggctgtgggtagatgtgcaa

SEQ ID NO: 4060025 - DNA, 16 bp, Homo sapiens
caggctgttctccagg

SEQ ID NO: 4060026 - DNA, 20 bp, Homo sapiens
caggctgttctccaggcttc

SEQ ID NO: 4060027 - DNA, 13 bp, Homo sapiens
caggcttcacagt

SEQ ID NO: 4060028 - DNA, 19 bp, Homo sapiens
cagggaaccctgcttgcac

SEQ ID NO: 4060029 - DNA, 22 bp, Homo sapiens
cagggaaccctgcttgcacttt

SEQ ID NO: 4060030 - DNA, 19 bp, Homo sapiens
cagggaactaggaaggcac

SEQ ID NO: 4060031 - DNA, 15 bp, Homo sapiens
cagggaaggcctgac

SEQ ID NO: 4060032 - DNA, 16 bp, Homo sapiens
cagggaagggcttggc

SEQ ID NO: 4060033 - DNA, 15 bp, Homo sapiens
cagggaatccagctc

SEQ ID NO: 4060034 - DNA, 17 bp, Homo sapiens
cagggaatccagctccc

SEQ ID NO: 4060035 - DNA, 14 bp, Homo sapiens
cagggtacctcaag

SEQ ID NO: 4060036 - DNA, 23 bp, Homo sapiens
cagggtagataacctgtacttca

SEQ ID NO: 4060037 - DNA, 18 bp, Homo sapiens
cagggtcatgtttgcagg

SEQ ID NO: 4060038 - DNA, 19 bp, Homo sapiens
cagggtctgtgtgaatgtg

SEQ ID NO: 4060039 - DNA, 21 bp, Homo sapiens
cagggtcttccctacctcagg

SEQ ID NO: 4060040 - DNA, 22 bp, Homo sapiens
cagggtcttccctacctcaggc

SEQ ID NO: 4060041 - DNA, 14 bp, Homo sapiens
cagggtcttgctct

SEQ ID NO: 4060042 - DNA, 20 bp, Homo sapiens
cagggtcttgctctgtcccc

SEQ ID NO: 4060043 - DNA, 23 bp, Homo sapiens
cagggtcttgctctgtcccccag

SEQ ID NO: 4060044 - DNA, 14 bp, Homo sapiens
cagggtgagagctg

SEQ ID NO: 4060045 - DNA, 21 bp, Homo sapiens
cagggtgagagctgctctgga

SEQ ID NO: 4060046 - DNA, 13 bp, Homo sapiens
cagggtgcagagg

SEQ ID NO: 4060047 - DNA, 22 bp, Homo sapiens
cagggtgcccagaacttccctg

SEQ ID NO: 4060048 - DNA, 18 bp, Homo sapiens
cagggtgggcagcctatg

SEQ ID NO: 4060049 - DNA, 20 bp, Homo sapiens
cagggtgggcagcctatggg

SEQ ID NO: 4060050 - DNA, 20 bp, Homo sapiens
cagggtggggggtgacagtg

SEQ ID NO: 4060051 - DNA, 20 bp, Homo sapiens
cagggtgggtgtccatgtgc

SEQ ID NO: 4060052 - DNA, 23 bp, Homo sapiens
cagggtgtctgccccctcctgag

SEQ ID NO: 4060053 - DNA, 13 bp, Homo sapiens
cagggtgtgtgct

SEQ ID NO: 4060054 - DNA, 18 bp, Homo sapiens
cagggttcaaaatgtctg

SEQ ID NO: 4060055 - DNA, 15 bp, Homo sapiens
cagggttcatctgtc

SEQ ID NO: 4060056 - DNA, 23 bp, Homo sapiens
cagggttctcttagcaactcaga

SEQ ID NO: 4060057 - DNA, 21 bp, Homo sapiens
cagggttgatcacactctggg

SEQ ID NO: 4060058 - DNA, 16 bp, Homo sapiens
cagggttgggcccaga

SEQ ID NO: 4060059 - DNA, 18 bp, Homo sapiens
cagggttggtgtgctgag

SEQ ID NO: 4060060 - DNA, 17 bp, Homo sapiens
cagggtttacccagtgg

SEQ ID NO: 4060061 - DNA, 15 bp, Homo sapiens
caggtaatgagggac

SEQ ID NO: 4060062 - DNA, 18 bp, Homo sapiens
caggtaccacccttcaga

SEQ ID NO: 4060063 - DNA, 21 bp, Homo sapiens
caggtaccagctgcgcttgct

SEQ ID NO: 4060064 - DNA, 14 bp, Homo sapiens
caggtaccagttct

SEQ ID NO: 4060065 - DNA, 21 bp, Homo sapiens
caggtagaacgccagggaccc

SEQ ID NO: 4060066 - DNA, 22 bp, Homo sapiens
caggtagaaggttgacacagtt

SEQ ID NO: 4060067 - DNA, 23 bp, Homo sapiens
caggtatggaagggtttgtggct

SEQ ID NO: 4060068 - DNA, 16 bp, Homo sapiens
caggtatggctctgca

SEQ ID NO: 4060069 - DNA, 13 bp, Homo sapiens
caggtcaataaac

SEQ ID NO: 4060070 - DNA, 16 bp, Homo sapiens
caggtcaataaactta

SEQ ID NO: 4060071 - DNA, 21 bp, Homo sapiens
caggtcaataaacttagagga

SEQ ID NO: 4060072 - DNA, 14 bp, Homo sapiens
caggtcaccaagca

SEQ ID NO: 4060073 - DNA, 16 bp, Homo sapiens
caggtcagggacttgg

SEQ ID NO: 4060074 - DNA, 20 bp, Homo sapiens
caggtcccagccccttttcc

SEQ ID NO: 4060075 - DNA, 22 bp, Homo sapiens
caggtcctgcccatgtgtcccc

SEQ ID NO: 4060076 - DNA, 15 bp, Homo sapiens
caggtcctgctcagc

SEQ ID NO: 4060077 - DNA, 17 bp, Homo sapiens
caggtcctgctcagcag

SEQ ID NO: 4060078 - DNA, 16 bp, Homo sapiens
caggtcgggcgcagga

SEQ ID NO: 4060079 - DNA, 22 bp, Homo sapiens
caggtctcccacgtgggagaca

SEQ ID NO: 4060080 - DNA, 18 bp, Homo sapiens
caggtgaaggaggctcca

SEQ ID NO: 4060081 - DNA, 17 bp, Homo sapiens
caggtgacatgtgaaac

SEQ ID NO: 4060082 - DNA, 13 bp, Homo sapiens
caggtgagaaact

SEQ ID NO: 4060083 - DNA, 19 bp, Homo sapiens
caggtgagaagtgagggag

SEQ ID NO: 4060084 - DNA, 21 bp, Homo sapiens
caggtgaggtctgttcctttt

SEQ ID NO: 4060085 - DNA, 16 bp, Homo sapiens
caggtgccagcctgag

SEQ ID NO: 4060086 - DNA, 18 bp, Homo sapiens
caggtgccagggcccacc

SEQ ID NO: 4060087 - DNA, 20 bp, Homo sapiens
caggtgccagggcccacccc

SEQ ID NO: 4060088 - DNA, 15 bp, Homo sapiens
caggtgcctggacat

SEQ ID NO: 4060089 - DNA, 14 bp, Homo sapiens
caggtgctcaatgg

SEQ ID NO: 4060090 - DNA, 16 bp, Homo sapiens
caggtgctcattgtaa

SEQ ID NO: 4060091 - DNA, 21 bp, Homo sapiens
caggtgctgacttcatctccc

SEQ ID NO: 4060092 - DNA, 14 bp, Homo sapiens
caggtgctggtccc

SEQ ID NO: 4060093 - DNA, 14 bp, Homo sapiens
caggtgctgtccat

SEQ ID NO: 4060094 - DNA, 15 bp, Homo sapiens
caggtggagggcaca

SEQ ID NO: 4060095 - DNA, 18 bp, Homo sapiens
caggtggagggcacagcc

SEQ ID NO: 4060096 - DNA, 23 bp, Homo sapiens
caggtggagggcacagccctccg

SEQ ID NO: 4060097 - DNA, 17 bp, Homo sapiens
caggtggatgaggagac

SEQ ID NO: 4060098 - DNA, 17 bp, Homo sapiens
caggtggcaggaccagg

SEQ ID NO: 4060099 - DNA, 18 bp, Homo sapiens
caggtggcaggaccagga

SEQ ID NO: 4060100 - DNA, 21 bp, Homo sapiens
caggtggcaggaccaggacta

SEQ ID NO: 4060101 - DNA, 16 bp, Homo sapiens
caggtggccactccag

SEQ ID NO: 4060102 - DNA, 10 bp, Homo sapiens
caggtgggca

SEQ ID NO: 4060103 - DNA, 15 bp, Homo sapiens
caggtgggcactgga

SEQ ID NO: 4060104 - DNA, 22 bp, Homo sapiens
caggtgggctggacttctacct

SEQ ID NO: 4060105 - DNA, 15 bp, Homo sapiens
caggtggggactggg

SEQ ID NO: 4060106 - DNA, 19 bp, Homo sapiens
caggtgggtgctgccctgt

SEQ ID NO: 4060107 - DNA, 20 bp, Homo sapiens
caggtggttgtcttattgca

SEQ ID NO: 4060108 - DNA, 20 bp, Homo sapiens
caggtgtcaggatagtcaca

SEQ ID NO: 4060109 - DNA, 20 bp, Homo sapiens
caggtgtgagggcagtgcaa

SEQ ID NO: 4060110 - DNA, 12 bp, Homo sapiens
caggtgtgcctg

SEQ ID NO: 4060111 - DNA, 20 bp, Homo sapiens
caggtgtggggacacagcag

SEQ ID NO: 4060112 - DNA, 13 bp, Homo sapiens
caggtgttgccaa

SEQ ID NO: 4060113 - DNA, 15 bp, Homo sapiens
caggtgtttggcacc

SEQ ID NO: 4060114 - DNA, 22 bp, Homo sapiens
caggtgtttggcacccaaatca

SEQ ID NO: 4060115 - DNA, 13 bp, Homo sapiens
caggttaacctgc

SEQ ID NO: 4060116 - DNA, 17 bp, Homo sapiens
caggttatactcctcct

SEQ ID NO: 4060117 - DNA, 19 bp, Homo sapiens
caggttatcgaaataacaa

SEQ ID NO: 4060118 - DNA, 20 bp, Homo sapiens
caggttatcgaaataacaat

SEQ ID NO: 4060119 - DNA, 14 bp, Homo sapiens
caggttcccaagct

SEQ ID NO: 4060120 - DNA, 12 bp, Homo sapiens
caggttcttcag

SEQ ID NO: 4060121 - DNA, 21 bp, Homo sapiens
caggttggaaggggccttgct

SEQ ID NO: 4060122 - DNA, 21 bp, Homo sapiens
caggttggatgggagtgggca

SEQ ID NO: 4060123 - DNA, 19 bp, Homo sapiens
caggttggcaaacgggctt

SEQ ID NO: 4060124 - DNA, 18 bp, Homo sapiens
caggttgggctagagaaa

SEQ ID NO: 4060125 - DNA, 15 bp, Homo sapiens
cagtaaatttgctag

SEQ ID NO: 4060126 - DNA, 19 bp, Homo sapiens
cagtaacgcgtcttcctga

SEQ ID NO: 4060127 - DNA, 20 bp, Homo sapiens
cagtaacgcgtcttcctgag

SEQ ID NO: 4060128 - DNA, 10 bp, Homo sapiens
cagtaactgt

SEQ ID NO: 4060129 - DNA, 19 bp, Homo sapiens
cagtaagtttcccctctgg

SEQ ID NO: 4060130 - DNA, 12 bp, Homo sapiens
cagtaataactc

SEQ ID NO: 4060131 - DNA, 13 bp, Homo sapiens
cagtaataactct

SEQ ID NO: 4060132 - DNA, 13 bp, Homo sapiens
cagtaatatttat

SEQ ID NO: 4060133 - DNA, 19 bp, Homo sapiens
cagtacccatggggctagg

SEQ ID NO: 4060134 - DNA, 16 bp, Homo sapiens
cagtaccctccattgg

SEQ ID NO: 4060135 - DNA, 19 bp, Homo sapiens
cagtaccctctcagctcca

SEQ ID NO: 4060136 - DNA, 21 bp, Homo sapiens
cagtacctctgtatagaaatc

SEQ ID NO: 4060137 - DNA, 23 bp, Homo sapiens
cagtgatgtaccatgaaacaaag

SEQ ID NO: 4060138 - DNA, 21 bp, Homo sapiens
cagtgcagacaggccatgtga

SEQ ID NO: 4060139 - DNA, 15 bp, Homo sapiens
cagtgcagccactgg

SEQ ID NO: 4060140 - DNA, 16 bp, Homo sapiens
cagtgcagccactggc

SEQ ID NO: 4060141 - DNA, 17 bp, Homo sapiens
cagtgcatctcagccca

SEQ ID NO: 4060142 - DNA, 18 bp, Homo sapiens
cagtgcatctcagcccac

SEQ ID NO: 4060143 - DNA, 16 bp, Homo sapiens
cagtgccaaatgctgg

SEQ ID NO: 4060144 - DNA, 17 bp, Homo sapiens
cagtgccaaatgctggg

SEQ ID NO: 4060145 - DNA, 18 bp, Homo sapiens
cagtgccaaatgctgggg

SEQ ID NO: 4060146 - DNA, 10 bp, Homo sapiens
cagtgccaac

SEQ ID NO: 4060147 - DNA, 17 bp, Homo sapiens
cagtgccagcaatgaca

SEQ ID NO: 4060148 - DNA, 20 bp, Homo sapiens
cagtgccatgtaaatcccca

SEQ ID NO: 4060149 - DNA, 10 bp, Homo sapiens
cagtgccatt

SEQ ID NO: 4060150 - DNA, 18 bp, Homo sapiens
cagtgccattccactcca

SEQ ID NO: 4060151 - DNA, 13 bp, Homo sapiens
cagtgccccaggg

SEQ ID NO: 4060152 - DNA, 18 bp, Homo sapiens
cagtgccccagggagtcc

SEQ ID NO: 4060153 - DNA, 21 bp, Homo sapiens
cagtgcccccactgaccagaa

SEQ ID NO: 4060154 - DNA, 13 bp, Homo sapiens
cagtgccttctct

SEQ ID NO: 4060155 - DNA, 12 bp, Homo sapiens
cagtgccttgct

SEQ ID NO: 4060156 - DNA, 13 bp, Homo sapiens
cagtgccttgctc

SEQ ID NO: 4060157 - DNA, 16 bp, Homo sapiens
cagtgctcaccagccc

SEQ ID NO: 4060158 - DNA, 22 bp, Homo sapiens
cagtgctcaccagccctgcagc

SEQ ID NO: 4060159 - DNA, 12 bp, Homo sapiens
cagtgctgtgtg

SEQ ID NO: 4060160 - DNA, 17 bp, Homo sapiens
cagtggagcccaggagt

SEQ ID NO: 4060161 - DNA, 15 bp, Homo sapiens
cagtggaggtttgtc

SEQ ID NO: 4060162 - DNA, 19 bp, Homo sapiens
cagtggagtgcaaaaggct

SEQ ID NO: 4060163 - DNA, 21 bp, Homo sapiens
cagtggagtgcaaaaggcttg

SEQ ID NO: 4060164 - DNA, 18 bp, Homo sapiens
cagtggcagacaaacaga

SEQ ID NO: 4060165 - DNA, 20 bp, Homo sapiens
cagtggcgggtgatggccag

SEQ ID NO: 4060166 - DNA, 17 bp, Homo sapiens
cagtggctgggtgggcc

SEQ ID NO: 4060167 - DNA, 20 bp, Homo sapiens
cagtggctgggtgggcccag

SEQ ID NO: 4060168 - DNA, 22 bp, Homo sapiens
cagtggctgggtgggcccagaa

SEQ ID NO: 4060169 - DNA, 19 bp, Homo sapiens
cagtggctggtccagggct

SEQ ID NO: 4060170 - DNA, 20 bp, Homo sapiens
cagtggctggtccagggcta

SEQ ID NO: 4060171 - DNA, 19 bp, Homo sapiens
cagtggcttcatctgtcaa

SEQ ID NO: 4060172 - DNA, 11 bp, Homo sapiens
cagtggcttcc

SEQ ID NO: 4060173 - DNA, 18 bp, Homo sapiens
cagtggcttcccagctct

SEQ ID NO: 4060174 - DNA, 16 bp, Homo sapiens
cagtgggacagggcat

SEQ ID NO: 4060175 - DNA, 19 bp, Homo sapiens
cagtgggacagggcatggc

SEQ ID NO: 4060176 - DNA, 16 bp, Homo sapiens
cagtgggaccacatgc

SEQ ID NO: 4060177 - DNA, 17 bp, Homo sapiens
cagtgggaccacatgcc

SEQ ID NO: 4060178 - DNA, 23 bp, Homo sapiens
cagtgggaccacatgccactgcc

SEQ ID NO: 4060179 - DNA, 13 bp, Homo sapiens
cagtgggagccct

SEQ ID NO: 4060180 - DNA, 14 bp, Homo sapiens
cagtgggagccctg

SEQ ID NO: 4060181 - DNA, 17 bp, Homo sapiens
cagtgggagccctgacc

SEQ ID NO: 4060182 - DNA, 17 bp, Homo sapiens
cagtgggatgggacagg

SEQ ID NO: 4060183 - DNA, 14 bp, Homo sapiens
cagtgggcgggcca

SEQ ID NO: 4060184 - DNA, 19 bp, Homo sapiens
cagtgggcgggccatgagg

SEQ ID NO: 4060185 - DNA, 23 bp, Homo sapiens
cagtgggcgttgggagcctagct

SEQ ID NO: 4060186 - DNA, 17 bp, Homo sapiens
cagtggggcctgtggaa

SEQ ID NO: 4060187 - DNA, 20 bp, Homo sapiens
cagtggtaagctctggcttt

SEQ ID NO: 4060188 - DNA, 14 bp, Homo sapiens
cagtggtgaagaaa

SEQ ID NO: 4060189 - DNA, 17 bp, Homo sapiens
cagtggtgaagaaaact

SEQ ID NO: 4060190 - DNA, 20 bp, Homo sapiens
cagtgtacatagtgtaatgt

SEQ ID NO: 4060191 - DNA, 17 bp, Homo sapiens
cagtgtagttaatttat

SEQ ID NO: 4060192 - DNA, 19 bp, Homo sapiens
cagtgtatcaggtcaggga

SEQ ID NO: 4060193 - DNA, 17 bp, Homo sapiens
cagtgtcacctctctca

SEQ ID NO: 4060194 - DNA, 20 bp, Homo sapiens
cagtgtcacctctctcagag

SEQ ID NO: 4060195 - DNA, 21 bp, Homo sapiens
cagtgtcacctctctcagagc

SEQ ID NO: 4060196 - DNA, 18 bp, Homo sapiens
cagtgtcctcttgctcaa

SEQ ID NO: 4060197 - DNA, 14 bp, Homo sapiens
cagtgtctcggagg

SEQ ID NO: 4060198 - DNA, 22 bp, Homo sapiens
cagtgtctgtatcggagacagt

SEQ ID NO: 4060199 - DNA, 15 bp, Homo sapiens
cagtgtctgtgccat

SEQ ID NO: 4060200 - DNA, 21 bp, Homo sapiens
cagtgtctgtgccatggattt

SEQ ID NO: 4060201 - DNA, 22 bp, Homo sapiens
cagtgtgcacgagtgggaagga

SEQ ID NO: 4060202 - DNA, 18 bp, Homo sapiens
cagtgtggagaccctgcc

SEQ ID NO: 4060203 - DNA, 22 bp, Homo sapiens
cagtgtggagaccctgccacag

SEQ ID NO: 4060204 - DNA, 13 bp, Homo sapiens
cagtgtggagtgg

SEQ ID NO: 4060205 - DNA, 14 bp, Homo sapiens
cagtgtgtctaaat

SEQ ID NO: 4060206 - DNA, 23 bp, Homo sapiens
cagtgtgtctaaatttgaatgtt

SEQ ID NO: 4060207 - DNA, 20 bp, Homo sapiens
cagtgtgtgaactgctttca

SEQ ID NO: 4060208 - DNA, 22 bp, Homo sapiens
cagtgtgtgtgtgtggtccatg

SEQ ID NO: 4060209 - DNA, 14 bp, Homo sapiens
cagtgttacctgtg

SEQ ID NO: 4060210 - DNA, 18 bp, Homo sapiens
cagtgttacctgtgtgct

SEQ ID NO: 4060211 - DNA, 19 bp, Homo sapiens
cagtgttagagaaatcctt

SEQ ID NO: 4060212 - DNA, 16 bp, Homo sapiens
cagtgttctcacagtg

SEQ ID NO: 4060213 - DNA, 17 bp, Homo sapiens
cagtgttgctcagctcc

SEQ ID NO: 4060214 - DNA, 23 bp, Homo sapiens
cagtgttgttgctctaggaagac

SEQ ID NO: 4060215 - DNA, 14 bp, Homo sapiens
cagtgttgtttgta

SEQ ID NO: 4060216 - DNA, 16 bp, Homo sapiens
cagtgttgtttgtaaa

SEQ ID NO: 4060217 - DNA, 17 bp, Homo sapiens
cagtgttgtttgtaaat

SEQ ID NO: 4060218 - DNA, 19 bp, Homo sapiens
cagtgttgtttgtaaataa

SEQ ID NO: 4060219 - DNA, 20 bp, Homo sapiens
cagtgttgtttgtaaataag

SEQ ID NO: 4060220 - DNA, 15 bp, Homo sapiens
cagtgtttcccataa

SEQ ID NO: 4060221 - DNA, 20 bp, Homo sapiens
cagtgtttcccataattttc

SEQ ID NO: 4060222 - DNA, 13 bp, Homo sapiens
cagtgtttgtgtg

SEQ ID NO: 4060223 - DNA, 20 bp, Homo sapiens
cagtgttttggactccatct

SEQ ID NO: 4060224 - DNA, 21 bp, Homo sapiens
cagttaactattgcatttata

SEQ ID NO: 4060225 - DNA, 24 bp, Homo sapiens
cagttaactattgcatttatatgt

SEQ ID NO: 4060226 - DNA, 16 bp, Homo sapiens
cagttaactttcagaa

SEQ ID NO: 4060227 - DNA, 16 bp, Homo sapiens
cagttaattcaatgtg

SEQ ID NO: 4060228 - DNA, 22 bp, Homo sapiens
cagttaccacacatctatgata

SEQ ID NO: 4060229 - DNA, 21 bp, Homo sapiens
cagttacccactcggtcccag

SEQ ID NO: 4060230 - DNA, 13 bp, Homo sapiens
cagttagactagt

SEQ ID NO: 4060231 - DNA, 20 bp, Homo sapiens
cagttagttgtgaaagaaag

SEQ ID NO: 4060232 - DNA, 18 bp, Homo sapiens
cagttatgtgaatgatct

SEQ ID NO: 4060233 - DNA, 19 bp, Homo sapiens
cagttattttggatatatt

SEQ ID NO: 4060234 - DNA, 21 bp, Homo sapiens
cagttattttggatatattat

SEQ ID NO: 4060235 - DNA, 16 bp, Homo sapiens
cagttcaacctggtgg

SEQ ID NO: 4060236 - DNA, 23 bp, Homo sapiens
cagttcaacctggtggcaccaga

SEQ ID NO: 4060237 - DNA, 19 bp, Homo sapiens
cagttcaatctcccgctgc

SEQ ID NO: 4060238 - DNA, 22 bp, Homo sapiens
cagttcaatctcccgctgctgc

SEQ ID NO: 4060239 - DNA, 13 bp, Homo sapiens
catacaggtgctc

SEQ ID NO: 4060240 - DNA, 21 bp, Homo sapiens
catacatcagttattcattct

SEQ ID NO: 4060241 - DNA, 17 bp, Homo sapiens
catacatttataatgtt

SEQ ID NO: 4060242 - DNA, 22 bp, Homo sapiens
cataccccactgggcacacgca

SEQ ID NO: 4060243 - DNA, 18 bp, Homo sapiens
catactactgaaacagat

SEQ ID NO: 4060244 - DNA, 20 bp, Homo sapiens
catactactgaaacagattt

SEQ ID NO: 4060245 - DNA, 20 bp, Homo sapiens
catactcagcctgctgccca

SEQ ID NO: 4060246 - DNA, 15 bp, Homo sapiens
catactgagggacca

SEQ ID NO: 4060247 - DNA, 13 bp, Homo sapiens
catactggcagga

SEQ ID NO: 4060248 - DNA, 16 bp, Homo sapiens
catacttatctctctg

SEQ ID NO: 4060249 - DNA, 18 bp, Homo sapiens
catacttatctctctgtg

SEQ ID NO: 4060250 - DNA, 20 bp, Homo sapiens
catacttatctctctgtgct

SEQ ID NO: 4060251 - DNA, 17 bp, Homo sapiens
catacttgaagggccag

SEQ ID NO: 4060252 - DNA, 20 bp, Homo sapiens
catacttgaagggccagagc

SEQ ID NO: 4060253 - DNA, 15 bp, Homo sapiens
catagaccctgaggc

SEQ ID NO: 4060254 - DNA, 12 bp, Homo sapiens
catagaggcttc

SEQ ID NO: 4060255 - DNA, 23 bp, Homo sapiens
catagatgtccctttcttggcca

SEQ ID NO: 4060256 - DNA, 16 bp, Homo sapiens
catagatgttttggta

SEQ ID NO: 4060257 - DNA, 15 bp, Homo sapiens
catagcaacaggaaa

SEQ ID NO: 4060258 - DNA, 18 bp, Homo sapiens
catagcagattttaattt

SEQ ID NO: 4060259 - DNA, 14 bp, Homo sapiens
catagcataggaca

SEQ ID NO: 4060260 - DNA, 11 bp, Homo sapiens
catagcattaa

SEQ ID NO: 4060261 - DNA, 16 bp, Homo sapiens
catagcccctgccccg

SEQ ID NO: 4060262 - DNA, 16 bp, Homo sapiens
catagcgaaataaaaa

SEQ ID NO: 4060263 - DNA, 14 bp, Homo sapiens
catagctccttgga

SEQ ID NO: 4060264 - DNA, 20 bp, Homo sapiens
catagctccttggagcaggc

SEQ ID NO: 4060265 - DNA, 12 bp, Homo sapiens
cataggaaaagt

SEQ ID NO: 4060266 - DNA, 18 bp, Homo sapiens
cataggaaaagtacattt

SEQ ID NO: 4060267 - DNA, 22 bp, Homo sapiens
cataggaaaagtacatttaata

SEQ ID NO: 4060268 - DNA, 17 bp, Homo sapiens
cataggacatactgcat

SEQ ID NO: 4060269 - DNA, 20 bp, Homo sapiens
cataggacatactgcatgta

SEQ ID NO: 4060270 - DNA, 14 bp, Homo sapiens
cataggcctgggtg

SEQ ID NO: 4060271 - DNA, 17 bp, Homo sapiens
cataggcctgggtgctg

SEQ ID NO: 4060272 - DNA, 15 bp, Homo sapiens
cataggtaagctgtg

SEQ ID NO: 4060273 - DNA, 16 bp, Homo sapiens
catagtaccaatcatt

SEQ ID NO: 4060274 - DNA, 22 bp, Homo sapiens
catagtaccaatcattttaatt

SEQ ID NO: 4060275 - DNA, 20 bp, Homo sapiens
catagtaccatttatacaaa

SEQ ID NO: 4060276 - DNA, 17 bp, Homo sapiens
catagtagtttttacag

SEQ ID NO: 4060277 - DNA, 18 bp, Homo sapiens
catagtgatggttcccct

SEQ ID NO: 4060278 - DNA, 19 bp, Homo sapiens
catagtgatggttcccctg

SEQ ID NO: 4060279 - DNA, 11 bp, Homo sapiens
catagtgctgg

SEQ ID NO: 4060280 - DNA, 13 bp, Homo sapiens
catagtgctggga

SEQ ID NO: 4060281 - DNA, 18 bp, Homo sapiens
catagttatgtgattttc

SEQ ID NO: 4060282 - DNA, 20 bp, Homo sapiens
catataaatgaatctggtgt

SEQ ID NO: 4060283 - DNA, 15 bp, Homo sapiens
catataatgttgtta

SEQ ID NO: 4060284 - DNA, 18 bp, Homo sapiens
catatactgttcttcatt

SEQ ID NO: 4060285 - DNA, 18 bp, Homo sapiens
catataggtgatgtttgc

SEQ ID NO: 4060286 - DNA, 18 bp, Homo sapiens
catatatgaccagaagcc

SEQ ID NO: 4060287 - DNA, 13 bp, Homo sapiens
catatatttattg

SEQ ID NO: 4060288 - DNA, 16 bp, Homo sapiens
catatcatgctaaaat

SEQ ID NO: 4060289 - DNA, 20 bp, Homo sapiens
catatcatgctaaaattcta

SEQ ID NO: 4060290 - DNA, 16 bp, Homo sapiens
catatccaagatcaat

SEQ ID NO: 4060291 - DNA, 15 bp, Homo sapiens
catatcctgagccat

SEQ ID NO: 4060292 - DNA, 22 bp, Homo sapiens
catatcttctatatctgaagag

SEQ ID NO: 4060293 - DNA, 15 bp, Homo sapiens
catatctttattaat

SEQ ID NO: 4060294 - DNA, 15 bp, Homo sapiens
catatgacttgatct

SEQ ID NO: 4060295 - DNA, 22 bp, Homo sapiens
catatgagccgtgaactgtgca

SEQ ID NO: 4060296 - DNA, 14 bp, Homo sapiens
catatgagtgtgga

SEQ ID NO: 4060297 - DNA, 17 bp, Homo sapiens
catatgagtgtggaagc

SEQ ID NO: 4060298 - DNA, 15 bp, Homo sapiens
catatgatctgtttt

SEQ ID NO: 4060299 - DNA, 21 bp, Homo sapiens
catatgggatattcccaagcc

SEQ ID NO: 4060300 - DNA, 16 bp, Homo sapiens
catatgtacataaatt

SEQ ID NO: 4060301 - DNA, 15 bp, Homo sapiens
catatgtaccatgta

SEQ ID NO: 4060302 - DNA, 16 bp, Homo sapiens
catatgttgaatactt

SEQ ID NO: 4060303 - DNA, 17 bp, Homo sapiens
catatgttgaatacttt

SEQ ID NO: 4060304 - DNA, 18 bp, Homo sapiens
catatgttgaatactttt

SEQ ID NO: 4060305 - DNA, 16 bp, Homo sapiens
catatgttgctcagtc

SEQ ID NO: 4060306 - DNA, 16 bp, Homo sapiens
catattactgttgcat

SEQ ID NO: 4060307 - DNA, 19 bp, Homo sapiens
catattactgttgcattta

SEQ ID NO: 4060308 - DNA, 23 bp, Homo sapiens
catattactgttgcatttacttt

SEQ ID NO: 4060309 - DNA, 16 bp, Homo sapiens
catattccatatttat

SEQ ID NO: 4060310 - DNA, 17 bp, Homo sapiens
catattctaaaaccatt

SEQ ID NO: 4060311 - DNA, 13 bp, Homo sapiens
catattctattgt

SEQ ID NO: 4060312 - DNA, 15 bp, Homo sapiens
catattcttgtgctt

SEQ ID NO: 4060313 - DNA, 13 bp, Homo sapiens
catattgatgaaa

SEQ ID NO: 4060314 - DNA, 16 bp, Homo sapiens
catattgctgagagaa

SEQ ID NO: 4060315 - DNA, 12 bp, Homo sapiens
catattgtttga

SEQ ID NO: 4060316 - DNA, 16 bp, Homo sapiens
catatttactacctta

SEQ ID NO: 4060317 - DNA, 16 bp, Homo sapiens
catatttacttcttat

SEQ ID NO: 4060318 - DNA, 22 bp, Homo sapiens
catatttatagcaatccatgtt

SEQ ID NO: 4060319 - DNA, 12 bp, Homo sapiens
catatttatcca

SEQ ID NO: 4060320 - DNA, 22 bp, Homo sapiens
catatttatccaaaatgtgtat

SEQ ID NO: 4060321 - DNA, 12 bp, Homo sapiens
catatttggaag

SEQ ID NO: 4060322 - DNA, 14 bp, Homo sapiens
catcaacatcttgg

SEQ ID NO: 4060323 - DNA, 19 bp, Homo sapiens
catcaatatccctcttgta

SEQ ID NO: 4060324 - DNA, 21 bp, Homo sapiens
catcaatatccctcttgtaag

SEQ ID NO: 4060325 - DNA, 14 bp, Homo sapiens
catcaatgttcatt

SEQ ID NO: 4060326 - DNA, 16 bp, Homo sapiens
catcaatgttcattgt

SEQ ID NO: 4060327 - DNA, 19 bp, Homo sapiens
catcacagggttgggccca

SEQ ID NO: 4060328 - DNA, 15 bp, Homo sapiens
catcaccctttgcct

SEQ ID NO: 4060329 - DNA, 16 bp, Homo sapiens
catcaccctttgcctt

SEQ ID NO: 4060330 - DNA, 21 bp, Homo sapiens
catcaccctttgccttagcag

SEQ ID NO: 4060331 - DNA, 23 bp, Homo sapiens
catcacctcaccaaggatcggac

SEQ ID NO: 4060332 - DNA, 19 bp, Homo sapiens
catcacgtaccccactggg

SEQ ID NO: 4060333 - DNA, 22 bp, Homo sapiens
catcactaaaccgataatgcat

SEQ ID NO: 4060334 - DNA, 20 bp, Homo sapiens
catcactgcttgatgaagca

SEQ ID NO: 4060335 - DNA, 15 bp, Homo sapiens
catcagacctgtctt

SEQ ID NO: 4060336 - DNA, 19 bp, Homo sapiens
catcagacctgtcttccaa

SEQ ID NO: 4060337 - DNA, 19 bp, Homo sapiens
catcagatggaaatatttt

SEQ ID NO: 4060338 - DNA, 17 bp, Homo sapiens
catcagctgtaagaaga

SEQ ID NO: 4060339 - DNA, 19 bp, Homo sapiens
catcaggaaggaaatgaca

SEQ ID NO: 4060340 - DNA, 13 bp, Homo sapiens
catcaggatgaac

SEQ ID NO: 4060341 - DNA, 17 bp, Homo sapiens
catcaggatgaacccag

SEQ ID NO: 4060342 - DNA, 21 bp, Homo sapiens
catcctttcacttctttccct

SEQ ID NO: 4060343 - DNA, 18 bp, Homo sapiens
catcctttgcagggcagc

SEQ ID NO: 4060344 - DNA, 15 bp, Homo sapiens
catcctttgttctga

SEQ ID NO: 4060345 - DNA, 19 bp, Homo sapiens
catcctttgttctgagcat

SEQ ID NO: 4060346 - DNA, 18 bp, Homo sapiens
catcgatatgtatatcat

SEQ ID NO: 4060347 - DNA, 21 bp, Homo sapiens
catcgcaggagtctctgccac

SEQ ID NO: 4060348 - DNA, 21 bp, Homo sapiens
catcggacaagacccccagca

SEQ ID NO: 4060349 - DNA, 20 bp, Homo sapiens
catcggaggctgggcccctg

SEQ ID NO: 4060350 - DNA, 23 bp, Homo sapiens
catcggaggctgggcccctggga

SEQ ID NO: 4060351 - DNA, 21 bp, Homo sapiens
catcggtgaaactaacagata

SEQ ID NO: 4060352 - DNA, 21 bp, Homo sapiens
catcgtataacacaatatgaa

SEQ ID NO: 4060353 - DNA, 19 bp, Homo sapiens
catctaatgcttgtttatg

SEQ ID NO: 4060354 - DNA, 20 bp, Homo sapiens
catctaccttttctggcaaa

SEQ ID NO: 4060355 - DNA, 16 bp, Homo sapiens
catctacttaataaat

SEQ ID NO: 4060356 - DNA, 17 bp, Homo sapiens
catctaggtaattttta

SEQ ID NO: 4060357 - DNA, 20 bp, Homo sapiens
catctatctcatctatctca

SEQ ID NO: 4060358 - DNA, 14 bp, Homo sapiens
catctattttggat

SEQ ID NO: 4060359 - DNA, 19 bp, Homo sapiens
catctcactggatgcaaag

SEQ ID NO: 4060360 - DNA, 18 bp, Homo sapiens
catctcagaccctttagc

SEQ ID NO: 4060361 - DNA, 20 bp, Homo sapiens
catctcagcctaccatgaga

SEQ ID NO: 4060362 - DNA, 14 bp, Homo sapiens
catctcagcctcct

SEQ ID NO: 4060363 - DNA, 17 bp, Homo sapiens
catctcagcctcctgag

SEQ ID NO: 4060364 - DNA, 13 bp, Homo sapiens
catctcaggagat

SEQ ID NO: 4060365 - DNA, 16 bp, Homo sapiens
catctcaggggccaga

SEQ ID NO: 4060366 - DNA, 19 bp, Homo sapiens
catctcaggggccagagga

SEQ ID NO: 4060367 - DNA, 22 bp, Homo sapiens
catctcatgcccctggctggga

SEQ ID NO: 4060368 - DNA, 23 bp, Homo sapiens
catctcatgtatcatctggatag

SEQ ID NO: 4060369 - DNA, 18 bp, Homo sapiens
catctccaaggatcctct

SEQ ID NO: 4060370 - DNA, 22 bp, Homo sapiens
catctccagggagcaagacaga

SEQ ID NO: 4060371 - DNA, 20 bp, Homo sapiens
catctccatcatatgcctga

SEQ ID NO: 4060372 - DNA, 21 bp, Homo sapiens
catctcccaccctgtacctca

SEQ ID NO: 4060373 - DNA, 21 bp, Homo sapiens
catctccctgcctggccccca

SEQ ID NO: 4060374 - DNA, 17 bp, Homo sapiens
catctcctgctcaccac

SEQ ID NO: 4060375 - DNA, 20 bp, Homo sapiens
catctcctgctcaccacctg

SEQ ID NO: 4060376 - DNA, 16 bp, Homo sapiens
catctccttagaaaag

SEQ ID NO: 4060377 - DNA, 12 bp, Homo sapiens
catctctcccca

SEQ ID NO: 4060378 - DNA, 18 bp, Homo sapiens
catctctctgcccaaccc

SEQ ID NO: 4060379 - DNA, 20 bp, Homo sapiens
catctctctggggccctggg

SEQ ID NO: 4060380 - DNA, 21 bp, Homo sapiens
catctctctggggccctgggc

SEQ ID NO: 4060381 - DNA, 13 bp, Homo sapiens
catctctgcttgg

SEQ ID NO: 4060382 - DNA, 12 bp, Homo sapiens
catctcttcccc

SEQ ID NO: 4060383 - DNA, 15 bp, Homo sapiens
catctgaagagcaga

SEQ ID NO: 4060384 - DNA, 15 bp, Homo sapiens
catctgagcaagagc

SEQ ID NO: 4060385 - DNA, 18 bp, Homo sapiens
catctgatgccgtgatcc

SEQ ID NO: 4060386 - DNA, 15 bp, Homo sapiens
catctgattaaaaca

SEQ ID NO: 4060387 - DNA, 17 bp, Homo sapiens
catctgcaatatgaatt

SEQ ID NO: 4060388 - DNA, 19 bp, Homo sapiens
catctgcaccccttctctc

SEQ ID NO: 4060389 - DNA, 23 bp, Homo sapiens
catctgcaccccttctctcctcc

SEQ ID NO: 4060390 - DNA, 20 bp, Homo sapiens
catctgccttaaaaccaaag

SEQ ID NO: 4060391 - DNA, 18 bp, Homo sapiens
catctgcgtgacaataaa

SEQ ID NO: 4060392 - DNA, 22 bp, Homo sapiens
catctgcgtgacaataaaacat

SEQ ID NO: 4060393 - DNA, 21 bp, Homo sapiens
catctggaatctggagaccag

SEQ ID NO: 4060394 - DNA, 18 bp, Homo sapiens
catctggataggagcctg

SEQ ID NO: 4060395 - DNA, 21 bp, Homo sapiens
catctggataggagcctgctg

SEQ ID NO: 4060396 - DNA, 21 bp, Homo sapiens
catctggctgtctagaatgtg

SEQ ID NO: 4060397 - DNA, 22 bp, Homo sapiens
catctggctgtttagcagaact

SEQ ID NO: 4060398 - DNA, 17 bp, Homo sapiens
catctgggctcctccag

SEQ ID NO: 4060399 - DNA, 20 bp, Homo sapiens
catctgggctcctccagggt

SEQ ID NO: 4060400 - DNA, 15 bp, Homo sapiens
catctgggtccttgc

SEQ ID NO: 4060401 - DNA, 22 bp, Homo sapiens
catctggttgaactctggtggc

SEQ ID NO: 4060402 - DNA, 12 bp, Homo sapiens
catctgtccagc

SEQ ID NO: 4060403 - DNA, 14 bp, Homo sapiens
catctgtccatggc

SEQ ID NO: 4060404 - DNA, 19 bp, Homo sapiens
catctgtccatggcctttc

SEQ ID NO: 4060405 - DNA, 17 bp, Homo sapiens
catctgtgcactgccca

SEQ ID NO: 4060406 - DNA, 18 bp, Homo sapiens
catctgtgcagggctggt

SEQ ID NO: 4060407 - DNA, 14 bp, Homo sapiens
catcttagtgcctg

SEQ ID NO: 4060408 - DNA, 15 bp, Homo sapiens
catcttcactgcaat

SEQ ID NO: 4060409 - DNA, 22 bp, Homo sapiens
catcttccctagagggttcctg

SEQ ID NO: 4060410 - DNA, 13 bp, Homo sapiens
catcttcctgtgt

SEQ ID NO: 4060411 - DNA, 14 bp, Homo sapiens
catcttcctgtgtc

SEQ ID NO: 4060412 - DNA, 15 bp, Homo sapiens
catcttcctgtgtcc

SEQ ID NO: 4060413 - DNA, 17 bp, Homo sapiens
catcttcctgtgtcctg

SEQ ID NO: 4060414 - DNA, 21 bp, Homo sapiens
catcttctaaacccaatccaa

SEQ ID NO: 4060415 - DNA, 14 bp, Homo sapiens
catcttcttcccag

SEQ ID NO: 4060416 - DNA, 15 bp, Homo sapiens
catcttcttcccagt

SEQ ID NO: 4060417 - DNA, 20 bp, Homo sapiens
catcttgacagagcctgccc

SEQ ID NO: 4060418 - DNA, 13 bp, Homo sapiens
catcttgctggct

SEQ ID NO: 4060419 - DNA, 14 bp, Homo sapiens
catcttgctggcta

SEQ ID NO: 4060420 - DNA, 19 bp, Homo sapiens
catctttaaacagtatttc

SEQ ID NO: 4060421 - DNA, 10 bp, Homo sapiens
catctttaag

SEQ ID NO: 4060422 - DNA, 16 bp, Homo sapiens
catctttatctgttct

SEQ ID NO: 4060423 - DNA, 15 bp, Homo sapiens
catctttgccttggg

SEQ ID NO: 4060424 - DNA, 21 bp, Homo sapiens
catcttttgaggcttctgttc

SEQ ID NO: 4060425 - DNA, 21 bp, Homo sapiens
catctttttaacctgcaaaat

SEQ ID NO: 4060426 - DNA, 15 bp, Homo sapiens
catgaaaaagcagct

SEQ ID NO: 4060427 - DNA, 16 bp, Homo sapiens
catgaaaacgttttat

SEQ ID NO: 4060428 - DNA, 13 bp, Homo sapiens
catgaaaatttta

SEQ ID NO: 4060429 - DNA, 17 bp, Homo sapiens
catgaaaattttaaaaa

SEQ ID NO: 4060430 - DNA, 13 bp, Homo sapiens
catgaaacaaagc

SEQ ID NO: 4060431 - DNA, 13 bp, Homo sapiens
catgaaaggcatc

SEQ ID NO: 4060432 - DNA, 15 bp, Homo sapiens
catgaaatatgcatc

SEQ ID NO: 4060433 - DNA, 18 bp, Homo sapiens
catgaacacccttagaaa

SEQ ID NO: 4060434 - DNA, 18 bp, Homo sapiens
catgaagaatagaaacaa

SEQ ID NO: 4060435 - DNA, 18 bp, Homo sapiens
catgaagagaagcaattt

SEQ ID NO: 4060436 - DNA, 13 bp, Homo sapiens
catgaagagcttg

SEQ ID NO: 4060437 - DNA, 17 bp, Homo sapiens
catgaagtaaattatgt

SEQ ID NO: 4060438 - DNA, 18 bp, Homo sapiens
catgaattcccttttaat

SEQ ID NO: 4060439 - DNA, 12 bp, Homo sapiens
catgacagaggc

SEQ ID NO: 4060440 - DNA, 14 bp, Homo sapiens
catgacagaggctg

SEQ ID NO: 4060441 - DNA, 14 bp, Homo sapiens
catgacagcctgca

SEQ ID NO: 4060442 - DNA, 18 bp, Homo sapiens
catgacatatgacttgat

SEQ ID NO: 4060443 - DNA, 14 bp, Homo sapiens
catgaccagtaaag

SEQ ID NO: 4060444 - DNA, 21 bp, Homo sapiens
catgctgttgcatttagaact

SEQ ID NO: 4060445 - DNA, 14 bp, Homo sapiens
catgcttcatcatt

SEQ ID NO: 4060446 - DNA, 19 bp, Homo sapiens
catgcttcccagagggagc

SEQ ID NO: 4060447 - DNA, 21 bp, Homo sapiens
catgcttcccagagggagcag

SEQ ID NO: 4060448 - DNA, 15 bp, Homo sapiens
catggaaaaatggtt

SEQ ID NO: 4060449 - DNA, 16 bp, Homo sapiens
catggaaaaatggttg

SEQ ID NO: 4060450 - DNA, 19 bp, Homo sapiens
catggaacttttctgtaat

SEQ ID NO: 4060451 - DNA, 18 bp, Homo sapiens
catggaatggacatcctg

SEQ ID NO: 4060452 - DNA, 23 bp, Homo sapiens
catggacaccccttatccaggac

SEQ ID NO: 4060453 - DNA, 14 bp, Homo sapiens
catggacactccag

SEQ ID NO: 4060454 - DNA, 16 bp, Homo sapiens
catggacaggctggct

SEQ ID NO: 4060455 - DNA, 18 bp, Homo sapiens
catggactgttgccacca

SEQ ID NO: 4060456 - DNA, 12 bp, Homo sapiens
catggacttgta

SEQ ID NO: 4060457 - DNA, 14 bp, Homo sapiens
catggagccagctc

SEQ ID NO: 4060458 - DNA, 17 bp, Homo sapiens
catggagccagctccct

SEQ ID NO: 4060459 - DNA, 15 bp, Homo sapiens
catggagccccctct

SEQ ID NO: 4060460 - DNA, 12 bp, Homo sapiens
catggagctgtc

SEQ ID NO: 4060461 - DNA, 14 bp, Homo sapiens
catggagtgtgtat

SEQ ID NO: 4060462 - DNA, 22 bp, Homo sapiens
catggagtgtgtattgttccca

SEQ ID NO: 4060463 - DNA, 19 bp, Homo sapiens
catggatgggggaactcag

SEQ ID NO: 4060464 - DNA, 23 bp, Homo sapiens
catggattttggataaatcattt

SEQ ID NO: 4060465 - DNA, 14 bp, Homo sapiens
catggatttttaca

SEQ ID NO: 4060466 - DNA, 21 bp, Homo sapiens
catggcagaataatctttggg

SEQ ID NO: 4060467 - DNA, 22 bp, Homo sapiens
catggcagaataatctttgggt

SEQ ID NO: 4060468 - DNA, 17 bp, Homo sapiens
catggcagctgtttctc

SEQ ID NO: 4060469 - DNA, 15 bp, Homo sapiens
catggcccccagggg

SEQ ID NO: 4060470 - DNA, 22 bp, Homo sapiens
catggcccccaggggcaggact

SEQ ID NO: 4060471 - DNA, 13 bp, Homo sapiens
catggcccctctg

SEQ ID NO: 4060472 - DNA, 12 bp, Homo sapiens
catggccctggg

SEQ ID NO: 4060473 - DNA, 16 bp, Homo sapiens
catggccctgtcccag

SEQ ID NO: 4060474 - DNA, 20 bp, Homo sapiens
catggcctattatattaaaa

SEQ ID NO: 4060475 - DNA, 19 bp, Homo sapiens
catggccttatgaggcagg

SEQ ID NO: 4060476 - DNA, 17 bp, Homo sapiens
catggctgtgtttgcag

SEQ ID NO: 4060477 - DNA, 13 bp, Homo sapiens
catggcttctgaa

SEQ ID NO: 4060478 - DNA, 23 bp, Homo sapiens
catgggaaactgttgtgggcgct

SEQ ID NO: 4060479 - DNA, 17 bp, Homo sapiens
catgggatatgtggtgt

SEQ ID NO: 4060480 - DNA, 21 bp, Homo sapiens
catgggcttcactgtataaat

SEQ ID NO: 4060481 - DNA, 17 bp, Homo sapiens
catggggccctcccaga

SEQ ID NO: 4060482 - DNA, 15 bp, Homo sapiens
catggggtttttatt

SEQ ID NO: 4060483 - DNA, 23 bp, Homo sapiens
catggggtttttattatttttac

SEQ ID NO: 4060484 - DNA, 19 bp, Homo sapiens
catgggtgaagggagagcc

SEQ ID NO: 4060485 - DNA, 14 bp, Homo sapiens
catggtcacacact

SEQ ID NO: 4060486 - DNA, 13 bp, Homo sapiens
catggtccctgcc

SEQ ID NO: 4060487 - DNA, 14 bp, Homo sapiens
catggtccctgcct

SEQ ID NO: 4060488 - DNA, 15 bp, Homo sapiens
catggtccctgcctt

SEQ ID NO: 4060489 - DNA, 17 bp, Homo sapiens
catggtccctgccttag

SEQ ID NO: 4060490 - DNA, 19 bp, Homo sapiens
catggtgaaaccccgtctc

SEQ ID NO: 4060491 - DNA, 16 bp, Homo sapiens
catggtgccccaggac

SEQ ID NO: 4060492 - DNA, 19 bp, Homo sapiens
catggtgccccaggaccag

SEQ ID NO: 4060493 - DNA, 13 bp, Homo sapiens
catggtgcctgag

SEQ ID NO: 4060494 - DNA, 14 bp, Homo sapiens
catggtgcctgaga

SEQ ID NO: 4060495 - DNA, 15 bp, Homo sapiens
catggtgcctgagag

SEQ ID NO: 4060496 - DNA, 22 bp, Homo sapiens
catggtgcctgagaggcaggca

SEQ ID NO: 4060497 - DNA, 22 bp, Homo sapiens
catggtggacccagcgggcagg

SEQ ID NO: 4060498 - DNA, 21 bp, Homo sapiens
catggtggatatggtgcagag

SEQ ID NO: 4060499 - DNA, 19 bp, Homo sapiens
catggtgggttcaggggac

SEQ ID NO: 4060500 - DNA, 15 bp, Homo sapiens
catggtgtaataaga

SEQ ID NO: 4060501 - DNA, 18 bp, Homo sapiens
catggtgtaataagacat

SEQ ID NO: 4060502 - DNA, 21 bp, Homo sapiens
catggtgtggggggctggggg

SEQ ID NO: 4060503 - DNA, 19 bp, Homo sapiens
catggttaaggtaaagtaa

SEQ ID NO: 4060504 - DNA, 16 bp, Homo sapiens
catggttgagaaatga

SEQ ID NO: 4060505 - DNA, 15 bp, Homo sapiens
catgtaaaacagaaa

SEQ ID NO: 4060506 - DNA, 17 bp, Homo sapiens
catgtaaaacagaaaaa

SEQ ID NO: 4060507 - DNA, 16 bp, Homo sapiens
catgtaaaagcggaaa

SEQ ID NO: 4060508 - DNA, 16 bp, Homo sapiens
catgtaaactatttgt

SEQ ID NO: 4060509 - DNA, 17 bp, Homo sapiens
catgtaaccggcatgtt

SEQ ID NO: 4060510 - DNA, 18 bp, Homo sapiens
catgtaaccggcatgttt

SEQ ID NO: 4060511 - DNA, 18 bp, Homo sapiens
catgtaattaagtactat

SEQ ID NO: 4060512 - DNA, 21 bp, Homo sapiens
catgtaattaagtactatgta

SEQ ID NO: 4060513 - DNA, 22 bp, Homo sapiens
catgtactgtagtttttcttca

SEQ ID NO: 4060514 - DNA, 17 bp, Homo sapiens
catgtagactgtgccag

SEQ ID NO: 4060515 - DNA, 19 bp, Homo sapiens
catgtagagaaaagcacac

SEQ ID NO: 4060516 - DNA, 17 bp, Homo sapiens
catgtagccccctggcc

SEQ ID NO: 4060517 - DNA, 20 bp, Homo sapiens
catgtagccccctggcctct

SEQ ID NO: 4060518 - DNA, 22 bp, Homo sapiens
catgtagccccctggcctctgt

SEQ ID NO: 4060519 - DNA, 16 bp, Homo sapiens
catgtagcttcttctg

SEQ ID NO: 4060520 - DNA, 17 bp, Homo sapiens
catgtagcttcttctga

SEQ ID NO: 4060521 - DNA, 14 bp, Homo sapiens
catgtatgttatga

SEQ ID NO: 4060522 - DNA, 18 bp, Homo sapiens
catgtatgttatgatatt

SEQ ID NO: 4060523 - DNA, 21 bp, Homo sapiens
catgtattgcacattgtaaaa

SEQ ID NO: 4060524 - DNA, 20 bp, Homo sapiens
catgtatttatctctattta

SEQ ID NO: 4060525 - DNA, 18 bp, Homo sapiens
catgtatttattcctctg

SEQ ID NO: 4060526 - DNA, 23 bp, Homo sapiens
catgtatttattcctctgtccta

SEQ ID NO: 4060527 - DNA, 13 bp, Homo sapiens
catgtattttgtt

SEQ ID NO: 4060528 - DNA, 22 bp, Homo sapiens
catgtcaacttctggctcctca

SEQ ID NO: 4060529 - DNA, 19 bp, Homo sapiens
catgtcaccggtcagtgcc

SEQ ID NO: 4060530 - DNA, 16 bp, Homo sapiens
catgtcaggcctgtgt

SEQ ID NO: 4060531 - DNA, 12 bp, Homo sapiens
catgtccaaaga

SEQ ID NO: 4060532 - DNA, 14 bp, Homo sapiens
catgtccaaagagg

SEQ ID NO: 4060533 - DNA, 16 bp, Homo sapiens
catgtccaaagaggct

SEQ ID NO: 4060534 - DNA, 17 bp, Homo sapiens
catgtccaaagaggctg

SEQ ID NO: 4060535 - DNA, 20 bp, Homo sapiens
catgtccaaagaggctgccc

SEQ ID NO: 4060536 - DNA, 15 bp, Homo sapiens
catgtccaagttctt

SEQ ID NO: 4060537 - DNA, 19 bp, Homo sapiens
catgtccatacactttgtt

SEQ ID NO: 4060538 - DNA, 22 bp, Homo sapiens
catgtccatacactttgttgca

SEQ ID NO: 4060539 - DNA, 18 bp, Homo sapiens
catgtcctgctggcttcc

SEQ ID NO: 4060540 - DNA, 20 bp, Homo sapiens
catgtcctgctggcttccag

SEQ ID NO: 4060541 - DNA, 21 bp, Homo sapiens
catgtcctgctggcttccagc

SEQ ID NO: 4060542 - DNA, 21 bp, Homo sapiens
catgtcctttgcgcctgtgac

SEQ ID NO: 4060543 - DNA, 22 bp, Homo sapiens
catgtcgctagccagtgctcca

SEQ ID NO: 4060544 - DNA, 22 bp, Homo sapiens
catgtctataatcccagcactt

SEQ ID NO: 4060545 - DNA, 17 bp, Homo sapiens
catgtctgcagtgtgcc

SEQ ID NO: 4060546 - DNA, 16 bp, Homo sapiens
cattccagtcaggctc

SEQ ID NO: 4060547 - DNA, 17 bp, Homo sapiens
cattccatcccttcctg

SEQ ID NO: 4060548 - DNA, 13 bp, Homo sapiens
cattccattgcct

SEQ ID NO: 4060549 - DNA, 16 bp, Homo sapiens
cattccattgcctagc

SEQ ID NO: 4060550 - DNA, 13 bp, Homo sapiens
cattccccatggg

SEQ ID NO: 4060551 - DNA, 19 bp, Homo sapiens
cattcccccaccagctgca

SEQ ID NO: 4060552 - DNA, 16 bp, Homo sapiens
cattcccgaggtcagc

SEQ ID NO: 4060553 - DNA, 19 bp, Homo sapiens
cattccctcgtctttccca

SEQ ID NO: 4060554 - DNA, 21 bp, Homo sapiens
cattccctctcatctcaggta

SEQ ID NO: 4060555 - DNA, 20 bp, Homo sapiens
cattccctctcctgcccaga

SEQ ID NO: 4060556 - DNA, 19 bp, Homo sapiens
cattccctgaatctgtgcc

SEQ ID NO: 4060557 - DNA, 20 bp, Homo sapiens
cattcctgaagaaccagtcc

SEQ ID NO: 4060558 - DNA, 21 bp, Homo sapiens
cattccttctggcctctgctg

SEQ ID NO: 4060559 - DNA, 15 bp, Homo sapiens
cattccttctttgat

SEQ ID NO: 4060560 - DNA, 23 bp, Homo sapiens
cattccttctttgataatgttaa

SEQ ID NO: 4060561 - DNA, 17 bp, Homo sapiens
cattccttgcgcctcag

SEQ ID NO: 4060562 - DNA, 19 bp, Homo sapiens
cattccttgcgcctcagcc

SEQ ID NO: 4060563 - DNA, 20 bp, Homo sapiens
cattccttgcgcctcagccc

SEQ ID NO: 4060564 - DNA, 18 bp, Homo sapiens
cattcgacataccccact

SEQ ID NO: 4060565 - DNA, 20 bp, Homo sapiens
cattctacagaataatccag

SEQ ID NO: 4060566 - DNA, 21 bp, Homo sapiens
cattctacagaataatccagt

SEQ ID NO: 4060567 - DNA, 14 bp, Homo sapiens
cattctacctgagg

SEQ ID NO: 4060568 - DNA, 15 bp, Homo sapiens
cattctactgaaaag

SEQ ID NO: 4060569 - DNA, 14 bp, Homo sapiens
cattctaggatgtg

SEQ ID NO: 4060570 - DNA, 16 bp, Homo sapiens
cattctaggatgtgga

SEQ ID NO: 4060571 - DNA, 14 bp, Homo sapiens
cattctagttcaga

SEQ ID NO: 4060572 - DNA, 17 bp, Homo sapiens
cattctatcaagcccag

SEQ ID NO: 4060573 - DNA, 18 bp, Homo sapiens
cattctatcaagcccagg

SEQ ID NO: 4060574 - DNA, 17 bp, Homo sapiens
cattctatcgttattat

SEQ ID NO: 4060575 - DNA, 16 bp, Homo sapiens
cattctattgccttct

SEQ ID NO: 4060576 - DNA, 20 bp, Homo sapiens
cattctattgccttctttga

SEQ ID NO: 4060577 - DNA, 21 bp, Homo sapiens
cattctattgccttctttgaa

SEQ ID NO: 4060578 - DNA, 16 bp, Homo sapiens
cattctattttagaat

SEQ ID NO: 4060579 - DNA, 14 bp, Homo sapiens
cattctcaagggac

SEQ ID NO: 4060580 - DNA, 22 bp, Homo sapiens
cattctcaagggacgtcctcca

SEQ ID NO: 4060581 - DNA, 14 bp, Homo sapiens
cattctcactccta

SEQ ID NO: 4060582 - DNA, 17 bp, Homo sapiens
cattctcactcctacct

SEQ ID NO: 4060583 - DNA, 16 bp, Homo sapiens
cattctcataattcct

SEQ ID NO: 4060584 - DNA, 13 bp, Homo sapiens
cattctcattgca

SEQ ID NO: 4060585 - DNA, 15 bp, Homo sapiens
cattctcccaggtac

SEQ ID NO: 4060586 - DNA, 21 bp, Homo sapiens
cattctcccaggtaccagctg

SEQ ID NO: 4060587 - DNA, 15 bp, Homo sapiens
cattctccccagtgt

SEQ ID NO: 4060588 - DNA, 15 bp, Homo sapiens
cattctcctgcctgt

SEQ ID NO: 4060589 - DNA, 15 bp, Homo sapiens
cattctgcattgcta

SEQ ID NO: 4060590 - DNA, 20 bp, Homo sapiens
cattctggaggggagagctt

SEQ ID NO: 4060591 - DNA, 11 bp, Homo sapiens
cattctgtcct

SEQ ID NO: 4060592 - DNA, 17 bp, Homo sapiens
cattctgtgatcattta

SEQ ID NO: 4060593 - DNA, 18 bp, Homo sapiens
cattctgttttcccccag

SEQ ID NO: 4060594 - DNA, 21 bp, Homo sapiens
cattctgttttcccccagcaa

SEQ ID NO: 4060595 - DNA, 22 bp, Homo sapiens
cattctgttttcccccagcaac

SEQ ID NO: 4060596 - DNA, 16 bp, Homo sapiens
cattcttctctgttgt

SEQ ID NO: 4060597 - DNA, 21 bp, Homo sapiens
cattcttctctgttgtcgtaa

SEQ ID NO: 4060598 - DNA, 16 bp, Homo sapiens
cattcttggcccagga

SEQ ID NO: 4060599 - DNA, 19 bp, Homo sapiens
cattcttgtcacaataaat

SEQ ID NO: 4060600 - DNA, 23 bp, Homo sapiens
cattcttgttttctttctttaaa

SEQ ID NO: 4060601 - DNA, 11 bp, Homo sapiens
cattgaaagag

SEQ ID NO: 4060602 - DNA, 22 bp, Homo sapiens
cattgaaagagaaccagtttca

SEQ ID NO: 4060603 - DNA, 19 bp, Homo sapiens
cattgaaatgagcacctcc

SEQ ID NO: 4060604 - DNA, 18 bp, Homo sapiens
cattgaaattctgagaaa

SEQ ID NO: 4060605 - DNA, 15 bp, Homo sapiens
cattgaacacaaact

SEQ ID NO: 4060606 - DNA, 16 bp, Homo sapiens
cattgaacacaaactg

SEQ ID NO: 4060607 - DNA, 18 bp, Homo sapiens
cattgaagccgactctgg

SEQ ID NO: 4060608 - DNA, 20 bp, Homo sapiens
cattgaatgcgctttattgc

SEQ ID NO: 4060609 - DNA, 14 bp, Homo sapiens
cattgacaccagaa

SEQ ID NO: 4060610 - DNA, 18 bp, Homo sapiens
cattgaccaagaactgca

SEQ ID NO: 4060611 - DNA, 16 bp, Homo sapiens
cattgaccgcaactca

SEQ ID NO: 4060612 - DNA, 15 bp, Homo sapiens
cattgacctatttcc

SEQ ID NO: 4060613 - DNA, 21 bp, Homo sapiens
cattgacctatttccagaaat

SEQ ID NO: 4060614 - DNA, 22 bp, Homo sapiens
cattgacctctcagggcctggc

SEQ ID NO: 4060615 - DNA, 20 bp, Homo sapiens
cattgactttcagtaaacat

SEQ ID NO: 4060616 - DNA, 22 bp, Homo sapiens
cattgactttcagtaaacataa

SEQ ID NO: 4060617 - DNA, 15 bp, Homo sapiens
cattgaggaaatatt

SEQ ID NO: 4060618 - DNA, 17 bp, Homo sapiens
cattgaggaagagtctt

SEQ ID NO: 4060619 - DNA, 23 bp, Homo sapiens
cattgaggatggaaactggactc

SEQ ID NO: 4060620 - DNA, 20 bp, Homo sapiens
cattgatcctagtgtcttta

SEQ ID NO: 4060621 - DNA, 18 bp, Homo sapiens
cattgcactctagcctgg

SEQ ID NO: 4060622 - DNA, 17 bp, Homo sapiens
cattgccaccaggagaa

SEQ ID NO: 4060623 - DNA, 22 bp, Homo sapiens
cattgccccaaatggattcctg

SEQ ID NO: 4060624 - DNA, 17 bp, Homo sapiens
cattgccgctgtataaa

SEQ ID NO: 4060625 - DNA, 22 bp, Homo sapiens
cattgccgctgtataaagcatg

SEQ ID NO: 4060626 - DNA, 22 bp, Homo sapiens
cattgcctaactactagttttt

SEQ ID NO: 4060627 - DNA, 21 bp, Homo sapiens
cattgcctgactaaaatgttt

SEQ ID NO: 4060628 - DNA, 16 bp, Homo sapiens
cattgcggccccagga

SEQ ID NO: 4060629 - DNA, 19 bp, Homo sapiens
cattgcggccccaggaggg

SEQ ID NO: 4060630 - DNA, 14 bp, Homo sapiens
cattgctgagcctc

SEQ ID NO: 4060631 - DNA, 16 bp, Homo sapiens
cattgctgagcctctg

SEQ ID NO: 4060632 - DNA, 14 bp, Homo sapiens
cattgctgttatgt

SEQ ID NO: 4060633 - DNA, 20 bp, Homo sapiens
cattgctgttatgtctgttt

SEQ ID NO: 4060634 - DNA, 21 bp, Homo sapiens
cattgctgttgtccctctgct

SEQ ID NO: 4060635 - DNA, 18 bp, Homo sapiens
cattgcttttattttgaa

SEQ ID NO: 4060636 - DNA, 16 bp, Homo sapiens
cattggaatgttctca

SEQ ID NO: 4060637 - DNA, 18 bp, Homo sapiens
cattggaatgttctcaga

SEQ ID NO: 4060638 - DNA, 23 bp, Homo sapiens
cattggcaagatgaaataatttt

SEQ ID NO: 4060639 - DNA, 21 bp, Homo sapiens
cattggcacctaatccaggca

SEQ ID NO: 4060640 - DNA, 18 bp, Homo sapiens
cattggctatttaaaact

SEQ ID NO: 4060641 - DNA, 19 bp, Homo sapiens
cattggctatttaaaactt

SEQ ID NO: 4060642 - DNA, 18 bp, Homo sapiens
cattgggcacagtccaga

SEQ ID NO: 4060643 - DNA, 19 bp, Homo sapiens
cattggggggccgggcagg

SEQ ID NO: 4060644 - DNA, 17 bp, Homo sapiens
cattggttggaagctac

SEQ ID NO: 4060645 - DNA, 16 bp, Homo sapiens
cattgtaatgttactg

SEQ ID NO: 4060646 - DNA, 21 bp, Homo sapiens
cattgtaatgttactgatcat

SEQ ID NO: 4060647 - DNA, 15 bp, Homo sapiens
cattgtactacctgt

SEQ ID NO: 4060648 - DNA, 20 bp, Homo sapiens
ccaacccccgccacctcagg

SEQ ID NO: 4060649 - DNA, 19 bp, Homo sapiens
ccaaccctaggttccctgt

SEQ ID NO: 4060650 - DNA, 14 bp, Homo sapiens
ccaaccctcagagc

SEQ ID NO: 4060651 - DNA, 20 bp, Homo sapiens
ccaacctcagggctcccagg

SEQ ID NO: 4060652 - DNA, 14 bp, Homo sapiens
ccaacctcctgacc

SEQ ID NO: 4060653 - DNA, 12 bp, Homo sapiens
ccaacctgctga

SEQ ID NO: 4060654 - DNA, 21 bp, Homo sapiens
ccaaccttcacatctgtcacg

SEQ ID NO: 4060655 - DNA, 13 bp, Homo sapiens
ccaacctttaaaa

SEQ ID NO: 4060656 - DNA, 21 bp, Homo sapiens
ccaacggccctgcagccagct

SEQ ID NO: 4060657 - DNA, 17 bp, Homo sapiens
ccaactagctgggacta

SEQ ID NO: 4060658 - DNA, 12 bp, Homo sapiens
ccaactgcccta

SEQ ID NO: 4060659 - DNA, 21 bp, Homo sapiens
ccaactgccctaagcccccag

SEQ ID NO: 4060660 - DNA, 16 bp, Homo sapiens
ccaactgggcccaaga

SEQ ID NO: 4060661 - DNA, 21 bp, Homo sapiens
ccaacttcatttgatgctaaa

SEQ ID NO: 4060662 - DNA, 13 bp, Homo sapiens
ccaacttcccagt

SEQ ID NO: 4060663 - DNA, 16 bp, Homo sapiens
ccaacttcttcctgtg

SEQ ID NO: 4060664 - DNA, 23 bp, Homo sapiens
ccaacttgtattaaagacagagg

SEQ ID NO: 4060665 - DNA, 18 bp, Homo sapiens
ccaagaaaatgaagggat

SEQ ID NO: 4060666 - DNA, 19 bp, Homo sapiens
ccaagacagatgccccaga

SEQ ID NO: 4060667 - DNA, 21 bp, Homo sapiens
ccaagacagatgccccagagc

SEQ ID NO: 4060668 - DNA, 24 bp, Homo sapiens
ccaagacagatgccccagagctgt

SEQ ID NO: 4060669 - DNA, 12 bp, Homo sapiens
ccaagacattgt

SEQ ID NO: 4060670 - DNA, 17 bp, Homo sapiens
ccaagacattgtcaata

SEQ ID NO: 4060671 - DNA, 20 bp, Homo sapiens
ccaagagcagagtctgggcc

SEQ ID NO: 4060672 - DNA, 21 bp, Homo sapiens
ccaagagcagagtctgggcct

SEQ ID NO: 4060673 - DNA, 23 bp, Homo sapiens
ccaagagcagagtctgggcctct

SEQ ID NO: 4060674 - DNA, 22 bp, Homo sapiens
ccaagaggtttggctcctgccc

SEQ ID NO: 4060675 - DNA, 23 bp, Homo sapiens
ccaagaggtttggctcctgccca

SEQ ID NO: 4060676 - DNA, 15 bp, Homo sapiens
ccaagagtaacttta

SEQ ID NO: 4060677 - DNA, 14 bp, Homo sapiens
ccaagcacagcagc

SEQ ID NO: 4060678 - DNA, 15 bp, Homo sapiens
ccaagcacagcagcc

SEQ ID NO: 4060679 - DNA, 18 bp, Homo sapiens
ccaagcacagcagcctgg

SEQ ID NO: 4060680 - DNA, 20 bp, Homo sapiens
ccaagcaggacgaaaaagag

SEQ ID NO: 4060681 - DNA, 14 bp, Homo sapiens
ccaagcaggagacg

SEQ ID NO: 4060682 - DNA, 13 bp, Homo sapiens
ccaagcccaaact

SEQ ID NO: 4060683 - DNA, 14 bp, Homo sapiens
ccaagccgtggctt

SEQ ID NO: 4060684 - DNA, 16 bp, Homo sapiens
ccaagccgtggcttcc

SEQ ID NO: 4060685 - DNA, 17 bp, Homo sapiens
ccaagccgtggcttccc

SEQ ID NO: 4060686 - DNA, 17 bp, Homo sapiens
ccaagccttaaactgta

SEQ ID NO: 4060687 - DNA, 15 bp, Homo sapiens
ccaagctatctaaag

SEQ ID NO: 4060688 - DNA, 17 bp, Homo sapiens
ccaagctattcaattct

SEQ ID NO: 4060689 - DNA, 17 bp, Homo sapiens
ccaagctgagtttccta

SEQ ID NO: 4060690 - DNA, 18 bp, Homo sapiens
ccaagctgagtttcctat

SEQ ID NO: 4060691 - DNA, 12 bp, Homo sapiens
ccaagcttccct

SEQ ID NO: 4060692 - DNA, 23 bp, Homo sapiens
ccaagctttcttctacaaccaga

SEQ ID NO: 4060693 - DNA, 22 bp, Homo sapiens
ccaaggactgagcaccctctgg

SEQ ID NO: 4060694 - DNA, 22 bp, Homo sapiens
ccaaggagaccaagtcctggct

SEQ ID NO: 4060695 - DNA, 11 bp, Homo sapiens
ccaaggatccc

SEQ ID NO: 4060696 - DNA, 18 bp, Homo sapiens
ccaaggatcggactctgc

SEQ ID NO: 4060697 - DNA, 19 bp, Homo sapiens
ccaaggccccctgcctgcc

SEQ ID NO: 4060698 - DNA, 21 bp, Homo sapiens
ccaaggcggcccctcccgccc

SEQ ID NO: 4060699 - DNA, 21 bp, Homo sapiens
ccaaggggtgggcctgtgaat

SEQ ID NO: 4060700 - DNA, 23 bp, Homo sapiens
ccaagggtatccaagttggactg

SEQ ID NO: 4060701 - DNA, 15 bp, Homo sapiens
ccaagggttgagagc

SEQ ID NO: 4060702 - DNA, 18 bp, Homo sapiens
ccaagggttgagagccag

SEQ ID NO: 4060703 - DNA, 19 bp, Homo sapiens
ccaagggttgagagccagt

SEQ ID NO: 4060704 - DNA, 23 bp, Homo sapiens
ccaaggtcccctccacatcccag

SEQ ID NO: 4060705 - DNA, 16 bp, Homo sapiens
ccaaggtcctctcagt

SEQ ID NO: 4060706 - DNA, 17 bp, Homo sapiens
ccaagtcacacagctag

SEQ ID NO: 4060707 - DNA, 14 bp, Homo sapiens
ccaagtctcagtgg

SEQ ID NO: 4060708 - DNA, 17 bp, Homo sapiens
ccaagtgcactttctaa

SEQ ID NO: 4060709 - DNA, 19 bp, Homo sapiens
ccaagtgccccctcacctc

SEQ ID NO: 4060710 - DNA, 21 bp, Homo sapiens
ccaagtgccccctcacctctc

SEQ ID NO: 4060711 - DNA, 19 bp, Homo sapiens
ccaagtggggatggggcct

SEQ ID NO: 4060712 - DNA, 16 bp, Homo sapiens
ccaagtggggtgctgg

SEQ ID NO: 4060713 - DNA, 14 bp, Homo sapiens
ccaagtggtcagga

SEQ ID NO: 4060714 - DNA, 22 bp, Homo sapiens
ccaagttataaatcaatgtcac

SEQ ID NO: 4060715 - DNA, 19 bp, Homo sapiens
ccaagttccgtcagtccaa

SEQ ID NO: 4060716 - DNA, 14 bp, Homo sapiens
ccaataaaaagttc

SEQ ID NO: 4060717 - DNA, 16 bp, Homo sapiens
ccaataaaaagttcag

SEQ ID NO: 4060718 - DNA, 13 bp, Homo sapiens
ccaataaaccagg

SEQ ID NO: 4060719 - DNA, 11 bp, Homo sapiens
ccaataaccaa

SEQ ID NO: 4060720 - DNA, 18 bp, Homo sapiens
ccaatattaaatctgctg

SEQ ID NO: 4060721 - DNA, 20 bp, Homo sapiens
ccaatattttctttaatgct

SEQ ID NO: 4060722 - DNA, 22 bp, Homo sapiens
ccaatattttctttaatgcttt

SEQ ID NO: 4060723 - DNA, 12 bp, Homo sapiens
ccaatcatttta

SEQ ID NO: 4060724 - DNA, 22 bp, Homo sapiens
ccaatcattttaattattattc

SEQ ID NO: 4060725 - DNA, 18 bp, Homo sapiens
ccaatcccgtgaaagaat

SEQ ID NO: 4060726 - DNA, 15 bp, Homo sapiens
ccaatccctgatccc

SEQ ID NO: 4060727 - DNA, 17 bp, Homo sapiens
ccaatcctcactgggtg

SEQ ID NO: 4060728 - DNA, 15 bp, Homo sapiens
ccaatctgcacactc

SEQ ID NO: 4060729 - DNA, 23 bp, Homo sapiens
ccaatctggcccttacacactca

SEQ ID NO: 4060730 - DNA, 24 bp, Homo sapiens
ccaatcttgctttgtgtatctcat

SEQ ID NO: 4060731 - DNA, 23 bp, Homo sapiens
ccaatgaaatacacaagtaaaca

SEQ ID NO: 4060732 - DNA, 17 bp, Homo sapiens
ccaatgacttccctgct

SEQ ID NO: 4060733 - DNA, 15 bp, Homo sapiens
ccaatgatggtcacc

SEQ ID NO: 4060734 - DNA, 18 bp, Homo sapiens
ccaatgccccactggcag

SEQ ID NO: 4060735 - DNA, 19 bp, Homo sapiens
ccaatggtgatcctctatt

SEQ ID NO: 4060736 - DNA, 12 bp, Homo sapiens
ccaatgttttcc

SEQ ID NO: 4060737 - DNA, 18 bp, Homo sapiens
ccaatgttttccacccat

SEQ ID NO: 4060738 - DNA, 17 bp, Homo sapiens
ccaattaggaagtgtaa

SEQ ID NO: 4060739 - DNA, 22 bp, Homo sapiens
ccaattatatgagacgtttttg

SEQ ID NO: 4060740 - DNA, 18 bp, Homo sapiens
ccaattattgttacacat

SEQ ID NO: 4060741 - DNA, 13 bp, Homo sapiens
ccaattggaggaa

SEQ ID NO: 4060742 - DNA, 16 bp, Homo sapiens
ccaatttcagactccc

SEQ ID NO: 4060743 - DNA, 20 bp, Homo sapiens
ccaatttcggattttttcca

SEQ ID NO: 4060744 - DNA, 21 bp, Homo sapiens
ccaatttcggattttttccaa

SEQ ID NO: 4060745 - DNA, 22 bp, Homo sapiens
ccaatttcggattttttccaaa

SEQ ID NO: 4060746 - DNA, 23 bp, Homo sapiens
ccaatttcggattttttccaaaa

SEQ ID NO: 4060747 - DNA, 24 bp, Homo sapiens
ccacaaggaataaatgagagggaa

SEQ ID NO: 4060748 - DNA, 17 bp, Homo sapiens
ccacaaggacttcctgt

SEQ ID NO: 4060749 - DNA, 14 bp, Homo sapiens
ccacaagggctctc

SEQ ID NO: 4060750 - DNA, 18 bp, Homo sapiens
ccagacccctggcttttc

SEQ ID NO: 4060751 - DNA, 24 bp, Homo sapiens
ccagacccctggcttttcactgct

SEQ ID NO: 4060752 - DNA, 18 bp, Homo sapiens
ccagacccttcttgcctg

SEQ ID NO: 4060753 - DNA, 18 bp, Homo sapiens
ccagacctgatcctggag

SEQ ID NO: 4060754 - DNA, 23 bp, Homo sapiens
ccagacctgatcctggaggccca

SEQ ID NO: 4060755 - DNA, 15 bp, Homo sapiens
ccagaccttaataaa

SEQ ID NO: 4060756 - DNA, 18 bp, Homo sapiens
ccagacgctgccgctgcc

SEQ ID NO: 4060757 - DNA, 22 bp, Homo sapiens
ccagacgtcaggccctgactcc

SEQ ID NO: 4060758 - DNA, 19 bp, Homo sapiens
ccagactaaaggatccaga

SEQ ID NO: 4060759 - DNA, 23 bp, Homo sapiens
ccagactaaaggatccagagagc

SEQ ID NO: 4060760 - DNA, 12 bp, Homo sapiens
ccagactacagg

SEQ ID NO: 4060761 - DNA, 16 bp, Homo sapiens
ccagactacttgggag

SEQ ID NO: 4060762 - DNA, 14 bp, Homo sapiens
ccagacttccttga

SEQ ID NO: 4060763 - DNA, 18 bp, Homo sapiens
ccagagaaacccagggag

SEQ ID NO: 4060764 - DNA, 16 bp, Homo sapiens
ccagagaaaggggagc

SEQ ID NO: 4060765 - DNA, 15 bp, Homo sapiens
ccagagagaggatgt

SEQ ID NO: 4060766 - DNA, 16 bp, Homo sapiens
ccagagaggcactcag

SEQ ID NO: 4060767 - DNA, 15 bp, Homo sapiens
ccagagagtggctcc

SEQ ID NO: 4060768 - DNA, 13 bp, Homo sapiens
ccagagatccaaa

SEQ ID NO: 4060769 - DNA, 20 bp, Homo sapiens
ccagagatccaaaagaagcc

SEQ ID NO: 4060770 - DNA, 19 bp, Homo sapiens
ccagagcaaccagaaggag

SEQ ID NO: 4060771 - DNA, 15 bp, Homo sapiens
ccagagcaacctctc

SEQ ID NO: 4060772 - DNA, 19 bp, Homo sapiens
ccagagcaacctctcactc

SEQ ID NO: 4060773 - DNA, 14 bp, Homo sapiens
ccagagcagatgca

SEQ ID NO: 4060774 - DNA, 20 bp, Homo sapiens
ccagagcagatgcagagagc

SEQ ID NO: 4060775 - DNA, 19 bp, Homo sapiens
ccagagcattccagtcagg

SEQ ID NO: 4060776 - DNA, 21 bp, Homo sapiens
ccagagcatttccaacaccac

SEQ ID NO: 4060777 - DNA, 22 bp, Homo sapiens
ccagagcatttccaacaccaca

SEQ ID NO: 4060778 - DNA, 23 bp, Homo sapiens
ccagagcatttccaacaccacag

SEQ ID NO: 4060779 - DNA, 15 bp, Homo sapiens
ccagagccacctgga

SEQ ID NO: 4060780 - DNA, 11 bp, Homo sapiens
ccagagccaga

SEQ ID NO: 4060781 - DNA, 16 bp, Homo sapiens
ccagagccagatgcag

SEQ ID NO: 4060782 - DNA, 21 bp, Homo sapiens
ccagagccagatgcaggacag

SEQ ID NO: 4060783 - DNA, 23 bp, Homo sapiens
ccagagccaggggggtgaggagc

SEQ ID NO: 4060784 - DNA, 14 bp, Homo sapiens
ccagagccccccac

SEQ ID NO: 4060785 - DNA, 16 bp, Homo sapiens
ccagagccccccacaa

SEQ ID NO: 4060786 - DNA, 21 bp, Homo sapiens
ccagagctgggaggcatggcc

SEQ ID NO: 4060787 - DNA, 20 bp, Homo sapiens
ccagagctgggtggggacag

SEQ ID NO: 4060788 - DNA, 19 bp, Homo sapiens
ccagagctgtttatggcct

SEQ ID NO: 4060789 - DNA, 24 bp, Homo sapiens
ccagagctgtttatggcctcagct

SEQ ID NO: 4060790 - DNA, 21 bp, Homo sapiens
ccagaggaactgtccagagag

SEQ ID NO: 4060791 - DNA, 22 bp, Homo sapiens
ccagaggaactgtccagagagc

SEQ ID NO: 4060792 - DNA, 21 bp, Homo sapiens
ccagaggaataacttagcttg

SEQ ID NO: 4060793 - DNA, 13 bp, Homo sapiens
ccagaggagggca

SEQ ID NO: 4060794 - DNA, 15 bp, Homo sapiens
ccagaggagggcaga

SEQ ID NO: 4060795 - DNA, 18 bp, Homo sapiens
ccagaggccgaaggtgcc

SEQ ID NO: 4060796 - DNA, 13 bp, Homo sapiens
ccagaggctggga

SEQ ID NO: 4060797 - DNA, 14 bp, Homo sapiens
ccagaggctgggag

SEQ ID NO: 4060798 - DNA, 17 bp, Homo sapiens
ccagaggctgggagtcc

SEQ ID NO: 4060799 - DNA, 22 bp, Homo sapiens
ccagagggagcaggccggaacc

SEQ ID NO: 4060800 - DNA, 20 bp, Homo sapiens
ccagagggtgtggctttcca

SEQ ID NO: 4060801 - DNA, 17 bp, Homo sapiens
ccagaggtaacagaaca

SEQ ID NO: 4060802 - DNA, 22 bp, Homo sapiens
ccagaggtaacagaacagcttc

SEQ ID NO: 4060803 - DNA, 23 bp, Homo sapiens
ccagaggtaacagaacagcttca

SEQ ID NO: 4060804 - DNA, 21 bp, Homo sapiens
tctggctgagctgaacccatt

SEQ ID NO: 4060805 - DNA, 14 bp, Homo sapiens
tctggctgtctaga

SEQ ID NO: 4060806 - DNA, 19 bp, Homo sapiens
tctggctgtctagaatgtg

SEQ ID NO: 4060807 - DNA, 14 bp, Homo sapiens
tctggctgtttagc

SEQ ID NO: 4060808 - DNA, 18 bp, Homo sapiens
tctggctgtttagcagaa

SEQ ID NO: 4060809 - DNA, 21 bp, Homo sapiens
tctggctttcccaggagatgg

SEQ ID NO: 4060810 - DNA, 16 bp, Homo sapiens
tctgggacctcagttt

SEQ ID NO: 4060811 - DNA, 21 bp, Homo sapiens
tctgggagcagaaacagccat

SEQ ID NO: 4060812 - DNA, 14 bp, Homo sapiens
tctgggagctggag

SEQ ID NO: 4060813 - DNA, 17 bp, Homo sapiens
tctgggaggcaagaaaa

SEQ ID NO: 4060814 - DNA, 15 bp, Homo sapiens
tctgggagtcacaca

SEQ ID NO: 4060815 - DNA, 18 bp, Homo sapiens
tctgggataagtaagttt

SEQ ID NO: 4060816 - DNA, 17 bp, Homo sapiens
tctgggcattttcctcc

SEQ ID NO: 4060817 - DNA, 22 bp, Homo sapiens
tctgggcattttcctcctctgc

SEQ ID NO: 4060818 - DNA, 21 bp, Homo sapiens
tctgggccattctccacagca

SEQ ID NO: 4060819 - DNA, 12 bp, Homo sapiens
tctgggcctctg

SEQ ID NO: 4060820 - DNA, 12 bp, Homo sapiens
tctgggcctgac

SEQ ID NO: 4060821 - DNA, 21 bp, Homo sapiens
tctgggctcctggaaccaatc

SEQ ID NO: 4060822 - DNA, 17 bp, Homo sapiens
tctgggctgctacccag

SEQ ID NO: 4060823 - DNA, 22 bp, Homo sapiens
tctgggctgtaacgtggcactg

SEQ ID NO: 4060824 - DNA, 19 bp, Homo sapiens
tctgggcttggggcttcct

SEQ ID NO: 4060825 - DNA, 21 bp, Homo sapiens
tctggggaccccaacctcaga

SEQ ID NO: 4060826 - DNA, 15 bp, Homo sapiens
tctggggcagatccc

SEQ ID NO: 4060827 - DNA, 17 bp, Homo sapiens
tctggggcagcccccat

SEQ ID NO: 4060828 - DNA, 17 bp, Homo sapiens
tctggggcaggctgggc

SEQ ID NO: 4060829 - DNA, 16 bp, Homo sapiens
tctggggccctgggcc

SEQ ID NO: 4060830 - DNA, 19 bp, Homo sapiens
tctggggccctgggcctca

SEQ ID NO: 4060831 - DNA, 16 bp, Homo sapiens
tctgggtatctttcca

SEQ ID NO: 4060832 - DNA, 22 bp, Homo sapiens
tctgggtctgattttctcactg

SEQ ID NO: 4060833 - DNA, 14 bp, Homo sapiens
tctgggtttctaga

SEQ ID NO: 4060834 - DNA, 16 bp, Homo sapiens
tctgggtttgagaaat

SEQ ID NO: 4060835 - DNA, 18 bp, Homo sapiens
tctggtagatagaaataa

SEQ ID NO: 4060836 - DNA, 16 bp, Homo sapiens
tctggtgtgtggtgag

SEQ ID NO: 4060837 - DNA, 22 bp, Homo sapiens
tctggttgtttctgttccaaat

SEQ ID NO: 4060838 - DNA, 16 bp, Homo sapiens
tctggtttctcattct

SEQ ID NO: 4060839 - DNA, 18 bp, Homo sapiens
tctggtttggcatggtga

SEQ ID NO: 4060840 - DNA, 19 bp, Homo sapiens
tctgtaaaaacactgaaaa

SEQ ID NO: 4060841 - DNA, 13 bp, Homo sapiens
tctgtaaataacc

SEQ ID NO: 4060842 - DNA, 14 bp, Homo sapiens
tctgtagctcctca

SEQ ID NO: 4060843 - DNA, 15 bp, Homo sapiens
tctgtagggctggac

SEQ ID NO: 4060844 - DNA, 17 bp, Homo sapiens
tctgtagggctggacct

SEQ ID NO: 4060845 - DNA, 19 bp, Homo sapiens
tctgtagtcatttactaaa

SEQ ID NO: 4060846 - DNA, 14 bp, Homo sapiens
tctgtataaatgtc

SEQ ID NO: 4060847 - DNA, 17 bp, Homo sapiens
tctgtataaatgtctat

SEQ ID NO: 4060848 - DNA, 18 bp, Homo sapiens
tctgtatcggagacagtg

SEQ ID NO: 4060849 - DNA, 13 bp, Homo sapiens
tctgtatttcctt

SEQ ID NO: 4060850 - DNA, 13 bp, Homo sapiens
tctgtcaccaaat

SEQ ID NO: 4060851 - DNA, 22 bp, Homo sapiens
tctgtcagccagccgccctggg

SEQ ID NO: 4060852 - DNA, 17 bp, Homo sapiens
tctgtcagtcacagcca

SEQ ID NO: 4060853 - DNA, 13 bp, Homo sapiens
tctgtcatttgtt

SEQ ID NO: 4060854 - DNA, 18 bp, Homo sapiens
tctgtccaactgagaagt

SEQ ID NO: 4060855 - DNA, 16 bp, Homo sapiens
tctgtccatggccttt

SEQ ID NO: 4060856 - DNA, 15 bp, Homo sapiens
tctgtcccaccccta

SEQ ID NO: 4060857 - DNA, 23 bp, Homo sapiens
tctgtcccactacatctgggact

SEQ ID NO: 4060858 - DNA, 22 bp, Homo sapiens
tctgtccccagccctgtcctgg

SEQ ID NO: 4060859 - DNA, 15 bp, Homo sapiens
tctgtcccccaggct

SEQ ID NO: 4060860 - DNA, 23 bp, Homo sapiens
tctgtccctgagagtgtctctga

SEQ ID NO: 4060861 - DNA, 16 bp, Homo sapiens
tctgtcccttgctgta

SEQ ID NO: 4060862 - DNA, 17 bp, Homo sapiens
tctgtcccttgctgtat

SEQ ID NO: 4060863 - DNA, 13 bp, Homo sapiens
tctgtcctcagcc

SEQ ID NO: 4060864 - DNA, 14 bp, Homo sapiens
tctgtcctcagcct

SEQ ID NO: 4060865 - DNA, 15 bp, Homo sapiens
tctgtcctcagcctt

SEQ ID NO: 4060866 - DNA, 19 bp, Homo sapiens
tctgtcctcagccttgcca

SEQ ID NO: 4060867 - DNA, 13 bp, Homo sapiens
tctgtcctgggca

SEQ ID NO: 4060868 - DNA, 14 bp, Homo sapiens
tctgtccttcagat

SEQ ID NO: 4060869 - DNA, 17 bp, Homo sapiens
tctgtctcatcctcctg

SEQ ID NO: 4060870 - DNA, 22 bp, Homo sapiens
tctgtctcccagttatgaatca

SEQ ID NO: 4060871 - DNA, 13 bp, Homo sapiens
tctgtctgccctt

SEQ ID NO: 4060872 - DNA, 22 bp, Homo sapiens
tctgtctgctggtcacttcttc

SEQ ID NO: 4060873 - DNA, 14 bp, Homo sapiens
tctgtctgctttgg

SEQ ID NO: 4060874 - DNA, 12 bp, Homo sapiens
tctgtctggcac

SEQ ID NO: 4060875 - DNA, 14 bp, Homo sapiens
tctgtcttaaatga

SEQ ID NO: 4060876 - DNA, 22 bp, Homo sapiens
tctgtcttaaatgagaagtact

SEQ ID NO: 4060877 - DNA, 14 bp, Homo sapiens
tctgtctttcctga

SEQ ID NO: 4060878 - DNA, 16 bp, Homo sapiens
tctgtgaaagtacatt

SEQ ID NO: 4060879 - DNA, 17 bp, Homo sapiens
tctgtgaacagagagac

SEQ ID NO: 4060880 - DNA, 17 bp, Homo sapiens
tctgtgaacgatttaga

SEQ ID NO: 4060881 - DNA, 19 bp, Homo sapiens
tctgtgaagaggaacagtg

SEQ ID NO: 4060882 - DNA, 20 bp, Homo sapiens
tctgtgaagaggaacagtgt

SEQ ID NO: 4060883 - DNA, 16 bp, Homo sapiens
tctgtgaatacaatta

SEQ ID NO: 4060884 - DNA, 22 bp, Homo sapiens
tctgtgaatacaattaaaggtc

SEQ ID NO: 4060885 - DNA, 23 bp, Homo sapiens
tctgtgagaggcagctatctgca

SEQ ID NO: 4060886 - DNA, 16 bp, Homo sapiens
tctgtgaggtgctgat

SEQ ID NO: 4060887 - DNA, 22 bp, Homo sapiens
tctgtgatcaccctctcggcct

SEQ ID NO: 4060888 - DNA, 15 bp, Homo sapiens
tctgtgatcttttaa

SEQ ID NO: 4060889 - DNA, 19 bp, Homo sapiens
tctgtgcagggctggtttg

SEQ ID NO: 4060890 - DNA, 16 bp, Homo sapiens
tctgtgccagaaacag

SEQ ID NO: 4060891 - DNA, 15 bp, Homo sapiens
tctgtgccatggatt

SEQ ID NO: 4060892 - DNA, 16 bp, Homo sapiens
tctgtgccatggattt

SEQ ID NO: 4060893 - DNA, 17 bp, Homo sapiens
tctgtgccccatgcctg

SEQ ID NO: 4060894 - DNA, 21 bp, Homo sapiens
tctgtggcttcccatgtcttt

SEQ ID NO: 4060895 - DNA, 12 bp, Homo sapiens
tctgtgggcccc

SEQ ID NO: 4060896 - DNA, 17 bp, Homo sapiens
tctgtgggcccctcaac

SEQ ID NO: 4060897 - DNA, 15 bp, Homo sapiens
tcttggtagagattc

SEQ ID NO: 4060898 - DNA, 13 bp, Homo sapiens
tcttggtcagctt

SEQ ID NO: 4060899 - DNA, 20 bp, Homo sapiens
tcttggtgccttttgtgtga

SEQ ID NO: 4060900 - DNA, 22 bp, Homo sapiens
tcttggtgccttttgtgtgatg

SEQ ID NO: 4060901 - DNA, 23 bp, Homo sapiens
tcttggtgccttttgtgtgatgc

SEQ ID NO: 4060902 - DNA, 13 bp, Homo sapiens
tcttggtgctctg

SEQ ID NO: 4060903 - DNA, 22 bp, Homo sapiens
tcttggtttctctctacagtgc

SEQ ID NO: 4060904 - DNA, 13 bp, Homo sapiens
tcttgtaaagact

SEQ ID NO: 4060905 - DNA, 16 bp, Homo sapiens
tcttgtagtagtctca

SEQ ID NO: 4060906 - DNA, 16 bp, Homo sapiens
tcttgtattaaactct

SEQ ID NO: 4060907 - DNA, 23 bp, Homo sapiens
tcttgtcccctcttgacccatct

SEQ ID NO: 4060908 - DNA, 20 bp, Homo sapiens
tcttgtccctttccctacct

SEQ ID NO: 4060909 - DNA, 16 bp, Homo sapiens
tcttgtcctcttctgc

SEQ ID NO: 4060910 - DNA, 12 bp, Homo sapiens
tcttgtctttat

SEQ ID NO: 4060911 - DNA, 20 bp, Homo sapiens
tcttgtgcaaggtggccttt

SEQ ID NO: 4060912 - DNA, 17 bp, Homo sapiens
tcttgtggtgtaaagct

SEQ ID NO: 4060913 - DNA, 15 bp, Homo sapiens
tcttgtttccttgtt

SEQ ID NO: 4060914 - DNA, 17 bp, Homo sapiens
tcttgttttaagcaaat

SEQ ID NO: 4060915 - DNA, 22 bp, Homo sapiens
tcttgttttaagcaaatgcatt

SEQ ID NO: 4060916 - DNA, 22 bp, Homo sapiens
tcttgttttgtcttgaaagtgg

SEQ ID NO: 4060917 - DNA, 15 bp, Homo sapiens
tcttgtttttattaa

SEQ ID NO: 4060918 - DNA, 20 bp, Homo sapiens
tcttgtttttattaatttat

SEQ ID NO: 4060919 - DNA, 21 bp, Homo sapiens
tcttgtttttattaatttata

SEQ ID NO: 4060920 - DNA, 19 bp, Homo sapiens
tctttaaaaagcagtcctc

SEQ ID NO: 4060921 - DNA, 17 bp, Homo sapiens
tctttaaaagagagaga

SEQ ID NO: 4060922 - DNA, 18 bp, Homo sapiens
tctttaaaaggaaagaaa

SEQ ID NO: 4060923 - DNA, 21 bp, Homo sapiens
tctttaaaatttaagtatctt

SEQ ID NO: 4060924 - DNA, 18 bp, Homo sapiens
tctttaaagtcaggtcca

SEQ ID NO: 4060925 - DNA, 13 bp, Homo sapiens
tctttaaatactt

SEQ ID NO: 4060926 - DNA, 15 bp, Homo sapiens
tctttaactcataaa

SEQ ID NO: 4060927 - DNA, 14 bp, Homo sapiens
tctttaagaaagta

SEQ ID NO: 4060928 - DNA, 23 bp, Homo sapiens
tctttaagccatagaccctgagg

SEQ ID NO: 4060929 - DNA, 22 bp, Homo sapiens
tctttaagggcatgccttgtgc

SEQ ID NO: 4060930 - DNA, 11 bp, Homo sapiens
tctttaatgct

SEQ ID NO: 4060931 - DNA, 13 bp, Homo sapiens
tctttaatgcttt

SEQ ID NO: 4060932 - DNA, 16 bp, Homo sapiens
tctttaatgcttttat

SEQ ID NO: 4060933 - DNA, 13 bp, Homo sapiens
tctttaattctgt

SEQ ID NO: 4060934 - DNA, 21 bp, Homo sapiens
tctttacaagcaggcactgta

SEQ ID NO: 4060935 - DNA, 13 bp, Homo sapiens
tctttacctgaga

SEQ ID NO: 4060936 - DNA, 19 bp, Homo sapiens
tctttacctgtatacagtg

SEQ ID NO: 4060937 - DNA, 16 bp, Homo sapiens
tctttactcccaagac

SEQ ID NO: 4060938 - DNA, 15 bp, Homo sapiens
tctttagaaaaggca

SEQ ID NO: 4060939 - DNA, 15 bp, Homo sapiens
tctttagtgccggct

SEQ ID NO: 4060940 - DNA, 14 bp, Homo sapiens
tctttatacagctg

SEQ ID NO: 4060941 - DNA, 15 bp, Homo sapiens
tctttatacagctgt

SEQ ID NO: 4060942 - DNA, 16 bp, Homo sapiens
tctttatacagctgta

SEQ ID NO: 4060943 - DNA, 16 bp, Homo sapiens
tctttattaatcacta

SEQ ID NO: 4060944 - DNA, 23 bp, Homo sapiens
tctttattttaacctttgataga

SEQ ID NO: 4060945 - DNA, 15 bp, Homo sapiens
tctttcacagctcct

SEQ ID NO: 4060946 - DNA, 22 bp, Homo sapiens
tctttcacattgtttgctgcta

SEQ ID NO: 4060947 - DNA, 16 bp, Homo sapiens
tctttcacttgaaaga

SEQ ID NO: 4060948 - DNA, 22 bp, Homo sapiens
tctttcagattttttgaaccat

SEQ ID NO: 4060949 - DNA, 16 bp, Homo sapiens
tctttccataataaaa

SEQ ID NO: 4060950 - DNA, 20 bp, Homo sapiens
tctttccatcaactcccaac

SEQ ID NO: 4060951 - DNA, 14 bp, Homo sapiens
tctttccctgcgag

SEQ ID NO: 4060952 - DNA, 16 bp, Homo sapiens
tctttcctgaaccatg

SEQ ID NO: 4060953 - DNA, 14 bp, Homo sapiens
tctttcgtcaccct

SEQ ID NO: 4060954 - DNA, 15 bp, Homo sapiens
tctttctacagagat

SEQ ID NO: 4060955 - DNA, 22 bp, Homo sapiens
tctttctacatgactgggcctc

SEQ ID NO: 4060956 - DNA, 15 bp, Homo sapiens
tctttctagtggtct

SEQ ID NO: 4060957 - DNA, 17 bp, Homo sapiens
tctttctagtggtcttt

SEQ ID NO: 4060958 - DNA, 21 bp, Homo sapiens
tctttctagtggtctttgtaa

SEQ ID NO: 4060959 - DNA, 18 bp, Homo sapiens
tctttctccttagtcttc

SEQ ID NO: 4060960 - DNA, 21 bp, Homo sapiens
tctttctccttgaatatcttt

SEQ ID NO: 4060961 - DNA, 12 bp, Homo sapiens
tctttctctcag

SEQ ID NO: 4060962 - DNA, 21 bp, Homo sapiens
tctttctctcagccttacatt

SEQ ID NO: 4060963 - DNA, 13 bp, Homo sapiens
tctttctctgcca

SEQ ID NO: 4060964 - DNA, 16 bp, Homo sapiens
tctttctctgccagtg

SEQ ID NO: 4060965 - DNA, 23 bp, Homo sapiens
tctttctggcctgccttcgttaa

SEQ ID NO: 4060966 - DNA, 22 bp, Homo sapiens
tctttcttgggatagtgttctg

SEQ ID NO: 4060967 - DNA, 21 bp, Homo sapiens
tctttctttacctgagaccag

SEQ ID NO: 4060968 - DNA, 21 bp, Homo sapiens
tctttgaaatagtctgtgtga

SEQ ID NO: 4060969 - DNA, 16 bp, Homo sapiens
tctttgataatgttaa

SEQ ID NO: 4060970 - DNA, 13 bp, Homo sapiens
tctttgcagggct

SEQ ID NO: 4060971 - DNA, 15 bp, Homo sapiens
tctttgccctttact

SEQ ID NO: 4060972 - DNA, 11 bp, Homo sapiens
tctttgcctct

SEQ ID NO: 4060973 - DNA, 15 bp, Homo sapiens
tctttgcctctgcag

SEQ ID NO: 4060974 - DNA, 20 bp, Homo sapiens
tctttgcctctgcagtctca

SEQ ID NO: 4060975 - DNA, 18 bp, Homo sapiens
tctttggaaggagtgaga

SEQ ID NO: 4060976 - DNA, 20 bp, Homo sapiens
tctttgggccagacatgcca

SEQ ID NO: 4060977 - DNA, 21 bp, Homo sapiens
tctttggggtcagccagggcc

SEQ ID NO: 4060978 - DNA, 14 bp, Homo sapiens
tctttgtaagagtg

SEQ ID NO: 4060979 - DNA, 18 bp, Homo sapiens
tctttgtaagagtgtaga

SEQ ID NO: 4060980 - DNA, 22 bp, Homo sapiens
tctttgtaagagtgtagaagca

SEQ ID NO: 4060981 - DNA, 12 bp, Homo sapiens
tctttgtatctt

SEQ ID NO: 4060982 - DNA, 15 bp, Homo sapiens
tctttgtgcctttgg

SEQ ID NO: 4060983 - DNA, 23 bp, Homo sapiens
tctttgtgtttgcttggtgctgg

SEQ ID NO: 4060984 - DNA, 15 bp, Homo sapiens
tctttgttataccat

SEQ ID NO: 4060985 - DNA, 21 bp, Homo sapiens
tctttgttatcaaacttcagc

SEQ ID NO: 4060986 - DNA, 18 bp, Homo sapiens
tcttttaaaaattcaaat

SEQ ID NO: 4060987 - DNA, 19 bp, Homo sapiens
tcttttaaaaattcaaatg

SEQ ID NO: 4060988 - DNA, 18 bp, Homo sapiens
tcttttaaagtgttactt

SEQ ID NO: 4060989 - DNA, 20 bp, Homo sapiens
tcttttaattgtttcagaat

SEQ ID NO: 4060990 - DNA, 12 bp, Homo sapiens
tcttttacaact

SEQ ID NO: 4060991 - DNA, 18 bp, Homo sapiens
tcttttagttttagttgc

SEQ ID NO: 4060992 - DNA, 13 bp, Homo sapiens
tcttttatatttg

SEQ ID NO: 4060993 - DNA, 14 bp, Homo sapiens
tcttttatcctggg

SEQ ID NO: 4060994 - DNA, 12 bp, Homo sapiens
tcttttatctgt

SEQ ID NO: 4060995 - DNA, 19 bp, Homo sapiens
tcttttcagaagcaagcca

SEQ ID NO: 4060996 - DNA, 21 bp, Homo sapiens
tcttttcagaagcaagccaga

SEQ ID NO: 4060997 - DNA, 22 bp, Homo sapiens
tcttttcagaagcaagccagac

SEQ ID NO: 4060998 - DNA, 18 bp, Homo sapiens
tcttttcccctttcctgt

SEQ ID NO: 4060999 - DNA, 13 bp, Homo sapiens
tcttttcctggtg

SEQ ID NO: 4061000 - DNA, 15 bp, Homo sapiens
tgaagttacatgcat

SEQ ID NO: 4061001 - DNA, 18 bp, Homo sapiens
tgaagttacatgcataaa

SEQ ID NO: 4061002 - DNA, 22 bp, Homo sapiens
tgaagttacatgcataaaaggg

SEQ ID NO: 4061003 - DNA, 13 bp, Homo sapiens
tgaagttgaacat

SEQ ID NO: 4061004 - DNA, 19 bp, Homo sapiens
tgaagtttaaaacagtatt

SEQ ID NO: 4061005 - DNA, 20 bp, Homo sapiens
tgaagtttacattgtaaata

SEQ ID NO: 4061006 - DNA, 15 bp, Homo sapiens
tgaagtttacatttt

SEQ ID NO: 4061007 - DNA, 16 bp, Homo sapiens
tgaagtttacattttt

SEQ ID NO: 4061008 - DNA, 13 bp, Homo sapiens
tgaagtttcacat

SEQ ID NO: 4061009 - DNA, 15 bp, Homo sapiens
tgaagttttacattg

SEQ ID NO: 4061010 - DNA, 17 bp, Homo sapiens
tgaagttttacattgtt

SEQ ID NO: 4061011 - DNA, 14 bp, Homo sapiens
tgaataaaaatgca

SEQ ID NO: 4061012 - DNA, 17 bp, Homo sapiens
tgaataaactgaatatt

SEQ ID NO: 4061013 - DNA, 18 bp, Homo sapiens
tgaataaagaatgccatt

SEQ ID NO: 4061014 - DNA, 23 bp, Homo sapiens
tgaataaagaatgccatttctca

SEQ ID NO: 4061015 - DNA, 14 bp, Homo sapiens
tgaataaagacacc

SEQ ID NO: 4061016 - DNA, 16 bp, Homo sapiens
tgaataaagacaccta

SEQ ID NO: 4061017 - DNA, 17 bp, Homo sapiens
tgaataaagtgtaacaa

SEQ ID NO: 4061018 - DNA, 13 bp, Homo sapiens
tgaataaatgtct

SEQ ID NO: 4061019 - DNA, 14 bp, Homo sapiens
tgaatagcctggcc

SEQ ID NO: 4061020 - DNA, 15 bp, Homo sapiens
tgaatagcctggcca

SEQ ID NO: 4061021 - DNA, 21 bp, Homo sapiens
tgaatatacagcaggtgctca

SEQ ID NO: 4061022 - DNA, 22 bp, Homo sapiens
tgaatatatttaagcaacatct

SEQ ID NO: 4061023 - DNA, 14 bp, Homo sapiens
tgaatatctattaa

SEQ ID NO: 4061024 - DNA, 18 bp, Homo sapiens
tgaatatctattaatata

SEQ ID NO: 4061025 - DNA, 12 bp, Homo sapiens
tgaatatggaca

SEQ ID NO: 4061026 - DNA, 22 bp, Homo sapiens
tgaatatggacaagaggtacag

SEQ ID NO: 4061027 - DNA, 17 bp, Homo sapiens
tgaatattgaagtttca

SEQ ID NO: 4061028 - DNA, 17 bp, Homo sapiens
tgaatatttataacagc

SEQ ID NO: 4061029 - DNA, 20 bp, Homo sapiens
tgaatattttggaaactgct

SEQ ID NO: 4061030 - DNA, 13 bp, Homo sapiens
tgaatcaatcctg

SEQ ID NO: 4061031 - DNA, 15 bp, Homo sapiens
tgaatcaatgaaaaa

SEQ ID NO: 4061032 - DNA, 12 bp, Homo sapiens
tgaatcacctgg

SEQ ID NO: 4061033 - DNA, 15 bp, Homo sapiens
tgaatcacctggctg

SEQ ID NO: 4061034 - DNA, 21 bp, Homo sapiens
tgaatcagtataaacaaagtt

SEQ ID NO: 4061035 - DNA, 17 bp, Homo sapiens
tgaatccaaaagaaaaa

SEQ ID NO: 4061036 - DNA, 21 bp, Homo sapiens
tgaatccaaaagaaaaacagc

SEQ ID NO: 4061037 - DNA, 15 bp, Homo sapiens
tgaatcctaagggct

SEQ ID NO: 4061038 - DNA, 14 bp, Homo sapiens
tgaatctaaggata

SEQ ID NO: 4061039 - DNA, 16 bp, Homo sapiens
tgaatctgctcacttt

SEQ ID NO: 4061040 - DNA, 19 bp, Homo sapiens
tgaatctttccaataaacc

SEQ ID NO: 4061041 - DNA, 21 bp, Homo sapiens
tgaatgaaaaatttaagcatt

SEQ ID NO: 4061042 - DNA, 11 bp, Homo sapiens
tgaatgaaaac

SEQ ID NO: 4061043 - DNA, 14 bp, Homo sapiens
tgaatgaaagatta

SEQ ID NO: 4061044 - DNA, 14 bp, Homo sapiens
tgaatgaaatatca

SEQ ID NO: 4061045 - DNA, 11 bp, Homo sapiens
tgaatgaacac

SEQ ID NO: 4061046 - DNA, 18 bp, Homo sapiens
tgaatgatctctctgaat

SEQ ID NO: 4061047 - DNA, 14 bp, Homo sapiens
tgaatgccgtggat

SEQ ID NO: 4061048 - DNA, 17 bp, Homo sapiens
tgaatgcctcaatgtga

SEQ ID NO: 4061049 - DNA, 17 bp, Homo sapiens
tgaatgcgctttattgc

SEQ ID NO: 4061050 - DNA, 11 bp, Homo sapiens
tgaatgctgcc

SEQ ID NO: 4061051 - DNA, 22 bp, Homo sapiens
tgaatgctgccagtgtggagtg

SEQ ID NO: 4061052 - DNA, 20 bp, Homo sapiens
tgaatggattggattattta

SEQ ID NO: 4061053 - DNA, 22 bp, Homo sapiens
tgaatggattggattatttaat

SEQ ID NO: 4061054 - DNA, 19 bp, Homo sapiens
tgaatgtagcagccccggg

SEQ ID NO: 4061055 - DNA, 20 bp, Homo sapiens
tgaatgtatgtaatgtgtgg

SEQ ID NO: 4061056 - DNA, 17 bp, Homo sapiens
tgaatgtatttatttgg

SEQ ID NO: 4061057 - DNA, 18 bp, Homo sapiens
tgaatgtggcttgagaaa

SEQ ID NO: 4061058 - DNA, 15 bp, Homo sapiens
tgaatgtgggcactg

SEQ ID NO: 4061059 - DNA, 16 bp, Homo sapiens
tgaatgtggtctcagg

SEQ ID NO: 4061060 - DNA, 17 bp, Homo sapiens
tgaatgtggttacttcc

SEQ ID NO: 4061061 - DNA, 14 bp, Homo sapiens
tgaatgtgtcacta

SEQ ID NO: 4061062 - DNA, 12 bp, Homo sapiens
tgaatgtgtcag

SEQ ID NO: 4061063 - DNA, 16 bp, Homo sapiens
tgaatgttctgacatt

SEQ ID NO: 4061064 - DNA, 17 bp, Homo sapiens
tgaatgttctgacatta

SEQ ID NO: 4061065 - DNA, 18 bp, Homo sapiens
tgaatgttctgacattaa

SEQ ID NO: 4061066 - DNA, 19 bp, Homo sapiens
tgaatgtttacactctttg

SEQ ID NO: 4061067 - DNA, 18 bp, Homo sapiens
tgaatgttttatttatca

SEQ ID NO: 4061068 - DNA, 18 bp, Homo sapiens
tgaattaaaacttcttaa

SEQ ID NO: 4061069 - DNA, 23 bp, Homo sapiens
tgaattaatcatctataaagaag

SEQ ID NO: 4061070 - DNA, 15 bp, Homo sapiens
tgaattatatgttca

SEQ ID NO: 4061071 - DNA, 15 bp, Homo sapiens
tgaattatctataca

SEQ ID NO: 4061072 - DNA, 17 bp, Homo sapiens
tgaattcaagaaaggaa

SEQ ID NO: 4061073 - DNA, 12 bp, Homo sapiens
tgaattcagatt

SEQ ID NO: 4061074 - DNA, 19 bp, Homo sapiens
tgaattgtttttattgttt

SEQ ID NO: 4061075 - DNA, 15 bp, Homo sapiens
tgaatttaaatataa

SEQ ID NO: 4061076 - DNA, 16 bp, Homo sapiens
tgaatttaaatataat

SEQ ID NO: 4061077 - DNA, 19 bp, Homo sapiens
tgaatttaaatataattct

SEQ ID NO: 4061078 - DNA, 13 bp, Homo sapiens
tgaatttcactgt

SEQ ID NO: 4061079 - DNA, 23 bp, Homo sapiens
tgaatttctgacctcaagtgatt

SEQ ID NO: 4061080 - DNA, 23 bp, Homo sapiens
tgaatttcttgatttttcagggt

SEQ ID NO: 4061081 - DNA, 13 bp, Homo sapiens
tgaatttgaatga

SEQ ID NO: 4061082 - DNA, 18 bp, Homo sapiens
tgaatttgaatgaaaaat

SEQ ID NO: 4061083 - DNA, 17 bp, Homo sapiens
tgaattttaaatctaaa

SEQ ID NO: 4061084 - DNA, 15 bp, Homo sapiens
tgaattttccacgca

SEQ ID NO: 4061085 - DNA, 21 bp, Homo sapiens
tgaattttgtttttattttca

SEQ ID NO: 4061086 - DNA, 13 bp, Homo sapiens
tgaatttttaagc

SEQ ID NO: 4061087 - DNA, 23 bp, Homo sapiens
tgaatttttatatatatatctgt

SEQ ID NO: 4061088 - DNA, 16 bp, Homo sapiens
tgaatttttttgtaat

SEQ ID NO: 4061089 - DNA, 13 bp, Homo sapiens
tgacaaaagtaaa

SEQ ID NO: 4061090 - DNA, 14 bp, Homo sapiens
tgacaaaagtaaat

SEQ ID NO: 4061091 - DNA, 16 bp, Homo sapiens
tgacaaaagtaaatgg

SEQ ID NO: 4061092 - DNA, 20 bp, Homo sapiens
tgacaaaagtaaatgggagg

SEQ ID NO: 4061093 - DNA, 10 bp, Homo sapiens
tgacaaaatt

SEQ ID NO: 4061094 - DNA, 17 bp, Homo sapiens
tgacaacctagaatgtc

SEQ ID NO: 4061095 - DNA, 23 bp, Homo sapiens
tgacaagatggtccatttgttcc

SEQ ID NO: 4061096 - DNA, 22 bp, Homo sapiens
tgacaagctcctggtcttgaga

SEQ ID NO: 4061097 - DNA, 20 bp, Homo sapiens
tgacaagtcattttaacttt

SEQ ID NO: 4061098 - DNA, 16 bp, Homo sapiens
tgacaagtgaagaaca

SEQ ID NO: 4061099 - DNA, 13 bp, Homo sapiens
tgacaataaaaca

SEQ ID NO: 4061100 - DNA, 16 bp, Homo sapiens
tgacaataaaacatta

SEQ ID NO: 4061101 - DNA, 14 bp, Homo sapiens
tgacaataaatgtg

SEQ ID NO: 4061102 - DNA, 20 bp, Homo sapiens
tgacaataatattgttgtat

SEQ ID NO: 4061103 - DNA, 16 bp, Homo sapiens
tgaggaggcctccatc

SEQ ID NO: 4061104 - DNA, 20 bp, Homo sapiens
tgaggaggggagcgtctggg

SEQ ID NO: 4061105 - DNA, 20 bp, Homo sapiens
tgaggattattataaaaggg

SEQ ID NO: 4061106 - DNA, 15 bp, Homo sapiens
tgaggcaagtgtggg

SEQ ID NO: 4061107 - DNA, 22 bp, Homo sapiens
tgaggccaaacgttttgaacta

SEQ ID NO: 4061108 - DNA, 12 bp, Homo sapiens
tgaggccacact

SEQ ID NO: 4061109 - DNA, 19 bp, Homo sapiens
tgaggccacactcagcaca

SEQ ID NO: 4061110 - DNA, 23 bp, Homo sapiens
tgaggccacactcagcacaaggc

SEQ ID NO: 4061111 - DNA, 14 bp, Homo sapiens
tgaggccagagtca

SEQ ID NO: 4061112 - DNA, 13 bp, Homo sapiens
tgaggccaggagt

SEQ ID NO: 4061113 - DNA, 20 bp, Homo sapiens
tgaggccatctcaggagatg

SEQ ID NO: 4061114 - DNA, 22 bp, Homo sapiens
tgaggcctccagcttcaggcag

SEQ ID NO: 4061115 - DNA, 18 bp, Homo sapiens
tgaggcctgccctcaggg

SEQ ID NO: 4061116 - DNA, 21 bp, Homo sapiens
tgaggcctgccctcagggatc

SEQ ID NO: 4061117 - DNA, 11 bp, Homo sapiens
tgaggcctgga

SEQ ID NO: 4061118 - DNA, 12 bp, Homo sapiens
tgaggcctggac

SEQ ID NO: 4061119 - DNA, 17 bp, Homo sapiens
tgaggcctggactttcc

SEQ ID NO: 4061120 - DNA, 16 bp, Homo sapiens
tgaggcggaggctgtg

SEQ ID NO: 4061121 - DNA, 18 bp, Homo sapiens
tgaggcggaggctgtgct

SEQ ID NO: 4061122 - DNA, 15 bp, Homo sapiens
tgaggctggcacagg

SEQ ID NO: 4061123 - DNA, 19 bp, Homo sapiens
tgaggctgggggagagccg

SEQ ID NO: 4061124 - DNA, 13 bp, Homo sapiens
tgaggcttagaga

SEQ ID NO: 4061125 - DNA, 17 bp, Homo sapiens
tgaggcttagagagagg

SEQ ID NO: 4061126 - DNA, 13 bp, Homo sapiens
tgaggctttggat

SEQ ID NO: 4061127 - DNA, 18 bp, Homo sapiens
tgaggctttggatttgac

SEQ ID NO: 4061128 - DNA, 23 bp, Homo sapiens
tgaggctttggatttgacattgc

SEQ ID NO: 4061129 - DNA, 17 bp, Homo sapiens
tgaggctttgtgttgta

SEQ ID NO: 4061130 - DNA, 18 bp, Homo sapiens
tgaggctttgtgttgtaa

SEQ ID NO: 4061131 - DNA, 20 bp, Homo sapiens
tgagggacatatcagtgacc

SEQ ID NO: 4061132 - DNA, 13 bp, Homo sapiens
tgagggacatgct

SEQ ID NO: 4061133 - DNA, 18 bp, Homo sapiens
tgagggcagactggggca

SEQ ID NO: 4061134 - DNA, 18 bp, Homo sapiens
tgagggccaagaaagagt

SEQ ID NO: 4061135 - DNA, 16 bp, Homo sapiens
tgagggcccagccagg

SEQ ID NO: 4061136 - DNA, 17 bp, Homo sapiens
tgagggcccagccagga

SEQ ID NO: 4061137 - DNA, 19 bp, Homo sapiens
tgagggcccagccaggagc

SEQ ID NO: 4061138 - DNA, 21 bp, Homo sapiens
tgagggcccagccaggagcag

SEQ ID NO: 4061139 - DNA, 22 bp, Homo sapiens
tgagggcccagccaggagcaga

SEQ ID NO: 4061140 - DNA, 18 bp, Homo sapiens
tgagggcctgctggaggc

SEQ ID NO: 4061141 - DNA, 19 bp, Homo sapiens
tgagggcctgctggaggcc

SEQ ID NO: 4061142 - DNA, 18 bp, Homo sapiens
tgagggctgccagcagcc

SEQ ID NO: 4061143 - DNA, 20 bp, Homo sapiens
tgagggctgccagcagcccc

SEQ ID NO: 4061144 - DNA, 18 bp, Homo sapiens
tgaggggagccaggaggg

SEQ ID NO: 4061145 - DNA, 19 bp, Homo sapiens
tgaggggccctggccagga

SEQ ID NO: 4061146 - DNA, 15 bp, Homo sapiens
tgaggggctttctct

SEQ ID NO: 4061147 - DNA, 14 bp, Homo sapiens
tgaggggggctggc

SEQ ID NO: 4061148 - DNA, 15 bp, Homo sapiens
tgagggtccccacct

SEQ ID NO: 4061149 - DNA, 19 bp, Homo sapiens
tgagggtcttcttacatgc

SEQ ID NO: 4061150 - DNA, 21 bp, Homo sapiens
tgagggtgcttgttccctctc

SEQ ID NO: 4061151 - DNA, 14 bp, Homo sapiens
tgagggtggagact

SEQ ID NO: 4061152 - DNA, 15 bp, Homo sapiens
tgaggtaagtttttt

SEQ ID NO: 4061153 - DNA, 22 bp, Homo sapiens
tgaggtagaccaggatttctaa

SEQ ID NO: 4061154 - DNA, 16 bp, Homo sapiens
tgaggtcaggagttcc

SEQ ID NO: 4061155 - DNA, 18 bp, Homo sapiens
tgaggtcagggagtgctg

SEQ ID NO: 4061156 - DNA, 13 bp, Homo sapiens
tgaggtcccaggc

SEQ ID NO: 4061157 - DNA, 12 bp, Homo sapiens
tgaggtccctgt

SEQ ID NO: 4061158 - DNA, 23 bp, Homo sapiens
tgaggtccctgtgtgtaggctgg

SEQ ID NO: 4061159 - DNA, 16 bp, Homo sapiens
tgaggtctgttccttt

SEQ ID NO: 4061160 - DNA, 21 bp, Homo sapiens
tgaggtcttttgacatgtgga

SEQ ID NO: 4061161 - DNA, 17 bp, Homo sapiens
tgaggtgaaagggagct

SEQ ID NO: 4061162 - DNA, 15 bp, Homo sapiens
tgaggtgcctgtccc

SEQ ID NO: 4061163 - DNA, 18 bp, Homo sapiens
tgaggtggcatggtccat

SEQ ID NO: 4061164 - DNA, 18 bp, Homo sapiens
tgaggtgggaggtggaag

SEQ ID NO: 4061165 - DNA, 21 bp, Homo sapiens
tgaggtgggaggtggaagaag

SEQ ID NO: 4061166 - DNA, 17 bp, Homo sapiens
tgaggtggtctgaatgt

SEQ ID NO: 4061167 - DNA, 14 bp, Homo sapiens
tgaggttcctctgc

SEQ ID NO: 4061168 - DNA, 17 bp, Homo sapiens
tgaggttcctctgcctg

SEQ ID NO: 4061169 - DNA, 18 bp, Homo sapiens
tgaggttcctctgcctgc

SEQ ID NO: 4061170 - DNA, 19 bp, Homo sapiens
tgaggttctgagaccagtg

SEQ ID NO: 4061171 - DNA, 15 bp, Homo sapiens
tgaggttgcttacta

SEQ ID NO: 4061172 - DNA, 20 bp, Homo sapiens
tgagtaaatattgaggcttt

SEQ ID NO: 4061173 - DNA, 17 bp, Homo sapiens
tgagtaacatttgctgt

SEQ ID NO: 4061174 - DNA, 16 bp, Homo sapiens
tgagtaagagctggtg

SEQ ID NO: 4061175 - DNA, 21 bp, Homo sapiens
tgagtaatcaatacagacaag

SEQ ID NO: 4061176 - DNA, 15 bp, Homo sapiens
tgagtaatggtgtag

SEQ ID NO: 4061177 - DNA, 19 bp, Homo sapiens
tgagtaatggtgtagaaca

SEQ ID NO: 4061178 - DNA, 17 bp, Homo sapiens
tgagtaccaggggctgg

SEQ ID NO: 4061179 - DNA, 18 bp, Homo sapiens
tgagtcaatgtgcagtgt

SEQ ID NO: 4061180 - DNA, 14 bp, Homo sapiens
tgagtcacctgctc

SEQ ID NO: 4061181 - DNA, 17 bp, Homo sapiens
tgagtcacctgctccag

SEQ ID NO: 4061182 - DNA, 21 bp, Homo sapiens
tgagtcagatgggtctgatat

SEQ ID NO: 4061183 - DNA, 20 bp, Homo sapiens
tgagtcatctgttagggcct

SEQ ID NO: 4061184 - DNA, 16 bp, Homo sapiens
tgagtcatttaaatgt

SEQ ID NO: 4061185 - DNA, 20 bp, Homo sapiens
tgagtccattctcccaggta

SEQ ID NO: 4061186 - DNA, 14 bp, Homo sapiens
tgagtcctccagaa

SEQ ID NO: 4061187 - DNA, 16 bp, Homo sapiens
tgagtcctccagaact

SEQ ID NO: 4061188 - DNA, 15 bp, Homo sapiens
tgagtctcctctctg

SEQ ID NO: 4061189 - DNA, 16 bp, Homo sapiens
tgagtctcctctctga

SEQ ID NO: 4061190 - DNA, 17 bp, Homo sapiens
tgagtctcctctctgag

SEQ ID NO: 4061191 - DNA, 18 bp, Homo sapiens
tgagtctcctctctgaga

SEQ ID NO: 4061192 - DNA, 15 bp, Homo sapiens
tgagtctcttcagaa

SEQ ID NO: 4061193 - DNA, 13 bp, Homo sapiens
tgagtctggactt

SEQ ID NO: 4061194 - DNA, 23 bp, Homo sapiens
tgagtgaaaatttttacattcat

SEQ ID NO: 4061195 - DNA, 23 bp, Homo sapiens
tgagtgacacaagcactttaatg

SEQ ID NO: 4061196 - DNA, 15 bp, Homo sapiens
tgagtgagccacaga

SEQ ID NO: 4061197 - DNA, 18 bp, Homo sapiens
tgagtgagccacagacca

SEQ ID NO: 4061198 - DNA, 19 bp, Homo sapiens
tgagtgccttttgcagaag

SEQ ID NO: 4061199 - DNA, 19 bp, Homo sapiens
tgagtgcgggctgaggcca

SEQ ID NO: 4061200 - DNA, 21 bp, Homo sapiens
tgagtgcgggctgaggccaga

SEQ ID NO: 4061201 - DNA, 22 bp, Homo sapiens
tgagtgcgggctgaggccagag

SEQ ID NO: 4061202 - DNA, 20 bp, Homo sapiens
tgagtggccagccagtgcca

SEQ ID NO: 4061203 - DNA, 12 bp, Homo sapiens
tgagtggcctgc

SEQ ID NO: 4061204 - DNA, 12 bp, Homo sapiens
tgagtgggagaa

SEQ ID NO: 4061205 - DNA, 19 bp, Homo sapiens
tgatcttctgggagcagga

SEQ ID NO: 4061206 - DNA, 14 bp, Homo sapiens
tgatcttcttcatc

SEQ ID NO: 4061207 - DNA, 18 bp, Homo sapiens
tgatcttgcattcatttt

SEQ ID NO: 4061208 - DNA, 21 bp, Homo sapiens
tgatcttggcttactgcagcc

SEQ ID NO: 4061209 - DNA, 19 bp, Homo sapiens
tgatcttttaaagtgttac

SEQ ID NO: 4061210 - DNA, 18 bp, Homo sapiens
tgatgaaatctgctagaa

SEQ ID NO: 4061211 - DNA, 18 bp, Homo sapiens
tgatgaactcttaatcaa

SEQ ID NO: 4061212 - DNA, 20 bp, Homo sapiens
tgatgacacccaccctgtgc

SEQ ID NO: 4061213 - DNA, 14 bp, Homo sapiens
tgatgaccaaagtc

SEQ ID NO: 4061214 - DNA, 16 bp, Homo sapiens
tgatgagaatttctaa

SEQ ID NO: 4061215 - DNA, 19 bp, Homo sapiens
tgatgataacacttaaaat

SEQ ID NO: 4061216 - DNA, 18 bp, Homo sapiens
tgatgatccagaacagtg

SEQ ID NO: 4061217 - DNA, 17 bp, Homo sapiens
tgatgatgctgtgacaa

SEQ ID NO: 4061218 - DNA, 20 bp, Homo sapiens
tgatgattaaacacctgaca

SEQ ID NO: 4061219 - DNA, 15 bp, Homo sapiens
tgatgatttggggga

SEQ ID NO: 4061220 - DNA, 17 bp, Homo sapiens
tgatgattttcatttca

SEQ ID NO: 4061221 - DNA, 21 bp, Homo sapiens
tgatgattttcatttcatgaa

SEQ ID NO: 4061222 - DNA, 16 bp, Homo sapiens
tgatgattttcctttt

SEQ ID NO: 4061223 - DNA, 18 bp, Homo sapiens
tgatgattttgcaaaatg

SEQ ID NO: 4061224 - DNA, 23 bp, Homo sapiens
tgatgcgccttgctgatggcttg

SEQ ID NO: 4061225 - DNA, 15 bp, Homo sapiens
tgatgctcaggcttg

SEQ ID NO: 4061226 - DNA, 21 bp, Homo sapiens
tgatgctgagattcttcaggc

SEQ ID NO: 4061227 - DNA, 15 bp, Homo sapiens
tgatgctggagaggt

SEQ ID NO: 4061228 - DNA, 13 bp, Homo sapiens
tgatgctgtattc

SEQ ID NO: 4061229 - DNA, 14 bp, Homo sapiens
tgatgctgtgacaa

SEQ ID NO: 4061230 - DNA, 18 bp, Homo sapiens
tgatggaaatatttattt

SEQ ID NO: 4061231 - DNA, 14 bp, Homo sapiens
tgatggaaccttaa

SEQ ID NO: 4061232 - DNA, 23 bp, Homo sapiens
tgatggaccagtggtttccagtc

SEQ ID NO: 4061233 - DNA, 20 bp, Homo sapiens
tgatggaccttctagaatta

SEQ ID NO: 4061234 - DNA, 18 bp, Homo sapiens
tgatggcagaactcccac

SEQ ID NO: 4061235 - DNA, 14 bp, Homo sapiens
tgatggccagcccc

SEQ ID NO: 4061236 - DNA, 15 bp, Homo sapiens
tgatggccagcccct

SEQ ID NO: 4061237 - DNA, 16 bp, Homo sapiens
tgatgggaaaatattt

SEQ ID NO: 4061238 - DNA, 19 bp, Homo sapiens
tgatgggaaaatatttcct

SEQ ID NO: 4061239 - DNA, 20 bp, Homo sapiens
tgatgggaaaatatttcctg

SEQ ID NO: 4061240 - DNA, 16 bp, Homo sapiens
tgatgggcacttgaga

SEQ ID NO: 4061241 - DNA, 17 bp, Homo sapiens
tgatggggctcagatgg

SEQ ID NO: 4061242 - DNA, 16 bp, Homo sapiens
tgatgggggccaggac

SEQ ID NO: 4061243 - DNA, 14 bp, Homo sapiens
tgatggttcccctg

SEQ ID NO: 4061244 - DNA, 17 bp, Homo sapiens
tgatgtaatctctctgc

SEQ ID NO: 4061245 - DNA, 20 bp, Homo sapiens
tgatgtacataactcctgtc

SEQ ID NO: 4061246 - DNA, 20 bp, Homo sapiens
tgatgtaccatgaaacaaag

SEQ ID NO: 4061247 - DNA, 12 bp, Homo sapiens
tgatgtatattt

SEQ ID NO: 4061248 - DNA, 18 bp, Homo sapiens
tgatgtcttttcttggca

SEQ ID NO: 4061249 - DNA, 23 bp, Homo sapiens
tgatgtcttttcttggcaaaagc

SEQ ID NO: 4061250 - DNA, 13 bp, Homo sapiens
tgatgtgactttt

SEQ ID NO: 4061251 - DNA, 21 bp, Homo sapiens
tgatgtgccattttaaaaaaa

SEQ ID NO: 4061252 - DNA, 15 bp, Homo sapiens
tgatgtggtgcctga

SEQ ID NO: 4061253 - DNA, 13 bp, Homo sapiens
tgatgttggaaga

SEQ ID NO: 4061254 - DNA, 18 bp, Homo sapiens
tgatgtttgtggcctcag

SEQ ID NO: 4061255 - DNA, 23 bp, Homo sapiens
tgattaaaatgcttcctcccagc

SEQ ID NO: 4061256 - DNA, 14 bp, Homo sapiens
tgattaacaaatat

SEQ ID NO: 4061257 - DNA, 15 bp, Homo sapiens
tgattaacaaatatg

SEQ ID NO: 4061258 - DNA, 17 bp, Homo sapiens
tgattaagattttacaa

SEQ ID NO: 4061259 - DNA, 11 bp, Homo sapiens
tgattaatcaa

SEQ ID NO: 4061260 - DNA, 12 bp, Homo sapiens
tgattaatcaaa

SEQ ID NO: 4061261 - DNA, 15 bp, Homo sapiens
tgattactgtcaata

SEQ ID NO: 4061262 - DNA, 21 bp, Homo sapiens
tgattagaaggcaagtttcta

SEQ ID NO: 4061263 - DNA, 13 bp, Homo sapiens
tgattagcaagtt

SEQ ID NO: 4061264 - DNA, 18 bp, Homo sapiens
tgattagctttgtgtttg

SEQ ID NO: 4061265 - DNA, 13 bp, Homo sapiens
tgattattttctt

SEQ ID NO: 4061266 - DNA, 19 bp, Homo sapiens
tgattcagaaaatgttctg

SEQ ID NO: 4061267 - DNA, 20 bp, Homo sapiens
tgattcagaaaatgttctgt

SEQ ID NO: 4061268 - DNA, 21 bp, Homo sapiens
tgattcagaaaatgttctgtt

SEQ ID NO: 4061269 - DNA, 14 bp, Homo sapiens
tgattcagaaattg

SEQ ID NO: 4061270 - DNA, 19 bp, Homo sapiens
tgattcatagtaacttctt

SEQ ID NO: 4061271 - DNA, 15 bp, Homo sapiens
tgattcattttcctg

SEQ ID NO: 4061272 - DNA, 16 bp, Homo sapiens
tgattcattttcctgt

SEQ ID NO: 4061273 - DNA, 14 bp, Homo sapiens
tgattcccgggctt

SEQ ID NO: 4061274 - DNA, 23 bp, Homo sapiens
tgattcctaagccacttgaaatg

SEQ ID NO: 4061275 - DNA, 12 bp, Homo sapiens
tgattcctggtt

SEQ ID NO: 4061276 - DNA, 22 bp, Homo sapiens
tgattctgcagtaaatctttta

SEQ ID NO: 4061277 - DNA, 19 bp, Homo sapiens
tgattctttgttacaggca

SEQ ID NO: 4061278 - DNA, 14 bp, Homo sapiens
tgattgaaccagct

SEQ ID NO: 4061279 - DNA, 19 bp, Homo sapiens
tgattgacacacagcactc

SEQ ID NO: 4061280 - DNA, 12 bp, Homo sapiens
tgattgcacaga

SEQ ID NO: 4061281 - DNA, 15 bp, Homo sapiens
tgattggattattca

SEQ ID NO: 4061282 - DNA, 16 bp, Homo sapiens
tgattggattattcat

SEQ ID NO: 4061283 - DNA, 21 bp, Homo sapiens
tgattggattattcatttaaa

SEQ ID NO: 4061284 - DNA, 19 bp, Homo sapiens
tgattggtgcaacccttac

SEQ ID NO: 4061285 - DNA, 17 bp, Homo sapiens
tgattggtttctcttct

SEQ ID NO: 4061286 - DNA, 16 bp, Homo sapiens
tgattgtataagcatg

SEQ ID NO: 4061287 - DNA, 14 bp, Homo sapiens
tgattgtcagctac

SEQ ID NO: 4061288 - DNA, 14 bp, Homo sapiens
tgattgtggaatgg

SEQ ID NO: 4061289 - DNA, 18 bp, Homo sapiens
tgattgtggaatggagat

SEQ ID NO: 4061290 - DNA, 13 bp, Homo sapiens
tgatttaataaaa

SEQ ID NO: 4061291 - DNA, 15 bp, Homo sapiens
tgatttaataaaata

SEQ ID NO: 4061292 - DNA, 19 bp, Homo sapiens
tgatttaataaaataattc

SEQ ID NO: 4061293 - DNA, 23 bp, Homo sapiens
tgatttaataaaataattctaaa

SEQ ID NO: 4061294 - DNA, 14 bp, Homo sapiens
tgatttaatatgga

SEQ ID NO: 4061295 - DNA, 15 bp, Homo sapiens
tgatttaatatggat

SEQ ID NO: 4061296 - DNA, 20 bp, Homo sapiens
tgatttacagcaagtagata

SEQ ID NO: 4061297 - DNA, 15 bp, Homo sapiens
tgatttataaacaga

SEQ ID NO: 4061298 - DNA, 16 bp, Homo sapiens
tgatttcacaacagat

SEQ ID NO: 4061299 - DNA, 11 bp, Homo sapiens
tgatttcagga

SEQ ID NO: 4061300 - DNA, 18 bp, Homo sapiens
tgatttcaggatactctg

SEQ ID NO: 4061301 - DNA, 15 bp, Homo sapiens
tgatttcattaatac

SEQ ID NO: 4061302 - DNA, 22 bp, Homo sapiens
tgatttccgtgaactctggtgc

SEQ ID NO: 4061303 - DNA, 14 bp, Homo sapiens
tgatttccttgaat

SEQ ID NO: 4061304 - DNA, 16 bp, Homo sapiens
tgatttccttgaatgt

SEQ ID NO: 4061305 - DNA, 17 bp, Homo sapiens
tgatttccttgaatgtg

SEQ ID NO: 4061306 - DNA, 17 bp, Homo sapiens
tgatttctagaaagcct

SEQ ID NO: 4061307 - DNA, 21 bp, Homo sapiens
tgatttctttaaaagaatgac

SEQ ID NO: 4061308 - DNA, 17 bp, Homo sapiens
tgccaaatgctggggca

SEQ ID NO: 4061309 - DNA, 18 bp, Homo sapiens
tgccaacaccacagaaat

SEQ ID NO: 4061310 - DNA, 13 bp, Homo sapiens
tgccaactcctca

SEQ ID NO: 4061311 - DNA, 23 bp, Homo sapiens
tgccaagtggggatggggcctcc

SEQ ID NO: 4061312 - DNA, 23 bp, Homo sapiens
tgccaataaaagttttctccaac

SEQ ID NO: 4061313 - DNA, 14 bp, Homo sapiens
tgccaataaccaag

SEQ ID NO: 4061314 - DNA, 19 bp, Homo sapiens
tgccaatattaaatctgct

SEQ ID NO: 4061315 - DNA, 16 bp, Homo sapiens
tgccaatctcaacacc

SEQ ID NO: 4061316 - DNA, 18 bp, Homo sapiens
tgccaatgatgtgaccct

SEQ ID NO: 4061317 - DNA, 21 bp, Homo sapiens
tgccaattattgttacacatt

SEQ ID NO: 4061318 - DNA, 15 bp, Homo sapiens
tgccacaaggacttc

SEQ ID NO: 4061319 - DNA, 23 bp, Homo sapiens
tgccacaatgcagttctgagcac

SEQ ID NO: 4061320 - DNA, 12 bp, Homo sapiens
tgccacacccag

SEQ ID NO: 4061321 - DNA, 15 bp, Homo sapiens
tgccacacttcaggc

SEQ ID NO: 4061322 - DNA, 16 bp, Homo sapiens
tgccacacttcaggct

SEQ ID NO: 4061323 - DNA, 22 bp, Homo sapiens
tgccacacttcaggctcttctc

SEQ ID NO: 4061324 - DNA, 15 bp, Homo sapiens
tgccacagccagagg

SEQ ID NO: 4061325 - DNA, 17 bp, Homo sapiens
tgccacagcttttgcaa

SEQ ID NO: 4061326 - DNA, 13 bp, Homo sapiens
tgccacatacagg

SEQ ID NO: 4061327 - DNA, 14 bp, Homo sapiens
tgccacatttctga

SEQ ID NO: 4061328 - DNA, 15 bp, Homo sapiens
tgccacatttctgat

SEQ ID NO: 4061329 - DNA, 18 bp, Homo sapiens
tgccacatttctgatcag

SEQ ID NO: 4061330 - DNA, 20 bp, Homo sapiens
tgccacatttctgatcagag

SEQ ID NO: 4061331 - DNA, 22 bp, Homo sapiens
tgccacatttctgatcagaggt

SEQ ID NO: 4061332 - DNA, 15 bp, Homo sapiens
tgccaccacctctgt

SEQ ID NO: 4061333 - DNA, 13 bp, Homo sapiens
tgccaccagcccc

SEQ ID NO: 4061334 - DNA, 23 bp, Homo sapiens
tgccaccagcccccgccccagag

SEQ ID NO: 4061335 - DNA, 17 bp, Homo sapiens
tgccaccaggagaacca

SEQ ID NO: 4061336 - DNA, 16 bp, Homo sapiens
tgccaccccaccctcc

SEQ ID NO: 4061337 - DNA, 17 bp, Homo sapiens
tgccaccccaccctccc

SEQ ID NO: 4061338 - DNA, 20 bp, Homo sapiens
tgccaccccaccctccctgg

SEQ ID NO: 4061339 - DNA, 14 bp, Homo sapiens
tgccacctccctga

SEQ ID NO: 4061340 - DNA, 12 bp, Homo sapiens
tgccacctggca

SEQ ID NO: 4061341 - DNA, 19 bp, Homo sapiens
tgccacgctttgctgctac

SEQ ID NO: 4061342 - DNA, 19 bp, Homo sapiens
tgccacgtggtcactgtgc

SEQ ID NO: 4061343 - DNA, 16 bp, Homo sapiens
tgccacgttccacagt

SEQ ID NO: 4061344 - DNA, 17 bp, Homo sapiens
tgccactcctccctccg

SEQ ID NO: 4061345 - DNA, 17 bp, Homo sapiens
tgccactgcccgagctg

SEQ ID NO: 4061346 - DNA, 21 bp, Homo sapiens
tgccactgcccgagctggtgc

SEQ ID NO: 4061347 - DNA, 13 bp, Homo sapiens
tgccactttccaa

SEQ ID NO: 4061348 - DNA, 14 bp, Homo sapiens
tgccagagatccaa

SEQ ID NO: 4061349 - DNA, 14 bp, Homo sapiens
tgccagaggggaag

SEQ ID NO: 4061350 - DNA, 17 bp, Homo sapiens
tgccagattctgcctct

SEQ ID NO: 4061351 - DNA, 22 bp, Homo sapiens
tgccagcacagagcgtccttcc

SEQ ID NO: 4061352 - DNA, 17 bp, Homo sapiens
tgccagccccacacagc

SEQ ID NO: 4061353 - DNA, 23 bp, Homo sapiens
tgccagccttgagccctggctgt

SEQ ID NO: 4061354 - DNA, 19 bp, Homo sapiens
tgccagctacttcctcctc

SEQ ID NO: 4061355 - DNA, 21 bp, Homo sapiens
tgccagcttctctctccaggg

SEQ ID NO: 4061356 - DNA, 20 bp, Homo sapiens
tgccagcttttcctcccttg

SEQ ID NO: 4061357 - DNA, 22 bp, Homo sapiens
tgccaggaacctgtcctaagga

SEQ ID NO: 4061358 - DNA, 12 bp, Homo sapiens
tgccaggactcc

SEQ ID NO: 4061359 - DNA, 15 bp, Homo sapiens
tgccaggcaggggtg

SEQ ID NO: 4061360 - DNA, 14 bp, Homo sapiens
tgccaggccagcct

SEQ ID NO: 4061361 - DNA, 17 bp, Homo sapiens
tgccaggccagcctccg

SEQ ID NO: 4061362 - DNA, 17 bp, Homo sapiens
tgccagggcaatgatga

SEQ ID NO: 4061363 - DNA, 22 bp, Homo sapiens
tgccagggcaatgatgaatgag

SEQ ID NO: 4061364 - DNA, 14 bp, Homo sapiens
tgccagggcccacc

SEQ ID NO: 4061365 - DNA, 15 bp, Homo sapiens
tgccagggcccaccc

SEQ ID NO: 4061366 - DNA, 19 bp, Homo sapiens
tgccagggcccaccccagc

SEQ ID NO: 4061367 - DNA, 23 bp, Homo sapiens
tgccagtaacacaggccaccctg

SEQ ID NO: 4061368 - DNA, 18 bp, Homo sapiens
tgccagtaacgcgtcttc

SEQ ID NO: 4061369 - DNA, 21 bp, Homo sapiens
tgccagtaacgcgtcttcctg

SEQ ID NO: 4061370 - DNA, 23 bp, Homo sapiens
tgccagtaacgcgtcttcctgag

SEQ ID NO: 4061371 - DNA, 16 bp, Homo sapiens
tgccagtgacagacag

SEQ ID NO: 4061372 - DNA, 14 bp, Homo sapiens
tgccagtgcagcca

SEQ ID NO: 4061373 - DNA, 16 bp, Homo sapiens
tgccagtgcagccact

SEQ ID NO: 4061374 - DNA, 17 bp, Homo sapiens
tgccagtggatcccctg

SEQ ID NO: 4061375 - DNA, 21 bp, Homo sapiens
tgccagtggatcccctgcggt

SEQ ID NO: 4061376 - DNA, 14 bp, Homo sapiens
tgccagttcctgta

SEQ ID NO: 4061377 - DNA, 13 bp, Homo sapiens
tgccataattcta

SEQ ID NO: 4061378 - DNA, 23 bp, Homo sapiens
tgccatacatcagttattcattc

SEQ ID NO: 4061379 - DNA, 15 bp, Homo sapiens
tgccatcatgcctga

SEQ ID NO: 4061380 - DNA, 22 bp, Homo sapiens
tgccatctgcgtgacaataaaa

SEQ ID NO: 4061381 - DNA, 14 bp, Homo sapiens
tgccatctgtacat

SEQ ID NO: 4061382 - DNA, 17 bp, Homo sapiens
tgccatgatctgtattt

SEQ ID NO: 4061383 - DNA, 22 bp, Homo sapiens
tgccatgggcttcactgtataa

SEQ ID NO: 4061384 - DNA, 23 bp, Homo sapiens
tgccatgggcttcactgtataaa

SEQ ID NO: 4061385 - DNA, 21 bp, Homo sapiens
tgccatgttgcccctttctct

SEQ ID NO: 4061386 - DNA, 18 bp, Homo sapiens
tgccattccactccactc

SEQ ID NO: 4061387 - DNA, 14 bp, Homo sapiens
tgccatttcccttc

SEQ ID NO: 4061388 - DNA, 21 bp, Homo sapiens
tgcccaagcccaggccaccct

SEQ ID NO: 4061389 - DNA, 17 bp, Homo sapiens
tgcccaagggcctccca

SEQ ID NO: 4061390 - DNA, 21 bp, Homo sapiens
tgcccaagggcctcccaccag

SEQ ID NO: 4061391 - DNA, 16 bp, Homo sapiens
tgcccaagtcacacag

SEQ ID NO: 4061392 - DNA, 17 bp, Homo sapiens
tgcccaagtcacacagc

SEQ ID NO: 4061393 - DNA, 21 bp, Homo sapiens
tgcccaatgagactctagggt

SEQ ID NO: 4061394 - DNA, 15 bp, Homo sapiens
tgcccaattggagga

SEQ ID NO: 4061395 - DNA, 21 bp, Homo sapiens
tgcccaattggaggaaagcaa

SEQ ID NO: 4061396 - DNA, 16 bp, Homo sapiens
tgcccacatcccaggc

SEQ ID NO: 4061397 - DNA, 13 bp, Homo sapiens
tgcccaccccctg

SEQ ID NO: 4061398 - DNA, 19 bp, Homo sapiens
tgcccaccccctgccctgc

SEQ ID NO: 4061399 - DNA, 18 bp, Homo sapiens
tgcccacccctcactccc

SEQ ID NO: 4061400 - DNA, 15 bp, Homo sapiens
tgcccacctgcccat

SEQ ID NO: 4061401 - DNA, 19 bp, Homo sapiens
tgcccacctgcccatcaca

SEQ ID NO: 4061402 - DNA, 16 bp, Homo sapiens
tgcccactccctatct

SEQ ID NO: 4061403 - DNA, 14 bp, Homo sapiens
tgcccactcctgct

SEQ ID NO: 4061404 - DNA, 16 bp, Homo sapiens
tgcccactgctggtgc

SEQ ID NO: 4061405 - DNA, 16 bp, Homo sapiens
tgcccagaacttccct

SEQ ID NO: 4061406 - DNA, 19 bp, Homo sapiens
tgcccagacccctctggcc

SEQ ID NO: 4061407 - DNA, 17 bp, Homo sapiens
tgcccagatcagccaga

SEQ ID NO: 4061408 - DNA, 14 bp, Homo sapiens
tgcccagcctgggg

SEQ ID NO: 4061409 - DNA, 23 bp, Homo sapiens
tgcccagcctggggcaaacctag

SEQ ID NO: 4061410 - DNA, 16 bp, Homo sapiens
tgccgctgccgctgca

SEQ ID NO: 4061411 - DNA, 18 bp, Homo sapiens
tgccggatacaaactggt

SEQ ID NO: 4061412 - DNA, 17 bp, Homo sapiens
tgccggctgtggagcaa

SEQ ID NO: 4061413 - DNA, 23 bp, Homo sapiens
tgccgggctgagggcctgctgga

SEQ ID NO: 4061414 - DNA, 21 bp, Homo sapiens
tgccggtcttgacagctcagt

SEQ ID NO: 4061415 - DNA, 20 bp, Homo sapiens
tgccgtgggcctgtcgtgcc

SEQ ID NO: 4061416 - DNA, 16 bp, Homo sapiens
tgccgtgtgagtgtga

SEQ ID NO: 4061417 - DNA, 22 bp, Homo sapiens
tgccgtgtgagtgtgacagggc

SEQ ID NO: 4061418 - DNA, 22 bp, Homo sapiens
tgcctacaaccatccctgccac

SEQ ID NO: 4061419 - DNA, 22 bp, Homo sapiens
tgcctacagaacttcagaaaga

SEQ ID NO: 4061420 - DNA, 23 bp, Homo sapiens
tgcctacagaacttcagaaagac

SEQ ID NO: 4061421 - DNA, 16 bp, Homo sapiens
tgcctagacttcccaa

SEQ ID NO: 4061422 - DNA, 16 bp, Homo sapiens
tgcctagcaagctggc

SEQ ID NO: 4061423 - DNA, 18 bp, Homo sapiens
tgcctagcaagctggcct

SEQ ID NO: 4061424 - DNA, 14 bp, Homo sapiens
tgcctagcagagtg

SEQ ID NO: 4061425 - DNA, 14 bp, Homo sapiens
tgcctatttgtgtg

SEQ ID NO: 4061426 - DNA, 15 bp, Homo sapiens
tgcctcaatgccagt

SEQ ID NO: 4061427 - DNA, 16 bp, Homo sapiens
tgcctcaatgccagta

SEQ ID NO: 4061428 - DNA, 19 bp, Homo sapiens
tgcctcaatgtgaccaggg

SEQ ID NO: 4061429 - DNA, 20 bp, Homo sapiens
tgcctcagactccgccctcc

SEQ ID NO: 4061430 - DNA, 14 bp, Homo sapiens
tgcctcagcctccg

SEQ ID NO: 4061431 - DNA, 14 bp, Homo sapiens
tgcctcagccttcc

SEQ ID NO: 4061432 - DNA, 16 bp, Homo sapiens
tgcctccaccctcctc

SEQ ID NO: 4061433 - DNA, 19 bp, Homo sapiens
tgcctcccaaggtcctctc

SEQ ID NO: 4061434 - DNA, 17 bp, Homo sapiens
tgcctccccatttccca

SEQ ID NO: 4061435 - DNA, 20 bp, Homo sapiens
tgcctcctgggaagatgagg

SEQ ID NO: 4061436 - DNA, 17 bp, Homo sapiens
tgcctcgctcaccgctg

SEQ ID NO: 4061437 - DNA, 22 bp, Homo sapiens
tgcctcgctcaccgctggccct

SEQ ID NO: 4061438 - DNA, 20 bp, Homo sapiens
tgcctctaccagttggcaga

SEQ ID NO: 4061439 - DNA, 13 bp, Homo sapiens
tgcctctcccgca

SEQ ID NO: 4061440 - DNA, 20 bp, Homo sapiens
tgcctctgcggggcagggcc

SEQ ID NO: 4061441 - DNA, 13 bp, Homo sapiens
tgcctcttctttg

SEQ ID NO: 4061442 - DNA, 19 bp, Homo sapiens
tgcctcttctttgtgcctt

SEQ ID NO: 4061443 - DNA, 19 bp, Homo sapiens
tgcctgaaacagccatgtc

SEQ ID NO: 4061444 - DNA, 20 bp, Homo sapiens
tgcctgaaacagccatgtcc

SEQ ID NO: 4061445 - DNA, 18 bp, Homo sapiens
tgcctgacactgagcccc

SEQ ID NO: 4061446 - DNA, 22 bp, Homo sapiens
tgcctgacactgagccccacct

SEQ ID NO: 4061447 - DNA, 16 bp, Homo sapiens
tgcctgactaaaatgt

SEQ ID NO: 4061448 - DNA, 11 bp, Homo sapiens
tgcctgagctg

SEQ ID NO: 4061449 - DNA, 14 bp, Homo sapiens
tgcctgagggcagt

SEQ ID NO: 4061450 - DNA, 16 bp, Homo sapiens
tgcctgaggggcagcc

SEQ ID NO: 4061451 - DNA, 14 bp, Homo sapiens
tgcctgagggtgga

SEQ ID NO: 4061452 - DNA, 15 bp, Homo sapiens
tgcctgagtttccag

SEQ ID NO: 4061453 - DNA, 22 bp, Homo sapiens
tgcctgcactgagagggcaagg

SEQ ID NO: 4061454 - DNA, 18 bp, Homo sapiens
tgcctgcagagagaagcc

SEQ ID NO: 4061455 - DNA, 14 bp, Homo sapiens
tgcctgcagcaggc

SEQ ID NO: 4061456 - DNA, 17 bp, Homo sapiens
tgcctgcagcaggcagc

SEQ ID NO: 4061457 - DNA, 19 bp, Homo sapiens
tgcctgccagctgcactga

SEQ ID NO: 4061458 - DNA, 14 bp, Homo sapiens
tgcctgccccacac

SEQ ID NO: 4061459 - DNA, 18 bp, Homo sapiens
tgcctgcccccctcatct

SEQ ID NO: 4061460 - DNA, 17 bp, Homo sapiens
tgcctgccccgccccca

SEQ ID NO: 4061461 - DNA, 10 bp, Homo sapiens
tgcctgccct

SEQ ID NO: 4061462 - DNA, 13 bp, Homo sapiens
tgcctgccctttg

SEQ ID NO: 4061463 - DNA, 21 bp, Homo sapiens
tgcctgccctttgtcctcctg

SEQ ID NO: 4061464 - DNA, 15 bp, Homo sapiens
tgcctgcgcctgctg

SEQ ID NO: 4061465 - DNA, 12 bp, Homo sapiens
tgcctgctgggc

SEQ ID NO: 4061466 - DNA, 21 bp, Homo sapiens
tgcctggacatttgccttgct

SEQ ID NO: 4061467 - DNA, 17 bp, Homo sapiens
tgcctggagagggtctc

SEQ ID NO: 4061468 - DNA, 21 bp, Homo sapiens
tgcctggagtgcccaccctgg

SEQ ID NO: 4061469 - DNA, 15 bp, Homo sapiens
tgcctggagtgctgt

SEQ ID NO: 4061470 - DNA, 23 bp, Homo sapiens
tgcctggatcccctctgtctaca

SEQ ID NO: 4061471 - DNA, 14 bp, Homo sapiens
tgcctggccaggca

SEQ ID NO: 4061472 - DNA, 16 bp, Homo sapiens
tgcctggccaggcaga

SEQ ID NO: 4061473 - DNA, 20 bp, Homo sapiens
tgcctggccaggcagatctg

SEQ ID NO: 4061474 - DNA, 16 bp, Homo sapiens
tgcctggccccagcct

SEQ ID NO: 4061475 - DNA, 17 bp, Homo sapiens
tgcctggccccagcctg

SEQ ID NO: 4061476 - DNA, 21 bp, Homo sapiens
tgcctggcccctcgcctgtgg

SEQ ID NO: 4061477 - DNA, 14 bp, Homo sapiens
tgcctggcctctgc

SEQ ID NO: 4061478 - DNA, 15 bp, Homo sapiens
tgcctggcctctgcc

SEQ ID NO: 4061479 - DNA, 16 bp, Homo sapiens
tgcctggcctctgcct

SEQ ID NO: 4061480 - DNA, 15 bp, Homo sapiens
tgcctggctaacttt

SEQ ID NO: 4061481 - DNA, 14 bp, Homo sapiens
tgcctgggggagtt

SEQ ID NO: 4061482 - DNA, 20 bp, Homo sapiens
tgcctgggggagttttcctc

SEQ ID NO: 4061483 - DNA, 12 bp, Homo sapiens
tgcctggggtct

SEQ ID NO: 4061484 - DNA, 13 bp, Homo sapiens
tgcctgtaaacat

SEQ ID NO: 4061485 - DNA, 14 bp, Homo sapiens
tgcctgtctgcccc

SEQ ID NO: 4061486 - DNA, 16 bp, Homo sapiens
tgcctgtctggctcag

SEQ ID NO: 4061487 - DNA, 14 bp, Homo sapiens
tgcctgtgccaccc

SEQ ID NO: 4061488 - DNA, 20 bp, Homo sapiens
tgcctgtgccacccaccagg

SEQ ID NO: 4061489 - DNA, 22 bp, Homo sapiens
tgcctgtggaagagtgtgtgtg

SEQ ID NO: 4061490 - DNA, 15 bp, Homo sapiens
tgccttaaaaccaaa

SEQ ID NO: 4061491 - DNA, 20 bp, Homo sapiens
tgccttaaaaccaaagaggg

SEQ ID NO: 4061492 - DNA, 19 bp, Homo sapiens
tgccttaaacactcacctt

SEQ ID NO: 4061493 - DNA, 17 bp, Homo sapiens
tgccttaaacctacctc

SEQ ID NO: 4061494 - DNA, 17 bp, Homo sapiens
tgccttaggcctacctg

SEQ ID NO: 4061495 - DNA, 16 bp, Homo sapiens
tgccttagtctcagtt

SEQ ID NO: 4061496 - DNA, 23 bp, Homo sapiens
tgccttcagctgttgcagatgaa

SEQ ID NO: 4061497 - DNA, 17 bp, Homo sapiens
tgccttcaggcttctgt

SEQ ID NO: 4061498 - DNA, 24 bp, Homo sapiens
tgccttcatggaactcagctgtct

SEQ ID NO: 4061499 - DNA, 13 bp, Homo sapiens
tgccttccataat

SEQ ID NO: 4061500 - DNA, 16 bp, Homo sapiens
tgccttccctagcttt

SEQ ID NO: 4061501 - DNA, 21 bp, Homo sapiens
tgccttcctttctccaggacc

SEQ ID NO: 4061502 - DNA, 19 bp, Homo sapiens
tgccttctcctctctgggc

SEQ ID NO: 4061503 - DNA, 21 bp, Homo sapiens
tgccttctccttccccaggat

SEQ ID NO: 4061504 - DNA, 23 bp, Homo sapiens
tgccttctccttccccaggatgg

SEQ ID NO: 4061505 - DNA, 24 bp, Homo sapiens
tgccttctccttccccaggatgga

SEQ ID NO: 4061506 - DNA, 20 bp, Homo sapiens
tgccttctgaaatgtgaccc

SEQ ID NO: 4061507 - DNA, 13 bp, Homo sapiens
tgccttcttcacc

SEQ ID NO: 4061508 - DNA, 13 bp, Homo sapiens
tgccttctttcca

SEQ ID NO: 4061509 - DNA, 12 bp, Homo sapiens
tgccttctttga

SEQ ID NO: 4061510 - DNA, 13 bp, Homo sapiens
tgccttctttgaa

SEQ ID NO: 4061511 - DNA, 15 bp, Homo sapiens
tgccttctttgaaga

SEQ ID NO: 4061512 - DNA, 16 bp, Homo sapiens
tgccttcttttgatta

SEQ ID NO: 4061513 - DNA, 18 bp, Homo sapiens
tgctcaaatctattcaga

SEQ ID NO: 4061514 - DNA, 19 bp, Homo sapiens
tgctcaaatctattcagac

SEQ ID NO: 4061515 - DNA, 20 bp, Homo sapiens
tgctcaactctacccctgct

SEQ ID NO: 4061516 - DNA, 23 bp, Homo sapiens
tgctcaactctacccctgctccc

SEQ ID NO: 4061517 - DNA, 18 bp, Homo sapiens
tgctcaataaacacttgt

SEQ ID NO: 4061518 - DNA, 19 bp, Homo sapiens
tgctcaatggagaatataa

SEQ ID NO: 4061519 - DNA, 17 bp, Homo sapiens
tgctcacaacttagtgt

SEQ ID NO: 4061520 - DNA, 15 bp, Homo sapiens
tgctcaccacctgcc

SEQ ID NO: 4061521 - DNA, 17 bp, Homo sapiens
tgctcaccagccctgca

SEQ ID NO: 4061522 - DNA, 12 bp, Homo sapiens
tgctcacctcta

SEQ ID NO: 4061523 - DNA, 17 bp, Homo sapiens
tgctcagaacttgctgc

SEQ ID NO: 4061524 - DNA, 21 bp, Homo sapiens
tgctcagcaattcagacccct

SEQ ID NO: 4061525 - DNA, 14 bp, Homo sapiens
tgctcagccaagct

SEQ ID NO: 4061526 - DNA, 17 bp, Homo sapiens
tgctcagccctgactgg

SEQ ID NO: 4061527 - DNA, 17 bp, Homo sapiens
tgctcagctctgggcca

SEQ ID NO: 4061528 - DNA, 18 bp, Homo sapiens
tgctcagctctgggccat

SEQ ID NO: 4061529 - DNA, 16 bp, Homo sapiens
tgctcagtctcccttt

SEQ ID NO: 4061530 - DNA, 12 bp, Homo sapiens
tgctcatttaag

SEQ ID NO: 4061531 - DNA, 19 bp, Homo sapiens
tgctcattttctggtttgg

SEQ ID NO: 4061532 - DNA, 21 bp, Homo sapiens
tgctcattttctggtttggca

SEQ ID NO: 4061533 - DNA, 23 bp, Homo sapiens
tgctccacccttggcctgtctca

SEQ ID NO: 4061534 - DNA, 18 bp, Homo sapiens
tgctccacgaagccttaa

SEQ ID NO: 4061535 - DNA, 20 bp, Homo sapiens
tgctccagaagatgccagct

SEQ ID NO: 4061536 - DNA, 17 bp, Homo sapiens
tgctccagctctggcat

SEQ ID NO: 4061537 - DNA, 13 bp, Homo sapiens
tgctccaggcctg

SEQ ID NO: 4061538 - DNA, 18 bp, Homo sapiens
tgctccataccttttctc

SEQ ID NO: 4061539 - DNA, 14 bp, Homo sapiens
tgctcccagcagcc

SEQ ID NO: 4061540 - DNA, 20 bp, Homo sapiens
tgctcccagcagccctaagg

SEQ ID NO: 4061541 - DNA, 21 bp, Homo sapiens
tgctcccagcagccctaagga

SEQ ID NO: 4061542 - DNA, 14 bp, Homo sapiens
tgctccccacagcg

SEQ ID NO: 4061543 - DNA, 22 bp, Homo sapiens
tgctccccacagcgtccctggc

SEQ ID NO: 4061544 - DNA, 16 bp, Homo sapiens
tgctccccagccctgg

SEQ ID NO: 4061545 - DNA, 13 bp, Homo sapiens
tgctccccctttt

SEQ ID NO: 4061546 - DNA, 18 bp, Homo sapiens
tgctcccctgtgccagcc

SEQ ID NO: 4061547 - DNA, 16 bp, Homo sapiens
tgctccccttcccctt

SEQ ID NO: 4061548 - DNA, 19 bp, Homo sapiens
tgctccctaccccagggcc

SEQ ID NO: 4061549 - DNA, 13 bp, Homo sapiens
tgctccctcagcc

SEQ ID NO: 4061550 - DNA, 20 bp, Homo sapiens
tgctccctcagcctcagagg

SEQ ID NO: 4061551 - DNA, 20 bp, Homo sapiens
tgctccctgctttggctgag

SEQ ID NO: 4061552 - DNA, 23 bp, Homo sapiens
tgctccctgtgtccacctgtggg

SEQ ID NO: 4061553 - DNA, 16 bp, Homo sapiens
tgctcccttcagcccc

SEQ ID NO: 4061554 - DNA, 13 bp, Homo sapiens
tgctccgcccgct

SEQ ID NO: 4061555 - DNA, 23 bp, Homo sapiens
tgctccgcccgctcctgccgcag

SEQ ID NO: 4061556 - DNA, 23 bp, Homo sapiens
tgctccgctgctccttggcttac

SEQ ID NO: 4061557 - DNA, 16 bp, Homo sapiens
tgctcctcacctgtct

SEQ ID NO: 4061558 - DNA, 11 bp, Homo sapiens
tgctcctcctg

SEQ ID NO: 4061559 - DNA, 18 bp, Homo sapiens
tgctcctcttgattcctg

SEQ ID NO: 4061560 - DNA, 16 bp, Homo sapiens
tgctcctgcttttctg

SEQ ID NO: 4061561 - DNA, 20 bp, Homo sapiens
tgctcctgcttttctgtcct

SEQ ID NO: 4061562 - DNA, 22 bp, Homo sapiens
tgctcctgcttttctgtcctgg

SEQ ID NO: 4061563 - DNA, 16 bp, Homo sapiens
tgctccttcccttgct

SEQ ID NO: 4061564 - DNA, 15 bp, Homo sapiens
tgctccttggcttac

SEQ ID NO: 4061565 - DNA, 22 bp, Homo sapiens
tgctccttggcttacctgacct

SEQ ID NO: 4061566 - DNA, 16 bp, Homo sapiens
tgctcgccccagcagg

SEQ ID NO: 4061567 - DNA, 23 bp, Homo sapiens
tgctctacccatgagcctgcccg

SEQ ID NO: 4061568 - DNA, 19 bp, Homo sapiens
tgctctaggaagacatttt

SEQ ID NO: 4061569 - DNA, 16 bp, Homo sapiens
tgctctagtgggacag

SEQ ID NO: 4061570 - DNA, 15 bp, Homo sapiens
tgctctcaattaaag

SEQ ID NO: 4061571 - DNA, 20 bp, Homo sapiens
tgctctccaagtctcagtgg

SEQ ID NO: 4061572 - DNA, 11 bp, Homo sapiens
tgctctcctca

SEQ ID NO: 4061573 - DNA, 17 bp, Homo sapiens
tgctctctcaaattgtc

SEQ ID NO: 4061574 - DNA, 18 bp, Homo sapiens
tgctctgacgtagaaaga

SEQ ID NO: 4061575 - DNA, 23 bp, Homo sapiens
tgctctgagagcaaactggcttg

SEQ ID NO: 4061576 - DNA, 16 bp, Homo sapiens
tgctctgagccacagt

SEQ ID NO: 4061577 - DNA, 10 bp, Homo sapiens
tgctctgctg

SEQ ID NO: 4061578 - DNA, 19 bp, Homo sapiens
tgctctggaaaatgtgacc

SEQ ID NO: 4061579 - DNA, 19 bp, Homo sapiens
tgctctggttgtttctgtt

SEQ ID NO: 4061580 - DNA, 21 bp, Homo sapiens
tgctctggttgtttctgttcc

SEQ ID NO: 4061581 - DNA, 12 bp, Homo sapiens
tgctctgtcccc

SEQ ID NO: 4061582 - DNA, 18 bp, Homo sapiens
tgctctgtcccccaggct

SEQ ID NO: 4061583 - DNA, 18 bp, Homo sapiens
tgctctgtgttcccagag

SEQ ID NO: 4061584 - DNA, 22 bp, Homo sapiens
tgctctgtgttcccagaggcag

SEQ ID NO: 4061585 - DNA, 13 bp, Homo sapiens
tgctctgttccca

SEQ ID NO: 4061586 - DNA, 16 bp, Homo sapiens
tgctcttgcagttgct

SEQ ID NO: 4061587 - DNA, 14 bp, Homo sapiens
tgctcttgtcccac

SEQ ID NO: 4061588 - DNA, 16 bp, Homo sapiens
tgctcttgtcccacgt

SEQ ID NO: 4061589 - DNA, 15 bp, Homo sapiens
tgctcttgtttttat

SEQ ID NO: 4061590 - DNA, 18 bp, Homo sapiens
tgctcttgtttttattaa

SEQ ID NO: 4061591 - DNA, 20 bp, Homo sapiens
tgctctttcccacccagcct

SEQ ID NO: 4061592 - DNA, 21 bp, Homo sapiens
tgctctttcccacccagcctg

SEQ ID NO: 4061593 - DNA, 16 bp, Homo sapiens
tgctcttttaagcagt

SEQ ID NO: 4061594 - DNA, 23 bp, Homo sapiens
tgctcttttaagcagtctcactg

SEQ ID NO: 4061595 - DNA, 15 bp, Homo sapiens
tgctcttttcctggt

SEQ ID NO: 4061596 - DNA, 14 bp, Homo sapiens
tgctcttttttctc

SEQ ID NO: 4061597 - DNA, 14 bp, Homo sapiens
tgctgaaaatggta

SEQ ID NO: 4061598 - DNA, 15 bp, Homo sapiens
tgctgaacacacaca

SEQ ID NO: 4061599 - DNA, 14 bp, Homo sapiens
tgctgaacagtgga

SEQ ID NO: 4061600 - DNA, 16 bp, Homo sapiens
tgctgaactccttgtt

SEQ ID NO: 4061601 - DNA, 17 bp, Homo sapiens
tgctgaactccttgtta

SEQ ID NO: 4061602 - DNA, 17 bp, Homo sapiens
tgctgaatgcagggaat

SEQ ID NO: 4061603 - DNA, 22 bp, Homo sapiens
tgctgaatggttttcaaaataa

SEQ ID NO: 4061604 - DNA, 18 bp, Homo sapiens
tgctgacattcacctgcc

SEQ ID NO: 4061605 - DNA, 16 bp, Homo sapiens
tgctgaccaattgtgc

SEQ ID NO: 4061606 - DNA, 18 bp, Homo sapiens
tgctgaccaattgtgctg

SEQ ID NO: 4061607 - DNA, 22 bp, Homo sapiens
tgctgacggccagggagaagct

SEQ ID NO: 4061608 - DNA, 23 bp, Homo sapiens
tgctgagagaaatatggaactta

SEQ ID NO: 4061609 - DNA, 12 bp, Homo sapiens
tgctgagcctct

SEQ ID NO: 4061610 - DNA, 14 bp, Homo sapiens
tgctgagcctctgc

SEQ ID NO: 4061611 - DNA, 16 bp, Homo sapiens
tgctgaggccagggct

SEQ ID NO: 4061612 - DNA, 17 bp, Homo sapiens
tgctgaggcctccagct

SEQ ID NO: 4061613 - DNA, 12 bp, Homo sapiens
tgctgagggtgt

SEQ ID NO: 4061614 - DNA, 22 bp, Homo sapiens
tgctgagggtgtttcttcctgc

SEQ ID NO: 4061615 - DNA, 17 bp, Homo sapiens
tgctgagtcatctgtta

SEQ ID NO: 4061616 - DNA, 19 bp, Homo sapiens
tgctgagtcatctgttagg

SEQ ID NO: 4061617 - DNA, 19 bp, Homo sapiens
tgctgagtggcgcaaggcc

SEQ ID NO: 4061618 - DNA, 15 bp, Homo sapiens
tgctgagttggcctg

SEQ ID NO: 4061619 - DNA, 23 bp, Homo sapiens
tgctgatgacccccccagcttca

SEQ ID NO: 4061620 - DNA, 20 bp, Homo sapiens
tgctgatgattttgcaaaat

SEQ ID NO: 4061621 - DNA, 20 bp, Homo sapiens
tgctgcatagctctatttta

SEQ ID NO: 4061622 - DNA, 15 bp, Homo sapiens
tgctgccacacttca

SEQ ID NO: 4061623 - DNA, 16 bp, Homo sapiens
tgctgccacacttcag

SEQ ID NO: 4061624 - DNA, 17 bp, Homo sapiens
tgctgccagtaccagcc

SEQ ID NO: 4061625 - DNA, 21 bp, Homo sapiens
tgctgccatgacagaggctgc

SEQ ID NO: 4061626 - DNA, 21 bp, Homo sapiens
tgctgccatttgatttttcta

SEQ ID NO: 4061627 - DNA, 12 bp, Homo sapiens
tgctgccccagc

SEQ ID NO: 4061628 - DNA, 13 bp, Homo sapiens
tgctgccccagct

SEQ ID NO: 4061629 - DNA, 13 bp, Homo sapiens
tgctgcccctgca

SEQ ID NO: 4061630 - DNA, 14 bp, Homo sapiens
tgctgcccctgcag

SEQ ID NO: 4061631 - DNA, 14 bp, Homo sapiens
tgctgccctgtgta

SEQ ID NO: 4061632 - DNA, 16 bp, Homo sapiens
tgctgcctgctgagat

SEQ ID NO: 4061633 - DNA, 18 bp, Homo sapiens
tgctgcgcaccaatgccc

SEQ ID NO: 4061634 - DNA, 16 bp, Homo sapiens
tgctgcgcccttacct

SEQ ID NO: 4061635 - DNA, 17 bp, Homo sapiens
tgctgctccgcccgctc

SEQ ID NO: 4061636 - DNA, 17 bp, Homo sapiens
tgctgctgcctctttcc

SEQ ID NO: 4061637 - DNA, 12 bp, Homo sapiens
tgctgctggcca

SEQ ID NO: 4061638 - DNA, 13 bp, Homo sapiens
tgctgctggccaa

SEQ ID NO: 4061639 - DNA, 14 bp, Homo sapiens
tgctgctggccaaa

SEQ ID NO: 4061640 - DNA, 21 bp, Homo sapiens
tgctgctggccaaatagcaaa

SEQ ID NO: 4061641 - DNA, 12 bp, Homo sapiens
tgctgctgtctt

SEQ ID NO: 4061642 - DNA, 14 bp, Homo sapiens
tgctgctgtgtttt

SEQ ID NO: 4061643 - DNA, 20 bp, Homo sapiens
tgctggacggggactgggga

SEQ ID NO: 4061644 - DNA, 21 bp, Homo sapiens
tgctggactggaggcccctgg

SEQ ID NO: 4061645 - DNA, 13 bp, Homo sapiens
tgctggagaggtt

SEQ ID NO: 4061646 - DNA, 17 bp, Homo sapiens
tgctggataaaatgagg

SEQ ID NO: 4061647 - DNA, 22 bp, Homo sapiens
tgctggatattttcaaattgta

SEQ ID NO: 4061648 - DNA, 14 bp, Homo sapiens
tgctggccagcacc

SEQ ID NO: 4061649 - DNA, 12 bp, Homo sapiens
tgctggcccagg

SEQ ID NO: 4061650 - DNA, 13 bp, Homo sapiens
tgctggcccaggg

SEQ ID NO: 4061651 - DNA, 14 bp, Homo sapiens
tgctggcccagggc

SEQ ID NO: 4061652 - DNA, 16 bp, Homo sapiens
tgctggcccagggccc

SEQ ID NO: 4061653 - DNA, 19 bp, Homo sapiens
tgctggcccagggcccaga

SEQ ID NO: 4061654 - DNA, 23 bp, Homo sapiens
tgctggcccagggcccagagccc

SEQ ID NO: 4061655 - DNA, 12 bp, Homo sapiens
tgctggcctgga

SEQ ID NO: 4061656 - DNA, 15 bp, Homo sapiens
tgctggcctggatct

SEQ ID NO: 4061657 - DNA, 13 bp, Homo sapiens
tgctggctcttct

SEQ ID NO: 4061658 - DNA, 13 bp, Homo sapiens
tgctggctgcctt

SEQ ID NO: 4061659 - DNA, 16 bp, Homo sapiens
tgctggcttccagctt

SEQ ID NO: 4061660 - DNA, 17 bp, Homo sapiens
tgctgggaccagagcca

SEQ ID NO: 4061661 - DNA, 18 bp, Homo sapiens
tgctgggaccagagccag

SEQ ID NO: 4061662 - DNA, 17 bp, Homo sapiens
tgctgggagttctagaa

SEQ ID NO: 4061663 - DNA, 14 bp, Homo sapiens
tgctgggccactgg

SEQ ID NO: 4061664 - DNA, 22 bp, Homo sapiens
tgctgggctccccccagtggga

SEQ ID NO: 4061665 - DNA, 12 bp, Homo sapiens
tgctgggctggg

SEQ ID NO: 4061666 - DNA, 16 bp, Homo sapiens
tgctgggctgggccct

SEQ ID NO: 4061667 - DNA, 12 bp, Homo sapiens
tgctggggcagg

SEQ ID NO: 4061668 - DNA, 21 bp, Homo sapiens
tgctgggggaatgagcccaga

SEQ ID NO: 4061669 - DNA, 23 bp, Homo sapiens
tgctgggggaatgagcccagaga

SEQ ID NO: 4061670 - DNA, 19 bp, Homo sapiens
tgctggggtcaaggcagta

SEQ ID NO: 4061671 - DNA, 17 bp, Homo sapiens
tgctggtaacagtggct

SEQ ID NO: 4061672 - DNA, 15 bp, Homo sapiens
tgctggtgccagggt

SEQ ID NO: 4061673 - DNA, 22 bp, Homo sapiens
tgctggtttatttgttgttttc

SEQ ID NO: 4061674 - DNA, 15 bp, Homo sapiens
tgctgtacccagatg

SEQ ID NO: 4061675 - DNA, 21 bp, Homo sapiens
tgctgtacccagatgcctaca

SEQ ID NO: 4061676 - DNA, 16 bp, Homo sapiens
tgctgtagatgacaac

SEQ ID NO: 4061677 - DNA, 16 bp, Homo sapiens
tgctgtataagttatt

SEQ ID NO: 4061678 - DNA, 20 bp, Homo sapiens
tgctgtatgctgatcatcgc

SEQ ID NO: 4061679 - DNA, 13 bp, Homo sapiens
tgctgtcattgct

SEQ ID NO: 4061680 - DNA, 24 bp, Homo sapiens
tgctgtcattgcttcttctgaggc

SEQ ID NO: 4061681 - DNA, 12 bp, Homo sapiens
tgctgtccctcc

SEQ ID NO: 4061682 - DNA, 13 bp, Homo sapiens
tgctgtccctccc

SEQ ID NO: 4061683 - DNA, 17 bp, Homo sapiens
tgctgtccctccccctt

SEQ ID NO: 4061684 - DNA, 21 bp, Homo sapiens
tgctgtcgttgttgtggaagc

SEQ ID NO: 4061685 - DNA, 21 bp, Homo sapiens
tgctgtcttccccaccgcagt

SEQ ID NO: 4061686 - DNA, 18 bp, Homo sapiens
tgctgtgaaccctggggc

SEQ ID NO: 4061687 - DNA, 19 bp, Homo sapiens
tgctgtgaggctgtcctgt

SEQ ID NO: 4061688 - DNA, 17 bp, Homo sapiens
tgctgtgagggagggga

SEQ ID NO: 4061689 - DNA, 18 bp, Homo sapiens
tgctgtgcgtggaaaaag

SEQ ID NO: 4061690 - DNA, 21 bp, Homo sapiens
tgctgtgcgtggaaaaagacg

SEQ ID NO: 4061691 - DNA, 16 bp, Homo sapiens
tgctgtgctgtgttta

SEQ ID NO: 4061692 - DNA, 22 bp, Homo sapiens
tgctgtggaactacattactgt

SEQ ID NO: 4061693 - DNA, 14 bp, Homo sapiens
tgctgtggccaggg

SEQ ID NO: 4061694 - DNA, 10 bp, Homo sapiens
tgctgtgggc

SEQ ID NO: 4061695 - DNA, 11 bp, Homo sapiens
tgctgtgggca

SEQ ID NO: 4061696 - DNA, 14 bp, Homo sapiens
tgctgtgggcagca

SEQ ID NO: 4061697 - DNA, 18 bp, Homo sapiens
tgctgtgggcagcaccct

SEQ ID NO: 4061698 - DNA, 16 bp, Homo sapiens
tgctgtggtggggaga

SEQ ID NO: 4061699 - DNA, 20 bp, Homo sapiens
tgctgtggtggggagaggca

SEQ ID NO: 4061700 - DNA, 20 bp, Homo sapiens
tgctgttactgttaaccatt

SEQ ID NO: 4061701 - DNA, 21 bp, Homo sapiens
tgctgttcactggacacttca

SEQ ID NO: 4061702 - DNA, 16 bp, Homo sapiens
tgctgtttgtagtgaa

SEQ ID NO: 4061703 - DNA, 21 bp, Homo sapiens
tgctgtttgtagtgaaataat

SEQ ID NO: 4061704 - DNA, 19 bp, Homo sapiens
tgcttaaaaatcattgatt

SEQ ID NO: 4061705 - DNA, 14 bp, Homo sapiens
tgcttaaaataagc

SEQ ID NO: 4061706 - DNA, 13 bp, Homo sapiens
tgcttaaactaaa

SEQ ID NO: 4061707 - DNA, 13 bp, Homo sapiens
tgcttaaatttct

SEQ ID NO: 4061708 - DNA, 17 bp, Homo sapiens
tgcttaattcaaataat

SEQ ID NO: 4061709 - DNA, 18 bp, Homo sapiens
tgcttaattcaaataata

SEQ ID NO: 4061710 - DNA, 20 bp, Homo sapiens
tgcttaattcaaataataat

SEQ ID NO: 4061711 - DNA, 15 bp, Homo sapiens
tgcttacacatctca

SEQ ID NO: 4061712 - DNA, 20 bp, Homo sapiens
tgcttacacatctcagaccc

SEQ ID NO: 4061713 - DNA, 14 bp, Homo sapiens
tgcttacttatgcc

SEQ ID NO: 4061714 - DNA, 16 bp, Homo sapiens
tgcttagagactatca

SEQ ID NO: 4061715 - DNA, 20 bp, Homo sapiens
tgcttatgaatatttataac

SEQ ID NO: 4061716 - DNA, 15 bp, Homo sapiens
tgcttattgttccaa

SEQ ID NO: 4061717 - DNA, 17 bp, Homo sapiens
tgcttattgttccaaga

SEQ ID NO: 4061718 - DNA, 23 bp, Homo sapiens
tgcttattgttccaagacattgt

SEQ ID NO: 4061719 - DNA, 19 bp, Homo sapiens
tgcttcaaatccatccaga

SEQ ID NO: 4061720 - DNA, 23 bp, Homo sapiens
tgcttcaattaataaaaaatgga

SEQ ID NO: 4061721 - DNA, 21 bp, Homo sapiens
tgcttcaccatggccttatga

SEQ ID NO: 4061722 - DNA, 18 bp, Homo sapiens
tgcttcataaatgaagca

SEQ ID NO: 4061723 - DNA, 20 bp, Homo sapiens
tgcttcataaatgaagcagc

SEQ ID NO: 4061724 - DNA, 19 bp, Homo sapiens
tgcttcatagtattggagc

SEQ ID NO: 4061725 - DNA, 20 bp, Homo sapiens
tgcttcatagtattggagca

SEQ ID NO: 4061726 - DNA, 17 bp, Homo sapiens
tgcttcatcattccctc

SEQ ID NO: 4061727 - DNA, 23 bp, Homo sapiens
tgcttcatcattccctctcatct

SEQ ID NO: 4061728 - DNA, 15 bp, Homo sapiens
tgcttcattcaatat

SEQ ID NO: 4061729 - DNA, 16 bp, Homo sapiens
tgcttcattttggagc

SEQ ID NO: 4061730 - DNA, 14 bp, Homo sapiens
tgcttccagaaaca

SEQ ID NO: 4061731 - DNA, 11 bp, Homo sapiens
tgcttccagga

SEQ ID NO: 4061732 - DNA, 16 bp, Homo sapiens
tgcttccaggaaactc

SEQ ID NO: 4061733 - DNA, 14 bp, Homo sapiens
tgcttcccctccag

SEQ ID NO: 4061734 - DNA, 15 bp, Homo sapiens
tgcttcccctccagg

SEQ ID NO: 4061735 - DNA, 17 bp, Homo sapiens
tgcttctccatgagaca

SEQ ID NO: 4061736 - DNA, 22 bp, Homo sapiens
tgcttctctagctctctaggcc

SEQ ID NO: 4061737 - DNA, 19 bp, Homo sapiens
tgcttctgaactcaagctg

SEQ ID NO: 4061738 - DNA, 20 bp, Homo sapiens
tgcttctgaactcaagctgc

SEQ ID NO: 4061739 - DNA, 20 bp, Homo sapiens
tgcttgaaattactgtgtaa

SEQ ID NO: 4061740 - DNA, 23 bp, Homo sapiens
tgcttgaaattactgtgtaaata

SEQ ID NO: 4061741 - DNA, 17 bp, Homo sapiens
tgcttgaacccaggaga

SEQ ID NO: 4061742 - DNA, 18 bp, Homo sapiens
tgcttgatgaagcaagga

SEQ ID NO: 4061743 - DNA, 22 bp, Homo sapiens
tgcttgcactttgtaacatgtt

SEQ ID NO: 4061744 - DNA, 17 bp, Homo sapiens
tgcttgcaggaggccaa

SEQ ID NO: 4061745 - DNA, 22 bp, Homo sapiens
tgcttgcccaagtcacacagct

SEQ ID NO: 4061746 - DNA, 23 bp, Homo sapiens
tgcttggcccggccggcctggca

SEQ ID NO: 4061747 - DNA, 15 bp, Homo sapiens
tgcttggtctgtttg

SEQ ID NO: 4061748 - DNA, 16 bp, Homo sapiens
tgcttggtgctggttt

SEQ ID NO: 4061749 - DNA, 18 bp, Homo sapiens
tgcttgtaatcaagcctt

SEQ ID NO: 4061750 - DNA, 16 bp, Homo sapiens
tgcttgtcctgggcct

SEQ ID NO: 4061751 - DNA, 21 bp, Homo sapiens
tgcttgtcgctttctcagtgt

SEQ ID NO: 4061752 - DNA, 16 bp, Homo sapiens
tgcttgttccctctcc

SEQ ID NO: 4061753 - DNA, 14 bp, Homo sapiens
tgcttgtttatgat

SEQ ID NO: 4061754 - DNA, 13 bp, Homo sapiens
tgctttagcttga

SEQ ID NO: 4061755 - DNA, 16 bp, Homo sapiens
tgctttatcttttcat

SEQ ID NO: 4061756 - DNA, 15 bp, Homo sapiens
tgctttatgccttct

SEQ ID NO: 4061757 - DNA, 15 bp, Homo sapiens
tgctttattccagaa

SEQ ID NO: 4061758 - DNA, 14 bp, Homo sapiens
tgctttcctgggcc

SEQ ID NO: 4061759 - DNA, 14 bp, Homo sapiens
tgctttctgaaatt

SEQ ID NO: 4061760 - DNA, 17 bp, Homo sapiens
tgctttctgttccaaat

SEQ ID NO: 4061761 - DNA, 23 bp, Homo sapiens
tgctttctgttgtcattgctgtt

SEQ ID NO: 4061762 - DNA, 13 bp, Homo sapiens
tgctttgctcttg

SEQ ID NO: 4061763 - DNA, 17 bp, Homo sapiens
tgctttgggctgccctg

SEQ ID NO: 4061764 - DNA, 18 bp, Homo sapiens
tgctttgggctgccctgg

SEQ ID NO: 4061765 - DNA, 20 bp, Homo sapiens
tgctttgggctgccctggtg

SEQ ID NO: 4061766 - DNA, 16 bp, Homo sapiens
tgctttgtctcctcta

SEQ ID NO: 4061767 - DNA, 17 bp, Homo sapiens
tgctttgtctcctctat

SEQ ID NO: 4061768 - DNA, 19 bp, Homo sapiens
tgcttttaaggaaaggcaa

SEQ ID NO: 4061769 - DNA, 22 bp, Homo sapiens
tgcttttatatggcccagcctt

SEQ ID NO: 4061770 - DNA, 20 bp, Homo sapiens
tgcttttctaagatacatat

SEQ ID NO: 4061771 - DNA, 15 bp, Homo sapiens
tgcttttctgccctg

SEQ ID NO: 4061772 - DNA, 17 bp, Homo sapiens
tgcttttctgtatttta

SEQ ID NO: 4061773 - DNA, 23 bp, Homo sapiens
tgcttttgttccaatgtcaatgt

SEQ ID NO: 4061774 - DNA, 19 bp, Homo sapiens
tgctttttatttctgcata

SEQ ID NO: 4061775 - DNA, 14 bp, Homo sapiens
tgctttttctaatg

SEQ ID NO: 4061776 - DNA, 17 bp, Homo sapiens
tgcttttttaaatatta

SEQ ID NO: 4061777 - DNA, 14 bp, Homo sapiens
tggaaaaaaacata

SEQ ID NO: 4061778 - DNA, 16 bp, Homo sapiens
tggaaaaacagcatgt

SEQ ID NO: 4061779 - DNA, 23 bp, Homo sapiens
tggaaaaatggttgatggaaaat

SEQ ID NO: 4061780 - DNA, 21 bp, Homo sapiens
tggaaaactaagaaaattgct

SEQ ID NO: 4061781 - DNA, 15 bp, Homo sapiens
tggaaaactgtgttg

SEQ ID NO: 4061782 - DNA, 15 bp, Homo sapiens
tggaaaagaactgtt

SEQ ID NO: 4061783 - DNA, 16 bp, Homo sapiens
tggaaaagaagaaact

SEQ ID NO: 4061784 - DNA, 14 bp, Homo sapiens
tggaaaagaataca

SEQ ID NO: 4061785 - DNA, 18 bp, Homo sapiens
tggaaaaggaagactaga

SEQ ID NO: 4061786 - DNA, 20 bp, Homo sapiens
tggaaaaggaagactagagg

SEQ ID NO: 4061787 - DNA, 22 bp, Homo sapiens
tggaaaaggaagactagaggct

SEQ ID NO: 4061788 - DNA, 13 bp, Homo sapiens
tggaaacaatgtg

SEQ ID NO: 4061789 - DNA, 16 bp, Homo sapiens
tggaaacactgatttt

SEQ ID NO: 4061790 - DNA, 16 bp, Homo sapiens
tggaaacattacagtt

SEQ ID NO: 4061791 - DNA, 17 bp, Homo sapiens
tggaaactgctaaattc

SEQ ID NO: 4061792 - DNA, 19 bp, Homo sapiens
tggaaactgctaaattcta

SEQ ID NO: 4061793 - DNA, 20 bp, Homo sapiens
tggaaactgctaaattctat

SEQ ID NO: 4061794 - DNA, 14 bp, Homo sapiens
tggaaagaggctct

SEQ ID NO: 4061795 - DNA, 18 bp, Homo sapiens
tggaaagataactaggaa

SEQ ID NO: 4061796 - DNA, 23 bp, Homo sapiens
tggaaagataactaggaaatcca

SEQ ID NO: 4061797 - DNA, 15 bp, Homo sapiens
tggaaaggggagagc

SEQ ID NO: 4061798 - DNA, 22 bp, Homo sapiens
tggaaaggggagagcctgctgg

SEQ ID NO: 4061799 - DNA, 23 bp, Homo sapiens
tggaaaggggagagcctgctggc

SEQ ID NO: 4061800 - DNA, 22 bp, Homo sapiens
tggaaaggtgtgagactgggaa

SEQ ID NO: 4061801 - DNA, 19 bp, Homo sapiens
tggaaagtacactctgctg

SEQ ID NO: 4061802 - DNA, 16 bp, Homo sapiens
tggaaagtgaatttga

SEQ ID NO: 4061803 - DNA, 20 bp, Homo sapiens
tggaaagtgaatttgaatga

SEQ ID NO: 4061804 - DNA, 16 bp, Homo sapiens
tggaaataaactgtgc

SEQ ID NO: 4061805 - DNA, 22 bp, Homo sapiens
tggaaatagaaagaagccatat

SEQ ID NO: 4061806 - DNA, 20 bp, Homo sapiens
tggaaatattaagaaagact

SEQ ID NO: 4061807 - DNA, 16 bp, Homo sapiens
tggaaattggaagagc

SEQ ID NO: 4061808 - DNA, 21 bp, Homo sapiens
tggaaatttgttataatgaat

SEQ ID NO: 4061809 - DNA, 14 bp, Homo sapiens
tggaacatccttgg

SEQ ID NO: 4061810 - DNA, 22 bp, Homo sapiens
tggaacatcctttgcagggcag

SEQ ID NO: 4061811 - DNA, 21 bp, Homo sapiens
tggaacatggctagcctttct

SEQ ID NO: 4061812 - DNA, 20 bp, Homo sapiens
tggaacattggaatgttctc

SEQ ID NO: 4061813 - DNA, 11 bp, Homo sapiens
tggaaccaatc

SEQ ID NO: 4061814 - DNA, 15 bp, Homo sapiens
tggaaccagccccat

SEQ ID NO: 4061815 - DNA, 12 bp, Homo sapiens
tggaacccagac

SEQ ID NO: 4061816 - DNA, 14 bp, Homo sapiens
tggaacccagactc

SEQ ID NO: 4061817 - DNA, 15 bp, Homo sapiens
tggaacccagactca

SEQ ID NO: 4061818 - DNA, 22 bp, Homo sapiens
tggaacccagactcagacattg

SEQ ID NO: 4061819 - DNA, 20 bp, Homo sapiens
tggaaccgtgtccagcacag

SEQ ID NO: 4061820 - DNA, 21 bp, Homo sapiens
tggaaccgtgtccagcacaga

SEQ ID NO: 4061821 - DNA, 15 bp, Homo sapiens
tggaacctcagcctg

SEQ ID NO: 4061822 - DNA, 16 bp, Homo sapiens
tggaacctcagcctgg

SEQ ID NO: 4061823 - DNA, 19 bp, Homo sapiens
tggaacctcagcctggcca

SEQ ID NO: 4061824 - DNA, 13 bp, Homo sapiens
tggaaccttccct

SEQ ID NO: 4061825 - DNA, 13 bp, Homo sapiens
tggaaccttgttt

SEQ ID NO: 4061826 - DNA, 17 bp, Homo sapiens
tggaagaagggagaaga

SEQ ID NO: 4061827 - DNA, 17 bp, Homo sapiens
tggaagagcccagtctg

SEQ ID NO: 4061828 - DNA, 21 bp, Homo sapiens
tggaagagcccagtctgttga

SEQ ID NO: 4061829 - DNA, 18 bp, Homo sapiens
tggaagagctaggcaggg

SEQ ID NO: 4061830 - DNA, 13 bp, Homo sapiens
tggaagagggtga

SEQ ID NO: 4061831 - DNA, 18 bp, Homo sapiens
tggaagagggtgaaaggc

SEQ ID NO: 4061832 - DNA, 17 bp, Homo sapiens
tggaagccggagggtgt

SEQ ID NO: 4061833 - DNA, 16 bp, Homo sapiens
tggaagctaatttgca

SEQ ID NO: 4061834 - DNA, 16 bp, Homo sapiens
tggaagctaccagagc

SEQ ID NO: 4061835 - DNA, 14 bp, Homo sapiens
tggaaggcagacag

SEQ ID NO: 4061836 - DNA, 13 bp, Homo sapiens
tggaagggctggg

SEQ ID NO: 4061837 - DNA, 16 bp, Homo sapiens
tggaagggctgggtgt

SEQ ID NO: 4061838 - DNA, 16 bp, Homo sapiens
tggaaggggccttgct

SEQ ID NO: 4061839 - DNA, 22 bp, Homo sapiens
tggaaggggccttgctgagtgg

SEQ ID NO: 4061840 - DNA, 17 bp, Homo sapiens
tggaagggtttgtggct

SEQ ID NO: 4061841 - DNA, 21 bp, Homo sapiens
tggaaggtttgtatattgtca

SEQ ID NO: 4061842 - DNA, 17 bp, Homo sapiens
tggaagtccaatgtggc

SEQ ID NO: 4061843 - DNA, 22 bp, Homo sapiens
tggaagtctccatgaagagctt

SEQ ID NO: 4061844 - DNA, 15 bp, Homo sapiens
tggaagttttcagga

SEQ ID NO: 4061845 - DNA, 16 bp, Homo sapiens
tggaataaagttgcag

SEQ ID NO: 4061846 - DNA, 18 bp, Homo sapiens
tggaataaagttgcagat

SEQ ID NO: 4061847 - DNA, 14 bp, Homo sapiens
tggaataacatgta

SEQ ID NO: 4061848 - DNA, 15 bp, Homo sapiens
tggaataacatgtaa

SEQ ID NO: 4061849 - DNA, 19 bp, Homo sapiens
tggaataacatgtaattaa

SEQ ID NO: 4061850 - DNA, 17 bp, Homo sapiens
tggaataatttgtaaat

SEQ ID NO: 4061851 - DNA, 18 bp, Homo sapiens
tggaataatttgtaaatg

SEQ ID NO: 4061852 - DNA, 19 bp, Homo sapiens
tggaataatttgtaaatga

SEQ ID NO: 4061853 - DNA, 14 bp, Homo sapiens
tggaatacagtgtt

SEQ ID NO: 4061854 - DNA, 12 bp, Homo sapiens
tggaatactttt

SEQ ID NO: 4061855 - DNA, 13 bp, Homo sapiens
tggaatacttttt

SEQ ID NO: 4061856 - DNA, 24 bp, Homo sapiens
tggaatatttataggccagggcat

SEQ ID NO: 4061857 - DNA, 18 bp, Homo sapiens
tggaatcattgtccagag

SEQ ID NO: 4061858 - DNA, 23 bp, Homo sapiens
tggaatcgatttcctcccacctc

SEQ ID NO: 4061859 - DNA, 18 bp, Homo sapiens
tggaatctggagaccagg

SEQ ID NO: 4061860 - DNA, 20 bp, Homo sapiens
tggaatcttctctttgacaa

SEQ ID NO: 4061861 - DNA, 18 bp, Homo sapiens
tggaatgtgcccctggcc

SEQ ID NO: 4061862 - DNA, 17 bp, Homo sapiens
tggaatgtttttccctc

SEQ ID NO: 4061863 - DNA, 19 bp, Homo sapiens
tggaattaaccatttaata

SEQ ID NO: 4061864 - DNA, 18 bp, Homo sapiens
tggaattaacctggtgct

SEQ ID NO: 4061865 - DNA, 13 bp, Homo sapiens
tggaattcttcct

SEQ ID NO: 4061866 - DNA, 19 bp, Homo sapiens
tggaattgatttgcattga

SEQ ID NO: 4061867 - DNA, 20 bp, Homo sapiens
tggaattgatttgcattgaa

SEQ ID NO: 4061868 - DNA, 23 bp, Homo sapiens
tggaattgatttgcattgaacac

SEQ ID NO: 4061869 - DNA, 11 bp, Homo sapiens
tggaattgctt

SEQ ID NO: 4061870 - DNA, 23 bp, Homo sapiens
tggaattgcttaccaaaggatag

SEQ ID NO: 4061871 - DNA, 17 bp, Homo sapiens
tggaatttgcctgctgg

SEQ ID NO: 4061872 - DNA, 17 bp, Homo sapiens
tggaatttgtaacctca

SEQ ID NO: 4061873 - DNA, 15 bp, Homo sapiens
tggaatttgttcaag

SEQ ID NO: 4061874 - DNA, 21 bp, Homo sapiens
tggacaacttatttaaaaata

SEQ ID NO: 4061875 - DNA, 22 bp, Homo sapiens
tggacaacttatttaaaaatat

SEQ ID NO: 4061876 - DNA, 22 bp, Homo sapiens
tggacaagcagaggtggccaga

SEQ ID NO: 4061877 - DNA, 22 bp, Homo sapiens
tggacacattggaatgccttgg

SEQ ID NO: 4061878 - DNA, 13 bp, Homo sapiens
tggacacccctgc

SEQ ID NO: 4061879 - DNA, 20 bp, Homo sapiens
tggacaccccttatccagga

SEQ ID NO: 4061880 - DNA, 21 bp, Homo sapiens
tggacaccccttatccaggac

SEQ ID NO: 4061881 - DNA, 17 bp, Homo sapiens
tggacactccagtgcca

SEQ ID NO: 4061882 - DNA, 19 bp, Homo sapiens
tggacagagcgcccctccc

SEQ ID NO: 4061883 - DNA, 12 bp, Homo sapiens
tggacagcagaa

SEQ ID NO: 4061884 - DNA, 15 bp, Homo sapiens
tggacagcagaagcc

SEQ ID NO: 4061885 - DNA, 19 bp, Homo sapiens
tggacagcagaagcctcca

SEQ ID NO: 4061886 - DNA, 13 bp, Homo sapiens
tggacagccagtg

SEQ ID NO: 4061887 - DNA, 15 bp, Homo sapiens
tggacattgtctgcg

SEQ ID NO: 4061888 - DNA, 17 bp, Homo sapiens
tggacatttgccttgct

SEQ ID NO: 4061889 - DNA, 22 bp, Homo sapiens
tggacatttgccttgctggacg

SEQ ID NO: 4061890 - DNA, 17 bp, Homo sapiens
tggaccaagcacaaaaa

SEQ ID NO: 4061891 - DNA, 15 bp, Homo sapiens
tggaccacaggcatc

SEQ ID NO: 4061892 - DNA, 22 bp, Homo sapiens
tggaccacaggcatctacacag

SEQ ID NO: 4061893 - DNA, 23 bp, Homo sapiens
tggaccatgccagattctgcctc

SEQ ID NO: 4061894 - DNA, 15 bp, Homo sapiens
tggacccccaccctg

SEQ ID NO: 4061895 - DNA, 15 bp, Homo sapiens
tggacctaacattcg

SEQ ID NO: 4061896 - DNA, 16 bp, Homo sapiens
tggacctgcctcctgc

SEQ ID NO: 4061897 - DNA, 17 bp, Homo sapiens
tggacctgcctcctgcc

SEQ ID NO: 4061898 - DNA, 20 bp, Homo sapiens
tggacctgcctcctgcctgc

SEQ ID NO: 4061899 - DNA, 15 bp, Homo sapiens
tggaccttaggcctt

SEQ ID NO: 4061900 - DNA, 19 bp, Homo sapiens
tggaccttaggccttcctc

SEQ ID NO: 4061901 - DNA, 21 bp, Homo sapiens
tggaccttaggccttcctctc

SEQ ID NO: 4061902 - DNA, 16 bp, Homo sapiens
tggacgcaccggcctg

SEQ ID NO: 4061903 - DNA, 13 bp, Homo sapiens
tggacggcaggct

SEQ ID NO: 4061904 - DNA, 15 bp, Homo sapiens
tggacggcaggctca

SEQ ID NO: 4061905 - DNA, 21 bp, Homo sapiens
tggacggcaggctcactgcca

SEQ ID NO: 4061906 - DNA, 23 bp, Homo sapiens
tggacggcaggctcactgccagg

SEQ ID NO: 4061907 - DNA, 16 bp, Homo sapiens
tggacggggactgggg

SEQ ID NO: 4061908 - DNA, 18 bp, Homo sapiens
tggactaaatatctgtca

SEQ ID NO: 4061909 - DNA, 14 bp, Homo sapiens
tggactcagggcag

SEQ ID NO: 4061910 - DNA, 15 bp, Homo sapiens
tggactcagggcagc

SEQ ID NO: 4061911 - DNA, 18 bp, Homo sapiens
tggactcagggcagcgcc

SEQ ID NO: 4061912 - DNA, 13 bp, Homo sapiens
tggactctcaggg

SEQ ID NO: 4061913 - DNA, 21 bp, Homo sapiens
tggactcttctcggctcaggc

SEQ ID NO: 4061914 - DNA, 22 bp, Homo sapiens
tggactcttctcggctcaggct

SEQ ID NO: 4061915 - DNA, 19 bp, Homo sapiens
tggactgcagaagcaaggg

SEQ ID NO: 4061916 - DNA, 14 bp, Homo sapiens
tggactggaagggg

SEQ ID NO: 4061917 - DNA, 18 bp, Homo sapiens
tggactggaggtgggcat

SEQ ID NO: 4061918 - DNA, 21 bp, Homo sapiens
tggactgtcacggggttccct

SEQ ID NO: 4061919 - DNA, 16 bp, Homo sapiens
tggacttacctggcag

SEQ ID NO: 4061920 - DNA, 17 bp, Homo sapiens
tggacttctacctgccc

SEQ ID NO: 4061921 - DNA, 15 bp, Homo sapiens
tggacttctgtgggc

SEQ ID NO: 4061922 - DNA, 17 bp, Homo sapiens
tggacttgtatatttgt

SEQ ID NO: 4061923 - DNA, 21 bp, Homo sapiens
tggacttgtatatttgtacaa

SEQ ID NO: 4061924 - DNA, 12 bp, Homo sapiens
tggactttcaaa

SEQ ID NO: 4061925 - DNA, 23 bp, Homo sapiens
tggactttcaaaattaaatctgt

SEQ ID NO: 4061926 - DNA, 14 bp, Homo sapiens
tggactttcctgca

SEQ ID NO: 4061927 - DNA, 19 bp, Homo sapiens
tggactttcctgcaactca

SEQ ID NO: 4061928 - DNA, 16 bp, Homo sapiens
tggactttgcttcccc

SEQ ID NO: 4061929 - DNA, 18 bp, Homo sapiens
tggagaacgccagtctcc

SEQ ID NO: 4061930 - DNA, 13 bp, Homo sapiens
tggagaatacttt

SEQ ID NO: 4061931 - DNA, 19 bp, Homo sapiens
tggagaccctgccacagcc

SEQ ID NO: 4061932 - DNA, 23 bp, Homo sapiens
tggagaccctgccacagccagag

SEQ ID NO: 4061933 - DNA, 18 bp, Homo sapiens
tggagactaagccctgtc

SEQ ID NO: 4061934 - DNA, 21 bp, Homo sapiens
tggagactgatggccaggcaa

SEQ ID NO: 4061935 - DNA, 11 bp, Homo sapiens
tggagagaata

SEQ ID NO: 4061936 - DNA, 13 bp, Homo sapiens
tggagagaatcat

SEQ ID NO: 4061937 - DNA, 17 bp, Homo sapiens
tggagagaatgtgtgtg

SEQ ID NO: 4061938 - DNA, 14 bp, Homo sapiens
tggagaggcggcct

SEQ ID NO: 4061939 - DNA, 14 bp, Homo sapiens
tggagagggcccag

SEQ ID NO: 4061940 - DNA, 14 bp, Homo sapiens
tggagagggtctcg

SEQ ID NO: 4061941 - DNA, 22 bp, Homo sapiens
tggagagggtctcgctgtcact

SEQ ID NO: 4061942 - DNA, 15 bp, Homo sapiens
tggagagtaaaaact

SEQ ID NO: 4061943 - DNA, 16 bp, Homo sapiens
tggagagtgagctaca

SEQ ID NO: 4061944 - DNA, 17 bp, Homo sapiens
tggagcaaaaggcagct

SEQ ID NO: 4061945 - DNA, 18 bp, Homo sapiens
tggagcaaaaggcagctc

SEQ ID NO: 4061946 - DNA, 23 bp, Homo sapiens
tggagcaaaaggcagctcacccc

SEQ ID NO: 4061947 - DNA, 18 bp, Homo sapiens
tggagcaggagccccgcc

SEQ ID NO: 4061948 - DNA, 12 bp, Homo sapiens
tggagcaggcaa

SEQ ID NO: 4061949 - DNA, 14 bp, Homo sapiens
tggagcatgcagag

SEQ ID NO: 4061950 - DNA, 15 bp, Homo sapiens
tggagcatgcagagg

SEQ ID NO: 4061951 - DNA, 17 bp, Homo sapiens
tggagccaatggagact

SEQ ID NO: 4061952 - DNA, 21 bp, Homo sapiens
tggagcccataggccaccccc

SEQ ID NO: 4061953 - DNA, 21 bp, Homo sapiens
tggagcccccagcagaggcag

SEQ ID NO: 4061954 - DNA, 17 bp, Homo sapiens
tggagcctgacagccag

SEQ ID NO: 4061955 - DNA, 19 bp, Homo sapiens
tggagcggagaggaagcca

SEQ ID NO: 4061956 - DNA, 12 bp, Homo sapiens
tggagctcagcc

SEQ ID NO: 4061957 - DNA, 15 bp, Homo sapiens
tggagctttctgtat

SEQ ID NO: 4061958 - DNA, 18 bp, Homo sapiens
tggaggaagagggacaga

SEQ ID NO: 4061959 - DNA, 18 bp, Homo sapiens
tggaggaaggattgtaaa

SEQ ID NO: 4061960 - DNA, 20 bp, Homo sapiens
tggaggaaggattgtaaaaa

SEQ ID NO: 4061961 - DNA, 18 bp, Homo sapiens
tggaggaattcagctcag

SEQ ID NO: 4061962 - DNA, 15 bp, Homo sapiens
tggaggacctgcccg

SEQ ID NO: 4061963 - DNA, 14 bp, Homo sapiens
tggaggagaaggac

SEQ ID NO: 4061964 - DNA, 14 bp, Homo sapiens
tggaggaggaaggc

SEQ ID NO: 4061965 - DNA, 12 bp, Homo sapiens
tggaggaggcct

SEQ ID NO: 4061966 - DNA, 17 bp, Homo sapiens
tggaggccaccgggaca

SEQ ID NO: 4061967 - DNA, 16 bp, Homo sapiens
tggaggcccctggagc

SEQ ID NO: 4061968 - DNA, 16 bp, Homo sapiens
tggaggccctcctgtg

SEQ ID NO: 4061969 - DNA, 21 bp, Homo sapiens
tggaggccctcctgtgctggg

SEQ ID NO: 4061970 - DNA, 24 bp, Homo sapiens
tggaggcctcaggtgctgtccatg

SEQ ID NO: 4061971 - DNA, 20 bp, Homo sapiens
tggaggccttccagctgctg

SEQ ID NO: 4061972 - DNA, 21 bp, Homo sapiens
tggaggccttccagctgctgt

SEQ ID NO: 4061973 - DNA, 19 bp, Homo sapiens
tggaggctgacgtgtgagg

SEQ ID NO: 4061974 - DNA, 13 bp, Homo sapiens
tggagggagggaa

SEQ ID NO: 4061975 - DNA, 20 bp, Homo sapiens
tggagggcttggcccagcgc

SEQ ID NO: 4061976 - DNA, 20 bp, Homo sapiens
tggaggggtggtcctgactc

SEQ ID NO: 4061977 - DNA, 18 bp, Homo sapiens
tggaggggtgtggcagtg

SEQ ID NO: 4061978 - DNA, 18 bp, Homo sapiens
tggaggtcacattcagga

SEQ ID NO: 4061979 - DNA, 20 bp, Homo sapiens
tggaggtcacattcaggaag

SEQ ID NO: 4061980 - DNA, 16 bp, Homo sapiens
tggaggttctcagagc

SEQ ID NO: 4061981 - DNA, 18 bp, Homo sapiens
tggaggttctcagagcca

SEQ ID NO: 4061982 - DNA, 13 bp, Homo sapiens
tggagtcagatga

SEQ ID NO: 4061983 - DNA, 14 bp, Homo sapiens
tggagtcagatgag

SEQ ID NO: 4061984 - DNA, 12 bp, Homo sapiens
tggagtcattca

SEQ ID NO: 4061985 - DNA, 14 bp, Homo sapiens
tggagtcccctcac

SEQ ID NO: 4061986 - DNA, 15 bp, Homo sapiens
tggagtcccctcacc

SEQ ID NO: 4061987 - DNA, 18 bp, Homo sapiens
tggagtctggagtgggca

SEQ ID NO: 4061988 - DNA, 17 bp, Homo sapiens
tggagtgcagggaggag

SEQ ID NO: 4061989 - DNA, 17 bp, Homo sapiens
tggagtgctgtgctgtg

SEQ ID NO: 4061990 - DNA, 16 bp, Homo sapiens
tggagtggagtgagag

SEQ ID NO: 4061991 - DNA, 17 bp, Homo sapiens
tggagtgtggctgagga

SEQ ID NO: 4061992 - DNA, 24 bp, Homo sapiens
tggagtgtttctaataaacttgga

SEQ ID NO: 4061993 - DNA, 18 bp, Homo sapiens
tggagttacattaatgtt

SEQ ID NO: 4061994 - DNA, 14 bp, Homo sapiens
tggagttccttatc

SEQ ID NO: 4061995 - DNA, 22 bp, Homo sapiens
tggagttgaaagagttaagaat

SEQ ID NO: 4061996 - DNA, 22 bp, Homo sapiens
tggagttgatctggaacccaga

SEQ ID NO: 4061997 - DNA, 20 bp, Homo sapiens
tggagtttgtgtctgttgct

SEQ ID NO: 4061998 - DNA, 21 bp, Homo sapiens
tggagtttttgtttggagagc

SEQ ID NO: 4061999 - DNA, 22 bp, Homo sapiens
tggagtttttgtttggagagca

SEQ ID NO: 4062000 - DNA, 19 bp, Homo sapiens
tggataaaataatgctgca

SEQ ID NO: 4062001 - DNA, 13 bp, Homo sapiens
tggataaatcatt

SEQ ID NO: 4062002 - DNA, 18 bp, Homo sapiens
tggataaatcatttcagt

SEQ ID NO: 4062003 - DNA, 21 bp, Homo sapiens
tggataacttaggtggcaagc

SEQ ID NO: 4062004 - DNA, 14 bp, Homo sapiens
tggatactacatct

SEQ ID NO: 4062005 - DNA, 14 bp, Homo sapiens
tggatacttggatt

SEQ ID NO: 4062006 - DNA, 16 bp, Homo sapiens
tggataggagcctgct

SEQ ID NO: 4062007 - DNA, 18 bp, Homo sapiens
tggatattttcaaattgt

SEQ ID NO: 4062008 - DNA, 16 bp, Homo sapiens
tggatcacaagatgga

SEQ ID NO: 4062009 - DNA, 14 bp, Homo sapiens
tggatcacagctgc

SEQ ID NO: 4062010 - DNA, 19 bp, Homo sapiens
tggatcacgacgctgcaga

SEQ ID NO: 4062011 - DNA, 16 bp, Homo sapiens
tggatcagtcctttga

SEQ ID NO: 4062012 - DNA, 19 bp, Homo sapiens
tggatcataagacaatgga

SEQ ID NO: 4062013 - DNA, 20 bp, Homo sapiens
tggatccctgcccttctcaa

SEQ ID NO: 4062014 - DNA, 16 bp, Homo sapiens
tggatctatccctgcg

SEQ ID NO: 4062015 - DNA, 14 bp, Homo sapiens
tggatctatttcat

SEQ ID NO: 4062016 - DNA, 18 bp, Homo sapiens
tggatctatttcatgttt

SEQ ID NO: 4062017 - DNA, 18 bp, Homo sapiens
tggatctccaaggaccag

SEQ ID NO: 4062018 - DNA, 15 bp, Homo sapiens
tggatctgcttgttg

SEQ ID NO: 4062019 - DNA, 19 bp, Homo sapiens
tggatcttgaatgtggtct

SEQ ID NO: 4062020 - DNA, 15 bp, Homo sapiens
tggatcttgccacat

SEQ ID NO: 4062021 - DNA, 21 bp, Homo sapiens
tggatgaaaaatatttctgag

SEQ ID NO: 4062022 - DNA, 15 bp, Homo sapiens
tggatgacagggcag

SEQ ID NO: 4062023 - DNA, 20 bp, Homo sapiens
tggatgacagggcagagcag

SEQ ID NO: 4062024 - DNA, 13 bp, Homo sapiens
tggatgaccagaa

SEQ ID NO: 4062025 - DNA, 20 bp, Homo sapiens
tggatgaccagaacaaggtt

SEQ ID NO: 4062026 - DNA, 21 bp, Homo sapiens
tggatgccaatattaaatctg

SEQ ID NO: 4062027 - DNA, 15 bp, Homo sapiens
tggatgccagctgtg

SEQ ID NO: 4062028 - DNA, 16 bp, Homo sapiens
tggatgccagctgtgt

SEQ ID NO: 4062029 - DNA, 19 bp, Homo sapiens
tggatgccagctgtgtcct

SEQ ID NO: 4062030 - DNA, 20 bp, Homo sapiens
tggatggaaggttggatgga

SEQ ID NO: 4062031 - DNA, 14 bp, Homo sapiens
tggatgggagtggg

SEQ ID NO: 4062032 - DNA, 20 bp, Homo sapiens
tggatgggagtgggcacctc

SEQ ID NO: 4062033 - DNA, 17 bp, Homo sapiens
tggatgggtggatggcc

SEQ ID NO: 4062034 - DNA, 18 bp, Homo sapiens
tggatggtcattgcagtt

SEQ ID NO: 4062035 - DNA, 15 bp, Homo sapiens
tggattaaatttaat

SEQ ID NO: 4062036 - DNA, 13 bp, Homo sapiens
tggattattcatt

SEQ ID NO: 4062037 - DNA, 17 bp, Homo sapiens
tggattattcatttaaa

SEQ ID NO: 4062038 - DNA, 16 bp, Homo sapiens
tggattatttaataac

SEQ ID NO: 4062039 - DNA, 13 bp, Homo sapiens
tggattctcagat

SEQ ID NO: 4062040 - DNA, 16 bp, Homo sapiens
tggattctcagatatt

SEQ ID NO: 4062041 - DNA, 17 bp, Homo sapiens
tggattctctaaccttt

SEQ ID NO: 4062042 - DNA, 20 bp, Homo sapiens
tggattctgaggccctgccc

SEQ ID NO: 4062043 - DNA, 23 bp, Homo sapiens
tggattctgggaggcaagaaaag

SEQ ID NO: 4062044 - DNA, 20 bp, Homo sapiens
tggattggattatttaataa

SEQ ID NO: 4062045 - DNA, 15 bp, Homo sapiens
tggattggccaaaca

SEQ ID NO: 4062046 - DNA, 23 bp, Homo sapiens
tggatttaagagtattttaagaa

SEQ ID NO: 4062047 - DNA, 15 bp, Homo sapiens
tggatttagtttcag

SEQ ID NO: 4062048 - DNA, 16 bp, Homo sapiens
tggatttagtttcagt

SEQ ID NO: 4062049 - DNA, 14 bp, Homo sapiens
tggatttataaatg

SEQ ID NO: 4062050 - DNA, 18 bp, Homo sapiens
tggatttcctttatactg

SEQ ID NO: 4062051 - DNA, 19 bp, Homo sapiens
tggatttgaagtttgccaa

SEQ ID NO: 4062052 - DNA, 17 bp, Homo sapiens
tggatttgcctgtgcca

SEQ ID NO: 4062053 - DNA, 14 bp, Homo sapiens
tggattttcctgaa

SEQ ID NO: 4062054 - DNA, 17 bp, Homo sapiens
tggattttctactgtaa

SEQ ID NO: 4062055 - DNA, 18 bp, Homo sapiens
tggcaaaaaggagccttt

SEQ ID NO: 4062056 - DNA, 21 bp, Homo sapiens
tggcaaaaatgcaacaaatga

SEQ ID NO: 4062057 - DNA, 17 bp, Homo sapiens
tggcaaaagccttgtgt

SEQ ID NO: 4062058 - DNA, 19 bp, Homo sapiens
tggcaaaagccttgtgtat

SEQ ID NO: 4062059 - DNA, 23 bp, Homo sapiens
tggcaaatgtaactgtgccagtt

SEQ ID NO: 4062060 - DNA, 20 bp, Homo sapiens
tggcaaattaacttgagttt

SEQ ID NO: 4062061 - DNA, 13 bp, Homo sapiens
tggcaacacagag

SEQ ID NO: 4062062 - DNA, 13 bp, Homo sapiens
tggcaacagatct

SEQ ID NO: 4062063 - DNA, 22 bp, Homo sapiens
tggcaacagatctggaacctca

SEQ ID NO: 4062064 - DNA, 22 bp, Homo sapiens
tggcaaccttgtctctatgcca

SEQ ID NO: 4062065 - DNA, 12 bp, Homo sapiens
tggcaaggaaag

SEQ ID NO: 4062066 - DNA, 15 bp, Homo sapiens
tggcaagtcacatgc

SEQ ID NO: 4062067 - DNA, 16 bp, Homo sapiens
tggcaatagtgtgttc

SEQ ID NO: 4062068 - DNA, 15 bp, Homo sapiens
tggcaatattcctta

SEQ ID NO: 4062069 - DNA, 19 bp, Homo sapiens
tggcaatctcagatgcagt

SEQ ID NO: 4062070 - DNA, 16 bp, Homo sapiens
tggcaatgcttaaact

SEQ ID NO: 4062071 - DNA, 18 bp, Homo sapiens
tggcaatgttttgctttt

SEQ ID NO: 4062072 - DNA, 16 bp, Homo sapiens
tggcaatttaacatgt

SEQ ID NO: 4062073 - DNA, 14 bp, Homo sapiens
tggcacagaaacac

SEQ ID NO: 4062074 - DNA, 16 bp, Homo sapiens
tggcacagggcagtgg

SEQ ID NO: 4062075 - DNA, 19 bp, Homo sapiens
tggcaccactgcactccag

SEQ ID NO: 4062076 - DNA, 16 bp, Homo sapiens
tggcaccagacaccca

SEQ ID NO: 4062077 - DNA, 14 bp, Homo sapiens
tggcaccagatgca

SEQ ID NO: 4062078 - DNA, 21 bp, Homo sapiens
tggcacccaaatcacatctca

SEQ ID NO: 4062079 - DNA, 13 bp, Homo sapiens
tggcacctgcaca

SEQ ID NO: 4062080 - DNA, 22 bp, Homo sapiens
tggcacctgcacactccatctc

SEQ ID NO: 4062081 - DNA, 22 bp, Homo sapiens
tggcactaacgttgagcccctg

SEQ ID NO: 4062082 - DNA, 22 bp, Homo sapiens
tggcactataatgtaagctcta

SEQ ID NO: 4062083 - DNA, 22 bp, Homo sapiens
tggcactgagatatttattgtt

SEQ ID NO: 4062084 - DNA, 17 bp, Homo sapiens
tggcactgggaggcagg

SEQ ID NO: 4062085 - DNA, 23 bp, Homo sapiens
tggcacttactggtccttaccag

SEQ ID NO: 4062086 - DNA, 20 bp, Homo sapiens
tggcactttttcgtgtggat

SEQ ID NO: 4062087 - DNA, 14 bp, Homo sapiens
tggcagaagacacc

SEQ ID NO: 4062088 - DNA, 20 bp, Homo sapiens
tggcagaagacaccagagca

SEQ ID NO: 4062089 - DNA, 19 bp, Homo sapiens
tggcagaataatctttggg

SEQ ID NO: 4062090 - DNA, 15 bp, Homo sapiens
tggcagacaaacaga

SEQ ID NO: 4062091 - DNA, 14 bp, Homo sapiens
tggcagacagccgt

SEQ ID NO: 4062092 - DNA, 17 bp, Homo sapiens
tggcagatgtcttccct

SEQ ID NO: 4062093 - DNA, 20 bp, Homo sapiens
tggcagatgtcttccctggg

SEQ ID NO: 4062094 - DNA, 16 bp, Homo sapiens
tggcagccgtgccttc

SEQ ID NO: 4062095 - DNA, 19 bp, Homo sapiens
tggcagcctcccatccagg

SEQ ID NO: 4062096 - DNA, 22 bp, Homo sapiens
tggcagcctcccatccagggcc

SEQ ID NO: 4062097 - DNA, 11 bp, Homo sapiens
tggcagctctg

SEQ ID NO: 4062098 - DNA, 14 bp, Homo sapiens
tggcagctgtttct

SEQ ID NO: 4062099 - DNA, 20 bp, Homo sapiens
tggcagctgtttctcatgaa

SEQ ID NO: 4062100 - DNA, 23 bp, Homo sapiens
tggcagctgtttctcatgaagct

SEQ ID NO: 4062101 - DNA, 14 bp, Homo sapiens
tggcaggaccagga

SEQ ID NO: 4062102 - DNA, 16 bp, Homo sapiens
tggcaggaccaggact

SEQ ID NO: 4062103 - DNA, 11 bp, Homo sapiens
tggcaggcagg

SEQ ID NO: 4062104 - DNA, 23 bp, Homo sapiens
tggcagggctggccccagggcac

SEQ ID NO: 4062105 - DNA, 21 bp, Homo sapiens
tggcagggggccccgccaggg

SEQ ID NO: 4062106 - DNA, 22 bp, Homo sapiens
tggcagggggccccgccagggc

SEQ ID NO: 4062107 - DNA, 22 bp, Homo sapiens
tggcagtatttcatttcttgtc

SEQ ID NO: 4062108 - DNA, 14 bp, Homo sapiens
tggcagtgactttg

SEQ ID NO: 4062109 - DNA, 12 bp, Homo sapiens
tggcagtggttt

SEQ ID NO: 4062110 - DNA, 21 bp, Homo sapiens
tggcagtgttttggttcagac

SEQ ID NO: 4062111 - DNA, 12 bp, Homo sapiens
tggcagttgcat

SEQ ID NO: 4062112 - DNA, 15 bp, Homo sapiens
tggcatagccccggc

SEQ ID NO: 4062113 - DNA, 20 bp, Homo sapiens
tggcatatatgtgatctggg

SEQ ID NO: 4062114 - DNA, 23 bp, Homo sapiens
tggcatcaagaggtgggagggcc

SEQ ID NO: 4062115 - DNA, 20 bp, Homo sapiens
tggcatgatcatagctcact

SEQ ID NO: 4062116 - DNA, 21 bp, Homo sapiens
tggcatgatcatagctcactg

SEQ ID NO: 4062117 - DNA, 17 bp, Homo sapiens
tggcatggtgagtgttg

SEQ ID NO: 4062118 - DNA, 20 bp, Homo sapiens
tggcatgtgctgtgaccatt

SEQ ID NO: 4062119 - DNA, 22 bp, Homo sapiens
tggcatgtgctgtgaccattta

SEQ ID NO: 4062120 - DNA, 18 bp, Homo sapiens
tggccaaaagcagtaaat

SEQ ID NO: 4062121 - DNA, 21 bp, Homo sapiens
tggccaaacatcagacctgtc

SEQ ID NO: 4062122 - DNA, 22 bp, Homo sapiens
tggccaacatcgtgaaaccctg

SEQ ID NO: 4062123 - DNA, 14 bp, Homo sapiens
tggccaagagaagg

SEQ ID NO: 4062124 - DNA, 21 bp, Homo sapiens
tggccacctgtagccatctgc

SEQ ID NO: 4062125 - DNA, 22 bp, Homo sapiens
tggccacctgtagccatctgca

SEQ ID NO: 4062126 - DNA, 13 bp, Homo sapiens
tggccactcagct

SEQ ID NO: 4062127 - DNA, 13 bp, Homo sapiens
tggccagacacag

SEQ ID NO: 4062128 - DNA, 17 bp, Homo sapiens
tggccagagctgggagg

SEQ ID NO: 4062129 - DNA, 23 bp, Homo sapiens
tggccagagctgggaggcatggc

SEQ ID NO: 4062130 - DNA, 24 bp, Homo sapiens
tggccagagctgggaggcatggcc

SEQ ID NO: 4062131 - DNA, 19 bp, Homo sapiens
tggccagcaaggcaggttg

SEQ ID NO: 4062132 - DNA, 12 bp, Homo sapiens
tggccagcaccc

SEQ ID NO: 4062133 - DNA, 13 bp, Homo sapiens
tggccagcaccct

SEQ ID NO: 4062134 - DNA, 14 bp, Homo sapiens
tggccagcaccctc

SEQ ID NO: 4062135 - DNA, 18 bp, Homo sapiens
tggccagcaccctctcct

SEQ ID NO: 4062136 - DNA, 15 bp, Homo sapiens
tggccagcccctggg

SEQ ID NO: 4062137 - DNA, 21 bp, Homo sapiens
tggccagcccctggggcccag

SEQ ID NO: 4062138 - DNA, 23 bp, Homo sapiens
tggccagcccctggggcccagcc

SEQ ID NO: 4062139 - DNA, 21 bp, Homo sapiens
tggccagccgggagcttggct

SEQ ID NO: 4062140 - DNA, 13 bp, Homo sapiens
tggccagcgctgt

SEQ ID NO: 4062141 - DNA, 15 bp, Homo sapiens
tggccaggagctctt

SEQ ID NO: 4062142 - DNA, 16 bp, Homo sapiens
tggccaggagctcttc

SEQ ID NO: 4062143 - DNA, 20 bp, Homo sapiens
tggccagggccacgctccag

SEQ ID NO: 4062144 - DNA, 11 bp, Homo sapiens
tggccaggtgg

SEQ ID NO: 4062145 - DNA, 15 bp, Homo sapiens
tggccaggtggccac

SEQ ID NO: 4062146 - DNA, 17 bp, Homo sapiens
tggccaggtggccactc

SEQ ID NO: 4062147 - DNA, 19 bp, Homo sapiens
tggccaggtggccactcca

SEQ ID NO: 4062148 - DNA, 19 bp, Homo sapiens
tggccaggtggttgtctta

SEQ ID NO: 4062149 - DNA, 23 bp, Homo sapiens
tggccagtttgaagcctgtgcct

SEQ ID NO: 4062150 - DNA, 14 bp, Homo sapiens
tggccatccctggg

SEQ ID NO: 4062151 - DNA, 16 bp, Homo sapiens
tggccatccctgggcc

SEQ ID NO: 4062152 - DNA, 19 bp, Homo sapiens
tggccatccctgggcccct

SEQ ID NO: 4062153 - DNA, 23 bp, Homo sapiens
tggccatccctgggcccctccac

SEQ ID NO: 4062154 - DNA, 20 bp, Homo sapiens
tggccatggggccctcccag

SEQ ID NO: 4062155 - DNA, 22 bp, Homo sapiens
tggccatttccaagaggctgta

SEQ ID NO: 4062156 - DNA, 19 bp, Homo sapiens
tggcccaaaacgtcttatt

SEQ ID NO: 4062157 - DNA, 14 bp, Homo sapiens
tggcccaccaggcc

SEQ ID NO: 4062158 - DNA, 16 bp, Homo sapiens
tggcccaccgtggcac

SEQ ID NO: 4062159 - DNA, 13 bp, Homo sapiens
tggcccagaaaca

SEQ ID NO: 4062160 - DNA, 17 bp, Homo sapiens
tggcccagaaacaacag

SEQ ID NO: 4062161 - DNA, 14 bp, Homo sapiens
tggcccagggccca

SEQ ID NO: 4062162 - DNA, 15 bp, Homo sapiens
tggcccagggcccag

SEQ ID NO: 4062163 - DNA, 18 bp, Homo sapiens
tggcccatctcagcctcc

SEQ ID NO: 4062164 - DNA, 19 bp, Homo sapiens
tggccccaccgagctggag

SEQ ID NO: 4062165 - DNA, 15 bp, Homo sapiens
tggccccagcctggg

SEQ ID NO: 4062166 - DNA, 15 bp, Homo sapiens
tggccccaggacctg

SEQ ID NO: 4062167 - DNA, 12 bp, Homo sapiens
tggccccaggcc

SEQ ID NO: 4062168 - DNA, 22 bp, Homo sapiens
tggccccagtgcggttcctcat

SEQ ID NO: 4062169 - DNA, 13 bp, Homo sapiens
tggccccatccca

SEQ ID NO: 4062170 - DNA, 21 bp, Homo sapiens
tggcccccaggggcaggactg

SEQ ID NO: 4062171 - DNA, 23 bp, Homo sapiens
tggcccctactttgtggcaatct

SEQ ID NO: 4062172 - DNA, 12 bp, Homo sapiens
tggcccctctga

SEQ ID NO: 4062173 - DNA, 12 bp, Homo sapiens
tggcccctgggt

SEQ ID NO: 4062174 - DNA, 15 bp, Homo sapiens
tggcccctgtgtgag

SEQ ID NO: 4062175 - DNA, 17 bp, Homo sapiens
tggccccttttactttt

SEQ ID NO: 4062176 - DNA, 13 bp, Homo sapiens
tggccctgcctcc

SEQ ID NO: 4062177 - DNA, 13 bp, Homo sapiens
tggccctggccct

SEQ ID NO: 4062178 - DNA, 19 bp, Homo sapiens
tggccctggctctgctgtc

SEQ ID NO: 4062179 - DNA, 19 bp, Homo sapiens
tggccctggggtcccacga

SEQ ID NO: 4062180 - DNA, 13 bp, Homo sapiens
tggccctgtccca

SEQ ID NO: 4062181 - DNA, 15 bp, Homo sapiens
tggccctgtcccagg

SEQ ID NO: 4062182 - DNA, 18 bp, Homo sapiens
tggccctgtcccaggccg

SEQ ID NO: 4062183 - DNA, 23 bp, Homo sapiens
tggcccttacacactcaggcctg

SEQ ID NO: 4062184 - DNA, 24 bp, Homo sapiens
tggcccttacacactcaggcctgt

SEQ ID NO: 4062185 - DNA, 23 bp, Homo sapiens
tggcccttacttgcttctctagc

SEQ ID NO: 4062186 - DNA, 23 bp, Homo sapiens
tggcccttgcagttcagcaccac

SEQ ID NO: 4062187 - DNA, 13 bp, Homo sapiens
tggccctttcctt

SEQ ID NO: 4062188 - DNA, 15 bp, Homo sapiens
tggccgagtccaagc

SEQ ID NO: 4062189 - DNA, 18 bp, Homo sapiens
tggccgggtgcggtggct

SEQ ID NO: 4062190 - DNA, 14 bp, Homo sapiens
tggccgtctcctcc

SEQ ID NO: 4062191 - DNA, 17 bp, Homo sapiens
tggccgtggtccagctc

SEQ ID NO: 4062192 - DNA, 19 bp, Homo sapiens
tggccgtggtccagctctt

SEQ ID NO: 4062193 - DNA, 21 bp, Homo sapiens
tggcctaaaactggcctgact

SEQ ID NO: 4062194 - DNA, 20 bp, Homo sapiens
tggcctattatattaaaata

SEQ ID NO: 4062195 - DNA, 13 bp, Homo sapiens
tggcctcagacca

SEQ ID NO: 4062196 - DNA, 16 bp, Homo sapiens
tggcctcagccctcag

SEQ ID NO: 4062197 - DNA, 17 bp, Homo sapiens
tggcctcagccctcaga

SEQ ID NO: 4062198 - DNA, 22 bp, Homo sapiens
tggcctcagctgaatgcctcct

SEQ ID NO: 4062199 - DNA, 17 bp, Homo sapiens
tggcctctaccacaagg

SEQ ID NO: 4062200 - DNA, 17 bp, Homo sapiens
tggcctctgcctccacc

SEQ ID NO: 4062201 - DNA, 14 bp, Homo sapiens
tggcctctgctgaa

SEQ ID NO: 4062202 - DNA, 16 bp, Homo sapiens
tggcctctggctctca

SEQ ID NO: 4062203 - DNA, 20 bp, Homo sapiens
tggcctcttgagcagtggct

SEQ ID NO: 4062204 - DNA, 19 bp, Homo sapiens
tggcctgaaccacaggaga

SEQ ID NO: 4062205 - DNA, 14 bp, Homo sapiens
tggcctgactcccc

SEQ ID NO: 4062206 - DNA, 17 bp, Homo sapiens
tggcctgactcccccag

SEQ ID NO: 4062207 - DNA, 17 bp, Homo sapiens
tggcctgacttggggga

SEQ ID NO: 4062208 - DNA, 15 bp, Homo sapiens
tggcctgagagggga

SEQ ID NO: 4062209 - DNA, 22 bp, Homo sapiens
tggcctgatcagaccacggctc

SEQ ID NO: 4062210 - DNA, 16 bp, Homo sapiens
tggcctgcactaattt

SEQ ID NO: 4062211 - DNA, 16 bp, Homo sapiens
tggcctgcccgtgccc

SEQ ID NO: 4062212 - DNA, 20 bp, Homo sapiens
tggcctgcccgtgccctggt

SEQ ID NO: 4062213 - DNA, 11 bp, Homo sapiens
tggcctgctgt

SEQ ID NO: 4062214 - DNA, 13 bp, Homo sapiens
tggcctggactgt

SEQ ID NO: 4062215 - DNA, 18 bp, Homo sapiens
tggcctggagggactttt

SEQ ID NO: 4062216 - DNA, 12 bp, Homo sapiens
tggcctggatct

SEQ ID NO: 4062217 - DNA, 14 bp, Homo sapiens
tggcctggatctcc

SEQ ID NO: 4062218 - DNA, 13 bp, Homo sapiens
tggcctggccagg

SEQ ID NO: 4062219 - DNA, 16 bp, Homo sapiens
tggcctggccaggagc

SEQ ID NO: 4062220 - DNA, 18 bp, Homo sapiens
tggcctggccaggagctc

SEQ ID NO: 4062221 - DNA, 21 bp, Homo sapiens
tggcctggccaggagctcttc

SEQ ID NO: 4062222 - DNA, 15 bp, Homo sapiens
tggcctgtagagttg

SEQ ID NO: 4062223 - DNA, 20 bp, Homo sapiens
tggcctgtctcatccccagg

SEQ ID NO: 4062224 - DNA, 20 bp, Homo sapiens
tggcctgtttctgcagccct

SEQ ID NO: 4062225 - DNA, 21 bp, Homo sapiens
tggcctgtttctgcagccctt

SEQ ID NO: 4062226 - DNA, 16 bp, Homo sapiens
tggccttaatttcctt

SEQ ID NO: 4062227 - DNA, 21 bp, Homo sapiens
tggccttggcttttctagcct

SEQ ID NO: 4062228 - DNA, 12 bp, Homo sapiens
tggcctttcctt

SEQ ID NO: 4062229 - DNA, 22 bp, Homo sapiens
tggcctttccttccctctctga

SEQ ID NO: 4062230 - DNA, 13 bp, Homo sapiens
tggcctttgcatt

SEQ ID NO: 4062231 - DNA, 14 bp, Homo sapiens
tggcctttgcattt

SEQ ID NO: 4062232 - DNA, 15 bp, Homo sapiens
tggcctttgcattta

SEQ ID NO: 4062233 - DNA, 18 bp, Homo sapiens
tggcgctagaggccatgg

SEQ ID NO: 4062234 - DNA, 17 bp, Homo sapiens
tggcgctattacaaata

SEQ ID NO: 4062235 - DNA, 14 bp, Homo sapiens
tggcggtggctgcc

SEQ ID NO: 4062236 - DNA, 16 bp, Homo sapiens
tggcggtggctgcccc

SEQ ID NO: 4062237 - DNA, 19 bp, Homo sapiens
tggcgttctgctgcccctg

SEQ ID NO: 4062238 - DNA, 16 bp, Homo sapiens
tggctaatttaacacc

SEQ ID NO: 4062239 - DNA, 20 bp, Homo sapiens
tggctacatcccagcctgtg

SEQ ID NO: 4062240 - DNA, 23 bp, Homo sapiens
tggctacgcctcttctgtccctg

SEQ ID NO: 4062241 - DNA, 23 bp, Homo sapiens
tggctactttggtttctgtctgt

SEQ ID NO: 4062242 - DNA, 22 bp, Homo sapiens
tggctagaggccagccccaccc

SEQ ID NO: 4062243 - DNA, 23 bp, Homo sapiens
tggctagaggccagccccaccca

SEQ ID NO: 4062244 - DNA, 16 bp, Homo sapiens
tggctagagtcctcac

SEQ ID NO: 4062245 - DNA, 16 bp, Homo sapiens
tggctagcctttcttg

SEQ ID NO: 4062246 - DNA, 22 bp, Homo sapiens
tggctatttgaaatactaaaag

SEQ ID NO: 4062247 - DNA, 14 bp, Homo sapiens
tggctcacagtaca

SEQ ID NO: 4062248 - DNA, 20 bp, Homo sapiens
tggctcagagcttgaagatt

SEQ ID NO: 4062249 - DNA, 17 bp, Homo sapiens
tggctccacacacacaa

SEQ ID NO: 4062250 - DNA, 21 bp, Homo sapiens
tggctccagatgcagggcagt

SEQ ID NO: 4062251 - DNA, 23 bp, Homo sapiens
tggctccagatgcagggcagtca

SEQ ID NO: 4062252 - DNA, 16 bp, Homo sapiens
tggctccccctcccca

SEQ ID NO: 4062253 - DNA, 22 bp, Homo sapiens
tggctccccctccccaggctgg

SEQ ID NO: 4062254 - DNA, 17 bp, Homo sapiens
tggctccctcctccagg

SEQ ID NO: 4062255 - DNA, 13 bp, Homo sapiens
tggctcctagggg

SEQ ID NO: 4062256 - DNA, 22 bp, Homo sapiens
tggctcctcaaacagtaggttg

SEQ ID NO: 4062257 - DNA, 16 bp, Homo sapiens
tggctcctcccggtgc

SEQ ID NO: 4062258 - DNA, 15 bp, Homo sapiens
tggctcctgcccact

SEQ ID NO: 4062259 - DNA, 14 bp, Homo sapiens
tggctcctttacaa

SEQ ID NO: 4062260 - DNA, 21 bp, Homo sapiens
tggctctcagttaaaatgtga

SEQ ID NO: 4062261 - DNA, 22 bp, Homo sapiens
tggctctgaggtgcctgtccca

SEQ ID NO: 4062262 - DNA, 13 bp, Homo sapiens
tggctctgccagt

SEQ ID NO: 4062263 - DNA, 19 bp, Homo sapiens
tggctctgctgtccccttg

SEQ ID NO: 4062264 - DNA, 21 bp, Homo sapiens
tggctcttgatacccccctct

SEQ ID NO: 4062265 - DNA, 14 bp, Homo sapiens
tggctgacccctct

SEQ ID NO: 4062266 - DNA, 19 bp, Homo sapiens
tggctgactggggctgggg

SEQ ID NO: 4062267 - DNA, 14 bp, Homo sapiens
tggctgaggggctt

SEQ ID NO: 4062268 - DNA, 20 bp, Homo sapiens
tggctgaggttcctctgcct

SEQ ID NO: 4062269 - DNA, 21 bp, Homo sapiens
tggctgatgatccagaacagt

SEQ ID NO: 4062270 - DNA, 22 bp, Homo sapiens
tggctgatgatccagaacagtg

SEQ ID NO: 4062271 - DNA, 12 bp, Homo sapiens
tggctgcagctg

SEQ ID NO: 4062272 - DNA, 18 bp, Homo sapiens
tggctgccacacccaggg

SEQ ID NO: 4062273 - DNA, 22 bp, Homo sapiens
tggctgccacacccaggggaag

SEQ ID NO: 4062274 - DNA, 14 bp, Homo sapiens
tggctgcccaggag

SEQ ID NO: 4062275 - DNA, 15 bp, Homo sapiens
tggctgcccctcacc

SEQ ID NO: 4062276 - DNA, 13 bp, Homo sapiens
tggctgccttctt

SEQ ID NO: 4062277 - DNA, 17 bp, Homo sapiens
tggctgccttctttcca

SEQ ID NO: 4062278 - DNA, 15 bp, Homo sapiens
tggctgctgccccca

SEQ ID NO: 4062279 - DNA, 16 bp, Homo sapiens
tggctgctgcccccac

SEQ ID NO: 4062280 - DNA, 16 bp, Homo sapiens
tggctgctttgcctct

SEQ ID NO: 4062281 - DNA, 18 bp, Homo sapiens
tggctggaaggggtccag

SEQ ID NO: 4062282 - DNA, 15 bp, Homo sapiens
tggctggcctcaccc

SEQ ID NO: 4062283 - DNA, 15 bp, Homo sapiens
tggctgggacgtggc

SEQ ID NO: 4062284 - DNA, 15 bp, Homo sapiens
tggctgggccatcct

SEQ ID NO: 4062285 - DNA, 19 bp, Homo sapiens
tggctggggtgtcaataaa

SEQ ID NO: 4062286 - DNA, 16 bp, Homo sapiens
tggctgggtgggccca

SEQ ID NO: 4062287 - DNA, 16 bp, Homo sapiens
tggctggtcctcccat

SEQ ID NO: 4062288 - DNA, 14 bp, Homo sapiens
tggctgtagataaa

SEQ ID NO: 4062289 - DNA, 15 bp, Homo sapiens
tggctgtagataaat

SEQ ID NO: 4062290 - DNA, 18 bp, Homo sapiens
tggctgtagataaataat

SEQ ID NO: 4062291 - DNA, 16 bp, Homo sapiens
tggctgtctagaatgt

SEQ ID NO: 4062292 - DNA, 17 bp, Homo sapiens
tggctgtttagcagaac

SEQ ID NO: 4062293 - DNA, 19 bp, Homo sapiens
tggcttacctgacctcttg

SEQ ID NO: 4062294 - DNA, 16 bp, Homo sapiens
tggcttataaacacat

SEQ ID NO: 4062295 - DNA, 19 bp, Homo sapiens
tggcttataaacacattga

SEQ ID NO: 4062296 - DNA, 21 bp, Homo sapiens
tggcttataaacacattgaat

SEQ ID NO: 4062297 - DNA, 17 bp, Homo sapiens
tggcttcaaaatagaga

SEQ ID NO: 4062298 - DNA, 14 bp, Homo sapiens
tggcttccagcttc

SEQ ID NO: 4062299 - DNA, 22 bp, Homo sapiens
tggcttccagcttcaggcacca

SEQ ID NO: 4062300 - DNA, 17 bp, Homo sapiens
tggcttcccgctcagcc

SEQ ID NO: 4062301 - DNA, 22 bp, Homo sapiens
tggcttcccgctcagccctccc

SEQ ID NO: 4062302 - DNA, 14 bp, Homo sapiens
tggcttcctttctt

SEQ ID NO: 4062303 - DNA, 12 bp, Homo sapiens
tggcttgacatg

SEQ ID NO: 4062304 - DNA, 24 bp, Homo sapiens
tggcttgtatcaacactgttactt

SEQ ID NO: 4062305 - DNA, 21 bp, Homo sapiens
tggctttccaggcaccctcag

SEQ ID NO: 4062306 - DNA, 14 bp, Homo sapiens
tggctttcccagga

SEQ ID NO: 4062307 - DNA, 14 bp, Homo sapiens
tggctttgcacttg

SEQ ID NO: 4062308 - DNA, 13 bp, Homo sapiens
tggctttgcccac

SEQ ID NO: 4062309 - DNA, 15 bp, Homo sapiens
tggctttgcccaccc

SEQ ID NO: 4062310 - DNA, 17 bp, Homo sapiens
tggctttgcctcttctt

SEQ ID NO: 4062311 - DNA, 20 bp, Homo sapiens
tggctttgcctcttctttgt

SEQ ID NO: 4062312 - DNA, 15 bp, Homo sapiens
tggctttggcagtgt

SEQ ID NO: 4062313 - DNA, 18 bp, Homo sapiens
tggctttggcagtgtttt

SEQ ID NO: 4062314 - DNA, 16 bp, Homo sapiens
tggcttttcactgctg

SEQ ID NO: 4062315 - DNA, 18 bp, Homo sapiens
tggcttttcactgctggc

SEQ ID NO: 4062316 - DNA, 19 bp, Homo sapiens
tggcttttcactgctggct

SEQ ID NO: 4062317 - DNA, 22 bp, Homo sapiens
tggcttttttaaaaaagcaaca

SEQ ID NO: 4062318 - DNA, 20 bp, Homo sapiens
tgggaaaaaaacttggcact

SEQ ID NO: 4062319 - DNA, 19 bp, Homo sapiens
tgggaaactgttgtgggcg

SEQ ID NO: 4062320 - DNA, 19 bp, Homo sapiens
tgggaaagatggataaact

SEQ ID NO: 4062321 - DNA, 15 bp, Homo sapiens
tgggaaagccacctc

SEQ ID NO: 4062322 - DNA, 17 bp, Homo sapiens
tgggaaataagagagaa

SEQ ID NO: 4062323 - DNA, 19 bp, Homo sapiens
tgggaaatgagaaggcagc

SEQ ID NO: 4062324 - DNA, 23 bp, Homo sapiens
tgggaaatggtatgagctgaggg

SEQ ID NO: 4062325 - DNA, 13 bp, Homo sapiens
tgggaagaagaag

SEQ ID NO: 4062326 - DNA, 23 bp, Homo sapiens
tgggaagagaagagggcccagcc

SEQ ID NO: 4062327 - DNA, 19 bp, Homo sapiens
tgggaagagggggctggcc

SEQ ID NO: 4062328 - DNA, 11 bp, Homo sapiens
tgggaagatga

SEQ ID NO: 4062329 - DNA, 12 bp, Homo sapiens
tgggaaggactt

SEQ ID NO: 4062330 - DNA, 20 bp, Homo sapiens
tgggaagggtcatagaaagg

SEQ ID NO: 4062331 - DNA, 16 bp, Homo sapiens
tgggacaattgtttta

SEQ ID NO: 4062332 - DNA, 17 bp, Homo sapiens
tgggacacagacccagg

SEQ ID NO: 4062333 - DNA, 18 bp, Homo sapiens
tgggacacagacccagga

SEQ ID NO: 4062334 - DNA, 13 bp, Homo sapiens
tgggacaccaggg

SEQ ID NO: 4062335 - DNA, 12 bp, Homo sapiens
tgggacagccag

SEQ ID NO: 4062336 - DNA, 21 bp, Homo sapiens
tgggacagccagagctgggtg

SEQ ID NO: 4062337 - DNA, 19 bp, Homo sapiens
tgggacagggagcagcccc

SEQ ID NO: 4062338 - DNA, 14 bp, Homo sapiens
tgggacagggaggc

SEQ ID NO: 4062339 - DNA, 18 bp, Homo sapiens
tgggacagggaggccaca

SEQ ID NO: 4062340 - DNA, 16 bp, Homo sapiens
tgggacagggcatggc

SEQ ID NO: 4062341 - DNA, 14 bp, Homo sapiens
tgggaccagagcca

SEQ ID NO: 4062342 - DNA, 14 bp, Homo sapiens
tgggaccccgagct

SEQ ID NO: 4062343 - DNA, 17 bp, Homo sapiens
tgggacctgccaggcag

SEQ ID NO: 4062344 - DNA, 16 bp, Homo sapiens
tgggacgctctgctgt

SEQ ID NO: 4062345 - DNA, 13 bp, Homo sapiens
tgggacggaccag

SEQ ID NO: 4062346 - DNA, 18 bp, Homo sapiens
tgggacggaccagcatct

SEQ ID NO: 4062347 - DNA, 15 bp, Homo sapiens
tgggacgtggctcag

SEQ ID NO: 4062348 - DNA, 16 bp, Homo sapiens
tgggacgtggctcagc

SEQ ID NO: 4062349 - DNA, 17 bp, Homo sapiens
tgggactcattgtagaa

SEQ ID NO: 4062350 - DNA, 15 bp, Homo sapiens
tgggactgactttcc

SEQ ID NO: 4062351 - DNA, 15 bp, Homo sapiens
tgggacttattacaa

SEQ ID NO: 4062352 - DNA, 18 bp, Homo sapiens
tgggacttccatgcctta

SEQ ID NO: 4062353 - DNA, 18 bp, Homo sapiens
tgggagaaggactatcaa

SEQ ID NO: 4062354 - DNA, 19 bp, Homo sapiens
tgggagacacccaaagggt

SEQ ID NO: 4062355 - DNA, 12 bp, Homo sapiens
tgggagacagac

SEQ ID NO: 4062356 - DNA, 14 bp, Homo sapiens
tgggagacatgtga

SEQ ID NO: 4062357 - DNA, 20 bp, Homo sapiens
tgggagaggatttttttctg

SEQ ID NO: 4062358 - DNA, 16 bp, Homo sapiens
tgggagagtcaggcag

SEQ ID NO: 4062359 - DNA, 15 bp, Homo sapiens
tgggagcagaaacag

SEQ ID NO: 4062360 - DNA, 21 bp, Homo sapiens
tgggagcagaaacagccattg

SEQ ID NO: 4062361 - DNA, 16 bp, Homo sapiens
tgggagccccagggtc

SEQ ID NO: 4062362 - DNA, 20 bp, Homo sapiens
tgggagcccccaccacaaac

SEQ ID NO: 4062363 - DNA, 18 bp, Homo sapiens
tgggagcctagctcctgc

SEQ ID NO: 4062364 - DNA, 22 bp, Homo sapiens
tgggagcgtcagggttggtgtg

SEQ ID NO: 4062365 - DNA, 14 bp, Homo sapiens
tgggagctcctctc

SEQ ID NO: 4062366 - DNA, 17 bp, Homo sapiens
tgggagctcctctcctg

SEQ ID NO: 4062367 - DNA, 20 bp, Homo sapiens
tgggagctcctctcctggag

SEQ ID NO: 4062368 - DNA, 23 bp, Homo sapiens
tgggagctcctctcctggaggat

SEQ ID NO: 4062369 - DNA, 16 bp, Homo sapiens
tgggagctgaggccac

SEQ ID NO: 4062370 - DNA, 13 bp, Homo sapiens
tgggaggagggag

SEQ ID NO: 4062371 - DNA, 14 bp, Homo sapiens
tgggaggagggaga

SEQ ID NO: 4062372 - DNA, 18 bp, Homo sapiens
tgggaggagggagaggga

SEQ ID NO: 4062373 - DNA, 19 bp, Homo sapiens
tgggaggagggagagggag

SEQ ID NO: 4062374 - DNA, 12 bp, Homo sapiens
tgggaggagggg

SEQ ID NO: 4062375 - DNA, 14 bp, Homo sapiens
tgggaggaggggga

SEQ ID NO: 4062376 - DNA, 21 bp, Homo sapiens
tgggaggagggggagggtgat

SEQ ID NO: 4062377 - DNA, 20 bp, Homo sapiens
tgggaggcagggctctcccg

SEQ ID NO: 4062378 - DNA, 22 bp, Homo sapiens
tgggaggcggagagtacagtga

SEQ ID NO: 4062379 - DNA, 17 bp, Homo sapiens
tgggagggaggctcagg

SEQ ID NO: 4062380 - DNA, 16 bp, Homo sapiens
tgggagggcattccat

SEQ ID NO: 4062381 - DNA, 18 bp, Homo sapiens
tgggaggtggaagaaggg

SEQ ID NO: 4062382 - DNA, 13 bp, Homo sapiens
tgggagtcagagc

SEQ ID NO: 4062383 - DNA, 17 bp, Homo sapiens
tgggagtcagagccctg

SEQ ID NO: 4062384 - DNA, 21 bp, Homo sapiens
tgggagtcagagccctggctg

SEQ ID NO: 4062385 - DNA, 17 bp, Homo sapiens
tgggagtgggcacctca

SEQ ID NO: 4062386 - DNA, 23 bp, Homo sapiens
tgggataaagatgcaaggaccag

SEQ ID NO: 4062387 - DNA, 20 bp, Homo sapiens
tgggatagtgttctgctcct

SEQ ID NO: 4062388 - DNA, 21 bp, Homo sapiens
tgggatagtgttctgctcctg

SEQ ID NO: 4062389 - DNA, 15 bp, Homo sapiens
tgggatatggctgcc

SEQ ID NO: 4062390 - DNA, 13 bp, Homo sapiens
tgggatcctccct

SEQ ID NO: 4062391 - DNA, 16 bp, Homo sapiens
tgggatgagccgctgt

SEQ ID NO: 4062392 - DNA, 21 bp, Homo sapiens
tgggatgggacagggaggcca

SEQ ID NO: 4062393 - DNA, 19 bp, Homo sapiens
tgggatgggttccagaggt

SEQ ID NO: 4062394 - DNA, 21 bp, Homo sapiens
tgggatgttcagcactgtccc

SEQ ID NO: 4062395 - DNA, 22 bp, Homo sapiens
tgggattaagaaaccttgctct

SEQ ID NO: 4062396 - DNA, 23 bp, Homo sapiens
tgggattaagaaaccttgctctc

SEQ ID NO: 4062397 - DNA, 14 bp, Homo sapiens
tgggatttgctgtg

SEQ ID NO: 4062398 - DNA, 14 bp, Homo sapiens
tgggcaaacaggca

SEQ ID NO: 4062399 - DNA, 21 bp, Homo sapiens
tgggcaaagccacaaggctgg

SEQ ID NO: 4062400 - DNA, 13 bp, Homo sapiens
tgggcacaggtca

SEQ ID NO: 4062401 - DNA, 13 bp, Homo sapiens
tgggcacagtcca

SEQ ID NO: 4062402 - DNA, 15 bp, Homo sapiens
tgggcacagtccaga

SEQ ID NO: 4062403 - DNA, 15 bp, Homo sapiens
tgggcacctcagaaa

SEQ ID NO: 4062404 - DNA, 21 bp, Homo sapiens
tgggcacctcagaaagtcacc

SEQ ID NO: 4062405 - DNA, 15 bp, Homo sapiens
tgggcactggcccag

SEQ ID NO: 4062406 - DNA, 16 bp, Homo sapiens
tgggcactggcccagg

SEQ ID NO: 4062407 - DNA, 15 bp, Homo sapiens
tgggcactgggatga

SEQ ID NO: 4062408 - DNA, 16 bp, Homo sapiens
tgggcactgggatgag

SEQ ID NO: 4062409 - DNA, 13 bp, Homo sapiens
tgggcacttgaga

SEQ ID NO: 4062410 - DNA, 15 bp, Homo sapiens
tgggcagaagggaga

SEQ ID NO: 4062411 - DNA, 17 bp, Homo sapiens
tgggcagaagggagaag

SEQ ID NO: 4062412 - DNA, 18 bp, Homo sapiens
tgggcagaagggagaagg

SEQ ID NO: 4062413 - DNA, 19 bp, Homo sapiens
tgggcagaagggagaagga

SEQ ID NO: 4062414 - DNA, 16 bp, Homo sapiens
tgggcagagctgcatc

SEQ ID NO: 4062415 - DNA, 23 bp, Homo sapiens
tgggcagaggaccaggctgtagg

SEQ ID NO: 4062416 - DNA, 17 bp, Homo sapiens
tgggcagcaatttaaat

SEQ ID NO: 4062417 - DNA, 21 bp, Homo sapiens
tgggcagcaatttaaatgtta

SEQ ID NO: 4062418 - DNA, 17 bp, Homo sapiens
tgggcagcaccctcccc

SEQ ID NO: 4062419 - DNA, 18 bp, Homo sapiens
tgggcagcaccctccccc

SEQ ID NO: 4062420 - DNA, 18 bp, Homo sapiens
tgggcagcatagcaagac

SEQ ID NO: 4062421 - DNA, 14 bp, Homo sapiens
tgggcagccaggct

SEQ ID NO: 4062422 - DNA, 12 bp, Homo sapiens
tgggcagcccaa

SEQ ID NO: 4062423 - DNA, 13 bp, Homo sapiens
tgggcagccccag

SEQ ID NO: 4062424 - DNA, 15 bp, Homo sapiens
tgggcagccccagag

SEQ ID NO: 4062425 - DNA, 16 bp, Homo sapiens
tgggcagccccagaga

SEQ ID NO: 4062426 - DNA, 18 bp, Homo sapiens
tgggcagccccagagaga

SEQ ID NO: 4062427 - DNA, 13 bp, Homo sapiens
tgggcagggagcg

SEQ ID NO: 4062428 - DNA, 21 bp, Homo sapiens
tgggcagggtctgtttggact

SEQ ID NO: 4062429 - DNA, 24 bp, Homo sapiens
tgggcagtgccccagggagtccag

SEQ ID NO: 4062430 - DNA, 13 bp, Homo sapiens
tgggcatgccacc

SEQ ID NO: 4062431 - DNA, 16 bp, Homo sapiens
tgggcatgccaccctc

SEQ ID NO: 4062432 - DNA, 23 bp, Homo sapiens
tgggcattactgtttaagacact

SEQ ID NO: 4062433 - DNA, 15 bp, Homo sapiens
tgggcattgctttcc

SEQ ID NO: 4062434 - DNA, 23 bp, Homo sapiens
tgggccaacaaagaacactaact

SEQ ID NO: 4062435 - DNA, 20 bp, Homo sapiens
tgggggacagaaagagactc

SEQ ID NO: 4062436 - DNA, 14 bp, Homo sapiens
tgggggacagagaa

SEQ ID NO: 4062437 - DNA, 12 bp, Homo sapiens
tgggggactggg

SEQ ID NO: 4062438 - DNA, 21 bp, Homo sapiens
tgggggagtagatctttctag

SEQ ID NO: 4062439 - DNA, 22 bp, Homo sapiens
tgggggcaggagggccctacct

SEQ ID NO: 4062440 - DNA, 13 bp, Homo sapiens
tgggggcagggct

SEQ ID NO: 4062441 - DNA, 15 bp, Homo sapiens
tgggggcagggctgt

SEQ ID NO: 4062442 - DNA, 21 bp, Homo sapiens
tgggggcatctcttccccaga

SEQ ID NO: 4062443 - DNA, 18 bp, Homo sapiens
tgggggccaggacaccag

SEQ ID NO: 4062444 - DNA, 14 bp, Homo sapiens
tgggggctggcctc

SEQ ID NO: 4062445 - DNA, 20 bp, Homo sapiens
tggggggccgggcaggtcct

SEQ ID NO: 4062446 - DNA, 19 bp, Homo sapiens
tggggggttggcagcccac

SEQ ID NO: 4062447 - DNA, 15 bp, Homo sapiens
tgggggtgagggtcc

SEQ ID NO: 4062448 - DNA, 15 bp, Homo sapiens
tgggggtggcaggca

SEQ ID NO: 4062449 - DNA, 17 bp, Homo sapiens
tgggggtggggagacct

SEQ ID NO: 4062450 - DNA, 17 bp, Homo sapiens
tggggtaagcggaataa

SEQ ID NO: 4062451 - DNA, 21 bp, Homo sapiens
tggggtaagcggaataaacta

SEQ ID NO: 4062452 - DNA, 21 bp, Homo sapiens
tggggtactcttgatgtgaag

SEQ ID NO: 4062453 - DNA, 13 bp, Homo sapiens
tggggtagggctg

SEQ ID NO: 4062454 - DNA, 22 bp, Homo sapiens
tggggtattggacatagatatt

SEQ ID NO: 4062455 - DNA, 22 bp, Homo sapiens
tggggtcaagaaacagccagca

SEQ ID NO: 4062456 - DNA, 18 bp, Homo sapiens
tggggtcagccagggcca

SEQ ID NO: 4062457 - DNA, 21 bp, Homo sapiens
tggggtcagccagggccaggg

SEQ ID NO: 4062458 - DNA, 13 bp, Homo sapiens
tggggtcaggaac

SEQ ID NO: 4062459 - DNA, 22 bp, Homo sapiens
tggggtcaggaacagtggctgg

SEQ ID NO: 4062460 - DNA, 19 bp, Homo sapiens
tggggtcaggccgggcaga

SEQ ID NO: 4062461 - DNA, 17 bp, Homo sapiens
tggggtcccactgctcg

SEQ ID NO: 4062462 - DNA, 15 bp, Homo sapiens
tggggtccctccacc

SEQ ID NO: 4062463 - DNA, 23 bp, Homo sapiens
tggggtctcacagtgttgcccag

SEQ ID NO: 4062464 - DNA, 14 bp, Homo sapiens
tggggtctgacccc

SEQ ID NO: 4062465 - DNA, 17 bp, Homo sapiens
tggggtctggcagcctc

SEQ ID NO: 4062466 - DNA, 18 bp, Homo sapiens
tggggtctggcagcctcc

SEQ ID NO: 4062467 - DNA, 11 bp, Homo sapiens
tggggtgacag

SEQ ID NO: 4062468 - DNA, 16 bp, Homo sapiens
tggggtgacagtcatc

SEQ ID NO: 4062469 - DNA, 17 bp, Homo sapiens
tggggtgacagtcatca

SEQ ID NO: 4062470 - DNA, 16 bp, Homo sapiens
tggggtgtttgggagg

SEQ ID NO: 4062471 - DNA, 18 bp, Homo sapiens
tggggttatctctgtgtt

SEQ ID NO: 4062472 - DNA, 19 bp, Homo sapiens
tggggttggcaacaggaca

SEQ ID NO: 4062473 - DNA, 21 bp, Homo sapiens
tggggttggcaacaggacaga

SEQ ID NO: 4062474 - DNA, 15 bp, Homo sapiens
tggggtttttattat

SEQ ID NO: 4062475 - DNA, 20 bp, Homo sapiens
tggggtttttattattttta

SEQ ID NO: 4062476 - DNA, 22 bp, Homo sapiens
tgggtaatccaggcacagctga

SEQ ID NO: 4062477 - DNA, 19 bp, Homo sapiens
tgggtacttcttgaaggtg

SEQ ID NO: 4062478 - DNA, 16 bp, Homo sapiens
tgggtagatgtgcaat

SEQ ID NO: 4062479 - DNA, 17 bp, Homo sapiens
tgggtagggctctgaca

SEQ ID NO: 4062480 - DNA, 17 bp, Homo sapiens
tgggtatgctcaggtca

SEQ ID NO: 4062481 - DNA, 22 bp, Homo sapiens
tgggtatgctcaggtcaactga

SEQ ID NO: 4062482 - DNA, 17 bp, Homo sapiens
tgggtcacatccatccc

SEQ ID NO: 4062483 - DNA, 14 bp, Homo sapiens
tgggtcaggccacc

SEQ ID NO: 4062484 - DNA, 20 bp, Homo sapiens
tgggtcattgacctctcagg

SEQ ID NO: 4062485 - DNA, 22 bp, Homo sapiens
tgggtcattgacctctcagggc

SEQ ID NO: 4062486 - DNA, 13 bp, Homo sapiens
tgggtccagggcc

SEQ ID NO: 4062487 - DNA, 15 bp, Homo sapiens
tgggtccccagccct

SEQ ID NO: 4062488 - DNA, 16 bp, Homo sapiens
tgggtccccagccctt

SEQ ID NO: 4062489 - DNA, 18 bp, Homo sapiens
tgggtccccctcagcaag

SEQ ID NO: 4062490 - DNA, 17 bp, Homo sapiens
tgggtcctagcccttcc

SEQ ID NO: 4062491 - DNA, 14 bp, Homo sapiens
tgggtcctgcaatt

SEQ ID NO: 4062492 - DNA, 15 bp, Homo sapiens
tgggtcggccctgcc

SEQ ID NO: 4062493 - DNA, 18 bp, Homo sapiens
tgggtctaatccttctca

SEQ ID NO: 4062494 - DNA, 22 bp, Homo sapiens
tgggtctcgctttgttgcccag

SEQ ID NO: 4062495 - DNA, 17 bp, Homo sapiens
tgggtctggctgagctg

SEQ ID NO: 4062496 - DNA, 18 bp, Homo sapiens
tgggtgaaggcctggctg

SEQ ID NO: 4062497 - DNA, 21 bp, Homo sapiens
tgggtgaaggcctggctggaa

SEQ ID NO: 4062498 - DNA, 14 bp, Homo sapiens
tgggtgaggaaatc

SEQ ID NO: 4062499 - DNA, 14 bp, Homo sapiens
tgggtgcaggagcg

SEQ ID NO: 4062500 - DNA, 15 bp, Homo sapiens
tgggtgctgccctgt

SEQ ID NO: 4062501 - DNA, 14 bp, Homo sapiens
tgggtgctggctgc

SEQ ID NO: 4062502 - DNA, 16 bp, Homo sapiens
tgggtgggattttgca

SEQ ID NO: 4062503 - DNA, 18 bp, Homo sapiens
tgggtgggattttgcaaa

SEQ ID NO: 4062504 - DNA, 20 bp, Homo sapiens
tgggtggggtgaggaccact

SEQ ID NO: 4062505 - DNA, 15 bp, Homo sapiens
tgggtgtccatgtgc

SEQ ID NO: 4062506 - DNA, 15 bp, Homo sapiens
tgggtgtcctgcctg

SEQ ID NO: 4062507 - DNA, 19 bp, Homo sapiens
tgggtgtcctgcctgtctg

SEQ ID NO: 4062508 - DNA, 19 bp, Homo sapiens
tgggtgttcctggcagttt

SEQ ID NO: 4062509 - DNA, 16 bp, Homo sapiens
tgggtgttctttcctg

SEQ ID NO: 4062510 - DNA, 15 bp, Homo sapiens
tgggtgttgatctta

SEQ ID NO: 4062511 - DNA, 11 bp, Homo sapiens
tgggttcatta

SEQ ID NO: 4062512 - DNA, 17 bp, Homo sapiens
tgggttctgatattgcc

SEQ ID NO: 4062513 - DNA, 21 bp, Homo sapiens
tgggttctgcctgccagctgc

SEQ ID NO: 4062514 - DNA, 23 bp, Homo sapiens
tgggttctttggaaggagtgaga

SEQ ID NO: 4062515 - DNA, 14 bp, Homo sapiens
tgggtttgagaaat

SEQ ID NO: 4062516 - DNA, 15 bp, Homo sapiens
tggtaaaactcactg

SEQ ID NO: 4062517 - DNA, 21 bp, Homo sapiens
tggtaaattagtatttattta

SEQ ID NO: 4062518 - DNA, 22 bp, Homo sapiens
tggtaactgctttctgttccaa

SEQ ID NO: 4062519 - DNA, 17 bp, Homo sapiens
tggtaagaaaaagcaaa

SEQ ID NO: 4062520 - DNA, 22 bp, Homo sapiens
tggtaagaagccgggaacagac

SEQ ID NO: 4062521 - DNA, 17 bp, Homo sapiens
tggtaatctttacctgt

SEQ ID NO: 4062522 - DNA, 22 bp, Homo sapiens
tggtaatctttacctgtataca

SEQ ID NO: 4062523 - DNA, 13 bp, Homo sapiens
tggtacatgtctt

SEQ ID NO: 4062524 - DNA, 17 bp, Homo sapiens
tggtactgactttgctt

SEQ ID NO: 4062525 - DNA, 19 bp, Homo sapiens
tggtacttttatgatgtat

SEQ ID NO: 4062526 - DNA, 12 bp, Homo sapiens
tggtagaaacaa

SEQ ID NO: 4062527 - DNA, 14 bp, Homo sapiens
tggtagagaaggag

SEQ ID NO: 4062528 - DNA, 17 bp, Homo sapiens
tggtagattaaatatag

SEQ ID NO: 4062529 - DNA, 19 bp, Homo sapiens
tggtagattaaatatagat

SEQ ID NO: 4062530 - DNA, 16 bp, Homo sapiens
tggtaggcatttccta

SEQ ID NO: 4062531 - DNA, 17 bp, Homo sapiens
tggtagggacttaaaaa

SEQ ID NO: 4062532 - DNA, 13 bp, Homo sapiens
tggtagggtggga

SEQ ID NO: 4062533 - DNA, 18 bp, Homo sapiens
tggtaggttgggacacca

SEQ ID NO: 4062534 - DNA, 21 bp, Homo sapiens
tggtaggttgggacaccaggg

SEQ ID NO: 4062535 - DNA, 20 bp, Homo sapiens
tggtagttagtagcatgttg

SEQ ID NO: 4062536 - DNA, 15 bp, Homo sapiens
tggtataatgtttaa

SEQ ID NO: 4062537 - DNA, 18 bp, Homo sapiens
tggtataatgtttaaatc

SEQ ID NO: 4062538 - DNA, 12 bp, Homo sapiens
tggttatgaact

SEQ ID NO: 4062539 - DNA, 17 bp, Homo sapiens
tggttattagcaaggct

SEQ ID NO: 4062540 - DNA, 15 bp, Homo sapiens
tggttattggttttt

SEQ ID NO: 4062541 - DNA, 13 bp, Homo sapiens
tggttatttctct

SEQ ID NO: 4062542 - DNA, 16 bp, Homo sapiens
tggttcataaatgaat

SEQ ID NO: 4062543 - DNA, 16 bp, Homo sapiens
tggttcccaataaaag

SEQ ID NO: 4062544 - DNA, 18 bp, Homo sapiens
tggttcccgtttctccac

SEQ ID NO: 4062545 - DNA, 20 bp, Homo sapiens
tggttcccgtttctccacct

SEQ ID NO: 4062546 - DNA, 16 bp, Homo sapiens
tggttccttctctggg

SEQ ID NO: 4062547 - DNA, 15 bp, Homo sapiens
tggttctctccagga

SEQ ID NO: 4062548 - DNA, 12 bp, Homo sapiens
tggttctggcca

SEQ ID NO: 4062549 - DNA, 19 bp, Homo sapiens
tggttcttagttctcactg

SEQ ID NO: 4062550 - DNA, 12 bp, Homo sapiens
tggttgatggaa

SEQ ID NO: 4062551 - DNA, 18 bp, Homo sapiens
tggttgatggaaaataaa

SEQ ID NO: 4062552 - DNA, 12 bp, Homo sapiens
tggttgatttgt

SEQ ID NO: 4062553 - DNA, 20 bp, Homo sapiens
tggttgatttgtaacacagt

SEQ ID NO: 4062554 - DNA, 23 bp, Homo sapiens
tggttggaagctaccagagctct

SEQ ID NO: 4062555 - DNA, 23 bp, Homo sapiens
tggttgtcatttttgcagtagag

SEQ ID NO: 4062556 - DNA, 22 bp, Homo sapiens
tggtttacaggccctgctcctg

SEQ ID NO: 4062557 - DNA, 11 bp, Homo sapiens
tggtttacatt

SEQ ID NO: 4062558 - DNA, 14 bp, Homo sapiens
tggtttacatttaa

SEQ ID NO: 4062559 - DNA, 23 bp, Homo sapiens
tggtttacatttaaagcattgct

SEQ ID NO: 4062560 - DNA, 20 bp, Homo sapiens
tggtttccacgatgaaaaac

SEQ ID NO: 4062561 - DNA, 19 bp, Homo sapiens
tggtttcctcattcctgaa

SEQ ID NO: 4062562 - DNA, 12 bp, Homo sapiens
tggtttcctgcc

SEQ ID NO: 4062563 - DNA, 14 bp, Homo sapiens
tggtttcctgccca

SEQ ID NO: 4062564 - DNA, 15 bp, Homo sapiens
tggtttctcttctcc

SEQ ID NO: 4062565 - DNA, 19 bp, Homo sapiens
tggtttctcttctcccctt

SEQ ID NO: 4062566 - DNA, 13 bp, Homo sapiens
tggtttctgaaaa

SEQ ID NO: 4062567 - DNA, 17 bp, Homo sapiens
tggtttctgaaaatgtt

SEQ ID NO: 4062568 - DNA, 22 bp, Homo sapiens
tggtttgcaacctctttgctca

SEQ ID NO: 4062569 - DNA, 16 bp, Homo sapiens
tggtttgggaaagatg

SEQ ID NO: 4062570 - DNA, 13 bp, Homo sapiens
tggtttgtcctga

SEQ ID NO: 4062571 - DNA, 22 bp, Homo sapiens
tggttttaagtggaactgccct

SEQ ID NO: 4062572 - DNA, 23 bp, Homo sapiens
tggttttatactgaaggaaaaac

SEQ ID NO: 4062573 - DNA, 17 bp, Homo sapiens
tggtttttatttctcct

SEQ ID NO: 4062574 - DNA, 21 bp, Homo sapiens
tgtaaaaaatggaaaaaaaca

SEQ ID NO: 4062575 - DNA, 19 bp, Homo sapiens
tgtaaaaacagcattgctt

SEQ ID NO: 4062576 - DNA, 23 bp, Homo sapiens
tgtaaaaacagcattgctttctg

SEQ ID NO: 4062577 - DNA, 19 bp, Homo sapiens
tgtaaacgacaagaataat

SEQ ID NO: 4062578 - DNA, 18 bp, Homo sapiens
tgtaaactgcattagaaa

SEQ ID NO: 4062579 - DNA, 13 bp, Homo sapiens
tgtaaagaaatgt

SEQ ID NO: 4062580 - DNA, 13 bp, Homo sapiens
tgtaaagctggcc

SEQ ID NO: 4062581 - DNA, 14 bp, Homo sapiens
tgtaaagctggccc

SEQ ID NO: 4062582 - DNA, 16 bp, Homo sapiens
tgtaaagctggccctg

SEQ ID NO: 4062583 - DNA, 19 bp, Homo sapiens
tgtaaagtaggaaaaataa

SEQ ID NO: 4062584 - DNA, 19 bp, Homo sapiens
tgtaaagttgcctttattt

SEQ ID NO: 4062585 - DNA, 14 bp, Homo sapiens
tgtaaataaaaaga

SEQ ID NO: 4062586 - DNA, 21 bp, Homo sapiens
tgtaaatacacatagcatgta

SEQ ID NO: 4062587 - DNA, 15 bp, Homo sapiens
tgtaaatattctata

SEQ ID NO: 4062588 - DNA, 13 bp, Homo sapiens
tgtaaatatttat

SEQ ID NO: 4062589 - DNA, 18 bp, Homo sapiens
tgtaaatatttatttatg

SEQ ID NO: 4062590 - DNA, 15 bp, Homo sapiens
tgtaaatgctggtat

SEQ ID NO: 4062591 - DNA, 15 bp, Homo sapiens
tgtaaatggtgtaca

SEQ ID NO: 4062592 - DNA, 16 bp, Homo sapiens
tgtaaattatttatgt

SEQ ID NO: 4062593 - DNA, 17 bp, Homo sapiens
tgtaaattgaatcagta

SEQ ID NO: 4062594 - DNA, 22 bp, Homo sapiens
tgtaaattgaatcagtataaac

SEQ ID NO: 4062595 - DNA, 15 bp, Homo sapiens
tgtaacaattgtgta

SEQ ID NO: 4062596 - DNA, 20 bp, Homo sapiens
tgtaacaattgtgtagcctt

SEQ ID NO: 4062597 - DNA, 11 bp, Homo sapiens
tgtaacagctg

SEQ ID NO: 4062598 - DNA, 12 bp, Homo sapiens
tgtaacctcagc

SEQ ID NO: 4062599 - DNA, 18 bp, Homo sapiens
tgtaacctcagctctggg

SEQ ID NO: 4062600 - DNA, 23 bp, Homo sapiens
tgtaacctgttgctgtgtttaat

SEQ ID NO: 4062601 - DNA, 16 bp, Homo sapiens
tgtaacgtggcactgg

SEQ ID NO: 4062602 - DNA, 18 bp, Homo sapiens
tgtaacgtgtgctgtgtt

SEQ ID NO: 4062603 - DNA, 21 bp, Homo sapiens
tgtaactaggctcagagatgt

SEQ ID NO: 4062604 - DNA, 12 bp, Homo sapiens
tgtaactatgtt

SEQ ID NO: 4062605 - DNA, 13 bp, Homo sapiens
tgtaactatgttt

SEQ ID NO: 4062606 - DNA, 17 bp, Homo sapiens
tgtaacttatattgaag

SEQ ID NO: 4062607 - DNA, 20 bp, Homo sapiens
tgtaacttatattgaagaca

SEQ ID NO: 4062608 - DNA, 23 bp, Homo sapiens
tgtaacttatattgaagacaatt

SEQ ID NO: 4062609 - DNA, 13 bp, Homo sapiens
tgtaacttcctgc

SEQ ID NO: 4062610 - DNA, 16 bp, Homo sapiens
tgtaacttcctgctgc

SEQ ID NO: 4062611 - DNA, 19 bp, Homo sapiens
tgtaagaaaacaaaatcta

SEQ ID NO: 4062612 - DNA, 19 bp, Homo sapiens
tgtaagaagagactgggaa

SEQ ID NO: 4062613 - DNA, 21 bp, Homo sapiens
tgtaagaagagactgggaaga

SEQ ID NO: 4062614 - DNA, 22 bp, Homo sapiens
tgtaagaataggcattaacaca

SEQ ID NO: 4062615 - DNA, 19 bp, Homo sapiens
tgtaagagtgtagaagcat

SEQ ID NO: 4062616 - DNA, 21 bp, Homo sapiens
tgtaagtaaattgcctgattt

SEQ ID NO: 4062617 - DNA, 14 bp, Homo sapiens
tgtaagtaattatc

SEQ ID NO: 4062618 - DNA, 16 bp, Homo sapiens
tgtaagtcagtgttga

SEQ ID NO: 4062619 - DNA, 17 bp, Homo sapiens
tgtaagtcagtgttgag

SEQ ID NO: 4062620 - DNA, 21 bp, Homo sapiens
tgtaagtgtgagtaagagctg

SEQ ID NO: 4062621 - DNA, 19 bp, Homo sapiens
tgtaagttgtacaaatgta

SEQ ID NO: 4062622 - DNA, 20 bp, Homo sapiens
tgtaagttgtacaaatgtat

SEQ ID NO: 4062623 - DNA, 21 bp, Homo sapiens
tgtaagttgtacaaatgtatt

SEQ ID NO: 4062624 - DNA, 19 bp, Homo sapiens
tgtaagtttcaggtgacat

SEQ ID NO: 4062625 - DNA, 20 bp, Homo sapiens
tgtaataaaaagtatatgtt

SEQ ID NO: 4062626 - DNA, 13 bp, Homo sapiens
tgtaataaatact

SEQ ID NO: 4062627 - DNA, 14 bp, Homo sapiens
tgtaataagacata

SEQ ID NO: 4062628 - DNA, 15 bp, Homo sapiens
tgtaataagacataa

SEQ ID NO: 4062629 - DNA, 21 bp, Homo sapiens
tgtaataagacttagattgtg

SEQ ID NO: 4062630 - DNA, 13 bp, Homo sapiens
tgtaataagcaat

SEQ ID NO: 4062631 - DNA, 20 bp, Homo sapiens
tgtaatactggaataatttg

SEQ ID NO: 4062632 - DNA, 18 bp, Homo sapiens
tgtaatatttagctgtaa

SEQ ID NO: 4062633 - DNA, 21 bp, Homo sapiens
tgtaatatttagctgtaaact

SEQ ID NO: 4062634 - DNA, 15 bp, Homo sapiens
tgtaatcaagccttt

SEQ ID NO: 4062635 - DNA, 20 bp, Homo sapiens
tgtaatccaggggtgtagat

SEQ ID NO: 4062636 - DNA, 23 bp, Homo sapiens
tgtaatcccagcactttgggagg

SEQ ID NO: 4062637 - DNA, 16 bp, Homo sapiens
tgtaatcccagctact

SEQ ID NO: 4062638 - DNA, 17 bp, Homo sapiens
tgtaatctctctgcagc

SEQ ID NO: 4062639 - DNA, 20 bp, Homo sapiens
tgtaatcttatttaggaagt

SEQ ID NO: 4062640 - DNA, 18 bp, Homo sapiens
tgtaatgaaaatgaatat

SEQ ID NO: 4062641 - DNA, 15 bp, Homo sapiens
tgtatatacagttat

SEQ ID NO: 4062642 - DNA, 15 bp, Homo sapiens
tgtatatacatatat

SEQ ID NO: 4062643 - DNA, 20 bp, Homo sapiens
tgtatatatacctgcgcttg

SEQ ID NO: 4062644 - DNA, 18 bp, Homo sapiens
tgtatatcattctacaga

SEQ ID NO: 4062645 - DNA, 21 bp, Homo sapiens
tgtatatcattctacagaata

SEQ ID NO: 4062646 - DNA, 22 bp, Homo sapiens
tgtatatcattctacagaataa

SEQ ID NO: 4062647 - DNA, 15 bp, Homo sapiens
tgtatatccttccaa

SEQ ID NO: 4062648 - DNA, 20 bp, Homo sapiens
tgtatatccttccaaaaaat

SEQ ID NO: 4062649 - DNA, 22 bp, Homo sapiens
tgtatatccttccaaaaaatta

SEQ ID NO: 4062650 - DNA, 18 bp, Homo sapiens
tgtatatcctttctaaca

SEQ ID NO: 4062651 - DNA, 23 bp, Homo sapiens
tgtatattatggaagattttaaa

SEQ ID NO: 4062652 - DNA, 20 bp, Homo sapiens
tgtatattgtgtttgtgtat

SEQ ID NO: 4062653 - DNA, 14 bp, Homo sapiens
tgtatatttgtaca

SEQ ID NO: 4062654 - DNA, 23 bp, Homo sapiens
tgtatatttgtgatagcactttc

SEQ ID NO: 4062655 - DNA, 22 bp, Homo sapiens
tgtatattttaagaaataacag

SEQ ID NO: 4062656 - DNA, 21 bp, Homo sapiens
tgtatcatctggataggagcc

SEQ ID NO: 4062657 - DNA, 17 bp, Homo sapiens
tgtatcggagacagtga

SEQ ID NO: 4062658 - DNA, 19 bp, Homo sapiens
tgtatcgtaaccagccaga

SEQ ID NO: 4062659 - DNA, 16 bp, Homo sapiens
tgtatctctttcacat

SEQ ID NO: 4062660 - DNA, 21 bp, Homo sapiens
tgtatcttccatatttggaag

SEQ ID NO: 4062661 - DNA, 21 bp, Homo sapiens
tgtatcttggggcaagactgc

SEQ ID NO: 4062662 - DNA, 16 bp, Homo sapiens
tgtatcttttttataa

SEQ ID NO: 4062663 - DNA, 20 bp, Homo sapiens
tgtatgaaaaattggggagg

SEQ ID NO: 4062664 - DNA, 21 bp, Homo sapiens
tgtatgaaggaatcattccag

SEQ ID NO: 4062665 - DNA, 19 bp, Homo sapiens
tgtatgatttgttttgaat

SEQ ID NO: 4062666 - DNA, 16 bp, Homo sapiens
tgtatgcacagtaaaa

SEQ ID NO: 4062667 - DNA, 16 bp, Homo sapiens
tgtatggaaacactga

SEQ ID NO: 4062668 - DNA, 19 bp, Homo sapiens
tgtatggaatcccactgta

SEQ ID NO: 4062669 - DNA, 20 bp, Homo sapiens
tgtatgggtagggtaaatca

SEQ ID NO: 4062670 - DNA, 22 bp, Homo sapiens
tgtatgggtagggtaaatcagt

SEQ ID NO: 4062671 - DNA, 23 bp, Homo sapiens
tgtatgtaaagttcctgctgtaa

SEQ ID NO: 4062672 - DNA, 14 bp, Homo sapiens
tgtatgtgagagat

SEQ ID NO: 4062673 - DNA, 18 bp, Homo sapiens
tgtatgtgagagattctg

SEQ ID NO: 4062674 - DNA, 11 bp, Homo sapiens
tgtatgtgcac

SEQ ID NO: 4062675 - DNA, 14 bp, Homo sapiens
tgtatgtgtaagta

SEQ ID NO: 4062676 - DNA, 16 bp, Homo sapiens
tgtattattctgcagc

SEQ ID NO: 4062677 - DNA, 13 bp, Homo sapiens
tgtattcatccag

SEQ ID NO: 4062678 - DNA, 15 bp, Homo sapiens
tgtattcttctgtat

SEQ ID NO: 4062679 - DNA, 16 bp, Homo sapiens
tgtattgactgtacca

SEQ ID NO: 4062680 - DNA, 16 bp, Homo sapiens
tgtattgctgctgtgc

SEQ ID NO: 4062681 - DNA, 18 bp, Homo sapiens
tgtattgctgctgtgcgt

SEQ ID NO: 4062682 - DNA, 14 bp, Homo sapiens
tgtattgttcccag

SEQ ID NO: 4062683 - DNA, 19 bp, Homo sapiens
tgtattgttttctgacagt

SEQ ID NO: 4062684 - DNA, 17 bp, Homo sapiens
tgtatttatgtgtgagg

SEQ ID NO: 4062685 - DNA, 17 bp, Homo sapiens
tgtatttattcctctgt

SEQ ID NO: 4062686 - DNA, 15 bp, Homo sapiens
tgtatttccagtgca

SEQ ID NO: 4062687 - DNA, 13 bp, Homo sapiens
tgtattttacata

SEQ ID NO: 4062688 - DNA, 19 bp, Homo sapiens
tgtattttatttagacaag

SEQ ID NO: 4062689 - DNA, 22 bp, Homo sapiens
tgtattttatttagacaagaga

SEQ ID NO: 4062690 - DNA, 12 bp, Homo sapiens
tgtattttccta

SEQ ID NO: 4062691 - DNA, 14 bp, Homo sapiens
tgtattttgaagaa

SEQ ID NO: 4062692 - DNA, 16 bp, Homo sapiens
tgtatttttgttagtt

SEQ ID NO: 4062693 - DNA, 14 bp, Homo sapiens
tgtattttttaaaa

SEQ ID NO: 4062694 - DNA, 16 bp, Homo sapiens
tgtattttttaaaaca

SEQ ID NO: 4062695 - DNA, 18 bp, Homo sapiens
tgtattttttaaaacact

SEQ ID NO: 4062696 - DNA, 20 bp, Homo sapiens
tgtattttttaattgatttt

SEQ ID NO: 4062697 - DNA, 23 bp, Homo sapiens
tgtcaaaagaaataatccctgta

SEQ ID NO: 4062698 - DNA, 18 bp, Homo sapiens
tgtcaaacagtgccaaat

SEQ ID NO: 4062699 - DNA, 16 bp, Homo sapiens
tgtcaaactgtagaaa

SEQ ID NO: 4062700 - DNA, 14 bp, Homo sapiens
tgtcaagctgctct

SEQ ID NO: 4062701 - DNA, 18 bp, Homo sapiens
tgtcaagctgctctgagc

SEQ ID NO: 4062702 - DNA, 19 bp, Homo sapiens
tgtcaagctgctctgagcc

SEQ ID NO: 4062703 - DNA, 19 bp, Homo sapiens
tgtcaaggaagacttttgg

SEQ ID NO: 4062704 - DNA, 23 bp, Homo sapiens
tgtcaaggaagacttttggtaga

SEQ ID NO: 4062705 - DNA, 18 bp, Homo sapiens
tgtcaaggctgcttagaa

SEQ ID NO: 4062706 - DNA, 19 bp, Homo sapiens
tgtcaaggctgcttagaat

SEQ ID NO: 4062707 - DNA, 16 bp, Homo sapiens
tgtcaagtctctgctg

SEQ ID NO: 4062708 - DNA, 17 bp, Homo sapiens
tgtcaagtctctgctgg

SEQ ID NO: 4062709 - DNA, 23 bp, Homo sapiens
tgtcaataaacagcttcatgcct

SEQ ID NO: 4062710 - DNA, 21 bp, Homo sapiens
tgtcaatattaaatacagaca

SEQ ID NO: 4062711 - DNA, 13 bp, Homo sapiens
tgtcaattatgtt

SEQ ID NO: 4062712 - DNA, 14 bp, Homo sapiens
tgtcaattatgttg

SEQ ID NO: 4062713 - DNA, 19 bp, Homo sapiens
tgtcaatttccctgactcc

SEQ ID NO: 4062714 - DNA, 23 bp, Homo sapiens
tgtcaatttccctgactcctcta

SEQ ID NO: 4062715 - DNA, 18 bp, Homo sapiens
tgtcacaacctctctgat

SEQ ID NO: 4062716 - DNA, 16 bp, Homo sapiens
tgtcacaatgagattg

SEQ ID NO: 4062717 - DNA, 19 bp, Homo sapiens
tgtcacagaaatcagagga

SEQ ID NO: 4062718 - DNA, 12 bp, Homo sapiens
tgtcacagggcc

SEQ ID NO: 4062719 - DNA, 13 bp, Homo sapiens
tgtcacagggcca

SEQ ID NO: 4062720 - DNA, 14 bp, Homo sapiens
tgtcacagggccaa

SEQ ID NO: 4062721 - DNA, 12 bp, Homo sapiens
tgtcacagttct

SEQ ID NO: 4062722 - DNA, 21 bp, Homo sapiens
tgtcacattgcattctattgc

SEQ ID NO: 4062723 - DNA, 22 bp, Homo sapiens
tgtcacattgcattctattgcc

SEQ ID NO: 4062724 - DNA, 15 bp, Homo sapiens
tgtcaccagctatct

SEQ ID NO: 4062725 - DNA, 18 bp, Homo sapiens
tgtcaccctccacctctt

SEQ ID NO: 4062726 - DNA, 22 bp, Homo sapiens
tgtcaccctccacctcttcacc

SEQ ID NO: 4062727 - DNA, 18 bp, Homo sapiens
tgtcacctctctcagagc

SEQ ID NO: 4062728 - DNA, 18 bp, Homo sapiens
tgtcacctgcttctctgc

SEQ ID NO: 4062729 - DNA, 20 bp, Homo sapiens
tgtcacctgcttctctgccc

SEQ ID NO: 4062730 - DNA, 16 bp, Homo sapiens
tgtcactactcacagt

SEQ ID NO: 4062731 - DNA, 15 bp, Homo sapiens
tgtcactcattgctg

SEQ ID NO: 4062732 - DNA, 14 bp, Homo sapiens
tgtcactggctggc

SEQ ID NO: 4062733 - DNA, 18 bp, Homo sapiens
tgtcactgtttctctgct

SEQ ID NO: 4062734 - DNA, 22 bp, Homo sapiens
tgtcacttcgcgtgccctcgct

SEQ ID NO: 4062735 - DNA, 15 bp, Homo sapiens
tgtcactttgctctg

SEQ ID NO: 4062736 - DNA, 16 bp, Homo sapiens
tgtcactttgctctgg

SEQ ID NO: 4062737 - DNA, 17 bp, Homo sapiens
tgtcactttgctctggg

SEQ ID NO: 4062738 - DNA, 16 bp, Homo sapiens
tgtcactttttatgct

SEQ ID NO: 4062739 - DNA, 21 bp, Homo sapiens
tgtcagaacagagtgcaaccc

SEQ ID NO: 4062740 - DNA, 14 bp, Homo sapiens
tgtcagactttaaa

SEQ ID NO: 4062741 - DNA, 23 bp, Homo sapiens
tgtcagactttaaagaataatat

SEQ ID NO: 4062742 - DNA, 21 bp, Homo sapiens
tgtcagatattttttcagaaa

SEQ ID NO: 4062743 - DNA, 18 bp, Homo sapiens
tgtctttaaatacttcat

SEQ ID NO: 4062744 - DNA, 15 bp, Homo sapiens
tgtctttcagataca

SEQ ID NO: 4062745 - DNA, 20 bp, Homo sapiens
tgtctttcagatacatggtt

SEQ ID NO: 4062746 - DNA, 16 bp, Homo sapiens
tgtcttttatatttgt

SEQ ID NO: 4062747 - DNA, 19 bp, Homo sapiens
tgtcttttatgcagataga

SEQ ID NO: 4062748 - DNA, 22 bp, Homo sapiens
tgtcttttcagaagcaagccag

SEQ ID NO: 4062749 - DNA, 22 bp, Homo sapiens
tgtgaaaaagatgccaattatt

SEQ ID NO: 4062750 - DNA, 13 bp, Homo sapiens
tgtgaaaagtatc

SEQ ID NO: 4062751 - DNA, 16 bp, Homo sapiens
tgtgaaacacagctgt

SEQ ID NO: 4062752 - DNA, 15 bp, Homo sapiens
tgtgaaacatggttg

SEQ ID NO: 4062753 - DNA, 14 bp, Homo sapiens
tgtgaaactttcat

SEQ ID NO: 4062754 - DNA, 22 bp, Homo sapiens
tgtgaaagaaagctgagaagaa

SEQ ID NO: 4062755 - DNA, 17 bp, Homo sapiens
tgtgaaatgctttctgt

SEQ ID NO: 4062756 - DNA, 18 bp, Homo sapiens
tgtgaaccctggggcctg

SEQ ID NO: 4062757 - DNA, 20 bp, Homo sapiens
tgtgaaccctggggcctgac

SEQ ID NO: 4062758 - DNA, 16 bp, Homo sapiens
tgtgaacctacctgcc

SEQ ID NO: 4062759 - DNA, 18 bp, Homo sapiens
tgtgaacctacctgcctt

SEQ ID NO: 4062760 - DNA, 14 bp, Homo sapiens
tgtgaactcaccct

SEQ ID NO: 4062761 - DNA, 17 bp, Homo sapiens
tgtgaactgctttcaag

SEQ ID NO: 4062762 - DNA, 18 bp, Homo sapiens
tgtgaactgctttcaagt

SEQ ID NO: 4062763 - DNA, 14 bp, Homo sapiens
tgtgaagacatttt

SEQ ID NO: 4062764 - DNA, 15 bp, Homo sapiens
tgtgaagacattttt

SEQ ID NO: 4062765 - DNA, 21 bp, Homo sapiens
tgtgaagacattttttgctat

SEQ ID NO: 4062766 - DNA, 13 bp, Homo sapiens
tgtgaagacccag

SEQ ID NO: 4062767 - DNA, 17 bp, Homo sapiens
tgtgaagacccagcagg

SEQ ID NO: 4062768 - DNA, 16 bp, Homo sapiens
tgtgaagaggaacagt

SEQ ID NO: 4062769 - DNA, 22 bp, Homo sapiens
tgtgaagatgatatactatttt

SEQ ID NO: 4062770 - DNA, 13 bp, Homo sapiens
tgtgaagcaccta

SEQ ID NO: 4062771 - DNA, 15 bp, Homo sapiens
tgtgaagcatttaca

SEQ ID NO: 4062772 - DNA, 13 bp, Homo sapiens
tgtgaaggaccct

SEQ ID NO: 4062773 - DNA, 12 bp, Homo sapiens
tgtgaaggccca

SEQ ID NO: 4062774 - DNA, 21 bp, Homo sapiens
tgtgaagttacatgcataaaa

SEQ ID NO: 4062775 - DNA, 12 bp, Homo sapiens
tgtgaataaatt

SEQ ID NO: 4062776 - DNA, 15 bp, Homo sapiens
tgtgaatagcctggc

SEQ ID NO: 4062777 - DNA, 18 bp, Homo sapiens
tgtgaatagcctggccac

SEQ ID NO: 4062778 - DNA, 23 bp, Homo sapiens
tgtgaatatttccatatggattt

SEQ ID NO: 4062779 - DNA, 14 bp, Homo sapiens
tgtgaatttttaag

SEQ ID NO: 4062780 - DNA, 15 bp, Homo sapiens
tgtgaatttttaagc

SEQ ID NO: 4062781 - DNA, 17 bp, Homo sapiens
tgtgaatttttaagctg

SEQ ID NO: 4062782 - DNA, 22 bp, Homo sapiens
tgtgaatttttaagctgcaaat

SEQ ID NO: 4062783 - DNA, 19 bp, Homo sapiens
tgtgacaactgtctaactt

SEQ ID NO: 4062784 - DNA, 19 bp, Homo sapiens
tgtgacaataagtttgaac

SEQ ID NO: 4062785 - DNA, 13 bp, Homo sapiens
tgtgacagggcca

SEQ ID NO: 4062786 - DNA, 17 bp, Homo sapiens
tgtgacatggtgcctga

SEQ ID NO: 4062787 - DNA, 20 bp, Homo sapiens
tgtgacatggtgcctgagag

SEQ ID NO: 4062788 - DNA, 18 bp, Homo sapiens
tgtgacattttacattaa

SEQ ID NO: 4062789 - DNA, 13 bp, Homo sapiens
tgtgaccaagtta

SEQ ID NO: 4062790 - DNA, 13 bp, Homo sapiens
tgtgaccaccacc

SEQ ID NO: 4062791 - DNA, 19 bp, Homo sapiens
tgtgaccaccttctgtccc

SEQ ID NO: 4062792 - DNA, 15 bp, Homo sapiens
tgtgaccaggggtga

SEQ ID NO: 4062793 - DNA, 15 bp, Homo sapiens
tgtgaccccactgcc

SEQ ID NO: 4062794 - DNA, 16 bp, Homo sapiens
tgtgaccccactgcca

SEQ ID NO: 4062795 - DNA, 15 bp, Homo sapiens
tgtgacccccagctc

SEQ ID NO: 4062796 - DNA, 17 bp, Homo sapiens
tgtgacccccagctccg

SEQ ID NO: 4062797 - DNA, 20 bp, Homo sapiens
tgtgacccccagctccggcc

SEQ ID NO: 4062798 - DNA, 14 bp, Homo sapiens
tgtgaccctctgaa

SEQ ID NO: 4062799 - DNA, 16 bp, Homo sapiens
tgtgacgcgcaagtct

SEQ ID NO: 4062800 - DNA, 21 bp, Homo sapiens
tgtgactctaagctcagtgct

SEQ ID NO: 4062801 - DNA, 19 bp, Homo sapiens
tgtgactcttactccttag

SEQ ID NO: 4062802 - DNA, 23 bp, Homo sapiens
tgtgactctttttagggccaggc

SEQ ID NO: 4062803 - DNA, 13 bp, Homo sapiens
tgtgagaagccag

SEQ ID NO: 4062804 - DNA, 13 bp, Homo sapiens
tgtgagagcccat

SEQ ID NO: 4062805 - DNA, 15 bp, Homo sapiens
tgtgagcccagctgg

SEQ ID NO: 4062806 - DNA, 22 bp, Homo sapiens
tgtgagcccctggtcctgaggg

SEQ ID NO: 4062807 - DNA, 12 bp, Homo sapiens
tgtgagctgcac

SEQ ID NO: 4062808 - DNA, 18 bp, Homo sapiens
tgtgaggagctgctggct

SEQ ID NO: 4062809 - DNA, 20 bp, Homo sapiens
tgtgaggagctgctggcttg

SEQ ID NO: 4062810 - DNA, 15 bp, Homo sapiens
tgtgaggaggaaaag

SEQ ID NO: 4062811 - DNA, 17 bp, Homo sapiens
tgtgaggaggaaaagga

SEQ ID NO: 4062812 - DNA, 23 bp, Homo sapiens
tgtgaggcccatggttgagaaat

SEQ ID NO: 4062813 - DNA, 13 bp, Homo sapiens
tgtgaggcccctg

SEQ ID NO: 4062814 - DNA, 14 bp, Homo sapiens
tgtgaggcccctgg

SEQ ID NO: 4062815 - DNA, 22 bp, Homo sapiens
tgtgaggcccctggacaagcag

SEQ ID NO: 4062816 - DNA, 14 bp, Homo sapiens
tgtgagggagggga

SEQ ID NO: 4062817 - DNA, 22 bp, Homo sapiens
tgtgagggaggggaaaagcatt

SEQ ID NO: 4062818 - DNA, 12 bp, Homo sapiens
tgtgagtaaata

SEQ ID NO: 4062819 - DNA, 14 bp, Homo sapiens
tgtgagtaaatatt

SEQ ID NO: 4062820 - DNA, 17 bp, Homo sapiens
tgtgagtgccttttgca

SEQ ID NO: 4062821 - DNA, 19 bp, Homo sapiens
tgtgagtgccttttgcaga

SEQ ID NO: 4062822 - DNA, 21 bp, Homo sapiens
tgtgagtgccttttgcagaag

SEQ ID NO: 4062823 - DNA, 16 bp, Homo sapiens
tgtgagtgtaagtgtg

SEQ ID NO: 4062824 - DNA, 20 bp, Homo sapiens
tgtgagtgtaagtgtgagta

SEQ ID NO: 4062825 - DNA, 11 bp, Homo sapiens
tgtgagtgtga

SEQ ID NO: 4062826 - DNA, 15 bp, Homo sapiens
tgtgagtgtgacagg

SEQ ID NO: 4062827 - DNA, 22 bp, Homo sapiens
tgtgagtgtttttatcttttta

SEQ ID NO: 4062828 - DNA, 16 bp, Homo sapiens
tgtgagtttaaagcaa

SEQ ID NO: 4062829 - DNA, 15 bp, Homo sapiens
tgtgatagcactttc

SEQ ID NO: 4062830 - DNA, 17 bp, Homo sapiens
tgtgatagcactttcta

SEQ ID NO: 4062831 - DNA, 14 bp, Homo sapiens
tgtgatatataagt

SEQ ID NO: 4062832 - DNA, 15 bp, Homo sapiens
tgtgatatataagtg

SEQ ID NO: 4062833 - DNA, 14 bp, Homo sapiens
tgtgatattaacag

SEQ ID NO: 4062834 - DNA, 15 bp, Homo sapiens
tgtgatcagaccata

SEQ ID NO: 4062835 - DNA, 21 bp, Homo sapiens
tgtgatcttaatatatttgaa

SEQ ID NO: 4062836 - DNA, 18 bp, Homo sapiens
tgtgatcttgcattcatt

SEQ ID NO: 4062837 - DNA, 16 bp, Homo sapiens
tgtgatcttttaaagt

SEQ ID NO: 4062838 - DNA, 18 bp, Homo sapiens
tgtgatgacattccctgc

SEQ ID NO: 4062839 - DNA, 15 bp, Homo sapiens
tgtgatgccacacag

SEQ ID NO: 4062840 - DNA, 14 bp, Homo sapiens
tgtgatgtattcta

SEQ ID NO: 4062841 - DNA, 14 bp, Homo sapiens
tgtgattaacttat

SEQ ID NO: 4062842 - DNA, 15 bp, Homo sapiens
tgtgattggcctgta

SEQ ID NO: 4062843 - DNA, 17 bp, Homo sapiens
tgtgattgtggaatgga

SEQ ID NO: 4062844 - DNA, 22 bp, Homo sapiens
tgtgatttctttaaaagaatga

SEQ ID NO: 4062845 - DNA, 23 bp, Homo sapiens
tgtgcaagcgacgacagatgcta

SEQ ID NO: 4062846 - DNA, 21 bp, Homo sapiens
tgtgggggccaaacctgggac

SEQ ID NO: 4062847 - DNA, 15 bp, Homo sapiens
tgtgggtccccactc

SEQ ID NO: 4062848 - DNA, 17 bp, Homo sapiens
tgtgggtggaagggctg

SEQ ID NO: 4062849 - DNA, 14 bp, Homo sapiens
tgtgggttctacag

SEQ ID NO: 4062850 - DNA, 14 bp, Homo sapiens
tgtggtccatgccc

SEQ ID NO: 4062851 - DNA, 17 bp, Homo sapiens
tgtggtgcagtgtgaaa

SEQ ID NO: 4062852 - DNA, 19 bp, Homo sapiens
tgtggtgcctgaggtctgt

SEQ ID NO: 4062853 - DNA, 22 bp, Homo sapiens
tgtggtgggttctttggaagga

SEQ ID NO: 4062854 - DNA, 21 bp, Homo sapiens
tgtggtgtaaagctggccctg

SEQ ID NO: 4062855 - DNA, 16 bp, Homo sapiens
tgtgtaaaaaatggaa

SEQ ID NO: 4062856 - DNA, 23 bp, Homo sapiens
tgtgtaaaaaatggaaaaaaaca

SEQ ID NO: 4062857 - DNA, 19 bp, Homo sapiens
tgtgtaaaggtttcatgtt

SEQ ID NO: 4062858 - DNA, 21 bp, Homo sapiens
tgtgtaaagtgtaaatccttt

SEQ ID NO: 4062859 - DNA, 18 bp, Homo sapiens
tgtgtaaatatgtacatt

SEQ ID NO: 4062860 - DNA, 21 bp, Homo sapiens
tgtgtaaatatgtacatttgt

SEQ ID NO: 4062861 - DNA, 14 bp, Homo sapiens
tgtgtaaatttctc

SEQ ID NO: 4062862 - DNA, 17 bp, Homo sapiens
tgtgtacacctctggat

SEQ ID NO: 4062863 - DNA, 20 bp, Homo sapiens
tgtgtacataactctgtaaa

SEQ ID NO: 4062864 - DNA, 15 bp, Homo sapiens
tgtgtacccaaacgt

SEQ ID NO: 4062865 - DNA, 14 bp, Homo sapiens
tgtgtactctgtcc

SEQ ID NO: 4062866 - DNA, 18 bp, Homo sapiens
tgtgtagagttaagaagc

SEQ ID NO: 4062867 - DNA, 14 bp, Homo sapiens
tgtgtagccttttt

SEQ ID NO: 4062868 - DNA, 21 bp, Homo sapiens
tgtgtatagatgcaagatatt

SEQ ID NO: 4062869 - DNA, 21 bp, Homo sapiens
tgtgtatcgtaaccagccaga

SEQ ID NO: 4062870 - DNA, 16 bp, Homo sapiens
tgtgtatgtacatata

SEQ ID NO: 4062871 - DNA, 17 bp, Homo sapiens
tgtgtcacttgtgcttt

SEQ ID NO: 4062872 - DNA, 21 bp, Homo sapiens
tgtgtcacttgtgctttgctc

SEQ ID NO: 4062873 - DNA, 15 bp, Homo sapiens
tgtgtcagctgaggc

SEQ ID NO: 4062874 - DNA, 17 bp, Homo sapiens
tgtgtcagctgaggctg

SEQ ID NO: 4062875 - DNA, 13 bp, Homo sapiens
tgtgtcatttcaa

SEQ ID NO: 4062876 - DNA, 14 bp, Homo sapiens
tgtgtcatttcaaa

SEQ ID NO: 4062877 - DNA, 16 bp, Homo sapiens
tgtgtccacctgtggg

SEQ ID NO: 4062878 - DNA, 15 bp, Homo sapiens
tgtgtcccccccagg

SEQ ID NO: 4062879 - DNA, 23 bp, Homo sapiens
tgtgtcctgtcctttcttgcaga

SEQ ID NO: 4062880 - DNA, 14 bp, Homo sapiens
tgtgtccttccctg

SEQ ID NO: 4062881 - DNA, 17 bp, Homo sapiens
tgtgtccttccctgcat

SEQ ID NO: 4062882 - DNA, 19 bp, Homo sapiens
tgtgtctaaatttgaatgt

SEQ ID NO: 4062883 - DNA, 22 bp, Homo sapiens
tgtgtctgctttaaagggcctg

SEQ ID NO: 4062884 - DNA, 14 bp, Homo sapiens
tgtgtctggacctc

SEQ ID NO: 4062885 - DNA, 16 bp, Homo sapiens
tgtgtgaatgaacact

SEQ ID NO: 4062886 - DNA, 17 bp, Homo sapiens
tgtgtgaatgaacactc

SEQ ID NO: 4062887 - DNA, 17 bp, Homo sapiens
tgtgtgaggagctgctg

SEQ ID NO: 4062888 - DNA, 18 bp, Homo sapiens
tgtgtgcagagtccattt

SEQ ID NO: 4062889 - DNA, 20 bp, Homo sapiens
tgtgtgccgagcccttgccc

SEQ ID NO: 4062890 - DNA, 19 bp, Homo sapiens
tgtgtggactgtgatgcca

SEQ ID NO: 4062891 - DNA, 19 bp, Homo sapiens
tgtgtggcagggggccccg

SEQ ID NO: 4062892 - DNA, 16 bp, Homo sapiens
tgtgtgtcttaattat

SEQ ID NO: 4062893 - DNA, 20 bp, Homo sapiens
tgtgtgtgaatgaacactct

SEQ ID NO: 4062894 - DNA, 9 bp, Homo sapiens
tgtgtgtgt

SEQ ID NO: 4062895 - DNA, 13 bp, Homo sapiens
tgtgtgtgtatgt

SEQ ID NO: 4062896 - DNA, 14 bp, Homo sapiens
tgtgtgtgtgcatg

SEQ ID NO: 4062897 - DNA, 12 bp, Homo sapiens
tgtgtgtgtgtg

SEQ ID NO: 4062898 - DNA, 14 bp, Homo sapiens
tgtgttcccagagg

SEQ ID NO: 4062899 - DNA, 10 bp, Homo sapiens
tgtgttcctg

SEQ ID NO: 4062900 - DNA, 11 bp, Homo sapiens
tgtgttcctgg

SEQ ID NO: 4062901 - DNA, 13 bp, Homo sapiens
tgtgttgtgaatg

SEQ ID NO: 4062902 - DNA, 17 bp, Homo sapiens
tgtgtttattcatccag

SEQ ID NO: 4062903 - DNA, 16 bp, Homo sapiens
tgtgtttggtttacat

SEQ ID NO: 4062904 - DNA, 17 bp, Homo sapiens
tgtgtttggtttacatt

SEQ ID NO: 4062905 - DNA, 15 bp, Homo sapiens
tgtgtttgtgtattt

SEQ ID NO: 4062906 - DNA, 13 bp, Homo sapiens
tgtgttttctgaa

SEQ ID NO: 4062907 - DNA, 14 bp, Homo sapiens
tgtgtttttattgt

SEQ ID NO: 4062908 - DNA, 16 bp, Homo sapiens
tgtgtttttgggaaga

SEQ ID NO: 4062909 - DNA, 20 bp, Homo sapiens
tgtgtttttgggaagaagaa

SEQ ID NO: 4062910 - DNA, 16 bp, Homo sapiens
tgtgttttttaagata

SEQ ID NO: 4062911 - DNA, 15 bp, Homo sapiens
tgttaaaagattttt

SEQ ID NO: 4062912 - DNA, 14 bp, Homo sapiens
tgttaaaatctatt

SEQ ID NO: 4062913 - DNA, 15 bp, Homo sapiens
tgttaaatactgtgc

SEQ ID NO: 4062914 - DNA, 16 bp, Homo sapiens
tgttaaatactgtgca

SEQ ID NO: 4062915 - DNA, 15 bp, Homo sapiens
tgttaaatttgtaag

SEQ ID NO: 4062916 - DNA, 16 bp, Homo sapiens
tgttaaatttttctga

SEQ ID NO: 4062917 - DNA, 21 bp, Homo sapiens
tgttaacatggacatgatctt

SEQ ID NO: 4062918 - DNA, 20 bp, Homo sapiens
tgttaagcgtgtctgtattt

SEQ ID NO: 4062919 - DNA, 22 bp, Homo sapiens
tgttaaggaaactcttatctca

SEQ ID NO: 4062920 - DNA, 16 bp, Homo sapiens
tgttaaggttgaactt

SEQ ID NO: 4062921 - DNA, 23 bp, Homo sapiens
tgttaaggttgaactttgccaaa

SEQ ID NO: 4062922 - DNA, 16 bp, Homo sapiens
tgttaagtatgtgtaa

SEQ ID NO: 4062923 - DNA, 15 bp, Homo sapiens
tgttaataaaggtct

SEQ ID NO: 4062924 - DNA, 23 bp, Homo sapiens
tgttaatcttaggggagagcttt

SEQ ID NO: 4062925 - DNA, 15 bp, Homo sapiens
tgttaattacaccat

SEQ ID NO: 4062926 - DNA, 15 bp, Homo sapiens
tgttaattcagcact

SEQ ID NO: 4062927 - DNA, 22 bp, Homo sapiens
tgttaattcagcactgatttca

SEQ ID NO: 4062928 - DNA, 23 bp, Homo sapiens
tgttacagccaagtgccaaatgc

SEQ ID NO: 4062929 - DNA, 15 bp, Homo sapiens
tgttacattattatc

SEQ ID NO: 4062930 - DNA, 19 bp, Homo sapiens
tgttaccatgtcactgtgg

SEQ ID NO: 4062931 - DNA, 13 bp, Homo sapiens
tgttacctgtgtg

SEQ ID NO: 4062932 - DNA, 14 bp, Homo sapiens
tgttactattttct

SEQ ID NO: 4062933 - DNA, 14 bp, Homo sapiens
tgttactccacagc

SEQ ID NO: 4062934 - DNA, 23 bp, Homo sapiens
tgttactccacagcggaggagac

SEQ ID NO: 4062935 - DNA, 20 bp, Homo sapiens
tgttactctggttctttgtt

SEQ ID NO: 4062936 - DNA, 14 bp, Homo sapiens
tgttactgatcatg

SEQ ID NO: 4062937 - DNA, 18 bp, Homo sapiens
tgttactgttaaccattt

SEQ ID NO: 4062938 - DNA, 18 bp, Homo sapiens
tgttagaaaatgacttat

SEQ ID NO: 4062939 - DNA, 23 bp, Homo sapiens
tgttagaaaatgacttatttctg

SEQ ID NO: 4062940 - DNA, 19 bp, Homo sapiens
tgttagatagctgcatgtg

SEQ ID NO: 4062941 - DNA, 19 bp, Homo sapiens
tgttagattttgcattttt

SEQ ID NO: 4062942 - DNA, 14 bp, Homo sapiens
tgttagcagacagg

SEQ ID NO: 4062943 - DNA, 15 bp, Homo sapiens
tgttagcccttcaga

SEQ ID NO: 4062944 - DNA, 20 bp, Homo sapiens
tgttagcccttcagattgtt

SEQ ID NO: 4062945 - DNA, 18 bp, Homo sapiens
tgttagtattttaatcct

SEQ ID NO: 4062946 - DNA, 20 bp, Homo sapiens
tgttagtattttaatcctgt

SEQ ID NO: 4062947 - DNA, 14 bp, Homo sapiens
tgttagtttacaat

SEQ ID NO: 4062948 - DNA, 23 bp, Homo sapiens
tgttagtttacaatattatgaaa

SEQ ID NO: 4062949 - DNA, 20 bp, Homo sapiens
tgttgcattattcatttagt

SEQ ID NO: 4062950 - DNA, 17 bp, Homo sapiens
tgttgccaaagctggtc

SEQ ID NO: 4062951 - DNA, 19 bp, Homo sapiens
tgttgccatgtgcaccttg

SEQ ID NO: 4062952 - DNA, 16 bp, Homo sapiens
tgttgcccctttctct

SEQ ID NO: 4062953 - DNA, 17 bp, Homo sapiens
tgttgcccctttctctt

SEQ ID NO: 4062954 - DNA, 13 bp, Homo sapiens
tgttgccctgagt

SEQ ID NO: 4062955 - DNA, 23 bp, Homo sapiens
tgttgctcaaatctattcagaca

SEQ ID NO: 4062956 - DNA, 13 bp, Homo sapiens
tgttgctcagctc

SEQ ID NO: 4062957 - DNA, 15 bp, Homo sapiens
tgttgctcagctcct

SEQ ID NO: 4062958 - DNA, 17 bp, Homo sapiens
tgttgctctaggaagac

SEQ ID NO: 4062959 - DNA, 20 bp, Homo sapiens
tgttgctctaggaagacatt

SEQ ID NO: 4062960 - DNA, 20 bp, Homo sapiens
tgttgcttgtcgctttctca

SEQ ID NO: 4062961 - DNA, 21 bp, Homo sapiens
tgttgcttttgtgaacttttt

SEQ ID NO: 4062962 - DNA, 14 bp, Homo sapiens
tgttggatcttcaa

SEQ ID NO: 4062963 - DNA, 23 bp, Homo sapiens
tgttggatttataaatgctattt

SEQ ID NO: 4062964 - DNA, 23 bp, Homo sapiens
tgttggcagatgcagctcttcct

SEQ ID NO: 4062965 - DNA, 23 bp, Homo sapiens
tgttggcattgatcctagtgtct

SEQ ID NO: 4062966 - DNA, 13 bp, Homo sapiens
tgttggcgctgag

SEQ ID NO: 4062967 - DNA, 15 bp, Homo sapiens
tgttggcgctgaggt

SEQ ID NO: 4062968 - DNA, 14 bp, Homo sapiens
tgttggctatttga

SEQ ID NO: 4062969 - DNA, 15 bp, Homo sapiens
tgttggggcagtggt

SEQ ID NO: 4062970 - DNA, 21 bp, Homo sapiens
tgttgggggggaccctgcctc

SEQ ID NO: 4062971 - DNA, 21 bp, Homo sapiens
tgttggtaattattttggtac

SEQ ID NO: 4062972 - DNA, 16 bp, Homo sapiens
tgttggttgttttttc

SEQ ID NO: 4062973 - DNA, 18 bp, Homo sapiens
tgttgtaattcttcagtt

SEQ ID NO: 4062974 - DNA, 17 bp, Homo sapiens
tgttgtacatttatgat

SEQ ID NO: 4062975 - DNA, 20 bp, Homo sapiens
tgttgtacatttatgattta

SEQ ID NO: 4062976 - DNA, 11 bp, Homo sapiens
tgttgtcattg

SEQ ID NO: 4062977 - DNA, 18 bp, Homo sapiens
tgttgtcgtaaagatttg

SEQ ID NO: 4062978 - DNA, 16 bp, Homo sapiens
tgttgtggaagcatgt

SEQ ID NO: 4062979 - DNA, 15 bp, Homo sapiens
tgttgtgtgtgcagg

SEQ ID NO: 4062980 - DNA, 15 bp, Homo sapiens
tgttgtgttcctggc

SEQ ID NO: 4062981 - DNA, 21 bp, Homo sapiens
tgttgtgttcctggctgatga

SEQ ID NO: 4062982 - DNA, 18 bp, Homo sapiens
tgttgttaatgaaaatgt

SEQ ID NO: 4062983 - DNA, 19 bp, Homo sapiens
tgttgttgaaaggtttttt

SEQ ID NO: 4062984 - DNA, 14 bp, Homo sapiens
tgttgttgccaaag

SEQ ID NO: 4062985 - DNA, 12 bp, Homo sapiens
tgttgtttcttt

SEQ ID NO: 4062986 - DNA, 14 bp, Homo sapiens
tgttgtttctttct

SEQ ID NO: 4062987 - DNA, 15 bp, Homo sapiens
tgttgtttctttcta

SEQ ID NO: 4062988 - DNA, 14 bp, Homo sapiens
tgttgtttgtaaat

SEQ ID NO: 4062989 - DNA, 15 bp, Homo sapiens
tgttgttttctgggg

SEQ ID NO: 4062990 - DNA, 12 bp, Homo sapiens
tgtttaaaataa

SEQ ID NO: 4062991 - DNA, 18 bp, Homo sapiens
tgtttaaaataaaatgaa

SEQ ID NO: 4062992 - DNA, 21 bp, Homo sapiens
tgtttaaaataaaatgaaaat

SEQ ID NO: 4062993 - DNA, 17 bp, Homo sapiens
tgtttaaaattcagttt

SEQ ID NO: 4062994 - DNA, 16 bp, Homo sapiens
tgtttaaagaataaag

SEQ ID NO: 4062995 - DNA, 17 bp, Homo sapiens
tgtttaaagagaggtta

SEQ ID NO: 4062996 - DNA, 13 bp, Homo sapiens
tgtttaaagtggc

SEQ ID NO: 4062997 - DNA, 18 bp, Homo sapiens
tgtttaacaacatggctt

SEQ ID NO: 4062998 - DNA, 18 bp, Homo sapiens
tgtttaagaaaagtattt

SEQ ID NO: 4062999 - DNA, 17 bp, Homo sapiens
tgtttaagacacttccg

SEQ ID NO: 4063000 - DNA, 21 bp, Homo sapiens
tgtttaagtgttgtaaatatt

SEQ ID NO: 4063001 - DNA, 17 bp, Homo sapiens
tgtttaatatttaaaca

SEQ ID NO: 4063002 - DNA, 17 bp, Homo sapiens
tgtttaatgggtatgct

SEQ ID NO: 4063003 - DNA, 20 bp, Homo sapiens
tgtttaatgggtatgctcag

SEQ ID NO: 4063004 - DNA, 16 bp, Homo sapiens
tgtttacactctttgt

SEQ ID NO: 4063005 - DNA, 18 bp, Homo sapiens
tgtttacactctttgtaa

SEQ ID NO: 4063006 - DNA, 17 bp, Homo sapiens
tgtttactttaaacttg

SEQ ID NO: 4063007 - DNA, 17 bp, Homo sapiens
tgtttataatctgaaga

SEQ ID NO: 4063008 - DNA, 21 bp, Homo sapiens
tgtttatagcaaacttggaat

SEQ ID NO: 4063009 - DNA, 18 bp, Homo sapiens
tgtttatatactgggttc

SEQ ID NO: 4063010 - DNA, 19 bp, Homo sapiens
tgtttatgatatttcttgc

SEQ ID NO: 4063011 - DNA, 17 bp, Homo sapiens
tgtttatggccacattt

SEQ ID NO: 4063012 - DNA, 14 bp, Homo sapiens
tgtttatggcctca

SEQ ID NO: 4063013 - DNA, 23 bp, Homo sapiens
tgtttatggcctcagctgcctca

SEQ ID NO: 4063014 - DNA, 13 bp, Homo sapiens
tgtttatgttctt

SEQ ID NO: 4063015 - DNA, 18 bp, Homo sapiens
tgtttatgttcttataga

SEQ ID NO: 4063016 - DNA, 14 bp, Homo sapiens
tgtttattaacaaa

SEQ ID NO: 4063017 - DNA, 20 bp, Homo sapiens
tgtttattcatccagcagtg

SEQ ID NO: 4063018 - DNA, 21 bp, Homo sapiens
tgtttattcatccagcagtgt

SEQ ID NO: 4063019 - DNA, 18 bp, Homo sapiens
tgtttattcctgataata

SEQ ID NO: 4063020 - DNA, 16 bp, Homo sapiens
tgtttattcttccaga

SEQ ID NO: 4063021 - DNA, 22 bp, Homo sapiens
tgtttatttataagcagattta

SEQ ID NO: 4063022 - DNA, 14 bp, Homo sapiens
tgtttatttataga

SEQ ID NO: 4063023 - DNA, 17 bp, Homo sapiens
tgtttatttctgtttct

SEQ ID NO: 4063024 - DNA, 12 bp, Homo sapiens
tgtttatttttc

SEQ ID NO: 4063025 - DNA, 19 bp, Homo sapiens
tgtttatttttcttgtctt

SEQ ID NO: 4063026 - DNA, 22 bp, Homo sapiens
tgtttcactgaaatgtttggat

SEQ ID NO: 4063027 - DNA, 15 bp, Homo sapiens
tgtttcagacccccc

SEQ ID NO: 4063028 - DNA, 24 bp, Homo sapiens
tgtttcagctaagggaagacattt

SEQ ID NO: 4063029 - DNA, 14 bp, Homo sapiens
tgtttcatatctgg

SEQ ID NO: 4063030 - DNA, 12 bp, Homo sapiens
tgtttcatcctt

SEQ ID NO: 4063031 - DNA, 18 bp, Homo sapiens
tgtttcatccttcccact

SEQ ID NO: 4063032 - DNA, 14 bp, Homo sapiens
tgtttcatctggtt

SEQ ID NO: 4063033 - DNA, 21 bp, Homo sapiens
tgtttccagcagaagacaaaa

SEQ ID NO: 4063034 - DNA, 14 bp, Homo sapiens
tgtttcccataatt

SEQ ID NO: 4063035 - DNA, 21 bp, Homo sapiens
tgtttccttgttggtcagagg

SEQ ID NO: 4063036 - DNA, 13 bp, Homo sapiens
tgtttctgttcca

SEQ ID NO: 4063037 - DNA, 19 bp, Homo sapiens
tgtttcttccaaagcacat

SEQ ID NO: 4063038 - DNA, 18 bp, Homo sapiens
tgtttctttgtgtttgct

SEQ ID NO: 4063039 - DNA, 23 bp, Homo sapiens
tgtttcttttttttttttttaca

SEQ ID NO: 4063040 - DNA, 21 bp, Homo sapiens
tgtttgaaatgaggtctgttt

SEQ ID NO: 4063041 - DNA, 15 bp, Homo sapiens
tgtttgaatatggac

SEQ ID NO: 4063042 - DNA, 19 bp, Homo sapiens
tgtttgagtttttcctccc

SEQ ID NO: 4063043 - DNA, 21 bp, Homo sapiens
tgtttgatgctatttatgcaa

SEQ ID NO: 4063044 - DNA, 12 bp, Homo sapiens
tgtttgcaatgc

SEQ ID NO: 4063045 - DNA, 12 bp, Homo sapiens
tgtttgcttaaa

SEQ ID NO: 4063046 - DNA, 21 bp, Homo sapiens
tgtttgcttattgttccaaga

SEQ ID NO: 4063047 - DNA, 13 bp, Homo sapiens
tgtttgcttggtg

SEQ ID NO: 4063048 - DNA, 21 bp, Homo sapiens
tgtttggatgtaatttagggt

SEQ ID NO: 4063049 - DNA, 21 bp, Homo sapiens
tgtttggatttcctttatact

SEQ ID NO: 4063050 - DNA, 22 bp, Homo sapiens
tgtttggatttcctttatactg

SEQ ID NO: 4063051 - DNA, 11 bp, Homo sapiens
tgtttggcacc

SEQ ID NO: 4063052 - DNA, 14 bp, Homo sapiens
tgtttggtttacat

SEQ ID NO: 4063053 - DNA, 13 bp, Homo sapiens
tgtttgtaaataa

SEQ ID NO: 4063054 - DNA, 16 bp, Homo sapiens
tgtttgtagtgaaata

SEQ ID NO: 4063055 - DNA, 15 bp, Homo sapiens
tgtttgtcccttcta

SEQ ID NO: 4063056 - DNA, 19 bp, Homo sapiens
tgtttgtctgtttgtttca

SEQ ID NO: 4063057 - DNA, 20 bp, Homo sapiens
tgtttgtctgtttgtttcaa

SEQ ID NO: 4063058 - DNA, 15 bp, Homo sapiens
tgtttgtggcctcag

SEQ ID NO: 4063059 - DNA, 12 bp, Homo sapiens
tgtttgtgtatt

SEQ ID NO: 4063060 - DNA, 16 bp, Homo sapiens
tgtttgtgtgtcaagt

SEQ ID NO: 4063061 - DNA, 16 bp, Homo sapiens
tgtttgtttgtctgtt

SEQ ID NO: 4063062 - DNA, 23 bp, Homo sapiens
tgttttaaaataaaaattctgaa

SEQ ID NO: 4063063 - DNA, 20 bp, Homo sapiens
tgttttaaacatagaaagtt

SEQ ID NO: 4063064 - DNA, 22 bp, Homo sapiens
tgttttaaacattaatagcagc

SEQ ID NO: 4063065 - DNA, 21 bp, Homo sapiens
tgttttaaactctcctagtca

SEQ ID NO: 4063066 - DNA, 15 bp, Homo sapiens
tgttttaaattctga

SEQ ID NO: 4063067 - DNA, 17 bp, Homo sapiens
tgttttaaattctgaga

SEQ ID NO: 4063068 - DNA, 16 bp, Homo sapiens
tgttttaagactgaat

SEQ ID NO: 4063069 - DNA, 13 bp, Homo sapiens
tgttttaagcaaa

SEQ ID NO: 4063070 - DNA, 18 bp, Homo sapiens
tgttttaagtactacaca

SEQ ID NO: 4063071 - DNA, 15 bp, Homo sapiens
tgttttaatctgaaa

SEQ ID NO: 4063072 - DNA, 22 bp, Homo sapiens
tgttttaatttaaacacctcct

SEQ ID NO: 4063073 - DNA, 15 bp, Homo sapiens
tgttttatttatcaa

SEQ ID NO: 4063074 - DNA, 17 bp, Homo sapiens
tgttttatttatcaaaa

SEQ ID NO: 4063075 - DNA, 15 bp, Homo sapiens
tgttttcagtgtaca

SEQ ID NO: 4063076 - DNA, 17 bp, Homo sapiens
tgttttcagtgtacatg

SEQ ID NO: 4063077 - DNA, 15 bp, Homo sapiens
tgttttcataataaa

SEQ ID NO: 4063078 - DNA, 15 bp, Homo sapiens
tgttttcccccagca

SEQ ID NO: 4063079 - DNA, 16 bp, Homo sapiens
tgttttccctgacctc

SEQ ID NO: 4063080 - DNA, 19 bp, Homo sapiens
tgttttccgtgaaaacgga

SEQ ID NO: 4063081 - DNA, 17 bp, Homo sapiens
tgttttctgactaatta

SEQ ID NO: 4063082 - DNA, 14 bp, Homo sapiens
tgttttctgtaaat

SEQ ID NO: 4063083 - DNA, 16 bp, Homo sapiens
tgttttctgtaaataa

SEQ ID NO: 4063084 - DNA, 17 bp, Homo sapiens
tgttttctgtaaataac

SEQ ID NO: 4063085 - DNA, 21 bp, Homo sapiens
tgttttctttctttaaatgtt

SEQ ID NO: 4063086 - DNA, 22 bp, Homo sapiens
tgttttctttctttaaatgttt

SEQ ID NO: 4063087 - DNA, 22 bp, Homo sapiens
tgttttgaaatcaatgcaagag

SEQ ID NO: 4063088 - DNA, 17 bp, Homo sapiens
tgttttgaaggcaaaat

SEQ ID NO: 4063089 - DNA, 20 bp, Homo sapiens
tgttttgatgtttgtggcct

SEQ ID NO: 4063090 - DNA, 20 bp, Homo sapiens
tgttttgccaaagactgtaa

SEQ ID NO: 4063091 - DNA, 19 bp, Homo sapiens
tgttttggactccatctct

SEQ ID NO: 4063092 - DNA, 15 bp, Homo sapiens
tgttttgtatataca

SEQ ID NO: 4063093 - DNA, 15 bp, Homo sapiens
tgttttgtgcatttg

SEQ ID NO: 4063094 - DNA, 13 bp, Homo sapiens
tgttttgtttctg

SEQ ID NO: 4063095 - DNA, 14 bp, Homo sapiens
tgtttttaagctgt

SEQ ID NO: 4063096 - DNA, 22 bp, Homo sapiens
tgtttttaagctgtttccatag

SEQ ID NO: 4063097 - DNA, 18 bp, Homo sapiens
tgtttttattaatttata

SEQ ID NO: 4063098 - DNA, 17 bp, Homo sapiens
tgtttttattgttttct

SEQ ID NO: 4063099 - DNA, 14 bp, Homo sapiens
tgtttttcattcat

SEQ ID NO: 4063100 - DNA, 19 bp, Homo sapiens
tgtttttctttttccacaa

SEQ ID NO: 4063101 - DNA, 13 bp, Homo sapiens
tgtttttgaattt

SEQ ID NO: 4063102 - DNA, 23 bp, Homo sapiens
tgtttttgggaagaagaagacct

SEQ ID NO: 4063103 - DNA, 14 bp, Homo sapiens
tgttttttaagata

SEQ ID NO: 4063104 - DNA, 16 bp, Homo sapiens
tgttttttaagatagt

SEQ ID NO: 4063105 - DNA, 21 bp, Homo sapiens
tgttttttttgactaaagcta

SEQ ID NO: 4063106 - DNA, 18 bp, Homo sapiens
tgttttttttttccactt

SEQ ID NO: 4063107 - DNA, 13 bp, Homo sapiens
ttaaaaaaaaaga

SEQ ID NO: 4063108 - DNA, 11 bp, Homo sapiens
ttaaaaaacaa

SEQ ID NO: 4063109 - DNA, 21 bp, Homo sapiens
ttaaaaaagcctggtttttct

SEQ ID NO: 4063110 - DNA, 18 bp, Homo sapiens
ttaaaaacaaatgagttt

SEQ ID NO: 4063111 - DNA, 13 bp, Homo sapiens
ttaaaaagccagt

SEQ ID NO: 4063112 - DNA, 18 bp, Homo sapiens
ttaaaaagggaagaaact

SEQ ID NO: 4063113 - DNA, 14 bp, Homo sapiens
ttaaaaagtcttca

SEQ ID NO: 4063114 - DNA, 11 bp, Homo sapiens
ttaaaaagttt

SEQ ID NO: 4063115 - DNA, 12 bp, Homo sapiens
ttaaaaatacat

SEQ ID NO: 4063116 - DNA, 13 bp, Homo sapiens
ttaaaaatatttc

SEQ ID NO: 4063117 - DNA, 14 bp, Homo sapiens
ttaaaaatatttca

SEQ ID NO: 4063118 - DNA, 13 bp, Homo sapiens
ttaaaaatgtaaa

SEQ ID NO: 4063119 - DNA, 16 bp, Homo sapiens
ttaaaaatgtaaatat

SEQ ID NO: 4063120 - DNA, 19 bp, Homo sapiens
ttaaaaatgtaaatattct

SEQ ID NO: 4063121 - DNA, 15 bp, Homo sapiens
ttaaaacactaaaag

SEQ ID NO: 4063122 - DNA, 12 bp, Homo sapiens
ttaaaacacttt

SEQ ID NO: 4063123 - DNA, 21 bp, Homo sapiens
ttaaaacagctgcattagaaa

SEQ ID NO: 4063124 - DNA, 20 bp, Homo sapiens
ttaaaacagtatttattttg

SEQ ID NO: 4063125 - DNA, 19 bp, Homo sapiens
ttaaaactaggtaatgttt

SEQ ID NO: 4063126 - DNA, 15 bp, Homo sapiens
ttaaaactatttagt

SEQ ID NO: 4063127 - DNA, 14 bp, Homo sapiens
ttaaaacttcttaa

SEQ ID NO: 4063128 - DNA, 14 bp, Homo sapiens
ttaaaagaatgact

SEQ ID NO: 4063129 - DNA, 21 bp, Homo sapiens
ttaaaagaggagaaaatttat

SEQ ID NO: 4063130 - DNA, 20 bp, Homo sapiens
ttaaaataaaaattctgaat

SEQ ID NO: 4063131 - DNA, 12 bp, Homo sapiens
ttaaaatagaaa

SEQ ID NO: 4063132 - DNA, 17 bp, Homo sapiens
ttaaaatagaaattttg

SEQ ID NO: 4063133 - DNA, 19 bp, Homo sapiens
ttaaaatctattctgtgtt

SEQ ID NO: 4063134 - DNA, 24 bp, Homo sapiens
ttaaaatctattctgtgttgcatt

SEQ ID NO: 4063135 - DNA, 11 bp, Homo sapiens
ttaaaatggaa

SEQ ID NO: 4063136 - DNA, 20 bp, Homo sapiens
ttaaaattcaagaaaataaa

SEQ ID NO: 4063137 - DNA, 14 bp, Homo sapiens
ttaaaattcagttt

SEQ ID NO: 4063138 - DNA, 15 bp, Homo sapiens
ttaaaattcagtttt

SEQ ID NO: 4063139 - DNA, 15 bp, Homo sapiens
ttaaaattgctatgt

SEQ ID NO: 4063140 - DNA, 13 bp, Homo sapiens
ttaaaattgtcac

SEQ ID NO: 4063141 - DNA, 14 bp, Homo sapiens
ttaaacaaagtgac

SEQ ID NO: 4063142 - DNA, 22 bp, Homo sapiens
ttaaacacacagatacacacac

SEQ ID NO: 4063143 - DNA, 23 bp, Homo sapiens
ttaaacacacagatacacacaca

SEQ ID NO: 4063144 - DNA, 11 bp, Homo sapiens
ttaaacacctg

SEQ ID NO: 4063145 - DNA, 18 bp, Homo sapiens
ttaaacacctgacacatc

SEQ ID NO: 4063146 - DNA, 23 bp, Homo sapiens
ttaaacattaatagcagcctttc

SEQ ID NO: 4063147 - DNA, 15 bp, Homo sapiens
ttaaacattgaagta

SEQ ID NO: 4063148 - DNA, 21 bp, Homo sapiens
ttaaaccaacctttaaaattg

SEQ ID NO: 4063149 - DNA, 22 bp, Homo sapiens
ttaaacctgtttttttttcatt

SEQ ID NO: 4063150 - DNA, 17 bp, Homo sapiens
ttaaacctttttcttga

SEQ ID NO: 4063151 - DNA, 20 bp, Homo sapiens
ttaaactaaataatgaataa

SEQ ID NO: 4063152 - DNA, 22 bp, Homo sapiens
ttaaactctgttgcaagtgcaa

SEQ ID NO: 4063153 - DNA, 15 bp, Homo sapiens
ttaaactgtacagaa

SEQ ID NO: 4063154 - DNA, 16 bp, Homo sapiens
ttaaactgtacagaat

SEQ ID NO: 4063155 - DNA, 15 bp, Homo sapiens
ttaatttaacaaact

SEQ ID NO: 4063156 - DNA, 14 bp, Homo sapiens
ttaatttacaaaaa

SEQ ID NO: 4063157 - DNA, 23 bp, Homo sapiens
ttaatttacaaaaatataaaata

SEQ ID NO: 4063158 - DNA, 13 bp, Homo sapiens
ttaatttatttca

SEQ ID NO: 4063159 - DNA, 14 bp, Homo sapiens
ttaatttatttcat

SEQ ID NO: 4063160 - DNA, 15 bp, Homo sapiens
ttaatttcctttttg

SEQ ID NO: 4063161 - DNA, 16 bp, Homo sapiens
ttaatttcctttttga

SEQ ID NO: 4063162 - DNA, 21 bp, Homo sapiens
ttaatttcctttttgacactg

SEQ ID NO: 4063163 - DNA, 23 bp, Homo sapiens
ttaatttcctttttgacactgaa

SEQ ID NO: 4063164 - DNA, 18 bp, Homo sapiens
ttaatttgatgaaagctg

SEQ ID NO: 4063165 - DNA, 23 bp, Homo sapiens
ttaatttggcttttcttatttaa

SEQ ID NO: 4063166 - DNA, 20 bp, Homo sapiens
ttaattttaccaagagtaac

SEQ ID NO: 4063167 - DNA, 22 bp, Homo sapiens
ttaattttaccaagagtaactt

SEQ ID NO: 4063168 - DNA, 18 bp, Homo sapiens
ttaatttttatttcttcc

SEQ ID NO: 4063169 - DNA, 18 bp, Homo sapiens
ttacaaaaatataaaata

SEQ ID NO: 4063170 - DNA, 20 bp, Homo sapiens
ttacaaaactacatgagaac

SEQ ID NO: 4063171 - DNA, 12 bp, Homo sapiens
ttacaaactgca

SEQ ID NO: 4063172 - DNA, 23 bp, Homo sapiens
ttacaaactgcaatagagactgt

SEQ ID NO: 4063173 - DNA, 14 bp, Homo sapiens
ttacaaagcagtta

SEQ ID NO: 4063174 - DNA, 16 bp, Homo sapiens
ttacaaagcagttact

SEQ ID NO: 4063175 - DNA, 15 bp, Homo sapiens
ttacaacattcaact

SEQ ID NO: 4063176 - DNA, 22 bp, Homo sapiens
ttacaactgcctcgaaacacag

SEQ ID NO: 4063177 - DNA, 13 bp, Homo sapiens
ttacaagaagttt

SEQ ID NO: 4063178 - DNA, 21 bp, Homo sapiens
ttacaataaaactttgctgcc

SEQ ID NO: 4063179 - DNA, 15 bp, Homo sapiens
ttacaatattatgaa

SEQ ID NO: 4063180 - DNA, 16 bp, Homo sapiens
ttacaatattatgaaa

SEQ ID NO: 4063181 - DNA, 23 bp, Homo sapiens
ttacaatattatgaaatttcact

SEQ ID NO: 4063182 - DNA, 17 bp, Homo sapiens
ttacaccaactcctaat

SEQ ID NO: 4063183 - DNA, 18 bp, Homo sapiens
ttacaccgactagccagg

SEQ ID NO: 4063184 - DNA, 13 bp, Homo sapiens
ttacactttatgc

SEQ ID NO: 4063185 - DNA, 17 bp, Homo sapiens
ttacagaaatactataa

SEQ ID NO: 4063186 - DNA, 19 bp, Homo sapiens
ttacagaaatggactggag

SEQ ID NO: 4063187 - DNA, 20 bp, Homo sapiens
ttacagacctcagttttatg

SEQ ID NO: 4063188 - DNA, 18 bp, Homo sapiens
ttacagagaggagaaaca

SEQ ID NO: 4063189 - DNA, 22 bp, Homo sapiens
ttacagagaggagaaacacatc

SEQ ID NO: 4063190 - DNA, 23 bp, Homo sapiens
ttacagatagtatctagcaatca

SEQ ID NO: 4063191 - DNA, 22 bp, Homo sapiens
ttacagccaagtgccaaatgct

SEQ ID NO: 4063192 - DNA, 19 bp, Homo sapiens
ttacagctcattaaacttt

SEQ ID NO: 4063193 - DNA, 18 bp, Homo sapiens
ttacaggcaccgagaatg

SEQ ID NO: 4063194 - DNA, 20 bp, Homo sapiens
ttacaggcatggacatgcag

SEQ ID NO: 4063195 - DNA, 11 bp, Homo sapiens
ttacaggccct

SEQ ID NO: 4063196 - DNA, 22 bp, Homo sapiens
ttacaggccctgctcctgcagc

SEQ ID NO: 4063197 - DNA, 18 bp, Homo sapiens
ttacaggtggacacacaa

SEQ ID NO: 4063198 - DNA, 16 bp, Homo sapiens
ttacagtccttcaaaa

SEQ ID NO: 4063199 - DNA, 17 bp, Homo sapiens
ttacataacggaaagtt

SEQ ID NO: 4063200 - DNA, 13 bp, Homo sapiens
ttacataactgcc

SEQ ID NO: 4063201 - DNA, 17 bp, Homo sapiens
ttacataactgccttga

SEQ ID NO: 4063202 - DNA, 20 bp, Homo sapiens
ttacataagataaatgtgct

SEQ ID NO: 4063203 - DNA, 12 bp, Homo sapiens
ttacatctgtgc

SEQ ID NO: 4063204 - DNA, 21 bp, Homo sapiens
ttacatctgttttaaatttat

SEQ ID NO: 4063205 - DNA, 18 bp, Homo sapiens
ttacatcttctgtgaaat

SEQ ID NO: 4063206 - DNA, 21 bp, Homo sapiens
ttacatcttctgtgaaatata

SEQ ID NO: 4063207 - DNA, 13 bp, Homo sapiens
ttacatgcataaa

SEQ ID NO: 4063208 - DNA, 22 bp, Homo sapiens
ttacatggttaaggtaaagtaa

SEQ ID NO: 4063209 - DNA, 18 bp, Homo sapiens
ttacatgtgtagcctatg

SEQ ID NO: 4063210 - DNA, 14 bp, Homo sapiens
ttacattaatgtta

SEQ ID NO: 4063211 - DNA, 12 bp, Homo sapiens
ttacattgtaaa

SEQ ID NO: 4063212 - DNA, 16 bp, Homo sapiens
ttacattgttcaatta

SEQ ID NO: 4063213 - DNA, 16 bp, Homo sapiens
ttacatttaaagcatt

SEQ ID NO: 4063214 - DNA, 21 bp, Homo sapiens
ttacatttaaagcattgctgt

SEQ ID NO: 4063215 - DNA, 13 bp, Homo sapiens
ttacatttttaca

SEQ ID NO: 4063216 - DNA, 14 bp, Homo sapiens
ttacatttttacaa

SEQ ID NO: 4063217 - DNA, 18 bp, Homo sapiens
ttacatttttacaataaa

SEQ ID NO: 4063218 - DNA, 21 bp, Homo sapiens
ttacatttttacaataaataa

SEQ ID NO: 4063219 - DNA, 19 bp, Homo sapiens
ttacatttttatttatgaa

SEQ ID NO: 4063220 - DNA, 14 bp, Homo sapiens
ttaccaagagaagg

SEQ ID NO: 4063221 - DNA, 14 bp, Homo sapiens
ttaccaagagtaac

SEQ ID NO: 4063222 - DNA, 15 bp, Homo sapiens
ttaccacacatctat

SEQ ID NO: 4063223 - DNA, 14 bp, Homo sapiens
ttaccactcaggca

SEQ ID NO: 4063224 - DNA, 17 bp, Homo sapiens
ttaccagacaaaaaaat

SEQ ID NO: 4063225 - DNA, 20 bp, Homo sapiens
ttaccagagacgcccagccc

SEQ ID NO: 4063226 - DNA, 21 bp, Homo sapiens
ttaccagagacgcccagcccc

SEQ ID NO: 4063227 - DNA, 19 bp, Homo sapiens
ttaccagatgctgactggc

SEQ ID NO: 4063228 - DNA, 23 bp, Homo sapiens
ttaccagtggcgttgttgcatgt

SEQ ID NO: 4063229 - DNA, 16 bp, Homo sapiens
ttaccagttaattact

SEQ ID NO: 4063230 - DNA, 14 bp, Homo sapiens
ttaccatcatctct

SEQ ID NO: 4063231 - DNA, 14 bp, Homo sapiens
ttaccatttgtaat

SEQ ID NO: 4063232 - DNA, 15 bp, Homo sapiens
ttaccatttgtaata

SEQ ID NO: 4063233 - DNA, 14 bp, Homo sapiens
ttacccaatttccc

SEQ ID NO: 4063234 - DNA, 21 bp, Homo sapiens
ttacccagagaatatatacat

SEQ ID NO: 4063235 - DNA, 22 bp, Homo sapiens
ttacccagagaatatatacatt

SEQ ID NO: 4063236 - DNA, 16 bp, Homo sapiens
ttaccccttagcctcc

SEQ ID NO: 4063237 - DNA, 13 bp, Homo sapiens
ttaccctctttgc

SEQ ID NO: 4063238 - DNA, 20 bp, Homo sapiens
ttaccgacaagcacagtcag

SEQ ID NO: 4063239 - DNA, 17 bp, Homo sapiens
ttaccgttgcttgaaat

SEQ ID NO: 4063240 - DNA, 18 bp, Homo sapiens
ttacctaaacagatataa

SEQ ID NO: 4063241 - DNA, 20 bp, Homo sapiens
ttacctaaacagatataaat

SEQ ID NO: 4063242 - DNA, 20 bp, Homo sapiens
ttacctaagtgacatttgta

SEQ ID NO: 4063243 - DNA, 21 bp, Homo sapiens
ttacctaagtgacatttgtag

SEQ ID NO: 4063244 - DNA, 17 bp, Homo sapiens
ttacctactattggccc

SEQ ID NO: 4063245 - DNA, 21 bp, Homo sapiens
ttacctccatccatccttcca

SEQ ID NO: 4063246 - DNA, 17 bp, Homo sapiens
ttacctgacctcttgct

SEQ ID NO: 4063247 - DNA, 18 bp, Homo sapiens
ttacctgacctcttgctg

SEQ ID NO: 4063248 - DNA, 19 bp, Homo sapiens
ttacctgacctcttgctgt

SEQ ID NO: 4063249 - DNA, 12 bp, Homo sapiens
ttacctggatta

SEQ ID NO: 4063250 - DNA, 19 bp, Homo sapiens
ttacctgtatacagtgcag

SEQ ID NO: 4063251 - DNA, 17 bp, Homo sapiens
ttacctgtcacattgca

SEQ ID NO: 4063252 - DNA, 22 bp, Homo sapiens
ttacctgttttcgcacctacca

SEQ ID NO: 4063253 - DNA, 15 bp, Homo sapiens
ttacgctttgattca

SEQ ID NO: 4063254 - DNA, 14 bp, Homo sapiens
ttactaagctttgc

SEQ ID NO: 4063255 - DNA, 22 bp, Homo sapiens
ttactaagctttgccagctgct

SEQ ID NO: 4063256 - DNA, 16 bp, Homo sapiens
ttactatgcacaattt

SEQ ID NO: 4063257 - DNA, 22 bp, Homo sapiens
ttattgttccaagacattgtca

SEQ ID NO: 4063258 - DNA, 14 bp, Homo sapiens
ttattgttgaacat

SEQ ID NO: 4063259 - DNA, 13 bp, Homo sapiens
ttatttaacagct

SEQ ID NO: 4063260 - DNA, 12 bp, Homo sapiens
ttatttaataac

SEQ ID NO: 4063261 - DNA, 15 bp, Homo sapiens
ttatttaataacatt

SEQ ID NO: 4063262 - DNA, 19 bp, Homo sapiens
ttatttaataacattacct

SEQ ID NO: 4063263 - DNA, 18 bp, Homo sapiens
ttatttaatgaaagactg

SEQ ID NO: 4063264 - DNA, 22 bp, Homo sapiens
ttatttaatgaaagactgtaca

SEQ ID NO: 4063265 - DNA, 17 bp, Homo sapiens
ttatttaattaaatgta

SEQ ID NO: 4063266 - DNA, 22 bp, Homo sapiens
ttatttaccgttgcttgaaatt

SEQ ID NO: 4063267 - DNA, 17 bp, Homo sapiens
ttatttactgagcttct

SEQ ID NO: 4063268 - DNA, 22 bp, Homo sapiens
ttatttactgagcttctctgtg

SEQ ID NO: 4063269 - DNA, 14 bp, Homo sapiens
ttatttagacaaga

SEQ ID NO: 4063270 - DNA, 16 bp, Homo sapiens
ttatttagacaagaga

SEQ ID NO: 4063271 - DNA, 20 bp, Homo sapiens
ttatttatcaaaatgtagct

SEQ ID NO: 4063272 - DNA, 18 bp, Homo sapiens
ttatttatcagtgacaga

SEQ ID NO: 4063273 - DNA, 20 bp, Homo sapiens
ttatttatgcctctgtattt

SEQ ID NO: 4063274 - DNA, 14 bp, Homo sapiens
ttatttattaagat

SEQ ID NO: 4063275 - DNA, 15 bp, Homo sapiens
ttatttattactgtc

SEQ ID NO: 4063276 - DNA, 14 bp, Homo sapiens
ttatttcaataaat

SEQ ID NO: 4063277 - DNA, 18 bp, Homo sapiens
ttatttcaataaatcttt

SEQ ID NO: 4063278 - DNA, 19 bp, Homo sapiens
ttatttccactaaaaatat

SEQ ID NO: 4063279 - DNA, 12 bp, Homo sapiens
ttatttctgcat

SEQ ID NO: 4063280 - DNA, 13 bp, Homo sapiens
ttatttctgcata

SEQ ID NO: 4063281 - DNA, 15 bp, Homo sapiens
ttatttctgcatatg

SEQ ID NO: 4063282 - DNA, 22 bp, Homo sapiens
ttatttctgcatatgttgaata

SEQ ID NO: 4063283 - DNA, 12 bp, Homo sapiens
ttatttcttcaa

SEQ ID NO: 4063284 - DNA, 14 bp, Homo sapiens
ttatttcttccctg

SEQ ID NO: 4063285 - DNA, 21 bp, Homo sapiens
ttatttcttccctgctttgca

SEQ ID NO: 4063286 - DNA, 14 bp, Homo sapiens
ttatttgacaaaat

SEQ ID NO: 4063287 - DNA, 13 bp, Homo sapiens
ttattttaatgta

SEQ ID NO: 4063288 - DNA, 14 bp, Homo sapiens
ttattttaatgtaa

SEQ ID NO: 4063289 - DNA, 13 bp, Homo sapiens
ttattttcaagag

SEQ ID NO: 4063290 - DNA, 19 bp, Homo sapiens
ttattttggaaagaagaaa

SEQ ID NO: 4063291 - DNA, 16 bp, Homo sapiens
ttattttggatatatt

SEQ ID NO: 4063292 - DNA, 13 bp, Homo sapiens
ttattttgtaatt

SEQ ID NO: 4063293 - DNA, 14 bp, Homo sapiens
ttatttttaaagat

SEQ ID NO: 4063294 - DNA, 14 bp, Homo sapiens
ttatttttacctaa

SEQ ID NO: 4063295 - DNA, 17 bp, Homo sapiens
ttatttttatactgaat

SEQ ID NO: 4063296 - DNA, 14 bp, Homo sapiens
ttatttttctaaaa

SEQ ID NO: 4063297 - DNA, 14 bp, Homo sapiens
ttatttttgtaatg

SEQ ID NO: 4063298 - DNA, 14 bp, Homo sapiens
ttatttttgtacat

SEQ ID NO: 4063299 - DNA, 16 bp, Homo sapiens
ttatttttgtacatgt

SEQ ID NO: 4063300 - DNA, 17 bp, Homo sapiens
ttatttttgtacatgtt

SEQ ID NO: 4063301 - DNA, 18 bp, Homo sapiens
ttattttttacattatta

SEQ ID NO: 4063302 - DNA, 22 bp, Homo sapiens
ttatttttttaaagtgatttgc

SEQ ID NO: 4063303 - DNA, 13 bp, Homo sapiens
ttcaaaagaaagt

SEQ ID NO: 4063304 - DNA, 17 bp, Homo sapiens
ttcaaaataaaaatgag

SEQ ID NO: 4063305 - DNA, 13 bp, Homo sapiens
ttcaaaatccttc

SEQ ID NO: 4063306 - DNA, 17 bp, Homo sapiens
ttcaaaatgctttttat

SEQ ID NO: 4063307 - DNA, 20 bp, Homo sapiens
ttcaaaatgctttttattat

SEQ ID NO: 4063308 - DNA, 21 bp, Homo sapiens
ttcaaactggggcctccagaa

SEQ ID NO: 4063309 - DNA, 12 bp, Homo sapiens
ttcaaactgtga

SEQ ID NO: 4063310 - DNA, 17 bp, Homo sapiens
ttcaaacttactatttt

SEQ ID NO: 4063311 - DNA, 13 bp, Homo sapiens
ttcaaagccacat

SEQ ID NO: 4063312 - DNA, 16 bp, Homo sapiens
ttcaaagcttgaagat

SEQ ID NO: 4063313 - DNA, 20 bp, Homo sapiens
ttcaaagtgttgtgttcctg

SEQ ID NO: 4063314 - DNA, 14 bp, Homo sapiens
ttcaaatacaaagt

SEQ ID NO: 4063315 - DNA, 16 bp, Homo sapiens
ttcaaatacaaagtaa

SEQ ID NO: 4063316 - DNA, 21 bp, Homo sapiens
ttcaaatctggtccatattta

SEQ ID NO: 4063317 - DNA, 20 bp, Homo sapiens
ttcaacaaggcttgctgcag

SEQ ID NO: 4063318 - DNA, 14 bp, Homo sapiens
ttcaacatcaatgt

SEQ ID NO: 4063319 - DNA, 19 bp, Homo sapiens
ttcaacatcaatgttcatt

SEQ ID NO: 4063320 - DNA, 17 bp, Homo sapiens
ttcaacatcctgccagc

SEQ ID NO: 4063321 - DNA, 15 bp, Homo sapiens
ttcaaccattcccca

SEQ ID NO: 4063322 - DNA, 15 bp, Homo sapiens
ttcaacgcagccctg

SEQ ID NO: 4063323 - DNA, 22 bp, Homo sapiens
ttcaagaaaacaacttcaatat

SEQ ID NO: 4063324 - DNA, 18 bp, Homo sapiens
ttcaagagggcaagtgga

SEQ ID NO: 4063325 - DNA, 11 bp, Homo sapiens
ttcaaggaagg

SEQ ID NO: 4063326 - DNA, 22 bp, Homo sapiens
ttcaagggctttcctgtgccag

SEQ ID NO: 4063327 - DNA, 22 bp, Homo sapiens
ttcaagtgccttttgctgcgca

SEQ ID NO: 4063328 - DNA, 23 bp, Homo sapiens
ttcaagtgccttttgctgcgcac

SEQ ID NO: 4063329 - DNA, 13 bp, Homo sapiens
ttcaagttaaagt

SEQ ID NO: 4063330 - DNA, 13 bp, Homo sapiens
ttcaagttgtaaa

SEQ ID NO: 4063331 - DNA, 18 bp, Homo sapiens
ttcaataaagcatttata

SEQ ID NO: 4063332 - DNA, 19 bp, Homo sapiens
ttcaatagctaagcatctc

SEQ ID NO: 4063333 - DNA, 15 bp, Homo sapiens
ttcaatattgacatt

SEQ ID NO: 4063334 - DNA, 18 bp, Homo sapiens
ttcaatattgacatttgt

SEQ ID NO: 4063335 - DNA, 19 bp, Homo sapiens
ttcaatattgacatttgta

SEQ ID NO: 4063336 - DNA, 21 bp, Homo sapiens
ttcaatattgacatttgtagt

SEQ ID NO: 4063337 - DNA, 22 bp, Homo sapiens
ttcaatattgacatttgtagtt

SEQ ID NO: 4063338 - DNA, 17 bp, Homo sapiens
ttcaatgggctcttcca

SEQ ID NO: 4063339 - DNA, 13 bp, Homo sapiens
ttcaattaatgct

SEQ ID NO: 4063340 - DNA, 12 bp, Homo sapiens
ttcaattgtaaa

SEQ ID NO: 4063341 - DNA, 14 bp, Homo sapiens
ttcaattttaaaga

SEQ ID NO: 4063342 - DNA, 21 bp, Homo sapiens
ttcacaaccttctgtggctca

SEQ ID NO: 4063343 - DNA, 22 bp, Homo sapiens
ttcacacatgcctatattatca

SEQ ID NO: 4063344 - DNA, 15 bp, Homo sapiens
ttcacagctcctccc

SEQ ID NO: 4063345 - DNA, 13 bp, Homo sapiens
ttcacaggcactc

SEQ ID NO: 4063346 - DNA, 15 bp, Homo sapiens
ttcacaggtcaataa

SEQ ID NO: 4063347 - DNA, 17 bp, Homo sapiens
ttcacatagatgtccct

SEQ ID NO: 4063348 - DNA, 16 bp, Homo sapiens
ttcacatgtttaactt

SEQ ID NO: 4063349 - DNA, 23 bp, Homo sapiens
ttcacattaaaaaatgaaatatt

SEQ ID NO: 4063350 - DNA, 22 bp, Homo sapiens
ttcaccaccaaatgccaagaaa

SEQ ID NO: 4063351 - DNA, 15 bp, Homo sapiens
ttcaccagagcccat

SEQ ID NO: 4063352 - DNA, 17 bp, Homo sapiens
ttcaccagagcccatgc

SEQ ID NO: 4063353 - DNA, 13 bp, Homo sapiens
ttcaccccaccct

SEQ ID NO: 4063354 - DNA, 17 bp, Homo sapiens
ttcaccccccactcacc

SEQ ID NO: 4063355 - DNA, 16 bp, Homo sapiens
ttcaccccctttcctg

SEQ ID NO: 4063356 - DNA, 19 bp, Homo sapiens
ttcaccccctttcctggac

SEQ ID NO: 4063357 - DNA, 13 bp, Homo sapiens
ttcacctatgtta

SEQ ID NO: 4063358 - DNA, 18 bp, Homo sapiens
ttcacctgccccaactct

SEQ ID NO: 4063359 - DNA, 14 bp, Homo sapiens
ttcacgcaacttga

SEQ ID NO: 4063360 - DNA, 22 bp, Homo sapiens
ttccttagactcttttccttcc

SEQ ID NO: 4063361 - DNA, 15 bp, Homo sapiens
ttccttatccctctc

SEQ ID NO: 4063362 - DNA, 18 bp, Homo sapiens
ttccttatccctctcttc

SEQ ID NO: 4063363 - DNA, 19 bp, Homo sapiens
ttccttatccctctcttcc

SEQ ID NO: 4063364 - DNA, 22 bp, Homo sapiens
ttccttatgtatcagtgtcctt

SEQ ID NO: 4063365 - DNA, 19 bp, Homo sapiens
ttccttcaatgtgcataat

SEQ ID NO: 4063366 - DNA, 16 bp, Homo sapiens
ttccttcagggtttaa

SEQ ID NO: 4063367 - DNA, 13 bp, Homo sapiens
ttccttccctctc

SEQ ID NO: 4063368 - DNA, 15 bp, Homo sapiens
ttccttctctgaaca

SEQ ID NO: 4063369 - DNA, 13 bp, Homo sapiens
ttccttctctggg

SEQ ID NO: 4063370 - DNA, 13 bp, Homo sapiens
ttccttctggcct

SEQ ID NO: 4063371 - DNA, 12 bp, Homo sapiens
ttccttctttga

SEQ ID NO: 4063372 - DNA, 15 bp, Homo sapiens
ttccttctttgccct

SEQ ID NO: 4063373 - DNA, 18 bp, Homo sapiens
ttccttggaggccaccgg

SEQ ID NO: 4063374 - DNA, 22 bp, Homo sapiens
ttccttggccaagagaagggct

SEQ ID NO: 4063375 - DNA, 13 bp, Homo sapiens
ttccttgtcccgt

SEQ ID NO: 4063376 - DNA, 14 bp, Homo sapiens
ttccttgtttatca

SEQ ID NO: 4063377 - DNA, 23 bp, Homo sapiens
ttcctttaaaaaaatttaagtgc

SEQ ID NO: 4063378 - DNA, 15 bp, Homo sapiens
ttcctttatgtgaat

SEQ ID NO: 4063379 - DNA, 23 bp, Homo sapiens
ttcctttcctgtgtgtactctgt

SEQ ID NO: 4063380 - DNA, 12 bp, Homo sapiens
ttcctttctcag

SEQ ID NO: 4063381 - DNA, 14 bp, Homo sapiens
ttcctttctccagg

SEQ ID NO: 4063382 - DNA, 19 bp, Homo sapiens
ttcctttctccaggaccaa

SEQ ID NO: 4063383 - DNA, 15 bp, Homo sapiens
ttcctttggagcttt

SEQ ID NO: 4063384 - DNA, 15 bp, Homo sapiens
ttccttttccctgct

SEQ ID NO: 4063385 - DNA, 16 bp, Homo sapiens
ttccttttccctgctt

SEQ ID NO: 4063386 - DNA, 17 bp, Homo sapiens
ttccttttccctgcttc

SEQ ID NO: 4063387 - DNA, 18 bp, Homo sapiens
ttccttttctaactctcc

SEQ ID NO: 4063388 - DNA, 13 bp, Homo sapiens
ttccttttcttta

SEQ ID NO: 4063389 - DNA, 16 bp, Homo sapiens
ttcctttttaaatgtg

SEQ ID NO: 4063390 - DNA, 19 bp, Homo sapiens
ttcctttttaaatgtgaat

SEQ ID NO: 4063391 - DNA, 21 bp, Homo sapiens
ttcctttttctgattagcttt

SEQ ID NO: 4063392 - DNA, 17 bp, Homo sapiens
ttcctttttgacactga

SEQ ID NO: 4063393 - DNA, 22 bp, Homo sapiens
ttcgaaacctgggattcaggaa

SEQ ID NO: 4063394 - DNA, 13 bp, Homo sapiens
ttcgaaactgcca

SEQ ID NO: 4063395 - DNA, 17 bp, Homo sapiens
ttcgaaactgccaaggg

SEQ ID NO: 4063396 - DNA, 23 bp, Homo sapiens
ttcgaagctgttaatttttctta

SEQ ID NO: 4063397 - DNA, 22 bp, Homo sapiens
ttcgaatcttaatttattattt

SEQ ID NO: 4063398 - DNA, 20 bp, Homo sapiens
ttcgagacccaaacccccaa

SEQ ID NO: 4063399 - DNA, 15 bp, Homo sapiens
ttcgaggcctgaagc

SEQ ID NO: 4063400 - DNA, 20 bp, Homo sapiens
ttcgatacaccgggcctgga

SEQ ID NO: 4063401 - DNA, 23 bp, Homo sapiens
ttcgatacccaggaccaagccac

SEQ ID NO: 4063402 - DNA, 16 bp, Homo sapiens
ttcgatgaaggctgcc

SEQ ID NO: 4063403 - DNA, 12 bp, Homo sapiens
ttcgccatctga

SEQ ID NO: 4063404 - DNA, 19 bp, Homo sapiens
ttcgcgtgccctcgctgct

SEQ ID NO: 4063405 - DNA, 19 bp, Homo sapiens
ttcggaactgtcctttcct

SEQ ID NO: 4063406 - DNA, 19 bp, Homo sapiens
ttcggaggccccactgatg

SEQ ID NO: 4063407 - DNA, 17 bp, Homo sapiens
ttcggccgagctggttt

SEQ ID NO: 4063408 - DNA, 15 bp, Homo sapiens
ttcgggagcagggct

SEQ ID NO: 4063409 - DNA, 18 bp, Homo sapiens
ttcggttctccagaatgt

SEQ ID NO: 4063410 - DNA, 19 bp, Homo sapiens
ttcggttctccagaatgta

SEQ ID NO: 4063411 - DNA, 18 bp, Homo sapiens
ttcgtgagctggggactc

SEQ ID NO: 4063412 - DNA, 20 bp, Homo sapiens
ttcgttgtgttttttaagat

SEQ ID NO: 4063413 - DNA, 14 bp, Homo sapiens
ttctaaaaaaagaa

SEQ ID NO: 4063414 - DNA, 17 bp, Homo sapiens
ttctaaaaagattagca

SEQ ID NO: 4063415 - DNA, 18 bp, Homo sapiens
ttctaaaaattgtgatca

SEQ ID NO: 4063416 - DNA, 23 bp, Homo sapiens
ttctaaagataatattactgttt

SEQ ID NO: 4063417 - DNA, 13 bp, Homo sapiens
ttctaaatagcaa

SEQ ID NO: 4063418 - DNA, 21 bp, Homo sapiens
ttctaaatgaatgtttacact

SEQ ID NO: 4063419 - DNA, 12 bp, Homo sapiens
ttctaaattaaa

SEQ ID NO: 4063420 - DNA, 18 bp, Homo sapiens
ttctaaccttgaatgctg

SEQ ID NO: 4063421 - DNA, 24 bp, Homo sapiens
ttctaaccttgaatgctgccagtg

SEQ ID NO: 4063422 - DNA, 13 bp, Homo sapiens
ttctaagagaagt

SEQ ID NO: 4063423 - DNA, 14 bp, Homo sapiens
ttctaagtgggaga

SEQ ID NO: 4063424 - DNA, 18 bp, Homo sapiens
ttctaagttatttacttt

SEQ ID NO: 4063425 - DNA, 12 bp, Homo sapiens
ttctaatagaac

SEQ ID NO: 4063426 - DNA, 18 bp, Homo sapiens
ttctaatagaactcagtt

SEQ ID NO: 4063427 - DNA, 15 bp, Homo sapiens
ttctaatccttttcc

SEQ ID NO: 4063428 - DNA, 12 bp, Homo sapiens
ttctaatcttaa

SEQ ID NO: 4063429 - DNA, 16 bp, Homo sapiens
ttctaatcttaaatca

SEQ ID NO: 4063430 - DNA, 21 bp, Homo sapiens
ttctaatcttaaatcagaata

SEQ ID NO: 4063431 - DNA, 23 bp, Homo sapiens
ttctaatcttaaatcagaataaa

SEQ ID NO: 4063432 - DNA, 16 bp, Homo sapiens
ttctaatgctgatatg

SEQ ID NO: 4063433 - DNA, 13 bp, Homo sapiens
ttctaatgtttct

SEQ ID NO: 4063434 - DNA, 15 bp, Homo sapiens
ttctaatttttaaga

SEQ ID NO: 4063435 - DNA, 13 bp, Homo sapiens
ttctacaaccaga

SEQ ID NO: 4063436 - DNA, 17 bp, Homo sapiens
ttctacaaccagagccc

SEQ ID NO: 4063437 - DNA, 18 bp, Homo sapiens
ttctacaaccagagcccc

SEQ ID NO: 4063438 - DNA, 14 bp, Homo sapiens
ttctacatgactgg

SEQ ID NO: 4063439 - DNA, 18 bp, Homo sapiens
ttctacccaacggccctg

SEQ ID NO: 4063440 - DNA, 18 bp, Homo sapiens
ttctaccttgaggtcttt

SEQ ID NO: 4063441 - DNA, 13 bp, Homo sapiens
ttctactcccctt

SEQ ID NO: 4063442 - DNA, 13 bp, Homo sapiens
ttctactcctgcc

SEQ ID NO: 4063443 - DNA, 17 bp, Homo sapiens
ttctagaaagcctgttc

SEQ ID NO: 4063444 - DNA, 15 bp, Homo sapiens
ttctagaagcacatg

SEQ ID NO: 4063445 - DNA, 18 bp, Homo sapiens
ttctagaagcacatgtgt

SEQ ID NO: 4063446 - DNA, 21 bp, Homo sapiens
ttctagaagtttcccttcctc

SEQ ID NO: 4063447 - DNA, 12 bp, Homo sapiens
ttctagagaaga

SEQ ID NO: 4063448 - DNA, 22 bp, Homo sapiens
ttctagctagaaatatgatttt

SEQ ID NO: 4063449 - DNA, 20 bp, Homo sapiens
ttctagctgttgagctgttt

SEQ ID NO: 4063450 - DNA, 21 bp, Homo sapiens
ttctagtctcctttgcactga

SEQ ID NO: 4063451 - DNA, 22 bp, Homo sapiens
ttctagtctcctttgcactgag

SEQ ID NO: 4063452 - DNA, 13 bp, Homo sapiens
ttctagttttgtc

SEQ ID NO: 4063453 - DNA, 15 bp, Homo sapiens
ttctataacagatat

SEQ ID NO: 4063454 - DNA, 19 bp, Homo sapiens
ttctatagagatagatatt

SEQ ID NO: 4063455 - DNA, 17 bp, Homo sapiens
ttctatattttaataga

SEQ ID NO: 4063456 - DNA, 18 bp, Homo sapiens
ttctatattttaatagaa

SEQ ID NO: 4063457 - DNA, 19 bp, Homo sapiens
ttctatattttaatagaaa

SEQ ID NO: 4063458 - DNA, 17 bp, Homo sapiens
ttctatcagtactttta

SEQ ID NO: 4063459 - DNA, 16 bp, Homo sapiens
ttctatgaagagtatt

SEQ ID NO: 4063460 - DNA, 17 bp, Homo sapiens
ttctatgaagagtatta

SEQ ID NO: 4063461 - DNA, 16 bp, Homo sapiens
ttctatggttatgaaa

SEQ ID NO: 4063462 - DNA, 19 bp, Homo sapiens
ttctatggttatgaaagaa

SEQ ID NO: 4063463 - DNA, 16 bp, Homo sapiens
ttgaactttgccaaaa

SEQ ID NO: 4063464 - DNA, 14 bp, Homo sapiens
ttgaacttttgtac

SEQ ID NO: 4063465 - DNA, 23 bp, Homo sapiens
ttgaacttttgtactgaattttt

SEQ ID NO: 4063466 - DNA, 22 bp, Homo sapiens
ttgaagaaggtggaccttttaa

SEQ ID NO: 4063467 - DNA, 17 bp, Homo sapiens
ttgaagaatatttaaga

SEQ ID NO: 4063468 - DNA, 21 bp, Homo sapiens
ttgaagaatatttaagaaaag

SEQ ID NO: 4063469 - DNA, 15 bp, Homo sapiens
ttgaagacaatttga

SEQ ID NO: 4063470 - DNA, 18 bp, Homo sapiens
ttgaagagagatatatct

SEQ ID NO: 4063471 - DNA, 20 bp, Homo sapiens
ttgaagatcgttagtatcta

SEQ ID NO: 4063472 - DNA, 11 bp, Homo sapiens
ttgaagccaaa

SEQ ID NO: 4063473 - DNA, 15 bp, Homo sapiens
ttgaagccaaagaaa

SEQ ID NO: 4063474 - DNA, 18 bp, Homo sapiens
ttgaagccgactctggcc

SEQ ID NO: 4063475 - DNA, 19 bp, Homo sapiens
ttgaagcctgctccttccc

SEQ ID NO: 4063476 - DNA, 15 bp, Homo sapiens
ttgaagcctgtgcct

SEQ ID NO: 4063477 - DNA, 20 bp, Homo sapiens
ttgaagcctgtgcctcccag

SEQ ID NO: 4063478 - DNA, 15 bp, Homo sapiens
ttgaagccttttgtt

SEQ ID NO: 4063479 - DNA, 15 bp, Homo sapiens
ttgaagggaggggct

SEQ ID NO: 4063480 - DNA, 20 bp, Homo sapiens
ttgaagggaggggctgtgtt

SEQ ID NO: 4063481 - DNA, 20 bp, Homo sapiens
ttgaagggccagagccaggg

SEQ ID NO: 4063482 - DNA, 12 bp, Homo sapiens
ttgaagtaatga

SEQ ID NO: 4063483 - DNA, 14 bp, Homo sapiens
ttgaagtttacatt

SEQ ID NO: 4063484 - DNA, 15 bp, Homo sapiens
ttgaagtttacattt

SEQ ID NO: 4063485 - DNA, 16 bp, Homo sapiens
ttgaagtttacatttt

SEQ ID NO: 4063486 - DNA, 19 bp, Homo sapiens
ttgaagtttacatttttat

SEQ ID NO: 4063487 - DNA, 13 bp, Homo sapiens
ttgaatatattat

SEQ ID NO: 4063488 - DNA, 13 bp, Homo sapiens
ttgaatatgtagc

SEQ ID NO: 4063489 - DNA, 18 bp, Homo sapiens
ttgaatgaaaaatttaag

SEQ ID NO: 4063490 - DNA, 16 bp, Homo sapiens
ttgaatgaaaacattt

SEQ ID NO: 4063491 - DNA, 15 bp, Homo sapiens
ttgaatgggtccatt

SEQ ID NO: 4063492 - DNA, 16 bp, Homo sapiens
ttgaatgttaagaatt

SEQ ID NO: 4063493 - DNA, 12 bp, Homo sapiens
ttgaattaaaac

SEQ ID NO: 4063494 - DNA, 14 bp, Homo sapiens
ttgaattaaaactt

SEQ ID NO: 4063495 - DNA, 16 bp, Homo sapiens
ttgaattaaaacttct

SEQ ID NO: 4063496 - DNA, 17 bp, Homo sapiens
ttgaattaaaacttctt

SEQ ID NO: 4063497 - DNA, 18 bp, Homo sapiens
ttgaatttactggacata

SEQ ID NO: 4063498 - DNA, 15 bp, Homo sapiens
ttgaattttaaatct

SEQ ID NO: 4063499 - DNA, 16 bp, Homo sapiens
ttgaattttaaatcta

SEQ ID NO: 4063500 - DNA, 14 bp, Homo sapiens
ttgaatttttctct

SEQ ID NO: 4063501 - DNA, 14 bp, Homo sapiens
ttgacaacctagaa

SEQ ID NO: 4063502 - DNA, 18 bp, Homo sapiens
ttgacaacctagaatgtc

SEQ ID NO: 4063503 - DNA, 19 bp, Homo sapiens
ttgacaattcctagataaa

SEQ ID NO: 4063504 - DNA, 14 bp, Homo sapiens
ttgacacaagtgga

SEQ ID NO: 4063505 - DNA, 14 bp, Homo sapiens
ttgacacagtcagc

SEQ ID NO: 4063506 - DNA, 21 bp, Homo sapiens
ttgacactgaaagttttgtaa

SEQ ID NO: 4063507 - DNA, 22 bp, Homo sapiens
ttgacactgaaagttttgtaaa

SEQ ID NO: 4063508 - DNA, 23 bp, Homo sapiens
ttgacagagcctgccccagcgct

SEQ ID NO: 4063509 - DNA, 12 bp, Homo sapiens
ttgacagcatga

SEQ ID NO: 4063510 - DNA, 12 bp, Homo sapiens
ttgacagctcag

SEQ ID NO: 4063511 - DNA, 12 bp, Homo sapiens
ttgacaggaggt

SEQ ID NO: 4063512 - DNA, 13 bp, Homo sapiens
ttgacatttaatt

SEQ ID NO: 4063513 - DNA, 22 bp, Homo sapiens
ttgaccagataaatagaactat

SEQ ID NO: 4063514 - DNA, 17 bp, Homo sapiens
ttgaccaggcacctccc

SEQ ID NO: 4063515 - DNA, 15 bp, Homo sapiens
ttgaccattaataaa

SEQ ID NO: 4063516 - DNA, 16 bp, Homo sapiens
ttgaccgtactctcac

SEQ ID NO: 4063517 - DNA, 22 bp, Homo sapiens
ttgaccgtactctcacatgtgg

SEQ ID NO: 4063518 - DNA, 19 bp, Homo sapiens
ttgacctctcagggcctgg

SEQ ID NO: 4063519 - DNA, 16 bp, Homo sapiens
ttgacctgctccgctg

SEQ ID NO: 4063520 - DNA, 15 bp, Homo sapiens
ttgacgattccttct

SEQ ID NO: 4063521 - DNA, 15 bp, Homo sapiens
ttgacggatgattgg

SEQ ID NO: 4063522 - DNA, 22 bp, Homo sapiens
ttgacgtcactttttggccatg

SEQ ID NO: 4063523 - DNA, 15 bp, Homo sapiens
ttgactaaagctatg

SEQ ID NO: 4063524 - DNA, 14 bp, Homo sapiens
ttgactcagttcca

SEQ ID NO: 4063525 - DNA, 16 bp, Homo sapiens
ttgactcccaagtttc

SEQ ID NO: 4063526 - DNA, 19 bp, Homo sapiens
ttgactcccaagtttccat

SEQ ID NO: 4063527 - DNA, 14 bp, Homo sapiens
ttgactctaaatgc

SEQ ID NO: 4063528 - DNA, 21 bp, Homo sapiens
ttgactggtttacaggccctg

SEQ ID NO: 4063529 - DNA, 16 bp, Homo sapiens
ttgactgtagccacag

SEQ ID NO: 4063530 - DNA, 17 bp, Homo sapiens
ttgactttatctcctgc

SEQ ID NO: 4063531 - DNA, 23 bp, Homo sapiens
ttgagaaaccttattgtacctct

SEQ ID NO: 4063532 - DNA, 15 bp, Homo sapiens
ttgagaaatgaataa

SEQ ID NO: 4063533 - DNA, 16 bp, Homo sapiens
ttgagaaatgaataat

SEQ ID NO: 4063534 - DNA, 22 bp, Homo sapiens
ttgagaaatgaataatttccca

SEQ ID NO: 4063535 - DNA, 22 bp, Homo sapiens
ttgagaagacctcacctagaaa

SEQ ID NO: 4063536 - DNA, 22 bp, Homo sapiens
ttgagaatcccttaaaattacc

SEQ ID NO: 4063537 - DNA, 14 bp, Homo sapiens
ttgagacaatgttt

SEQ ID NO: 4063538 - DNA, 17 bp, Homo sapiens
ttgagactcaaaaaaac

SEQ ID NO: 4063539 - DNA, 21 bp, Homo sapiens
ttgagataatatctgtgaggt

SEQ ID NO: 4063540 - DNA, 17 bp, Homo sapiens
ttgagattagagggagg

SEQ ID NO: 4063541 - DNA, 21 bp, Homo sapiens
ttgagcatgacagcctgcagc

SEQ ID NO: 4063542 - DNA, 13 bp, Homo sapiens
ttgagcccaggag

SEQ ID NO: 4063543 - DNA, 15 bp, Homo sapiens
ttgagctattgctgt

SEQ ID NO: 4063544 - DNA, 21 bp, Homo sapiens
ttgagctcagccccaactctt

SEQ ID NO: 4063545 - DNA, 16 bp, Homo sapiens
ttgagctgccttccct

SEQ ID NO: 4063546 - DNA, 19 bp, Homo sapiens
ttgagctgccttccctagc

SEQ ID NO: 4063547 - DNA, 13 bp, Homo sapiens
ttgaggaaatatt

SEQ ID NO: 4063548 - DNA, 16 bp, Homo sapiens
ttgaggagccccagct

SEQ ID NO: 4063549 - DNA, 19 bp, Homo sapiens
ttgaggctgtcacagtcct

SEQ ID NO: 4063550 - DNA, 17 bp, Homo sapiens
ttgaggcttctccttct

SEQ ID NO: 4063551 - DNA, 14 bp, Homo sapiens
ttgaggctttgtgt

SEQ ID NO: 4063552 - DNA, 23 bp, Homo sapiens
ttgagggcccagagcaggaagca

SEQ ID NO: 4063553 - DNA, 21 bp, Homo sapiens
ttgagggcccagccaggagca

SEQ ID NO: 4063554 - DNA, 13 bp, Homo sapiens
ttgaggggaggag

SEQ ID NO: 4063555 - DNA, 13 bp, Homo sapiens
ttgagggtaggag

SEQ ID NO: 4063556 - DNA, 21 bp, Homo sapiens
ttgaggtagaccaggatttct

SEQ ID NO: 4063557 - DNA, 12 bp, Homo sapiens
ttgagtaatggt

SEQ ID NO: 4063558 - DNA, 21 bp, Homo sapiens
ttgagtaatggtgtagaacac

SEQ ID NO: 4063559 - DNA, 13 bp, Homo sapiens
ttgagtaatgtga

SEQ ID NO: 4063560 - DNA, 16 bp, Homo sapiens
ttgagtaatgtgacta

SEQ ID NO: 4063561 - DNA, 21 bp, Homo sapiens
ttgagtacctactgtgtgcca

SEQ ID NO: 4063562 - DNA, 17 bp, Homo sapiens
ttgagtataagaaatgc

SEQ ID NO: 4063563 - DNA, 20 bp, Homo sapiens
ttgagtgactcgagggttgg

SEQ ID NO: 4063564 - DNA, 23 bp, Homo sapiens
ttgagtggggttatctctgtgtt

SEQ ID NO: 4063565 - DNA, 18 bp, Homo sapiens
ttgagtgttcctttttaa

SEQ ID NO: 4063566 - DNA, 13 bp, Homo sapiens
ttggggggccggg

SEQ ID NO: 4063567 - DNA, 18 bp, Homo sapiens
ttgggggggaccctgcct

SEQ ID NO: 4063568 - DNA, 16 bp, Homo sapiens
ttggggtacaattgta

SEQ ID NO: 4063569 - DNA, 21 bp, Homo sapiens
ttgggtatcctgcccagtgtt

SEQ ID NO: 4063570 - DNA, 19 bp, Homo sapiens
ttgggtcattgacctctca

SEQ ID NO: 4063571 - DNA, 10 bp, Homo sapiens
ttgggttgac

SEQ ID NO: 4063572 - DNA, 19 bp, Homo sapiens
ttggtaaaactcactgtga

SEQ ID NO: 4063573 - DNA, 20 bp, Homo sapiens
ttggtaaaactcactgtgat

SEQ ID NO: 4063574 - DNA, 12 bp, Homo sapiens
ttggtaataaca

SEQ ID NO: 4063575 - DNA, 22 bp, Homo sapiens
ttggtactactagatgtcttta

SEQ ID NO: 4063576 - DNA, 13 bp, Homo sapiens
ttggtagattaaa

SEQ ID NO: 4063577 - DNA, 15 bp, Homo sapiens
ttggtagattaaata

SEQ ID NO: 4063578 - DNA, 18 bp, Homo sapiens
ttggtagattaaatatag

SEQ ID NO: 4063579 - DNA, 21 bp, Homo sapiens
ttggtattatataattcaagg

SEQ ID NO: 4063580 - DNA, 13 bp, Homo sapiens
ttggtctttgtat

SEQ ID NO: 4063581 - DNA, 14 bp, Homo sapiens
ttggtgaagtaaat

SEQ ID NO: 4063582 - DNA, 15 bp, Homo sapiens
ttggtgactgtccca

SEQ ID NO: 4063583 - DNA, 20 bp, Homo sapiens
ttggtgcatgtctgttcttc

SEQ ID NO: 4063584 - DNA, 20 bp, Homo sapiens
ttggtgccaccaaaagtgct

SEQ ID NO: 4063585 - DNA, 21 bp, Homo sapiens
ttggtgccaccaaaagtgctc

SEQ ID NO: 4063586 - DNA, 17 bp, Homo sapiens
ttggtgccttttgtgtg

SEQ ID NO: 4063587 - DNA, 15 bp, Homo sapiens
ttggtgctctgtgtt

SEQ ID NO: 4063588 - DNA, 22 bp, Homo sapiens
ttggtgcttacacatctcagac

SEQ ID NO: 4063589 - DNA, 21 bp, Homo sapiens
ttggtggcagattttacaaaa

SEQ ID NO: 4063590 - DNA, 13 bp, Homo sapiens
ttggtgggagggt

SEQ ID NO: 4063591 - DNA, 21 bp, Homo sapiens
ttggtgggtctatgttcccca

SEQ ID NO: 4063592 - DNA, 17 bp, Homo sapiens
ttggtgtaatttgaaga

SEQ ID NO: 4063593 - DNA, 13 bp, Homo sapiens
ttggtgttggctg

SEQ ID NO: 4063594 - DNA, 21 bp, Homo sapiens
ttggttcaataaagcactgag

SEQ ID NO: 4063595 - DNA, 20 bp, Homo sapiens
ttggttcagacacctgttca

SEQ ID NO: 4063596 - DNA, 14 bp, Homo sapiens
ttggttccttctct

SEQ ID NO: 4063597 - DNA, 15 bp, Homo sapiens
ttggttccttctctg

SEQ ID NO: 4063598 - DNA, 15 bp, Homo sapiens
ttggttctaatagaa

SEQ ID NO: 4063599 - DNA, 20 bp, Homo sapiens
ttggttgctaagaagcctat

SEQ ID NO: 4063600 - DNA, 12 bp, Homo sapiens
ttggttgtcaat

SEQ ID NO: 4063601 - DNA, 12 bp, Homo sapiens
ttggtttaaaaa

SEQ ID NO: 4063602 - DNA, 14 bp, Homo sapiens
ttggtttacattta

SEQ ID NO: 4063603 - DNA, 19 bp, Homo sapiens
ttgtaaaaacagcattgct

SEQ ID NO: 4063604 - DNA, 20 bp, Homo sapiens
ttgtaaaaacagcattgctt

SEQ ID NO: 4063605 - DNA, 13 bp, Homo sapiens
ttgtaaaagaaat

SEQ ID NO: 4063606 - DNA, 22 bp, Homo sapiens
ttgtaaaagaaatcatgtccat

SEQ ID NO: 4063607 - DNA, 20 bp, Homo sapiens
ttgtaaaagaacagtaaaca

SEQ ID NO: 4063608 - DNA, 21 bp, Homo sapiens
ttgtaaaagaacagtaaacat

SEQ ID NO: 4063609 - DNA, 20 bp, Homo sapiens
ttgtaaaatatcgtgtgtgt

SEQ ID NO: 4063610 - DNA, 15 bp, Homo sapiens
ttgtaaataagagat

SEQ ID NO: 4063611 - DNA, 16 bp, Homo sapiens
ttgtaaataagagatt

SEQ ID NO: 4063612 - DNA, 12 bp, Homo sapiens
ttgtaaatacac

SEQ ID NO: 4063613 - DNA, 14 bp, Homo sapiens
ttgtaaatacacat

SEQ ID NO: 4063614 - DNA, 14 bp, Homo sapiens
ttgtaaatacacca

SEQ ID NO: 4063615 - DNA, 19 bp, Homo sapiens
ttgtaaatactgcttgacc

SEQ ID NO: 4063616 - DNA, 17 bp, Homo sapiens
ttgtaaatagtatttga

SEQ ID NO: 4063617 - DNA, 12 bp, Homo sapiens
ttgtaaatattt

SEQ ID NO: 4063618 - DNA, 16 bp, Homo sapiens
ttgtaaatatttatgt

SEQ ID NO: 4063619 - DNA, 21 bp, Homo sapiens
ttgtaaattaaacataaaaca

SEQ ID NO: 4063620 - DNA, 15 bp, Homo sapiens
ttgtaaattatttgc

SEQ ID NO: 4063621 - DNA, 16 bp, Homo sapiens
ttgtaaattatttgct

SEQ ID NO: 4063622 - DNA, 14 bp, Homo sapiens
ttgtaaccatttct

SEQ ID NO: 4063623 - DNA, 18 bp, Homo sapiens
ttgtaacctcagctctgg

SEQ ID NO: 4063624 - DNA, 19 bp, Homo sapiens
ttgtaacctcagctctggg

SEQ ID NO: 4063625 - DNA, 20 bp, Homo sapiens
ttgtaactaggctcagagat

SEQ ID NO: 4063626 - DNA, 14 bp, Homo sapiens
ttgtaacttatatt

SEQ ID NO: 4063627 - DNA, 17 bp, Homo sapiens
ttgtaacttatattgaa

SEQ ID NO: 4063628 - DNA, 19 bp, Homo sapiens
ttgtaacttatattgaaga

SEQ ID NO: 4063629 - DNA, 24 bp, Homo sapiens
ttgtaagaaggcaatattaaccta

SEQ ID NO: 4063630 - DNA, 20 bp, Homo sapiens
ttgtaagagtggaaccaaca

SEQ ID NO: 4063631 - DNA, 15 bp, Homo sapiens
ttgtaagagtgtaga

SEQ ID NO: 4063632 - DNA, 17 bp, Homo sapiens
ttgtaagagtgtagaag

SEQ ID NO: 4063633 - DNA, 15 bp, Homo sapiens
ttgtaagtcagtgtt

SEQ ID NO: 4063634 - DNA, 12 bp, Homo sapiens
ttgtaagtcatc

SEQ ID NO: 4063635 - DNA, 21 bp, Homo sapiens
ttgtaagttgtacaaatgtat

SEQ ID NO: 4063636 - DNA, 16 bp, Homo sapiens
ttgtaagtttcaggtg

SEQ ID NO: 4063637 - DNA, 19 bp, Homo sapiens
ttgtaagtttcaggtgaca

SEQ ID NO: 4063638 - DNA, 22 bp, Homo sapiens
ttgtaagtttcaggtgacatgt

SEQ ID NO: 4063639 - DNA, 18 bp, Homo sapiens
ttgtaataaagtatataa

SEQ ID NO: 4063640 - DNA, 20 bp, Homo sapiens
ttgtaataaagtatataatt

SEQ ID NO: 4063641 - DNA, 12 bp, Homo sapiens
ttgtaatatgcg

SEQ ID NO: 4063642 - DNA, 14 bp, Homo sapiens
ttgtaatgtgaaaa

SEQ ID NO: 4063643 - DNA, 23 bp, Homo sapiens
ttgtaattctaaatgaatgttta

SEQ ID NO: 4063644 - DNA, 17 bp, Homo sapiens
ttgtaattgcttacatt

SEQ ID NO: 4063645 - DNA, 18 bp, Homo sapiens
ttgtaattgcttacattt

SEQ ID NO: 4063646 - DNA, 12 bp, Homo sapiens
ttgtaattgtgt

SEQ ID NO: 4063647 - DNA, 22 bp, Homo sapiens
ttgtaattgtgtaaaaaatgga

SEQ ID NO: 4063648 - DNA, 19 bp, Homo sapiens
ttgtaatttttggggaaaa

SEQ ID NO: 4063649 - DNA, 22 bp, Homo sapiens
ttgtaatttttggggaaaaaag

SEQ ID NO: 4063650 - DNA, 16 bp, Homo sapiens
ttgtacaaaaaaaaag

SEQ ID NO: 4063651 - DNA, 18 bp, Homo sapiens
ttgtacaaatgtattttg

SEQ ID NO: 4063652 - DNA, 19 bp, Homo sapiens
ttgtacaaatgtattttga

SEQ ID NO: 4063653 - DNA, 17 bp, Homo sapiens
ttgtacagaatatttct

SEQ ID NO: 4063654 - DNA, 21 bp, Homo sapiens
ttgtacagaatatttctattg

SEQ ID NO: 4063655 - DNA, 20 bp, Homo sapiens
ttgtacatttatgatttaat

SEQ ID NO: 4063656 - DNA, 22 bp, Homo sapiens
ttgtacatttatttattactgt

SEQ ID NO: 4063657 - DNA, 17 bp, Homo sapiens
ttgtaccatcattttat

SEQ ID NO: 4063658 - DNA, 11 bp, Homo sapiens
ttgtacctctc

SEQ ID NO: 4063659 - DNA, 18 bp, Homo sapiens
ttgtactttgtggagaga

SEQ ID NO: 4063660 - DNA, 17 bp, Homo sapiens
ttgtagaactcactctg

SEQ ID NO: 4063661 - DNA, 23 bp, Homo sapiens
ttgtagcatataggtgatgtttg

SEQ ID NO: 4063662 - DNA, 15 bp, Homo sapiens
ttgtagccatggctg

SEQ ID NO: 4063663 - DNA, 23 bp, Homo sapiens
ttgtagtagcgttttttaaatgt

SEQ ID NO: 4063664 - DNA, 14 bp, Homo sapiens
ttgtataaaataga

SEQ ID NO: 4063665 - DNA, 14 bp, Homo sapiens
ttgtataatttcga

SEQ ID NO: 4063666 - DNA, 19 bp, Homo sapiens
ttgtatatacagttatttt

SEQ ID NO: 4063667 - DNA, 20 bp, Homo sapiens
ttgtatattacacatttgta

SEQ ID NO: 4063668 - DNA, 18 bp, Homo sapiens
ttgtatattatggaagat

SEQ ID NO: 4063669 - DNA, 22 bp, Homo sapiens
tttataaatataagccttttat

SEQ ID NO: 4063670 - DNA, 13 bp, Homo sapiens
tttataaatgcta

SEQ ID NO: 4063671 - DNA, 16 bp, Homo sapiens
tttataaatgctattt

SEQ ID NO: 4063672 - DNA, 19 bp, Homo sapiens
tttataaccccagcctgac

SEQ ID NO: 4063673 - DNA, 16 bp, Homo sapiens
tttataactcatcata

SEQ ID NO: 4063674 - DNA, 19 bp, Homo sapiens
tttataactcatcataaaa

SEQ ID NO: 4063675 - DNA, 21 bp, Homo sapiens
tttataactcatcataaaata

SEQ ID NO: 4063676 - DNA, 14 bp, Homo sapiens
tttataatctgaag

SEQ ID NO: 4063677 - DNA, 15 bp, Homo sapiens
tttataatctgaaga

SEQ ID NO: 4063678 - DNA, 16 bp, Homo sapiens
tttataatctgaagat

SEQ ID NO: 4063679 - DNA, 16 bp, Homo sapiens
tttatacaatatcatc

SEQ ID NO: 4063680 - DNA, 14 bp, Homo sapiens
tttatacagctgta

SEQ ID NO: 4063681 - DNA, 18 bp, Homo sapiens
tttatacagtgccttgct

SEQ ID NO: 4063682 - DNA, 16 bp, Homo sapiens
tttatacattagtaaa

SEQ ID NO: 4063683 - DNA, 18 bp, Homo sapiens
tttatacccccaggaaac

SEQ ID NO: 4063684 - DNA, 10 bp, Homo sapiens
tttatacctc

SEQ ID NO: 4063685 - DNA, 15 bp, Homo sapiens
tttatactgtgaagt

SEQ ID NO: 4063686 - DNA, 20 bp, Homo sapiens
tttatatacctggcttttac

SEQ ID NO: 4063687 - DNA, 23 bp, Homo sapiens
tttatatactgggttcttgtttt

SEQ ID NO: 4063688 - DNA, 17 bp, Homo sapiens
tttatatatgaaaacta

SEQ ID NO: 4063689 - DNA, 12 bp, Homo sapiens
tttatatattta

SEQ ID NO: 4063690 - DNA, 17 bp, Homo sapiens
tttatatcagcctgagt

SEQ ID NO: 4063691 - DNA, 16 bp, Homo sapiens
tttatatcatgcaaaa

SEQ ID NO: 4063692 - DNA, 17 bp, Homo sapiens
tttatatcatgcaaaat

SEQ ID NO: 4063693 - DNA, 17 bp, Homo sapiens
tttatatcccattttta

SEQ ID NO: 4063694 - DNA, 17 bp, Homo sapiens
tttatatcttttggtta

SEQ ID NO: 4063695 - DNA, 17 bp, Homo sapiens
tttatatggcccagcct

SEQ ID NO: 4063696 - DNA, 18 bp, Homo sapiens
tttatatggcccagcctt

SEQ ID NO: 4063697 - DNA, 18 bp, Homo sapiens
tttatatggggaatatat

SEQ ID NO: 4063698 - DNA, 14 bp, Homo sapiens
tttatatgtacatg

SEQ ID NO: 4063699 - DNA, 17 bp, Homo sapiens
tttatatgtacatgaga

SEQ ID NO: 4063700 - DNA, 14 bp, Homo sapiens
tttatattatccat

SEQ ID NO: 4063701 - DNA, 22 bp, Homo sapiens
tttatattatccataggtttct

SEQ ID NO: 4063702 - DNA, 18 bp, Homo sapiens
tttatatttaattattaa

SEQ ID NO: 4063703 - DNA, 16 bp, Homo sapiens
tttatatttattgtta

SEQ ID NO: 4063704 - DNA, 14 bp, Homo sapiens
tttatatttccttt

SEQ ID NO: 4063705 - DNA, 17 bp, Homo sapiens
tttatatttcctttatg

SEQ ID NO: 4063706 - DNA, 21 bp, Homo sapiens
tttatcaaaccctagccttgc

SEQ ID NO: 4063707 - DNA, 22 bp, Homo sapiens
tttatcaaagcatagatgtttt

SEQ ID NO: 4063708 - DNA, 22 bp, Homo sapiens
tttatcacaaccaccgttacaa

SEQ ID NO: 4063709 - DNA, 20 bp, Homo sapiens
tttatccacaggaaagtgtt

SEQ ID NO: 4063710 - DNA, 16 bp, Homo sapiens
tttatcccaaagttgt

SEQ ID NO: 4063711 - DNA, 18 bp, Homo sapiens
tttatcccaaagttgttg

SEQ ID NO: 4063712 - DNA, 16 bp, Homo sapiens
tttatccctcacctgt

SEQ ID NO: 4063713 - DNA, 23 bp, Homo sapiens
tttatcctagtcattcttcccta

SEQ ID NO: 4063714 - DNA, 21 bp, Homo sapiens
tttatcgccctggcaggcagg

SEQ ID NO: 4063715 - DNA, 15 bp, Homo sapiens
tttatctaaattaaa

SEQ ID NO: 4063716 - DNA, 12 bp, Homo sapiens
tttatctcctgc

SEQ ID NO: 4063717 - DNA, 15 bp, Homo sapiens
tttatctgcagaaca

SEQ ID NO: 4063718 - DNA, 21 bp, Homo sapiens
tttatcttggactgacattta

SEQ ID NO: 4063719 - DNA, 12 bp, Homo sapiens
tttatcttttta

SEQ ID NO: 4063720 - DNA, 12 bp, Homo sapiens
tttatgaaatga

SEQ ID NO: 4063721 - DNA, 21 bp, Homo sapiens
tttatgaaatggttaagaatt

SEQ ID NO: 4063722 - DNA, 12 bp, Homo sapiens
tttatgaagttt

SEQ ID NO: 4063723 - DNA, 14 bp, Homo sapiens
tttatgaatgggtg

SEQ ID NO: 4063724 - DNA, 12 bp, Homo sapiens
tttatgagccag

SEQ ID NO: 4063725 - DNA, 17 bp, Homo sapiens
tttatgagccagacaaa

SEQ ID NO: 4063726 - DNA, 15 bp, Homo sapiens
tttatgatcagtgtt

SEQ ID NO: 4063727 - DNA, 12 bp, Homo sapiens
tttatgatttaa

SEQ ID NO: 4063728 - DNA, 23 bp, Homo sapiens
tttatggtaactgctttctgttc

SEQ ID NO: 4063729 - DNA, 21 bp, Homo sapiens
tttatggttacttcttctctt

SEQ ID NO: 4063730 - DNA, 22 bp, Homo sapiens
tttatgtaaactgcattagaaa

SEQ ID NO: 4063731 - DNA, 19 bp, Homo sapiens
tttatgtagtaattgacat

SEQ ID NO: 4063732 - DNA, 12 bp, Homo sapiens
tttatgtatctc

SEQ ID NO: 4063733 - DNA, 20 bp, Homo sapiens
tttatgtgaatttttaagct

SEQ ID NO: 4063734 - DNA, 16 bp, Homo sapiens
tttatgtgatcaattt

SEQ ID NO: 4063735 - DNA, 17 bp, Homo sapiens
tttatgttagattttgc

SEQ ID NO: 4063736 - DNA, 12 bp, Homo sapiens
tttatgtttgaa

SEQ ID NO: 4063737 - DNA, 17 bp, Homo sapiens
tttatgttttgtttctg

SEQ ID NO: 4063738 - DNA, 18 bp, Homo sapiens
tttatgttttgtttctga

SEQ ID NO: 4063739 - DNA, 20 bp, Homo sapiens
tttatgttttgtttctgaaa

SEQ ID NO: 4063740 - DNA, 14 bp, Homo sapiens
tttatgtttttggt

SEQ ID NO: 4063741 - DNA, 19 bp, Homo sapiens
tttattaaataaaatcaat

SEQ ID NO: 4063742 - DNA, 15 bp, Homo sapiens
tttattaaatacaaa

SEQ ID NO: 4063743 - DNA, 18 bp, Homo sapiens
tttattaacaaattatgt

SEQ ID NO: 4063744 - DNA, 16 bp, Homo sapiens
tttattaatatttgtg

SEQ ID NO: 4063745 - DNA, 21 bp, Homo sapiens
tttattaatgcctctcccgca

SEQ ID NO: 4063746 - DNA, 12 bp, Homo sapiens
tttattaccccc

SEQ ID NO: 4063747 - DNA, 14 bp, Homo sapiens
tttattacctctga

SEQ ID NO: 4063748 - DNA, 21 bp, Homo sapiens
tttattactgtccctatctat

SEQ ID NO: 4063749 - DNA, 19 bp, Homo sapiens
tttattataaactgtatgc

SEQ ID NO: 4063750 - DNA, 16 bp, Homo sapiens
tttattatttttacct

SEQ ID NO: 4063751 - DNA, 11 bp, Homo sapiens
tttattcacat

SEQ ID NO: 4063752 - DNA, 17 bp, Homo sapiens
tttattcagtaaacaac

SEQ ID NO: 4063753 - DNA, 13 bp, Homo sapiens
tttattccagagc

SEQ ID NO: 4063754 - DNA, 14 bp, Homo sapiens
tttattctcatttg

SEQ ID NO: 4063755 - DNA, 14 bp, Homo sapiens
tttattcttccaga

SEQ ID NO: 4063756 - DNA, 15 bp, Homo sapiens
tttattgacacagaa

SEQ ID NO: 4063757 - DNA, 14 bp, Homo sapiens
tttattgagaattt

SEQ ID NO: 4063758 - DNA, 21 bp, Homo sapiens
tttattgagtacctactgtgt

SEQ ID NO: 4063759 - DNA, 23 bp, Homo sapiens
tttattgctagtatttgaattaa

SEQ ID NO: 4063760 - DNA, 17 bp, Homo sapiens
tttattgtgtttttaat

SEQ ID NO: 4063761 - DNA, 18 bp, Homo sapiens
tttatttaattaaatgta

SEQ ID NO: 4063762 - DNA, 11 bp, Homo sapiens
tttatttacta

SEQ ID NO: 4063763 - DNA, 22 bp, Homo sapiens
tttatttatggaattaaccatt

SEQ ID NO: 4063764 - DNA, 15 bp, Homo sapiens
tttatttattttatc

SEQ ID NO: 4063765 - DNA, 19 bp, Homo sapiens
tttatttcaataaatcttt

SEQ ID NO: 4063766 - DNA, 20 bp, Homo sapiens
tttatttccactaaaaatat

SEQ ID NO: 4063767 - DNA, 13 bp, Homo sapiens
tttatttctcctt

SEQ ID NO: 4063768 - DNA, 16 bp, Homo sapiens
tttatttctccttttg

SEQ ID NO: 4063769 - DNA, 19 bp, Homo sapiens
tttattttacagctcatta

SEQ ID NO: 4063770 - DNA, 14 bp, Homo sapiens
tttattttactatt

SEQ ID NO: 4063771 - DNA, 11 bp, Homo sapiens
tttattttctt

SEQ ID NO: 4063772 - DNA, 15 bp, Homo sapiens
tttgcacctgtcccc

SEQ ID NO: 4063773 - DNA, 12 bp, Homo sapiens
tttgcactgagg

SEQ ID NO: 4063774 - DNA, 16 bp, Homo sapiens
tttgcactgagggcca

SEQ ID NO: 4063775 - DNA, 17 bp, Homo sapiens
tttgcactgagggccac

SEQ ID NO: 4063776 - DNA, 18 bp, Homo sapiens
tttgcactgatatatcat

SEQ ID NO: 4063777 - DNA, 13 bp, Homo sapiens
tttgcacttttct

SEQ ID NO: 4063778 - DNA, 18 bp, Homo sapiens
tttgcagatttatttagt

SEQ ID NO: 4063779 - DNA, 9 bp, Homo sapiens
tttgcagta

SEQ ID NO: 4063780 - DNA, 14 bp, Homo sapiens
tttgcagtaactgt

SEQ ID NO: 4063781 - DNA, 21 bp, Homo sapiens
tttgcagtagagtcatctcca

SEQ ID NO: 4063782 - DNA, 20 bp, Homo sapiens
tttgcagttggactctcagg

SEQ ID NO: 4063783 - DNA, 23 bp, Homo sapiens
tttgcatagtaccaatcatttta

SEQ ID NO: 4063784 - DNA, 24 bp, Homo sapiens
tttgcatattttgagaaactgctg

SEQ ID NO: 4063785 - DNA, 22 bp, Homo sapiens
tttgcatggctccagaaatgtc

SEQ ID NO: 4063786 - DNA, 17 bp, Homo sapiens
tttgcattaaattcaca

SEQ ID NO: 4063787 - DNA, 18 bp, Homo sapiens
tttgcattaaattcacaa

SEQ ID NO: 4063788 - DNA, 21 bp, Homo sapiens
tttgcattaaattcacaaact

SEQ ID NO: 4063789 - DNA, 22 bp, Homo sapiens
tttgcattaaattcacaaactt

SEQ ID NO: 4063790 - DNA, 13 bp, Homo sapiens
tttgcattccaga

SEQ ID NO: 4063791 - DNA, 14 bp, Homo sapiens
tttgcattccagaa

SEQ ID NO: 4063792 - DNA, 23 bp, Homo sapiens
tttgcattgaggaaatattaatt

SEQ ID NO: 4063793 - DNA, 16 bp, Homo sapiens
tttgccacagcttttg

SEQ ID NO: 4063794 - DNA, 18 bp, Homo sapiens
tttgccagttttccctgg

SEQ ID NO: 4063795 - DNA, 19 bp, Homo sapiens
tttgccagttttccctgga

SEQ ID NO: 4063796 - DNA, 14 bp, Homo sapiens
tttgccatgggctt

SEQ ID NO: 4063797 - DNA, 20 bp, Homo sapiens
tttgccatgggcttcactgt

SEQ ID NO: 4063798 - DNA, 18 bp, Homo sapiens
tttgccggatacaaactg

SEQ ID NO: 4063799 - DNA, 15 bp, Homo sapiens
tttgcctaaaatata

SEQ ID NO: 4063800 - DNA, 16 bp, Homo sapiens
tttgcctcttctttgt

SEQ ID NO: 4063801 - DNA, 17 bp, Homo sapiens
tttgccttcctttctcc

SEQ ID NO: 4063802 - DNA, 20 bp, Homo sapiens
tttgccttgcagccacatgg

SEQ ID NO: 4063803 - DNA, 22 bp, Homo sapiens
tttgcctttctgggagcagaaa

SEQ ID NO: 4063804 - DNA, 19 bp, Homo sapiens
tttgctaattaaaaagtta

SEQ ID NO: 4063805 - DNA, 19 bp, Homo sapiens
tttgctagactctagacaa

SEQ ID NO: 4063806 - DNA, 20 bp, Homo sapiens
tttgctagcagtaaaagatg

SEQ ID NO: 4063807 - DNA, 14 bp, Homo sapiens
tttgctataatcat

SEQ ID NO: 4063808 - DNA, 16 bp, Homo sapiens
tttgctataatcatta

SEQ ID NO: 4063809 - DNA, 20 bp, Homo sapiens
tttgctattgacaagtcatt

SEQ ID NO: 4063810 - DNA, 17 bp, Homo sapiens
tttgctcttgtcccacg

SEQ ID NO: 4063811 - DNA, 23 bp, Homo sapiens
tttgctcttgtttttattaattt

SEQ ID NO: 4063812 - DNA, 17 bp, Homo sapiens
tttgctcttttaagcag

SEQ ID NO: 4063813 - DNA, 19 bp, Homo sapiens
tttgctcttttaagcagtc

SEQ ID NO: 4063814 - DNA, 14 bp, Homo sapiens
tttgctgccccagc

SEQ ID NO: 4063815 - DNA, 12 bp, Homo sapiens
tttgctgcctta

SEQ ID NO: 4063816 - DNA, 21 bp, Homo sapiens
tttgctgtgaggctgtcctgt

SEQ ID NO: 4063817 - DNA, 14 bp, Homo sapiens
tttgcttaaacaaa

SEQ ID NO: 4063818 - DNA, 12 bp, Homo sapiens
tttgcttcatag

SEQ ID NO: 4063819 - DNA, 19 bp, Homo sapiens
tttgcttgctcatatgcat

SEQ ID NO: 4063820 - DNA, 23 bp, Homo sapiens
tttgcttgctttgaagtagctct

SEQ ID NO: 4063821 - DNA, 20 bp, Homo sapiens
tttggaaagtacactctgct

SEQ ID NO: 4063822 - DNA, 14 bp, Homo sapiens
tttggaaccttgtt

SEQ ID NO: 4063823 - DNA, 13 bp, Homo sapiens
tttggaataaagt

SEQ ID NO: 4063824 - DNA, 23 bp, Homo sapiens
tttggacagctgataaatttaat

SEQ ID NO: 4063825 - DNA, 13 bp, Homo sapiens
tttggacagttta

SEQ ID NO: 4063826 - DNA, 20 bp, Homo sapiens
tttggaccaatagcccacag

SEQ ID NO: 4063827 - DNA, 18 bp, Homo sapiens
tttggactccatctctca

SEQ ID NO: 4063828 - DNA, 14 bp, Homo sapiens
tttggactctgcct

SEQ ID NO: 4063829 - DNA, 19 bp, Homo sapiens
tttggagaacgccagtctc

SEQ ID NO: 4063830 - DNA, 18 bp, Homo sapiens
tttggagagtttcctgaa

SEQ ID NO: 4063831 - DNA, 18 bp, Homo sapiens
tttggagcactctgagtt

SEQ ID NO: 4063832 - DNA, 18 bp, Homo sapiens
tttggagggaagctcttg

SEQ ID NO: 4063833 - DNA, 21 bp, Homo sapiens
tttggatgggagtgagacaga

SEQ ID NO: 4063834 - DNA, 13 bp, Homo sapiens
tttggatgtaatt

SEQ ID NO: 4063835 - DNA, 15 bp, Homo sapiens
tttggatgtaattta

SEQ ID NO: 4063836 - DNA, 14 bp, Homo sapiens
tttggattgtatat

SEQ ID NO: 4063837 - DNA, 14 bp, Homo sapiens
tttggctcctgccc

SEQ ID NO: 4063838 - DNA, 15 bp, Homo sapiens
tttggctcctgccca

SEQ ID NO: 4063839 - DNA, 20 bp, Homo sapiens
tttggctgacttcatctggg

SEQ ID NO: 4063840 - DNA, 22 bp, Homo sapiens
tttggcttttcttatttaaaat

SEQ ID NO: 4063841 - DNA, 19 bp, Homo sapiens
tttgggaaagatggataaa

SEQ ID NO: 4063842 - DNA, 23 bp, Homo sapiens
tttgggaaagatggataaactga

SEQ ID NO: 4063843 - DNA, 12 bp, Homo sapiens
tttgggaagaat

SEQ ID NO: 4063844 - DNA, 20 bp, Homo sapiens
tttgggaagtgaagactgga

SEQ ID NO: 4063845 - DNA, 18 bp, Homo sapiens
tttgggatttaatttcca

SEQ ID NO: 4063846 - DNA, 17 bp, Homo sapiens
tttggggaaacctagag

SEQ ID NO: 4063847 - DNA, 16 bp, Homo sapiens
tttggggaaatgtgga

SEQ ID NO: 4063848 - DNA, 15 bp, Homo sapiens
tttggggagggaggg

SEQ ID NO: 4063849 - DNA, 22 bp, Homo sapiens
tttggggagggaggggaaatgt

SEQ ID NO: 4063850 - DNA, 18 bp, Homo sapiens
tttggggcagaaaggact

SEQ ID NO: 4063851 - DNA, 15 bp, Homo sapiens
tttggtaataacaaa

SEQ ID NO: 4063852 - DNA, 23 bp, Homo sapiens
tttggtaataacaaacgtgtttt

SEQ ID NO: 4063853 - DNA, 23 bp, Homo sapiens
tttggtacttttgagtgtgtgtg

SEQ ID NO: 4063854 - DNA, 14 bp, Homo sapiens
tttggtagattaaa

SEQ ID NO: 4063855 - DNA, 16 bp, Homo sapiens
tttggtcgaggagtaa

SEQ ID NO: 4063856 - DNA, 19 bp, Homo sapiens
tttggtcgaggagtaacaa

SEQ ID NO: 4063857 - DNA, 15 bp, Homo sapiens
tttggtctgccagaa

SEQ ID NO: 4063858 - DNA, 13 bp, Homo sapiens
tttggtctgtgtt

SEQ ID NO: 4063859 - DNA, 22 bp, Homo sapiens
tttggtctgtgttcaatccaga

SEQ ID NO: 4063860 - DNA, 20 bp, Homo sapiens
tttggttcattaattctata

SEQ ID NO: 4063861 - DNA, 17 bp, Homo sapiens
tttggttctctccagga

SEQ ID NO: 4063862 - DNA, 19 bp, Homo sapiens
tttggtttatttttgtaat

SEQ ID NO: 4063863 - DNA, 16 bp, Homo sapiens
tttggtttggttttta

SEQ ID NO: 4063864 - DNA, 22 bp, Homo sapiens
tttgtaaagttgcctttatttg

SEQ ID NO: 4063865 - DNA, 15 bp, Homo sapiens
tttgtaaatctgcca

SEQ ID NO: 4063866 - DNA, 17 bp, Homo sapiens
tttgtaaatctgccaca

SEQ ID NO: 4063867 - DNA, 12 bp, Homo sapiens
tttgtaaatgat

SEQ ID NO: 4063868 - DNA, 21 bp, Homo sapiens
tttgtaacccagattttgctg

SEQ ID NO: 4063869 - DNA, 18 bp, Homo sapiens
tttgtaacctcagctctg

SEQ ID NO: 4063870 - DNA, 21 bp, Homo sapiens
tttgtaagagtgtagaagcat

SEQ ID NO: 4063871 - DNA, 23 bp, Homo sapiens
tttgtaagagtgtagaagcattc

SEQ ID NO: 4063872 - DNA, 18 bp, Homo sapiens
tttgtaatgtgtgaaaaa

SEQ ID NO: 4063873 - DNA, 18 bp, Homo sapiens
tttgtaattgcttacatt

SEQ ID NO: 4063874 - DNA, 13 bp, Homo sapiens
acctctctcagag

SEQ ID NO: 4063875 - DNA, 14 bp, Homo sapiens
acctctctgtagtt

SEQ ID NO: 4063876 - DNA, 19 bp, Homo sapiens
acctctctgtcccttgctg

SEQ ID NO: 4063877 - DNA, 22 bp, Homo sapiens
acctctcttatagaatatttat

SEQ ID NO: 4063878 - DNA, 15 bp, Homo sapiens
acctctgatacctca

SEQ ID NO: 4063879 - DNA, 16 bp, Homo sapiens
acctctggactggcta

SEQ ID NO: 4063880 - DNA, 15 bp, Homo sapiens
acctctgtctcatcc

SEQ ID NO: 4063881 - DNA, 16 bp, Homo sapiens
acctctgtctcatcct

SEQ ID NO: 4063882 - DNA, 20 bp, Homo sapiens
acctctgtctcatcctcctg

SEQ ID NO: 4063883 - DNA, 23 bp, Homo sapiens
acctctgtctcatcctcctggaa

SEQ ID NO: 4063884 - DNA, 22 bp, Homo sapiens
acctctgttaaggttgaacttt

SEQ ID NO: 4063885 - DNA, 13 bp, Homo sapiens
acctcttccccag

SEQ ID NO: 4063886 - DNA, 14 bp, Homo sapiens
acctcttctggctc

SEQ ID NO: 4063887 - DNA, 16 bp, Homo sapiens
acctcttctggctcaa

SEQ ID NO: 4063888 - DNA, 12 bp, Homo sapiens
acctcttgctgt

SEQ ID NO: 4063889 - DNA, 20 bp, Homo sapiens
acctcttgctgtctctgctc

SEQ ID NO: 4063890 - DNA, 13 bp, Homo sapiens
acctctttttcct

SEQ ID NO: 4063891 - DNA, 14 bp, Homo sapiens
acctctttttcctc

SEQ ID NO: 4063892 - DNA, 15 bp, Homo sapiens
acctctttttcctcc

SEQ ID NO: 4063893 - DNA, 18 bp, Homo sapiens
acctctttttcctcctgg

SEQ ID NO: 4063894 - DNA, 13 bp, Homo sapiens
acctgaagactga

SEQ ID NO: 4063895 - DNA, 21 bp, Homo sapiens
acctgaagtttttttgctgct

SEQ ID NO: 4063896 - DNA, 16 bp, Homo sapiens
acctgacaagcactgc

SEQ ID NO: 4063897 - DNA, 16 bp, Homo sapiens
acctgacctcttgctg

SEQ ID NO: 4063898 - DNA, 20 bp, Homo sapiens
acctgacctcttgctgtctc

SEQ ID NO: 4063899 - DNA, 22 bp, Homo sapiens
acctgagactgtcggagaggct

SEQ ID NO: 4063900 - DNA, 19 bp, Homo sapiens
acctgagctattttcctct

SEQ ID NO: 4063901 - DNA, 21 bp, Homo sapiens
acctgagctattttcctctgg

SEQ ID NO: 4063902 - DNA, 12 bp, Homo sapiens
acctgagctggc

SEQ ID NO: 4063903 - DNA, 18 bp, Homo sapiens
acctgagctggccaggcc

SEQ ID NO: 4063904 - DNA, 21 bp, Homo sapiens
acctgaggccaggacgtctgg

SEQ ID NO: 4063905 - DNA, 20 bp, Homo sapiens
acctgatcctggaggcccag

SEQ ID NO: 4063906 - DNA, 22 bp, Homo sapiens
acctgatggaagtaaagcctca

SEQ ID NO: 4063907 - DNA, 19 bp, Homo sapiens
acctgatgtacctgatgct

SEQ ID NO: 4063908 - DNA, 15 bp, Homo sapiens
acctgcaaaaaatag

SEQ ID NO: 4063909 - DNA, 23 bp, Homo sapiens
acctgcactggggagcccgtctc

SEQ ID NO: 4063910 - DNA, 13 bp, Homo sapiens
acctgcagctccc

SEQ ID NO: 4063911 - DNA, 23 bp, Homo sapiens
acctgcaggctgagccactctct

SEQ ID NO: 4063912 - DNA, 17 bp, Homo sapiens
acctgcatctggggccc

SEQ ID NO: 4063913 - DNA, 23 bp, Homo sapiens
acctgcatttttcactttgctct

SEQ ID NO: 4063914 - DNA, 18 bp, Homo sapiens
acctgccaggcaggggtg

SEQ ID NO: 4063915 - DNA, 16 bp, Homo sapiens
acctgccatgccagga

SEQ ID NO: 4063916 - DNA, 19 bp, Homo sapiens
acctgccatgccaggaacc

SEQ ID NO: 4063917 - DNA, 14 bp, Homo sapiens
acctgccctggaac

SEQ ID NO: 4063918 - DNA, 17 bp, Homo sapiens
acctgcctcctgcctgc

SEQ ID NO: 4063919 - DNA, 20 bp, Homo sapiens
acctgcctgccccacacgga

SEQ ID NO: 4063920 - DNA, 22 bp, Homo sapiens
acctgcctgccccacacggact

SEQ ID NO: 4063921 - DNA, 13 bp, Homo sapiens
acctgccttggcc

SEQ ID NO: 4063922 - DNA, 15 bp, Homo sapiens
acctgctatcagcag

SEQ ID NO: 4063923 - DNA, 12 bp, Homo sapiens
acctgctccaga

SEQ ID NO: 4063924 - DNA, 22 bp, Homo sapiens
acctgctccagaagatgccagc

SEQ ID NO: 4063925 - DNA, 23 bp, Homo sapiens
acctgctccagaagatgccagct

SEQ ID NO: 4063926 - DNA, 22 bp, Homo sapiens
acctgctccgctgctccttggc

SEQ ID NO: 4063927 - DNA, 13 bp, Homo sapiens
acctgctctgtcc

SEQ ID NO: 4063928 - DNA, 17 bp, Homo sapiens
acctgctctgtccccaa

SEQ ID NO: 4063929 - DNA, 16 bp, Homo sapiens
acctgctgccccagct

SEQ ID NO: 4063930 - DNA, 18 bp, Homo sapiens
acctgcttcacgttggcc

SEQ ID NO: 4063931 - DNA, 17 bp, Homo sapiens
acctggaaaaattccag

SEQ ID NO: 4063932 - DNA, 15 bp, Homo sapiens
acctggcaaaggacc

SEQ ID NO: 4063933 - DNA, 16 bp, Homo sapiens
acctggcaaaggaccc

SEQ ID NO: 4063934 - DNA, 14 bp, Homo sapiens
acctggcagacttg

SEQ ID NO: 4063935 - DNA, 14 bp, Homo sapiens
acctggcagctctg

SEQ ID NO: 4063936 - DNA, 14 bp, Homo sapiens
acctggctgagcag

SEQ ID NO: 4063937 - DNA, 22 bp, Homo sapiens
acctggctgaggttcctctgcc

SEQ ID NO: 4063938 - DNA, 16 bp, Homo sapiens
acctggctgccatact

SEQ ID NO: 4063939 - DNA, 16 bp, Homo sapiens
acctggcttttacttt

SEQ ID NO: 4063940 - DNA, 20 bp, Homo sapiens
acctgggatgaggggtgctg

SEQ ID NO: 4063941 - DNA, 23 bp, Homo sapiens
acctgggtccccagcccttcctc

SEQ ID NO: 4063942 - DNA, 11 bp, Homo sapiens
acctggtgctg

SEQ ID NO: 4063943 - DNA, 20 bp, Homo sapiens
acctgtaacttttgtaaata

SEQ ID NO: 4063944 - DNA, 15 bp, Homo sapiens
acctgtagatgcaga

SEQ ID NO: 4063945 - DNA, 20 bp, Homo sapiens
acctgtagatgcagaaaaag

SEQ ID NO: 4063946 - DNA, 12 bp, Homo sapiens
acctgtattttt

SEQ ID NO: 4063947 - DNA, 14 bp, Homo sapiens
acctgtatttttgt

SEQ ID NO: 4063948 - DNA, 16 bp, Homo sapiens
acctgtatttttgtta

SEQ ID NO: 4063949 - DNA, 17 bp, Homo sapiens
acctgtatttttgttag

SEQ ID NO: 4063950 - DNA, 13 bp, Homo sapiens
acctgtcacattg

SEQ ID NO: 4063951 - DNA, 23 bp, Homo sapiens
acctgtctaggtctcctcagggt

SEQ ID NO: 4063952 - DNA, 14 bp, Homo sapiens
acctgtctcagcct

SEQ ID NO: 4063953 - DNA, 11 bp, Homo sapiens
acctgtctgct

SEQ ID NO: 4063954 - DNA, 17 bp, Homo sapiens
acctgtcttccaaggag

SEQ ID NO: 4063955 - DNA, 17 bp, Homo sapiens
acctgtcttttgggagt

SEQ ID NO: 4063956 - DNA, 13 bp, Homo sapiens
acctgtgaccagc

SEQ ID NO: 4063957 - DNA, 17 bp, Homo sapiens
acctgtgagcccagctg

SEQ ID NO: 4063958 - DNA, 17 bp, Homo sapiens
acctgtgagtaaatatt

SEQ ID NO: 4063959 - DNA, 19 bp, Homo sapiens
acctgtgagtttaaagcaa

SEQ ID NO: 4063960 - DNA, 12 bp, Homo sapiens
acctgtgggtgt

SEQ ID NO: 4063961 - DNA, 16 bp, Homo sapiens
acctgtgtacataact

SEQ ID NO: 4063962 - DNA, 13 bp, Homo sapiens
acctgtgtgcttg

SEQ ID NO: 4063963 - DNA, 22 bp, Homo sapiens
acctgtgtggtactctgaaaca

SEQ ID NO: 4063964 - DNA, 17 bp, Homo sapiens
acctgttaaaattatac

SEQ ID NO: 4063965 - DNA, 19 bp, Homo sapiens
acctgttatatatctcttt

SEQ ID NO: 4063966 - DNA, 17 bp, Homo sapiens
acctgttatgtatgaag

SEQ ID NO: 4063967 - DNA, 15 bp, Homo sapiens
acctgttcacagaaa

SEQ ID NO: 4063968 - DNA, 17 bp, Homo sapiens
acctgttcacagaaaaa

SEQ ID NO: 4063969 - DNA, 22 bp, Homo sapiens
acctgttcacagaaaaagcatg

SEQ ID NO: 4063970 - DNA, 15 bp, Homo sapiens
acctgttgctgtgtt

SEQ ID NO: 4063971 - DNA, 19 bp, Homo sapiens
acctgttgctgtgtttaat

SEQ ID NO: 4063972 - DNA, 22 bp, Homo sapiens
acctgttgctgtgtttaatttg

SEQ ID NO: 4063973 - DNA, 15 bp, Homo sapiens
acctgtttctctgcc

SEQ ID NO: 4063974 - DNA, 18 bp, Homo sapiens
acctgtttttaagctgtt

SEQ ID NO: 4063975 - DNA, 17 bp, Homo sapiens
acctgtttttttttcat

SEQ ID NO: 4063976 - DNA, 14 bp, Homo sapiens
accttagaatacag

SEQ ID NO: 4063977 - DNA, 14 bp, Homo sapiens
acggccacccgccc

SEQ ID NO: 4063978 - DNA, 22 bp, Homo sapiens
acggccatctctttgtacagga

SEQ ID NO: 4063979 - DNA, 13 bp, Homo sapiens
acggcctcctttc

SEQ ID NO: 4063980 - DNA, 18 bp, Homo sapiens
acggcggccaggcacagg

SEQ ID NO: 4063981 - DNA, 13 bp, Homo sapiens
acggctcctcaga

SEQ ID NO: 4063982 - DNA, 18 bp, Homo sapiens
acggctcgatttctccag

SEQ ID NO: 4063983 - DNA, 19 bp, Homo sapiens
acggctcgatttctccagg

SEQ ID NO: 4063984 - DNA, 16 bp, Homo sapiens
acgggaggctgggcac

SEQ ID NO: 4063985 - DNA, 22 bp, Homo sapiens
acgggctcatgcacccctgagc

SEQ ID NO: 4063986 - DNA, 18 bp, Homo sapiens
acggtgcccatcctgcca

SEQ ID NO: 4063987 - DNA, 19 bp, Homo sapiens
acggtgggcatttgtgagg

SEQ ID NO: 4063988 - DNA, 23 bp, Homo sapiens
acgtcaggccctgactcctctgg

SEQ ID NO: 4063989 - DNA, 21 bp, Homo sapiens
acgtccaggttcaacccacag

SEQ ID NO: 4063990 - DNA, 21 bp, Homo sapiens
acgtcccagcatccctggagc

SEQ ID NO: 4063991 - DNA, 14 bp, Homo sapiens
acgtcctgcctggc

SEQ ID NO: 4063992 - DNA, 16 bp, Homo sapiens
acgtctggccaggcac

SEQ ID NO: 4063993 - DNA, 14 bp, Homo sapiens
acgtctggggtgtg

SEQ ID NO: 4063994 - DNA, 12 bp, Homo sapiens
acgtcttctaaa

SEQ ID NO: 4063995 - DNA, 18 bp, Homo sapiens
acgtcttcttgctgcagc

SEQ ID NO: 4063996 - DNA, 19 bp, Homo sapiens
acgtcttcttgctgcagcc

SEQ ID NO: 4063997 - DNA, 17 bp, Homo sapiens
acgtgcaaggactcccg

SEQ ID NO: 4063998 - DNA, 16 bp, Homo sapiens
acgtggaacctctgtc

SEQ ID NO: 4063999 - DNA, 17 bp, Homo sapiens
acgtggaacctctgtct

SEQ ID NO: 4064000 - DNA, 18 bp, Homo sapiens
acgtggaacctctgtctc

SEQ ID NO: 4064001 - DNA, 20 bp, Homo sapiens
acgtggaacctctgtctcat

SEQ ID NO: 4064002 - DNA, 16 bp, Homo sapiens
acgtggagagctggtg

SEQ ID NO: 4064003 - DNA, 18 bp, Homo sapiens
acgtggagagctggtgcc

SEQ ID NO: 4064004 - DNA, 19 bp, Homo sapiens
acgtggagagctggtgccc

SEQ ID NO: 4064005 - DNA, 22 bp, Homo sapiens
acgtggagcggggtatgaagag

SEQ ID NO: 4064006 - DNA, 17 bp, Homo sapiens
acgtggctcagccagca

SEQ ID NO: 4064007 - DNA, 19 bp, Homo sapiens
acgtggctcagccagcact

SEQ ID NO: 4064008 - DNA, 15 bp, Homo sapiens
acgtggtcactgtgc

SEQ ID NO: 4064009 - DNA, 21 bp, Homo sapiens
acgtggtcactgtgcactgcc

SEQ ID NO: 4064010 - DNA, 13 bp, Homo sapiens
acgtgtcttccac

SEQ ID NO: 4064011 - DNA, 19 bp, Homo sapiens
acgtgtcttccactttgca

SEQ ID NO: 4064012 - DNA, 22 bp, Homo sapiens
acgtgtgtaaatatgtacattt

SEQ ID NO: 4064013 - DNA, 13 bp, Homo sapiens
acgttcataacca

SEQ ID NO: 4064014 - DNA, 13 bp, Homo sapiens
acgttccacagtt

SEQ ID NO: 4064015 - DNA, 18 bp, Homo sapiens
acgttcctattgtcatta

SEQ ID NO: 4064016 - DNA, 13 bp, Homo sapiens
acgttgctcccca

SEQ ID NO: 4064017 - DNA, 23 bp, Homo sapiens
acgttggacttttcgttaacatt

SEQ ID NO: 4064018 - DNA, 16 bp, Homo sapiens
acgttttattgtgttt

SEQ ID NO: 4064019 - DNA, 20 bp, Homo sapiens
acgtttttaatataaagcct

SEQ ID NO: 4064020 - DNA, 21 bp, Homo sapiens
actaaaaatattgtttctgca

SEQ ID NO: 4064021 - DNA, 15 bp, Homo sapiens
actaaaagcaaatct

SEQ ID NO: 4064022 - DNA, 18 bp, Homo sapiens
actaaacatatgatttca

SEQ ID NO: 4064023 - DNA, 16 bp, Homo sapiens
actaaagatccaagaa

SEQ ID NO: 4064024 - DNA, 11 bp, Homo sapiens
actaaagcaaa

SEQ ID NO: 4064025 - DNA, 17 bp, Homo sapiens
actaaagcagtagaaat

SEQ ID NO: 4064026 - DNA, 16 bp, Homo sapiens
actaaagctatgttac

SEQ ID NO: 4064027 - DNA, 23 bp, Homo sapiens
actaaataatgaataaactgaat

SEQ ID NO: 4064028 - DNA, 22 bp, Homo sapiens
actaaatgagattatatgtgga

SEQ ID NO: 4064029 - DNA, 15 bp, Homo sapiens
actaaatgagctcct

SEQ ID NO: 4064030 - DNA, 13 bp, Homo sapiens
actaaatgttcta

SEQ ID NO: 4064031 - DNA, 19 bp, Homo sapiens
actaaatttaaatttaaag

SEQ ID NO: 4064032 - DNA, 13 bp, Homo sapiens
actaacaagaatg

SEQ ID NO: 4064033 - DNA, 14 bp, Homo sapiens
actaacaagaatgt

SEQ ID NO: 4064034 - DNA, 15 bp, Homo sapiens
actaacatataatgt

SEQ ID NO: 4064035 - DNA, 23 bp, Homo sapiens
actaacatttcccccgagctctt

SEQ ID NO: 4064036 - DNA, 15 bp, Homo sapiens
actaaccaagctgag

SEQ ID NO: 4064037 - DNA, 22 bp, Homo sapiens
actaaccaagctgagtttccta

SEQ ID NO: 4064038 - DNA, 15 bp, Homo sapiens
actaactatgcatgg

SEQ ID NO: 4064039 - DNA, 14 bp, Homo sapiens
actaagaaaagata

SEQ ID NO: 4064040 - DNA, 18 bp, Homo sapiens
actaagaccctggtctga

SEQ ID NO: 4064041 - DNA, 20 bp, Homo sapiens
actaagaccctggtctgagg

SEQ ID NO: 4064042 - DNA, 17 bp, Homo sapiens
actaagccaggcctggc

SEQ ID NO: 4064043 - DNA, 16 bp, Homo sapiens
actaagccctgtcgag

SEQ ID NO: 4064044 - DNA, 19 bp, Homo sapiens
actaagcctacctgctctc

SEQ ID NO: 4064045 - DNA, 16 bp, Homo sapiens
actaagctctttgaga

SEQ ID NO: 4064046 - DNA, 18 bp, Homo sapiens
actaagttatagtatatc

SEQ ID NO: 4064047 - DNA, 13 bp, Homo sapiens
actaagttcacat

SEQ ID NO: 4064048 - DNA, 22 bp, Homo sapiens
actaataaaagcataaatgcaa

SEQ ID NO: 4064049 - DNA, 17 bp, Homo sapiens
actaatatagtagattt

SEQ ID NO: 4064050 - DNA, 13 bp, Homo sapiens
actaatgatgttt

SEQ ID NO: 4064051 - DNA, 13 bp, Homo sapiens
actaatgcagcca

SEQ ID NO: 4064052 - DNA, 12 bp, Homo sapiens
actaatgtaaaa

SEQ ID NO: 4064053 - DNA, 20 bp, Homo sapiens
actaattagggtacatttat

SEQ ID NO: 4064054 - DNA, 14 bp, Homo sapiens
actaattctcacat

SEQ ID NO: 4064055 - DNA, 14 bp, Homo sapiens
actaatttcaaaat

SEQ ID NO: 4064056 - DNA, 23 bp, Homo sapiens
actaattttacacattagatttt

SEQ ID NO: 4064057 - DNA, 15 bp, Homo sapiens
actacaaaatacaat

SEQ ID NO: 4064058 - DNA, 16 bp, Homo sapiens
actacaaaatttgaaa

SEQ ID NO: 4064059 - DNA, 23 bp, Homo sapiens
actacaaagcttctatcccagga

SEQ ID NO: 4064060 - DNA, 13 bp, Homo sapiens
actacaaatcaag

SEQ ID NO: 4064061 - DNA, 18 bp, Homo sapiens
actacacatttttaaatt

SEQ ID NO: 4064062 - DNA, 14 bp, Homo sapiens
actacactgaggag

SEQ ID NO: 4064063 - DNA, 16 bp, Homo sapiens
actacactgaggagag

SEQ ID NO: 4064064 - DNA, 14 bp, Homo sapiens
actacagagcagct

SEQ ID NO: 4064065 - DNA, 17 bp, Homo sapiens
actacataaactgactt

SEQ ID NO: 4064066 - DNA, 20 bp, Homo sapiens
actacatgagaacaaacaga

SEQ ID NO: 4064067 - DNA, 13 bp, Homo sapiens
actacattcattt

SEQ ID NO: 4064068 - DNA, 12 bp, Homo sapiens
actaccccacac

SEQ ID NO: 4064069 - DNA, 23 bp, Homo sapiens
actacccccttttcagctgagcc

SEQ ID NO: 4064070 - DNA, 22 bp, Homo sapiens
actaccctctcactagtgccaa

SEQ ID NO: 4064071 - DNA, 13 bp, Homo sapiens
actacctgtcaag

SEQ ID NO: 4064072 - DNA, 17 bp, Homo sapiens
actactgaaacagattt

SEQ ID NO: 4064073 - DNA, 18 bp, Homo sapiens
actactgacatgtggggc

SEQ ID NO: 4064074 - DNA, 13 bp, Homo sapiens
actactgggtgtc

SEQ ID NO: 4064075 - DNA, 14 bp, Homo sapiens
actactgggtgtca

SEQ ID NO: 4064076 - DNA, 15 bp, Homo sapiens
actactgtgttcctg

SEQ ID NO: 4064077 - DNA, 18 bp, Homo sapiens
actactgtgttcctggca

SEQ ID NO: 4064078 - DNA, 21 bp, Homo sapiens
actactgttaggaacagcagt

SEQ ID NO: 4064079 - DNA, 17 bp, Homo sapiens
actacttagcatcctaa

SEQ ID NO: 4064080 - DNA, 20 bp, Homo sapiens
actactttaataaagaatta

SEQ ID NO: 4064081 - DNA, 13 bp, Homo sapiens
actactttgcctt

SEQ ID NO: 4064082 - DNA, 13 bp, Homo sapiens
actagaagaaaag

SEQ ID NO: 4064083 - DNA, 14 bp, Homo sapiens
actagaagaaaagc

SEQ ID NO: 4064084 - DNA, 15 bp, Homo sapiens
actagaagaaaagcc

SEQ ID NO: 4064085 - DNA, 19 bp, Homo sapiens
actagaagaaaagcccatt

SEQ ID NO: 4064086 - DNA, 14 bp, Homo sapiens
actagaagggccag

SEQ ID NO: 4064087 - DNA, 13 bp, Homo sapiens
actagaattctgt

SEQ ID NO: 4064088 - DNA, 13 bp, Homo sapiens
actagacacacaa

SEQ ID NO: 4064089 - DNA, 12 bp, Homo sapiens
actagagaaggg

SEQ ID NO: 4064090 - DNA, 21 bp, Homo sapiens
actagaggaaaccagtttggt

SEQ ID NO: 4064091 - DNA, 20 bp, Homo sapiens
actagagtctgaacagctgt

SEQ ID NO: 4064092 - DNA, 13 bp, Homo sapiens
actagatgatgga

SEQ ID NO: 4064093 - DNA, 21 bp, Homo sapiens
actagctgggactacaggtgc

SEQ ID NO: 4064094 - DNA, 14 bp, Homo sapiens
actaggctcagaga

SEQ ID NO: 4064095 - DNA, 22 bp, Homo sapiens
actaggctcttatgtgtgcctt

SEQ ID NO: 4064096 - DNA, 16 bp, Homo sapiens
actagggattcaggct

SEQ ID NO: 4064097 - DNA, 18 bp, Homo sapiens
actagggattcaggctgc

SEQ ID NO: 4064098 - DNA, 14 bp, Homo sapiens
actaggtaacttca

SEQ ID NO: 4064099 - DNA, 16 bp, Homo sapiens
actaggtaacttcata

SEQ ID NO: 4064100 - DNA, 18 bp, Homo sapiens
actaggtaacttcatatt

SEQ ID NO: 4064101 - DNA, 15 bp, Homo sapiens
actaggtttttgctt

SEQ ID NO: 4064102 - DNA, 20 bp, Homo sapiens
actagtacaaattataaaaa

SEQ ID NO: 4064103 - DNA, 19 bp, Homo sapiens
actagtagttcctgctaca

SEQ ID NO: 4064104 - DNA, 23 bp, Homo sapiens
actagtgacaagctcctggtctt

SEQ ID NO: 4064105 - DNA, 14 bp, Homo sapiens
actagtgacagctt

SEQ ID NO: 4064106 - DNA, 14 bp, Homo sapiens
actagtgtcaggcc

SEQ ID NO: 4064107 - DNA, 17 bp, Homo sapiens
actagtgtcaggccccc

SEQ ID NO: 4064108 - DNA, 17 bp, Homo sapiens
actagttttgtgccagc

SEQ ID NO: 4064109 - DNA, 12 bp, Homo sapiens
actataaagaga

SEQ ID NO: 4064110 - DNA, 18 bp, Homo sapiens
actataaaggttgacaat

SEQ ID NO: 4064111 - DNA, 12 bp, Homo sapiens
actataaataca

SEQ ID NO: 4064112 - DNA, 15 bp, Homo sapiens
actataaatacaaat

SEQ ID NO: 4064113 - DNA, 22 bp, Homo sapiens
actataacatatgtacataaat

SEQ ID NO: 4064114 - DNA, 11 bp, Homo sapiens
actataatgta

SEQ ID NO: 4064115 - DNA, 21 bp, Homo sapiens
actataatgtaagctctactg

SEQ ID NO: 4064116 - DNA, 12 bp, Homo sapiens
actataatttga

SEQ ID NO: 4064117 - DNA, 15 bp, Homo sapiens
actatacaacaaagg

SEQ ID NO: 4064118 - DNA, 18 bp, Homo sapiens
actatattgattgtcctt

SEQ ID NO: 4064119 - DNA, 19 bp, Homo sapiens
actatattgattgtccttt

SEQ ID NO: 4064120 - DNA, 23 bp, Homo sapiens
actatatttgggcctgctccaga

SEQ ID NO: 4064121 - DNA, 14 bp, Homo sapiens
actatcataaaatc

SEQ ID NO: 4064122 - DNA, 12 bp, Homo sapiens
actatcttcttc

SEQ ID NO: 4064123 - DNA, 13 bp, Homo sapiens
actatcttcttca

SEQ ID NO: 4064124 - DNA, 14 bp, Homo sapiens
actatctttctgat

SEQ ID NO: 4064125 - DNA, 15 bp, Homo sapiens
actatctttctgata

SEQ ID NO: 4064126 - DNA, 16 bp, Homo sapiens
actatctttctgataa

SEQ ID NO: 4064127 - DNA, 18 bp, Homo sapiens
actatgacagatatattt

SEQ ID NO: 4064128 - DNA, 15 bp, Homo sapiens
actatgactgctccc

SEQ ID NO: 4064129 - DNA, 16 bp, Homo sapiens
actatgcacaatttaa

SEQ ID NO: 4064130 - DNA, 22 bp, Homo sapiens
actatgcatggtgccccaggac

SEQ ID NO: 4064131 - DNA, 23 bp, Homo sapiens
actatgcatggtgccccaggacc

SEQ ID NO: 4064132 - DNA, 18 bp, Homo sapiens
actatggtatgctggcca

SEQ ID NO: 4064133 - DNA, 22 bp, Homo sapiens
actatggtatgctggccagcac

SEQ ID NO: 4064134 - DNA, 11 bp, Homo sapiens
actatgtaaac

SEQ ID NO: 4064135 - DNA, 12 bp, Homo sapiens
actatgtaaact

SEQ ID NO: 4064136 - DNA, 17 bp, Homo sapiens
actatgtgccagttcct

SEQ ID NO: 4064137 - DNA, 20 bp, Homo sapiens
actattaagcagtaaaaact

SEQ ID NO: 4064138 - DNA, 17 bp, Homo sapiens
actattccttttctgta

SEQ ID NO: 4064139 - DNA, 14 bp, Homo sapiens
actattggaaagta

SEQ ID NO: 4064140 - DNA, 13 bp, Homo sapiens
actattggcccta

SEQ ID NO: 4064141 - DNA, 16 bp, Homo sapiens
actatttaaacttata

SEQ ID NO: 4064142 - DNA, 22 bp, Homo sapiens
actatttctgggtcttttgcta

SEQ ID NO: 4064143 - DNA, 14 bp, Homo sapiens
actattttctacaa

SEQ ID NO: 4064144 - DNA, 14 bp, Homo sapiens
actattttcttttt

SEQ ID NO: 4064145 - DNA, 21 bp, Homo sapiens
actcaaatatgagtacaaatg

SEQ ID NO: 4064146 - DNA, 23 bp, Homo sapiens
actcaaatatgagtacaaatgcc

SEQ ID NO: 4064147 - DNA, 17 bp, Homo sapiens
actcaaatggggccaga

SEQ ID NO: 4064148 - DNA, 21 bp, Homo sapiens
actcaaatggggccagatcca

SEQ ID NO: 4064149 - DNA, 22 bp, Homo sapiens
actcaaatggggccagatccag

SEQ ID NO: 4064150 - DNA, 19 bp, Homo sapiens
actcaaattaatctttctt

SEQ ID NO: 4064151 - DNA, 20 bp, Homo sapiens
actcaacatgttactgacca

SEQ ID NO: 4064152 - DNA, 12 bp, Homo sapiens
actcaagcactg

SEQ ID NO: 4064153 - DNA, 17 bp, Homo sapiens
actcaaggactttgcag

SEQ ID NO: 4064154 - DNA, 12 bp, Homo sapiens
actcaataaatt

SEQ ID NO: 4064155 - DNA, 22 bp, Homo sapiens
actcaataaattgcaacatatt

SEQ ID NO: 4064156 - DNA, 19 bp, Homo sapiens
actcaatgtgtgccgagcc

SEQ ID NO: 4064157 - DNA, 22 bp, Homo sapiens
actcacacattcccccaccagc

SEQ ID NO: 4064158 - DNA, 19 bp, Homo sapiens
actcaccagtgtcccctcc

SEQ ID NO: 4064159 - DNA, 23 bp, Homo sapiens
actcaccagtgtcccctccactg

SEQ ID NO: 4064160 - DNA, 20 bp, Homo sapiens
actcacctaatgtttatgag

SEQ ID NO: 4064161 - DNA, 14 bp, Homo sapiens
actcactctgggct

SEQ ID NO: 4064162 - DNA, 15 bp, Homo sapiens
actcactctgggctg

SEQ ID NO: 4064163 - DNA, 15 bp, Homo sapiens
actcactgaagcctg

SEQ ID NO: 4064164 - DNA, 16 bp, Homo sapiens
actcactgaagcctgc

SEQ ID NO: 4064165 - DNA, 22 bp, Homo sapiens
actcagagaaaaatgctcccca

SEQ ID NO: 4064166 - DNA, 12 bp, Homo sapiens
actcagagcagt

SEQ ID NO: 4064167 - DNA, 12 bp, Homo sapiens
actcagatccag

SEQ ID NO: 4064168 - DNA, 16 bp, Homo sapiens
actcagatccagggac

SEQ ID NO: 4064169 - DNA, 14 bp, Homo sapiens
actcagccctgagg

SEQ ID NO: 4064170 - DNA, 15 bp, Homo sapiens
actcagcctgctgcc

SEQ ID NO: 4064171 - DNA, 18 bp, Homo sapiens
actcagctgtctgtggct

SEQ ID NO: 4064172 - DNA, 17 bp, Homo sapiens
actcagctttagttttt

SEQ ID NO: 4064173 - DNA, 18 bp, Homo sapiens
actcagggacagagccat

SEQ ID NO: 4064174 - DNA, 17 bp, Homo sapiens
actcagggcagcgccag

SEQ ID NO: 4064175 - DNA, 21 bp, Homo sapiens
actcagggcagcgccaggctg

SEQ ID NO: 4064176 - DNA, 19 bp, Homo sapiens
actcaggtgggccctctga

SEQ ID NO: 4064177 - DNA, 21 bp, Homo sapiens
actcaggttcttcagggccag

SEQ ID NO: 4064178 - DNA, 16 bp, Homo sapiens
actcagtgttagagaa

SEQ ID NO: 4064179 - DNA, 17 bp, Homo sapiens
actcagtgttagagaaa

SEQ ID NO: 4064180 - DNA, 21 bp, Homo sapiens
actcagtgttagagaaatcct

SEQ ID NO: 4064181 - DNA, 22 bp, Homo sapiens
actcagtttgtcagactttaaa

SEQ ID NO: 4064182 - DNA, 17 bp, Homo sapiens
actcatacctttaaagg

SEQ ID NO: 4064183 - DNA, 21 bp, Homo sapiens
actctctccaccctatatgta

SEQ ID NO: 4064184 - DNA, 18 bp, Homo sapiens
actctctgaccctctgga

SEQ ID NO: 4064185 - DNA, 16 bp, Homo sapiens
actctctgcctggtgg

SEQ ID NO: 4064186 - DNA, 13 bp, Homo sapiens
actctcttccctt

SEQ ID NO: 4064187 - DNA, 16 bp, Homo sapiens
actctcttccctttcc

SEQ ID NO: 4064188 - DNA, 17 bp, Homo sapiens
actctgaactttggaga

SEQ ID NO: 4064189 - DNA, 14 bp, Homo sapiens
actctgaagcctct

SEQ ID NO: 4064190 - DNA, 16 bp, Homo sapiens
actctgaagcctctgg

SEQ ID NO: 4064191 - DNA, 19 bp, Homo sapiens
actctgaagcctctgggaa

SEQ ID NO: 4064192 - DNA, 19 bp, Homo sapiens
actctgagatgtggagact

SEQ ID NO: 4064193 - DNA, 16 bp, Homo sapiens
actctgagtccactgc

SEQ ID NO: 4064194 - DNA, 16 bp, Homo sapiens
actctgagtttaccat

SEQ ID NO: 4064195 - DNA, 23 bp, Homo sapiens
actctgatggttcttcacctcct

SEQ ID NO: 4064196 - DNA, 16 bp, Homo sapiens
actctgcattctagta

SEQ ID NO: 4064197 - DNA, 17 bp, Homo sapiens
actctgccccctgctgg

SEQ ID NO: 4064198 - DNA, 14 bp, Homo sapiens
actctgcctgccct

SEQ ID NO: 4064199 - DNA, 17 bp, Homo sapiens
actctgctaatcatgtg

SEQ ID NO: 4064200 - DNA, 15 bp, Homo sapiens
actctggcaaagctt

SEQ ID NO: 4064201 - DNA, 16 bp, Homo sapiens
actctggcaaagcttt

SEQ ID NO: 4064202 - DNA, 17 bp, Homo sapiens
actctggcaaagctttt

SEQ ID NO: 4064203 - DNA, 23 bp, Homo sapiens
actctggcaaagcttttagaaat

SEQ ID NO: 4064204 - DNA, 14 bp, Homo sapiens
actctggccctggc

SEQ ID NO: 4064205 - DNA, 16 bp, Homo sapiens
actctggccctggccc

SEQ ID NO: 4064206 - DNA, 17 bp, Homo sapiens
actctggcttccaggta

SEQ ID NO: 4064207 - DNA, 17 bp, Homo sapiens
actctgggctgctaccc

SEQ ID NO: 4064208 - DNA, 23 bp, Homo sapiens
actctgggctgtaacgtggcact

SEQ ID NO: 4064209 - DNA, 19 bp, Homo sapiens
actctggtggcacaggagt

SEQ ID NO: 4064210 - DNA, 15 bp, Homo sapiens
actctggtttctcat

SEQ ID NO: 4064211 - DNA, 14 bp, Homo sapiens
actctgtcagatgg

SEQ ID NO: 4064212 - DNA, 15 bp, Homo sapiens
actctgtcttgtgtt

SEQ ID NO: 4064213 - DNA, 14 bp, Homo sapiens
actctgtgtttaaa

SEQ ID NO: 4064214 - DNA, 18 bp, Homo sapiens
actctgttcccccaccct

SEQ ID NO: 4064215 - DNA, 13 bp, Homo sapiens
actcttaaagcaa

SEQ ID NO: 4064216 - DNA, 20 bp, Homo sapiens
actcttaaagcaaaaaatga

SEQ ID NO: 4064217 - DNA, 22 bp, Homo sapiens
actcttaatctgtgtgtatatt

SEQ ID NO: 4064218 - DNA, 12 bp, Homo sapiens
actcttatctca

SEQ ID NO: 4064219 - DNA, 22 bp, Homo sapiens
actcttatctcagtcatgcata

SEQ ID NO: 4064220 - DNA, 23 bp, Homo sapiens
actcttatctcagtcatgcataa

SEQ ID NO: 4064221 - DNA, 17 bp, Homo sapiens
actcttcacaaaatctg

SEQ ID NO: 4064222 - DNA, 12 bp, Homo sapiens
actcttcactgt

SEQ ID NO: 4064223 - DNA, 13 bp, Homo sapiens
actcttcactgtt

SEQ ID NO: 4064224 - DNA, 17 bp, Homo sapiens
actcttctcggctcagg

SEQ ID NO: 4064225 - DNA, 14 bp, Homo sapiens
actcttctctctgc

SEQ ID NO: 4064226 - DNA, 15 bp, Homo sapiens
actcttctctctgct

SEQ ID NO: 4064227 - DNA, 16 bp, Homo sapiens
actcttctctctgctc

SEQ ID NO: 4064228 - DNA, 13 bp, Homo sapiens
actcttgatgtga

SEQ ID NO: 4064229 - DNA, 20 bp, Homo sapiens
actcttggtcagcttttgtt

SEQ ID NO: 4064230 - DNA, 21 bp, Homo sapiens
actcttggttcgatacctgga

SEQ ID NO: 4064231 - DNA, 16 bp, Homo sapiens
actcttgttgagttct

SEQ ID NO: 4064232 - DNA, 20 bp, Homo sapiens
actctttatcaagcaacatt

SEQ ID NO: 4064233 - DNA, 16 bp, Homo sapiens
actctttgaaagcttt

SEQ ID NO: 4064234 - DNA, 14 bp, Homo sapiens
actctttgtaagag

SEQ ID NO: 4064235 - DNA, 18 bp, Homo sapiens
actcttttccttcccttt

SEQ ID NO: 4064236 - DNA, 16 bp, Homo sapiens
actgaaaacttagcca

SEQ ID NO: 4064237 - DNA, 18 bp, Homo sapiens
actgaaaacttagccaga

SEQ ID NO: 4064238 - DNA, 19 bp, Homo sapiens
actgaaaagactcagtgtt

SEQ ID NO: 4064239 - DNA, 16 bp, Homo sapiens
actgaaaatgtaaatt

SEQ ID NO: 4064240 - DNA, 19 bp, Homo sapiens
actgaaaatgtaaatttat

SEQ ID NO: 4064241 - DNA, 14 bp, Homo sapiens
actgaaacagattt

SEQ ID NO: 4064242 - DNA, 13 bp, Homo sapiens
actgaaaccattt

SEQ ID NO: 4064243 - DNA, 15 bp, Homo sapiens
actgaaaccattttc

SEQ ID NO: 4064244 - DNA, 17 bp, Homo sapiens
actgaaagttttgtaaa

SEQ ID NO: 4064245 - DNA, 23 bp, Homo sapiens
actgaaagttttgtaaaagaaat

SEQ ID NO: 4064246 - DNA, 13 bp, Homo sapiens
actgaacttcagg

SEQ ID NO: 4064247 - DNA, 18 bp, Homo sapiens
actgaaggaaaaacacaa

SEQ ID NO: 4064248 - DNA, 20 bp, Homo sapiens
actgaaggaaaaacacaagc

SEQ ID NO: 4064249 - DNA, 19 bp, Homo sapiens
actgaaggacctgagctgg

SEQ ID NO: 4064250 - DNA, 19 bp, Homo sapiens
actgaagtcttttctgtca

SEQ ID NO: 4064251 - DNA, 16 bp, Homo sapiens
actgaagtttcacatg

SEQ ID NO: 4064252 - DNA, 15 bp, Homo sapiens
actgaatatttatat

SEQ ID NO: 4064253 - DNA, 21 bp, Homo sapiens
actgaatatttatatttcact

SEQ ID NO: 4064254 - DNA, 22 bp, Homo sapiens
actgaatatttatatttcacta

SEQ ID NO: 4064255 - DNA, 20 bp, Homo sapiens
actgaatattttggaaactg

SEQ ID NO: 4064256 - DNA, 17 bp, Homo sapiens
actgaatttttttgtaa

SEQ ID NO: 4064257 - DNA, 20 bp, Homo sapiens
actgaatttttttgtaataa

SEQ ID NO: 4064258 - DNA, 14 bp, Homo sapiens
actgacaacattat

SEQ ID NO: 4064259 - DNA, 18 bp, Homo sapiens
actgacatgtggggccag

SEQ ID NO: 4064260 - DNA, 13 bp, Homo sapiens
actgaccactggg

SEQ ID NO: 4064261 - DNA, 12 bp, Homo sapiens
actgaccagaac

SEQ ID NO: 4064262 - DNA, 14 bp, Homo sapiens
actgaccagaacta

SEQ ID NO: 4064263 - DNA, 22 bp, Homo sapiens
actgaccatccactctaccctc

SEQ ID NO: 4064264 - DNA, 22 bp, Homo sapiens
actgacctgaccccattcctga

SEQ ID NO: 4064265 - DNA, 21 bp, Homo sapiens
actgactatcataaaatcaaa

SEQ ID NO: 4064266 - DNA, 20 bp, Homo sapiens
actgacttgtttgtcttcca

SEQ ID NO: 4064267 - DNA, 16 bp, Homo sapiens
actgactttgcttgct

SEQ ID NO: 4064268 - DNA, 21 bp, Homo sapiens
actgagagggcaaggaagtgg

SEQ ID NO: 4064269 - DNA, 14 bp, Homo sapiens
actgagatcactga

SEQ ID NO: 4064270 - DNA, 18 bp, Homo sapiens
actgagcagccgccagct

SEQ ID NO: 4064271 - DNA, 13 bp, Homo sapiens
actgagccccacc

SEQ ID NO: 4064272 - DNA, 14 bp, Homo sapiens
actgagccccacct

SEQ ID NO: 4064273 - DNA, 17 bp, Homo sapiens
actgagctcacatggga

SEQ ID NO: 4064274 - DNA, 18 bp, Homo sapiens
actgagctccccagatct

SEQ ID NO: 4064275 - DNA, 20 bp, Homo sapiens
actgagctccccagatctcc

SEQ ID NO: 4064276 - DNA, 19 bp, Homo sapiens
actgaggacaaagtggagg

SEQ ID NO: 4064277 - DNA, 18 bp, Homo sapiens
actgaggagatgaccagg

SEQ ID NO: 4064278 - DNA, 20 bp, Homo sapiens
actgaggagatgaccaggga

SEQ ID NO: 4064279 - DNA, 13 bp, Homo sapiens
actgaggcagcct

SEQ ID NO: 4064280 - DNA, 19 bp, Homo sapiens
actgaggcttagagagagg

SEQ ID NO: 4064281 - DNA, 20 bp, Homo sapiens
actgagtcccctccaggaag

SEQ ID NO: 4064282 - DNA, 21 bp, Homo sapiens
actgataacttggggaggcaa

SEQ ID NO: 4064283 - DNA, 13 bp, Homo sapiens
actgataagactg

SEQ ID NO: 4064284 - DNA, 21 bp, Homo sapiens
actgatgaaatctgctagaaa

SEQ ID NO: 4064285 - DNA, 16 bp, Homo sapiens
actgatgctgagattc

SEQ ID NO: 4064286 - DNA, 15 bp, Homo sapiens
actgggagtcagagc

SEQ ID NO: 4064287 - DNA, 16 bp, Homo sapiens
actgggagtcagagcc

SEQ ID NO: 4064288 - DNA, 20 bp, Homo sapiens
actgggagtcagagccctgg

SEQ ID NO: 4064289 - DNA, 23 bp, Homo sapiens
actgggattaagaaaccttgctc

SEQ ID NO: 4064290 - DNA, 13 bp, Homo sapiens
actggggagcccg

SEQ ID NO: 4064291 - DNA, 17 bp, Homo sapiens
actggggagcccgtctc

SEQ ID NO: 4064292 - DNA, 16 bp, Homo sapiens
actggggatgtgggag

SEQ ID NO: 4064293 - DNA, 17 bp, Homo sapiens
actggggcctccagaac

SEQ ID NO: 4064294 - DNA, 13 bp, Homo sapiens
actggggctgggg

SEQ ID NO: 4064295 - DNA, 20 bp, Homo sapiens
actggggctggggtgagaga

SEQ ID NO: 4064296 - DNA, 19 bp, Homo sapiens
actgggggactgggagtca

SEQ ID NO: 4064297 - DNA, 21 bp, Homo sapiens
actggggtaagcggaataaac

SEQ ID NO: 4064298 - DNA, 19 bp, Homo sapiens
actgggtgaggaaatccat

SEQ ID NO: 4064299 - DNA, 18 bp, Homo sapiens
actgggtggggtgaggac

SEQ ID NO: 4064300 - DNA, 18 bp, Homo sapiens
actgggtggtggcctggt

SEQ ID NO: 4064301 - DNA, 21 bp, Homo sapiens
actgggtgttgatcttacaag

SEQ ID NO: 4064302 - DNA, 22 bp, Homo sapiens
actgggttcttgttttatatac

SEQ ID NO: 4064303 - DNA, 13 bp, Homo sapiens
actggtaacatgt

SEQ ID NO: 4064304 - DNA, 17 bp, Homo sapiens
actggtacttcctttct

SEQ ID NO: 4064305 - DNA, 18 bp, Homo sapiens
actggtatgtaaaagaaa

SEQ ID NO: 4064306 - DNA, 15 bp, Homo sapiens
actggtccttaccag

SEQ ID NO: 4064307 - DNA, 20 bp, Homo sapiens
actggtccttaccagagacg

SEQ ID NO: 4064308 - DNA, 12 bp, Homo sapiens
actggtggcccg

SEQ ID NO: 4064309 - DNA, 14 bp, Homo sapiens
actggttgtatatt

SEQ ID NO: 4064310 - DNA, 19 bp, Homo sapiens
actggttttctgccaatga

SEQ ID NO: 4064311 - DNA, 16 bp, Homo sapiens
actgtaaaatgaaatt

SEQ ID NO: 4064312 - DNA, 18 bp, Homo sapiens
actgtaaataaaaagaaa

SEQ ID NO: 4064313 - DNA, 16 bp, Homo sapiens
actgtaaatatgaatc

SEQ ID NO: 4064314 - DNA, 22 bp, Homo sapiens
actgtaaatatttatttatgtg

SEQ ID NO: 4064315 - DNA, 19 bp, Homo sapiens
actgtaatcttatttagga

SEQ ID NO: 4064316 - DNA, 16 bp, Homo sapiens
actgtaattaaaacta

SEQ ID NO: 4064317 - DNA, 17 bp, Homo sapiens
actgtacagaatttcca

SEQ ID NO: 4064318 - DNA, 22 bp, Homo sapiens
actgtacatttaaaattgctat

SEQ ID NO: 4064319 - DNA, 20 bp, Homo sapiens
actgtactccagcctgaaga

SEQ ID NO: 4064320 - DNA, 13 bp, Homo sapiens
actgtactcctcc

SEQ ID NO: 4064321 - DNA, 20 bp, Homo sapiens
actgtactcctcccaggcgc

SEQ ID NO: 4064322 - DNA, 17 bp, Homo sapiens
actgtacttaataaatt

SEQ ID NO: 4064323 - DNA, 20 bp, Homo sapiens
actgtagattgcttctgtag

SEQ ID NO: 4064324 - DNA, 14 bp, Homo sapiens
actgtagccacagc

SEQ ID NO: 4064325 - DNA, 19 bp, Homo sapiens
actgtagcttttaggaata

SEQ ID NO: 4064326 - DNA, 18 bp, Homo sapiens
actgtaggttatttaaaa

SEQ ID NO: 4064327 - DNA, 23 bp, Homo sapiens
actgtagtgtagtcaggtgctca

SEQ ID NO: 4064328 - DNA, 18 bp, Homo sapiens
actgtagtttttcttcaa

SEQ ID NO: 4064329 - DNA, 21 bp, Homo sapiens
actgtagtttttcttcaacat

SEQ ID NO: 4064330 - DNA, 15 bp, Homo sapiens
actgtataaatagga

SEQ ID NO: 4064331 - DNA, 21 bp, Homo sapiens
actgtataaataggagaggat

SEQ ID NO: 4064332 - DNA, 15 bp, Homo sapiens
actgtatgatttata

SEQ ID NO: 4064333 - DNA, 19 bp, Homo sapiens
actgtatggaaacactgat

SEQ ID NO: 4064334 - DNA, 22 bp, Homo sapiens
actgtcaaggctgcttagaatc

SEQ ID NO: 4064335 - DNA, 12 bp, Homo sapiens
actgtcaataaa

SEQ ID NO: 4064336 - DNA, 13 bp, Homo sapiens
actgtcaataaac

SEQ ID NO: 4064337 - DNA, 17 bp, Homo sapiens
actgtcaataaacagct

SEQ ID NO: 4064338 - DNA, 14 bp, Homo sapiens
actgtcaccctcca

SEQ ID NO: 4064339 - DNA, 21 bp, Homo sapiens
actgtcacggggttccctcct

SEQ ID NO: 4064340 - DNA, 14 bp, Homo sapiens
actgtcactcattg

SEQ ID NO: 4064341 - DNA, 24 bp, Homo sapiens
actgtcactcattgctgagcctct

SEQ ID NO: 4064342 - DNA, 15 bp, Homo sapiens
actgtcactgtttct

SEQ ID NO: 4064343 - DNA, 21 bp, Homo sapiens
actgtcactgtttctctgctg

SEQ ID NO: 4064344 - DNA, 15 bp, Homo sapiens
actgtcactttgctc

SEQ ID NO: 4064345 - DNA, 14 bp, Homo sapiens
actgtccagagagc

SEQ ID NO: 4064346 - DNA, 14 bp, Homo sapiens
actgtcctgggcct

SEQ ID NO: 4064347 - DNA, 17 bp, Homo sapiens
actgtcctgggcctgca

SEQ ID NO: 4064348 - DNA, 19 bp, Homo sapiens
actgtcctgggcctgcaga

SEQ ID NO: 4064349 - DNA, 20 bp, Homo sapiens
actgtcggagaggctgtctg

SEQ ID NO: 4064350 - DNA, 20 bp, Homo sapiens
actgtctcaagagggcactg

SEQ ID NO: 4064351 - DNA, 12 bp, Homo sapiens
actgtctgtctg

SEQ ID NO: 4064352 - DNA, 15 bp, Homo sapiens
actgtctgtgaacag

SEQ ID NO: 4064353 - DNA, 13 bp, Homo sapiens
actgtcttcctca

SEQ ID NO: 4064354 - DNA, 14 bp, Homo sapiens
actgtcttcctcaa

SEQ ID NO: 4064355 - DNA, 20 bp, Homo sapiens
actgtcttcctcaaaataaa

SEQ ID NO: 4064356 - DNA, 18 bp, Homo sapiens
actgtctttaaaagagag

SEQ ID NO: 4064357 - DNA, 12 bp, Homo sapiens
actgtctttcag

SEQ ID NO: 4064358 - DNA, 21 bp, Homo sapiens
actgtctttttttccctacca

SEQ ID NO: 4064359 - DNA, 13 bp, Homo sapiens
actgtgaacttga

SEQ ID NO: 4064360 - DNA, 21 bp, Homo sapiens
actgtgaacttgactgggtga

SEQ ID NO: 4064361 - DNA, 22 bp, Homo sapiens
actgtgaagacccagcaggaag

SEQ ID NO: 4064362 - DNA, 16 bp, Homo sapiens
actgtgaaggaccctt

SEQ ID NO: 4064363 - DNA, 21 bp, Homo sapiens
actgtgacccccagctccggc

SEQ ID NO: 4064364 - DNA, 12 bp, Homo sapiens
actgtgccacaa

SEQ ID NO: 4064365 - DNA, 23 bp, Homo sapiens
actgtgccacaatgcagttctga

SEQ ID NO: 4064366 - DNA, 13 bp, Homo sapiens
actgtgctgaatg

SEQ ID NO: 4064367 - DNA, 16 bp, Homo sapiens
actgtggaggaaggat

SEQ ID NO: 4064368 - DNA, 17 bp, Homo sapiens
actgtggaggaaggatt

SEQ ID NO: 4064369 - DNA, 18 bp, Homo sapiens
actgtggaggaaggattg

SEQ ID NO: 4064370 - DNA, 17 bp, Homo sapiens
actgtggcgttctgctg

SEQ ID NO: 4064371 - DNA, 23 bp, Homo sapiens
actgtgtacataatgcttaattt

SEQ ID NO: 4064372 - DNA, 18 bp, Homo sapiens
actgtgtatgtacatata

SEQ ID NO: 4064373 - DNA, 14 bp, Homo sapiens
actgtgttgccaca

SEQ ID NO: 4064374 - DNA, 19 bp, Homo sapiens
actgttaactatgacagat

SEQ ID NO: 4064375 - DNA, 13 bp, Homo sapiens
actgttagctttt

SEQ ID NO: 4064376 - DNA, 21 bp, Homo sapiens
actgttagctttttaaaacat

SEQ ID NO: 4064377 - DNA, 12 bp, Homo sapiens
actgttcaagtg

SEQ ID NO: 4064378 - DNA, 16 bp, Homo sapiens
actgttcaagtgtccc

SEQ ID NO: 4064379 - DNA, 20 bp, Homo sapiens
actgttccaaagccagtgaa

SEQ ID NO: 4064380 - DNA, 15 bp, Homo sapiens
actgttccctctgct

SEQ ID NO: 4064381 - DNA, 16 bp, Homo sapiens
actgttccctctgctc

SEQ ID NO: 4064382 - DNA, 22 bp, Homo sapiens
actgttccctctgctcctggag

SEQ ID NO: 4064383 - DNA, 13 bp, Homo sapiens
actgttctgcaaa

SEQ ID NO: 4064384 - DNA, 16 bp, Homo sapiens
actgttctgtgtcttt

SEQ ID NO: 4064385 - DNA, 18 bp, Homo sapiens
actgttcttcattttatt

SEQ ID NO: 4064386 - DNA, 12 bp, Homo sapiens
actgttgagtta

SEQ ID NO: 4064387 - DNA, 22 bp, Homo sapiens
actgttgatgaagtatactttt

SEQ ID NO: 4064388 - DNA, 21 bp, Homo sapiens
actgttgctcaaatctattca

SEQ ID NO: 4064389 - DNA, 16 bp, Homo sapiens
gaaagtcaagaagaat

SEQ ID NO: 4064390 - DNA, 16 bp, Homo sapiens
gaaagtgaatttgaat

SEQ ID NO: 4064391 - DNA, 23 bp, Homo sapiens
gaaagtgaatttgaatgaaaaat

SEQ ID NO: 4064392 - DNA, 22 bp, Homo sapiens
gaaagtgatttctagaaagcct

SEQ ID NO: 4064393 - DNA, 18 bp, Homo sapiens
gaaagtgtgagctcttcc

SEQ ID NO: 4064394 - DNA, 19 bp, Homo sapiens
gaaagtgtgagctcttccc

SEQ ID NO: 4064395 - DNA, 11 bp, Homo sapiens
gaaagtgtttt

SEQ ID NO: 4064396 - DNA, 22 bp, Homo sapiens
gaaagttcccccatcagttccc

SEQ ID NO: 4064397 - DNA, 15 bp, Homo sapiens
gaaagttttgtaaaa

SEQ ID NO: 4064398 - DNA, 18 bp, Homo sapiens
gaaagttttgtaaaagaa

SEQ ID NO: 4064399 - DNA, 15 bp, Homo sapiens
gaaataaaaatggca

SEQ ID NO: 4064400 - DNA, 18 bp, Homo sapiens
gaaataaaaggaagccaa

SEQ ID NO: 4064401 - DNA, 23 bp, Homo sapiens
gaaataaaagtgaatgaaagatt

SEQ ID NO: 4064402 - DNA, 14 bp, Homo sapiens
gaaataaactgtgc

SEQ ID NO: 4064403 - DNA, 20 bp, Homo sapiens
gaaataaaggatgtgattgt

SEQ ID NO: 4064404 - DNA, 16 bp, Homo sapiens
gaaataaatcagagag

SEQ ID NO: 4064405 - DNA, 15 bp, Homo sapiens
gaaataaattcctaa

SEQ ID NO: 4064406 - DNA, 17 bp, Homo sapiens
gaaataaattcctaaac

SEQ ID NO: 4064407 - DNA, 15 bp, Homo sapiens
gaaataacaaaatgg

SEQ ID NO: 4064408 - DNA, 19 bp, Homo sapiens
gaaataacaaaatggacat

SEQ ID NO: 4064409 - DNA, 15 bp, Homo sapiens
gaaataacaatgtta

SEQ ID NO: 4064410 - DNA, 18 bp, Homo sapiens
gaaataacaatgttaagg

SEQ ID NO: 4064411 - DNA, 14 bp, Homo sapiens
gaaataatatgcat

SEQ ID NO: 4064412 - DNA, 17 bp, Homo sapiens
gaaataatcagtgactg

SEQ ID NO: 4064413 - DNA, 14 bp, Homo sapiens
gaaataatttttct

SEQ ID NO: 4064414 - DNA, 21 bp, Homo sapiens
gaaatacaattctacattgtc

SEQ ID NO: 4064415 - DNA, 18 bp, Homo sapiens
gaaatacacaagtaaaca

SEQ ID NO: 4064416 - DNA, 19 bp, Homo sapiens
gaaatacacaagtaaacat

SEQ ID NO: 4064417 - DNA, 18 bp, Homo sapiens
gaaatagacagtatattt

SEQ ID NO: 4064418 - DNA, 18 bp, Homo sapiens
gaaatagatatcctctcc

SEQ ID NO: 4064419 - DNA, 19 bp, Homo sapiens
gaaatagtaccttcaatac

SEQ ID NO: 4064420 - DNA, 13 bp, Homo sapiens
gaaatataattga

SEQ ID NO: 4064421 - DNA, 19 bp, Homo sapiens
gaaatatatacaaaaagaa

SEQ ID NO: 4064422 - DNA, 13 bp, Homo sapiens
gaaatatcattta

SEQ ID NO: 4064423 - DNA, 14 bp, Homo sapiens
gaaatatcatttat

SEQ ID NO: 4064424 - DNA, 18 bp, Homo sapiens
gaaatatctgaaaatgta

SEQ ID NO: 4064425 - DNA, 21 bp, Homo sapiens
gaaatatctgaaaatgtatgt

SEQ ID NO: 4064426 - DNA, 15 bp, Homo sapiens
gaaatatgattttat

SEQ ID NO: 4064427 - DNA, 14 bp, Homo sapiens
gaaatatgtgagat

SEQ ID NO: 4064428 - DNA, 13 bp, Homo sapiens
gaaatattttgat

SEQ ID NO: 4064429 - DNA, 19 bp, Homo sapiens
gaaatattttgataataaa

SEQ ID NO: 4064430 - DNA, 21 bp, Homo sapiens
gaaatattttttaatttaaag

SEQ ID NO: 4064431 - DNA, 19 bp, Homo sapiens
gaaatcaggtgttttaaga

SEQ ID NO: 4064432 - DNA, 21 bp, Homo sapiens
gaaatcaggtgttttaagact

SEQ ID NO: 4064433 - DNA, 18 bp, Homo sapiens
gaaatccctgtttaatat

SEQ ID NO: 4064434 - DNA, 22 bp, Homo sapiens
gaaatccctgtttaatatttaa

SEQ ID NO: 4064435 - DNA, 22 bp, Homo sapiens
gaaatccgagcggctacaaagc

SEQ ID NO: 4064436 - DNA, 17 bp, Homo sapiens
gaaatccggagaagctg

SEQ ID NO: 4064437 - DNA, 21 bp, Homo sapiens
gaaatctagttatttacagga

SEQ ID NO: 4064438 - DNA, 20 bp, Homo sapiens
gaaatctcctttagccatca

SEQ ID NO: 4064439 - DNA, 19 bp, Homo sapiens
gaaatgaaaacatgtaata

SEQ ID NO: 4064440 - DNA, 22 bp, Homo sapiens
gaaatgaacaaaagattggagc

SEQ ID NO: 4064441 - DNA, 19 bp, Homo sapiens
gaaatgaataatttcccaa

SEQ ID NO: 4064442 - DNA, 13 bp, Homo sapiens
gaaatgactaatt

SEQ ID NO: 4064443 - DNA, 17 bp, Homo sapiens
gaaatgagaaggcagcc

SEQ ID NO: 4064444 - DNA, 19 bp, Homo sapiens
gaaatgagaaggcagccac

SEQ ID NO: 4064445 - DNA, 22 bp, Homo sapiens
gaaatgagcacctccattaaag

SEQ ID NO: 4064446 - DNA, 16 bp, Homo sapiens
gaaatgaggtctgttt

SEQ ID NO: 4064447 - DNA, 17 bp, Homo sapiens
gaaatgaggtctgttta

SEQ ID NO: 4064448 - DNA, 12 bp, Homo sapiens
gaaatgcaaggg

SEQ ID NO: 4064449 - DNA, 20 bp, Homo sapiens
gaaatgcattattttgaatg

SEQ ID NO: 4064450 - DNA, 21 bp, Homo sapiens
gaaatgcattttattctttaa

SEQ ID NO: 4064451 - DNA, 13 bp, Homo sapiens
gaaatgctgctgg

SEQ ID NO: 4064452 - DNA, 22 bp, Homo sapiens
gaaatgcttgtggattgagggt

SEQ ID NO: 4064453 - DNA, 19 bp, Homo sapiens
gaaatggaatgtgcccctg

SEQ ID NO: 4064454 - DNA, 17 bp, Homo sapiens
gaaatgggacttaactc

SEQ ID NO: 4064455 - DNA, 21 bp, Homo sapiens
gaaatggtatgagctgagggg

SEQ ID NO: 4064456 - DNA, 18 bp, Homo sapiens
gaaatgtaatactggaat

SEQ ID NO: 4064457 - DNA, 16 bp, Homo sapiens
gaaatgtccctttctt

SEQ ID NO: 4064458 - DNA, 18 bp, Homo sapiens
gaaattaaatccaataaa

SEQ ID NO: 4064459 - DNA, 18 bp, Homo sapiens
gaaattactacaaaattt

SEQ ID NO: 4064460 - DNA, 19 bp, Homo sapiens
gaaattactacaaaatttg

SEQ ID NO: 4064461 - DNA, 19 bp, Homo sapiens
gaaattagctgtgtgaaat

SEQ ID NO: 4064462 - DNA, 13 bp, Homo sapiens
gaaattagggccc

SEQ ID NO: 4064463 - DNA, 15 bp, Homo sapiens
gaaattccagcaata

SEQ ID NO: 4064464 - DNA, 16 bp, Homo sapiens
gaaattctaaagagca

SEQ ID NO: 4064465 - DNA, 18 bp, Homo sapiens
gaaattctgttaaaatct

SEQ ID NO: 4064466 - DNA, 13 bp, Homo sapiens
gaaattcttccta

SEQ ID NO: 4064467 - DNA, 21 bp, Homo sapiens
gaaattgacacaagtggacct

SEQ ID NO: 4064468 - DNA, 19 bp, Homo sapiens
gaaattgcatttcctgaca

SEQ ID NO: 4064469 - DNA, 17 bp, Homo sapiens
gaaattggaacagaatg

SEQ ID NO: 4064470 - DNA, 14 bp, Homo sapiens
gaaattggctggat

SEQ ID NO: 4064471 - DNA, 15 bp, Homo sapiens
gaaattggctggatg

SEQ ID NO: 4064472 - DNA, 22 bp, Homo sapiens
gaaattgtttaagtgttgtaaa

SEQ ID NO: 4064473 - DNA, 15 bp, Homo sapiens
gaaattttacaatag

SEQ ID NO: 4064474 - DNA, 13 bp, Homo sapiens
gaaattttgcaaa

SEQ ID NO: 4064475 - DNA, 19 bp, Homo sapiens
gaaattttgcaaatataaa

SEQ ID NO: 4064476 - DNA, 21 bp, Homo sapiens
gaaattttgcaaatataaaca

SEQ ID NO: 4064477 - DNA, 22 bp, Homo sapiens
gaaattttgcaaatataaacat

SEQ ID NO: 4064478 - DNA, 24 bp, Homo sapiens
gaaattttgcaaatataaacatct

SEQ ID NO: 4064479 - DNA, 15 bp, Homo sapiens
gaaattttgtaagaa

SEQ ID NO: 4064480 - DNA, 17 bp, Homo sapiens
gaaatttttcagatgct

SEQ ID NO: 4064481 - DNA, 17 bp, Homo sapiens
gaacaaaaagttttttt

SEQ ID NO: 4064482 - DNA, 20 bp, Homo sapiens
gaacaaaagattggagctga

SEQ ID NO: 4064483 - DNA, 14 bp, Homo sapiens
gaacaaagcagcca

SEQ ID NO: 4064484 - DNA, 15 bp, Homo sapiens
gaacaactactgtga

SEQ ID NO: 4064485 - DNA, 13 bp, Homo sapiens
gaacaactgatac

SEQ ID NO: 4064486 - DNA, 11 bp, Homo sapiens
gaacacacaca

SEQ ID NO: 4064487 - DNA, 12 bp, Homo sapiens
gaacacaggcag

SEQ ID NO: 4064488 - DNA, 13 bp, Homo sapiens
gaacacaggcagc

SEQ ID NO: 4064489 - DNA, 14 bp, Homo sapiens
gaacacggccacat

SEQ ID NO: 4064490 - DNA, 15 bp, Homo sapiens
gaacactaattcata

SEQ ID NO: 4064491 - DNA, 18 bp, Homo sapiens
gaacactaattcataatc

SEQ ID NO: 4064492 - DNA, 22 bp, Homo sapiens
gaactggggctttgccttgcag

SEQ ID NO: 4064493 - DNA, 18 bp, Homo sapiens
gaactgtccagagagcaa

SEQ ID NO: 4064494 - DNA, 16 bp, Homo sapiens
gaactgttctggcctc

SEQ ID NO: 4064495 - DNA, 22 bp, Homo sapiens
gaactgttctggcctcagacca

SEQ ID NO: 4064496 - DNA, 18 bp, Homo sapiens
gaacttgaagcctgctcc

SEQ ID NO: 4064497 - DNA, 21 bp, Homo sapiens
gaacttgaagggttactgacg

SEQ ID NO: 4064498 - DNA, 12 bp, Homo sapiens
gaacttgcatgg

SEQ ID NO: 4064499 - DNA, 24 bp, Homo sapiens
gaacttgcgagaaattcgtgtgtt

SEQ ID NO: 4064500 - DNA, 22 bp, Homo sapiens
gaacttgctgctgagtgcacca

SEQ ID NO: 4064501 - DNA, 14 bp, Homo sapiens
gaacttgctgctgt

SEQ ID NO: 4064502 - DNA, 15 bp, Homo sapiens
gaacttgctgctgtc

SEQ ID NO: 4064503 - DNA, 18 bp, Homo sapiens
gaacttgctgctgtcttg

SEQ ID NO: 4064504 - DNA, 14 bp, Homo sapiens
gaactttctgcttt

SEQ ID NO: 4064505 - DNA, 18 bp, Homo sapiens
gaagaaaaaaaataacac

SEQ ID NO: 4064506 - DNA, 14 bp, Homo sapiens
gaagaaaaaaatct

SEQ ID NO: 4064507 - DNA, 16 bp, Homo sapiens
gaagaaaaaaatcttc

SEQ ID NO: 4064508 - DNA, 22 bp, Homo sapiens
gaagaaaactatcctgcgggtt

SEQ ID NO: 4064509 - DNA, 20 bp, Homo sapiens
gaagaaatatgaaattccag

SEQ ID NO: 4064510 - DNA, 19 bp, Homo sapiens
gaagaaccagtccccccac

SEQ ID NO: 4064511 - DNA, 22 bp, Homo sapiens
gaagaactgtgtttcaagttca

SEQ ID NO: 4064512 - DNA, 16 bp, Homo sapiens
gaagaacttgcatgga

SEQ ID NO: 4064513 - DNA, 14 bp, Homo sapiens
gaagaagggagaag

SEQ ID NO: 4064514 - DNA, 16 bp, Homo sapiens
gaagaagggagaagaa

SEQ ID NO: 4064515 - DNA, 20 bp, Homo sapiens
gaagaaggtggaccttttaa

SEQ ID NO: 4064516 - DNA, 21 bp, Homo sapiens
gaagaatatttaagaaaagca

SEQ ID NO: 4064517 - DNA, 22 bp, Homo sapiens
gaagaatatttaagaaaagcac

SEQ ID NO: 4064518 - DNA, 23 bp, Homo sapiens
gaagaatatttaagaaaagcact

SEQ ID NO: 4064519 - DNA, 16 bp, Homo sapiens
gaagaatccagtatta

SEQ ID NO: 4064520 - DNA, 16 bp, Homo sapiens
gaagaattgccaatct

SEQ ID NO: 4064521 - DNA, 18 bp, Homo sapiens
gaagacaatttgatacat

SEQ ID NO: 4064522 - DNA, 15 bp, Homo sapiens
gaagacaccagagca

SEQ ID NO: 4064523 - DNA, 17 bp, Homo sapiens
gaagacaccagagcaga

SEQ ID NO: 4064524 - DNA, 18 bp, Homo sapiens
gaagacaccagagcagat

SEQ ID NO: 4064525 - DNA, 21 bp, Homo sapiens
gaagacaccagagcagatgca

SEQ ID NO: 4064526 - DNA, 23 bp, Homo sapiens
gaagacaccagagcagatgcaga

SEQ ID NO: 4064527 - DNA, 18 bp, Homo sapiens
gaagacatgaaccaagtg

SEQ ID NO: 4064528 - DNA, 20 bp, Homo sapiens
gaagacatggagactcctgc

SEQ ID NO: 4064529 - DNA, 21 bp, Homo sapiens
gaagacatggagactcctgcc

SEQ ID NO: 4064530 - DNA, 17 bp, Homo sapiens
gaagacatttctgctct

SEQ ID NO: 4064531 - DNA, 15 bp, Homo sapiens
gaagacattttttgc

SEQ ID NO: 4064532 - DNA, 21 bp, Homo sapiens
gaagacattttttgctataat

SEQ ID NO: 4064533 - DNA, 14 bp, Homo sapiens
gaagaccacatcca

SEQ ID NO: 4064534 - DNA, 12 bp, Homo sapiens
gaagaccagagc

SEQ ID NO: 4064535 - DNA, 17 bp, Homo sapiens
gaagaccagagcagttt

SEQ ID NO: 4064536 - DNA, 15 bp, Homo sapiens
gaagacccagcagga

SEQ ID NO: 4064537 - DNA, 19 bp, Homo sapiens
gaagacctcacctagaaat

SEQ ID NO: 4064538 - DNA, 20 bp, Homo sapiens
gaagacctcacctagaaatt

SEQ ID NO: 4064539 - DNA, 16 bp, Homo sapiens
gaagacgcctgagctc

SEQ ID NO: 4064540 - DNA, 15 bp, Homo sapiens
gaagactccagaaat

SEQ ID NO: 4064541 - DNA, 20 bp, Homo sapiens
gaagactgtcagcttccaaa

SEQ ID NO: 4064542 - DNA, 15 bp, Homo sapiens
gaagagaagctgctg

SEQ ID NO: 4064543 - DNA, 24 bp, Homo sapiens
gaagagaagtgaccgagagaacct

SEQ ID NO: 4064544 - DNA, 23 bp, Homo sapiens
gaagagcaggactccaggcccaa

SEQ ID NO: 4064545 - DNA, 17 bp, Homo sapiens
gaagagcccagtctgtt

SEQ ID NO: 4064546 - DNA, 20 bp, Homo sapiens
gaagagctatggcccagaaa

SEQ ID NO: 4064547 - DNA, 15 bp, Homo sapiens
gaagagggcccagcc

SEQ ID NO: 4064548 - DNA, 16 bp, Homo sapiens
gaagagggcccagccc

SEQ ID NO: 4064549 - DNA, 22 bp, Homo sapiens
gaagagggcccagcccagagcc

SEQ ID NO: 4064550 - DNA, 13 bp, Homo sapiens
gaagagggcctgt

SEQ ID NO: 4064551 - DNA, 18 bp, Homo sapiens
gaagagggtgtgtttgaa

SEQ ID NO: 4064552 - DNA, 17 bp, Homo sapiens
gaagagggttttaggta

SEQ ID NO: 4064553 - DNA, 21 bp, Homo sapiens
gaagagtgccctgctttgcaa

SEQ ID NO: 4064554 - DNA, 17 bp, Homo sapiens
gaagataattgttgaaa

SEQ ID NO: 4064555 - DNA, 15 bp, Homo sapiens
gaagataatttgcat

SEQ ID NO: 4064556 - DNA, 16 bp, Homo sapiens
gaagataatttgcata

SEQ ID NO: 4064557 - DNA, 20 bp, Homo sapiens
gaagataggctctgcacaga

SEQ ID NO: 4064558 - DNA, 19 bp, Homo sapiens
gaagatataacattcagtt

SEQ ID NO: 4064559 - DNA, 17 bp, Homo sapiens
gaagatctttgggcata

SEQ ID NO: 4064560 - DNA, 16 bp, Homo sapiens
gaagatgaggttctga

SEQ ID NO: 4064561 - DNA, 20 bp, Homo sapiens
gaagatgaggttctgagacc

SEQ ID NO: 4064562 - DNA, 22 bp, Homo sapiens
gaagatgaggttctgagaccag

SEQ ID NO: 4064563 - DNA, 13 bp, Homo sapiens
gaagatgcagctc

SEQ ID NO: 4064564 - DNA, 14 bp, Homo sapiens
gaagatgcagctca

SEQ ID NO: 4064565 - DNA, 22 bp, Homo sapiens
gaagatggtttcaattcagatt

SEQ ID NO: 4064566 - DNA, 20 bp, Homo sapiens
gaagattaggagaaacacat

SEQ ID NO: 4064567 - DNA, 20 bp, Homo sapiens
gaagattcttgtatttatta

SEQ ID NO: 4064568 - DNA, 20 bp, Homo sapiens
gaagatttgatgctggagag

SEQ ID NO: 4064569 - DNA, 16 bp, Homo sapiens
gaagcaaagcaccagc

SEQ ID NO: 4064570 - DNA, 14 bp, Homo sapiens
gaagcaaataaata

SEQ ID NO: 4064571 - DNA, 15 bp, Homo sapiens
gaagcaaataaatat

SEQ ID NO: 4064572 - DNA, 22 bp, Homo sapiens
gaagcaacattttagctctatt

SEQ ID NO: 4064573 - DNA, 18 bp, Homo sapiens
gaagcaaggaagatatac

SEQ ID NO: 4064574 - DNA, 17 bp, Homo sapiens
gaagcacagaatatttt

SEQ ID NO: 4064575 - DNA, 14 bp, Homo sapiens
gaagcacatgttta

SEQ ID NO: 4064576 - DNA, 22 bp, Homo sapiens
gaagcacctactatgtgctggg

SEQ ID NO: 4064577 - DNA, 23 bp, Homo sapiens
gaagcactttgggattctttcca

SEQ ID NO: 4064578 - DNA, 12 bp, Homo sapiens
gaagcagccagc

SEQ ID NO: 4064579 - DNA, 13 bp, Homo sapiens
gaagcagccagct

SEQ ID NO: 4064580 - DNA, 12 bp, Homo sapiens
gaagcaggttcc

SEQ ID NO: 4064581 - DNA, 23 bp, Homo sapiens
gaagcagtcgtggctttggcagt

SEQ ID NO: 4064582 - DNA, 22 bp, Homo sapiens
gaagcattccttctttgataat

SEQ ID NO: 4064583 - DNA, 19 bp, Homo sapiens
gaagcattctccccagtgt

SEQ ID NO: 4064584 - DNA, 10 bp, Homo sapiens
gaagccaaag

SEQ ID NO: 4064585 - DNA, 16 bp, Homo sapiens
gaagccaaagaaaaat

SEQ ID NO: 4064586 - DNA, 20 bp, Homo sapiens
gaagccaagggaaaggggtg

SEQ ID NO: 4064587 - DNA, 21 bp, Homo sapiens
gaagccaagggaaaggggtgc

SEQ ID NO: 4064588 - DNA, 19 bp, Homo sapiens
gaagccaagtggggtgctg

SEQ ID NO: 4064589 - DNA, 22 bp, Homo sapiens
gaagccagagccccaagcagga

SEQ ID NO: 4064590 - DNA, 10 bp, Homo sapiens
gaagccagct

SEQ ID NO: 4064591 - DNA, 13 bp, Homo sapiens
gaagccagctgcc

SEQ ID NO: 4064592 - DNA, 21 bp, Homo sapiens
gaagccaggaatttcccagga

SEQ ID NO: 4064593 - DNA, 21 bp, Homo sapiens
gaagccatatatgaccagaag

SEQ ID NO: 4064594 - DNA, 23 bp, Homo sapiens
gaagtgtaacagctgaggtctct

SEQ ID NO: 4064595 - DNA, 15 bp, Homo sapiens
gaagtgtatttattt

SEQ ID NO: 4064596 - DNA, 20 bp, Homo sapiens
gaagtgtccgagaactaaag

SEQ ID NO: 4064597 - DNA, 15 bp, Homo sapiens
gaagttaacagagac

SEQ ID NO: 4064598 - DNA, 19 bp, Homo sapiens
gaagttacatgcataaaag

SEQ ID NO: 4064599 - DNA, 20 bp, Homo sapiens
gaagttacatgcataaaagg

SEQ ID NO: 4064600 - DNA, 16 bp, Homo sapiens
gaagttactttatgtt

SEQ ID NO: 4064601 - DNA, 20 bp, Homo sapiens
gaagttctcaaagttaattc

SEQ ID NO: 4064602 - DNA, 23 bp, Homo sapiens
gaagttgacttatagtacatgat

SEQ ID NO: 4064603 - DNA, 17 bp, Homo sapiens
gaagttgcagtgagctg

SEQ ID NO: 4064604 - DNA, 21 bp, Homo sapiens
gaagtttaaaacagtatttat

SEQ ID NO: 4064605 - DNA, 13 bp, Homo sapiens
gaagtttacattt

SEQ ID NO: 4064606 - DNA, 21 bp, Homo sapiens
gaagtttacatttttatttat

SEQ ID NO: 4064607 - DNA, 13 bp, Homo sapiens
gaagttttcagga

SEQ ID NO: 4064608 - DNA, 13 bp, Homo sapiens
gaagttttctgta

SEQ ID NO: 4064609 - DNA, 12 bp, Homo sapiens
gaagttttgcat

SEQ ID NO: 4064610 - DNA, 13 bp, Homo sapiens
gaataaactgaat

SEQ ID NO: 4064611 - DNA, 14 bp, Homo sapiens
gaataaactgaata

SEQ ID NO: 4064612 - DNA, 17 bp, Homo sapiens
gaataaagaatgccatt

SEQ ID NO: 4064613 - DNA, 20 bp, Homo sapiens
gaataaagaatgccatttct

SEQ ID NO: 4064614 - DNA, 18 bp, Homo sapiens
gaataaaggcagctgttg

SEQ ID NO: 4064615 - DNA, 20 bp, Homo sapiens
gaataaagttctgagtgttt

SEQ ID NO: 4064616 - DNA, 14 bp, Homo sapiens
gaataaagttgaag

SEQ ID NO: 4064617 - DNA, 14 bp, Homo sapiens
gaataaagttgcag

SEQ ID NO: 4064618 - DNA, 21 bp, Homo sapiens
gaataaattaatattgtattg

SEQ ID NO: 4064619 - DNA, 20 bp, Homo sapiens
gaataaattcccaacttctc

SEQ ID NO: 4064620 - DNA, 14 bp, Homo sapiens
gaataacatgtaat

SEQ ID NO: 4064621 - DNA, 18 bp, Homo sapiens
gaataacatgtaattaag

SEQ ID NO: 4064622 - DNA, 22 bp, Homo sapiens
gaataaccacttaaaaaatgtc

SEQ ID NO: 4064623 - DNA, 12 bp, Homo sapiens
gaataaggcctt

SEQ ID NO: 4064624 - DNA, 15 bp, Homo sapiens
gaataatctttgggt

SEQ ID NO: 4064625 - DNA, 14 bp, Homo sapiens
gaataatttcccaa

SEQ ID NO: 4064626 - DNA, 21 bp, Homo sapiens
gaataatttcccaattaggaa

SEQ ID NO: 4064627 - DNA, 14 bp, Homo sapiens
gaataatttgtaaa

SEQ ID NO: 4064628 - DNA, 17 bp, Homo sapiens
gaataatttgtaaatga

SEQ ID NO: 4064629 - DNA, 20 bp, Homo sapiens
gaataatttgtaaatgattt

SEQ ID NO: 4064630 - DNA, 14 bp, Homo sapiens
gaatacaattaaag

SEQ ID NO: 4064631 - DNA, 23 bp, Homo sapiens
gaatacagggcatgcattttgca

SEQ ID NO: 4064632 - DNA, 18 bp, Homo sapiens
gaatactgggttcttagt

SEQ ID NO: 4064633 - DNA, 23 bp, Homo sapiens
gaatagaaataaaggatgtgatt

SEQ ID NO: 4064634 - DNA, 23 bp, Homo sapiens
gaatagccacatttggaatactt

SEQ ID NO: 4064635 - DNA, 14 bp, Homo sapiens
gaatagcctggcca

SEQ ID NO: 4064636 - DNA, 22 bp, Homo sapiens
gaatataaacatatacagaaaa

SEQ ID NO: 4064637 - DNA, 22 bp, Homo sapiens
gaatatacatgaagaatagaaa

SEQ ID NO: 4064638 - DNA, 21 bp, Homo sapiens
gaatatatcagtacctctcaa

SEQ ID NO: 4064639 - DNA, 14 bp, Homo sapiens
gaatatctgggatt

SEQ ID NO: 4064640 - DNA, 16 bp, Homo sapiens
gaatatgcaacattgt

SEQ ID NO: 4064641 - DNA, 15 bp, Homo sapiens
gaatatgtttccttg

SEQ ID NO: 4064642 - DNA, 15 bp, Homo sapiens
gaatattgtgattct

SEQ ID NO: 4064643 - DNA, 18 bp, Homo sapiens
gaatatttataacagcat

SEQ ID NO: 4064644 - DNA, 19 bp, Homo sapiens
gaatatttataggccaggg

SEQ ID NO: 4064645 - DNA, 12 bp, Homo sapiens
gaatatttatta

SEQ ID NO: 4064646 - DNA, 14 bp, Homo sapiens
gaatattttatctt

SEQ ID NO: 4064647 - DNA, 22 bp, Homo sapiens
gaatattttggaaactgctaaa

SEQ ID NO: 4064648 - DNA, 23 bp, Homo sapiens
gaatattttgttttgtgcagaga

SEQ ID NO: 4064649 - DNA, 19 bp, Homo sapiens
gaatatttttatatttcct

SEQ ID NO: 4064650 - DNA, 19 bp, Homo sapiens
gaatcaagagctgccctcc

SEQ ID NO: 4064651 - DNA, 12 bp, Homo sapiens
gaatcacctggc

SEQ ID NO: 4064652 - DNA, 13 bp, Homo sapiens
gaatcagaaacag

SEQ ID NO: 4064653 - DNA, 16 bp, Homo sapiens
gaatcagaatcatgga

SEQ ID NO: 4064654 - DNA, 19 bp, Homo sapiens
gaatcatacttagcaaagt

SEQ ID NO: 4064655 - DNA, 14 bp, Homo sapiens
gaatcatggagaaa

SEQ ID NO: 4064656 - DNA, 17 bp, Homo sapiens
gaatcatgtcaggcctg

SEQ ID NO: 4064657 - DNA, 21 bp, Homo sapiens
gaatcatgtcaggcctgtgtg

SEQ ID NO: 4064658 - DNA, 21 bp, Homo sapiens
gaatcattccagtgctagaaa

SEQ ID NO: 4064659 - DNA, 21 bp, Homo sapiens
gaatcattgtccagagctgct

SEQ ID NO: 4064660 - DNA, 19 bp, Homo sapiens
gaatccagctccctagact

SEQ ID NO: 4064661 - DNA, 19 bp, Homo sapiens
gaatcccaaatttgattga

SEQ ID NO: 4064662 - DNA, 16 bp, Homo sapiens
gaatcccactgtatga

SEQ ID NO: 4064663 - DNA, 17 bp, Homo sapiens
gaatcccactgtatgat

SEQ ID NO: 4064664 - DNA, 17 bp, Homo sapiens
gaatcccagaggtggga

SEQ ID NO: 4064665 - DNA, 16 bp, Homo sapiens
gaatcccttaaaatta

SEQ ID NO: 4064666 - DNA, 22 bp, Homo sapiens
gaatctaaggataatgaaataa

SEQ ID NO: 4064667 - DNA, 18 bp, Homo sapiens
gaatctacccccagatcc

SEQ ID NO: 4064668 - DNA, 15 bp, Homo sapiens
gaatctactaattcc

SEQ ID NO: 4064669 - DNA, 19 bp, Homo sapiens
gaatctcaagatgggggca

SEQ ID NO: 4064670 - DNA, 17 bp, Homo sapiens
gaatctgagctgcaggt

SEQ ID NO: 4064671 - DNA, 16 bp, Homo sapiens
gaatctgctcacttta

SEQ ID NO: 4064672 - DNA, 23 bp, Homo sapiens
gaatctgtgcagatgagcagtca

SEQ ID NO: 4064673 - DNA, 18 bp, Homo sapiens
gaatcttaatgcttgtaa

SEQ ID NO: 4064674 - DNA, 16 bp, Homo sapiens
gaatcttgactttctg

SEQ ID NO: 4064675 - DNA, 17 bp, Homo sapiens
gaatcttgactttctga

SEQ ID NO: 4064676 - DNA, 15 bp, Homo sapiens
gaatgaaaaatttaa

SEQ ID NO: 4064677 - DNA, 20 bp, Homo sapiens
gaatgaaaaatttaagcatt

SEQ ID NO: 4064678 - DNA, 23 bp, Homo sapiens
gaatgaaaaatttaagcattgtt

SEQ ID NO: 4064679 - DNA, 14 bp, Homo sapiens
gaatgaaaacattt

SEQ ID NO: 4064680 - DNA, 17 bp, Homo sapiens
gaatgaacccaagagca

SEQ ID NO: 4064681 - DNA, 23 bp, Homo sapiens
gaatgaggaataataagttaaac

SEQ ID NO: 4064682 - DNA, 16 bp, Homo sapiens
gaatgaggtcccaggc

SEQ ID NO: 4064683 - DNA, 22 bp, Homo sapiens
gaatgaggtgggaggtggaaga

SEQ ID NO: 4064684 - DNA, 14 bp, Homo sapiens
gaatgagtgtgcat

SEQ ID NO: 4064685 - DNA, 21 bp, Homo sapiens
gaatgatcaagtcctttgtga

SEQ ID NO: 4064686 - DNA, 14 bp, Homo sapiens
gaatgattaatcaa

SEQ ID NO: 4064687 - DNA, 14 bp, Homo sapiens
gaatgcaatccttc

SEQ ID NO: 4064688 - DNA, 20 bp, Homo sapiens
gaatgcacaagaatggatca

SEQ ID NO: 4064689 - DNA, 21 bp, Homo sapiens
gaatgcacaagaatggatcac

SEQ ID NO: 4064690 - DNA, 22 bp, Homo sapiens
gaatgcagggaatgcaatcctt

SEQ ID NO: 4064691 - DNA, 13 bp, Homo sapiens
gaatgccatttct

SEQ ID NO: 4064692 - DNA, 16 bp, Homo sapiens
gaatgccatttctcac

SEQ ID NO: 4064693 - DNA, 17 bp, Homo sapiens
gaatgccatttctcacg

SEQ ID NO: 4064694 - DNA, 23 bp, Homo sapiens
gaatgccatttctcacgccctct

SEQ ID NO: 4064695 - DNA, 20 bp, Homo sapiens
gaatgcctcaatgtgaccag

SEQ ID NO: 4064696 - DNA, 16 bp, Homo sapiens
cttccccaaataatat

SEQ ID NO: 4064697 - DNA, 15 bp, Homo sapiens
cttcccctccaggag

SEQ ID NO: 4064698 - DNA, 17 bp, Homo sapiens
cttccccttagaaacac

SEQ ID NO: 4064699 - DNA, 14 bp, Homo sapiens
cttccccttccttc

SEQ ID NO: 4064700 - DNA, 18 bp, Homo sapiens
cttccccttctgtgtcac

SEQ ID NO: 4064701 - DNA, 13 bp, Homo sapiens
cttcccctttccc

SEQ ID NO: 4064702 - DNA, 19 bp, Homo sapiens
cttcccgccagagggcttg

SEQ ID NO: 4064703 - DNA, 17 bp, Homo sapiens
cttcccgctcagccctc

SEQ ID NO: 4064704 - DNA, 18 bp, Homo sapiens
cttcccgctcagccctcc

SEQ ID NO: 4064705 - DNA, 23 bp, Homo sapiens
cttcccgctcagccctccctgcc

SEQ ID NO: 4064706 - DNA, 19 bp, Homo sapiens
cttcccgggccagggctgc

SEQ ID NO: 4064707 - DNA, 18 bp, Homo sapiens
cttccctcacccccagca

SEQ ID NO: 4064708 - DNA, 14 bp, Homo sapiens
cttccctccctgct

SEQ ID NO: 4064709 - DNA, 16 bp, Homo sapiens
cttccctccctgctgt

SEQ ID NO: 4064710 - DNA, 23 bp, Homo sapiens
cttccctctctgatgtcccagtg

SEQ ID NO: 4064711 - DNA, 12 bp, Homo sapiens
cttccctctggg

SEQ ID NO: 4064712 - DNA, 22 bp, Homo sapiens
cttccctgagtgcgggctgagg

SEQ ID NO: 4064713 - DNA, 19 bp, Homo sapiens
cttccctgattgacctgct

SEQ ID NO: 4064714 - DNA, 20 bp, Homo sapiens
cttccctgattgacctgctc

SEQ ID NO: 4064715 - DNA, 16 bp, Homo sapiens
cttccctgctcttgca

SEQ ID NO: 4064716 - DNA, 15 bp, Homo sapiens
cttccctgctttgca

SEQ ID NO: 4064717 - DNA, 22 bp, Homo sapiens
cttccgatggatgaatctccca

SEQ ID NO: 4064718 - DNA, 18 bp, Homo sapiens
cttccgccaatctggccc

SEQ ID NO: 4064719 - DNA, 19 bp, Homo sapiens
cttccgccaatctggccct

SEQ ID NO: 4064720 - DNA, 22 bp, Homo sapiens
cttcctaaacccaatgacttcc

SEQ ID NO: 4064721 - DNA, 18 bp, Homo sapiens
cttcctacaagagcagcc

SEQ ID NO: 4064722 - DNA, 22 bp, Homo sapiens
cttcctacaagagcagcctgtg

SEQ ID NO: 4064723 - DNA, 24 bp, Homo sapiens
cttcctacaagagcagcctgtggc

SEQ ID NO: 4064724 - DNA, 16 bp, Homo sapiens
cttcctacccacacct

SEQ ID NO: 4064725 - DNA, 19 bp, Homo sapiens
cttcctacccacacctctg

SEQ ID NO: 4064726 - DNA, 22 bp, Homo sapiens
cttcctacccacacctctgcca

SEQ ID NO: 4064727 - DNA, 16 bp, Homo sapiens
cttcctagttcatccc

SEQ ID NO: 4064728 - DNA, 20 bp, Homo sapiens
cttcctatgcccaggtacca

SEQ ID NO: 4064729 - DNA, 14 bp, Homo sapiens
cttcctcacacccc

SEQ ID NO: 4064730 - DNA, 15 bp, Homo sapiens
cttcctcacacccct

SEQ ID NO: 4064731 - DNA, 19 bp, Homo sapiens
cttcctcacacccctgtcc

SEQ ID NO: 4064732 - DNA, 20 bp, Homo sapiens
cttcctcactatgacactga

SEQ ID NO: 4064733 - DNA, 23 bp, Homo sapiens
cttcctcagatgatgtttgcttt

SEQ ID NO: 4064734 - DNA, 18 bp, Homo sapiens
cttcctcagctgcctcct

SEQ ID NO: 4064735 - DNA, 19 bp, Homo sapiens
cttcctcagctgcctcctg

SEQ ID NO: 4064736 - DNA, 22 bp, Homo sapiens
cttcctcagctggttactcagg

SEQ ID NO: 4064737 - DNA, 23 bp, Homo sapiens
cttcctcagctggttactcaggg

SEQ ID NO: 4064738 - DNA, 18 bp, Homo sapiens
cttcctcatccaccccat

SEQ ID NO: 4064739 - DNA, 15 bp, Homo sapiens
cttcctccagctgca

SEQ ID NO: 4064740 - DNA, 17 bp, Homo sapiens
cttcctccagctgcacc

SEQ ID NO: 4064741 - DNA, 22 bp, Homo sapiens
cttcctccagctgcaccagagc

SEQ ID NO: 4064742 - DNA, 14 bp, Homo sapiens
cttcctccatcctc

SEQ ID NO: 4064743 - DNA, 13 bp, Homo sapiens
cttcctctccact

SEQ ID NO: 4064744 - DNA, 15 bp, Homo sapiens
cttcctctctccaga

SEQ ID NO: 4064745 - DNA, 12 bp, Homo sapiens
cttcctctgctc

SEQ ID NO: 4064746 - DNA, 15 bp, Homo sapiens
cttcctctgctcccc

SEQ ID NO: 4064747 - DNA, 22 bp, Homo sapiens
cttcctgaagggggacactcca

SEQ ID NO: 4064748 - DNA, 20 bp, Homo sapiens
cttcctgattggtttctctt

SEQ ID NO: 4064749 - DNA, 22 bp, Homo sapiens
cttcctgattggtttctcttct

SEQ ID NO: 4064750 - DNA, 23 bp, Homo sapiens
cttcctgattggtttctcttctc

SEQ ID NO: 4064751 - DNA, 15 bp, Homo sapiens
cttcctgcaaggact

SEQ ID NO: 4064752 - DNA, 16 bp, Homo sapiens
cttcctgcccttccct

SEQ ID NO: 4064753 - DNA, 17 bp, Homo sapiens
cttcctgcccttccctc

SEQ ID NO: 4064754 - DNA, 17 bp, Homo sapiens
cttagtatctcatcaac

SEQ ID NO: 4064755 - DNA, 22 bp, Homo sapiens
cttagtatctcatcaacaaaga

SEQ ID NO: 4064756 - DNA, 18 bp, Homo sapiens
cttagtatttctcaggaa

SEQ ID NO: 4064757 - DNA, 17 bp, Homo sapiens
cttagtcaaatgtaatg

SEQ ID NO: 4064758 - DNA, 13 bp, Homo sapiens
cttagtcccaagc

SEQ ID NO: 4064759 - DNA, 15 bp, Homo sapiens
cttagtcccaagcta

SEQ ID NO: 4064760 - DNA, 13 bp, Homo sapiens
cttagtctcagtt

SEQ ID NO: 4064761 - DNA, 19 bp, Homo sapiens
cttagtctcagtttgtgtg

SEQ ID NO: 4064762 - DNA, 20 bp, Homo sapiens
cttagtctcagtttgtgtgt

SEQ ID NO: 4064763 - DNA, 21 bp, Homo sapiens
cttagtgattgagactcaaaa

SEQ ID NO: 4064764 - DNA, 22 bp, Homo sapiens
cttagtgcggacaagttttaat

SEQ ID NO: 4064765 - DNA, 18 bp, Homo sapiens
cttagtgggccagggctg

SEQ ID NO: 4064766 - DNA, 23 bp, Homo sapiens
cttagtgggccagggctgccctg

SEQ ID NO: 4064767 - DNA, 16 bp, Homo sapiens
cttagttacatttcta

SEQ ID NO: 4064768 - DNA, 13 bp, Homo sapiens
cttagttactttt

SEQ ID NO: 4064769 - DNA, 14 bp, Homo sapiens
cttagttctcactg

SEQ ID NO: 4064770 - DNA, 17 bp, Homo sapiens
cttagttggctttgccc

SEQ ID NO: 4064771 - DNA, 19 bp, Homo sapiens
cttagttggctttgcccac

SEQ ID NO: 4064772 - DNA, 15 bp, Homo sapiens
cttataaaccaatct

SEQ ID NO: 4064773 - DNA, 12 bp, Homo sapiens
cttatacacatt

SEQ ID NO: 4064774 - DNA, 16 bp, Homo sapiens
cttatagaataaaagc

SEQ ID NO: 4064775 - DNA, 14 bp, Homo sapiens
cttatagaatattt

SEQ ID NO: 4064776 - DNA, 15 bp, Homo sapiens
cttatagaatattta

SEQ ID NO: 4064777 - DNA, 19 bp, Homo sapiens
cttatagtacatgataaat

SEQ ID NO: 4064778 - DNA, 14 bp, Homo sapiens
cttatatgtacttt

SEQ ID NO: 4064779 - DNA, 23 bp, Homo sapiens
cttatattgaagacaatttgata

SEQ ID NO: 4064780 - DNA, 15 bp, Homo sapiens
cttatatttacaata

SEQ ID NO: 4064781 - DNA, 23 bp, Homo sapiens
cttatatttccctaaaatacatt

SEQ ID NO: 4064782 - DNA, 17 bp, Homo sapiens
cttatcaactggttgta

SEQ ID NO: 4064783 - DNA, 13 bp, Homo sapiens
cttatccaggact

SEQ ID NO: 4064784 - DNA, 14 bp, Homo sapiens
cttatccctctctt

SEQ ID NO: 4064785 - DNA, 16 bp, Homo sapiens
cttatccctctcttcc

SEQ ID NO: 4064786 - DNA, 18 bp, Homo sapiens
cttatccctctcttcccc

SEQ ID NO: 4064787 - DNA, 19 bp, Homo sapiens
cttatctgtgcgtgaaaca

SEQ ID NO: 4064788 - DNA, 20 bp, Homo sapiens
cttatctgtgcgtgaaacac

SEQ ID NO: 4064789 - DNA, 21 bp, Homo sapiens
cttatgaataagcacttgaat

SEQ ID NO: 4064790 - DNA, 21 bp, Homo sapiens
cttatgattaaacttccttct

SEQ ID NO: 4064791 - DNA, 15 bp, Homo sapiens
cttatgattgcagat

SEQ ID NO: 4064792 - DNA, 14 bp, Homo sapiens
cttatgcaaaatgg

SEQ ID NO: 4064793 - DNA, 15 bp, Homo sapiens
cttatgcaaaatgga

SEQ ID NO: 4064794 - DNA, 15 bp, Homo sapiens
cttatgctgatttat

SEQ ID NO: 4064795 - DNA, 16 bp, Homo sapiens
cttatggagctcacac

SEQ ID NO: 4064796 - DNA, 14 bp, Homo sapiens
cttatgtcctgtca

SEQ ID NO: 4064797 - DNA, 23 bp, Homo sapiens
cttattaattcttcacctgttat

SEQ ID NO: 4064798 - DNA, 19 bp, Homo sapiens
cttattcctaatggctatt

SEQ ID NO: 4064799 - DNA, 14 bp, Homo sapiens
cttattcctctagg

SEQ ID NO: 4064800 - DNA, 14 bp, Homo sapiens
cttattgcgctgct

SEQ ID NO: 4064801 - DNA, 17 bp, Homo sapiens
cttattgcgctgctacc

SEQ ID NO: 4064802 - DNA, 20 bp, Homo sapiens
cttattgttccaagacattg

SEQ ID NO: 4064803 - DNA, 22 bp, Homo sapiens
cttattgttccaagacattgtc

SEQ ID NO: 4064804 - DNA, 13 bp, Homo sapiens
cttatttaaaaat

SEQ ID NO: 4064805 - DNA, 18 bp, Homo sapiens
cttatttaaaaatatttc

SEQ ID NO: 4064806 - DNA, 22 bp, Homo sapiens
cttatttaaaaatatttcagat

SEQ ID NO: 4064807 - DNA, 16 bp, Homo sapiens
attttcattaaacttg

SEQ ID NO: 4064808 - DNA, 18 bp, Homo sapiens
attttccacgcagttctt

SEQ ID NO: 4064809 - DNA, 18 bp, Homo sapiens
attttcccatcatccttt

SEQ ID NO: 4064810 - DNA, 20 bp, Homo sapiens
attttcccatcatcctttgt

SEQ ID NO: 4064811 - DNA, 20 bp, Homo sapiens
attttcccccactactgcag

SEQ ID NO: 4064812 - DNA, 22 bp, Homo sapiens
attttccccccactctccccac

SEQ ID NO: 4064813 - DNA, 20 bp, Homo sapiens
attttcccccttttctgcat

SEQ ID NO: 4064814 - DNA, 22 bp, Homo sapiens
attttcccccttttctgcattt

SEQ ID NO: 4064815 - DNA, 21 bp, Homo sapiens
attttccctcttggtgtgatt

SEQ ID NO: 4064816 - DNA, 14 bp, Homo sapiens
attttcctcctctg

SEQ ID NO: 4064817 - DNA, 15 bp, Homo sapiens
attttcctcctctgc

SEQ ID NO: 4064818 - DNA, 12 bp, Homo sapiens
attttcctctgg

SEQ ID NO: 4064819 - DNA, 15 bp, Homo sapiens
attttcctctggccg

SEQ ID NO: 4064820 - DNA, 15 bp, Homo sapiens
attttcctcttgtga

SEQ ID NO: 4064821 - DNA, 17 bp, Homo sapiens
attttcctttttcttcg

SEQ ID NO: 4064822 - DNA, 16 bp, Homo sapiens
attttctactgtaaga

SEQ ID NO: 4064823 - DNA, 17 bp, Homo sapiens
attttctataacagata

SEQ ID NO: 4064824 - DNA, 16 bp, Homo sapiens
attttctattgttact

SEQ ID NO: 4064825 - DNA, 20 bp, Homo sapiens
attttctattgttactctgg

SEQ ID NO: 4064826 - DNA, 17 bp, Homo sapiens
attttctcaaaagcatt

SEQ ID NO: 4064827 - DNA, 18 bp, Homo sapiens
attttctctgtgtttgtt

SEQ ID NO: 4064828 - DNA, 22 bp, Homo sapiens
attttctctgtgtttgttccta

SEQ ID NO: 4064829 - DNA, 15 bp, Homo sapiens
attttctgacatgca

SEQ ID NO: 4064830 - DNA, 11 bp, Homo sapiens
attttctgttg

SEQ ID NO: 4064831 - DNA, 19 bp, Homo sapiens
attttcttatcttctgcaa

SEQ ID NO: 4064832 - DNA, 18 bp, Homo sapiens
attttcttcatgcaatga

SEQ ID NO: 4064833 - DNA, 19 bp, Homo sapiens
attttctttaatgctttta

SEQ ID NO: 4064834 - DNA, 17 bp, Homo sapiens
attttgaaaagatgtac

SEQ ID NO: 4064835 - DNA, 18 bp, Homo sapiens
attttgaaaagcttctta

SEQ ID NO: 4064836 - DNA, 19 bp, Homo sapiens
attttgaaaagcttcttaa

SEQ ID NO: 4064837 - DNA, 23 bp, Homo sapiens
attttgaagaatatttaagaaaa

SEQ ID NO: 4064838 - DNA, 12 bp, Homo sapiens
attttgaagttt

SEQ ID NO: 4064839 - DNA, 16 bp, Homo sapiens
attttgaagtttacat

SEQ ID NO: 4064840 - DNA, 18 bp, Homo sapiens
attttgacctactctcat

SEQ ID NO: 4064841 - DNA, 23 bp, Homo sapiens
attttgagtgactcgagggttgg

SEQ ID NO: 4064842 - DNA, 15 bp, Homo sapiens
attttgataataaat

SEQ ID NO: 4064843 - DNA, 17 bp, Homo sapiens
attttgataccagaagg

SEQ ID NO: 4064844 - DNA, 19 bp, Homo sapiens
attttgataccagaaggga

SEQ ID NO: 4064845 - DNA, 19 bp, Homo sapiens
attttgatgtgacaataat

SEQ ID NO: 4064846 - DNA, 20 bp, Homo sapiens
attttgcaaaaatcctattc

SEQ ID NO: 4064847 - DNA, 18 bp, Homo sapiens
attttgcaaaatttccag

SEQ ID NO: 4064848 - DNA, 13 bp, Homo sapiens
attttgcaaatat

SEQ ID NO: 4064849 - DNA, 14 bp, Homo sapiens
attttgcagcagtg

SEQ ID NO: 4064850 - DNA, 15 bp, Homo sapiens
attttgcagcagtga

SEQ ID NO: 4064851 - DNA, 16 bp, Homo sapiens
attttgcattccagaa

SEQ ID NO: 4064852 - DNA, 18 bp, Homo sapiens
attttgcctcttttctct

SEQ ID NO: 4064853 - DNA, 21 bp, Homo sapiens
attttgcctcttttctctgtg

SEQ ID NO: 4064854 - DNA, 17 bp, Homo sapiens
attttgctattgtaaat

SEQ ID NO: 4064855 - DNA, 22 bp, Homo sapiens
attttgctattgtaaatatgtt

SEQ ID NO: 4064856 - DNA, 23 bp, Homo sapiens
attttgctattgtaaatatgttt

SEQ ID NO: 4064857 - DNA, 12 bp, Homo sapiens
attttgctgtat

SEQ ID NO: 4064858 - DNA, 14 bp, Homo sapiens
attttgctgtatat

SEQ ID NO: 4064859 - DNA, 14 bp, Homo sapiens
attttggaaaataa

SEQ ID NO: 4064860 - DNA, 16 bp, Homo sapiens
attttggaaactgcta

SEQ ID NO: 4064861 - DNA, 19 bp, Homo sapiens
attttggaaactgctaaat

SEQ ID NO: 4064862 - DNA, 23 bp, Homo sapiens
attttggaaactgctaaattcta

SEQ ID NO: 4064863 - DNA, 17 bp, Homo sapiens
attttggaagattttca

SEQ ID NO: 4064864 - DNA, 19 bp, Homo sapiens
attttggataaatcatttc

SEQ ID NO: 4064865 - DNA, 19 bp, Homo sapiens
attttggatatattattgt

SEQ ID NO: 4064866 - DNA, 22 bp, Homo sapiens
attttgggacaattgttttaat

SEQ ID NO: 4064867 - DNA, 23 bp, Homo sapiens
attttggggaagggtttgaattg

SEQ ID NO: 4064868 - DNA, 16 bp, Homo sapiens
attttggggtctcttt

SEQ ID NO: 4064869 - DNA, 14 bp, Homo sapiens
attttgtactttgt

SEQ ID NO: 4064870 - DNA, 12 bp, Homo sapiens
attttgtgaatg

SEQ ID NO: 4064871 - DNA, 20 bp, Homo sapiens
attttgtggctttctttctt

SEQ ID NO: 4064872 - DNA, 15 bp, Homo sapiens
attttgtggttctat

SEQ ID NO: 4064873 - DNA, 21 bp, Homo sapiens
attttgtggttctattttact

SEQ ID NO: 4064874 - DNA, 12 bp, Homo sapiens
attttgtgtcct

SEQ ID NO: 4064875 - DNA, 12 bp, Homo sapiens
attttgttctgt

SEQ ID NO: 4064876 - DNA, 13 bp, Homo sapiens
attttgttgcctt

SEQ ID NO: 4064877 - DNA, 20 bp, Homo sapiens
attttgtttcttttaaagca

SEQ ID NO: 4064878 - DNA, 17 bp, Homo sapiens
atttttaaaaagaaatc

SEQ ID NO: 4064879 - DNA, 14 bp, Homo sapiens
atttttaaagtaga

SEQ ID NO: 4064880 - DNA, 19 bp, Homo sapiens
atttttaaagtagaagagg

SEQ ID NO: 4064881 - DNA, 19 bp, Homo sapiens
atttttaaatgtaaaacat

SEQ ID NO: 4064882 - DNA, 14 bp, Homo sapiens
atttttaaattgtt

SEQ ID NO: 4064883 - DNA, 13 bp, Homo sapiens
atttttaagaact

SEQ ID NO: 4064884 - DNA, 14 bp, Homo sapiens
atttttaagaactt

SEQ ID NO: 4064885 - DNA, 15 bp, Homo sapiens
atttttaattttatg

SEQ ID NO: 4064886 - DNA, 20 bp, Homo sapiens
atttttaattttcacaaaat

SEQ ID NO: 4064887 - DNA, 14 bp, Homo sapiens
atttttacaataaa

SEQ ID NO: 4064888 - DNA, 15 bp, Homo sapiens
atttttacctaaaga

SEQ ID NO: 4064889 - DNA, 22 bp, Homo sapiens
atttttagcctgtgtcattgcc

SEQ ID NO: 4064890 - DNA, 17 bp, Homo sapiens
atttttaggcaaagata

SEQ ID NO: 4064891 - DNA, 20 bp, Homo sapiens
atttttatatcagcctgagt

SEQ ID NO: 4064892 - DNA, 22 bp, Homo sapiens
atttttatatcatgcaaaatat

SEQ ID NO: 4064893 - DNA, 22 bp, Homo sapiens
atttttatattgtttttgtatt

SEQ ID NO: 4064894 - DNA, 16 bp, Homo sapiens
atttttatatttcctt

SEQ ID NO: 4064895 - DNA, 17 bp, Homo sapiens
atttttatcatgaattc

SEQ ID NO: 4064896 - DNA, 16 bp, Homo sapiens
atttttattaaagcat

SEQ ID NO: 4064897 - DNA, 14 bp, Homo sapiens
atttttatttatat

SEQ ID NO: 4064898 - DNA, 16 bp, Homo sapiens
atttttatttatgaag

SEQ ID NO: 4064899 - DNA, 18 bp, Homo sapiens
atttttatttctttttaa

SEQ ID NO: 4064900 - DNA, 16 bp, Homo sapiens
atttttatttttctaa

SEQ ID NO: 4064901 - DNA, 15 bp, Homo sapiens
atttttcaaggaagg

SEQ ID NO: 4064902 - DNA, 14 bp, Homo sapiens
atttttcagatgct

SEQ ID NO: 4064903 - DNA, 17 bp, Homo sapiens
atttttcagcacttaac

SEQ ID NO: 4064904 - DNA, 18 bp, Homo sapiens
atttttctaaccttgaat

SEQ ID NO: 4064905 - DNA, 17 bp, Homo sapiens
atttttctcaaagtttt

SEQ ID NO: 4064906 - DNA, 21 bp, Homo sapiens
atttttctcaaagttttgaaa

SEQ ID NO: 4064907 - DNA, 18 bp, Homo sapiens
atttttctcccaagaaac

SEQ ID NO: 4064908 - DNA, 14 bp, Homo sapiens
cttaaacctgggag

SEQ ID NO: 4064909 - DNA, 19 bp, Homo sapiens
cttaaactaaataatgaat

SEQ ID NO: 4064910 - DNA, 20 bp, Homo sapiens
cttaaactaaataatgaata

SEQ ID NO: 4064911 - DNA, 22 bp, Homo sapiens
cttaaactgtacagaatttcca

SEQ ID NO: 4064912 - DNA, 15 bp, Homo sapiens
cttaaactgtgtgga

SEQ ID NO: 4064913 - DNA, 21 bp, Homo sapiens
cttaaaggctgtggtagtact

SEQ ID NO: 4064914 - DNA, 18 bp, Homo sapiens
cttaaagtttaaagttgc

SEQ ID NO: 4064915 - DNA, 16 bp, Homo sapiens
cttaaatatcttttat

SEQ ID NO: 4064916 - DNA, 19 bp, Homo sapiens
cttaaatcagaataaatta

SEQ ID NO: 4064917 - DNA, 18 bp, Homo sapiens
cttaaatttcttatgtga

SEQ ID NO: 4064918 - DNA, 22 bp, Homo sapiens
cttaaatttcttatgtgacatt

SEQ ID NO: 4064919 - DNA, 21 bp, Homo sapiens
cttaaatttgatttacatata

SEQ ID NO: 4064920 - DNA, 23 bp, Homo sapiens
cttaacatacacgttaactgcag

SEQ ID NO: 4064921 - DNA, 14 bp, Homo sapiens
cttaacattctgta

SEQ ID NO: 4064922 - DNA, 17 bp, Homo sapiens
cttaagaacacaaagcg

SEQ ID NO: 4064923 - DNA, 15 bp, Homo sapiens
cttaagcaaaagaaa

SEQ ID NO: 4064924 - DNA, 11 bp, Homo sapiens
cttaagcacaa

SEQ ID NO: 4064925 - DNA, 13 bp, Homo sapiens
cttaagcagcatg

SEQ ID NO: 4064926 - DNA, 15 bp, Homo sapiens
cttaagcagcatgga

SEQ ID NO: 4064927 - DNA, 16 bp, Homo sapiens
cttaagcagcatggaa

SEQ ID NO: 4064928 - DNA, 21 bp, Homo sapiens
cttaagcagcatggaaaaatg

SEQ ID NO: 4064929 - DNA, 22 bp, Homo sapiens
cttaagcagcatggaaaaatgg

SEQ ID NO: 4064930 - DNA, 14 bp, Homo sapiens
cttaagctgcagga

SEQ ID NO: 4064931 - DNA, 20 bp, Homo sapiens
cttaaggacaaaaatgaact

SEQ ID NO: 4064932 - DNA, 21 bp, Homo sapiens
cttaaggatggagccagctct

SEQ ID NO: 4064933 - DNA, 14 bp, Homo sapiens
cttaagtagtttct

SEQ ID NO: 4064934 - DNA, 19 bp, Homo sapiens
cttaagttctatgaagagt

SEQ ID NO: 4064935 - DNA, 12 bp, Homo sapiens
cttaataaattc

SEQ ID NO: 4064936 - DNA, 20 bp, Homo sapiens
cttaataaattgtgtttcct

SEQ ID NO: 4064937 - DNA, 15 bp, Homo sapiens
cttaataactgtgta

SEQ ID NO: 4064938 - DNA, 22 bp, Homo sapiens
cttaatactcaaatgagtaaca

SEQ ID NO: 4064939 - DNA, 15 bp, Homo sapiens
cttaatagccctccc

SEQ ID NO: 4064940 - DNA, 19 bp, Homo sapiens
cttaatagtagttagctta

SEQ ID NO: 4064941 - DNA, 14 bp, Homo sapiens
cttaatatgttaac

SEQ ID NO: 4064942 - DNA, 21 bp, Homo sapiens
cttaatcaagatttttttcct

SEQ ID NO: 4064943 - DNA, 20 bp, Homo sapiens
cttaatctgtgtgtatattg

SEQ ID NO: 4064944 - DNA, 22 bp, Homo sapiens
cttaatgttcacatagtgaaat

SEQ ID NO: 4064945 - DNA, 15 bp, Homo sapiens
cttaatgtttattcc

SEQ ID NO: 4064946 - DNA, 14 bp, Homo sapiens
cttaattaatttga

SEQ ID NO: 4064947 - DNA, 19 bp, Homo sapiens
cttaattcctttctcatcc

SEQ ID NO: 4064948 - DNA, 18 bp, Homo sapiens
cttaattgatgcaaataa

SEQ ID NO: 4064949 - DNA, 14 bp, Homo sapiens
cttaattttcagta

SEQ ID NO: 4064950 - DNA, 11 bp, Homo sapiens
cttacaaactt

SEQ ID NO: 4064951 - DNA, 14 bp, Homo sapiens
cttacaaagcctta

SEQ ID NO: 4064952 - DNA, 17 bp, Homo sapiens
cttacaaagccttacac

SEQ ID NO: 4064953 - DNA, 14 bp, Homo sapiens
cttacacactcagg

SEQ ID NO: 4064954 - DNA, 18 bp, Homo sapiens
cttacacactcaggcctg

SEQ ID NO: 4064955 - DNA, 14 bp, Homo sapiens
cttacatgcatttg

SEQ ID NO: 4064956 - DNA, 20 bp, Homo sapiens
cttacattgttcaattagaa

SEQ ID NO: 4064957 - DNA, 17 bp, Homo sapiens
atttagggtactaaatt

SEQ ID NO: 4064958 - DNA, 19 bp, Homo sapiens
atttagggtactaaattta

SEQ ID NO: 4064959 - DNA, 18 bp, Homo sapiens
atttaggtttttattagt

SEQ ID NO: 4064960 - DNA, 14 bp, Homo sapiens
atttagtcatgtga

SEQ ID NO: 4064961 - DNA, 12 bp, Homo sapiens
atttagtcctgt

SEQ ID NO: 4064962 - DNA, 18 bp, Homo sapiens
atttagtctaagatgatt

SEQ ID NO: 4064963 - DNA, 15 bp, Homo sapiens
atttagtgtatccat

SEQ ID NO: 4064964 - DNA, 22 bp, Homo sapiens
atttataaatatatttaagata

SEQ ID NO: 4064965 - DNA, 18 bp, Homo sapiens
atttataaccccagcctg

SEQ ID NO: 4064966 - DNA, 15 bp, Homo sapiens
atttataactcatca

SEQ ID NO: 4064967 - DNA, 20 bp, Homo sapiens
atttataactcatcataaaa

SEQ ID NO: 4064968 - DNA, 14 bp, Homo sapiens
atttataagcagat

SEQ ID NO: 4064969 - DNA, 17 bp, Homo sapiens
atttataagcagattta

SEQ ID NO: 4064970 - DNA, 14 bp, Homo sapiens
atttataatgttag

SEQ ID NO: 4064971 - DNA, 14 bp, Homo sapiens
atttataatgtttg

SEQ ID NO: 4064972 - DNA, 11 bp, Homo sapiens
atttataattg

SEQ ID NO: 4064973 - DNA, 13 bp, Homo sapiens
atttatacctcaa

SEQ ID NO: 4064974 - DNA, 18 bp, Homo sapiens
atttatacctcaaactat

SEQ ID NO: 4064975 - DNA, 23 bp, Homo sapiens
atttataggccagggcatgtgta

SEQ ID NO: 4064976 - DNA, 15 bp, Homo sapiens
atttatataaatgta

SEQ ID NO: 4064977 - DNA, 18 bp, Homo sapiens
atttatataaatgtaaaa

SEQ ID NO: 4064978 - DNA, 21 bp, Homo sapiens
atttatatcagtttcatgaaa

SEQ ID NO: 4064979 - DNA, 13 bp, Homo sapiens
atttatatttcac

SEQ ID NO: 4064980 - DNA, 19 bp, Homo sapiens
atttatatttttaaaatat

SEQ ID NO: 4064981 - DNA, 18 bp, Homo sapiens
atttatatttttatttta

SEQ ID NO: 4064982 - DNA, 14 bp, Homo sapiens
atttatcaaagcat

SEQ ID NO: 4064983 - DNA, 18 bp, Homo sapiens
atttatcagtgacagagt

SEQ ID NO: 4064984 - DNA, 13 bp, Homo sapiens
atttatctaaatt

SEQ ID NO: 4064985 - DNA, 14 bp, Homo sapiens
atttatctctattt

SEQ ID NO: 4064986 - DNA, 19 bp, Homo sapiens
atttatctctatttaatat

SEQ ID NO: 4064987 - DNA, 22 bp, Homo sapiens
atttatctctatttaatattta

SEQ ID NO: 4064988 - DNA, 16 bp, Homo sapiens
atttatctttcaaaga

SEQ ID NO: 4064989 - DNA, 15 bp, Homo sapiens
atttatgagtttttg

SEQ ID NO: 4064990 - DNA, 19 bp, Homo sapiens
atttatgagtttttgatag

SEQ ID NO: 4064991 - DNA, 17 bp, Homo sapiens
atttatgatttaataaa

SEQ ID NO: 4064992 - DNA, 19 bp, Homo sapiens
atttatgatttaataaaat

SEQ ID NO: 4064993 - DNA, 17 bp, Homo sapiens
atttatgcaagttaggg

SEQ ID NO: 4064994 - DNA, 13 bp, Homo sapiens
atttatgcacatt

SEQ ID NO: 4064995 - DNA, 14 bp, Homo sapiens
atttatgcactgtg

SEQ ID NO: 4064996 - DNA, 14 bp, Homo sapiens
atttatgtagatgt

SEQ ID NO: 4064997 - DNA, 20 bp, Homo sapiens
atttatgtagatgtgcattt

SEQ ID NO: 4064998 - DNA, 16 bp, Homo sapiens
atttatgtgtatatgg

SEQ ID NO: 4064999 - DNA, 19 bp, Homo sapiens
atttatgtgtgaggagctg

SEQ ID NO: 4065000 - DNA, 22 bp, Homo sapiens
atttatgtgtgaggagctgctg

SEQ ID NO: 4065001 - DNA, 13 bp, Homo sapiens
atttatgtttgca

SEQ ID NO: 4065002 - DNA, 21 bp, Homo sapiens
atttattaagatggattctca

SEQ ID NO: 4065003 - DNA, 15 bp, Homo sapiens
atttattaatattta

SEQ ID NO: 4065004 - DNA, 22 bp, Homo sapiens
atttattactgtccctatctat

SEQ ID NO: 4065005 - DNA, 11 bp, Homo sapiens
atttattattt

SEQ ID NO: 4065006 - DNA, 14 bp, Homo sapiens
atttattatttacc

SEQ ID NO: 4065007 - DNA, 21 bp, Homo sapiens
atttattattttcacctgttt

SEQ ID NO: 4065008 - DNA, 19 bp, Homo sapiens
atttattcaattcctctgg

SEQ ID NO: 4065009 - DNA, 18 bp, Homo sapiens
atttattcctctgtccta

SEQ ID NO: 4065010 - DNA, 24 bp, Homo sapiens
atttattgcagaggatgttcataa

SEQ ID NO: 4065011 - DNA, 23 bp, Homo sapiens
atttattgttagaaaatgactta

SEQ ID NO: 4065012 - DNA, 16 bp, Homo sapiens
atttattgtttatgta

SEQ ID NO: 4065013 - DNA, 22 bp, Homo sapiens
atttattgtttatttatcagtg

SEQ ID NO: 4065014 - DNA, 14 bp, Homo sapiens
atttatttaaattt

SEQ ID NO: 4065015 - DNA, 15 bp, Homo sapiens
atttatttaatattt

SEQ ID NO: 4065016 - DNA, 15 bp, Homo sapiens
atttatttaatgtta

SEQ ID NO: 4065017 - DNA, 15 bp, Homo sapiens
atttatttaattttc

SEQ ID NO: 4065018 - DNA, 13 bp, Homo sapiens
atttatttacaga

SEQ ID NO: 4065019 - DNA, 16 bp, Homo sapiens
atttatttattaagat

SEQ ID NO: 4065020 - DNA, 14 bp, Homo sapiens
atttatttatttat

SEQ ID NO: 4065021 - DNA, 18 bp, Homo sapiens
atttatttcaataaatct

SEQ ID NO: 4065022 - DNA, 21 bp, Homo sapiens
atttatttccactaaaaatat

SEQ ID NO: 4065023 - DNA, 12 bp, Homo sapiens
atttatttcctc

SEQ ID NO: 4065024 - DNA, 15 bp, Homo sapiens
atttattttaatgta

SEQ ID NO: 4065025 - DNA, 15 bp, Homo sapiens
atttattttgtaatt

SEQ ID NO: 4065026 - DNA, 18 bp, Homo sapiens
atttatttttacaagaag

SEQ ID NO: 4065027 - DNA, 19 bp, Homo sapiens
atttattttttacattatt

SEQ ID NO: 4065028 - DNA, 18 bp, Homo sapiens
atttcaaaaatataactt

SEQ ID NO: 4065029 - DNA, 15 bp, Homo sapiens
atttcaaaatgcttt

SEQ ID NO: 4065030 - DNA, 13 bp, Homo sapiens
atttcacaacaga

SEQ ID NO: 4065031 - DNA, 10 bp, Homo sapiens
atttcacaag

SEQ ID NO: 4065032 - DNA, 19 bp, Homo sapiens
atttcactatcttcttcaa

SEQ ID NO: 4065033 - DNA, 14 bp, Homo sapiens
atttcactattttt

SEQ ID NO: 4065034 - DNA, 23 bp, Homo sapiens
atttcactgtctttaattctgta

SEQ ID NO: 4065035 - DNA, 12 bp, Homo sapiens
atttcacttgat

SEQ ID NO: 4065036 - DNA, 19 bp, Homo sapiens
atttcacttgatgatacaa

SEQ ID NO: 4065037 - DNA, 15 bp, Homo sapiens
atttcacttttgttc

SEQ ID NO: 4065038 - DNA, 19 bp, Homo sapiens
atttcacttttgttctgct

SEQ ID NO: 4065039 - DNA, 12 bp, Homo sapiens
atttcagactcc

SEQ ID NO: 4065040 - DNA, 15 bp, Homo sapiens
atttcaggagggatt

SEQ ID NO: 4065041 - DNA, 15 bp, Homo sapiens
atttcagtccagaag

SEQ ID NO: 4065042 - DNA, 16 bp, Homo sapiens
atttcagtgtagttaa

SEQ ID NO: 4065043 - DNA, 20 bp, Homo sapiens
atttcagtgtagttaattta

SEQ ID NO: 4065044 - DNA, 19 bp, Homo sapiens
atttcagtgttacctgtgt

SEQ ID NO: 4065045 - DNA, 21 bp, Homo sapiens
atttcagttattgtccctggc

SEQ ID NO: 4065046 - DNA, 17 bp, Homo sapiens
atttcatagttcagaat

SEQ ID NO: 4065047 - DNA, 16 bp, Homo sapiens
atttcatatgctgtat

SEQ ID NO: 4065048 - DNA, 23 bp, Homo sapiens
atttcatccagtttgttctccgg

SEQ ID NO: 4065049 - DNA, 20 bp, Homo sapiens
atttcatcctttcacttctt

SEQ ID NO: 4065050 - DNA, 18 bp, Homo sapiens
atttcatgaacgttatta

SEQ ID NO: 4065051 - DNA, 20 bp, Homo sapiens
atttcatgtaaaacagaaaa

SEQ ID NO: 4065052 - DNA, 11 bp, Homo sapiens
atttcattcca

SEQ ID NO: 4065053 - DNA, 12 bp, Homo sapiens
atttcattccat

SEQ ID NO: 4065054 - DNA, 16 bp, Homo sapiens
atttcattccattgcc

SEQ ID NO: 4065055 - DNA, 14 bp, Homo sapiens
atttcattgcctgt

SEQ ID NO: 4065056 - DNA, 18 bp, Homo sapiens
atttcattgcctgtgtat

SEQ ID NO: 4065057 - DNA, 16 bp, Homo sapiens
atttggaaccttgttt

SEQ ID NO: 4065058 - DNA, 20 bp, Homo sapiens
atttggagacacaactattt

SEQ ID NO: 4065059 - DNA, 21 bp, Homo sapiens
atttggagacacaactatttt

SEQ ID NO: 4065060 - DNA, 20 bp, Homo sapiens
atttggagttaggtcctcac

SEQ ID NO: 4065061 - DNA, 21 bp, Homo sapiens
atttggcccaaactcatcttg

SEQ ID NO: 4065062 - DNA, 19 bp, Homo sapiens
atttggcctgcactaattt

SEQ ID NO: 4065063 - DNA, 15 bp, Homo sapiens
atttggcttttctta

SEQ ID NO: 4065064 - DNA, 22 bp, Homo sapiens
tcaggccctgactcctctggct

SEQ ID NO: 4065065 - DNA, 24 bp, Homo sapiens
tcaggcctacagccacatccccaa

SEQ ID NO: 4065066 - DNA, 18 bp, Homo sapiens
tcaggcctataaccccag

SEQ ID NO: 4065067 - DNA, 22 bp, Homo sapiens
tcaggctatatgcagtccttta

SEQ ID NO: 4065068 - DNA, 15 bp, Homo sapiens
tcaggctccattagg

SEQ ID NO: 4065069 - DNA, 15 bp, Homo sapiens
tcaggctctgtggag

SEQ ID NO: 4065070 - DNA, 21 bp, Homo sapiens
tcaggctcttctcctttcaca

SEQ ID NO: 4065071 - DNA, 17 bp, Homo sapiens
tcaggctgggcagcccc

SEQ ID NO: 4065072 - DNA, 18 bp, Homo sapiens
tcaggcttgaaatgcatt

SEQ ID NO: 4065073 - DNA, 22 bp, Homo sapiens
tcagggaatccagctccctaga

SEQ ID NO: 4065074 - DNA, 16 bp, Homo sapiens
tcagggaccgtccagg

SEQ ID NO: 4065075 - DNA, 23 bp, Homo sapiens
tcagggagcagggaaggcctgac

SEQ ID NO: 4065076 - DNA, 13 bp, Homo sapiens
tcagggagcctcc

SEQ ID NO: 4065077 - DNA, 18 bp, Homo sapiens
tcagggagcctccccatc

SEQ ID NO: 4065078 - DNA, 15 bp, Homo sapiens
tcagggatcttgcat

SEQ ID NO: 4065079 - DNA, 18 bp, Homo sapiens
tcagggcagacagccctc

SEQ ID NO: 4065080 - DNA, 15 bp, Homo sapiens
tcagggccaggccca

SEQ ID NO: 4065081 - DNA, 19 bp, Homo sapiens
tcagggccaggcccaggcc

SEQ ID NO: 4065082 - DNA, 14 bp, Homo sapiens
tcagggccagtcct

SEQ ID NO: 4065083 - DNA, 13 bp, Homo sapiens
tcagggcctggca

SEQ ID NO: 4065084 - DNA, 18 bp, Homo sapiens
tcagggcctggcaggcca

SEQ ID NO: 4065085 - DNA, 18 bp, Homo sapiens
tcagggcctggggcctga

SEQ ID NO: 4065086 - DNA, 14 bp, Homo sapiens
tcagggcgctcaga

SEQ ID NO: 4065087 - DNA, 15 bp, Homo sapiens
tcagggcgctcagac

SEQ ID NO: 4065088 - DNA, 16 bp, Homo sapiens
tcagggctcccagggg

SEQ ID NO: 4065089 - DNA, 20 bp, Homo sapiens
tcagggctgtcccagccccg

SEQ ID NO: 4065090 - DNA, 15 bp, Homo sapiens
tcaggggccagagga

SEQ ID NO: 4065091 - DNA, 13 bp, Homo sapiens
tcaggggggagaa

SEQ ID NO: 4065092 - DNA, 17 bp, Homo sapiens
tcaggggtgcattctgg

SEQ ID NO: 4065093 - DNA, 18 bp, Homo sapiens
tcaggggttcgagaccag

SEQ ID NO: 4065094 - DNA, 22 bp, Homo sapiens
tcagggtcaaagacagaatggt

SEQ ID NO: 4065095 - DNA, 14 bp, Homo sapiens
tcagggttcatctg

SEQ ID NO: 4065096 - DNA, 15 bp, Homo sapiens
tcagggttcatctgt

SEQ ID NO: 4065097 - DNA, 19 bp, Homo sapiens
tcaggtctcccacgtggga

SEQ ID NO: 4065098 - DNA, 15 bp, Homo sapiens
tcaggtgacatgtga

SEQ ID NO: 4065099 - DNA, 21 bp, Homo sapiens
tcaggtgacatgtgaaacctt

SEQ ID NO: 4065100 - DNA, 12 bp, Homo sapiens
tcaggtgctcaa

SEQ ID NO: 4065101 - DNA, 16 bp, Homo sapiens
gcccggatgctgcttc

SEQ ID NO: 4065102 - DNA, 13 bp, Homo sapiens
gcccggccagcgg

SEQ ID NO: 4065103 - DNA, 16 bp, Homo sapiens
gcccggccagcgggca

SEQ ID NO: 4065104 - DNA, 17 bp, Homo sapiens
gcccggccagcgggcac

SEQ ID NO: 4065105 - DNA, 18 bp, Homo sapiens
gcccggccagcgggcaca

SEQ ID NO: 4065106 - DNA, 12 bp, Homo sapiens
gcccggccggcc

SEQ ID NO: 4065107 - DNA, 15 bp, Homo sapiens
gcccggccggcctgg

SEQ ID NO: 4065108 - DNA, 22 bp, Homo sapiens
gcccggcctgctcccagcagcc

SEQ ID NO: 4065109 - DNA, 18 bp, Homo sapiens
gcccggctaatttttgta

SEQ ID NO: 4065110 - DNA, 20 bp, Homo sapiens
gcccgggaaggtcaccagca

SEQ ID NO: 4065111 - DNA, 23 bp, Homo sapiens
gcccgggaaggtcaccagcacca

SEQ ID NO: 4065112 - DNA, 19 bp, Homo sapiens
gcccgggcgcggccagccc

SEQ ID NO: 4065113 - DNA, 19 bp, Homo sapiens
gcccggtgggggggcagag

SEQ ID NO: 4065114 - DNA, 13 bp, Homo sapiens
gcccgtgccctgg

SEQ ID NO: 4065115 - DNA, 15 bp, Homo sapiens
gcccgttagccccag

SEQ ID NO: 4065116 - DNA, 19 bp, Homo sapiens
gccctaaaattccactgcg

SEQ ID NO: 4065117 - DNA, 18 bp, Homo sapiens
gccctaaatagcagaaag

SEQ ID NO: 4065118 - DNA, 14 bp, Homo sapiens
gccctaagccccca

SEQ ID NO: 4065119 - DNA, 15 bp, Homo sapiens
gccctaagcccccag

SEQ ID NO: 4065120 - DNA, 18 bp, Homo sapiens
gccctaagcccccagggc

SEQ ID NO: 4065121 - DNA, 15 bp, Homo sapiens
gccctaaggatctct

SEQ ID NO: 4065122 - DNA, 17 bp, Homo sapiens
gccctagagcctgcctg

SEQ ID NO: 4065123 - DNA, 17 bp, Homo sapiens
gccctaggcccctccta

SEQ ID NO: 4065124 - DNA, 20 bp, Homo sapiens
gccctaggcccctcctagac

SEQ ID NO: 4065125 - DNA, 13 bp, Homo sapiens
gccctatgggcct

SEQ ID NO: 4065126 - DNA, 14 bp, Homo sapiens
gccctatgggcctg

SEQ ID NO: 4065127 - DNA, 15 bp, Homo sapiens
gccctatgggcctgc

SEQ ID NO: 4065128 - DNA, 21 bp, Homo sapiens
gccctatttagatgataaaga

SEQ ID NO: 4065129 - DNA, 13 bp, Homo sapiens
gccctcaagggtg

SEQ ID NO: 4065130 - DNA, 20 bp, Homo sapiens
gccctcaatccaccttcagg

SEQ ID NO: 4065131 - DNA, 16 bp, Homo sapiens
gccctcagttccttca

SEQ ID NO: 4065132 - DNA, 21 bp, Homo sapiens
gccctcatctatgaggaaagg

SEQ ID NO: 4065133 - DNA, 16 bp, Homo sapiens
gccctcatggcccctc

SEQ ID NO: 4065134 - DNA, 22 bp, Homo sapiens
gccctcatggcccctctgacct

SEQ ID NO: 4065135 - DNA, 22 bp, Homo sapiens
gccctcatgggtcctagccctt

SEQ ID NO: 4065136 - DNA, 15 bp, Homo sapiens
gccctccactccagc

SEQ ID NO: 4065137 - DNA, 17 bp, Homo sapiens
gccctccccatcccatg

SEQ ID NO: 4065138 - DNA, 13 bp, Homo sapiens
gccctccccctca

SEQ ID NO: 4065139 - DNA, 23 bp, Homo sapiens
gccctcccccttccccttctgtg

SEQ ID NO: 4065140 - DNA, 17 bp, Homo sapiens
gccctccctgactccct

SEQ ID NO: 4065141 - DNA, 20 bp, Homo sapiens
gccctccctgactccctgtg

SEQ ID NO: 4065142 - DNA, 21 bp, Homo sapiens
gccctccctgactccctgtgg

SEQ ID NO: 4065143 - DNA, 22 bp, Homo sapiens
gccctccctgactccctgtggg

SEQ ID NO: 4065144 - DNA, 21 bp, Homo sapiens
gccctccctgcccctcccttc

SEQ ID NO: 4065145 - DNA, 18 bp, Homo sapiens
gccctccctgttccccag

SEQ ID NO: 4065146 - DNA, 22 bp, Homo sapiens
gccctccctgttccccagagaa

SEQ ID NO: 4065147 - DNA, 23 bp, Homo sapiens
gccctcctcgggccgaggcccag

SEQ ID NO: 4065148 - DNA, 12 bp, Homo sapiens
gccctcctgtgc

SEQ ID NO: 4065149 - DNA, 18 bp, Homo sapiens
gccctcctgtgctggggg

SEQ ID NO: 4065150 - DNA, 13 bp, Homo sapiens
gccctcctttctg

SEQ ID NO: 4065151 - DNA, 17 bp, Homo sapiens
gccctcctttctgtgcc

SEQ ID NO: 4065152 - DNA, 13 bp, Homo sapiens
gccctcgacactc

SEQ ID NO: 4065153 - DNA, 23 bp, Homo sapiens
gccctcgacactcaccatgaagc

SEQ ID NO: 4065154 - DNA, 13 bp, Homo sapiens
gccctctctgagt

SEQ ID NO: 4065155 - DNA, 17 bp, Homo sapiens
gccctctgaacttgcct

SEQ ID NO: 4065156 - DNA, 19 bp, Homo sapiens
gccctcttgggggcactgc

SEQ ID NO: 4065157 - DNA, 22 bp, Homo sapiens
gccctgaccttggctgactggg

SEQ ID NO: 4065158 - DNA, 23 bp, Homo sapiens
gccctgaggcggaggctgtgctc

SEQ ID NO: 4065159 - DNA, 22 bp, Homo sapiens
gccctgatgtgtcctcagggag

SEQ ID NO: 4065160 - DNA, 20 bp, Homo sapiens
gccctgcacagatatttcca

SEQ ID NO: 4065161 - DNA, 14 bp, Homo sapiens
gccctgcagccagc

SEQ ID NO: 4065162 - DNA, 15 bp, Homo sapiens
gccctgcagccagct

SEQ ID NO: 4065163 - DNA, 19 bp, Homo sapiens
gccctgcagctctcatgct

SEQ ID NO: 4065164 - DNA, 17 bp, Homo sapiens
gccctgccctggcaggg

SEQ ID NO: 4065165 - DNA, 11 bp, Homo sapiens
gccctgcctcc

SEQ ID NO: 4065166 - DNA, 15 bp, Homo sapiens
gccctgcctcctggg

SEQ ID NO: 4065167 - DNA, 18 bp, Homo sapiens
gccctgcctcctgggaag

SEQ ID NO: 4065168 - DNA, 15 bp, Homo sapiens
gccctgctcctgcag

SEQ ID NO: 4065169 - DNA, 13 bp, Homo sapiens
gccctgctgagtc

SEQ ID NO: 4065170 - DNA, 16 bp, Homo sapiens
gccctgctttgggctg

SEQ ID NO: 4065171 - DNA, 19 bp, Homo sapiens
gccctgctttgggctgccc

SEQ ID NO: 4065172 - DNA, 21 bp, Homo sapiens
gccctgctttgggctgccctg

SEQ ID NO: 4065173 - DNA, 23 bp, Homo sapiens
gccctgctttgggctgccctggt

SEQ ID NO: 4065174 - DNA, 20 bp, Homo sapiens
gccctggaacatcctttgca

SEQ ID NO: 4065175 - DNA, 23 bp, Homo sapiens
gccctggattggttggcaaacta

SEQ ID NO: 4065176 - DNA, 15 bp, Homo sapiens
gccctggcaggcagg

SEQ ID NO: 4065177 - DNA, 14 bp, Homo sapiens
gccctggccaggac

SEQ ID NO: 4065178 - DNA, 14 bp, Homo sapiens
gccctggctctgca

SEQ ID NO: 4065179 - DNA, 17 bp, Homo sapiens
gccctggctctgctgtc

SEQ ID NO: 4065180 - DNA, 22 bp, Homo sapiens
gccctggctgctgcccccaccc

SEQ ID NO: 4065181 - DNA, 13 bp, Homo sapiens
gccctgggcctca

SEQ ID NO: 4065182 - DNA, 23 bp, Homo sapiens
gccctgggcctcagttcaacctg

SEQ ID NO: 4065183 - DNA, 15 bp, Homo sapiens
gccctgggctcggag

SEQ ID NO: 4065184 - DNA, 17 bp, Homo sapiens
gccctgggctcggaggc

SEQ ID NO: 4065185 - DNA, 12 bp, Homo sapiens
gccctgggctgg

SEQ ID NO: 4065186 - DNA, 16 bp, Homo sapiens
gccctgggctggactg

SEQ ID NO: 4065187 - DNA, 21 bp, Homo sapiens
gccctgggctggactggaggt

SEQ ID NO: 4065188 - DNA, 15 bp, Homo sapiens
gccctgggctgggtg

SEQ ID NO: 4065189 - DNA, 20 bp, Homo sapiens
gccctgggctgggtgctggg

SEQ ID NO: 4065190 - DNA, 20 bp, Homo sapiens
gccctgggctgtctgtcacc

SEQ ID NO: 4065191 - DNA, 23 bp, Homo sapiens
gccctgggctgtctgtcaccagc

SEQ ID NO: 4065192 - DNA, 13 bp, Homo sapiens
gccctggtccagg

SEQ ID NO: 4065193 - DNA, 21 bp, Homo sapiens
gccctggtgaatcacctggct

SEQ ID NO: 4065194 - DNA, 17 bp, Homo sapiens
tcgccgttgaagaggaa

SEQ ID NO: 4065195 - DNA, 20 bp, Homo sapiens
tcgcctgacaaccactggtc

SEQ ID NO: 4065196 - DNA, 12 bp, Homo sapiens
tcgcctgcctgc

SEQ ID NO: 4065197 - DNA, 15 bp, Homo sapiens
tcgcctgcctgcagc

SEQ ID NO: 4065198 - DNA, 16 bp, Homo sapiens
tcgcctgtcaccccca

SEQ ID NO: 4065199 - DNA, 15 bp, Homo sapiens
tcgccttccacctct

SEQ ID NO: 4065200 - DNA, 14 bp, Homo sapiens
tcgcctttcagcag

SEQ ID NO: 4065201 - DNA, 19 bp, Homo sapiens
tcgcctttcagcaggcagc

SEQ ID NO: 4065202 - DNA, 19 bp, Homo sapiens
tcgcgggcagcgggccagg

SEQ ID NO: 4065203 - DNA, 20 bp, Homo sapiens
tcgcgggcagcgggccaggc

SEQ ID NO: 4065204 - DNA, 21 bp, Homo sapiens
tcgcgggcagcgggccaggcc

SEQ ID NO: 4065205 - DNA, 20 bp, Homo sapiens
tcgcgtgccctcgctgcttc

SEQ ID NO: 4065206 - DNA, 16 bp, Homo sapiens
tcgctcaccgctggcc

SEQ ID NO: 4065207 - DNA, 14 bp, Homo sapiens
tcgctctcagttct

SEQ ID NO: 4065208 - DNA, 15 bp, Homo sapiens
tcgctggactattgt

SEQ ID NO: 4065209 - DNA, 17 bp, Homo sapiens
tcgctggactattgtgc

SEQ ID NO: 4065210 - DNA, 22 bp, Homo sapiens
tcgctggatggcggaagctgct

SEQ ID NO: 4065211 - DNA, 16 bp, Homo sapiens
tcgctgtcacaggcgg

SEQ ID NO: 4065212 - DNA, 22 bp, Homo sapiens
tcgctgtcactggctggctcct

SEQ ID NO: 4065213 - DNA, 22 bp, Homo sapiens
tcgcttctgtgtatctctttca

SEQ ID NO: 4065214 - DNA, 20 bp, Homo sapiens
tcggaacctgtgagctgcac

SEQ ID NO: 4065215 - DNA, 19 bp, Homo sapiens
tcggaactgtcctttcctt

SEQ ID NO: 4065216 - DNA, 21 bp, Homo sapiens
tcggacaagacccccagcact

SEQ ID NO: 4065217 - DNA, 19 bp, Homo sapiens
tcggactaagcctacctgc

SEQ ID NO: 4065218 - DNA, 18 bp, Homo sapiens
atgaagagtattaatgta

SEQ ID NO: 4065219 - DNA, 22 bp, Homo sapiens
atgaagatgtttcaaaaaatct

SEQ ID NO: 4065220 - DNA, 22 bp, Homo sapiens
atgaagattctcctgtgctaga

SEQ ID NO: 4065221 - DNA, 20 bp, Homo sapiens
atgaagcaacgataaaatta

SEQ ID NO: 4065222 - DNA, 15 bp, Homo sapiens
atgaagcaaggaaga

SEQ ID NO: 4065223 - DNA, 17 bp, Homo sapiens
atgaagcccaagtgaaa

SEQ ID NO: 4065224 - DNA, 14 bp, Homo sapiens
atgaagctacctca

SEQ ID NO: 4065225 - DNA, 23 bp, Homo sapiens
atgaagcttggaggtcacagctg

SEQ ID NO: 4065226 - DNA, 17 bp, Homo sapiens
atgaaggaatcattcca

SEQ ID NO: 4065227 - DNA, 17 bp, Homo sapiens
atgaagggcgagtgaat

SEQ ID NO: 4065228 - DNA, 21 bp, Homo sapiens
atgaaggttaggatttaacag

SEQ ID NO: 4065229 - DNA, 16 bp, Homo sapiens
atgaagtaaattatgt

SEQ ID NO: 4065230 - DNA, 19 bp, Homo sapiens
atgaagtaaattatgtaac

SEQ ID NO: 4065231 - DNA, 21 bp, Homo sapiens
atgaagtttaaaacagtattt

SEQ ID NO: 4065232 - DNA, 22 bp, Homo sapiens
atgaagtttaaaacagtattta

SEQ ID NO: 4065233 - DNA, 17 bp, Homo sapiens
atgaataaactgaatat

SEQ ID NO: 4065234 - DNA, 18 bp, Homo sapiens
atgaataaactgaatatt

SEQ ID NO: 4065235 - DNA, 21 bp, Homo sapiens
atgaataaactgaatattttg

SEQ ID NO: 4065236 - DNA, 13 bp, Homo sapiens
atgaatacaaatt

SEQ ID NO: 4065237 - DNA, 21 bp, Homo sapiens
atgaatacagggcatgcattt

SEQ ID NO: 4065238 - DNA, 23 bp, Homo sapiens
atgaatatatttaagcaacatct

SEQ ID NO: 4065239 - DNA, 19 bp, Homo sapiens
atgaatatctattaatata

SEQ ID NO: 4065240 - DNA, 20 bp, Homo sapiens
atgaatatctattaatatat

SEQ ID NO: 4065241 - DNA, 22 bp, Homo sapiens
atgaatatctattaatatatgt

SEQ ID NO: 4065242 - DNA, 14 bp, Homo sapiens
atgaatcaatgaaa

SEQ ID NO: 4065243 - DNA, 20 bp, Homo sapiens
atgaatctcccactccagcg

SEQ ID NO: 4065244 - DNA, 16 bp, Homo sapiens
atgaatctgctcactt

SEQ ID NO: 4065245 - DNA, 24 bp, Homo sapiens
atgaatctgtctcccagttatgaa

SEQ ID NO: 4065246 - DNA, 17 bp, Homo sapiens
atgaatgaaacattttg

SEQ ID NO: 4065247 - DNA, 16 bp, Homo sapiens
atgaatgagaatctac

SEQ ID NO: 4065248 - DNA, 19 bp, Homo sapiens
atgaatgaggtcccaggca

SEQ ID NO: 4065249 - DNA, 15 bp, Homo sapiens
atgaatgcacactag

SEQ ID NO: 4065250 - DNA, 21 bp, Homo sapiens
atgaatgggctgagctgcctg

SEQ ID NO: 4065251 - DNA, 21 bp, Homo sapiens
atgaatggtatggaactctct

SEQ ID NO: 4065252 - DNA, 18 bp, Homo sapiens
atgaatgtatgtgcactg

SEQ ID NO: 4065253 - DNA, 20 bp, Homo sapiens
atgaatgtatttatttggga

SEQ ID NO: 4065254 - DNA, 13 bp, Homo sapiens
atgaattgtacag

SEQ ID NO: 4065255 - DNA, 22 bp, Homo sapiens
atgaattgtacagaatatttct

SEQ ID NO: 4065256 - DNA, 23 bp, Homo sapiens
atgaatttaaatataattctgta

SEQ ID NO: 4065257 - DNA, 18 bp, Homo sapiens
atgaatttcttctaatta

SEQ ID NO: 4065258 - DNA, 13 bp, Homo sapiens
atgaattttacat

SEQ ID NO: 4065259 - DNA, 22 bp, Homo sapiens
atgaattttcaagtaattgtga

SEQ ID NO: 4065260 - DNA, 15 bp, Homo sapiens
atgacaactttgcca

SEQ ID NO: 4065261 - DNA, 13 bp, Homo sapiens
atgacaagcattt

SEQ ID NO: 4065262 - DNA, 20 bp, Homo sapiens
atgacacccaccctgtgcca

SEQ ID NO: 4065263 - DNA, 14 bp, Homo sapiens
atgacaccctggcc

SEQ ID NO: 4065264 - DNA, 17 bp, Homo sapiens
atgacaccctggcctga

SEQ ID NO: 4065265 - DNA, 16 bp, Homo sapiens
atgacactagaaaact

SEQ ID NO: 4065266 - DNA, 15 bp, Homo sapiens
atgacagcctgcagc

SEQ ID NO: 4065267 - DNA, 18 bp, Homo sapiens
atgacatctcaggggcca

SEQ ID NO: 4065268 - DNA, 22 bp, Homo sapiens
atgacattaaatgcaataattt

SEQ ID NO: 4065269 - DNA, 19 bp, Homo sapiens
ctaccacggcctcctttcc

SEQ ID NO: 4065270 - DNA, 15 bp, Homo sapiens
ctaccaggtgttcta

SEQ ID NO: 4065271 - DNA, 14 bp, Homo sapiens
ctaccagttgccct

SEQ ID NO: 4065272 - DNA, 18 bp, Homo sapiens
ctaccagttggcagacag

SEQ ID NO: 4065273 - DNA, 14 bp, Homo sapiens
ctacccaaccactc

SEQ ID NO: 4065274 - DNA, 15 bp, Homo sapiens
ctacccaaccactca

SEQ ID NO: 4065275 - DNA, 16 bp, Homo sapiens
ctacccacacctctgc

SEQ ID NO: 4065276 - DNA, 18 bp, Homo sapiens
ctacccacacctctgcca

SEQ ID NO: 4065277 - DNA, 23 bp, Homo sapiens
ctacccaccgatggagcccccag

SEQ ID NO: 4065278 - DNA, 15 bp, Homo sapiens
ctacccactatcctt

SEQ ID NO: 4065279 - DNA, 20 bp, Homo sapiens
ctacccactatccttcgtga

SEQ ID NO: 4065280 - DNA, 16 bp, Homo sapiens
ctacccacttctaaat

SEQ ID NO: 4065281 - DNA, 15 bp, Homo sapiens
ctacccatgagcctg

SEQ ID NO: 4065282 - DNA, 16 bp, Homo sapiens
ctaccccacaccagcc

SEQ ID NO: 4065283 - DNA, 17 bp, Homo sapiens
ctaccccctaagagcca

SEQ ID NO: 4065284 - DNA, 15 bp, Homo sapiens
ctacccccttttcag

SEQ ID NO: 4065285 - DNA, 23 bp, Homo sapiens
ctacccccttttcagctgagccc

SEQ ID NO: 4065286 - DNA, 13 bp, Homo sapiens
ctaccctcccacc

SEQ ID NO: 4065287 - DNA, 17 bp, Homo sapiens
ctaccctgctccctgct

SEQ ID NO: 4065288 - DNA, 13 bp, Homo sapiens
ctaccgccctggg

SEQ ID NO: 4065289 - DNA, 14 bp, Homo sapiens
ctaccgccctgggc

SEQ ID NO: 4065290 - DNA, 15 bp, Homo sapiens
ctaccgccctgggct

SEQ ID NO: 4065291 - DNA, 18 bp, Homo sapiens
ctaccgccctgggctgga

SEQ ID NO: 4065292 - DNA, 14 bp, Homo sapiens
ctacctcaggcagg

SEQ ID NO: 4065293 - DNA, 23 bp, Homo sapiens
ctacctcaggcaggaagggcagg

SEQ ID NO: 4065294 - DNA, 12 bp, Homo sapiens
ctacctccctcc

SEQ ID NO: 4065295 - DNA, 13 bp, Homo sapiens
ctacctccctccc

SEQ ID NO: 4065296 - DNA, 15 bp, Homo sapiens
ctacctcccttgcct

SEQ ID NO: 4065297 - DNA, 14 bp, Homo sapiens
ctacctctctgtcc

SEQ ID NO: 4065298 - DNA, 20 bp, Homo sapiens
ctacctctctgtcccttgct

SEQ ID NO: 4065299 - DNA, 18 bp, Homo sapiens
ctacctctgtgccagggc

SEQ ID NO: 4065300 - DNA, 15 bp, Homo sapiens
ctacctgctctccaa

SEQ ID NO: 4065301 - DNA, 19 bp, Homo sapiens
ctacctgctctccaagtct

SEQ ID NO: 4065302 - DNA, 15 bp, Homo sapiens
ctacctgtgtggtac

SEQ ID NO: 4065303 - DNA, 22 bp, Homo sapiens
ctaccttatcactgcattattc

SEQ ID NO: 4065304 - DNA, 18 bp, Homo sapiens
ctaccttcatttcaggag

SEQ ID NO: 4065305 - DNA, 16 bp, Homo sapiens
ctaccttcctgtccct

SEQ ID NO: 4065306 - DNA, 19 bp, Homo sapiens
ctaccttcctgtccctgag

SEQ ID NO: 4065307 - DNA, 19 bp, Homo sapiens
ctaccttgaaaataagaat

SEQ ID NO: 4065308 - DNA, 16 bp, Homo sapiens
ctacgctgtccagaaa

SEQ ID NO: 4065309 - DNA, 21 bp, Homo sapiens
ctactaaggggcttgtgttct

SEQ ID NO: 4065310 - DNA, 14 bp, Homo sapiens
ctactaatgatgtt

SEQ ID NO: 4065311 - DNA, 12 bp, Homo sapiens
ctactaattcca

SEQ ID NO: 4065312 - DNA, 14 bp, Homo sapiens
ctactataaagaga

SEQ ID NO: 4065313 - DNA, 17 bp, Homo sapiens
ctactataaagagaaga

SEQ ID NO: 4065314 - DNA, 22 bp, Homo sapiens
ctactcagatggctgaggcagg

SEQ ID NO: 4065315 - DNA, 20 bp, Homo sapiens
ctactctccccacgagggct

SEQ ID NO: 4065316 - DNA, 21 bp, Homo sapiens
ctactctccccacgagggctg

SEQ ID NO: 4065317 - DNA, 14 bp, Homo sapiens
ctactcttctctct

SEQ ID NO: 4065318 - DNA, 20 bp, Homo sapiens
ctactgaaacagatttcata

SEQ ID NO: 4065319 - DNA, 15 bp, Homo sapiens
ctactgacatgtggg

SEQ ID NO: 4065320 - DNA, 20 bp, Homo sapiens
ctactgagctgagaccactg

SEQ ID NO: 4065321 - DNA, 16 bp, Homo sapiens
ctactgatgaaatctg

SEQ ID NO: 4065322 - DNA, 21 bp, Homo sapiens
ctactgcactccagcctgggg

SEQ ID NO: 4065323 - DNA, 18 bp, Homo sapiens
ctactgcagcacctccag

SEQ ID NO: 4065324 - DNA, 21 bp, Homo sapiens
ctactgcagcacctccaggcc

SEQ ID NO: 4065325 - DNA, 15 bp, Homo sapiens
ctactgctaaatcct

SEQ ID NO: 4065326 - DNA, 16 bp, Homo sapiens
ctactgtaattttata

SEQ ID NO: 4065327 - DNA, 12 bp, Homo sapiens
ctactgtgttcc

SEQ ID NO: 4065328 - DNA, 19 bp, Homo sapiens
ctactgttaggaacagcag

SEQ ID NO: 4065329 - DNA, 20 bp, Homo sapiens
ctactgttaggaacagcagt

SEQ ID NO: 4065330 - DNA, 21 bp, Homo sapiens
ctactgttaggaacagcagtg

SEQ ID NO: 4065331 - DNA, 22 bp, Homo sapiens
ctactgttaggaacagcagtgt

SEQ ID NO: 4065332 - DNA, 19 bp, Homo sapiens
ctacttaattcctttctca

SEQ ID NO: 4065333 - DNA, 22 bp, Homo sapiens
ctacttaattcctttctcatcc

SEQ ID NO: 4065334 - DNA, 12 bp, Homo sapiens
ctacttagcatc

SEQ ID NO: 4065335 - DNA, 22 bp, Homo sapiens
ctacttagcatgtccctaccga

SEQ ID NO: 4065336 - DNA, 19 bp, Homo sapiens
ctacttcatagctccttgg

SEQ ID NO: 4065337 - DNA, 13 bp, Homo sapiens
ctacttcctcctc

SEQ ID NO: 4065338 - DNA, 20 bp, Homo sapiens
ctacttctggaagtcatctc

SEQ ID NO: 4065339 - DNA, 17 bp, Homo sapiens
ctactttgtggcaatct

SEQ ID NO: 4065340 - DNA, 18 bp, Homo sapiens
ctacttttttcattttgt

SEQ ID NO: 4065341 - DNA, 22 bp, Homo sapiens
ctagaaaacaatgcaaaacctt

SEQ ID NO: 4065342 - DNA, 18 bp, Homo sapiens
ctagaaaagctgatcata

SEQ ID NO: 4065343 - DNA, 19 bp, Homo sapiens
ctagaaaatttagcccttt

SEQ ID NO: 4065344 - DNA, 17 bp, Homo sapiens
ctagaaatatgatttta

SEQ ID NO: 4065345 - DNA, 16 bp, Homo sapiens
ctagaaattgacacaa

SEQ ID NO: 4065346 - DNA, 15 bp, Homo sapiens
ctagaagattagaaa

SEQ ID NO: 4065347 - DNA, 20 bp, Homo sapiens
ctagaagccaagggaaaggg

SEQ ID NO: 4065348 - DNA, 23 bp, Homo sapiens
ctagaagggccagtcctgcctgg

SEQ ID NO: 4065349 - DNA, 20 bp, Homo sapiens
ctagaagtttcccttcctcc

SEQ ID NO: 4065350 - DNA, 17 bp, Homo sapiens
ctagaatgtcagatttc

SEQ ID NO: 4065351 - DNA, 21 bp, Homo sapiens
ctagaatgtcagatttctggt

SEQ ID NO: 4065352 - DNA, 22 bp, Homo sapiens
ctagaatgtcagatttctggtt

SEQ ID NO: 4065353 - DNA, 18 bp, Homo sapiens
ctagacaagatattgtac

SEQ ID NO: 4065354 - DNA, 23 bp, Homo sapiens
ctagacaagatattgtacataaa

SEQ ID NO: 4065355 - DNA, 14 bp, Homo sapiens
ctagacacacaaag

SEQ ID NO: 4065356 - DNA, 23 bp, Homo sapiens
ctagacccaggtggagggcacag

SEQ ID NO: 4065357 - DNA, 19 bp, Homo sapiens
ctagactagcaatctcttc

SEQ ID NO: 4065358 - DNA, 19 bp, Homo sapiens
ctagacttcccaacagcct

SEQ ID NO: 4065359 - DNA, 17 bp, Homo sapiens
ctagagaacgcagccct

SEQ ID NO: 4065360 - DNA, 15 bp, Homo sapiens
ctagagaagataatt

SEQ ID NO: 4065361 - DNA, 16 bp, Homo sapiens
ctagagaagataattg

SEQ ID NO: 4065362 - DNA, 22 bp, Homo sapiens
ctagagaagggagacattgttt

SEQ ID NO: 4065363 - DNA, 23 bp, Homo sapiens
ctagagaagtggactggaggagc

SEQ ID NO: 4065364 - DNA, 15 bp, Homo sapiens
ctagagcagggatta

SEQ ID NO: 4065365 - DNA, 22 bp, Homo sapiens
ctagaggccagccccacccagg

SEQ ID NO: 4065366 - DNA, 23 bp, Homo sapiens
ctagaggccagccccacccagga

SEQ ID NO: 4065367 - DNA, 23 bp, Homo sapiens
ctagaggttgcagcatgagactt

SEQ ID NO: 4065368 - DNA, 14 bp, Homo sapiens
ctagagtctcagaa

SEQ ID NO: 4065369 - DNA, 19 bp, Homo sapiens
ctagagtctgaacagctgt

SEQ ID NO: 4065370 - DNA, 19 bp, Homo sapiens
ctagagttcggtctgacag

SEQ ID NO: 4065371 - DNA, 15 bp, Homo sapiens
ctagataaaaagatg

SEQ ID NO: 4065372 - DNA, 20 bp, Homo sapiens
ctaggcgagtgccaggactc

SEQ ID NO: 4065373 - DNA, 13 bp, Homo sapiens
ctaggctcagaga

SEQ ID NO: 4065374 - DNA, 12 bp, Homo sapiens
ctaggctccttc

SEQ ID NO: 4065375 - DNA, 13 bp, Homo sapiens
ctaggctccttca

SEQ ID NO: 4065376 - DNA, 21 bp, Homo sapiens
ctaggcttcagcatatttata

SEQ ID NO: 4065377 - DNA, 23 bp, Homo sapiens
ctagggaggaccttatctgtgcg

SEQ ID NO: 4065378 - DNA, 17 bp, Homo sapiens
ctaggggagaagagccc

SEQ ID NO: 4065379 - DNA, 20 bp, Homo sapiens
ctaggggagaagagccctgg

SEQ ID NO: 4065380 - DNA, 23 bp, Homo sapiens
ctaggggagaagagccctggaca

SEQ ID NO: 4065381 - DNA, 23 bp, Homo sapiens
ctagggggagccccttctgctca

SEQ ID NO: 4065382 - DNA, 15 bp, Homo sapiens
ctaggggtcactgta

SEQ ID NO: 4065383 - DNA, 17 bp, Homo sapiens
ctagggtggcccttgca

SEQ ID NO: 4065384 - DNA, 18 bp, Homo sapiens
ctaggtaatgttttgtat

SEQ ID NO: 4065385 - DNA, 16 bp, Homo sapiens
ctaggtctcctcaggg

SEQ ID NO: 4065386 - DNA, 20 bp, Homo sapiens
ctaggtctcctcagggtggg

SEQ ID NO: 4065387 - DNA, 13 bp, Homo sapiens
ctaggttccctgt

SEQ ID NO: 4065388 - DNA, 13 bp, Homo sapiens
ctaggttctaaaa

SEQ ID NO: 4065389 - DNA, 17 bp, Homo sapiens
ctagtagttcctgctac

SEQ ID NO: 4065390 - DNA, 15 bp, Homo sapiens
ctagtatttgaatta

SEQ ID NO: 4065391 - DNA, 23 bp, Homo sapiens
ctagtatttgaattaaaacttct

SEQ ID NO: 4065392 - DNA, 17 bp, Homo sapiens
ctagtccccctgttttc

SEQ ID NO: 4065393 - DNA, 15 bp, Homo sapiens
ctagtcccttcccct

SEQ ID NO: 4065394 - DNA, 23 bp, Homo sapiens
ctagtcccttcccctccctggct

SEQ ID NO: 4065395 - DNA, 19 bp, Homo sapiens
ctagtctcctttgcactga

SEQ ID NO: 4065396 - DNA, 23 bp, Homo sapiens
ctagtctcctttgcactgagggc

SEQ ID NO: 4065397 - DNA, 12 bp, Homo sapiens
ctagtgaagacc

SEQ ID NO: 4065398 - DNA, 17 bp, Homo sapiens
ctagtgaggaagacaag

SEQ ID NO: 4065399 - DNA, 14 bp, Homo sapiens
ctagtgcagctgat

SEQ ID NO: 4065400 - DNA, 22 bp, Homo sapiens
ctagtgcagctgattttaacaa

SEQ ID NO: 4065401 - DNA, 20 bp, Homo sapiens
ctagtgccaatgatgtgacc

SEQ ID NO: 4065402 - DNA, 15 bp, Homo sapiens
ctagtggcttcaaaa

SEQ ID NO: 4065403 - DNA, 18 bp, Homo sapiens
ctagtgggacagcccaga

SEQ ID NO: 4065404 - DNA, 20 bp, Homo sapiens
ctagtgggccctctctctgg

SEQ ID NO: 4065405 - DNA, 16 bp, Homo sapiens
ctagtggtctttgtaa

SEQ ID NO: 4065406 - DNA, 17 bp, Homo sapiens
ctagtggtctttgtaag

SEQ ID NO: 4065407 - DNA, 21 bp, Homo sapiens
ctagtgtacctcctctcagtg

SEQ ID NO: 4065408 - DNA, 23 bp, Homo sapiens
ctagtgtacctcctctcagtgtt

SEQ ID NO: 4065409 - DNA, 21 bp, Homo sapiens
ctagtgtcaggcccccagtgg

SEQ ID NO: 4065410 - DNA, 20 bp, Homo sapiens
ctagttatttacaggaactt

SEQ ID NO: 4065411 - DNA, 14 bp, Homo sapiens
ctagttcagagcca

SEQ ID NO: 4065412 - DNA, 16 bp, Homo sapiens
ctagttcatcccttct

SEQ ID NO: 4065413 - DNA, 20 bp, Homo sapiens
ctagttcatcccttctcttc

SEQ ID NO: 4065414 - DNA, 14 bp, Homo sapiens
aacttggattctct

SEQ ID NO: 4065415 - DNA, 15 bp, Homo sapiens
aacttggatttttga

SEQ ID NO: 4065416 - DNA, 12 bp, Homo sapiens
aacttggcactt

SEQ ID NO: 4065417 - DNA, 21 bp, Homo sapiens
aacttggcactttttcgtgtg

SEQ ID NO: 4065418 - DNA, 17 bp, Homo sapiens
aacttggtatttttcag

SEQ ID NO: 4065419 - DNA, 14 bp, Homo sapiens
aacttgtaaataca

SEQ ID NO: 4065420 - DNA, 15 bp, Homo sapiens
aacttgtaaatacac

SEQ ID NO: 4065421 - DNA, 15 bp, Homo sapiens
aacttgtaaatgctg

SEQ ID NO: 4065422 - DNA, 12 bp, Homo sapiens
aactttaatcaa

SEQ ID NO: 4065423 - DNA, 14 bp, Homo sapiens
aactttaatgtttt

SEQ ID NO: 4065424 - DNA, 20 bp, Homo sapiens
aactttaattctctttcaaa

SEQ ID NO: 4065425 - DNA, 18 bp, Homo sapiens
aactttactctgtgttta

SEQ ID NO: 4065426 - DNA, 15 bp, Homo sapiens
aactttatacattag

SEQ ID NO: 4065427 - DNA, 18 bp, Homo sapiens
aactttatacattagtaa

SEQ ID NO: 4065428 - DNA, 19 bp, Homo sapiens
aactttattaaatacaaaa

SEQ ID NO: 4065429 - DNA, 15 bp, Homo sapiens
aagacatgatttcct

SEQ ID NO: 4065430 - DNA, 18 bp, Homo sapiens
aagacatggagactcctg

SEQ ID NO: 4065431 - DNA, 21 bp, Homo sapiens
aagacatgtgaggaggaaaag

SEQ ID NO: 4065432 - DNA, 17 bp, Homo sapiens
aagacattgtcaataaa

SEQ ID NO: 4065433 - DNA, 22 bp, Homo sapiens
aagacatttcttttctttttac

SEQ ID NO: 4065434 - DNA, 16 bp, Homo sapiens
aagacatttgtttgct

SEQ ID NO: 4065435 - DNA, 15 bp, Homo sapiens
aagacattttttgct

SEQ ID NO: 4065436 - DNA, 13 bp, Homo sapiens
aagaccagagcag

SEQ ID NO: 4065437 - DNA, 17 bp, Homo sapiens
aagacccagcaggaagc

SEQ ID NO: 4065438 - DNA, 15 bp, Homo sapiens
aagacccccagcact

SEQ ID NO: 4065439 - DNA, 21 bp, Homo sapiens
aagaccctcttgcccatcctg

SEQ ID NO: 4065440 - DNA, 15 bp, Homo sapiens
aagaccctggtctga

SEQ ID NO: 4065441 - DNA, 14 bp, Homo sapiens
aagacgcctgagct

SEQ ID NO: 4065442 - DNA, 12 bp, Homo sapiens
aagacgtttttg

SEQ ID NO: 4065443 - DNA, 21 bp, Homo sapiens
aagacgtttttgtgctgtggg

SEQ ID NO: 4065444 - DNA, 22 bp, Homo sapiens
aagacgtttttgtgctgtgggc

SEQ ID NO: 4065445 - DNA, 16 bp, Homo sapiens
aagactatctaaatgt

SEQ ID NO: 4065446 - DNA, 18 bp, Homo sapiens
aagactatctaaatgttg

SEQ ID NO: 4065447 - DNA, 14 bp, Homo sapiens
aagactcagtgttc

SEQ ID NO: 4065448 - DNA, 12 bp, Homo sapiens
aagactccagaa

SEQ ID NO: 4065449 - DNA, 13 bp, Homo sapiens
aagactgaatgtt

SEQ ID NO: 4065450 - DNA, 20 bp, Homo sapiens
aagactggaagctaatttgc

SEQ ID NO: 4065451 - DNA, 22 bp, Homo sapiens
aagactggaagctaatttgcat

SEQ ID NO: 4065452 - DNA, 23 bp, Homo sapiens
aagactggaagctaatttgcatt

SEQ ID NO: 4065453 - DNA, 16 bp, Homo sapiens
aagactgtacaaagta

SEQ ID NO: 4065454 - DNA, 17 bp, Homo sapiens
aagactgtacaaagtag

SEQ ID NO: 4065455 - DNA, 16 bp, Homo sapiens
aagactgttgctcaaa

SEQ ID NO: 4065456 - DNA, 20 bp, Homo sapiens
aagactgtttttaagtaact

SEQ ID NO: 4065457 - DNA, 20 bp, Homo sapiens
aagacttttggtagagaagg

SEQ ID NO: 4065458 - DNA, 20 bp, Homo sapiens
aagagaaactttatacatta

SEQ ID NO: 4065459 - DNA, 16 bp, Homo sapiens
aagagaagacgaaata

SEQ ID NO: 4065460 - DNA, 13 bp, Homo sapiens
aagagaagctgct

SEQ ID NO: 4065461 - DNA, 17 bp, Homo sapiens
aagagaagctgctgacc

SEQ ID NO: 4065462 - DNA, 17 bp, Homo sapiens
aagagaagtgagtggtg

SEQ ID NO: 4065463 - DNA, 14 bp, Homo sapiens
aagagagaaaataa

SEQ ID NO: 4065464 - DNA, 20 bp, Homo sapiens
aagagagagagagaaaaaaa

SEQ ID NO: 4065465 - DNA, 19 bp, Homo sapiens
aagagagagagagagagaa

SEQ ID NO: 4065466 - DNA, 17 bp, Homo sapiens
aagagagatatatctga

SEQ ID NO: 4065467 - DNA, 15 bp, Homo sapiens
aagagagattctcca

SEQ ID NO: 4065468 - DNA, 20 bp, Homo sapiens
aagagaggatgtgcaagcga

SEQ ID NO: 4065469 - DNA, 13 bp, Homo sapiens
aagagataataag

SEQ ID NO: 4065470 - DNA, 16 bp, Homo sapiens
aagagataataagatt

SEQ ID NO: 4065471 - DNA, 14 bp, Homo sapiens
aagagatacagagg

SEQ ID NO: 4065472 - DNA, 21 bp, Homo sapiens
aagagatattttaaaatgaga

SEQ ID NO: 4065473 - DNA, 17 bp, Homo sapiens
aagagatgggcttgttt

SEQ ID NO: 4065474 - DNA, 20 bp, Homo sapiens
aagagatgggcttgttttct

SEQ ID NO: 4065475 - DNA, 12 bp, Homo sapiens
aagagcagcatt

SEQ ID NO: 4065476 - DNA, 16 bp, Homo sapiens
aagagcagcctgtggc

SEQ ID NO: 4065477 - DNA, 18 bp, Homo sapiens
aagagcagcctgtggcat

SEQ ID NO: 4065478 - DNA, 20 bp, Homo sapiens
aagagcagtcagagtccagt

SEQ ID NO: 4065479 - DNA, 13 bp, Homo sapiens
aagagcccttgcc

SEQ ID NO: 4065480 - DNA, 14 bp, Homo sapiens
aagagcccttgcct

SEQ ID NO: 4065481 - DNA, 16 bp, Homo sapiens
aagagcccttgcctcc

SEQ ID NO: 4065482 - DNA, 18 bp, Homo sapiens
aagagcccttgcctcccc

SEQ ID NO: 4065483 - DNA, 13 bp, Homo sapiens
aagagcctggaga

SEQ ID NO: 4065484 - DNA, 14 bp, Homo sapiens
aagagcctggagaa

SEQ ID NO: 4065485 - DNA, 21 bp, Homo sapiens
aagagcctggagaagctgatg

SEQ ID NO: 4065486 - DNA, 22 bp, Homo sapiens
aagagctaggcagggtgtctgc

SEQ ID NO: 4065487 - DNA, 13 bp, Homo sapiens
aagagctattgcc

SEQ ID NO: 4065488 - DNA, 21 bp, Homo sapiens
aagagcttgtgtcctgtcctt

SEQ ID NO: 4065489 - DNA, 20 bp, Homo sapiens
aagaggagtttcgaggtaga

SEQ ID NO: 4065490 - DNA, 21 bp, Homo sapiens
aagaggctctggacagcagaa

SEQ ID NO: 4065491 - DNA, 18 bp, Homo sapiens
aagaggctgaaagaggcc

SEQ ID NO: 4065492 - DNA, 17 bp, Homo sapiens
aagaggctgcccctctc

SEQ ID NO: 4065493 - DNA, 17 bp, Homo sapiens
aagaggctggtgctgtg

SEQ ID NO: 4065494 - DNA, 17 bp, Homo sapiens
aagagggagaagcatga

SEQ ID NO: 4065495 - DNA, 16 bp, Homo sapiens
aagagggcccagccca

SEQ ID NO: 4065496 - DNA, 17 bp, Homo sapiens
aagagggcccagcccag

SEQ ID NO: 4065497 - DNA, 12 bp, Homo sapiens
aagagggcctgt

SEQ ID NO: 4065498 - DNA, 13 bp, Homo sapiens
aaatttgctagca

SEQ ID NO: 4065499 - DNA, 14 bp, Homo sapiens
aaatttgctagcag

SEQ ID NO: 4065500 - DNA, 16 bp, Homo sapiens
aaatttggttctaata

SEQ ID NO: 4065501 - DNA, 12 bp, Homo sapiens
aaatttgtaagt

SEQ ID NO: 4065502 - DNA, 15 bp, Homo sapiens
aaatttgtaagtttc

SEQ ID NO: 4065503 - DNA, 17 bp, Homo sapiens
aaatttgtaagtttcag

SEQ ID NO: 4065504 - DNA, 18 bp, Homo sapiens
aaatttgttgaaattatg

SEQ ID NO: 4065505 - DNA, 22 bp, Homo sapiens
aaatttgtttaattaaatttaa

SEQ ID NO: 4065506 - DNA, 14 bp, Homo sapiens
aaatttgtttgaaa

SEQ ID NO: 4065507 - DNA, 21 bp, Homo sapiens
aaattttataaaattaagcaa

SEQ ID NO: 4065508 - DNA, 16 bp, Homo sapiens
aaattttattttgtgc

SEQ ID NO: 4065509 - DNA, 14 bp, Homo sapiens
aaattttgcaaata

SEQ ID NO: 4065510 - DNA, 22 bp, Homo sapiens
aaattttgcttttaattaaata

SEQ ID NO: 4065511 - DNA, 19 bp, Homo sapiens
aaatttttcttttcttgat

SEQ ID NO: 4065512 - DNA, 18 bp, Homo sapiens
aaattttttttacatttt

SEQ ID NO: 4065513 - DNA, 14 bp, Homo sapiens
aacaaaaagcttcc

SEQ ID NO: 4065514 - DNA, 15 bp, Homo sapiens
aacaaaaagtttttt

SEQ ID NO: 4065515 - DNA, 14 bp, Homo sapiens
aacaaaaattaggt

SEQ ID NO: 4065516 - DNA, 23 bp, Homo sapiens
aacaaacactgcagtttcctgga

SEQ ID NO: 4065517 - DNA, 15 bp, Homo sapiens
aacaaactaaaaata

SEQ ID NO: 4065518 - DNA, 14 bp, Homo sapiens
aacaaagaaatatt

SEQ ID NO: 4065519 - DNA, 15 bp, Homo sapiens
aacaaagcagccacg

SEQ ID NO: 4065520 - DNA, 13 bp, Homo sapiens
aacaaagttacta

SEQ ID NO: 4065521 - DNA, 19 bp, Homo sapiens
aacaaataaaaaagctctt

SEQ ID NO: 4065522 - DNA, 22 bp, Homo sapiens
aacaaatggagctttctgtata

SEQ ID NO: 4065523 - DNA, 21 bp, Homo sapiens
aacaacttgtacttgtttcat

SEQ ID NO: 4065524 - DNA, 14 bp, Homo sapiens
aacaagaagaaata

SEQ ID NO: 4065525 - DNA, 15 bp, Homo sapiens
aacaagaagaaatat

SEQ ID NO: 4065526 - DNA, 17 bp, Homo sapiens
aacaagaagaaatatga

SEQ ID NO: 4065527 - DNA, 18 bp, Homo sapiens
aacaagaagaaatatgaa

SEQ ID NO: 4065528 - DNA, 22 bp, Homo sapiens
aacaagaccaccacttcgaaac

SEQ ID NO: 4065529 - DNA, 19 bp, Homo sapiens
aacaagagcactacattca

SEQ ID NO: 4065530 - DNA, 18 bp, Homo sapiens
aacaagagtttgttctgt

SEQ ID NO: 4065531 - DNA, 12 bp, Homo sapiens
aacaaggaatgc

SEQ ID NO: 4065532 - DNA, 19 bp, Homo sapiens
aacaaggaatgcctgtgcc

SEQ ID NO: 4065533 - DNA, 21 bp, Homo sapiens
aacaagggagagacctcatca

SEQ ID NO: 4065534 - DNA, 13 bp, Homo sapiens
aacaagtaccaaa

SEQ ID NO: 4065535 - DNA, 15 bp, Homo sapiens
aacaataactactgt

SEQ ID NO: 4065536 - DNA, 18 bp, Homo sapiens
aacaataactactgtgtt

SEQ ID NO: 4065537 - DNA, 19 bp, Homo sapiens
aacaataactactgtgttc

SEQ ID NO: 4065538 - DNA, 21 bp, Homo sapiens
aacaataactactgtgttcct

SEQ ID NO: 4065539 - DNA, 13 bp, Homo sapiens
aacaatacaaatg

SEQ ID NO: 4065540 - DNA, 17 bp, Homo sapiens
aacaatacaaatggatt

SEQ ID NO: 4065541 - DNA, 16 bp, Homo sapiens
aacaatataaaccgtg

SEQ ID NO: 4065542 - DNA, 18 bp, Homo sapiens
aacaatatcatatcatca

SEQ ID NO: 4065543 - DNA, 20 bp, Homo sapiens
aacaatctggaagaaaaaaa

SEQ ID NO: 4065544 - DNA, 22 bp, Homo sapiens
aacaatgtggagtctccctctg

SEQ ID NO: 4065545 - DNA, 13 bp, Homo sapiens
aacaatgttaagg

SEQ ID NO: 4065546 - DNA, 22 bp, Homo sapiens
aacaattcatgcctttcatagt

SEQ ID NO: 4065547 - DNA, 13 bp, Homo sapiens
aacaatttctgtc

SEQ ID NO: 4065548 - DNA, 15 bp, Homo sapiens
aacacaaactgtaaa

SEQ ID NO: 4065549 - DNA, 14 bp, Homo sapiens
aacacaaaggaagt

SEQ ID NO: 4065550 - DNA, 10 bp, Homo sapiens
aacacacaca

SEQ ID NO: 4065551 - DNA, 20 bp, Homo sapiens
aacacacagatacacacaca

SEQ ID NO: 4065552 - DNA, 18 bp, Homo sapiens
aacacagcatgtgtattt

SEQ ID NO: 4065553 - DNA, 17 bp, Homo sapiens
aacacagctgttcttct

SEQ ID NO: 4065554 - DNA, 18 bp, Homo sapiens
aacacagctgttcttctg

SEQ ID NO: 4065555 - DNA, 14 bp, Homo sapiens
aacacaggcagctt

SEQ ID NO: 4065556 - DNA, 18 bp, Homo sapiens
aacacaggcagctttcta

SEQ ID NO: 4065557 - DNA, 22 bp, Homo sapiens
aacacagtcattctaggatgtg

SEQ ID NO: 4065558 - DNA, 21 bp, Homo sapiens
aacacattatcgggagcagtg

SEQ ID NO: 4065559 - DNA, 14 bp, Homo sapiens
aacacattatgtat

SEQ ID NO: 4065560 - DNA, 19 bp, Homo sapiens
aacacattgaatgcgcttt

SEQ ID NO: 4065561 - DNA, 14 bp, Homo sapiens
aacacattgcctaa

SEQ ID NO: 4065562 - DNA, 22 bp, Homo sapiens
aacaccaaaaaaatccagaaac

SEQ ID NO: 4065563 - DNA, 14 bp, Homo sapiens
aacaccaagcacag

SEQ ID NO: 4065564 - DNA, 17 bp, Homo sapiens
aacaccaagcacagcag

SEQ ID NO: 4065565 - DNA, 19 bp, Homo sapiens
aacaccaagcacagcagcc

SEQ ID NO: 4065566 - DNA, 16 bp, Homo sapiens
aacaccaatcccaggg

SEQ ID NO: 4065567 - DNA, 19 bp, Homo sapiens
aacaccacagacacacaca

SEQ ID NO: 4065568 - DNA, 20 bp, Homo sapiens
aacacccagtctgttcccca

SEQ ID NO: 4065569 - DNA, 19 bp, Homo sapiens
aacacccccatccctcggg

SEQ ID NO: 4065570 - DNA, 16 bp, Homo sapiens
aacaccctatattttg

SEQ ID NO: 4065571 - DNA, 19 bp, Homo sapiens
aacacctagctttattctt

SEQ ID NO: 4065572 - DNA, 14 bp, Homo sapiens
aacacgcacctgcc

SEQ ID NO: 4065573 - DNA, 19 bp, Homo sapiens
aacacgcacctgcctcagg

SEQ ID NO: 4065574 - DNA, 13 bp, Homo sapiens
aacacggccacat

SEQ ID NO: 4065575 - DNA, 13 bp, Homo sapiens
aacactaaaattt

SEQ ID NO: 4065576 - DNA, 18 bp, Homo sapiens
aacactaacatataatgt

SEQ ID NO: 4065577 - DNA, 23 bp, Homo sapiens
aaccactgtggcgttctgctgcc

SEQ ID NO: 4065578 - DNA, 13 bp, Homo sapiens
aaccacttaaaaa

SEQ ID NO: 4065579 - DNA, 19 bp, Homo sapiens
aaccacttaaaaaatgtcc

SEQ ID NO: 4065580 - DNA, 16 bp, Homo sapiens
aaccacttcattctgc

SEQ ID NO: 4065581 - DNA, 23 bp, Homo sapiens
aaccacttcctgctacaggaggg

SEQ ID NO: 4065582 - DNA, 11 bp, Homo sapiens
aaccagagccc

SEQ ID NO: 4065583 - DNA, 20 bp, Homo sapiens
aaccagagccccccacaatg

SEQ ID NO: 4065584 - DNA, 15 bp, Homo sapiens
aaccagagtgctgaa

SEQ ID NO: 4065585 - DNA, 14 bp, Homo sapiens
aaccagctcatctc

SEQ ID NO: 4065586 - DNA, 18 bp, Homo sapiens
aaccaggcacctcttcct

SEQ ID NO: 4065587 - DNA, 21 bp, Homo sapiens
aaccaggtttagacagtatga

SEQ ID NO: 4065588 - DNA, 18 bp, Homo sapiens
aaccagtttcaggtgttt

SEQ ID NO: 4065589 - DNA, 21 bp, Homo sapiens
aaccatccacttacatatatt

SEQ ID NO: 4065590 - DNA, 17 bp, Homo sapiens
aaccatgaagacaggat

SEQ ID NO: 4065591 - DNA, 12 bp, Homo sapiens
aaccatgactgt

SEQ ID NO: 4065592 - DNA, 20 bp, Homo sapiens
aaccatgagaattttacttc

SEQ ID NO: 4065593 - DNA, 22 bp, Homo sapiens
aaccatgagaccactgttatca

SEQ ID NO: 4065594 - DNA, 23 bp, Homo sapiens
aaccatgctggtatatggcttca

SEQ ID NO: 4065595 - DNA, 23 bp, Homo sapiens
aaccattaagtcatgtgtgaaca

SEQ ID NO: 4065596 - DNA, 21 bp, Homo sapiens
aaccatttaataaagaaatat

SEQ ID NO: 4065597 - DNA, 14 bp, Homo sapiens
aaccatttctcact

SEQ ID NO: 4065598 - DNA, 19 bp, Homo sapiens
aacccaagcaacatttgta

SEQ ID NO: 4065599 - DNA, 14 bp, Homo sapiens
aacccaatccaaat

SEQ ID NO: 4065600 - DNA, 21 bp, Homo sapiens
aacccaatctgcacactccag

SEQ ID NO: 4065601 - DNA, 13 bp, Homo sapiens
aacccagattttg

SEQ ID NO: 4065602 - DNA, 22 bp, Homo sapiens
aacccagggcaacaagcccgtt

SEQ ID NO: 4065603 - DNA, 15 bp, Homo sapiens
aacccagttgccatc

SEQ ID NO: 4065604 - DNA, 12 bp, Homo sapiens
aaccccagcctg

SEQ ID NO: 4065605 - DNA, 21 bp, Homo sapiens
aaccccagcctgacctgagac

SEQ ID NO: 4065606 - DNA, 20 bp, Homo sapiens
aacccccaaaatccaaaact

SEQ ID NO: 4065607 - DNA, 17 bp, Homo sapiens
aacccccaccccacact

SEQ ID NO: 4065608 - DNA, 18 bp, Homo sapiens
aacccccaccccacactt

SEQ ID NO: 4065609 - DNA, 21 bp, Homo sapiens
aacccgaggggccggggaagc

SEQ ID NO: 4065610 - DNA, 23 bp, Homo sapiens
aacccgggagcggaggttgcagt

SEQ ID NO: 4065611 - DNA, 22 bp, Homo sapiens
aaccctaatctttcacttgaaa

SEQ ID NO: 4065612 - DNA, 17 bp, Homo sapiens
aaccctaggttccctgt

SEQ ID NO: 4065613 - DNA, 22 bp, Homo sapiens
aaccctcaggggaaaactgtta

SEQ ID NO: 4065614 - DNA, 19 bp, Homo sapiens
aaccctggggaaggagcca

SEQ ID NO: 4065615 - DNA, 18 bp, Homo sapiens
aaccctggggcctgactg

SEQ ID NO: 4065616 - DNA, 20 bp, Homo sapiens
aaccctggggcctgactgct

SEQ ID NO: 4065617 - DNA, 20 bp, Homo sapiens
aaccctgttttatactgtac

SEQ ID NO: 4065618 - DNA, 23 bp, Homo sapiens
aaccctgttttatactgtactta

SEQ ID NO: 4065619 - DNA, 19 bp, Homo sapiens
aacccttcatcttcctgtg

SEQ ID NO: 4065620 - DNA, 22 bp, Homo sapiens
aacccttcatcttcctgtgtcc

SEQ ID NO: 4065621 - DNA, 20 bp, Homo sapiens
aacccttgctttcctgggcc

SEQ ID NO: 4065622 - DNA, 17 bp, Homo sapiens
aaccgacaggccctggc

SEQ ID NO: 4065623 - DNA, 17 bp, Homo sapiens
aaccgagcaaagatcaa

SEQ ID NO: 4065624 - DNA, 16 bp, Homo sapiens
aaccgataatgcatga

SEQ ID NO: 4065625 - DNA, 18 bp, Homo sapiens
aaccgcactcacccatgt

SEQ ID NO: 4065626 - DNA, 16 bp, Homo sapiens
aaccgtggtatgtctg

SEQ ID NO: 4065627 - DNA, 18 bp, Homo sapiens
aaccgtggtatgtctgcc

SEQ ID NO: 4065628 - DNA, 14 bp, Homo sapiens
aaccgttaggaaaa

SEQ ID NO: 4065629 - DNA, 20 bp, Homo sapiens
aacctaatcaccatgtaagc

SEQ ID NO: 4065630 - DNA, 18 bp, Homo sapiens
aacctacctcccacactc

SEQ ID NO: 4065631 - DNA, 13 bp, Homo sapiens
aacctagaatgtc

SEQ ID NO: 4065632 - DNA, 14 bp, Homo sapiens
aacctagaatgtca

SEQ ID NO: 4065633 - DNA, 23 bp, Homo sapiens
aacctcaccattgtgaagcacct

SEQ ID NO: 4065634 - DNA, 15 bp, Homo sapiens
aacctcaccttcctg

SEQ ID NO: 4065635 - DNA, 23 bp, Homo sapiens
aacctcactatggtatgctggcc

SEQ ID NO: 4065636 - DNA, 19 bp, Homo sapiens
aacctcagacttaccagga

SEQ ID NO: 4065637 - DNA, 18 bp, Homo sapiens
aacctcagattcttcatt

SEQ ID NO: 4065638 - DNA, 12 bp, Homo sapiens
aacctcagcctg

SEQ ID NO: 4065639 - DNA, 20 bp, Homo sapiens
aacctcagcctggccagaca

SEQ ID NO: 4065640 - DNA, 13 bp, Homo sapiens
aacctcagctctg

SEQ ID NO: 4065641 - DNA, 13 bp, Homo sapiens
aacctctgtctca

SEQ ID NO: 4065642 - DNA, 11 bp, Homo sapiens
aacctcttccc

SEQ ID NO: 4065643 - DNA, 19 bp, Homo sapiens
aacctctttttcctcctgg

SEQ ID NO: 4065644 - DNA, 23 bp, Homo sapiens
aacctctttttcctcctggacac

SEQ ID NO: 4065645 - DNA, 19 bp, Homo sapiens
aacctgacaaaaaaaaagt

SEQ ID NO: 4065646 - DNA, 23 bp, Homo sapiens
aacctgacagatgtcagccgagc

SEQ ID NO: 4065647 - DNA, 17 bp, Homo sapiens
aacctgatgttaaaatt

SEQ ID NO: 4065648 - DNA, 19 bp, Homo sapiens
aacctggaaaaattccaga

SEQ ID NO: 4065649 - DNA, 22 bp, Homo sapiens
aacctggaatctacaagccaaa

SEQ ID NO: 4065650 - DNA, 14 bp, Homo sapiens
aacctggagatatt

SEQ ID NO: 4065651 - DNA, 16 bp, Homo sapiens
aacctggatccagcac

SEQ ID NO: 4065652 - DNA, 21 bp, Homo sapiens
aacctgggattcaggaatgtg

SEQ ID NO: 4065653 - DNA, 14 bp, Homo sapiens
aacctggtgctgga

SEQ ID NO: 4065654 - DNA, 15 bp, Homo sapiens
aacctgtacttcaag

SEQ ID NO: 4065655 - DNA, 11 bp, Homo sapiens
aacctgtctga

SEQ ID NO: 4065656 - DNA, 18 bp, Homo sapiens
aacctgtgagtaaatatt

SEQ ID NO: 4065657 - DNA, 19 bp, Homo sapiens
aacctgtttttttttcatt

SEQ ID NO: 4065658 - DNA, 17 bp, Homo sapiens
aaccttatatttacaat

SEQ ID NO: 4065659 - DNA, 21 bp, Homo sapiens
aaccttatatttacaataaat

SEQ ID NO: 4065660 - DNA, 17 bp, Homo sapiens
aaccttattgtacctct

SEQ ID NO: 4065661 - DNA, 22 bp, Homo sapiens
aaccttccatacatttttttct

SEQ ID NO: 4065662 - DNA, 13 bp, Homo sapiens
aaccttccctcca

SEQ ID NO: 4065663 - DNA, 14 bp, Homo sapiens
aaccttgaatgctg

SEQ ID NO: 4065664 - DNA, 21 bp, Homo sapiens
aaccttgctctcctcatctcc

SEQ ID NO: 4065665 - DNA, 13 bp, Homo sapiens
aaccttgctgtcc

SEQ ID NO: 4065666 - DNA, 16 bp, Homo sapiens
aaccttgctgtcctga

SEQ ID NO: 4065667 - DNA, 13 bp, Homo sapiens
aaccttgttttgg

SEQ ID NO: 4065668 - DNA, 20 bp, Homo sapiens
aacctttaaaattgtcacct

SEQ ID NO: 4065669 - DNA, 22 bp, Homo sapiens
aacctttccgctgtcgccccag

SEQ ID NO: 4065670 - DNA, 23 bp, Homo sapiens
aacctttccgctgtcgccccagg

SEQ ID NO: 4065671 - DNA, 12 bp, Homo sapiens
aacctttttaaa

SEQ ID NO: 4065672 - DNA, 14 bp, Homo sapiens
aacctttttcttga

SEQ ID NO: 4065673 - DNA, 17 bp, Homo sapiens
aacctttttcttgatct

SEQ ID NO: 4065674 - DNA, 21 bp, Homo sapiens
aaccttttttaagatttttct

SEQ ID NO: 4065675 - DNA, 23 bp, Homo sapiens
aaccttttttaagatttttctca

SEQ ID NO: 4065676 - DNA, 15 bp, Homo sapiens
aacctttttttttga

SEQ ID NO: 4065677 - DNA, 18 bp, Homo sapiens
aacctttttttttgaaac

SEQ ID NO: 4065678 - DNA, 19 bp, Homo sapiens
aacctttttttttgaaaca

SEQ ID NO: 4065679 - DNA, 18 bp, Homo sapiens
aactgaatattttggaaa

SEQ ID NO: 4065680 - DNA, 22 bp, Homo sapiens
aactgacctgaccccattcctg

SEQ ID NO: 4065681 - DNA, 23 bp, Homo sapiens
aactgacctgaccccattcctga

SEQ ID NO: 4065682 - DNA, 12 bp, Homo sapiens
aactgagctggg

SEQ ID NO: 4065683 - DNA, 20 bp, Homo sapiens
aactgagctgggcaggaagg

SEQ ID NO: 4065684 - DNA, 19 bp, Homo sapiens
aactgattcttatgattac

SEQ ID NO: 4065685 - DNA, 13 bp, Homo sapiens
aactgatttcttc

SEQ ID NO: 4065686 - DNA, 16 bp, Homo sapiens
aactgatttcttcaga

SEQ ID NO: 4065687 - DNA, 14 bp, Homo sapiens
aactgcaaacagaa

SEQ ID NO: 4065688 - DNA, 17 bp, Homo sapiens
aactgcaataacttctg

SEQ ID NO: 4065689 - DNA, 19 bp, Homo sapiens
aactgcaataacttctgac

SEQ ID NO: 4065690 - DNA, 17 bp, Homo sapiens
aactgcaatagagactg

SEQ ID NO: 4065691 - DNA, 22 bp, Homo sapiens
aactgcagaccatgaagtaaat

SEQ ID NO: 4065692 - DNA, 22 bp, Homo sapiens
aactgcagagtaaattgctctg

SEQ ID NO: 4065693 - DNA, 17 bp, Homo sapiens
aactgcaggagcagttt

SEQ ID NO: 4065694 - DNA, 15 bp, Homo sapiens
aactgcatggaccta

SEQ ID NO: 4065695 - DNA, 20 bp, Homo sapiens
aactgccaggctgcctcctg

SEQ ID NO: 4065696 - DNA, 13 bp, Homo sapiens
aactgcccccact

SEQ ID NO: 4065697 - DNA, 14 bp, Homo sapiens
aactgccctaagcc

SEQ ID NO: 4065698 - DNA, 22 bp, Homo sapiens
aactgccctaagcccccagggc

SEQ ID NO: 4065699 - DNA, 23 bp, Homo sapiens
aactgctaaattctatgttaaat

SEQ ID NO: 4065700 - DNA, 15 bp, Homo sapiens
aactgctttctgttc

SEQ ID NO: 4065701 - DNA, 18 bp, Homo sapiens
aactgctttctgttccaa

SEQ ID NO: 4065702 - DNA, 20 bp, Homo sapiens
aactgctttctgttccaaat

SEQ ID NO: 4065703 - DNA, 17 bp, Homo sapiens
aactggactcacattcg

SEQ ID NO: 4065704 - DNA, 18 bp, Homo sapiens
aactggcccgtggagact

SEQ ID NO: 4065705 - DNA, 19 bp, Homo sapiens
aactggggctttgccttgc

SEQ ID NO: 4065706 - DNA, 14 bp, Homo sapiens
aactggtattgttt

SEQ ID NO: 4065707 - DNA, 16 bp, Homo sapiens
aactggtattgtttac

SEQ ID NO: 4065708 - DNA, 16 bp, Homo sapiens
aactggttgtatattt

SEQ ID NO: 4065709 - DNA, 17 bp, Homo sapiens
aactgtaacgttttctt

SEQ ID NO: 4065710 - DNA, 18 bp, Homo sapiens
aactgtacatttaaaatt

SEQ ID NO: 4065711 - DNA, 15 bp, Homo sapiens
aactgtactgtctgt

SEQ ID NO: 4065712 - DNA, 14 bp, Homo sapiens
aactgtagaaatga

SEQ ID NO: 4065713 - DNA, 15 bp, Homo sapiens
aactgtagaaatgat

SEQ ID NO: 4065714 - DNA, 23 bp, Homo sapiens
aactgtagtgtagtcaggtgctc

SEQ ID NO: 4065715 - DNA, 14 bp, Homo sapiens
aactgtccagagag

SEQ ID NO: 4065716 - DNA, 13 bp, Homo sapiens
aactgtccctccc

SEQ ID NO: 4065717 - DNA, 14 bp, Homo sapiens
aactgtcctgtcct

SEQ ID NO: 4065718 - DNA, 19 bp, Homo sapiens
aactgtctagcacttcctt

SEQ ID NO: 4065719 - DNA, 16 bp, Homo sapiens
aactgtcttcctcaaa

SEQ ID NO: 4065720 - DNA, 18 bp, Homo sapiens
aactgtctttaaaagaga

SEQ ID NO: 4065721 - DNA, 19 bp, Homo sapiens
aactgtgaagtttacattg

SEQ ID NO: 4065722 - DNA, 21 bp, Homo sapiens
aactgtgctgaatgctttaga

SEQ ID NO: 4065723 - DNA, 17 bp, Homo sapiens
aactgtgtatgtacata

SEQ ID NO: 4065724 - DNA, 18 bp, Homo sapiens
aactgtgtggactgtgat

SEQ ID NO: 4065725 - DNA, 19 bp, Homo sapiens
aactgtgtttcaagttcaa

SEQ ID NO: 4065726 - DNA, 20 bp, Homo sapiens
aactgttaactatgacagat

SEQ ID NO: 4065727 - DNA, 21 bp, Homo sapiens
aactgttctggcctcagacca

SEQ ID NO: 4065728 - DNA, 14 bp, Homo sapiens
aactgttgattgca

SEQ ID NO: 4065729 - DNA, 15 bp, Homo sapiens
aactgttttttaagt

SEQ ID NO: 4065730 - DNA, 13 bp, Homo sapiens
aacttaaaaatgt

SEQ ID NO: 4065731 - DNA, 18 bp, Homo sapiens
aacttaaaaatgtaaata

SEQ ID NO: 4065732 - DNA, 21 bp, Homo sapiens
aacttaaaaatgtaaatattc

SEQ ID NO: 4065733 - DNA, 13 bp, Homo sapiens
aacttaaataata

SEQ ID NO: 4065734 - DNA, 14 bp, Homo sapiens
aacttaaataataa

SEQ ID NO: 4065735 - DNA, 16 bp, Homo sapiens
aacttaacattctgta

SEQ ID NO: 4065736 - DNA, 17 bp, Homo sapiens
aacttaacattctgtaa

SEQ ID NO: 4065737 - DNA, 14 bp, Homo sapiens
aacttaagcaaagg

SEQ ID NO: 4065738 - DNA, 21 bp, Homo sapiens
aacttacattgttcaattaga

SEQ ID NO: 4065739 - DNA, 22 bp, Homo sapiens
aacttacattgttcaattagaa

SEQ ID NO: 4065740 - DNA, 19 bp, Homo sapiens
aacttacctgggcattctt

SEQ ID NO: 4065741 - DNA, 15 bp, Homo sapiens
aacttagaggaaaat

SEQ ID NO: 4065742 - DNA, 16 bp, Homo sapiens
aacttagaggaaaatg

SEQ ID NO: 4065743 - DNA, 19 bp, Homo sapiens
aacttagccagagttaggt

SEQ ID NO: 4065744 - DNA, 15 bp, Homo sapiens
aacttataaatcata

SEQ ID NO: 4065745 - DNA, 21 bp, Homo sapiens
aacttatgacctcttccttta

SEQ ID NO: 4065746 - DNA, 18 bp, Homo sapiens
aacttatttaaaaatatt

SEQ ID NO: 4065747 - DNA, 14 bp, Homo sapiens
aacttcagaaagac

SEQ ID NO: 4065748 - DNA, 15 bp, Homo sapiens
aacttcagacacaaa

SEQ ID NO: 4065749 - DNA, 22 bp, Homo sapiens
aacttcagagggaaagtaaata

SEQ ID NO: 4065750 - DNA, 17 bp, Homo sapiens
aacttcagctgtacttc

SEQ ID NO: 4065751 - DNA, 21 bp, Homo sapiens
aacttcaggataataaagtgt

SEQ ID NO: 4065752 - DNA, 12 bp, Homo sapiens
aacttcattctc

SEQ ID NO: 4065753 - DNA, 13 bp, Homo sapiens
aacttccaattta

SEQ ID NO: 4065754 - DNA, 12 bp, Homo sapiens
aacttcctgctg

SEQ ID NO: 4065755 - DNA, 15 bp, Homo sapiens
aacttcttatggaat

SEQ ID NO: 4065756 - DNA, 17 bp, Homo sapiens
aacttcttatggaattg

SEQ ID NO: 4065757 - DNA, 15 bp, Homo sapiens
aacttctttgaattt

SEQ ID NO: 4065758 - DNA, 24 bp, Homo sapiens
aacttgaaacagattcaggccagc

SEQ ID NO: 4065759 - DNA, 19 bp, Homo sapiens
aacttgaaattatatctgt

SEQ ID NO: 4065760 - DNA, 14 bp, Homo sapiens
aacttgactgggtg

SEQ ID NO: 4065761 - DNA, 20 bp, Homo sapiens
aacttgatttgcatggattt

SEQ ID NO: 4065762 - DNA, 15 bp, Homo sapiens
aacttgcatggagca

SEQ ID NO: 4065763 - DNA, 14 bp, Homo sapiens
aacttgcttaaatt

SEQ ID NO: 4065764 - DNA, 23 bp, Homo sapiens
aacttggaatttgtaacctcagc

SEQ ID NO: 4065765 - DNA, 22 bp, Homo sapiens
aaagccagggtctctccctcag

SEQ ID NO: 4065766 - DNA, 16 bp, Homo sapiens
aaagcccaacctcctg

SEQ ID NO: 4065767 - DNA, 13 bp, Homo sapiens
aaagcctcaacca

SEQ ID NO: 4065768 - DNA, 13 bp, Homo sapiens
aaagcctggtttt

SEQ ID NO: 4065769 - DNA, 17 bp, Homo sapiens
aaagcctgtaagcctgc

SEQ ID NO: 4065770 - DNA, 15 bp, Homo sapiens
aaagccttagggaag

SEQ ID NO: 4065771 - DNA, 19 bp, Homo sapiens
aaagccttgtgtatatttg

SEQ ID NO: 4065772 - DNA, 14 bp, Homo sapiens
aaagcggggggagg

SEQ ID NO: 4065773 - DNA, 15 bp, Homo sapiens
aaagcggtccctgtc

SEQ ID NO: 4065774 - DNA, 23 bp, Homo sapiens
aaagctaaaatgattttatctgt

SEQ ID NO: 4065775 - DNA, 20 bp, Homo sapiens
aaagctagtgtacctcctct

SEQ ID NO: 4065776 - DNA, 17 bp, Homo sapiens
aaagctattagccagga

SEQ ID NO: 4065777 - DNA, 22 bp, Homo sapiens
aaagctattagccaggatcatg

SEQ ID NO: 4065778 - DNA, 23 bp, Homo sapiens
aaagctattagccaggatcatgg

SEQ ID NO: 4065779 - DNA, 20 bp, Homo sapiens
aaagctcatgcatttcaagc

SEQ ID NO: 4065780 - DNA, 18 bp, Homo sapiens
aaagcttccatgattcta

SEQ ID NO: 4065781 - DNA, 20 bp, Homo sapiens
aaagcttccctccctgctgt

SEQ ID NO: 4065782 - DNA, 21 bp, Homo sapiens
aaagcttctatcccaggaggt

SEQ ID NO: 4065783 - DNA, 20 bp, Homo sapiens
aaagcttcttaattaatttg

SEQ ID NO: 4065784 - DNA, 14 bp, Homo sapiens
aaagcttcttcaga

SEQ ID NO: 4065785 - DNA, 20 bp, Homo sapiens
aaagcttgaagatcgttagt

SEQ ID NO: 4065786 - DNA, 13 bp, Homo sapiens
aaagctttcctgc

SEQ ID NO: 4065787 - DNA, 16 bp, Homo sapiens
aaagctttttcctcct

SEQ ID NO: 4065788 - DNA, 17 bp, Homo sapiens
aaagctttttcctcctg

SEQ ID NO: 4065789 - DNA, 18 bp, Homo sapiens
aaaggaaaacctgaagac

SEQ ID NO: 4065790 - DNA, 18 bp, Homo sapiens
aaaggaaaatagtaatgt

SEQ ID NO: 4065791 - DNA, 22 bp, Homo sapiens
aaaggaaacttcagttgatctt

SEQ ID NO: 4065792 - DNA, 15 bp, Homo sapiens
aaaggaaagaaaaca

SEQ ID NO: 4065793 - DNA, 17 bp, Homo sapiens
aaaggaaatctcacccc

SEQ ID NO: 4065794 - DNA, 14 bp, Homo sapiens
aaagtttttagaat

SEQ ID NO: 4065795 - DNA, 22 bp, Homo sapiens
aaagttttttttttgtttgttt

SEQ ID NO: 4065796 - DNA, 20 bp, Homo sapiens
aaataaaaagtgacacagca

SEQ ID NO: 4065797 - DNA, 15 bp, Homo sapiens
aaataaaaatggata

SEQ ID NO: 4065798 - DNA, 16 bp, Homo sapiens
aaataaaaatggcaaa

SEQ ID NO: 4065799 - DNA, 16 bp, Homo sapiens
aaataaaaattctgaa

SEQ ID NO: 4065800 - DNA, 13 bp, Homo sapiens
aaataaaactgaa

SEQ ID NO: 4065801 - DNA, 11 bp, Homo sapiens
aaataaaagca

SEQ ID NO: 4065802 - DNA, 13 bp, Homo sapiens
aaataaaagcagc

SEQ ID NO: 4065803 - DNA, 22 bp, Homo sapiens
aaataaaagtgaatgaaagatt

SEQ ID NO: 4065804 - DNA, 21 bp, Homo sapiens
aaataaaatcaccaaaaacat

SEQ ID NO: 4065805 - DNA, 19 bp, Homo sapiens
aaataaaatgaaaattgta

SEQ ID NO: 4065806 - DNA, 21 bp, Homo sapiens
aaataaaatgaaaattgtatt

SEQ ID NO: 4065807 - DNA, 18 bp, Homo sapiens
aaataaacatcagtttct

SEQ ID NO: 4065808 - DNA, 13 bp, Homo sapiens
aaataaataattt

SEQ ID NO: 4065809 - DNA, 16 bp, Homo sapiens
aaataaatagctatat

SEQ ID NO: 4065810 - DNA, 21 bp, Homo sapiens
aaataaatggtttctgaaaat

SEQ ID NO: 4065811 - DNA, 12 bp, Homo sapiens
aaataaatgtac

SEQ ID NO: 4065812 - DNA, 17 bp, Homo sapiens
aaataaattagttgtta

SEQ ID NO: 4065813 - DNA, 11 bp, Homo sapiens
aaataaattat

SEQ ID NO: 4065814 - DNA, 14 bp, Homo sapiens
aaataaattcctaa

SEQ ID NO: 4065815 - DNA, 15 bp, Homo sapiens
aaataaattcctaca

SEQ ID NO: 4065816 - DNA, 14 bp, Homo sapiens
aaataaattctgat

SEQ ID NO: 4065817 - DNA, 15 bp, Homo sapiens
aaataacaatgttaa

SEQ ID NO: 4065818 - DNA, 15 bp, Homo sapiens
aaataacacagagag

SEQ ID NO: 4065819 - DNA, 20 bp, Homo sapiens
aaataacaggcatttgttca

SEQ ID NO: 4065820 - DNA, 16 bp, Homo sapiens
aaataaccacaaggtc

SEQ ID NO: 4065821 - DNA, 20 bp, Homo sapiens
aaataaccacaaggtccact

SEQ ID NO: 4065822 - DNA, 15 bp, Homo sapiens
aaataacttcaagca

SEQ ID NO: 4065823 - DNA, 16 bp, Homo sapiens
aaataacttcaagcaa

SEQ ID NO: 4065824 - DNA, 18 bp, Homo sapiens
aaataacttcaagcaaac

SEQ ID NO: 4065825 - DNA, 14 bp, Homo sapiens
aaataagaaaccta

SEQ ID NO: 4065826 - DNA, 15 bp, Homo sapiens
aaataagcaggtgga

SEQ ID NO: 4065827 - DNA, 14 bp, Homo sapiens
aaataagtatttat

SEQ ID NO: 4065828 - DNA, 18 bp, Homo sapiens
aaataagtatttctgatt

SEQ ID NO: 4065829 - DNA, 15 bp, Homo sapiens
aaataataataatgt

SEQ ID NO: 4065830 - DNA, 13 bp, Homo sapiens
aaataatatgcat

SEQ ID NO: 4065831 - DNA, 15 bp, Homo sapiens
aaataatcaagattt

SEQ ID NO: 4065832 - DNA, 12 bp, Homo sapiens
aaataatgaata

SEQ ID NO: 4065833 - DNA, 21 bp, Homo sapiens
aaataatgcttcagatattat

SEQ ID NO: 4065834 - DNA, 14 bp, Homo sapiens
aaataattctaaag

SEQ ID NO: 4065835 - DNA, 15 bp, Homo sapiens
aaataattctaaagg

SEQ ID NO: 4065836 - DNA, 12 bp, Homo sapiens
aaataattttaa

SEQ ID NO: 4065837 - DNA, 15 bp, Homo sapiens
aaatacaaaacttcc

SEQ ID NO: 4065838 - DNA, 14 bp, Homo sapiens
aaatacaaatctgt

SEQ ID NO: 4065839 - DNA, 17 bp, Homo sapiens
aaatacaaatctgtata

SEQ ID NO: 4065840 - DNA, 19 bp, Homo sapiens
aaatacaacttaaataata

SEQ ID NO: 4065841 - DNA, 15 bp, Homo sapiens
aaatacaagactgtt

SEQ ID NO: 4065842 - DNA, 18 bp, Homo sapiens
aaatacaagactgttgtg

SEQ ID NO: 4065843 - DNA, 12 bp, Homo sapiens
aaatacaataaa

SEQ ID NO: 4065844 - DNA, 17 bp, Homo sapiens
aaatacacaagtaaaca

SEQ ID NO: 4065845 - DNA, 17 bp, Homo sapiens
aaatacagacactaagt

SEQ ID NO: 4065846 - DNA, 22 bp, Homo sapiens
aaatacagacactaagttatag

SEQ ID NO: 4065847 - DNA, 21 bp, Homo sapiens
aaatacatatcgctgacttca

SEQ ID NO: 4065848 - DNA, 17 bp, Homo sapiens
aaataccagtgtggttt

SEQ ID NO: 4065849 - DNA, 15 bp, Homo sapiens
aaatactaaaagcaa

SEQ ID NO: 4065850 - DNA, 22 bp, Homo sapiens
aaatactaaaagcaaatctaca

SEQ ID NO: 4065851 - DNA, 20 bp, Homo sapiens
aaatactatttaaagcctcc

SEQ ID NO: 4065852 - DNA, 17 bp, Homo sapiens
aaatactgcaagaaaat

SEQ ID NO: 4065853 - DNA, 21 bp, Homo sapiens
aaatactgtgcagaataatgg

SEQ ID NO: 4065854 - DNA, 16 bp, Homo sapiens
aaatacttgtgatttt

SEQ ID NO: 4065855 - DNA, 14 bp, Homo sapiens
aaatagaaaatggt

SEQ ID NO: 4065856 - DNA, 15 bp, Homo sapiens
aaatagacagtatat

SEQ ID NO: 4065857 - DNA, 19 bp, Homo sapiens
aaatagacagtatatttat

SEQ ID NO: 4065858 - DNA, 17 bp, Homo sapiens
aaatagagtatatgcac

SEQ ID NO: 4065859 - DNA, 13 bp, Homo sapiens
aaatagcagaaag

SEQ ID NO: 4065860 - DNA, 21 bp, Homo sapiens
aaatagccctgcaaaaattca

SEQ ID NO: 4065861 - DNA, 23 bp, Homo sapiens
aaatagctaatttatttccccag

SEQ ID NO: 4065862 - DNA, 19 bp, Homo sapiens
aaatagctatatccatgta

SEQ ID NO: 4065863 - DNA, 13 bp, Homo sapiens
aaatagctctttc

SEQ ID NO: 4065864 - DNA, 23 bp, Homo sapiens
aaataggagaggatgagagccca

SEQ ID NO: 4065865 - DNA, 14 bp, Homo sapiens
aaataggcagaatg

SEQ ID NO: 4065866 - DNA, 16 bp, Homo sapiens
aaataggcagaatgga

SEQ ID NO: 4065867 - DNA, 21 bp, Homo sapiens
aaatagtgacataatatattc

SEQ ID NO: 4065868 - DNA, 17 bp, Homo sapiens
aaatagttaagacatga

SEQ ID NO: 4065869 - DNA, 18 bp, Homo sapiens
aaatagtttaggagaaac

SEQ ID NO: 4065870 - DNA, 22 bp, Homo sapiens
aaacctcaaaatgtctaagata

SEQ ID NO: 4065871 - DNA, 15 bp, Homo sapiens
aaacctcagggctgt

SEQ ID NO: 4065872 - DNA, 19 bp, Homo sapiens
aaacctgatgttaaaattc

SEQ ID NO: 4065873 - DNA, 21 bp, Homo sapiens
aaacctgggattcaggaatgt

SEQ ID NO: 4065874 - DNA, 12 bp, Homo sapiens
aaacctgtctga

SEQ ID NO: 4065875 - DNA, 17 bp, Homo sapiens
aaaccttattgtacctc

SEQ ID NO: 4065876 - DNA, 20 bp, Homo sapiens
aaaccttgctaattttctca

SEQ ID NO: 4065877 - DNA, 20 bp, Homo sapiens
aaaccttttggaaaatctgc

SEQ ID NO: 4065878 - DNA, 19 bp, Homo sapiens
aaaccttttttaagatttt

SEQ ID NO: 4065879 - DNA, 20 bp, Homo sapiens
aaaccttttttaagattttt

SEQ ID NO: 4065880 - DNA, 21 bp, Homo sapiens
aaacgacactctctggaagcc

SEQ ID NO: 4065881 - DNA, 18 bp, Homo sapiens
aaacgctacctctctgtc

SEQ ID NO: 4065882 - DNA, 16 bp, Homo sapiens
aaacggtgcccatcct

SEQ ID NO: 4065883 - DNA, 18 bp, Homo sapiens
aaacgtgttttttaaaaa

SEQ ID NO: 4065884 - DNA, 16 bp, Homo sapiens
aaacgttttattgtgt

SEQ ID NO: 4065885 - DNA, 14 bp, Homo sapiens
aaactaaataatga

SEQ ID NO: 4065886 - DNA, 15 bp, Homo sapiens
aaactaaccttgaat

SEQ ID NO: 4065887 - DNA, 18 bp, Homo sapiens
aaactaatcaccatattg

SEQ ID NO: 4065888 - DNA, 22 bp, Homo sapiens
aaactaccaggtgtgcctggaa

SEQ ID NO: 4065889 - DNA, 12 bp, Homo sapiens
aaactactcttt

SEQ ID NO: 4065890 - DNA, 17 bp, Homo sapiens
aaactactctttgattt

SEQ ID NO: 4065891 - DNA, 23 bp, Homo sapiens
aaactataaatacaaatctgtat

SEQ ID NO: 4065892 - DNA, 15 bp, Homo sapiens
aaactatctggccat

SEQ ID NO: 4065893 - DNA, 17 bp, Homo sapiens
aaactatggttcccaat

SEQ ID NO: 4065894 - DNA, 23 bp, Homo sapiens
aaactatggttcccaataaaagt

SEQ ID NO: 4065895 - DNA, 19 bp, Homo sapiens
aaactatttagtgttagtt

SEQ ID NO: 4065896 - DNA, 20 bp, Homo sapiens
aaactatttagtgttagtta

SEQ ID NO: 4065897 - DNA, 13 bp, Homo sapiens
aaactatttatct

SEQ ID NO: 4065898 - DNA, 22 bp, Homo sapiens
aaactatttatctgtgtttttg

SEQ ID NO: 4065899 - DNA, 13 bp, Homo sapiens
aaactcacaaatg

SEQ ID NO: 4065900 - DNA, 18 bp, Homo sapiens
aaactcaccatgtaaaag

SEQ ID NO: 4065901 - DNA, 13 bp, Homo sapiens
aaactcactgtga

SEQ ID NO: 4065902 - DNA, 13 bp, Homo sapiens
aaactcagggaca

SEQ ID NO: 4065903 - DNA, 17 bp, Homo sapiens
aaactcagggacagagc

SEQ ID NO: 4065904 - DNA, 16 bp, Homo sapiens
aaactccacatctgcc

SEQ ID NO: 4065905 - DNA, 17 bp, Homo sapiens
aaactccacatctgcct

SEQ ID NO: 4065906 - DNA, 18 bp, Homo sapiens
aaactccacatctgcctt

SEQ ID NO: 4065907 - DNA, 19 bp, Homo sapiens
aaactccacatctgcctta

SEQ ID NO: 4065908 - DNA, 23 bp, Homo sapiens
aaactcccatttacgtgtctgaa

SEQ ID NO: 4065909 - DNA, 17 bp, Homo sapiens
aaactcttaatctgtgt

SEQ ID NO: 4065910 - DNA, 16 bp, Homo sapiens
aaactcttatctcagt

SEQ ID NO: 4065911 - DNA, 13 bp, Homo sapiens
aaactctttattt

SEQ ID NO: 4065912 - DNA, 15 bp, Homo sapiens
aaactgaatataaag

SEQ ID NO: 4065913 - DNA, 14 bp, Homo sapiens
aaactgaatatttt

SEQ ID NO: 4065914 - DNA, 14 bp, Homo sapiens
aaactgaatggaag

SEQ ID NO: 4065915 - DNA, 22 bp, Homo sapiens
aaactgagcctcacttgccctc

SEQ ID NO: 4065916 - DNA, 16 bp, Homo sapiens
aaactgcaatagagac

SEQ ID NO: 4065917 - DNA, 22 bp, Homo sapiens
aaactgcaatagagactgtaga

SEQ ID NO: 4065918 - DNA, 14 bp, Homo sapiens
aaactgcattagaa

SEQ ID NO: 4065919 - DNA, 17 bp, Homo sapiens
aaactgcattagaaatt

SEQ ID NO: 4065920 - DNA, 14 bp, Homo sapiens
aaactggaataaga

SEQ ID NO: 4065921 - DNA, 22 bp, Homo sapiens
aaactggattaaaacaattttt

SEQ ID NO: 4065922 - DNA, 17 bp, Homo sapiens
aaactggggcctccaga

SEQ ID NO: 4065923 - DNA, 22 bp, Homo sapiens
aaactggtttgttgcagccaaa

SEQ ID NO: 4065924 - DNA, 18 bp, Homo sapiens
aaactgtacagaatttcc

SEQ ID NO: 4065925 - DNA, 15 bp, Homo sapiens
aaactgtagaaatga

SEQ ID NO: 4065926 - DNA, 18 bp, Homo sapiens
aaactgtagaaatgatga

SEQ ID NO: 4065927 - DNA, 19 bp, Homo sapiens
aaactgtctttaaaagaga

SEQ ID NO: 4065928 - DNA, 20 bp, Homo sapiens
aaactgtctttaaaagagag

SEQ ID NO: 4065929 - DNA, 19 bp, Homo sapiens
aaactgtgtggactgtgat

SEQ ID NO: 4065930 - DNA, 16 bp, Homo sapiens
aaactgtgttgccaca

SEQ ID NO: 4065931 - DNA, 17 bp, Homo sapiens
aaactgtgttgccacag

SEQ ID NO: 4065932 - DNA, 21 bp, Homo sapiens
aaactgttacctaaagtattt

SEQ ID NO: 4065933 - DNA, 23 bp, Homo sapiens
aaactgtttgaaaacttcagaag

SEQ ID NO: 4065934 - DNA, 23 bp, Homo sapiens
aaacttaactttaactgaacaat

SEQ ID NO: 4065935 - DNA, 23 bp, Homo sapiens
aaacttacctaagtgacatttgt

SEQ ID NO: 4065936 - DNA, 17 bp, Homo sapiens
aaacttagtgacaaaat

SEQ ID NO: 4065937 - DNA, 12 bp, Homo sapiens
aaacttcagaag

SEQ ID NO: 4065938 - DNA, 13 bp, Homo sapiens
aaaagtattttga

SEQ ID NO: 4065939 - DNA, 16 bp, Homo sapiens
aaaagtattttgaagt

SEQ ID NO: 4065940 - DNA, 18 bp, Homo sapiens
aaaagtattttgaagttt

SEQ ID NO: 4065941 - DNA, 22 bp, Homo sapiens
aaaagtattttgaagtttacat

SEQ ID NO: 4065942 - DNA, 23 bp, Homo sapiens
aaaagtcttcactctctgaagat

SEQ ID NO: 4065943 - DNA, 20 bp, Homo sapiens
aaaagtgaatgaaagattaa

SEQ ID NO: 4065944 - DNA, 14 bp, Homo sapiens
aaaagtgacacagc

SEQ ID NO: 4065945 - DNA, 15 bp, Homo sapiens
aaaagttacagaaat

SEQ ID NO: 4065946 - DNA, 19 bp, Homo sapiens
aaaagtttcacgtcttggt

SEQ ID NO: 4065947 - DNA, 23 bp, Homo sapiens
aaaagtttcctaggatgtcatgt

SEQ ID NO: 4065948 - DNA, 17 bp, Homo sapiens
aaaataaaaagtgacac

SEQ ID NO: 4065949 - DNA, 21 bp, Homo sapiens
aaaataaaaagtgacacagca

SEQ ID NO: 4065950 - DNA, 12 bp, Homo sapiens
aaaataaataat

SEQ ID NO: 4065951 - DNA, 15 bp, Homo sapiens
aaaataaataatttt

SEQ ID NO: 4065952 - DNA, 13 bp, Homo sapiens
aaaataaatatca

SEQ ID NO: 4065953 - DNA, 13 bp, Homo sapiens
aaaataagcaggt

SEQ ID NO: 4065954 - DNA, 12 bp, Homo sapiens
aaaataataatt

SEQ ID NO: 4065955 - DNA, 14 bp, Homo sapiens
aaaatacaataaac

SEQ ID NO: 4065956 - DNA, 17 bp, Homo sapiens
aaaatacataagaccat

SEQ ID NO: 4065957 - DNA, 14 bp, Homo sapiens
aaaatactattgcc

SEQ ID NO: 4065958 - DNA, 9 bp, Homo sapiens
aaaatactt

SEQ ID NO: 4065959 - DNA, 11 bp, Homo sapiens
aaaatactttt

SEQ ID NO: 4065960 - DNA, 22 bp, Homo sapiens
aaaatacttttactctgcctac

SEQ ID NO: 4065961 - DNA, 17 bp, Homo sapiens
aaaatagaaattttgta

SEQ ID NO: 4065962 - DNA, 15 bp, Homo sapiens
aaaatagacaaatag

SEQ ID NO: 4065963 - DNA, 21 bp, Homo sapiens
aaaatagagcttttaaaaatg

SEQ ID NO: 4065964 - DNA, 18 bp, Homo sapiens
aaaataggggatatttaa

SEQ ID NO: 4065965 - DNA, 16 bp, Homo sapiens
aaaatatatttaatga

SEQ ID NO: 4065966 - DNA, 23 bp, Homo sapiens
acctcagcatttccttccagccc

SEQ ID NO: 4065967 - DNA, 14 bp, Homo sapiens
acctcagcctggcc

SEQ ID NO: 4065968 - DNA, 15 bp, Homo sapiens
acctcagcctggcca

SEQ ID NO: 4065969 - DNA, 21 bp, Homo sapiens
acctcagcctggccagacaca

SEQ ID NO: 4065970 - DNA, 15 bp, Homo sapiens
acctcagctctggga

SEQ ID NO: 4065971 - DNA, 15 bp, Homo sapiens
acctcaggcagctca

SEQ ID NO: 4065972 - DNA, 16 bp, Homo sapiens
acctcaggcagctcaa

SEQ ID NO: 4065973 - DNA, 10 bp, Homo sapiens
acctcagggc

SEQ ID NO: 4065974 - DNA, 18 bp, Homo sapiens
acctcagggctgtcccag

SEQ ID NO: 4065975 - DNA, 21 bp, Homo sapiens
acctcagggctgtcccagccc

SEQ ID NO: 4065976 - DNA, 22 bp, Homo sapiens
acctcagggctgtcccagcccc

SEQ ID NO: 4065977 - DNA, 19 bp, Homo sapiens
acctcagtgtcatttatga

SEQ ID NO: 4065978 - DNA, 21 bp, Homo sapiens
acctcagtgtcatttatgaaa

SEQ ID NO: 4065979 - DNA, 18 bp, Homo sapiens
acctcagttcattgtggt

SEQ ID NO: 4065980 - DNA, 19 bp, Homo sapiens
acctcagttcccttggcct

SEQ ID NO: 4065981 - DNA, 21 bp, Homo sapiens
acctcagttcccttggcctca

SEQ ID NO: 4065982 - DNA, 18 bp, Homo sapiens
acctcagttttatcattt

SEQ ID NO: 4065983 - DNA, 15 bp, Homo sapiens
acctcatcaggatga

SEQ ID NO: 4065984 - DNA, 18 bp, Homo sapiens
acctcatcaggatgaacc

SEQ ID NO: 4065985 - DNA, 20 bp, Homo sapiens
acctcatcaggatgaaccca

SEQ ID NO: 4065986 - DNA, 16 bp, Homo sapiens
acctcatgcccacccc

SEQ ID NO: 4065987 - DNA, 19 bp, Homo sapiens
acctccacacccgtgagaa

SEQ ID NO: 4065988 - DNA, 19 bp, Homo sapiens
acctccaccacatctgcca

SEQ ID NO: 4065989 - DNA, 14 bp, Homo sapiens
acctccacccagcc

SEQ ID NO: 4065990 - DNA, 17 bp, Homo sapiens
acctccacccagcccct

SEQ ID NO: 4065991 - DNA, 12 bp, Homo sapiens
acctccactccc

SEQ ID NO: 4065992 - DNA, 23 bp, Homo sapiens
acctccactcccacctcacccgg

SEQ ID NO: 4065993 - DNA, 23 bp, Homo sapiens
acctccagcctccctgtctccag

SEQ ID NO: 4065994 - DNA, 15 bp, Homo sapiens
acctccaggcctgtt

SEQ ID NO: 4065995 - DNA, 22 bp, Homo sapiens
acctccccacatcgcacactgg

SEQ ID NO: 4065996 - DNA, 11 bp, Homo sapiens
acctcccccac

SEQ ID NO: 4065997 - DNA, 15 bp, Homo sapiens
acctccccgctggga

SEQ ID NO: 4065998 - DNA, 17 bp, Homo sapiens
acctccctgacccgtct

SEQ ID NO: 4065999 - DNA, 19 bp, Homo sapiens
acctccgagacagtccagt

SEQ ID NO: 4066000 - DNA, 17 bp, Homo sapiens
acctcctctcagtgttt

SEQ ID NO: 4066001 - DNA, 14 bp, Homo sapiens
acctcctctcctga

SEQ ID NO: 4066002 - DNA, 19 bp, Homo sapiens
acctccttagccctgtctg

SEQ ID NO: 4066003 - DNA, 14 bp, Homo sapiens
acctcgctgagggc

SEQ ID NO: 4066004 - DNA, 15 bp, Homo sapiens
acctcggcctcccaa

SEQ ID NO: 4066005 - DNA, 17 bp, Homo sapiens
acctcggcttgtgggct

SEQ ID NO: 4066006 - DNA, 16 bp, Homo sapiens
acctctagccctgccc

SEQ ID NO: 4066007 - DNA, 18 bp, Homo sapiens
acctctagccctgcccgg

SEQ ID NO: 4066008 - DNA, 15 bp, Homo sapiens
acctctatccaaaga

SEQ ID NO: 4066009 - DNA, 15 bp, Homo sapiens
acctctcaagctagt

SEQ ID NO: 4066010 - DNA, 12 bp, Homo sapiens
acctctcactcc

SEQ ID NO: 4066011 - DNA, 16 bp, Homo sapiens
acctctcagggcctgg

SEQ ID NO: 4066012 - DNA, 18 bp, Homo sapiens
acctctcatcagtgtcct

SEQ ID NO: 4066013 - DNA, 16 bp, Homo sapiens
acctctccaagtctct

SEQ ID NO: 4066014 - DNA, 23 bp, Homo sapiens
acctctccaagtctctctgtgaa

SEQ ID NO: 4066015 - DNA, 15 bp, Homo sapiens
acctctccaggtgct

SEQ ID NO: 4066016 - DNA, 16 bp, Homo sapiens
acctctcctgccctgt

SEQ ID NO: 4066017 - DNA, 16 bp, Homo sapiens
acctctctcagagcat

SEQ ID NO: 4066018 - DNA, 18 bp, Homo sapiens
acctctctcagagcatct

SEQ ID NO: 4066019 - DNA, 14 bp, Homo sapiens
acctctctgtccct

SEQ ID NO: 4066020 - DNA, 22 bp, Homo sapiens
acctctctgtcccttgctgtat

SEQ ID NO: 4066021 - DNA, 21 bp, Homo sapiens
acctctgcactactgacatgt

SEQ ID NO: 4066022 - DNA, 18 bp, Homo sapiens
acctctgcctcccaggtt

SEQ ID NO: 4066023 - DNA, 14 bp, Homo sapiens
acctctggactggc

SEQ ID NO: 4066024 - DNA, 15 bp, Homo sapiens
acctctggactggct

SEQ ID NO: 4066025 - DNA, 19 bp, Homo sapiens
acctctggactggctagag

SEQ ID NO: 4066026 - DNA, 23 bp, Homo sapiens
acctctggactggctagagtcct

SEQ ID NO: 4066027 - DNA, 13 bp, Homo sapiens
acctctgggagct

SEQ ID NO: 4066028 - DNA, 20 bp, Homo sapiens
acctctggggaccccaacct

SEQ ID NO: 4066029 - DNA, 15 bp, Homo sapiens
acctctgtaggcagc

SEQ ID NO: 4066030 - DNA, 14 bp, Homo sapiens
acctctgtatagaa

SEQ ID NO: 4066031 - DNA, 15 bp, Homo sapiens
acctctgtcatttgt

SEQ ID NO: 4066032 - DNA, 12 bp, Homo sapiens
acctctgtctca

SEQ ID NO: 4066033 - DNA, 21 bp, Homo sapiens
acctctgtctcatcctcctgg

SEQ ID NO: 4066034 - DNA, 15 bp, Homo sapiens
acctcttactttgct

SEQ ID NO: 4066035 - DNA, 14 bp, Homo sapiens
acctcttcccatga

SEQ ID NO: 4066036 - DNA, 16 bp, Homo sapiens
acctcttcccatgact

SEQ ID NO: 4066037 - DNA, 21 bp, Homo sapiens
aaacgctacctctctgtccct

SEQ ID NO: 4066038 - DNA, 14 bp, Homo sapiens
aaacgctcctttgt

SEQ ID NO: 4066039 - DNA, 13 bp, Homo sapiens
aaactaaaaatat

SEQ ID NO: 4066040 - DNA, 18 bp, Homo sapiens
aaactaaaagacatttgt

SEQ ID NO: 4066041 - DNA, 16 bp, Homo sapiens
aaactaatattttatg

SEQ ID NO: 4066042 - DNA, 15 bp, Homo sapiens
aaactacatattgta

SEQ ID NO: 4066043 - DNA, 21 bp, Homo sapiens
aaactactgttaggaacagca

SEQ ID NO: 4066044 - DNA, 17 bp, Homo sapiens
aaactaggaaatttttt

SEQ ID NO: 4066045 - DNA, 15 bp, Homo sapiens
aaactaggctccttc

SEQ ID NO: 4066046 - DNA, 20 bp, Homo sapiens
aaactaggtaatgttttgta

SEQ ID NO: 4066047 - DNA, 21 bp, Homo sapiens
aaactaggtaatgttttgtat

SEQ ID NO: 4066048 - DNA, 14 bp, Homo sapiens
aaactagttatttt

SEQ ID NO: 4066049 - DNA, 17 bp, Homo sapiens
aaactatgaagatctga

SEQ ID NO: 4066050 - DNA, 22 bp, Homo sapiens
aaactcactgtgatcaatattt

SEQ ID NO: 4066051 - DNA, 19 bp, Homo sapiens
aaactcagggacagagcca

SEQ ID NO: 4066052 - DNA, 20 bp, Homo sapiens
aaactccttcctggcctgag

SEQ ID NO: 4066053 - DNA, 22 bp, Homo sapiens
aaactctgggaaataagagaga

SEQ ID NO: 4066054 - DNA, 19 bp, Homo sapiens
aaactctgttgcaagtgca

SEQ ID NO: 4066055 - DNA, 18 bp, Homo sapiens
aaactcttaatctgtgtg

SEQ ID NO: 4066056 - DNA, 22 bp, Homo sapiens
aaactcttatctcagtcatgca

SEQ ID NO: 4066057 - DNA, 16 bp, Homo sapiens
aaactctttaacttct

SEQ ID NO: 4066058 - DNA, 17 bp, Homo sapiens
aaactgaatataaagct

SEQ ID NO: 4066059 - DNA, 19 bp, Homo sapiens
aaactgaatataaagctta

SEQ ID NO: 4066060 - DNA, 21 bp, Homo sapiens
aaactgaatataaagcttaat

SEQ ID NO: 4066061 - DNA, 13 bp, Homo sapiens
aaactgaatattt

SEQ ID NO: 4066062 - DNA, 18 bp, Homo sapiens
aaactgaatattttggaa

SEQ ID NO: 4066063 - DNA, 12 bp, Homo sapiens
aaactgacttta

SEQ ID NO: 4066064 - DNA, 11 bp, Homo sapiens
aaactgagcct

SEQ ID NO: 4066065 - DNA, 13 bp, Homo sapiens
aaactgatttctt

SEQ ID NO: 4066066 - DNA, 12 bp, Homo sapiens
aaactgcaatag

SEQ ID NO: 4066067 - DNA, 18 bp, Homo sapiens
aaactgcaatagagactg

SEQ ID NO: 4066068 - DNA, 21 bp, Homo sapiens
aaactgcaatagagactgtag

SEQ ID NO: 4066069 - DNA, 12 bp, Homo sapiens
aaatctgtctgc

SEQ ID NO: 4066070 - DNA, 13 bp, Homo sapiens
aaatcttccttgt

SEQ ID NO: 4066071 - DNA, 15 bp, Homo sapiens
aaatcttctccagat

SEQ ID NO: 4066072 - DNA, 23 bp, Homo sapiens
aaatcttggaagtacatgaatac

SEQ ID NO: 4066073 - DNA, 13 bp, Homo sapiens
aaatgaaaattgt

SEQ ID NO: 4066074 - DNA, 14 bp, Homo sapiens
aaatgaaaattgta

SEQ ID NO: 4066075 - DNA, 14 bp, Homo sapiens
aaatgaaatttgca

SEQ ID NO: 4066076 - DNA, 19 bp, Homo sapiens
aaatgaaatttgcaaaatc

SEQ ID NO: 4066077 - DNA, 20 bp, Homo sapiens
aaatgaaatttgcaaaatca

SEQ ID NO: 4066078 - DNA, 21 bp, Homo sapiens
aaatgaaatttgcaaaatcac

SEQ ID NO: 4066079 - DNA, 19 bp, Homo sapiens
aaatgaatgtctaaaattg

SEQ ID NO: 4066080 - DNA, 20 bp, Homo sapiens
aaatgacctctgtcctccct

SEQ ID NO: 4066081 - DNA, 17 bp, Homo sapiens
aaatgactaaaaatatt

SEQ ID NO: 4066082 - DNA, 17 bp, Homo sapiens
aaatgactacttagcat

SEQ ID NO: 4066083 - DNA, 22 bp, Homo sapiens
aaatgactacttagcatcctaa

SEQ ID NO: 4066084 - DNA, 16 bp, Homo sapiens
aaatgacttatttctg

SEQ ID NO: 4066085 - DNA, 15 bp, Homo sapiens
aaatgagaagtactt

SEQ ID NO: 4066086 - DNA, 18 bp, Homo sapiens
aaatgagaattttatatt

SEQ ID NO: 4066087 - DNA, 23 bp, Homo sapiens
aaatgagctcgcatttgtcaatg

SEQ ID NO: 4066088 - DNA, 16 bp, Homo sapiens
aaatgaggtactctcc

SEQ ID NO: 4066089 - DNA, 23 bp, Homo sapiens
aaatgaggtactctcctggaaat

SEQ ID NO: 4066090 - DNA, 21 bp, Homo sapiens
aaatgaggtctgtttaaagtg

SEQ ID NO: 4066091 - DNA, 14 bp, Homo sapiens
aaatgagtaacatt

SEQ ID NO: 4066092 - DNA, 22 bp, Homo sapiens
aaatgatgatgtggaagaactt

SEQ ID NO: 4066093 - DNA, 19 bp, Homo sapiens
aaatgattttaattttata

SEQ ID NO: 4066094 - DNA, 21 bp, Homo sapiens
aaatgattttatctgtgaatt

SEQ ID NO: 4066095 - DNA, 21 bp, Homo sapiens
aaatgcaaacacacaaaggta

SEQ ID NO: 4066096 - DNA, 16 bp, Homo sapiens
aaatgcaataatttta

SEQ ID NO: 4066097 - DNA, 17 bp, Homo sapiens
aaatgcaataattttac

SEQ ID NO: 4066098 - DNA, 20 bp, Homo sapiens
aaatgcagtcctgaggagag

SEQ ID NO: 4066099 - DNA, 18 bp, Homo sapiens
aaatgcagttttaagaat

SEQ ID NO: 4066100 - DNA, 19 bp, Homo sapiens
aaatgcatatcctgagcca

SEQ ID NO: 4066101 - DNA, 20 bp, Homo sapiens
aaatgcatatcctgagccat

SEQ ID NO: 4066102 - DNA, 17 bp, Homo sapiens
aaatgcattctatcgtt

SEQ ID NO: 4066103 - DNA, 22 bp, Homo sapiens
aaatgcattctatcgttattat

SEQ ID NO: 4066104 - DNA, 18 bp, Homo sapiens
aaatgcctttgagacagt

SEQ ID NO: 4066105 - DNA, 20 bp, Homo sapiens
aaatgcctttgagacagttt

SEQ ID NO: 4066106 - DNA, 15 bp, Homo sapiens
aaatgcggttataaa

SEQ ID NO: 4066107 - DNA, 22 bp, Homo sapiens
aaatgcggttataaaaaatggt

SEQ ID NO: 4066108 - DNA, 23 bp, Homo sapiens
aaatgcggttataaaaaatggtt

SEQ ID NO: 4066109 - DNA, 23 bp, Homo sapiens
aaatgctagaagctgtctaggtc

SEQ ID NO: 4066110 - DNA, 14 bp, Homo sapiens
aaatgctatttttt

SEQ ID NO: 4066111 - DNA, 12 bp, Homo sapiens
aaatggaaaaaa

SEQ ID NO: 4066112 - DNA, 13 bp, Homo sapiens
aaatggaaactat

SEQ ID NO: 4066113 - DNA, 22 bp, Homo sapiens
aaatggaatgtgcccctggccc

SEQ ID NO: 4066114 - DNA, 16 bp, Homo sapiens
aaatggacactgtgcc

SEQ ID NO: 4066115 - DNA, 19 bp, Homo sapiens
aaatggatattattagaaa

SEQ ID NO: 4066116 - DNA, 16 bp, Homo sapiens
aaatggcagtatttca

SEQ ID NO: 4066117 - DNA, 20 bp, Homo sapiens
aaatgggtgtatataatttt

SEQ ID NO: 4066118 - DNA, 20 bp, Homo sapiens
aaatggtgtacataatgtat

SEQ ID NO: 4066119 - DNA, 14 bp, Homo sapiens
aaatggtgtttttt

SEQ ID NO: 4066120 - DNA, 14 bp, Homo sapiens
aaatggttcagaat

SEQ ID NO: 4066121 - DNA, 23 bp, Homo sapiens
aaatgtaactgtgccagttcttt

SEQ ID NO: 4066122 - DNA, 10 bp, Homo sapiens
aaatgtaata

SEQ ID NO: 4066123 - DNA, 16 bp, Homo sapiens
aaatgtaatactggaa

SEQ ID NO: 4066124 - DNA, 20 bp, Homo sapiens
aaatgtaatactggaataat

SEQ ID NO: 4066125 - DNA, 22 bp, Homo sapiens
aaatgtaatactggaataattt

SEQ ID NO: 4066126 - DNA, 19 bp, Homo sapiens
aaatgtaggatcaaaaggc

SEQ ID NO: 4066127 - DNA, 17 bp, Homo sapiens
aaatgtatcttattcac

SEQ ID NO: 4066128 - DNA, 14 bp, Homo sapiens
aaatgtattcaaat

SEQ ID NO: 4066129 - DNA, 23 bp, Homo sapiens
aaatgtatttaattaaatctcaa

SEQ ID NO: 4066130 - DNA, 16 bp, Homo sapiens
aaatgtattttgaaga

SEQ ID NO: 4066131 - DNA, 21 bp, Homo sapiens
aaatgtattttgaagaatatt

SEQ ID NO: 4066132 - DNA, 18 bp, Homo sapiens
aaatgtcttaatttttga

SEQ ID NO: 4066133 - DNA, 14 bp, Homo sapiens
aaatgtctttgtaa

SEQ ID NO: 4066134 - DNA, 18 bp, Homo sapiens
aaatgtcttttagaagat

SEQ ID NO: 4066135 - DNA, 17 bp, Homo sapiens
aaatgtgaatttttatt

SEQ ID NO: 4066136 - DNA, 13 bp, Homo sapiens
aaatgtgattttt

SEQ ID NO: 4066137 - DNA, 17 bp, Homo sapiens
aaatgtgatttttctga

SEQ ID NO: 4066138 - DNA, 20 bp, Homo sapiens
aaatgtgtaattcaaaagat

SEQ ID NO: 4066139 - DNA, 18 bp, Homo sapiens
aaatgttagtcattgtta

SEQ ID NO: 4066140 - DNA, 13 bp, Homo sapiens
aaatgttcttcca

SEQ ID NO: 4066141 - DNA, 15 bp, Homo sapiens
aaatgttcttccagt

SEQ ID NO: 4066142 - DNA, 23 bp, Homo sapiens
aaatgtttaagtattaacttaca

SEQ ID NO: 4066143 - DNA, 16 bp, Homo sapiens
aaatgtttttctgcca

SEQ ID NO: 4066144 - DNA, 13 bp, Homo sapiens
aaattaaaacgaa

SEQ ID NO: 4066145 - DNA, 13 bp, Homo sapiens
aaattaaatctgt

SEQ ID NO: 4066146 - DNA, 14 bp, Homo sapiens
aaattaagaaggca

SEQ ID NO: 4066147 - DNA, 13 bp, Homo sapiens
aaattaatcacaa

SEQ ID NO: 4066148 - DNA, 12 bp, Homo sapiens
aaattacaacta

SEQ ID NO: 4066149 - DNA, 14 bp, Homo sapiens
aaattacagcttca

SEQ ID NO: 4066150 - DNA, 13 bp, Homo sapiens
aaattacatttcg

SEQ ID NO: 4066151 - DNA, 23 bp, Homo sapiens
aaattacgtttgttattcctagt

SEQ ID NO: 4066152 - DNA, 11 bp, Homo sapiens
aaattagaaaa

SEQ ID NO: 4066153 - DNA, 12 bp, Homo sapiens
aaattagaaaat

SEQ ID NO: 4066154 - DNA, 20 bp, Homo sapiens
aaattagactgtgattcaga

SEQ ID NO: 4066155 - DNA, 18 bp, Homo sapiens
aaattagataaattgtag

SEQ ID NO: 4066156 - DNA, 17 bp, Homo sapiens
aaattagctgtgtgaaa

SEQ ID NO: 4066157 - DNA, 18 bp, Homo sapiens
aaattaggaataaataaa

SEQ ID NO: 4066158 - DNA, 18 bp, Homo sapiens
aaattaggtattttgtcc

SEQ ID NO: 4066159 - DNA, 16 bp, Homo sapiens
aaattataacttaaaa

SEQ ID NO: 4066160 - DNA, 13 bp, Homo sapiens
aaattatgtaact

SEQ ID NO: 4066161 - DNA, 17 bp, Homo sapiens
aaattatgtgacatttt

SEQ ID NO: 4066162 - DNA, 22 bp, Homo sapiens
aaattatgtgacattttacatt

SEQ ID NO: 4066163 - DNA, 16 bp, Homo sapiens
aaattcaagaaaataa

SEQ ID NO: 4066164 - DNA, 15 bp, Homo sapiens
aaattcaattgtaaa

SEQ ID NO: 4066165 - DNA, 17 bp, Homo sapiens
aaattcaattgtaaatt

SEQ ID NO: 4066166 - DNA, 20 bp, Homo sapiens
aaattcaattgtaaattgaa

SEQ ID NO: 4066167 - DNA, 23 bp, Homo sapiens
aaattcaattgtaaattgaatca

SEQ ID NO: 4066168 - DNA, 14 bp, Homo sapiens
aaattcacaaactt

SEQ ID NO: 4066169 - DNA, 13 bp, Homo sapiens
aaattcagttttt

SEQ ID NO: 4066170 - DNA, 16 bp, Homo sapiens
aaattcagtttttgta

SEQ ID NO: 4066171 - DNA, 17 bp, Homo sapiens
aaattcagtttttgtat

SEQ ID NO: 4066172 - DNA, 21 bp, Homo sapiens
aacatgtaattaagtactatg

SEQ ID NO: 4066173 - DNA, 16 bp, Homo sapiens
aacatgttactgacca

SEQ ID NO: 4066174 - DNA, 13 bp, Homo sapiens
aacatgtttaatg

SEQ ID NO: 4066175 - DNA, 19 bp, Homo sapiens
aacattaatagcagccttt

SEQ ID NO: 4066176 - DNA, 12 bp, Homo sapiens
aacattatttat

SEQ ID NO: 4066177 - DNA, 17 bp, Homo sapiens
aacattgaccaagaact

SEQ ID NO: 4066178 - DNA, 21 bp, Homo sapiens
aacattgaccaagaactgcat

SEQ ID NO: 4066179 - DNA, 15 bp, Homo sapiens
aacatttacagtcct

SEQ ID NO: 4066180 - DNA, 22 bp, Homo sapiens
aacattttaaaaacatagaaaa

SEQ ID NO: 4066181 - DNA, 19 bp, Homo sapiens
aacatttttaatttaacaa

SEQ ID NO: 4066182 - DNA, 14 bp, Homo sapiens
aaccaacctttaaa

SEQ ID NO: 4066183 - DNA, 18 bp, Homo sapiens
aaccaacctttaaaattg

SEQ ID NO: 4066184 - DNA, 21 bp, Homo sapiens
aaccaacctttaaaattgtca

SEQ ID NO: 4066185 - DNA, 19 bp, Homo sapiens
aaccaagcaggagacgaca

SEQ ID NO: 4066186 - DNA, 19 bp, Homo sapiens
aaccaagctgagtttccta

SEQ ID NO: 4066187 - DNA, 21 bp, Homo sapiens
aaccaagtttattcagtaaac

SEQ ID NO: 4066188 - DNA, 17 bp, Homo sapiens
aaccacagggccagagg

SEQ ID NO: 4066189 - DNA, 19 bp, Homo sapiens
aaccacctaatcaggctga

SEQ ID NO: 4066190 - DNA, 19 bp, Homo sapiens
aaccactcaaattaatctt

SEQ ID NO: 4066191 - DNA, 21 bp, Homo sapiens
aaccactgtgcgtcttggtgt

SEQ ID NO: 4066192 - DNA, 13 bp, Homo sapiens
aaccacttcattc

SEQ ID NO: 4066193 - DNA, 14 bp, Homo sapiens
aaccacttcattct

SEQ ID NO: 4066194 - DNA, 20 bp, Homo sapiens
aaccacttcctgctacagga

SEQ ID NO: 4066195 - DNA, 22 bp, Homo sapiens
aaccacttcctgctacaggagg

SEQ ID NO: 4066196 - DNA, 12 bp, Homo sapiens
aaccagacacaa

SEQ ID NO: 4066197 - DNA, 15 bp, Homo sapiens
aaccagccccatcag

SEQ ID NO: 4066198 - DNA, 14 bp, Homo sapiens
aaccagctaagaaa

SEQ ID NO: 4066199 - DNA, 16 bp, Homo sapiens
aaccagctaagaaaag

SEQ ID NO: 4066200 - DNA, 21 bp, Homo sapiens
aaccagctaagaaaagatttt

SEQ ID NO: 4066201 - DNA, 20 bp, Homo sapiens
aaccagcttgttctgggctc

SEQ ID NO: 4066202 - DNA, 21 bp, Homo sapiens
aaccagcttgttctgggctca

SEQ ID NO: 4066203 - DNA, 16 bp, Homo sapiens
aaccaggcacctcttc

SEQ ID NO: 4066204 - DNA, 12 bp, Homo sapiens
aaccaggcctct

SEQ ID NO: 4066205 - DNA, 17 bp, Homo sapiens
aaccaggcctctgctgc

SEQ ID NO: 4066206 - DNA, 18 bp, Homo sapiens
aaccagggaagctgtccc

SEQ ID NO: 4066207 - DNA, 19 bp, Homo sapiens
aaccagggaagctgtccct

SEQ ID NO: 4066208 - DNA, 18 bp, Homo sapiens
aaccagtccccccaccct

SEQ ID NO: 4066209 - DNA, 22 bp, Homo sapiens
aaccagtccccccaccctcatt

SEQ ID NO: 4066210 - DNA, 14 bp, Homo sapiens
aaccagttatgtga

SEQ ID NO: 4066211 - DNA, 16 bp, Homo sapiens
aaccatcattataaac

SEQ ID NO: 4066212 - DNA, 20 bp, Homo sapiens
aaccatccagtgacaaacca

SEQ ID NO: 4066213 - DNA, 22 bp, Homo sapiens
aaccatccagtgacaaaccatc

SEQ ID NO: 4066214 - DNA, 15 bp, Homo sapiens
aaccatccctgccac

SEQ ID NO: 4066215 - DNA, 22 bp, Homo sapiens
aaccatttctcactagtgtcag

SEQ ID NO: 4066216 - DNA, 21 bp, Homo sapiens
aacccaaattgggacaacagt

SEQ ID NO: 4066217 - DNA, 16 bp, Homo sapiens
aacccaagcaacattt

SEQ ID NO: 4066218 - DNA, 16 bp, Homo sapiens
aacccaagcttagaac

SEQ ID NO: 4066219 - DNA, 22 bp, Homo sapiens
aacccaaggtgggtagatcacg

SEQ ID NO: 4066220 - DNA, 19 bp, Homo sapiens
aacccaatctgcacactcc

SEQ ID NO: 4066221 - DNA, 14 bp, Homo sapiens
aacccacctctcct

SEQ ID NO: 4066222 - DNA, 15 bp, Homo sapiens
aacccacctctcctg

SEQ ID NO: 4066223 - DNA, 20 bp, Homo sapiens
aacccacctctcctgccctg

SEQ ID NO: 4066224 - DNA, 15 bp, Homo sapiens
aacccagactcagac

SEQ ID NO: 4066225 - DNA, 16 bp, Homo sapiens
aacccagactcagaca

SEQ ID NO: 4066226 - DNA, 21 bp, Homo sapiens
aacccagattttgctgtatat

SEQ ID NO: 4066227 - DNA, 10 bp, Homo sapiens
aacccagccg

SEQ ID NO: 4066228 - DNA, 18 bp, Homo sapiens
aacccaggacgcttctga

SEQ ID NO: 4066229 - DNA, 12 bp, Homo sapiens
aacccagggcaa

SEQ ID NO: 4066230 - DNA, 21 bp, Homo sapiens
aacccatcggtaggcaaagga

SEQ ID NO: 4066231 - DNA, 17 bp, Homo sapiens
aacccattcactacagg

SEQ ID NO: 4066232 - DNA, 12 bp, Homo sapiens
aacccccacccc

SEQ ID NO: 4066233 - DNA, 13 bp, Homo sapiens
aacccccacccca

SEQ ID NO: 4066234 - DNA, 15 bp, Homo sapiens
aacccccaccccaca

SEQ ID NO: 4066235 - DNA, 20 bp, Homo sapiens
aacccccgccacctcagggc

SEQ ID NO: 4066236 - DNA, 20 bp, Homo sapiens
aaccccggggtgcccacagg

SEQ ID NO: 4066237 - DNA, 12 bp, Homo sapiens
aaccccttccca

SEQ ID NO: 4066238 - DNA, 13 bp, Homo sapiens
aacccgaggggcc

SEQ ID NO: 4066239 - DNA, 12 bp, Homo sapiens
aaccctcagagc

SEQ ID NO: 4066240 - DNA, 15 bp, Homo sapiens
aaccctgttttatac

SEQ ID NO: 4066241 - DNA, 21 bp, Homo sapiens
aacccttgtcagtgacagtat

SEQ ID NO: 4066242 - DNA, 15 bp, Homo sapiens
aaccgagcaaagatc

SEQ ID NO: 4066243 - DNA, 17 bp, Homo sapiens
aaccgataatgcatgaa

SEQ ID NO: 4066244 - DNA, 16 bp, Homo sapiens
aaccgcctcaaaatgt

SEQ ID NO: 4066245 - DNA, 16 bp, Homo sapiens
aaccgtgtccagcaca

SEQ ID NO: 4066246 - DNA, 17 bp, Homo sapiens
aaccgtgtccagcacag

SEQ ID NO: 4066247 - DNA, 20 bp, Homo sapiens
aaccgtgtttgtctcttctg

SEQ ID NO: 4066248 - DNA, 16 bp, Homo sapiens
aaccgttaggaaaacc

SEQ ID NO: 4066249 - DNA, 17 bp, Homo sapiens
aaccgttttgaagctac

SEQ ID NO: 4066250 - DNA, 22 bp, Homo sapiens
aacctaaatttggttctaggcc

SEQ ID NO: 4066251 - DNA, 21 bp, Homo sapiens
aacctaatcaccatgtaagca

SEQ ID NO: 4066252 - DNA, 22 bp, Homo sapiens
aacctacctcccacactcccaa

SEQ ID NO: 4066253 - DNA, 21 bp, Homo sapiens
aacctaccttcatttcaggag

SEQ ID NO: 4066254 - DNA, 23 bp, Homo sapiens
aacctaccttcatttcaggaggg

SEQ ID NO: 4066255 - DNA, 15 bp, Homo sapiens
aacctagaatgtcag

SEQ ID NO: 4066256 - DNA, 12 bp, Homo sapiens
aacctcaccatt

SEQ ID NO: 4066257 - DNA, 14 bp, Homo sapiens
aacctcaccttcct

SEQ ID NO: 4066258 - DNA, 20 bp, Homo sapiens
aacctcaccttcctgtgggt

SEQ ID NO: 4066259 - DNA, 20 bp, Homo sapiens
aacctcagcatttccttcca

SEQ ID NO: 4066260 - DNA, 15 bp, Homo sapiens
aacctcagctctggg

SEQ ID NO: 4066261 - DNA, 17 bp, Homo sapiens
aacctcagggctcccag

SEQ ID NO: 4066262 - DNA, 18 bp, Homo sapiens
aacctcagggctcccagg

SEQ ID NO: 4066263 - DNA, 13 bp, Homo sapiens
aacctcagggctg

SEQ ID NO: 4066264 - DNA, 19 bp, Homo sapiens
aacctcagggctgtcccag

SEQ ID NO: 4066265 - DNA, 22 bp, Homo sapiens
aacctcagggctgtcccagccc

SEQ ID NO: 4066266 - DNA, 16 bp, Homo sapiens
aacctcattgacaaga

SEQ ID NO: 4066267 - DNA, 21 bp, Homo sapiens
aacctcattgacaagaactga

SEQ ID NO: 4066268 - DNA, 18 bp, Homo sapiens
aacctccagcctccctgt

SEQ ID NO: 4066269 - DNA, 22 bp, Homo sapiens
aacctccattctattttagaat

SEQ ID NO: 4066270 - DNA, 18 bp, Homo sapiens
aacctctcacttcaccct

SEQ ID NO: 4066271 - DNA, 15 bp, Homo sapiens
aacctctctgatctt

SEQ ID NO: 4066272 - DNA, 16 bp, Homo sapiens
aacctctgtctcatcc

SEQ ID NO: 4066273 - DNA, 12 bp, Homo sapiens
aacctcttcccc

SEQ ID NO: 4066274 - DNA, 18 bp, Homo sapiens
aacctcttttctgcatca

SEQ ID NO: 4066275 - DNA, 13 bp, Homo sapiens
aagacccccagca

SEQ ID NO: 4066276 - DNA, 20 bp, Homo sapiens
aagacccccatttgtcccag

SEQ ID NO: 4066277 - DNA, 15 bp, Homo sapiens
aagaccgccccccgc

SEQ ID NO: 4066278 - DNA, 23 bp, Homo sapiens
aagacctaggctcatggacgaga

SEQ ID NO: 4066279 - DNA, 17 bp, Homo sapiens
aagacctcacctagaaa

SEQ ID NO: 4066280 - DNA, 21 bp, Homo sapiens
aagaccttctccaaatgagat

SEQ ID NO: 4066281 - DNA, 23 bp, Homo sapiens
aagaccttgcttatgattgcaga

SEQ ID NO: 4066282 - DNA, 20 bp, Homo sapiens
aagacgtctctttttggtaa

SEQ ID NO: 4066283 - DNA, 21 bp, Homo sapiens
aagactagaaaattagactgt

SEQ ID NO: 4066284 - DNA, 20 bp, Homo sapiens
aagactagaggcttgcataa

SEQ ID NO: 4066285 - DNA, 17 bp, Homo sapiens
aagactatctaaatgtt

SEQ ID NO: 4066286 - DNA, 11 bp, Homo sapiens
aagactcagcc

SEQ ID NO: 4066287 - DNA, 12 bp, Homo sapiens
aagactcagcca

SEQ ID NO: 4066288 - DNA, 15 bp, Homo sapiens
aagactgagcacctg

SEQ ID NO: 4066289 - DNA, 15 bp, Homo sapiens
aagactggttttctg

SEQ ID NO: 4066290 - DNA, 16 bp, Homo sapiens
aagactggttttctgc

SEQ ID NO: 4066291 - DNA, 17 bp, Homo sapiens
aagactgttgctcaaat

SEQ ID NO: 4066292 - DNA, 24 bp, Homo sapiens
aagactgttgctcaaatctattca

SEQ ID NO: 4066293 - DNA, 23 bp, Homo sapiens
aagactgttgtgatcttgcattc

SEQ ID NO: 4066294 - DNA, 17 bp, Homo sapiens
aagacttagattgtgct

SEQ ID NO: 4066295 - DNA, 17 bp, Homo sapiens
aagacttgagacaatgt

SEQ ID NO: 4066296 - DNA, 23 bp, Homo sapiens
aagacttggttggtagggtggga

SEQ ID NO: 4066297 - DNA, 19 bp, Homo sapiens
aagacttgtaatattttta

SEQ ID NO: 4066298 - DNA, 20 bp, Homo sapiens
aagactttagcttttccttc

SEQ ID NO: 4066299 - DNA, 16 bp, Homo sapiens
aagagaaaattgcact

SEQ ID NO: 4066300 - DNA, 18 bp, Homo sapiens
aagagaaaattgcactaa

SEQ ID NO: 4066301 - DNA, 12 bp, Homo sapiens
aagagaaacttt

SEQ ID NO: 4066302 - DNA, 18 bp, Homo sapiens
aagagaaactttatacat

SEQ ID NO: 4066303 - DNA, 21 bp, Homo sapiens
aagagaaccgagcaaagatca

SEQ ID NO: 4066304 - DNA, 22 bp, Homo sapiens
aagagaaccgagcaaagatcaa

SEQ ID NO: 4066305 - DNA, 21 bp, Homo sapiens
aagagaagagggcccagccca

SEQ ID NO: 4066306 - DNA, 15 bp, Homo sapiens
aagagaagctgctga

SEQ ID NO: 4066307 - DNA, 16 bp, Homo sapiens
aagagaagctgctgac

SEQ ID NO: 4066308 - DNA, 18 bp, Homo sapiens
aagagaagctgctgacca

SEQ ID NO: 4066309 - DNA, 21 bp, Homo sapiens
aagagaagttattttctacag

SEQ ID NO: 4066310 - DNA, 14 bp, Homo sapiens
aagagacagtgata

SEQ ID NO: 4066311 - DNA, 19 bp, Homo sapiens
aagagacttaaaggacagg

SEQ ID NO: 4066312 - DNA, 20 bp, Homo sapiens
aagagacttaaaggacagga

SEQ ID NO: 4066313 - DNA, 20 bp, Homo sapiens
aagagagatatatctgaaaa

SEQ ID NO: 4066314 - DNA, 14 bp, Homo sapiens
aagagataattctt

SEQ ID NO: 4066315 - DNA, 13 bp, Homo sapiens
aagagcagcctgt

SEQ ID NO: 4066316 - DNA, 14 bp, Homo sapiens
aagagcagcctgtg

SEQ ID NO: 4066317 - DNA, 9 bp, Homo sapiens
aagagccat

SEQ ID NO: 4066318 - DNA, 14 bp, Homo sapiens
aagagcccagtctg

SEQ ID NO: 4066319 - DNA, 23 bp, Homo sapiens
aagagccctggacacccctgctc

SEQ ID NO: 4066320 - DNA, 11 bp, Homo sapiens
aagagcctgga

SEQ ID NO: 4066321 - DNA, 13 bp, Homo sapiens
aagagctgccctc

SEQ ID NO: 4066322 - DNA, 14 bp, Homo sapiens
aagagcttgctttg

SEQ ID NO: 4066323 - DNA, 22 bp, Homo sapiens
aagaggaacagcactggggagt

SEQ ID NO: 4066324 - DNA, 18 bp, Homo sapiens
aagaggaacagtgtggtt

SEQ ID NO: 4066325 - DNA, 13 bp, Homo sapiens
aagaggagcactt

SEQ ID NO: 4066326 - DNA, 21 bp, Homo sapiens
aagaggagcacttccaaaatt

SEQ ID NO: 4066327 - DNA, 22 bp, Homo sapiens
aagaggcagttgcccagcctct

SEQ ID NO: 4066328 - DNA, 18 bp, Homo sapiens
aagaggctgaggcctgga

SEQ ID NO: 4066329 - DNA, 20 bp, Homo sapiens
aagaggctgaggcctggact

SEQ ID NO: 4066330 - DNA, 23 bp, Homo sapiens
aagaggctgcccctctcaccaaa

SEQ ID NO: 4066331 - DNA, 18 bp, Homo sapiens
aagagggagaagcatgaa

SEQ ID NO: 4066332 - DNA, 23 bp, Homo sapiens
aagagggcccagcccagagccac

SEQ ID NO: 4066333 - DNA, 13 bp, Homo sapiens
aagagggggctgg

SEQ ID NO: 4066334 - DNA, 13 bp, Homo sapiens
aagagggggtgga

SEQ ID NO: 4066335 - DNA, 13 bp, Homo sapiens
aagaggtgttatt

SEQ ID NO: 4066336 - DNA, 15 bp, Homo sapiens
aagaggtgttatttg

SEQ ID NO: 4066337 - DNA, 14 bp, Homo sapiens
aagagtaactttac

SEQ ID NO: 4066338 - DNA, 19 bp, Homo sapiens
aagagtactgggagaatca

SEQ ID NO: 4066339 - DNA, 23 bp, Homo sapiens
aagagtagttgatgttgcatttt

SEQ ID NO: 4066340 - DNA, 15 bp, Homo sapiens
aagagtatccttcct

SEQ ID NO: 4066341 - DNA, 22 bp, Homo sapiens
aagagtgacagtggattgcatt

SEQ ID NO: 4066342 - DNA, 17 bp, Homo sapiens
aagagtgattgcagctt

SEQ ID NO: 4066343 - DNA, 21 bp, Homo sapiens
aagagtgattgcagctttatg

SEQ ID NO: 4066344 - DNA, 12 bp, Homo sapiens
aagagtgccctg

SEQ ID NO: 4066345 - DNA, 12 bp, Homo sapiens
aagagtgtagaa

SEQ ID NO: 4066346 - DNA, 13 bp, Homo sapiens
aagagtgtagaag

SEQ ID NO: 4066347 - DNA, 18 bp, Homo sapiens
aagagtgtagaagcattc

SEQ ID NO: 4066348 - DNA, 19 bp, Homo sapiens
aagagtgtcagaatcagaa

SEQ ID NO: 4066349 - DNA, 15 bp, Homo sapiens
aagagttaagaatgt

SEQ ID NO: 4066350 - DNA, 19 bp, Homo sapiens
aagagtttgccttataaat

SEQ ID NO: 4066351 - DNA, 15 bp, Homo sapiens
aagagtttgttctgt

SEQ ID NO: 4066352 - DNA, 23 bp, Homo sapiens
aagagtttgttctgttctggggg

SEQ ID NO: 4066353 - DNA, 17 bp, Homo sapiens
aagataaacctggagat

SEQ ID NO: 4066354 - DNA, 14 bp, Homo sapiens
aagataaagatgat

SEQ ID NO: 4066355 - DNA, 19 bp, Homo sapiens
aagataacaagatctttca

SEQ ID NO: 4066356 - DNA, 18 bp, Homo sapiens
aagatacaaattaatttt

SEQ ID NO: 4066357 - DNA, 16 bp, Homo sapiens
aagataggctctgcac

SEQ ID NO: 4066358 - DNA, 18 bp, Homo sapiens
aagataggctctgcacag

SEQ ID NO: 4066359 - DNA, 22 bp, Homo sapiens
aagatatatttcacttttgttc

SEQ ID NO: 4066360 - DNA, 19 bp, Homo sapiens
aagatatcccagctttaaa

SEQ ID NO: 4066361 - DNA, 22 bp, Homo sapiens
aagatcaaaagcttattcatct

SEQ ID NO: 4066362 - DNA, 15 bp, Homo sapiens
aagatcaaaataaaa

SEQ ID NO: 4066363 - DNA, 17 bp, Homo sapiens
aagatcaaaataaaaag

SEQ ID NO: 4066364 - DNA, 22 bp, Homo sapiens
aagatcaaaataaaaagtgaca

SEQ ID NO: 4066365 - DNA, 17 bp, Homo sapiens
aagatcaattccctctc

SEQ ID NO: 4066366 - DNA, 15 bp, Homo sapiens
aagatccatttgcct

SEQ ID NO: 4066367 - DNA, 17 bp, Homo sapiens
aagatccatttgccttt

SEQ ID NO: 4066368 - DNA, 14 bp, Homo sapiens
aagatcgttagtat

SEQ ID NO: 4066369 - DNA, 13 bp, Homo sapiens
aagatctttcagg

SEQ ID NO: 4066370 - DNA, 16 bp, Homo sapiens
aagatgaggttctgag

SEQ ID NO: 4066371 - DNA, 14 bp, Homo sapiens
aagatgatcatttg

SEQ ID NO: 4066372 - DNA, 17 bp, Homo sapiens
aagatgatctactcaga

SEQ ID NO: 4066373 - DNA, 23 bp, Homo sapiens
aagatgcactgaaaacttagcca

SEQ ID NO: 4066374 - DNA, 15 bp, Homo sapiens
aagatgccagcttct

SEQ ID NO: 4066375 - DNA, 22 bp, Homo sapiens
aagatgccagcttctctctcca

SEQ ID NO: 4066376 - DNA, 18 bp, Homo sapiens
aagatggataaactgagc

SEQ ID NO: 4066377 - DNA, 18 bp, Homo sapiens
aagctattcacattgtta

SEQ ID NO: 4066378 - DNA, 22 bp, Homo sapiens
aagctattcagtaataactcta

SEQ ID NO: 4066379 - DNA, 17 bp, Homo sapiens
aagctatttatctgtag

SEQ ID NO: 4066380 - DNA, 18 bp, Homo sapiens
aagctcagtgctctctcc

SEQ ID NO: 4066381 - DNA, 18 bp, Homo sapiens
aagctcctctccccagcc

SEQ ID NO: 4066382 - DNA, 14 bp, Homo sapiens
aagctcctgtcctc

SEQ ID NO: 4066383 - DNA, 20 bp, Homo sapiens
aagctcctgtcctcccatcc

SEQ ID NO: 4066384 - DNA, 12 bp, Homo sapiens
aagctctcttaa

SEQ ID NO: 4066385 - DNA, 12 bp, Homo sapiens
aagctctgaagt

SEQ ID NO: 4066386 - DNA, 15 bp, Homo sapiens
aagctctttgagaac

SEQ ID NO: 4066387 - DNA, 14 bp, Homo sapiens
aagctgaagtgcat

SEQ ID NO: 4066388 - DNA, 21 bp, Homo sapiens
aagctgaagtgcatccaaagg

SEQ ID NO: 4066389 - DNA, 15 bp, Homo sapiens
aagctgagtttccta

SEQ ID NO: 4066390 - DNA, 17 bp, Homo sapiens
aagctgattactgtcaa

SEQ ID NO: 4066391 - DNA, 22 bp, Homo sapiens
aagctgattactgtcaataaac

SEQ ID NO: 4066392 - DNA, 19 bp, Homo sapiens
aagctgcaaatctgatggc

SEQ ID NO: 4066393 - DNA, 16 bp, Homo sapiens
aagctgccagcccaga

SEQ ID NO: 4066394 - DNA, 17 bp, Homo sapiens
aagctgccagcccagaa

SEQ ID NO: 4066395 - DNA, 19 bp, Homo sapiens
aagctgccagcccagaaca

SEQ ID NO: 4066396 - DNA, 12 bp, Homo sapiens
aagctgctctga

SEQ ID NO: 4066397 - DNA, 20 bp, Homo sapiens
aagctgctctgagccacagt

SEQ ID NO: 4066398 - DNA, 13 bp, Homo sapiens
aagctgctgacca

SEQ ID NO: 4066399 - DNA, 14 bp, Homo sapiens
aagctggaagcaca

SEQ ID NO: 4066400 - DNA, 15 bp, Homo sapiens
aagctggcagaacgg

SEQ ID NO: 4066401 - DNA, 18 bp, Homo sapiens
aagctggccctgcctcct

SEQ ID NO: 4066402 - DNA, 19 bp, Homo sapiens
aagctggccctgcctcctg

SEQ ID NO: 4066403 - DNA, 20 bp, Homo sapiens
aagctggccctgcctcctgg

SEQ ID NO: 4066404 - DNA, 22 bp, Homo sapiens
aagctggccgagggtcctggct

SEQ ID NO: 4066405 - DNA, 12 bp, Homo sapiens
aagctggcctct

SEQ ID NO: 4066406 - DNA, 13 bp, Homo sapiens
aagctggcctgag

SEQ ID NO: 4066407 - DNA, 16 bp, Homo sapiens
aagctgtgaacaggct

SEQ ID NO: 4066408 - DNA, 19 bp, Homo sapiens
aagctgtgacttctccagg

SEQ ID NO: 4066409 - DNA, 12 bp, Homo sapiens
aagctgttgtac

SEQ ID NO: 4066410 - DNA, 18 bp, Homo sapiens
aagctgttgtacatttat

SEQ ID NO: 4066411 - DNA, 11 bp, Homo sapiens
aagcttagaac

SEQ ID NO: 4066412 - DNA, 20 bp, Homo sapiens
aagcttccatgattctattt

SEQ ID NO: 4066413 - DNA, 21 bp, Homo sapiens
aagcttcttaattaatttgat

SEQ ID NO: 4066414 - DNA, 12 bp, Homo sapiens
aagcttgactcc

SEQ ID NO: 4066415 - DNA, 17 bp, Homo sapiens
aagcttgactcccaagt

SEQ ID NO: 4066416 - DNA, 12 bp, Homo sapiens
aagctttcctgc

SEQ ID NO: 4066417 - DNA, 17 bp, Homo sapiens
aagctttgccagctgct

SEQ ID NO: 4066418 - DNA, 13 bp, Homo sapiens
aagcttttagaaa

SEQ ID NO: 4066419 - DNA, 18 bp, Homo sapiens
aagcttttagaaatactg

SEQ ID NO: 4066420 - DNA, 13 bp, Homo sapiens
aagcttttgctca

SEQ ID NO: 4066421 - DNA, 16 bp, Homo sapiens
aagctttttcctcctg

SEQ ID NO: 4066422 - DNA, 16 bp, Homo sapiens
aaggaaaaacacaagc

SEQ ID NO: 4066423 - DNA, 12 bp, Homo sapiens
aaggaaactctt

SEQ ID NO: 4066424 - DNA, 21 bp, Homo sapiens
aaggaaacttgaatcaaagca

SEQ ID NO: 4066425 - DNA, 16 bp, Homo sapiens
aaggaaagcaataaat

SEQ ID NO: 4066426 - DNA, 16 bp, Homo sapiens
aaggaaatctcacccc

SEQ ID NO: 4066427 - DNA, 22 bp, Homo sapiens
aaggaaatctcaccccatccca

SEQ ID NO: 4066428 - DNA, 17 bp, Homo sapiens
aaggaacagcaatggtg

SEQ ID NO: 4066429 - DNA, 20 bp, Homo sapiens
aaggaactctggcttccagg

SEQ ID NO: 4066430 - DNA, 15 bp, Homo sapiens
aaggaagagggctga

SEQ ID NO: 4066431 - DNA, 18 bp, Homo sapiens
aaggaagccaaatttatc

SEQ ID NO: 4066432 - DNA, 16 bp, Homo sapiens
aagtttacatttttat

SEQ ID NO: 4066433 - DNA, 19 bp, Homo sapiens
aagtttcacaggtcaataa

SEQ ID NO: 4066434 - DNA, 20 bp, Homo sapiens
aagtttcacaggtcaataaa

SEQ ID NO: 4066435 - DNA, 14 bp, Homo sapiens
aagtttcagacagg

SEQ ID NO: 4066436 - DNA, 15 bp, Homo sapiens
aagtttcaggtgaca

SEQ ID NO: 4066437 - DNA, 16 bp, Homo sapiens
aagtttcaggtgacat

SEQ ID NO: 4066438 - DNA, 22 bp, Homo sapiens
aagtttcaggtgacatgtgaaa

SEQ ID NO: 4066439 - DNA, 12 bp, Homo sapiens
aagtttccatat

SEQ ID NO: 4066440 - DNA, 21 bp, Homo sapiens
aagtttcctaatcagaaattt

SEQ ID NO: 4066441 - DNA, 15 bp, Homo sapiens
aagtttgatttcatt

SEQ ID NO: 4066442 - DNA, 13 bp, Homo sapiens
aagtttgcttaga

SEQ ID NO: 4066443 - DNA, 15 bp, Homo sapiens
aagtttgcttagaaa

SEQ ID NO: 4066444 - DNA, 14 bp, Homo sapiens
aagtttgtttttaa

SEQ ID NO: 4066445 - DNA, 17 bp, Homo sapiens
aagttttaaaaagccag

SEQ ID NO: 4066446 - DNA, 15 bp, Homo sapiens
aagttttgcatttat

SEQ ID NO: 4066447 - DNA, 16 bp, Homo sapiens
aagttttgtaaaagaa

SEQ ID NO: 4066448 - DNA, 13 bp, Homo sapiens
aagtttttttgct

SEQ ID NO: 4066449 - DNA, 23 bp, Homo sapiens
aagtttttttgctgctgcctctt

SEQ ID NO: 4066450 - DNA, 14 bp, Homo sapiens
aataaaaaaagaaa

SEQ ID NO: 4066451 - DNA, 19 bp, Homo sapiens
aataaaaagtgacacagca

SEQ ID NO: 4066452 - DNA, 12 bp, Homo sapiens
aataaaaagttc

SEQ ID NO: 4066453 - DNA, 12 bp, Homo sapiens
aataaaaggaaa

SEQ ID NO: 4066454 - DNA, 13 bp, Homo sapiens
aataaaaggaaaa

SEQ ID NO: 4066455 - DNA, 20 bp, Homo sapiens
aataaaaggaagccaaagag

SEQ ID NO: 4066456 - DNA, 12 bp, Homo sapiens
aataaaagtgac

SEQ ID NO: 4066457 - DNA, 16 bp, Homo sapiens
aataaaataattctaa

SEQ ID NO: 4066458 - DNA, 17 bp, Homo sapiens
aataaaataattctaaa

SEQ ID NO: 4066459 - DNA, 15 bp, Homo sapiens
aataaaattggcacc

SEQ ID NO: 4066460 - DNA, 15 bp, Homo sapiens
aataaacagtatatt

SEQ ID NO: 4066461 - DNA, 23 bp, Homo sapiens
aataaacatccttcaagaactct

SEQ ID NO: 4066462 - DNA, 19 bp, Homo sapiens
aataaactactctttgatt

SEQ ID NO: 4066463 - DNA, 20 bp, Homo sapiens
aataaactagagaagggaga

SEQ ID NO: 4066464 - DNA, 15 bp, Homo sapiens
aataaactattggaa

SEQ ID NO: 4066465 - DNA, 21 bp, Homo sapiens
aataaactgaatattttggaa

SEQ ID NO: 4066466 - DNA, 20 bp, Homo sapiens
aataaacttagaggaaaatg

SEQ ID NO: 4066467 - DNA, 21 bp, Homo sapiens
aataaacttggattctctaac

SEQ ID NO: 4066468 - DNA, 17 bp, Homo sapiens
aataaagaatgccattt

SEQ ID NO: 4066469 - DNA, 21 bp, Homo sapiens
aataaagacactggcagagag

SEQ ID NO: 4066470 - DNA, 18 bp, Homo sapiens
aataaaggactgtaatct

SEQ ID NO: 4066471 - DNA, 19 bp, Homo sapiens
aataaaggtcttaaataat

SEQ ID NO: 4066472 - DNA, 15 bp, Homo sapiens
aataaatatctgtac

SEQ ID NO: 4066473 - DNA, 14 bp, Homo sapiens
aataaatatttatg

SEQ ID NO: 4066474 - DNA, 16 bp, Homo sapiens
aataaatcataaaact

SEQ ID NO: 4066475 - DNA, 17 bp, Homo sapiens
aataaatctgacccagt

SEQ ID NO: 4066476 - DNA, 22 bp, Homo sapiens
aataaatgggtgtatataattt

SEQ ID NO: 4066477 - DNA, 21 bp, Homo sapiens
aataaatgtatcttattcaca

SEQ ID NO: 4066478 - DNA, 14 bp, Homo sapiens
aataaatgtcttgc

SEQ ID NO: 4066479 - DNA, 17 bp, Homo sapiens
aataaattaatattgta

SEQ ID NO: 4066480 - DNA, 18 bp, Homo sapiens
aataaattaatattgtat

SEQ ID NO: 4066481 - DNA, 16 bp, Homo sapiens
aataaattagttgtta

SEQ ID NO: 4066482 - DNA, 14 bp, Homo sapiens
aataaattcagata

SEQ ID NO: 4066483 - DNA, 21 bp, Homo sapiens
aataaattcctacaacttaat

SEQ ID NO: 4066484 - DNA, 17 bp, Homo sapiens
aataaattgcaacatat

SEQ ID NO: 4066485 - DNA, 15 bp, Homo sapiens
aataacaaaatggac

SEQ ID NO: 4066486 - DNA, 14 bp, Homo sapiens
aataacaaacgtgt

SEQ ID NO: 4066487 - DNA, 13 bp, Homo sapiens
aataacaatgtta

SEQ ID NO: 4066488 - DNA, 14 bp, Homo sapiens
aataacaatgttaa

SEQ ID NO: 4066489 - DNA, 15 bp, Homo sapiens
aataacaatgttaag

SEQ ID NO: 4066490 - DNA, 24 bp, Homo sapiens
aataacaatgttaaggaaactctt

SEQ ID NO: 4066491 - DNA, 12 bp, Homo sapiens
aataacacacat

SEQ ID NO: 4066492 - DNA, 23 bp, Homo sapiens
aataacacagagagacagacttg

SEQ ID NO: 4066493 - DNA, 21 bp, Homo sapiens
aataacaggcatttgttcact

SEQ ID NO: 4066494 - DNA, 19 bp, Homo sapiens
aataacatgtaattaagta

SEQ ID NO: 4066495 - DNA, 14 bp, Homo sapiens
aataacattacctt

SEQ ID NO: 4066496 - DNA, 22 bp, Homo sapiens
aataaccaagtttattcagtaa

SEQ ID NO: 4066497 - DNA, 18 bp, Homo sapiens
aataaccctttggttttt

SEQ ID NO: 4066498 - DNA, 16 bp, Homo sapiens
aataaccgcttggttt

SEQ ID NO: 4066499 - DNA, 20 bp, Homo sapiens
aataaccgcttggtttgcaa

SEQ ID NO: 4066500 - DNA, 16 bp, Homo sapiens
aataactactgtgttc

SEQ ID NO: 4066501 - DNA, 21 bp, Homo sapiens
aataactccttcttgtagtag

SEQ ID NO: 4066502 - DNA, 13 bp, Homo sapiens
aataactgtgaag

SEQ ID NO: 4066503 - DNA, 12 bp, Homo sapiens
aataactgtgta

SEQ ID NO: 4066504 - DNA, 15 bp, Homo sapiens
aataactgtgtactg

SEQ ID NO: 4066505 - DNA, 16 bp, Homo sapiens
aataactgtgtactgt

SEQ ID NO: 4066506 - DNA, 21 bp, Homo sapiens
aataacttctatattttaata

SEQ ID NO: 4066507 - DNA, 13 bp, Homo sapiens
aataagaatagaa

SEQ ID NO: 4066508 - DNA, 14 bp, Homo sapiens
aataagagaaagaa

SEQ ID NO: 4066509 - DNA, 14 bp, Homo sapiens
aataagctaaagag

SEQ ID NO: 4066510 - DNA, 18 bp, Homo sapiens
aataaggtcaagggaaaa

SEQ ID NO: 4066511 - DNA, 18 bp, Homo sapiens
aataagtatttctgattt

SEQ ID NO: 4066512 - DNA, 23 bp, Homo sapiens
aataagtgtgtggtagaaacaaa

SEQ ID NO: 4066513 - DNA, 15 bp, Homo sapiens
aataataaaaagcaa

SEQ ID NO: 4066514 - DNA, 21 bp, Homo sapiens
aataataattatccagagttt

SEQ ID NO: 4066515 - DNA, 20 bp, Homo sapiens
aataataatttttatattta

SEQ ID NO: 4066516 - DNA, 14 bp, Homo sapiens
aataatagttatta

SEQ ID NO: 4066517 - DNA, 11 bp, Homo sapiens
aataatatgca

SEQ ID NO: 4066518 - DNA, 13 bp, Homo sapiens
aataatatgcatt

SEQ ID NO: 4066519 - DNA, 15 bp, Homo sapiens
aataatatgcattgt

SEQ ID NO: 4066520 - DNA, 20 bp, Homo sapiens
aataatattgttgtataatt

SEQ ID NO: 4066521 - DNA, 14 bp, Homo sapiens
aataatcaagattt

SEQ ID NO: 4066522 - DNA, 17 bp, Homo sapiens
aataatcaagattttag

SEQ ID NO: 4066523 - DNA, 20 bp, Homo sapiens
aataatccagtattgctgat

SEQ ID NO: 4066524 - DNA, 16 bp, Homo sapiens
aataatgaataaactg

SEQ ID NO: 4066525 - DNA, 15 bp, Homo sapiens
aataatggaaacatt

SEQ ID NO: 4066526 - DNA, 19 bp, Homo sapiens
aataatgtacatctggcct

SEQ ID NO: 4066527 - DNA, 12 bp, Homo sapiens
aataatgtattg

SEQ ID NO: 4066528 - DNA, 15 bp, Homo sapiens
aataatgtattgtaa

SEQ ID NO: 4066529 - DNA, 16 bp, Homo sapiens
aataatgttctattgt

SEQ ID NO: 4066530 - DNA, 14 bp, Homo sapiens
aataattctaaatc

SEQ ID NO: 4066531 - DNA, 14 bp, Homo sapiens
aataattggttctt

SEQ ID NO: 4066532 - DNA, 16 bp, Homo sapiens
aataatttgtaaatga

SEQ ID NO: 4066533 - DNA, 14 bp, Homo sapiens
aataattttatctc

SEQ ID NO: 4066534 - DNA, 17 bp, Homo sapiens
aataatttttatattta

SEQ ID NO: 4066535 - DNA, 14 bp, Homo sapiens
aatattatgtgttt

SEQ ID NO: 4066536 - DNA, 13 bp, Homo sapiens
aatattattatga

SEQ ID NO: 4066537 - DNA, 12 bp, Homo sapiens
aatattccaagc

SEQ ID NO: 4066538 - DNA, 20 bp, Homo sapiens
aatattgacatttgtagttg

SEQ ID NO: 4066539 - DNA, 20 bp, Homo sapiens
aatattgaggctttgtgttg

SEQ ID NO: 4066540 - DNA, 18 bp, Homo sapiens
aatattgatatgcttata

SEQ ID NO: 4066541 - DNA, 17 bp, Homo sapiens
aatattgtattgctgct

SEQ ID NO: 4066542 - DNA, 20 bp, Homo sapiens
aatattgttgacaactgtga

SEQ ID NO: 4066543 - DNA, 19 bp, Homo sapiens
aatattgttgtataatttc

SEQ ID NO: 4066544 - DNA, 23 bp, Homo sapiens
aatattgttgtataatttcgaga

SEQ ID NO: 4066545 - DNA, 12 bp, Homo sapiens
aatattgtttct

SEQ ID NO: 4066546 - DNA, 15 bp, Homo sapiens
aatattgtttctgca

SEQ ID NO: 4066547 - DNA, 19 bp, Homo sapiens
aatatttaaacagcagtgt

SEQ ID NO: 4066548 - DNA, 19 bp, Homo sapiens
aatatttaagaaaagcact

SEQ ID NO: 4066549 - DNA, 20 bp, Homo sapiens
aatatttaagaaaagcactt

SEQ ID NO: 4066550 - DNA, 22 bp, Homo sapiens
aatatttaagaaaagcactttt

SEQ ID NO: 4066551 - DNA, 23 bp, Homo sapiens
aatatttagtctaagatgattca

SEQ ID NO: 4066552 - DNA, 11 bp, Homo sapiens
aatatttataa

SEQ ID NO: 4066553 - DNA, 17 bp, Homo sapiens
aatatttataacagcat

SEQ ID NO: 4066554 - DNA, 13 bp, Homo sapiens
aatatttatggat

SEQ ID NO: 4066555 - DNA, 15 bp, Homo sapiens
aatatttatgtaaac

SEQ ID NO: 4066556 - DNA, 11 bp, Homo sapiens
aatatttatta

SEQ ID NO: 4066557 - DNA, 13 bp, Homo sapiens
aatatttattacc

SEQ ID NO: 4066558 - DNA, 18 bp, Homo sapiens
aatatttattacctctga

SEQ ID NO: 4066559 - DNA, 13 bp, Homo sapiens
aatatttctattg

SEQ ID NO: 4066560 - DNA, 14 bp, Homo sapiens
aatatttctattga

SEQ ID NO: 4066561 - DNA, 11 bp, Homo sapiens
aatatttctga

SEQ ID NO: 4066562 - DNA, 19 bp, Homo sapiens
aatatttgtgaaagaagac

SEQ ID NO: 4066563 - DNA, 21 bp, Homo sapiens
aatattttcaactatgtaggt

SEQ ID NO: 4066564 - DNA, 16 bp, Homo sapiens
aatattttcagcctac

SEQ ID NO: 4066565 - DNA, 14 bp, Homo sapiens
aatattttgataat

SEQ ID NO: 4066566 - DNA, 12 bp, Homo sapiens
aatattttggaa

SEQ ID NO: 4066567 - DNA, 14 bp, Homo sapiens
aatattttggaaac

SEQ ID NO: 4066568 - DNA, 16 bp, Homo sapiens
aatattttggaaactg

SEQ ID NO: 4066569 - DNA, 21 bp, Homo sapiens
aatattttggaaactgctaaa

SEQ ID NO: 4066570 - DNA, 18 bp, Homo sapiens
aatatttttatatacaga

SEQ ID NO: 4066571 - DNA, 15 bp, Homo sapiens
aatatttttatatca

SEQ ID NO: 4066572 - DNA, 23 bp, Homo sapiens
aatatttttatatcatgcaaaat

SEQ ID NO: 4066573 - DNA, 19 bp, Homo sapiens
aatatttttatatttcctt

SEQ ID NO: 4066574 - DNA, 14 bp, Homo sapiens
aatattttttgcaa

SEQ ID NO: 4066575 - DNA, 16 bp, Homo sapiens
aatattttttgcaagt

SEQ ID NO: 4066576 - DNA, 14 bp, Homo sapiens
aatcaaacagtaat

SEQ ID NO: 4066577 - DNA, 14 bp, Homo sapiens
aatcaaataagtat

SEQ ID NO: 4066578 - DNA, 19 bp, Homo sapiens
aatcaaataagtatttata

SEQ ID NO: 4066579 - DNA, 14 bp, Homo sapiens
aatcaactctaata

SEQ ID NO: 4066580 - DNA, 22 bp, Homo sapiens
aatcaagccatgtataaatgtg

SEQ ID NO: 4066581 - DNA, 23 bp, Homo sapiens
aatcaataacagccgctccagag

SEQ ID NO: 4066582 - DNA, 13 bp, Homo sapiens
aatcaatgaaaaa

SEQ ID NO: 4066583 - DNA, 22 bp, Homo sapiens
aatcaatgaatattgaagtttc

SEQ ID NO: 4066584 - DNA, 23 bp, Homo sapiens
aatcaatgttcacgcaacttgaa

SEQ ID NO: 4066585 - DNA, 14 bp, Homo sapiens
aatcacaaaaattt

SEQ ID NO: 4066586 - DNA, 15 bp, Homo sapiens
aatcaccaaaggctc

SEQ ID NO: 4066587 - DNA, 23 bp, Homo sapiens
aatcaccatgtaagcactctgga

SEQ ID NO: 4066588 - DNA, 13 bp, Homo sapiens
aatcacctggctg

SEQ ID NO: 4066589 - DNA, 18 bp, Homo sapiens
aatcactctaattaattg

SEQ ID NO: 4066590 - DNA, 20 bp, Homo sapiens
aatcactctaattaattgta

SEQ ID NO: 4066591 - DNA, 13 bp, Homo sapiens
aatcactttgtct

SEQ ID NO: 4066592 - DNA, 16 bp, Homo sapiens
aatcactttgtctaac

SEQ ID NO: 4066593 - DNA, 14 bp, Homo sapiens
aatcagaaattttt

SEQ ID NO: 4066594 - DNA, 15 bp, Homo sapiens
aatcagaataaatta

SEQ ID NO: 4066595 - DNA, 23 bp, Homo sapiens
aatcagaataaattaatattgta

SEQ ID NO: 4066596 - DNA, 15 bp, Homo sapiens
aatcagatctttatt

SEQ ID NO: 4066597 - DNA, 22 bp, Homo sapiens
aatcagtaagaggtgttatttg

SEQ ID NO: 4066598 - DNA, 15 bp, Homo sapiens
aatcagtataaacaa

SEQ ID NO: 4066599 - DNA, 17 bp, Homo sapiens
aatcagtgtgtctaaat

SEQ ID NO: 4066600 - DNA, 14 bp, Homo sapiens
aatcatattgatga

SEQ ID NO: 4066601 - DNA, 16 bp, Homo sapiens
aatcatattgatgaaa

SEQ ID NO: 4066602 - DNA, 18 bp, Homo sapiens
aatcatattgatgaaaag

SEQ ID NO: 4066603 - DNA, 19 bp, Homo sapiens
aatcatccccatcctccag

SEQ ID NO: 4066604 - DNA, 16 bp, Homo sapiens
aatcatctggattttt

SEQ ID NO: 4066605 - DNA, 16 bp, Homo sapiens
aatcatgagcctgctg

SEQ ID NO: 4066606 - DNA, 18 bp, Homo sapiens
aatcatgagcctgctgga

SEQ ID NO: 4066607 - DNA, 17 bp, Homo sapiens
aatcatgtatgttatga

SEQ ID NO: 4066608 - DNA, 23 bp, Homo sapiens
aatcatgtatgttatgatattgt

SEQ ID NO: 4066609 - DNA, 17 bp, Homo sapiens
aatcatgtccatacact

SEQ ID NO: 4066610 - DNA, 15 bp, Homo sapiens
aatcatgtgaacccg

SEQ ID NO: 4066611 - DNA, 19 bp, Homo sapiens
aatcatgtgggtgagccag

SEQ ID NO: 4066612 - DNA, 12 bp, Homo sapiens
aatcattccagt

SEQ ID NO: 4066613 - DNA, 20 bp, Homo sapiens
aatcattccagtgctagaaa

SEQ ID NO: 4066614 - DNA, 15 bp, Homo sapiens
aatcattgtccagag

SEQ ID NO: 4066615 - DNA, 12 bp, Homo sapiens
aatcattgttgc

SEQ ID NO: 4066616 - DNA, 20 bp, Homo sapiens
aatcattttaattattattc

SEQ ID NO: 4066617 - DNA, 20 bp, Homo sapiens
aatcattttacccttggctc

SEQ ID NO: 4066618 - DNA, 15 bp, Homo sapiens
aatccaaaagaaaaa

SEQ ID NO: 4066619 - DNA, 16 bp, Homo sapiens
aatccaaaagaaaaac

SEQ ID NO: 4066620 - DNA, 14 bp, Homo sapiens
aatccaaacttgga

SEQ ID NO: 4066621 - DNA, 21 bp, Homo sapiens
aatccaaacttggatttttga

SEQ ID NO: 4066622 - DNA, 22 bp, Homo sapiens
aatccaataaaaacattttgaa

SEQ ID NO: 4066623 - DNA, 18 bp, Homo sapiens
aatccagagagcttaaat

SEQ ID NO: 4066624 - DNA, 12 bp, Homo sapiens
aatccagctccc

SEQ ID NO: 4066625 - DNA, 13 bp, Homo sapiens
aatccagctccct

SEQ ID NO: 4066626 - DNA, 18 bp, Homo sapiens
aatccagctccctagact

SEQ ID NO: 4066627 - DNA, 16 bp, Homo sapiens
aatccaggcacagctg

SEQ ID NO: 4066628 - DNA, 22 bp, Homo sapiens
aatccatgttagtttttacttt

SEQ ID NO: 4066629 - DNA, 16 bp, Homo sapiens
aatcccaccttcccac

SEQ ID NO: 4066630 - DNA, 20 bp, Homo sapiens
aatcccagcactttgggagg

SEQ ID NO: 4066631 - DNA, 14 bp, Homo sapiens
aatcccagggctgg

SEQ ID NO: 4066632 - DNA, 21 bp, Homo sapiens
aatcccctccctgtcaaagct

SEQ ID NO: 4066633 - DNA, 17 bp, Homo sapiens
aatcccgccacctatct

SEQ ID NO: 4066634 - DNA, 19 bp, Homo sapiens
aatccctgggcattgcttt

SEQ ID NO: 4066635 - DNA, 21 bp, Homo sapiens
aatccctgggcattgctttcc

SEQ ID NO: 4066636 - DNA, 17 bp, Homo sapiens
aatccctggggctgtgc

SEQ ID NO: 4066637 - DNA, 18 bp, Homo sapiens
aatccctggggctgtgca

SEQ ID NO: 4066638 - DNA, 20 bp, Homo sapiens
aatgtaaaggagtcaaaact

SEQ ID NO: 4066639 - DNA, 21 bp, Homo sapiens
aatgtaaaggagtcaaaacta

SEQ ID NO: 4066640 - DNA, 23 bp, Homo sapiens
aatgtaaaggagtcaaaactaca

SEQ ID NO: 4066641 - DNA, 18 bp, Homo sapiens
aatgtaaatattctatat

SEQ ID NO: 4066642 - DNA, 21 bp, Homo sapiens
aatgtaagaaaacaaaatcta

SEQ ID NO: 4066643 - DNA, 13 bp, Homo sapiens
aatgtaagctcta

SEQ ID NO: 4066644 - DNA, 17 bp, Homo sapiens
aatgtacatctggcctt

SEQ ID NO: 4066645 - DNA, 16 bp, Homo sapiens
aatgtacatgaagcaa

SEQ ID NO: 4066646 - DNA, 15 bp, Homo sapiens
aatgtacattaatta

SEQ ID NO: 4066647 - DNA, 18 bp, Homo sapiens
aatgtactgcatatgaaa

SEQ ID NO: 4066648 - DNA, 18 bp, Homo sapiens
aatgtagcgtgtttacat

SEQ ID NO: 4066649 - DNA, 21 bp, Homo sapiens
aatgtagcgtgtttacatgtg

SEQ ID NO: 4066650 - DNA, 14 bp, Homo sapiens
aatgtagctggttt

SEQ ID NO: 4066651 - DNA, 19 bp, Homo sapiens
aatgtatactatagtacca

SEQ ID NO: 4066652 - DNA, 15 bp, Homo sapiens
aatgtatcaggaaat

SEQ ID NO: 4066653 - DNA, 19 bp, Homo sapiens
aatgtatgtaatgtgtggt

SEQ ID NO: 4066654 - DNA, 20 bp, Homo sapiens
aatgtatgtgcactgtcact

SEQ ID NO: 4066655 - DNA, 12 bp, Homo sapiens
aatgtatgtgta

SEQ ID NO: 4066656 - DNA, 14 bp, Homo sapiens
aatgtatgtgtaag

SEQ ID NO: 4066657 - DNA, 20 bp, Homo sapiens
aatgtatgtgtaagtattct

SEQ ID NO: 4066658 - DNA, 17 bp, Homo sapiens
aatgtattattctgcag

SEQ ID NO: 4066659 - DNA, 15 bp, Homo sapiens
aatgtattttgaaga

SEQ ID NO: 4066660 - DNA, 16 bp, Homo sapiens
aatgtcaaacagtgcc

SEQ ID NO: 4066661 - DNA, 19 bp, Homo sapiens
aatgtcagaaaccagttat

SEQ ID NO: 4066662 - DNA, 14 bp, Homo sapiens
aatgtcagatttct

SEQ ID NO: 4066663 - DNA, 12 bp, Homo sapiens
aatgtcagtgtt

SEQ ID NO: 4066664 - DNA, 12 bp, Homo sapiens
aatgtctaaatg

SEQ ID NO: 4066665 - DNA, 14 bp, Homo sapiens
aatgtctcactgtt

SEQ ID NO: 4066666 - DNA, 16 bp, Homo sapiens
aatgtctcactgttct

SEQ ID NO: 4066667 - DNA, 18 bp, Homo sapiens
aatgtctcactgttctgc

SEQ ID NO: 4066668 - DNA, 13 bp, Homo sapiens
aatgtctttgtaa

SEQ ID NO: 4066669 - DNA, 17 bp, Homo sapiens
aatgtgaaggcccaaga

SEQ ID NO: 4066670 - DNA, 20 bp, Homo sapiens
aatgtgatgcttataataaa

SEQ ID NO: 4066671 - DNA, 17 bp, Homo sapiens
aatgtgattactgctct

SEQ ID NO: 4066672 - DNA, 16 bp, Homo sapiens
aatgtgatttttctga

SEQ ID NO: 4066673 - DNA, 20 bp, Homo sapiens
aatgtgcagatgcaattgtt

SEQ ID NO: 4066674 - DNA, 17 bp, Homo sapiens
aatgtggagaagagtgc

SEQ ID NO: 4066675 - DNA, 16 bp, Homo sapiens
aatgtggagtctccct

SEQ ID NO: 4066676 - DNA, 20 bp, Homo sapiens
aatgtggagtctccctctga

SEQ ID NO: 4066677 - DNA, 17 bp, Homo sapiens
aatgtggatttgattca

SEQ ID NO: 4066678 - DNA, 20 bp, Homo sapiens
aatgtggccacttatttcac

SEQ ID NO: 4066679 - DNA, 21 bp, Homo sapiens
aatgtggcttgagaaatatgg

SEQ ID NO: 4066680 - DNA, 16 bp, Homo sapiens
aatgtggtctcaggat

SEQ ID NO: 4066681 - DNA, 18 bp, Homo sapiens
aatgtggttatttctctg

SEQ ID NO: 4066682 - DNA, 19 bp, Homo sapiens
aatgtggttatttctctga

SEQ ID NO: 4066683 - DNA, 16 bp, Homo sapiens
aatgtgtggtggcctc

SEQ ID NO: 4066684 - DNA, 19 bp, Homo sapiens
aatgtgtgtgtgtggcagg

SEQ ID NO: 4066685 - DNA, 21 bp, Homo sapiens
aatgtgtgtgtgtggcagggg

SEQ ID NO: 4066686 - DNA, 13 bp, Homo sapiens
aatgtgtttgctg

SEQ ID NO: 4066687 - DNA, 18 bp, Homo sapiens
aatgttaaatttgtaagt

SEQ ID NO: 4066688 - DNA, 21 bp, Homo sapiens
aatgttaatggatttcagaag

SEQ ID NO: 4066689 - DNA, 18 bp, Homo sapiens
aatgttactgatcatgca

SEQ ID NO: 4066690 - DNA, 20 bp, Homo sapiens
aatgttactgatcatgcatt

SEQ ID NO: 4066691 - DNA, 13 bp, Homo sapiens
aatgttagtattt

SEQ ID NO: 4066692 - DNA, 18 bp, Homo sapiens
aatgttagtattttaatc

SEQ ID NO: 4066693 - DNA, 13 bp, Homo sapiens
aatgttagttcta

SEQ ID NO: 4066694 - DNA, 22 bp, Homo sapiens
aatgttatgactatgtaaacta

SEQ ID NO: 4066695 - DNA, 19 bp, Homo sapiens
aatgttattttttaattat

SEQ ID NO: 4066696 - DNA, 21 bp, Homo sapiens
aatgttattttttaattatta

SEQ ID NO: 4066697 - DNA, 19 bp, Homo sapiens
aatgttcacatagtgaaat

SEQ ID NO: 4066698 - DNA, 19 bp, Homo sapiens
aatgttcacgcaacttgaa

SEQ ID NO: 4066699 - DNA, 11 bp, Homo sapiens
aatgttcattg

SEQ ID NO: 4066700 - DNA, 21 bp, Homo sapiens
aatgttcattgtaatgttact

SEQ ID NO: 4066701 - DNA, 22 bp, Homo sapiens
aatgttcattgtaatgttactg

SEQ ID NO: 4066702 - DNA, 17 bp, Homo sapiens
aatgttctcagatttct

SEQ ID NO: 4066703 - DNA, 14 bp, Homo sapiens
aatgttctgacatt

SEQ ID NO: 4066704 - DNA, 12 bp, Homo sapiens
aatgttcttcca

SEQ ID NO: 4066705 - DNA, 20 bp, Homo sapiens
aatgttctttggaaagtaca

SEQ ID NO: 4066706 - DNA, 22 bp, Homo sapiens
aatgttggatttataaatgcta

SEQ ID NO: 4066707 - DNA, 13 bp, Homo sapiens
aatgttgggaaag

SEQ ID NO: 4066708 - DNA, 17 bp, Homo sapiens
aatgttgtattcagtga

SEQ ID NO: 4066709 - DNA, 22 bp, Homo sapiens
aatgtttaaatcatgtatgtta

SEQ ID NO: 4066710 - DNA, 22 bp, Homo sapiens
aatgtttatgcaaggaaggaaa

SEQ ID NO: 4066711 - DNA, 18 bp, Homo sapiens
aatgtttgggcagaaggg

SEQ ID NO: 4066712 - DNA, 14 bp, Homo sapiens
aatgttttgtatat

SEQ ID NO: 4066713 - DNA, 15 bp, Homo sapiens
aatgttttgtatata

SEQ ID NO: 4066714 - DNA, 20 bp, Homo sapiens
aatgttttgtatatacagtt

SEQ ID NO: 4066715 - DNA, 16 bp, Homo sapiens
aatgtttttccctccc

SEQ ID NO: 4066716 - DNA, 20 bp, Homo sapiens
aatgtttttccctccccaga

SEQ ID NO: 4066717 - DNA, 15 bp, Homo sapiens
aatgttttttgccac

SEQ ID NO: 4066718 - DNA, 21 bp, Homo sapiens
aattaaaaaaaaagatctgtt

SEQ ID NO: 4066719 - DNA, 14 bp, Homo sapiens
aattaaaacacttt

SEQ ID NO: 4066720 - DNA, 15 bp, Homo sapiens
aattaaaacttctta

SEQ ID NO: 4066721 - DNA, 13 bp, Homo sapiens
aattaaaatttat

SEQ ID NO: 4066722 - DNA, 15 bp, Homo sapiens
aattaaaatttatct

SEQ ID NO: 4066723 - DNA, 18 bp, Homo sapiens
aattaaaatttatcttaa

SEQ ID NO: 4066724 - DNA, 19 bp, Homo sapiens
aattaaacttttaattcat

SEQ ID NO: 4066725 - DNA, 14 bp, Homo sapiens
aattaaattttgag

SEQ ID NO: 4066726 - DNA, 14 bp, Homo sapiens
aattaacctggtgc

SEQ ID NO: 4066727 - DNA, 15 bp, Homo sapiens
aattaacctggtgct

SEQ ID NO: 4066728 - DNA, 15 bp, Homo sapiens
aattaacttgagttt

SEQ ID NO: 4066729 - DNA, 19 bp, Homo sapiens
aattaagaaggcaaaaatg

SEQ ID NO: 4066730 - DNA, 21 bp, Homo sapiens
aattaagaatatgtttccttg

SEQ ID NO: 4066731 - DNA, 22 bp, Homo sapiens
aattaagatacaaattaatttt

SEQ ID NO: 4066732 - DNA, 20 bp, Homo sapiens
aattaatgacttactttaat

SEQ ID NO: 4066733 - DNA, 12 bp, Homo sapiens
aattaatgtcat

SEQ ID NO: 4066734 - DNA, 12 bp, Homo sapiens
aattaattgtaa

SEQ ID NO: 4066735 - DNA, 22 bp, Homo sapiens
aattaatttgattaacaaatat

SEQ ID NO: 4066736 - DNA, 20 bp, Homo sapiens
aattacaaaagagcagcatt

SEQ ID NO: 4066737 - DNA, 16 bp, Homo sapiens
aattacaactaagtga

SEQ ID NO: 4066738 - DNA, 17 bp, Homo sapiens
aattacatgtaaaacat

SEQ ID NO: 4066739 - DNA, 14 bp, Homo sapiens
aattaccaagagaa

SEQ ID NO: 4066740 - DNA, 22 bp, Homo sapiens
aattacgtttgttattcctagt

SEQ ID NO: 4066741 - DNA, 18 bp, Homo sapiens
acaagctggaagcacatg

SEQ ID NO: 4066742 - DNA, 15 bp, Homo sapiens
acaaggacttcctgt

SEQ ID NO: 4066743 - DNA, 16 bp, Homo sapiens
acaaggatagatgctg

SEQ ID NO: 4066744 - DNA, 14 bp, Homo sapiens
acaaggtagttttt

SEQ ID NO: 4066745 - DNA, 14 bp, Homo sapiens
acaaggtccactcc

SEQ ID NO: 4066746 - DNA, 23 bp, Homo sapiens
acaaggtcctctgtcagtcacag

SEQ ID NO: 4066747 - DNA, 16 bp, Homo sapiens
acaaggtgcaggcagg

SEQ ID NO: 4066748 - DNA, 21 bp, Homo sapiens
acaaggtggggattgcccctg

SEQ ID NO: 4066749 - DNA, 17 bp, Homo sapiens
acaaggttggttgctaa

SEQ ID NO: 4066750 - DNA, 22 bp, Homo sapiens
acaagtaccaaagttttatcaa

SEQ ID NO: 4066751 - DNA, 19 bp, Homo sapiens
acaagtatatgtgaaaaaa

SEQ ID NO: 4066752 - DNA, 20 bp, Homo sapiens
acaagtatatgtgaaaaaaa

SEQ ID NO: 4066753 - DNA, 23 bp, Homo sapiens
acaagtatgaataaagacaccta

SEQ ID NO: 4066754 - DNA, 20 bp, Homo sapiens
acaagtcctggatgttgtgt

SEQ ID NO: 4066755 - DNA, 16 bp, Homo sapiens
acaagtgaagaacact

SEQ ID NO: 4066756 - DNA, 15 bp, Homo sapiens
acaagtggactcagg

SEQ ID NO: 4066757 - DNA, 18 bp, Homo sapiens
acaagtggactcagggca

SEQ ID NO: 4066758 - DNA, 19 bp, Homo sapiens
acaagtggactcagggcag

SEQ ID NO: 4066759 - DNA, 19 bp, Homo sapiens
acaagtggtgtttattgca

SEQ ID NO: 4066760 - DNA, 17 bp, Homo sapiens
acaagttgcgacggaga

SEQ ID NO: 4066761 - DNA, 13 bp, Homo sapiens
acaagttgttatt

SEQ ID NO: 4066762 - DNA, 13 bp, Homo sapiens
acaagtttcagac

SEQ ID NO: 4066763 - DNA, 16 bp, Homo sapiens
acaagtttcagacagg

SEQ ID NO: 4066764 - DNA, 12 bp, Homo sapiens
acaataaaacat

SEQ ID NO: 4066765 - DNA, 16 bp, Homo sapiens
acaataaaacattaat

SEQ ID NO: 4066766 - DNA, 14 bp, Homo sapiens
acaataaataatct

SEQ ID NO: 4066767 - DNA, 14 bp, Homo sapiens
acaataaatgaaga

SEQ ID NO: 4066768 - DNA, 19 bp, Homo sapiens
acaataaatgtattcaaat

SEQ ID NO: 4066769 - DNA, 16 bp, Homo sapiens
acaataactactgtgt

SEQ ID NO: 4066770 - DNA, 19 bp, Homo sapiens
acaataactactgtgttcc

SEQ ID NO: 4066771 - DNA, 20 bp, Homo sapiens
acaataactactgtgttcct

SEQ ID NO: 4066772 - DNA, 18 bp, Homo sapiens
acaataatattgttgtat

SEQ ID NO: 4066773 - DNA, 22 bp, Homo sapiens
acaataatattgttgtataatt

SEQ ID NO: 4066774 - DNA, 23 bp, Homo sapiens
acaataatattgttgtataattt

SEQ ID NO: 4066775 - DNA, 17 bp, Homo sapiens
acaatacagataacatt

SEQ ID NO: 4066776 - DNA, 20 bp, Homo sapiens
acaatagctttaccctcagg

SEQ ID NO: 4066777 - DNA, 18 bp, Homo sapiens
acaataggtgcttattct

SEQ ID NO: 4066778 - DNA, 15 bp, Homo sapiens
acaatatgaatacag

SEQ ID NO: 4066779 - DNA, 14 bp, Homo sapiens
acaatatgtatgct

SEQ ID NO: 4066780 - DNA, 16 bp, Homo sapiens
acaatatgtatgcttt

SEQ ID NO: 4066781 - DNA, 14 bp, Homo sapiens
acaatatgtgagtg

SEQ ID NO: 4066782 - DNA, 14 bp, Homo sapiens
acaatcaaaggaaa

SEQ ID NO: 4066783 - DNA, 23 bp, Homo sapiens
acaatcaactctaatagtgctta

SEQ ID NO: 4066784 - DNA, 19 bp, Homo sapiens
acaatcagccacattctag

SEQ ID NO: 4066785 - DNA, 20 bp, Homo sapiens
acaatccccatcaggtagct

SEQ ID NO: 4066786 - DNA, 13 bp, Homo sapiens
acaatccctgggg

SEQ ID NO: 4066787 - DNA, 15 bp, Homo sapiens
acaatccctggggct

SEQ ID NO: 4066788 - DNA, 20 bp, Homo sapiens
acaatccctggggctgtgca

SEQ ID NO: 4066789 - DNA, 15 bp, Homo sapiens
acaatccgagcagtg

SEQ ID NO: 4066790 - DNA, 21 bp, Homo sapiens
acaatcctgtttataatctga

SEQ ID NO: 4066791 - DNA, 16 bp, Homo sapiens
acaatgaacacttata

SEQ ID NO: 4066792 - DNA, 21 bp, Homo sapiens
acaatgatgattaaacacctg

SEQ ID NO: 4066793 - DNA, 22 bp, Homo sapiens
acaatgatgattaaacacctga

SEQ ID NO: 4066794 - DNA, 12 bp, Homo sapiens
acaatgcaaaac

SEQ ID NO: 4066795 - DNA, 16 bp, Homo sapiens
acaatgcaaaaccttt

SEQ ID NO: 4066796 - DNA, 20 bp, Homo sapiens
acaatgtcgagtatattatt

SEQ ID NO: 4066797 - DNA, 21 bp, Homo sapiens
acaatgtcgagtatattatta

SEQ ID NO: 4066798 - DNA, 19 bp, Homo sapiens
acaatgtgaactttattaa

SEQ ID NO: 4066799 - DNA, 17 bp, Homo sapiens
acaatgtggagtctccc

SEQ ID NO: 4066800 - DNA, 14 bp, Homo sapiens
acaatgtgtattca

SEQ ID NO: 4066801 - DNA, 20 bp, Homo sapiens
acaatgttaaggaaactctt

SEQ ID NO: 4066802 - DNA, 21 bp, Homo sapiens
acaatgttaaggaaactctta

SEQ ID NO: 4066803 - DNA, 23 bp, Homo sapiens
acaattataaactcattttgctt

SEQ ID NO: 4066804 - DNA, 14 bp, Homo sapiens
acaattattggcaa

SEQ ID NO: 4066805 - DNA, 17 bp, Homo sapiens
acaattattggcaaagt

SEQ ID NO: 4066806 - DNA, 22 bp, Homo sapiens
acaattcctagataaaaagatg

SEQ ID NO: 4066807 - DNA, 13 bp, Homo sapiens
acaattgaagtaa

SEQ ID NO: 4066808 - DNA, 18 bp, Homo sapiens
acaattgtgtagcctttt

SEQ ID NO: 4066809 - DNA, 18 bp, Homo sapiens
acaattgttttaatctga

SEQ ID NO: 4066810 - DNA, 20 bp, Homo sapiens
acaattgttttaatctgaaa

SEQ ID NO: 4066811 - DNA, 22 bp, Homo sapiens
acaattgttttaatctgaaatt

SEQ ID NO: 4066812 - DNA, 17 bp, Homo sapiens
acaatttgatacataat

SEQ ID NO: 4066813 - DNA, 18 bp, Homo sapiens
acaatttgatacataata

SEQ ID NO: 4066814 - DNA, 15 bp, Homo sapiens
acaattttgtacaaa

SEQ ID NO: 4066815 - DNA, 15 bp, Homo sapiens
acacaaactgtaaat

SEQ ID NO: 4066816 - DNA, 16 bp, Homo sapiens
acacaaactgtaaata

SEQ ID NO: 4066817 - DNA, 19 bp, Homo sapiens
acacaaactgtaaataaaa

SEQ ID NO: 4066818 - DNA, 13 bp, Homo sapiens
acacaaaggaagt

SEQ ID NO: 4066819 - DNA, 20 bp, Homo sapiens
acacaaatgctcaaagaaat

SEQ ID NO: 4066820 - DNA, 13 bp, Homo sapiens
acacaacacacac

SEQ ID NO: 4066821 - DNA, 17 bp, Homo sapiens
acacaagcactttaatg

SEQ ID NO: 4066822 - DNA, 15 bp, Homo sapiens
acacaagctggaagc

SEQ ID NO: 4066823 - DNA, 23 bp, Homo sapiens
acacaaggatagatgctggccca

SEQ ID NO: 4066824 - DNA, 13 bp, Homo sapiens
acacaataagcaa

SEQ ID NO: 4066825 - DNA, 13 bp, Homo sapiens
acacacacacaca

SEQ ID NO: 4066826 - DNA, 15 bp, Homo sapiens
acacacacacacaaa

SEQ ID NO: 4066827 - DNA, 15 bp, Homo sapiens
acacacacacacaca

SEQ ID NO: 4066828 - DNA, 10 bp, Homo sapiens
acacacacag

SEQ ID NO: 4066829 - DNA, 16 bp, Homo sapiens
acacacacccaggccc

SEQ ID NO: 4066830 - DNA, 21 bp, Homo sapiens
acacacacgcacgcacacaca

SEQ ID NO: 4066831 - DNA, 12 bp, Homo sapiens
acacacactatg

SEQ ID NO: 4066832 - DNA, 14 bp, Homo sapiens
acacacagccccta

SEQ ID NO: 4066833 - DNA, 15 bp, Homo sapiens
acacacagctgggca

SEQ ID NO: 4066834 - DNA, 16 bp, Homo sapiens
acacaccaggctgtgg

SEQ ID NO: 4066835 - DNA, 23 bp, Homo sapiens
acacacccaggcccatgccaagg

SEQ ID NO: 4066836 - DNA, 16 bp, Homo sapiens
acacactccctgcttg

SEQ ID NO: 4066837 - DNA, 16 bp, Homo sapiens
acacactggtacttag

SEQ ID NO: 4066838 - DNA, 17 bp, Homo sapiens
acacactggtacttaga

SEQ ID NO: 4066839 - DNA, 14 bp, Homo sapiens
acacactttttaag

SEQ ID NO: 4066840 - DNA, 18 bp, Homo sapiens
acacagaaaatgttgaga

SEQ ID NO: 4066841 - DNA, 18 bp, Homo sapiens
acacagaaacctttttaa

SEQ ID NO: 4066842 - DNA, 14 bp, Homo sapiens
acacagaaatgctg

SEQ ID NO: 4066843 - DNA, 17 bp, Homo sapiens
acacagaaatgctgctg

SEQ ID NO: 4066844 - DNA, 23 bp, Homo sapiens
acactccccgccttagagcctcg

SEQ ID NO: 4066845 - DNA, 17 bp, Homo sapiens
acactcgccatctcctg

SEQ ID NO: 4066846 - DNA, 12 bp, Homo sapiens
acactctgctgt

SEQ ID NO: 4066847 - DNA, 17 bp, Homo sapiens
acactctgctgtttgac

SEQ ID NO: 4066848 - DNA, 12 bp, Homo sapiens
acactctttgta

SEQ ID NO: 4066849 - DNA, 14 bp, Homo sapiens
acactgaaaaatta

SEQ ID NO: 4066850 - DNA, 16 bp, Homo sapiens
acactgaaaaattata

SEQ ID NO: 4066851 - DNA, 13 bp, Homo sapiens
acactgaaagttt

SEQ ID NO: 4066852 - DNA, 20 bp, Homo sapiens
acactgaaagttttgtaaaa

SEQ ID NO: 4066853 - DNA, 17 bp, Homo sapiens
acactgagccccacctc

SEQ ID NO: 4066854 - DNA, 21 bp, Homo sapiens
acactgagccccacctctcca

SEQ ID NO: 4066855 - DNA, 18 bp, Homo sapiens
acactgaggcagccttgg

SEQ ID NO: 4066856 - DNA, 13 bp, Homo sapiens
acactgattttgt

SEQ ID NO: 4066857 - DNA, 13 bp, Homo sapiens
acactgcaaattt

SEQ ID NO: 4066858 - DNA, 14 bp, Homo sapiens
acactgcagacttg

SEQ ID NO: 4066859 - DNA, 15 bp, Homo sapiens
acactgccctcttgt

SEQ ID NO: 4066860 - DNA, 11 bp, Homo sapiens
acactgctgta

SEQ ID NO: 4066861 - DNA, 22 bp, Homo sapiens
acactgctgtacccagatgcct

SEQ ID NO: 4066862 - DNA, 22 bp, Homo sapiens
acactggcacactgctcttaag

SEQ ID NO: 4066863 - DNA, 17 bp, Homo sapiens
acactggctaaagataa

SEQ ID NO: 4066864 - DNA, 13 bp, Homo sapiens
acactgggtggtg

SEQ ID NO: 4066865 - DNA, 18 bp, Homo sapiens
acactgggtggtggcctg

SEQ ID NO: 4066866 - DNA, 20 bp, Homo sapiens
acacttaagggttttagaaa

SEQ ID NO: 4066867 - DNA, 13 bp, Homo sapiens
acacttcagagag

SEQ ID NO: 4066868 - DNA, 18 bp, Homo sapiens
acacttcagagagctggt

SEQ ID NO: 4066869 - DNA, 23 bp, Homo sapiens
acacttctgtgagacccccacac

SEQ ID NO: 4066870 - DNA, 20 bp, Homo sapiens
acacttgccttcttcaccca

SEQ ID NO: 4066871 - DNA, 19 bp, Homo sapiens
acacttgtgattataaaat

SEQ ID NO: 4066872 - DNA, 24 bp, Homo sapiens
acactttgggcttagtatttctca

SEQ ID NO: 4066873 - DNA, 23 bp, Homo sapiens
acactttgttgcaagatgtgaat

SEQ ID NO: 4066874 - DNA, 21 bp, Homo sapiens
acagaaaaacagacaaaacaa

SEQ ID NO: 4066875 - DNA, 14 bp, Homo sapiens
acagaaaagtgcct

SEQ ID NO: 4066876 - DNA, 19 bp, Homo sapiens
acagaaaagtgcctgagct

SEQ ID NO: 4066877 - DNA, 17 bp, Homo sapiens
acagaaacctatcctca

SEQ ID NO: 4066878 - DNA, 22 bp, Homo sapiens
acagaaacctatcctcactgcc

SEQ ID NO: 4066879 - DNA, 14 bp, Homo sapiens
acagaaatgctgct

SEQ ID NO: 4066880 - DNA, 15 bp, Homo sapiens
acagaaatgctgctg

SEQ ID NO: 4066881 - DNA, 20 bp, Homo sapiens
acagaaatgctgctggccaa

SEQ ID NO: 4066882 - DNA, 21 bp, Homo sapiens
acagaaatgctgctggccaaa

SEQ ID NO: 4066883 - DNA, 19 bp, Homo sapiens
acagaaatggggaattctc

SEQ ID NO: 4066884 - DNA, 15 bp, Homo sapiens
acagaacagcttcag

SEQ ID NO: 4066885 - DNA, 14 bp, Homo sapiens
acagaacagggtca

SEQ ID NO: 4066886 - DNA, 18 bp, Homo sapiens
acagaaccttcaacccag

SEQ ID NO: 4066887 - DNA, 16 bp, Homo sapiens
acagaactaaatgttc

SEQ ID NO: 4066888 - DNA, 14 bp, Homo sapiens
acagaacttcagaa

SEQ ID NO: 4066889 - DNA, 18 bp, Homo sapiens
acagaacttcagaaagac

SEQ ID NO: 4066890 - DNA, 19 bp, Homo sapiens
acagaacttgaatgtgtca

SEQ ID NO: 4066891 - DNA, 22 bp, Homo sapiens
acagaagctcttactctttcct

SEQ ID NO: 4066892 - DNA, 22 bp, Homo sapiens
acagaaggaatctgtgcagatg

SEQ ID NO: 4066893 - DNA, 19 bp, Homo sapiens
acagaaggctcctgccccc

SEQ ID NO: 4066894 - DNA, 16 bp, Homo sapiens
acagaagtcatgaagc

SEQ ID NO: 4066895 - DNA, 12 bp, Homo sapiens
acagaatatttc

SEQ ID NO: 4066896 - DNA, 21 bp, Homo sapiens
acagaatatttctattgaatt

SEQ ID NO: 4066897 - DNA, 10 bp, Homo sapiens
acagaatttt

SEQ ID NO: 4066898 - DNA, 14 bp, Homo sapiens
acagaattttggaa

SEQ ID NO: 4066899 - DNA, 13 bp, Homo sapiens
acagacaaaacaa

SEQ ID NO: 4066900 - DNA, 12 bp, Homo sapiens
acagacaaggtt

SEQ ID NO: 4066901 - DNA, 21 bp, Homo sapiens
acagacaagttggaaaaacaa

SEQ ID NO: 4066902 - DNA, 15 bp, Homo sapiens
acagacacacacacg

SEQ ID NO: 4066903 - DNA, 16 bp, Homo sapiens
acagacacacacacgc

SEQ ID NO: 4066904 - DNA, 18 bp, Homo sapiens
acagacacacacacgcac

SEQ ID NO: 4066905 - DNA, 21 bp, Homo sapiens
acagacagatcccatccatca

SEQ ID NO: 4066906 - DNA, 19 bp, Homo sapiens
acagaccacctgcttctga

SEQ ID NO: 4066907 - DNA, 20 bp, Homo sapiens
acagaccacctgcttctgaa

SEQ ID NO: 4066908 - DNA, 23 bp, Homo sapiens
acagaccacctgcttctgaactc

SEQ ID NO: 4066909 - DNA, 19 bp, Homo sapiens
acagaccagtgaccccaga

SEQ ID NO: 4066910 - DNA, 21 bp, Homo sapiens
acagaccagtgaccccagaaa

SEQ ID NO: 4066911 - DNA, 20 bp, Homo sapiens
acagaccatattacctggat

SEQ ID NO: 4066912 - DNA, 13 bp, Homo sapiens
acagacctggaca

SEQ ID NO: 4066913 - DNA, 18 bp, Homo sapiens
acagactccatctcttct

SEQ ID NO: 4066914 - DNA, 24 bp, Homo sapiens
acagactccatctcttctgcaagc

SEQ ID NO: 4066915 - DNA, 20 bp, Homo sapiens
acagagaagcggatttccag

SEQ ID NO: 4066916 - DNA, 19 bp, Homo sapiens
acagagaaggcgcttccca

SEQ ID NO: 4066917 - DNA, 13 bp, Homo sapiens
acagagaataact

SEQ ID NO: 4066918 - DNA, 11 bp, Homo sapiens
acagagaccta

SEQ ID NO: 4066919 - DNA, 17 bp, Homo sapiens
acagagattgaactcca

SEQ ID NO: 4066920 - DNA, 15 bp, Homo sapiens
acagagcaagactct

SEQ ID NO: 4066921 - DNA, 16 bp, Homo sapiens
acagagcagctcccca

SEQ ID NO: 4066922 - DNA, 17 bp, Homo sapiens
acagagcagctccccag

SEQ ID NO: 4066923 - DNA, 19 bp, Homo sapiens
acagagcagctccccagga

SEQ ID NO: 4066924 - DNA, 21 bp, Homo sapiens
acagagcctcgggacatcaaa

SEQ ID NO: 4066925 - DNA, 12 bp, Homo sapiens
acagagcctgcc

SEQ ID NO: 4066926 - DNA, 15 bp, Homo sapiens
acagagcctgcccca

SEQ ID NO: 4066927 - DNA, 14 bp, Homo sapiens
acagagcctggccc

SEQ ID NO: 4066928 - DNA, 20 bp, Homo sapiens
acagagcctggccccaggcc

SEQ ID NO: 4066929 - DNA, 22 bp, Homo sapiens
acagagctgtggaggattgcta

SEQ ID NO: 4066930 - DNA, 17 bp, Homo sapiens
acagaggagcttttctg

SEQ ID NO: 4066931 - DNA, 17 bp, Homo sapiens
acagaggccatggcaga

SEQ ID NO: 4066932 - DNA, 19 bp, Homo sapiens
acagagtgagccagtgagg

SEQ ID NO: 4066933 - DNA, 20 bp, Homo sapiens
acagagtggcctccctgctg

SEQ ID NO: 4066934 - DNA, 21 bp, Homo sapiens
acagagtggcctccctgctgt

SEQ ID NO: 4066935 - DNA, 21 bp, Homo sapiens
acagagtggtctttctggaga

SEQ ID NO: 4066936 - DNA, 18 bp, Homo sapiens
acagagttcacaggaggc

SEQ ID NO: 4066937 - DNA, 13 bp, Homo sapiens
acagagttgattt

SEQ ID NO: 4066938 - DNA, 22 bp, Homo sapiens
acagataacattaggttgtcct

SEQ ID NO: 4066939 - DNA, 21 bp, Homo sapiens
acagataagcaagagagatgt

SEQ ID NO: 4066940 - DNA, 15 bp, Homo sapiens
acagataataatggg

SEQ ID NO: 4066941 - DNA, 21 bp, Homo sapiens
acagatactggaagttttgca

SEQ ID NO: 4066942 - DNA, 13 bp, Homo sapiens
acagatagttgtg

SEQ ID NO: 4066943 - DNA, 17 bp, Homo sapiens
acagatataaatggctg

SEQ ID NO: 4066944 - DNA, 20 bp, Homo sapiens
acagatatttccatttcttc

SEQ ID NO: 4066945 - DNA, 17 bp, Homo sapiens
acagatcctttttccat

SEQ ID NO: 4066946 - DNA, 17 bp, Homo sapiens
acatgcagcccatgccc

SEQ ID NO: 4066947 - DNA, 12 bp, Homo sapiens
acatgcatttga

SEQ ID NO: 4066948 - DNA, 17 bp, Homo sapiens
acatgcatttgaggtca

SEQ ID NO: 4066949 - DNA, 13 bp, Homo sapiens
acatgccactgcc

SEQ ID NO: 4066950 - DNA, 23 bp, Homo sapiens
acatgccactgcctgcacctttc

SEQ ID NO: 4066951 - DNA, 15 bp, Homo sapiens
acatgcctgccccaa

SEQ ID NO: 4066952 - DNA, 17 bp, Homo sapiens
acatgcggtagccagca

SEQ ID NO: 4066953 - DNA, 20 bp, Homo sapiens
acatgcggtagccagcacac

SEQ ID NO: 4066954 - DNA, 22 bp, Homo sapiens
acatgcggtagccagcacacag

SEQ ID NO: 4066955 - DNA, 16 bp, Homo sapiens
acatgctcacctctag

SEQ ID NO: 4066956 - DNA, 20 bp, Homo sapiens
acatgctcacctctagcctt

SEQ ID NO: 4066957 - DNA, 21 bp, Homo sapiens
acatgctgtatatgcaatgtc

SEQ ID NO: 4066958 - DNA, 20 bp, Homo sapiens
acatggaataacatgtaatt

SEQ ID NO: 4066959 - DNA, 18 bp, Homo sapiens
acatggacttgtatattt

SEQ ID NO: 4066960 - DNA, 23 bp, Homo sapiens
acatggacttgtatatttgtaca

SEQ ID NO: 4066961 - DNA, 16 bp, Homo sapiens
acatggagctgtcatc

SEQ ID NO: 4066962 - DNA, 15 bp, Homo sapiens
acatggccccatccc

SEQ ID NO: 4066963 - DNA, 15 bp, Homo sapiens
acatggctttgataa

SEQ ID NO: 4066964 - DNA, 12 bp, Homo sapiens
acatgggactgg

SEQ ID NO: 4066965 - DNA, 15 bp, Homo sapiens
acatgggcagcccaa

SEQ ID NO: 4066966 - DNA, 18 bp, Homo sapiens
acatggttacaatcattg

SEQ ID NO: 4066967 - DNA, 22 bp, Homo sapiens
acatggttacaatcattgctga

SEQ ID NO: 4066968 - DNA, 23 bp, Homo sapiens
acatggttacaatcattgctgaa

SEQ ID NO: 4066969 - DNA, 17 bp, Homo sapiens
acatgtaattaagtact

SEQ ID NO: 4066970 - DNA, 19 bp, Homo sapiens
acatgtaattaagtactat

SEQ ID NO: 4066971 - DNA, 20 bp, Homo sapiens
acatgtagtagtacttgaaa

SEQ ID NO: 4066972 - DNA, 19 bp, Homo sapiens
acatgtattgcacattgta

SEQ ID NO: 4066973 - DNA, 12 bp, Homo sapiens
acatgtgaaacc

SEQ ID NO: 4066974 - DNA, 14 bp, Homo sapiens
acatgtgaaacctt

SEQ ID NO: 4066975 - DNA, 17 bp, Homo sapiens
acatgtgaaaccttttt

SEQ ID NO: 4066976 - DNA, 15 bp, Homo sapiens
acatgtgacatttat

SEQ ID NO: 4066977 - DNA, 16 bp, Homo sapiens
acatgtgacatttata

SEQ ID NO: 4066978 - DNA, 21 bp, Homo sapiens
acatgtgcaattgtgagggac

SEQ ID NO: 4066979 - DNA, 19 bp, Homo sapiens
acatgtgccgaatgtgcag

SEQ ID NO: 4066980 - DNA, 20 bp, Homo sapiens
acatgtgccgaatgtgcagg

SEQ ID NO: 4066981 - DNA, 18 bp, Homo sapiens
acatgtggaaagtgaatt

SEQ ID NO: 4066982 - DNA, 20 bp, Homo sapiens
acatgtgtagcctatgttgt

SEQ ID NO: 4066983 - DNA, 18 bp, Homo sapiens
acatgtgtttattcatcc

SEQ ID NO: 4066984 - DNA, 19 bp, Homo sapiens
acatgttactgaccagcaa

SEQ ID NO: 4066985 - DNA, 13 bp, Homo sapiens
acatgttactgct

SEQ ID NO: 4066986 - DNA, 21 bp, Homo sapiens
acatgttatcaaatctgggta

SEQ ID NO: 4066987 - DNA, 16 bp, Homo sapiens
acatgttttaaagaaa

SEQ ID NO: 4066988 - DNA, 22 bp, Homo sapiens
acattaaaactaggtaatgttt

SEQ ID NO: 4066989 - DNA, 15 bp, Homo sapiens
acattaaatgcaata

SEQ ID NO: 4066990 - DNA, 21 bp, Homo sapiens
acattaaatgcaataatttta

SEQ ID NO: 4066991 - DNA, 11 bp, Homo sapiens
acattaacagt

SEQ ID NO: 4066992 - DNA, 17 bp, Homo sapiens
acattaacagttttcca

SEQ ID NO: 4066993 - DNA, 22 bp, Homo sapiens
acattaacagttttccatgaaa

SEQ ID NO: 4066994 - DNA, 18 bp, Homo sapiens
acattaatagcagccttt

SEQ ID NO: 4066995 - DNA, 15 bp, Homo sapiens
acattaatgttaatt

SEQ ID NO: 4066996 - DNA, 22 bp, Homo sapiens
acattaatgttaattcagcact

SEQ ID NO: 4066997 - DNA, 16 bp, Homo sapiens
acattaccttactgtg

SEQ ID NO: 4066998 - DNA, 18 bp, Homo sapiens
acattagcagtttgcttt

SEQ ID NO: 4066999 - DNA, 14 bp, Homo sapiens
acattagtaaatgt

SEQ ID NO: 4067000 - DNA, 15 bp, Homo sapiens
acattagtaaatgtc

SEQ ID NO: 4067001 - DNA, 16 bp, Homo sapiens
acattagtaaatgtct

SEQ ID NO: 4067002 - DNA, 20 bp, Homo sapiens
acattagtaaatgtctttgt

SEQ ID NO: 4067003 - DNA, 24 bp, Homo sapiens
acattagtaaatgtctttgtaagt

SEQ ID NO: 4067004 - DNA, 11 bp, Homo sapiens
acattataaac

SEQ ID NO: 4067005 - DNA, 19 bp, Homo sapiens
acattatcgggagcagtgt

SEQ ID NO: 4067006 - DNA, 12 bp, Homo sapiens
acattatttcta

SEQ ID NO: 4067007 - DNA, 20 bp, Homo sapiens
acattcacctgccccaactc

SEQ ID NO: 4067008 - DNA, 14 bp, Homo sapiens
acattcccccacca

SEQ ID NO: 4067009 - DNA, 19 bp, Homo sapiens
acattcccccaccagctgc

SEQ ID NO: 4067010 - DNA, 15 bp, Homo sapiens
acattccctctcctg

SEQ ID NO: 4067011 - DNA, 18 bp, Homo sapiens
acattccctctcctgccc

SEQ ID NO: 4067012 - DNA, 21 bp, Homo sapiens
acattccctctcctgcccaga

SEQ ID NO: 4067013 - DNA, 15 bp, Homo sapiens
acattcctgcattca

SEQ ID NO: 4067014 - DNA, 19 bp, Homo sapiens
acattcgatctcattcagt

SEQ ID NO: 4067015 - DNA, 12 bp, Homo sapiens
acattctagttc

SEQ ID NO: 4067016 - DNA, 17 bp, Homo sapiens
acattctagttcagagc

SEQ ID NO: 4067017 - DNA, 22 bp, Homo sapiens
acattctattttgggtattaat

SEQ ID NO: 4067018 - DNA, 19 bp, Homo sapiens
acattgaccaagaactgca

SEQ ID NO: 4067019 - DNA, 22 bp, Homo sapiens
acattgaccgcaactcacacat

SEQ ID NO: 4067020 - DNA, 20 bp, Homo sapiens
acattgacgattccttctct

SEQ ID NO: 4067021 - DNA, 15 bp, Homo sapiens
acattgcattctatt

SEQ ID NO: 4067022 - DNA, 19 bp, Homo sapiens
acattgcattctattgcct

SEQ ID NO: 4067023 - DNA, 22 bp, Homo sapiens
acattgcattctattgccttct

SEQ ID NO: 4067024 - DNA, 16 bp, Homo sapiens
acattgccccaagata

SEQ ID NO: 4067025 - DNA, 15 bp, Homo sapiens
acattgcgtttgacc

SEQ ID NO: 4067026 - DNA, 12 bp, Homo sapiens
acattgcttttc

SEQ ID NO: 4067027 - DNA, 16 bp, Homo sapiens
acattggaatgccttg

SEQ ID NO: 4067028 - DNA, 17 bp, Homo sapiens
acattggaatgccttgg

SEQ ID NO: 4067029 - DNA, 21 bp, Homo sapiens
acattggcacctaatccaggc

SEQ ID NO: 4067030 - DNA, 14 bp, Homo sapiens
acattgtcaataaa

SEQ ID NO: 4067031 - DNA, 12 bp, Homo sapiens
acattgtctgcg

SEQ ID NO: 4067032 - DNA, 20 bp, Homo sapiens
acattgttcaattagaatag

SEQ ID NO: 4067033 - DNA, 14 bp, Homo sapiens
acatttaaaactta

SEQ ID NO: 4067034 - DNA, 13 bp, Homo sapiens
acatttaaagcat

SEQ ID NO: 4067035 - DNA, 19 bp, Homo sapiens
acatttaaagcattgctgt

SEQ ID NO: 4067036 - DNA, 17 bp, Homo sapiens
acatttaaatgtaactt

SEQ ID NO: 4067037 - DNA, 16 bp, Homo sapiens
acatttaatacagcag

SEQ ID NO: 4067038 - DNA, 12 bp, Homo sapiens
acatttataatt

SEQ ID NO: 4067039 - DNA, 13 bp, Homo sapiens
acatttataattg

SEQ ID NO: 4067040 - DNA, 14 bp, Homo sapiens
acatttataattgc

SEQ ID NO: 4067041 - DNA, 15 bp, Homo sapiens
acatttatgatttaa

SEQ ID NO: 4067042 - DNA, 17 bp, Homo sapiens
acatttatgatttaata

SEQ ID NO: 4067043 - DNA, 19 bp, Homo sapiens
acatttatgatttaataaa

SEQ ID NO: 4067044 - DNA, 19 bp, Homo sapiens
acatttatttattactgtc

SEQ ID NO: 4067045 - DNA, 20 bp, Homo sapiens
acatttatttattactgtcc

SEQ ID NO: 4067046 - DNA, 21 bp, Homo sapiens
acatttatttattactgtccc

SEQ ID NO: 4067047 - DNA, 13 bp, Homo sapiens
acatttatttcct

SEQ ID NO: 4067048 - DNA, 14 bp, Homo sapiens
acatttcaaagttt

SEQ ID NO: 4067049 - DNA, 23 bp, Homo sapiens
acccccttttcagctgagccctg

SEQ ID NO: 4067050 - DNA, 14 bp, Homo sapiens
accccgcctgccct

SEQ ID NO: 4067051 - DNA, 16 bp, Homo sapiens
accccggcctcagggc

SEQ ID NO: 4067052 - DNA, 13 bp, Homo sapiens
accccgggctctc

SEQ ID NO: 4067053 - DNA, 16 bp, Homo sapiens
accccgggctctctgc

SEQ ID NO: 4067054 - DNA, 21 bp, Homo sapiens
accccgggctctctgctgtac

SEQ ID NO: 4067055 - DNA, 15 bp, Homo sapiens
accccggggaccctg

SEQ ID NO: 4067056 - DNA, 16 bp, Homo sapiens
accccggggaccctgt

SEQ ID NO: 4067057 - DNA, 20 bp, Homo sapiens
accccggggtgcccacaggc

SEQ ID NO: 4067058 - DNA, 20 bp, Homo sapiens
accccgtcgaggggctctca

SEQ ID NO: 4067059 - DNA, 18 bp, Homo sapiens
acccctacacacacactc

SEQ ID NO: 4067060 - DNA, 14 bp, Homo sapiens
acccctagccacca

SEQ ID NO: 4067061 - DNA, 16 bp, Homo sapiens
acccctagccaccagt

SEQ ID NO: 4067062 - DNA, 18 bp, Homo sapiens
acccctagccaccagtgt

SEQ ID NO: 4067063 - DNA, 19 bp, Homo sapiens
acccctagccaccagtgtc

SEQ ID NO: 4067064 - DNA, 14 bp, Homo sapiens
acccctagttccct

SEQ ID NO: 4067065 - DNA, 15 bp, Homo sapiens
acccctcactcccca

SEQ ID NO: 4067066 - DNA, 17 bp, Homo sapiens
acccctcactccccagg

SEQ ID NO: 4067067 - DNA, 18 bp, Homo sapiens
acccctcactccccaggg

SEQ ID NO: 4067068 - DNA, 23 bp, Homo sapiens
acccctccattggctcccaagtc

SEQ ID NO: 4067069 - DNA, 21 bp, Homo sapiens
acccctcgtccaccccccaca

SEQ ID NO: 4067070 - DNA, 15 bp, Homo sapiens
acccctctggccagg

SEQ ID NO: 4067071 - DNA, 12 bp, Homo sapiens
acccctctggtg

SEQ ID NO: 4067072 - DNA, 17 bp, Homo sapiens
acccctgcccccagccc

SEQ ID NO: 4067073 - DNA, 11 bp, Homo sapiens
acccctgcctg

SEQ ID NO: 4067074 - DNA, 17 bp, Homo sapiens
acccctgctcccagcct

SEQ ID NO: 4067075 - DNA, 21 bp, Homo sapiens
acccctgctcccagcctgctg

SEQ ID NO: 4067076 - DNA, 23 bp, Homo sapiens
acccctgctcccagcctgctgag

SEQ ID NO: 4067077 - DNA, 19 bp, Homo sapiens
acccctgctcccattcctc

SEQ ID NO: 4067078 - DNA, 22 bp, Homo sapiens
acccctgctcccattcctccct

SEQ ID NO: 4067079 - DNA, 23 bp, Homo sapiens
acccctggaagagcccagtctgt

SEQ ID NO: 4067080 - DNA, 18 bp, Homo sapiens
acccctggcttttcactg

SEQ ID NO: 4067081 - DNA, 20 bp, Homo sapiens
acccctggcttttcactgct

SEQ ID NO: 4067082 - DNA, 21 bp, Homo sapiens
acccctggcttttcactgctg

SEQ ID NO: 4067083 - DNA, 12 bp, Homo sapiens
acccctgggcag

SEQ ID NO: 4067084 - DNA, 14 bp, Homo sapiens
accccttagcctcc

SEQ ID NO: 4067085 - DNA, 17 bp, Homo sapiens
accccttagcctccctg

SEQ ID NO: 4067086 - DNA, 18 bp, Homo sapiens
accccttagcctccctga

SEQ ID NO: 4067087 - DNA, 15 bp, Homo sapiens
accccttatccagga

SEQ ID NO: 4067088 - DNA, 17 bp, Homo sapiens
accccttctttgcaggg

SEQ ID NO: 4067089 - DNA, 17 bp, Homo sapiens
acccctttctgtcccac

SEQ ID NO: 4067090 - DNA, 13 bp, Homo sapiens
acccgaaatgcca

SEQ ID NO: 4067091 - DNA, 23 bp, Homo sapiens
acccgaaatgccacgtggtcact

SEQ ID NO: 4067092 - DNA, 19 bp, Homo sapiens
acccgacctggctgcccct

SEQ ID NO: 4067093 - DNA, 21 bp, Homo sapiens
acccgagtcattcgttctgtg

SEQ ID NO: 4067094 - DNA, 16 bp, Homo sapiens
acccgctttcttgctg

SEQ ID NO: 4067095 - DNA, 15 bp, Homo sapiens
acccggaggggcctg

SEQ ID NO: 4067096 - DNA, 14 bp, Homo sapiens
acccggcctctctg

SEQ ID NO: 4067097 - DNA, 23 bp, Homo sapiens
acccggcctctctgccccaccca

SEQ ID NO: 4067098 - DNA, 20 bp, Homo sapiens
acccggggacccccaactcc

SEQ ID NO: 4067099 - DNA, 13 bp, Homo sapiens
acccgggggagcc

SEQ ID NO: 4067100 - DNA, 16 bp, Homo sapiens
acccgggggagcccag

SEQ ID NO: 4067101 - DNA, 17 bp, Homo sapiens
acccgggggagcccagt

SEQ ID NO: 4067102 - DNA, 19 bp, Homo sapiens
acccgggggagcccagtga

SEQ ID NO: 4067103 - DNA, 22 bp, Homo sapiens
acccgttctgctggcctggatc

SEQ ID NO: 4067104 - DNA, 19 bp, Homo sapiens
accctaatgtcttcataaa

SEQ ID NO: 4067105 - DNA, 23 bp, Homo sapiens
accctaatgtcttcataaagtac

SEQ ID NO: 4067106 - DNA, 16 bp, Homo sapiens
accctaggttccctgt

SEQ ID NO: 4067107 - DNA, 18 bp, Homo sapiens
accctaggttccctgttc

SEQ ID NO: 4067108 - DNA, 21 bp, Homo sapiens
accctagttctacctcaggca

SEQ ID NO: 4067109 - DNA, 17 bp, Homo sapiens
accctcacacacacagc

SEQ ID NO: 4067110 - DNA, 18 bp, Homo sapiens
accctcagagccacccct

SEQ ID NO: 4067111 - DNA, 19 bp, Homo sapiens
accctcaggcataggcctg

SEQ ID NO: 4067112 - DNA, 14 bp, Homo sapiens
acctgcagaaacag

SEQ ID NO: 4067113 - DNA, 17 bp, Homo sapiens
acctgcagattctagga

SEQ ID NO: 4067114 - DNA, 15 bp, Homo sapiens
acctgcagctccctc

SEQ ID NO: 4067115 - DNA, 17 bp, Homo sapiens
acctgcaggctgagcca

SEQ ID NO: 4067116 - DNA, 13 bp, Homo sapiens
acctgccctggaa

SEQ ID NO: 4067117 - DNA, 13 bp, Homo sapiens
acctgcctcctgc

SEQ ID NO: 4067118 - DNA, 18 bp, Homo sapiens
acctgcctcctgcctgcc

SEQ ID NO: 4067119 - DNA, 23 bp, Homo sapiens
acctgcctcggcctcccaaagtg

SEQ ID NO: 4067120 - DNA, 13 bp, Homo sapiens
acctgctccagaa

SEQ ID NO: 4067121 - DNA, 14 bp, Homo sapiens
acctgctccagaag

SEQ ID NO: 4067122 - DNA, 17 bp, Homo sapiens
acctgctccagaagatg

SEQ ID NO: 4067123 - DNA, 16 bp, Homo sapiens
acctgctccgctgctc

SEQ ID NO: 4067124 - DNA, 16 bp, Homo sapiens
acctgctctgtcccca

SEQ ID NO: 4067125 - DNA, 21 bp, Homo sapiens
acctgctgtgatacgatgctt

SEQ ID NO: 4067126 - DNA, 21 bp, Homo sapiens
acctgcttcatgctcagccct

SEQ ID NO: 4067127 - DNA, 23 bp, Homo sapiens
acctgcttcatgctcagccctga

SEQ ID NO: 4067128 - DNA, 15 bp, Homo sapiens
acctgcttctctgcc

SEQ ID NO: 4067129 - DNA, 21 bp, Homo sapiens
acctgcttctctgcccagctt

SEQ ID NO: 4067130 - DNA, 15 bp, Homo sapiens
acctgctttgactga

SEQ ID NO: 4067131 - DNA, 18 bp, Homo sapiens
acctggaacttggggagt

SEQ ID NO: 4067132 - DNA, 18 bp, Homo sapiens
acctggaaggcccagcac

SEQ ID NO: 4067133 - DNA, 19 bp, Homo sapiens
acctggaatctacaagcca

SEQ ID NO: 4067134 - DNA, 21 bp, Homo sapiens
acctggaatctacaagccaaa

SEQ ID NO: 4067135 - DNA, 19 bp, Homo sapiens
acctggcactgggaggcag

SEQ ID NO: 4067136 - DNA, 18 bp, Homo sapiens
acctggcatcatggtgga

SEQ ID NO: 4067137 - DNA, 23 bp, Homo sapiens
acctggctgagcagttcccctgg

SEQ ID NO: 4067138 - DNA, 21 bp, Homo sapiens
acctggctgaggttcctctgc

SEQ ID NO: 4067139 - DNA, 17 bp, Homo sapiens
acctggctgcccctcac

SEQ ID NO: 4067140 - DNA, 20 bp, Homo sapiens
acctggctgcccctcacctt

SEQ ID NO: 4067141 - DNA, 14 bp, Homo sapiens
acctgggccctgga

SEQ ID NO: 4067142 - DNA, 17 bp, Homo sapiens
acctgggttccctttcc

SEQ ID NO: 4067143 - DNA, 16 bp, Homo sapiens
acctggtaccctcctg

SEQ ID NO: 4067144 - DNA, 18 bp, Homo sapiens
acctggtaccctcctggc

SEQ ID NO: 4067145 - DNA, 10 bp, Homo sapiens
acctggtgct

SEQ ID NO: 4067146 - DNA, 14 bp, Homo sapiens
acctggtgctggat

SEQ ID NO: 4067147 - DNA, 15 bp, Homo sapiens
acctgtaacttttgt

SEQ ID NO: 4067148 - DNA, 11 bp, Homo sapiens
acctgtaatca

SEQ ID NO: 4067149 - DNA, 15 bp, Homo sapiens
acctgtaatcccagc

SEQ ID NO: 4067150 - DNA, 16 bp, Homo sapiens
acctgtagccatctgc

SEQ ID NO: 4067151 - DNA, 17 bp, Homo sapiens
acctgtagccatctgca

SEQ ID NO: 4067152 - DNA, 21 bp, Homo sapiens
acctgtatttttgttagttta

SEQ ID NO: 4067153 - DNA, 17 bp, Homo sapiens
acctgtcacattgcatt

SEQ ID NO: 4067154 - DNA, 18 bp, Homo sapiens
acctgtcaccgtgagcag

SEQ ID NO: 4067155 - DNA, 19 bp, Homo sapiens
acctgtcttccaaggagac

SEQ ID NO: 4067156 - DNA, 18 bp, Homo sapiens
acctgtgagcccagctgg

SEQ ID NO: 4067157 - DNA, 18 bp, Homo sapiens
acctgtgagtttaaagca

SEQ ID NO: 4067158 - DNA, 13 bp, Homo sapiens
acctgtgctggag

SEQ ID NO: 4067159 - DNA, 23 bp, Homo sapiens
acctgtgctggagccctgttcct

SEQ ID NO: 4067160 - DNA, 20 bp, Homo sapiens
acctgtggaacataaaaagg

SEQ ID NO: 4067161 - DNA, 23 bp, Homo sapiens
acctgtggaacataaaaaggaca

SEQ ID NO: 4067162 - DNA, 13 bp, Homo sapiens
acctgtgtacata

SEQ ID NO: 4067163 - DNA, 17 bp, Homo sapiens
acctgttagcagacagg

SEQ ID NO: 4067164 - DNA, 21 bp, Homo sapiens
acctgtttatgagatgctggt

SEQ ID NO: 4067165 - DNA, 19 bp, Homo sapiens
acctgtttttaagctgttt

SEQ ID NO: 4067166 - DNA, 21 bp, Homo sapiens
accttactgtggaggaaggat

SEQ ID NO: 4067167 - DNA, 14 bp, Homo sapiens
accttaggccttcc

SEQ ID NO: 4067168 - DNA, 15 bp, Homo sapiens
accttaggccttcct

SEQ ID NO: 4067169 - DNA, 16 bp, Homo sapiens
accttaggccttcctc

SEQ ID NO: 4067170 - DNA, 17 bp, Homo sapiens
accttaggccttcctct

SEQ ID NO: 4067171 - DNA, 15 bp, Homo sapiens
accttatatttacaa

SEQ ID NO: 4067172 - DNA, 17 bp, Homo sapiens
accttatatttacaata

SEQ ID NO: 4067173 - DNA, 18 bp, Homo sapiens
accttatatttacaataa

SEQ ID NO: 4067174 - DNA, 13 bp, Homo sapiens
accttatctgtgc

SEQ ID NO: 4067175 - DNA, 22 bp, Homo sapiens
accttatctgtgcgtgaaacac

SEQ ID NO: 4067176 - DNA, 20 bp, Homo sapiens
accttcaatgacttctaatt

SEQ ID NO: 4067177 - DNA, 23 bp, Homo sapiens
accttcatctgaaacccacagat

SEQ ID NO: 4067178 - DNA, 14 bp, Homo sapiens
accttccagctcct

SEQ ID NO: 4067179 - DNA, 17 bp, Homo sapiens
accttccagctcctgta

SEQ ID NO: 4067180 - DNA, 15 bp, Homo sapiens
accttccagggccct

SEQ ID NO: 4067181 - DNA, 17 bp, Homo sapiens
accttccagggccctag

SEQ ID NO: 4067182 - DNA, 17 bp, Homo sapiens
accttcctcacttccat

SEQ ID NO: 4067183 - DNA, 15 bp, Homo sapiens
accttctagaattat

SEQ ID NO: 4067184 - DNA, 18 bp, Homo sapiens
accttctagtcttggcca

SEQ ID NO: 4067185 - DNA, 12 bp, Homo sapiens
accttctgcctt

SEQ ID NO: 4067186 - DNA, 14 bp, Homo sapiens
accttctgtcccca

SEQ ID NO: 4067187 - DNA, 13 bp, Homo sapiens
accttctgtggct

SEQ ID NO: 4067188 - DNA, 16 bp, Homo sapiens
accttgaatgctgcca

SEQ ID NO: 4067189 - DNA, 18 bp, Homo sapiens
accttgaatgctgccagt

SEQ ID NO: 4067190 - DNA, 17 bp, Homo sapiens
accttgacttgattagt

SEQ ID NO: 4067191 - DNA, 21 bp, Homo sapiens
accttgcaacctcaccttcct

SEQ ID NO: 4067192 - DNA, 20 bp, Homo sapiens
accttgccaagctttcttct

SEQ ID NO: 4067193 - DNA, 13 bp, Homo sapiens
accttgctaattt

SEQ ID NO: 4067194 - DNA, 15 bp, Homo sapiens
accttgctctcctca

SEQ ID NO: 4067195 - DNA, 17 bp, Homo sapiens
accttgctctcctcatc

SEQ ID NO: 4067196 - DNA, 12 bp, Homo sapiens
accttgctgtcc

SEQ ID NO: 4067197 - DNA, 14 bp, Homo sapiens
accttgctgtcctg

SEQ ID NO: 4067198 - DNA, 19 bp, Homo sapiens
accttgctgtcctgatctg

SEQ ID NO: 4067199 - DNA, 23 bp, Homo sapiens
accttgctgtcctgatctgtgat

SEQ ID NO: 4067200 - DNA, 22 bp, Homo sapiens
accttgcttcttactgataatt

SEQ ID NO: 4067201 - DNA, 17 bp, Homo sapiens
accttggcaccagacac

SEQ ID NO: 4067202 - DNA, 20 bp, Homo sapiens
accttggctctgccagtgga

SEQ ID NO: 4067203 - DNA, 18 bp, Homo sapiens
acctttaaaattgtcacc

SEQ ID NO: 4067204 - DNA, 16 bp, Homo sapiens
acctttaacacagacc

SEQ ID NO: 4067205 - DNA, 15 bp, Homo sapiens
acctttatggtttct

SEQ ID NO: 4067206 - DNA, 17 bp, Homo sapiens
acctttattttagaatt

SEQ ID NO: 4067207 - DNA, 11 bp, Homo sapiens
acctttcatac

SEQ ID NO: 4067208 - DNA, 18 bp, Homo sapiens
acctttcccatcttccaa

SEQ ID NO: 4067209 - DNA, 19 bp, Homo sapiens
acctttcggcagaggaacc

SEQ ID NO: 4067210 - DNA, 14 bp, Homo sapiens
accttttaaagtgt

SEQ ID NO: 4067211 - DNA, 19 bp, Homo sapiens
accttttaaagtgtttcag

SEQ ID NO: 4067212 - DNA, 16 bp, Homo sapiens
accttttattgacaca

SEQ ID NO: 4067213 - DNA, 13 bp, Homo sapiens
accttttctcttt

SEQ ID NO: 4067214 - DNA, 19 bp, Homo sapiens
acctttttcttgatcttaa

SEQ ID NO: 4067215 - DNA, 22 bp, Homo sapiens
actgcccgagctggtgcattac

SEQ ID NO: 4067216 - DNA, 13 bp, Homo sapiens
actgccctaagcc

SEQ ID NO: 4067217 - DNA, 17 bp, Homo sapiens
actgccctaagccccca

SEQ ID NO: 4067218 - DNA, 15 bp, Homo sapiens
actgccctactggga

SEQ ID NO: 4067219 - DNA, 20 bp, Homo sapiens
actgccctactgggagactg

SEQ ID NO: 4067220 - DNA, 20 bp, Homo sapiens
actgccctgttcatgtgcct

SEQ ID NO: 4067221 - DNA, 22 bp, Homo sapiens
actgccctgttcatgtgcctct

SEQ ID NO: 4067222 - DNA, 24 bp, Homo sapiens
actgccctgttcatgtgcctctgc

SEQ ID NO: 4067223 - DNA, 17 bp, Homo sapiens
actgccctgtttctgtt

SEQ ID NO: 4067224 - DNA, 15 bp, Homo sapiens
actgcctgcaccttt

SEQ ID NO: 4067225 - DNA, 23 bp, Homo sapiens
actgccttgaacctgtgagtaaa

SEQ ID NO: 4067226 - DNA, 22 bp, Homo sapiens
actgcgaagaccctcttgccca

SEQ ID NO: 4067227 - DNA, 13 bp, Homo sapiens
actgctactgtaa

SEQ ID NO: 4067228 - DNA, 18 bp, Homo sapiens
actgctactgtaatttta

SEQ ID NO: 4067229 - DNA, 18 bp, Homo sapiens
actgctaggcgagtgcca

SEQ ID NO: 4067230 - DNA, 19 bp, Homo sapiens
actgctaggcgagtgccag

SEQ ID NO: 4067231 - DNA, 22 bp, Homo sapiens
actgctaggcgagtgccaggac

SEQ ID NO: 4067232 - DNA, 14 bp, Homo sapiens
actgctggtgccag

SEQ ID NO: 4067233 - DNA, 16 bp, Homo sapiens
actgctggtgccaggg

SEQ ID NO: 4067234 - DNA, 18 bp, Homo sapiens
actgctggtgccagggtg

SEQ ID NO: 4067235 - DNA, 13 bp, Homo sapiens
actgctgtaccca

SEQ ID NO: 4067236 - DNA, 18 bp, Homo sapiens
actgctgtacccagatgc

SEQ ID NO: 4067237 - DNA, 16 bp, Homo sapiens
actgcttaattcaaat

SEQ ID NO: 4067238 - DNA, 17 bp, Homo sapiens
actgcttacttatgcca

SEQ ID NO: 4067239 - DNA, 12 bp, Homo sapiens
actgctttctgt

SEQ ID NO: 4067240 - DNA, 14 bp, Homo sapiens
actgctttctgttc

SEQ ID NO: 4067241 - DNA, 18 bp, Homo sapiens
actgctttctgttccaaa

SEQ ID NO: 4067242 - DNA, 19 bp, Homo sapiens
actgctttctgttccaaat

SEQ ID NO: 4067243 - DNA, 22 bp, Homo sapiens
actgctttgggatttaatttcc

SEQ ID NO: 4067244 - DNA, 17 bp, Homo sapiens
actggaacatggctagc

SEQ ID NO: 4067245 - DNA, 21 bp, Homo sapiens
actggaacatggctagccttt

SEQ ID NO: 4067246 - DNA, 16 bp, Homo sapiens
actggaagctaatttg

SEQ ID NO: 4067247 - DNA, 20 bp, Homo sapiens
actggaagctaatttgcatt

SEQ ID NO: 4067248 - DNA, 16 bp, Homo sapiens
actggaagttttgcat

SEQ ID NO: 4067249 - DNA, 23 bp, Homo sapiens
actggaataagaagcaaataaat

SEQ ID NO: 4067250 - DNA, 20 bp, Homo sapiens
actggaataatttgtaaatg

SEQ ID NO: 4067251 - DNA, 21 bp, Homo sapiens
actggaataatttgtaaatga

SEQ ID NO: 4067252 - DNA, 15 bp, Homo sapiens
actggactcacattc

SEQ ID NO: 4067253 - DNA, 15 bp, Homo sapiens
actggaggagctggg

SEQ ID NO: 4067254 - DNA, 14 bp, Homo sapiens
actggaggtcacat

SEQ ID NO: 4067255 - DNA, 19 bp, Homo sapiens
actggaggtcacattcagg

SEQ ID NO: 4067256 - DNA, 20 bp, Homo sapiens
actggaggtcacattcagga

SEQ ID NO: 4067257 - DNA, 15 bp, Homo sapiens
actggaggtgggcat

SEQ ID NO: 4067258 - DNA, 15 bp, Homo sapiens
actggagtctggagt

SEQ ID NO: 4067259 - DNA, 13 bp, Homo sapiens
actggagtgcagg

SEQ ID NO: 4067260 - DNA, 17 bp, Homo sapiens
actggagtgcagggagg

SEQ ID NO: 4067261 - DNA, 14 bp, Homo sapiens
actggagttacatt

SEQ ID NO: 4067262 - DNA, 21 bp, Homo sapiens
actggagttccttatccctct

SEQ ID NO: 4067263 - DNA, 10 bp, Homo sapiens
actggatgaa

SEQ ID NO: 4067264 - DNA, 22 bp, Homo sapiens
actggatgaaataactccttct

SEQ ID NO: 4067265 - DNA, 14 bp, Homo sapiens
actggatgaagatt

SEQ ID NO: 4067266 - DNA, 19 bp, Homo sapiens
actggcaattgtctattta

SEQ ID NO: 4067267 - DNA, 13 bp, Homo sapiens
actggcccctggg

SEQ ID NO: 4067268 - DNA, 15 bp, Homo sapiens
actggcccctgggtc

SEQ ID NO: 4067269 - DNA, 18 bp, Homo sapiens
actggctggcctgagcaa

SEQ ID NO: 4067270 - DNA, 14 bp, Homo sapiens
actggctggctcct

SEQ ID NO: 4067271 - DNA, 16 bp, Homo sapiens
actggcttccccactc

SEQ ID NO: 4067272 - DNA, 22 bp, Homo sapiens
actgggatgggaacactggtgg

SEQ ID NO: 4067273 - DNA, 13 bp, Homo sapiens
actgggcacacgc

SEQ ID NO: 4067274 - DNA, 14 bp, Homo sapiens
actgggccacggag

SEQ ID NO: 4067275 - DNA, 17 bp, Homo sapiens
actgggccagccctgca

SEQ ID NO: 4067276 - DNA, 19 bp, Homo sapiens
actgggccagccctgcagc

SEQ ID NO: 4067277 - DNA, 21 bp, Homo sapiens
actgggccagccctgcagccc

SEQ ID NO: 4067278 - DNA, 23 bp, Homo sapiens
actgggccataatgttgcttctc

SEQ ID NO: 4067279 - DNA, 21 bp, Homo sapiens
actgggccttagtgggccagg

SEQ ID NO: 4067280 - DNA, 15 bp, Homo sapiens
actggggcatcctgt

SEQ ID NO: 4067281 - DNA, 12 bp, Homo sapiens
actggggcctcc

SEQ ID NO: 4067282 - DNA, 16 bp, Homo sapiens
actggggcctccagaa

SEQ ID NO: 4067283 - DNA, 22 bp, Homo sapiens
actggggtgggaggtcttgcta

SEQ ID NO: 4067284 - DNA, 15 bp, Homo sapiens
actgggtaggaaaga

SEQ ID NO: 4067285 - DNA, 22 bp, Homo sapiens
actgggtggtggcctggtccct

SEQ ID NO: 4067286 - DNA, 17 bp, Homo sapiens
actgggtgtcatttcat

SEQ ID NO: 4067287 - DNA, 21 bp, Homo sapiens
actgggtgtcatttcattcca

SEQ ID NO: 4067288 - DNA, 14 bp, Homo sapiens
actgggtgttgatc

SEQ ID NO: 4067289 - DNA, 22 bp, Homo sapiens
actgggtgttgatcttacaaga

SEQ ID NO: 4067290 - DNA, 14 bp, Homo sapiens
actgggttcttgtt

SEQ ID NO: 4067291 - DNA, 15 bp, Homo sapiens
actggtctgtaggga

SEQ ID NO: 4067292 - DNA, 13 bp, Homo sapiens
actggtgccaaaa

SEQ ID NO: 4067293 - DNA, 23 bp, Homo sapiens
actggtgctataggctggagaag

SEQ ID NO: 4067294 - DNA, 22 bp, Homo sapiens
actggtggcccgacagcctggc

SEQ ID NO: 4067295 - DNA, 14 bp, Homo sapiens
actggtgtgacctg

SEQ ID NO: 4067296 - DNA, 22 bp, Homo sapiens
actggttggctcccgcggtgcc

SEQ ID NO: 4067297 - DNA, 13 bp, Homo sapiens
actggttttctgc

SEQ ID NO: 4067298 - DNA, 17 bp, Homo sapiens
actgtaacatattctgt

SEQ ID NO: 4067299 - DNA, 22 bp, Homo sapiens
actgtaatcttatttaggaagt

SEQ ID NO: 4067300 - DNA, 21 bp, Homo sapiens
actgtaattaaaactatttag

SEQ ID NO: 4067301 - DNA, 13 bp, Homo sapiens
actgtacaaagta

SEQ ID NO: 4067302 - DNA, 14 bp, Homo sapiens
actgtacaaagtag

SEQ ID NO: 4067303 - DNA, 15 bp, Homo sapiens
actgtacaaagtaga

SEQ ID NO: 4067304 - DNA, 22 bp, Homo sapiens
actgtacaaagtagaagtctta

SEQ ID NO: 4067305 - DNA, 21 bp, Homo sapiens
actgtaccacagacacaatat

SEQ ID NO: 4067306 - DNA, 18 bp, Homo sapiens
actgtagattgcttctgt

SEQ ID NO: 4067307 - DNA, 22 bp, Homo sapiens
actgtagattgcttctgtagta

SEQ ID NO: 4067308 - DNA, 15 bp, Homo sapiens
actgtagccacagct

SEQ ID NO: 4067309 - DNA, 20 bp, Homo sapiens
actgtagtgtagtcaggtgc

SEQ ID NO: 4067310 - DNA, 21 bp, Homo sapiens
actgtagtgtagtcaggtgct

SEQ ID NO: 4067311 - DNA, 20 bp, Homo sapiens
actgtagtttttcttcaaca

SEQ ID NO: 4067312 - DNA, 12 bp, Homo sapiens
actgtataaata

SEQ ID NO: 4067313 - DNA, 14 bp, Homo sapiens
actgtataaatagg

SEQ ID NO: 4067314 - DNA, 20 bp, Homo sapiens
actgtataaataggagagga

SEQ ID NO: 4067315 - DNA, 23 bp, Homo sapiens
actgtataaataggagaggatga

SEQ ID NO: 4067316 - DNA, 15 bp, Homo sapiens
actgtataagtacta

SEQ ID NO: 4067317 - DNA, 19 bp, Homo sapiens
acttcagttttatttttgc

SEQ ID NO: 4067318 - DNA, 18 bp, Homo sapiens
acttcatgagcattcata

SEQ ID NO: 4067319 - DNA, 20 bp, Homo sapiens
acttcatggaatggacatcc

SEQ ID NO: 4067320 - DNA, 15 bp, Homo sapiens
acttcattcttgaaa

SEQ ID NO: 4067321 - DNA, 14 bp, Homo sapiens
acttcatttttaat

SEQ ID NO: 4067322 - DNA, 19 bp, Homo sapiens
acttccaaaattcttattt

SEQ ID NO: 4067323 - DNA, 21 bp, Homo sapiens
acttccacctcgggcacattt

SEQ ID NO: 4067324 - DNA, 12 bp, Homo sapiens
acttccaccttg

SEQ ID NO: 4067325 - DNA, 17 bp, Homo sapiens
acttccactgccatcct

SEQ ID NO: 4067326 - DNA, 18 bp, Homo sapiens
acttccaggggaacctgc

SEQ ID NO: 4067327 - DNA, 20 bp, Homo sapiens
acttccaggtgttactgtaa

SEQ ID NO: 4067328 - DNA, 23 bp, Homo sapiens
acttcccagctaggaagagcagg

SEQ ID NO: 4067329 - DNA, 23 bp, Homo sapiens
acttcccagttcaggagtcccaa

SEQ ID NO: 4067330 - DNA, 19 bp, Homo sapiens
acttcccgggccagggctg

SEQ ID NO: 4067331 - DNA, 14 bp, Homo sapiens
acttccctttctgc

SEQ ID NO: 4067332 - DNA, 15 bp, Homo sapiens
acttcctcctcccca

SEQ ID NO: 4067333 - DNA, 18 bp, Homo sapiens
acttcctcctccccactt

SEQ ID NO: 4067334 - DNA, 14 bp, Homo sapiens
acttcctgctacag

SEQ ID NO: 4067335 - DNA, 19 bp, Homo sapiens
acttcctgctacaggaggg

SEQ ID NO: 4067336 - DNA, 16 bp, Homo sapiens
acttcctgctgcaccc

SEQ ID NO: 4067337 - DNA, 19 bp, Homo sapiens
acttcctgctgcaccctgc

SEQ ID NO: 4067338 - DNA, 23 bp, Homo sapiens
acttcctgtccagctccaacctg

SEQ ID NO: 4067339 - DNA, 20 bp, Homo sapiens
acttcctttaaagatgaact

SEQ ID NO: 4067340 - DNA, 15 bp, Homo sapiens
acttcgactcaggat

SEQ ID NO: 4067341 - DNA, 15 bp, Homo sapiens
acttcgtcttctaat

SEQ ID NO: 4067342 - DNA, 13 bp, Homo sapiens
acttctaatctta

SEQ ID NO: 4067343 - DNA, 13 bp, Homo sapiens
acttctaatttat

SEQ ID NO: 4067344 - DNA, 21 bp, Homo sapiens
acttctatattttaatagaaa

SEQ ID NO: 4067345 - DNA, 17 bp, Homo sapiens
acttctcttgaaaagtt

SEQ ID NO: 4067346 - DNA, 17 bp, Homo sapiens
acttctcttgctttcta

SEQ ID NO: 4067347 - DNA, 19 bp, Homo sapiens
acttctgaaataaatgttc

SEQ ID NO: 4067348 - DNA, 12 bp, Homo sapiens
acttctgcagct

SEQ ID NO: 4067349 - DNA, 23 bp, Homo sapiens
acttctgcctgaggggcagcctg

SEQ ID NO: 4067350 - DNA, 19 bp, Homo sapiens
acttctgtgagacccccac

SEQ ID NO: 4067351 - DNA, 20 bp, Homo sapiens
acttctgtgagacccccaca

SEQ ID NO: 4067352 - DNA, 23 bp, Homo sapiens
acttctgtgagacccccacacct

SEQ ID NO: 4067353 - DNA, 22 bp, Homo sapiens
acttcttaaatatcttttatgt

SEQ ID NO: 4067354 - DNA, 17 bp, Homo sapiens
acttcttcctttctctt

SEQ ID NO: 4067355 - DNA, 11 bp, Homo sapiens
acttcttctgt

SEQ ID NO: 4067356 - DNA, 12 bp, Homo sapiens
acttcttgaagg

SEQ ID NO: 4067357 - DNA, 17 bp, Homo sapiens
acttctttcccttcctc

SEQ ID NO: 4067358 - DNA, 19 bp, Homo sapiens
acttctttcccttcctcca

SEQ ID NO: 4067359 - DNA, 15 bp, Homo sapiens
acttgaaaagaaagt

SEQ ID NO: 4067360 - DNA, 12 bp, Homo sapiens
acttgaaagatt

SEQ ID NO: 4067361 - DNA, 14 bp, Homo sapiens
acttgaaagatttt

SEQ ID NO: 4067362 - DNA, 14 bp, Homo sapiens
acttgaaagcatcc

SEQ ID NO: 4067363 - DNA, 14 bp, Homo sapiens
acttgaaatgttag

SEQ ID NO: 4067364 - DNA, 23 bp, Homo sapiens
acttgaaattatatctgtggtct

SEQ ID NO: 4067365 - DNA, 16 bp, Homo sapiens
acttgaagcctgctcc

SEQ ID NO: 4067366 - DNA, 20 bp, Homo sapiens
acttgaagcctgctccttcc

SEQ ID NO: 4067367 - DNA, 14 bp, Homo sapiens
acttgaagggccag

SEQ ID NO: 4067368 - DNA, 22 bp, Homo sapiens
acttgaagggccagagccaggg

SEQ ID NO: 4067369 - DNA, 22 bp, Homo sapiens
acttgaagtctaaaagcagaaa

SEQ ID NO: 4067370 - DNA, 15 bp, Homo sapiens
acttgaatcagtttt

SEQ ID NO: 4067371 - DNA, 15 bp, Homo sapiens
acttgaatgtgtcag

SEQ ID NO: 4067372 - DNA, 19 bp, Homo sapiens
acttgacccccttgagggt

SEQ ID NO: 4067373 - DNA, 13 bp, Homo sapiens
acttgacctcatc

SEQ ID NO: 4067374 - DNA, 21 bp, Homo sapiens
acttgactccatttcatcatt

SEQ ID NO: 4067375 - DNA, 23 bp, Homo sapiens
acttgagaacttgacaagttgcg

SEQ ID NO: 4067376 - DNA, 15 bp, Homo sapiens
acttgagacaatgtt

SEQ ID NO: 4067377 - DNA, 17 bp, Homo sapiens
acttgagacaatgtttt

SEQ ID NO: 4067378 - DNA, 21 bp, Homo sapiens
acttgagacaatgttttcttc

SEQ ID NO: 4067379 - DNA, 16 bp, Homo sapiens
acttgagaggatgaat

SEQ ID NO: 4067380 - DNA, 19 bp, Homo sapiens
acttgagaggatgaatgta

SEQ ID NO: 4067381 - DNA, 17 bp, Homo sapiens
acttgagggcccagagc

SEQ ID NO: 4067382 - DNA, 18 bp, Homo sapiens
acttgagggcccagagca

SEQ ID NO: 4067383 - DNA, 20 bp, Homo sapiens
acttgagggcccagagcagg

SEQ ID NO: 4067384 - DNA, 21 bp, Homo sapiens
acttgagggcccagagcagga

SEQ ID NO: 4067385 - DNA, 23 bp, Homo sapiens
acttgagttggagtactatattt

SEQ ID NO: 4067386 - DNA, 15 bp, Homo sapiens
acttgagttttattt

SEQ ID NO: 4067387 - DNA, 21 bp, Homo sapiens
acttgagttttatttatttta

SEQ ID NO: 4067388 - DNA, 14 bp, Homo sapiens
acttgattaagatt

SEQ ID NO: 4067389 - DNA, 16 bp, Homo sapiens
acttgattaagatttt

SEQ ID NO: 4067390 - DNA, 16 bp, Homo sapiens
acttgatttgatgtga

SEQ ID NO: 4067391 - DNA, 21 bp, Homo sapiens
acttgatttgatgtgactttt

SEQ ID NO: 4067392 - DNA, 16 bp, Homo sapiens
acttgatttgcatgga

SEQ ID NO: 4067393 - DNA, 19 bp, Homo sapiens
acttgcactgggggaacag

SEQ ID NO: 4067394 - DNA, 12 bp, Homo sapiens
acttgcatgaag

SEQ ID NO: 4067395 - DNA, 17 bp, Homo sapiens
acttgcctggggtctga

SEQ ID NO: 4067396 - DNA, 21 bp, Homo sapiens
acttgcctggggtctgagcat

SEQ ID NO: 4067397 - DNA, 20 bp, Homo sapiens
acttgccttcttcacccagc

SEQ ID NO: 4067398 - DNA, 17 bp, Homo sapiens
acttgcgagaaattcgt

SEQ ID NO: 4067399 - DNA, 22 bp, Homo sapiens
acttgcgagaaattcgtgtgtt

SEQ ID NO: 4067400 - DNA, 14 bp, Homo sapiens
acttgctaccctga

SEQ ID NO: 4067401 - DNA, 23 bp, Homo sapiens
acttgcttaaatttcttatgtga

SEQ ID NO: 4067402 - DNA, 18 bp, Homo sapiens
acttggatacttggattt

SEQ ID NO: 4067403 - DNA, 21 bp, Homo sapiens
acttggggagttaagacctgg

SEQ ID NO: 4067404 - DNA, 17 bp, Homo sapiens
acttggggcacagggag

SEQ ID NO: 4067405 - DNA, 22 bp, Homo sapiens
acttgggggaacgatgtgtctg

SEQ ID NO: 4067406 - DNA, 18 bp, Homo sapiens
acttggtcacagccaggc

SEQ ID NO: 4067407 - DNA, 20 bp, Homo sapiens
acttggtcacagccaggcgc

SEQ ID NO: 4067408 - DNA, 13 bp, Homo sapiens
acttggttttatg

SEQ ID NO: 4067409 - DNA, 17 bp, Homo sapiens
acttggttttatggtta

SEQ ID NO: 4067410 - DNA, 21 bp, Homo sapiens
acttggtttttttttttctta

SEQ ID NO: 4067411 - DNA, 14 bp, Homo sapiens
acttgtaaatacac

SEQ ID NO: 4067412 - DNA, 14 bp, Homo sapiens
acttgtaaatgctg

SEQ ID NO: 4067413 - DNA, 18 bp, Homo sapiens
acttgtaatttttttaat

SEQ ID NO: 4067414 - DNA, 13 bp, Homo sapiens
acttgtacttgtt

SEQ ID NO: 4067415 - DNA, 14 bp, Homo sapiens
acttgtacttgttt

SEQ ID NO: 4067416 - DNA, 14 bp, Homo sapiens
acttgtaggataag

SEQ ID NO: 4067417 - DNA, 23 bp, Homo sapiens
acttgtaggataagtgaaatgga

SEQ ID NO: 4067418 - DNA, 17 bp, Homo sapiens
acttgtatatttgtaca

SEQ ID NO: 4067419 - DNA, 15 bp, Homo sapiens
agaaaacatgcctct

SEQ ID NO: 4067420 - DNA, 15 bp, Homo sapiens
agaaaacctgtattt

SEQ ID NO: 4067421 - DNA, 21 bp, Homo sapiens
agaaaacttgacatgtagctt

SEQ ID NO: 4067422 - DNA, 22 bp, Homo sapiens
agaaaactttaaaaaatattta

SEQ ID NO: 4067423 - DNA, 13 bp, Homo sapiens
agaaaagagaaac

SEQ ID NO: 4067424 - DNA, 15 bp, Homo sapiens
agaaaagataaagat

SEQ ID NO: 4067425 - DNA, 17 bp, Homo sapiens
agaaaagataaagatga

SEQ ID NO: 4067426 - DNA, 20 bp, Homo sapiens
agaaaagatacgactttatt

SEQ ID NO: 4067427 - DNA, 15 bp, Homo sapiens
agaaaagattttaat

SEQ ID NO: 4067428 - DNA, 16 bp, Homo sapiens
agaaaagcacttttgt

SEQ ID NO: 4067429 - DNA, 21 bp, Homo sapiens
agaaaagcacttttgttattc

SEQ ID NO: 4067430 - DNA, 17 bp, Homo sapiens
agaaaagtattttgaag

SEQ ID NO: 4067431 - DNA, 18 bp, Homo sapiens
agaaaagtattttgaagt

SEQ ID NO: 4067432 - DNA, 19 bp, Homo sapiens
agaaaagtattttgaagtt

SEQ ID NO: 4067433 - DNA, 23 bp, Homo sapiens
agaaaagtattttgaagtttaca

SEQ ID NO: 4067434 - DNA, 21 bp, Homo sapiens
agaaaagtgcatatttatcca

SEQ ID NO: 4067435 - DNA, 15 bp, Homo sapiens
agaaaagttgcagat

SEQ ID NO: 4067436 - DNA, 21 bp, Homo sapiens
agaaaataaaactaagctctt

SEQ ID NO: 4067437 - DNA, 15 bp, Homo sapiens
agaaaatacaataaa

SEQ ID NO: 4067438 - DNA, 17 bp, Homo sapiens
agaaaatacaataaact

SEQ ID NO: 4067439 - DNA, 23 bp, Homo sapiens
agaaaatagaatgtggccactta

SEQ ID NO: 4067440 - DNA, 20 bp, Homo sapiens
agaaaataggggatggtcca

SEQ ID NO: 4067441 - DNA, 20 bp, Homo sapiens
agaaaatgacttatttctgc

SEQ ID NO: 4067442 - DNA, 15 bp, Homo sapiens
agaaaattcaattgt

SEQ ID NO: 4067443 - DNA, 17 bp, Homo sapiens
agaaaattcaattgtaa

SEQ ID NO: 4067444 - DNA, 23 bp, Homo sapiens
agaaaattctgtgccttgttttt

SEQ ID NO: 4067445 - DNA, 15 bp, Homo sapiens
agaaaatttagccct

SEQ ID NO: 4067446 - DNA, 20 bp, Homo sapiens
agaaaatttagccctttaaa

SEQ ID NO: 4067447 - DNA, 22 bp, Homo sapiens
agaaaatttttgtagtagcgtt

SEQ ID NO: 4067448 - DNA, 13 bp, Homo sapiens
agaaacaaacatc

SEQ ID NO: 4067449 - DNA, 10 bp, Homo sapiens
agaaacacaa

SEQ ID NO: 4067450 - DNA, 18 bp, Homo sapiens
agaaacacccacaggcat

SEQ ID NO: 4067451 - DNA, 17 bp, Homo sapiens
agaaacagagtggcctc

SEQ ID NO: 4067452 - DNA, 20 bp, Homo sapiens
agaaacagagtggcctccct

SEQ ID NO: 4067453 - DNA, 21 bp, Homo sapiens
agaaacagtgggagccctgac

SEQ ID NO: 4067454 - DNA, 13 bp, Homo sapiens
agaaacagttaac

SEQ ID NO: 4067455 - DNA, 21 bp, Homo sapiens
agaaaccagttatgtgaatga

SEQ ID NO: 4067456 - DNA, 12 bp, Homo sapiens
agaaacccaggg

SEQ ID NO: 4067457 - DNA, 14 bp, Homo sapiens
agaaacccagggag

SEQ ID NO: 4067458 - DNA, 16 bp, Homo sapiens
agaaaccttattgtac

SEQ ID NO: 4067459 - DNA, 18 bp, Homo sapiens
agaaacgtcttctaaact

SEQ ID NO: 4067460 - DNA, 18 bp, Homo sapiens
agaaactcccctgggggt

SEQ ID NO: 4067461 - DNA, 13 bp, Homo sapiens
agaaactgctgca

SEQ ID NO: 4067462 - DNA, 23 bp, Homo sapiens
agaaactgctgcagattagttct

SEQ ID NO: 4067463 - DNA, 19 bp, Homo sapiens
agaaactggattaaaacaa

SEQ ID NO: 4067464 - DNA, 21 bp, Homo sapiens
agaaactggattaaaacaatt

SEQ ID NO: 4067465 - DNA, 17 bp, Homo sapiens
agaaactgtctagcact

SEQ ID NO: 4067466 - DNA, 18 bp, Homo sapiens
agaaacttaagcaaaggg

SEQ ID NO: 4067467 - DNA, 14 bp, Homo sapiens
agaaagaagccata

SEQ ID NO: 4067468 - DNA, 19 bp, Homo sapiens
agaaagcctgggtgacatt

SEQ ID NO: 4067469 - DNA, 23 bp, Homo sapiens
agaaagcttcttcagagtgaaga

SEQ ID NO: 4067470 - DNA, 17 bp, Homo sapiens
agaaaggaacctgggat

SEQ ID NO: 4067471 - DNA, 11 bp, Homo sapiens
agaaaggagac

SEQ ID NO: 4067472 - DNA, 16 bp, Homo sapiens
agaaaggatatttaag

SEQ ID NO: 4067473 - DNA, 19 bp, Homo sapiens
agaaaggatatttaagaaa

SEQ ID NO: 4067474 - DNA, 16 bp, Homo sapiens
agaaaggggagaatgt

SEQ ID NO: 4067475 - DNA, 22 bp, Homo sapiens
agaaaggtgagtttgagctgcc

SEQ ID NO: 4067476 - DNA, 17 bp, Homo sapiens
agaaagtcaccaggact

SEQ ID NO: 4067477 - DNA, 15 bp, Homo sapiens
agaaagtgaagcaaa

SEQ ID NO: 4067478 - DNA, 15 bp, Homo sapiens
agaaagtgatttcta

SEQ ID NO: 4067479 - DNA, 15 bp, Homo sapiens
agaaagtgcctgaca

SEQ ID NO: 4067480 - DNA, 19 bp, Homo sapiens
agaaagtgcctgacacact

SEQ ID NO: 4067481 - DNA, 17 bp, Homo sapiens
agaaagtgtgagcaaac

SEQ ID NO: 4067482 - DNA, 23 bp, Homo sapiens
agaaagtgtgagcaaactaactt

SEQ ID NO: 4067483 - DNA, 13 bp, Homo sapiens
agaaagtttagaa

SEQ ID NO: 4067484 - DNA, 18 bp, Homo sapiens
agaaataaaaggaagcca

SEQ ID NO: 4067485 - DNA, 20 bp, Homo sapiens
agaaataaaaggaagccaaa

SEQ ID NO: 4067486 - DNA, 23 bp, Homo sapiens
agaaataaaagtgaatgaaagat

SEQ ID NO: 4067487 - DNA, 18 bp, Homo sapiens
agaaataaagtttgctta

SEQ ID NO: 4067488 - DNA, 19 bp, Homo sapiens
agaaataaatagctatatc

SEQ ID NO: 4067489 - DNA, 14 bp, Homo sapiens
agaaataatatgca

SEQ ID NO: 4067490 - DNA, 19 bp, Homo sapiens
agaaatacaattctacatt

SEQ ID NO: 4067491 - DNA, 21 bp, Homo sapiens
agaaatactataacatatgta

SEQ ID NO: 4067492 - DNA, 16 bp, Homo sapiens
agaaatacttgtgatt

SEQ ID NO: 4067493 - DNA, 19 bp, Homo sapiens
agaaatatctgaaaatgta

SEQ ID NO: 4067494 - DNA, 22 bp, Homo sapiens
agaaatatgattttatttgaca

SEQ ID NO: 4067495 - DNA, 16 bp, Homo sapiens
agaaatatggaactta

SEQ ID NO: 4067496 - DNA, 20 bp, Homo sapiens
agaaatatggaacttacatt

SEQ ID NO: 4067497 - DNA, 14 bp, Homo sapiens
agaaatatggacac

SEQ ID NO: 4067498 - DNA, 17 bp, Homo sapiens
agaaatatggacactta

SEQ ID NO: 4067499 - DNA, 16 bp, Homo sapiens
agaaatatgtgagatt

SEQ ID NO: 4067500 - DNA, 13 bp, Homo sapiens
agaaatatttacc

SEQ ID NO: 4067501 - DNA, 18 bp, Homo sapiens
agaaatcaagcataaatc

SEQ ID NO: 4067502 - DNA, 16 bp, Homo sapiens
agaaatcaggtgtttt

SEQ ID NO: 4067503 - DNA, 22 bp, Homo sapiens
agaaatccctgtttaatattta

SEQ ID NO: 4067504 - DNA, 22 bp, Homo sapiens
agaaatctggtcttgttagaaa

SEQ ID NO: 4067505 - DNA, 18 bp, Homo sapiens
agaaatgaaataaaatgg

SEQ ID NO: 4067506 - DNA, 17 bp, Homo sapiens
agaaatgaacaaaagat

SEQ ID NO: 4067507 - DNA, 14 bp, Homo sapiens
agaaatgactaatt

SEQ ID NO: 4067508 - DNA, 23 bp, Homo sapiens
agaaatgcatatgtcactagaat

SEQ ID NO: 4067509 - DNA, 13 bp, Homo sapiens
agaaatgctgctg

SEQ ID NO: 4067510 - DNA, 17 bp, Homo sapiens
agaaatgctgctggcca

SEQ ID NO: 4067511 - DNA, 12 bp, Homo sapiens
agaaattagaaa

SEQ ID NO: 4067512 - DNA, 21 bp, Homo sapiens
agaaattagaaaaaaattact

SEQ ID NO: 4067513 - DNA, 15 bp, Homo sapiens
agaaattagctgtgt

SEQ ID NO: 4067514 - DNA, 11 bp, Homo sapiens
agaaattctgt

SEQ ID NO: 4067515 - DNA, 14 bp, Homo sapiens
agaaattctgttaa

SEQ ID NO: 4067516 - DNA, 14 bp, Homo sapiens
agaaattggctgga

SEQ ID NO: 4067517 - DNA, 13 bp, Homo sapiens
agaaattttgtaa

SEQ ID NO: 4067518 - DNA, 14 bp, Homo sapiens
agaaattttgtaag

SEQ ID NO: 4067519 - DNA, 22 bp, Homo sapiens
agaaatttttcagatgcttctg

SEQ ID NO: 4067520 - DNA, 13 bp, Homo sapiens
agaacaaaaaacc

SEQ ID NO: 4067521 - DNA, 22 bp, Homo sapiens
agaagggtggatgacagggcag

SEQ ID NO: 4067522 - DNA, 16 bp, Homo sapiens
agaagtatttttgtct

SEQ ID NO: 4067523 - DNA, 14 bp, Homo sapiens
agaagtgccttctc

SEQ ID NO: 4067524 - DNA, 21 bp, Homo sapiens
agaagtgctcttggctgaccc

SEQ ID NO: 4067525 - DNA, 19 bp, Homo sapiens
agaagtggctactgactac

SEQ ID NO: 4067526 - DNA, 14 bp, Homo sapiens
agaagttactttgt

SEQ ID NO: 4067527 - DNA, 16 bp, Homo sapiens
agaagttactttgtaa

SEQ ID NO: 4067528 - DNA, 20 bp, Homo sapiens
agaagttactttgtaatttt

SEQ ID NO: 4067529 - DNA, 16 bp, Homo sapiens
agaagtttcccttcct

SEQ ID NO: 4067530 - DNA, 16 bp, Homo sapiens
agaagtttctggccct

SEQ ID NO: 4067531 - DNA, 20 bp, Homo sapiens
agaagtttgatattaaagga

SEQ ID NO: 4067532 - DNA, 11 bp, Homo sapiens
agaataaaagc

SEQ ID NO: 4067533 - DNA, 15 bp, Homo sapiens
agaataaaaggtagt

SEQ ID NO: 4067534 - DNA, 17 bp, Homo sapiens
agaataaagtccaaagt

SEQ ID NO: 4067535 - DNA, 14 bp, Homo sapiens
agaataagagaaag

SEQ ID NO: 4067536 - DNA, 16 bp, Homo sapiens
agaataagagaaagaa

SEQ ID NO: 4067537 - DNA, 21 bp, Homo sapiens
agaataagagaaagaaaatga

SEQ ID NO: 4067538 - DNA, 15 bp, Homo sapiens
agaataaggcaggca

SEQ ID NO: 4067539 - DNA, 23 bp, Homo sapiens
agaataatatgctgccaaatttt

SEQ ID NO: 4067540 - DNA, 16 bp, Homo sapiens
agaataatctttgggt

SEQ ID NO: 4067541 - DNA, 16 bp, Homo sapiens
agaataatggaaacat

SEQ ID NO: 4067542 - DNA, 18 bp, Homo sapiens
agaatactttgcttcata

SEQ ID NO: 4067543 - DNA, 17 bp, Homo sapiens
agaatagccacatttgg

SEQ ID NO: 4067544 - DNA, 18 bp, Homo sapiens
agaataggcattaacaca

SEQ ID NO: 4067545 - DNA, 18 bp, Homo sapiens
agaatataaacatataca

SEQ ID NO: 4067546 - DNA, 14 bp, Homo sapiens
agaatataattatc

SEQ ID NO: 4067547 - DNA, 18 bp, Homo sapiens
agaatatatttatttaaa

SEQ ID NO: 4067548 - DNA, 14 bp, Homo sapiens
agaatatttaagaa

SEQ ID NO: 4067549 - DNA, 20 bp, Homo sapiens
agaatatttaagaaaagcac

SEQ ID NO: 4067550 - DNA, 23 bp, Homo sapiens
agaatatttaagaaaagcacttt

SEQ ID NO: 4067551 - DNA, 22 bp, Homo sapiens
agaatatttattacctctgata

SEQ ID NO: 4067552 - DNA, 13 bp, Homo sapiens
agaatatttctat

SEQ ID NO: 4067553 - DNA, 16 bp, Homo sapiens
agaatatttctattga

SEQ ID NO: 4067554 - DNA, 14 bp, Homo sapiens
agaatcatacttag

SEQ ID NO: 4067555 - DNA, 19 bp, Homo sapiens
agaatcatgctgttgcatt

SEQ ID NO: 4067556 - DNA, 13 bp, Homo sapiens
agaatcatggaga

SEQ ID NO: 4067557 - DNA, 14 bp, Homo sapiens
agaatcatggagaa

SEQ ID NO: 4067558 - DNA, 15 bp, Homo sapiens
agaatcatggagaaa

SEQ ID NO: 4067559 - DNA, 21 bp, Homo sapiens
agaatcatgtgaacccgggac

SEQ ID NO: 4067560 - DNA, 15 bp, Homo sapiens
agaatcccaaatttg

SEQ ID NO: 4067561 - DNA, 17 bp, Homo sapiens
agaatcccaaatttgat

SEQ ID NO: 4067562 - DNA, 19 bp, Homo sapiens
agaatcccttaaaattacc

SEQ ID NO: 4067563 - DNA, 20 bp, Homo sapiens
agaatcccttaaaattacca

SEQ ID NO: 4067564 - DNA, 10 bp, Homo sapiens
agaatctaaa

SEQ ID NO: 4067565 - DNA, 14 bp, Homo sapiens
agaatctaaacctt

SEQ ID NO: 4067566 - DNA, 20 bp, Homo sapiens
agaatctaaaccttacatgt

SEQ ID NO: 4067567 - DNA, 17 bp, Homo sapiens
agaatctgctgcatagc

SEQ ID NO: 4067568 - DNA, 16 bp, Homo sapiens
agaatgaaatgtatgt

SEQ ID NO: 4067569 - DNA, 20 bp, Homo sapiens
agaatgaaattgctgaaaga

SEQ ID NO: 4067570 - DNA, 16 bp, Homo sapiens
agaatgagggccaaga

SEQ ID NO: 4067571 - DNA, 20 bp, Homo sapiens
agaatgatcaaggatctgga

SEQ ID NO: 4067572 - DNA, 13 bp, Homo sapiens
agaatgattaatc

SEQ ID NO: 4067573 - DNA, 17 bp, Homo sapiens
agaatgcacaagaatgg

SEQ ID NO: 4067574 - DNA, 21 bp, Homo sapiens
agaatgcattccctgaatctg

SEQ ID NO: 4067575 - DNA, 17 bp, Homo sapiens
agaatgccatttctcac

SEQ ID NO: 4067576 - DNA, 12 bp, Homo sapiens
agaatgctgaac

SEQ ID NO: 4067577 - DNA, 14 bp, Homo sapiens
agaatgctgtacat

SEQ ID NO: 4067578 - DNA, 13 bp, Homo sapiens
agaatggagacag

SEQ ID NO: 4067579 - DNA, 18 bp, Homo sapiens
agaatggataaaataatg

SEQ ID NO: 4067580 - DNA, 17 bp, Homo sapiens
agaatggggctgggccc

SEQ ID NO: 4067581 - DNA, 16 bp, Homo sapiens
agaatgtaaaagaact

SEQ ID NO: 4067582 - DNA, 17 bp, Homo sapiens
agaatgtcagatttctg

SEQ ID NO: 4067583 - DNA, 14 bp, Homo sapiens
agaatgtggatttg

SEQ ID NO: 4067584 - DNA, 18 bp, Homo sapiens
agaatgtggccacttatt

SEQ ID NO: 4067585 - DNA, 22 bp, Homo sapiens
agaatgtggccacttatttcac

SEQ ID NO: 4067586 - DNA, 21 bp, Homo sapiens
agaatgtgtgtgtgtggcagg

SEQ ID NO: 4067587 - DNA, 19 bp, Homo sapiens
agaatgttgtattcagtga

SEQ ID NO: 4067588 - DNA, 15 bp, Homo sapiens
agaattaaactttta

SEQ ID NO: 4067589 - DNA, 18 bp, Homo sapiens
agaattaaacttttaatt

SEQ ID NO: 4067590 - DNA, 21 bp, Homo sapiens
agaattaaacttttaattcat

SEQ ID NO: 4067591 - DNA, 19 bp, Homo sapiens
agaattagtgccagaattt

SEQ ID NO: 4067592 - DNA, 11 bp, Homo sapiens
agaattattta

SEQ ID NO: 4067593 - DNA, 19 bp, Homo sapiens
agaattatttttaaaaaga

SEQ ID NO: 4067594 - DNA, 23 bp, Homo sapiens
agaattatttttaaaaagaaatc

SEQ ID NO: 4067595 - DNA, 18 bp, Homo sapiens
agaattcagaagacccct

SEQ ID NO: 4067596 - DNA, 14 bp, Homo sapiens
agaattccaaggag

SEQ ID NO: 4067597 - DNA, 18 bp, Homo sapiens
agaattctgtattggata

SEQ ID NO: 4067598 - DNA, 21 bp, Homo sapiens
agaattggagagtaaaaactg

SEQ ID NO: 4067599 - DNA, 17 bp, Homo sapiens
agaattgtttttgaatt

SEQ ID NO: 4067600 - DNA, 22 bp, Homo sapiens
agaattgtttttgaatttaaat

SEQ ID NO: 4067601 - DNA, 15 bp, Homo sapiens
agaatttaggttttt

SEQ ID NO: 4067602 - DNA, 14 bp, Homo sapiens
agaatttattcaat

SEQ ID NO: 4067603 - DNA, 15 bp, Homo sapiens
agaatttccactgta

SEQ ID NO: 4067604 - DNA, 16 bp, Homo sapiens
agaatttccactgtaa

SEQ ID NO: 4067605 - DNA, 17 bp, Homo sapiens
agaatttctaaaaagat

SEQ ID NO: 4067606 - DNA, 22 bp, Homo sapiens
agaattttaggaacttcagaga

SEQ ID NO: 4067607 - DNA, 12 bp, Homo sapiens
agaattttggaa

SEQ ID NO: 4067608 - DNA, 18 bp, Homo sapiens
agacaaaaagacaaacat

SEQ ID NO: 4067609 - DNA, 21 bp, Homo sapiens
agacaaaacaatccccatcag

SEQ ID NO: 4067610 - DNA, 22 bp, Homo sapiens
agacaaaagtctgtctttcctg

SEQ ID NO: 4067611 - DNA, 13 bp, Homo sapiens
agacaaaatttta

SEQ ID NO: 4067612 - DNA, 14 bp, Homo sapiens
agacaaatggagga

SEQ ID NO: 4067613 - DNA, 17 bp, Homo sapiens
agacaagaaatccctgt

SEQ ID NO: 4067614 - DNA, 22 bp, Homo sapiens
agacaagatattgtacataaaa

SEQ ID NO: 4067615 - DNA, 11 bp, Homo sapiens
agacaatatac

SEQ ID NO: 4067616 - DNA, 18 bp, Homo sapiens
agacaatatgtgagtgcc

SEQ ID NO: 4067617 - DNA, 21 bp, Homo sapiens
agacaatatgtgagtgccttt

SEQ ID NO: 4067618 - DNA, 17 bp, Homo sapiens
agacaatttgatacata

SEQ ID NO: 4067619 - DNA, 22 bp, Homo sapiens
agacaatttgatacataataaa

SEQ ID NO: 4067620 - DNA, 23 bp, Homo sapiens
agacaatttgatacataataaaa

SEQ ID NO: 4067621 - DNA, 13 bp, Homo sapiens
agacaatttgcac

SEQ ID NO: 4067622 - DNA, 18 bp, Homo sapiens
agacaatttgcacatctt

SEQ ID NO: 4067623 - DNA, 19 bp, Homo sapiens
agacacaatatgtatgctt

SEQ ID NO: 4067624 - DNA, 17 bp, Homo sapiens
agacctcatcaggatga

SEQ ID NO: 4067625 - DNA, 22 bp, Homo sapiens
agacctcatcaggatgaaccca

SEQ ID NO: 4067626 - DNA, 19 bp, Homo sapiens
agacctgacaagcactgct

SEQ ID NO: 4067627 - DNA, 14 bp, Homo sapiens
agacctgatcctgg

SEQ ID NO: 4067628 - DNA, 15 bp, Homo sapiens
agacctgatcctgga

SEQ ID NO: 4067629 - DNA, 19 bp, Homo sapiens
agacctgatcctggaggcc

SEQ ID NO: 4067630 - DNA, 23 bp, Homo sapiens
agacctgtcttccaaggagacca

SEQ ID NO: 4067631 - DNA, 22 bp, Homo sapiens
agacctgtgctagttttacaga

SEQ ID NO: 4067632 - DNA, 12 bp, Homo sapiens
agaccttttcaa

SEQ ID NO: 4067633 - DNA, 17 bp, Homo sapiens
agaccttttcaacttgg

SEQ ID NO: 4067634 - DNA, 13 bp, Homo sapiens
agacgatgtttat

SEQ ID NO: 4067635 - DNA, 17 bp, Homo sapiens
agacgatgtttatgttc

SEQ ID NO: 4067636 - DNA, 14 bp, Homo sapiens
agacgcaggaatgg

SEQ ID NO: 4067637 - DNA, 17 bp, Homo sapiens
agacgccactccctggg

SEQ ID NO: 4067638 - DNA, 15 bp, Homo sapiens
agacgcccagcccca

SEQ ID NO: 4067639 - DNA, 20 bp, Homo sapiens
agacgccggggacagaggcc

SEQ ID NO: 4067640 - DNA, 15 bp, Homo sapiens
agacgcctgagctca

SEQ ID NO: 4067641 - DNA, 16 bp, Homo sapiens
agacggaggggagtag

SEQ ID NO: 4067642 - DNA, 14 bp, Homo sapiens
agacggcggccagg

SEQ ID NO: 4067643 - DNA, 21 bp, Homo sapiens
agacggcggccaggcacaggg

SEQ ID NO: 4067644 - DNA, 11 bp, Homo sapiens
agacgggcaca

SEQ ID NO: 4067645 - DNA, 17 bp, Homo sapiens
agacgtcaggccctgac

SEQ ID NO: 4067646 - DNA, 22 bp, Homo sapiens
agactaaaggatccagagagca

SEQ ID NO: 4067647 - DNA, 15 bp, Homo sapiens
agactaagccctgtc

SEQ ID NO: 4067648 - DNA, 23 bp, Homo sapiens
agactagcaatctcttcattatt

SEQ ID NO: 4067649 - DNA, 22 bp, Homo sapiens
agactagtttttattccttgtg

SEQ ID NO: 4067650 - DNA, 17 bp, Homo sapiens
agactatctaaatgttg

SEQ ID NO: 4067651 - DNA, 19 bp, Homo sapiens
agactatctaaatgttgaa

SEQ ID NO: 4067652 - DNA, 14 bp, Homo sapiens
agactatggtgctg

SEQ ID NO: 4067653 - DNA, 17 bp, Homo sapiens
agactatttaaacttat

SEQ ID NO: 4067654 - DNA, 22 bp, Homo sapiens
agactatttaaacttataaatc

SEQ ID NO: 4067655 - DNA, 14 bp, Homo sapiens
agactcaaaaaaac

SEQ ID NO: 4067656 - DNA, 21 bp, Homo sapiens
agactcaagagaatttatgtg

SEQ ID NO: 4067657 - DNA, 22 bp, Homo sapiens
agactcaaggtggtcagtaaat

SEQ ID NO: 4067658 - DNA, 15 bp, Homo sapiens
agactcacaggaagg

SEQ ID NO: 4067659 - DNA, 22 bp, Homo sapiens
agactcacaggaaggaggagcc

SEQ ID NO: 4067660 - DNA, 18 bp, Homo sapiens
agactcacttacatcttc

SEQ ID NO: 4067661 - DNA, 23 bp, Homo sapiens
agactcaggccaagaaacgtctt

SEQ ID NO: 4067662 - DNA, 16 bp, Homo sapiens
agactccatctcttct

SEQ ID NO: 4067663 - DNA, 17 bp, Homo sapiens
agactccatctcttctg

SEQ ID NO: 4067664 - DNA, 16 bp, Homo sapiens
agactccgccctcctc

SEQ ID NO: 4067665 - DNA, 23 bp, Homo sapiens
agactctagacaagatattgtac

SEQ ID NO: 4067666 - DNA, 13 bp, Homo sapiens
agactgaatgttt

SEQ ID NO: 4067667 - DNA, 13 bp, Homo sapiens
agactgagcagcc

SEQ ID NO: 4067668 - DNA, 15 bp, Homo sapiens
agactgagcagccgc

SEQ ID NO: 4067669 - DNA, 16 bp, Homo sapiens
agactgcaaacttttt

SEQ ID NO: 4067670 - DNA, 13 bp, Homo sapiens
agactgcaagctg

SEQ ID NO: 4067671 - DNA, 16 bp, Homo sapiens
agactgcaagctgctt

SEQ ID NO: 4067672 - DNA, 21 bp, Homo sapiens
agactgccccacggagacaga

SEQ ID NO: 4067673 - DNA, 14 bp, Homo sapiens
agactggaagctaa

SEQ ID NO: 4067674 - DNA, 22 bp, Homo sapiens
agactgggaagataggctctgc

SEQ ID NO: 4067675 - DNA, 20 bp, Homo sapiens
agactgggagccacttctcc

SEQ ID NO: 4067676 - DNA, 22 bp, Homo sapiens
agactgggagccacttctcccc

SEQ ID NO: 4067677 - DNA, 14 bp, Homo sapiens
agactgtacaaagt

SEQ ID NO: 4067678 - DNA, 22 bp, Homo sapiens
agactgtgaacttgactgggtg

SEQ ID NO: 4067679 - DNA, 20 bp, Homo sapiens
agactgtgccagaggccaga

SEQ ID NO: 4067680 - DNA, 15 bp, Homo sapiens
agactgttgctcaaa

SEQ ID NO: 4067681 - DNA, 15 bp, Homo sapiens
agactgttgtgatct

SEQ ID NO: 4067682 - DNA, 15 bp, Homo sapiens
agacttactattaca

SEQ ID NO: 4067683 - DNA, 22 bp, Homo sapiens
agacttactgggtgaggaaatc

SEQ ID NO: 4067684 - DNA, 19 bp, Homo sapiens
agacttagtatattttctt

SEQ ID NO: 4067685 - DNA, 20 bp, Homo sapiens
agacttccaaacctgacaga

SEQ ID NO: 4067686 - DNA, 21 bp, Homo sapiens
agacttccaaacctgacagat

SEQ ID NO: 4067687 - DNA, 19 bp, Homo sapiens
agacttcccaacagcctta

SEQ ID NO: 4067688 - DNA, 16 bp, Homo sapiens
agacttccttgagaca

SEQ ID NO: 4067689 - DNA, 16 bp, Homo sapiens
agacttcgactcagga

SEQ ID NO: 4067690 - DNA, 15 bp, Homo sapiens
agacttgagaacttg

SEQ ID NO: 4067691 - DNA, 12 bp, Homo sapiens
agacttgccaac

SEQ ID NO: 4067692 - DNA, 22 bp, Homo sapiens
agacttggttggtagggtggga

SEQ ID NO: 4067693 - DNA, 12 bp, Homo sapiens
agactttagaaa

SEQ ID NO: 4067694 - DNA, 17 bp, Homo sapiens
agactttagaaataaat

SEQ ID NO: 4067695 - DNA, 18 bp, Homo sapiens
agactttagaaataaatg

SEQ ID NO: 4067696 - DNA, 18 bp, Homo sapiens
agactttagcttttcctt

SEQ ID NO: 4067697 - DNA, 16 bp, Homo sapiens
agagaaaaaaaaaata

SEQ ID NO: 4067698 - DNA, 13 bp, Homo sapiens
agagaaaaaagaa

SEQ ID NO: 4067699 - DNA, 17 bp, Homo sapiens
agagaaaaaagaagtgt

SEQ ID NO: 4067700 - DNA, 12 bp, Homo sapiens
agagaaacttta

SEQ ID NO: 4067701 - DNA, 21 bp, Homo sapiens
agagaaactttatacattagt

SEQ ID NO: 4067702 - DNA, 15 bp, Homo sapiens
agagaaagaaaatga

SEQ ID NO: 4067703 - DNA, 14 bp, Homo sapiens
agagaaagagagag

SEQ ID NO: 4067704 - DNA, 18 bp, Homo sapiens
agagaaagcacgtgtctc

SEQ ID NO: 4067705 - DNA, 18 bp, Homo sapiens
agagaaagtgatttctag

SEQ ID NO: 4067706 - DNA, 14 bp, Homo sapiens
agagaaatatggaa

SEQ ID NO: 4067707 - DNA, 13 bp, Homo sapiens
agagaaatccttc

SEQ ID NO: 4067708 - DNA, 20 bp, Homo sapiens
agagaagagggcccagccca

SEQ ID NO: 4067709 - DNA, 21 bp, Homo sapiens
agagaagagggcccagcccag

SEQ ID NO: 4067710 - DNA, 17 bp, Homo sapiens
agagaagcggatttcca

SEQ ID NO: 4067711 - DNA, 13 bp, Homo sapiens
agagaagctggac

SEQ ID NO: 4067712 - DNA, 15 bp, Homo sapiens
agagaagctggactt

SEQ ID NO: 4067713 - DNA, 18 bp, Homo sapiens
agagaagttctcaaagtt

SEQ ID NO: 4067714 - DNA, 15 bp, Homo sapiens
agagaatcatactta

SEQ ID NO: 4067715 - DNA, 22 bp, Homo sapiens
agagaatgaaattgctgaaaga

SEQ ID NO: 4067716 - DNA, 15 bp, Homo sapiens
agagacaggagggca

SEQ ID NO: 4067717 - DNA, 14 bp, Homo sapiens
agagacaggcagcc

SEQ ID NO: 4067718 - DNA, 21 bp, Homo sapiens
agagacaggcagcccagcagt

SEQ ID NO: 4067719 - DNA, 17 bp, Homo sapiens
agagacatacttgaagg

SEQ ID NO: 4067720 - DNA, 16 bp, Homo sapiens
agagacgcaggaatgg

SEQ ID NO: 4067721 - DNA, 15 bp, Homo sapiens
agagacgccactccc

SEQ ID NO: 4067722 - DNA, 19 bp, Homo sapiens
agagacgccactccctggg

SEQ ID NO: 4067723 - DNA, 17 bp, Homo sapiens
agagacgcccagcccca

SEQ ID NO: 4067724 - DNA, 23 bp, Homo sapiens
agagacgcccagccccatccctg

SEQ ID NO: 4067725 - DNA, 19 bp, Homo sapiens
agagactgcaagctgcttg

SEQ ID NO: 4067726 - DNA, 22 bp, Homo sapiens
agagactgggagccacttctcc

SEQ ID NO: 4067727 - DNA, 16 bp, Homo sapiens
agagtgagctacagag

SEQ ID NO: 4067728 - DNA, 15 bp, Homo sapiens
agagtgattgcagct

SEQ ID NO: 4067729 - DNA, 15 bp, Homo sapiens
agagtgcacagctgt

SEQ ID NO: 4067730 - DNA, 16 bp, Homo sapiens
agagtgccctgctttg

SEQ ID NO: 4067731 - DNA, 19 bp, Homo sapiens
agagtggagagaagctctt

SEQ ID NO: 4067732 - DNA, 20 bp, Homo sapiens
agagtggagagaagctcttc

SEQ ID NO: 4067733 - DNA, 12 bp, Homo sapiens
agagtggcccac

SEQ ID NO: 4067734 - DNA, 18 bp, Homo sapiens
agagtggcctccctgctg

SEQ ID NO: 4067735 - DNA, 13 bp, Homo sapiens
agagtggcctggc

SEQ ID NO: 4067736 - DNA, 13 bp, Homo sapiens
agagtggctcctc

SEQ ID NO: 4067737 - DNA, 15 bp, Homo sapiens
agagtggctcctccc

SEQ ID NO: 4067738 - DNA, 12 bp, Homo sapiens
agagtgtagaag

SEQ ID NO: 4067739 - DNA, 15 bp, Homo sapiens
agagtgtagaagcat

SEQ ID NO: 4067740 - DNA, 11 bp, Homo sapiens
agagtgtgtgt

SEQ ID NO: 4067741 - DNA, 12 bp, Homo sapiens
agagttaagaag

SEQ ID NO: 4067742 - DNA, 13 bp, Homo sapiens
agagttaagaagc

SEQ ID NO: 4067743 - DNA, 16 bp, Homo sapiens
agagttaagaagctgt

SEQ ID NO: 4067744 - DNA, 20 bp, Homo sapiens
agagttaagaagctgttgta

SEQ ID NO: 4067745 - DNA, 12 bp, Homo sapiens
agagttaagaat

SEQ ID NO: 4067746 - DNA, 16 bp, Homo sapiens
agagttcactataaat

SEQ ID NO: 4067747 - DNA, 15 bp, Homo sapiens
agagttcttaaagtt

SEQ ID NO: 4067748 - DNA, 18 bp, Homo sapiens
agagtttctgtttgattc

SEQ ID NO: 4067749 - DNA, 13 bp, Homo sapiens
agagtttgaagga

SEQ ID NO: 4067750 - DNA, 16 bp, Homo sapiens
agagttttatcaactt

SEQ ID NO: 4067751 - DNA, 14 bp, Homo sapiens
agataaaaagatgg

SEQ ID NO: 4067752 - DNA, 21 bp, Homo sapiens
agataaaaagatggcctttgc

SEQ ID NO: 4067753 - DNA, 22 bp, Homo sapiens
agataaaaggtggagtttctct

SEQ ID NO: 4067754 - DNA, 14 bp, Homo sapiens
agataaataatgta

SEQ ID NO: 4067755 - DNA, 12 bp, Homo sapiens
agataaatgtgc

SEQ ID NO: 4067756 - DNA, 18 bp, Homo sapiens
agataacaagatctttca

SEQ ID NO: 4067757 - DNA, 13 bp, Homo sapiens
agataactaggaa

SEQ ID NO: 4067758 - DNA, 22 bp, Homo sapiens
agataagaatgctggttttcct

SEQ ID NO: 4067759 - DNA, 12 bp, Homo sapiens
agataagacata

SEQ ID NO: 4067760 - DNA, 13 bp, Homo sapiens
agataagcaagag

SEQ ID NO: 4067761 - DNA, 17 bp, Homo sapiens
agataagcaagagagat

SEQ ID NO: 4067762 - DNA, 20 bp, Homo sapiens
agataagcaagagagatgtt

SEQ ID NO: 4067763 - DNA, 19 bp, Homo sapiens
agataatatctgtgaggtg

SEQ ID NO: 4067764 - DNA, 13 bp, Homo sapiens
agataattcttaa

SEQ ID NO: 4067765 - DNA, 18 bp, Homo sapiens
agataattgctatttatt

SEQ ID NO: 4067766 - DNA, 18 bp, Homo sapiens
agatacatatgagtgtgg

SEQ ID NO: 4067767 - DNA, 13 bp, Homo sapiens
agatacatcactg

SEQ ID NO: 4067768 - DNA, 23 bp, Homo sapiens
agataccctacgctgtccagaaa

SEQ ID NO: 4067769 - DNA, 22 bp, Homo sapiens
agataccggtgcttctggaaac

SEQ ID NO: 4067770 - DNA, 23 bp, Homo sapiens
agataccggtgcttctggaaact

SEQ ID NO: 4067771 - DNA, 13 bp, Homo sapiens
agatacctcaccc

SEQ ID NO: 4067772 - DNA, 14 bp, Homo sapiens
agatacctcaccct

SEQ ID NO: 4067773 - DNA, 18 bp, Homo sapiens
agataccttgaaaggaag

SEQ ID NO: 4067774 - DNA, 16 bp, Homo sapiens
agatacgactttattt

SEQ ID NO: 4067775 - DNA, 19 bp, Homo sapiens
agatactggaagttttgca

SEQ ID NO: 4067776 - DNA, 17 bp, Homo sapiens
agatacttatttttctg

SEQ ID NO: 4067777 - DNA, 22 bp, Homo sapiens
agatagaaataaatagctatat

SEQ ID NO: 4067778 - DNA, 12 bp, Homo sapiens
agatagagaaat

SEQ ID NO: 4067779 - DNA, 20 bp, Homo sapiens
agatagagaaatagtgacaa

SEQ ID NO: 4067780 - DNA, 21 bp, Homo sapiens
agatagctgcatgtggctttt

SEQ ID NO: 4067781 - DNA, 16 bp, Homo sapiens
agataggaaactgaag

SEQ ID NO: 4067782 - DNA, 21 bp, Homo sapiens
agataggctctgcacagatgg

SEQ ID NO: 4067783 - DNA, 22 bp, Homo sapiens
agataggctctgcacagatgga

SEQ ID NO: 4067784 - DNA, 19 bp, Homo sapiens
agatagtgtaacttgctta

SEQ ID NO: 4067785 - DNA, 17 bp, Homo sapiens
agatataaatggctggt

SEQ ID NO: 4067786 - DNA, 16 bp, Homo sapiens
agatataacattcagt

SEQ ID NO: 4067787 - DNA, 17 bp, Homo sapiens
agatatatctgaaaact

SEQ ID NO: 4067788 - DNA, 18 bp, Homo sapiens
agatatatctgaaaactg

SEQ ID NO: 4067789 - DNA, 21 bp, Homo sapiens
agatatatttaagccttataa

SEQ ID NO: 4067790 - DNA, 14 bp, Homo sapiens
agatatatttcact

SEQ ID NO: 4067791 - DNA, 22 bp, Homo sapiens
agatatatttcacttttgttct

SEQ ID NO: 4067792 - DNA, 14 bp, Homo sapiens
agatatccatcttt

SEQ ID NO: 4067793 - DNA, 15 bp, Homo sapiens
agatatccatctttt

SEQ ID NO: 4067794 - DNA, 20 bp, Homo sapiens
agatatcctctccccctcct

SEQ ID NO: 4067795 - DNA, 17 bp, Homo sapiens
agatatgatatgtaaac

SEQ ID NO: 4067796 - DNA, 23 bp, Homo sapiens
agatatggagtgagtcacctgct

SEQ ID NO: 4067797 - DNA, 15 bp, Homo sapiens
agatattgtacataa

SEQ ID NO: 4067798 - DNA, 18 bp, Homo sapiens
agatattgtacataaaag

SEQ ID NO: 4067799 - DNA, 19 bp, Homo sapiens
agatattgtgaagtacata

SEQ ID NO: 4067800 - DNA, 23 bp, Homo sapiens
agatattgttttctgtaaataac

SEQ ID NO: 4067801 - DNA, 20 bp, Homo sapiens
agatatttatatttttattt

SEQ ID NO: 4067802 - DNA, 23 bp, Homo sapiens
agatatttatatttttattttat

SEQ ID NO: 4067803 - DNA, 16 bp, Homo sapiens
agatatttccatttct

SEQ ID NO: 4067804 - DNA, 23 bp, Homo sapiens
agatatttccatttcttcctcac

SEQ ID NO: 4067805 - DNA, 21 bp, Homo sapiens
agatattttcacaatgtcagt

SEQ ID NO: 4067806 - DNA, 22 bp, Homo sapiens
agatattttttcagaaatatgt

SEQ ID NO: 4067807 - DNA, 16 bp, Homo sapiens
agatcaaaataaaaag

SEQ ID NO: 4067808 - DNA, 17 bp, Homo sapiens
agatcaaagtatgtatg

SEQ ID NO: 4067809 - DNA, 20 bp, Homo sapiens
agatcaaatactttaaagga

SEQ ID NO: 4067810 - DNA, 16 bp, Homo sapiens
agatcaagtgggcctt

SEQ ID NO: 4067811 - DNA, 15 bp, Homo sapiens
agatcaattccctct

SEQ ID NO: 4067812 - DNA, 16 bp, Homo sapiens
agatcacagcctccag

SEQ ID NO: 4067813 - DNA, 18 bp, Homo sapiens
agatcacagcctccaggg

SEQ ID NO: 4067814 - DNA, 16 bp, Homo sapiens
agatcaccagcccggc

SEQ ID NO: 4067815 - DNA, 21 bp, Homo sapiens
agatcaccagcccggcctgct

SEQ ID NO: 4067816 - DNA, 12 bp, Homo sapiens
agatcagccaga

SEQ ID NO: 4067817 - DNA, 14 bp, Homo sapiens
agatcagccagaag

SEQ ID NO: 4067818 - DNA, 15 bp, Homo sapiens
agatcagtgtaccat

SEQ ID NO: 4067819 - DNA, 18 bp, Homo sapiens
agatcagtgtaccatttg

SEQ ID NO: 4067820 - DNA, 21 bp, Homo sapiens
agatccaaaagaagcccccag

SEQ ID NO: 4067821 - DNA, 14 bp, Homo sapiens
agatccagcctggg

SEQ ID NO: 4067822 - DNA, 19 bp, Homo sapiens
agatccagggacagaggcc

SEQ ID NO: 4067823 - DNA, 20 bp, Homo sapiens
agatcccatccatcagctcc

SEQ ID NO: 4067824 - DNA, 16 bp, Homo sapiens
agatccccagggcagc

SEQ ID NO: 4067825 - DNA, 17 bp, Homo sapiens
agatccccgttcctgac

SEQ ID NO: 4067826 - DNA, 19 bp, Homo sapiens
agatccttcgggtgctgga

SEQ ID NO: 4067827 - DNA, 20 bp, Homo sapiens
agatcctttttccatcattt

SEQ ID NO: 4067828 - DNA, 23 bp, Homo sapiens
agatcctttttccatcattttac

SEQ ID NO: 4067829 - DNA, 18 bp, Homo sapiens
agatcgagaccatcctgg

SEQ ID NO: 4067830 - DNA, 20 bp, Homo sapiens
agattaccctcaaatgctag

SEQ ID NO: 4067831 - DNA, 22 bp, Homo sapiens
agattagatgtgccaataacca

SEQ ID NO: 4067832 - DNA, 23 bp, Homo sapiens
agattagatgtgccaataaccaa

SEQ ID NO: 4067833 - DNA, 14 bp, Homo sapiens
agattaggtagact

SEQ ID NO: 4067834 - DNA, 20 bp, Homo sapiens
agattatggagcttttttcc

SEQ ID NO: 4067835 - DNA, 18 bp, Homo sapiens
agattattggctgctttg

SEQ ID NO: 4067836 - DNA, 17 bp, Homo sapiens
agattcaagtagttttg

SEQ ID NO: 4067837 - DNA, 16 bp, Homo sapiens
agattcaggccagccc

SEQ ID NO: 4067838 - DNA, 17 bp, Homo sapiens
agattcaggccagccca

SEQ ID NO: 4067839 - DNA, 21 bp, Homo sapiens
agattccagagagtggctcct

SEQ ID NO: 4067840 - DNA, 15 bp, Homo sapiens
agattcctctgtatt

SEQ ID NO: 4067841 - DNA, 16 bp, Homo sapiens
agattcgctttccatg

SEQ ID NO: 4067842 - DNA, 22 bp, Homo sapiens
agattcttgtatttattacaac

SEQ ID NO: 4067843 - DNA, 17 bp, Homo sapiens
agattgacgacaagtgc

SEQ ID NO: 4067844 - DNA, 16 bp, Homo sapiens
agattgcagaaaattc

SEQ ID NO: 4067845 - DNA, 17 bp, Homo sapiens
agattgcttctgtagta

SEQ ID NO: 4067846 - DNA, 16 bp, Homo sapiens
agattggagctgaaga

SEQ ID NO: 4067847 - DNA, 19 bp, Homo sapiens
agattggagctgaagacct

SEQ ID NO: 4067848 - DNA, 13 bp, Homo sapiens
agattgtcttgca

SEQ ID NO: 4067849 - DNA, 18 bp, Homo sapiens
agattgtgaatatttcca

SEQ ID NO: 4067850 - DNA, 21 bp, Homo sapiens
agattgtgtaacaattttaat

SEQ ID NO: 4067851 - DNA, 20 bp, Homo sapiens
agatttaagcacaaacttta

SEQ ID NO: 4067852 - DNA, 19 bp, Homo sapiens
agatttagtgtaataagac

SEQ ID NO: 4067853 - DNA, 19 bp, Homo sapiens
agatttcatagttcagaat

SEQ ID NO: 4067854 - DNA, 13 bp, Homo sapiens
agatttctggttg

SEQ ID NO: 4067855 - DNA, 16 bp, Homo sapiens
agatttctggttgatt

SEQ ID NO: 4067856 - DNA, 16 bp, Homo sapiens
agatttggagcactct

SEQ ID NO: 4067857 - DNA, 15 bp, Homo sapiens
agatttgtctaattg

SEQ ID NO: 4067858 - DNA, 13 bp, Homo sapiens
agattttaaattc

SEQ ID NO: 4067859 - DNA, 22 bp, Homo sapiens
agattttaaattcacaatagaa

SEQ ID NO: 4067860 - DNA, 15 bp, Homo sapiens
agattttaggtgttg

SEQ ID NO: 4067861 - DNA, 13 bp, Homo sapiens
agattttattgta

SEQ ID NO: 4067862 - DNA, 15 bp, Homo sapiens
agattttattgtata

SEQ ID NO: 4067863 - DNA, 15 bp, Homo sapiens
agattttattttact

SEQ ID NO: 4067864 - DNA, 12 bp, Homo sapiens
agattttcagaa

SEQ ID NO: 4067865 - DNA, 20 bp, Homo sapiens
agattttcctcttgtgattt

SEQ ID NO: 4067866 - DNA, 21 bp, Homo sapiens
agattttgaaatttttattaa

SEQ ID NO: 4067867 - DNA, 14 bp, Homo sapiens
agattttgaatgct

SEQ ID NO: 4067868 - DNA, 16 bp, Homo sapiens
agatttttaagaactt

SEQ ID NO: 4067869 - DNA, 13 bp, Homo sapiens
agatttttacaaa

SEQ ID NO: 4067870 - DNA, 21 bp, Homo sapiens
agatttttcggaggccccact

SEQ ID NO: 4067871 - DNA, 22 bp, Homo sapiens
agattttttattgctagtattt

SEQ ID NO: 4067872 - DNA, 15 bp, Homo sapiens
agatttttttcctga

SEQ ID NO: 4067873 - DNA, 14 bp, Homo sapiens
agatttttttgtgt

SEQ ID NO: 4067874 - DNA, 16 bp, Homo sapiens
agatttttttgtgtat

SEQ ID NO: 4067875 - DNA, 20 bp, Homo sapiens
agcaaaaaatgaatgtctaa

SEQ ID NO: 4067876 - DNA, 20 bp, Homo sapiens
agcaaaataaggaagagggc

SEQ ID NO: 4067877 - DNA, 24 bp, Homo sapiens
agcaaaatatgccccttcttgggc

SEQ ID NO: 4067878 - DNA, 23 bp, Homo sapiens
agcaaaccatttttaaagtagaa

SEQ ID NO: 4067879 - DNA, 22 bp, Homo sapiens
agcaaagaaggccagcaacatt

SEQ ID NO: 4067880 - DNA, 15 bp, Homo sapiens
agcaaagcaccagct

SEQ ID NO: 4067881 - DNA, 19 bp, Homo sapiens
agcaaatctacagatcctt

SEQ ID NO: 4067882 - DNA, 21 bp, Homo sapiens
agcaaatgcattctatcgtta

SEQ ID NO: 4067883 - DNA, 11 bp, Homo sapiens
agcaaattgat

SEQ ID NO: 4067884 - DNA, 23 bp, Homo sapiens
agcaacaacaattggtaaaactc

SEQ ID NO: 4067885 - DNA, 18 bp, Homo sapiens
agcaacacaagctggaag

SEQ ID NO: 4067886 - DNA, 22 bp, Homo sapiens
agcaacacagaggaatttatac

SEQ ID NO: 4067887 - DNA, 21 bp, Homo sapiens
agcaacaggaatcaagagctg

SEQ ID NO: 4067888 - DNA, 19 bp, Homo sapiens
agcaacaggttttataatt

SEQ ID NO: 4067889 - DNA, 18 bp, Homo sapiens
agcaaccggtggatcctc

SEQ ID NO: 4067890 - DNA, 20 bp, Homo sapiens
agcaacgcccctccaaacct

SEQ ID NO: 4067891 - DNA, 14 bp, Homo sapiens
agcaactcttgatt

SEQ ID NO: 4067892 - DNA, 16 bp, Homo sapiens
agcaactcttgattat

SEQ ID NO: 4067893 - DNA, 20 bp, Homo sapiens
agcaactcttgattatccat

SEQ ID NO: 4067894 - DNA, 20 bp, Homo sapiens
agcaacttttgtgtaatgaa

SEQ ID NO: 4067895 - DNA, 11 bp, Homo sapiens
agcaagaaata

SEQ ID NO: 4067896 - DNA, 16 bp, Homo sapiens
agcaagactgttgctc

SEQ ID NO: 4067897 - DNA, 18 bp, Homo sapiens
agcaagagagcagcaagg

SEQ ID NO: 4067898 - DNA, 17 bp, Homo sapiens
agcaagagctggcaaag

SEQ ID NO: 4067899 - DNA, 16 bp, Homo sapiens
agcaagatcttgtctc

SEQ ID NO: 4067900 - DNA, 16 bp, Homo sapiens
agcaagcaacacagag

SEQ ID NO: 4067901 - DNA, 11 bp, Homo sapiens
agcaagccaga

SEQ ID NO: 4067902 - DNA, 19 bp, Homo sapiens
agcaagccctacagagctg

SEQ ID NO: 4067903 - DNA, 16 bp, Homo sapiens
agcaagctggcctcta

SEQ ID NO: 4067904 - DNA, 22 bp, Homo sapiens
agcaagcttttacaacagtgct

SEQ ID NO: 4067905 - DNA, 16 bp, Homo sapiens
agcaaggacattgccc

SEQ ID NO: 4067906 - DNA, 15 bp, Homo sapiens
agcaaggccctgctg

SEQ ID NO: 4067907 - DNA, 19 bp, Homo sapiens
agcaaggccctgctgccca

SEQ ID NO: 4067908 - DNA, 21 bp, Homo sapiens
agcaagggagaaaagagaaac

SEQ ID NO: 4067909 - DNA, 20 bp, Homo sapiens
agcaagtacagcggctcccc

SEQ ID NO: 4067910 - DNA, 22 bp, Homo sapiens
agcaagtacagcggctcccctc

SEQ ID NO: 4067911 - DNA, 15 bp, Homo sapiens
agcaagtagataaat

SEQ ID NO: 4067912 - DNA, 20 bp, Homo sapiens
agcaagtcttaacaaaccaa

SEQ ID NO: 4067913 - DNA, 19 bp, Homo sapiens
agcaagtgtgcactccagc

SEQ ID NO: 4067914 - DNA, 23 bp, Homo sapiens
agcaagttctagagaagaggctg

SEQ ID NO: 4067915 - DNA, 14 bp, Homo sapiens
agcaataagaaatg

SEQ ID NO: 4067916 - DNA, 15 bp, Homo sapiens
agcaataagaaatga

SEQ ID NO: 4067917 - DNA, 22 bp, Homo sapiens
agcaatatttatggatgcaaca

SEQ ID NO: 4067918 - DNA, 17 bp, Homo sapiens
agcaatccacctgcctt

SEQ ID NO: 4067919 - DNA, 13 bp, Homo sapiens
agcaatcctcctg

SEQ ID NO: 4067920 - DNA, 14 bp, Homo sapiens
agcaatcctcctgc

SEQ ID NO: 4067921 - DNA, 17 bp, Homo sapiens
agcaatcctcctgcctc

SEQ ID NO: 4067922 - DNA, 21 bp, Homo sapiens
agcaatcctcctgcctcagcc

SEQ ID NO: 4067923 - DNA, 22 bp, Homo sapiens
agcaatcctcctgcctcagcct

SEQ ID NO: 4067924 - DNA, 20 bp, Homo sapiens
agcaatctgattcagcatca

SEQ ID NO: 4067925 - DNA, 20 bp, Homo sapiens
agcaatgacatctcaggggc

SEQ ID NO: 4067926 - DNA, 18 bp, Homo sapiens
agcaatgatgtccagaag

SEQ ID NO: 4067927 - DNA, 23 bp, Homo sapiens
agcaatgccatttcagtggcttc

SEQ ID NO: 4067928 - DNA, 20 bp, Homo sapiens
agcaatgggactggagtcag

SEQ ID NO: 4067929 - DNA, 21 bp, Homo sapiens
agcaatgggactggagtcaga

SEQ ID NO: 4067930 - DNA, 13 bp, Homo sapiens
agcaatttaaatg

SEQ ID NO: 4067931 - DNA, 16 bp, Homo sapiens
agcaatttaaatgtta

SEQ ID NO: 4067932 - DNA, 18 bp, Homo sapiens
agcagcccaagcttccct

SEQ ID NO: 4067933 - DNA, 19 bp, Homo sapiens
agcagcccaagcttccctc

SEQ ID NO: 4067934 - DNA, 21 bp, Homo sapiens
agcagcccaagcttccctcca

SEQ ID NO: 4067935 - DNA, 21 bp, Homo sapiens
agcagccctcaacaggcccag

SEQ ID NO: 4067936 - DNA, 20 bp, Homo sapiens
agcagccgccttaagctgat

SEQ ID NO: 4067937 - DNA, 12 bp, Homo sapiens
agcagcctcaga

SEQ ID NO: 4067938 - DNA, 16 bp, Homo sapiens
agcagcctcagagtgg

SEQ ID NO: 4067939 - DNA, 20 bp, Homo sapiens
agcagcctcagagtggtcga

SEQ ID NO: 4067940 - DNA, 14 bp, Homo sapiens
agcagcctccttat

SEQ ID NO: 4067941 - DNA, 12 bp, Homo sapiens
agcagcctctgg

SEQ ID NO: 4067942 - DNA, 16 bp, Homo sapiens
agcagcctctggacag

SEQ ID NO: 4067943 - DNA, 23 bp, Homo sapiens
agcagcctgagcaactcttgatt

SEQ ID NO: 4067944 - DNA, 18 bp, Homo sapiens
agcagcgaccgccccctc

SEQ ID NO: 4067945 - DNA, 17 bp, Homo sapiens
agcagcggtttggggag

SEQ ID NO: 4067946 - DNA, 22 bp, Homo sapiens
agcagcggtttggggagcagag

SEQ ID NO: 4067947 - DNA, 17 bp, Homo sapiens
agcagctaaattttctg

SEQ ID NO: 4067948 - DNA, 16 bp, Homo sapiens
agcagctccccaggag

SEQ ID NO: 4067949 - DNA, 19 bp, Homo sapiens
agcagctccccaggagctc

SEQ ID NO: 4067950 - DNA, 21 bp, Homo sapiens
agcagctccccaggagctcag

SEQ ID NO: 4067951 - DNA, 18 bp, Homo sapiens
agcagctccctttctcag

SEQ ID NO: 4067952 - DNA, 18 bp, Homo sapiens
agcagctgaacagccaaa

SEQ ID NO: 4067953 - DNA, 20 bp, Homo sapiens
agcagctttaaactcaggga

SEQ ID NO: 4067954 - DNA, 22 bp, Homo sapiens
agcaggaagcattcagagagca

SEQ ID NO: 4067955 - DNA, 18 bp, Homo sapiens
agcaggaagccaggctga

SEQ ID NO: 4067956 - DNA, 22 bp, Homo sapiens
agcaggaaggacaggaagctgg

SEQ ID NO: 4067957 - DNA, 17 bp, Homo sapiens
agcaggacctggcatca

SEQ ID NO: 4067958 - DNA, 14 bp, Homo sapiens
agcaggactccagg

SEQ ID NO: 4067959 - DNA, 23 bp, Homo sapiens
agcaggactccaggcccaaggct

SEQ ID NO: 4067960 - DNA, 10 bp, Homo sapiens
agcaggaggc

SEQ ID NO: 4067961 - DNA, 14 bp, Homo sapiens
agcaggaggccaat

SEQ ID NO: 4067962 - DNA, 15 bp, Homo sapiens
agcaggaggccaata

SEQ ID NO: 4067963 - DNA, 15 bp, Homo sapiens
agcaggaggctggga

SEQ ID NO: 4067964 - DNA, 20 bp, Homo sapiens
agcaggagtggtgcagacag

SEQ ID NO: 4067965 - DNA, 15 bp, Homo sapiens
agcaggcaccgccac

SEQ ID NO: 4067966 - DNA, 16 bp, Homo sapiens
agcaggcaccgccacg

SEQ ID NO: 4067967 - DNA, 23 bp, Homo sapiens
agcaggcaccgccacgtcccagc

SEQ ID NO: 4067968 - DNA, 13 bp, Homo sapiens
agcaggcactgta

SEQ ID NO: 4067969 - DNA, 11 bp, Homo sapiens
agcaggcagcc

SEQ ID NO: 4067970 - DNA, 19 bp, Homo sapiens
agcaggccggaaccacagg

SEQ ID NO: 4067971 - DNA, 21 bp, Homo sapiens
agcaggccggaaccacagggc

SEQ ID NO: 4067972 - DNA, 23 bp, Homo sapiens
agcaggccggaaccacagggcca

SEQ ID NO: 4067973 - DNA, 13 bp, Homo sapiens
agcaggctgttcc

SEQ ID NO: 4067974 - DNA, 14 bp, Homo sapiens
agcaggctgttcca

SEQ ID NO: 4067975 - DNA, 15 bp, Homo sapiens
agcagggaaggcctg

SEQ ID NO: 4067976 - DNA, 16 bp, Homo sapiens
agcagggaaggcctga

SEQ ID NO: 4067977 - DNA, 21 bp, Homo sapiens
agcagggattaacctctgcac

SEQ ID NO: 4067978 - DNA, 20 bp, Homo sapiens
agcagggggagaaacccttc

SEQ ID NO: 4067979 - DNA, 22 bp, Homo sapiens
agcagggggagaaacccttcac

SEQ ID NO: 4067980 - DNA, 21 bp, Homo sapiens
agcagggtagtctggtttcta

SEQ ID NO: 4067981 - DNA, 17 bp, Homo sapiens
agcaggtgggaaatggt

SEQ ID NO: 4067982 - DNA, 17 bp, Homo sapiens
agcaggttcccaagctc

SEQ ID NO: 4067983 - DNA, 18 bp, Homo sapiens
agcaggttcccaagctca

SEQ ID NO: 4067984 - DNA, 15 bp, Homo sapiens
agcagtaaaaactgt

SEQ ID NO: 4067985 - DNA, 14 bp, Homo sapiens
agcagtcacactgt

SEQ ID NO: 4067986 - DNA, 19 bp, Homo sapiens
agcagtcagagtccagtgc

SEQ ID NO: 4067987 - DNA, 21 bp, Homo sapiens
agcagtcccagtattctcaga

SEQ ID NO: 4067988 - DNA, 14 bp, Homo sapiens
agcagtcctcttat

SEQ ID NO: 4067989 - DNA, 19 bp, Homo sapiens
agcagtcctcttattccta

SEQ ID NO: 4067990 - DNA, 19 bp, Homo sapiens
agcagtcctgcctcagcct

SEQ ID NO: 4067991 - DNA, 14 bp, Homo sapiens
agcagtcgcctgcc

SEQ ID NO: 4067992 - DNA, 23 bp, Homo sapiens
agcagtcgcctgcctgcagcagg

SEQ ID NO: 4067993 - DNA, 22 bp, Homo sapiens
agcagtcgtggctttggcagtg

SEQ ID NO: 4067994 - DNA, 23 bp, Homo sapiens
agcagtctcactgcagtcttatt

SEQ ID NO: 4067995 - DNA, 13 bp, Homo sapiens
agcagtcttgctc

SEQ ID NO: 4067996 - DNA, 16 bp, Homo sapiens
agcagtgagaaaaagc

SEQ ID NO: 4067997 - DNA, 22 bp, Homo sapiens
agcagtgagaaaaagctcctgt

SEQ ID NO: 4067998 - DNA, 16 bp, Homo sapiens
agcagtgagagcagat

SEQ ID NO: 4067999 - DNA, 13 bp, Homo sapiens
agcagtgatctca

SEQ ID NO: 4068000 - DNA, 16 bp, Homo sapiens
agcagtgccttccata

SEQ ID NO: 4068001 - DNA, 22 bp, Homo sapiens
agcagtggcctttttctgagat

SEQ ID NO: 4068002 - DNA, 12 bp, Homo sapiens
agcagtggctgg

SEQ ID NO: 4068003 - DNA, 16 bp, Homo sapiens
agcagtggctggtcca

SEQ ID NO: 4068004 - DNA, 18 bp, Homo sapiens
agcagtggctggtccagg

SEQ ID NO: 4068005 - DNA, 19 bp, Homo sapiens
agcagtggctggtccaggg

SEQ ID NO: 4068006 - DNA, 21 bp, Homo sapiens
agcagtggctggtccagggct

SEQ ID NO: 4068007 - DNA, 13 bp, Homo sapiens
agcagtgtcatca

SEQ ID NO: 4068008 - DNA, 15 bp, Homo sapiens
agcagtgtcatcaga

SEQ ID NO: 4068009 - DNA, 15 bp, Homo sapiens
agcagtgtcttccat

SEQ ID NO: 4068010 - DNA, 16 bp, Homo sapiens
agcagtgtcttccata

SEQ ID NO: 4068011 - DNA, 22 bp, Homo sapiens
agcagtgtgaatagcctggcca

SEQ ID NO: 4068012 - DNA, 23 bp, Homo sapiens
agcagtgtgaatagcctggccac

SEQ ID NO: 4068013 - DNA, 17 bp, Homo sapiens
agcagtgttgctcagct

SEQ ID NO: 4068014 - DNA, 15 bp, Homo sapiens
agcagttaactttaa

SEQ ID NO: 4068015 - DNA, 14 bp, Homo sapiens
agcagtttgctttg

SEQ ID NO: 4068016 - DNA, 21 bp, Homo sapiens
agcagttttcaagtcaaatta

SEQ ID NO: 4068017 - DNA, 13 bp, Homo sapiens
agcataaaaacat

SEQ ID NO: 4068018 - DNA, 21 bp, Homo sapiens
agcataaaaacattttaaaaa

SEQ ID NO: 4068019 - DNA, 22 bp, Homo sapiens
agcataaatcacttcaactgct

SEQ ID NO: 4068020 - DNA, 14 bp, Homo sapiens
agcataaatgcaaa

SEQ ID NO: 4068021 - DNA, 13 bp, Homo sapiens
agcatacatttat

SEQ ID NO: 4068022 - DNA, 20 bp, Homo sapiens
agcatagcttattattgaag

SEQ ID NO: 4068023 - DNA, 15 bp, Homo sapiens
agcatattttctcta

SEQ ID NO: 4068024 - DNA, 22 bp, Homo sapiens
agcatcactccccaaggaagag

SEQ ID NO: 4068025 - DNA, 20 bp, Homo sapiens
agcatccaccttggctctgc

SEQ ID NO: 4068026 - DNA, 12 bp, Homo sapiens
agcatccctgga

SEQ ID NO: 4068027 - DNA, 20 bp, Homo sapiens
agcatccctggagcaggagc

SEQ ID NO: 4068028 - DNA, 21 bp, Homo sapiens
agcatccctggagcaggagcc

SEQ ID NO: 4068029 - DNA, 20 bp, Homo sapiens
agcatcccttcccacatgcc

SEQ ID NO: 4068030 - DNA, 16 bp, Homo sapiens
agcatccgcaggtgct

SEQ ID NO: 4068031 - DNA, 15 bp, Homo sapiens
agcatcctaagaaat

SEQ ID NO: 4068032 - DNA, 21 bp, Homo sapiens
agcatcctaagaaatatgtga

SEQ ID NO: 4068033 - DNA, 20 bp, Homo sapiens
agcatcgggagcacccagag

SEQ ID NO: 4068034 - DNA, 17 bp, Homo sapiens
agccacttcggccaggt

SEQ ID NO: 4068035 - DNA, 22 bp, Homo sapiens
agccacttcggccaggtcacac

SEQ ID NO: 4068036 - DNA, 18 bp, Homo sapiens
agccagaactctgtgtcc

SEQ ID NO: 4068037 - DNA, 12 bp, Homo sapiens
agccagagcccc

SEQ ID NO: 4068038 - DNA, 14 bp, Homo sapiens
agccagagccccaa

SEQ ID NO: 4068039 - DNA, 15 bp, Homo sapiens
agccagagccccaag

SEQ ID NO: 4068040 - DNA, 16 bp, Homo sapiens
agccagagctgggtgg

SEQ ID NO: 4068041 - DNA, 22 bp, Homo sapiens
agccagaggagggcagagggag

SEQ ID NO: 4068042 - DNA, 14 bp, Homo sapiens
agccagatcctctt

SEQ ID NO: 4068043 - DNA, 22 bp, Homo sapiens
agccagcaatgatgtccagaag

SEQ ID NO: 4068044 - DNA, 18 bp, Homo sapiens
agccagcacacagggcag

SEQ ID NO: 4068045 - DNA, 22 bp, Homo sapiens
agccagcagagggggagtagcc

SEQ ID NO: 4068046 - DNA, 14 bp, Homo sapiens
agccagccgccctg

SEQ ID NO: 4068047 - DNA, 17 bp, Homo sapiens
agccagccgccctgggc

SEQ ID NO: 4068048 - DNA, 23 bp, Homo sapiens
agccagcctgaccttccttcctg

SEQ ID NO: 4068049 - DNA, 15 bp, Homo sapiens
agccagctcacagtg

SEQ ID NO: 4068050 - DNA, 14 bp, Homo sapiens
agccagctccctct

SEQ ID NO: 4068051 - DNA, 19 bp, Homo sapiens
agccagctccctctattta

SEQ ID NO: 4068052 - DNA, 13 bp, Homo sapiens
agccagctgcttt

SEQ ID NO: 4068053 - DNA, 19 bp, Homo sapiens
agccaggaatttcccagga

SEQ ID NO: 4068054 - DNA, 22 bp, Homo sapiens
agccaggaatttcccaggaccc

SEQ ID NO: 4068055 - DNA, 23 bp, Homo sapiens
agccaggaatttcccaggaccct

SEQ ID NO: 4068056 - DNA, 13 bp, Homo sapiens
agccaggagcaga

SEQ ID NO: 4068057 - DNA, 14 bp, Homo sapiens
agccaggagctgtc

SEQ ID NO: 4068058 - DNA, 14 bp, Homo sapiens
agccaggatcatgg

SEQ ID NO: 4068059 - DNA, 23 bp, Homo sapiens
agccaggatcatggtgtaataag

SEQ ID NO: 4068060 - DNA, 17 bp, Homo sapiens
agccaggcctggctgga

SEQ ID NO: 4068061 - DNA, 19 bp, Homo sapiens
agccaggcgctagcacagc

SEQ ID NO: 4068062 - DNA, 20 bp, Homo sapiens
agccaggctgccaaggccag

SEQ ID NO: 4068063 - DNA, 21 bp, Homo sapiens
agccaggctgccaaggccaga

SEQ ID NO: 4068064 - DNA, 11 bp, Homo sapiens
agccagggcca

SEQ ID NO: 4068065 - DNA, 13 bp, Homo sapiens
agccagggccagg

SEQ ID NO: 4068066 - DNA, 14 bp, Homo sapiens
agccagggccaggg

SEQ ID NO: 4068067 - DNA, 20 bp, Homo sapiens
agccagggggatgccactcc

SEQ ID NO: 4068068 - DNA, 18 bp, Homo sapiens
agccagggtctctccctc

SEQ ID NO: 4068069 - DNA, 22 bp, Homo sapiens
agccagggtctctccctcaggt

SEQ ID NO: 4068070 - DNA, 19 bp, Homo sapiens
agccaggtatggctctgca

SEQ ID NO: 4068071 - DNA, 17 bp, Homo sapiens
agccaggtttagcggca

SEQ ID NO: 4068072 - DNA, 21 bp, Homo sapiens
agccagtgaaatgtgaaggaa

SEQ ID NO: 4068073 - DNA, 14 bp, Homo sapiens
agccagttgtccta

SEQ ID NO: 4068074 - DNA, 22 bp, Homo sapiens
agccagtttgggtaaaatactt

SEQ ID NO: 4068075 - DNA, 16 bp, Homo sapiens
agccagttttcatttt

SEQ ID NO: 4068076 - DNA, 16 bp, Homo sapiens
agccatacttatctct

SEQ ID NO: 4068077 - DNA, 22 bp, Homo sapiens
agccatacttatctctctgtgc

SEQ ID NO: 4068078 - DNA, 21 bp, Homo sapiens
agccatagaccctgaggccct

SEQ ID NO: 4068079 - DNA, 14 bp, Homo sapiens
agccataggcccag

SEQ ID NO: 4068080 - DNA, 14 bp, Homo sapiens
agccataggccctt

SEQ ID NO: 4068081 - DNA, 19 bp, Homo sapiens
agccatatatgaccagaag

SEQ ID NO: 4068082 - DNA, 15 bp, Homo sapiens
agccatcaaaatgct

SEQ ID NO: 4068083 - DNA, 19 bp, Homo sapiens
agccatcactagaagaaaa

SEQ ID NO: 4068084 - DNA, 20 bp, Homo sapiens
agccatcactagaagaaaag

SEQ ID NO: 4068085 - DNA, 14 bp, Homo sapiens
agccatcctccctc

SEQ ID NO: 4068086 - DNA, 23 bp, Homo sapiens
agccatcctccctccacctcaag

SEQ ID NO: 4068087 - DNA, 19 bp, Homo sapiens
agccatctaatgcttgttt

SEQ ID NO: 4068088 - DNA, 23 bp, Homo sapiens
agccatctaatgcttgtttatga

SEQ ID NO: 4068089 - DNA, 21 bp, Homo sapiens
agccatctcatgaggggagag

SEQ ID NO: 4068090 - DNA, 19 bp, Homo sapiens
agccatgctgggaagacgc

SEQ ID NO: 4068091 - DNA, 17 bp, Homo sapiens
agccattgcggccccag

SEQ ID NO: 4068092 - DNA, 22 bp, Homo sapiens
agccattgcggccccaggaggg

SEQ ID NO: 4068093 - DNA, 22 bp, Homo sapiens
agccattggctatttaaaactt

SEQ ID NO: 4068094 - DNA, 17 bp, Homo sapiens
agccattttgtgaatgg

SEQ ID NO: 4068095 - DNA, 19 bp, Homo sapiens
agcccaagcttaatagccc

SEQ ID NO: 4068096 - DNA, 22 bp, Homo sapiens
agcccaagcttaatagccctcc

SEQ ID NO: 4068097 - DNA, 15 bp, Homo sapiens
agcccaatattataa

SEQ ID NO: 4068098 - DNA, 23 bp, Homo sapiens
agcccacacttgagaggatgaat

SEQ ID NO: 4068099 - DNA, 16 bp, Homo sapiens
agcccaccaggtgtca

SEQ ID NO: 4068100 - DNA, 14 bp, Homo sapiens
agcccactgtcctg

SEQ ID NO: 4068101 - DNA, 17 bp, Homo sapiens
agcccactgtcctgggc

SEQ ID NO: 4068102 - DNA, 22 bp, Homo sapiens
agcccactgtcctgggcctgca

SEQ ID NO: 4068103 - DNA, 23 bp, Homo sapiens
agcccactgtcctgggcctgcag

SEQ ID NO: 4068104 - DNA, 14 bp, Homo sapiens
agcccagaacaccc

SEQ ID NO: 4068105 - DNA, 11 bp, Homo sapiens
agcccagagac

SEQ ID NO: 4068106 - DNA, 22 bp, Homo sapiens
agcccagagacatacttgaagg

SEQ ID NO: 4068107 - DNA, 13 bp, Homo sapiens
agcccagaggtaa

SEQ ID NO: 4068108 - DNA, 18 bp, Homo sapiens
agcccagaggtaacagaa

SEQ ID NO: 4068109 - DNA, 20 bp, Homo sapiens
agcccagaggtaacagaaca

SEQ ID NO: 4068110 - DNA, 20 bp, Homo sapiens
agcccagatggaaagacgtt

SEQ ID NO: 4068111 - DNA, 18 bp, Homo sapiens
agcccagattcccctgtg

SEQ ID NO: 4068112 - DNA, 21 bp, Homo sapiens
agcccagattcccctgtgtca

SEQ ID NO: 4068113 - DNA, 17 bp, Homo sapiens
agcccagcccctactgc

SEQ ID NO: 4068114 - DNA, 19 bp, Homo sapiens
agcccagcccctactgctg

SEQ ID NO: 4068115 - DNA, 13 bp, Homo sapiens
agcccagcctggg

SEQ ID NO: 4068116 - DNA, 13 bp, Homo sapiens
agcccagctgcct

SEQ ID NO: 4068117 - DNA, 14 bp, Homo sapiens
agcccagctgcctg

SEQ ID NO: 4068118 - DNA, 16 bp, Homo sapiens
agcccagctgggtcag

SEQ ID NO: 4068119 - DNA, 21 bp, Homo sapiens
agcccagctgggtcaggcagg

SEQ ID NO: 4068120 - DNA, 20 bp, Homo sapiens
agcccaggagggagcagagg

SEQ ID NO: 4068121 - DNA, 23 bp, Homo sapiens
agcccaggagggcatccatacca

SEQ ID NO: 4068122 - DNA, 11 bp, Homo sapiens
agcccaggagt

SEQ ID NO: 4068123 - DNA, 20 bp, Homo sapiens
agcccaggagtcccactcca

SEQ ID NO: 4068124 - DNA, 17 bp, Homo sapiens
agcccagtgaagcctct

SEQ ID NO: 4068125 - DNA, 19 bp, Homo sapiens
agcccataggccaccccct

SEQ ID NO: 4068126 - DNA, 24 bp, Homo sapiens
agcccataggccaccccctatcct

SEQ ID NO: 4068127 - DNA, 18 bp, Homo sapiens
agcccatccaaacactga

SEQ ID NO: 4068128 - DNA, 23 bp, Homo sapiens
agcccatccattaggccagcaac

SEQ ID NO: 4068129 - DNA, 11 bp, Homo sapiens
agcccatgccc

SEQ ID NO: 4068130 - DNA, 12 bp, Homo sapiens
agccccacccag

SEQ ID NO: 4068131 - DNA, 15 bp, Homo sapiens
agccccacccaggag

SEQ ID NO: 4068132 - DNA, 23 bp, Homo sapiens
agccccacctctccaagtctctc

SEQ ID NO: 4068133 - DNA, 15 bp, Homo sapiens
agccccagcactaac

SEQ ID NO: 4068134 - DNA, 16 bp, Homo sapiens
agccccaggcctctgt

SEQ ID NO: 4068135 - DNA, 21 bp, Homo sapiens
agccccaggcctctgtgtcct

SEQ ID NO: 4068136 - DNA, 20 bp, Homo sapiens
agccccagggtcttccctac

SEQ ID NO: 4068137 - DNA, 17 bp, Homo sapiens
agcccccaccacaaact

SEQ ID NO: 4068138 - DNA, 23 bp, Homo sapiens
agcccccagatagagctgggtgg

SEQ ID NO: 4068139 - DNA, 19 bp, Homo sapiens
agcccccagcagaggcagg

SEQ ID NO: 4068140 - DNA, 15 bp, Homo sapiens
agcccccagcccctc

SEQ ID NO: 4068141 - DNA, 17 bp, Homo sapiens
agcccccagcccctccc

SEQ ID NO: 4068142 - DNA, 19 bp, Homo sapiens
agcccccagctaagaacct

SEQ ID NO: 4068143 - DNA, 20 bp, Homo sapiens
agcccccagctaagaacctg

SEQ ID NO: 4068144 - DNA, 21 bp, Homo sapiens
agcccccaggaagcccaggag

SEQ ID NO: 4068145 - DNA, 17 bp, Homo sapiens
agcccccgccccagagt

SEQ ID NO: 4068146 - DNA, 15 bp, Homo sapiens
agccccctccacacc

SEQ ID NO: 4068147 - DNA, 22 bp, Homo sapiens
agccccggcaagccacaggaag

SEQ ID NO: 4068148 - DNA, 14 bp, Homo sapiens
agccccggcccccc

SEQ ID NO: 4068149 - DNA, 16 bp, Homo sapiens
agcccctactgctgtg

SEQ ID NO: 4068150 - DNA, 19 bp, Homo sapiens
agcccctatagcactgagc

SEQ ID NO: 4068151 - DNA, 23 bp, Homo sapiens
agcccctatagcactgagctcac

SEQ ID NO: 4068152 - DNA, 20 bp, Homo sapiens
agcccctcccccatctccca

SEQ ID NO: 4068153 - DNA, 21 bp, Homo sapiens
agcccctcccccatctcccac

SEQ ID NO: 4068154 - DNA, 13 bp, Homo sapiens
agcccctcctcca

SEQ ID NO: 4068155 - DNA, 13 bp, Homo sapiens
agcccctcttccc

SEQ ID NO: 4068156 - DNA, 17 bp, Homo sapiens
agcccctcttccccaat

SEQ ID NO: 4068157 - DNA, 16 bp, Homo sapiens
agcccctggggcccag

SEQ ID NO: 4068158 - DNA, 11 bp, Homo sapiens
agcccctgtcc

SEQ ID NO: 4068159 - DNA, 13 bp, Homo sapiens
agcccctgtccca

SEQ ID NO: 4068160 - DNA, 18 bp, Homo sapiens
agccccttctcccagcac

SEQ ID NO: 4068161 - DNA, 16 bp, Homo sapiens
agccccttctgctcag

SEQ ID NO: 4068162 - DNA, 15 bp, Homo sapiens
agccccttgctctca

SEQ ID NO: 4068163 - DNA, 16 bp, Homo sapiens
agccccttgctctcag

SEQ ID NO: 4068164 - DNA, 22 bp, Homo sapiens
agcccctttttcatatgttgct

SEQ ID NO: 4068165 - DNA, 19 bp, Homo sapiens
agcccggcctgctcccagc

SEQ ID NO: 4068166 - DNA, 20 bp, Homo sapiens
agcccggcctgctcccagca

SEQ ID NO: 4068167 - DNA, 18 bp, Homo sapiens
agcccgttagccccaggg

SEQ ID NO: 4068168 - DNA, 16 bp, Homo sapiens
agccctaagtggctgc

SEQ ID NO: 4068169 - DNA, 19 bp, Homo sapiens
agccctaagtggctgcctt

SEQ ID NO: 4068170 - DNA, 16 bp, Homo sapiens
agccctagagcctgcc

SEQ ID NO: 4068171 - DNA, 20 bp, Homo sapiens
agccctagagcctgcctgga

SEQ ID NO: 4068172 - DNA, 19 bp, Homo sapiens
agccctcaacaggcccagg

SEQ ID NO: 4068173 - DNA, 22 bp, Homo sapiens
agccctcaacaggcccagggag

SEQ ID NO: 4068174 - DNA, 20 bp, Homo sapiens
agccctccactccagctctg

SEQ ID NO: 4068175 - DNA, 12 bp, Homo sapiens
agccctccccat

SEQ ID NO: 4068176 - DNA, 19 bp, Homo sapiens
agccctccccatggagcca

SEQ ID NO: 4068177 - DNA, 20 bp, Homo sapiens
agccctccccatggagccag

SEQ ID NO: 4068178 - DNA, 22 bp, Homo sapiens
agccctcccccttccccttctg

SEQ ID NO: 4068179 - DNA, 17 bp, Homo sapiens
agccctccctgcccctc

SEQ ID NO: 4068180 - DNA, 19 bp, Homo sapiens
agccctccctgcccctccc

SEQ ID NO: 4068181 - DNA, 23 bp, Homo sapiens
agccctccctgcccctcccttca

SEQ ID NO: 4068182 - DNA, 19 bp, Homo sapiens
agccctccgaccctcatgg

SEQ ID NO: 4068183 - DNA, 14 bp, Homo sapiens
agccctcgtctccc

SEQ ID NO: 4068184 - DNA, 20 bp, Homo sapiens
agccctcttgggggcactgc

SEQ ID NO: 4068185 - DNA, 19 bp, Homo sapiens
agccctgaccttggctgac

SEQ ID NO: 4068186 - DNA, 23 bp, Homo sapiens
agccctgaccttggctgactggg

SEQ ID NO: 4068187 - DNA, 17 bp, Homo sapiens
agccctgaggaggcctt

SEQ ID NO: 4068188 - DNA, 18 bp, Homo sapiens
agccctgaggaggccttg

SEQ ID NO: 4068189 - DNA, 12 bp, Homo sapiens
agccctgcagcc

SEQ ID NO: 4068190 - DNA, 14 bp, Homo sapiens
agccctgccctgca

SEQ ID NO: 4068191 - DNA, 14 bp, Homo sapiens
agccctgctccctc

SEQ ID NO: 4068192 - DNA, 19 bp, Homo sapiens
agccctgctttgggctgcc

SEQ ID NO: 4068193 - DNA, 20 bp, Homo sapiens
agccctggacacccctgctc

SEQ ID NO: 4068194 - DNA, 16 bp, Homo sapiens
agccctggctgggttc

SEQ ID NO: 4068195 - DNA, 24 bp, Homo sapiens
agccctggctgggttcaggtccca

SEQ ID NO: 4068196 - DNA, 19 bp, Homo sapiens
agccctggggactgttcca

SEQ ID NO: 4068197 - DNA, 11 bp, Homo sapiens
agccctgtcct

SEQ ID NO: 4068198 - DNA, 13 bp, Homo sapiens
agccctgtcctgg

SEQ ID NO: 4068199 - DNA, 19 bp, Homo sapiens
agccctgtcctggttcctt

SEQ ID NO: 4068200 - DNA, 12 bp, Homo sapiens
agcccttccctg

SEQ ID NO: 4068201 - DNA, 13 bp, Homo sapiens
agcccttccctga

SEQ ID NO: 4068202 - DNA, 23 bp, Homo sapiens
agcccttccctgagtgcgggctg

SEQ ID NO: 4068203 - DNA, 21 bp, Homo sapiens
agcccttcctctgctccccct

SEQ ID NO: 4068204 - DNA, 22 bp, Homo sapiens
agcccttgcccatgctgggctc

SEQ ID NO: 4068205 - DNA, 16 bp, Homo sapiens
agcccttgcctcccca

SEQ ID NO: 4068206 - DNA, 22 bp, Homo sapiens
agcccttgggcagttctcactc

SEQ ID NO: 4068207 - DNA, 14 bp, Homo sapiens
agccctttaaaacg

SEQ ID NO: 4068208 - DNA, 16 bp, Homo sapiens
agccgactctggccct

SEQ ID NO: 4068209 - DNA, 20 bp, Homo sapiens
agccgactctggccctggcc

SEQ ID NO: 4068210 - DNA, 13 bp, Homo sapiens
agccgccagctgg

SEQ ID NO: 4068211 - DNA, 14 bp, Homo sapiens
agccgccagctggg

SEQ ID NO: 4068212 - DNA, 13 bp, Homo sapiens
agccgccccagcc

SEQ ID NO: 4068213 - DNA, 22 bp, Homo sapiens
agccgccctgggctgtctgtca

SEQ ID NO: 4068214 - DNA, 20 bp, Homo sapiens
agccgcggggaagctggctt

SEQ ID NO: 4068215 - DNA, 22 bp, Homo sapiens
agccgcggtgcccaaccacact

SEQ ID NO: 4068216 - DNA, 13 bp, Homo sapiens
agccgctccagag

SEQ ID NO: 4068217 - DNA, 22 bp, Homo sapiens
agccgctgtgagcccctggtcc

SEQ ID NO: 4068218 - DNA, 14 bp, Homo sapiens
agccggaaggccga

SEQ ID NO: 4068219 - DNA, 16 bp, Homo sapiens
agccggaaggccgagg

SEQ ID NO: 4068220 - DNA, 14 bp, Homo sapiens
agccggcacagggt

SEQ ID NO: 4068221 - DNA, 13 bp, Homo sapiens
agccgggctctgc

SEQ ID NO: 4068222 - DNA, 15 bp, Homo sapiens
agccgggctctgcac

SEQ ID NO: 4068223 - DNA, 19 bp, Homo sapiens
agccgggctctgcacccac

SEQ ID NO: 4068224 - DNA, 16 bp, Homo sapiens
agccgtcagccaaatg

SEQ ID NO: 4068225 - DNA, 22 bp, Homo sapiens
agccgtccttctaatgaagaca

SEQ ID NO: 4068226 - DNA, 18 bp, Homo sapiens
agccgtgctcgccccagc

SEQ ID NO: 4068227 - DNA, 13 bp, Homo sapiens
agccgtggcttcc

SEQ ID NO: 4068228 - DNA, 21 bp, Homo sapiens
agccgtggcttcccgctcagc

SEQ ID NO: 4068229 - DNA, 23 bp, Homo sapiens
agccgtggcttcccgctcagccc

SEQ ID NO: 4068230 - DNA, 15 bp, Homo sapiens
agccgtggtccctga

SEQ ID NO: 4068231 - DNA, 20 bp, Homo sapiens
agcctaaagtacagcctgga

SEQ ID NO: 4068232 - DNA, 18 bp, Homo sapiens
agcctagcggagcccagc

SEQ ID NO: 4068233 - DNA, 12 bp, Homo sapiens
agcctagctcct

SEQ ID NO: 4068234 - DNA, 20 bp, Homo sapiens
agcctagttcatccaatcct

SEQ ID NO: 4068235 - DNA, 22 bp, Homo sapiens
agcctagttcatccaatcctca

SEQ ID NO: 4068236 - DNA, 23 bp, Homo sapiens
agcctagttcatccaatcctcac

SEQ ID NO: 4068237 - DNA, 20 bp, Homo sapiens
agcctatttacctgcaggct

SEQ ID NO: 4068238 - DNA, 13 bp, Homo sapiens
agcctttcttgta

SEQ ID NO: 4068239 - DNA, 16 bp, Homo sapiens
agcctttgcctccccg

SEQ ID NO: 4068240 - DNA, 18 bp, Homo sapiens
agcctttggttctggcca

SEQ ID NO: 4068241 - DNA, 14 bp, Homo sapiens
agccttttatctgc

SEQ ID NO: 4068242 - DNA, 23 bp, Homo sapiens
agccttttccctctttggctccc

SEQ ID NO: 4068243 - DNA, 16 bp, Homo sapiens
agccttttgctctctg

SEQ ID NO: 4068244 - DNA, 23 bp, Homo sapiens
agccttttgtttcccttgctttg

SEQ ID NO: 4068245 - DNA, 18 bp, Homo sapiens
agcctttttgtttcaatg

SEQ ID NO: 4068246 - DNA, 13 bp, Homo sapiens
agcgaagtagctt

SEQ ID NO: 4068247 - DNA, 13 bp, Homo sapiens
agcgacagagcag

SEQ ID NO: 4068248 - DNA, 17 bp, Homo sapiens
agcgacccattcagaga

SEQ ID NO: 4068249 - DNA, 16 bp, Homo sapiens
agcgaccgccccctcc

SEQ ID NO: 4068250 - DNA, 24 bp, Homo sapiens
agcgaggctgagcctacagatgaa

SEQ ID NO: 4068251 - DNA, 17 bp, Homo sapiens
agcgatatacagatgaa

SEQ ID NO: 4068252 - DNA, 18 bp, Homo sapiens
agcgatctctcctggcct

SEQ ID NO: 4068253 - DNA, 23 bp, Homo sapiens
agcgattattatctaaagtgtgt

SEQ ID NO: 4068254 - DNA, 21 bp, Homo sapiens
agcgcagctggactctgcatc

SEQ ID NO: 4068255 - DNA, 15 bp, Homo sapiens
agcgccaagtgcgtg

SEQ ID NO: 4068256 - DNA, 13 bp, Homo sapiens
agcgcccctgctg

SEQ ID NO: 4068257 - DNA, 11 bp, Homo sapiens
agcgccctcac

SEQ ID NO: 4068258 - DNA, 11 bp, Homo sapiens
agcgctccctt

SEQ ID NO: 4068259 - DNA, 22 bp, Homo sapiens
agcgctggtcccctccctctgt

SEQ ID NO: 4068260 - DNA, 12 bp, Homo sapiens
agcggaataaac

SEQ ID NO: 4068261 - DNA, 21 bp, Homo sapiens
agcggaataaactagagaagg

SEQ ID NO: 4068262 - DNA, 16 bp, Homo sapiens
agcggagcccagcctg

SEQ ID NO: 4068263 - DNA, 20 bp, Homo sapiens
agcggaggagaccagctcag

SEQ ID NO: 4068264 - DNA, 16 bp, Homo sapiens
agcggaggctgtgtgc

SEQ ID NO: 4068265 - DNA, 22 bp, Homo sapiens
agcggccggccagcccctggcc

SEQ ID NO: 4068266 - DNA, 17 bp, Homo sapiens
agcggctcccctctgct

SEQ ID NO: 4068267 - DNA, 17 bp, Homo sapiens
agcgggagacctgtgct

SEQ ID NO: 4068268 - DNA, 15 bp, Homo sapiens
agcgggaggcagagt

SEQ ID NO: 4068269 - DNA, 12 bp, Homo sapiens
agcgggcacagg

SEQ ID NO: 4068270 - DNA, 18 bp, Homo sapiens
agcgggcacagggcacca

SEQ ID NO: 4068271 - DNA, 14 bp, Homo sapiens
agcgggcagatggg

SEQ ID NO: 4068272 - DNA, 14 bp, Homo sapiens
agcgggccaggccc

SEQ ID NO: 4068273 - DNA, 22 bp, Homo sapiens
agcgggctaacgggaggctggg

SEQ ID NO: 4068274 - DNA, 19 bp, Homo sapiens
agcggtaccaatgcagaac

SEQ ID NO: 4068275 - DNA, 17 bp, Homo sapiens
agcggtccctgtccctc

SEQ ID NO: 4068276 - DNA, 16 bp, Homo sapiens
agcgtaaaatggtgaa

SEQ ID NO: 4068277 - DNA, 15 bp, Homo sapiens
agcgtcagctgctcc

SEQ ID NO: 4068278 - DNA, 23 bp, Homo sapiens
agcgtcagggttggtgtgctgag

SEQ ID NO: 4068279 - DNA, 13 bp, Homo sapiens
agcgtcccagtct

SEQ ID NO: 4068280 - DNA, 18 bp, Homo sapiens
agcgtgtttacatgtgta

SEQ ID NO: 4068281 - DNA, 16 bp, Homo sapiens
agcgttggatgtagca

SEQ ID NO: 4068282 - DNA, 17 bp, Homo sapiens
agcgttttttaaatgta

SEQ ID NO: 4068283 - DNA, 23 bp, Homo sapiens
agcgttttttaaatgtatactat

SEQ ID NO: 4068284 - DNA, 16 bp, Homo sapiens
agctaaaatgatttta

SEQ ID NO: 4068285 - DNA, 18 bp, Homo sapiens
agctaaacggattccaaa

SEQ ID NO: 4068286 - DNA, 18 bp, Homo sapiens
agctaaactccttcctgg

SEQ ID NO: 4068287 - DNA, 16 bp, Homo sapiens
agctaaagcccaacct

SEQ ID NO: 4068288 - DNA, 13 bp, Homo sapiens
agctaaatccttt

SEQ ID NO: 4068289 - DNA, 14 bp, Homo sapiens
agctaagaaaagat

SEQ ID NO: 4068290 - DNA, 13 bp, Homo sapiens
agctaagaacctg

SEQ ID NO: 4068291 - DNA, 17 bp, Homo sapiens
agctaagaacctggaac

SEQ ID NO: 4068292 - DNA, 20 bp, Homo sapiens
agctaagggaagacatttct

SEQ ID NO: 4068293 - DNA, 20 bp, Homo sapiens
agctaagggtgggtgctcag

SEQ ID NO: 4068294 - DNA, 21 bp, Homo sapiens
agctaagggtgggtgctcaga

SEQ ID NO: 4068295 - DNA, 22 bp, Homo sapiens
agctaagggtgggtgctcagaa

SEQ ID NO: 4068296 - DNA, 23 bp, Homo sapiens
agctaagggtgggtgctcagaat

SEQ ID NO: 4068297 - DNA, 19 bp, Homo sapiens
agctaataaatctcttctt

SEQ ID NO: 4068298 - DNA, 23 bp, Homo sapiens
agctaatctgtagggctggacct

SEQ ID NO: 4068299 - DNA, 22 bp, Homo sapiens
agctaatttgcattaaattcac

SEQ ID NO: 4068300 - DNA, 14 bp, Homo sapiens
agctacaggaagca

SEQ ID NO: 4068301 - DNA, 19 bp, Homo sapiens
agctaccagagctctatcc

SEQ ID NO: 4068302 - DNA, 17 bp, Homo sapiens
agctacccactatcctt

SEQ ID NO: 4068303 - DNA, 14 bp, Homo sapiens
agctactaaaatca

SEQ ID NO: 4068304 - DNA, 16 bp, Homo sapiens
agctactaatgatgtt

SEQ ID NO: 4068305 - DNA, 18 bp, Homo sapiens
agctactaatgatgtttt

SEQ ID NO: 4068306 - DNA, 22 bp, Homo sapiens
agctactctccccacgagggct

SEQ ID NO: 4068307 - DNA, 23 bp, Homo sapiens
agctactctccccacgagggctg

SEQ ID NO: 4068308 - DNA, 20 bp, Homo sapiens
agctactgtgtgtgtgaatg

SEQ ID NO: 4068309 - DNA, 23 bp, Homo sapiens
agctactgtgtgtgtgaatgaac

SEQ ID NO: 4068310 - DNA, 15 bp, Homo sapiens
agctacttcctcctc

SEQ ID NO: 4068311 - DNA, 21 bp, Homo sapiens
agctacttgggaggctgaggc

SEQ ID NO: 4068312 - DNA, 16 bp, Homo sapiens
agctacttggtttgtg

SEQ ID NO: 4068313 - DNA, 17 bp, Homo sapiens
agctacttggtttgtgt

SEQ ID NO: 4068314 - DNA, 12 bp, Homo sapiens
agctaggcaggg

SEQ ID NO: 4068315 - DNA, 13 bp, Homo sapiens
agctaggcagggt

SEQ ID NO: 4068316 - DNA, 14 bp, Homo sapiens
agctagtgaagacc

SEQ ID NO: 4068317 - DNA, 19 bp, Homo sapiens
agctagtgaagaccagagc

SEQ ID NO: 4068318 - DNA, 19 bp, Homo sapiens
agctagtggcttcaaaata

SEQ ID NO: 4068319 - DNA, 23 bp, Homo sapiens
agctagtgtacctcctctcagtg

SEQ ID NO: 4068320 - DNA, 23 bp, Homo sapiens
agctatacctgcacgttcataac

SEQ ID NO: 4068321 - DNA, 17 bp, Homo sapiens
agctatataagacaaga

SEQ ID NO: 4068322 - DNA, 17 bp, Homo sapiens
agctatatccatgtact

SEQ ID NO: 4068323 - DNA, 23 bp, Homo sapiens
agctatcaagtgtgctttagctt

SEQ ID NO: 4068324 - DNA, 17 bp, Homo sapiens
agctatcgaacttcaca

SEQ ID NO: 4068325 - DNA, 18 bp, Homo sapiens
agctatctaggtggagtt

SEQ ID NO: 4068326 - DNA, 18 bp, Homo sapiens
agctatctatatggaatt

SEQ ID NO: 4068327 - DNA, 23 bp, Homo sapiens
agctatctgcactctaaactgca

SEQ ID NO: 4068328 - DNA, 18 bp, Homo sapiens
agctatctgtcatctctc

SEQ ID NO: 4068329 - DNA, 17 bp, Homo sapiens
agctatgcgcaatgtgg

SEQ ID NO: 4068330 - DNA, 20 bp, Homo sapiens
agctatggacagcattgcca

SEQ ID NO: 4068331 - DNA, 18 bp, Homo sapiens
agctatgggagccccagg

SEQ ID NO: 4068332 - DNA, 14 bp, Homo sapiens
agctattttcctct

SEQ ID NO: 4068333 - DNA, 17 bp, Homo sapiens
agctcaaataaaaataa

SEQ ID NO: 4068334 - DNA, 21 bp, Homo sapiens
agctcacactccagtggcaga

SEQ ID NO: 4068335 - DNA, 18 bp, Homo sapiens
agctcacagtgctgtgtg

SEQ ID NO: 4068336 - DNA, 18 bp, Homo sapiens
agctcacccctgggcagg

SEQ ID NO: 4068337 - DNA, 22 bp, Homo sapiens
agctcagaggcgcactgtgacc

SEQ ID NO: 4068338 - DNA, 18 bp, Homo sapiens
agctcagccccaactctt

SEQ ID NO: 4068339 - DNA, 21 bp, Homo sapiens
agctcagcttcttcctaggtc

SEQ ID NO: 4068340 - DNA, 10 bp, Homo sapiens
agctgcccta

SEQ ID NO: 4068341 - DNA, 18 bp, Homo sapiens
agctgccctagctgaccc

SEQ ID NO: 4068342 - DNA, 22 bp, Homo sapiens
agctgccctagctgaccccgag

SEQ ID NO: 4068343 - DNA, 18 bp, Homo sapiens
agctgccctatgggcctg

SEQ ID NO: 4068344 - DNA, 20 bp, Homo sapiens
agctgcctagcaagctggcc

SEQ ID NO: 4068345 - DNA, 21 bp, Homo sapiens
agctgcctagcaagctggcct

SEQ ID NO: 4068346 - DNA, 20 bp, Homo sapiens
agctgcctggagagggtctc

SEQ ID NO: 4068347 - DNA, 13 bp, Homo sapiens
agctgcctgggcc

SEQ ID NO: 4068348 - DNA, 14 bp, Homo sapiens
agctgccttcccta

SEQ ID NO: 4068349 - DNA, 14 bp, Homo sapiens
agctgccttgagct

SEQ ID NO: 4068350 - DNA, 14 bp, Homo sapiens
agctgccttggctc

SEQ ID NO: 4068351 - DNA, 23 bp, Homo sapiens
agctgcgtttattaatgcctctc

SEQ ID NO: 4068352 - DNA, 21 bp, Homo sapiens
agctgctactcgtgagcgcca

SEQ ID NO: 4068353 - DNA, 15 bp, Homo sapiens
agctgctccaggcct

SEQ ID NO: 4068354 - DNA, 19 bp, Homo sapiens
agctgctccaggcctgcag

SEQ ID NO: 4068355 - DNA, 15 bp, Homo sapiens
agctgctctgagcca

SEQ ID NO: 4068356 - DNA, 16 bp, Homo sapiens
agctgctctgagccac

SEQ ID NO: 4068357 - DNA, 14 bp, Homo sapiens
agctgctggcttgc

SEQ ID NO: 4068358 - DNA, 21 bp, Homo sapiens
agctggacttctgtgggcccc

SEQ ID NO: 4068359 - DNA, 22 bp, Homo sapiens
agctggacttctgtgggcccct

SEQ ID NO: 4068360 - DNA, 15 bp, Homo sapiens
agctggagcccccag

SEQ ID NO: 4068361 - DNA, 23 bp, Homo sapiens
agctggagcccccagcagaggca

SEQ ID NO: 4068362 - DNA, 19 bp, Homo sapiens
agctggcaaaggtggctct

SEQ ID NO: 4068363 - DNA, 20 bp, Homo sapiens
agctggccctgcctcctggg

SEQ ID NO: 4068364 - DNA, 20 bp, Homo sapiens
agctggccgagggtcctggc

SEQ ID NO: 4068365 - DNA, 14 bp, Homo sapiens
agctggcctctacc

SEQ ID NO: 4068366 - DNA, 21 bp, Homo sapiens
agctggcctgagaggggaagc

SEQ ID NO: 4068367 - DNA, 15 bp, Homo sapiens
agctggctccagcct

SEQ ID NO: 4068368 - DNA, 22 bp, Homo sapiens
agctggctttgaaacctcaggg

SEQ ID NO: 4068369 - DNA, 18 bp, Homo sapiens
agctggctttgcacttga

SEQ ID NO: 4068370 - DNA, 16 bp, Homo sapiens
agctgggaggcatggc

SEQ ID NO: 4068371 - DNA, 21 bp, Homo sapiens
agctgggaggcatggccctgg

SEQ ID NO: 4068372 - DNA, 20 bp, Homo sapiens
agctgggctggggaggacct

SEQ ID NO: 4068373 - DNA, 15 bp, Homo sapiens
agctggggactcagg

SEQ ID NO: 4068374 - DNA, 15 bp, Homo sapiens
agctggggatccctc

SEQ ID NO: 4068375 - DNA, 16 bp, Homo sapiens
agctggggccagaggc

SEQ ID NO: 4068376 - DNA, 14 bp, Homo sapiens
agctgggtcaggca

SEQ ID NO: 4068377 - DNA, 15 bp, Homo sapiens
agctgggtggcctgt

SEQ ID NO: 4068378 - DNA, 18 bp, Homo sapiens
agctggtgcattacagag

SEQ ID NO: 4068379 - DNA, 20 bp, Homo sapiens
agctggtgcattacagagag

SEQ ID NO: 4068380 - DNA, 18 bp, Homo sapiens
agctggtgtctgattgtt

SEQ ID NO: 4068381 - DNA, 16 bp, Homo sapiens
agctggttactcaggg

SEQ ID NO: 4068382 - DNA, 17 bp, Homo sapiens
agctggttactcagggt

SEQ ID NO: 4068383 - DNA, 19 bp, Homo sapiens
agctggttactcagggttc

SEQ ID NO: 4068384 - DNA, 21 bp, Homo sapiens
agctggttactcagggttcat

SEQ ID NO: 4068385 - DNA, 21 bp, Homo sapiens
agctggtttcctcattcctga

SEQ ID NO: 4068386 - DNA, 14 bp, Homo sapiens
agctggtttcctgc

SEQ ID NO: 4068387 - DNA, 18 bp, Homo sapiens
agctgtaagaagagactg

SEQ ID NO: 4068388 - DNA, 23 bp, Homo sapiens
agctgtaagaagagactgggaag

SEQ ID NO: 4068389 - DNA, 15 bp, Homo sapiens
agctgtatgatttgt

SEQ ID NO: 4068390 - DNA, 16 bp, Homo sapiens
agctgtattgtctgaa

SEQ ID NO: 4068391 - DNA, 17 bp, Homo sapiens
agctgtcaccaaggaaa

SEQ ID NO: 4068392 - DNA, 18 bp, Homo sapiens
agctgtcaccaaggaaac

SEQ ID NO: 4068393 - DNA, 16 bp, Homo sapiens
agctgtcactctgtgc

SEQ ID NO: 4068394 - DNA, 11 bp, Homo sapiens
agctgtcatca

SEQ ID NO: 4068395 - DNA, 14 bp, Homo sapiens
agctgtccagagaa

SEQ ID NO: 4068396 - DNA, 16 bp, Homo sapiens
agctgtctaaccccca

SEQ ID NO: 4068397 - DNA, 22 bp, Homo sapiens
agctgtctaacccccagctggg

SEQ ID NO: 4068398 - DNA, 15 bp, Homo sapiens
agctgtgcagcacgt

SEQ ID NO: 4068399 - DNA, 22 bp, Homo sapiens
agctgtggaggattgctatctg

SEQ ID NO: 4068400 - DNA, 23 bp, Homo sapiens
agctgtgtgacatttggagaggg

SEQ ID NO: 4068401 - DNA, 19 bp, Homo sapiens
agctgtgttattcctggtt

SEQ ID NO: 4068402 - DNA, 17 bp, Homo sapiens
agctgttatttcttccc

SEQ ID NO: 4068403 - DNA, 13 bp, Homo sapiens
agctgttcttcct

SEQ ID NO: 4068404 - DNA, 20 bp, Homo sapiens
agctgttgcagatgaaatgt

SEQ ID NO: 4068405 - DNA, 23 bp, Homo sapiens
agctgttgcagatgaaatgttct

SEQ ID NO: 4068406 - DNA, 20 bp, Homo sapiens
agctgttgtctcttctcctt

SEQ ID NO: 4068407 - DNA, 17 bp, Homo sapiens
agctgtttatggcctca

SEQ ID NO: 4068408 - DNA, 12 bp, Homo sapiens
agctgtttctca

SEQ ID NO: 4068409 - DNA, 13 bp, Homo sapiens
agctgtttgtcat

SEQ ID NO: 4068410 - DNA, 15 bp, Homo sapiens
agctgttttccctga

SEQ ID NO: 4068411 - DNA, 20 bp, Homo sapiens
agcttaaaataaacagttgt

SEQ ID NO: 4068412 - DNA, 14 bp, Homo sapiens
agcttaaattgtca

SEQ ID NO: 4068413 - DNA, 20 bp, Homo sapiens
agcttaaattgtcattattt

SEQ ID NO: 4068414 - DNA, 21 bp, Homo sapiens
agcttacaatcgcaaatcaaa

SEQ ID NO: 4068415 - DNA, 17 bp, Homo sapiens
agcttacatagttttaa

SEQ ID NO: 4068416 - DNA, 13 bp, Homo sapiens
agcttatctcttt

SEQ ID NO: 4068417 - DNA, 19 bp, Homo sapiens
agcttatctcttttatatt

SEQ ID NO: 4068418 - DNA, 17 bp, Homo sapiens
agcttcaagtgcctttt

SEQ ID NO: 4068419 - DNA, 14 bp, Homo sapiens
agcttcacttctga

SEQ ID NO: 4068420 - DNA, 22 bp, Homo sapiens
agcttcatgcctttgtaagtta

SEQ ID NO: 4068421 - DNA, 22 bp, Homo sapiens
agcttcctacccacacctctgc

SEQ ID NO: 4068422 - DNA, 14 bp, Homo sapiens
agcttcctcacacc

SEQ ID NO: 4068423 - DNA, 19 bp, Homo sapiens
agcttccttctgtgaaagt

SEQ ID NO: 4068424 - DNA, 19 bp, Homo sapiens
agcttcggagggcccctgc

SEQ ID NO: 4068425 - DNA, 19 bp, Homo sapiens
agcttctactcctgcctca

SEQ ID NO: 4068426 - DNA, 14 bp, Homo sapiens
agcttctccaggct

SEQ ID NO: 4068427 - DNA, 12 bp, Homo sapiens
agcttctgcttt

SEQ ID NO: 4068428 - DNA, 21 bp, Homo sapiens
agcttctgcttttctgccctg

SEQ ID NO: 4068429 - DNA, 14 bp, Homo sapiens
agcttcttaattaa

SEQ ID NO: 4068430 - DNA, 18 bp, Homo sapiens
agcttcttaattaatttg

SEQ ID NO: 4068431 - DNA, 12 bp, Homo sapiens
agcttcttcaga

SEQ ID NO: 4068432 - DNA, 13 bp, Homo sapiens
agcttcttcagag

SEQ ID NO: 4068433 - DNA, 18 bp, Homo sapiens
agcttcttcagagtgaag

SEQ ID NO: 4068434 - DNA, 19 bp, Homo sapiens
agcttcttcagagtgaaga

SEQ ID NO: 4068435 - DNA, 14 bp, Homo sapiens
agcttcttctgaaa

SEQ ID NO: 4068436 - DNA, 13 bp, Homo sapiens
agcttcttgtttc

SEQ ID NO: 4068437 - DNA, 14 bp, Homo sapiens
agcttcttgtttcc

SEQ ID NO: 4068438 - DNA, 19 bp, Homo sapiens
agcttcttgtttccttgtt

SEQ ID NO: 4068439 - DNA, 13 bp, Homo sapiens
agcttctttccct

SEQ ID NO: 4068440 - DNA, 22 bp, Homo sapiens
agcttgacacagtcagcatgct

SEQ ID NO: 4068441 - DNA, 13 bp, Homo sapiens
agcttgactccca

SEQ ID NO: 4068442 - DNA, 24 bp, Homo sapiens
agcttgagccgggcccctgggctt

SEQ ID NO: 4068443 - DNA, 15 bp, Homo sapiens
aggaggcctgtccca

SEQ ID NO: 4068444 - DNA, 16 bp, Homo sapiens
aggaggctggaggaag

SEQ ID NO: 4068445 - DNA, 13 bp, Homo sapiens
aggaggctggcag

SEQ ID NO: 4068446 - DNA, 16 bp, Homo sapiens
aggaggctggcaggta

SEQ ID NO: 4068447 - DNA, 22 bp, Homo sapiens
aggaggctgggacgctctgctg

SEQ ID NO: 4068448 - DNA, 18 bp, Homo sapiens
aggagggaccaccctccc

SEQ ID NO: 4068449 - DNA, 23 bp, Homo sapiens
aggagggaccaccctccctgact

SEQ ID NO: 4068450 - DNA, 15 bp, Homo sapiens
aggagggatgctgct

SEQ ID NO: 4068451 - DNA, 20 bp, Homo sapiens
aggagggcaagggccatgct

SEQ ID NO: 4068452 - DNA, 14 bp, Homo sapiens
aggagggcatccat

SEQ ID NO: 4068453 - DNA, 14 bp, Homo sapiens
aggaggggagggta

SEQ ID NO: 4068454 - DNA, 13 bp, Homo sapiens
aggaggggtctca

SEQ ID NO: 4068455 - DNA, 18 bp, Homo sapiens
aggagggtacagctgggc

SEQ ID NO: 4068456 - DNA, 23 bp, Homo sapiens
aggagtcccactccaagccagca

SEQ ID NO: 4068457 - DNA, 19 bp, Homo sapiens
aggagtctctgccacccac

SEQ ID NO: 4068458 - DNA, 14 bp, Homo sapiens
aggagtgagatcat

SEQ ID NO: 4068459 - DNA, 14 bp, Homo sapiens
aggagtggtgcaga

SEQ ID NO: 4068460 - DNA, 16 bp, Homo sapiens
aggagtgtgagaatca

SEQ ID NO: 4068461 - DNA, 16 bp, Homo sapiens
aggagttggaatgttg

SEQ ID NO: 4068462 - DNA, 18 bp, Homo sapiens
aggagttgtttctgaccc

SEQ ID NO: 4068463 - DNA, 22 bp, Homo sapiens
aggagttgtttctgacccactg

SEQ ID NO: 4068464 - DNA, 16 bp, Homo sapiens
aggagtttgagaccag

SEQ ID NO: 4068465 - DNA, 21 bp, Homo sapiens
aggagtttgagaccagcttag

SEQ ID NO: 4068466 - DNA, 13 bp, Homo sapiens
aggataagtgaaa

SEQ ID NO: 4068467 - DNA, 21 bp, Homo sapiens
aggatacatgtgccgaatgtg

SEQ ID NO: 4068468 - DNA, 15 bp, Homo sapiens
aggatactggacgct

SEQ ID NO: 4068469 - DNA, 14 bp, Homo sapiens
aggatagatgctgg

SEQ ID NO: 4068470 - DNA, 15 bp, Homo sapiens
aggatagatgctggc

SEQ ID NO: 4068471 - DNA, 21 bp, Homo sapiens
aggatagatgctggcccaggg

SEQ ID NO: 4068472 - DNA, 22 bp, Homo sapiens
aggatagatgctggcccagggc

SEQ ID NO: 4068473 - DNA, 14 bp, Homo sapiens
aggatatttaagaa

SEQ ID NO: 4068474 - DNA, 15 bp, Homo sapiens
aggatccagagagca

SEQ ID NO: 4068475 - DNA, 22 bp, Homo sapiens
aggatcctattctcaccaggaa

SEQ ID NO: 4068476 - DNA, 13 bp, Homo sapiens
aggatcctctcca

SEQ ID NO: 4068477 - DNA, 23 bp, Homo sapiens
aggatcggactctgcccctggac

SEQ ID NO: 4068478 - DNA, 22 bp, Homo sapiens
aggatctagaatgtgttttctg

SEQ ID NO: 4068479 - DNA, 22 bp, Homo sapiens
aggatctccactgataagactg

SEQ ID NO: 4068480 - DNA, 13 bp, Homo sapiens
aggatctctcagg

SEQ ID NO: 4068481 - DNA, 15 bp, Homo sapiens
aggatctctcaggag

SEQ ID NO: 4068482 - DNA, 21 bp, Homo sapiens
aggatctctcaggagcacagg

SEQ ID NO: 4068483 - DNA, 19 bp, Homo sapiens
aggatgaatgaggtcccag

SEQ ID NO: 4068484 - DNA, 12 bp, Homo sapiens
aggatgaatgta

SEQ ID NO: 4068485 - DNA, 20 bp, Homo sapiens
aggatgaatgtatgtgcact

SEQ ID NO: 4068486 - DNA, 20 bp, Homo sapiens
aggatgacctggataactta

SEQ ID NO: 4068487 - DNA, 16 bp, Homo sapiens
aggatgagagcccaga

SEQ ID NO: 4068488 - DNA, 12 bp, Homo sapiens
aggatgctggcc

SEQ ID NO: 4068489 - DNA, 21 bp, Homo sapiens
aggatgcttgattccagtggt

SEQ ID NO: 4068490 - DNA, 14 bp, Homo sapiens
aggatggaacacgg

SEQ ID NO: 4068491 - DNA, 19 bp, Homo sapiens
aggatggaacacggccaca

SEQ ID NO: 4068492 - DNA, 19 bp, Homo sapiens
aggatggaggggtggtcct

SEQ ID NO: 4068493 - DNA, 14 bp, Homo sapiens
aggatggcctttcc

SEQ ID NO: 4068494 - DNA, 21 bp, Homo sapiens
aggatggcctttccttccctc

SEQ ID NO: 4068495 - DNA, 20 bp, Homo sapiens
aggatgggatgggttccaga

SEQ ID NO: 4068496 - DNA, 15 bp, Homo sapiens
aggatgtcacagggc

SEQ ID NO: 4068497 - DNA, 17 bp, Homo sapiens
aggatgtcatgtctgct

SEQ ID NO: 4068498 - DNA, 20 bp, Homo sapiens
aggatgtccctgggccaggg

SEQ ID NO: 4068499 - DNA, 14 bp, Homo sapiens
aggatgtgatatat

SEQ ID NO: 4068500 - DNA, 21 bp, Homo sapiens
aggatgtgatatataagtgta

SEQ ID NO: 4068501 - DNA, 19 bp, Homo sapiens
aggatgtggaaagcacttt

SEQ ID NO: 4068502 - DNA, 18 bp, Homo sapiens
aggatgtggaagagcatt

SEQ ID NO: 4068503 - DNA, 14 bp, Homo sapiens
aggatgtttttcat

SEQ ID NO: 4068504 - DNA, 16 bp, Homo sapiens
aggattacatgcatgt

SEQ ID NO: 4068505 - DNA, 16 bp, Homo sapiens
aggattataaatgaaa

SEQ ID NO: 4068506 - DNA, 17 bp, Homo sapiens
aggattataaatgaaat

SEQ ID NO: 4068507 - DNA, 13 bp, Homo sapiens
aggattattgata

SEQ ID NO: 4068508 - DNA, 16 bp, Homo sapiens
aggattcagccggagg

SEQ ID NO: 4068509 - DNA, 13 bp, Homo sapiens
aggattgaagagc

SEQ ID NO: 4068510 - DNA, 22 bp, Homo sapiens
aggattgaagagcattgcatgg

SEQ ID NO: 4068511 - DNA, 18 bp, Homo sapiens
aggattgcttgagcccag

SEQ ID NO: 4068512 - DNA, 18 bp, Homo sapiens
aggatttaacagtcattt

SEQ ID NO: 4068513 - DNA, 23 bp, Homo sapiens
aggattttaacaaaagcaagact

SEQ ID NO: 4068514 - DNA, 13 bp, Homo sapiens
aggattttatacc

SEQ ID NO: 4068515 - DNA, 13 bp, Homo sapiens
aggcaaaattgca

SEQ ID NO: 4068516 - DNA, 17 bp, Homo sapiens
aggcaaaattgcaaatc

SEQ ID NO: 4068517 - DNA, 22 bp, Homo sapiens
aggcaaagataatttatttcaa

SEQ ID NO: 4068518 - DNA, 16 bp, Homo sapiens
aggcaacatccaaaat

SEQ ID NO: 4068519 - DNA, 15 bp, Homo sapiens
aggcaacttttaaag

SEQ ID NO: 4068520 - DNA, 13 bp, Homo sapiens
aggcaagaaaagg

SEQ ID NO: 4068521 - DNA, 14 bp, Homo sapiens
aggcaagaaaagga

SEQ ID NO: 4068522 - DNA, 12 bp, Homo sapiens
aggcaagagaat

SEQ ID NO: 4068523 - DNA, 17 bp, Homo sapiens
aggcaagcaggacctgg

SEQ ID NO: 4068524 - DNA, 18 bp, Homo sapiens
aggcaagttaagagaaac

SEQ ID NO: 4068525 - DNA, 15 bp, Homo sapiens
aggcaagtttctagc

SEQ ID NO: 4068526 - DNA, 14 bp, Homo sapiens
aggcaataaaaatc

SEQ ID NO: 4068527 - DNA, 17 bp, Homo sapiens
aggcaatgtcaggaaca

SEQ ID NO: 4068528 - DNA, 11 bp, Homo sapiens
aggcacacagc

SEQ ID NO: 4068529 - DNA, 15 bp, Homo sapiens
aggcacacagcagcc

SEQ ID NO: 4068530 - DNA, 13 bp, Homo sapiens
aggcacacagcta

SEQ ID NO: 4068531 - DNA, 13 bp, Homo sapiens
aggcacagggccc

SEQ ID NO: 4068532 - DNA, 14 bp, Homo sapiens
aggcacagggcccg

SEQ ID NO: 4068533 - DNA, 22 bp, Homo sapiens
aggcacagggcccgcagtgctg

SEQ ID NO: 4068534 - DNA, 14 bp, Homo sapiens
aggcaccagaagaa

SEQ ID NO: 4068535 - DNA, 16 bp, Homo sapiens
aggcaccccctggaga

SEQ ID NO: 4068536 - DNA, 20 bp, Homo sapiens
aggcaccccctggagagaag

SEQ ID NO: 4068537 - DNA, 22 bp, Homo sapiens
aggcaccctcagggagcctccc

SEQ ID NO: 4068538 - DNA, 16 bp, Homo sapiens
aggcaccgagaatgtt

SEQ ID NO: 4068539 - DNA, 15 bp, Homo sapiens
aggcacgggtccctg

SEQ ID NO: 4068540 - DNA, 17 bp, Homo sapiens
aggcactgaagtgctta

SEQ ID NO: 4068541 - DNA, 22 bp, Homo sapiens
aggcactgccttctcctctctg

SEQ ID NO: 4068542 - DNA, 16 bp, Homo sapiens
aggcacttaagcacaa

SEQ ID NO: 4068543 - DNA, 17 bp, Homo sapiens
aggcagaaggaagcagg

SEQ ID NO: 4068544 - DNA, 15 bp, Homo sapiens
aggcagacagcaggc

SEQ ID NO: 4068545 - DNA, 22 bp, Homo sapiens
aggcagacagcaggcagcgcca

SEQ ID NO: 4068546 - DNA, 13 bp, Homo sapiens
aggctctgcccag

SEQ ID NO: 4068547 - DNA, 22 bp, Homo sapiens
aggctctggacagcagaagcct

SEQ ID NO: 4068548 - DNA, 19 bp, Homo sapiens
aggctctggggcagccccc

SEQ ID NO: 4068549 - DNA, 20 bp, Homo sapiens
aggctctggggcagccccca

SEQ ID NO: 4068550 - DNA, 19 bp, Homo sapiens
aggctcttaagcagcatgg

SEQ ID NO: 4068551 - DNA, 22 bp, Homo sapiens
aggctcttaagcagcatggaaa

SEQ ID NO: 4068552 - DNA, 22 bp, Homo sapiens
aggctcttagcagcttccagat

SEQ ID NO: 4068553 - DNA, 19 bp, Homo sapiens
aggctcttatgtgtgcctt

SEQ ID NO: 4068554 - DNA, 14 bp, Homo sapiens
aggctcttctcctt

SEQ ID NO: 4068555 - DNA, 13 bp, Homo sapiens
aggctgaaagagg

SEQ ID NO: 4068556 - DNA, 14 bp, Homo sapiens
aggctgagacagga

SEQ ID NO: 4068557 - DNA, 15 bp, Homo sapiens
aggctgagacaggag

SEQ ID NO: 4068558 - DNA, 17 bp, Homo sapiens
aggctgaggcctggact

SEQ ID NO: 4068559 - DNA, 14 bp, Homo sapiens
aggctgaggctggc

SEQ ID NO: 4068560 - DNA, 18 bp, Homo sapiens
aggctgaggctggcacag

SEQ ID NO: 4068561 - DNA, 19 bp, Homo sapiens
aggctgagtgagccacaga

SEQ ID NO: 4068562 - DNA, 18 bp, Homo sapiens
aggctgcagaggcacctc

SEQ ID NO: 4068563 - DNA, 21 bp, Homo sapiens
aggctgcagaggcacctcaac

SEQ ID NO: 4068564 - DNA, 20 bp, Homo sapiens
aggctgcagccgtggtccaa

SEQ ID NO: 4068565 - DNA, 20 bp, Homo sapiens
aggctgcccccggccccctg

SEQ ID NO: 4068566 - DNA, 12 bp, Homo sapiens
aggctgcccctc

SEQ ID NO: 4068567 - DNA, 18 bp, Homo sapiens
aggctgccgaggaccctc

SEQ ID NO: 4068568 - DNA, 17 bp, Homo sapiens
aggctgcctatgttggg

SEQ ID NO: 4068569 - DNA, 22 bp, Homo sapiens
aggctgcctatgttggggggga

SEQ ID NO: 4068570 - DNA, 14 bp, Homo sapiens
aggctgcctcctgc

SEQ ID NO: 4068571 - DNA, 15 bp, Homo sapiens
aggctgctaacctgg

SEQ ID NO: 4068572 - DNA, 20 bp, Homo sapiens
aggctggagtgcagtggcat

SEQ ID NO: 4068573 - DNA, 20 bp, Homo sapiens
aggctggagtggagtggcgt

SEQ ID NO: 4068574 - DNA, 20 bp, Homo sapiens
aggctggccagcaaggcagg

SEQ ID NO: 4068575 - DNA, 21 bp, Homo sapiens
aggctggccagcaaggcaggt

SEQ ID NO: 4068576 - DNA, 19 bp, Homo sapiens
aggctgggagtccctacct

SEQ ID NO: 4068577 - DNA, 19 bp, Homo sapiens
aggctgggcagccccagag

SEQ ID NO: 4068578 - DNA, 22 bp, Homo sapiens
aggctgggccatgtccaaagag

SEQ ID NO: 4068579 - DNA, 15 bp, Homo sapiens
aggctgggcccctgg

SEQ ID NO: 4068580 - DNA, 21 bp, Homo sapiens
aggctggggcggggcccagga

SEQ ID NO: 4068581 - DNA, 19 bp, Homo sapiens
aggctggtaagagaagtga

SEQ ID NO: 4068582 - DNA, 23 bp, Homo sapiens
aggctggtgctgtggccagggtg

SEQ ID NO: 4068583 - DNA, 20 bp, Homo sapiens
aggctgtcacagtcctgagt

SEQ ID NO: 4068584 - DNA, 16 bp, Homo sapiens
aggctgtcctgtacat

SEQ ID NO: 4068585 - DNA, 19 bp, Homo sapiens
aggctgtgggtagatgtgc

SEQ ID NO: 4068586 - DNA, 22 bp, Homo sapiens
aggcttatatttgtgtaatttt

SEQ ID NO: 4068587 - DNA, 15 bp, Homo sapiens
aggcttcacagtctg

SEQ ID NO: 4068588 - DNA, 10 bp, Homo sapiens
aggcttcctg

SEQ ID NO: 4068589 - DNA, 22 bp, Homo sapiens
aggcttcctgcaattttctaag

SEQ ID NO: 4068590 - DNA, 22 bp, Homo sapiens
aggcttcctgcgtcctcctcac

SEQ ID NO: 4068591 - DNA, 16 bp, Homo sapiens
aggcttctccgccagc

SEQ ID NO: 4068592 - DNA, 18 bp, Homo sapiens
aggcttctccgccagcct

SEQ ID NO: 4068593 - DNA, 19 bp, Homo sapiens
aggcttctccgccagcctc

SEQ ID NO: 4068594 - DNA, 22 bp, Homo sapiens
aggcttctccgccagcctcctc

SEQ ID NO: 4068595 - DNA, 23 bp, Homo sapiens
aggcttctccgccagcctcctct

SEQ ID NO: 4068596 - DNA, 20 bp, Homo sapiens
aggcttctgttcctctcttt

SEQ ID NO: 4068597 - DNA, 12 bp, Homo sapiens
aggcttgcagaa

SEQ ID NO: 4068598 - DNA, 15 bp, Homo sapiens
aggctttgtgttgta

SEQ ID NO: 4068599 - DNA, 17 bp, Homo sapiens
aggctttgtgttgtaat

SEQ ID NO: 4068600 - DNA, 14 bp, Homo sapiens
agggaaaagggaag

SEQ ID NO: 4068601 - DNA, 22 bp, Homo sapiens
agggaaaataaaaaaagaaaaa

SEQ ID NO: 4068602 - DNA, 16 bp, Homo sapiens
agggaaactattgtcc

SEQ ID NO: 4068603 - DNA, 18 bp, Homo sapiens
agggaaaggatattttct

SEQ ID NO: 4068604 - DNA, 17 bp, Homo sapiens
agggaaaggttttgtat

SEQ ID NO: 4068605 - DNA, 21 bp, Homo sapiens
agggaaaggttttgtattttt

SEQ ID NO: 4068606 - DNA, 13 bp, Homo sapiens
agggaagaaactg

SEQ ID NO: 4068607 - DNA, 15 bp, Homo sapiens
agggaagagaaagtg

SEQ ID NO: 4068608 - DNA, 13 bp, Homo sapiens
agggaagctggcc

SEQ ID NO: 4068609 - DNA, 16 bp, Homo sapiens
agggaagctggccgag

SEQ ID NO: 4068610 - DNA, 16 bp, Homo sapiens
agggaagctggcctga

SEQ ID NO: 4068611 - DNA, 17 bp, Homo sapiens
agggaagctggcctgag

SEQ ID NO: 4068612 - DNA, 23 bp, Homo sapiens
agggaagctggcctgagagggga

SEQ ID NO: 4068613 - DNA, 23 bp, Homo sapiens
agggaaggaactctggcttccag

SEQ ID NO: 4068614 - DNA, 17 bp, Homo sapiens
agggaagggtttctcta

SEQ ID NO: 4068615 - DNA, 21 bp, Homo sapiens
agggaaggtggccacagcaag

SEQ ID NO: 4068616 - DNA, 15 bp, Homo sapiens
agggaagtgtgagcg

SEQ ID NO: 4068617 - DNA, 20 bp, Homo sapiens
agggaagtgtgagcgccttg

SEQ ID NO: 4068618 - DNA, 12 bp, Homo sapiens
agggaattgctc

SEQ ID NO: 4068619 - DNA, 16 bp, Homo sapiens
agggaatttctatcta

SEQ ID NO: 4068620 - DNA, 22 bp, Homo sapiens
agggacaagtggactcagggca

SEQ ID NO: 4068621 - DNA, 22 bp, Homo sapiens
agggacagaggccccagcctcc

SEQ ID NO: 4068622 - DNA, 14 bp, Homo sapiens
agggacagcatgcc

SEQ ID NO: 4068623 - DNA, 21 bp, Homo sapiens
agggacagcccactgagaagt

SEQ ID NO: 4068624 - DNA, 18 bp, Homo sapiens
agggaccacaccctgtac

SEQ ID NO: 4068625 - DNA, 13 bp, Homo sapiens
agggaccaccctc

SEQ ID NO: 4068626 - DNA, 21 bp, Homo sapiens
agggaccatcaagaacctaca

SEQ ID NO: 4068627 - DNA, 20 bp, Homo sapiens
agggaccggtgctgcaggag

SEQ ID NO: 4068628 - DNA, 14 bp, Homo sapiens
agggacgctttgtc

SEQ ID NO: 4068629 - DNA, 17 bp, Homo sapiens
agggacgctttgtctgt

SEQ ID NO: 4068630 - DNA, 22 bp, Homo sapiens
agggactatctttgctgcagag

SEQ ID NO: 4068631 - DNA, 18 bp, Homo sapiens
agggactggaaccaggga

SEQ ID NO: 4068632 - DNA, 18 bp, Homo sapiens
agggacttttattttctt

SEQ ID NO: 4068633 - DNA, 14 bp, Homo sapiens
agggagaaaagaga

SEQ ID NO: 4068634 - DNA, 16 bp, Homo sapiens
agggagaaaagagaaa

SEQ ID NO: 4068635 - DNA, 13 bp, Homo sapiens
agggagaagctcc

SEQ ID NO: 4068636 - DNA, 23 bp, Homo sapiens
agggagagacctcatcaggatga

SEQ ID NO: 4068637 - DNA, 11 bp, Homo sapiens
agggagagaga

SEQ ID NO: 4068638 - DNA, 22 bp, Homo sapiens
agggagagagagagagagagga

SEQ ID NO: 4068639 - DNA, 12 bp, Homo sapiens
agggagaggccg

SEQ ID NO: 4068640 - DNA, 13 bp, Homo sapiens
agggagagggagg

SEQ ID NO: 4068641 - DNA, 15 bp, Homo sapiens
agggagcaagacaga

SEQ ID NO: 4068642 - DNA, 23 bp, Homo sapiens
agggagctctggggacagcttcc

SEQ ID NO: 4068643 - DNA, 19 bp, Homo sapiens
agggagctggctccagcct

SEQ ID NO: 4068644 - DNA, 19 bp, Homo sapiens
agggaggaagaaggcagtg

SEQ ID NO: 4068645 - DNA, 16 bp, Homo sapiens
agggaggagtggaggt

SEQ ID NO: 4068646 - DNA, 16 bp, Homo sapiens
agggagggaagtgtga

SEQ ID NO: 4068647 - DNA, 13 bp, Homo sapiens
agggagggaattt

SEQ ID NO: 4068648 - DNA, 19 bp, Homo sapiens
aggtggaagaagggagaag

SEQ ID NO: 4068649 - DNA, 14 bp, Homo sapiens
aggtggacctttta

SEQ ID NO: 4068650 - DNA, 15 bp, Homo sapiens
aggtggaccttttaa

SEQ ID NO: 4068651 - DNA, 22 bp, Homo sapiens
aggtggagaactgggatttgaa

SEQ ID NO: 4068652 - DNA, 22 bp, Homo sapiens
aggtggagcgttcaccagtgac

SEQ ID NO: 4068653 - DNA, 20 bp, Homo sapiens
aggtggaggctgcagtgagc

SEQ ID NO: 4068654 - DNA, 14 bp, Homo sapiens
aggtggagggaggg

SEQ ID NO: 4068655 - DNA, 17 bp, Homo sapiens
aggtggagggcacagcc

SEQ ID NO: 4068656 - DNA, 18 bp, Homo sapiens
aggtggagggcacagccc

SEQ ID NO: 4068657 - DNA, 19 bp, Homo sapiens
aggtggagggcacagccct

SEQ ID NO: 4068658 - DNA, 17 bp, Homo sapiens
aggtggagtttctctgt

SEQ ID NO: 4068659 - DNA, 15 bp, Homo sapiens
aggtggatctatttc

SEQ ID NO: 4068660 - DNA, 16 bp, Homo sapiens
aggtggatctatttca

SEQ ID NO: 4068661 - DNA, 14 bp, Homo sapiens
aggtggcaggacca

SEQ ID NO: 4068662 - DNA, 17 bp, Homo sapiens
aggtggcaggaccagga

SEQ ID NO: 4068663 - DNA, 19 bp, Homo sapiens
aggtggcaggaccaggact

SEQ ID NO: 4068664 - DNA, 14 bp, Homo sapiens
aggtggccactcca

SEQ ID NO: 4068665 - DNA, 22 bp, Homo sapiens
aggtggcctttgtgctgcgcct

SEQ ID NO: 4068666 - DNA, 17 bp, Homo sapiens
aggtggctctccagtta

SEQ ID NO: 4068667 - DNA, 22 bp, Homo sapiens
aggtgggcatgccaccctcaca

SEQ ID NO: 4068668 - DNA, 19 bp, Homo sapiens
aggtgggccttgctacctc

SEQ ID NO: 4068669 - DNA, 22 bp, Homo sapiens
aggtgggccttgctacctcaag

SEQ ID NO: 4068670 - DNA, 22 bp, Homo sapiens
aggtggggagtccagggctccc

SEQ ID NO: 4068671 - DNA, 17 bp, Homo sapiens
aggtgggtgctgccctg

SEQ ID NO: 4068672 - DNA, 20 bp, Homo sapiens
aggtgggtgctgccctgtgt

SEQ ID NO: 4068673 - DNA, 21 bp, Homo sapiens
aggtgggtgtgggtggaaggg

SEQ ID NO: 4068674 - DNA, 14 bp, Homo sapiens
aggtggtctgaatg

SEQ ID NO: 4068675 - DNA, 17 bp, Homo sapiens
aggtggtctgaatgttc

SEQ ID NO: 4068676 - DNA, 18 bp, Homo sapiens
aggtggtctgaatgttct

SEQ ID NO: 4068677 - DNA, 20 bp, Homo sapiens
aggtggtctgaatgttctga

SEQ ID NO: 4068678 - DNA, 21 bp, Homo sapiens
aggtggtctgaatgttctgac

SEQ ID NO: 4068679 - DNA, 16 bp, Homo sapiens
aggtgtacactaacat

SEQ ID NO: 4068680 - DNA, 17 bp, Homo sapiens
aggtgtacactaacatt

SEQ ID NO: 4068681 - DNA, 18 bp, Homo sapiens
aggtgtacactaacattt

SEQ ID NO: 4068682 - DNA, 20 bp, Homo sapiens
aggtgtacactaacatttcc

SEQ ID NO: 4068683 - DNA, 22 bp, Homo sapiens
aggtgtcaggatagtcacagtg

SEQ ID NO: 4068684 - DNA, 14 bp, Homo sapiens
aggtgtctgcaccc

SEQ ID NO: 4068685 - DNA, 16 bp, Homo sapiens
aggtgtctgcacccag

SEQ ID NO: 4068686 - DNA, 17 bp, Homo sapiens
aggtgtctggcctgagg

SEQ ID NO: 4068687 - DNA, 19 bp, Homo sapiens
aggtgtgaacctacctgcc

SEQ ID NO: 4068688 - DNA, 21 bp, Homo sapiens
aggtgtgaacctacctgcctt

SEQ ID NO: 4068689 - DNA, 17 bp, Homo sapiens
aggtgtgaggaggaggc

SEQ ID NO: 4068690 - DNA, 24 bp, Homo sapiens
aggtgtgcctggcctctgcctcca

SEQ ID NO: 4068691 - DNA, 14 bp, Homo sapiens
aggtgttagagagg

SEQ ID NO: 4068692 - DNA, 20 bp, Homo sapiens
aggtgttctacactcatctt

SEQ ID NO: 4068693 - DNA, 18 bp, Homo sapiens
aggtgttgattttctgtt

SEQ ID NO: 4068694 - DNA, 23 bp, Homo sapiens
aggtgttgccaaatatgtcctgg

SEQ ID NO: 4068695 - DNA, 20 bp, Homo sapiens
aggtgtttaaagagaggtta

SEQ ID NO: 4068696 - DNA, 19 bp, Homo sapiens
aggtgttttttatgaagtg

SEQ ID NO: 4068697 - DNA, 13 bp, Homo sapiens
aggttaatattta

SEQ ID NO: 4068698 - DNA, 14 bp, Homo sapiens
aggttaatgttcat

SEQ ID NO: 4068699 - DNA, 15 bp, Homo sapiens
aggttaattccaatt

SEQ ID NO: 4068700 - DNA, 22 bp, Homo sapiens
aggttaattccaattatatgag

SEQ ID NO: 4068701 - DNA, 16 bp, Homo sapiens
aggttaatttttcctt

SEQ ID NO: 4068702 - DNA, 19 bp, Homo sapiens
aggttataattttttttaa

SEQ ID NO: 4068703 - DNA, 20 bp, Homo sapiens
aggttatcgaaataacaatg

SEQ ID NO: 4068704 - DNA, 23 bp, Homo sapiens
aggttattttctttatcattgct

SEQ ID NO: 4068705 - DNA, 14 bp, Homo sapiens
aggttcccaagctc

SEQ ID NO: 4068706 - DNA, 15 bp, Homo sapiens
aggttcccaagctca

SEQ ID NO: 4068707 - DNA, 18 bp, Homo sapiens
aggttccctgttcttcct

SEQ ID NO: 4068708 - DNA, 20 bp, Homo sapiens
aggttccctgttcttcctcc

SEQ ID NO: 4068709 - DNA, 17 bp, Homo sapiens
aggttcctctgcctgcc

SEQ ID NO: 4068710 - DNA, 18 bp, Homo sapiens
aggttcctctgcctgccc

SEQ ID NO: 4068711 - DNA, 20 bp, Homo sapiens
aggttctctctactggtcct

SEQ ID NO: 4068712 - DNA, 14 bp, Homo sapiens
aggttctgcctgct

SEQ ID NO: 4068713 - DNA, 22 bp, Homo sapiens
aggttgaagacctaaccagggc

SEQ ID NO: 4068714 - DNA, 12 bp, Homo sapiens
aggttgaagcca

SEQ ID NO: 4068715 - DNA, 23 bp, Homo sapiens
aggttgaagccaagtggggtgct

SEQ ID NO: 4068716 - DNA, 21 bp, Homo sapiens
aggttgacaataaatgtgctt

SEQ ID NO: 4068717 - DNA, 15 bp, Homo sapiens
aggttgacaggaggt

SEQ ID NO: 4068718 - DNA, 20 bp, Homo sapiens
aggttggaaggggccttgct

SEQ ID NO: 4068719 - DNA, 15 bp, Homo sapiens
aggttggagcccagg

SEQ ID NO: 4068720 - DNA, 15 bp, Homo sapiens
aggttggatggatgg

SEQ ID NO: 4068721 - DNA, 12 bp, Homo sapiens
aggttggatggg

SEQ ID NO: 4068722 - DNA, 20 bp, Homo sapiens
aggttggatgggagtgggca

SEQ ID NO: 4068723 - DNA, 17 bp, Homo sapiens
aggttgtcactgagaag

SEQ ID NO: 4068724 - DNA, 20 bp, Homo sapiens
aggttgtctgaagtcactgc

SEQ ID NO: 4068725 - DNA, 16 bp, Homo sapiens
aggtttctctccctcc

SEQ ID NO: 4068726 - DNA, 14 bp, Homo sapiens
aggtttggctcctg

SEQ ID NO: 4068727 - DNA, 20 bp, Homo sapiens
aggtttggctcctgcccact

SEQ ID NO: 4068728 - DNA, 22 bp, Homo sapiens
aggtttggtgtgtggagatgca

SEQ ID NO: 4068729 - DNA, 23 bp, Homo sapiens
aggttttggatcttgaatgtggt

SEQ ID NO: 4068730 - DNA, 19 bp, Homo sapiens
aggtttttaaattgtttca

SEQ ID NO: 4068731 - DNA, 20 bp, Homo sapiens
aggtttttattagtaccata

SEQ ID NO: 4068732 - DNA, 20 bp, Homo sapiens
aggtttttctcatgtatctt

SEQ ID NO: 4068733 - DNA, 14 bp, Homo sapiens
agtaaaaaggctaa

SEQ ID NO: 4068734 - DNA, 17 bp, Homo sapiens
agtaaaataataatttt

SEQ ID NO: 4068735 - DNA, 21 bp, Homo sapiens
agtaaactactgttaggaaca

SEQ ID NO: 4068736 - DNA, 16 bp, Homo sapiens
agtaaaggcaaactta

SEQ ID NO: 4068737 - DNA, 18 bp, Homo sapiens
agtaaagtgttctgccag

SEQ ID NO: 4068738 - DNA, 15 bp, Homo sapiens
agtaaagttaaaaga

SEQ ID NO: 4068739 - DNA, 21 bp, Homo sapiens
agtaaatattgaggctttgtg

SEQ ID NO: 4068740 - DNA, 15 bp, Homo sapiens
agtaaatctcttctg

SEQ ID NO: 4068741 - DNA, 22 bp, Homo sapiens
agtaaatgctaggttaattcca

SEQ ID NO: 4068742 - DNA, 15 bp, Homo sapiens
agtaaatgtctttgt

SEQ ID NO: 4068743 - DNA, 19 bp, Homo sapiens
agtaaatgtctttgtaagt

SEQ ID NO: 4068744 - DNA, 19 bp, Homo sapiens
agtaaattgcctgatttgt

SEQ ID NO: 4068745 - DNA, 21 bp, Homo sapiens
agtaagaaagtgaagcaaatc

SEQ ID NO: 4068746 - DNA, 20 bp, Homo sapiens
ccacagttgccaccacctct

SEQ ID NO: 4068747 - DNA, 22 bp, Homo sapiens
ccacatagtgatggttcccctg

SEQ ID NO: 4068748 - DNA, 21 bp, Homo sapiens
cttccagcttcaggcaccagc

SEQ ID NO: 4068749 - DNA, 19 bp, Homo sapiens
cttccaggaaactccacat

SEQ ID NO: 4068750 - DNA, 20 bp, Homo sapiens
agtatttatatatttataac

SEQ ID NO: 4068751 - DNA, 23 bp, Homo sapiens
agtatttatatatttataactca

SEQ ID NO: 4068752 - DNA, 15 bp, Homo sapiens
agtatttattttgta

SEQ ID NO: 4068753 - DNA, 17 bp, Homo sapiens
agtatttattttgtaat

SEQ ID NO: 4068754 - DNA, 22 bp, Homo sapiens
agtatttattttgtaattatga

SEQ ID NO: 4068755 - DNA, 14 bp, Homo sapiens
agtatttcagtgta

SEQ ID NO: 4068756 - DNA, 15 bp, Homo sapiens
agtatttcatttctt

SEQ ID NO: 4068757 - DNA, 20 bp, Homo sapiens
agtatttgaattaaaacttc

SEQ ID NO: 4068758 - DNA, 22 bp, Homo sapiens
agtatttgaattaaaacttctt

SEQ ID NO: 4068759 - DNA, 17 bp, Homo sapiens
agtatttgggaagtgaa

SEQ ID NO: 4068760 - DNA, 19 bp, Homo sapiens
agtattttaagaagacata

SEQ ID NO: 4068761 - DNA, 17 bp, Homo sapiens
agtattttaatcctgta

SEQ ID NO: 4068762 - DNA, 13 bp, Homo sapiens
agtattttgaagt

SEQ ID NO: 4068763 - DNA, 19 bp, Homo sapiens
agtattttgaagtttacat

SEQ ID NO: 4068764 - DNA, 20 bp, Homo sapiens
agtattttgaagtttacatt

SEQ ID NO: 4068765 - DNA, 23 bp, Homo sapiens
agtattttggttcttagttctca

SEQ ID NO: 4068766 - DNA, 13 bp, Homo sapiens
agtatttttataa

SEQ ID NO: 4068767 - DNA, 15 bp, Homo sapiens
agtatttttgtctct

SEQ ID NO: 4068768 - DNA, 14 bp, Homo sapiens
agtattttttcaag

SEQ ID NO: 4068769 - DNA, 18 bp, Homo sapiens
agtcaaacatttcaaagt

SEQ ID NO: 4068770 - DNA, 23 bp, Homo sapiens
agtcaaatggtaggcatttccta

SEQ ID NO: 4068771 - DNA, 13 bp, Homo sapiens
agtcaagaagaat

SEQ ID NO: 4068772 - DNA, 14 bp, Homo sapiens
agtcaataggccta

SEQ ID NO: 4068773 - DNA, 14 bp, Homo sapiens
agtcaatgtgcagt

SEQ ID NO: 4068774 - DNA, 19 bp, Homo sapiens
agtcacactgctagcaaat

SEQ ID NO: 4068775 - DNA, 15 bp, Homo sapiens
agtcaccacttattt

SEQ ID NO: 4068776 - DNA, 20 bp, Homo sapiens
agtcacccctttctgtccca

SEQ ID NO: 4068777 - DNA, 14 bp, Homo sapiens
agtcacctgctcca

SEQ ID NO: 4068778 - DNA, 15 bp, Homo sapiens
agtcacctgctccag

SEQ ID NO: 4068779 - DNA, 17 bp, Homo sapiens
agtcacctgctccagaa

SEQ ID NO: 4068780 - DNA, 22 bp, Homo sapiens
agtcacgctggggctctctgag

SEQ ID NO: 4068781 - DNA, 18 bp, Homo sapiens
agtcactgcaaaaccagg

SEQ ID NO: 4068782 - DNA, 22 bp, Homo sapiens
agtcactggaggttgaagccaa

SEQ ID NO: 4068783 - DNA, 23 bp, Homo sapiens
agtcactggaggttgaagccaag

SEQ ID NO: 4068784 - DNA, 16 bp, Homo sapiens
agtcacttactattgt

SEQ ID NO: 4068785 - DNA, 20 bp, Homo sapiens
agtcacttgatgtgccattt

SEQ ID NO: 4068786 - DNA, 23 bp, Homo sapiens
agtcacttgatgtgccattttaa

SEQ ID NO: 4068787 - DNA, 15 bp, Homo sapiens
agtcagaaaacttta

SEQ ID NO: 4068788 - DNA, 19 bp, Homo sapiens
agtcagagccctggctggg

SEQ ID NO: 4068789 - DNA, 22 bp, Homo sapiens
agtcagagccctggctgggttc

SEQ ID NO: 4068790 - DNA, 20 bp, Homo sapiens
agtcagagtccagtgctctg

SEQ ID NO: 4068791 - DNA, 23 bp, Homo sapiens
agtcagatgagcaaggacattgc

SEQ ID NO: 4068792 - DNA, 18 bp, Homo sapiens
agtcagatgggtctgata

SEQ ID NO: 4068793 - DNA, 17 bp, Homo sapiens
agtcagcatgcttccca

SEQ ID NO: 4068794 - DNA, 18 bp, Homo sapiens
agtcagcatgcttcccag

SEQ ID NO: 4068795 - DNA, 16 bp, Homo sapiens
agtcagcctcgcaggc

SEQ ID NO: 4068796 - DNA, 14 bp, Homo sapiens
agtcagctctctgc

SEQ ID NO: 4068797 - DNA, 17 bp, Homo sapiens
agtcagctctctgccct

SEQ ID NO: 4068798 - DNA, 11 bp, Homo sapiens
agtcaggcagg

SEQ ID NO: 4068799 - DNA, 14 bp, Homo sapiens
agtcaggtccaatt

SEQ ID NO: 4068800 - DNA, 15 bp, Homo sapiens
agtcaggtgctcaat

SEQ ID NO: 4068801 - DNA, 21 bp, Homo sapiens
agtcagtcatgatggcaccac

SEQ ID NO: 4068802 - DNA, 16 bp, Homo sapiens
agtcagtgtctggctt

SEQ ID NO: 4068803 - DNA, 14 bp, Homo sapiens
agtcagtttgcagt

SEQ ID NO: 4068804 - DNA, 16 bp, Homo sapiens
agtcataggttaatat

SEQ ID NO: 4068805 - DNA, 14 bp, Homo sapiens
agtcatcatcaggg

SEQ ID NO: 4068806 - DNA, 16 bp, Homo sapiens
agtcatcatcagggcc

SEQ ID NO: 4068807 - DNA, 21 bp, Homo sapiens
agtcatcatcagggcctgggg

SEQ ID NO: 4068808 - DNA, 17 bp, Homo sapiens
agtcatcgagtggccca

SEQ ID NO: 4068809 - DNA, 19 bp, Homo sapiens
agtcatctccatcagctgt

SEQ ID NO: 4068810 - DNA, 20 bp, Homo sapiens
agtcatctccatcagctgta

SEQ ID NO: 4068811 - DNA, 13 bp, Homo sapiens
agtcatgaagccc

SEQ ID NO: 4068812 - DNA, 21 bp, Homo sapiens
agtcatgaagcccaagtgaaa

SEQ ID NO: 4068813 - DNA, 23 bp, Homo sapiens
agtcatgcaaaccgttaggaaaa

SEQ ID NO: 4068814 - DNA, 13 bp, Homo sapiens
agtcatgcataaa

SEQ ID NO: 4068815 - DNA, 14 bp, Homo sapiens
agtcatgcataaat

SEQ ID NO: 4068816 - DNA, 14 bp, Homo sapiens
agtcatgctcccct

SEQ ID NO: 4068817 - DNA, 18 bp, Homo sapiens
agtcatgctcccctgtgc

SEQ ID NO: 4068818 - DNA, 12 bp, Homo sapiens
agtcatgtgacc

SEQ ID NO: 4068819 - DNA, 18 bp, Homo sapiens
agtcattagactcctcct

SEQ ID NO: 4068820 - DNA, 19 bp, Homo sapiens
agtcattagactcctcctc

SEQ ID NO: 4068821 - DNA, 15 bp, Homo sapiens
agtcattggctgtct

SEQ ID NO: 4068822 - DNA, 19 bp, Homo sapiens
agtcatttactaaacatat

SEQ ID NO: 4068823 - DNA, 19 bp, Homo sapiens
agtcatttgctgagcatgt

SEQ ID NO: 4068824 - DNA, 23 bp, Homo sapiens
agtccaaatgtcctccagaagcc

SEQ ID NO: 4068825 - DNA, 21 bp, Homo sapiens
agtccaaggggtcccctccag

SEQ ID NO: 4068826 - DNA, 14 bp, Homo sapiens
agtccaatgtggca

SEQ ID NO: 4068827 - DNA, 14 bp, Homo sapiens
agtccactgctcca

SEQ ID NO: 4068828 - DNA, 11 bp, Homo sapiens
agtccagaccc

SEQ ID NO: 4068829 - DNA, 13 bp, Homo sapiens
agtccagagcttg

SEQ ID NO: 4068830 - DNA, 22 bp, Homo sapiens
agtccagggctcccggagaggg

SEQ ID NO: 4068831 - DNA, 15 bp, Homo sapiens
agtccagtgctctgc

SEQ ID NO: 4068832 - DNA, 16 bp, Homo sapiens
agtccagtgctctgcc

SEQ ID NO: 4068833 - DNA, 24 bp, Homo sapiens
agtccagtgtcacctctctcagag

SEQ ID NO: 4068834 - DNA, 14 bp, Homo sapiens
agtccattctccca

SEQ ID NO: 4068835 - DNA, 16 bp, Homo sapiens
agtccattctcccagg

SEQ ID NO: 4068836 - DNA, 16 bp, Homo sapiens
agtccatttatatatg

SEQ ID NO: 4068837 - DNA, 18 bp, Homo sapiens
agtccatttcccacatct

SEQ ID NO: 4068838 - DNA, 16 bp, Homo sapiens
agtcccaagctaggct

SEQ ID NO: 4068839 - DNA, 22 bp, Homo sapiens
agtcccagtattctcagagcat

SEQ ID NO: 4068840 - DNA, 16 bp, Homo sapiens
agtccccacccctgcc

SEQ ID NO: 4068841 - DNA, 18 bp, Homo sapiens
agtccccacccctgcccc

SEQ ID NO: 4068842 - DNA, 20 bp, Homo sapiens
agtccccacccctgccccca

SEQ ID NO: 4068843 - DNA, 13 bp, Homo sapiens
agtccccagaact

SEQ ID NO: 4068844 - DNA, 14 bp, Homo sapiens
agtccccctgtgca

SEQ ID NO: 4068845 - DNA, 15 bp, Homo sapiens
agtcccctccaggaa

SEQ ID NO: 4068846 - DNA, 17 bp, Homo sapiens
agtcccctccaggaaga

SEQ ID NO: 4068847 - DNA, 14 bp, Homo sapiens
agtccctccctgcc

SEQ ID NO: 4068848 - DNA, 15 bp, Homo sapiens
agtccctccctgcct

SEQ ID NO: 4068849 - DNA, 19 bp, Homo sapiens
agtccctccctgcctgagg

SEQ ID NO: 4068850 - DNA, 20 bp, Homo sapiens
agtcccttcccctccctggc

SEQ ID NO: 4068851 - DNA, 21 bp, Homo sapiens
agtcccttcccctccctggct

SEQ ID NO: 4068852 - DNA, 22 bp, Homo sapiens
agtcccttcccctccctggctc

SEQ ID NO: 4068853 - DNA, 19 bp, Homo sapiens
ccctcaacaagggagagac

SEQ ID NO: 4068854 - DNA, 21 bp, Homo sapiens
ccctcaacaagggagagacct

SEQ ID NO: 4068855 - DNA, 16 bp, Homo sapiens
ccctcaacaggcccag

SEQ ID NO: 4068856 - DNA, 16 bp, Homo sapiens
ccctcaacctcttctg

SEQ ID NO: 4068857 - DNA, 15 bp, Homo sapiens
ccctcaagccccagc

SEQ ID NO: 4068858 - DNA, 21 bp, Homo sapiens
ccctcaagccccagcagccct

SEQ ID NO: 4068859 - DNA, 22 bp, Homo sapiens
ccctcaagccccagcagccctc

SEQ ID NO: 4068860 - DNA, 19 bp, Homo sapiens
ccctcaatccaccttcagg

SEQ ID NO: 4068861 - DNA, 23 bp, Homo sapiens
ccctcacacacacagctgggcaa

SEQ ID NO: 4068862 - DNA, 13 bp, Homo sapiens
ccctcaccctgcc

SEQ ID NO: 4068863 - DNA, 21 bp, Homo sapiens
ccctcactattcttggaccat

SEQ ID NO: 4068864 - DNA, 14 bp, Homo sapiens
ccctcactctggcc

SEQ ID NO: 4068865 - DNA, 17 bp, Homo sapiens
ccctcactctgtcagcc

SEQ ID NO: 4068866 - DNA, 18 bp, Homo sapiens
ccctcactctgtcagcca

SEQ ID NO: 4068867 - DNA, 23 bp, Homo sapiens
ccctcactctgtcagccagccgc

SEQ ID NO: 4068868 - DNA, 18 bp, Homo sapiens
ccctcactgaatgcctca

SEQ ID NO: 4068869 - DNA, 18 bp, Homo sapiens
ccctcagatgatctctcc

SEQ ID NO: 4068870 - DNA, 22 bp, Homo sapiens
ccctcagatgatctctccacgg

SEQ ID NO: 4068871 - DNA, 13 bp, Homo sapiens
ccctcagcctcag

SEQ ID NO: 4068872 - DNA, 16 bp, Homo sapiens
ccctcagcctcagagg

SEQ ID NO: 4068873 - DNA, 22 bp, Homo sapiens
ccctcagcctcagaggagctct

SEQ ID NO: 4068874 - DNA, 17 bp, Homo sapiens
ccctcaggactgcaaca

SEQ ID NO: 4068875 - DNA, 18 bp, Homo sapiens
ccctcaggcataggcctg

SEQ ID NO: 4068876 - DNA, 19 bp, Homo sapiens
ccctcaggcataggcctgg

SEQ ID NO: 4068877 - DNA, 22 bp, Homo sapiens
ccctcaggggaaaactgttacc

SEQ ID NO: 4068878 - DNA, 17 bp, Homo sapiens
ccctcatctctctgccc

SEQ ID NO: 4068879 - DNA, 15 bp, Homo sapiens
ccctcatggccccca

SEQ ID NO: 4068880 - DNA, 19 bp, Homo sapiens
ccctcatggcccccagggg

SEQ ID NO: 4068881 - DNA, 16 bp, Homo sapiens
ccctcatggcccctct

SEQ ID NO: 4068882 - DNA, 17 bp, Homo sapiens
ccctcattactgggcct

SEQ ID NO: 4068883 - DNA, 15 bp, Homo sapiens
ccctccaaacctcca

SEQ ID NO: 4068884 - DNA, 16 bp, Homo sapiens
ccctccaaacctccag

SEQ ID NO: 4068885 - DNA, 17 bp, Homo sapiens
ccctccaaacctccagc

SEQ ID NO: 4068886 - DNA, 13 bp, Homo sapiens
ccctccacaccag

SEQ ID NO: 4068887 - DNA, 15 bp, Homo sapiens
ccctccacatcccag

SEQ ID NO: 4068888 - DNA, 14 bp, Homo sapiens
ccctccaccccaca

SEQ ID NO: 4068889 - DNA, 16 bp, Homo sapiens
ccctccaccccacaga

SEQ ID NO: 4068890 - DNA, 21 bp, Homo sapiens
ccctccacgcctcctggccag

SEQ ID NO: 4068891 - DNA, 11 bp, Homo sapiens
ccctccaggaa

SEQ ID NO: 4068892 - DNA, 21 bp, Homo sapiens
ccctccattggctcccaagtc

SEQ ID NO: 4068893 - DNA, 22 bp, Homo sapiens
ccctccattgggcacagtccag

SEQ ID NO: 4068894 - DNA, 24 bp, Homo sapiens
ccctccattgggcacagtccagac

SEQ ID NO: 4068895 - DNA, 16 bp, Homo sapiens
ccctcccccaaccccc

SEQ ID NO: 4068896 - DNA, 18 bp, Homo sapiens
ccctcccccattccctcc

SEQ ID NO: 4068897 - DNA, 12 bp, Homo sapiens
ccctcccccttg

SEQ ID NO: 4068898 - DNA, 15 bp, Homo sapiens
ccctccctacacaca

SEQ ID NO: 4068899 - DNA, 17 bp, Homo sapiens
ccctccctacacacaca

SEQ ID NO: 4068900 - DNA, 13 bp, Homo sapiens
ccctccctgactc

SEQ ID NO: 4068901 - DNA, 22 bp, Homo sapiens
ccctccctgactggcctgggat

SEQ ID NO: 4068902 - DNA, 14 bp, Homo sapiens
ccctccctgcccct

SEQ ID NO: 4068903 - DNA, 17 bp, Homo sapiens
ccctccctgcctgaggg

SEQ ID NO: 4068904 - DNA, 20 bp, Homo sapiens
ccctccctgcctgagggcag

SEQ ID NO: 4068905 - DNA, 19 bp, Homo sapiens
ccctccctggctcccatga

SEQ ID NO: 4068906 - DNA, 19 bp, Homo sapiens
ccctccctgttccccagag

SEQ ID NO: 4068907 - DNA, 14 bp, Homo sapiens
ccctcccttcaacc

SEQ ID NO: 4068908 - DNA, 21 bp, Homo sapiens
ccctcccttgctgaacacaca

SEQ ID NO: 4068909 - DNA, 18 bp, Homo sapiens
ccctccgaccctcatggc

SEQ ID NO: 4068910 - DNA, 13 bp, Homo sapiens
ccctccgccttct

SEQ ID NO: 4068911 - DNA, 19 bp, Homo sapiens
ccctccggactggtgccct

SEQ ID NO: 4068912 - DNA, 17 bp, Homo sapiens
ccctccgtgatccatcc

SEQ ID NO: 4068913 - DNA, 12 bp, Homo sapiens
ccctcctcacct

SEQ ID NO: 4068914 - DNA, 13 bp, Homo sapiens
ccctcctcacctc

SEQ ID NO: 4068915 - DNA, 16 bp, Homo sapiens
ccctcctcacctctgg

SEQ ID NO: 4068916 - DNA, 21 bp, Homo sapiens
ccctcctcactcccacctgca

SEQ ID NO: 4068917 - DNA, 19 bp, Homo sapiens
ccctcctccagcccctgtc

SEQ ID NO: 4068918 - DNA, 16 bp, Homo sapiens
ccctcctcctcttcac

SEQ ID NO: 4068919 - DNA, 19 bp, Homo sapiens
ccctcctcctcttcaccag

SEQ ID NO: 4068920 - DNA, 15 bp, Homo sapiens
ccctcctcgggccga

SEQ ID NO: 4068921 - DNA, 18 bp, Homo sapiens
ccctcctcgggccgaggc

SEQ ID NO: 4068922 - DNA, 17 bp, Homo sapiens
ccctcctctgagaggcg

SEQ ID NO: 4068923 - DNA, 18 bp, Homo sapiens
ccctcctgccccacactc

SEQ ID NO: 4068924 - DNA, 19 bp, Homo sapiens
ccctcctgccccacactcc

SEQ ID NO: 4068925 - DNA, 19 bp, Homo sapiens
ccctcctgtgctgggggaa

SEQ ID NO: 4068926 - DNA, 12 bp, Homo sapiens
ccctccttccct

SEQ ID NO: 4068927 - DNA, 17 bp, Homo sapiens
ccctccttgggtcattg

SEQ ID NO: 4068928 - DNA, 20 bp, Homo sapiens
ccctcgacagcgcccctgct

SEQ ID NO: 4068929 - DNA, 23 bp, Homo sapiens
ccctcgacagcgcccctgctgtc

SEQ ID NO: 4068930 - DNA, 16 bp, Homo sapiens
ccctcgatatttttaa

SEQ ID NO: 4068931 - DNA, 18 bp, Homo sapiens
ccctcggagttcttcttg

SEQ ID NO: 4068932 - DNA, 18 bp, Homo sapiens
ccctcgtccaccccccac

SEQ ID NO: 4068933 - DNA, 20 bp, Homo sapiens
ccctcgtccaccccccacac

SEQ ID NO: 4068934 - DNA, 19 bp, Homo sapiens
ccctctagaaatttttcag

SEQ ID NO: 4068935 - DNA, 17 bp, Homo sapiens
ccctctagtgccttctt

SEQ ID NO: 4068936 - DNA, 17 bp, Homo sapiens
ccctctcagaggcctgc

SEQ ID NO: 4068937 - DNA, 23 bp, Homo sapiens
ccctctcagaggcctgctgccag

SEQ ID NO: 4068938 - DNA, 13 bp, Homo sapiens
ccctctcagctcc

SEQ ID NO: 4068939 - DNA, 15 bp, Homo sapiens
ccctctcctgcccag

SEQ ID NO: 4068940 - DNA, 12 bp, Homo sapiens
ccctctcctggg

SEQ ID NO: 4068941 - DNA, 20 bp, Homo sapiens
ccctctctcagcacagcctg

SEQ ID NO: 4068942 - DNA, 19 bp, Homo sapiens
ccctctctcttctgctcca

SEQ ID NO: 4068943 - DNA, 16 bp, Homo sapiens
ccctctgaacttgcct

SEQ ID NO: 4068944 - DNA, 15 bp, Homo sapiens
ccctctgacctgcac

SEQ ID NO: 4068945 - DNA, 20 bp, Homo sapiens
ccctctgagaattccaagga

SEQ ID NO: 4068946 - DNA, 21 bp, Homo sapiens
ccctctgagaattccaaggag

SEQ ID NO: 4068947 - DNA, 20 bp, Homo sapiens
ccctctgccggtcgggcagc

SEQ ID NO: 4068948 - DNA, 16 bp, Homo sapiens
ccctctgccttcaggc

SEQ ID NO: 4068949 - DNA, 20 bp, Homo sapiens
ccctctgccttcaggcttct

SEQ ID NO: 4068950 - DNA, 14 bp, Homo sapiens
ccctctgctgctgt

SEQ ID NO: 4068951 - DNA, 12 bp, Homo sapiens
ccctctggaggg

SEQ ID NO: 4068952 - DNA, 22 bp, Homo sapiens
ccctctggaggggtgtggctcc

SEQ ID NO: 4068953 - DNA, 12 bp, Homo sapiens
ccctctggccag

SEQ ID NO: 4068954 - DNA, 13 bp, Homo sapiens
ccctctggccagg

SEQ ID NO: 4068955 - DNA, 12 bp, Homo sapiens
ccctctggtgtg

SEQ ID NO: 4068956 - DNA, 23 bp, Homo sapiens
ccctctgtcttcaggctctgccc

SEQ ID NO: 4068957 - DNA, 18 bp, Homo sapiens
ccctcttattcctctagg

SEQ ID NO: 4068958 - DNA, 20 bp, Homo sapiens
ccctcttgtccctttcccta

SEQ ID NO: 4068959 - DNA, 14 bp, Homo sapiens
ccctctttgctgca

SEQ ID NO: 4068960 - DNA, 19 bp, Homo sapiens
ccctctttgctgcagagaa

SEQ ID NO: 4068961 - DNA, 21 bp, Homo sapiens
ccctctttggctcccctgtac

SEQ ID NO: 4068962 - DNA, 21 bp, Homo sapiens
ccctcttttgttaaataatat

SEQ ID NO: 4068963 - DNA, 17 bp, Homo sapiens
ccctgaaggggccatga

SEQ ID NO: 4068964 - DNA, 15 bp, Homo sapiens
ccctgaatccccctt

SEQ ID NO: 4068965 - DNA, 20 bp, Homo sapiens
ccctgaatggttccatgcct

SEQ ID NO: 4068966 - DNA, 19 bp, Homo sapiens
ccctgacctccgcccctgc

SEQ ID NO: 4068967 - DNA, 20 bp, Homo sapiens
ccctgacctgtgagcccagc

SEQ ID NO: 4068968 - DNA, 15 bp, Homo sapiens
ccctgactcctctgg

SEQ ID NO: 4068969 - DNA, 17 bp, Homo sapiens
ccctgactcctctggct

SEQ ID NO: 4068970 - DNA, 19 bp, Homo sapiens
ccctgactcctctggcttt

SEQ ID NO: 4068971 - DNA, 16 bp, Homo sapiens
ccctgagaagctgctc

SEQ ID NO: 4068972 - DNA, 15 bp, Homo sapiens
ccctgagagtctggt

SEQ ID NO: 4068973 - DNA, 16 bp, Homo sapiens
ccctgagatcccctga

SEQ ID NO: 4068974 - DNA, 17 bp, Homo sapiens
ccctgagatcccctgag

SEQ ID NO: 4068975 - DNA, 16 bp, Homo sapiens
ccctgagcaggaaagt

SEQ ID NO: 4068976 - DNA, 22 bp, Homo sapiens
ccctgaggatgggtcagagcta

SEQ ID NO: 4068977 - DNA, 17 bp, Homo sapiens
ccctgaggccctgggct

SEQ ID NO: 4068978 - DNA, 18 bp, Homo sapiens
ccctgaggccctgggctg

SEQ ID NO: 4068979 - DNA, 20 bp, Homo sapiens
ccctgaggcggaggctgtgc

SEQ ID NO: 4068980 - DNA, 22 bp, Homo sapiens
ccctgaggcggaggctgtgctc

SEQ ID NO: 4068981 - DNA, 18 bp, Homo sapiens
ccctgaggtcagggagtg

SEQ ID NO: 4068982 - DNA, 18 bp, Homo sapiens
ccctgaggtgaaagggag

SEQ ID NO: 4068983 - DNA, 20 bp, Homo sapiens
ccctgaggtgaaagggagct

SEQ ID NO: 4068984 - DNA, 21 bp, Homo sapiens
ccctgagtggatctccaagga

SEQ ID NO: 4068985 - DNA, 23 bp, Homo sapiens
ccctgagtggatctccaaggacc

SEQ ID NO: 4068986 - DNA, 18 bp, Homo sapiens
ccctgatcccattttcct

SEQ ID NO: 4068987 - DNA, 22 bp, Homo sapiens
ccctgatcccattttcctctga

SEQ ID NO: 4068988 - DNA, 23 bp, Homo sapiens
ccctgatcccttccacctgctct

SEQ ID NO: 4068989 - DNA, 20 bp, Homo sapiens
ccctgatgacacccaccctg

SEQ ID NO: 4068990 - DNA, 13 bp, Homo sapiens
ccctgatggcaga

SEQ ID NO: 4068991 - DNA, 24 bp, Homo sapiens
ccctgattgacctgctccgctgct

SEQ ID NO: 4068992 - DNA, 13 bp, Homo sapiens
ccctgcaaacaga

SEQ ID NO: 4068993 - DNA, 18 bp, Homo sapiens
ccctgcaaacagaacagg

SEQ ID NO: 4068994 - DNA, 19 bp, Homo sapiens
ccctgcaacttccgctgag

SEQ ID NO: 4068995 - DNA, 23 bp, Homo sapiens
ccctgcaacttccgctgaggggt

SEQ ID NO: 4068996 - DNA, 14 bp, Homo sapiens
ccctgcacgtcatg

SEQ ID NO: 4068997 - DNA, 18 bp, Homo sapiens
ccctgcagacctcaagcc

SEQ ID NO: 4068998 - DNA, 21 bp, Homo sapiens
ccctgcagacctcaagccatc

SEQ ID NO: 4068999 - DNA, 17 bp, Homo sapiens
ccctgcagcccaccaga

SEQ ID NO: 4069000 - DNA, 13 bp, Homo sapiens
ccctgcagctctc

SEQ ID NO: 4069001 - DNA, 20 bp, Homo sapiens
ccctgcagttggcagaaagg

SEQ ID NO: 4069002 - DNA, 12 bp, Homo sapiens
ccctgcatcccc

SEQ ID NO: 4069003 - DNA, 10 bp, Homo sapiens
ccctgccaca

SEQ ID NO: 4069004 - DNA, 13 bp, Homo sapiens
ccctgccacagcc

SEQ ID NO: 4069005 - DNA, 15 bp, Homo sapiens
ccctgccacagccag

SEQ ID NO: 4069006 - DNA, 16 bp, Homo sapiens
ccctgccacagccaga

SEQ ID NO: 4069007 - DNA, 18 bp, Homo sapiens
ccctgccacagccagagg

SEQ ID NO: 4069008 - DNA, 14 bp, Homo sapiens
ccctgccacataca

SEQ ID NO: 4069009 - DNA, 20 bp, Homo sapiens
ccctgccacatacaggtgct

SEQ ID NO: 4069010 - DNA, 17 bp, Homo sapiens
ccctgccacctccctga

SEQ ID NO: 4069011 - DNA, 22 bp, Homo sapiens
ccctgcccaagggcctcccacc

SEQ ID NO: 4069012 - DNA, 14 bp, Homo sapiens
ccctgcccagatca

SEQ ID NO: 4069013 - DNA, 12 bp, Homo sapiens
ccctgcccccca

SEQ ID NO: 4069014 - DNA, 16 bp, Homo sapiens
ccctgccccccagcct

SEQ ID NO: 4069015 - DNA, 18 bp, Homo sapiens
ccctgccccggaggaagc

SEQ ID NO: 4069016 - DNA, 19 bp, Homo sapiens
ccctgcccctcccttcaac

SEQ ID NO: 4069017 - DNA, 12 bp, Homo sapiens
ccctgccctgca

SEQ ID NO: 4069018 - DNA, 16 bp, Homo sapiens
ccctgcccttctcaag

SEQ ID NO: 4069019 - DNA, 14 bp, Homo sapiens
ccctgcctcagctg

SEQ ID NO: 4069020 - DNA, 12 bp, Homo sapiens
ccctgcctcctg

SEQ ID NO: 4069021 - DNA, 14 bp, Homo sapiens
ccctgcctcctggg

SEQ ID NO: 4069022 - DNA, 15 bp, Homo sapiens
ccctgcctcctggga

SEQ ID NO: 4069023 - DNA, 16 bp, Homo sapiens
ccctgcctcctgggaa

SEQ ID NO: 4069024 - DNA, 12 bp, Homo sapiens
ccctgcctgagg

SEQ ID NO: 4069025 - DNA, 13 bp, Homo sapiens
ccctgcctgccct

SEQ ID NO: 4069026 - DNA, 23 bp, Homo sapiens
ccctgccttgggccttgctgctg

SEQ ID NO: 4069027 - DNA, 14 bp, Homo sapiens
ccctgcgcctccag

SEQ ID NO: 4069028 - DNA, 18 bp, Homo sapiens
ccctgcgcctccagaggt

SEQ ID NO: 4069029 - DNA, 21 bp, Homo sapiens
ccctgcgcctccagaggtcct

SEQ ID NO: 4069030 - DNA, 15 bp, Homo sapiens
ccctgcgcctgtgat

SEQ ID NO: 4069031 - DNA, 14 bp, Homo sapiens
ccctgcggcctcca

SEQ ID NO: 4069032 - DNA, 22 bp, Homo sapiens
ccctgcgggtgaacaaagcagc

SEQ ID NO: 4069033 - DNA, 22 bp, Homo sapiens
ccctgcggtcaggctgggcagc

SEQ ID NO: 4069034 - DNA, 17 bp, Homo sapiens
ccctgcgtgggggccag

SEQ ID NO: 4069035 - DNA, 15 bp, Homo sapiens
ccctgctccaccagc

SEQ ID NO: 4069036 - DNA, 16 bp, Homo sapiens
ccctgctccaccagca

SEQ ID NO: 4069037 - DNA, 19 bp, Homo sapiens
ccctgctccaccagcagca

SEQ ID NO: 4069038 - DNA, 16 bp, Homo sapiens
ccctgctcccagcctg

SEQ ID NO: 4069039 - DNA, 17 bp, Homo sapiens
ccctgctcccagcctgc

SEQ ID NO: 4069040 - DNA, 20 bp, Homo sapiens
ccctgctcccagcctgctga

SEQ ID NO: 4069041 - DNA, 23 bp, Homo sapiens
ccctgctccctccgggtcttcct

SEQ ID NO: 4069042 - DNA, 12 bp, Homo sapiens
ccctgctccctg

SEQ ID NO: 4069043 - DNA, 19 bp, Homo sapiens
ccctgctccctgctttggc

SEQ ID NO: 4069044 - DNA, 18 bp, Homo sapiens
ccctgctcctcctgccct

SEQ ID NO: 4069045 - DNA, 12 bp, Homo sapiens
ccctgctcctgc

SEQ ID NO: 4069046 - DNA, 15 bp, Homo sapiens
ccctgctctacccat

SEQ ID NO: 4069047 - DNA, 22 bp, Homo sapiens
ccctgctctacccatgagcctg

SEQ ID NO: 4069048 - DNA, 18 bp, Homo sapiens
ccctgctgagtcatctgt

SEQ ID NO: 4069049 - DNA, 13 bp, Homo sapiens
ccctgctggctct

SEQ ID NO: 4069050 - DNA, 20 bp, Homo sapiens
ccctgctggctcttctgccc

SEQ ID NO: 4069051 - DNA, 19 bp, Homo sapiens
ccctgctgtcttccccacc

SEQ ID NO: 4069052 - DNA, 21 bp, Homo sapiens
ccctgctgtcttccccaccgc

SEQ ID NO: 4069053 - DNA, 23 bp, Homo sapiens
ccctgctgtcttccccaccgcag

SEQ ID NO: 4069054 - DNA, 20 bp, Homo sapiens
ccctgctgtgccatgctggg

SEQ ID NO: 4069055 - DNA, 16 bp, Homo sapiens
ccctgcttccaggaaa

SEQ ID NO: 4069056 - DNA, 17 bp, Homo sapiens
ccctgctttgggctgcc

SEQ ID NO: 4069057 - DNA, 15 bp, Homo sapiens
ccgggttcagcctgg

SEQ ID NO: 4069058 - DNA, 16 bp, Homo sapiens
ccgggttcagcctggc

SEQ ID NO: 4069059 - DNA, 23 bp, Homo sapiens
ccgggttcgcaccattctcctgc

SEQ ID NO: 4069060 - DNA, 17 bp, Homo sapiens
ccgggttctagtctcct

SEQ ID NO: 4069061 - DNA, 20 bp, Homo sapiens
ccgggttctagtctcctttg

SEQ ID NO: 4069062 - DNA, 15 bp, Homo sapiens
ccggtaactgtcctg

SEQ ID NO: 4069063 - DNA, 16 bp, Homo sapiens
ccggtaactgtcctgt

SEQ ID NO: 4069064 - DNA, 16 bp, Homo sapiens
ccggtagggaggcagc

SEQ ID NO: 4069065 - DNA, 17 bp, Homo sapiens
ccggtcgggcagccagc

SEQ ID NO: 4069066 - DNA, 18 bp, Homo sapiens
ccggtgacctctagccct

SEQ ID NO: 4069067 - DNA, 15 bp, Homo sapiens
ccggtgctgcaggag

SEQ ID NO: 4069068 - DNA, 17 bp, Homo sapiens
ccggttcagacccctgc

SEQ ID NO: 4069069 - DNA, 21 bp, Homo sapiens
ccggtttagtcatccaacaag

SEQ ID NO: 4069070 - DNA, 22 bp, Homo sapiens
ccgtacctcttcccatgactgc

SEQ ID NO: 4069071 - DNA, 12 bp, Homo sapiens
ccgtactctcac

SEQ ID NO: 4069072 - DNA, 19 bp, Homo sapiens
ccgtcaccacgactggcca

SEQ ID NO: 4069073 - DNA, 21 bp, Homo sapiens
ccgtcatggcttaatgtttat

SEQ ID NO: 4069074 - DNA, 22 bp, Homo sapiens
ccgtccagccgccattgccacc

SEQ ID NO: 4069075 - DNA, 23 bp, Homo sapiens
ccgtccatatcagaactgtgcca

SEQ ID NO: 4069076 - DNA, 21 bp, Homo sapiens
ccgtcgaggggctctcagctc

SEQ ID NO: 4069077 - DNA, 22 bp, Homo sapiens
ccgtcgaggggctctcagctca

SEQ ID NO: 4069078 - DNA, 12 bp, Homo sapiens
ccgtctcctccc

SEQ ID NO: 4069079 - DNA, 17 bp, Homo sapiens
ccgtctcctccctcagc

SEQ ID NO: 4069080 - DNA, 12 bp, Homo sapiens
ccgtctgcccac

SEQ ID NO: 4069081 - DNA, 14 bp, Homo sapiens
ccgtctgcccacca

SEQ ID NO: 4069082 - DNA, 16 bp, Homo sapiens
ccgtgaactctggtgc

SEQ ID NO: 4069083 - DNA, 14 bp, Homo sapiens
ccgtgcatcccccc

SEQ ID NO: 4069084 - DNA, 21 bp, Homo sapiens
ccgtgcatcccccctgctcag

SEQ ID NO: 4069085 - DNA, 14 bp, Homo sapiens
ccgtgccaggagca

SEQ ID NO: 4069086 - DNA, 14 bp, Homo sapiens
ccgtgccctggtga

SEQ ID NO: 4069087 - DNA, 16 bp, Homo sapiens
ccgtgccttcagctct

SEQ ID NO: 4069088 - DNA, 17 bp, Homo sapiens
ccgtgccttcagctcta

SEQ ID NO: 4069089 - DNA, 20 bp, Homo sapiens
ccgtggaggaggaaggcaag

SEQ ID NO: 4069090 - DNA, 22 bp, Homo sapiens
ccgtggaggaggaaggcaagag

SEQ ID NO: 4069091 - DNA, 23 bp, Homo sapiens
ccgtggaggaggaaggcaagagg

SEQ ID NO: 4069092 - DNA, 22 bp, Homo sapiens
ccgtggattgcacgtggcctct

SEQ ID NO: 4069093 - DNA, 23 bp, Homo sapiens
ccgtggattgcacgtggcctctt

SEQ ID NO: 4069094 - DNA, 15 bp, Homo sapiens
ccgtggcttcccgct

SEQ ID NO: 4069095 - DNA, 23 bp, Homo sapiens
ccgtggcttcccgctcagccctc

SEQ ID NO: 4069096 - DNA, 15 bp, Homo sapiens
ccgtggtccagctct

SEQ ID NO: 4069097 - DNA, 20 bp, Homo sapiens
ccgtggtccagctcttggcc

SEQ ID NO: 4069098 - DNA, 14 bp, Homo sapiens
ccgtggtccctgag

SEQ ID NO: 4069099 - DNA, 16 bp, Homo sapiens
ccgtggtccctgagga

SEQ ID NO: 4069100 - DNA, 16 bp, Homo sapiens
ccgtgtccagcacaga

SEQ ID NO: 4069101 - DNA, 18 bp, Homo sapiens
ccgtgtccagcacagaag

SEQ ID NO: 4069102 - DNA, 19 bp, Homo sapiens
ccgtgtccagcacagaagg

SEQ ID NO: 4069103 - DNA, 19 bp, Homo sapiens
ccgtgttagccaggatggt

SEQ ID NO: 4069104 - DNA, 14 bp, Homo sapiens
ccgtgtttgtctct

SEQ ID NO: 4069105 - DNA, 18 bp, Homo sapiens
ccgtgtttgtctcttctg

SEQ ID NO: 4069106 - DNA, 15 bp, Homo sapiens
ccgttctgctggcct

SEQ ID NO: 4069107 - DNA, 23 bp, Homo sapiens
ccgttctgctggcctggatctcc

SEQ ID NO: 4069108 - DNA, 23 bp, Homo sapiens
ccgttggaaacataaccattaca

SEQ ID NO: 4069109 - DNA, 13 bp, Homo sapiens
ccgtttctccttt

SEQ ID NO: 4069110 - DNA, 17 bp, Homo sapiens
ccgtttctccttttcct

SEQ ID NO: 4069111 - DNA, 12 bp, Homo sapiens
cctaaaacaaat

SEQ ID NO: 4069112 - DNA, 15 bp, Homo sapiens
cctaaaactggcctg

SEQ ID NO: 4069113 - DNA, 22 bp, Homo sapiens
cctaaaaggaaatctcacccca

SEQ ID NO: 4069114 - DNA, 12 bp, Homo sapiens
cctaaaatcttg

SEQ ID NO: 4069115 - DNA, 17 bp, Homo sapiens
cctaaacccctgtccca

SEQ ID NO: 4069116 - DNA, 12 bp, Homo sapiens
cctaaagagata

SEQ ID NO: 4069117 - DNA, 18 bp, Homo sapiens
cctaaagtacagcctgga

SEQ ID NO: 4069118 - DNA, 18 bp, Homo sapiens
cctaaccagggccagaag

SEQ ID NO: 4069119 - DNA, 14 bp, Homo sapiens
cctaagaatcagag

SEQ ID NO: 4069120 - DNA, 17 bp, Homo sapiens
cctaagaatctttagag

SEQ ID NO: 4069121 - DNA, 14 bp, Homo sapiens
cctaagacatgtga

SEQ ID NO: 4069122 - DNA, 23 bp, Homo sapiens
cctaagacatgtgaggaggaaaa

SEQ ID NO: 4069123 - DNA, 16 bp, Homo sapiens
cctaagccacttgaaa

SEQ ID NO: 4069124 - DNA, 22 bp, Homo sapiens
cctaagcccccagggcctccag

SEQ ID NO: 4069125 - DNA, 14 bp, Homo sapiens
cctaaggacacact

SEQ ID NO: 4069126 - DNA, 20 bp, Homo sapiens
cctaaggtccaacaagaatg

SEQ ID NO: 4069127 - DNA, 18 bp, Homo sapiens
cctaagtggctgccttct

SEQ ID NO: 4069128 - DNA, 18 bp, Homo sapiens
cctaatcactcagagcag

SEQ ID NO: 4069129 - DNA, 20 bp, Homo sapiens
cctaatggctatttttgaag

SEQ ID NO: 4069130 - DNA, 14 bp, Homo sapiens
cctaatttctcctc

SEQ ID NO: 4069131 - DNA, 15 bp, Homo sapiens
cctaatttctcctcc

SEQ ID NO: 4069132 - DNA, 16 bp, Homo sapiens
cctaatttctcctccc

SEQ ID NO: 4069133 - DNA, 18 bp, Homo sapiens
cctaatttctcctccctt

SEQ ID NO: 4069134 - DNA, 16 bp, Homo sapiens
cctacacacacactcc

SEQ ID NO: 4069135 - DNA, 12 bp, Homo sapiens
cctacacacacc

SEQ ID NO: 4069136 - DNA, 15 bp, Homo sapiens
cctacacactgtcat

SEQ ID NO: 4069137 - DNA, 21 bp, Homo sapiens
cctacaccattatcttggaaa

SEQ ID NO: 4069138 - DNA, 11 bp, Homo sapiens
cctacagaatt

SEQ ID NO: 4069139 - DNA, 17 bp, Homo sapiens
cctacagactccatctc

SEQ ID NO: 4069140 - DNA, 18 bp, Homo sapiens
cctacagactccatctct

SEQ ID NO: 4069141 - DNA, 14 bp, Homo sapiens
cctacagatgaact

SEQ ID NO: 4069142 - DNA, 12 bp, Homo sapiens
cctacagcacta

SEQ ID NO: 4069143 - DNA, 20 bp, Homo sapiens
cctacagcactactgggtgt

SEQ ID NO: 4069144 - DNA, 16 bp, Homo sapiens
cctacagccacatccc

SEQ ID NO: 4069145 - DNA, 17 bp, Homo sapiens
cctacagccacatcccc

SEQ ID NO: 4069146 - DNA, 20 bp, Homo sapiens
cctacagctttgatccctga

SEQ ID NO: 4069147 - DNA, 23 bp, Homo sapiens
cctacattccctctcctgcccag

SEQ ID NO: 4069148 - DNA, 13 bp, Homo sapiens
cctaccacagtgt

SEQ ID NO: 4069149 - DNA, 16 bp, Homo sapiens
cctaccacagtgtctg

SEQ ID NO: 4069150 - DNA, 15 bp, Homo sapiens
cctaccagttgccct

SEQ ID NO: 4069151 - DNA, 22 bp, Homo sapiens
cctaccatcagggacaggatga

SEQ ID NO: 4069152 - DNA, 18 bp, Homo sapiens
cctacccacacctctgcc

SEQ ID NO: 4069153 - DNA, 21 bp, Homo sapiens
cctaccccagggccctggcca

SEQ ID NO: 4069154 - DNA, 16 bp, Homo sapiens
cctaccgagtctcttc

SEQ ID NO: 4069155 - DNA, 19 bp, Homo sapiens
cctaccgagtctcttctcc

SEQ ID NO: 4069156 - DNA, 21 bp, Homo sapiens
cctaccgagtctcttctccac

SEQ ID NO: 4069157 - DNA, 22 bp, Homo sapiens
cctaccgagtctcttctccact

SEQ ID NO: 4069158 - DNA, 23 bp, Homo sapiens
cctaccgagtctcttctccactg

SEQ ID NO: 4069159 - DNA, 12 bp, Homo sapiens
cctcctgtgggg

SEQ ID NO: 4069160 - DNA, 18 bp, Homo sapiens
cctccttagccctgtctg

SEQ ID NO: 4069161 - DNA, 22 bp, Homo sapiens
cctccttagccctgtctgctag

SEQ ID NO: 4069162 - DNA, 14 bp, Homo sapiens
cctccttcagacac

SEQ ID NO: 4069163 - DNA, 22 bp, Homo sapiens
cctccttcagacaccctcaacc

SEQ ID NO: 4069164 - DNA, 19 bp, Homo sapiens
cctccttccacctccctcc

SEQ ID NO: 4069165 - DNA, 22 bp, Homo sapiens
cctccttccctcacccccagca

SEQ ID NO: 4069166 - DNA, 15 bp, Homo sapiens
cctccttctcccttt

SEQ ID NO: 4069167 - DNA, 16 bp, Homo sapiens
cctccttctccctttt

SEQ ID NO: 4069168 - DNA, 15 bp, Homo sapiens
cctccttgtccaccc

SEQ ID NO: 4069169 - DNA, 18 bp, Homo sapiens
cctcctttctgtgcccta

SEQ ID NO: 4069170 - DNA, 20 bp, Homo sapiens
cctcgaaacacagaaacctt

SEQ ID NO: 4069171 - DNA, 21 bp, Homo sapiens
cctcgacagcgcccctgctgt

SEQ ID NO: 4069172 - DNA, 23 bp, Homo sapiens
cctcgacagcgcccctgctgtct

SEQ ID NO: 4069173 - DNA, 20 bp, Homo sapiens
cctcgacagggcctggagcc

SEQ ID NO: 4069174 - DNA, 13 bp, Homo sapiens
cctcgcctgacaa

SEQ ID NO: 4069175 - DNA, 14 bp, Homo sapiens
cctcgctcaccgct

SEQ ID NO: 4069176 - DNA, 18 bp, Homo sapiens
cctcggagagcagcagca

SEQ ID NO: 4069177 - DNA, 22 bp, Homo sapiens
cctcggcctcccaaagtgctgg

SEQ ID NO: 4069178 - DNA, 16 bp, Homo sapiens
cctcggcttgtgggct

SEQ ID NO: 4069179 - DNA, 18 bp, Homo sapiens
cctcggcttgtgggctgg

SEQ ID NO: 4069180 - DNA, 20 bp, Homo sapiens
cctcggcttgtgggctggtg

SEQ ID NO: 4069181 - DNA, 21 bp, Homo sapiens
cctcggcttgtgggctggtgc

SEQ ID NO: 4069182 - DNA, 18 bp, Homo sapiens
cctcgggccccatcctca

SEQ ID NO: 4069183 - DNA, 17 bp, Homo sapiens
cctcgggccgaggccca

SEQ ID NO: 4069184 - DNA, 18 bp, Homo sapiens
cctcgggccgaggcccag

SEQ ID NO: 4069185 - DNA, 16 bp, Homo sapiens
cctcggtagcagaggc

SEQ ID NO: 4069186 - DNA, 20 bp, Homo sapiens
cctcgtccaccccccacaca

SEQ ID NO: 4069187 - DNA, 15 bp, Homo sapiens
cctcgtccctccctc

SEQ ID NO: 4069188 - DNA, 14 bp, Homo sapiens
cctcgtctttccca

SEQ ID NO: 4069189 - DNA, 19 bp, Homo sapiens
cctcgttcctttctcctgt

SEQ ID NO: 4069190 - DNA, 15 bp, Homo sapiens
cctcgttggaagagg

SEQ ID NO: 4069191 - DNA, 17 bp, Homo sapiens
cctctaaagcagaggca

SEQ ID NO: 4069192 - DNA, 22 bp, Homo sapiens
cctctaccagttggcagacagc

SEQ ID NO: 4069193 - DNA, 15 bp, Homo sapiens
cctctaccccaattt

SEQ ID NO: 4069194 - DNA, 17 bp, Homo sapiens
cctctagaaatttttca

SEQ ID NO: 4069195 - DNA, 14 bp, Homo sapiens
cctctagcaggcct

SEQ ID NO: 4069196 - DNA, 15 bp, Homo sapiens
cctctaggcaagcag

SEQ ID NO: 4069197 - DNA, 16 bp, Homo sapiens
cctctaggcaagcagg

SEQ ID NO: 4069198 - DNA, 17 bp, Homo sapiens
cctctaggcaagcagga

SEQ ID NO: 4069199 - DNA, 20 bp, Homo sapiens
cctctaggcaagcaggacct

SEQ ID NO: 4069200 - DNA, 21 bp, Homo sapiens
cctctaggcaagcaggacctg

SEQ ID NO: 4069201 - DNA, 22 bp, Homo sapiens
cctctaggcaagcaggacctgg

SEQ ID NO: 4069202 - DNA, 15 bp, Homo sapiens
cctctagtgccttct

SEQ ID NO: 4069203 - DNA, 17 bp, Homo sapiens
cctctatttatgtttgc

SEQ ID NO: 4069204 - DNA, 21 bp, Homo sapiens
cctctatttatgtttgcactt

SEQ ID NO: 4069205 - DNA, 21 bp, Homo sapiens
cctctcaagctagtgtttcta

SEQ ID NO: 4069206 - DNA, 14 bp, Homo sapiens
cctctcactcccca

SEQ ID NO: 4069207 - DNA, 22 bp, Homo sapiens
cctctcagaggcctgctgccag

SEQ ID NO: 4069208 - DNA, 14 bp, Homo sapiens
cctctcagggcctg

SEQ ID NO: 4069209 - DNA, 17 bp, Homo sapiens
cctctcagggcctggca

SEQ ID NO: 4069210 - DNA, 15 bp, Homo sapiens
cctctcatctcaggt

SEQ ID NO: 4069211 - DNA, 23 bp, Homo sapiens
cctctccaagtctctctgtgaat

SEQ ID NO: 4069212 - DNA, 14 bp, Homo sapiens
cctctccactccat

SEQ ID NO: 4069213 - DNA, 20 bp, Homo sapiens
cctctccaggtgctcattgt

SEQ ID NO: 4069214 - DNA, 19 bp, Homo sapiens
cctctccagtttgcacctg

SEQ ID NO: 4069215 - DNA, 23 bp, Homo sapiens
cctctccagtttgcacctgtccc

SEQ ID NO: 4069216 - DNA, 21 bp, Homo sapiens
cctctccccagcccagagaca

SEQ ID NO: 4069217 - DNA, 22 bp, Homo sapiens
cctctccctcaacaagggagag

SEQ ID NO: 4069218 - DNA, 23 bp, Homo sapiens
cctctccgtttattataaactgt

SEQ ID NO: 4069219 - DNA, 11 bp, Homo sapiens
cctctcctgga

SEQ ID NO: 4069220 - DNA, 12 bp, Homo sapiens
cctctcctggag

SEQ ID NO: 4069221 - DNA, 14 bp, Homo sapiens
cctctcctgggggt

SEQ ID NO: 4069222 - DNA, 22 bp, Homo sapiens
cctctcctgggggtggcaggca

SEQ ID NO: 4069223 - DNA, 13 bp, Homo sapiens
cctctccttttga

SEQ ID NO: 4069224 - DNA, 13 bp, Homo sapiens
cctctctcagagc

SEQ ID NO: 4069225 - DNA, 24 bp, Homo sapiens
cctctctcagagcatctggctgtt

SEQ ID NO: 4069226 - DNA, 17 bp, Homo sapiens
cctctctcagcacagcc

SEQ ID NO: 4069227 - DNA, 23 bp, Homo sapiens
cctctctccttatagacacttgc

SEQ ID NO: 4069228 - DNA, 22 bp, Homo sapiens
cctctctcttctgctccaccct

SEQ ID NO: 4069229 - DNA, 21 bp, Homo sapiens
cctctctgatcttgtgctcag

SEQ ID NO: 4069230 - DNA, 22 bp, Homo sapiens
cctctctgatcttgtgctcagc

SEQ ID NO: 4069231 - DNA, 21 bp, Homo sapiens
cctctctgcagacttcccagc

SEQ ID NO: 4069232 - DNA, 13 bp, Homo sapiens
cctctcttcccct

SEQ ID NO: 4069233 - DNA, 15 bp, Homo sapiens
cctctcttccccttc

SEQ ID NO: 4069234 - DNA, 20 bp, Homo sapiens
cctctcttccccttccctta

SEQ ID NO: 4069235 - DNA, 21 bp, Homo sapiens
cctctcttccccttcccttat

SEQ ID NO: 4069236 - DNA, 22 bp, Homo sapiens
cctctgaccctagctctttcct

SEQ ID NO: 4069237 - DNA, 16 bp, Homo sapiens
cctctgacctgcactg

SEQ ID NO: 4069238 - DNA, 18 bp, Homo sapiens
cctctgactctgagtcca

SEQ ID NO: 4069239 - DNA, 15 bp, Homo sapiens
cctctgagcccagct

SEQ ID NO: 4069240 - DNA, 21 bp, Homo sapiens
cctctgagcccagctgcctgg

SEQ ID NO: 4069241 - DNA, 15 bp, Homo sapiens
cctctgatacccaga

SEQ ID NO: 4069242 - DNA, 18 bp, Homo sapiens
cctctgatacccagagca

SEQ ID NO: 4069243 - DNA, 20 bp, Homo sapiens
cctctgatacccagagcatt

SEQ ID NO: 4069244 - DNA, 17 bp, Homo sapiens
cctctgcagtctcattt

SEQ ID NO: 4069245 - DNA, 18 bp, Homo sapiens
cctctgcagtctcatttc

SEQ ID NO: 4069246 - DNA, 20 bp, Homo sapiens
cctctgccaaaggatgtgat

SEQ ID NO: 4069247 - DNA, 12 bp, Homo sapiens
cctctgccctgg

SEQ ID NO: 4069248 - DNA, 22 bp, Homo sapiens
cctctgccggtcgggcagccag

SEQ ID NO: 4069249 - DNA, 17 bp, Homo sapiens
cctctgcctacagccag

SEQ ID NO: 4069250 - DNA, 18 bp, Homo sapiens
cctctgcctacagccagg

SEQ ID NO: 4069251 - DNA, 18 bp, Homo sapiens
cctctgcctccaccctcc

SEQ ID NO: 4069252 - DNA, 14 bp, Homo sapiens
cctctgccttcagg

SEQ ID NO: 4069253 - DNA, 20 bp, Homo sapiens
cctctgcggggcagggcctt

SEQ ID NO: 4069254 - DNA, 24 bp, Homo sapiens
cctctgcggggcagggccttcctg

SEQ ID NO: 4069255 - DNA, 11 bp, Homo sapiens
cctctgctacg

SEQ ID NO: 4069256 - DNA, 15 bp, Homo sapiens
cctctgctcaccgcc

SEQ ID NO: 4069257 - DNA, 21 bp, Homo sapiens
cctctgctcaccgcccatcag

SEQ ID NO: 4069258 - DNA, 23 bp, Homo sapiens
cctctgctcaccgcccatcaggg

SEQ ID NO: 4069259 - DNA, 13 bp, Homo sapiens
cctctgctcccca

SEQ ID NO: 4069260 - DNA, 19 bp, Homo sapiens
cctctgctcccccttttcc

SEQ ID NO: 4069261 - DNA, 13 bp, Homo sapiens
cctggctgctgcc

SEQ ID NO: 4069262 - DNA, 14 bp, Homo sapiens
cctggctgctgccc

SEQ ID NO: 4069263 - DNA, 16 bp, Homo sapiens
cctggctgctgccccc

SEQ ID NO: 4069264 - DNA, 20 bp, Homo sapiens
cctggctgctgcccccaccc

SEQ ID NO: 4069265 - DNA, 21 bp, Homo sapiens
cctggctgctgcccccacccc

SEQ ID NO: 4069266 - DNA, 13 bp, Homo sapiens
cctggctggagga

SEQ ID NO: 4069267 - DNA, 21 bp, Homo sapiens
cctggctggaggagcagcagc

SEQ ID NO: 4069268 - DNA, 13 bp, Homo sapiens
cctggctgggcca

SEQ ID NO: 4069269 - DNA, 22 bp, Homo sapiens
cctggctgggccatccttccgc

SEQ ID NO: 4069270 - DNA, 12 bp, Homo sapiens
cctggctggtcc

SEQ ID NO: 4069271 - DNA, 13 bp, Homo sapiens
cctggctttgcct

SEQ ID NO: 4069272 - DNA, 17 bp, Homo sapiens
cctggctttgcctcttc

SEQ ID NO: 4069273 - DNA, 19 bp, Homo sapiens
cctggctttgcctcttctt

SEQ ID NO: 4069274 - DNA, 18 bp, Homo sapiens
cctggcttttcactgctg

SEQ ID NO: 4069275 - DNA, 15 bp, Homo sapiens
cctgggacacagacc

SEQ ID NO: 4069276 - DNA, 16 bp, Homo sapiens
cctgggacacagaccc

SEQ ID NO: 4069277 - DNA, 17 bp, Homo sapiens
cctgggacacagaccca

SEQ ID NO: 4069278 - DNA, 14 bp, Homo sapiens
cctgggacttccat

SEQ ID NO: 4069279 - DNA, 20 bp, Homo sapiens
cctgggacttccatgcctta

SEQ ID NO: 4069280 - DNA, 19 bp, Homo sapiens
cctgggaggaaatttgaat

SEQ ID NO: 4069281 - DNA, 16 bp, Homo sapiens
cctgggaggcggagag

SEQ ID NO: 4069282 - DNA, 18 bp, Homo sapiens
cctgggatgggaccaggg

SEQ ID NO: 4069283 - DNA, 19 bp, Homo sapiens
cctgggcagccaggctgcc

SEQ ID NO: 4069284 - DNA, 22 bp, Homo sapiens
cctgggcaggcggtccccatcc

SEQ ID NO: 4069285 - DNA, 22 bp, Homo sapiens
cctgggcatatccaccacctcc

SEQ ID NO: 4069286 - DNA, 17 bp, Homo sapiens
cctgggcatgggtccag

SEQ ID NO: 4069287 - DNA, 21 bp, Homo sapiens
cctgggcatgggtccagggcc

SEQ ID NO: 4069288 - DNA, 21 bp, Homo sapiens
cctgggccagcggggctgctc

SEQ ID NO: 4069289 - DNA, 22 bp, Homo sapiens
cctgggccagcggggctgctca

SEQ ID NO: 4069290 - DNA, 15 bp, Homo sapiens
cctgggccagggtct

SEQ ID NO: 4069291 - DNA, 15 bp, Homo sapiens
cctgggcccctccac

SEQ ID NO: 4069292 - DNA, 18 bp, Homo sapiens
cctgggcccctccacgcc

SEQ ID NO: 4069293 - DNA, 23 bp, Homo sapiens
cctgggcccctccacgcctcctg

SEQ ID NO: 4069294 - DNA, 15 bp, Homo sapiens
cctgggccctggagg

SEQ ID NO: 4069295 - DNA, 15 bp, Homo sapiens
cctgggcctctgccc

SEQ ID NO: 4069296 - DNA, 19 bp, Homo sapiens
cctgggcctctgcccctcc

SEQ ID NO: 4069297 - DNA, 12 bp, Homo sapiens
cctgggcctgca

SEQ ID NO: 4069298 - DNA, 13 bp, Homo sapiens
cctgggcctgccc

SEQ ID NO: 4069299 - DNA, 23 bp, Homo sapiens
cctgggcctttgcaagatgcttg

SEQ ID NO: 4069300 - DNA, 18 bp, Homo sapiens
cctgggctgccaccagcc

SEQ ID NO: 4069301 - DNA, 14 bp, Homo sapiens
cctgggctggactg

SEQ ID NO: 4069302 - DNA, 15 bp, Homo sapiens
cctgggctggactgg

SEQ ID NO: 4069303 - DNA, 16 bp, Homo sapiens
cctgggctggactgga

SEQ ID NO: 4069304 - DNA, 15 bp, Homo sapiens
cctgggctggggcca

SEQ ID NO: 4069305 - DNA, 21 bp, Homo sapiens
cctgggctggggccaccatcc

SEQ ID NO: 4069306 - DNA, 22 bp, Homo sapiens
cctgggctggggccaccatccc

SEQ ID NO: 4069307 - DNA, 17 bp, Homo sapiens
cctgggctgtctgtcac

SEQ ID NO: 4069308 - DNA, 18 bp, Homo sapiens
cctgggctgtctgtcacc

SEQ ID NO: 4069309 - DNA, 14 bp, Homo sapiens
cctgggcttggcct

SEQ ID NO: 4069310 - DNA, 19 bp, Homo sapiens
cctgggcttggcctgctgt

SEQ ID NO: 4069311 - DNA, 20 bp, Homo sapiens
cctgggcttggcctgctgtg

SEQ ID NO: 4069312 - DNA, 21 bp, Homo sapiens
cctgggcttggcctgctgtga

SEQ ID NO: 4069313 - DNA, 12 bp, Homo sapiens
cctggggaagga

SEQ ID NO: 4069314 - DNA, 17 bp, Homo sapiens
cctggggacccccacga

SEQ ID NO: 4069315 - DNA, 14 bp, Homo sapiens
cctggggcctgact

SEQ ID NO: 4069316 - DNA, 17 bp, Homo sapiens
cctggggcctgactgct

SEQ ID NO: 4069317 - DNA, 17 bp, Homo sapiens
cctggggcctgagagaa

SEQ ID NO: 4069318 - DNA, 18 bp, Homo sapiens
cctggggcctggacctgc

SEQ ID NO: 4069319 - DNA, 19 bp, Homo sapiens
cctgggggagttttcctct

SEQ ID NO: 4069320 - DNA, 14 bp, Homo sapiens
cctgggggtggcag

SEQ ID NO: 4069321 - DNA, 17 bp, Homo sapiens
cctgggggtggcaggca

SEQ ID NO: 4069322 - DNA, 14 bp, Homo sapiens
cctggggtgcatct

SEQ ID NO: 4069323 - DNA, 16 bp, Homo sapiens
cctggggtgcatctcc

SEQ ID NO: 4069324 - DNA, 18 bp, Homo sapiens
cctgggtactgaaagcct

SEQ ID NO: 4069325 - DNA, 19 bp, Homo sapiens
cctgggtcagtctggtggg

SEQ ID NO: 4069326 - DNA, 22 bp, Homo sapiens
cctgggtcagtctggtgggagg

SEQ ID NO: 4069327 - DNA, 16 bp, Homo sapiens
cctgggtctgtgtctc

SEQ ID NO: 4069328 - DNA, 17 bp, Homo sapiens
cctgggtctgtgtctct

SEQ ID NO: 4069329 - DNA, 14 bp, Homo sapiens
cctgggtgacattt

SEQ ID NO: 4069330 - DNA, 23 bp, Homo sapiens
cctgggtgctggctgcccagacc

SEQ ID NO: 4069331 - DNA, 17 bp, Homo sapiens
cctggtaccctcctggc

SEQ ID NO: 4069332 - DNA, 14 bp, Homo sapiens
cctggtccagggaa

SEQ ID NO: 4069333 - DNA, 14 bp, Homo sapiens
cctggtcctgaggg

SEQ ID NO: 4069334 - DNA, 23 bp, Homo sapiens
cctggtcctgagggtccccacct

SEQ ID NO: 4069335 - DNA, 16 bp, Homo sapiens
cctggtctgaggatgt

SEQ ID NO: 4069336 - DNA, 23 bp, Homo sapiens
cctggtgaatcacctggctgagc

SEQ ID NO: 4069337 - DNA, 22 bp, Homo sapiens
cctggtgccccccacccctgga

SEQ ID NO: 4069338 - DNA, 9 bp, Homo sapiens
cctggtgct

SEQ ID NO: 4069339 - DNA, 15 bp, Homo sapiens
cctggtgctgccaca

SEQ ID NO: 4069340 - DNA, 13 bp, Homo sapiens
cctggtgctggat

SEQ ID NO: 4069341 - DNA, 17 bp, Homo sapiens
cctggttggccgtggtc

SEQ ID NO: 4069342 - DNA, 22 bp, Homo sapiens
cctggttggccgtggtccagct

SEQ ID NO: 4069343 - DNA, 20 bp, Homo sapiens
cctggtttaattcagcagag

SEQ ID NO: 4069344 - DNA, 21 bp, Homo sapiens
cctggtttcataacttcctgt

SEQ ID NO: 4069345 - DNA, 15 bp, Homo sapiens
cctggtttgactcag

SEQ ID NO: 4069346 - DNA, 19 bp, Homo sapiens
cctggttttgtacactgct

SEQ ID NO: 4069347 - DNA, 19 bp, Homo sapiens
cctgtaaatggtgtacata

SEQ ID NO: 4069348 - DNA, 23 bp, Homo sapiens
cctgtaacaggtgtggggacaca

SEQ ID NO: 4069349 - DNA, 20 bp, Homo sapiens
cctgtaatcatataataaat

SEQ ID NO: 4069350 - DNA, 15 bp, Homo sapiens
cctgtaatcccagca

SEQ ID NO: 4069351 - DNA, 14 bp, Homo sapiens
cctgtacagtgtta

SEQ ID NO: 4069352 - DNA, 16 bp, Homo sapiens
cctgtacattgtggga

SEQ ID NO: 4069353 - DNA, 18 bp, Homo sapiens
cctgtactgttctgtgtc

SEQ ID NO: 4069354 - DNA, 18 bp, Homo sapiens
cctgtagacctagggagg

SEQ ID NO: 4069355 - DNA, 16 bp, Homo sapiens
cctgtagagttgctga

SEQ ID NO: 4069356 - DNA, 19 bp, Homo sapiens
cctgtagatgcagaaaaag

SEQ ID NO: 4069357 - DNA, 13 bp, Homo sapiens
cctgtagcagtga

SEQ ID NO: 4069358 - DNA, 13 bp, Homo sapiens
cctgtagccatct

SEQ ID NO: 4069359 - DNA, 13 bp, Homo sapiens
cctgtagtcccag

SEQ ID NO: 4069360 - DNA, 18 bp, Homo sapiens
cctgtagtcccagccact

SEQ ID NO: 4069361 - DNA, 13 bp, Homo sapiens
cctgtagtcctag

SEQ ID NO: 4069362 - DNA, 18 bp, Homo sapiens
cctgtataagtggaggca

SEQ ID NO: 4069363 - DNA, 22 bp, Homo sapiens
cctgtataagtggaggcacttt

SEQ ID NO: 4069364 - DNA, 23 bp, Homo sapiens
ccttaatttcctttttgacactg

SEQ ID NO: 4069365 - DNA, 12 bp, Homo sapiens
ccttacacactc

SEQ ID NO: 4069366 - DNA, 13 bp, Homo sapiens
ccttacacactca

SEQ ID NO: 4069367 - DNA, 18 bp, Homo sapiens
ccttacacactcaggcct

SEQ ID NO: 4069368 - DNA, 22 bp, Homo sapiens
ccttacacgtacctctcatcag

SEQ ID NO: 4069369 - DNA, 21 bp, Homo sapiens
ccttacagagcatacaacaga

SEQ ID NO: 4069370 - DNA, 16 bp, Homo sapiens
ccttaccccttagcct

SEQ ID NO: 4069371 - DNA, 14 bp, Homo sapiens
ccttacctcttccg

SEQ ID NO: 4069372 - DNA, 16 bp, Homo sapiens
ccttacgctttgtcac

SEQ ID NO: 4069373 - DNA, 15 bp, Homo sapiens
ccttagaaaatgtgt

SEQ ID NO: 4069374 - DNA, 16 bp, Homo sapiens
ccttagaaaatgtgtc

SEQ ID NO: 4069375 - DNA, 15 bp, Homo sapiens
ccttagaacctttct

SEQ ID NO: 4069376 - DNA, 15 bp, Homo sapiens
ccttagccctgtctg

SEQ ID NO: 4069377 - DNA, 15 bp, Homo sapiens
ccttagcctccctga

SEQ ID NO: 4069378 - DNA, 21 bp, Homo sapiens
ccttagggaagctggcctgag

SEQ ID NO: 4069379 - DNA, 16 bp, Homo sapiens
ccttagggcactgggc

SEQ ID NO: 4069380 - DNA, 14 bp, Homo sapiens
ccttagtctcagtt

SEQ ID NO: 4069381 - DNA, 20 bp, Homo sapiens
ccttagtctcagtttgtgtg

SEQ ID NO: 4069382 - DNA, 19 bp, Homo sapiens
ccttagtgggccagggctg

SEQ ID NO: 4069383 - DNA, 17 bp, Homo sapiens
ccttagttggctggaaa

SEQ ID NO: 4069384 - DNA, 16 bp, Homo sapiens
ccttataaaccaatct

SEQ ID NO: 4069385 - DNA, 13 bp, Homo sapiens
ccttatcagagct

SEQ ID NO: 4069386 - DNA, 14 bp, Homo sapiens
ccttatcagagcta

SEQ ID NO: 4069387 - DNA, 13 bp, Homo sapiens
ccttatccaggac

SEQ ID NO: 4069388 - DNA, 13 bp, Homo sapiens
ccttatccctctc

SEQ ID NO: 4069389 - DNA, 16 bp, Homo sapiens
ccttatccctctcttc

SEQ ID NO: 4069390 - DNA, 14 bp, Homo sapiens
ccttcaaccattcc

SEQ ID NO: 4069391 - DNA, 13 bp, Homo sapiens
ccttcaactgaaa

SEQ ID NO: 4069392 - DNA, 17 bp, Homo sapiens
ccttcacaccccaggcc

SEQ ID NO: 4069393 - DNA, 17 bp, Homo sapiens
ccttcaccagagcccat

SEQ ID NO: 4069394 - DNA, 22 bp, Homo sapiens
ccttcaccagagcccatgctca

SEQ ID NO: 4069395 - DNA, 11 bp, Homo sapiens
ccttcagacac

SEQ ID NO: 4069396 - DNA, 17 bp, Homo sapiens
ccttcagacaccctcaa

SEQ ID NO: 4069397 - DNA, 22 bp, Homo sapiens
ccttcagagtacgtcctgcctg

SEQ ID NO: 4069398 - DNA, 23 bp, Homo sapiens
ccttcagagtacgtcctgcctgg

SEQ ID NO: 4069399 - DNA, 18 bp, Homo sapiens
ccttcagcccccagcccc

SEQ ID NO: 4069400 - DNA, 16 bp, Homo sapiens
ccttcagctgttgcag

SEQ ID NO: 4069401 - DNA, 16 bp, Homo sapiens
ccttcagggctgagtt

SEQ ID NO: 4069402 - DNA, 21 bp, Homo sapiens
ccttcagtcttgaatttctaa

SEQ ID NO: 4069403 - DNA, 15 bp, Homo sapiens
ccttcatcttcctgt

SEQ ID NO: 4069404 - DNA, 19 bp, Homo sapiens
ccttcatttcaggagggat

SEQ ID NO: 4069405 - DNA, 17 bp, Homo sapiens
ccttcatttccaccagg

SEQ ID NO: 4069406 - DNA, 16 bp, Homo sapiens
ccttccacctctggga

SEQ ID NO: 4069407 - DNA, 16 bp, Homo sapiens
ccttccacctgctctg

SEQ ID NO: 4069408 - DNA, 13 bp, Homo sapiens
ccttccagcccat

SEQ ID NO: 4069409 - DNA, 13 bp, Homo sapiens
ccttccagctgct

SEQ ID NO: 4069410 - DNA, 19 bp, Homo sapiens
ccttccagggccctaggcc

SEQ ID NO: 4069411 - DNA, 23 bp, Homo sapiens
ccttccatccatctttccatcca

SEQ ID NO: 4069412 - DNA, 16 bp, Homo sapiens
ccttccatgtgccttt

SEQ ID NO: 4069413 - DNA, 17 bp, Homo sapiens
ccttccatgtgcctttc

SEQ ID NO: 4069414 - DNA, 14 bp, Homo sapiens
ccttcccaccccta

SEQ ID NO: 4069415 - DNA, 21 bp, Homo sapiens
ccttcccacccctacacacac

SEQ ID NO: 4069416 - DNA, 22 bp, Homo sapiens
ccttcccacccctacacacaca

SEQ ID NO: 4069417 - DNA, 15 bp, Homo sapiens
ccttcccatttcttc

SEQ ID NO: 4069418 - DNA, 18 bp, Homo sapiens
ccttcccatttcttccca

SEQ ID NO: 4069419 - DNA, 15 bp, Homo sapiens
ccttccccagcgtcc

SEQ ID NO: 4069420 - DNA, 12 bp, Homo sapiens
ccttccccagga

SEQ ID NO: 4069421 - DNA, 21 bp, Homo sapiens
ccttccccaggatggactctt

SEQ ID NO: 4069422 - DNA, 23 bp, Homo sapiens
ccttcccctcagccacacccagg

SEQ ID NO: 4069423 - DNA, 22 bp, Homo sapiens
ccttcccctccctggctcccat

SEQ ID NO: 4069424 - DNA, 14 bp, Homo sapiens
ccttccccttctgt

SEQ ID NO: 4069425 - DNA, 12 bp, Homo sapiens
ccttccctagct

SEQ ID NO: 4069426 - DNA, 15 bp, Homo sapiens
ccttccctagcttta

SEQ ID NO: 4069427 - DNA, 21 bp, Homo sapiens
ccttccctcatgcccgccagt

SEQ ID NO: 4069428 - DNA, 13 bp, Homo sapiens
ccttccctccaaa

SEQ ID NO: 4069429 - DNA, 13 bp, Homo sapiens
ccttccctctctg

SEQ ID NO: 4069430 - DNA, 21 bp, Homo sapiens
ccttccctctctgatgtccca

SEQ ID NO: 4069431 - DNA, 13 bp, Homo sapiens
ccttccctctggg

SEQ ID NO: 4069432 - DNA, 22 bp, Homo sapiens
ccttcccttttctgttctagtt

SEQ ID NO: 4069433 - DNA, 14 bp, Homo sapiens
ccttccgccaatct

SEQ ID NO: 4069434 - DNA, 15 bp, Homo sapiens
ccttccgccaatctg

SEQ ID NO: 4069435 - DNA, 18 bp, Homo sapiens
ccttccgccaatctggcc

SEQ ID NO: 4069436 - DNA, 19 bp, Homo sapiens
ccttccgccaatctggccc

SEQ ID NO: 4069437 - DNA, 20 bp, Homo sapiens
ccttccgccaatctggccct

SEQ ID NO: 4069438 - DNA, 21 bp, Homo sapiens
ccttcctagttcatcccttct

SEQ ID NO: 4069439 - DNA, 15 bp, Homo sapiens
ccttcctatgcccag

SEQ ID NO: 4069440 - DNA, 15 bp, Homo sapiens
ccttcctcacttcca

SEQ ID NO: 4069441 - DNA, 18 bp, Homo sapiens
ccttcctcagctgcctcc

SEQ ID NO: 4069442 - DNA, 18 bp, Homo sapiens
ccttcctcatccacccca

SEQ ID NO: 4069443 - DNA, 23 bp, Homo sapiens
ccttcctccatcctcctccttcc

SEQ ID NO: 4069444 - DNA, 16 bp, Homo sapiens
ccttcctctccactgc

SEQ ID NO: 4069445 - DNA, 15 bp, Homo sapiens
ccttcctctctccag

SEQ ID NO: 4069446 - DNA, 17 bp, Homo sapiens
ccttcctctctccagat

SEQ ID NO: 4069447 - DNA, 18 bp, Homo sapiens
ccttcctggaggctgcct

SEQ ID NO: 4069448 - DNA, 14 bp, Homo sapiens
ccttcctgtcccca

SEQ ID NO: 4069449 - DNA, 18 bp, Homo sapiens
ccttcctgtccccaaaat

SEQ ID NO: 4069450 - DNA, 16 bp, Homo sapiens
ccttcctgtccctgag

SEQ ID NO: 4069451 - DNA, 19 bp, Homo sapiens
ccttcctgtccctgaggtt

SEQ ID NO: 4069452 - DNA, 13 bp, Homo sapiens
ccttccttcaggg

SEQ ID NO: 4069453 - DNA, 13 bp, Homo sapiens
ccttccttcctgt

SEQ ID NO: 4069454 - DNA, 14 bp, Homo sapiens
ccttcctttctcca

SEQ ID NO: 4069455 - DNA, 19 bp, Homo sapiens
ccttccttttccctgcttc

SEQ ID NO: 4069456 - DNA, 20 bp, Homo sapiens
ccttcgatacaccgggcctg

SEQ ID NO: 4069457 - DNA, 22 bp, Homo sapiens
ccttcgatacaccgggcctgga

SEQ ID NO: 4069458 - DNA, 23 bp, Homo sapiens
ccttcgatacaccgggcctggag

SEQ ID NO: 4069459 - DNA, 19 bp, Homo sapiens
ccttcgggagcagggctgt

SEQ ID NO: 4069460 - DNA, 20 bp, Homo sapiens
ccttcggggcgatgctccct

SEQ ID NO: 4069461 - DNA, 23 bp, Homo sapiens
ccttcggggcgatgctccctcag

SEQ ID NO: 4069462 - DNA, 18 bp, Homo sapiens
ccttcgggtgctggaagt

SEQ ID NO: 4069463 - DNA, 17 bp, Homo sapiens
ccttcgttaactgtgta

SEQ ID NO: 4069464 - DNA, 17 bp, Homo sapiens
ccttctaatgaagacaa

SEQ ID NO: 4069465 - DNA, 18 bp, Homo sapiens
ccttctaatgaagacaat

SEQ ID NO: 4069466 - DNA, 17 bp, Homo sapiens
ccttctcattacccacc

SEQ ID NO: 4069467 - DNA, 19 bp, Homo sapiens
cgcaggagtctctgccacc

SEQ ID NO: 4069468 - DNA, 21 bp, Homo sapiens
cgcaggagtctctgccaccca

SEQ ID NO: 4069469 - DNA, 22 bp, Homo sapiens
cgcaggagtctctgccacccac

SEQ ID NO: 4069470 - DNA, 18 bp, Homo sapiens
cgcaggcctccctgccag

SEQ ID NO: 4069471 - DNA, 19 bp, Homo sapiens
cgcaggcctccctgccagt

SEQ ID NO: 4069472 - DNA, 17 bp, Homo sapiens
cgcaggctgagtccaga

SEQ ID NO: 4069473 - DNA, 16 bp, Homo sapiens
cgcaggtgggtgctgc

SEQ ID NO: 4069474 - DNA, 23 bp, Homo sapiens
cgcaggtgtttggcacccaaatc

SEQ ID NO: 4069475 - DNA, 18 bp, Homo sapiens
cgcagtgctgggaccaga

SEQ ID NO: 4069476 - DNA, 15 bp, Homo sapiens
cgcagtgtttgtgtg

SEQ ID NO: 4069477 - DNA, 14 bp, Homo sapiens
cgcatccagcaaga

SEQ ID NO: 4069478 - DNA, 22 bp, Homo sapiens
cgcatggagtgtgtattgttcc

SEQ ID NO: 4069479 - DNA, 16 bp, Homo sapiens
cgccaagtgcgtgccg

SEQ ID NO: 4069480 - DNA, 17 bp, Homo sapiens
cgccacgtcccagcatc

SEQ ID NO: 4069481 - DNA, 18 bp, Homo sapiens
cgccagcctcctctggac

SEQ ID NO: 4069482 - DNA, 23 bp, Homo sapiens
cgccagcctcctctggacggcag

SEQ ID NO: 4069483 - DNA, 22 bp, Homo sapiens
cgccagctcaccccatcatccc

SEQ ID NO: 4069484 - DNA, 14 bp, Homo sapiens
cgccagctgggagc

SEQ ID NO: 4069485 - DNA, 17 bp, Homo sapiens
cgccaggaagccagagc

SEQ ID NO: 4069486 - DNA, 21 bp, Homo sapiens
cgccaggaagccagagcccca

SEQ ID NO: 4069487 - DNA, 17 bp, Homo sapiens
cgccaggctgaccacag

SEQ ID NO: 4069488 - DNA, 14 bp, Homo sapiens
cgccagtctcccag

SEQ ID NO: 4069489 - DNA, 13 bp, Homo sapiens
cgccatccttcac

SEQ ID NO: 4069490 - DNA, 24 bp, Homo sapiens
cgccatccttcaccagagcccatg

SEQ ID NO: 4069491 - DNA, 15 bp, Homo sapiens
cgccatctcctgggc

SEQ ID NO: 4069492 - DNA, 13 bp, Homo sapiens
cgccatctgatcc

SEQ ID NO: 4069493 - DNA, 21 bp, Homo sapiens
cgccatctgatccccatgcct

SEQ ID NO: 4069494 - DNA, 14 bp, Homo sapiens
cgccattgccacca

SEQ ID NO: 4069495 - DNA, 17 bp, Homo sapiens
cgccattgccaccagga

SEQ ID NO: 4069496 - DNA, 16 bp, Homo sapiens
cgccattggttggaag

SEQ ID NO: 4069497 - DNA, 13 bp, Homo sapiens
cgcccaactccac

SEQ ID NO: 4069498 - DNA, 18 bp, Homo sapiens
cgcccacaggaagcctgc

SEQ ID NO: 4069499 - DNA, 21 bp, Homo sapiens
cgcccacaggaagcctgcagt

SEQ ID NO: 4069500 - DNA, 22 bp, Homo sapiens
cgcccaccaccccctcaagccc

SEQ ID NO: 4069501 - DNA, 12 bp, Homo sapiens
cgcccagcccca

SEQ ID NO: 4069502 - DNA, 12 bp, Homo sapiens
cgccccagcccg

SEQ ID NO: 4069503 - DNA, 12 bp, Homo sapiens
cgccccaggccc

SEQ ID NO: 4069504 - DNA, 22 bp, Homo sapiens
cgcccctccaaacctccagcct

SEQ ID NO: 4069505 - DNA, 18 bp, Homo sapiens
cgcccctgtggccctggc

SEQ ID NO: 4069506 - DNA, 19 bp, Homo sapiens
cgcccctgtggccctggcc

SEQ ID NO: 4069507 - DNA, 13 bp, Homo sapiens
cgccccttccccc

SEQ ID NO: 4069508 - DNA, 18 bp, Homo sapiens
cgcccgctgagctgagtg

SEQ ID NO: 4069509 - DNA, 14 bp, Homo sapiens
cgccctggcaggca

SEQ ID NO: 4069510 - DNA, 14 bp, Homo sapiens
cgccctgggctgga

SEQ ID NO: 4069511 - DNA, 15 bp, Homo sapiens
cgccctgggctggac

SEQ ID NO: 4069512 - DNA, 22 bp, Homo sapiens
cgccctgggctgtctgtcacca

SEQ ID NO: 4069513 - DNA, 18 bp, Homo sapiens
cgccctgttcacgctcac

SEQ ID NO: 4069514 - DNA, 15 bp, Homo sapiens
cgcccttaccttccc

SEQ ID NO: 4069515 - DNA, 13 bp, Homo sapiens
cgcccttcctgga

SEQ ID NO: 4069516 - DNA, 19 bp, Homo sapiens
cgccctttcctcctcaggc

SEQ ID NO: 4069517 - DNA, 20 bp, Homo sapiens
cgccctttcctcctcaggca

SEQ ID NO: 4069518 - DNA, 16 bp, Homo sapiens
cgcctactcttcaggg

SEQ ID NO: 4069519 - DNA, 16 bp, Homo sapiens
cgcctcagccctcagt

SEQ ID NO: 4069520 - DNA, 16 bp, Homo sapiens
cgcctcccctgcccca

SEQ ID NO: 4069521 - DNA, 12 bp, Homo sapiens
cgcctcctggcc

SEQ ID NO: 4069522 - DNA, 14 bp, Homo sapiens
cgcctcctggccag

SEQ ID NO: 4069523 - DNA, 17 bp, Homo sapiens
cgcctcggatcagctga

SEQ ID NO: 4069524 - DNA, 19 bp, Homo sapiens
cgcctcttcttcttcagaa

SEQ ID NO: 4069525 - DNA, 21 bp, Homo sapiens
cgcctgacaaccactggtctg

SEQ ID NO: 4069526 - DNA, 15 bp, Homo sapiens
cgcctgagctcctgc

SEQ ID NO: 4069527 - DNA, 13 bp, Homo sapiens
cgcctgcaggcag

SEQ ID NO: 4069528 - DNA, 17 bp, Homo sapiens
cgcctgccctcatggcc

SEQ ID NO: 4069529 - DNA, 15 bp, Homo sapiens
cgcctgcctgcagca

SEQ ID NO: 4069530 - DNA, 14 bp, Homo sapiens
cgcctgctgcctgc

SEQ ID NO: 4069531 - DNA, 18 bp, Homo sapiens
cgcctgctgcctgctgag

SEQ ID NO: 4069532 - DNA, 22 bp, Homo sapiens
cgcctgctggccgacccactga

SEQ ID NO: 4069533 - DNA, 17 bp, Homo sapiens
cgcctgtaatcccagca

SEQ ID NO: 4069534 - DNA, 17 bp, Homo sapiens
cgcctgtagtcctagcc

SEQ ID NO: 4069535 - DNA, 15 bp, Homo sapiens
cgcctgtgatgctgg

SEQ ID NO: 4069536 - DNA, 16 bp, Homo sapiens
cgcctgtgatgctggg

SEQ ID NO: 4069537 - DNA, 19 bp, Homo sapiens
cgccttgtctcctactcct

SEQ ID NO: 4069538 - DNA, 15 bp, Homo sapiens
cgcgcaccccacgcc

SEQ ID NO: 4069539 - DNA, 20 bp, Homo sapiens
cgcgcctttccgcggagccc

SEQ ID NO: 4069540 - DNA, 14 bp, Homo sapiens
cgcgggcagcgggc

SEQ ID NO: 4069541 - DNA, 21 bp, Homo sapiens
cgcgggcagcgggccaggccc

SEQ ID NO: 4069542 - DNA, 12 bp, Homo sapiens
cgcgtctcctgt

SEQ ID NO: 4069543 - DNA, 21 bp, Homo sapiens
cgcgtctcctgtttttctggg

SEQ ID NO: 4069544 - DNA, 12 bp, Homo sapiens
cgcgtcttcctg

SEQ ID NO: 4069545 - DNA, 15 bp, Homo sapiens
cgctaaagagccctt

SEQ ID NO: 4069546 - DNA, 20 bp, Homo sapiens
cgctaagctggctctgtttg

SEQ ID NO: 4069547 - DNA, 11 bp, Homo sapiens
cgctacccact

SEQ ID NO: 4069548 - DNA, 13 bp, Homo sapiens
cgctacctccctc

SEQ ID NO: 4069549 - DNA, 15 bp, Homo sapiens
cgctacctctctgtc

SEQ ID NO: 4069550 - DNA, 17 bp, Homo sapiens
cgctacctctctgtccc

SEQ ID NO: 4069551 - DNA, 17 bp, Homo sapiens
cgctactataaagagaa

SEQ ID NO: 4069552 - DNA, 15 bp, Homo sapiens
cgctagcacagctcc

SEQ ID NO: 4069553 - DNA, 16 bp, Homo sapiens
cgctagcacagctccc

SEQ ID NO: 4069554 - DNA, 15 bp, Homo sapiens
cgctcaccgctggcc

SEQ ID NO: 4069555 - DNA, 21 bp, Homo sapiens
cgctcaccgctggcccttaga

SEQ ID NO: 4069556 - DNA, 23 bp, Homo sapiens
cgctcaccgctggcccttagaga

SEQ ID NO: 4069557 - DNA, 21 bp, Homo sapiens
cgctcagccctccctgcccct

SEQ ID NO: 4069558 - DNA, 15 bp, Homo sapiens
cgctccagctgcccc

SEQ ID NO: 4069559 - DNA, 23 bp, Homo sapiens
cgctcccaggttcccccagcaag

SEQ ID NO: 4069560 - DNA, 15 bp, Homo sapiens
cgctcccgctcccag

SEQ ID NO: 4069561 - DNA, 15 bp, Homo sapiens
cgctcctgccgcaga

SEQ ID NO: 4069562 - DNA, 22 bp, Homo sapiens
cgctcctgccgcagacgggcac

SEQ ID NO: 4069563 - DNA, 14 bp, Homo sapiens
cgctcgcccagcag

SEQ ID NO: 4069564 - DNA, 15 bp, Homo sapiens
cgctcgcccagcagg

SEQ ID NO: 4069565 - DNA, 21 bp, Homo sapiens
cgctcgcgggcagcgggccag

SEQ ID NO: 4069566 - DNA, 13 bp, Homo sapiens
cgctgagctgagt

SEQ ID NO: 4069567 - DNA, 18 bp, Homo sapiens
cgctgagctgagtggcca

SEQ ID NO: 4069568 - DNA, 17 bp, Homo sapiens
cgctgaggtgtctggcc

SEQ ID NO: 4069569 - DNA, 17 bp, Homo sapiens
cgctgccagcacagagc

SEQ ID NO: 4069570 - DNA, 19 bp, Homo sapiens
gcctcctgagcctgtgggt

SEQ ID NO: 4069571 - DNA, 12 bp, Homo sapiens
gcctcctggcca

SEQ ID NO: 4069572 - DNA, 19 bp, Homo sapiens
gcctcctggccagacgctg

SEQ ID NO: 4069573 - DNA, 12 bp, Homo sapiens
gcctcctgggaa

SEQ ID NO: 4069574 - DNA, 14 bp, Homo sapiens
gcctcctgtgcctg

SEQ ID NO: 4069575 - DNA, 21 bp, Homo sapiens
gcctcctgtgcctggccccag

SEQ ID NO: 4069576 - DNA, 14 bp, Homo sapiens
gcctcctgtggcct

SEQ ID NO: 4069577 - DNA, 12 bp, Homo sapiens
gcctcctgtggg

SEQ ID NO: 4069578 - DNA, 17 bp, Homo sapiens
gcctccttccacctccc

SEQ ID NO: 4069579 - DNA, 20 bp, Homo sapiens
gcctccttccacctccctcc

SEQ ID NO: 4069580 - DNA, 16 bp, Homo sapiens
gcctcgaaacacagaa

SEQ ID NO: 4069581 - DNA, 22 bp, Homo sapiens
gcctcgacagggcctggagccc

SEQ ID NO: 4069582 - DNA, 21 bp, Homo sapiens
gcctcgcaggcctccctgcca

SEQ ID NO: 4069583 - DNA, 12 bp, Homo sapiens
gcctcgcctgtc

SEQ ID NO: 4069584 - DNA, 15 bp, Homo sapiens
gcctcgcctgtcacc

SEQ ID NO: 4069585 - DNA, 18 bp, Homo sapiens
gcctctaccagttggcag

SEQ ID NO: 4069586 - DNA, 21 bp, Homo sapiens
gcctctccagtttgcacctgt

SEQ ID NO: 4069587 - DNA, 20 bp, Homo sapiens
gcctctcccgcaccaggccg

SEQ ID NO: 4069588 - DNA, 21 bp, Homo sapiens
gcctctctggaaagaggctct

SEQ ID NO: 4069589 - DNA, 12 bp, Homo sapiens
gcctctgcagtc

SEQ ID NO: 4069590 - DNA, 22 bp, Homo sapiens
gcctctgcccctcccaacccag

SEQ ID NO: 4069591 - DNA, 13 bp, Homo sapiens
gcctctgcctcca

SEQ ID NO: 4069592 - DNA, 15 bp, Homo sapiens
gcctctgctgccgcc

SEQ ID NO: 4069593 - DNA, 19 bp, Homo sapiens
gcctctggacagccagtga

SEQ ID NO: 4069594 - DNA, 22 bp, Homo sapiens
gcctctggacagccagtgacct

SEQ ID NO: 4069595 - DNA, 14 bp, Homo sapiens
gcctctgggactgg

SEQ ID NO: 4069596 - DNA, 14 bp, Homo sapiens
gcctctgtgtcctt

SEQ ID NO: 4069597 - DNA, 18 bp, Homo sapiens
gcctctgtgtccttccct

SEQ ID NO: 4069598 - DNA, 17 bp, Homo sapiens
gcctcttactaatgtaa

SEQ ID NO: 4069599 - DNA, 21 bp, Homo sapiens
gcctcttgagcagtggctggt

SEQ ID NO: 4069600 - DNA, 18 bp, Homo sapiens
gcctcttgtaaagactgg

SEQ ID NO: 4069601 - DNA, 17 bp, Homo sapiens
gcctcttgtctgaggga

SEQ ID NO: 4069602 - DNA, 12 bp, Homo sapiens
gcctctttccct

SEQ ID NO: 4069603 - DNA, 15 bp, Homo sapiens
gcctgaaaaatggga

SEQ ID NO: 4069604 - DNA, 19 bp, Homo sapiens
gcctgaaacagccatgtcc

SEQ ID NO: 4069605 - DNA, 20 bp, Homo sapiens
gcctgaacagaagctcttac

SEQ ID NO: 4069606 - DNA, 18 bp, Homo sapiens
gcctgaatcatgagcctg

SEQ ID NO: 4069607 - DNA, 23 bp, Homo sapiens
gcctgaatcatgagcctgctgga

SEQ ID NO: 4069608 - DNA, 15 bp, Homo sapiens
gcctgacacactaac

SEQ ID NO: 4069609 - DNA, 15 bp, Homo sapiens
gcctgaccttccttc

SEQ ID NO: 4069610 - DNA, 13 bp, Homo sapiens
gcctgactgctca

SEQ ID NO: 4069611 - DNA, 19 bp, Homo sapiens
gcctgacttctgctggcat

SEQ ID NO: 4069612 - DNA, 20 bp, Homo sapiens
gcctgagaagaagtggctgc

SEQ ID NO: 4069613 - DNA, 19 bp, Homo sapiens
gcctgagagaattggctca

SEQ ID NO: 4069614 - DNA, 20 bp, Homo sapiens
gcctgagagaattggctcaa

SEQ ID NO: 4069615 - DNA, 15 bp, Homo sapiens
gcctgagaggcaggc

SEQ ID NO: 4069616 - DNA, 18 bp, Homo sapiens
gcctgagaggcaggcata

SEQ ID NO: 4069617 - DNA, 19 bp, Homo sapiens
gcctgagaggcaggcatag

SEQ ID NO: 4069618 - DNA, 14 bp, Homo sapiens
gcctgagatgcctg

SEQ ID NO: 4069619 - DNA, 13 bp, Homo sapiens
gcctgagcaacat

SEQ ID NO: 4069620 - DNA, 21 bp, Homo sapiens
gcctgagcaacatctcgggag

SEQ ID NO: 4069621 - DNA, 14 bp, Homo sapiens
gcctgagctcactc

SEQ ID NO: 4069622 - DNA, 17 bp, Homo sapiens
gcctgagctcactcggc

SEQ ID NO: 4069623 - DNA, 16 bp, Homo sapiens
gcctgagctcctgctg

SEQ ID NO: 4069624 - DNA, 17 bp, Homo sapiens
gcctgagctcctgctgc

SEQ ID NO: 4069625 - DNA, 15 bp, Homo sapiens
gcctgagctggggaa

SEQ ID NO: 4069626 - DNA, 13 bp, Homo sapiens
gcctgaggctcct

SEQ ID NO: 4069627 - DNA, 13 bp, Homo sapiens
gcctgagggcagt

SEQ ID NO: 4069628 - DNA, 13 bp, Homo sapiens
gcctgagtctcct

SEQ ID NO: 4069629 - DNA, 21 bp, Homo sapiens
gcctgatcttgcctgtctggc

SEQ ID NO: 4069630 - DNA, 12 bp, Homo sapiens
gcctgatgacag

SEQ ID NO: 4069631 - DNA, 20 bp, Homo sapiens
gcctgatgctccctcccctg

SEQ ID NO: 4069632 - DNA, 18 bp, Homo sapiens
gcctgcaatctgagccag

SEQ ID NO: 4069633 - DNA, 16 bp, Homo sapiens
gcctgcagagagaagc

SEQ ID NO: 4069634 - DNA, 13 bp, Homo sapiens
gcctgcagcaggc

SEQ ID NO: 4069635 - DNA, 14 bp, Homo sapiens
gcctgcagcaggca

SEQ ID NO: 4069636 - DNA, 20 bp, Homo sapiens
gcctgcaggagagagcagca

SEQ ID NO: 4069637 - DNA, 22 bp, Homo sapiens
gcctgcaggagagagcagcact

SEQ ID NO: 4069638 - DNA, 13 bp, Homo sapiens
gcctgcaggcaga

SEQ ID NO: 4069639 - DNA, 19 bp, Homo sapiens
gcctgcaggcagagctgga

SEQ ID NO: 4069640 - DNA, 14 bp, Homo sapiens
gcctgccagctgca

SEQ ID NO: 4069641 - DNA, 17 bp, Homo sapiens
gcctgccccaaacaaat

SEQ ID NO: 4069642 - DNA, 23 bp, Homo sapiens
gcctgccccaaacaaatatgcaa

SEQ ID NO: 4069643 - DNA, 17 bp, Homo sapiens
gcctgcccctctcccgc

SEQ ID NO: 4069644 - DNA, 20 bp, Homo sapiens
gcctgccctcatggcccctc

SEQ ID NO: 4069645 - DNA, 22 bp, Homo sapiens
gcctgccctcatggcccctctg

SEQ ID NO: 4069646 - DNA, 20 bp, Homo sapiens
gcctgccgggctgagggcct

SEQ ID NO: 4069647 - DNA, 13 bp, Homo sapiens
gcctgcctcccaa

SEQ ID NO: 4069648 - DNA, 15 bp, Homo sapiens
gcctgccttcgttaa

SEQ ID NO: 4069649 - DNA, 17 bp, Homo sapiens
gcctgcgcctgctgcct

SEQ ID NO: 4069650 - DNA, 18 bp, Homo sapiens
gcctgcgcctgctgcctg

SEQ ID NO: 4069651 - DNA, 17 bp, Homo sapiens
gcctgctcccagcagcc

SEQ ID NO: 4069652 - DNA, 20 bp, Homo sapiens
gcctgctcccagcagcccta

SEQ ID NO: 4069653 - DNA, 12 bp, Homo sapiens
gcctgctccttc

SEQ ID NO: 4069654 - DNA, 15 bp, Homo sapiens
gcctgctgagagccc

SEQ ID NO: 4069655 - DNA, 17 bp, Homo sapiens
gcctgctgagagccccc

SEQ ID NO: 4069656 - DNA, 11 bp, Homo sapiens
gcctgctgcat

SEQ ID NO: 4069657 - DNA, 14 bp, Homo sapiens
gcctgctgccagtg

SEQ ID NO: 4069658 - DNA, 21 bp, Homo sapiens
gcctgctgccagtgcagccac

SEQ ID NO: 4069659 - DNA, 17 bp, Homo sapiens
gcctgctgcctgctgag

SEQ ID NO: 4069660 - DNA, 19 bp, Homo sapiens
gcctgctggaagcccagcc

SEQ ID NO: 4069661 - DNA, 13 bp, Homo sapiens
gcctgctggaggc

SEQ ID NO: 4069662 - DNA, 15 bp, Homo sapiens
gcctgctggaggcct

SEQ ID NO: 4069663 - DNA, 23 bp, Homo sapiens
gcctgctggaggcctcaggtgct

SEQ ID NO: 4069664 - DNA, 13 bp, Homo sapiens
gcctgctggcacc

SEQ ID NO: 4069665 - DNA, 17 bp, Homo sapiens
gcctgctggcacccacc

SEQ ID NO: 4069666 - DNA, 21 bp, Homo sapiens
gcctgctggtcacagcctcct

SEQ ID NO: 4069667 - DNA, 22 bp, Homo sapiens
gcctgctggtcacagcctcctc

SEQ ID NO: 4069668 - DNA, 15 bp, Homo sapiens
gcctgcttggcccgg

SEQ ID NO: 4069669 - DNA, 18 bp, Homo sapiens
gcctggaaacctgtctga

SEQ ID NO: 4069670 - DNA, 18 bp, Homo sapiens
gcctggacctgcctcctg

SEQ ID NO: 4069671 - DNA, 19 bp, Homo sapiens
gcctggacctgcctcctgc

SEQ ID NO: 4069672 - DNA, 17 bp, Homo sapiens
gcctggactctgcccca

SEQ ID NO: 4069673 - DNA, 18 bp, Homo sapiens
gctactgtgtgtgtgaat

SEQ ID NO: 4069674 - DNA, 18 bp, Homo sapiens
gctacttcctcctcccca

SEQ ID NO: 4069675 - DNA, 13 bp, Homo sapiens
gctacttgggagg

SEQ ID NO: 4069676 - DNA, 22 bp, Homo sapiens
gctactttggtttctgtctgta

SEQ ID NO: 4069677 - DNA, 20 bp, Homo sapiens
gctagagaaatcagctgcta

SEQ ID NO: 4069678 - DNA, 18 bp, Homo sapiens
gctagaggccagccccac

SEQ ID NO: 4069679 - DNA, 20 bp, Homo sapiens
gctagaggccagccccaccc

SEQ ID NO: 4069680 - DNA, 20 bp, Homo sapiens
gctagaggccatggaggcag

SEQ ID NO: 4069681 - DNA, 13 bp, Homo sapiens
gctagagtcctca

SEQ ID NO: 4069682 - DNA, 14 bp, Homo sapiens
gctagcacagctcc

SEQ ID NO: 4069683 - DNA, 16 bp, Homo sapiens
gctagcctttcttgta

SEQ ID NO: 4069684 - DNA, 22 bp, Homo sapiens
gctaggcagggtgtctgccccc

SEQ ID NO: 4069685 - DNA, 17 bp, Homo sapiens
gctagtatcttcaaact

SEQ ID NO: 4069686 - DNA, 21 bp, Homo sapiens
gctagtatcttcaaactttca

SEQ ID NO: 4069687 - DNA, 22 bp, Homo sapiens
gctagtatttgaattaaaactt

SEQ ID NO: 4069688 - DNA, 19 bp, Homo sapiens
gctagtgggccctctctct

SEQ ID NO: 4069689 - DNA, 18 bp, Homo sapiens
gctataatcattagtttt

SEQ ID NO: 4069690 - DNA, 21 bp, Homo sapiens
gctatacctgcacgttcataa

SEQ ID NO: 4069691 - DNA, 17 bp, Homo sapiens
gctatataagacaagaa

SEQ ID NO: 4069692 - DNA, 14 bp, Homo sapiens
gctatatataaaac

SEQ ID NO: 4069693 - DNA, 13 bp, Homo sapiens
gctatcacacagt

SEQ ID NO: 4069694 - DNA, 18 bp, Homo sapiens
gctatccccatctccctg

SEQ ID NO: 4069695 - DNA, 16 bp, Homo sapiens
gctatctgtcatctct

SEQ ID NO: 4069696 - DNA, 15 bp, Homo sapiens
gctatggcctgtgcg

SEQ ID NO: 4069697 - DNA, 17 bp, Homo sapiens
gctatgttactattttc

SEQ ID NO: 4069698 - DNA, 12 bp, Homo sapiens
gctattacaaat

SEQ ID NO: 4069699 - DNA, 13 bp, Homo sapiens
gctattacaaata

SEQ ID NO: 4069700 - DNA, 19 bp, Homo sapiens
gctattagccaggatcatg

SEQ ID NO: 4069701 - DNA, 19 bp, Homo sapiens
gctattggaggatcagttt

SEQ ID NO: 4069702 - DNA, 13 bp, Homo sapiens
gctattgtaaata

SEQ ID NO: 4069703 - DNA, 14 bp, Homo sapiens
gctatttaaaactt

SEQ ID NO: 4069704 - DNA, 13 bp, Homo sapiens
gctatttatgcaa

SEQ ID NO: 4069705 - DNA, 19 bp, Homo sapiens
gctatttgaaatactaaaa

SEQ ID NO: 4069706 - DNA, 23 bp, Homo sapiens
gctatttgaaatactaaaagcaa

SEQ ID NO: 4069707 - DNA, 15 bp, Homo sapiens
gctatttgtaaatct

SEQ ID NO: 4069708 - DNA, 19 bp, Homo sapiens
gctatttgtaaatctgcca

SEQ ID NO: 4069709 - DNA, 16 bp, Homo sapiens
gctattttcctctggc

SEQ ID NO: 4069710 - DNA, 23 bp, Homo sapiens
gctattttcctctggccgcagag

SEQ ID NO: 4069711 - DNA, 19 bp, Homo sapiens
gctcaaaaggaaaccaagt

SEQ ID NO: 4069712 - DNA, 23 bp, Homo sapiens
gctcaaatctattcagacaagca

SEQ ID NO: 4069713 - DNA, 15 bp, Homo sapiens
gctcaaccactgtgg

SEQ ID NO: 4069714 - DNA, 16 bp, Homo sapiens
gctcaaccactgtggc

SEQ ID NO: 4069715 - DNA, 19 bp, Homo sapiens
gctcaactctacccctgct

SEQ ID NO: 4069716 - DNA, 20 bp, Homo sapiens
gctcaactctacccctgctc

SEQ ID NO: 4069717 - DNA, 23 bp, Homo sapiens
gctcaagcaatcctcctgcctca

SEQ ID NO: 4069718 - DNA, 15 bp, Homo sapiens
gctcaagcagcgacc

SEQ ID NO: 4069719 - DNA, 16 bp, Homo sapiens
gctcaagcccaggagg

SEQ ID NO: 4069720 - DNA, 18 bp, Homo sapiens
gctcaagcgattctcctg

SEQ ID NO: 4069721 - DNA, 14 bp, Homo sapiens
gctcaatcctctaa

SEQ ID NO: 4069722 - DNA, 17 bp, Homo sapiens
gctcacactccagtggc

SEQ ID NO: 4069723 - DNA, 14 bp, Homo sapiens
gctcaccagccctg

SEQ ID NO: 4069724 - DNA, 19 bp, Homo sapiens
gctcaccccatcatccctt

SEQ ID NO: 4069725 - DNA, 11 bp, Homo sapiens
gctcacccctg

SEQ ID NO: 4069726 - DNA, 17 bp, Homo sapiens
gctcacccctgggcagg

SEQ ID NO: 4069727 - DNA, 18 bp, Homo sapiens
gctcacccctgggcaggc

SEQ ID NO: 4069728 - DNA, 15 bp, Homo sapiens
gctcaccgcccatca

SEQ ID NO: 4069729 - DNA, 21 bp, Homo sapiens
gctcaccgctggcccttagag

SEQ ID NO: 4069730 - DNA, 21 bp, Homo sapiens
gctcacgcctgtaatcccagc

SEQ ID NO: 4069731 - DNA, 23 bp, Homo sapiens
gctcacgcctgtaatcccagcac

SEQ ID NO: 4069732 - DNA, 22 bp, Homo sapiens
gctcacggggcctccaacccat

SEQ ID NO: 4069733 - DNA, 12 bp, Homo sapiens
gctcactgccag

SEQ ID NO: 4069734 - DNA, 14 bp, Homo sapiens
gctcactgccaggc

SEQ ID NO: 4069735 - DNA, 21 bp, Homo sapiens
gctcactgccaggccagcctc

SEQ ID NO: 4069736 - DNA, 22 bp, Homo sapiens
gctcactgccaggccagcctcc

SEQ ID NO: 4069737 - DNA, 20 bp, Homo sapiens
gctcactttattatccctat

SEQ ID NO: 4069738 - DNA, 15 bp, Homo sapiens
gctcagaataaggca

SEQ ID NO: 4069739 - DNA, 17 bp, Homo sapiens
gctcagacggcggccag

SEQ ID NO: 4069740 - DNA, 18 bp, Homo sapiens
gctcagacggcggccagg

SEQ ID NO: 4069741 - DNA, 23 bp, Homo sapiens
gctcagacggcggccaggcacag

SEQ ID NO: 4069742 - DNA, 17 bp, Homo sapiens
gctcagagaaggaaaag

SEQ ID NO: 4069743 - DNA, 15 bp, Homo sapiens
gctcagaggcccagg

SEQ ID NO: 4069744 - DNA, 20 bp, Homo sapiens
gctcagaggcgcactgtgac

SEQ ID NO: 4069745 - DNA, 19 bp, Homo sapiens
gctcagatggactgggagg

SEQ ID NO: 4069746 - DNA, 12 bp, Homo sapiens
gctcagccctcc

SEQ ID NO: 4069747 - DNA, 16 bp, Homo sapiens
gctcagccctccctgc

SEQ ID NO: 4069748 - DNA, 21 bp, Homo sapiens
gctcagccctccctgcccctc

SEQ ID NO: 4069749 - DNA, 16 bp, Homo sapiens
gctcagccctgactgg

SEQ ID NO: 4069750 - DNA, 21 bp, Homo sapiens
gctcagccctgactggtgcta

SEQ ID NO: 4069751 - DNA, 11 bp, Homo sapiens
gctcagctcct

SEQ ID NO: 4069752 - DNA, 20 bp, Homo sapiens
gctcagctcctacctctgtg

SEQ ID NO: 4069753 - DNA, 22 bp, Homo sapiens
gctcagctcctacctctgtgcc

SEQ ID NO: 4069754 - DNA, 16 bp, Homo sapiens
gctcagcttcttccta

SEQ ID NO: 4069755 - DNA, 17 bp, Homo sapiens
gctcaggacagatgcca

SEQ ID NO: 4069756 - DNA, 24 bp, Homo sapiens
gctcaggcgatccacctgtctcag

SEQ ID NO: 4069757 - DNA, 13 bp, Homo sapiens
gctcaggctctgc

SEQ ID NO: 4069758 - DNA, 14 bp, Homo sapiens
gctcaggctctgct

SEQ ID NO: 4069759 - DNA, 19 bp, Homo sapiens
gctcagggtcaaagacaga

SEQ ID NO: 4069760 - DNA, 15 bp, Homo sapiens
gctcaggtccctggg

SEQ ID NO: 4069761 - DNA, 19 bp, Homo sapiens
gctcaggtccctggggcta

SEQ ID NO: 4069762 - DNA, 12 bp, Homo sapiens
gctcagtcccat

SEQ ID NO: 4069763 - DNA, 15 bp, Homo sapiens
gctcagtgctctctc

SEQ ID NO: 4069764 - DNA, 16 bp, Homo sapiens
gctcagtgctctctcc

SEQ ID NO: 4069765 - DNA, 16 bp, Homo sapiens
gctcatacaaaataaa

SEQ ID NO: 4069766 - DNA, 15 bp, Homo sapiens
gctcatctccaagga

SEQ ID NO: 4069767 - DNA, 11 bp, Homo sapiens
gctcatttaag

SEQ ID NO: 4069768 - DNA, 21 bp, Homo sapiens
gctccaacccccgccacctca

SEQ ID NO: 4069769 - DNA, 18 bp, Homo sapiens
gctccaacctgcaaagat

SEQ ID NO: 4069770 - DNA, 20 bp, Homo sapiens
gctccaagggaccctttgcc

SEQ ID NO: 4069771 - DNA, 19 bp, Homo sapiens
gctccaccaagaaagcagg

SEQ ID NO: 4069772 - DNA, 15 bp, Homo sapiens
gctccaccacatcct

SEQ ID NO: 4069773 - DNA, 15 bp, Homo sapiens
gctccacccttggcc

SEQ ID NO: 4069774 - DNA, 16 bp, Homo sapiens
gctccacccttggcct

SEQ ID NO: 4069775 - DNA, 19 bp, Homo sapiens
gctccacccttggcctgtc

SEQ ID NO: 4069776 - DNA, 21 bp, Homo sapiens
gctgaggtgtctggcctgagg

SEQ ID NO: 4069777 - DNA, 21 bp, Homo sapiens
gctgaggtgtcttaagccttt

SEQ ID NO: 4069778 - DNA, 16 bp, Homo sapiens
gctgaggttcctctgc

SEQ ID NO: 4069779 - DNA, 23 bp, Homo sapiens
gctgaggttcctctgcctgcccc

SEQ ID NO: 4069780 - DNA, 16 bp, Homo sapiens
gctgagtggccagcca

SEQ ID NO: 4069781 - DNA, 18 bp, Homo sapiens
gctgagtggcgcaaggcc

SEQ ID NO: 4069782 - DNA, 13 bp, Homo sapiens
gctgatataaatt

SEQ ID NO: 4069783 - DNA, 17 bp, Homo sapiens
gctgatataaattctgt

SEQ ID NO: 4069784 - DNA, 18 bp, Homo sapiens
gctgatcatcgccagagg

SEQ ID NO: 4069785 - DNA, 22 bp, Homo sapiens
gctgatcatcgccagaggtgct

SEQ ID NO: 4069786 - DNA, 14 bp, Homo sapiens
gctgatgatccaga

SEQ ID NO: 4069787 - DNA, 19 bp, Homo sapiens
gctgatgatccagaacagt

SEQ ID NO: 4069788 - DNA, 16 bp, Homo sapiens
gctgatggaggaaaaa

SEQ ID NO: 4069789 - DNA, 15 bp, Homo sapiens
gctgatggcagctgg

SEQ ID NO: 4069790 - DNA, 19 bp, Homo sapiens
gctgatggcttgacatgtg

SEQ ID NO: 4069791 - DNA, 19 bp, Homo sapiens
gctgatgtccctagaaaac

SEQ ID NO: 4069792 - DNA, 17 bp, Homo sapiens
gctgatttaaaaagtga

SEQ ID NO: 4069793 - DNA, 15 bp, Homo sapiens
gctgatttcccctct

SEQ ID NO: 4069794 - DNA, 14 bp, Homo sapiens
gctgattttaacaa

SEQ ID NO: 4069795 - DNA, 20 bp, Homo sapiens
gctgcaccacggcgtttttt

SEQ ID NO: 4069796 - DNA, 17 bp, Homo sapiens
gctgcaccagagcaacc

SEQ ID NO: 4069797 - DNA, 15 bp, Homo sapiens
gctgcaccaggtaga

SEQ ID NO: 4069798 - DNA, 18 bp, Homo sapiens
gctgcacccaactactga

SEQ ID NO: 4069799 - DNA, 19 bp, Homo sapiens
gctgcagattagttctttt

SEQ ID NO: 4069800 - DNA, 16 bp, Homo sapiens
gctgcagcctggctgg

SEQ ID NO: 4069801 - DNA, 17 bp, Homo sapiens
gctgcagctgggcagca

SEQ ID NO: 4069802 - DNA, 22 bp, Homo sapiens
gctgcaggaatcaaaaattgaa

SEQ ID NO: 4069803 - DNA, 23 bp, Homo sapiens
gctgcaggagtgtcctgcccatg

SEQ ID NO: 4069804 - DNA, 14 bp, Homo sapiens
gctgcagtcatcta

SEQ ID NO: 4069805 - DNA, 15 bp, Homo sapiens
gctgccaaattttgg

SEQ ID NO: 4069806 - DNA, 17 bp, Homo sapiens
gctgccaaattttggcc

SEQ ID NO: 4069807 - DNA, 15 bp, Homo sapiens
gctgccaaggccaga

SEQ ID NO: 4069808 - DNA, 22 bp, Homo sapiens
gctgccaaggccagagtggcct

SEQ ID NO: 4069809 - DNA, 21 bp, Homo sapiens
gctgccacaaccagccaggca

SEQ ID NO: 4069810 - DNA, 23 bp, Homo sapiens
gctgccacacttcaggctcttct

SEQ ID NO: 4069811 - DNA, 17 bp, Homo sapiens
gctgccagcccagaaca

SEQ ID NO: 4069812 - DNA, 20 bp, Homo sapiens
gctgccagccttgagccctg

SEQ ID NO: 4069813 - DNA, 21 bp, Homo sapiens
gctgccagccttgagccctgg

SEQ ID NO: 4069814 - DNA, 17 bp, Homo sapiens
gctgccagtaccagccc

SEQ ID NO: 4069815 - DNA, 16 bp, Homo sapiens
gctgccagtgcagcca

SEQ ID NO: 4069816 - DNA, 17 bp, Homo sapiens
gctgccagtgcagccac

SEQ ID NO: 4069817 - DNA, 22 bp, Homo sapiens
gctgccagtgcagccactggct

SEQ ID NO: 4069818 - DNA, 14 bp, Homo sapiens
gctgccataattct

SEQ ID NO: 4069819 - DNA, 16 bp, Homo sapiens
gctgccataattctaa

SEQ ID NO: 4069820 - DNA, 17 bp, Homo sapiens
gctgcccaatctccatc

SEQ ID NO: 4069821 - DNA, 14 bp, Homo sapiens
gctgccccaacctg

SEQ ID NO: 4069822 - DNA, 16 bp, Homo sapiens
gctgccccaacctgct

SEQ ID NO: 4069823 - DNA, 17 bp, Homo sapiens
gctgccccaacctgctg

SEQ ID NO: 4069824 - DNA, 18 bp, Homo sapiens
gctgcccccggccccctg

SEQ ID NO: 4069825 - DNA, 20 bp, Homo sapiens
gctgcccccggccccctggt

SEQ ID NO: 4069826 - DNA, 17 bp, Homo sapiens
gctgccccggcctcctc

SEQ ID NO: 4069827 - DNA, 19 bp, Homo sapiens
gctgcccctaatctctgta

SEQ ID NO: 4069828 - DNA, 15 bp, Homo sapiens
gctgcccctctcacc

SEQ ID NO: 4069829 - DNA, 13 bp, Homo sapiens
gctgcccctgcag

SEQ ID NO: 4069830 - DNA, 23 bp, Homo sapiens
gctgccccttaaacacaggctgt

SEQ ID NO: 4069831 - DNA, 16 bp, Homo sapiens
gctgccctccttgtcc

SEQ ID NO: 4069832 - DNA, 16 bp, Homo sapiens
gctgccctgagaagct

SEQ ID NO: 4069833 - DNA, 21 bp, Homo sapiens
gctgccctgagaagctgctcc

SEQ ID NO: 4069834 - DNA, 22 bp, Homo sapiens
gctgccctgagaagctgctcca

SEQ ID NO: 4069835 - DNA, 17 bp, Homo sapiens
gctgccctggtgctgcc

SEQ ID NO: 4069836 - DNA, 22 bp, Homo sapiens
gctgccctggtgctgccacact

SEQ ID NO: 4069837 - DNA, 14 bp, Homo sapiens
gctgccgctgcacc

SEQ ID NO: 4069838 - DNA, 16 bp, Homo sapiens
gctgccgctgcaccac

SEQ ID NO: 4069839 - DNA, 17 bp, Homo sapiens
gctgccgctgcaccacg

SEQ ID NO: 4069840 - DNA, 17 bp, Homo sapiens
gctgccgctgccgctgc

SEQ ID NO: 4069841 - DNA, 15 bp, Homo sapiens
gctgccgggcctgat

SEQ ID NO: 4069842 - DNA, 17 bp, Homo sapiens
gctgcctagcaagctgg

SEQ ID NO: 4069843 - DNA, 12 bp, Homo sapiens
gctgcctcactt

SEQ ID NO: 4069844 - DNA, 13 bp, Homo sapiens
gctgcctcctgcg

SEQ ID NO: 4069845 - DNA, 16 bp, Homo sapiens
gctgcctctcccatca

SEQ ID NO: 4069846 - DNA, 13 bp, Homo sapiens
gctgcctctgggc

SEQ ID NO: 4069847 - DNA, 15 bp, Homo sapiens
gctgcctctgggcca

SEQ ID NO: 4069848 - DNA, 13 bp, Homo sapiens
gctgcctgctgag

SEQ ID NO: 4069849 - DNA, 13 bp, Homo sapiens
gctgcctgcttgg

SEQ ID NO: 4069850 - DNA, 21 bp, Homo sapiens
gctgccttcccatgaatctgt

SEQ ID NO: 4069851 - DNA, 12 bp, Homo sapiens
gctgccttccct

SEQ ID NO: 4069852 - DNA, 15 bp, Homo sapiens
gctgccttccctagc

SEQ ID NO: 4069853 - DNA, 16 bp, Homo sapiens
gctgccttggctcaga

SEQ ID NO: 4069854 - DNA, 17 bp, Homo sapiens
gctgccttggctcagac

SEQ ID NO: 4069855 - DNA, 19 bp, Homo sapiens
gctgccttggctcagacat

SEQ ID NO: 4069856 - DNA, 21 bp, Homo sapiens
gctgccttggctcagacatgt

SEQ ID NO: 4069857 - DNA, 24 bp, Homo sapiens
gctgcgcaccaatgcccagcaggg

SEQ ID NO: 4069858 - DNA, 17 bp, Homo sapiens
gctgcgcctgcaggcag

SEQ ID NO: 4069859 - DNA, 21 bp, Homo sapiens
gctgcgcctgcaggcagagct

SEQ ID NO: 4069860 - DNA, 17 bp, Homo sapiens
gctgcgcttgcttttct

SEQ ID NO: 4069861 - DNA, 16 bp, Homo sapiens
gctgctaacctggaaa

SEQ ID NO: 4069862 - DNA, 17 bp, Homo sapiens
gctgctaacctggaaag

SEQ ID NO: 4069863 - DNA, 19 bp, Homo sapiens
gctgctaccgccctgggct

SEQ ID NO: 4069864 - DNA, 22 bp, Homo sapiens
gctgctaccgttgacttccagg

SEQ ID NO: 4069865 - DNA, 17 bp, Homo sapiens
gctgctatccccatctc

SEQ ID NO: 4069866 - DNA, 12 bp, Homo sapiens
gctgctccgccc

SEQ ID NO: 4069867 - DNA, 13 bp, Homo sapiens
gctgctcctcatg

SEQ ID NO: 4069868 - DNA, 15 bp, Homo sapiens
gctgctccttggctt

SEQ ID NO: 4069869 - DNA, 12 bp, Homo sapiens
gctgctctggaa

SEQ ID NO: 4069870 - DNA, 10 bp, Homo sapiens
gctgctgacc

SEQ ID NO: 4069871 - DNA, 21 bp, Homo sapiens
gctgctgaccaattgtgctgc

SEQ ID NO: 4069872 - DNA, 23 bp, Homo sapiens
gctgctgaccaattgtgctgcca

SEQ ID NO: 4069873 - DNA, 14 bp, Homo sapiens
gctgctgctgcacc

SEQ ID NO: 4069874 - DNA, 22 bp, Homo sapiens
gctgctggccaaatagcaaaga

SEQ ID NO: 4069875 - DNA, 11 bp, Homo sapiens
gctgctggctt

SEQ ID NO: 4069876 - DNA, 13 bp, Homo sapiens
gctgcttccagga

SEQ ID NO: 4069877 - DNA, 19 bp, Homo sapiens
gctgctttctgttgtcatt

SEQ ID NO: 4069878 - DNA, 23 bp, Homo sapiens
gctggaagaagtgagcagtgttg

SEQ ID NO: 4069879 - DNA, 13 bp, Homo sapiens
gctggaagcccag

SEQ ID NO: 4069880 - DNA, 19 bp, Homo sapiens
gctggaagtctccatgaag

SEQ ID NO: 4069881 - DNA, 19 bp, Homo sapiens
gctggacggggactgggga

SEQ ID NO: 4069882 - DNA, 21 bp, Homo sapiens
gctggacggggactggggatg

SEQ ID NO: 4069883 - DNA, 15 bp, Homo sapiens
gctggactattgtgc

SEQ ID NO: 4069884 - DNA, 13 bp, Homo sapiens
gctggactctgca

SEQ ID NO: 4069885 - DNA, 20 bp, Homo sapiens
gctggacttctacctgccct

SEQ ID NO: 4069886 - DNA, 22 bp, Homo sapiens
gctggacttctacctgccctca

SEQ ID NO: 4069887 - DNA, 17 bp, Homo sapiens
gctggacttctgtgggc

SEQ ID NO: 4069888 - DNA, 12 bp, Homo sapiens
gctggagaagct

SEQ ID NO: 4069889 - DNA, 13 bp, Homo sapiens
gctggagccccca

SEQ ID NO: 4069890 - DNA, 13 bp, Homo sapiens
gctggagccctgt

SEQ ID NO: 4069891 - DNA, 19 bp, Homo sapiens
gctggaggagcagcagctt

SEQ ID NO: 4069892 - DNA, 12 bp, Homo sapiens
gctggaggccca

SEQ ID NO: 4069893 - DNA, 15 bp, Homo sapiens
gctggaggcccaggc

SEQ ID NO: 4069894 - DNA, 20 bp, Homo sapiens
gctggaggcccaggctggga

SEQ ID NO: 4069895 - DNA, 14 bp, Homo sapiens
gctggaggcctcag

SEQ ID NO: 4069896 - DNA, 16 bp, Homo sapiens
gctggaggtggggcga

SEQ ID NO: 4069897 - DNA, 20 bp, Homo sapiens
gctggagtgcagtggtgtga

SEQ ID NO: 4069898 - DNA, 15 bp, Homo sapiens
gctggcaaaggtggc

SEQ ID NO: 4069899 - DNA, 20 bp, Homo sapiens
gctggcaaaggtggctctcc

SEQ ID NO: 4069900 - DNA, 16 bp, Homo sapiens
gctggcacccaccgtg

SEQ ID NO: 4069901 - DNA, 20 bp, Homo sapiens
gctggcacccaccgtggagg

SEQ ID NO: 4069902 - DNA, 16 bp, Homo sapiens
gctggcatttgcacct

SEQ ID NO: 4069903 - DNA, 20 bp, Homo sapiens
gctggccagcaaggcaggtt

SEQ ID NO: 4069904 - DNA, 13 bp, Homo sapiens
gctggccagcacc

SEQ ID NO: 4069905 - DNA, 19 bp, Homo sapiens
gctggccagcaccctctcc

SEQ ID NO: 4069906 - DNA, 14 bp, Homo sapiens
gctggccaggccct

SEQ ID NO: 4069907 - DNA, 20 bp, Homo sapiens
gctggccatggggccctccc

SEQ ID NO: 4069908 - DNA, 16 bp, Homo sapiens
gctggcccagggccca

SEQ ID NO: 4069909 - DNA, 16 bp, Homo sapiens
gctggccccagggcac

SEQ ID NO: 4069910 - DNA, 18 bp, Homo sapiens
gctggccctgcctcctgg

SEQ ID NO: 4069911 - DNA, 19 bp, Homo sapiens
gctggccctgcctcctggg

SEQ ID NO: 4069912 - DNA, 14 bp, Homo sapiens
gctggcccttagag

SEQ ID NO: 4069913 - DNA, 18 bp, Homo sapiens
gctggcccttagagaccc

SEQ ID NO: 4069914 - DNA, 22 bp, Homo sapiens
gctggcccttagagaccccgag

SEQ ID NO: 4069915 - DNA, 15 bp, Homo sapiens
gctggctacgcctct

SEQ ID NO: 4069916 - DNA, 17 bp, Homo sapiens
gctggctccagatgcag

SEQ ID NO: 4069917 - DNA, 17 bp, Homo sapiens
gctggctccccctcccc

SEQ ID NO: 4069918 - DNA, 19 bp, Homo sapiens
gctggctccccctccccag

SEQ ID NO: 4069919 - DNA, 23 bp, Homo sapiens
gctggctccccctccccaggctg

SEQ ID NO: 4069920 - DNA, 20 bp, Homo sapiens
gctggctctgcactaagaga

SEQ ID NO: 4069921 - DNA, 18 bp, Homo sapiens
gctggctcttctgcccaa

SEQ ID NO: 4069922 - DNA, 19 bp, Homo sapiens
gctggctgcccagacccct

SEQ ID NO: 4069923 - DNA, 20 bp, Homo sapiens
gctggctgccttagaacctt

SEQ ID NO: 4069924 - DNA, 23 bp, Homo sapiens
gctggcttccagcttcaggcacc

SEQ ID NO: 4069925 - DNA, 13 bp, Homo sapiens
gctgggaccagag

SEQ ID NO: 4069926 - DNA, 18 bp, Homo sapiens
gctgggaccagagccaga

SEQ ID NO: 4069927 - DNA, 19 bp, Homo sapiens
gctgggacgtggctcagcc

SEQ ID NO: 4069928 - DNA, 20 bp, Homo sapiens
gctgggacgtggctcagcca

SEQ ID NO: 4069929 - DNA, 22 bp, Homo sapiens
gctgggacgtggctcagccagc

SEQ ID NO: 4069930 - DNA, 17 bp, Homo sapiens
gctgggaggagggagag

SEQ ID NO: 4069931 - DNA, 15 bp, Homo sapiens
gctgggagttctaga

SEQ ID NO: 4069932 - DNA, 15 bp, Homo sapiens
gctgggcaaagccac

SEQ ID NO: 4069933 - DNA, 18 bp, Homo sapiens
gctgggcaaagccacaag

SEQ ID NO: 4069934 - DNA, 20 bp, Homo sapiens
gctgggcacagaggtcagga

SEQ ID NO: 4069935 - DNA, 17 bp, Homo sapiens
gctgggcagccccagag

SEQ ID NO: 4069936 - DNA, 21 bp, Homo sapiens
gctgggcagccccagagagag

SEQ ID NO: 4069937 - DNA, 18 bp, Homo sapiens
gctgggccactggggact

SEQ ID NO: 4069938 - DNA, 14 bp, Homo sapiens
gctgggccatcctt

SEQ ID NO: 4069939 - DNA, 14 bp, Homo sapiens
gctgggcccctggg

SEQ ID NO: 4069940 - DNA, 17 bp, Homo sapiens
gctgggccctctttccc

SEQ ID NO: 4069941 - DNA, 19 bp, Homo sapiens
gctgggccctctttccctg

SEQ ID NO: 4069942 - DNA, 17 bp, Homo sapiens
gctgggcgtgctagagg

SEQ ID NO: 4069943 - DNA, 21 bp, Homo sapiens
gctgggctccccccagtggga

SEQ ID NO: 4069944 - DNA, 13 bp, Homo sapiens
gctgggctcccgt

SEQ ID NO: 4069945 - DNA, 15 bp, Homo sapiens
gctgggctgggccct

SEQ ID NO: 4069946 - DNA, 18 bp, Homo sapiens
gctgggctgggccctctt

SEQ ID NO: 4069947 - DNA, 16 bp, Homo sapiens
gctggggacctggtac

SEQ ID NO: 4069948 - DNA, 15 bp, Homo sapiens
gctggggcagggggt

SEQ ID NO: 4069949 - DNA, 12 bp, Homo sapiens
gctggggccacc

SEQ ID NO: 4069950 - DNA, 18 bp, Homo sapiens
gctggggccagaggctgg

SEQ ID NO: 4069951 - DNA, 14 bp, Homo sapiens
gctggggcggggcc

SEQ ID NO: 4069952 - DNA, 21 bp, Homo sapiens
gctggggctaggggaagggct

SEQ ID NO: 4069953 - DNA, 23 bp, Homo sapiens
gctggggctcacggggcctccaa

SEQ ID NO: 4069954 - DNA, 16 bp, Homo sapiens
gctggggctctctgag

SEQ ID NO: 4069955 - DNA, 17 bp, Homo sapiens
gctggggctctctgaga

SEQ ID NO: 4069956 - DNA, 14 bp, Homo sapiens
gctgggggactggg

SEQ ID NO: 4069957 - DNA, 23 bp, Homo sapiens
gctgggggcaggagggccctacc

SEQ ID NO: 4069958 - DNA, 15 bp, Homo sapiens
gctggggggcacccc

SEQ ID NO: 4069959 - DNA, 19 bp, Homo sapiens
gctggggggttggcagccc

SEQ ID NO: 4069960 - DNA, 21 bp, Homo sapiens
gctggggggttggcagcccac

SEQ ID NO: 4069961 - DNA, 16 bp, Homo sapiens
gctggggtgagagagg

SEQ ID NO: 4069962 - DNA, 22 bp, Homo sapiens
gctgggtaatgtgaaggcccaa

SEQ ID NO: 4069963 - DNA, 16 bp, Homo sapiens
gctgggtcaggcaggg

SEQ ID NO: 4069964 - DNA, 14 bp, Homo sapiens
gctgggtggcctgt

SEQ ID NO: 4069965 - DNA, 20 bp, Homo sapiens
gctgggtgggcccagaactg

SEQ ID NO: 4069966 - DNA, 13 bp, Homo sapiens
gctgggtttgctg

SEQ ID NO: 4069967 - DNA, 18 bp, Homo sapiens
gctgggtttgctgtcttg

SEQ ID NO: 4069968 - DNA, 20 bp, Homo sapiens
gctgggtttgctgtcttggg

SEQ ID NO: 4069969 - DNA, 22 bp, Homo sapiens
gctggtagcataaataaaactg

SEQ ID NO: 4069970 - DNA, 18 bp, Homo sapiens
gctggtatctcagaaagt

SEQ ID NO: 4069971 - DNA, 13 bp, Homo sapiens
gctggtcacagcc

SEQ ID NO: 4069972 - DNA, 17 bp, Homo sapiens
gctggtcacagcctcct

SEQ ID NO: 4069973 - DNA, 23 bp, Homo sapiens
gctggtcactaaccaacaaggtt

SEQ ID NO: 4069974 - DNA, 20 bp, Homo sapiens
gctggtcacttcttctgtcc

SEQ ID NO: 4069975 - DNA, 19 bp, Homo sapiens
gctggtccagggctagtga

SEQ ID NO: 4069976 - DNA, 12 bp, Homo sapiens
gctggtcccctc

SEQ ID NO: 4069977 - DNA, 14 bp, Homo sapiens
gctggtcctcccat

SEQ ID NO: 4069978 - DNA, 22 bp, Homo sapiens
gctggtctcaaacttgtggcct

SEQ ID NO: 4069979 - DNA, 17 bp, Homo sapiens
gctggtgcattacagag

SEQ ID NO: 4069980 - DNA, 22 bp, Homo sapiens
gctggtgcattacagagaggag

SEQ ID NO: 4069981 - DNA, 21 bp, Homo sapiens
gcttatctcttttatatttgt

SEQ ID NO: 4069982 - DNA, 13 bp, Homo sapiens
gcttattgttcca

SEQ ID NO: 4069983 - DNA, 14 bp, Homo sapiens
gcttattgttccaa

SEQ ID NO: 4069984 - DNA, 21 bp, Homo sapiens
gcttattgttccaagacattg

SEQ ID NO: 4069985 - DNA, 16 bp, Homo sapiens
gcttatttattaacag

SEQ ID NO: 4069986 - DNA, 16 bp, Homo sapiens
gcttatttttctgtga

SEQ ID NO: 4069987 - DNA, 19 bp, Homo sapiens
gcttattttttaaaatatt

SEQ ID NO: 4069988 - DNA, 14 bp, Homo sapiens
gcttcaagtgcctt

SEQ ID NO: 4069989 - DNA, 19 bp, Homo sapiens
gcttcaagtgccttttgct

SEQ ID NO: 4069990 - DNA, 22 bp, Homo sapiens
gcttcaagtgccttttgctgcg

SEQ ID NO: 4069991 - DNA, 19 bp, Homo sapiens
gcttcaagttgtaaaaatg

SEQ ID NO: 4069992 - DNA, 17 bp, Homo sapiens
gcttcaccatggcctta

SEQ ID NO: 4069993 - DNA, 22 bp, Homo sapiens
gcttcaccctgaatggttccat

SEQ ID NO: 4069994 - DNA, 16 bp, Homo sapiens
gcttcactgtataaat

SEQ ID NO: 4069995 - DNA, 17 bp, Homo sapiens
gcttcactgtataaata

SEQ ID NO: 4069996 - DNA, 12 bp, Homo sapiens
gcttcacttctg

SEQ ID NO: 4069997 - DNA, 21 bp, Homo sapiens
gcttcacttctgactcttccc

SEQ ID NO: 4069998 - DNA, 20 bp, Homo sapiens
gcttcaggcaccagcatcca

SEQ ID NO: 4069999 - DNA, 17 bp, Homo sapiens
gcttcaggttatcgaaa

SEQ ID NO: 4070000 - DNA, 21 bp, Homo sapiens
gcttcaggttatcgaaataac

SEQ ID NO: 4070001 - DNA, 14 bp, Homo sapiens
gcttcataaatgaa

SEQ ID NO: 4070002 - DNA, 18 bp, Homo sapiens
gcttcataaatgaagcag

SEQ ID NO: 4070003 - DNA, 18 bp, Homo sapiens
gcttcatagtattggagc

SEQ ID NO: 4070004 - DNA, 17 bp, Homo sapiens
gcttcatcattccctct

SEQ ID NO: 4070005 - DNA, 13 bp, Homo sapiens
gcttcatctgtca

SEQ ID NO: 4070006 - DNA, 18 bp, Homo sapiens
gcttcatctgtcaagtgg

SEQ ID NO: 4070007 - DNA, 17 bp, Homo sapiens
gcttcatgcctttgtaa

SEQ ID NO: 4070008 - DNA, 18 bp, Homo sapiens
gcttcatgctcagccctg

SEQ ID NO: 4070009 - DNA, 17 bp, Homo sapiens
gcttcattcaatattga

SEQ ID NO: 4070010 - DNA, 15 bp, Homo sapiens
gcttccaaatattgt

SEQ ID NO: 4070011 - DNA, 15 bp, Homo sapiens
gcttccaatcttgct

SEQ ID NO: 4070012 - DNA, 22 bp, Homo sapiens
gcttccagattgacgacaagtg

SEQ ID NO: 4070013 - DNA, 16 bp, Homo sapiens
gcttccagcttcaggc

SEQ ID NO: 4070014 - DNA, 20 bp, Homo sapiens
gcttccaggtatctccagga

SEQ ID NO: 4070015 - DNA, 15 bp, Homo sapiens
gcttccatgattcta

SEQ ID NO: 4070016 - DNA, 12 bp, Homo sapiens
gcttcccagagg

SEQ ID NO: 4070017 - DNA, 14 bp, Homo sapiens
gcttcccagctctg

SEQ ID NO: 4070018 - DNA, 17 bp, Homo sapiens
gcttcccatgtctttct

SEQ ID NO: 4070019 - DNA, 15 bp, Homo sapiens
gcttcccgctcagcc

SEQ ID NO: 4070020 - DNA, 14 bp, Homo sapiens
gcttccctccctgc

SEQ ID NO: 4070021 - DNA, 20 bp, Homo sapiens
gcttccggtagggaggcagc

SEQ ID NO: 4070022 - DNA, 22 bp, Homo sapiens
gcttcctcacacccctgtccca

SEQ ID NO: 4070023 - DNA, 22 bp, Homo sapiens
gcttcctctagaagccaaggga

SEQ ID NO: 4070024 - DNA, 23 bp, Homo sapiens
gcttcctctagaagccaagggaa

SEQ ID NO: 4070025 - DNA, 11 bp, Homo sapiens
gcttcctgccc

SEQ ID NO: 4070026 - DNA, 13 bp, Homo sapiens
gcttcctgccctt

SEQ ID NO: 4070027 - DNA, 17 bp, Homo sapiens
gcttcctgcccttccct

SEQ ID NO: 4070028 - DNA, 19 bp, Homo sapiens
gcttcggagggcccctgcg

SEQ ID NO: 4070029 - DNA, 18 bp, Homo sapiens
gcttctactcctgcctca

SEQ ID NO: 4070030 - DNA, 20 bp, Homo sapiens
gcttctatcccaggaggtgg

SEQ ID NO: 4070031 - DNA, 15 bp, Homo sapiens
gcttctccgccagcc

SEQ ID NO: 4070032 - DNA, 16 bp, Homo sapiens
gcttctccgccagcct

SEQ ID NO: 4070033 - DNA, 23 bp, Homo sapiens
gcttctccgccagcctcctctgg

SEQ ID NO: 4070034 - DNA, 17 bp, Homo sapiens
gcttctccttctccttc

SEQ ID NO: 4070035 - DNA, 21 bp, Homo sapiens
gcttctctagctctctaggcc

SEQ ID NO: 4070036 - DNA, 22 bp, Homo sapiens
gcttctctagctctctaggcct

SEQ ID NO: 4070037 - DNA, 14 bp, Homo sapiens
gcttctctctccag

SEQ ID NO: 4070038 - DNA, 15 bp, Homo sapiens
gcttctctctccagg

SEQ ID NO: 4070039 - DNA, 16 bp, Homo sapiens
gcttctctctccaggg

SEQ ID NO: 4070040 - DNA, 17 bp, Homo sapiens
gcttctctctccagggt

SEQ ID NO: 4070041 - DNA, 19 bp, Homo sapiens
gcttctctgtgaacgattt

SEQ ID NO: 4070042 - DNA, 18 bp, Homo sapiens
gcttctgaactcaagctg

SEQ ID NO: 4070043 - DNA, 13 bp, Homo sapiens
gcttctgcctgca

SEQ ID NO: 4070044 - DNA, 14 bp, Homo sapiens
gcttctgcttttct

SEQ ID NO: 4070045 - DNA, 16 bp, Homo sapiens
gcttctgtatttcctt

SEQ ID NO: 4070046 - DNA, 16 bp, Homo sapiens
gcttcttaattaattt

SEQ ID NO: 4070047 - DNA, 20 bp, Homo sapiens
gcttcttactattaagcagt

SEQ ID NO: 4070048 - DNA, 18 bp, Homo sapiens
gcttcttcacaggcactc

SEQ ID NO: 4070049 - DNA, 23 bp, Homo sapiens
gcttcttcagagtgaagaatctt

SEQ ID NO: 4070050 - DNA, 21 bp, Homo sapiens
gcttcttcctatttgccatgg

SEQ ID NO: 4070051 - DNA, 15 bp, Homo sapiens
gcttcttctgaaaga

SEQ ID NO: 4070052 - DNA, 16 bp, Homo sapiens
gcttcttctgaggcct

SEQ ID NO: 4070053 - DNA, 15 bp, Homo sapiens
gcttgaaattactgt

SEQ ID NO: 4070054 - DNA, 13 bp, Homo sapiens
gcttgaacccagg

SEQ ID NO: 4070055 - DNA, 16 bp, Homo sapiens
gcttgaagccaaagaa

SEQ ID NO: 4070056 - DNA, 15 bp, Homo sapiens
gcttgaaggccctgc

SEQ ID NO: 4070057 - DNA, 18 bp, Homo sapiens
gcttgaaggccctgctga

SEQ ID NO: 4070058 - DNA, 13 bp, Homo sapiens
gcttgacatgtgc

SEQ ID NO: 4070059 - DNA, 22 bp, Homo sapiens
gcttgaccgtactctcacatgt

SEQ ID NO: 4070060 - DNA, 12 bp, Homo sapiens
gcttgagcccag

SEQ ID NO: 4070061 - DNA, 14 bp, Homo sapiens
gcttgagcccagga

SEQ ID NO: 4070062 - DNA, 12 bp, Homo sapiens
gcttgagccggg

SEQ ID NO: 4070063 - DNA, 18 bp, Homo sapiens
gcttgagccgggcccctg

SEQ ID NO: 4070064 - DNA, 22 bp, Homo sapiens
gcttgagccgggcccctgggct

SEQ ID NO: 4070065 - DNA, 14 bp, Homo sapiens
gcttgatccagaag

SEQ ID NO: 4070066 - DNA, 21 bp, Homo sapiens
gcttgatccagaagagcccat

SEQ ID NO: 4070067 - DNA, 14 bp, Homo sapiens
gcttgatgaagcaa

SEQ ID NO: 4070068 - DNA, 20 bp, Homo sapiens
gcttgatgaagcaaggaaga

SEQ ID NO: 4070069 - DNA, 18 bp, Homo sapiens
gcttgatggtgacagctg

SEQ ID NO: 4070070 - DNA, 18 bp, Homo sapiens
gcttgattttaatacatt

SEQ ID NO: 4070071 - DNA, 16 bp, Homo sapiens
gcttgcgtatgtctgt

SEQ ID NO: 4070072 - DNA, 12 bp, Homo sapiens
gcttgcttttct

SEQ ID NO: 4070073 - DNA, 16 bp, Homo sapiens
gcttggagggatggag

SEQ ID NO: 4070074 - DNA, 19 bp, Homo sapiens
gcttggagtagacaaaagg

SEQ ID NO: 4070075 - DNA, 13 bp, Homo sapiens
gcttggcctgctg

SEQ ID NO: 4070076 - DNA, 14 bp, Homo sapiens
gcttggcctgctgt

SEQ ID NO: 4070077 - DNA, 23 bp, Homo sapiens
gcttgggaaaaaaacttggcact

SEQ ID NO: 4070078 - DNA, 17 bp, Homo sapiens
gcttgggcagtgcccca

SEQ ID NO: 4070079 - DNA, 13 bp, Homo sapiens
gcttggtctgttt

SEQ ID NO: 4070080 - DNA, 20 bp, Homo sapiens
gcttggtgctggtttatttg

SEQ ID NO: 4070081 - DNA, 18 bp, Homo sapiens
gcttgtaatcaagccttt

SEQ ID NO: 4070082 - DNA, 18 bp, Homo sapiens
gcttgtagaactcactct

SEQ ID NO: 4070083 - DNA, 22 bp, Homo sapiens
gcttgtagaactcactctgggc

SEQ ID NO: 4070084 - DNA, 13 bp, Homo sapiens
ggaacataaaaag

SEQ ID NO: 4070085 - DNA, 18 bp, Homo sapiens
ggaacataaaaaggacat

SEQ ID NO: 4070086 - DNA, 20 bp, Homo sapiens
ggaacatcctttgcagggca

SEQ ID NO: 4070087 - DNA, 23 bp, Homo sapiens
ggaacatcctttgcagggcagcc

SEQ ID NO: 4070088 - DNA, 13 bp, Homo sapiens
ggaaccacagggc

SEQ ID NO: 4070089 - DNA, 20 bp, Homo sapiens
ggaaccacagggccagaggg

SEQ ID NO: 4070090 - DNA, 23 bp, Homo sapiens
ggaaccacagggccagagggagc

SEQ ID NO: 4070091 - DNA, 12 bp, Homo sapiens
ggaaccagcccc

SEQ ID NO: 4070092 - DNA, 17 bp, Homo sapiens
ggaaccagggagaccga

SEQ ID NO: 4070093 - DNA, 18 bp, Homo sapiens
ggaaccatgaagacagga

SEQ ID NO: 4070094 - DNA, 13 bp, Homo sapiens
ggaacccagactc

SEQ ID NO: 4070095 - DNA, 13 bp, Homo sapiens
ggaacccccacca

SEQ ID NO: 4070096 - DNA, 17 bp, Homo sapiens
ggaaccgtgtccagcac

SEQ ID NO: 4070097 - DNA, 14 bp, Homo sapiens
ggaacctcagcctg

SEQ ID NO: 4070098 - DNA, 22 bp, Homo sapiens
ggaacctcagcctggccagaca

SEQ ID NO: 4070099 - DNA, 23 bp, Homo sapiens
ggaacctcagcctggccagacac

SEQ ID NO: 4070100 - DNA, 13 bp, Homo sapiens
ggaaccttgctgt

SEQ ID NO: 4070101 - DNA, 15 bp, Homo sapiens
ggaaccttgctgtcc

SEQ ID NO: 4070102 - DNA, 14 bp, Homo sapiens
ggaacgatgtgtct

SEQ ID NO: 4070103 - DNA, 21 bp, Homo sapiens
ggaactagagggatacactga

SEQ ID NO: 4070104 - DNA, 22 bp, Homo sapiens
ggaactagagggatacactgaa

SEQ ID NO: 4070105 - DNA, 16 bp, Homo sapiens
ggaactcagatccagg

SEQ ID NO: 4070106 - DNA, 17 bp, Homo sapiens
ggaactcagatccaggg

SEQ ID NO: 4070107 - DNA, 20 bp, Homo sapiens
ggaactcagatccagggaca

SEQ ID NO: 4070108 - DNA, 13 bp, Homo sapiens
ggaactcccagca

SEQ ID NO: 4070109 - DNA, 19 bp, Homo sapiens
ggaactcgcacctgtgctg

SEQ ID NO: 4070110 - DNA, 15 bp, Homo sapiens
ggaactgtccagaga

SEQ ID NO: 4070111 - DNA, 16 bp, Homo sapiens
ggaactgtccagagag

SEQ ID NO: 4070112 - DNA, 14 bp, Homo sapiens
ggaagaacatagaa

SEQ ID NO: 4070113 - DNA, 15 bp, Homo sapiens
ggaagacatttcttt

SEQ ID NO: 4070114 - DNA, 19 bp, Homo sapiens
ggaagacatttcttttctt

SEQ ID NO: 4070115 - DNA, 16 bp, Homo sapiens
ggaagacgcctgagct

SEQ ID NO: 4070116 - DNA, 22 bp, Homo sapiens
ggaagagaagagggcccagccc

SEQ ID NO: 4070117 - DNA, 23 bp, Homo sapiens
ggaagagcaggactccaggccca

SEQ ID NO: 4070118 - DNA, 15 bp, Homo sapiens
ggaagagcccagtct

SEQ ID NO: 4070119 - DNA, 14 bp, Homo sapiens
ggaagatatacatg

SEQ ID NO: 4070120 - DNA, 18 bp, Homo sapiens
ggaagatgaggttctgag

SEQ ID NO: 4070121 - DNA, 13 bp, Homo sapiens
ggaagcaccccat

SEQ ID NO: 4070122 - DNA, 15 bp, Homo sapiens
ggaagcaccccatgc

SEQ ID NO: 4070123 - DNA, 15 bp, Homo sapiens
ggaagcagccagctc

SEQ ID NO: 4070124 - DNA, 17 bp, Homo sapiens
ggaagcatgtagactgt

SEQ ID NO: 4070125 - DNA, 20 bp, Homo sapiens
ggaagcatgtggatgacaca

SEQ ID NO: 4070126 - DNA, 23 bp, Homo sapiens
ggaagccagagccccaagcagga

SEQ ID NO: 4070127 - DNA, 15 bp, Homo sapiens
ggaagccctggagac

SEQ ID NO: 4070128 - DNA, 20 bp, Homo sapiens
ggaagccggagggtgtttat

SEQ ID NO: 4070129 - DNA, 14 bp, Homo sapiens
ggaagcctgcagtc

SEQ ID NO: 4070130 - DNA, 14 bp, Homo sapiens
ggaagctccactgt

SEQ ID NO: 4070131 - DNA, 23 bp, Homo sapiens
ggaagctccactgtcaccctcca

SEQ ID NO: 4070132 - DNA, 21 bp, Homo sapiens
ggaagctcttggagctgtgag

SEQ ID NO: 4070133 - DNA, 15 bp, Homo sapiens
ggaagctgccagccc

SEQ ID NO: 4070134 - DNA, 21 bp, Homo sapiens
ggaagctgccagcccagaaca

SEQ ID NO: 4070135 - DNA, 17 bp, Homo sapiens
ggaagctggcagaacgg

SEQ ID NO: 4070136 - DNA, 19 bp, Homo sapiens
ggaaggaaagaaagaagga

SEQ ID NO: 4070137 - DNA, 17 bp, Homo sapiens
ggaaggacaggaagctg

SEQ ID NO: 4070138 - DNA, 13 bp, Homo sapiens
ggaaggcagacag

SEQ ID NO: 4070139 - DNA, 14 bp, Homo sapiens
ggaaggcagacagc

SEQ ID NO: 4070140 - DNA, 22 bp, Homo sapiens
ggaaggcagacagcaggcagcg

SEQ ID NO: 4070141 - DNA, 14 bp, Homo sapiens
ggaaggcccagcac

SEQ ID NO: 4070142 - DNA, 13 bp, Homo sapiens
ggaaggcctccct

SEQ ID NO: 4070143 - DNA, 15 bp, Homo sapiens
ggaaggcctccctct

SEQ ID NO: 4070144 - DNA, 20 bp, Homo sapiens
ggaaggcctgacttctgctg

SEQ ID NO: 4070145 - DNA, 23 bp, Homo sapiens
ggaagggctttggttccttctct

SEQ ID NO: 4070146 - DNA, 18 bp, Homo sapiens
ggaaggggccttgctgag

SEQ ID NO: 4070147 - DNA, 21 bp, Homo sapiens
ggaagggggggctacattata

SEQ ID NO: 4070148 - DNA, 17 bp, Homo sapiens
ggaaggggggtcagaag

SEQ ID NO: 4070149 - DNA, 19 bp, Homo sapiens
ggaaggggttcctcaaatt

SEQ ID NO: 4070150 - DNA, 22 bp, Homo sapiens
ggaaggggttcctcaaattttt

SEQ ID NO: 4070151 - DNA, 18 bp, Homo sapiens
ggaagggtttgtggctgg

SEQ ID NO: 4070152 - DNA, 21 bp, Homo sapiens
ggaaggtagcccagcactgtg

SEQ ID NO: 4070153 - DNA, 17 bp, Homo sapiens
ggaaggtggccacagca

SEQ ID NO: 4070154 - DNA, 16 bp, Homo sapiens
ggaagtagtccttggc

SEQ ID NO: 4070155 - DNA, 23 bp, Homo sapiens
ggaagtgaagagggagaagggat

SEQ ID NO: 4070156 - DNA, 18 bp, Homo sapiens
ggaagtggggtgttcttc

SEQ ID NO: 4070157 - DNA, 17 bp, Homo sapiens
ggaagtgtaacagctga

SEQ ID NO: 4070158 - DNA, 21 bp, Homo sapiens
ggaagtgtaacagctgaggtc

SEQ ID NO: 4070159 - DNA, 18 bp, Homo sapiens
ggaataaagttgcagatg

SEQ ID NO: 4070160 - DNA, 20 bp, Homo sapiens
ggaataagaagcaaataaat

SEQ ID NO: 4070161 - DNA, 13 bp, Homo sapiens
ggaataataccta

SEQ ID NO: 4070162 - DNA, 12 bp, Homo sapiens
ggaatacagtgt

SEQ ID NO: 4070163 - DNA, 12 bp, Homo sapiens
ggaatacttttt

SEQ ID NO: 4070164 - DNA, 13 bp, Homo sapiens
ggaatagggagac

SEQ ID NO: 4070165 - DNA, 15 bp, Homo sapiens
ggaatagggagacag

SEQ ID NO: 4070166 - DNA, 16 bp, Homo sapiens
ggaatagggagacagg

SEQ ID NO: 4070167 - DNA, 22 bp, Homo sapiens
ggaatatatcagtacctctcaa

SEQ ID NO: 4070168 - DNA, 14 bp, Homo sapiens
ggaatattgtgatt

SEQ ID NO: 4070169 - DNA, 14 bp, Homo sapiens
ggaatcaaaaattg

SEQ ID NO: 4070170 - DNA, 16 bp, Homo sapiens
ggaatcaagagctgcc

SEQ ID NO: 4070171 - DNA, 17 bp, Homo sapiens
ggaatcaagagctgccc

SEQ ID NO: 4070172 - DNA, 15 bp, Homo sapiens
ggaatcatgtcaggc

SEQ ID NO: 4070173 - DNA, 18 bp, Homo sapiens
ggaatcatgtcaggcctg

SEQ ID NO: 4070174 - DNA, 21 bp, Homo sapiens
ggaatcatgtcaggcctgtgt

SEQ ID NO: 4070175 - DNA, 17 bp, Homo sapiens
ggaatcattgtccagag

SEQ ID NO: 4070176 - DNA, 20 bp, Homo sapiens
ggaatccagctccctagact

SEQ ID NO: 4070177 - DNA, 22 bp, Homo sapiens
ggaatcctatatagaatgctgc

SEQ ID NO: 4070178 - DNA, 23 bp, Homo sapiens
ggaatcctatatagaatgctgca

SEQ ID NO: 4070179 - DNA, 19 bp, Homo sapiens
ggaatcctcctccagggtg

SEQ ID NO: 4070180 - DNA, 13 bp, Homo sapiens
ggaatcttcacta

SEQ ID NO: 4070181 - DNA, 21 bp, Homo sapiens
ggaatgagcccagagaacagc

SEQ ID NO: 4070182 - DNA, 23 bp, Homo sapiens
ggaatgagccgcggggaagctgg

SEQ ID NO: 4070183 - DNA, 14 bp, Homo sapiens
ggaatgctggactg

SEQ ID NO: 4070184 - DNA, 18 bp, Homo sapiens
ggaatgtttttccctccc

SEQ ID NO: 4070185 - DNA, 13 bp, Homo sapiens
ggaattcatgcaa

SEQ ID NO: 4070186 - DNA, 23 bp, Homo sapiens
ggaattcattttcatcactggga

SEQ ID NO: 4070187 - DNA, 20 bp, Homo sapiens
ggactgtctttcagatacat

SEQ ID NO: 4070188 - DNA, 21 bp, Homo sapiens
ggactgttccaaagccagtga

SEQ ID NO: 4070189 - DNA, 20 bp, Homo sapiens
ggacttaacggctccaggat

SEQ ID NO: 4070190 - DNA, 11 bp, Homo sapiens
ggacttcctga

SEQ ID NO: 4070191 - DNA, 11 bp, Homo sapiens
ggacttcctgt

SEQ ID NO: 4070192 - DNA, 21 bp, Homo sapiens
ggacttcctgtccagctccaa

SEQ ID NO: 4070193 - DNA, 22 bp, Homo sapiens
ggacttctgtgggcccctcaac

SEQ ID NO: 4070194 - DNA, 16 bp, Homo sapiens
ggacttggacaggagt

SEQ ID NO: 4070195 - DNA, 15 bp, Homo sapiens
ggacttggcgcgccc

SEQ ID NO: 4070196 - DNA, 15 bp, Homo sapiens
ggacttgtatatttg

SEQ ID NO: 4070197 - DNA, 20 bp, Homo sapiens
ggacttgtatatttgtacaa

SEQ ID NO: 4070198 - DNA, 22 bp, Homo sapiens
ggactttgctgatttcccctct

SEQ ID NO: 4070199 - DNA, 22 bp, Homo sapiens
ggacttttcgttaacattgacc

SEQ ID NO: 4070200 - DNA, 13 bp, Homo sapiens
ggagaagagccct

SEQ ID NO: 4070201 - DNA, 12 bp, Homo sapiens
ggagaagccagg

SEQ ID NO: 4070202 - DNA, 13 bp, Homo sapiens
ggagaagccagga

SEQ ID NO: 4070203 - DNA, 14 bp, Homo sapiens
ggagaaggatctag

SEQ ID NO: 4070204 - DNA, 14 bp, Homo sapiens
ggagaagggatgga

SEQ ID NO: 4070205 - DNA, 21 bp, Homo sapiens
ggagaagggatggaggtcaca

SEQ ID NO: 4070206 - DNA, 21 bp, Homo sapiens
ggagaagttcttgattcagcc

SEQ ID NO: 4070207 - DNA, 19 bp, Homo sapiens
ggagaatactttgcttcat

SEQ ID NO: 4070208 - DNA, 14 bp, Homo sapiens
ggagaatcatgtga

SEQ ID NO: 4070209 - DNA, 16 bp, Homo sapiens
ggagacagaggaaagg

SEQ ID NO: 4070210 - DNA, 17 bp, Homo sapiens
ggagacaggagcctagc

SEQ ID NO: 4070211 - DNA, 19 bp, Homo sapiens
ggagacagggtaggaaagg

SEQ ID NO: 4070212 - DNA, 18 bp, Homo sapiens
ggagacagtgatctccat

SEQ ID NO: 4070213 - DNA, 14 bp, Homo sapiens
ggagacatgtgaca

SEQ ID NO: 4070214 - DNA, 13 bp, Homo sapiens
ggagaccagctca

SEQ ID NO: 4070215 - DNA, 22 bp, Homo sapiens
ggagacccccccccaactccag

SEQ ID NO: 4070216 - DNA, 21 bp, Homo sapiens
ggagaccctgcaaacagaaca

SEQ ID NO: 4070217 - DNA, 23 bp, Homo sapiens
ggagaccctgcaaacagaacagg

SEQ ID NO: 4070218 - DNA, 20 bp, Homo sapiens
ggagaccggggtatcctggg

SEQ ID NO: 4070219 - DNA, 23 bp, Homo sapiens
ggagacgtggaacctctgtctca

SEQ ID NO: 4070220 - DNA, 14 bp, Homo sapiens
ggagactagattgc

SEQ ID NO: 4070221 - DNA, 12 bp, Homo sapiens
ggagactcctgc

SEQ ID NO: 4070222 - DNA, 16 bp, Homo sapiens
ggagactgtctcaaga

SEQ ID NO: 4070223 - DNA, 13 bp, Homo sapiens
ggagagacaggca

SEQ ID NO: 4070224 - DNA, 16 bp, Homo sapiens
ggagagacaggcagcc

SEQ ID NO: 4070225 - DNA, 21 bp, Homo sapiens
ggagagacaggcagcccagca

SEQ ID NO: 4070226 - DNA, 11 bp, Homo sapiens
ggagagacctc

SEQ ID NO: 4070227 - DNA, 13 bp, Homo sapiens
ggagagacctcat

SEQ ID NO: 4070228 - DNA, 16 bp, Homo sapiens
ggagagactgagcagc

SEQ ID NO: 4070229 - DNA, 19 bp, Homo sapiens
ggagagactgagcagccgc

SEQ ID NO: 4070230 - DNA, 14 bp, Homo sapiens
ggagagccaacctc

SEQ ID NO: 4070231 - DNA, 17 bp, Homo sapiens
ggagagccaacctcggc

SEQ ID NO: 4070232 - DNA, 11 bp, Homo sapiens
ggagagcctgc

SEQ ID NO: 4070233 - DNA, 13 bp, Homo sapiens
ggagagcctgctg

SEQ ID NO: 4070234 - DNA, 16 bp, Homo sapiens
ggagagcctgctggca

SEQ ID NO: 4070235 - DNA, 15 bp, Homo sapiens
ggagagctggtgccc

SEQ ID NO: 4070236 - DNA, 16 bp, Homo sapiens
ggagagctttgtgctt

SEQ ID NO: 4070237 - DNA, 20 bp, Homo sapiens
ggagaggatgagagcccaga

SEQ ID NO: 4070238 - DNA, 21 bp, Homo sapiens
ggagaggatgagagcccagag

SEQ ID NO: 4070239 - DNA, 14 bp, Homo sapiens
ggagaggcggcctc

SEQ ID NO: 4070240 - DNA, 17 bp, Homo sapiens
ggagaggcggcctcgtg

SEQ ID NO: 4070241 - DNA, 17 bp, Homo sapiens
ggagagggaggtcactg

SEQ ID NO: 4070242 - DNA, 21 bp, Homo sapiens
ggagagggatttccctgcaga

SEQ ID NO: 4070243 - DNA, 18 bp, Homo sapiens
ggagagggcccaggtccc

SEQ ID NO: 4070244 - DNA, 18 bp, Homo sapiens
ggagaggggaagggccag

SEQ ID NO: 4070245 - DNA, 22 bp, Homo sapiens
ggagaggggaagggccagtctg

SEQ ID NO: 4070246 - DNA, 17 bp, Homo sapiens
ggagagtacagtgagcc

SEQ ID NO: 4070247 - DNA, 18 bp, Homo sapiens
ggagagtttcctgaaaca

SEQ ID NO: 4070248 - DNA, 18 bp, Homo sapiens
ggagatactggtggaagt

SEQ ID NO: 4070249 - DNA, 17 bp, Homo sapiens
ggagatgaccagggatg

SEQ ID NO: 4070250 - DNA, 18 bp, Homo sapiens
ggagatgaccagggatgc

SEQ ID NO: 4070251 - DNA, 18 bp, Homo sapiens
ggagatgcttctctcctt

SEQ ID NO: 4070252 - DNA, 21 bp, Homo sapiens
ggagatgcttctctccttgcc

SEQ ID NO: 4070253 - DNA, 18 bp, Homo sapiens
ggagatgggtccaggggt

SEQ ID NO: 4070254 - DNA, 14 bp, Homo sapiens
ggagcaaaaggcag

SEQ ID NO: 4070255 - DNA, 18 bp, Homo sapiens
ggagcaaaaggcagctca

SEQ ID NO: 4070256 - DNA, 22 bp, Homo sapiens
ggagcaaaaggcagctcacccc

SEQ ID NO: 4070257 - DNA, 15 bp, Homo sapiens
ggagcaatgggactg

SEQ ID NO: 4070258 - DNA, 17 bp, Homo sapiens
ggagcaatgggactgga

SEQ ID NO: 4070259 - DNA, 14 bp, Homo sapiens
ggagcacaggcagc

SEQ ID NO: 4070260 - DNA, 16 bp, Homo sapiens
ggagcacatgttactg

SEQ ID NO: 4070261 - DNA, 14 bp, Homo sapiens
ggagcagaggaggg

SEQ ID NO: 4070262 - DNA, 16 bp, Homo sapiens
ggagcagatggacagc

SEQ ID NO: 4070263 - DNA, 18 bp, Homo sapiens
ggagcaggaggccaataa

SEQ ID NO: 4070264 - DNA, 17 bp, Homo sapiens
ggagcaggccggaacca

SEQ ID NO: 4070265 - DNA, 21 bp, Homo sapiens
ggagcaggccggaaccacagg

SEQ ID NO: 4070266 - DNA, 19 bp, Homo sapiens
ggagcagggaaggcctgac

SEQ ID NO: 4070267 - DNA, 12 bp, Homo sapiens
ggagcagtgtct

SEQ ID NO: 4070268 - DNA, 21 bp, Homo sapiens
ggagcatctcttgaggccagg

SEQ ID NO: 4070269 - DNA, 15 bp, Homo sapiens
ggagccacttctccc

SEQ ID NO: 4070270 - DNA, 13 bp, Homo sapiens
ggagccagctgct

SEQ ID NO: 4070271 - DNA, 13 bp, Homo sapiens
ggagccaggaggg

SEQ ID NO: 4070272 - DNA, 22 bp, Homo sapiens
ggagcccactgtcctgggcctg

SEQ ID NO: 4070273 - DNA, 12 bp, Homo sapiens
ggagcccagcct

SEQ ID NO: 4070274 - DNA, 17 bp, Homo sapiens
ggagcccagcctgggag

SEQ ID NO: 4070275 - DNA, 19 bp, Homo sapiens
ggagcccagcctgggagcc

SEQ ID NO: 4070276 - DNA, 18 bp, Homo sapiens
ggagcccaggagtcccac

SEQ ID NO: 4070277 - DNA, 15 bp, Homo sapiens
ggagcccagggcatc

SEQ ID NO: 4070278 - DNA, 12 bp, Homo sapiens
ggagcccagtga

SEQ ID NO: 4070279 - DNA, 19 bp, Homo sapiens
ggagcccagtgaagcctct

SEQ ID NO: 4070280 - DNA, 20 bp, Homo sapiens
ggagcccagtgaagcctctg

SEQ ID NO: 4070281 - DNA, 21 bp, Homo sapiens
ggagcccataggccaccccct

SEQ ID NO: 4070282 - DNA, 17 bp, Homo sapiens
ggagccccagctaccct

SEQ ID NO: 4070283 - DNA, 20 bp, Homo sapiens
ggagccccaggcctctgtgt

SEQ ID NO: 4070284 - DNA, 22 bp, Homo sapiens
ggagccccaggcctctgtgtcc

SEQ ID NO: 4070285 - DNA, 23 bp, Homo sapiens
ggagccccaggcctctgtgtcct

SEQ ID NO: 4070286 - DNA, 14 bp, Homo sapiens
ggagccccagggtc

SEQ ID NO: 4070287 - DNA, 13 bp, Homo sapiens
ggagcccccacca

SEQ ID NO: 4070288 - DNA, 14 bp, Homo sapiens
ggagcccccagata

SEQ ID NO: 4070289 - DNA, 11 bp, Homo sapiens
ggagccccctc

SEQ ID NO: 4070290 - DNA, 13 bp, Homo sapiens
ggagtcagtgtct

SEQ ID NO: 4070291 - DNA, 20 bp, Homo sapiens
ggagtctctgccacccactc

SEQ ID NO: 4070292 - DNA, 20 bp, Homo sapiens
ggagtctgaggcctgagtga

SEQ ID NO: 4070293 - DNA, 18 bp, Homo sapiens
ggagtctgtcctgtgacg

SEQ ID NO: 4070294 - DNA, 21 bp, Homo sapiens
ggagtgagtcacctgctccag

SEQ ID NO: 4070295 - DNA, 19 bp, Homo sapiens
ggagtgatgatttggggga

SEQ ID NO: 4070296 - DNA, 15 bp, Homo sapiens
ggagtgcagccttct

SEQ ID NO: 4070297 - DNA, 17 bp, Homo sapiens
ggagtgcagccttctcc

SEQ ID NO: 4070298 - DNA, 18 bp, Homo sapiens
ggagtgcagccttctcca

SEQ ID NO: 4070299 - DNA, 22 bp, Homo sapiens
ggagtgctggctcacagtacag

SEQ ID NO: 4070300 - DNA, 15 bp, Homo sapiens
ggagtgggcacctca

SEQ ID NO: 4070301 - DNA, 17 bp, Homo sapiens
ggagtgggtctggagga

SEQ ID NO: 4070302 - DNA, 22 bp, Homo sapiens
ggagtgtggctgaggaggcctc

SEQ ID NO: 4070303 - DNA, 19 bp, Homo sapiens
ggagtgtttctaataaact

SEQ ID NO: 4070304 - DNA, 15 bp, Homo sapiens
ggagttccatgaaga

SEQ ID NO: 4070305 - DNA, 19 bp, Homo sapiens
ggagttccatgaagaccac

SEQ ID NO: 4070306 - DNA, 15 bp, Homo sapiens
ggagttcctaacagg

SEQ ID NO: 4070307 - DNA, 12 bp, Homo sapiens
ggagttccttat

SEQ ID NO: 4070308 - DNA, 22 bp, Homo sapiens
ggagttccttatccctctcttc

SEQ ID NO: 4070309 - DNA, 15 bp, Homo sapiens
ggagttcgaggctgc

SEQ ID NO: 4070310 - DNA, 17 bp, Homo sapiens
ggagttgatctggaacc

SEQ ID NO: 4070311 - DNA, 15 bp, Homo sapiens
ggataaaatgaggtt

SEQ ID NO: 4070312 - DNA, 23 bp, Homo sapiens
ggataagtttctattctgtcagt

SEQ ID NO: 4070313 - DNA, 16 bp, Homo sapiens
ggataatgaaataatc

SEQ ID NO: 4070314 - DNA, 18 bp, Homo sapiens
ggatactctgtcagatgg

SEQ ID NO: 4070315 - DNA, 15 bp, Homo sapiens
ggatagtgttctgct

SEQ ID NO: 4070316 - DNA, 19 bp, Homo sapiens
ggatatattattgtaagtt

SEQ ID NO: 4070317 - DNA, 21 bp, Homo sapiens
ggatatctttacaagcaggca

SEQ ID NO: 4070318 - DNA, 17 bp, Homo sapiens
ggatatggctgcccagg

SEQ ID NO: 4070319 - DNA, 20 bp, Homo sapiens
ggatatggctgcccaggaga

SEQ ID NO: 4070320 - DNA, 12 bp, Homo sapiens
ggatatttaagg

SEQ ID NO: 4070321 - DNA, 14 bp, Homo sapiens
ggatcacaagatgg

SEQ ID NO: 4070322 - DNA, 19 bp, Homo sapiens
ggatcacgacgctgcagag

SEQ ID NO: 4070323 - DNA, 17 bp, Homo sapiens
ggatcagaacagcagag

SEQ ID NO: 4070324 - DNA, 21 bp, Homo sapiens
ggatcagttaactattgcatt

SEQ ID NO: 4070325 - DNA, 21 bp, Homo sapiens
ggatcatggtgtaataagaca

SEQ ID NO: 4070326 - DNA, 21 bp, Homo sapiens
ggatccaattgatgtatatgt

SEQ ID NO: 4070327 - DNA, 22 bp, Homo sapiens
ggatcccctctgtctacaaata

SEQ ID NO: 4070328 - DNA, 16 bp, Homo sapiens
ggatcggactctgccc

SEQ ID NO: 4070329 - DNA, 17 bp, Homo sapiens
ggatcggactctgcccc

SEQ ID NO: 4070330 - DNA, 18 bp, Homo sapiens
ggatctaccagcataaat

SEQ ID NO: 4070331 - DNA, 21 bp, Homo sapiens
ggatctatttcatgtttttga

SEQ ID NO: 4070332 - DNA, 14 bp, Homo sapiens
ggatctccaaggac

SEQ ID NO: 4070333 - DNA, 21 bp, Homo sapiens
ggatctccaaggaccaggtta

SEQ ID NO: 4070334 - DNA, 22 bp, Homo sapiens
ggatctctcaggagcacaggca

SEQ ID NO: 4070335 - DNA, 14 bp, Homo sapiens
ggatcttgaatgtg

SEQ ID NO: 4070336 - DNA, 18 bp, Homo sapiens
ggatcttgccacatttct

SEQ ID NO: 4070337 - DNA, 18 bp, Homo sapiens
ggatgaatgaggtcccag

SEQ ID NO: 4070338 - DNA, 22 bp, Homo sapiens
ggatgaatgaggtcccaggcag

SEQ ID NO: 4070339 - DNA, 19 bp, Homo sapiens
ggatgacaccctggcctga

SEQ ID NO: 4070340 - DNA, 14 bp, Homo sapiens
ggatgaccagaaca

SEQ ID NO: 4070341 - DNA, 17 bp, Homo sapiens
ggatgattggattattc

SEQ ID NO: 4070342 - DNA, 19 bp, Homo sapiens
ggatgccactcctccctcc

SEQ ID NO: 4070343 - DNA, 13 bp, Homo sapiens
ggatgccagctgt

SEQ ID NO: 4070344 - DNA, 16 bp, Homo sapiens
ggatgctaacatctaa

SEQ ID NO: 4070345 - DNA, 15 bp, Homo sapiens
ggatgctgctccgcc

SEQ ID NO: 4070346 - DNA, 14 bp, Homo sapiens
ggatgctgggctgg

SEQ ID NO: 4070347 - DNA, 19 bp, Homo sapiens
ggatggaaaaggaagacta

SEQ ID NO: 4070348 - DNA, 20 bp, Homo sapiens
ggatggacactaatgcagcc

SEQ ID NO: 4070349 - DNA, 17 bp, Homo sapiens
ggatggcctttccttcc

SEQ ID NO: 4070350 - DNA, 17 bp, Homo sapiens
ggatgggccagggttta

SEQ ID NO: 4070351 - DNA, 15 bp, Homo sapiens
ggatgggggaactca

SEQ ID NO: 4070352 - DNA, 22 bp, Homo sapiens
ggatgggggaactcagatccag

SEQ ID NO: 4070353 - DNA, 23 bp, Homo sapiens
ggatgggggaactcagatccagg

SEQ ID NO: 4070354 - DNA, 17 bp, Homo sapiens
ggatgggggatgggcca

SEQ ID NO: 4070355 - DNA, 21 bp, Homo sapiens
ggatgggggatgggccagggt

SEQ ID NO: 4070356 - DNA, 22 bp, Homo sapiens
ggatggtggactacaaaataca

SEQ ID NO: 4070357 - DNA, 18 bp, Homo sapiens
ggatgtagagagaacagg

SEQ ID NO: 4070358 - DNA, 20 bp, Homo sapiens
ggatgtagagagaacaggtg

SEQ ID NO: 4070359 - DNA, 15 bp, Homo sapiens
ggatgtcacagggcc

SEQ ID NO: 4070360 - DNA, 22 bp, Homo sapiens
ggatgtccctgggccagggtct

SEQ ID NO: 4070361 - DNA, 23 bp, Homo sapiens
ggatgtccctgggccagggtctg

SEQ ID NO: 4070362 - DNA, 18 bp, Homo sapiens
ggatgtgattgtggaatg

SEQ ID NO: 4070363 - DNA, 18 bp, Homo sapiens
ggattaagaaaccttgct

SEQ ID NO: 4070364 - DNA, 15 bp, Homo sapiens
ggattaatatgaaaa

SEQ ID NO: 4070365 - DNA, 21 bp, Homo sapiens
ggattattcatttaaaatgat

SEQ ID NO: 4070366 - DNA, 13 bp, Homo sapiens
ggattcaggctgc

SEQ ID NO: 4070367 - DNA, 14 bp, Homo sapiens
ggattcaggctgct

SEQ ID NO: 4070368 - DNA, 18 bp, Homo sapiens
ggattcaggggctggggg

SEQ ID NO: 4070369 - DNA, 22 bp, Homo sapiens
ggattcattgtctctcacagat

SEQ ID NO: 4070370 - DNA, 23 bp, Homo sapiens
ggattcccaccaaggtcttcagc

SEQ ID NO: 4070371 - DNA, 16 bp, Homo sapiens
ggattctcaccagctg

SEQ ID NO: 4070372 - DNA, 12 bp, Homo sapiens
ggattctgagca

SEQ ID NO: 4070373 - DNA, 13 bp, Homo sapiens
ggattctgagcag

SEQ ID NO: 4070374 - DNA, 21 bp, Homo sapiens
ggattctgaggccctgcccaa

SEQ ID NO: 4070375 - DNA, 18 bp, Homo sapiens
ggattcttgttttgcttc

SEQ ID NO: 4070376 - DNA, 19 bp, Homo sapiens
ggattcttgttttgcttcc

SEQ ID NO: 4070377 - DNA, 20 bp, Homo sapiens
ggattgaacttctttgaatt

SEQ ID NO: 4070378 - DNA, 19 bp, Homo sapiens
ggattgaggggccctggcc

SEQ ID NO: 4070379 - DNA, 17 bp, Homo sapiens
ggattgcacgtggcctc

SEQ ID NO: 4070380 - DNA, 22 bp, Homo sapiens
ggattgtaaaaaaaaatgcctt

SEQ ID NO: 4070381 - DNA, 21 bp, Homo sapiens
ggatttaacagtcatttaaaa

SEQ ID NO: 4070382 - DNA, 12 bp, Homo sapiens
ggattttttcca

SEQ ID NO: 4070383 - DNA, 17 bp, Homo sapiens
ggcaaaaaagggacagc

SEQ ID NO: 4070384 - DNA, 20 bp, Homo sapiens
ggcaaaaatgcaacaaatga

SEQ ID NO: 4070385 - DNA, 15 bp, Homo sapiens
ggcaaaaccttgcta

SEQ ID NO: 4070386 - DNA, 20 bp, Homo sapiens
ggcaaaagccttgtgtatat

SEQ ID NO: 4070387 - DNA, 13 bp, Homo sapiens
ggcaaaattgcaa

SEQ ID NO: 4070388 - DNA, 15 bp, Homo sapiens
ggcaaacctttcccc

SEQ ID NO: 4070389 - DNA, 16 bp, Homo sapiens
ggcaaagggggaggag

SEQ ID NO: 4070390 - DNA, 20 bp, Homo sapiens
ggcaaaggtggctctccagt

SEQ ID NO: 4070391 - DNA, 18 bp, Homo sapiens
ggcaaagtttaaatgtat

SEQ ID NO: 4070392 - DNA, 15 bp, Homo sapiens
ggccagaggctggga

SEQ ID NO: 4070393 - DNA, 14 bp, Homo sapiens
ggccagagggagct

SEQ ID NO: 4070394 - DNA, 21 bp, Homo sapiens
ggccagagggagctggaaccc

SEQ ID NO: 4070395 - DNA, 23 bp, Homo sapiens
ggccagatggcccggatgctgct

SEQ ID NO: 4070396 - DNA, 15 bp, Homo sapiens
ggccagcaaggcagg

SEQ ID NO: 4070397 - DNA, 13 bp, Homo sapiens
ggccagcaccctc

SEQ ID NO: 4070398 - DNA, 15 bp, Homo sapiens
ggccagccagtgcca

SEQ ID NO: 4070399 - DNA, 11 bp, Homo sapiens
ggccagcccag

SEQ ID NO: 4070400 - DNA, 14 bp, Homo sapiens
ggccagcccagcca

SEQ ID NO: 4070401 - DNA, 16 bp, Homo sapiens
ggccagcccagccagg

SEQ ID NO: 4070402 - DNA, 18 bp, Homo sapiens
ggccagcccagccaggcc

SEQ ID NO: 4070403 - DNA, 16 bp, Homo sapiens
ggccagccccacccag

SEQ ID NO: 4070404 - DNA, 20 bp, Homo sapiens
ggccagccccacccaggagg

SEQ ID NO: 4070405 - DNA, 15 bp, Homo sapiens
ggccagccccggccc

SEQ ID NO: 4070406 - DNA, 17 bp, Homo sapiens
ggccagccccggccctg

SEQ ID NO: 4070407 - DNA, 16 bp, Homo sapiens
ggccagcccctggggc

SEQ ID NO: 4070408 - DNA, 17 bp, Homo sapiens
ggccagccctgcagccc

SEQ ID NO: 4070409 - DNA, 19 bp, Homo sapiens
ggccagccgggagcttggc

SEQ ID NO: 4070410 - DNA, 14 bp, Homo sapiens
ggccagcgggcaca

SEQ ID NO: 4070411 - DNA, 18 bp, Homo sapiens
ggccagcgggcacagggc

SEQ ID NO: 4070412 - DNA, 13 bp, Homo sapiens
ggccagcgtccca

SEQ ID NO: 4070413 - DNA, 16 bp, Homo sapiens
ggccaggatggagggg

SEQ ID NO: 4070414 - DNA, 12 bp, Homo sapiens
ggccaggcacag

SEQ ID NO: 4070415 - DNA, 13 bp, Homo sapiens
ggccaggcacagg

SEQ ID NO: 4070416 - DNA, 14 bp, Homo sapiens
ggccaggcacaggg

SEQ ID NO: 4070417 - DNA, 15 bp, Homo sapiens
ggccaggcacagggc

SEQ ID NO: 4070418 - DNA, 14 bp, Homo sapiens
ggccaggcactgcc

SEQ ID NO: 4070419 - DNA, 15 bp, Homo sapiens
ggccaggcagatctg

SEQ ID NO: 4070420 - DNA, 22 bp, Homo sapiens
ggccaggcagatctgtgcccca

SEQ ID NO: 4070421 - DNA, 11 bp, Homo sapiens
ggccaggcagg

SEQ ID NO: 4070422 - DNA, 12 bp, Homo sapiens
ggccaggcaggt

SEQ ID NO: 4070423 - DNA, 17 bp, Homo sapiens
ggccaggcccaggcctc

SEQ ID NO: 4070424 - DNA, 17 bp, Homo sapiens
ggccaggggtctccctg

SEQ ID NO: 4070425 - DNA, 19 bp, Homo sapiens
ggccagggtctgtgtgaat

SEQ ID NO: 4070426 - DNA, 22 bp, Homo sapiens
ggccagtccccatttctgcctc

SEQ ID NO: 4070427 - DNA, 16 bp, Homo sapiens
ggccagtcctgcctgg

SEQ ID NO: 4070428 - DNA, 20 bp, Homo sapiens
ggccagtcctgcctggccag

SEQ ID NO: 4070429 - DNA, 21 bp, Homo sapiens
ggccagtcctgcctggccagg

SEQ ID NO: 4070430 - DNA, 15 bp, Homo sapiens
ggccagtctgggctg

SEQ ID NO: 4070431 - DNA, 17 bp, Homo sapiens
ggccagtctgggctgcc

SEQ ID NO: 4070432 - DNA, 18 bp, Homo sapiens
ggccagtggggaactgag

SEQ ID NO: 4070433 - DNA, 14 bp, Homo sapiens
ggccagtggggcct

SEQ ID NO: 4070434 - DNA, 16 bp, Homo sapiens
ggccagtggggcctgt

SEQ ID NO: 4070435 - DNA, 17 bp, Homo sapiens
ggccagtggggcctgtg

SEQ ID NO: 4070436 - DNA, 19 bp, Homo sapiens
ggccagtggggcctgtgga

SEQ ID NO: 4070437 - DNA, 19 bp, Homo sapiens
ggccagtttgaagcctgtg

SEQ ID NO: 4070438 - DNA, 13 bp, Homo sapiens
ggccatactgcct

SEQ ID NO: 4070439 - DNA, 13 bp, Homo sapiens
ggccatccctggg

SEQ ID NO: 4070440 - DNA, 16 bp, Homo sapiens
ggccatccctgggccc

SEQ ID NO: 4070441 - DNA, 19 bp, Homo sapiens
ggccatccctgggcccctc

SEQ ID NO: 4070442 - DNA, 14 bp, Homo sapiens
ggccatctcaggag

SEQ ID NO: 4070443 - DNA, 15 bp, Homo sapiens
ggccatctcaggaga

SEQ ID NO: 4070444 - DNA, 22 bp, Homo sapiens
ggccatctgggctcctccaggg

SEQ ID NO: 4070445 - DNA, 22 bp, Homo sapiens
ggccatgatggcaacagatctg

SEQ ID NO: 4070446 - DNA, 17 bp, Homo sapiens
ggccatgctgaagggac

SEQ ID NO: 4070447 - DNA, 16 bp, Homo sapiens
ggccatgtccaaagag

SEQ ID NO: 4070448 - DNA, 23 bp, Homo sapiens
ggccatgtgagccaccgctgcca

SEQ ID NO: 4070449 - DNA, 14 bp, Homo sapiens
ggcccaaggcggcc

SEQ ID NO: 4070450 - DNA, 20 bp, Homo sapiens
ggcccacccaagcaggaggc

SEQ ID NO: 4070451 - DNA, 18 bp, Homo sapiens
ggcccagaactgccccca

SEQ ID NO: 4070452 - DNA, 14 bp, Homo sapiens
ggcccagagcagga

SEQ ID NO: 4070453 - DNA, 16 bp, Homo sapiens
ggcccagagcaggaag

SEQ ID NO: 4070454 - DNA, 18 bp, Homo sapiens
ggcccagagcccagctcc

SEQ ID NO: 4070455 - DNA, 15 bp, Homo sapiens
ggcccagcccagagc

SEQ ID NO: 4070456 - DNA, 15 bp, Homo sapiens
ggcccagcgcggcca

SEQ ID NO: 4070457 - DNA, 18 bp, Homo sapiens
ggcccagcgcggccagcg

SEQ ID NO: 4070458 - DNA, 21 bp, Homo sapiens
ggcccagcgcggccagcgtcc

SEQ ID NO: 4070459 - DNA, 15 bp, Homo sapiens
ggcccagcgggcaga

SEQ ID NO: 4070460 - DNA, 15 bp, Homo sapiens
ggcccaggcctgggt

SEQ ID NO: 4070461 - DNA, 13 bp, Homo sapiens
ggcccagggaggg

SEQ ID NO: 4070462 - DNA, 19 bp, Homo sapiens
ggcccagggcccagagccc

SEQ ID NO: 4070463 - DNA, 24 bp, Homo sapiens
ggcccatatctgtgaaatgctggc

SEQ ID NO: 4070464 - DNA, 16 bp, Homo sapiens
ggcccatctcagcctc

SEQ ID NO: 4070465 - DNA, 16 bp, Homo sapiens
ggccccacctgcagct

SEQ ID NO: 4070466 - DNA, 16 bp, Homo sapiens
ggccccagaccccagg

SEQ ID NO: 4070467 - DNA, 18 bp, Homo sapiens
ggccccagaccccagggc

SEQ ID NO: 4070468 - DNA, 22 bp, Homo sapiens
ggccccagcctgggccatctct

SEQ ID NO: 4070469 - DNA, 16 bp, Homo sapiens
ggccccaggacctggc

SEQ ID NO: 4070470 - DNA, 23 bp, Homo sapiens
ggccccaggaggggaactgagtc

SEQ ID NO: 4070471 - DNA, 21 bp, Homo sapiens
ggccccatcctcatccctgac

SEQ ID NO: 4070472 - DNA, 21 bp, Homo sapiens
ggcccccaacctcagggctcc

SEQ ID NO: 4070473 - DNA, 12 bp, Homo sapiens
ggcccccagggg

SEQ ID NO: 4070474 - DNA, 13 bp, Homo sapiens
ggcccccaggggc

SEQ ID NO: 4070475 - DNA, 16 bp, Homo sapiens
ggccccccaaatccca

SEQ ID NO: 4070476 - DNA, 13 bp, Homo sapiens
ggccccgccaggg

SEQ ID NO: 4070477 - DNA, 14 bp, Homo sapiens
ggccccgccagggc

SEQ ID NO: 4070478 - DNA, 23 bp, Homo sapiens
ggccccgggttcagcctggcctg

SEQ ID NO: 4070479 - DNA, 13 bp, Homo sapiens
ggcccctcaacag

SEQ ID NO: 4070480 - DNA, 19 bp, Homo sapiens
ggcccctcaccctgcctta

SEQ ID NO: 4070481 - DNA, 21 bp, Homo sapiens
ggcccctcagagccctgccct

SEQ ID NO: 4070482 - DNA, 13 bp, Homo sapiens
ggcccctccatcc

SEQ ID NO: 4070483 - DNA, 14 bp, Homo sapiens
ggcccctcctagac

SEQ ID NO: 4070484 - DNA, 21 bp, Homo sapiens
ggcccctcttattcctctagg

SEQ ID NO: 4070485 - DNA, 13 bp, Homo sapiens
ggcccctgggatg

SEQ ID NO: 4070486 - DNA, 20 bp, Homo sapiens
ggcccctgggatgggaccag

SEQ ID NO: 4070487 - DNA, 22 bp, Homo sapiens
ggcccctgggatgggaccaggg

SEQ ID NO: 4070488 - DNA, 13 bp, Homo sapiens
ggcccctgggccc

SEQ ID NO: 4070489 - DNA, 16 bp, Homo sapiens
ggcccctgggtttctt

SEQ ID NO: 4070490 - DNA, 22 bp, Homo sapiens
ggcccgcaccccggcctcaggg

SEQ ID NO: 4070491 - DNA, 16 bp, Homo sapiens
ggcccgcagtgctggg

SEQ ID NO: 4070492 - DNA, 13 bp, Homo sapiens
ggcccggcagggc

SEQ ID NO: 4070493 - DNA, 20 bp, Homo sapiens
ggcccggccagcgggcacag

SEQ ID NO: 4070494 - DNA, 22 bp, Homo sapiens
ggcccggccagcgggcacaggg

SEQ ID NO: 4070495 - DNA, 19 bp, Homo sapiens
ggctcccatgaccatactg

SEQ ID NO: 4070496 - DNA, 17 bp, Homo sapiens
ggctccccatgtgtcct

SEQ ID NO: 4070497 - DNA, 22 bp, Homo sapiens
ggctccccatgtgtcctggttc

SEQ ID NO: 4070498 - DNA, 22 bp, Homo sapiens
ggctccccccagtgggatggga

SEQ ID NO: 4070499 - DNA, 16 bp, Homo sapiens
ggctccccctccccag

SEQ ID NO: 4070500 - DNA, 17 bp, Homo sapiens
ggctccccctccccagg

SEQ ID NO: 4070501 - DNA, 19 bp, Homo sapiens
ggctccccctccccaggct

SEQ ID NO: 4070502 - DNA, 14 bp, Homo sapiens
ggctcccgaagaat

SEQ ID NO: 4070503 - DNA, 20 bp, Homo sapiens
ggctccctcctccaggcctg

SEQ ID NO: 4070504 - DNA, 22 bp, Homo sapiens
ggctcctcagagcgccaggaag

SEQ ID NO: 4070505 - DNA, 12 bp, Homo sapiens
ggctcctgccca

SEQ ID NO: 4070506 - DNA, 17 bp, Homo sapiens
ggctcctggaaccaatc

SEQ ID NO: 4070507 - DNA, 13 bp, Homo sapiens
ggctcctttctcc

SEQ ID NO: 4070508 - DNA, 21 bp, Homo sapiens
ggctcctttctccagccagca

SEQ ID NO: 4070509 - DNA, 17 bp, Homo sapiens
ggctcggaggctgcccc

SEQ ID NO: 4070510 - DNA, 15 bp, Homo sapiens
ggctctaccttcctg

SEQ ID NO: 4070511 - DNA, 14 bp, Homo sapiens
ggctctcagctcag

SEQ ID NO: 4070512 - DNA, 19 bp, Homo sapiens
ggctctgacaaagcttccc

SEQ ID NO: 4070513 - DNA, 20 bp, Homo sapiens
ggctctgcaatgggcactgg

SEQ ID NO: 4070514 - DNA, 15 bp, Homo sapiens
ggctctgccagtgga

SEQ ID NO: 4070515 - DNA, 22 bp, Homo sapiens
ggctctgccagtggatcccctg

SEQ ID NO: 4070516 - DNA, 13 bp, Homo sapiens
ggctctggggcag

SEQ ID NO: 4070517 - DNA, 13 bp, Homo sapiens
ggctctgtggagg

SEQ ID NO: 4070518 - DNA, 14 bp, Homo sapiens
ggctcttaagcagc

SEQ ID NO: 4070519 - DNA, 19 bp, Homo sapiens
ggctcttatgtgtgccttt

SEQ ID NO: 4070520 - DNA, 14 bp, Homo sapiens
ggctcttctccttt

SEQ ID NO: 4070521 - DNA, 13 bp, Homo sapiens
ggctgaaagacag

SEQ ID NO: 4070522 - DNA, 17 bp, Homo sapiens
ggctgaccacagcacag

SEQ ID NO: 4070523 - DNA, 18 bp, Homo sapiens
ggctgaccacagcacagc

SEQ ID NO: 4070524 - DNA, 19 bp, Homo sapiens
ggctgaccccaaagagcct

SEQ ID NO: 4070525 - DNA, 13 bp, Homo sapiens
ggctgacccctct

SEQ ID NO: 4070526 - DNA, 14 bp, Homo sapiens
ggctgacccctctg

SEQ ID NO: 4070527 - DNA, 15 bp, Homo sapiens
ggctgacgtgtgagg

SEQ ID NO: 4070528 - DNA, 19 bp, Homo sapiens
ggctgactagaagggccag

SEQ ID NO: 4070529 - DNA, 22 bp, Homo sapiens
ggctgactagaagggccagtcc

SEQ ID NO: 4070530 - DNA, 24 bp, Homo sapiens
ggctgactagaagggccagtcctg

SEQ ID NO: 4070531 - DNA, 16 bp, Homo sapiens
ggctgactgggccagg

SEQ ID NO: 4070532 - DNA, 16 bp, Homo sapiens
ggctgactggggctgg

SEQ ID NO: 4070533 - DNA, 18 bp, Homo sapiens
ggctgagacaggagaatc

SEQ ID NO: 4070534 - DNA, 15 bp, Homo sapiens
ggctgaggaggcctc

SEQ ID NO: 4070535 - DNA, 13 bp, Homo sapiens
ggctgagggcctg

SEQ ID NO: 4070536 - DNA, 17 bp, Homo sapiens
ggctgagggcctgctgg

SEQ ID NO: 4070537 - DNA, 21 bp, Homo sapiens
ggctgaggttcctctgcctgc

SEQ ID NO: 4070538 - DNA, 22 bp, Homo sapiens
ggctgaggttcctctgcctgcc

SEQ ID NO: 4070539 - DNA, 16 bp, Homo sapiens
ggctgatgatccagaa

SEQ ID NO: 4070540 - DNA, 16 bp, Homo sapiens
ggctgatggaggaaaa

SEQ ID NO: 4070541 - DNA, 19 bp, Homo sapiens
ggctgcacccctgggccag

SEQ ID NO: 4070542 - DNA, 15 bp, Homo sapiens
ggctgcagtgagcca

SEQ ID NO: 4070543 - DNA, 15 bp, Homo sapiens
ggctgccaaggccag

SEQ ID NO: 4070544 - DNA, 14 bp, Homo sapiens
ggctgccagcagcc

SEQ ID NO: 4070545 - DNA, 18 bp, Homo sapiens
ggctgccagcagccccgt

SEQ ID NO: 4070546 - DNA, 14 bp, Homo sapiens
ggctgcccaggaga

SEQ ID NO: 4070547 - DNA, 19 bp, Homo sapiens
ggctgcccatcatgtggcc

SEQ ID NO: 4070548 - DNA, 13 bp, Homo sapiens
ggctgcccctcac

SEQ ID NO: 4070549 - DNA, 15 bp, Homo sapiens
ggctgcccctctcac

SEQ ID NO: 4070550 - DNA, 13 bp, Homo sapiens
ggctgccctgaga

SEQ ID NO: 4070551 - DNA, 18 bp, Homo sapiens
ggctgccctgagaagctg

SEQ ID NO: 4070552 - DNA, 24 bp, Homo sapiens
ggctgccctgagaagctgctccag

SEQ ID NO: 4070553 - DNA, 12 bp, Homo sapiens
ggctgccctggt

SEQ ID NO: 4070554 - DNA, 19 bp, Homo sapiens
ggctgccctggtgctgcca

SEQ ID NO: 4070555 - DNA, 21 bp, Homo sapiens
ggctgcctatgttggggggga

SEQ ID NO: 4070556 - DNA, 11 bp, Homo sapiens
ggctgctgccc

SEQ ID NO: 4070557 - DNA, 17 bp, Homo sapiens
ggctgctgcccccaccc

SEQ ID NO: 4070558 - DNA, 18 bp, Homo sapiens
ggctgctgcccccacccc

SEQ ID NO: 4070559 - DNA, 14 bp, Homo sapiens
ggctgcttagaatc

SEQ ID NO: 4070560 - DNA, 16 bp, Homo sapiens
ggctgctttgcctcta

SEQ ID NO: 4070561 - DNA, 15 bp, Homo sapiens
ggctggaagagggtg

SEQ ID NO: 4070562 - DNA, 22 bp, Homo sapiens
ggctggacctatgtcctaagga

SEQ ID NO: 4070563 - DNA, 14 bp, Homo sapiens
ggctggaggcccag

SEQ ID NO: 4070564 - DNA, 19 bp, Homo sapiens
ggctggagtgcagtggcgt

SEQ ID NO: 4070565 - DNA, 20 bp, Homo sapiens
ggctggagtgcagtggtgtg

SEQ ID NO: 4070566 - DNA, 18 bp, Homo sapiens
ggctggatgtggtggcat

SEQ ID NO: 4070567 - DNA, 14 bp, Homo sapiens
ggctggcacaggac

SEQ ID NO: 4070568 - DNA, 15 bp, Homo sapiens
ggctggcacaggaca

SEQ ID NO: 4070569 - DNA, 14 bp, Homo sapiens
ggctggcaggtatg

SEQ ID NO: 4070570 - DNA, 12 bp, Homo sapiens
ggctggccagca

SEQ ID NO: 4070571 - DNA, 18 bp, Homo sapiens
ggctggccagcaaggcag

SEQ ID NO: 4070572 - DNA, 16 bp, Homo sapiens
ggctggccccagggca

SEQ ID NO: 4070573 - DNA, 24 bp, Homo sapiens
ggctggctccagatgcagggcagt

SEQ ID NO: 4070574 - DNA, 14 bp, Homo sapiens
ggctggctccccct

SEQ ID NO: 4070575 - DNA, 15 bp, Homo sapiens
ggctggctccccctc

SEQ ID NO: 4070576 - DNA, 19 bp, Homo sapiens
ggctggctctaccttcctg

SEQ ID NO: 4070577 - DNA, 12 bp, Homo sapiens
ggctggctctgc

SEQ ID NO: 4070578 - DNA, 18 bp, Homo sapiens
ggctgggacgtggctcag

SEQ ID NO: 4070579 - DNA, 14 bp, Homo sapiens
ggctgggagtccct

SEQ ID NO: 4070580 - DNA, 19 bp, Homo sapiens
ggctgggcagccccagaga

SEQ ID NO: 4070581 - DNA, 13 bp, Homo sapiens
ggctgggcccctg

SEQ ID NO: 4070582 - DNA, 14 bp, Homo sapiens
ggctgggctccctg

SEQ ID NO: 4070583 - DNA, 20 bp, Homo sapiens
ggctggggcagcctctgggc

SEQ ID NO: 4070584 - DNA, 23 bp, Homo sapiens
ggctggggcagcctctgggccca

SEQ ID NO: 4070585 - DNA, 17 bp, Homo sapiens
ggctggggcggggccca

SEQ ID NO: 4070586 - DNA, 12 bp, Homo sapiens
ggctgggggact

SEQ ID NO: 4070587 - DNA, 16 bp, Homo sapiens
ggctgggggactgggg

SEQ ID NO: 4070588 - DNA, 16 bp, Homo sapiens
ggctgggggagagccg

SEQ ID NO: 4070589 - DNA, 18 bp, Homo sapiens
ggctgggggcaggagggc

SEQ ID NO: 4070590 - DNA, 19 bp, Homo sapiens
ggctggggggcaccccagc

SEQ ID NO: 4070591 - DNA, 14 bp, Homo sapiens
ggctgggggtgctg

SEQ ID NO: 4070592 - DNA, 17 bp, Homo sapiens
ggctggggtgagagagg

SEQ ID NO: 4070593 - DNA, 12 bp, Homo sapiens
ggctgggtgctg

SEQ ID NO: 4070594 - DNA, 15 bp, Homo sapiens
ggctgggtgctggga

SEQ ID NO: 4070595 - DNA, 18 bp, Homo sapiens
ggctggtatctcagaaag

SEQ ID NO: 4070596 - DNA, 14 bp, Homo sapiens
ggctggtcctccca

SEQ ID NO: 4070597 - DNA, 14 bp, Homo sapiens
ggctggtttgttct

SEQ ID NO: 4070598 - DNA, 16 bp, Homo sapiens
gggcagccaggctgcc

SEQ ID NO: 4070599 - DNA, 18 bp, Homo sapiens
gggcagcgggccaggccc

SEQ ID NO: 4070600 - DNA, 16 bp, Homo sapiens
gggcaggaaggagagc

SEQ ID NO: 4070601 - DNA, 13 bp, Homo sapiens
gggcaggctgggc

SEQ ID NO: 4070602 - DNA, 14 bp, Homo sapiens
gggcaggctgggcc

SEQ ID NO: 4070603 - DNA, 16 bp, Homo sapiens
gggcagggctgtgctt

SEQ ID NO: 4070604 - DNA, 14 bp, Homo sapiens
gggcagggtgaccc

SEQ ID NO: 4070605 - DNA, 18 bp, Homo sapiens
gggcagggtgggcagcct

SEQ ID NO: 4070606 - DNA, 16 bp, Homo sapiens
gggcagttctcactcc

SEQ ID NO: 4070607 - DNA, 13 bp, Homo sapiens
gggcatctcttcc

SEQ ID NO: 4070608 - DNA, 17 bp, Homo sapiens
gggcatctcttccccag

SEQ ID NO: 4070609 - DNA, 20 bp, Homo sapiens
gggcatctgcccctccccca

SEQ ID NO: 4070610 - DNA, 17 bp, Homo sapiens
gggcatcttgctggcta

SEQ ID NO: 4070611 - DNA, 18 bp, Homo sapiens
gggcatgggtccagggcc

SEQ ID NO: 4070612 - DNA, 21 bp, Homo sapiens
gggcatttcttgcgagcctcg

SEQ ID NO: 4070613 - DNA, 17 bp, Homo sapiens
gggcattttcctcctct

SEQ ID NO: 4070614 - DNA, 18 bp, Homo sapiens
gggcattttcctcctctg

SEQ ID NO: 4070615 - DNA, 19 bp, Homo sapiens
gggcattttcctcctctgc

SEQ ID NO: 4070616 - DNA, 19 bp, Homo sapiens
gggccacagggcgagactc

SEQ ID NO: 4070617 - DNA, 23 bp, Homo sapiens
gggccaccatccctgatggcaga

SEQ ID NO: 4070618 - DNA, 18 bp, Homo sapiens
gggccacgccccagcccg

SEQ ID NO: 4070619 - DNA, 14 bp, Homo sapiens
gggccactggaagg

SEQ ID NO: 4070620 - DNA, 13 bp, Homo sapiens
gggccactgggga

SEQ ID NO: 4070621 - DNA, 22 bp, Homo sapiens
gggccactggggactttattta

SEQ ID NO: 4070622 - DNA, 15 bp, Homo sapiens
gggccagagccaggg

SEQ ID NO: 4070623 - DNA, 11 bp, Homo sapiens
gggccagaggg

SEQ ID NO: 4070624 - DNA, 14 bp, Homo sapiens
gggccagagggagc

SEQ ID NO: 4070625 - DNA, 13 bp, Homo sapiens
gggccagatccag

SEQ ID NO: 4070626 - DNA, 17 bp, Homo sapiens
gggccagatccagcctg

SEQ ID NO: 4070627 - DNA, 19 bp, Homo sapiens
gggccagccctgcagccca

SEQ ID NO: 4070628 - DNA, 23 bp, Homo sapiens
gggccaggcaggtgcctggacat

SEQ ID NO: 4070629 - DNA, 16 bp, Homo sapiens
gggccaggcccaggcc

SEQ ID NO: 4070630 - DNA, 18 bp, Homo sapiens
gggccaggcccaggcctc

SEQ ID NO: 4070631 - DNA, 23 bp, Homo sapiens
gggccaggggtctccctggagtg

SEQ ID NO: 4070632 - DNA, 18 bp, Homo sapiens
gggccagtcctcctggga

SEQ ID NO: 4070633 - DNA, 20 bp, Homo sapiens
gggccagtcctcctgggagc

SEQ ID NO: 4070634 - DNA, 22 bp, Homo sapiens
gggccagtcctgcctggccagg

SEQ ID NO: 4070635 - DNA, 15 bp, Homo sapiens
gggccagtctgggct

SEQ ID NO: 4070636 - DNA, 14 bp, Homo sapiens
gggccagtggggaa

SEQ ID NO: 4070637 - DNA, 20 bp, Homo sapiens
gggccagtggggaactgagg

SEQ ID NO: 4070638 - DNA, 21 bp, Homo sapiens
gggccagtggggaactgaggg

SEQ ID NO: 4070639 - DNA, 15 bp, Homo sapiens
gggccagtggggcct

SEQ ID NO: 4070640 - DNA, 18 bp, Homo sapiens
gggccagtggggcctgtg

SEQ ID NO: 4070641 - DNA, 13 bp, Homo sapiens
gggccatccttcc

SEQ ID NO: 4070642 - DNA, 23 bp, Homo sapiens
gggccatctcttaggtgagacag

SEQ ID NO: 4070643 - DNA, 12 bp, Homo sapiens
gggccatgaggg

SEQ ID NO: 4070644 - DNA, 16 bp, Homo sapiens
gggccatgagggacag

SEQ ID NO: 4070645 - DNA, 14 bp, Homo sapiens
gggccatgctgaag

SEQ ID NO: 4070646 - DNA, 23 bp, Homo sapiens
gggccatgtccaaagaggctgcc

SEQ ID NO: 4070647 - DNA, 16 bp, Homo sapiens
gggccattctccacag

SEQ ID NO: 4070648 - DNA, 19 bp, Homo sapiens
gggcccaaggcggcccctc

SEQ ID NO: 4070649 - DNA, 13 bp, Homo sapiens
gggcccaccccag

SEQ ID NO: 4070650 - DNA, 21 bp, Homo sapiens
gggcccagaactgcccccact

SEQ ID NO: 4070651 - DNA, 23 bp, Homo sapiens
gggcccagaactgcccccactgt

SEQ ID NO: 4070652 - DNA, 11 bp, Homo sapiens
gggcccagagc

SEQ ID NO: 4070653 - DNA, 17 bp, Homo sapiens
gggcccagagcccagct

SEQ ID NO: 4070654 - DNA, 20 bp, Homo sapiens
gggcccagagcccagctcca

SEQ ID NO: 4070655 - DNA, 13 bp, Homo sapiens
gggcccagatctg

SEQ ID NO: 4070656 - DNA, 12 bp, Homo sapiens
gggcccagccca

SEQ ID NO: 4070657 - DNA, 13 bp, Homo sapiens
gggcccagcccct

SEQ ID NO: 4070658 - DNA, 12 bp, Homo sapiens
gggccccagacc

SEQ ID NO: 4070659 - DNA, 16 bp, Homo sapiens
gggccccagaccccag

SEQ ID NO: 4070660 - DNA, 21 bp, Homo sapiens
gggccccgccagggctgggga

SEQ ID NO: 4070661 - DNA, 19 bp, Homo sapiens
gggccccgggttcagcctg

SEQ ID NO: 4070662 - DNA, 21 bp, Homo sapiens
gggccccgggttcagcctggc

SEQ ID NO: 4070663 - DNA, 22 bp, Homo sapiens
gggccccgggttcagcctggcc

SEQ ID NO: 4070664 - DNA, 12 bp, Homo sapiens
gggcccctcaac

SEQ ID NO: 4070665 - DNA, 19 bp, Homo sapiens
gggcccctcaccctgcctt

SEQ ID NO: 4070666 - DNA, 13 bp, Homo sapiens
gggcccctccacg

SEQ ID NO: 4070667 - DNA, 14 bp, Homo sapiens
gggcccctccatcc

SEQ ID NO: 4070668 - DNA, 21 bp, Homo sapiens
gggcccctgggcttggcctgc

SEQ ID NO: 4070669 - DNA, 23 bp, Homo sapiens
gggcccctgggcttggcctgctg

SEQ ID NO: 4070670 - DNA, 19 bp, Homo sapiens
gggcccgcagtgctgggac

SEQ ID NO: 4070671 - DNA, 21 bp, Homo sapiens
gggcccgcagtgctgggacca

SEQ ID NO: 4070672 - DNA, 21 bp, Homo sapiens
gggccctctctctgggcccag

SEQ ID NO: 4070673 - DNA, 18 bp, Homo sapiens
gggccctctttccctgcg

SEQ ID NO: 4070674 - DNA, 18 bp, Homo sapiens
gggccctgcacctgtgca

SEQ ID NO: 4070675 - DNA, 14 bp, Homo sapiens
gggccctgcagctc

SEQ ID NO: 4070676 - DNA, 12 bp, Homo sapiens
gggccctggcca

SEQ ID NO: 4070677 - DNA, 14 bp, Homo sapiens
gggccctgggcctc

SEQ ID NO: 4070678 - DNA, 12 bp, Homo sapiens
gggccgaggagg

SEQ ID NO: 4070679 - DNA, 20 bp, Homo sapiens
gggccgaggaggtgcctgga

SEQ ID NO: 4070680 - DNA, 21 bp, Homo sapiens
gggccgggcacggtcacacgg

SEQ ID NO: 4070681 - DNA, 20 bp, Homo sapiens
gggccgggcaggtcctgccc

SEQ ID NO: 4070682 - DNA, 16 bp, Homo sapiens
gggcctcaaggacttg

SEQ ID NO: 4070683 - DNA, 12 bp, Homo sapiens
gggcctccaggg

SEQ ID NO: 4070684 - DNA, 16 bp, Homo sapiens
gggcctcccaccagag

SEQ ID NO: 4070685 - DNA, 16 bp, Homo sapiens
gggcctcgggacctca

SEQ ID NO: 4070686 - DNA, 14 bp, Homo sapiens
gggcctgagagaat

SEQ ID NO: 4070687 - DNA, 11 bp, Homo sapiens
gggcctgcccc

SEQ ID NO: 4070688 - DNA, 15 bp, Homo sapiens
gggcctgccgggctg

SEQ ID NO: 4070689 - DNA, 20 bp, Homo sapiens
gggcctgccgggctgagggc

SEQ ID NO: 4070690 - DNA, 14 bp, Homo sapiens
gggcctgctggagg

SEQ ID NO: 4070691 - DNA, 20 bp, Homo sapiens
gggcctggcaggccagtgtc

SEQ ID NO: 4070692 - DNA, 21 bp, Homo sapiens
gggcctgggacttccatgcct

SEQ ID NO: 4070693 - DNA, 15 bp, Homo sapiens
gggcctgggcctctg

SEQ ID NO: 4070694 - DNA, 14 bp, Homo sapiens
gggcctggggcctg

SEQ ID NO: 4070695 - DNA, 16 bp, Homo sapiens
gggcctggggcctgag

SEQ ID NO: 4070696 - DNA, 18 bp, Homo sapiens
gggcctggggcctgagag

SEQ ID NO: 4070697 - DNA, 19 bp, Homo sapiens
gggcctggggcctgagaga

SEQ ID NO: 4070698 - DNA, 19 bp, Homo sapiens
gggcctggtccctgggagg

SEQ ID NO: 4070699 - DNA, 21 bp, Homo sapiens
gggccttagggcactgggctg

SEQ ID NO: 4070700 - DNA, 17 bp, Homo sapiens
gggccttagtgggccag

SEQ ID NO: 4070701 - DNA, 21 bp, Homo sapiens
gggtgcttttatagaggctag

SEQ ID NO: 4070702 - DNA, 14 bp, Homo sapiens
gggtggaagggctg

SEQ ID NO: 4070703 - DNA, 16 bp, Homo sapiens
gggtggaagggctggg

SEQ ID NO: 4070704 - DNA, 17 bp, Homo sapiens
gggtggaagggctgggt

SEQ ID NO: 4070705 - DNA, 16 bp, Homo sapiens
gggtggaggcttcctg

SEQ ID NO: 4070706 - DNA, 17 bp, Homo sapiens
gggtggatcacgaggtc

SEQ ID NO: 4070707 - DNA, 21 bp, Homo sapiens
gggtgggcccagaactgcccc

SEQ ID NO: 4070708 - DNA, 22 bp, Homo sapiens
gggtggggaatgtttgggcaga

SEQ ID NO: 4070709 - DNA, 13 bp, Homo sapiens
gggtgggtgaagg

SEQ ID NO: 4070710 - DNA, 13 bp, Homo sapiens
gggtgtagccagg

SEQ ID NO: 4070711 - DNA, 17 bp, Homo sapiens
gggtgtgaacatgttct

SEQ ID NO: 4070712 - DNA, 21 bp, Homo sapiens
gggtgtgcaatgtctgagtga

SEQ ID NO: 4070713 - DNA, 11 bp, Homo sapiens
gggtgtggcct

SEQ ID NO: 4070714 - DNA, 13 bp, Homo sapiens
gggtgtggcctca

SEQ ID NO: 4070715 - DNA, 16 bp, Homo sapiens
gggtgtggggtggggt

SEQ ID NO: 4070716 - DNA, 15 bp, Homo sapiens
gggtgtgggtggaag

SEQ ID NO: 4070717 - DNA, 14 bp, Homo sapiens
gggtgttctttcct

SEQ ID NO: 4070718 - DNA, 22 bp, Homo sapiens
gggttaagaaaagagatatttt

SEQ ID NO: 4070719 - DNA, 15 bp, Homo sapiens
gggttaaggcctgaa

SEQ ID NO: 4070720 - DNA, 12 bp, Homo sapiens
gggttacaaact

SEQ ID NO: 4070721 - DNA, 16 bp, Homo sapiens
gggttacaaactgcaa

SEQ ID NO: 4070722 - DNA, 13 bp, Homo sapiens
gggttatctctgt

SEQ ID NO: 4070723 - DNA, 15 bp, Homo sapiens
gggttcatctgtcca

SEQ ID NO: 4070724 - DNA, 21 bp, Homo sapiens
gggttccctcctagctctccc

SEQ ID NO: 4070725 - DNA, 22 bp, Homo sapiens
gggttccctcctagctctccca

SEQ ID NO: 4070726 - DNA, 18 bp, Homo sapiens
gggttccctttccttcca

SEQ ID NO: 4070727 - DNA, 16 bp, Homo sapiens
gggttgaaaatgtgtt

SEQ ID NO: 4070728 - DNA, 13 bp, Homo sapiens
gggttggcagccc

SEQ ID NO: 4070729 - DNA, 22 bp, Homo sapiens
gggttgggcccagatctggtcc

SEQ ID NO: 4070730 - DNA, 15 bp, Homo sapiens
gggttggggccgggc

SEQ ID NO: 4070731 - DNA, 20 bp, Homo sapiens
gggtttcacctgggccctgg

SEQ ID NO: 4070732 - DNA, 21 bp, Homo sapiens
gggtttcacctgggccctgga

SEQ ID NO: 4070733 - DNA, 20 bp, Homo sapiens
gggtttcactgtgttagcca

SEQ ID NO: 4070734 - DNA, 16 bp, Homo sapiens
gggtttgggcccctca

SEQ ID NO: 4070735 - DNA, 10 bp, Homo sapiens
gggtttttct

SEQ ID NO: 4070736 - DNA, 14 bp, Homo sapiens
gggtttttcttgtg

SEQ ID NO: 4070737 - DNA, 23 bp, Homo sapiens
ggtaaaatacttttactctgcct

SEQ ID NO: 4070738 - DNA, 22 bp, Homo sapiens
ggtaaaggagcatttttttatt

SEQ ID NO: 4070739 - DNA, 20 bp, Homo sapiens
ggtaaataaaccactgtgcg

SEQ ID NO: 4070740 - DNA, 13 bp, Homo sapiens
ggtaaatgatgtg

SEQ ID NO: 4070741 - DNA, 20 bp, Homo sapiens
ggtaaatttttaggcaaaga

SEQ ID NO: 4070742 - DNA, 14 bp, Homo sapiens
ggtaacagaacagc

SEQ ID NO: 4070743 - DNA, 15 bp, Homo sapiens
ggtaacagaacagct

SEQ ID NO: 4070744 - DNA, 12 bp, Homo sapiens
ggtaacagtggc

SEQ ID NO: 4070745 - DNA, 18 bp, Homo sapiens
ggtaaccttatatttaca

SEQ ID NO: 4070746 - DNA, 16 bp, Homo sapiens
ggtaactgtcctgtcc

SEQ ID NO: 4070747 - DNA, 17 bp, Homo sapiens
ggtaactgtcctgtcct

SEQ ID NO: 4070748 - DNA, 16 bp, Homo sapiens
ggtaacttattagaaa

SEQ ID NO: 4070749 - DNA, 23 bp, Homo sapiens
ggtaagaagccgggaacagacaa

SEQ ID NO: 4070750 - DNA, 18 bp, Homo sapiens
ggtaagttttttgaaatt

SEQ ID NO: 4070751 - DNA, 20 bp, Homo sapiens
ggtaatccaggcacagctga

SEQ ID NO: 4070752 - DNA, 12 bp, Homo sapiens
ggtacagtttgg

SEQ ID NO: 4070753 - DNA, 19 bp, Homo sapiens
ggtacatttataattgcat

SEQ ID NO: 4070754 - DNA, 14 bp, Homo sapiens
ggtactaaatttaa

SEQ ID NO: 4070755 - DNA, 13 bp, Homo sapiens
ggtacttagagtt

SEQ ID NO: 4070756 - DNA, 16 bp, Homo sapiens
ggtacttcttgaaggt

SEQ ID NO: 4070757 - DNA, 19 bp, Homo sapiens
ggtacttcttgaaggtgct

SEQ ID NO: 4070758 - DNA, 21 bp, Homo sapiens
ggtacttttatgatgtatatt

SEQ ID NO: 4070759 - DNA, 22 bp, Homo sapiens
ggtacttttatgatgtatattt

SEQ ID NO: 4070760 - DNA, 23 bp, Homo sapiens
ggtacttttatgatgtatattta

SEQ ID NO: 4070761 - DNA, 20 bp, Homo sapiens
ggtagaaagagatacagagg

SEQ ID NO: 4070762 - DNA, 23 bp, Homo sapiens
ggtagaaatatctgaaaatgtat

SEQ ID NO: 4070763 - DNA, 14 bp, Homo sapiens
ggtagaacgccagg

SEQ ID NO: 4070764 - DNA, 13 bp, Homo sapiens
ggtagatgtgcaa

SEQ ID NO: 4070765 - DNA, 21 bp, Homo sapiens
ggtagcataaataaaactgaa

SEQ ID NO: 4070766 - DNA, 21 bp, Homo sapiens
ggtagccagcacacagggcag

SEQ ID NO: 4070767 - DNA, 13 bp, Homo sapiens
ggtagcccagcac

SEQ ID NO: 4070768 - DNA, 22 bp, Homo sapiens
ggtagggagcctcccctccctg

SEQ ID NO: 4070769 - DNA, 16 bp, Homo sapiens
ggtagggtaaatcagt

SEQ ID NO: 4070770 - DNA, 15 bp, Homo sapiens
ggtaggttgggacac

SEQ ID NO: 4070771 - DNA, 17 bp, Homo sapiens
ggtaggttgggacacca

SEQ ID NO: 4070772 - DNA, 18 bp, Homo sapiens
ggtagttgcaattgaatt

SEQ ID NO: 4070773 - DNA, 15 bp, Homo sapiens
ggtataatgtttaaa

SEQ ID NO: 4070774 - DNA, 21 bp, Homo sapiens
ggtatatccttttctgtgttt

SEQ ID NO: 4070775 - DNA, 15 bp, Homo sapiens
ggtatcaagaaagtc

SEQ ID NO: 4070776 - DNA, 18 bp, Homo sapiens
ggtatcctgcccagtgtt

SEQ ID NO: 4070777 - DNA, 14 bp, Homo sapiens
ggtatctccaggat

SEQ ID NO: 4070778 - DNA, 18 bp, Homo sapiens
ggtatgtagccagctgtg

SEQ ID NO: 4070779 - DNA, 12 bp, Homo sapiens
ggtatgtctgcc

SEQ ID NO: 4070780 - DNA, 12 bp, Homo sapiens
ggtatgtttaat

SEQ ID NO: 4070781 - DNA, 17 bp, Homo sapiens
ggtatttcgaaactgcc

SEQ ID NO: 4070782 - DNA, 20 bp, Homo sapiens
ggtcaagattttgaatgctt

SEQ ID NO: 4070783 - DNA, 21 bp, Homo sapiens
ggtcaagggcttactatttct

SEQ ID NO: 4070784 - DNA, 20 bp, Homo sapiens
ggtcaagtaagaagacatga

SEQ ID NO: 4070785 - DNA, 19 bp, Homo sapiens
ggtcaagttgagattttta

SEQ ID NO: 4070786 - DNA, 11 bp, Homo sapiens
ggtcaataaac

SEQ ID NO: 4070787 - DNA, 14 bp, Homo sapiens
ggtcaataaactta

SEQ ID NO: 4070788 - DNA, 14 bp, Homo sapiens
ggtcacacggccac

SEQ ID NO: 4070789 - DNA, 20 bp, Homo sapiens
ggtcacacggccacccgccc

SEQ ID NO: 4070790 - DNA, 16 bp, Homo sapiens
ggtcacatccatccct

SEQ ID NO: 4070791 - DNA, 21 bp, Homo sapiens
ggtcacattcaggaagatgaa

SEQ ID NO: 4070792 - DNA, 22 bp, Homo sapiens
ggtcactgtgcactgccctgtt

SEQ ID NO: 4070793 - DNA, 17 bp, Homo sapiens
ggtcaggagatcgagac

SEQ ID NO: 4070794 - DNA, 19 bp, Homo sapiens
ggtcaggcggggtgctgtg

SEQ ID NO: 4070795 - DNA, 14 bp, Homo sapiens
ggtcaggctgggca

SEQ ID NO: 4070796 - DNA, 15 bp, Homo sapiens
ggtcaggctgggcag

SEQ ID NO: 4070797 - DNA, 17 bp, Homo sapiens
ggtcaggctgggcagcc

SEQ ID NO: 4070798 - DNA, 16 bp, Homo sapiens
ggtcagggagtgctgg

SEQ ID NO: 4070799 - DNA, 20 bp, Homo sapiens
ggtcaggttatactcctcct

SEQ ID NO: 4070800 - DNA, 12 bp, Homo sapiens
ggtcagtgcctt

SEQ ID NO: 4070801 - DNA, 22 bp, Homo sapiens
ggtcagtgccttttggaactgt

SEQ ID NO: 4070802 - DNA, 20 bp, Homo sapiens
ggtcatgatgctctttccca

SEQ ID NO: 4070803 - DNA, 19 bp, Homo sapiens
ggtcatgtttgcaggggtg

SEQ ID NO: 4070804 - DNA, 17 bp, Homo sapiens
ggtgttttaaaaaatct

SEQ ID NO: 4070805 - DNA, 21 bp, Homo sapiens
ggttaaaactgtacatttaaa

SEQ ID NO: 4070806 - DNA, 14 bp, Homo sapiens
ggttaaactgcagg

SEQ ID NO: 4070807 - DNA, 21 bp, Homo sapiens
ggttaagcattaccactcagg

SEQ ID NO: 4070808 - DNA, 12 bp, Homo sapiens
ggttaagtgttt

SEQ ID NO: 4070809 - DNA, 17 bp, Homo sapiens
ggttacttcttctctta

SEQ ID NO: 4070810 - DNA, 16 bp, Homo sapiens
ggttaggatttaacag

SEQ ID NO: 4070811 - DNA, 18 bp, Homo sapiens
ggttatcaaaaatttcat

SEQ ID NO: 4070812 - DNA, 14 bp, Homo sapiens
ggttatctctgtgt

SEQ ID NO: 4070813 - DNA, 18 bp, Homo sapiens
ggttattagcaaggctgg

SEQ ID NO: 4070814 - DNA, 19 bp, Homo sapiens
ggttcagaattaaactttt

SEQ ID NO: 4070815 - DNA, 18 bp, Homo sapiens
ggttcagacccctgcctg

SEQ ID NO: 4070816 - DNA, 13 bp, Homo sapiens
ggttcagcctggc

SEQ ID NO: 4070817 - DNA, 15 bp, Homo sapiens
ggttcagcctggcct

SEQ ID NO: 4070818 - DNA, 16 bp, Homo sapiens
ggttcagcctggcctg

SEQ ID NO: 4070819 - DNA, 20 bp, Homo sapiens
ggttcagcctggcctgcccg

SEQ ID NO: 4070820 - DNA, 15 bp, Homo sapiens
ggttcagtgtttctg

SEQ ID NO: 4070821 - DNA, 17 bp, Homo sapiens
ggttcatctgtccatgg

SEQ ID NO: 4070822 - DNA, 22 bp, Homo sapiens
ggttcatctgtccatggccttt

SEQ ID NO: 4070823 - DNA, 19 bp, Homo sapiens
ggttcattattggaattaa

SEQ ID NO: 4070824 - DNA, 14 bp, Homo sapiens
ggttccatgcctga

SEQ ID NO: 4070825 - DNA, 18 bp, Homo sapiens
ggttccatgcctgagggt

SEQ ID NO: 4070826 - DNA, 15 bp, Homo sapiens
ggttcccctgttcac

SEQ ID NO: 4070827 - DNA, 16 bp, Homo sapiens
ggttccctctgagaat

SEQ ID NO: 4070828 - DNA, 17 bp, Homo sapiens
ggttccctttccttcca

SEQ ID NO: 4070829 - DNA, 14 bp, Homo sapiens
ggttcctctgcctg

SEQ ID NO: 4070830 - DNA, 17 bp, Homo sapiens
ggttcctcttaggtcag

SEQ ID NO: 4070831 - DNA, 15 bp, Homo sapiens
ggttccttttattag

SEQ ID NO: 4070832 - DNA, 18 bp, Homo sapiens
ggttctaggcatctctgt

SEQ ID NO: 4070833 - DNA, 13 bp, Homo sapiens
ggttctattttct

SEQ ID NO: 4070834 - DNA, 23 bp, Homo sapiens
ggttctcatttggtctgccagaa

SEQ ID NO: 4070835 - DNA, 20 bp, Homo sapiens
ggttctgcctgccagctgca

SEQ ID NO: 4070836 - DNA, 16 bp, Homo sapiens
ggttctgcctgctttg

SEQ ID NO: 4070837 - DNA, 12 bp, Homo sapiens
ggttctggctgc

SEQ ID NO: 4070838 - DNA, 17 bp, Homo sapiens
ggttcttggtagagatt

SEQ ID NO: 4070839 - DNA, 15 bp, Homo sapiens
ggttctttgttttaa

SEQ ID NO: 4070840 - DNA, 18 bp, Homo sapiens
ggttgaaaatgtgtttgc

SEQ ID NO: 4070841 - DNA, 23 bp, Homo sapiens
ggttgaccccaatccaacccggg

SEQ ID NO: 4070842 - DNA, 14 bp, Homo sapiens
ggttgatcacactc

SEQ ID NO: 4070843 - DNA, 15 bp, Homo sapiens
ggttgatggaaaata

SEQ ID NO: 4070844 - DNA, 19 bp, Homo sapiens
ggttgatggaaaataaaca

SEQ ID NO: 4070845 - DNA, 14 bp, Homo sapiens
ggttggagcccagg

SEQ ID NO: 4070846 - DNA, 21 bp, Homo sapiens
ggttggccgtggtccagctct

SEQ ID NO: 4070847 - DNA, 17 bp, Homo sapiens
ggttgggcccagatctg

SEQ ID NO: 4070848 - DNA, 13 bp, Homo sapiens
ggttgtctccagg

SEQ ID NO: 4070849 - DNA, 21 bp, Homo sapiens
ggttgtctgtttttgtaactt

SEQ ID NO: 4070850 - DNA, 21 bp, Homo sapiens
ggttgtgaggcctggccaggc

SEQ ID NO: 4070851 - DNA, 14 bp, Homo sapiens
ggtttacaggccct

SEQ ID NO: 4070852 - DNA, 15 bp, Homo sapiens
ggtttacatttaaag

SEQ ID NO: 4070853 - DNA, 17 bp, Homo sapiens
ggtttacctagagaaca

SEQ ID NO: 4070854 - DNA, 22 bp, Homo sapiens
ggtttatttgttgttttctggg

SEQ ID NO: 4070855 - DNA, 19 bp, Homo sapiens
ggtttcacctgggccctgg

SEQ ID NO: 4070856 - DNA, 13 bp, Homo sapiens
ggtttcatgttca

SEQ ID NO: 4070857 - DNA, 17 bp, Homo sapiens
ggtttcatgttcactgt

SEQ ID NO: 4070858 - DNA, 14 bp, Homo sapiens
ggtttcctgcccag

SEQ ID NO: 4070859 - DNA, 19 bp, Homo sapiens
ggtttcctgcccagcctgg

SEQ ID NO: 4070860 - DNA, 16 bp, Homo sapiens
ggtttctctccctcct

SEQ ID NO: 4070861 - DNA, 15 bp, Homo sapiens
ggtttctctctacag

SEQ ID NO: 4070862 - DNA, 15 bp, Homo sapiens
ggtttctttcagatt

SEQ ID NO: 4070863 - DNA, 22 bp, Homo sapiens
ggtttctttcagattttttgaa

SEQ ID NO: 4070864 - DNA, 17 bp, Homo sapiens
ggtttgggaaagatgga

SEQ ID NO: 4070865 - DNA, 15 bp, Homo sapiens
ggtttggtttgcttt

SEQ ID NO: 4070866 - DNA, 18 bp, Homo sapiens
ggtttgtggcgtctccct

SEQ ID NO: 4070867 - DNA, 19 bp, Homo sapiens
ggtttgtgtttgagtttta

SEQ ID NO: 4070868 - DNA, 17 bp, Homo sapiens
ggttttaggtagaaaaa

SEQ ID NO: 4070869 - DNA, 21 bp, Homo sapiens
ggttttggggaaatgtggaga

SEQ ID NO: 4070870 - DNA, 21 bp, Homo sapiens
ggtttttaatctttgtgacag

SEQ ID NO: 4070871 - DNA, 15 bp, Homo sapiens
ggtttttattagtac

SEQ ID NO: 4070872 - DNA, 18 bp, Homo sapiens
ggtttttatttctccttt

SEQ ID NO: 4070873 - DNA, 21 bp, Homo sapiens
ggtttttatttctcgggtgca

SEQ ID NO: 4070874 - DNA, 13 bp, Homo sapiens
ggtttttgctctc

SEQ ID NO: 4070875 - DNA, 20 bp, Homo sapiens
gtaaaaaaaaatgcctttga

SEQ ID NO: 4070876 - DNA, 15 bp, Homo sapiens
gtaaaaaatggaaaa

SEQ ID NO: 4070877 - DNA, 19 bp, Homo sapiens
gtaaaaacagcattgcttt

SEQ ID NO: 4070878 - DNA, 23 bp, Homo sapiens
gtaaaaacagcattgctttctga

SEQ ID NO: 4070879 - DNA, 14 bp, Homo sapiens
gtaaaagaaatcat

SEQ ID NO: 4070880 - DNA, 18 bp, Homo sapiens
gtaaaagaacagtaaaca

SEQ ID NO: 4070881 - DNA, 12 bp, Homo sapiens
gtaaaagtctac

SEQ ID NO: 4070882 - DNA, 15 bp, Homo sapiens
gtaaaagtgtgagca

SEQ ID NO: 4070883 - DNA, 12 bp, Homo sapiens
gtaaaatacttt

SEQ ID NO: 4070884 - DNA, 20 bp, Homo sapiens
gtaaacaacttgtacttgtt

SEQ ID NO: 4070885 - DNA, 19 bp, Homo sapiens
gtaaacagatggcactttg

SEQ ID NO: 4070886 - DNA, 20 bp, Homo sapiens
gtaaacagatggcactttga

SEQ ID NO: 4070887 - DNA, 14 bp, Homo sapiens
gtaaacagggtacc

SEQ ID NO: 4070888 - DNA, 14 bp, Homo sapiens
gtaaacctgtctga

SEQ ID NO: 4070889 - DNA, 21 bp, Homo sapiens
gtaaactatttatctgtgttt

SEQ ID NO: 4070890 - DNA, 19 bp, Homo sapiens
gtaaagactggttttctgc

SEQ ID NO: 4070891 - DNA, 21 bp, Homo sapiens
gtaaagcccatttttaaaata

SEQ ID NO: 4070892 - DNA, 13 bp, Homo sapiens
gtaaataaaaaga

SEQ ID NO: 4070893 - DNA, 11 bp, Homo sapiens
gtaaataagag

SEQ ID NO: 4070894 - DNA, 16 bp, Homo sapiens
gtaaataagagatttg

SEQ ID NO: 4070895 - DNA, 15 bp, Homo sapiens
gtaaatacaagactg

SEQ ID NO: 4070896 - DNA, 16 bp, Homo sapiens
gtaaatacaagactgt

SEQ ID NO: 4070897 - DNA, 19 bp, Homo sapiens
gtaaatacacaacacacac

SEQ ID NO: 4070898 - DNA, 14 bp, Homo sapiens
gtaaatacaggtag

SEQ ID NO: 4070899 - DNA, 16 bp, Homo sapiens
gtaaatacgaacccaa

SEQ ID NO: 4070900 - DNA, 16 bp, Homo sapiens
gtaaatagtatttgag

SEQ ID NO: 4070901 - DNA, 15 bp, Homo sapiens
gtaaatatgaatctg

SEQ ID NO: 4070902 - DNA, 22 bp, Homo sapiens
gtaaatattgaggctttgtgtt

SEQ ID NO: 4070903 - DNA, 11 bp, Homo sapiens
gtaaatattta

SEQ ID NO: 4070904 - DNA, 12 bp, Homo sapiens
gtaaatatttat

SEQ ID NO: 4070905 - DNA, 21 bp, Homo sapiens
gtaaatcagtaagaggtgtta

SEQ ID NO: 4070906 - DNA, 20 bp, Homo sapiens
gtaaatcctgccatttaaaa

SEQ ID NO: 4070907 - DNA, 21 bp, Homo sapiens
gtagggagtacctgctgcccc

SEQ ID NO: 4070908 - DNA, 15 bp, Homo sapiens
gtaggggtgtgtgtg

SEQ ID NO: 4070909 - DNA, 12 bp, Homo sapiens
gtagggtgggag

SEQ ID NO: 4070910 - DNA, 23 bp, Homo sapiens
gtaggtatgatctcttctggtgt

SEQ ID NO: 4070911 - DNA, 20 bp, Homo sapiens
gtagtactccttaagaacac

SEQ ID NO: 4070912 - DNA, 22 bp, Homo sapiens
gtagtagtctcattacttttga

SEQ ID NO: 4070913 - DNA, 16 bp, Homo sapiens
gtagtataaagaaaag

SEQ ID NO: 4070914 - DNA, 15 bp, Homo sapiens
gtagtcaggtgctca

SEQ ID NO: 4070915 - DNA, 12 bp, Homo sapiens
gtagtcccagcc

SEQ ID NO: 4070916 - DNA, 12 bp, Homo sapiens
gtagtcccagct

SEQ ID NO: 4070917 - DNA, 14 bp, Homo sapiens
gtagtcggcacagc

SEQ ID NO: 4070918 - DNA, 13 bp, Homo sapiens
gtagtgagcagtg

SEQ ID NO: 4070919 - DNA, 15 bp, Homo sapiens
gtagttcctgctaca

SEQ ID NO: 4070920 - DNA, 19 bp, Homo sapiens
gtagttgaggaaagcacag

SEQ ID NO: 4070921 - DNA, 20 bp, Homo sapiens
gtagttgaggaaagcacaga

SEQ ID NO: 4070922 - DNA, 22 bp, Homo sapiens
gtagttgtattcttctgtattt

SEQ ID NO: 4070923 - DNA, 22 bp, Homo sapiens
gtagtttttacagctgtgttat

SEQ ID NO: 4070924 - DNA, 12 bp, Homo sapiens
gtataaaaacaa

SEQ ID NO: 4070925 - DNA, 15 bp, Homo sapiens
gtataaaactttcct

SEQ ID NO: 4070926 - DNA, 16 bp, Homo sapiens
gtataaaactttcctc

SEQ ID NO: 4070927 - DNA, 18 bp, Homo sapiens
gtataaaactttcctcgc

SEQ ID NO: 4070928 - DNA, 19 bp, Homo sapiens
gtataaaactttcctcgcc

SEQ ID NO: 4070929 - DNA, 14 bp, Homo sapiens
gtataaacaaagtt

SEQ ID NO: 4070930 - DNA, 18 bp, Homo sapiens
gtataaacataagttgca

SEQ ID NO: 4070931 - DNA, 16 bp, Homo sapiens
gtataaagcatgtggt

SEQ ID NO: 4070932 - DNA, 12 bp, Homo sapiens
gtataaatggtt

SEQ ID NO: 4070933 - DNA, 17 bp, Homo sapiens
gtataaatggttgtctg

SEQ ID NO: 4070934 - DNA, 17 bp, Homo sapiens
gtataagaaatgcatat

SEQ ID NO: 4070935 - DNA, 20 bp, Homo sapiens
gtataagtggaggcacttta

SEQ ID NO: 4070936 - DNA, 21 bp, Homo sapiens
gtataagtggaggcactttag

SEQ ID NO: 4070937 - DNA, 23 bp, Homo sapiens
gtataagttatttttgtacatgt

SEQ ID NO: 4070938 - DNA, 13 bp, Homo sapiens
gtataatgtttaa

SEQ ID NO: 4070939 - DNA, 14 bp, Homo sapiens
gtataatgtttaaa

SEQ ID NO: 4070940 - DNA, 18 bp, Homo sapiens
gtataatgtttaaatcat

SEQ ID NO: 4070941 - DNA, 14 bp, Homo sapiens
gtataatttcgaga

SEQ ID NO: 4070942 - DNA, 23 bp, Homo sapiens
gtatacaccatatactgttcttc

SEQ ID NO: 4070943 - DNA, 14 bp, Homo sapiens
gtatagaccaaagc

SEQ ID NO: 4070944 - DNA, 16 bp, Homo sapiens
gtatagatgcaagata

SEQ ID NO: 4070945 - DNA, 15 bp, Homo sapiens
gtatagccatgattt

SEQ ID NO: 4070946 - DNA, 13 bp, Homo sapiens
gtatataatttta

SEQ ID NO: 4070947 - DNA, 16 bp, Homo sapiens
gtatatacagttattt

SEQ ID NO: 4070948 - DNA, 12 bp, Homo sapiens
gtatatactttg

SEQ ID NO: 4070949 - DNA, 21 bp, Homo sapiens
gtatatatatgccatgatgga

SEQ ID NO: 4070950 - DNA, 12 bp, Homo sapiens
gtatatcatgta

SEQ ID NO: 4070951 - DNA, 15 bp, Homo sapiens
gtatatgactgagcg

SEQ ID NO: 4070952 - DNA, 15 bp, Homo sapiens
gtatatgtgaaaaaa

SEQ ID NO: 4070953 - DNA, 17 bp, Homo sapiens
gtatattacacatttgt

SEQ ID NO: 4070954 - DNA, 18 bp, Homo sapiens
gtatattacacatttgta

SEQ ID NO: 4070955 - DNA, 22 bp, Homo sapiens
gtatattacacatttgtacaga

SEQ ID NO: 4070956 - DNA, 14 bp, Homo sapiens
gtatattgagaatc

SEQ ID NO: 4070957 - DNA, 19 bp, Homo sapiens
gtatattgtgtttgtgtat

SEQ ID NO: 4070958 - DNA, 21 bp, Homo sapiens
gtatcaggaaatatatatgtg

SEQ ID NO: 4070959 - DNA, 15 bp, Homo sapiens
gtatcaggtctccca

SEQ ID NO: 4070960 - DNA, 14 bp, Homo sapiens
gtatcagtgtcctt

SEQ ID NO: 4070961 - DNA, 19 bp, Homo sapiens
gtatcagtgttttaaattc

SEQ ID NO: 4070962 - DNA, 20 bp, Homo sapiens
gtatcagtgttttaaattct

SEQ ID NO: 4070963 - DNA, 22 bp, Homo sapiens
gtatcagtgttttaaattctga

SEQ ID NO: 4070964 - DNA, 23 bp, Homo sapiens
gtatcagtgttttaaattctgag

SEQ ID NO: 4070965 - DNA, 14 bp, Homo sapiens
gtatcatctggata

SEQ ID NO: 4070966 - DNA, 24 bp, Homo sapiens
gtatcatctggataggagcctgct

SEQ ID NO: 4070967 - DNA, 20 bp, Homo sapiens
gtatcccaaatctgtcagca

SEQ ID NO: 4070968 - DNA, 17 bp, Homo sapiens
gtatcctgcccagtgtt

SEQ ID NO: 4070969 - DNA, 15 bp, Homo sapiens
gtatcggagacagtg

SEQ ID NO: 4070970 - DNA, 15 bp, Homo sapiens
gtatcgtaaccagcc

SEQ ID NO: 4070971 - DNA, 16 bp, Homo sapiens
gtatctagtgcagctg

SEQ ID NO: 4070972 - DNA, 17 bp, Homo sapiens
gtatctagtgcagctga

SEQ ID NO: 4070973 - DNA, 13 bp, Homo sapiens
gtatctcagaaag

SEQ ID NO: 4070974 - DNA, 20 bp, Homo sapiens
gtatctcagaaagtgcctga

SEQ ID NO: 4070975 - DNA, 20 bp, Homo sapiens
gtatctctttcacattgttt

SEQ ID NO: 4070976 - DNA, 20 bp, Homo sapiens
gtatcttccatatttggaag

SEQ ID NO: 4070977 - DNA, 14 bp, Homo sapiens
gtatcttctatttt

SEQ ID NO: 4070978 - DNA, 15 bp, Homo sapiens
gtatctttccaggct

SEQ ID NO: 4070979 - DNA, 17 bp, Homo sapiens
gtatcttttatcctggg

SEQ ID NO: 4070980 - DNA, 18 bp, Homo sapiens
gtatgaaggaatcattcc

SEQ ID NO: 4070981 - DNA, 18 bp, Homo sapiens
gtatgaataaagacacct

SEQ ID NO: 4070982 - DNA, 20 bp, Homo sapiens
gtatgagtcaatgtgcagtg

SEQ ID NO: 4070983 - DNA, 21 bp, Homo sapiens
gtatgagtcaatgtgcagtgt

SEQ ID NO: 4070984 - DNA, 23 bp, Homo sapiens
gtatgatctctctagctttgtca

SEQ ID NO: 4070985 - DNA, 21 bp, Homo sapiens
gtatgatttgttttgaatttt

SEQ ID NO: 4070986 - DNA, 22 bp, Homo sapiens
gtatgatttgttttgaattttg

SEQ ID NO: 4070987 - DNA, 13 bp, Homo sapiens
gtatgctgatcat

SEQ ID NO: 4070988 - DNA, 13 bp, Homo sapiens
gtatgctggccag

SEQ ID NO: 4070989 - DNA, 23 bp, Homo sapiens
gtatgctggccagcaccctctcc

SEQ ID NO: 4070990 - DNA, 14 bp, Homo sapiens
gtatggaaacactg

SEQ ID NO: 4070991 - DNA, 17 bp, Homo sapiens
gtatggaagttttccta

SEQ ID NO: 4070992 - DNA, 11 bp, Homo sapiens
gtatgtctgcc

SEQ ID NO: 4070993 - DNA, 21 bp, Homo sapiens
gtatgtgacaccaaagccacc

SEQ ID NO: 4070994 - DNA, 16 bp, Homo sapiens
gtatgtgcactgtcac

SEQ ID NO: 4070995 - DNA, 14 bp, Homo sapiens
gtattaatatatag

SEQ ID NO: 4070996 - DNA, 15 bp, Homo sapiens
gtattattctgcagc

SEQ ID NO: 4070997 - DNA, 12 bp, Homo sapiens
gtattatttata

SEQ ID NO: 4070998 - DNA, 13 bp, Homo sapiens
gtattctcagagc

SEQ ID NO: 4070999 - DNA, 13 bp, Homo sapiens
gtattgcacattg

SEQ ID NO: 4071000 - DNA, 21 bp, Homo sapiens
gtattgcacattgtaaaaagt

SEQ ID NO: 4071001 - DNA, 11 bp, Homo sapiens
gtattgctgct

SEQ ID NO: 4071002 - DNA, 14 bp, Homo sapiens
gtattgctgctgtg

SEQ ID NO: 4071003 - DNA, 15 bp, Homo sapiens
gtattgctgctgtgc

SEQ ID NO: 4071004 - DNA, 18 bp, Homo sapiens
gtattggagcacatgtta

SEQ ID NO: 4071005 - DNA, 20 bp, Homo sapiens
gtattggagcacatgttact

SEQ ID NO: 4071006 - DNA, 11 bp, Homo sapiens
gtattgttccc

SEQ ID NO: 4071007 - DNA, 17 bp, Homo sapiens
gtatttacgctttgatt

SEQ ID NO: 4071008 - DNA, 19 bp, Homo sapiens
gtatttacgctttgattca

SEQ ID NO: 4071009 - DNA, 17 bp, Homo sapiens
gtatttatatatttata

SEQ ID NO: 4071010 - DNA, 14 bp, Homo sapiens
gtccagtgctctgc

SEQ ID NO: 4071011 - DNA, 16 bp, Homo sapiens
gtccagtgtcacctct

SEQ ID NO: 4071012 - DNA, 21 bp, Homo sapiens
gtccatatcagaactgtgcca

SEQ ID NO: 4071013 - DNA, 18 bp, Homo sapiens
gtccatatttacattcta

SEQ ID NO: 4071014 - DNA, 14 bp, Homo sapiens
gtccatgcccactg

SEQ ID NO: 4071015 - DNA, 19 bp, Homo sapiens
gtccatgcccactgctggt

SEQ ID NO: 4071016 - DNA, 13 bp, Homo sapiens
gtccattctccca

SEQ ID NO: 4071017 - DNA, 15 bp, Homo sapiens
gtccattctcccagg

SEQ ID NO: 4071018 - DNA, 19 bp, Homo sapiens
gtccatttatatatgaaaa

SEQ ID NO: 4071019 - DNA, 21 bp, Homo sapiens
gtcccaaatatgtattttcct

SEQ ID NO: 4071020 - DNA, 16 bp, Homo sapiens
gtcccaaggaaagccc

SEQ ID NO: 4071021 - DNA, 17 bp, Homo sapiens
gtcccacactggtgact

SEQ ID NO: 4071022 - DNA, 17 bp, Homo sapiens
gtcccacccacacagct

SEQ ID NO: 4071023 - DNA, 19 bp, Homo sapiens
gtcccacccacacagctgc

SEQ ID NO: 4071024 - DNA, 19 bp, Homo sapiens
gtcccacccccacccccag

SEQ ID NO: 4071025 - DNA, 21 bp, Homo sapiens
gtcccacccccacccccagct

SEQ ID NO: 4071026 - DNA, 18 bp, Homo sapiens
gtcccacccctagccacc

SEQ ID NO: 4071027 - DNA, 21 bp, Homo sapiens
gtcccacgtgtcttccacttt

SEQ ID NO: 4071028 - DNA, 14 bp, Homo sapiens
gtcccagcatccct

SEQ ID NO: 4071029 - DNA, 16 bp, Homo sapiens
gtcccagcatccctgg

SEQ ID NO: 4071030 - DNA, 18 bp, Homo sapiens
gtcccagcatccctggag

SEQ ID NO: 4071031 - DNA, 18 bp, Homo sapiens
gtcccagccaccccgggc

SEQ ID NO: 4071032 - DNA, 23 bp, Homo sapiens
gtcccagccaccccgggctctct

SEQ ID NO: 4071033 - DNA, 23 bp, Homo sapiens
gtcccagttttgttgccccagaa

SEQ ID NO: 4071034 - DNA, 17 bp, Homo sapiens
gtcccatgatccctgtg

SEQ ID NO: 4071035 - DNA, 18 bp, Homo sapiens
gtcccatgtgagctgctg

SEQ ID NO: 4071036 - DNA, 22 bp, Homo sapiens
gtcccatgtgagctgctgccat

SEQ ID NO: 4071037 - DNA, 15 bp, Homo sapiens
gtcccatttccttgg

SEQ ID NO: 4071038 - DNA, 20 bp, Homo sapiens
gtcccatttccttggaggcc

SEQ ID NO: 4071039 - DNA, 14 bp, Homo sapiens
gtccccacccctgc

SEQ ID NO: 4071040 - DNA, 17 bp, Homo sapiens
gtccccactcaccccct

SEQ ID NO: 4071041 - DNA, 13 bp, Homo sapiens
gtccccagccctg

SEQ ID NO: 4071042 - DNA, 19 bp, Homo sapiens
gtccccagccctgtcctgg

SEQ ID NO: 4071043 - DNA, 12 bp, Homo sapiens
gtccccatcccc

SEQ ID NO: 4071044 - DNA, 13 bp, Homo sapiens
gtccccatcccca

SEQ ID NO: 4071045 - DNA, 16 bp, Homo sapiens
gtccccatccccacca

SEQ ID NO: 4071046 - DNA, 19 bp, Homo sapiens
gtccccatccccaccagct

SEQ ID NO: 4071047 - DNA, 21 bp, Homo sapiens
gtccccatccccaccagctcg

SEQ ID NO: 4071048 - DNA, 15 bp, Homo sapiens
gtccccctacccacc

SEQ ID NO: 4071049 - DNA, 16 bp, Homo sapiens
gtccccctacccaccg

SEQ ID NO: 4071050 - DNA, 19 bp, Homo sapiens
gtccccctcccctcccagt

SEQ ID NO: 4071051 - DNA, 23 bp, Homo sapiens
gtccccctcccctcccagtcctc

SEQ ID NO: 4071052 - DNA, 13 bp, Homo sapiens
gtcccctcactct

SEQ ID NO: 4071053 - DNA, 15 bp, Homo sapiens
gtcccctcactctgt

SEQ ID NO: 4071054 - DNA, 17 bp, Homo sapiens
gtcccctcactctgtca

SEQ ID NO: 4071055 - DNA, 19 bp, Homo sapiens
gtcccctcactctgtcagc

SEQ ID NO: 4071056 - DNA, 20 bp, Homo sapiens
gtcccctcactctgtcagcc

SEQ ID NO: 4071057 - DNA, 19 bp, Homo sapiens
gtcccctccacatcccagc

SEQ ID NO: 4071058 - DNA, 22 bp, Homo sapiens
gtcccctccttccctcaccccc

SEQ ID NO: 4071059 - DNA, 12 bp, Homo sapiens
gtccccttcccg

SEQ ID NO: 4071060 - DNA, 15 bp, Homo sapiens
gtcccgaatccacag

SEQ ID NO: 4071061 - DNA, 20 bp, Homo sapiens
gtcccgtctggacctgggga

SEQ ID NO: 4071062 - DNA, 21 bp, Homo sapiens
gtccctaccgagtctcttctc

SEQ ID NO: 4071063 - DNA, 16 bp, Homo sapiens
gtccctacctgcttca

SEQ ID NO: 4071064 - DNA, 15 bp, Homo sapiens
gtccctatgcatatc

SEQ ID NO: 4071065 - DNA, 19 bp, Homo sapiens
gtccctcactccacagagt

SEQ ID NO: 4071066 - DNA, 14 bp, Homo sapiens
gtccctcccttgct

SEQ ID NO: 4071067 - DNA, 15 bp, Homo sapiens
gtccctctttggcag

SEQ ID NO: 4071068 - DNA, 17 bp, Homo sapiens
gtccctgggccagggtc

SEQ ID NO: 4071069 - DNA, 16 bp, Homo sapiens
gtccctgtccctctag

SEQ ID NO: 4071070 - DNA, 20 bp, Homo sapiens
gtccctgtccctctagtgcc

SEQ ID NO: 4071071 - DNA, 12 bp, Homo sapiens
gtccctgttaga

SEQ ID NO: 4071072 - DNA, 12 bp, Homo sapiens
gtcccttcccct

SEQ ID NO: 4071073 - DNA, 13 bp, Homo sapiens
gtcccttcccctc

SEQ ID NO: 4071074 - DNA, 17 bp, Homo sapiens
gtcccttcccctccctg

SEQ ID NO: 4071075 - DNA, 18 bp, Homo sapiens
gtcccttcccctccctgg

SEQ ID NO: 4071076 - DNA, 22 bp, Homo sapiens
gtcccttcccctccctggctcc

SEQ ID NO: 4071077 - DNA, 18 bp, Homo sapiens
tgccccagctgactgtgg

SEQ ID NO: 4071078 - DNA, 20 bp, Homo sapiens
tgccccagctgactgtggcc

SEQ ID NO: 4071079 - DNA, 14 bp, Homo sapiens
tgccccaggaccag

SEQ ID NO: 4071080 - DNA, 14 bp, Homo sapiens
tgccccaggcctga

SEQ ID NO: 4071081 - DNA, 17 bp, Homo sapiens
tgccccagggagtccag

SEQ ID NO: 4071082 - DNA, 18 bp, Homo sapiens
tgccccagggagtccagg

SEQ ID NO: 4071083 - DNA, 21 bp, Homo sapiens
tgccccagtcggccccatctc

SEQ ID NO: 4071084 - DNA, 22 bp, Homo sapiens
tgccccagtcggccccatctct

SEQ ID NO: 4071085 - DNA, 23 bp, Homo sapiens
tgccccatgcctgtccagcctgg

SEQ ID NO: 4071086 - DNA, 17 bp, Homo sapiens
tgcccccactgaccaga

SEQ ID NO: 4071087 - DNA, 12 bp, Homo sapiens
tgcccccactgt

SEQ ID NO: 4071088 - DNA, 20 bp, Homo sapiens
tgcccccagccccggggtga

SEQ ID NO: 4071089 - DNA, 17 bp, Homo sapiens
tgccccccgccctcatg

SEQ ID NO: 4071090 - DNA, 15 bp, Homo sapiens
tgcccccggccccct

SEQ ID NO: 4071091 - DNA, 17 bp, Homo sapiens
tgcccccggccccctgg

SEQ ID NO: 4071092 - DNA, 13 bp, Homo sapiens
tgccccctcacct

SEQ ID NO: 4071093 - DNA, 17 bp, Homo sapiens
tgccccggcccctcccc

SEQ ID NO: 4071094 - DNA, 18 bp, Homo sapiens
tgcccctaatctctgtag

SEQ ID NO: 4071095 - DNA, 21 bp, Homo sapiens
tgcccctaatctctgtaggaa

SEQ ID NO: 4071096 - DNA, 12 bp, Homo sapiens
tgcccctcacct

SEQ ID NO: 4071097 - DNA, 22 bp, Homo sapiens
tgcccctcaccttgggctgggg

SEQ ID NO: 4071098 - DNA, 15 bp, Homo sapiens
tgcccctcccttcaa

SEQ ID NO: 4071099 - DNA, 15 bp, Homo sapiens
tgcccctctcaccaa

SEQ ID NO: 4071100 - DNA, 22 bp, Homo sapiens
tgcccctggcccatctcagcct

SEQ ID NO: 4071101 - DNA, 16 bp, Homo sapiens
tgcccctggctttgcc

SEQ ID NO: 4071102 - DNA, 20 bp, Homo sapiens
tgcccctggctttgcctctt

SEQ ID NO: 4071103 - DNA, 19 bp, Homo sapiens
tgccccttcccatctcttc

SEQ ID NO: 4071104 - DNA, 22 bp, Homo sapiens
tgccccttggctggatcaggga

SEQ ID NO: 4071105 - DNA, 17 bp, Homo sapiens
tgcccctttcaggccta

SEQ ID NO: 4071106 - DNA, 19 bp, Homo sapiens
tgcccgaaactaagccagg

SEQ ID NO: 4071107 - DNA, 16 bp, Homo sapiens
tgcccgactgactgga

SEQ ID NO: 4071108 - DNA, 13 bp, Homo sapiens
tgcccgagctggt

SEQ ID NO: 4071109 - DNA, 16 bp, Homo sapiens
tgcccgagctggtgca

SEQ ID NO: 4071110 - DNA, 19 bp, Homo sapiens
tgcccgctccatggaaaag

SEQ ID NO: 4071111 - DNA, 19 bp, Homo sapiens
tgcccgctgcaatgcctag

SEQ ID NO: 4071112 - DNA, 22 bp, Homo sapiens
tgcccgctgcaatgcctagact

SEQ ID NO: 4071113 - DNA, 21 bp, Homo sapiens
tgcccggagattggacggcct

SEQ ID NO: 4071114 - DNA, 19 bp, Homo sapiens
tgccctaagcccccagggc

SEQ ID NO: 4071115 - DNA, 20 bp, Homo sapiens
tgccctaagcccccagggcc

SEQ ID NO: 4071116 - DNA, 19 bp, Homo sapiens
tgccctactcattggggtt

SEQ ID NO: 4071117 - DNA, 15 bp, Homo sapiens
tgccctactgggaga

SEQ ID NO: 4071118 - DNA, 16 bp, Homo sapiens
tgccctagcccagact

SEQ ID NO: 4071119 - DNA, 21 bp, Homo sapiens
tgccctagcccagactctgag

SEQ ID NO: 4071120 - DNA, 23 bp, Homo sapiens
tgccctagcccagactctgagct

SEQ ID NO: 4071121 - DNA, 15 bp, Homo sapiens
tgccctagctgaccc

SEQ ID NO: 4071122 - DNA, 21 bp, Homo sapiens
tgccctatggatttgaagttt

SEQ ID NO: 4071123 - DNA, 16 bp, Homo sapiens
tgccctatgggcctgc

SEQ ID NO: 4071124 - DNA, 12 bp, Homo sapiens
tgccctcaggga

SEQ ID NO: 4071125 - DNA, 19 bp, Homo sapiens
tgccctcatggcccctctg

SEQ ID NO: 4071126 - DNA, 18 bp, Homo sapiens
tgccctcattactgggcc

SEQ ID NO: 4071127 - DNA, 23 bp, Homo sapiens
tgccctcattactgggccttagt

SEQ ID NO: 4071128 - DNA, 17 bp, Homo sapiens
tgccctcgctgcttctg

SEQ ID NO: 4071129 - DNA, 20 bp, Homo sapiens
tgccctctctgagtctggac

SEQ ID NO: 4071130 - DNA, 20 bp, Homo sapiens
tgccctcttctcgtgcctcc

SEQ ID NO: 4071131 - DNA, 11 bp, Homo sapiens
tgccctgagaa

SEQ ID NO: 4071132 - DNA, 20 bp, Homo sapiens
tgccctgagaagctgctcca

SEQ ID NO: 4071133 - DNA, 22 bp, Homo sapiens
tgccctgagtggatctccaagg

SEQ ID NO: 4071134 - DNA, 22 bp, Homo sapiens
tgccctggcagggtcatcctgt

SEQ ID NO: 4071135 - DNA, 11 bp, Homo sapiens
tgccctggctg

SEQ ID NO: 4071136 - DNA, 15 bp, Homo sapiens
tgccctggctgctgc

SEQ ID NO: 4071137 - DNA, 20 bp, Homo sapiens
tgccctggctgctgccccca

SEQ ID NO: 4071138 - DNA, 13 bp, Homo sapiens
tgccctgggccac

SEQ ID NO: 4071139 - DNA, 21 bp, Homo sapiens
tgccctggtccagggaagctg

SEQ ID NO: 4071140 - DNA, 21 bp, Homo sapiens
tgccctgtccaaaagcgccct

SEQ ID NO: 4071141 - DNA, 12 bp, Homo sapiens
tgccctgtccct

SEQ ID NO: 4071142 - DNA, 23 bp, Homo sapiens
tgccctgttcatgtgcctctgcg

SEQ ID NO: 4071143 - DNA, 20 bp, Homo sapiens
tgcccttcaccccagtggcc

SEQ ID NO: 4071144 - DNA, 14 bp, Homo sapiens
tgcccttctcaaga

SEQ ID NO: 4071145 - DNA, 17 bp, Homo sapiens
tgcccttctcaagactt

SEQ ID NO: 4071146 - DNA, 15 bp, Homo sapiens
tgccctttgtcctcc

SEQ ID NO: 4071147 - DNA, 17 bp, Homo sapiens
tgccctttgtcctcctg

SEQ ID NO: 4071148 - DNA, 19 bp, Homo sapiens
tgccctttgtcctcctgct

SEQ ID NO: 4071149 - DNA, 16 bp, Homo sapiens
tgcccttttcaggaag

SEQ ID NO: 4071150 - DNA, 15 bp, Homo sapiens
tgccgcagacgggca

SEQ ID NO: 4071151 - DNA, 17 bp, Homo sapiens
tgccgcagacgggcaca

SEQ ID NO: 4071152 - DNA, 21 bp, Homo sapiens
tgccgcagacgggcacagaca

SEQ ID NO: 4071153 - DNA, 22 bp, Homo sapiens
tgccgctgatgtttggccgtga

SEQ ID NO: 4071154 - DNA, 14 bp, Homo sapiens
tgccgctgcaccac

SEQ ID NO: 4071155 - DNA, 17 bp, Homo sapiens
tgccttgaacctgtgag

SEQ ID NO: 4071156 - DNA, 19 bp, Homo sapiens
tgccttgcagccacatggc

SEQ ID NO: 4071157 - DNA, 21 bp, Homo sapiens
tgccttgcagccacatggccc

SEQ ID NO: 4071158 - DNA, 22 bp, Homo sapiens
tgccttgcagccacatggcccc

SEQ ID NO: 4071159 - DNA, 16 bp, Homo sapiens
tgccttgctcctagca

SEQ ID NO: 4071160 - DNA, 18 bp, Homo sapiens
tgccttgctcctagcaga

SEQ ID NO: 4071161 - DNA, 15 bp, Homo sapiens
tgccttgctcggcgc

SEQ ID NO: 4071162 - DNA, 21 bp, Homo sapiens
tgccttgcttctgtatttcct

SEQ ID NO: 4071163 - DNA, 19 bp, Homo sapiens
tgccttggcctcccaaagt

SEQ ID NO: 4071164 - DNA, 13 bp, Homo sapiens
tgccttggctcag

SEQ ID NO: 4071165 - DNA, 16 bp, Homo sapiens
tgccttggctcagaca

SEQ ID NO: 4071166 - DNA, 19 bp, Homo sapiens
tgccttggctcagacatgt

SEQ ID NO: 4071167 - DNA, 19 bp, Homo sapiens
tgccttgggccttgctgct

SEQ ID NO: 4071168 - DNA, 22 bp, Homo sapiens
tgccttgggccttgctgctgct

SEQ ID NO: 4071169 - DNA, 16 bp, Homo sapiens
tgcctttatttgctgt

SEQ ID NO: 4071170 - DNA, 15 bp, Homo sapiens
tgcctttctgggagc

SEQ ID NO: 4071171 - DNA, 14 bp, Homo sapiens
tgcctttcttctgc

SEQ ID NO: 4071172 - DNA, 12 bp, Homo sapiens
tgcctttctttg

SEQ ID NO: 4071173 - DNA, 22 bp, Homo sapiens
tgcctttctttgcctctgcagt

SEQ ID NO: 4071174 - DNA, 17 bp, Homo sapiens
tgcctttgagacagttt

SEQ ID NO: 4071175 - DNA, 18 bp, Homo sapiens
tgcctttgagacagtttc

SEQ ID NO: 4071176 - DNA, 20 bp, Homo sapiens
tgcctttgagacagtttctt

SEQ ID NO: 4071177 - DNA, 21 bp, Homo sapiens
tgcctttgagacagtttctta

SEQ ID NO: 4071178 - DNA, 13 bp, Homo sapiens
tgcctttggcctg

SEQ ID NO: 4071179 - DNA, 16 bp, Homo sapiens
tgcctttgtaagttat

SEQ ID NO: 4071180 - DNA, 15 bp, Homo sapiens
tgcctttgttttgat

SEQ ID NO: 4071181 - DNA, 16 bp, Homo sapiens
tgccttttgcagaaga

SEQ ID NO: 4071182 - DNA, 17 bp, Homo sapiens
tgccttttgcagaagag

SEQ ID NO: 4071183 - DNA, 12 bp, Homo sapiens
tgccttttgtgt

SEQ ID NO: 4071184 - DNA, 19 bp, Homo sapiens
tgccttttttgtagttttt

SEQ ID NO: 4071185 - DNA, 20 bp, Homo sapiens
tgcgaagaccctcttgccca

SEQ ID NO: 4071186 - DNA, 15 bp, Homo sapiens
tgcgacggagagaaa

SEQ ID NO: 4071187 - DNA, 16 bp, Homo sapiens
tgcgacggagagaaaa

SEQ ID NO: 4071188 - DNA, 21 bp, Homo sapiens
tgcgagacgcacacagctgag

SEQ ID NO: 4071189 - DNA, 20 bp, Homo sapiens
tgcgagtccaaggccagtcc

SEQ ID NO: 4071190 - DNA, 17 bp, Homo sapiens
tgcgatcttcagagcag

SEQ ID NO: 4071191 - DNA, 18 bp, Homo sapiens
tgcgatcttcagagcagg

SEQ ID NO: 4071192 - DNA, 13 bp, Homo sapiens
tgcgatttcttcc

SEQ ID NO: 4071193 - DNA, 18 bp, Homo sapiens
tgcgcaccaatgcccagc

SEQ ID NO: 4071194 - DNA, 15 bp, Homo sapiens
tgcgcataggcctgc

SEQ ID NO: 4071195 - DNA, 15 bp, Homo sapiens
tgcgcccttaccttc

SEQ ID NO: 4071196 - DNA, 17 bp, Homo sapiens
tgcgcctcagccctcag

SEQ ID NO: 4071197 - DNA, 14 bp, Homo sapiens
tgcgcctccagagg

SEQ ID NO: 4071198 - DNA, 16 bp, Homo sapiens
tgcgcctgctgcctgc

SEQ ID NO: 4071199 - DNA, 17 bp, Homo sapiens
tgcgcctgctgcctgct

SEQ ID NO: 4071200 - DNA, 19 bp, Homo sapiens
tgcgcctgtgatgctgggc

SEQ ID NO: 4071201 - DNA, 21 bp, Homo sapiens
tgcgctggtggaccacaggca

SEQ ID NO: 4071202 - DNA, 17 bp, Homo sapiens
tgcgggagtagttggaa

SEQ ID NO: 4071203 - DNA, 18 bp, Homo sapiens
tgcgggtgaacaaagcag

SEQ ID NO: 4071204 - DNA, 15 bp, Homo sapiens
tgcggtgggtgctgc

SEQ ID NO: 4071205 - DNA, 19 bp, Homo sapiens
tgcgtatgtctgttaccat

SEQ ID NO: 4071206 - DNA, 17 bp, Homo sapiens
tgcgtattggctttttc

SEQ ID NO: 4071207 - DNA, 19 bp, Homo sapiens
tgcgtcctcctcacctcat

SEQ ID NO: 4071208 - DNA, 15 bp, Homo sapiens
tgcgtcttggtgtaa

SEQ ID NO: 4071209 - DNA, 14 bp, Homo sapiens
tgcgtgaaacacac

SEQ ID NO: 4071210 - DNA, 22 bp, Homo sapiens
tgcgtgaaacacaccaggctgt

SEQ ID NO: 4071211 - DNA, 12 bp, Homo sapiens
tgcgtgaatgta

SEQ ID NO: 4071212 - DNA, 17 bp, Homo sapiens
tgcgtgacaataaaaca

SEQ ID NO: 4071213 - DNA, 15 bp, Homo sapiens
tgcgtgccgtgtgag

SEQ ID NO: 4071214 - DNA, 23 bp, Homo sapiens
tgcgtgccgtgtgagtgtgacag

SEQ ID NO: 4071215 - DNA, 13 bp, Homo sapiens
tgcgtggaaaaag

SEQ ID NO: 4071216 - DNA, 14 bp, Homo sapiens
tgcgtgtgtagagt

SEQ ID NO: 4071217 - DNA, 14 bp, Homo sapiens
tgcgtttttacagt

SEQ ID NO: 4071218 - DNA, 11 bp, Homo sapiens
tgctaaaattc

SEQ ID NO: 4071219 - DNA, 16 bp, Homo sapiens
tgctaaagcctgtggg

SEQ ID NO: 4071220 - DNA, 19 bp, Homo sapiens
tgctaaagcctgtgggttt

SEQ ID NO: 4071221 - DNA, 18 bp, Homo sapiens
tgctaaattctatgttaa

SEQ ID NO: 4071222 - DNA, 13 bp, Homo sapiens
tgctaacaaagac

SEQ ID NO: 4071223 - DNA, 13 bp, Homo sapiens
tgctaacatctaa

SEQ ID NO: 4071224 - DNA, 19 bp, Homo sapiens
tgctaagaagcctataaga

SEQ ID NO: 4071225 - DNA, 21 bp, Homo sapiens
tgctaagtaaatctcttctgt

SEQ ID NO: 4071226 - DNA, 12 bp, Homo sapiens
tgctaataaaac

SEQ ID NO: 4071227 - DNA, 17 bp, Homo sapiens
tgctaataaactgtttt

SEQ ID NO: 4071228 - DNA, 14 bp, Homo sapiens
tgctaatgtaaact

SEQ ID NO: 4071229 - DNA, 15 bp, Homo sapiens
tgctaattaaaaagt

SEQ ID NO: 4071230 - DNA, 14 bp, Homo sapiens
tgctaatttagaga

SEQ ID NO: 4071231 - DNA, 15 bp, Homo sapiens
tgctaattttctcaa

SEQ ID NO: 4071232 - DNA, 12 bp, Homo sapiens
tgctacaatgtc

SEQ ID NO: 4071233 - DNA, 20 bp, Homo sapiens
tgctaccacggcctcctttc

SEQ ID NO: 4071234 - DNA, 17 bp, Homo sapiens
tgctaccgccctgggct

SEQ ID NO: 4071235 - DNA, 20 bp, Homo sapiens
tgctaccgccctgggctgga

SEQ ID NO: 4071236 - DNA, 23 bp, Homo sapiens
tgctaccgccctgggctggactg

SEQ ID NO: 4071237 - DNA, 15 bp, Homo sapiens
tgctacctcccttgc

SEQ ID NO: 4071238 - DNA, 18 bp, Homo sapiens
tgctactaagttcacatt

SEQ ID NO: 4071239 - DNA, 20 bp, Homo sapiens
tgctactgcactccagcctg

SEQ ID NO: 4071240 - DNA, 16 bp, Homo sapiens
tgctagaaaatttagc

SEQ ID NO: 4071241 - DNA, 13 bp, Homo sapiens
tgctagataaaag

SEQ ID NO: 4071242 - DNA, 19 bp, Homo sapiens
tgctagatgtgcaaatgca

SEQ ID NO: 4071243 - DNA, 20 bp, Homo sapiens
tgctagatgtgcaaatgcaa

SEQ ID NO: 4071244 - DNA, 18 bp, Homo sapiens
tgctagcagtaaaagatg

SEQ ID NO: 4071245 - DNA, 16 bp, Homo sapiens
tgctagcttgacacag

SEQ ID NO: 4071246 - DNA, 20 bp, Homo sapiens
tgctaggatgcggaaatccc

SEQ ID NO: 4071247 - DNA, 18 bp, Homo sapiens
tgctaggcgagtgccagg

SEQ ID NO: 4071248 - DNA, 21 bp, Homo sapiens
tgctaggcgagtgccaggact

SEQ ID NO: 4071249 - DNA, 23 bp, Homo sapiens
tgctaggttaattccaattatat

SEQ ID NO: 4071250 - DNA, 13 bp, Homo sapiens
tgctagtatttga

SEQ ID NO: 4071251 - DNA, 13 bp, Homo sapiens
tgctagttttaca

SEQ ID NO: 4071252 - DNA, 23 bp, Homo sapiens
tgctataggctggagaagctcac

SEQ ID NO: 4071253 - DNA, 22 bp, Homo sapiens
tgctatccccatctccctgcct

SEQ ID NO: 4071254 - DNA, 20 bp, Homo sapiens
tgctatcctgccaaaatcat

SEQ ID NO: 4071255 - DNA, 12 bp, Homo sapiens
tgctatttatgc

SEQ ID NO: 4071256 - DNA, 15 bp, Homo sapiens
tgctcaaaaatctgt

SEQ ID NO: 4071257 - DNA, 13 bp, Homo sapiens
tgctcaaagaaat

SEQ ID NO: 4071258 - DNA, 13 bp, Homo sapiens
tgggccagacatg

SEQ ID NO: 4071259 - DNA, 20 bp, Homo sapiens
tgggccagcggggctgctca

SEQ ID NO: 4071260 - DNA, 12 bp, Homo sapiens
tgggccagggct

SEQ ID NO: 4071261 - DNA, 13 bp, Homo sapiens
tgggccagggctg

SEQ ID NO: 4071262 - DNA, 20 bp, Homo sapiens
tgggccagggctgccctgag

SEQ ID NO: 4071263 - DNA, 22 bp, Homo sapiens
tgggccagggctgccctgagaa

SEQ ID NO: 4071264 - DNA, 17 bp, Homo sapiens
tgggccatgtccaaaga

SEQ ID NO: 4071265 - DNA, 19 bp, Homo sapiens
tgggccatgtccaaagagg

SEQ ID NO: 4071266 - DNA, 23 bp, Homo sapiens
tgggccatgtccaaagaggctgc

SEQ ID NO: 4071267 - DNA, 22 bp, Homo sapiens
tgggcccaagacagatgcccca

SEQ ID NO: 4071268 - DNA, 23 bp, Homo sapiens
tgggcccaagacagatgccccag

SEQ ID NO: 4071269 - DNA, 14 bp, Homo sapiens
tgggcccacatccg

SEQ ID NO: 4071270 - DNA, 22 bp, Homo sapiens
tgggcccagaactgcccccact

SEQ ID NO: 4071271 - DNA, 15 bp, Homo sapiens
tgggcccaggggctg

SEQ ID NO: 4071272 - DNA, 18 bp, Homo sapiens
tgggcccctccacgcctc

SEQ ID NO: 4071273 - DNA, 17 bp, Homo sapiens
tgggcccctcttattcc

SEQ ID NO: 4071274 - DNA, 18 bp, Homo sapiens
tgggccctctctctgggc

SEQ ID NO: 4071275 - DNA, 23 bp, Homo sapiens
tgggccctctttccctgcgagac

SEQ ID NO: 4071276 - DNA, 11 bp, Homo sapiens
tgggccctgga

SEQ ID NO: 4071277 - DNA, 12 bp, Homo sapiens
tgggccctggag

SEQ ID NO: 4071278 - DNA, 16 bp, Homo sapiens
tgggcctcaaggactt

SEQ ID NO: 4071279 - DNA, 20 bp, Homo sapiens
tgggcctcagttcaacctgg

SEQ ID NO: 4071280 - DNA, 22 bp, Homo sapiens
tgggcctcccttgggctggaag

SEQ ID NO: 4071281 - DNA, 20 bp, Homo sapiens
tgggcctgccgggctgaggg

SEQ ID NO: 4071282 - DNA, 18 bp, Homo sapiens
tgggcctgctccagacct

SEQ ID NO: 4071283 - DNA, 15 bp, Homo sapiens
tgggcctgggcctct

SEQ ID NO: 4071284 - DNA, 22 bp, Homo sapiens
tgggcctgtcgtgccagtcctg

SEQ ID NO: 4071285 - DNA, 23 bp, Homo sapiens
tgggccttagtgggccagggctg

SEQ ID NO: 4071286 - DNA, 23 bp, Homo sapiens
tgggcgtgctagaggttgcagca

SEQ ID NO: 4071287 - DNA, 16 bp, Homo sapiens
tgggcgttgggagcct

SEQ ID NO: 4071288 - DNA, 17 bp, Homo sapiens
tgggctaattaaataaa

SEQ ID NO: 4071289 - DNA, 19 bp, Homo sapiens
tgggctacatgctggggtc

SEQ ID NO: 4071290 - DNA, 21 bp, Homo sapiens
tgggctattgctgctgcccct

SEQ ID NO: 4071291 - DNA, 22 bp, Homo sapiens
tgggctcaagcaatcctcctgc

SEQ ID NO: 4071292 - DNA, 14 bp, Homo sapiens
tgggctcagcacat

SEQ ID NO: 4071293 - DNA, 20 bp, Homo sapiens
tgggctctgcaattcccctc

SEQ ID NO: 4071294 - DNA, 17 bp, Homo sapiens
tgggctctgtgcagtca

SEQ ID NO: 4071295 - DNA, 16 bp, Homo sapiens
tgggctgaccaggctt

SEQ ID NO: 4071296 - DNA, 16 bp, Homo sapiens
tgggctgccatgtgaa

SEQ ID NO: 4071297 - DNA, 21 bp, Homo sapiens
tgggctgccctggtgctgcca

SEQ ID NO: 4071298 - DNA, 15 bp, Homo sapiens
tgggctgctcctcat

SEQ ID NO: 4071299 - DNA, 19 bp, Homo sapiens
tgggctgctgcaggccgtg

SEQ ID NO: 4071300 - DNA, 14 bp, Homo sapiens
tgggctggactgga

SEQ ID NO: 4071301 - DNA, 18 bp, Homo sapiens
tgggctggtgccccacag

SEQ ID NO: 4071302 - DNA, 19 bp, Homo sapiens
tgggctggtgccccacagc

SEQ ID NO: 4071303 - DNA, 20 bp, Homo sapiens
tgggctggtgccccacagct

SEQ ID NO: 4071304 - DNA, 20 bp, Homo sapiens
tgggctgtaacgtggcactg

SEQ ID NO: 4071305 - DNA, 15 bp, Homo sapiens
tgggctgtctgtcac

SEQ ID NO: 4071306 - DNA, 12 bp, Homo sapiens
tgggctgtgagt

SEQ ID NO: 4071307 - DNA, 16 bp, Homo sapiens
tgggcttagtatttct

SEQ ID NO: 4071308 - DNA, 20 bp, Homo sapiens
tgggcttagtatttctcagg

SEQ ID NO: 4071309 - DNA, 23 bp, Homo sapiens
tgggcttagtatttctcaggaag

SEQ ID NO: 4071310 - DNA, 17 bp, Homo sapiens
tgggcttcactgtataa

SEQ ID NO: 4071311 - DNA, 14 bp, Homo sapiens
tgggcttcctgccc

SEQ ID NO: 4071312 - DNA, 20 bp, Homo sapiens
tgggcttcctgcccttccct

SEQ ID NO: 4071313 - DNA, 14 bp, Homo sapiens
tgggcttgattctg

SEQ ID NO: 4071314 - DNA, 14 bp, Homo sapiens
tgggcttggcctgc

SEQ ID NO: 4071315 - DNA, 17 bp, Homo sapiens
tgggcttggcctgctgt

SEQ ID NO: 4071316 - DNA, 18 bp, Homo sapiens
tgggcttggcctgctgtg

SEQ ID NO: 4071317 - DNA, 14 bp, Homo sapiens
tgggcttgttttct

SEQ ID NO: 4071318 - DNA, 14 bp, Homo sapiens
tggggaaaaaagca

SEQ ID NO: 4071319 - DNA, 16 bp, Homo sapiens
tggggaaaaaagcaca

SEQ ID NO: 4071320 - DNA, 23 bp, Homo sapiens
tggggaaaaaagcacatacatta

SEQ ID NO: 4071321 - DNA, 20 bp, Homo sapiens
tggggaaaggggttggggtg

SEQ ID NO: 4071322 - DNA, 14 bp, Homo sapiens
tggggaaatgtgga

SEQ ID NO: 4071323 - DNA, 16 bp, Homo sapiens
tggggaaatgtggaga

SEQ ID NO: 4071324 - DNA, 11 bp, Homo sapiens
tggggaaggag

SEQ ID NO: 4071325 - DNA, 19 bp, Homo sapiens
tggggaccccaacctcaga

SEQ ID NO: 4071326 - DNA, 22 bp, Homo sapiens
tggggacccccacgattggcca

SEQ ID NO: 4071327 - DNA, 14 bp, Homo sapiens
tggggagacctggt

SEQ ID NO: 4071328 - DNA, 20 bp, Homo sapiens
tggggagcaggaggccaata

SEQ ID NO: 4071329 - DNA, 23 bp, Homo sapiens
tggggagcaggaggccaataaaa

SEQ ID NO: 4071330 - DNA, 16 bp, Homo sapiens
tggggagccaacagaa

SEQ ID NO: 4071331 - DNA, 19 bp, Homo sapiens
tggggagcccgtctcagtg

SEQ ID NO: 4071332 - DNA, 13 bp, Homo sapiens
tggggaggacctg

SEQ ID NO: 4071333 - DNA, 16 bp, Homo sapiens
tggggagggaggggaa

SEQ ID NO: 4071334 - DNA, 21 bp, Homo sapiens
tggggagggatgaagggcgag

SEQ ID NO: 4071335 - DNA, 19 bp, Homo sapiens
tggggagtaggacatacca

SEQ ID NO: 4071336 - DNA, 16 bp, Homo sapiens
tggggagttaagacct

SEQ ID NO: 4071337 - DNA, 20 bp, Homo sapiens
tggggagttaagacctggca

SEQ ID NO: 4071338 - DNA, 16 bp, Homo sapiens
tggggataaaatgact

SEQ ID NO: 4071339 - DNA, 16 bp, Homo sapiens
tggggatgtgggaggg

SEQ ID NO: 4071340 - DNA, 20 bp, Homo sapiens
tggggcaaacctagccggaa

SEQ ID NO: 4071341 - DNA, 20 bp, Homo sapiens
tggggcaagacagaaaagtg

SEQ ID NO: 4071342 - DNA, 15 bp, Homo sapiens
tggggcagcccccat

SEQ ID NO: 4071343 - DNA, 13 bp, Homo sapiens
tggggcagccgtc

SEQ ID NO: 4071344 - DNA, 16 bp, Homo sapiens
tggggcaggctgggcc

SEQ ID NO: 4071345 - DNA, 15 bp, Homo sapiens
tggggccaccatccc

SEQ ID NO: 4071346 - DNA, 20 bp, Homo sapiens
tggggccagaggctgggagt

SEQ ID NO: 4071347 - DNA, 21 bp, Homo sapiens
tggggccagatccagcctggg

SEQ ID NO: 4071348 - DNA, 15 bp, Homo sapiens
tggggccaggtcacc

SEQ ID NO: 4071349 - DNA, 21 bp, Homo sapiens
tggggcctagcgatctctcct

SEQ ID NO: 4071350 - DNA, 20 bp, Homo sapiens
tggggcctccctccttgggt

SEQ ID NO: 4071351 - DNA, 17 bp, Homo sapiens
tggggcctgactgctca

SEQ ID NO: 4071352 - DNA, 16 bp, Homo sapiens
tggggcctggacctgc

SEQ ID NO: 4071353 - DNA, 19 bp, Homo sapiens
tggggcctggacctgcctc

SEQ ID NO: 4071354 - DNA, 14 bp, Homo sapiens
tggggcgaggcagg

SEQ ID NO: 4071355 - DNA, 23 bp, Homo sapiens
tggggctcagatggactgggagg

SEQ ID NO: 4071356 - DNA, 14 bp, Homo sapiens
tggggctggcctcc

SEQ ID NO: 4071357 - DNA, 13 bp, Homo sapiens
tggggctgtgcat

SEQ ID NO: 4071358 - DNA, 13 bp, Homo sapiens
tgggggaaaaagc

SEQ ID NO: 4071359 - DNA, 23 bp, Homo sapiens
tgggggaatgagcccagagaaca

SEQ ID NO: 4071360 - DNA, 22 bp, Homo sapiens
tggtataatgtttaaatcatgt

SEQ ID NO: 4071361 - DNA, 13 bp, Homo sapiens
tggtatctcagaa

SEQ ID NO: 4071362 - DNA, 16 bp, Homo sapiens
tggtatctcagaaagt

SEQ ID NO: 4071363 - DNA, 16 bp, Homo sapiens
tggtatcttaaagtgt

SEQ ID NO: 4071364 - DNA, 15 bp, Homo sapiens
tggtatgagctgagg

SEQ ID NO: 4071365 - DNA, 15 bp, Homo sapiens
tggtatgctggccag

SEQ ID NO: 4071366 - DNA, 16 bp, Homo sapiens
tggtatgctggccagc

SEQ ID NO: 4071367 - DNA, 17 bp, Homo sapiens
tggtatgctggccagca

SEQ ID NO: 4071368 - DNA, 21 bp, Homo sapiens
tggtatgctggccagcaccct

SEQ ID NO: 4071369 - DNA, 19 bp, Homo sapiens
tggtatggaactctctcca

SEQ ID NO: 4071370 - DNA, 19 bp, Homo sapiens
tggtattcaggattacatg

SEQ ID NO: 4071371 - DNA, 21 bp, Homo sapiens
tggtcaaaccgcactcaccca

SEQ ID NO: 4071372 - DNA, 15 bp, Homo sapiens
tggtcaagattttga

SEQ ID NO: 4071373 - DNA, 20 bp, Homo sapiens
tggtcaagttgagattttta

SEQ ID NO: 4071374 - DNA, 17 bp, Homo sapiens
tggtcacagcctcctct

SEQ ID NO: 4071375 - DNA, 21 bp, Homo sapiens
tggtcaccaaatcagctgcta

SEQ ID NO: 4071376 - DNA, 12 bp, Homo sapiens
tggtcactgtgc

SEQ ID NO: 4071377 - DNA, 19 bp, Homo sapiens
tggtcactgtgcactgccc

SEQ ID NO: 4071378 - DNA, 15 bp, Homo sapiens
tggtcacttcttctg

SEQ ID NO: 4071379 - DNA, 22 bp, Homo sapiens
tggtcagatttgaactcttcaa

SEQ ID NO: 4071380 - DNA, 18 bp, Homo sapiens
tggtccaattagtttcct

SEQ ID NO: 4071381 - DNA, 19 bp, Homo sapiens
tggtccaattagtttcctt

SEQ ID NO: 4071382 - DNA, 12 bp, Homo sapiens
tggtccagagcg

SEQ ID NO: 4071383 - DNA, 13 bp, Homo sapiens
tggtccagctctt

SEQ ID NO: 4071384 - DNA, 19 bp, Homo sapiens
tggtccagggaagctggcc

SEQ ID NO: 4071385 - DNA, 13 bp, Homo sapiens
tggtccagggcta

SEQ ID NO: 4071386 - DNA, 15 bp, Homo sapiens
tggtccatgctgatg

SEQ ID NO: 4071387 - DNA, 18 bp, Homo sapiens
tggtccatgctgatgatt

SEQ ID NO: 4071388 - DNA, 13 bp, Homo sapiens
tggtccctgggag

SEQ ID NO: 4071389 - DNA, 14 bp, Homo sapiens
tggtccctgggagg

SEQ ID NO: 4071390 - DNA, 18 bp, Homo sapiens
tggtccttaccagagacg

SEQ ID NO: 4071391 - DNA, 20 bp, Homo sapiens
tggtcgaggagtaacaatac

SEQ ID NO: 4071392 - DNA, 19 bp, Homo sapiens
tggtcgagtgacacacctc

SEQ ID NO: 4071393 - DNA, 13 bp, Homo sapiens
tggtcgcccagga

SEQ ID NO: 4071394 - DNA, 21 bp, Homo sapiens
tggtctcatgtaacacataaa

SEQ ID NO: 4071395 - DNA, 22 bp, Homo sapiens
tggtctccccaattctcccctc

SEQ ID NO: 4071396 - DNA, 23 bp, Homo sapiens
tggtctccccaattctcccctcc

SEQ ID NO: 4071397 - DNA, 13 bp, Homo sapiens
tggtctgaatgtt

SEQ ID NO: 4071398 - DNA, 17 bp, Homo sapiens
tggtctgcgccttggga

SEQ ID NO: 4071399 - DNA, 11 bp, Homo sapiens
tggtctgctgt

SEQ ID NO: 4071400 - DNA, 22 bp, Homo sapiens
tggtcttatagtgtttggacag

SEQ ID NO: 4071401 - DNA, 23 bp, Homo sapiens
tggtcttatagtgtttggacagc

SEQ ID NO: 4071402 - DNA, 14 bp, Homo sapiens
tggtctttctggag

SEQ ID NO: 4071403 - DNA, 22 bp, Homo sapiens
tggtctttgtaagagtgtagaa

SEQ ID NO: 4071404 - DNA, 23 bp, Homo sapiens
tggtgaaagctgagaactcctga

SEQ ID NO: 4071405 - DNA, 21 bp, Homo sapiens
tggtgaactgagctgggcagg

SEQ ID NO: 4071406 - DNA, 16 bp, Homo sapiens
tggtgaatttcacaag

SEQ ID NO: 4071407 - DNA, 15 bp, Homo sapiens
tggtgacagctgcaa

SEQ ID NO: 4071408 - DNA, 18 bp, Homo sapiens
tggtgagcattacaggca

SEQ ID NO: 4071409 - DNA, 19 bp, Homo sapiens
tggtgaggggctttctctt

SEQ ID NO: 4071410 - DNA, 20 bp, Homo sapiens
tggtgaggggctttctcttc

SEQ ID NO: 4071411 - DNA, 18 bp, Homo sapiens
tggtgatcaattaaatgt

SEQ ID NO: 4071412 - DNA, 17 bp, Homo sapiens
tggtgatcctctatttt

SEQ ID NO: 4071413 - DNA, 18 bp, Homo sapiens
tggtgatcctctattttg

SEQ ID NO: 4071414 - DNA, 21 bp, Homo sapiens
tggtgatctcccaagctatct

SEQ ID NO: 4071415 - DNA, 19 bp, Homo sapiens
tggtgcaaaggagccgcca

SEQ ID NO: 4071416 - DNA, 14 bp, Homo sapiens
tggtgcaaatccta

SEQ ID NO: 4071417 - DNA, 17 bp, Homo sapiens
tggtgcatagcagatgg

SEQ ID NO: 4071418 - DNA, 19 bp, Homo sapiens
tggtgcattacagagagga

SEQ ID NO: 4071419 - DNA, 18 bp, Homo sapiens
tggtgccaaaaccaggcc

SEQ ID NO: 4071420 - DNA, 15 bp, Homo sapiens
tggtgccagggtggg

SEQ ID NO: 4071421 - DNA, 17 bp, Homo sapiens
tggtgccccacagctac

SEQ ID NO: 4071422 - DNA, 13 bp, Homo sapiens
tggtgccccagga

SEQ ID NO: 4071423 - DNA, 14 bp, Homo sapiens
tggtgccccaggac

SEQ ID NO: 4071424 - DNA, 21 bp, Homo sapiens
tggtgccccaggaccagctca

SEQ ID NO: 4071425 - DNA, 16 bp, Homo sapiens
tggtgccccccacccc

SEQ ID NO: 4071426 - DNA, 23 bp, Homo sapiens
tggtgccccccacccctggaaga

SEQ ID NO: 4071427 - DNA, 20 bp, Homo sapiens
tggtgcctgagaggcaggca

SEQ ID NO: 4071428 - DNA, 16 bp, Homo sapiens
tggtgcggatggacac

SEQ ID NO: 4071429 - DNA, 13 bp, Homo sapiens
tggtgctctgtgt

SEQ ID NO: 4071430 - DNA, 18 bp, Homo sapiens
tggtgctgccacacttca

SEQ ID NO: 4071431 - DNA, 12 bp, Homo sapiens
tggtgctggata

SEQ ID NO: 4071432 - DNA, 12 bp, Homo sapiens
tggtgctggttt

SEQ ID NO: 4071433 - DNA, 14 bp, Homo sapiens
tggtgctggtttat

SEQ ID NO: 4071434 - DNA, 12 bp, Homo sapiens
tggtgctgtggc

SEQ ID NO: 4071435 - DNA, 22 bp, Homo sapiens
tggtgcttgggagagtcaggca

SEQ ID NO: 4071436 - DNA, 15 bp, Homo sapiens
tggtggactacaaaa

SEQ ID NO: 4071437 - DNA, 21 bp, Homo sapiens
tggtggcaccagatgcaacct

SEQ ID NO: 4071438 - DNA, 19 bp, Homo sapiens
tggtggcagattttacaaa

SEQ ID NO: 4071439 - DNA, 23 bp, Homo sapiens
tggtgggagggttggcacctgca

SEQ ID NO: 4071440 - DNA, 20 bp, Homo sapiens
tggtgggccaacaaagaaca

SEQ ID NO: 4071441 - DNA, 16 bp, Homo sapiens
tggtggggagaggcat

SEQ ID NO: 4071442 - DNA, 15 bp, Homo sapiens
tggtggtgaaattga

SEQ ID NO: 4071443 - DNA, 18 bp, Homo sapiens
tggtgtaaagctggccct

SEQ ID NO: 4071444 - DNA, 13 bp, Homo sapiens
tggtgtaataaga

SEQ ID NO: 4071445 - DNA, 15 bp, Homo sapiens
tggtgtaataagaca

SEQ ID NO: 4071446 - DNA, 15 bp, Homo sapiens
tggtgtaatttgaag

SEQ ID NO: 4071447 - DNA, 17 bp, Homo sapiens
tggtgtagaacactaat

SEQ ID NO: 4071448 - DNA, 18 bp, Homo sapiens
tggtgtcagtatccaggc

SEQ ID NO: 4071449 - DNA, 18 bp, Homo sapiens
tggtgtgaccctctgaat

SEQ ID NO: 4071450 - DNA, 14 bp, Homo sapiens
tggtgtgctgaggt

SEQ ID NO: 4071451 - DNA, 16 bp, Homo sapiens
tggtgtgggtgtcctg

SEQ ID NO: 4071452 - DNA, 22 bp, Homo sapiens
tggtgtgggtgtcctgcctgtc

SEQ ID NO: 4071453 - DNA, 23 bp, Homo sapiens
tggtgtgggtgtcctgcctgtct

SEQ ID NO: 4071454 - DNA, 14 bp, Homo sapiens
tggtgttgactgga

SEQ ID NO: 4071455 - DNA, 11 bp, Homo sapiens
tggtgttggct

SEQ ID NO: 4071456 - DNA, 22 bp, Homo sapiens
tggttaaaactgtacatttaaa

SEQ ID NO: 4071457 - DNA, 17 bp, Homo sapiens
tggttaagggctcccta

SEQ ID NO: 4071458 - DNA, 13 bp, Homo sapiens
tggttaataaaac

SEQ ID NO: 4071459 - DNA, 20 bp, Homo sapiens
tggttacctgacctaaatta

SEQ ID NO: 4071460 - DNA, 22 bp, Homo sapiens
tggttactcagggttcatctgt

SEQ ID NO: 4071461 - DNA, 23 bp, Homo sapiens
tggttactcagggttcatctgtc

SEQ ID NO: 4071462 - DNA, 19 bp, Homo sapiens
tggttatgaaagaatatat

SEQ ID NO: 4071463 - DNA, 20 bp, Homo sapiens
tgtaatggtatcttaaagtg

SEQ ID NO: 4071464 - DNA, 17 bp, Homo sapiens
tgtaatgtgaaaagtat

SEQ ID NO: 4071465 - DNA, 23 bp, Homo sapiens
tgtaatgtgtgaaaaagatgcca

SEQ ID NO: 4071466 - DNA, 20 bp, Homo sapiens
tgtaatgtgtggtggcctca

SEQ ID NO: 4071467 - DNA, 13 bp, Homo sapiens
tgtaatgttactg

SEQ ID NO: 4071468 - DNA, 19 bp, Homo sapiens
tgtaattaagtactatgta

SEQ ID NO: 4071469 - DNA, 17 bp, Homo sapiens
tgtaattacttattgta

SEQ ID NO: 4071470 - DNA, 17 bp, Homo sapiens
tgtaattgcttacattt

SEQ ID NO: 4071471 - DNA, 21 bp, Homo sapiens
tgtaattgtgtaaaaaatgga

SEQ ID NO: 4071472 - DNA, 23 bp, Homo sapiens
tgtaatttagggtactaaattta

SEQ ID NO: 4071473 - DNA, 21 bp, Homo sapiens
tgtaattttaaataaaagtga

SEQ ID NO: 4071474 - DNA, 16 bp, Homo sapiens
tgtacaaatgtatttt

SEQ ID NO: 4071475 - DNA, 16 bp, Homo sapiens
tgtacacattcctgca

SEQ ID NO: 4071476 - DNA, 15 bp, Homo sapiens
tgtacactaacattt

SEQ ID NO: 4071477 - DNA, 16 bp, Homo sapiens
tgtacactgaatattt

SEQ ID NO: 4071478 - DNA, 19 bp, Homo sapiens
tgtacactgaatatttata

SEQ ID NO: 4071479 - DNA, 12 bp, Homo sapiens
tgtacactgctg

SEQ ID NO: 4071480 - DNA, 13 bp, Homo sapiens
tgtacactgctgt

SEQ ID NO: 4071481 - DNA, 12 bp, Homo sapiens
tgtacagacaag

SEQ ID NO: 4071482 - DNA, 19 bp, Homo sapiens
tgtacagagtgcttttctg

SEQ ID NO: 4071483 - DNA, 17 bp, Homo sapiens
tgtacagtgtctgtgcc

SEQ ID NO: 4071484 - DNA, 17 bp, Homo sapiens
tgtacagtgtgtaaagt

SEQ ID NO: 4071485 - DNA, 13 bp, Homo sapiens
tgtacagtgttac

SEQ ID NO: 4071486 - DNA, 13 bp, Homo sapiens
tgtacataaaaga

SEQ ID NO: 4071487 - DNA, 14 bp, Homo sapiens
tgtacataactctg

SEQ ID NO: 4071488 - DNA, 22 bp, Homo sapiens
tgtacataatgcttaatttcta

SEQ ID NO: 4071489 - DNA, 23 bp, Homo sapiens
tgtacataatgcttaatttctaa

SEQ ID NO: 4071490 - DNA, 14 bp, Homo sapiens
tgtacatctatttt

SEQ ID NO: 4071491 - DNA, 22 bp, Homo sapiens
tgtacatgaagaagctaaatcc

SEQ ID NO: 4071492 - DNA, 16 bp, Homo sapiens
tgtacatgagaaggaa

SEQ ID NO: 4071493 - DNA, 21 bp, Homo sapiens
tgtacatggaataacatgtaa

SEQ ID NO: 4071494 - DNA, 19 bp, Homo sapiens
tgtacatttatttattact

SEQ ID NO: 4071495 - DNA, 20 bp, Homo sapiens
tgtaccaaatctgacatatt

SEQ ID NO: 4071496 - DNA, 16 bp, Homo sapiens
tgtacccagatgccta

SEQ ID NO: 4071497 - DNA, 19 bp, Homo sapiens
tgtacctcctctcagtgtt

SEQ ID NO: 4071498 - DNA, 16 bp, Homo sapiens
tgtacctgtgtacata

SEQ ID NO: 4071499 - DNA, 21 bp, Homo sapiens
tgtacggattttcagttactt

SEQ ID NO: 4071500 - DNA, 14 bp, Homo sapiens
tgtactgaattttt

SEQ ID NO: 4071501 - DNA, 24 bp, Homo sapiens
tgtactgtatggaaacactgattt

SEQ ID NO: 4071502 - DNA, 15 bp, Homo sapiens
tgtactgttctgtgt

SEQ ID NO: 4071503 - DNA, 19 bp, Homo sapiens
tgtactgttctgtgtcttt

SEQ ID NO: 4071504 - DNA, 21 bp, Homo sapiens
tgtacttcgtcttctaatttc

SEQ ID NO: 4071505 - DNA, 15 bp, Homo sapiens
tgtactttgcttgct

SEQ ID NO: 4071506 - DNA, 21 bp, Homo sapiens
tgtagaaaggggagaatgtca

SEQ ID NO: 4071507 - DNA, 21 bp, Homo sapiens
tgtagaaatgatgatgtggaa

SEQ ID NO: 4071508 - DNA, 19 bp, Homo sapiens
tgtagaactcactctgggc

SEQ ID NO: 4071509 - DNA, 21 bp, Homo sapiens
tgtagaactcactctgggctg

SEQ ID NO: 4071510 - DNA, 12 bp, Homo sapiens
tgtagagttaag

SEQ ID NO: 4071511 - DNA, 13 bp, Homo sapiens
tgtagagttaaga

SEQ ID NO: 4071512 - DNA, 17 bp, Homo sapiens
tgtagagttaagaagct

SEQ ID NO: 4071513 - DNA, 18 bp, Homo sapiens
tgtagagttaagaagctg

SEQ ID NO: 4071514 - DNA, 19 bp, Homo sapiens
tgtagatattgtgaagtac

SEQ ID NO: 4071515 - DNA, 21 bp, Homo sapiens
tgtagatattgttttctgtaa

SEQ ID NO: 4071516 - DNA, 14 bp, Homo sapiens
tgtagatgcagaaa

SEQ ID NO: 4071517 - DNA, 20 bp, Homo sapiens
tgtagatgggggaactgtga

SEQ ID NO: 4071518 - DNA, 22 bp, Homo sapiens
tgtagatttagtgtaataagac

SEQ ID NO: 4071519 - DNA, 13 bp, Homo sapiens
tgtagcactgagg

SEQ ID NO: 4071520 - DNA, 23 bp, Homo sapiens
tgtagcagtgagaaaaagctcct

SEQ ID NO: 4071521 - DNA, 16 bp, Homo sapiens
tgtagccatggctggg

SEQ ID NO: 4071522 - DNA, 16 bp, Homo sapiens
tgtagcccacacttga

SEQ ID NO: 4071523 - DNA, 18 bp, Homo sapiens
tgtagccccctggcctct

SEQ ID NO: 4071524 - DNA, 14 bp, Homo sapiens
tgtagctggtttcc

SEQ ID NO: 4071525 - DNA, 15 bp, Homo sapiens
tgtagcttttgggga

SEQ ID NO: 4071526 - DNA, 22 bp, Homo sapiens
tgtaggaaccgtggtatgtctg

SEQ ID NO: 4071527 - DNA, 22 bp, Homo sapiens
tgtaggagctgccttggctcag

SEQ ID NO: 4071528 - DNA, 22 bp, Homo sapiens
tgtaggctggggcggggcccag

SEQ ID NO: 4071529 - DNA, 12 bp, Homo sapiens
tgtagggctgga

SEQ ID NO: 4071530 - DNA, 15 bp, Homo sapiens
tgtagggctggacct

SEQ ID NO: 4071531 - DNA, 20 bp, Homo sapiens
tgtaggggcttacaaagcct

SEQ ID NO: 4071532 - DNA, 23 bp, Homo sapiens
tgtagggtagcggaaaagttgtc

SEQ ID NO: 4071533 - DNA, 16 bp, Homo sapiens
tgtagggttataataa

SEQ ID NO: 4071534 - DNA, 19 bp, Homo sapiens
tgtagtaattgacatgtgc

SEQ ID NO: 4071535 - DNA, 21 bp, Homo sapiens
tgtagtagcgttttttaaatg

SEQ ID NO: 4071536 - DNA, 23 bp, Homo sapiens
tgtagtagcgttttttaaatgta

SEQ ID NO: 4071537 - DNA, 16 bp, Homo sapiens
tgtagtcaggtgctca

SEQ ID NO: 4071538 - DNA, 15 bp, Homo sapiens
tgtagtcatttacta

SEQ ID NO: 4071539 - DNA, 20 bp, Homo sapiens
tgtagtcatttactaaacat

SEQ ID NO: 4071540 - DNA, 15 bp, Homo sapiens
tgtagtcccagccac

SEQ ID NO: 4071541 - DNA, 17 bp, Homo sapiens
tgtagtcctcataaaaa

SEQ ID NO: 4071542 - DNA, 15 bp, Homo sapiens
tgtagtgtagtcagg

SEQ ID NO: 4071543 - DNA, 16 bp, Homo sapiens
tgtagtgttcagaaaa

SEQ ID NO: 4071544 - DNA, 18 bp, Homo sapiens
tgtagttaatttatctaa

SEQ ID NO: 4071545 - DNA, 19 bp, Homo sapiens
tgtagttcttgtctgattg

SEQ ID NO: 4071546 - DNA, 14 bp, Homo sapiens
tgtataaaaaccat

SEQ ID NO: 4071547 - DNA, 13 bp, Homo sapiens
tgtataaatgtct

SEQ ID NO: 4071548 - DNA, 16 bp, Homo sapiens
tgtataaatgtctatt

SEQ ID NO: 4071549 - DNA, 22 bp, Homo sapiens
tgtataaatgtctattattatg

SEQ ID NO: 4071550 - DNA, 13 bp, Homo sapiens
tgtataagcatgc

SEQ ID NO: 4071551 - DNA, 14 bp, Homo sapiens
tgtataagcatgct

SEQ ID NO: 4071552 - DNA, 16 bp, Homo sapiens
tgtataagcatgcttt

SEQ ID NO: 4071553 - DNA, 19 bp, Homo sapiens
tgtataagtactagatgca

SEQ ID NO: 4071554 - DNA, 20 bp, Homo sapiens
tgtataagtggaggcacttt

SEQ ID NO: 4071555 - DNA, 13 bp, Homo sapiens
tgtataatttcga

SEQ ID NO: 4071556 - DNA, 16 bp, Homo sapiens
tgtatacagtgcagag

SEQ ID NO: 4071557 - DNA, 23 bp, Homo sapiens
tgtatacagtgcagagccttctc

SEQ ID NO: 4071558 - DNA, 19 bp, Homo sapiens
tgtatacgtttcaaaaaca

SEQ ID NO: 4071559 - DNA, 14 bp, Homo sapiens
tgtatactatagta

SEQ ID NO: 4071560 - DNA, 23 bp, Homo sapiens
tgtatagaccaaagcaaagaaaa

SEQ ID NO: 4071561 - DNA, 19 bp, Homo sapiens
tgtatagatgcaagatatt

SEQ ID NO: 4071562 - DNA, 23 bp, Homo sapiens
tgtatagccaaatgactgaaagc

SEQ ID NO: 4071563 - DNA, 21 bp, Homo sapiens
tgtatataagtactgaccact

SEQ ID NO: 4071564 - DNA, 14 bp, Homo sapiens
tgtatataatttta

SEQ ID NO: 4071565 - DNA, 13 bp, Homo sapiens
tgtcagatttctg

SEQ ID NO: 4071566 - DNA, 16 bp, Homo sapiens
tgtcagatttctggtt

SEQ ID NO: 4071567 - DNA, 23 bp, Homo sapiens
tgtcagcatctggctgtctagaa

SEQ ID NO: 4071568 - DNA, 13 bp, Homo sapiens
tgtcagccagccg

SEQ ID NO: 4071569 - DNA, 18 bp, Homo sapiens
tgtcagccagccgccctg

SEQ ID NO: 4071570 - DNA, 20 bp, Homo sapiens
tgtcagccagccgccctggg

SEQ ID NO: 4071571 - DNA, 20 bp, Homo sapiens
tgtcagccgagccgggcctg

SEQ ID NO: 4071572 - DNA, 23 bp, Homo sapiens
tgtcagccgagccgggcctgggg

SEQ ID NO: 4071573 - DNA, 18 bp, Homo sapiens
tgtcagctactaatgatg

SEQ ID NO: 4071574 - DNA, 20 bp, Homo sapiens
tgtcaggaacagaaggatga

SEQ ID NO: 4071575 - DNA, 14 bp, Homo sapiens
tgtcaggcatggct

SEQ ID NO: 4071576 - DNA, 20 bp, Homo sapiens
tgtcaggcatggctcagagc

SEQ ID NO: 4071577 - DNA, 14 bp, Homo sapiens
tgtcaggcctgtgt

SEQ ID NO: 4071578 - DNA, 15 bp, Homo sapiens
tgtcagtatccaggc

SEQ ID NO: 4071579 - DNA, 16 bp, Homo sapiens
tgtcagtcacagccac

SEQ ID NO: 4071580 - DNA, 17 bp, Homo sapiens
tgtcagtcacagccacc

SEQ ID NO: 4071581 - DNA, 18 bp, Homo sapiens
tgtcagtcacagccaccc

SEQ ID NO: 4071582 - DNA, 20 bp, Homo sapiens
tgtcagtgttaaagattttg

SEQ ID NO: 4071583 - DNA, 22 bp, Homo sapiens
tgtcagtgttaaagattttgtt

SEQ ID NO: 4071584 - DNA, 23 bp, Homo sapiens
tgtcagttcttggtgctctgtgt

SEQ ID NO: 4071585 - DNA, 17 bp, Homo sapiens
tgtcatatactgccatg

SEQ ID NO: 4071586 - DNA, 17 bp, Homo sapiens
tgtcatcagaagataac

SEQ ID NO: 4071587 - DNA, 19 bp, Homo sapiens
tgtcatcagaagataactt

SEQ ID NO: 4071588 - DNA, 14 bp, Homo sapiens
tgtcatcagatgga

SEQ ID NO: 4071589 - DNA, 14 bp, Homo sapiens
tgtcatctctctgg

SEQ ID NO: 4071590 - DNA, 23 bp, Homo sapiens
tgtcatctctctggggccctggg

SEQ ID NO: 4071591 - DNA, 21 bp, Homo sapiens
tgtcatggactgttgccacca

SEQ ID NO: 4071592 - DNA, 16 bp, Homo sapiens
tgtcattccagagtgc

SEQ ID NO: 4071593 - DNA, 18 bp, Homo sapiens
tgtcattgcttcttctga

SEQ ID NO: 4071594 - DNA, 20 bp, Homo sapiens
tgtcatttagttcagcatcc

SEQ ID NO: 4071595 - DNA, 22 bp, Homo sapiens
tgtcatttcttcacttcaagct

SEQ ID NO: 4071596 - DNA, 15 bp, Homo sapiens
tgtcatttttgcagt

SEQ ID NO: 4071597 - DNA, 11 bp, Homo sapiens
tgtccaaagag

SEQ ID NO: 4071598 - DNA, 20 bp, Homo sapiens
tgtccaaagaggctgcccct

SEQ ID NO: 4071599 - DNA, 21 bp, Homo sapiens
tgtccaagttcttcacctcta

SEQ ID NO: 4071600 - DNA, 22 bp, Homo sapiens
tgtccaagttcttcacctctat

SEQ ID NO: 4071601 - DNA, 23 bp, Homo sapiens
tgtccaagttcttcacctctatc

SEQ ID NO: 4071602 - DNA, 21 bp, Homo sapiens
tgtccacccacctatgtgcca

SEQ ID NO: 4071603 - DNA, 14 bp, Homo sapiens
tgtccacctgtggg

SEQ ID NO: 4071604 - DNA, 19 bp, Homo sapiens
tgtccagcctgggcagcca

SEQ ID NO: 4071605 - DNA, 16 bp, Homo sapiens
tgtccagctccaacct

SEQ ID NO: 4071606 - DNA, 17 bp, Homo sapiens
tgtccagctgagcgcca

SEQ ID NO: 4071607 - DNA, 16 bp, Homo sapiens
tgtccatggcctttct

SEQ ID NO: 4071608 - DNA, 11 bp, Homo sapiens
tgtccatgtgc

SEQ ID NO: 4071609 - DNA, 20 bp, Homo sapiens
tgtccatttatccacaggaa

SEQ ID NO: 4071610 - DNA, 22 bp, Homo sapiens
tgtcccacccacacagctgccc

SEQ ID NO: 4071611 - DNA, 17 bp, Homo sapiens
tgtcccacccccacccc

SEQ ID NO: 4071612 - DNA, 22 bp, Homo sapiens
tgtcccacccccacccccagct

SEQ ID NO: 4071613 - DNA, 13 bp, Homo sapiens
tgtcccaccccta

SEQ ID NO: 4071614 - DNA, 22 bp, Homo sapiens
tgtcccacccctagccaccagt

SEQ ID NO: 4071615 - DNA, 16 bp, Homo sapiens
tgtcccaccgggagcc

SEQ ID NO: 4071616 - DNA, 21 bp, Homo sapiens
tgtcccacgtgtcttccactt

SEQ ID NO: 4071617 - DNA, 22 bp, Homo sapiens
tgtcccacgtgtcttccacttt

SEQ ID NO: 4071618 - DNA, 18 bp, Homo sapiens
tgtcccactacatctggg

SEQ ID NO: 4071619 - DNA, 20 bp, Homo sapiens
tgtcccagatgggccacggc

SEQ ID NO: 4071620 - DNA, 21 bp, Homo sapiens
tgtcccagatgggccacggct

SEQ ID NO: 4071621 - DNA, 18 bp, Homo sapiens
tgtcccaggccggcccag

SEQ ID NO: 4071622 - DNA, 13 bp, Homo sapiens
tgtcccagtgctc

SEQ ID NO: 4071623 - DNA, 16 bp, Homo sapiens
tgtcccatgatccctg

SEQ ID NO: 4071624 - DNA, 18 bp, Homo sapiens
tgtcccatgatccctgtg

SEQ ID NO: 4071625 - DNA, 22 bp, Homo sapiens
tgtcccatggacactccagtgc

SEQ ID NO: 4071626 - DNA, 19 bp, Homo sapiens
tgtcccatgtgagctgctg

SEQ ID NO: 4071627 - DNA, 20 bp, Homo sapiens
tgtcccatttccttggaggc

SEQ ID NO: 4071628 - DNA, 22 bp, Homo sapiens
tgtccccaccctccactcagct

SEQ ID NO: 4071629 - DNA, 14 bp, Homo sapiens
tgtccccagaccct

SEQ ID NO: 4071630 - DNA, 15 bp, Homo sapiens
tgtccccagccctgt

SEQ ID NO: 4071631 - DNA, 16 bp, Homo sapiens
tgtcccccaggctgga

SEQ ID NO: 4071632 - DNA, 23 bp, Homo sapiens
tgtcccctatggggatggtccac

SEQ ID NO: 4071633 - DNA, 15 bp, Homo sapiens
tgtcccctcactctg

SEQ ID NO: 4071634 - DNA, 18 bp, Homo sapiens
tgtcccctcactctgtca

SEQ ID NO: 4071635 - DNA, 18 bp, Homo sapiens
tgtcccctccactgtcac

SEQ ID NO: 4071636 - DNA, 16 bp, Homo sapiens
tgtcccggtaccttcc

SEQ ID NO: 4071637 - DNA, 17 bp, Homo sapiens
tgtcccggtaccttcca

SEQ ID NO: 4071638 - DNA, 22 bp, Homo sapiens
tgtccctaccgagtctcttctc

SEQ ID NO: 4071639 - DNA, 21 bp, Homo sapiens
tgtccctatctattaaagtga

SEQ ID NO: 4071640 - DNA, 21 bp, Homo sapiens
tgtccctcactgttgaatttt

SEQ ID NO: 4071641 - DNA, 13 bp, Homo sapiens
tgtccctcccttg

SEQ ID NO: 4071642 - DNA, 16 bp, Homo sapiens
tgtccctggcttcctt

SEQ ID NO: 4071643 - DNA, 20 bp, Homo sapiens
tgtccctgggccagggtctg

SEQ ID NO: 4071644 - DNA, 19 bp, Homo sapiens
tgtccctgtccccctcccc

SEQ ID NO: 4071645 - DNA, 13 bp, Homo sapiens
tgtccctgttaga

SEQ ID NO: 4071646 - DNA, 13 bp, Homo sapiens
tgtcccttgcctc

SEQ ID NO: 4071647 - DNA, 22 bp, Homo sapiens
tgtcccttgcctcaatgccagt

SEQ ID NO: 4071648 - DNA, 16 bp, Homo sapiens
tgtcccttgcctctgc

SEQ ID NO: 4071649 - DNA, 17 bp, Homo sapiens
tgtccctttccctacct

SEQ ID NO: 4071650 - DNA, 16 bp, Homo sapiens
tgtccctttcttctcc

SEQ ID NO: 4071651 - DNA, 16 bp, Homo sapiens
tgtccctttcttggcc

SEQ ID NO: 4071652 - DNA, 18 bp, Homo sapiens
tgtccctttcttggccag

SEQ ID NO: 4071653 - DNA, 16 bp, Homo sapiens
tgtcccttttccctta

SEQ ID NO: 4071654 - DNA, 14 bp, Homo sapiens
tgtcccttttgcta

SEQ ID NO: 4071655 - DNA, 22 bp, Homo sapiens
tgtccgagaactaaagccaagg

SEQ ID NO: 4071656 - DNA, 20 bp, Homo sapiens
tgtccgctgggtggtaccct

SEQ ID NO: 4071657 - DNA, 19 bp, Homo sapiens
tgtcctaaggaaccttcct

SEQ ID NO: 4071658 - DNA, 15 bp, Homo sapiens
tgtcctaaggacaca

SEQ ID NO: 4071659 - DNA, 18 bp, Homo sapiens
tgtcctaaggacacacta

SEQ ID NO: 4071660 - DNA, 14 bp, Homo sapiens
tgtcctaattcttc

SEQ ID NO: 4071661 - DNA, 15 bp, Homo sapiens
tgtcctacgtccaag

SEQ ID NO: 4071662 - DNA, 20 bp, Homo sapiens
tgtcctatctatcttccaaa

SEQ ID NO: 4071663 - DNA, 12 bp, Homo sapiens
tgtcctcagcct

SEQ ID NO: 4071664 - DNA, 17 bp, Homo sapiens
tgtcctcagccttgcca

SEQ ID NO: 4071665 - DNA, 16 bp, Homo sapiens
tgtcctccaggagctt

SEQ ID NO: 4071666 - DNA, 18 bp, Homo sapiens
tgtcctcccatcccctgg

SEQ ID NO: 4071667 - DNA, 17 bp, Homo sapiens
tgtcctcctgctgccag

SEQ ID NO: 4071668 - DNA, 16 bp, Homo sapiens
tgtcctctcgagccca

SEQ ID NO: 4071669 - DNA, 20 bp, Homo sapiens
tgtcctctcgagcccagatg

SEQ ID NO: 4071670 - DNA, 16 bp, Homo sapiens
tgtcctcttccctctc

SEQ ID NO: 4071671 - DNA, 17 bp, Homo sapiens
tgtcctcttctgctctt

SEQ ID NO: 4071672 - DNA, 18 bp, Homo sapiens
tgtcctcttctgctcttt

SEQ ID NO: 4071673 - DNA, 20 bp, Homo sapiens
tgtcctcttctgctcttttc

SEQ ID NO: 4071674 - DNA, 23 bp, Homo sapiens
tgtcctcttctgctcttttcctg

SEQ ID NO: 4071675 - DNA, 23 bp, Homo sapiens
tgtcctcttgctcaaaaatctgt

SEQ ID NO: 4071676 - DNA, 15 bp, Homo sapiens
tgtcctgatgctttt

SEQ ID NO: 4071677 - DNA, 18 bp, Homo sapiens
tgtcctgatgcttttgtc

SEQ ID NO: 4071678 - DNA, 18 bp, Homo sapiens
tgtcctgcagcaaacact

SEQ ID NO: 4071679 - DNA, 14 bp, Homo sapiens
tgtcctgcctgtct

SEQ ID NO: 4071680 - DNA, 19 bp, Homo sapiens
tgtcctgcctgtctgcccc

SEQ ID NO: 4071681 - DNA, 23 bp, Homo sapiens
tgtcctgggcatgggtccagggc

SEQ ID NO: 4071682 - DNA, 17 bp, Homo sapiens
tgtcctgggcctgcccc

SEQ ID NO: 4071683 - DNA, 21 bp, Homo sapiens
tgtcctgggcctgcccctgtg

SEQ ID NO: 4071684 - DNA, 15 bp, Homo sapiens
tgtcctgtcctgctc

SEQ ID NO: 4071685 - DNA, 17 bp, Homo sapiens
tgtccttaacccacctc

SEQ ID NO: 4071686 - DNA, 20 bp, Homo sapiens
tgtccttaacccacctctcc

SEQ ID NO: 4071687 - DNA, 21 bp, Homo sapiens
tgtccttaacccacctctcct

SEQ ID NO: 4071688 - DNA, 23 bp, Homo sapiens
tgtccttaacccacctctcctgc

SEQ ID NO: 4071689 - DNA, 12 bp, Homo sapiens
tgtccttagaac

SEQ ID NO: 4071690 - DNA, 17 bp, Homo sapiens
tgtccttagtgtataaa

SEQ ID NO: 4071691 - DNA, 17 bp, Homo sapiens
tgtccttccctcaaaga

SEQ ID NO: 4071692 - DNA, 16 bp, Homo sapiens
tgtcctttaaaaaaga

SEQ ID NO: 4071693 - DNA, 14 bp, Homo sapiens
tgtcctttcttgca

SEQ ID NO: 4071694 - DNA, 21 bp, Homo sapiens
tgtccttttcccctacagaat

SEQ ID NO: 4071695 - DNA, 19 bp, Homo sapiens
tgtcgaattcctactgaca

SEQ ID NO: 4071696 - DNA, 15 bp, Homo sapiens
tgtcgccccaggccc

SEQ ID NO: 4071697 - DNA, 16 bp, Homo sapiens
tgtcgccccaggccct

SEQ ID NO: 4071698 - DNA, 21 bp, Homo sapiens
tgtcgccccaggccctccctg

SEQ ID NO: 4071699 - DNA, 23 bp, Homo sapiens
tgtcggttttttttaaataaaag

SEQ ID NO: 4071700 - DNA, 16 bp, Homo sapiens
tgtcgtaaagatttgg

SEQ ID NO: 4071701 - DNA, 21 bp, Homo sapiens
tgtctacaaatataagatttt

SEQ ID NO: 4071702 - DNA, 16 bp, Homo sapiens
tgtctagcacttcctt

SEQ ID NO: 4071703 - DNA, 21 bp, Homo sapiens
tgtctagcacttccttgccag

SEQ ID NO: 4071704 - DNA, 16 bp, Homo sapiens
tgtctataaaagaaac

SEQ ID NO: 4071705 - DNA, 16 bp, Homo sapiens
tgtctattattatgaa

SEQ ID NO: 4071706 - DNA, 11 bp, Homo sapiens
tgtctatttta

SEQ ID NO: 4071707 - DNA, 16 bp, Homo sapiens
tgtctattttaaaata

SEQ ID NO: 4071708 - DNA, 22 bp, Homo sapiens
tgtctattttaaaataaattag

SEQ ID NO: 4071709 - DNA, 19 bp, Homo sapiens
tgtctcaacgcctccccct

SEQ ID NO: 4071710 - DNA, 18 bp, Homo sapiens
tgtctcaagagggcactg

SEQ ID NO: 4071711 - DNA, 20 bp, Homo sapiens
tgtctcaagagggcactggt

SEQ ID NO: 4071712 - DNA, 13 bp, Homo sapiens
tgtctcatcccca

SEQ ID NO: 4071713 - DNA, 23 bp, Homo sapiens
tgtctcatccccaggggtcccag

SEQ ID NO: 4071714 - DNA, 16 bp, Homo sapiens
tgtctccagctgcctg

SEQ ID NO: 4071715 - DNA, 17 bp, Homo sapiens
tgtctccagctgcctgg

SEQ ID NO: 4071716 - DNA, 18 bp, Homo sapiens
tgtctccagctgcctggg

SEQ ID NO: 4071717 - DNA, 16 bp, Homo sapiens
tgtctcctactcctga

SEQ ID NO: 4071718 - DNA, 13 bp, Homo sapiens
tgtctctcctggc

SEQ ID NO: 4071719 - DNA, 16 bp, Homo sapiens
tgtctctcctggctgg

SEQ ID NO: 4071720 - DNA, 17 bp, Homo sapiens
tgtctctcctggctggg

SEQ ID NO: 4071721 - DNA, 20 bp, Homo sapiens
tgtctctcctggctgggcca

SEQ ID NO: 4071722 - DNA, 21 bp, Homo sapiens
tgtctctcctggctgggccat

SEQ ID NO: 4071723 - DNA, 11 bp, Homo sapiens
tgtctctgctc

SEQ ID NO: 4071724 - DNA, 22 bp, Homo sapiens
tgtctctgctcgccctcctttc

SEQ ID NO: 4071725 - DNA, 11 bp, Homo sapiens
tgtctctgggg

SEQ ID NO: 4071726 - DNA, 13 bp, Homo sapiens
tgtctctggggca

SEQ ID NO: 4071727 - DNA, 15 bp, Homo sapiens
tgtctcttctgagga

SEQ ID NO: 4071728 - DNA, 14 bp, Homo sapiens
tgtctcttttctct

SEQ ID NO: 4071729 - DNA, 18 bp, Homo sapiens
tgtctcttttctctttct

SEQ ID NO: 4071730 - DNA, 16 bp, Homo sapiens
tgtctgaacttgcatt

SEQ ID NO: 4071731 - DNA, 16 bp, Homo sapiens
tgtctgaagtcactgc

SEQ ID NO: 4071732 - DNA, 17 bp, Homo sapiens
tgtctgaagtcactgca

SEQ ID NO: 4071733 - DNA, 17 bp, Homo sapiens
tgtctgagtgaacctgt

SEQ ID NO: 4071734 - DNA, 19 bp, Homo sapiens
tgtctgattggctcaccca

SEQ ID NO: 4071735 - DNA, 16 bp, Homo sapiens
tgtctgcagtgtgccc

SEQ ID NO: 4071736 - DNA, 19 bp, Homo sapiens
tgtctgcagtgtgcccccc

SEQ ID NO: 4071737 - DNA, 14 bp, Homo sapiens
tgtctgccccagcc

SEQ ID NO: 4071738 - DNA, 21 bp, Homo sapiens
tgtctgcgtggttcctttctc

SEQ ID NO: 4071739 - DNA, 14 bp, Homo sapiens
tgtctgctaatgta

SEQ ID NO: 4071740 - DNA, 16 bp, Homo sapiens
tgtctgctaatgtaaa

SEQ ID NO: 4071741 - DNA, 17 bp, Homo sapiens
tgtctgctccagctctg

SEQ ID NO: 4071742 - DNA, 18 bp, Homo sapiens
tgtctgctgagttggcct

SEQ ID NO: 4071743 - DNA, 19 bp, Homo sapiens
tgtctgctgagttggcctg

SEQ ID NO: 4071744 - DNA, 22 bp, Homo sapiens
tgtctgctggtcacttcttctg

SEQ ID NO: 4071745 - DNA, 15 bp, Homo sapiens
tgtctgcttgtcaaa

SEQ ID NO: 4071746 - DNA, 16 bp, Homo sapiens
tgtctgggtttgagaa

SEQ ID NO: 4071747 - DNA, 17 bp, Homo sapiens
tgtctgggtttgagaaa

SEQ ID NO: 4071748 - DNA, 14 bp, Homo sapiens
tgtctgtatttcat

SEQ ID NO: 4071749 - DNA, 16 bp, Homo sapiens
tgtctgtctggtccat

SEQ ID NO: 4071750 - DNA, 14 bp, Homo sapiens
tgtctgtgaacaga

SEQ ID NO: 4071751 - DNA, 13 bp, Homo sapiens
tgtctgtgccatg

SEQ ID NO: 4071752 - DNA, 16 bp, Homo sapiens
tgtctgtgccatggat

SEQ ID NO: 4071753 - DNA, 20 bp, Homo sapiens
tgtctgtggatggtcattgc

SEQ ID NO: 4071754 - DNA, 13 bp, Homo sapiens
tgtctgttgcttg

SEQ ID NO: 4071755 - DNA, 13 bp, Homo sapiens
tgtcttaaaaggt

SEQ ID NO: 4071756 - DNA, 19 bp, Homo sapiens
tgtcttaatttttgaaaaa

SEQ ID NO: 4071757 - DNA, 13 bp, Homo sapiens
tgtcttattgcac

SEQ ID NO: 4071758 - DNA, 22 bp, Homo sapiens
tgtcttcagcagtcaatacaaa

SEQ ID NO: 4071759 - DNA, 17 bp, Homo sapiens
tgtcttcataaagtact

SEQ ID NO: 4071760 - DNA, 24 bp, Homo sapiens
tgtcttccaaggagaccaagtcct

SEQ ID NO: 4071761 - DNA, 15 bp, Homo sapiens
tgtcttccactttgc

SEQ ID NO: 4071762 - DNA, 18 bp, Homo sapiens
tgtcttccattccattgt

SEQ ID NO: 4071763 - DNA, 12 bp, Homo sapiens
tgtcttccctgg

SEQ ID NO: 4071764 - DNA, 13 bp, Homo sapiens
tgtcttccctggg

SEQ ID NO: 4071765 - DNA, 15 bp, Homo sapiens
tgtcttccctgggct

SEQ ID NO: 4071766 - DNA, 11 bp, Homo sapiens
tgtcttcctca

SEQ ID NO: 4071767 - DNA, 19 bp, Homo sapiens
tgtcttcggccgagctggt

SEQ ID NO: 4071768 - DNA, 22 bp, Homo sapiens
tgtcttcggccgagctggtttc

SEQ ID NO: 4071769 - DNA, 19 bp, Homo sapiens
tgtcttctgggcacagtgg

SEQ ID NO: 4071770 - DNA, 18 bp, Homo sapiens
tgtgcaaggtggcctttg

SEQ ID NO: 4071771 - DNA, 21 bp, Homo sapiens
tgtgcaaggtggcctttgtgc

SEQ ID NO: 4071772 - DNA, 13 bp, Homo sapiens
tgtgcacaggcag

SEQ ID NO: 4071773 - DNA, 13 bp, Homo sapiens
tgtgcacatcttc

SEQ ID NO: 4071774 - DNA, 14 bp, Homo sapiens
tgtgcacccatggg

SEQ ID NO: 4071775 - DNA, 19 bp, Homo sapiens
tgtgcacccggcctggatg

SEQ ID NO: 4071776 - DNA, 21 bp, Homo sapiens
tgtgcactgcccatggacagg

SEQ ID NO: 4071777 - DNA, 14 bp, Homo sapiens
tgtgcactgtcact

SEQ ID NO: 4071778 - DNA, 12 bp, Homo sapiens
tgtgcagaataa

SEQ ID NO: 4071779 - DNA, 17 bp, Homo sapiens
tgtgcagaataatggaa

SEQ ID NO: 4071780 - DNA, 15 bp, Homo sapiens
tgtgcagcgcagctg

SEQ ID NO: 4071781 - DNA, 15 bp, Homo sapiens
tgtgcagggagggca

SEQ ID NO: 4071782 - DNA, 17 bp, Homo sapiens
tgtgcaggtttgttaca

SEQ ID NO: 4071783 - DNA, 14 bp, Homo sapiens
tgtgcagtgtagcc

SEQ ID NO: 4071784 - DNA, 16 bp, Homo sapiens
tgtgcatggaggccct

SEQ ID NO: 4071785 - DNA, 19 bp, Homo sapiens
tgtgcatggaggccctcct

SEQ ID NO: 4071786 - DNA, 22 bp, Homo sapiens
tgtgcatggaggccctcctgtg

SEQ ID NO: 4071787 - DNA, 21 bp, Homo sapiens
tgtgcatttttgtgaaatgaa

SEQ ID NO: 4071788 - DNA, 22 bp, Homo sapiens
tgtgcatttttgtgaaatgaaa

SEQ ID NO: 4071789 - DNA, 21 bp, Homo sapiens
tgtgccaactgccaggctgcc

SEQ ID NO: 4071790 - DNA, 21 bp, Homo sapiens
tgtgccactaaactacattgt

SEQ ID NO: 4071791 - DNA, 18 bp, Homo sapiens
tgtgccagggcaatgatg

SEQ ID NO: 4071792 - DNA, 19 bp, Homo sapiens
tgtgccagggcagcatttt

SEQ ID NO: 4071793 - DNA, 19 bp, Homo sapiens
tgtgccaggtgaaggaggc

SEQ ID NO: 4071794 - DNA, 16 bp, Homo sapiens
tgtgccagttcctgta

SEQ ID NO: 4071795 - DNA, 14 bp, Homo sapiens
tgtgccatgctggg

SEQ ID NO: 4071796 - DNA, 19 bp, Homo sapiens
tgtgcccagcccggacctt

SEQ ID NO: 4071797 - DNA, 14 bp, Homo sapiens
tgtgcccctggccc

SEQ ID NO: 4071798 - DNA, 17 bp, Homo sapiens
tgtgcccctggcccatc

SEQ ID NO: 4071799 - DNA, 12 bp, Homo sapiens
tgtgcctctgcg

SEQ ID NO: 4071800 - DNA, 14 bp, Homo sapiens
tgtgcctgcactga

SEQ ID NO: 4071801 - DNA, 13 bp, Homo sapiens
tgtgcctggcccc

SEQ ID NO: 4071802 - DNA, 22 bp, Homo sapiens
tgtgcctggccccagcctgggc

SEQ ID NO: 4071803 - DNA, 13 bp, Homo sapiens
tgtgcctggcctc

SEQ ID NO: 4071804 - DNA, 16 bp, Homo sapiens
tgtgcctggcctctgc

SEQ ID NO: 4071805 - DNA, 22 bp, Homo sapiens
tgtgcctggcttctttctctca

SEQ ID NO: 4071806 - DNA, 23 bp, Homo sapiens
tgtgcctggcttctttctctcag

SEQ ID NO: 4071807 - DNA, 13 bp, Homo sapiens
tgtgcctggggga

SEQ ID NO: 4071808 - DNA, 15 bp, Homo sapiens
tgtgccttgtttttt

SEQ ID NO: 4071809 - DNA, 12 bp, Homo sapiens
tgtgcctttctt

SEQ ID NO: 4071810 - DNA, 15 bp, Homo sapiens
tgtgcctttctttgc

SEQ ID NO: 4071811 - DNA, 17 bp, Homo sapiens
tgtgcctttctttgcct

SEQ ID NO: 4071812 - DNA, 18 bp, Homo sapiens
tgtgcctttctttgcctc

SEQ ID NO: 4071813 - DNA, 22 bp, Homo sapiens
tgtgcctttctttgcctctgca

SEQ ID NO: 4071814 - DNA, 13 bp, Homo sapiens
tgtgcctttggcc

SEQ ID NO: 4071815 - DNA, 15 bp, Homo sapiens
tgtgcctttggcctg

SEQ ID NO: 4071816 - DNA, 22 bp, Homo sapiens
tgtgcgcataggcctgctttgt

SEQ ID NO: 4071817 - DNA, 21 bp, Homo sapiens
tgtgcggagcgggaggcggtg

SEQ ID NO: 4071818 - DNA, 16 bp, Homo sapiens
tgtgcgtggaaaaaga

SEQ ID NO: 4071819 - DNA, 17 bp, Homo sapiens
tgtgctactgattgttt

SEQ ID NO: 4071820 - DNA, 19 bp, Homo sapiens
tgtgctcttgttttgtctt

SEQ ID NO: 4071821 - DNA, 16 bp, Homo sapiens
tgtgctgccatttgat

SEQ ID NO: 4071822 - DNA, 22 bp, Homo sapiens
tgtgctgcgcctgcaggcagag

SEQ ID NO: 4071823 - DNA, 24 bp, Homo sapiens
tgtgctgggggaatgagcccagag

SEQ ID NO: 4071824 - DNA, 17 bp, Homo sapiens
tgtgctgggtgcctccc

SEQ ID NO: 4071825 - DNA, 14 bp, Homo sapiens
tgtgctgtggaagc

SEQ ID NO: 4071826 - DNA, 19 bp, Homo sapiens
tgtgctgtgggcagcaccc

SEQ ID NO: 4071827 - DNA, 20 bp, Homo sapiens
tgtgctgtgtttgctcccct

SEQ ID NO: 4071828 - DNA, 17 bp, Homo sapiens
tgtgcttgaaggccctg

SEQ ID NO: 4071829 - DNA, 21 bp, Homo sapiens
tgtgcttgaaggccctgctga

SEQ ID NO: 4071830 - DNA, 22 bp, Homo sapiens
tgtgcttgaaggccctgctgag

SEQ ID NO: 4071831 - DNA, 18 bp, Homo sapiens
tgtgcttgtcattccaga

SEQ ID NO: 4071832 - DNA, 14 bp, Homo sapiens
tgtgctttagcttg

SEQ ID NO: 4071833 - DNA, 13 bp, Homo sapiens
tgtgctttgctct

SEQ ID NO: 4071834 - DNA, 18 bp, Homo sapiens
tgtgctttgctcttgtcc

SEQ ID NO: 4071835 - DNA, 19 bp, Homo sapiens
tgtggaaagtgaatttgaa

SEQ ID NO: 4071836 - DNA, 22 bp, Homo sapiens
tgtggaaagtgaatttgaatga

SEQ ID NO: 4071837 - DNA, 21 bp, Homo sapiens
tgtggaacataaaaaggacat

SEQ ID NO: 4071838 - DNA, 18 bp, Homo sapiens
tgtggaaggcctccctct

SEQ ID NO: 4071839 - DNA, 18 bp, Homo sapiens
tgtggaccgtggacaggc

SEQ ID NO: 4071840 - DNA, 14 bp, Homo sapiens
tgtggactaaatat

SEQ ID NO: 4071841 - DNA, 16 bp, Homo sapiens
tgtggactaaatatct

SEQ ID NO: 4071842 - DNA, 16 bp, Homo sapiens
tgtggacttggcaggt

SEQ ID NO: 4071843 - DNA, 22 bp, Homo sapiens
tgtggagaccctgccacagcca

SEQ ID NO: 4071844 - DNA, 17 bp, Homo sapiens
tgtggaggaaggattgt

SEQ ID NO: 4071845 - DNA, 15 bp, Homo sapiens
tgtggatataaaatg

SEQ ID NO: 4071846 - DNA, 23 bp, Homo sapiens
tgtggatcttgccacatttctga

SEQ ID NO: 4071847 - DNA, 22 bp, Homo sapiens
tgtggatgcctgtggaagagtg

SEQ ID NO: 4071848 - DNA, 23 bp, Homo sapiens
tgtggatttgattcattttcctg

SEQ ID NO: 4071849 - DNA, 21 bp, Homo sapiens
tgtggattttctactgtaaga

SEQ ID NO: 4071850 - DNA, 14 bp, Homo sapiens
tgtggcagagagag

SEQ ID NO: 4071851 - DNA, 23 bp, Homo sapiens
tgtggcagagagagagaaagaga

SEQ ID NO: 4071852 - DNA, 14 bp, Homo sapiens
tgtggcattggggg

SEQ ID NO: 4071853 - DNA, 19 bp, Homo sapiens
tgtggccagggtgagagct

SEQ ID NO: 4071854 - DNA, 13 bp, Homo sapiens
tgtggccccaccc

SEQ ID NO: 4071855 - DNA, 23 bp, Homo sapiens
tgtggccccttttacttttttat

SEQ ID NO: 4071856 - DNA, 12 bp, Homo sapiens
tgtggccctggc

SEQ ID NO: 4071857 - DNA, 17 bp, Homo sapiens
tgtggccgtctcctccc

SEQ ID NO: 4071858 - DNA, 13 bp, Homo sapiens
tgtggcctcagcc

SEQ ID NO: 4071859 - DNA, 18 bp, Homo sapiens
tgtggcctcagccctcag

SEQ ID NO: 4071860 - DNA, 11 bp, Homo sapiens
tgtggcctgca

SEQ ID NO: 4071861 - DNA, 20 bp, Homo sapiens
tgtggcgttctgctgcccct

SEQ ID NO: 4071862 - DNA, 23 bp, Homo sapiens
tgtggcgttctgctgcccctgca

SEQ ID NO: 4071863 - DNA, 16 bp, Homo sapiens
tgtggctgaggaggcc

SEQ ID NO: 4071864 - DNA, 15 bp, Homo sapiens
tgtggctgggggcag

SEQ ID NO: 4071865 - DNA, 13 bp, Homo sapiens
tgtggctttccag

SEQ ID NO: 4071866 - DNA, 13 bp, Homo sapiens
tgtgggagggagc

SEQ ID NO: 4071867 - DNA, 22 bp, Homo sapiens
tgtgggatgttcagcactgtcc

SEQ ID NO: 4071868 - DNA, 23 bp, Homo sapiens
tgtgggcactggcccaggttcat

SEQ ID NO: 4071869 - DNA, 17 bp, Homo sapiens
tgtgggcccctcaacag

SEQ ID NO: 4071870 - DNA, 22 bp, Homo sapiens
tgtgggctggtgccccacagct

SEQ ID NO: 4071871 - DNA, 14 bp, Homo sapiens
tgtggggacacagc

SEQ ID NO: 4071872 - DNA, 16 bp, Homo sapiens
tgttagtttagtgtgt

SEQ ID NO: 4071873 - DNA, 23 bp, Homo sapiens
tgttagtttagtgtgtgtgcaga

SEQ ID NO: 4071874 - DNA, 21 bp, Homo sapiens
tgttatatatctcttttggtc

SEQ ID NO: 4071875 - DNA, 15 bp, Homo sapiens
tgttatatcatatgt

SEQ ID NO: 4071876 - DNA, 18 bp, Homo sapiens
tgttatcaaactgctgtc

SEQ ID NO: 4071877 - DNA, 21 bp, Homo sapiens
tgttatcagtcaatattttta

SEQ ID NO: 4071878 - DNA, 16 bp, Homo sapiens
tgttatgactatgtaa

SEQ ID NO: 4071879 - DNA, 20 bp, Homo sapiens
tgttatgactatgtaaacta

SEQ ID NO: 4071880 - DNA, 15 bp, Homo sapiens
tgttatgatattgtt

SEQ ID NO: 4071881 - DNA, 12 bp, Homo sapiens
tgttatgtatga

SEQ ID NO: 4071882 - DNA, 18 bp, Homo sapiens
tgttattccatcaataaa

SEQ ID NO: 4071883 - DNA, 14 bp, Homo sapiens
tgttattgttgaac

SEQ ID NO: 4071884 - DNA, 18 bp, Homo sapiens
tgttatttaacagctgaa

SEQ ID NO: 4071885 - DNA, 14 bp, Homo sapiens
tgttatttcttccc

SEQ ID NO: 4071886 - DNA, 16 bp, Homo sapiens
tgttatttcttccctg

SEQ ID NO: 4071887 - DNA, 22 bp, Homo sapiens
tgttatttttatatcagcctga

SEQ ID NO: 4071888 - DNA, 16 bp, Homo sapiens
tgttcaaatgcatttt

SEQ ID NO: 4071889 - DNA, 16 bp, Homo sapiens
tgttcaatgtttaatg

SEQ ID NO: 4071890 - DNA, 16 bp, Homo sapiens
tgttcacaatatattt

SEQ ID NO: 4071891 - DNA, 23 bp, Homo sapiens
tgttcaccctgcattacatgtgt

SEQ ID NO: 4071892 - DNA, 15 bp, Homo sapiens
tgttcagaaaaaagg

SEQ ID NO: 4071893 - DNA, 22 bp, Homo sapiens
tgttcagctcccccaggctgtt

SEQ ID NO: 4071894 - DNA, 18 bp, Homo sapiens
tgttcagtgagatatcat

SEQ ID NO: 4071895 - DNA, 21 bp, Homo sapiens
tgttcattgtaatgttactga

SEQ ID NO: 4071896 - DNA, 15 bp, Homo sapiens
tgttccaaagccagt

SEQ ID NO: 4071897 - DNA, 10 bp, Homo sapiens
tgttccaaat

SEQ ID NO: 4071898 - DNA, 18 bp, Homo sapiens
tgttccaaattcagtttc

SEQ ID NO: 4071899 - DNA, 19 bp, Homo sapiens
tgttccaaattcagtttca

SEQ ID NO: 4071900 - DNA, 14 bp, Homo sapiens
tgttccaagacatt

SEQ ID NO: 4071901 - DNA, 19 bp, Homo sapiens
tgttccaagacattgtcaa

SEQ ID NO: 4071902 - DNA, 21 bp, Homo sapiens
tgttccaagacattgtcaata

SEQ ID NO: 4071903 - DNA, 10 bp, Homo sapiens
tgttccagtt

SEQ ID NO: 4071904 - DNA, 16 bp, Homo sapiens
tgttcccagaggcagg

SEQ ID NO: 4071905 - DNA, 22 bp, Homo sapiens
tgttcccagtgacacttcagag

SEQ ID NO: 4071906 - DNA, 20 bp, Homo sapiens
tgttcccatgtagccccctg

SEQ ID NO: 4071907 - DNA, 14 bp, Homo sapiens
tgttccccagagaa

SEQ ID NO: 4071908 - DNA, 17 bp, Homo sapiens
tgttccccctgccgcag

SEQ ID NO: 4071909 - DNA, 19 bp, Homo sapiens
tgttcctactcacacttca

SEQ ID NO: 4071910 - DNA, 23 bp, Homo sapiens
tgttcctgcagccccagaagaaa

SEQ ID NO: 4071911 - DNA, 18 bp, Homo sapiens
tgttcctggagttttgat

SEQ ID NO: 4071912 - DNA, 14 bp, Homo sapiens
tgttcctggcaata

SEQ ID NO: 4071913 - DNA, 22 bp, Homo sapiens
tgttcgcatggtcacacactga

SEQ ID NO: 4071914 - DNA, 23 bp, Homo sapiens
tgttcgcatggtcacacactgat

SEQ ID NO: 4071915 - DNA, 23 bp, Homo sapiens
tgttctcacactggtctgctgtc

SEQ ID NO: 4071916 - DNA, 16 bp, Homo sapiens
tgttctcacagtgtgg

SEQ ID NO: 4071917 - DNA, 20 bp, Homo sapiens
tgttctccgggtgtggcctc

SEQ ID NO: 4071918 - DNA, 22 bp, Homo sapiens
tgttctccgggtgtggcctcag

SEQ ID NO: 4071919 - DNA, 20 bp, Homo sapiens
tgttctcttcttcattctat

SEQ ID NO: 4071920 - DNA, 20 bp, Homo sapiens
tgttctgacattaacagttt

SEQ ID NO: 4071921 - DNA, 18 bp, Homo sapiens
tgttctgaccctgcttca

SEQ ID NO: 4071922 - DNA, 21 bp, Homo sapiens
tgttctgaggattcaggggct

SEQ ID NO: 4071923 - DNA, 14 bp, Homo sapiens
tgttctgattagaa

SEQ ID NO: 4071924 - DNA, 16 bp, Homo sapiens
tgttctgattagaaat

SEQ ID NO: 4071925 - DNA, 23 bp, Homo sapiens
tgttctgcaaaaatatttataaa

SEQ ID NO: 4071926 - DNA, 12 bp, Homo sapiens
tgttctgcaaag

SEQ ID NO: 4071927 - DNA, 12 bp, Homo sapiens
tgttctgctcct

SEQ ID NO: 4071928 - DNA, 15 bp, Homo sapiens
tgttctgctcctgct

SEQ ID NO: 4071929 - DNA, 16 bp, Homo sapiens
tgttctgctcctgctt

SEQ ID NO: 4071930 - DNA, 13 bp, Homo sapiens
tgttctgctttat

SEQ ID NO: 4071931 - DNA, 13 bp, Homo sapiens
tgttctgggctca

SEQ ID NO: 4071932 - DNA, 23 bp, Homo sapiens
tgttctgtggttcctctgctcac

SEQ ID NO: 4071933 - DNA, 14 bp, Homo sapiens
tgttctgtgtcttt

SEQ ID NO: 4071934 - DNA, 16 bp, Homo sapiens
tgttctgttctggggg

SEQ ID NO: 4071935 - DNA, 19 bp, Homo sapiens
tgttctgtttgttattgtt

SEQ ID NO: 4071936 - DNA, 14 bp, Homo sapiens
tgttcttatagaat

SEQ ID NO: 4071937 - DNA, 11 bp, Homo sapiens
tgttcttccaa

SEQ ID NO: 4071938 - DNA, 13 bp, Homo sapiens
tgttcttcctcca

SEQ ID NO: 4071939 - DNA, 14 bp, Homo sapiens
tgttcttcttggga

SEQ ID NO: 4071940 - DNA, 21 bp, Homo sapiens
tgttcttgcataggctcttaa

SEQ ID NO: 4071941 - DNA, 16 bp, Homo sapiens
tgttctttcctgccct

SEQ ID NO: 4071942 - DNA, 17 bp, Homo sapiens
tgttctttcctgccctg

SEQ ID NO: 4071943 - DNA, 22 bp, Homo sapiens
tgttctttcctgccctgtccaa

SEQ ID NO: 4071944 - DNA, 18 bp, Homo sapiens
tgttctttggaaagtaca

SEQ ID NO: 4071945 - DNA, 20 bp, Homo sapiens
tgttctttggaaatacacag

SEQ ID NO: 4071946 - DNA, 15 bp, Homo sapiens
tgttgaaattatgta

SEQ ID NO: 4071947 - DNA, 22 bp, Homo sapiens
tgttgaaattatgtatgtttac

SEQ ID NO: 4071948 - DNA, 18 bp, Homo sapiens
tgttgaaattttgcaaat

SEQ ID NO: 4071949 - DNA, 21 bp, Homo sapiens
tgttgaaattttgcaaatata

SEQ ID NO: 4071950 - DNA, 15 bp, Homo sapiens
tgttgaacatacttc

SEQ ID NO: 4071951 - DNA, 17 bp, Homo sapiens
tgttgacagttcatatg

SEQ ID NO: 4071952 - DNA, 12 bp, Homo sapiens
tgttgacataca

SEQ ID NO: 4071953 - DNA, 21 bp, Homo sapiens
tgttgaccaggcacctcccct

SEQ ID NO: 4071954 - DNA, 17 bp, Homo sapiens
tgttgactggactgctt

SEQ ID NO: 4071955 - DNA, 21 bp, Homo sapiens
tgttgacttattttctctgtg

SEQ ID NO: 4071956 - DNA, 22 bp, Homo sapiens
tgttgagaatcccaaatttgat

SEQ ID NO: 4071957 - DNA, 13 bp, Homo sapiens
tgttgagacccag

SEQ ID NO: 4071958 - DNA, 20 bp, Homo sapiens
tgttgagcatgacagcctgc

SEQ ID NO: 4071959 - DNA, 16 bp, Homo sapiens
tgttgagccttttccc

SEQ ID NO: 4071960 - DNA, 21 bp, Homo sapiens
tgttgaggtggtctgaatgtt

SEQ ID NO: 4071961 - DNA, 13 bp, Homo sapiens
tgttgagttatga

SEQ ID NO: 4071962 - DNA, 16 bp, Homo sapiens
tgttgagttatgataa

SEQ ID NO: 4071963 - DNA, 22 bp, Homo sapiens
tgttgatgggcacttgagaact

SEQ ID NO: 4071964 - DNA, 13 bp, Homo sapiens
tgttgattaaaac

SEQ ID NO: 4071965 - DNA, 14 bp, Homo sapiens
tgttgattaaaaca

SEQ ID NO: 4071966 - DNA, 11 bp, Homo sapiens
tgttgattatt

SEQ ID NO: 4071967 - DNA, 16 bp, Homo sapiens
tgttgattattagcca

SEQ ID NO: 4071968 - DNA, 20 bp, Homo sapiens
tgttgattgcaggaataagg

SEQ ID NO: 4071969 - DNA, 15 bp, Homo sapiens
tgttgattttctgtt

SEQ ID NO: 4071970 - DNA, 15 bp, Homo sapiens
tgttgcaagatgtga

SEQ ID NO: 4071971 - DNA, 18 bp, Homo sapiens
tgttgcaagatgtgaatt

SEQ ID NO: 4071972 - DNA, 13 bp, Homo sapiens
tgttgcagatgaa

SEQ ID NO: 4071973 - DNA, 22 bp, Homo sapiens
tgttgcagatgaaatgttctgt

SEQ ID NO: 4071974 - DNA, 16 bp, Homo sapiens
tgttgcattattcatt

SEQ ID NO: 4071975 - DNA, 19 bp, Homo sapiens
ttaaactgtacagaatttc

SEQ ID NO: 4071976 - DNA, 17 bp, Homo sapiens
ttaaacttttaattcat

SEQ ID NO: 4071977 - DNA, 12 bp, Homo sapiens
ttaaagaataaa

SEQ ID NO: 4071978 - DNA, 21 bp, Homo sapiens
ttaaagaataaagtccaaagt

SEQ ID NO: 4071979 - DNA, 13 bp, Homo sapiens
ttaaagagaggtt

SEQ ID NO: 4071980 - DNA, 19 bp, Homo sapiens
ttaaagatattgttcaaac

SEQ ID NO: 4071981 - DNA, 22 bp, Homo sapiens
ttaaagatctgtaagtaacttc

SEQ ID NO: 4071982 - DNA, 16 bp, Homo sapiens
ttaaagcaagcaacac

SEQ ID NO: 4071983 - DNA, 14 bp, Homo sapiens
ttaaagcagacagt

SEQ ID NO: 4071984 - DNA, 22 bp, Homo sapiens
ttaaagcagagggactttgtat

SEQ ID NO: 4071985 - DNA, 19 bp, Homo sapiens
ttaaagcatatagagatga

SEQ ID NO: 4071986 - DNA, 14 bp, Homo sapiens
ttaaagcattgctg

SEQ ID NO: 4071987 - DNA, 21 bp, Homo sapiens
ttaaagcattgctgttatgtc

SEQ ID NO: 4071988 - DNA, 18 bp, Homo sapiens
ttaaagcctttagtatca

SEQ ID NO: 4071989 - DNA, 22 bp, Homo sapiens
ttaaagcctttagtatcagtgt

SEQ ID NO: 4071990 - DNA, 16 bp, Homo sapiens
ttaaaggaaaaaatgt

SEQ ID NO: 4071991 - DNA, 21 bp, Homo sapiens
ttaaaggcagtattttgtgtc

SEQ ID NO: 4071992 - DNA, 15 bp, Homo sapiens
ttaaaggctgtggta

SEQ ID NO: 4071993 - DNA, 19 bp, Homo sapiens
ttaaagggtgtacttatat

SEQ ID NO: 4071994 - DNA, 21 bp, Homo sapiens
ttaaaggtttttaaattgttt

SEQ ID NO: 4071995 - DNA, 17 bp, Homo sapiens
ttaaagtgtttcagcta

SEQ ID NO: 4071996 - DNA, 19 bp, Homo sapiens
ttaaagttggaatttacca

SEQ ID NO: 4071997 - DNA, 13 bp, Homo sapiens
ttaaataaaatca

SEQ ID NO: 4071998 - DNA, 24 bp, Homo sapiens
ttaaataatatggctatgcttaaa

SEQ ID NO: 4071999 - DNA, 20 bp, Homo sapiens
ttaaataatgcttcagatat

SEQ ID NO: 4072000 - DNA, 15 bp, Homo sapiens
ttaaatacaaaactt

SEQ ID NO: 4072001 - DNA, 16 bp, Homo sapiens
ttaaatacaaaacttc

SEQ ID NO: 4072002 - DNA, 17 bp, Homo sapiens
ttaaatacagacactaa

SEQ ID NO: 4072003 - DNA, 19 bp, Homo sapiens
ttaaatacagacactaagt

SEQ ID NO: 4072004 - DNA, 20 bp, Homo sapiens
ttaaatacagacactaagtt

SEQ ID NO: 4072005 - DNA, 19 bp, Homo sapiens
ttaaatataattctgtaaa

SEQ ID NO: 4072006 - DNA, 19 bp, Homo sapiens
ttaaatatcttttatgttt

SEQ ID NO: 4072007 - DNA, 20 bp, Homo sapiens
ttaaatatcttttatgtttg

SEQ ID NO: 4072008 - DNA, 16 bp, Homo sapiens
ttaaatcagaataaat

SEQ ID NO: 4072009 - DNA, 12 bp, Homo sapiens
ttaaatcatgta

SEQ ID NO: 4072010 - DNA, 15 bp, Homo sapiens
ttaaatcatgtatgt

SEQ ID NO: 4072011 - DNA, 16 bp, Homo sapiens
ttaaatcatgtatgtt

SEQ ID NO: 4072012 - DNA, 21 bp, Homo sapiens
ttaaatcatgtatgttatgat

SEQ ID NO: 4072013 - DNA, 19 bp, Homo sapiens
ttaaatcgccttgaacaaa

SEQ ID NO: 4072014 - DNA, 20 bp, Homo sapiens
ttaaatctaaatctatttat

SEQ ID NO: 4072015 - DNA, 12 bp, Homo sapiens
ttaaatctcaaa

SEQ ID NO: 4072016 - DNA, 18 bp, Homo sapiens
ttaaatctcaaatttatt

SEQ ID NO: 4072017 - DNA, 16 bp, Homo sapiens
ttaaatgaggattatt

SEQ ID NO: 4072018 - DNA, 19 bp, Homo sapiens
ttaaatgcaataattttac

SEQ ID NO: 4072019 - DNA, 16 bp, Homo sapiens
ttaaatggcagtattt

SEQ ID NO: 4072020 - DNA, 19 bp, Homo sapiens
ttaaatggcagtatttcat

SEQ ID NO: 4072021 - DNA, 14 bp, Homo sapiens
ttaaatgtaactta

SEQ ID NO: 4072022 - DNA, 16 bp, Homo sapiens
ttaaatgtatttaatt

SEQ ID NO: 4072023 - DNA, 16 bp, Homo sapiens
ttaaatgtattttaca

SEQ ID NO: 4072024 - DNA, 18 bp, Homo sapiens
ttaaatgtattttacata

SEQ ID NO: 4072025 - DNA, 16 bp, Homo sapiens
ttaaatgttatgacta

SEQ ID NO: 4072026 - DNA, 21 bp, Homo sapiens
ttaaattataacttaaaatat

SEQ ID NO: 4072027 - DNA, 12 bp, Homo sapiens
ttaaattctgag

SEQ ID NO: 4072028 - DNA, 14 bp, Homo sapiens
ttaaatttcttatg

SEQ ID NO: 4072029 - DNA, 13 bp, Homo sapiens
ttaaatttgtaag

SEQ ID NO: 4072030 - DNA, 15 bp, Homo sapiens
ttaaatttgtaagtt

SEQ ID NO: 4072031 - DNA, 17 bp, Homo sapiens
ttaaatttgtaagtttc

SEQ ID NO: 4072032 - DNA, 19 bp, Homo sapiens
ttaaatttgttgacaaaat

SEQ ID NO: 4072033 - DNA, 17 bp, Homo sapiens
ttaaattttttttacat

SEQ ID NO: 4072034 - DNA, 19 bp, Homo sapiens
ttaacaaaccaacatcttt

SEQ ID NO: 4072035 - DNA, 12 bp, Homo sapiens
ttaacaaatatg

SEQ ID NO: 4072036 - DNA, 22 bp, Homo sapiens
ttaacaacaataacactgtctc

SEQ ID NO: 4072037 - DNA, 21 bp, Homo sapiens
ttaacaaggaatgcctgtgcc

SEQ ID NO: 4072038 - DNA, 16 bp, Homo sapiens
ttaacaattccaaagg

SEQ ID NO: 4072039 - DNA, 13 bp, Homo sapiens
ttaacagttttcc

SEQ ID NO: 4072040 - DNA, 16 bp, Homo sapiens
ttaacagttttccatg

SEQ ID NO: 4072041 - DNA, 19 bp, Homo sapiens
ttaacagttttccatgaaa

SEQ ID NO: 4072042 - DNA, 20 bp, Homo sapiens
ttaacagttttccatgaaaa

SEQ ID NO: 4072043 - DNA, 15 bp, Homo sapiens
ttaacattcatagag

SEQ ID NO: 4072044 - DNA, 22 bp, Homo sapiens
ttaacattgaccaagaactgca

SEQ ID NO: 4072045 - DNA, 17 bp, Homo sapiens
ttaaccccatgtcctca

SEQ ID NO: 4072046 - DNA, 15 bp, Homo sapiens
ttaacccttcatctt

SEQ ID NO: 4072047 - DNA, 12 bp, Homo sapiens
ttaacctttgat

SEQ ID NO: 4072048 - DNA, 14 bp, Homo sapiens
ttaacctttttgta

SEQ ID NO: 4072049 - DNA, 21 bp, Homo sapiens
ttaacctttttgtaaatactg

SEQ ID NO: 4072050 - DNA, 15 bp, Homo sapiens
ttaactaatttgaat

SEQ ID NO: 4072051 - DNA, 13 bp, Homo sapiens
ttaactacattta

SEQ ID NO: 4072052 - DNA, 16 bp, Homo sapiens
ttaactagaatttatt

SEQ ID NO: 4072053 - DNA, 21 bp, Homo sapiens
ttaactattgcatttatatgt

SEQ ID NO: 4072054 - DNA, 15 bp, Homo sapiens
ttaactgaaaatgta

SEQ ID NO: 4072055 - DNA, 21 bp, Homo sapiens
ttaactgaacaatggccctgt

SEQ ID NO: 4072056 - DNA, 14 bp, Homo sapiens
ttaactttaatgtt

SEQ ID NO: 4072057 - DNA, 23 bp, Homo sapiens
ttaactttatcacattatttgca

SEQ ID NO: 4072058 - DNA, 11 bp, Homo sapiens
ttaagaaaaaa

SEQ ID NO: 4072059 - DNA, 14 bp, Homo sapiens
ttaagaaaagtatt

SEQ ID NO: 4072060 - DNA, 15 bp, Homo sapiens
ttaagaaaagtattt

SEQ ID NO: 4072061 - DNA, 18 bp, Homo sapiens
ttaagaaaagtattttga

SEQ ID NO: 4072062 - DNA, 22 bp, Homo sapiens
ttaagaagctgttgtacattta

SEQ ID NO: 4072063 - DNA, 14 bp, Homo sapiens
ttaagaaggcaaaa

SEQ ID NO: 4072064 - DNA, 18 bp, Homo sapiens
ttaagaaggcaaaaatgt

SEQ ID NO: 4072065 - DNA, 19 bp, Homo sapiens
ttaagaatatgtttccttg

SEQ ID NO: 4072066 - DNA, 19 bp, Homo sapiens
ttaagaattgagtaatggt

SEQ ID NO: 4072067 - DNA, 18 bp, Homo sapiens
ttaagacatgatttcctt

SEQ ID NO: 4072068 - DNA, 11 bp, Homo sapiens
ttaagacctgg

SEQ ID NO: 4072069 - DNA, 12 bp, Homo sapiens
ttaagagaaact

SEQ ID NO: 4072070 - DNA, 19 bp, Homo sapiens
ttaagagaaactttataca

SEQ ID NO: 4072071 - DNA, 20 bp, Homo sapiens
ttaagagaaactttatacat

SEQ ID NO: 4072072 - DNA, 23 bp, Homo sapiens
ttaagagaaactttatacattag

SEQ ID NO: 4072073 - DNA, 13 bp, Homo sapiens
ttaagagataatt

SEQ ID NO: 4072074 - DNA, 21 bp, Homo sapiens
ttaagagataattcttaaaag

SEQ ID NO: 4072075 - DNA, 17 bp, Homo sapiens
ttaagagctaaccagtt

SEQ ID NO: 4072076 - DNA, 14 bp, Homo sapiens
ttaagatggattct

SEQ ID NO: 4072077 - DNA, 17 bp, Homo sapiens
ttaagatggattctcag

SEQ ID NO: 4072078 - DNA, 21 bp, Homo sapiens
ttactatgtgccagttcctgt

SEQ ID NO: 4072079 - DNA, 14 bp, Homo sapiens
ttactattaagcag

SEQ ID NO: 4072080 - DNA, 19 bp, Homo sapiens
ttactattaagcagtaaaa

SEQ ID NO: 4072081 - DNA, 21 bp, Homo sapiens
ttactattccctttgacttca

SEQ ID NO: 4072082 - DNA, 21 bp, Homo sapiens
ttactattttctacaattaat

SEQ ID NO: 4072083 - DNA, 21 bp, Homo sapiens
ttactattttgacagttattt

SEQ ID NO: 4072084 - DNA, 12 bp, Homo sapiens
ttactcagggtt

SEQ ID NO: 4072085 - DNA, 14 bp, Homo sapiens
ttactcagggttca

SEQ ID NO: 4072086 - DNA, 20 bp, Homo sapiens
ttactcccaagacttcattg

SEQ ID NO: 4072087 - DNA, 14 bp, Homo sapiens
ttactgatcatgca

SEQ ID NO: 4072088 - DNA, 15 bp, Homo sapiens
ttactgatcatgcat

SEQ ID NO: 4072089 - DNA, 16 bp, Homo sapiens
ttactgatcatgcatt

SEQ ID NO: 4072090 - DNA, 13 bp, Homo sapiens
ttactgattattt

SEQ ID NO: 4072091 - DNA, 22 bp, Homo sapiens
ttactgcagcctttgcctcccc

SEQ ID NO: 4072092 - DNA, 23 bp, Homo sapiens
ttactgtcaaggctgcttagaat

SEQ ID NO: 4072093 - DNA, 12 bp, Homo sapiens
ttactgtgtaaa

SEQ ID NO: 4072094 - DNA, 19 bp, Homo sapiens
ttactgtgtaaatatatgt

SEQ ID NO: 4072095 - DNA, 16 bp, Homo sapiens
ttactgttatttaatt

SEQ ID NO: 4072096 - DNA, 16 bp, Homo sapiens
ttactgttgcatttac

SEQ ID NO: 4072097 - DNA, 15 bp, Homo sapiens
ttactgtttatttct

SEQ ID NO: 4072098 - DNA, 18 bp, Homo sapiens
ttactgtttatttctgtt

SEQ ID NO: 4072099 - DNA, 23 bp, Homo sapiens
ttactgttttgaaatcaatgcaa

SEQ ID NO: 4072100 - DNA, 14 bp, Homo sapiens
ttacttgacctcct

SEQ ID NO: 4072101 - DNA, 19 bp, Homo sapiens
ttacttgcattgaatatat

SEQ ID NO: 4072102 - DNA, 13 bp, Homo sapiens
ttacttgcttctc

SEQ ID NO: 4072103 - DNA, 16 bp, Homo sapiens
ttactttaaacttgtc

SEQ ID NO: 4072104 - DNA, 13 bp, Homo sapiens
ttactttagaaaa

SEQ ID NO: 4072105 - DNA, 15 bp, Homo sapiens
ttactttatgtttgt

SEQ ID NO: 4072106 - DNA, 18 bp, Homo sapiens
ttactttctgttgccaca

SEQ ID NO: 4072107 - DNA, 10 bp, Homo sapiens
ttactttgta

SEQ ID NO: 4072108 - DNA, 19 bp, Homo sapiens
ttactttgtacttgtgttt

SEQ ID NO: 4072109 - DNA, 15 bp, Homo sapiens
ttagaaaaaaattac

SEQ ID NO: 4072110 - DNA, 19 bp, Homo sapiens
ttagaaaatgttatttaac

SEQ ID NO: 4072111 - DNA, 17 bp, Homo sapiens
ttagaaacatggttttg

SEQ ID NO: 4072112 - DNA, 13 bp, Homo sapiens
ttagaaatagaca

SEQ ID NO: 4072113 - DNA, 12 bp, Homo sapiens
ttagaaatataa

SEQ ID NO: 4072114 - DNA, 16 bp, Homo sapiens
ttagaaatcaagcata

SEQ ID NO: 4072115 - DNA, 17 bp, Homo sapiens
ttagaaatgaccaatat

SEQ ID NO: 4072116 - DNA, 17 bp, Homo sapiens
ttagaagtgcatttctg

SEQ ID NO: 4072117 - DNA, 19 bp, Homo sapiens
ttagaagtgcatttctgaa

SEQ ID NO: 4072118 - DNA, 13 bp, Homo sapiens
ttagaatgttgaa

SEQ ID NO: 4072119 - DNA, 21 bp, Homo sapiens
ttagactcatcaatcaaataa

SEQ ID NO: 4072120 - DNA, 17 bp, Homo sapiens
ttagactcttttccttc

SEQ ID NO: 4072121 - DNA, 18 bp, Homo sapiens
ttagactgtgattcagaa

SEQ ID NO: 4072122 - DNA, 15 bp, Homo sapiens
ttagacttactatta

SEQ ID NO: 4072123 - DNA, 21 bp, Homo sapiens
ttagagaagtatacataagtt

SEQ ID NO: 4072124 - DNA, 14 bp, Homo sapiens
ttagagccttttat

SEQ ID NO: 4072125 - DNA, 15 bp, Homo sapiens
ttagagccttttatc

SEQ ID NO: 4072126 - DNA, 21 bp, Homo sapiens
ttagagcttccgagaatagct

SEQ ID NO: 4072127 - DNA, 15 bp, Homo sapiens
ttagaggaaaatgag

SEQ ID NO: 4072128 - DNA, 20 bp, Homo sapiens
ttagaggcattgttagttta

SEQ ID NO: 4072129 - DNA, 13 bp, Homo sapiens
ttagagtttctgt

SEQ ID NO: 4072130 - DNA, 17 bp, Homo sapiens
ttagatagctgcatgtg

SEQ ID NO: 4072131 - DNA, 21 bp, Homo sapiens
ttagatgttccagtaatctaa

SEQ ID NO: 4072132 - DNA, 22 bp, Homo sapiens
ttagatgttccagtaatctaat

SEQ ID NO: 4072133 - DNA, 15 bp, Homo sapiens
ttagatgtttcacac

SEQ ID NO: 4072134 - DNA, 14 bp, Homo sapiens
ttagatttcatagt

SEQ ID NO: 4072135 - DNA, 18 bp, Homo sapiens
ttagatttcatagttcag

SEQ ID NO: 4072136 - DNA, 17 bp, Homo sapiens
ttagcatgtgttgaaaa

SEQ ID NO: 4072137 - DNA, 17 bp, Homo sapiens
ttagccaggatcatggt

SEQ ID NO: 4072138 - DNA, 13 bp, Homo sapiens
ttagcccttcaga

SEQ ID NO: 4072139 - DNA, 15 bp, Homo sapiens
ttagcctccctgaaa

SEQ ID NO: 4072140 - DNA, 19 bp, Homo sapiens
ttagcggcaaacctttccc

SEQ ID NO: 4072141 - DNA, 21 bp, Homo sapiens
ttagcgtagctaagtgaaaag

SEQ ID NO: 4072142 - DNA, 10 bp, Homo sapiens
ttagctgagc

SEQ ID NO: 4072143 - DNA, 17 bp, Homo sapiens
ttagctgtaacagttct

SEQ ID NO: 4072144 - DNA, 13 bp, Homo sapiens
ttagcttccttaa

SEQ ID NO: 4072145 - DNA, 20 bp, Homo sapiens
ttagctttgtgtttggttta

SEQ ID NO: 4072146 - DNA, 22 bp, Homo sapiens
ttagctttgtgtttggtttaca

SEQ ID NO: 4072147 - DNA, 20 bp, Homo sapiens
ttaggaaaaccagagcctat

SEQ ID NO: 4072148 - DNA, 17 bp, Homo sapiens
ttaggaacagcagtgtt

SEQ ID NO: 4072149 - DNA, 18 bp, Homo sapiens
ttaggaacagcagtgttc

SEQ ID NO: 4072150 - DNA, 19 bp, Homo sapiens
ttaggaagtgtaacagctg

SEQ ID NO: 4072151 - DNA, 22 bp, Homo sapiens
ttaggaagttgacttatagtac

SEQ ID NO: 4072152 - DNA, 17 bp, Homo sapiens
ttaggaagttttctgta

SEQ ID NO: 4072153 - DNA, 23 bp, Homo sapiens
ttaggaattaagttatctttaaa

SEQ ID NO: 4072154 - DNA, 13 bp, Homo sapiens
ttaggagaagcca

SEQ ID NO: 4072155 - DNA, 20 bp, Homo sapiens
ttaggagtggttctcatttg

SEQ ID NO: 4072156 - DNA, 19 bp, Homo sapiens
ttaggcaaagataatttat

SEQ ID NO: 4072157 - DNA, 23 bp, Homo sapiens
ttaggcagcagcttttaatacag

SEQ ID NO: 4072158 - DNA, 18 bp, Homo sapiens
ttaggcatggttttgggc

SEQ ID NO: 4072159 - DNA, 10 bp, Homo sapiens
ttaggccagc

SEQ ID NO: 4072160 - DNA, 22 bp, Homo sapiens
ttaggctatttgtaaatctgcc

SEQ ID NO: 4072161 - DNA, 17 bp, Homo sapiens
ttagggagaaaattcaa

SEQ ID NO: 4072162 - DNA, 15 bp, Homo sapiens
ttagggccaggcagg

SEQ ID NO: 4072163 - DNA, 11 bp, Homo sapiens
ttagggtacag

SEQ ID NO: 4072164 - DNA, 15 bp, Homo sapiens
ttagggtgaaccact

SEQ ID NO: 4072165 - DNA, 17 bp, Homo sapiens
ttagggttttgcaataa

SEQ ID NO: 4072166 - DNA, 21 bp, Homo sapiens
ttaggtaaccttatatttaca

SEQ ID NO: 4072167 - DNA, 23 bp, Homo sapiens
ttaggtaagaagttttaaaaagc

SEQ ID NO: 4072168 - DNA, 16 bp, Homo sapiens
ttaggtagactttgct

SEQ ID NO: 4072169 - DNA, 23 bp, Homo sapiens
ttaggtccctcactccacagagt

SEQ ID NO: 4072170 - DNA, 19 bp, Homo sapiens
ttaggtgttgattttctgt

SEQ ID NO: 4072171 - DNA, 16 bp, Homo sapiens
ttaggtttttccttat

SEQ ID NO: 4072172 - DNA, 13 bp, Homo sapiens
ttagtaaatgtct

SEQ ID NO: 4072173 - DNA, 24 bp, Homo sapiens
ttagtaacatgaggggacattttg

SEQ ID NO: 4072174 - DNA, 16 bp, Homo sapiens
ttagtaactttgaaag

SEQ ID NO: 4072175 - DNA, 17 bp, Homo sapiens
ttagtaactttgaaagg

SEQ ID NO: 4072176 - DNA, 21 bp, Homo sapiens
ttagtagaaattttacaatag

SEQ ID NO: 4072177 - DNA, 14 bp, Homo sapiens
ttagtattcattct

SEQ ID NO: 4072178 - DNA, 14 bp, Homo sapiens
ttagtatttttact

SEQ ID NO: 4072179 - DNA, 15 bp, Homo sapiens
ttagtcatccaacaa

SEQ ID NO: 4072180 - DNA, 23 bp, Homo sapiens
ttagtcatccaacaagaagaaat

SEQ ID NO: 4072181 - DNA, 23 bp, Homo sapiens
ttcactagaagccgtgggaagaa

SEQ ID NO: 4072182 - DNA, 13 bp, Homo sapiens
ttcactagctttg

SEQ ID NO: 4072183 - DNA, 18 bp, Homo sapiens
ttcactataaatggtgtt

SEQ ID NO: 4072184 - DNA, 17 bp, Homo sapiens
ttcactccccctaaacc

SEQ ID NO: 4072185 - DNA, 12 bp, Homo sapiens
ttcactctctga

SEQ ID NO: 4072186 - DNA, 18 bp, Homo sapiens
ttcactgaaatgtttgga

SEQ ID NO: 4072187 - DNA, 15 bp, Homo sapiens
ttcactgagctcccc

SEQ ID NO: 4072188 - DNA, 21 bp, Homo sapiens
ttcactgagctccccagatct

SEQ ID NO: 4072189 - DNA, 13 bp, Homo sapiens
ttcactgcaattt

SEQ ID NO: 4072190 - DNA, 16 bp, Homo sapiens
ttcactggagttacat

SEQ ID NO: 4072191 - DNA, 15 bp, Homo sapiens
ttcactgtataaata

SEQ ID NO: 4072192 - DNA, 15 bp, Homo sapiens
ttcactgtctgtctg

SEQ ID NO: 4072193 - DNA, 19 bp, Homo sapiens
ttcactgtctttaattctg

SEQ ID NO: 4072194 - DNA, 13 bp, Homo sapiens
ttcacttctttcc

SEQ ID NO: 4072195 - DNA, 15 bp, Homo sapiens
ttcacttctttccct

SEQ ID NO: 4072196 - DNA, 16 bp, Homo sapiens
ttcacttctttccctt

SEQ ID NO: 4072197 - DNA, 16 bp, Homo sapiens
ttcacttttgttctgc

SEQ ID NO: 4072198 - DNA, 13 bp, Homo sapiens
ttcagaaaatatt

SEQ ID NO: 4072199 - DNA, 14 bp, Homo sapiens
ttcagaaaatatta

SEQ ID NO: 4072200 - DNA, 21 bp, Homo sapiens
ttcagaaaatattatgtgttt

SEQ ID NO: 4072201 - DNA, 16 bp, Homo sapiens
ttcagaaagacttggt

SEQ ID NO: 4072202 - DNA, 13 bp, Homo sapiens
ttcagaaattgga

SEQ ID NO: 4072203 - DNA, 21 bp, Homo sapiens
ttcagaaattggaacagaatg

SEQ ID NO: 4072204 - DNA, 12 bp, Homo sapiens
ttcagaacctct

SEQ ID NO: 4072205 - DNA, 15 bp, Homo sapiens
ttcagaacctcttcc

SEQ ID NO: 4072206 - DNA, 20 bp, Homo sapiens
ttcagacacctgttcacaga

SEQ ID NO: 4072207 - DNA, 22 bp, Homo sapiens
ttcagacacctgttcacagaaa

SEQ ID NO: 4072208 - DNA, 16 bp, Homo sapiens
ttcagacccctgcctg

SEQ ID NO: 4072209 - DNA, 20 bp, Homo sapiens
ttcagagagggcagaggggt

SEQ ID NO: 4072210 - DNA, 22 bp, Homo sapiens
ttcagaggataaatatcaatgg

SEQ ID NO: 4072211 - DNA, 19 bp, Homo sapiens
ttcagagtgaagaatctta

SEQ ID NO: 4072212 - DNA, 22 bp, Homo sapiens
ttcagatatcaaaattctagct

SEQ ID NO: 4072213 - DNA, 15 bp, Homo sapiens
ttcagatgcttctgg

SEQ ID NO: 4072214 - DNA, 19 bp, Homo sapiens
ttcagatgcttctgggaga

SEQ ID NO: 4072215 - DNA, 14 bp, Homo sapiens
ttcagattgtcttg

SEQ ID NO: 4072216 - DNA, 20 bp, Homo sapiens
ttcagattttaaaaagtctt

SEQ ID NO: 4072217 - DNA, 15 bp, Homo sapiens
ttcagcacccccacc

SEQ ID NO: 4072218 - DNA, 18 bp, Homo sapiens
ttcagcacccccacccac

SEQ ID NO: 4072219 - DNA, 21 bp, Homo sapiens
ttcagcacccccacccacctc

SEQ ID NO: 4072220 - DNA, 21 bp, Homo sapiens
ttcagcactgtcccttgcctc

SEQ ID NO: 4072221 - DNA, 12 bp, Homo sapiens
ttcagcctggcc

SEQ ID NO: 4072222 - DNA, 13 bp, Homo sapiens
ttcagctgagccc

SEQ ID NO: 4072223 - DNA, 15 bp, Homo sapiens
ttcagctgagccctg

SEQ ID NO: 4072224 - DNA, 17 bp, Homo sapiens
ttcagctgcctgaaaca

SEQ ID NO: 4072225 - DNA, 19 bp, Homo sapiens
ttcagctgcctgaaacagc

SEQ ID NO: 4072226 - DNA, 22 bp, Homo sapiens
ttcaggaactggggctttgcct

SEQ ID NO: 4072227 - DNA, 14 bp, Homo sapiens
ttcaggaggctgga

SEQ ID NO: 4072228 - DNA, 15 bp, Homo sapiens
ttcaggccagcccag

SEQ ID NO: 4072229 - DNA, 16 bp, Homo sapiens
ttcaggccagcccagc

SEQ ID NO: 4072230 - DNA, 18 bp, Homo sapiens
ttcaggccagcccagcca

SEQ ID NO: 4072231 - DNA, 18 bp, Homo sapiens
ttcagggcagggctctga

SEQ ID NO: 4072232 - DNA, 15 bp, Homo sapiens
ttcagggccagtcct

SEQ ID NO: 4072233 - DNA, 17 bp, Homo sapiens
ttcaggggactcagccc

SEQ ID NO: 4072234 - DNA, 20 bp, Homo sapiens
ttcaggggctgggggtgctg

SEQ ID NO: 4072235 - DNA, 22 bp, Homo sapiens
ttcaggggggttgtgaggcctg

SEQ ID NO: 4072236 - DNA, 21 bp, Homo sapiens
ttcagggttttctgagggaaa

SEQ ID NO: 4072237 - DNA, 14 bp, Homo sapiens
ttcaggtgacatgt

SEQ ID NO: 4072238 - DNA, 19 bp, Homo sapiens
ttcaggtgacatgtgaaac

SEQ ID NO: 4072239 - DNA, 22 bp, Homo sapiens
ttcaggtgacatgtgaaacctt

SEQ ID NO: 4072240 - DNA, 20 bp, Homo sapiens
ttcaggtgtttagttgcaga

SEQ ID NO: 4072241 - DNA, 22 bp, Homo sapiens
ttcaggttatcgaaataacaat

SEQ ID NO: 4072242 - DNA, 17 bp, Homo sapiens
ttcagtccagaagaatt

SEQ ID NO: 4072243 - DNA, 20 bp, Homo sapiens
ttcagtctgaatgctgccac

SEQ ID NO: 4072244 - DNA, 19 bp, Homo sapiens
ttcagtcttggtggttcta

SEQ ID NO: 4072245 - DNA, 14 bp, Homo sapiens
ttcagtgtagttaa

SEQ ID NO: 4072246 - DNA, 20 bp, Homo sapiens
ttcagtgtagttaatttatc

SEQ ID NO: 4072247 - DNA, 22 bp, Homo sapiens
ttcagtgttacctgtgtgcttg

SEQ ID NO: 4072248 - DNA, 22 bp, Homo sapiens
ttcagtttatttgaaccaataa

SEQ ID NO: 4072249 - DNA, 13 bp, Homo sapiens
ttcagtttcataa

SEQ ID NO: 4072250 - DNA, 16 bp, Homo sapiens
ttcagtttcataaaag

SEQ ID NO: 4072251 - DNA, 19 bp, Homo sapiens
ttcagttttatttttgcca

SEQ ID NO: 4072252 - DNA, 21 bp, Homo sapiens
ttcagttttcatttggttcat

SEQ ID NO: 4072253 - DNA, 13 bp, Homo sapiens
ttcagtttttgta

SEQ ID NO: 4072254 - DNA, 16 bp, Homo sapiens
ttcagtttttgtatct

SEQ ID NO: 4072255 - DNA, 20 bp, Homo sapiens
ttcataaagtacttgagtgt

SEQ ID NO: 4072256 - DNA, 18 bp, Homo sapiens
ttcataaccaacaatata

SEQ ID NO: 4072257 - DNA, 18 bp, Homo sapiens
ttcatacactaaccaaat

SEQ ID NO: 4072258 - DNA, 20 bp, Homo sapiens
ttcatacactaaccaaatct

SEQ ID NO: 4072259 - DNA, 20 bp, Homo sapiens
ttcatagagatttgtctaat

SEQ ID NO: 4072260 - DNA, 23 bp, Homo sapiens
ttcatagggaaaggttttgtatt

SEQ ID NO: 4072261 - DNA, 15 bp, Homo sapiens
ttcatagtttattat

SEQ ID NO: 4072262 - DNA, 13 bp, Homo sapiens
ttcatatgctgta

SEQ ID NO: 4072263 - DNA, 14 bp, Homo sapiens
ttcatatgttgctc

SEQ ID NO: 4072264 - DNA, 16 bp, Homo sapiens
ttcatatgttgctcag

SEQ ID NO: 4072265 - DNA, 16 bp, Homo sapiens
ttcatatttacttctt

SEQ ID NO: 4072266 - DNA, 21 bp, Homo sapiens
ttcatatttacttcttataca

SEQ ID NO: 4072267 - DNA, 22 bp, Homo sapiens
ttcatcaatatccctcttgtaa

SEQ ID NO: 4072268 - DNA, 11 bp, Homo sapiens
ttcatcactgg

SEQ ID NO: 4072269 - DNA, 15 bp, Homo sapiens
ttcatcattgtttct

SEQ ID NO: 4072270 - DNA, 18 bp, Homo sapiens
ttcatccaacttccaaga

SEQ ID NO: 4072271 - DNA, 16 bp, Homo sapiens
ttcatccaatcctcac

SEQ ID NO: 4072272 - DNA, 22 bp, Homo sapiens
ttcatccaatcctcactgggtg

SEQ ID NO: 4072273 - DNA, 13 bp, Homo sapiens
ttcatccagagtt

SEQ ID NO: 4072274 - DNA, 14 bp, Homo sapiens
ttcatccagagttc

SEQ ID NO: 4072275 - DNA, 17 bp, Homo sapiens
ttcatccagcagtgttg

SEQ ID NO: 4072276 - DNA, 21 bp, Homo sapiens
ttcatccaggcccaactgtga

SEQ ID NO: 4072277 - DNA, 18 bp, Homo sapiens
ttcatcctgactctgccc

SEQ ID NO: 4072278 - DNA, 17 bp, Homo sapiens
ttcatccttcccactct

SEQ ID NO: 4072279 - DNA, 18 bp, Homo sapiens
ttcatcgaatctactaat

SEQ ID NO: 4072280 - DNA, 20 bp, Homo sapiens
ttcatcgaatctactaattc

SEQ ID NO: 4072281 - DNA, 16 bp, Homo sapiens
ttcatctgtccatggc

SEQ ID NO: 4072282 - DNA, 20 bp, Homo sapiens
ttcatctgtccatggccttt

SEQ ID NO: 4072283 - DNA, 15 bp, Homo sapiens
ttccctttgacttca

SEQ ID NO: 4072284 - DNA, 17 bp, Homo sapiens
ttccctttggagatgct

SEQ ID NO: 4072285 - DNA, 17 bp, Homo sapiens
ttccgcaggcagactac

SEQ ID NO: 4072286 - DNA, 16 bp, Homo sapiens
ttccgtgaactctggt

SEQ ID NO: 4072287 - DNA, 23 bp, Homo sapiens
ttccgttaacctttttgtaaata

SEQ ID NO: 4072288 - DNA, 16 bp, Homo sapiens
ttccgttctgttctgc

SEQ ID NO: 4072289 - DNA, 15 bp, Homo sapiens
ttccgtttgcttttg

SEQ ID NO: 4072290 - DNA, 16 bp, Homo sapiens
ttcctaaatgcagtga

SEQ ID NO: 4072291 - DNA, 19 bp, Homo sapiens
ttcctaacacagcatgtgt

SEQ ID NO: 4072292 - DNA, 13 bp, Homo sapiens
ttcctaagccact

SEQ ID NO: 4072293 - DNA, 17 bp, Homo sapiens
ttcctaagtataaatgg

SEQ ID NO: 4072294 - DNA, 20 bp, Homo sapiens
ttcctaatcagaaattttta

SEQ ID NO: 4072295 - DNA, 16 bp, Homo sapiens
ttcctacaaagatgtt

SEQ ID NO: 4072296 - DNA, 23 bp, Homo sapiens
ttcctacaagagcagcctgtggc

SEQ ID NO: 4072297 - DNA, 14 bp, Homo sapiens
ttcctacagcacta

SEQ ID NO: 4072298 - DNA, 22 bp, Homo sapiens
ttcctacagcactactgggtgt

SEQ ID NO: 4072299 - DNA, 14 bp, Homo sapiens
ttcctacagcccct

SEQ ID NO: 4072300 - DNA, 20 bp, Homo sapiens
ttcctacatcttcttcccag

SEQ ID NO: 4072301 - DNA, 21 bp, Homo sapiens
ttcctacccacacctctgcca

SEQ ID NO: 4072302 - DNA, 16 bp, Homo sapiens
ttcctactcacacttc

SEQ ID NO: 4072303 - DNA, 12 bp, Homo sapiens
ttcctactcttc

SEQ ID NO: 4072304 - DNA, 18 bp, Homo sapiens
ttcctactcttctctctg

SEQ ID NO: 4072305 - DNA, 20 bp, Homo sapiens
ttcctactcttctctctgct

SEQ ID NO: 4072306 - DNA, 21 bp, Homo sapiens
ttcctactcttctctctgctc

SEQ ID NO: 4072307 - DNA, 22 bp, Homo sapiens
ttcctactcttctctctgctct

SEQ ID NO: 4072308 - DNA, 19 bp, Homo sapiens
ttcctactgacaacattat

SEQ ID NO: 4072309 - DNA, 18 bp, Homo sapiens
ttcctagataaaaagatg

SEQ ID NO: 4072310 - DNA, 17 bp, Homo sapiens
ttcctaggatgtcatgt

SEQ ID NO: 4072311 - DNA, 21 bp, Homo sapiens
ttcctaggcccaggcctgggt

SEQ ID NO: 4072312 - DNA, 17 bp, Homo sapiens
ttcctagtggatgactg

SEQ ID NO: 4072313 - DNA, 22 bp, Homo sapiens
ttcctagttcatcccttctctt

SEQ ID NO: 4072314 - DNA, 22 bp, Homo sapiens
ttcctatttcagtgttacctgt

SEQ ID NO: 4072315 - DNA, 22 bp, Homo sapiens
ttcctcaaattttttgactttt

SEQ ID NO: 4072316 - DNA, 15 bp, Homo sapiens
ttcctcacacccctg

SEQ ID NO: 4072317 - DNA, 13 bp, Homo sapiens
ttcctcagatgat

SEQ ID NO: 4072318 - DNA, 16 bp, Homo sapiens
ttcctcagctgcctcc

SEQ ID NO: 4072319 - DNA, 23 bp, Homo sapiens
ttcctcagctggttactcagggt

SEQ ID NO: 4072320 - DNA, 19 bp, Homo sapiens
ttcctcatccaccccatcc

SEQ ID NO: 4072321 - DNA, 22 bp, Homo sapiens
ttcctccaaatctcttgcttgt

SEQ ID NO: 4072322 - DNA, 17 bp, Homo sapiens
ttcctccagctgcacca

SEQ ID NO: 4072323 - DNA, 22 bp, Homo sapiens
ttcctccagctgcaccagagca

SEQ ID NO: 4072324 - DNA, 17 bp, Homo sapiens
ttcctccatttgagaaa

SEQ ID NO: 4072325 - DNA, 15 bp, Homo sapiens
ttcctccccctgcaa

SEQ ID NO: 4072326 - DNA, 10 bp, Homo sapiens
ttcctccctc

SEQ ID NO: 4072327 - DNA, 22 bp, Homo sapiens
ttcctccctcccacactcgcca

SEQ ID NO: 4072328 - DNA, 15 bp, Homo sapiens
ttcctcccttacaga

SEQ ID NO: 4072329 - DNA, 20 bp, Homo sapiens
ttcctcctcaggcacacagc

SEQ ID NO: 4072330 - DNA, 14 bp, Homo sapiens
ttcctcctccccac

SEQ ID NO: 4072331 - DNA, 20 bp, Homo sapiens
ttcctcctctgcctacagcc

SEQ ID NO: 4072332 - DNA, 15 bp, Homo sapiens
ttcctctagaagcca

SEQ ID NO: 4072333 - DNA, 17 bp, Homo sapiens
ttcctctagaagccaag

SEQ ID NO: 4072334 - DNA, 13 bp, Homo sapiens
ttcctctccactg

SEQ ID NO: 4072335 - DNA, 15 bp, Homo sapiens
ttcctctgagcccag

SEQ ID NO: 4072336 - DNA, 17 bp, Homo sapiens
ttcctctgagcccagct

SEQ ID NO: 4072337 - DNA, 21 bp, Homo sapiens
ttcctctgagcccagctgcct

SEQ ID NO: 4072338 - DNA, 22 bp, Homo sapiens
ttcctctgagcccagctgcctg

SEQ ID NO: 4072339 - DNA, 23 bp, Homo sapiens
ttcctctgagcccagctgcctgg

SEQ ID NO: 4072340 - DNA, 11 bp, Homo sapiens
ttcctctgctc

SEQ ID NO: 4072341 - DNA, 15 bp, Homo sapiens
ttcctctggccgcag

SEQ ID NO: 4072342 - DNA, 21 bp, Homo sapiens
ttcctctgtattgtgctgatt

SEQ ID NO: 4072343 - DNA, 12 bp, Homo sapiens
ttcctcttccaa

SEQ ID NO: 4072344 - DNA, 15 bp, Homo sapiens
ttcctgaagaaccag

SEQ ID NO: 4072345 - DNA, 16 bp, Homo sapiens
ttcctgaatgaaatat

SEQ ID NO: 4072346 - DNA, 16 bp, Homo sapiens
ttcctgacatcacagc

SEQ ID NO: 4072347 - DNA, 17 bp, Homo sapiens
ttcctgacatcacagca

SEQ ID NO: 4072348 - DNA, 19 bp, Homo sapiens
ttcctgacatcacagcagc

SEQ ID NO: 4072349 - DNA, 20 bp, Homo sapiens
ttcctgacatcacagcagcc

SEQ ID NO: 4072350 - DNA, 13 bp, Homo sapiens
ttcctgacttgag

SEQ ID NO: 4072351 - DNA, 16 bp, Homo sapiens
ttcctgagatttcctc

SEQ ID NO: 4072352 - DNA, 21 bp, Homo sapiens
ttcctgagatttcctcctggc

SEQ ID NO: 4072353 - DNA, 19 bp, Homo sapiens
ttcctgattggtttctctt

SEQ ID NO: 4072354 - DNA, 19 bp, Homo sapiens
ttcctgcaactcaaggact

SEQ ID NO: 4072355 - DNA, 17 bp, Homo sapiens
ttcctgcaattttctaa

SEQ ID NO: 4072356 - DNA, 19 bp, Homo sapiens
ttcctgcagccccagaaga

SEQ ID NO: 4072357 - DNA, 21 bp, Homo sapiens
ttcctgcagccccagaagaaa

SEQ ID NO: 4072358 - DNA, 12 bp, Homo sapiens
ttcctgcattca

SEQ ID NO: 4072359 - DNA, 16 bp, Homo sapiens
ttcctgcccagcctgg

SEQ ID NO: 4072360 - DNA, 19 bp, Homo sapiens
ttcctgcccagcctggggc

SEQ ID NO: 4072361 - DNA, 16 bp, Homo sapiens
ttcctgccccaggcct

SEQ ID NO: 4072362 - DNA, 18 bp, Homo sapiens
ttcctgccccaggcctga

SEQ ID NO: 4072363 - DNA, 19 bp, Homo sapiens
ttcctgcccttccctctgg

SEQ ID NO: 4072364 - DNA, 15 bp, Homo sapiens
ttcctgcgtcctcct

SEQ ID NO: 4072365 - DNA, 17 bp, Homo sapiens
ttcctgcgtcctcctca

SEQ ID NO: 4072366 - DNA, 13 bp, Homo sapiens
ttcctgcttccga

SEQ ID NO: 4072367 - DNA, 15 bp, Homo sapiens
ttcctggacactcag

SEQ ID NO: 4072368 - DNA, 20 bp, Homo sapiens
ttcctggacatcctcttctg

SEQ ID NO: 4072369 - DNA, 24 bp, Homo sapiens
ttcctggacatcctcttctgctta

SEQ ID NO: 4072370 - DNA, 15 bp, Homo sapiens
ttcctggcaatagtg

SEQ ID NO: 4072371 - DNA, 18 bp, Homo sapiens
ttcctggcaatagtgtgt

SEQ ID NO: 4072372 - DNA, 13 bp, Homo sapiens
ttcctggctgatg

SEQ ID NO: 4072373 - DNA, 20 bp, Homo sapiens
ttcctggctgatgatccaga

SEQ ID NO: 4072374 - DNA, 17 bp, Homo sapiens
ttcctgggcctttgcaa

SEQ ID NO: 4072375 - DNA, 15 bp, Homo sapiens
ttcctggtgctcttt

SEQ ID NO: 4072376 - DNA, 21 bp, Homo sapiens
ttcctggttttgtacactgct

SEQ ID NO: 4072377 - DNA, 23 bp, Homo sapiens
ttcctggttttgtacactgctgt

SEQ ID NO: 4072378 - DNA, 12 bp, Homo sapiens
ttcctgtcccca

SEQ ID NO: 4072379 - DNA, 14 bp, Homo sapiens
ttcctgtgccaggt

SEQ ID NO: 4072380 - DNA, 21 bp, Homo sapiens
ttcctgtgggtgttctttcct

SEQ ID NO: 4072381 - DNA, 21 bp, Homo sapiens
ttcctgtgtgtactctgtcca

SEQ ID NO: 4072382 - DNA, 16 bp, Homo sapiens
ttcctgttcagtgaga

SEQ ID NO: 4072383 - DNA, 12 bp, Homo sapiens
ttccttaagtat

SEQ ID NO: 4072384 - DNA, 19 bp, Homo sapiens
ttccttaagtatatcatgt

SEQ ID NO: 4072385 - DNA, 16 bp, Homo sapiens
ttcttcagaattagat

SEQ ID NO: 4072386 - DNA, 19 bp, Homo sapiens
ttcttcagcgtaaaatggt

SEQ ID NO: 4072387 - DNA, 18 bp, Homo sapiens
ttcttcagggccagtcct

SEQ ID NO: 4072388 - DNA, 18 bp, Homo sapiens
ttcttcataacaatttta

SEQ ID NO: 4072389 - DNA, 15 bp, Homo sapiens
ttcttcatattctaa

SEQ ID NO: 4072390 - DNA, 21 bp, Homo sapiens
ttcttcatccaacttccaaga

SEQ ID NO: 4072391 - DNA, 13 bp, Homo sapiens
ttcttccctgctt

SEQ ID NO: 4072392 - DNA, 21 bp, Homo sapiens
ttcttcctatttgccatgggc

SEQ ID NO: 4072393 - DNA, 16 bp, Homo sapiens
ttcttcctcactatga

SEQ ID NO: 4072394 - DNA, 15 bp, Homo sapiens
ttcttcctcagctgg

SEQ ID NO: 4072395 - DNA, 15 bp, Homo sapiens
ttcttcctcattccc

SEQ ID NO: 4072396 - DNA, 11 bp, Homo sapiens
ttcttcctggt

SEQ ID NO: 4072397 - DNA, 14 bp, Homo sapiens
ttcttcctgtgaag

SEQ ID NO: 4072398 - DNA, 13 bp, Homo sapiens
ttcttcctttctc

SEQ ID NO: 4072399 - DNA, 21 bp, Homo sapiens
ttcttcgctggactattgtgc

SEQ ID NO: 4072400 - DNA, 19 bp, Homo sapiens
ttcttctacaaccagagcc

SEQ ID NO: 4072401 - DNA, 21 bp, Homo sapiens
ttcttctacaaccagagcccc

SEQ ID NO: 4072402 - DNA, 21 bp, Homo sapiens
ttcttctaggttctaaaaatt

SEQ ID NO: 4072403 - DNA, 22 bp, Homo sapiens
ttcttctcaaaaaataattagt

SEQ ID NO: 4072404 - DNA, 17 bp, Homo sapiens
ttcttctcccccatcct

SEQ ID NO: 4072405 - DNA, 14 bp, Homo sapiens
ttcttctctttagt

SEQ ID NO: 4072406 - DNA, 14 bp, Homo sapiens
ttcttctgaggcct

SEQ ID NO: 4072407 - DNA, 12 bp, Homo sapiens
ttcttctgccct

SEQ ID NO: 4072408 - DNA, 13 bp, Homo sapiens
ttcttcttcagaa

SEQ ID NO: 4072409 - DNA, 13 bp, Homo sapiens
ttcttgaaagctg

SEQ ID NO: 4072410 - DNA, 15 bp, Homo sapiens
ttcttgaaagctgtg

SEQ ID NO: 4072411 - DNA, 17 bp, Homo sapiens
ttcttgatcttaaagat

SEQ ID NO: 4072412 - DNA, 18 bp, Homo sapiens
ttcttgatcttaaagatc

SEQ ID NO: 4072413 - DNA, 23 bp, Homo sapiens
ttcttgcataggctcttaagcag

SEQ ID NO: 4072414 - DNA, 16 bp, Homo sapiens
ttcttgccaatgaggt

SEQ ID NO: 4072415 - DNA, 21 bp, Homo sapiens
ttcttgcctactatgccagat

SEQ ID NO: 4072416 - DNA, 14 bp, Homo sapiens
ttcttgcctgctgg

SEQ ID NO: 4072417 - DNA, 23 bp, Homo sapiens
ttcttgctggttgtcatttttgc

SEQ ID NO: 4072418 - DNA, 18 bp, Homo sapiens
ttcttggggtactcttga

SEQ ID NO: 4072419 - DNA, 18 bp, Homo sapiens
ttcttggtgactgtccca

SEQ ID NO: 4072420 - DNA, 17 bp, Homo sapiens
ttcttggttcataaatg

SEQ ID NO: 4072421 - DNA, 19 bp, Homo sapiens
ttcttggttcataaatgaa

SEQ ID NO: 4072422 - DNA, 14 bp, Homo sapiens
ttcttgtgcttttc

SEQ ID NO: 4072423 - DNA, 20 bp, Homo sapiens
ttcttgtggtgtaaagctgg

SEQ ID NO: 4072424 - DNA, 21 bp, Homo sapiens
ttcttgtggtgtaaagctggc

SEQ ID NO: 4072425 - DNA, 14 bp, Homo sapiens
ttcttgtttccttg

SEQ ID NO: 4072426 - DNA, 15 bp, Homo sapiens
ttctttaaaattaca

SEQ ID NO: 4072427 - DNA, 13 bp, Homo sapiens
ttctttaaatgtt

SEQ ID NO: 4072428 - DNA, 12 bp, Homo sapiens
ttctttaatgct

SEQ ID NO: 4072429 - DNA, 18 bp, Homo sapiens
ttctttaatgcttttata

SEQ ID NO: 4072430 - DNA, 14 bp, Homo sapiens
ttctttacctgaga

SEQ ID NO: 4072431 - DNA, 20 bp, Homo sapiens
ttctttacctgagaccagtt

SEQ ID NO: 4072432 - DNA, 19 bp, Homo sapiens
ttctttcaagggctttcct

SEQ ID NO: 4072433 - DNA, 23 bp, Homo sapiens
ttctttcaagggctttcctgtgc

SEQ ID NO: 4072434 - DNA, 12 bp, Homo sapiens
ttctttcctgcc

SEQ ID NO: 4072435 - DNA, 14 bp, Homo sapiens
ttctttcctgccct

SEQ ID NO: 4072436 - DNA, 18 bp, Homo sapiens
ttctttctagtggtcttt

SEQ ID NO: 4072437 - DNA, 15 bp, Homo sapiens
ttctttgaaattgtt

SEQ ID NO: 4072438 - DNA, 13 bp, Homo sapiens
ttctttgaattta

SEQ ID NO: 4072439 - DNA, 17 bp, Homo sapiens
ttctttgagactgggtc

SEQ ID NO: 4072440 - DNA, 18 bp, Homo sapiens
ttctttgataatgttaaa

SEQ ID NO: 4072441 - DNA, 22 bp, Homo sapiens
ttctttgataatgttaaatttg

SEQ ID NO: 4072442 - DNA, 23 bp, Homo sapiens
ttctttgctgcagtcatctactt

SEQ ID NO: 4072443 - DNA, 13 bp, Homo sapiens
ttctttgggccag

SEQ ID NO: 4072444 - DNA, 15 bp, Homo sapiens
ttctttggttgtgaa

SEQ ID NO: 4072445 - DNA, 10 bp, Homo sapiens
ttctttgtgt

SEQ ID NO: 4072446 - DNA, 11 bp, Homo sapiens
ttctttgtgta

SEQ ID NO: 4072447 - DNA, 22 bp, Homo sapiens
ttcttttaatgatgccatggca

SEQ ID NO: 4072448 - DNA, 15 bp, Homo sapiens
ttcttttctggccaa

SEQ ID NO: 4072449 - DNA, 20 bp, Homo sapiens
ttctttttaattattttaaa

SEQ ID NO: 4072450 - DNA, 14 bp, Homo sapiens
ttctttttacataa

SEQ ID NO: 4072451 - DNA, 14 bp, Homo sapiens
ttctttttgccagt

SEQ ID NO: 4072452 - DNA, 20 bp, Homo sapiens
ttctttttttttaagttctt

SEQ ID NO: 4072453 - DNA, 16 bp, Homo sapiens
ttgaaaacctgacaaa

SEQ ID NO: 4072454 - DNA, 22 bp, Homo sapiens
ttgaaaagctattagccaggat

SEQ ID NO: 4072455 - DNA, 17 bp, Homo sapiens
ttgaaaagcttcttaat

SEQ ID NO: 4072456 - DNA, 19 bp, Homo sapiens
ttgaaaagcttcttaatta

SEQ ID NO: 4072457 - DNA, 16 bp, Homo sapiens
ttgaaaaggtgacctt

SEQ ID NO: 4072458 - DNA, 15 bp, Homo sapiens
ttgaaaatcttgtgt

SEQ ID NO: 4072459 - DNA, 18 bp, Homo sapiens
ttgaaaattttacttcca

SEQ ID NO: 4072460 - DNA, 21 bp, Homo sapiens
ttgaaaccaccgtgaaccaga

SEQ ID NO: 4072461 - DNA, 19 bp, Homo sapiens
ttgaaaccaccttttatta

SEQ ID NO: 4072462 - DNA, 18 bp, Homo sapiens
ttgaaactagttatttta

SEQ ID NO: 4072463 - DNA, 14 bp, Homo sapiens
ttgaaagagatggc

SEQ ID NO: 4072464 - DNA, 20 bp, Homo sapiens
ttgaaagattttattgtata

SEQ ID NO: 4072465 - DNA, 22 bp, Homo sapiens
ttgaaagctgtggccagcttgt

SEQ ID NO: 4072466 - DNA, 19 bp, Homo sapiens
ttgaaaggtccaaatgttt

SEQ ID NO: 4072467 - DNA, 20 bp, Homo sapiens
ttgaaatgaggtctgtttaa

SEQ ID NO: 4072468 - DNA, 19 bp, Homo sapiens
ttgaaattatatctgtggt

SEQ ID NO: 4072469 - DNA, 19 bp, Homo sapiens
ttgaaattatgtatgttta

SEQ ID NO: 4072470 - DNA, 21 bp, Homo sapiens
ttgaaattatgtatgtttaca

SEQ ID NO: 4072471 - DNA, 23 bp, Homo sapiens
ttgaaattatgtatgtttacata

SEQ ID NO: 4072472 - DNA, 17 bp, Homo sapiens
ttgaaattatgtgacat

SEQ ID NO: 4072473 - DNA, 18 bp, Homo sapiens
ttgaaattttgcaaatat

SEQ ID NO: 4072474 - DNA, 20 bp, Homo sapiens
ttgaaattttgcaaatataa

SEQ ID NO: 4072475 - DNA, 22 bp, Homo sapiens
ttgaaattttgcaaatataaac

SEQ ID NO: 4072476 - DNA, 20 bp, Homo sapiens
ttgaacacaaactgtaaata

SEQ ID NO: 4072477 - DNA, 21 bp, Homo sapiens
ttgaacattttatcattaatt

SEQ ID NO: 4072478 - DNA, 15 bp, Homo sapiens
ttgaaccatccactt

SEQ ID NO: 4072479 - DNA, 21 bp, Homo sapiens
ttgaaccatccacttacatat

SEQ ID NO: 4072480 - DNA, 20 bp, Homo sapiens
ttgaacctggatccagcact

SEQ ID NO: 4072481 - DNA, 21 bp, Homo sapiens
ttgaacctgtgagtaaatatt

SEQ ID NO: 4072482 - DNA, 23 bp, Homo sapiens
ttgaacctgtgagtaaatattga

SEQ ID NO: 4072483 - DNA, 21 bp, Homo sapiens
ttgaacctttttttttgaaac

SEQ ID NO: 4072484 - DNA, 20 bp, Homo sapiens
ttgaactcagatctgtctga

SEQ ID NO: 4072485 - DNA, 21 bp, Homo sapiens
ttgaactgttctggcctcaga

SEQ ID NO: 4072486 - DNA, 13 bp, Homo sapiens
ttgaactttgcca

SEQ ID NO: 4072487 - DNA, 19 bp, Homo sapiens
ttgcttgttatattaagca

SEQ ID NO: 4072488 - DNA, 21 bp, Homo sapiens
ttgcttgttatattaagcaga

SEQ ID NO: 4072489 - DNA, 20 bp, Homo sapiens
ttgctttatgccttcttatt

SEQ ID NO: 4072490 - DNA, 17 bp, Homo sapiens
ttgctttcctgggcctt

SEQ ID NO: 4072491 - DNA, 14 bp, Homo sapiens
ttgctttctgaaat

SEQ ID NO: 4072492 - DNA, 16 bp, Homo sapiens
ttgctttgtatgcact

SEQ ID NO: 4072493 - DNA, 15 bp, Homo sapiens
ttgcttttttaaata

SEQ ID NO: 4072494 - DNA, 22 bp, Homo sapiens
ttggaaagtacactctgctgtt

SEQ ID NO: 4072495 - DNA, 19 bp, Homo sapiens
ttggaaccttgttttggac

SEQ ID NO: 4072496 - DNA, 19 bp, Homo sapiens
ttggaagaaaaaaatcttc

SEQ ID NO: 4072497 - DNA, 13 bp, Homo sapiens
ttggaagagaaag

SEQ ID NO: 4072498 - DNA, 15 bp, Homo sapiens
ttggaagattcagct

SEQ ID NO: 4072499 - DNA, 17 bp, Homo sapiens
ttggaagctctgaagtc

SEQ ID NO: 4072500 - DNA, 15 bp, Homo sapiens
ttggaagtacatgaa

SEQ ID NO: 4072501 - DNA, 19 bp, Homo sapiens
ttggaattaacctggtgct

SEQ ID NO: 4072502 - DNA, 13 bp, Homo sapiens
ttggaatttacca

SEQ ID NO: 4072503 - DNA, 12 bp, Homo sapiens
ttggacagctga

SEQ ID NO: 4072504 - DNA, 20 bp, Homo sapiens
ttggacaggagtcagtgtct

SEQ ID NO: 4072505 - DNA, 21 bp, Homo sapiens
ttggacggcctgatgctccct

SEQ ID NO: 4072506 - DNA, 14 bp, Homo sapiens
ttggactccatctc

SEQ ID NO: 4072507 - DNA, 23 bp, Homo sapiens
ttggactttcaaaattaaatctg

SEQ ID NO: 4072508 - DNA, 18 bp, Homo sapiens
ttggacttttcgttaaca

SEQ ID NO: 4072509 - DNA, 13 bp, Homo sapiens
ttggagaatttag

SEQ ID NO: 4072510 - DNA, 18 bp, Homo sapiens
ttggagaatttaggtttt

SEQ ID NO: 4072511 - DNA, 20 bp, Homo sapiens
ttggagacacaactattttt

SEQ ID NO: 4072512 - DNA, 13 bp, Homo sapiens
ttggagagtaaaa

SEQ ID NO: 4072513 - DNA, 18 bp, Homo sapiens
ttggagagtaaaaactga

SEQ ID NO: 4072514 - DNA, 22 bp, Homo sapiens
ttggagatgctgagggtgtttc

SEQ ID NO: 4072515 - DNA, 15 bp, Homo sapiens
ttggagcccagggca

SEQ ID NO: 4072516 - DNA, 20 bp, Homo sapiens
ttggagcttacatagtttta

SEQ ID NO: 4072517 - DNA, 20 bp, Homo sapiens
ttggaggtcacagctggatc

SEQ ID NO: 4072518 - DNA, 14 bp, Homo sapiens
ttggagtgtttcta

SEQ ID NO: 4072519 - DNA, 21 bp, Homo sapiens
ttggataagtttctattctgt

SEQ ID NO: 4072520 - DNA, 19 bp, Homo sapiens
ttggatatattattgtaag

SEQ ID NO: 4072521 - DNA, 17 bp, Homo sapiens
ttggatcttgaatgtgg

SEQ ID NO: 4072522 - DNA, 21 bp, Homo sapiens
ttggatgggagtgggcacctc

SEQ ID NO: 4072523 - DNA, 21 bp, Homo sapiens
ttggattatttaataacatta

SEQ ID NO: 4072524 - DNA, 14 bp, Homo sapiens
ttggattgtatatt

SEQ ID NO: 4072525 - DNA, 18 bp, Homo sapiens
ttggattgtatattgtgt

SEQ ID NO: 4072526 - DNA, 17 bp, Homo sapiens
ttggcaaaagccttgtg

SEQ ID NO: 4072527 - DNA, 22 bp, Homo sapiens
ttggcaaaatggggtttgggcc

SEQ ID NO: 4072528 - DNA, 17 bp, Homo sapiens
ttggcaaacgggcttga

SEQ ID NO: 4072529 - DNA, 16 bp, Homo sapiens
ttggcaaactaaagga

SEQ ID NO: 4072530 - DNA, 12 bp, Homo sapiens
ttggcaaagttt

SEQ ID NO: 4072531 - DNA, 20 bp, Homo sapiens
ttggcaagatgaaataattt

SEQ ID NO: 4072532 - DNA, 15 bp, Homo sapiens
ttggcacagaaacac

SEQ ID NO: 4072533 - DNA, 20 bp, Homo sapiens
ttggcacatgccacctggca

SEQ ID NO: 4072534 - DNA, 21 bp, Homo sapiens
ttggcaccagacacccaggac

SEQ ID NO: 4072535 - DNA, 12 bp, Homo sapiens
ttggcacctgca

SEQ ID NO: 4072536 - DNA, 23 bp, Homo sapiens
ttggcactttttcgtgtggatct

SEQ ID NO: 4072537 - DNA, 16 bp, Homo sapiens
ttggcagaaaggatgt

SEQ ID NO: 4072538 - DNA, 14 bp, Homo sapiens
ttggcagacagccg

SEQ ID NO: 4072539 - DNA, 16 bp, Homo sapiens
ttggcagatgcagctc

SEQ ID NO: 4072540 - DNA, 14 bp, Homo sapiens
ttggcagtgacttt

SEQ ID NO: 4072541 - DNA, 11 bp, Homo sapiens
ttggcagtgtt

SEQ ID NO: 4072542 - DNA, 15 bp, Homo sapiens
ttggccaagagaagg

SEQ ID NO: 4072543 - DNA, 16 bp, Homo sapiens
ttggccaagagaaggg

SEQ ID NO: 4072544 - DNA, 22 bp, Homo sapiens
ttggccagccaactctgggaat

SEQ ID NO: 4072545 - DNA, 19 bp, Homo sapiens
ttggccctttccttccaga

SEQ ID NO: 4072546 - DNA, 12 bp, Homo sapiens
ttggcctcagaa

SEQ ID NO: 4072547 - DNA, 18 bp, Homo sapiens
ttggcctggggtgcatct

SEQ ID NO: 4072548 - DNA, 21 bp, Homo sapiens
ttggcctggggtgcatctcct

SEQ ID NO: 4072549 - DNA, 23 bp, Homo sapiens
ttggcctgtctttggattgttaa

SEQ ID NO: 4072550 - DNA, 21 bp, Homo sapiens
ttggccttggcttttctagcc

SEQ ID NO: 4072551 - DNA, 17 bp, Homo sapiens
ttggcgctattacaaat

SEQ ID NO: 4072552 - DNA, 18 bp, Homo sapiens
ttggcgctattacaaata

SEQ ID NO: 4072553 - DNA, 13 bp, Homo sapiens
ttggcgctgaggt

SEQ ID NO: 4072554 - DNA, 17 bp, Homo sapiens
ttggctatttgaaatac

SEQ ID NO: 4072555 - DNA, 21 bp, Homo sapiens
ttggctatttgaaatactaaa

SEQ ID NO: 4072556 - DNA, 22 bp, Homo sapiens
ttggctatttgaaatactaaaa

SEQ ID NO: 4072557 - DNA, 12 bp, Homo sapiens
ttggctcaccca

SEQ ID NO: 4072558 - DNA, 13 bp, Homo sapiens
ttggctcagacat

SEQ ID NO: 4072559 - DNA, 14 bp, Homo sapiens
ttggctcagacatg

SEQ ID NO: 4072560 - DNA, 19 bp, Homo sapiens
ttggctctcctctggctag

SEQ ID NO: 4072561 - DNA, 21 bp, Homo sapiens
ttggctgacccctctggtgtg

SEQ ID NO: 4072562 - DNA, 22 bp, Homo sapiens
ttggctgacccctctggtgtgt

SEQ ID NO: 4072563 - DNA, 17 bp, Homo sapiens
ttggctgacttcatctg

SEQ ID NO: 4072564 - DNA, 18 bp, Homo sapiens
ttggctgacttcatctgg

SEQ ID NO: 4072565 - DNA, 19 bp, Homo sapiens
ttggctgaggggcttggga

SEQ ID NO: 4072566 - DNA, 17 bp, Homo sapiens
ttggctggatcagggaa

SEQ ID NO: 4072567 - DNA, 14 bp, Homo sapiens
ttggctttgcccac

SEQ ID NO: 4072568 - DNA, 15 bp, Homo sapiens
ttggctttgcccacc

SEQ ID NO: 4072569 - DNA, 23 bp, Homo sapiens
ttggctttgcccacccctcactc

SEQ ID NO: 4072570 - DNA, 14 bp, Homo sapiens
ttgggacaccaggg

SEQ ID NO: 4072571 - DNA, 22 bp, Homo sapiens
ttgggagcactggagtgcaggg

SEQ ID NO: 4072572 - DNA, 19 bp, Homo sapiens
ttgggagggaaaagggaag

SEQ ID NO: 4072573 - DNA, 18 bp, Homo sapiens
ttgggagttttgaatgtt

SEQ ID NO: 4072574 - DNA, 17 bp, Homo sapiens
ttgggcagtgccccagg

SEQ ID NO: 4072575 - DNA, 20 bp, Homo sapiens
ttgggcagtgccccagggag

SEQ ID NO: 4072576 - DNA, 18 bp, Homo sapiens
ttgggccccagaccccag

SEQ ID NO: 4072577 - DNA, 18 bp, Homo sapiens
ttgggcccctcagagccc

SEQ ID NO: 4072578 - DNA, 13 bp, Homo sapiens
ttgggccctgcac

SEQ ID NO: 4072579 - DNA, 14 bp, Homo sapiens
ttgggccctgcaca

SEQ ID NO: 4072580 - DNA, 13 bp, Homo sapiens
ttgggctggggga

SEQ ID NO: 4072581 - DNA, 16 bp, Homo sapiens
ttggggaaaaaagcac

SEQ ID NO: 4072582 - DNA, 23 bp, Homo sapiens
ttggggaaaaaagcacatacatt

SEQ ID NO: 4072583 - DNA, 20 bp, Homo sapiens
ttggggaaccccgagctggg

SEQ ID NO: 4072584 - DNA, 23 bp, Homo sapiens
ttggggaaccccgagctgggggg

SEQ ID NO: 4072585 - DNA, 12 bp, Homo sapiens
ttggggaggcaa

SEQ ID NO: 4072586 - DNA, 17 bp, Homo sapiens
ttggggagttaagacct

SEQ ID NO: 4072587 - DNA, 20 bp, Homo sapiens
ttgggggaaaaaaaaaaaag

SEQ ID NO: 4072588 - DNA, 19 bp, Homo sapiens
ttgggggctcatttttgct

SEQ ID NO: 4072589 - DNA, 12 bp, Homo sapiens
tttaagaaaagt

SEQ ID NO: 4072590 - DNA, 15 bp, Homo sapiens
tttaagaaaagtatt

SEQ ID NO: 4072591 - DNA, 21 bp, Homo sapiens
tttaagaaaatacaataaact

SEQ ID NO: 4072592 - DNA, 18 bp, Homo sapiens
tttaagaacttcattttt

SEQ ID NO: 4072593 - DNA, 20 bp, Homo sapiens
tttaagaattgagtaatggt

SEQ ID NO: 4072594 - DNA, 15 bp, Homo sapiens
tttaagataaattat

SEQ ID NO: 4072595 - DNA, 17 bp, Homo sapiens
tttaagatttttctcaa

SEQ ID NO: 4072596 - DNA, 18 bp, Homo sapiens
tttaagatttttctcaaa

SEQ ID NO: 4072597 - DNA, 14 bp, Homo sapiens
tttaagcaaatgca

SEQ ID NO: 4072598 - DNA, 15 bp, Homo sapiens
tttaagcaaatgcat

SEQ ID NO: 4072599 - DNA, 20 bp, Homo sapiens
tttaagcactacataaactg

SEQ ID NO: 4072600 - DNA, 23 bp, Homo sapiens
tttaagcactacataaactgact

SEQ ID NO: 4072601 - DNA, 15 bp, Homo sapiens
tttaagcactcttaa

SEQ ID NO: 4072602 - DNA, 21 bp, Homo sapiens
tttaagcattgtttgcttatt

SEQ ID NO: 4072603 - DNA, 18 bp, Homo sapiens
tttaagctgtttccatag

SEQ ID NO: 4072604 - DNA, 18 bp, Homo sapiens
tttaaggctaaaacttaa

SEQ ID NO: 4072605 - DNA, 15 bp, Homo sapiens
tttaagggaaagaaa

SEQ ID NO: 4072606 - DNA, 17 bp, Homo sapiens
tttaagggaaagaaaat

SEQ ID NO: 4072607 - DNA, 12 bp, Homo sapiens
tttaagtattta

SEQ ID NO: 4072608 - DNA, 20 bp, Homo sapiens
tttaagtgcgtgtgtagagt

SEQ ID NO: 4072609 - DNA, 16 bp, Homo sapiens
tttaataaaataattc

SEQ ID NO: 4072610 - DNA, 17 bp, Homo sapiens
tttaataaaataattct

SEQ ID NO: 4072611 - DNA, 20 bp, Homo sapiens
tttaataaaataattctaaa

SEQ ID NO: 4072612 - DNA, 15 bp, Homo sapiens
tttaataaagaaata

SEQ ID NO: 4072613 - DNA, 12 bp, Homo sapiens
tttaataacatt

SEQ ID NO: 4072614 - DNA, 22 bp, Homo sapiens
tttaataacattaccttactgt

SEQ ID NO: 4072615 - DNA, 23 bp, Homo sapiens
tttaataacattaccttactgtg

SEQ ID NO: 4072616 - DNA, 21 bp, Homo sapiens
tttaatacaggacttttaaat

SEQ ID NO: 4072617 - DNA, 14 bp, Homo sapiens
tttaatacagggta

SEQ ID NO: 4072618 - DNA, 17 bp, Homo sapiens
tttaatacagtttattt

SEQ ID NO: 4072619 - DNA, 21 bp, Homo sapiens
tttaatagaatataattatcg

SEQ ID NO: 4072620 - DNA, 16 bp, Homo sapiens
tttaatagtgcttttt

SEQ ID NO: 4072621 - DNA, 13 bp, Homo sapiens
tttaatatcttca

SEQ ID NO: 4072622 - DNA, 22 bp, Homo sapiens
tttaatattgagaaagaaacta

SEQ ID NO: 4072623 - DNA, 12 bp, Homo sapiens
tttaatatttaa

SEQ ID NO: 4072624 - DNA, 13 bp, Homo sapiens
tttaatatttaaa

SEQ ID NO: 4072625 - DNA, 18 bp, Homo sapiens
tttaatatttaaacagca

SEQ ID NO: 4072626 - DNA, 22 bp, Homo sapiens
tttaatcctgtaccaaatctga

SEQ ID NO: 4072627 - DNA, 16 bp, Homo sapiens
tttaatgaaagactgt

SEQ ID NO: 4072628 - DNA, 23 bp, Homo sapiens
tttaatgccgatatactctagat

SEQ ID NO: 4072629 - DNA, 18 bp, Homo sapiens
tttaattattaactacat

SEQ ID NO: 4072630 - DNA, 19 bp, Homo sapiens
tttaattattaactacatt

SEQ ID NO: 4072631 - DNA, 17 bp, Homo sapiens
tttaattgaaactagtt

SEQ ID NO: 4072632 - DNA, 12 bp, Homo sapiens
tttaattgcaac

SEQ ID NO: 4072633 - DNA, 16 bp, Homo sapiens
tttaattgttgtttct

SEQ ID NO: 4072634 - DNA, 21 bp, Homo sapiens
tttaattgttgtttctttcta

SEQ ID NO: 4072635 - DNA, 20 bp, Homo sapiens
tttaatttaacaaactaaaa

SEQ ID NO: 4072636 - DNA, 14 bp, Homo sapiens
tttaatttatttca

SEQ ID NO: 4072637 - DNA, 18 bp, Homo sapiens
tttaatttgatgaaagct

SEQ ID NO: 4072638 - DNA, 17 bp, Homo sapiens
tttaatttgtaataaaa

SEQ ID NO: 4072639 - DNA, 12 bp, Homo sapiens
tttaattttcac

SEQ ID NO: 4072640 - DNA, 15 bp, Homo sapiens
tttaattttcacaaa

SEQ ID NO: 4072641 - DNA, 19 bp, Homo sapiens
tttacaaaactacatgaga

SEQ ID NO: 4072642 - DNA, 11 bp, Homo sapiens
tttacaaaaga

SEQ ID NO: 4072643 - DNA, 20 bp, Homo sapiens
tttacaaaagaggagcactt

SEQ ID NO: 4072644 - DNA, 19 bp, Homo sapiens
tttacaagaagtttattct

SEQ ID NO: 4072645 - DNA, 21 bp, Homo sapiens
tttacagagatgtctcttata

SEQ ID NO: 4072646 - DNA, 15 bp, Homo sapiens
tttacagctgtgtta

SEQ ID NO: 4072647 - DNA, 20 bp, Homo sapiens
tttacagctttcatgattag

SEQ ID NO: 4072648 - DNA, 19 bp, Homo sapiens
tttacaggccctgctcctg

SEQ ID NO: 4072649 - DNA, 16 bp, Homo sapiens
tttacagtatccaaaa

SEQ ID NO: 4072650 - DNA, 16 bp, Homo sapiens
tttacagtccttcaaa

SEQ ID NO: 4072651 - DNA, 21 bp, Homo sapiens
tttacagtgaccttttcttca

SEQ ID NO: 4072652 - DNA, 20 bp, Homo sapiens
tttacataacggaaagtttt

SEQ ID NO: 4072653 - DNA, 15 bp, Homo sapiens
tttacataactgcct

SEQ ID NO: 4072654 - DNA, 23 bp, Homo sapiens
tttacataactgccttgaacctg

SEQ ID NO: 4072655 - DNA, 18 bp, Homo sapiens
tttacattctagttcaga

SEQ ID NO: 4072656 - DNA, 16 bp, Homo sapiens
tttacatttaaagcat

SEQ ID NO: 4072657 - DNA, 22 bp, Homo sapiens
tttacatttttatttatgaagt

SEQ ID NO: 4072658 - DNA, 17 bp, Homo sapiens
tttaccagttgcctttt

SEQ ID NO: 4072659 - DNA, 15 bp, Homo sapiens
tttacccatgaagat

SEQ ID NO: 4072660 - DNA, 19 bp, Homo sapiens
tttaccctaatgtcttcat

SEQ ID NO: 4072661 - DNA, 13 bp, Homo sapiens
tttacccttttcc

SEQ ID NO: 4072662 - DNA, 22 bp, Homo sapiens
tttacctagctggtagcataaa

SEQ ID NO: 4072663 - DNA, 16 bp, Homo sapiens
tttacctgagaccagt

SEQ ID NO: 4072664 - DNA, 19 bp, Homo sapiens
tttactaattttctagatt

SEQ ID NO: 4072665 - DNA, 13 bp, Homo sapiens
tttactctgccta

SEQ ID NO: 4072666 - DNA, 15 bp, Homo sapiens
tttactctgtgttta

SEQ ID NO: 4072667 - DNA, 19 bp, Homo sapiens
tttactctgtgtttaaaaa

SEQ ID NO: 4072668 - DNA, 14 bp, Homo sapiens
tttactctttgaaa

SEQ ID NO: 4072669 - DNA, 14 bp, Homo sapiens
tttactgagcttct

SEQ ID NO: 4072670 - DNA, 17 bp, Homo sapiens
tttactgttatttaatt

SEQ ID NO: 4072671 - DNA, 22 bp, Homo sapiens
tttactgttttgaaatcaatgc

SEQ ID NO: 4072672 - DNA, 14 bp, Homo sapiens
tttagaaatataat

SEQ ID NO: 4072673 - DNA, 16 bp, Homo sapiens
tttagaacagcattgt

SEQ ID NO: 4072674 - DNA, 23 bp, Homo sapiens
tttagaataaattcccaacttct

SEQ ID NO: 4072675 - DNA, 18 bp, Homo sapiens
tttagagataggaaactg

SEQ ID NO: 4072676 - DNA, 18 bp, Homo sapiens
tttagagtagcatgagag

SEQ ID NO: 4072677 - DNA, 21 bp, Homo sapiens
tttagatgataaagagacagt

SEQ ID NO: 4072678 - DNA, 15 bp, Homo sapiens
tttagccaaaccctt

SEQ ID NO: 4072679 - DNA, 13 bp, Homo sapiens
tttagcctgtgtc

SEQ ID NO: 4072680 - DNA, 14 bp, Homo sapiens
tttagcttttcctt

SEQ ID NO: 4072681 - DNA, 11 bp, Homo sapiens
tttaggagaaa

SEQ ID NO: 4072682 - DNA, 22 bp, Homo sapiens
tttaggcactcttaaatgatct

SEQ ID NO: 4072683 - DNA, 14 bp, Homo sapiens
tttagggccaggca

SEQ ID NO: 4072684 - DNA, 14 bp, Homo sapiens
tttagggtactaaa

SEQ ID NO: 4072685 - DNA, 17 bp, Homo sapiens
tttaggtactattctga

SEQ ID NO: 4072686 - DNA, 22 bp, Homo sapiens
tttaggtgttgattttctgttg

SEQ ID NO: 4072687 - DNA, 22 bp, Homo sapiens
tttagtatcagtgttttaaatt

SEQ ID NO: 4072688 - DNA, 15 bp, Homo sapiens
tttagtgtgtgtgca

SEQ ID NO: 4072689 - DNA, 23 bp, Homo sapiens
tttagttcaatatttgttactgt

SEQ ID NO: 4072690 - DNA, 14 bp, Homo sapiens
tttagttttgcttt

SEQ ID NO: 4072691 - DNA, 18 bp, Homo sapiens
tttataaacagacaatat

SEQ ID NO: 4072692 - DNA, 24 bp, Homo sapiens
tttctgtagtcatttactaaacat

SEQ ID NO: 4072693 - DNA, 15 bp, Homo sapiens
tttctgttccaaatt

SEQ ID NO: 4072694 - DNA, 16 bp, Homo sapiens
tttctgttccaaattc

SEQ ID NO: 4072695 - DNA, 22 bp, Homo sapiens
tttctgttccaaattcagtttc

SEQ ID NO: 4072696 - DNA, 17 bp, Homo sapiens
tttctgtttgtaaatta

SEQ ID NO: 4072697 - DNA, 13 bp, Homo sapiens
tttcttaaaccaa

SEQ ID NO: 4072698 - DNA, 22 bp, Homo sapiens
tttcttaaataatgcttcagat

SEQ ID NO: 4072699 - DNA, 12 bp, Homo sapiens
tttcttaaggtt

SEQ ID NO: 4072700 - DNA, 19 bp, Homo sapiens
tttcttagctttttaattg

SEQ ID NO: 4072701 - DNA, 22 bp, Homo sapiens
tttcttagctttttaattgttg

SEQ ID NO: 4072702 - DNA, 15 bp, Homo sapiens
tttcttagtcattac

SEQ ID NO: 4072703 - DNA, 14 bp, Homo sapiens
tttcttagttactt

SEQ ID NO: 4072704 - DNA, 13 bp, Homo sapiens
tttcttattgcgc

SEQ ID NO: 4072705 - DNA, 16 bp, Homo sapiens
tttcttcacttcaagc

SEQ ID NO: 4072706 - DNA, 13 bp, Homo sapiens
tttcttccctgct

SEQ ID NO: 4072707 - DNA, 15 bp, Homo sapiens
tttcttccctgcttt

SEQ ID NO: 4072708 - DNA, 20 bp, Homo sapiens
tttcttccctgctttgcatc

SEQ ID NO: 4072709 - DNA, 23 bp, Homo sapiens
tttcttccttggccaagagaagg

SEQ ID NO: 4072710 - DNA, 14 bp, Homo sapiens
tttcttcgctggac

SEQ ID NO: 4072711 - DNA, 21 bp, Homo sapiens
tttcttctacaaccagagccc

SEQ ID NO: 4072712 - DNA, 15 bp, Homo sapiens
tttcttgatcttaaa

SEQ ID NO: 4072713 - DNA, 17 bp, Homo sapiens
tttcttgatcttaaaga

SEQ ID NO: 4072714 - DNA, 23 bp, Homo sapiens
tttcttgccaatgaggtctgaaa

SEQ ID NO: 4072715 - DNA, 13 bp, Homo sapiens
tttcttgctccct

SEQ ID NO: 4072716 - DNA, 19 bp, Homo sapiens
tttcttgctcccttcagcc

SEQ ID NO: 4072717 - DNA, 21 bp, Homo sapiens
tttcttgctggttgtcatttt

SEQ ID NO: 4072718 - DNA, 22 bp, Homo sapiens
tttcttggcaaaagccttgtgt

SEQ ID NO: 4072719 - DNA, 23 bp, Homo sapiens
tttcttgtggtgtaaagctggcc

SEQ ID NO: 4072720 - DNA, 13 bp, Homo sapiens
tttctttaaagat

SEQ ID NO: 4072721 - DNA, 20 bp, Homo sapiens
tttctttaagataatagttt

SEQ ID NO: 4072722 - DNA, 11 bp, Homo sapiens
tttctttgcct

SEQ ID NO: 4072723 - DNA, 12 bp, Homo sapiens
tttctttgcctc

SEQ ID NO: 4072724 - DNA, 16 bp, Homo sapiens
tttctttgttatcaaa

SEQ ID NO: 4072725 - DNA, 16 bp, Homo sapiens
tttcttttgaattgtt

SEQ ID NO: 4072726 - DNA, 14 bp, Homo sapiens
tttcttttgtaatt

SEQ ID NO: 4072727 - DNA, 16 bp, Homo sapiens
tttcttttgtaattgt

SEQ ID NO: 4072728 - DNA, 13 bp, Homo sapiens
tttctttttaatt

SEQ ID NO: 4072729 - DNA, 17 bp, Homo sapiens
tttctttttttttaagt

SEQ ID NO: 4072730 - DNA, 13 bp, Homo sapiens
tttgaaaacttca

SEQ ID NO: 4072731 - DNA, 18 bp, Homo sapiens
tttgaaaagctattagcc

SEQ ID NO: 4072732 - DNA, 19 bp, Homo sapiens
tttgaaaagctattagcca

SEQ ID NO: 4072733 - DNA, 16 bp, Homo sapiens
tttgaaaagcttctta

SEQ ID NO: 4072734 - DNA, 17 bp, Homo sapiens
tttgaaaagcttcttaa

SEQ ID NO: 4072735 - DNA, 23 bp, Homo sapiens
tttgaaaagcttcttaattaatt

SEQ ID NO: 4072736 - DNA, 12 bp, Homo sapiens
tttgaaagcttt

SEQ ID NO: 4072737 - DNA, 21 bp, Homo sapiens
tttgaaaggagatgtcttgga

SEQ ID NO: 4072738 - DNA, 20 bp, Homo sapiens
tttgaaatgaggtctgttta

SEQ ID NO: 4072739 - DNA, 15 bp, Homo sapiens
tttgaaattatgtga

SEQ ID NO: 4072740 - DNA, 22 bp, Homo sapiens
tttgaaattatgtgacatttta

SEQ ID NO: 4072741 - DNA, 14 bp, Homo sapiens
tttgaacactggct

SEQ ID NO: 4072742 - DNA, 20 bp, Homo sapiens
tttgaacccccgccatcctt

SEQ ID NO: 4072743 - DNA, 22 bp, Homo sapiens
tttgaacccccgccatccttca

SEQ ID NO: 4072744 - DNA, 18 bp, Homo sapiens
tttgaagaacatgtgaga

SEQ ID NO: 4072745 - DNA, 21 bp, Homo sapiens
tttgaagaaggtggacctttt

SEQ ID NO: 4072746 - DNA, 17 bp, Homo sapiens
tttgaagaatatttaag

SEQ ID NO: 4072747 - DNA, 15 bp, Homo sapiens
tttgaagcctgtgcc

SEQ ID NO: 4072748 - DNA, 21 bp, Homo sapiens
tttgaagcctgtgcctcccag

SEQ ID NO: 4072749 - DNA, 16 bp, Homo sapiens
tttgaagctactgtgt

SEQ ID NO: 4072750 - DNA, 13 bp, Homo sapiens
tttgaaggcaaaa

SEQ ID NO: 4072751 - DNA, 16 bp, Homo sapiens
tttgaagtttacattt

SEQ ID NO: 4072752 - DNA, 19 bp, Homo sapiens
tttgaagtttacattttta

SEQ ID NO: 4072753 - DNA, 13 bp, Homo sapiens
tttgaatgaaaaa

SEQ ID NO: 4072754 - DNA, 14 bp, Homo sapiens
tttgaatgaaaaat

SEQ ID NO: 4072755 - DNA, 23 bp, Homo sapiens
tttgaatgttaagaattgaccat

SEQ ID NO: 4072756 - DNA, 16 bp, Homo sapiens
tttgaattgttttctt

SEQ ID NO: 4072757 - DNA, 18 bp, Homo sapiens
tttgaattgttttcttta

SEQ ID NO: 4072758 - DNA, 15 bp, Homo sapiens
tttgaattttgtttt

SEQ ID NO: 4072759 - DNA, 16 bp, Homo sapiens
tttgacaaaagtaaat

SEQ ID NO: 4072760 - DNA, 14 bp, Homo sapiens
tttgacaactaaaa

SEQ ID NO: 4072761 - DNA, 22 bp, Homo sapiens
tttgacactgaaagttttgtaa

SEQ ID NO: 4072762 - DNA, 17 bp, Homo sapiens
tttgacatgtggaaagt

SEQ ID NO: 4072763 - DNA, 16 bp, Homo sapiens
tttgacatttaattta

SEQ ID NO: 4072764 - DNA, 19 bp, Homo sapiens
tttgaccttttatgtagta

SEQ ID NO: 4072765 - DNA, 20 bp, Homo sapiens
tttgactaaagctatgttac

SEQ ID NO: 4072766 - DNA, 19 bp, Homo sapiens
tttgactaacaagaatgta

SEQ ID NO: 4072767 - DNA, 14 bp, Homo sapiens
tttgacttaatgtg

SEQ ID NO: 4072768 - DNA, 23 bp, Homo sapiens
tttgacttaatgtgattactgct

SEQ ID NO: 4072769 - DNA, 13 bp, Homo sapiens
tttgacttcagct

SEQ ID NO: 4072770 - DNA, 17 bp, Homo sapiens
tttgactttcttctgaa

SEQ ID NO: 4072771 - DNA, 22 bp, Homo sapiens
tttgactttcttctgaatattt

SEQ ID NO: 4072772 - DNA, 16 bp, Homo sapiens
tttgagaaaataaagc

SEQ ID NO: 4072773 - DNA, 13 bp, Homo sapiens
tttgagacaggag

SEQ ID NO: 4072774 - DNA, 19 bp, Homo sapiens
tttgagaccagcctgggca

SEQ ID NO: 4072775 - DNA, 14 bp, Homo sapiens
tttgagctgccttc

SEQ ID NO: 4072776 - DNA, 22 bp, Homo sapiens
tttgaggggaggagatggaaac

SEQ ID NO: 4072777 - DNA, 23 bp, Homo sapiens
tttgaggtagaaatgcaaggggg

SEQ ID NO: 4072778 - DNA, 23 bp, Homo sapiens
tttgaggtcaagtaagaagacat

SEQ ID NO: 4072779 - DNA, 15 bp, Homo sapiens
tttgataatgttaaa

SEQ ID NO: 4072780 - DNA, 22 bp, Homo sapiens
tttgatacagttttcagaaaaa

SEQ ID NO: 4072781 - DNA, 15 bp, Homo sapiens
tttgatacataataa

SEQ ID NO: 4072782 - DNA, 21 bp, Homo sapiens
tttgatattatacaggaaagc

SEQ ID NO: 4072783 - DNA, 13 bp, Homo sapiens
tttgatatttgca

SEQ ID NO: 4072784 - DNA, 16 bp, Homo sapiens
tttgatgaaagctgat

SEQ ID NO: 4072785 - DNA, 20 bp, Homo sapiens
tttgatgctatttatgcaag

SEQ ID NO: 4072786 - DNA, 16 bp, Homo sapiens
tttgatgctggagagg

SEQ ID NO: 4072787 - DNA, 19 bp, Homo sapiens
tttgatgctggagaggtta

SEQ ID NO: 4072788 - DNA, 19 bp, Homo sapiens
tttgatgtgacaataatat

SEQ ID NO: 4072789 - DNA, 15 bp, Homo sapiens
tttgattaacaaata

SEQ ID NO: 4072790 - DNA, 20 bp, Homo sapiens
tttgcaaaatcacttagcag

SEQ ID NO: 4072791 - DNA, 14 bp, Homo sapiens
tttgcaaataggca

SEQ ID NO: 4072792 - DNA, 17 bp, Homo sapiens
tttgcaaatataaacat

SEQ ID NO: 4072793 - DNA, 17 bp, Homo sapiens
tttgcaacttaatactc

SEQ ID NO: 4072794 - DNA, 20 bp, Homo sapiens
tttgcacaggaaagagtcac

SEQ ID NO: 4072795 - DNA, 22 bp, Homo sapiens
tttttgacactgaaagttttgt

SEQ ID NO: 4072796 - DNA, 22 bp, Homo sapiens
tttttgcccgttgaccagataa

SEQ ID NO: 4072797 - DNA, 11 bp, Homo sapiens
tttttgctata

SEQ ID NO: 4072798 - DNA, 20 bp, Homo sapiens
tttttgctataatcattagt

SEQ ID NO: 4072799 - DNA, 21 bp, Homo sapiens
tttttggagaaggttatcaaa

SEQ ID NO: 4072800 - DNA, 21 bp, Homo sapiens
tttttgggcagcaatttaaat

SEQ ID NO: 4072801 - DNA, 15 bp, Homo sapiens
tttttggtataatgt

SEQ ID NO: 4072802 - DNA, 18 bp, Homo sapiens
tttttggttgtcaatatt

SEQ ID NO: 4072803 - DNA, 12 bp, Homo sapiens
tttttgtaaata

SEQ ID NO: 4072804 - DNA, 22 bp, Homo sapiens
tttttgtaataagcaatcaagg

SEQ ID NO: 4072805 - DNA, 13 bp, Homo sapiens
tttttgtacttga

SEQ ID NO: 4072806 - DNA, 20 bp, Homo sapiens
tttttgtagtgacctgttta

SEQ ID NO: 4072807 - DNA, 14 bp, Homo sapiens
tttttgtatgtgtg

SEQ ID NO: 4072808 - DNA, 13 bp, Homo sapiens
tttttgtctcaat

SEQ ID NO: 4072809 - DNA, 20 bp, Homo sapiens
tttttgttctggtccttttt

SEQ ID NO: 4072810 - DNA, 15 bp, Homo sapiens
tttttgtttgtttct

SEQ ID NO: 4072811 - DNA, 17 bp, Homo sapiens
tttttgttttacaatgt

SEQ ID NO: 4072812 - DNA, 10 bp, Homo sapiens
ttttttaaga

SEQ ID NO: 4072813 - DNA, 18 bp, Homo sapiens
ttttttaagttcttatga

SEQ ID NO: 4072814 - DNA, 12 bp, Homo sapiens
ttttttacattt

SEQ ID NO: 4072815 - DNA, 11 bp, Homo sapiens
ttttttattca

SEQ ID NO: 4072816 - DNA, 15 bp, Homo sapiens
ttttttattcagcag

SEQ ID NO: 4072817 - DNA, 18 bp, Homo sapiens
ttttttcaatatttatta

SEQ ID NO: 4072818 - DNA, 13 bp, Homo sapiens
ttttttccactta

SEQ ID NO: 4072819 - DNA, 22 bp, Homo sapiens
ttttttccatctttacaaaact

SEQ ID NO: 4072820 - DNA, 15 bp, Homo sapiens
ttttttctaagagaa

SEQ ID NO: 4072821 - DNA, 11 bp, Homo sapiens
ttttttctgag

SEQ ID NO: 4072822 - DNA, 12 bp, Homo sapiens
ttttttctttca

SEQ ID NO: 4072823 - DNA, 9 bp, Homo sapiens
ttttttgaa

SEQ ID NO: 4072824 - DNA, 13 bp, Homo sapiens
ttttttgaaagtg

SEQ ID NO: 4072825 - DNA, 9 bp, Homo sapiens
ttttttgca

SEQ ID NO: 4072826 - DNA, 13 bp, Homo sapiens
ttttttggtataa

SEQ ID NO: 4072827 - DNA, 13 bp, Homo sapiens
ttttttgtaataa

SEQ ID NO: 4072828 - DNA, 21 bp, Homo sapiens
ttttttgtatagaccaaagca

SEQ ID NO: 4072829 - DNA, 16 bp, Homo sapiens
ttttttgtttgtttgt

SEQ ID NO: 4072830 - DNA, 12 bp, Homo sapiens
tttttttcagtt

SEQ ID NO: 4072831 - DNA, 12 bp, Homo sapiens
tttttttcctga

SEQ ID NO: 4072832 - DNA, 12 bp, Homo sapiens
tttttttcttta

SEQ ID NO: 4072833 - DNA, 13 bp, Homo sapiens
tttttttgtaata

SEQ ID NO: 4072834 - DNA, 13 bp, Homo sapiens
gtctgcctggagt

SEQ ID NO: 4072835 - DNA, 13 bp, Homo sapiens
gtctgccttaaag

SEQ ID NO: 4072836 - DNA, 15 bp, Homo sapiens
gtctgctaggcgctg

SEQ ID NO: 4072837 - DNA, 13 bp, Homo sapiens
gtctgctgaggag

SEQ ID NO: 4072838 - DNA, 20 bp, Homo sapiens
gtctgctgatcaaaagcatt

SEQ ID NO: 4072839 - DNA, 20 bp, Homo sapiens
gtctgctggtcacttcttct

SEQ ID NO: 4072840 - DNA, 22 bp, Homo sapiens
gtctgctttaaagggcctgcct

SEQ ID NO: 4072841 - DNA, 23 bp, Homo sapiens
gtctgctttaaagggcctgcctg

SEQ ID NO: 4072842 - DNA, 14 bp, Homo sapiens
gtctggaagtccaa

SEQ ID NO: 4072843 - DNA, 15 bp, Homo sapiens
gtctggacctgggga

SEQ ID NO: 4072844 - DNA, 12 bp, Homo sapiens
gtctggagtggg

SEQ ID NO: 4072845 - DNA, 14 bp, Homo sapiens
gtctggagtgggca

SEQ ID NO: 4072846 - DNA, 24 bp, Homo sapiens
gtctggctttttcctctgagccca

SEQ ID NO: 4072847 - DNA, 21 bp, Homo sapiens
gtctgggatatggctgcccag

SEQ ID NO: 4072848 - DNA, 15 bp, Homo sapiens
gtctgggcctctgac

SEQ ID NO: 4072849 - DNA, 23 bp, Homo sapiens
gtctgtatagtctagactttaaa

SEQ ID NO: 4072850 - DNA, 19 bp, Homo sapiens
gtctgtatttatgtgtgag

SEQ ID NO: 4072851 - DNA, 12 bp, Homo sapiens
gtctgtatttca

SEQ ID NO: 4072852 - DNA, 20 bp, Homo sapiens
gtctgtcaccagctatctgt

SEQ ID NO: 4072853 - DNA, 16 bp, Homo sapiens
gtctgtcgtgatgggg

SEQ ID NO: 4072854 - DNA, 13 bp, Homo sapiens
gtctgtctgcttt

SEQ ID NO: 4072855 - DNA, 20 bp, Homo sapiens
gtctgtctttcctgaaccat

SEQ ID NO: 4072856 - DNA, 15 bp, Homo sapiens
gtctgtgccatggat

SEQ ID NO: 4072857 - DNA, 14 bp, Homo sapiens
gtctgtgtgaatgt

SEQ ID NO: 4072858 - DNA, 13 bp, Homo sapiens
gtctgtttaaagt

SEQ ID NO: 4072859 - DNA, 14 bp, Homo sapiens
gtctgtttaaagtg

SEQ ID NO: 4072860 - DNA, 14 bp, Homo sapiens
gtctgtttaagaaa

SEQ ID NO: 4072861 - DNA, 16 bp, Homo sapiens
gtctgtttaagaaaag

SEQ ID NO: 4072862 - DNA, 18 bp, Homo sapiens
gtctgtttaagaaaagta

SEQ ID NO: 4072863 - DNA, 23 bp, Homo sapiens
gtcttaacaaaccaacatctttg

SEQ ID NO: 4072864 - DNA, 18 bp, Homo sapiens
gtcttaattattatttgt

SEQ ID NO: 4072865 - DNA, 16 bp, Homo sapiens
gtcttatcaactggtt

SEQ ID NO: 4072866 - DNA, 15 bp, Homo sapiens
gtcttatgcttccag

SEQ ID NO: 4072867 - DNA, 17 bp, Homo sapiens
gtcttatggtccagaaa

SEQ ID NO: 4072868 - DNA, 14 bp, Homo sapiens
gtcttatttcctca

SEQ ID NO: 4072869 - DNA, 17 bp, Homo sapiens
gtcttcaaattgtcttt

SEQ ID NO: 4072870 - DNA, 17 bp, Homo sapiens
gtcttcaacatcctgcc

SEQ ID NO: 4072871 - DNA, 20 bp, Homo sapiens
gtcttcaacatcctgccagc

SEQ ID NO: 4072872 - DNA, 21 bp, Homo sapiens
gtcttcaacatcctgccagcc

SEQ ID NO: 4072873 - DNA, 18 bp, Homo sapiens
gtcttccctacctcaggc

SEQ ID NO: 4072874 - DNA, 21 bp, Homo sapiens
gtcttccctacctcaggcagg

SEQ ID NO: 4072875 - DNA, 22 bp, Homo sapiens
gtcttcctactcttctctctgc

SEQ ID NO: 4072876 - DNA, 18 bp, Homo sapiens
gtcttcctgaaatgcagt

SEQ ID NO: 4072877 - DNA, 19 bp, Homo sapiens
gtcttcctgagtggtgcca

SEQ ID NO: 4072878 - DNA, 17 bp, Homo sapiens
gtcttcggccgagctgg

SEQ ID NO: 4072879 - DNA, 21 bp, Homo sapiens
gtcttcggccgagctggtttc

SEQ ID NO: 4072880 - DNA, 19 bp, Homo sapiens
gtcttctcatagcattaac

SEQ ID NO: 4072881 - DNA, 12 bp, Homo sapiens
gtcttgctctgt

SEQ ID NO: 4072882 - DNA, 15 bp, Homo sapiens
gtcttggtgcctttt

SEQ ID NO: 4072883 - DNA, 16 bp, Homo sapiens
gtcttggtggttctat

SEQ ID NO: 4072884 - DNA, 13 bp, Homo sapiens
gtcttgttagaaa

SEQ ID NO: 4072885 - DNA, 20 bp, Homo sapiens
gtcttgttgcggatggatgg

SEQ ID NO: 4072886 - DNA, 16 bp, Homo sapiens
gtctttcctggcacta

SEQ ID NO: 4072887 - DNA, 16 bp, Homo sapiens
gtctttctccaaagtt

SEQ ID NO: 4072888 - DNA, 23 bp, Homo sapiens
gtctttcttgggatagtgttctg

SEQ ID NO: 4072889 - DNA, 22 bp, Homo sapiens
gtctttgtaagagtgtagaagc

SEQ ID NO: 4072890 - DNA, 15 bp, Homo sapiens
gtctttgtaagtcag

SEQ ID NO: 4072891 - DNA, 17 bp, Homo sapiens
gtctttgtatcttccat

SEQ ID NO: 4072892 - DNA, 16 bp, Homo sapiens
gtcttttcaggtttgt

SEQ ID NO: 4072893 - DNA, 14 bp, Homo sapiens
gtcttttgacatgt

SEQ ID NO: 4072894 - DNA, 15 bp, Homo sapiens
gtcttttgttcgcat

SEQ ID NO: 4072895 - DNA, 15 bp, Homo sapiens
gtcttttttttcctg

SEQ ID NO: 4072896 - DNA, 16 bp, Homo sapiens
gtgaaaagattttatt

SEQ ID NO: 4072897 - DNA, 20 bp, Homo sapiens
gtgaaaatttttacattcat

SEQ ID NO: 4072898 - DNA, 23 bp, Homo sapiens
gtgaaacacaccaggctgtgggc

SEQ ID NO: 4072899 - DNA, 16 bp, Homo sapiens
gtgaaaccctgtctct

SEQ ID NO: 4072900 - DNA, 14 bp, Homo sapiens
gtgaaacctttttt

SEQ ID NO: 4072901 - DNA, 21 bp, Homo sapiens
gtgaaaccttttttaagattt

SEQ ID NO: 4072902 - DNA, 19 bp, Homo sapiens
gtgaaactaacagataagc

SEQ ID NO: 4072903 - DNA, 20 bp, Homo sapiens
gtgaaagaaagctgagaaga

SEQ ID NO: 4072904 - DNA, 17 bp, Homo sapiens
gtgaaagctgagaactc

SEQ ID NO: 4072905 - DNA, 21 bp, Homo sapiens
gtgaaagctgagaactcctga

SEQ ID NO: 4072906 - DNA, 15 bp, Homo sapiens
gtgaaaggcagggcc

SEQ ID NO: 4072907 - DNA, 17 bp, Homo sapiens
gtgaaataacaaaatgg

SEQ ID NO: 4072908 - DNA, 19 bp, Homo sapiens
gtgaaataacaaaatggac

SEQ ID NO: 4072909 - DNA, 22 bp, Homo sapiens
gtgaaataccaacctgaagaca

SEQ ID NO: 4072910 - DNA, 17 bp, Homo sapiens
gtgaacaaagcagccac

SEQ ID NO: 4072911 - DNA, 17 bp, Homo sapiens
gtgaaccagagggtgtg

SEQ ID NO: 4072912 - DNA, 14 bp, Homo sapiens
gtgaacctgtataa

SEQ ID NO: 4072913 - DNA, 14 bp, Homo sapiens
gtgaacgatttaga

SEQ ID NO: 4072914 - DNA, 16 bp, Homo sapiens
gtgaacgatttagaaa

SEQ ID NO: 4072915 - DNA, 17 bp, Homo sapiens
gtgaactagggaagctc

SEQ ID NO: 4072916 - DNA, 22 bp, Homo sapiens
gtgaactcaccctgggagccag

SEQ ID NO: 4072917 - DNA, 13 bp, Homo sapiens
gtgaactcctgcc

SEQ ID NO: 4072918 - DNA, 17 bp, Homo sapiens
gtgaacttgactgggtg

SEQ ID NO: 4072919 - DNA, 13 bp, Homo sapiens
gtgaagacatttt

SEQ ID NO: 4072920 - DNA, 15 bp, Homo sapiens
gtgaagataatttgc

SEQ ID NO: 4072921 - DNA, 16 bp, Homo sapiens
gtgaaggaggctccag

SEQ ID NO: 4072922 - DNA, 21 bp, Homo sapiens
gtgaaggtattttgtagatgt

SEQ ID NO: 4072923 - DNA, 16 bp, Homo sapiens
gtgaataaatgtcttg

SEQ ID NO: 4072924 - DNA, 19 bp, Homo sapiens
gtgaatacaattaaaggtc

SEQ ID NO: 4072925 - DNA, 14 bp, Homo sapiens
gtgaatagcctggc

SEQ ID NO: 4072926 - DNA, 14 bp, Homo sapiens
gtgaatcacctggc

SEQ ID NO: 4072927 - DNA, 21 bp, Homo sapiens
gtgaatcacctggctgagcag

SEQ ID NO: 4072928 - DNA, 12 bp, Homo sapiens
gtgaatgaaaga

SEQ ID NO: 4072929 - DNA, 17 bp, Homo sapiens
gtgaatgaaagattaaa

SEQ ID NO: 4072930 - DNA, 18 bp, Homo sapiens
gtgaatgaaagattaaac

SEQ ID NO: 4072931 - DNA, 14 bp, Homo sapiens
gtgaatgtgggcac

SEQ ID NO: 4072932 - DNA, 18 bp, Homo sapiens
gtgaattattgacactga

SEQ ID NO: 4072933 - DNA, 13 bp, Homo sapiens
gtgaattgactac

SEQ ID NO: 4072934 - DNA, 13 bp, Homo sapiens
gtgaatttgaatg

SEQ ID NO: 4072935 - DNA, 18 bp, Homo sapiens
gtgaatttgaatgaaaaa

SEQ ID NO: 4072936 - DNA, 23 bp, Homo sapiens
gtgacaagctcctggtcttgaga

SEQ ID NO: 4072937 - DNA, 14 bp, Homo sapiens
gtgctctgcctcag

SEQ ID NO: 4072938 - DNA, 21 bp, Homo sapiens
gtgctcttggctgacccctct

SEQ ID NO: 4072939 - DNA, 23 bp, Homo sapiens
gtgctgaatggttttcaaaataa

SEQ ID NO: 4072940 - DNA, 15 bp, Homo sapiens
gtgctgacggccagg

SEQ ID NO: 4072941 - DNA, 23 bp, Homo sapiens
gtgctgacggccagggagaagct

SEQ ID NO: 4072942 - DNA, 18 bp, Homo sapiens
gtgctgagattgcagatg

SEQ ID NO: 4072943 - DNA, 22 bp, Homo sapiens
gtgctgcagatttgatatttgc

SEQ ID NO: 4072944 - DNA, 11 bp, Homo sapiens
gtgctgcagga

SEQ ID NO: 4072945 - DNA, 13 bp, Homo sapiens
gtgctgcaggagt

SEQ ID NO: 4072946 - DNA, 21 bp, Homo sapiens
gtgctgccatttgatttttct

SEQ ID NO: 4072947 - DNA, 22 bp, Homo sapiens
gtgctggcacttagtaggtcct

SEQ ID NO: 4072948 - DNA, 14 bp, Homo sapiens
gtgctggctcacag

SEQ ID NO: 4072949 - DNA, 19 bp, Homo sapiens
gtgctggctcacagtacag

SEQ ID NO: 4072950 - DNA, 14 bp, Homo sapiens
gtgctgggaaggga

SEQ ID NO: 4072951 - DNA, 18 bp, Homo sapiens
gtgctgggaagggagggt

SEQ ID NO: 4072952 - DNA, 11 bp, Homo sapiens
gtgctgggacc

SEQ ID NO: 4072953 - DNA, 12 bp, Homo sapiens
gtgctgggacca

SEQ ID NO: 4072954 - DNA, 14 bp, Homo sapiens
gtgctgggaccaga

SEQ ID NO: 4072955 - DNA, 15 bp, Homo sapiens
gtgctgggaccagag

SEQ ID NO: 4072956 - DNA, 19 bp, Homo sapiens
gtgctgggaccagagccag

SEQ ID NO: 4072957 - DNA, 19 bp, Homo sapiens
gtgctgggaggagggagag

SEQ ID NO: 4072958 - DNA, 23 bp, Homo sapiens
gtgctgggaggagggagagggag

SEQ ID NO: 4072959 - DNA, 23 bp, Homo sapiens
gtgctgggggaatgagcccagag

SEQ ID NO: 4072960 - DNA, 14 bp, Homo sapiens
gtgctggtttattt

SEQ ID NO: 4072961 - DNA, 18 bp, Homo sapiens
gtgctgtgaccatttata

SEQ ID NO: 4072962 - DNA, 18 bp, Homo sapiens
gtgctgtggccagggtga

SEQ ID NO: 4072963 - DNA, 19 bp, Homo sapiens
gtgctgtgggcagcaccct

SEQ ID NO: 4072964 - DNA, 12 bp, Homo sapiens
gtgctgtgtgcc

SEQ ID NO: 4072965 - DNA, 15 bp, Homo sapiens
gtgcttcaattaata

SEQ ID NO: 4072966 - DNA, 14 bp, Homo sapiens
gtgcttctggaaac

SEQ ID NO: 4072967 - DNA, 13 bp, Homo sapiens
gtgcttgaaggcc

SEQ ID NO: 4072968 - DNA, 14 bp, Homo sapiens
gtgcttgaaggccc

SEQ ID NO: 4072969 - DNA, 15 bp, Homo sapiens
gtgcttgaaggccct

SEQ ID NO: 4072970 - DNA, 18 bp, Homo sapiens
gtgcttgaaggccctgct

SEQ ID NO: 4072971 - DNA, 19 bp, Homo sapiens
gtgcttgaaggccctgctg

SEQ ID NO: 4072972 - DNA, 18 bp, Homo sapiens
gtgcttgtgaaagaggtc

SEQ ID NO: 4072973 - DNA, 20 bp, Homo sapiens
gtgcttgttccctctccctg

SEQ ID NO: 4072974 - DNA, 14 bp, Homo sapiens
gtggaaagcacttt

SEQ ID NO: 4072975 - DNA, 16 bp, Homo sapiens
gtggaaagtgaatttg

SEQ ID NO: 4072976 - DNA, 19 bp, Homo sapiens
gtggaaagtgaatttgaat

SEQ ID NO: 4072977 - DNA, 20 bp, Homo sapiens
gtggaacataaaaaggacat

SEQ ID NO: 4072978 - DNA, 15 bp, Homo sapiens
gtggaagaagggaga

SEQ ID NO: 4072979 - DNA, 18 bp, Homo sapiens
gtggaagaagggagaaga

SEQ ID NO: 4072980 - DNA, 17 bp, Homo sapiens
gtggaaggcctccctct

SEQ ID NO: 4072981 - DNA, 13 bp, Homo sapiens
gtggaagggctgg

SEQ ID NO: 4072982 - DNA, 15 bp, Homo sapiens
gtggaagggctgggt

SEQ ID NO: 4072983 - DNA, 16 bp, Homo sapiens
gtggaagggctgggtg

SEQ ID NO: 4072984 - DNA, 12 bp, Homo sapiens
gtggacaggccc

SEQ ID NO: 4072985 - DNA, 19 bp, Homo sapiens
gtggaccgtggacaggccc

SEQ ID NO: 4072986 - DNA, 21 bp, Homo sapiens
gtggaccgtggacaggcccag

SEQ ID NO: 4072987 - DNA, 17 bp, Homo sapiens
gtggaccttaggccttc

SEQ ID NO: 4072988 - DNA, 18 bp, Homo sapiens
gtggaccttttaaagtgt

SEQ ID NO: 4072989 - DNA, 15 bp, Homo sapiens
gtggactcagggcag

SEQ ID NO: 4072990 - DNA, 14 bp, Homo sapiens
gtggactgcgctgg

SEQ ID NO: 4072991 - DNA, 16 bp, Homo sapiens
gtggactggcccctgg

SEQ ID NO: 4072992 - DNA, 22 bp, Homo sapiens
gtggagaaaatcaaaccgagca

SEQ ID NO: 4072993 - DNA, 14 bp, Homo sapiens
gtggagagctggtg

SEQ ID NO: 4072994 - DNA, 16 bp, Homo sapiens
gtggagcatgggcctg

SEQ ID NO: 4072995 - DNA, 19 bp, Homo sapiens
gtggagcctgacagccaga

SEQ ID NO: 4072996 - DNA, 16 bp, Homo sapiens
gtggagctcagccccg

SEQ ID NO: 4072997 - DNA, 13 bp, Homo sapiens
gtggaggcacttt

SEQ ID NO: 4072998 - DNA, 14 bp, Homo sapiens
gtggaggcttcctg

SEQ ID NO: 4072999 - DNA, 12 bp, Homo sapiens
gtggagggaggg

SEQ ID NO: 4073000 - DNA, 14 bp, Homo sapiens
gtggagggcacagc

SEQ ID NO: 4073001 - DNA, 16 bp, Homo sapiens
gtggagggcacagccc

SEQ ID NO: 4073002 - DNA, 17 bp, Homo sapiens
gtggagggcacagccct

SEQ ID NO: 4073003 - DNA, 15 bp, Homo sapiens
gtggaggggtgtggc

SEQ ID NO: 4073004 - DNA, 14 bp, Homo sapiens
gtggagtttctctg

SEQ ID NO: 4073005 - DNA, 20 bp, Homo sapiens
gtggatcccctgcggtcagg

SEQ ID NO: 4073006 - DNA, 19 bp, Homo sapiens
gtggatctatttcatgttt

SEQ ID NO: 4073007 - DNA, 15 bp, Homo sapiens
gtggatgactgttga

SEQ ID NO: 4073008 - DNA, 21 bp, Homo sapiens
gtggatgccacagcccagctt

SEQ ID NO: 4073009 - DNA, 16 bp, Homo sapiens
gtggatgggaatttgt

SEQ ID NO: 4073010 - DNA, 18 bp, Homo sapiens
gtggattctgaggccctg

SEQ ID NO: 4073011 - DNA, 13 bp, Homo sapiens
gtggattgagggt

SEQ ID NO: 4073012 - DNA, 19 bp, Homo sapiens
gtggattttttattattat

SEQ ID NO: 4073013 - DNA, 21 bp, Homo sapiens
gtggcaatgcttaaactaaat

SEQ ID NO: 4073014 - DNA, 16 bp, Homo sapiens
gtggcacaggccccct

SEQ ID NO: 4073015 - DNA, 21 bp, Homo sapiens
gtggcactcaactctgagccc

SEQ ID NO: 4073016 - DNA, 17 bp, Homo sapiens
gtggcagagagagagaa

SEQ ID NO: 4073017 - DNA, 15 bp, Homo sapiens
gtggcaggaccagga

SEQ ID NO: 4073018 - DNA, 17 bp, Homo sapiens
gtggcaggaccaggact

SEQ ID NO: 4073019 - DNA, 18 bp, Homo sapiens
gtggcagtggaggtgggg

SEQ ID NO: 4073020 - DNA, 20 bp, Homo sapiens
gtggcatctttgccttgggc

SEQ ID NO: 4073021 - DNA, 14 bp, Homo sapiens
gtggcatgttttga

SEQ ID NO: 4073022 - DNA, 19 bp, Homo sapiens
gtggccacagcaagtacag

SEQ ID NO: 4073023 - DNA, 14 bp, Homo sapiens
gtggccactcagct

SEQ ID NO: 4073024 - DNA, 17 bp, Homo sapiens
gtggccagagctgggag

SEQ ID NO: 4073025 - DNA, 23 bp, Homo sapiens
gtggccagagctgggaggcatgg

SEQ ID NO: 4073026 - DNA, 14 bp, Homo sapiens
gtggccatccctgg

SEQ ID NO: 4073027 - DNA, 16 bp, Homo sapiens
gtggccatccctgggc

SEQ ID NO: 4073028 - DNA, 21 bp, Homo sapiens
gtggccatccctgggcccctc

SEQ ID NO: 4073029 - DNA, 22 bp, Homo sapiens
gtggccccaccgagctggagcg

SEQ ID NO: 4073030 - DNA, 16 bp, Homo sapiens
gtggcccgacagcctg

SEQ ID NO: 4073031 - DNA, 19 bp, Homo sapiens
gtggcccgacagcctggca

SEQ ID NO: 4073032 - DNA, 20 bp, Homo sapiens
gtggccgtctcctccctcag

SEQ ID NO: 4073033 - DNA, 13 bp, Homo sapiens
gtggcctcagaat

SEQ ID NO: 4073034 - DNA, 14 bp, Homo sapiens
gtggcctcagccct

SEQ ID NO: 4073035 - DNA, 18 bp, Homo sapiens
gtggcctcagccctcaga

SEQ ID NO: 4073036 - DNA, 19 bp, Homo sapiens
gtggcctcagccctcagaa

SEQ ID NO: 4073037 - DNA, 18 bp, Homo sapiens
gtggcctcagctgaatgc

SEQ ID NO: 4073038 - DNA, 15 bp, Homo sapiens
gtggcctccctgctg

SEQ ID NO: 4073039 - DNA, 17 bp, Homo sapiens
gtggcctcttgagcagt

SEQ ID NO: 4073040 - DNA, 13 bp, Homo sapiens
gtgttttttaaaa

SEQ ID NO: 4073041 - DNA, 23 bp, Homo sapiens
gtgttttttctttttttttaagt

SEQ ID NO: 4073042 - DNA, 12 bp, Homo sapiens
gttaaacagtag

SEQ ID NO: 4073043 - DNA, 23 bp, Homo sapiens
gttaaacagtagttgtattcttc

SEQ ID NO: 4073044 - DNA, 14 bp, Homo sapiens
gttaaacattgaag

SEQ ID NO: 4073045 - DNA, 19 bp, Homo sapiens
gttaaacggtgcccatcct

SEQ ID NO: 4073046 - DNA, 13 bp, Homo sapiens
gttaaatactgtg

SEQ ID NO: 4073047 - DNA, 17 bp, Homo sapiens
gttaaatactgtgcaga

SEQ ID NO: 4073048 - DNA, 22 bp, Homo sapiens
gttaaatactgtgcagaataat

SEQ ID NO: 4073049 - DNA, 19 bp, Homo sapiens
gttaaatagagtatatgca

SEQ ID NO: 4073050 - DNA, 23 bp, Homo sapiens
gttaaatttgtaagtttcaggtg

SEQ ID NO: 4073051 - DNA, 20 bp, Homo sapiens
gttaacacaatgtgaatttc

SEQ ID NO: 4073052 - DNA, 17 bp, Homo sapiens
gttaacctcagtgtcat

SEQ ID NO: 4073053 - DNA, 19 bp, Homo sapiens
gttaacctttttgtaaata

SEQ ID NO: 4073054 - DNA, 17 bp, Homo sapiens
gttaactatgacagata

SEQ ID NO: 4073055 - DNA, 19 bp, Homo sapiens
gttaactgttaactatgac

SEQ ID NO: 4073056 - DNA, 19 bp, Homo sapiens
gttaagacatgatttcctt

SEQ ID NO: 4073057 - DNA, 13 bp, Homo sapiens
gttaagacctggc

SEQ ID NO: 4073058 - DNA, 16 bp, Homo sapiens
gttaagacctggcagc

SEQ ID NO: 4073059 - DNA, 16 bp, Homo sapiens
gttaagatacagtgta

SEQ ID NO: 4073060 - DNA, 18 bp, Homo sapiens
gttaagcattaccactca

SEQ ID NO: 4073061 - DNA, 16 bp, Homo sapiens
gttaaggaaactctta

SEQ ID NO: 4073062 - DNA, 19 bp, Homo sapiens
gttaaggaaactcttatct

SEQ ID NO: 4073063 - DNA, 21 bp, Homo sapiens
gttaaggaaactcttatctca

SEQ ID NO: 4073064 - DNA, 16 bp, Homo sapiens
gttaaggcctgaatca

SEQ ID NO: 4073065 - DNA, 14 bp, Homo sapiens
gttaagggaaggaa

SEQ ID NO: 4073066 - DNA, 14 bp, Homo sapiens
gttaagtatgtgta

SEQ ID NO: 4073067 - DNA, 21 bp, Homo sapiens
gttaagtctcctgtcttatgg

SEQ ID NO: 4073068 - DNA, 15 bp, Homo sapiens
gttaatatttaagac

SEQ ID NO: 4073069 - DNA, 12 bp, Homo sapiens
gttaatcttagg

SEQ ID NO: 4073070 - DNA, 16 bp, Homo sapiens
gttaatgaaaatgtca

SEQ ID NO: 4073071 - DNA, 15 bp, Homo sapiens
gttaatgttatatca

SEQ ID NO: 4073072 - DNA, 12 bp, Homo sapiens
gttaattaatgt

SEQ ID NO: 4073073 - DNA, 21 bp, Homo sapiens
gttaattaatgtcatgttgct

SEQ ID NO: 4073074 - DNA, 21 bp, Homo sapiens
gttaattcagcactgatttca

SEQ ID NO: 4073075 - DNA, 12 bp, Homo sapiens
gttaattttacc

SEQ ID NO: 4073076 - DNA, 21 bp, Homo sapiens
gttaatttttccttcctctgt

SEQ ID NO: 4073077 - DNA, 21 bp, Homo sapiens
gttaatttttcttagtgttgt

SEQ ID NO: 4073078 - DNA, 13 bp, Homo sapiens
gttacaaactgca

SEQ ID NO: 4073079 - DNA, 13 bp, Homo sapiens
gttacaagtatac

SEQ ID NO: 4073080 - DNA, 20 bp, Homo sapiens
gttacacagaaatgctgctg

SEQ ID NO: 4073081 - DNA, 21 bp, Homo sapiens
gttacacagaaatgctgctgg

SEQ ID NO: 4073082 - DNA, 20 bp, Homo sapiens
gttacacattaagtaatcaa

SEQ ID NO: 4073083 - DNA, 15 bp, Homo sapiens
gttacactaaaaggt

SEQ ID NO: 4073084 - DNA, 19 bp, Homo sapiens
gttacaggtaccagttctt

SEQ ID NO: 4073085 - DNA, 17 bp, Homo sapiens
gttacatcacagtgttt

SEQ ID NO: 4073086 - DNA, 15 bp, Homo sapiens
gttacatctgtgcag

SEQ ID NO: 4073087 - DNA, 17 bp, Homo sapiens
gttacatgcataaaagg

SEQ ID NO: 4073088 - DNA, 21 bp, Homo sapiens
gttacatttctatcagtactt

SEQ ID NO: 4073089 - DNA, 20 bp, Homo sapiens
gttacccaggctggagtgca

SEQ ID NO: 4073090 - DNA, 16 bp, Homo sapiens
gttaccgcctgtctct

SEQ ID NO: 4073091 - DNA, 23 bp, Homo sapiens
gttacgcacacgtacttaaatga

SEQ ID NO: 4073092 - DNA, 16 bp, Homo sapiens
gttactaatatgccta

SEQ ID NO: 4073093 - DNA, 15 bp, Homo sapiens
gttactacctcctct

SEQ ID NO: 4073094 - DNA, 12 bp, Homo sapiens
gttactcagggt

SEQ ID NO: 4073095 - DNA, 17 bp, Homo sapiens
gttactgatcatgcatt

SEQ ID NO: 4073096 - DNA, 16 bp, Homo sapiens
gttacttcttctctta

SEQ ID NO: 4073097 - DNA, 17 bp, Homo sapiens
gttactttgtaattttt

SEQ ID NO: 4073098 - DNA, 20 bp, Homo sapiens
gttactttgtaatttttggg

SEQ ID NO: 4073099 - DNA, 15 bp, Homo sapiens
gttagaaaatgactt

SEQ ID NO: 4073100 - DNA, 22 bp, Homo sapiens
gttagactgacttgtttgtctt

SEQ ID NO: 4073101 - DNA, 20 bp, Homo sapiens
gttagagagggaccatgtgt

SEQ ID NO: 4073102 - DNA, 15 bp, Homo sapiens
gttagattttgcatt

SEQ ID NO: 4073103 - DNA, 22 bp, Homo sapiens
gttagccccagggatcactggc

SEQ ID NO: 4073104 - DNA, 22 bp, Homo sapiens
gttaggaaaaccagagcctata

SEQ ID NO: 4073105 - DNA, 16 bp, Homo sapiens
gttaggaacagcagtg

SEQ ID NO: 4073106 - DNA, 18 bp, Homo sapiens
gttaggcattaatgtttc

SEQ ID NO: 4073107 - DNA, 23 bp, Homo sapiens
gttagggtgctctggaagagagg

SEQ ID NO: 4073108 - DNA, 21 bp, Homo sapiens
gttaggtagagggagttgtca

SEQ ID NO: 4073109 - DNA, 17 bp, Homo sapiens
gttaggttgtctccagg

SEQ ID NO: 4073110 - DNA, 16 bp, Homo sapiens
gttagtagcatgttga

SEQ ID NO: 4073111 - DNA, 14 bp, Homo sapiens
gttagtattttaat

SEQ ID NO: 4073112 - DNA, 22 bp, Homo sapiens
gttagtctcttgtattaaactc

SEQ ID NO: 4073113 - DNA, 15 bp, Homo sapiens
gttagttataaatag

SEQ ID NO: 4073114 - DNA, 21 bp, Homo sapiens
gttagttataaatagccttca

SEQ ID NO: 4073115 - DNA, 19 bp, Homo sapiens
gttagttgtgaaagaaagc

SEQ ID NO: 4073116 - DNA, 13 bp, Homo sapiens
gttagtttacaat

SEQ ID NO: 4073117 - DNA, 16 bp, Homo sapiens
gttagtttctttggga

SEQ ID NO: 4073118 - DNA, 16 bp, Homo sapiens
gttataaaaaatggtt

SEQ ID NO: 4073119 - DNA, 22 bp, Homo sapiens
gttataaaaaatggttcagaat

SEQ ID NO: 4073120 - DNA, 18 bp, Homo sapiens
gttataaatcaatgtcac

SEQ ID NO: 4073121 - DNA, 12 bp, Homo sapiens
gttataattttt

SEQ ID NO: 4073122 - DNA, 15 bp, Homo sapiens
gttatagtatatctg

SEQ ID NO: 4073123 - DNA, 22 bp, Homo sapiens
gttatagtgacagctttccatg

SEQ ID NO: 4073124 - DNA, 18 bp, Homo sapiens
gttatatatctcttttgg

SEQ ID NO: 4073125 - DNA, 17 bp, Homo sapiens
gttatcgaaataacaat

SEQ ID NO: 4073126 - DNA, 23 bp, Homo sapiens
gttatcgaaataacaatgttaag

SEQ ID NO: 4073127 - DNA, 12 bp, Homo sapiens
gttatctctgtg

SEQ ID NO: 4073128 - DNA, 13 bp, Homo sapiens
gttatctctgtgt

SEQ ID NO: 4073129 - DNA, 13 bp, Homo sapiens
gttatgaaagaat

SEQ ID NO: 4073130 - DNA, 17 bp, Homo sapiens
gttatgaaagaatatat

SEQ ID NO: 4073131 - DNA, 20 bp, Homo sapiens
gttatgaaagaatatattta

SEQ ID NO: 4073132 - DNA, 20 bp, Homo sapiens
gttatgaaattcaccccctt

SEQ ID NO: 4073133 - DNA, 23 bp, Homo sapiens
gttatgataacaccagtgggaat

SEQ ID NO: 4073134 - DNA, 17 bp, Homo sapiens
gttatgatattgtttaa

SEQ ID NO: 4073135 - DNA, 20 bp, Homo sapiens
gttatgatttccttcaatgt

SEQ ID NO: 4073136 - DNA, 16 bp, Homo sapiens
gttatgtctgtttaag

SEQ ID NO: 4073137 - DNA, 17 bp, Homo sapiens
gttattagcaaggctgg

SEQ ID NO: 4073138 - DNA, 16 bp, Homo sapiens
gttattataaatgtta

SEQ ID NO: 4073139 - DNA, 19 bp, Homo sapiens
gttattccatcaataaatg

SEQ ID NO: 4073140 - DNA, 21 bp, Homo sapiens
gttattctaagccctttgcca

SEQ ID NO: 4073141 - DNA, 16 bp, Homo sapiens
gttattgttgttgcca

SEQ ID NO: 4073142 - DNA, 23 bp, Homo sapiens
gttcctttttaaatgtgaatttt

SEQ ID NO: 4073143 - DNA, 22 bp, Homo sapiens
gttcgaaatagatatcctctcc

SEQ ID NO: 4073144 - DNA, 22 bp, Homo sapiens
gttcgaggactacaaccaattt

SEQ ID NO: 4073145 - DNA, 14 bp, Homo sapiens
gttcgcatggtcac

SEQ ID NO: 4073146 - DNA, 19 bp, Homo sapiens
gttctaaaaattgtgatca

SEQ ID NO: 4073147 - DNA, 14 bp, Homo sapiens
gttctagaaccact

SEQ ID NO: 4073148 - DNA, 23 bp, Homo sapiens
gttctagtctcctttgcactgag

SEQ ID NO: 4073149 - DNA, 23 bp, Homo sapiens
gttctatcaggggtgcattctgg

SEQ ID NO: 4073150 - DNA, 18 bp, Homo sapiens
gttctcacaccaacagtg

SEQ ID NO: 4073151 - DNA, 16 bp, Homo sapiens
gttctcactgttccct

SEQ ID NO: 4073152 - DNA, 16 bp, Homo sapiens
gttctcaggacagcat

SEQ ID NO: 4073153 - DNA, 22 bp, Homo sapiens
gttctcatttggtctgccagaa

SEQ ID NO: 4073154 - DNA, 17 bp, Homo sapiens
gttctccagaatgtaag

SEQ ID NO: 4073155 - DNA, 22 bp, Homo sapiens
gttctccagaatgtaagaaaac

SEQ ID NO: 4073156 - DNA, 14 bp, Homo sapiens
gttctccaggcttc

SEQ ID NO: 4073157 - DNA, 17 bp, Homo sapiens
gttctccaggcttcaca

SEQ ID NO: 4073158 - DNA, 19 bp, Homo sapiens
gttctccgggtgtggcctc

SEQ ID NO: 4073159 - DNA, 22 bp, Homo sapiens
gttctccgggtgtggcctcagc

SEQ ID NO: 4073160 - DNA, 23 bp, Homo sapiens
gttctcctcgtccatcagggatc

SEQ ID NO: 4073161 - DNA, 16 bp, Homo sapiens
gttctgacattaacag

SEQ ID NO: 4073162 - DNA, 22 bp, Homo sapiens
gttctgactttttgtttctttg

SEQ ID NO: 4073163 - DNA, 20 bp, Homo sapiens
gttctgaggattcaggggct

SEQ ID NO: 4073164 - DNA, 14 bp, Homo sapiens
gttctgattagaaa

SEQ ID NO: 4073165 - DNA, 16 bp, Homo sapiens
gttctgcaaaaatatt

SEQ ID NO: 4073166 - DNA, 22 bp, Homo sapiens
gttctgcaaaaatatttataaa

SEQ ID NO: 4073167 - DNA, 14 bp, Homo sapiens
gttctgccaggcaa

SEQ ID NO: 4073168 - DNA, 13 bp, Homo sapiens
gttctgcctgcca

SEQ ID NO: 4073169 - DNA, 22 bp, Homo sapiens
gttctgcctgccagctgcactg

SEQ ID NO: 4073170 - DNA, 14 bp, Homo sapiens
gttctgctccatac

SEQ ID NO: 4073171 - DNA, 15 bp, Homo sapiens
gttctgctcctgctt

SEQ ID NO: 4073172 - DNA, 22 bp, Homo sapiens
gttctgctcctgcttttctgtc

SEQ ID NO: 4073173 - DNA, 22 bp, Homo sapiens
gttctgctctggttgtttctgt

SEQ ID NO: 4073174 - DNA, 13 bp, Homo sapiens
gttctgctggcct

SEQ ID NO: 4073175 - DNA, 20 bp, Homo sapiens
gttctgctgggagttctaga

SEQ ID NO: 4073176 - DNA, 20 bp, Homo sapiens
gttctggaggaaagggagga

SEQ ID NO: 4073177 - DNA, 18 bp, Homo sapiens
gttctgtggttcctctgc

SEQ ID NO: 4073178 - DNA, 22 bp, Homo sapiens
gttctgtgtctttcacagctcc

SEQ ID NO: 4073179 - DNA, 23 bp, Homo sapiens
gttctgtgtctttcacagctcct

SEQ ID NO: 4073180 - DNA, 14 bp, Homo sapiens
gttctgttctgggg

SEQ ID NO: 4073181 - DNA, 14 bp, Homo sapiens
gttctgtttgttat

SEQ ID NO: 4073182 - DNA, 23 bp, Homo sapiens
gttctgtttgttattgttttgtt

SEQ ID NO: 4073183 - DNA, 22 bp, Homo sapiens
gttcttagttgacaacctagaa

SEQ ID NO: 4073184 - DNA, 17 bp, Homo sapiens
gttcttagtttgcagtt

SEQ ID NO: 4073185 - DNA, 23 bp, Homo sapiens
gttcttatagaataaaagctgtg

SEQ ID NO: 4073186 - DNA, 21 bp, Homo sapiens
gttcttattttgcattccaga

SEQ ID NO: 4073187 - DNA, 13 bp, Homo sapiens
gttcttcacctct

SEQ ID NO: 4073188 - DNA, 14 bp, Homo sapiens
gttcttcacctcta

SEQ ID NO: 4073189 - DNA, 17 bp, Homo sapiens
gttcttcacctctatcc

SEQ ID NO: 4073190 - DNA, 14 bp, Homo sapiens
gttcttcagggcca

SEQ ID NO: 4073191 - DNA, 19 bp, Homo sapiens
gttcttccagttactttcc

SEQ ID NO: 4073192 - DNA, 21 bp, Homo sapiens
gttcttcctccagctgcacca

SEQ ID NO: 4073193 - DNA, 21 bp, Homo sapiens
gttcttgcagtcatcagaagt

SEQ ID NO: 4073194 - DNA, 16 bp, Homo sapiens
gttcttggtagagatt

SEQ ID NO: 4073195 - DNA, 16 bp, Homo sapiens
gttcttggtgctctgt

SEQ ID NO: 4073196 - DNA, 12 bp, Homo sapiens
gttcttgtctga

SEQ ID NO: 4073197 - DNA, 16 bp, Homo sapiens
gttcttgttttatata

SEQ ID NO: 4073198 - DNA, 16 bp, Homo sapiens
gttctttaggagattt

SEQ ID NO: 4073199 - DNA, 20 bp, Homo sapiens
gttctttccataataaaagg

SEQ ID NO: 4073200 - DNA, 16 bp, Homo sapiens
gttctttcctgccctg

SEQ ID NO: 4073201 - DNA, 18 bp, Homo sapiens
gttctttggaaggagtga

SEQ ID NO: 4073202 - DNA, 22 bp, Homo sapiens
gttctttgggccagacatgcca

SEQ ID NO: 4073203 - DNA, 21 bp, Homo sapiens
gttgaaaggttttttttcagt

SEQ ID NO: 4073204 - DNA, 24 bp, Homo sapiens
gttgaaattttgcaaatataaaca

SEQ ID NO: 4073205 - DNA, 20 bp, Homo sapiens
gttgaactttgccaaaaaaa

SEQ ID NO: 4073206 - DNA, 21 bp, Homo sapiens
gttgaagacctaaccagggcc

SEQ ID NO: 4073207 - DNA, 15 bp, Homo sapiens
gttgaagaggaaggg

SEQ ID NO: 4073208 - DNA, 20 bp, Homo sapiens
gttgaagtcatgctcccctg

SEQ ID NO: 4073209 - DNA, 15 bp, Homo sapiens
gttgacaacctagaa

SEQ ID NO: 4073210 - DNA, 18 bp, Homo sapiens
gttgacagttcatatgta

SEQ ID NO: 4073211 - DNA, 14 bp, Homo sapiens
gttgaccagataaa

SEQ ID NO: 4073212 - DNA, 24 bp, Homo sapiens
gttgacttatagtacatgataaat

SEQ ID NO: 4073213 - DNA, 16 bp, Homo sapiens
gttgagaatcccaaat

SEQ ID NO: 4073214 - DNA, 19 bp, Homo sapiens
gttgagatttttaagaact

SEQ ID NO: 4073215 - DNA, 19 bp, Homo sapiens
gttgagcatgacagcctgc

SEQ ID NO: 4073216 - DNA, 15 bp, Homo sapiens
gttgagccaggcctg

SEQ ID NO: 4073217 - DNA, 15 bp, Homo sapiens
gttgagcccctggag

SEQ ID NO: 4073218 - DNA, 13 bp, Homo sapiens
gttgagctgtttt

SEQ ID NO: 4073219 - DNA, 22 bp, Homo sapiens
gttgagtctcctctctgagact

SEQ ID NO: 4073220 - DNA, 17 bp, Homo sapiens
gttgatctggaacccag

SEQ ID NO: 4073221 - DNA, 19 bp, Homo sapiens
gttgatctggaacccagac

SEQ ID NO: 4073222 - DNA, 19 bp, Homo sapiens
gttgatcttacaagatatt

SEQ ID NO: 4073223 - DNA, 15 bp, Homo sapiens
gttgatggaaaataa

SEQ ID NO: 4073224 - DNA, 17 bp, Homo sapiens
gttgcaagatgtgaatt

SEQ ID NO: 4073225 - DNA, 15 bp, Homo sapiens
gttgcagtgagctga

SEQ ID NO: 4073226 - DNA, 19 bp, Homo sapiens
gttgccaaagctggtctca

SEQ ID NO: 4073227 - DNA, 19 bp, Homo sapiens
gttgccaaatatgtcctgg

SEQ ID NO: 4073228 - DNA, 21 bp, Homo sapiens
gttgccaaatatgtcctgggg

SEQ ID NO: 4073229 - DNA, 19 bp, Homo sapiens
gttgccacagtagaactgt

SEQ ID NO: 4073230 - DNA, 17 bp, Homo sapiens
gttgccaccacctctgt

SEQ ID NO: 4073231 - DNA, 19 bp, Homo sapiens
gttgccaccacctctgtgg

SEQ ID NO: 4073232 - DNA, 18 bp, Homo sapiens
gttgccaccatgtattca

SEQ ID NO: 4073233 - DNA, 22 bp, Homo sapiens
gttgccaccatgtattcatcca

SEQ ID NO: 4073234 - DNA, 20 bp, Homo sapiens
gttgcccagcctctttccct

SEQ ID NO: 4073235 - DNA, 11 bp, Homo sapiens
gttgccccaga

SEQ ID NO: 4073236 - DNA, 19 bp, Homo sapiens
gttgcccctttctcttttc

SEQ ID NO: 4073237 - DNA, 20 bp, Homo sapiens
gttgccctagcccagactct

SEQ ID NO: 4073238 - DNA, 13 bp, Homo sapiens
gttgccctggcat

SEQ ID NO: 4073239 - DNA, 15 bp, Homo sapiens
gttgcctgaaaaatg

SEQ ID NO: 4073240 - DNA, 12 bp, Homo sapiens
gttgccttttat

SEQ ID NO: 4073241 - DNA, 15 bp, Homo sapiens
gttgcgacggagaga

SEQ ID NO: 4073242 - DNA, 20 bp, Homo sapiens
gttgctcaaatctattcaga

SEQ ID NO: 4073243 - DNA, 22 bp, Homo sapiens
gttggaagctaccagagctcta

SEQ ID NO: 4073244 - DNA, 13 bp, Homo sapiens
gtttctcattctt

SEQ ID NO: 4073245 - DNA, 15 bp, Homo sapiens
gtttctcccgtgctt

SEQ ID NO: 4073246 - DNA, 14 bp, Homo sapiens
gtttctccttttcc

SEQ ID NO: 4073247 - DNA, 13 bp, Homo sapiens
gtttctctgcaga

SEQ ID NO: 4073248 - DNA, 23 bp, Homo sapiens
gtttctctgccgctacctccctc

SEQ ID NO: 4073249 - DNA, 13 bp, Homo sapiens
gtttctcttctcc

SEQ ID NO: 4073250 - DNA, 21 bp, Homo sapiens
gtttctcttctccccttccat

SEQ ID NO: 4073251 - DNA, 19 bp, Homo sapiens
gtttctgacccactgatct

SEQ ID NO: 4073252 - DNA, 19 bp, Homo sapiens
gtttctgcagcccttgggc

SEQ ID NO: 4073253 - DNA, 13 bp, Homo sapiens
gtttctgtctgta

SEQ ID NO: 4073254 - DNA, 12 bp, Homo sapiens
gtttctgttcca

SEQ ID NO: 4073255 - DNA, 15 bp, Homo sapiens
gtttctgttccaaat

SEQ ID NO: 4073256 - DNA, 16 bp, Homo sapiens
gtttcttagcttttta

SEQ ID NO: 4073257 - DNA, 11 bp, Homo sapiens
gtttcttccaa

SEQ ID NO: 4073258 - DNA, 14 bp, Homo sapiens
gtttctttacttct

SEQ ID NO: 4073259 - DNA, 18 bp, Homo sapiens
gtttctttctagtggtct

SEQ ID NO: 4073260 - DNA, 18 bp, Homo sapiens
gtttgaaaacttcagaag

SEQ ID NO: 4073261 - DNA, 14 bp, Homo sapiens
gtttgaaatctttt

SEQ ID NO: 4073262 - DNA, 22 bp, Homo sapiens
gtttgaacctttttttttgaaa

SEQ ID NO: 4073263 - DNA, 15 bp, Homo sapiens
gtttgaagcctgtgc

SEQ ID NO: 4073264 - DNA, 17 bp, Homo sapiens
gtttgaaggaggtgagg

SEQ ID NO: 4073265 - DNA, 13 bp, Homo sapiens
gtttgaatatgga

SEQ ID NO: 4073266 - DNA, 16 bp, Homo sapiens
gtttgcaaataggcag

SEQ ID NO: 4073267 - DNA, 15 bp, Homo sapiens
gtttgcacacttgtg

SEQ ID NO: 4073268 - DNA, 15 bp, Homo sapiens
gtttgcaggggtgac

SEQ ID NO: 4073269 - DNA, 18 bp, Homo sapiens
gtttgccttcctttctcc

SEQ ID NO: 4073270 - DNA, 14 bp, Homo sapiens
gtttgctccccttc

SEQ ID NO: 4073271 - DNA, 22 bp, Homo sapiens
gtttgctccccttccccttcct

SEQ ID NO: 4073272 - DNA, 23 bp, Homo sapiens
gtttgctccccttccccttcctt

SEQ ID NO: 4073273 - DNA, 17 bp, Homo sapiens
gtttgcttaaacaaagt

SEQ ID NO: 4073274 - DNA, 13 bp, Homo sapiens
gtttgcttattgt

SEQ ID NO: 4073275 - DNA, 14 bp, Homo sapiens
gtttgcttattgtt

SEQ ID NO: 4073276 - DNA, 15 bp, Homo sapiens
gtttgcttattgttc

SEQ ID NO: 4073277 - DNA, 17 bp, Homo sapiens
gtttgcttattgttcca

SEQ ID NO: 4073278 - DNA, 20 bp, Homo sapiens
gtttggatgggagtgagaca

SEQ ID NO: 4073279 - DNA, 15 bp, Homo sapiens
gtttggggagcagag

SEQ ID NO: 4073280 - DNA, 17 bp, Homo sapiens
gtttgggtgattcctaa

SEQ ID NO: 4073281 - DNA, 13 bp, Homo sapiens
gtttggtttacat

SEQ ID NO: 4073282 - DNA, 14 bp, Homo sapiens
gtttggtttacatt

SEQ ID NO: 4073283 - DNA, 15 bp, Homo sapiens
gtttgtaaattattt

SEQ ID NO: 4073284 - DNA, 13 bp, Homo sapiens
gtttgtatattgt

SEQ ID NO: 4073285 - DNA, 22 bp, Homo sapiens
gtttgtcctgatgcttttgtct

SEQ ID NO: 4073286 - DNA, 19 bp, Homo sapiens
gtttgtctattttaaaata

SEQ ID NO: 4073287 - DNA, 11 bp, Homo sapiens
gtttgtctgtt

SEQ ID NO: 4073288 - DNA, 12 bp, Homo sapiens
gtttgtggcctc

SEQ ID NO: 4073289 - DNA, 15 bp, Homo sapiens
gtttgtggcctcaga

SEQ ID NO: 4073290 - DNA, 16 bp, Homo sapiens
gtttgttaaaaataaa

SEQ ID NO: 4073291 - DNA, 19 bp, Homo sapiens
gtttgttaaaaataaatcc

SEQ ID NO: 4073292 - DNA, 12 bp, Homo sapiens
gtttgtttcttt

SEQ ID NO: 4073293 - DNA, 14 bp, Homo sapiens
gtttgtttctttgt

SEQ ID NO: 4073294 - DNA, 14 bp, Homo sapiens
gtttgtttgtctgt

SEQ ID NO: 4073295 - DNA, 14 bp, Homo sapiens
gtttgtttttgctt

SEQ ID NO: 4073296 - DNA, 12 bp, Homo sapiens
gtttgttttttt

SEQ ID NO: 4073297 - DNA, 15 bp, Homo sapiens
gtttgtttttttgcc

SEQ ID NO: 4073298 - DNA, 16 bp, Homo sapiens
gttttaaaaagccagt

SEQ ID NO: 4073299 - DNA, 12 bp, Homo sapiens
gttttaaattct

SEQ ID NO: 4073300 - DNA, 13 bp, Homo sapiens
gttttaaattctg

SEQ ID NO: 4073301 - DNA, 19 bp, Homo sapiens
gttttaactagaatttatt

SEQ ID NO: 4073302 - DNA, 16 bp, Homo sapiens
gttttaataaacagta

SEQ ID NO: 4073303 - DNA, 19 bp, Homo sapiens
gttttaatctgaaattcta

SEQ ID NO: 4073304 - DNA, 20 bp, Homo sapiens
gttttaatctgaaattctaa

SEQ ID NO: 4073305 - DNA, 14 bp, Homo sapiens
gttttaatttaaac

SEQ ID NO: 4073306 - DNA, 21 bp, Homo sapiens
gttttaatttaaacacctcct

SEQ ID NO: 4073307 - DNA, 14 bp, Homo sapiens
gttttactgtgaaa

SEQ ID NO: 4073308 - DNA, 14 bp, Homo sapiens
gttttagttgcaga

SEQ ID NO: 4073309 - DNA, 21 bp, Homo sapiens
gttttagttgcagaaacattt

SEQ ID NO: 4073310 - DNA, 18 bp, Homo sapiens
gttttatactgtacttaa

SEQ ID NO: 4073311 - DNA, 20 bp, Homo sapiens
gttttatggttacttcttct

SEQ ID NO: 4073312 - DNA, 21 bp, Homo sapiens
gttttattatttctattaaat

SEQ ID NO: 4073313 - DNA, 15 bp, Homo sapiens
gttttatttgtcagt

SEQ ID NO: 4073314 - DNA, 19 bp, Homo sapiens
gttttattttcaaatctgg

SEQ ID NO: 4073315 - DNA, 23 bp, Homo sapiens
gttttcaaattggactttcaaaa

SEQ ID NO: 4073316 - DNA, 17 bp, Homo sapiens
gttttcaagtcaaatta

SEQ ID NO: 4073317 - DNA, 19 bp, Homo sapiens
gttttcagaaaaagaaatg

SEQ ID NO: 4073318 - DNA, 19 bp, Homo sapiens
gttttcagaacctcttccc

SEQ ID NO: 4073319 - DNA, 21 bp, Homo sapiens
gttttcagaacctcttcccca

SEQ ID NO: 4073320 - DNA, 16 bp, Homo sapiens
gttttcagtgtacatg

SEQ ID NO: 4073321 - DNA, 18 bp, Homo sapiens
gttttccatgaaaacgtt

SEQ ID NO: 4073322 - DNA, 23 bp, Homo sapiens
gttttcccccagcaacgcccctc

SEQ ID NO: 4073323 - DNA, 21 bp, Homo sapiens
gttttccctgacctccctcta

SEQ ID NO: 4073324 - DNA, 17 bp, Homo sapiens
gttttcctaaatgcagt

SEQ ID NO: 4073325 - DNA, 16 bp, Homo sapiens
gttttctgagggaaag

SEQ ID NO: 4073326 - DNA, 18 bp, Homo sapiens
gttttctgggggaaaaag

SEQ ID NO: 4073327 - DNA, 19 bp, Homo sapiens
gttttctgggggaaaaagc

SEQ ID NO: 4073328 - DNA, 15 bp, Homo sapiens
gttttctttctttaa

SEQ ID NO: 4073329 - DNA, 15 bp, Homo sapiens
gttttgaaaagctat

SEQ ID NO: 4073330 - DNA, 17 bp, Homo sapiens
gttttgaactaataaaa

SEQ ID NO: 4073331 - DNA, 21 bp, Homo sapiens
gttttgatgtttgtggcctca

SEQ ID NO: 4073332 - DNA, 22 bp, Homo sapiens
gttttgatgtttgtggcctcag

SEQ ID NO: 4073333 - DNA, 23 bp, Homo sapiens
gttttgatgtttgtggcctcaga

SEQ ID NO: 4073334 - DNA, 13 bp, Homo sapiens
gttttgcaaaggg

SEQ ID NO: 4073335 - DNA, 16 bp, Homo sapiens
gttttgcaataacttc

SEQ ID NO: 4073336 - DNA, 13 bp, Homo sapiens
gttttgcactctt

SEQ ID NO: 4073337 - DNA, 18 bp, Homo sapiens
gttttggacagtttacca

SEQ ID NO: 4073338 - DNA, 15 bp, Homo sapiens
gttttggttccacaa

SEQ ID NO: 4073339 - DNA, 13 bp, Homo sapiens
gttttgtaaaaga

SEQ ID NO: 4073340 - DNA, 14 bp, Homo sapiens
gttttgtaaaagaa

SEQ ID NO: 4073341 - DNA, 19 bp, Homo sapiens
gttttgtatcttaaatttg

SEQ ID NO: 4073342 - DNA, 17 bp, Homo sapiens
gttttgtcaaactgtag

SEQ ID NO: 4073343 - DNA, 24 bp, Homo sapiens
gttttgtcaaactgtagaaatgat

SEQ ID NO: 4073344 - DNA, 19 bp, Homo sapiens
gttttgtcttgaaagtggc

SEQ ID NO: 4073345 - DNA, 12 bp, Homo sapiens
gttttgttgagc

SEQ ID NO: 4073346 - DNA, 20 bp, Homo sapiens
gttttgtttggcaaggaaag

SEQ ID NO: 4073347 - DNA, 15 bp, Homo sapiens
gtttttaaaatattt

SEQ ID NO: 4073348 - DNA, 18 bp, Homo sapiens
taaactaaataatgaata

SEQ ID NO: 4073349 - DNA, 22 bp, Homo sapiens
taaactactgttaggaacagca

SEQ ID NO: 4073350 - DNA, 16 bp, Homo sapiens
taaactagagaaggga

SEQ ID NO: 4073351 - DNA, 19 bp, Homo sapiens
taaactcagggacagagcc

SEQ ID NO: 4073352 - DNA, 22 bp, Homo sapiens
taaactgaaaactcccatttac

SEQ ID NO: 4073353 - DNA, 15 bp, Homo sapiens
taaactgaatataaa

SEQ ID NO: 4073354 - DNA, 16 bp, Homo sapiens
taaactgaatataaag

SEQ ID NO: 4073355 - DNA, 20 bp, Homo sapiens
taaactgaatataaagctta

SEQ ID NO: 4073356 - DNA, 17 bp, Homo sapiens
taaactgaatattttgg

SEQ ID NO: 4073357 - DNA, 20 bp, Homo sapiens
taaactgaatattttggaaa

SEQ ID NO: 4073358 - DNA, 22 bp, Homo sapiens
taaactgaatattttggaaact

SEQ ID NO: 4073359 - DNA, 14 bp, Homo sapiens
taaactgactatca

SEQ ID NO: 4073360 - DNA, 18 bp, Homo sapiens
taaactgactatcataaa

SEQ ID NO: 4073361 - DNA, 15 bp, Homo sapiens
taaactgactttatc

SEQ ID NO: 4073362 - DNA, 16 bp, Homo sapiens
taaactgcaggagcag

SEQ ID NO: 4073363 - DNA, 19 bp, Homo sapiens
taaactgcaggagcagttt

SEQ ID NO: 4073364 - DNA, 23 bp, Homo sapiens
taaactgcaggagcagtttgcca

SEQ ID NO: 4073365 - DNA, 13 bp, Homo sapiens
taaactgtgttta

SEQ ID NO: 4073366 - DNA, 20 bp, Homo sapiens
taaacttaactttaactgaa

SEQ ID NO: 4073367 - DNA, 15 bp, Homo sapiens
taaacttataaatca

SEQ ID NO: 4073368 - DNA, 18 bp, Homo sapiens
taaactttagagtagcat

SEQ ID NO: 4073369 - DNA, 17 bp, Homo sapiens
taaactttttgttctgg

SEQ ID NO: 4073370 - DNA, 15 bp, Homo sapiens
taaagaaatatttac

SEQ ID NO: 4073371 - DNA, 23 bp, Homo sapiens
taaagaacttaaattatgtttta

SEQ ID NO: 4073372 - DNA, 16 bp, Homo sapiens
taaagaaggataaatt

SEQ ID NO: 4073373 - DNA, 14 bp, Homo sapiens
taaagaataaagtc

SEQ ID NO: 4073374 - DNA, 15 bp, Homo sapiens
taaagaatgccattt

SEQ ID NO: 4073375 - DNA, 20 bp, Homo sapiens
taaagacactggcagagaga

SEQ ID NO: 4073376 - DNA, 19 bp, Homo sapiens
taaagacccagggggagaa

SEQ ID NO: 4073377 - DNA, 21 bp, Homo sapiens
taaagacccagggggagaatg

SEQ ID NO: 4073378 - DNA, 19 bp, Homo sapiens
taaagactggttttctgcc

SEQ ID NO: 4073379 - DNA, 22 bp, Homo sapiens
taaagagacagtgatattggaa

SEQ ID NO: 4073380 - DNA, 12 bp, Homo sapiens
taaagagttctt

SEQ ID NO: 4073381 - DNA, 12 bp, Homo sapiens
taaagataatat

SEQ ID NO: 4073382 - DNA, 19 bp, Homo sapiens
taaagataatattactgtt

SEQ ID NO: 4073383 - DNA, 11 bp, Homo sapiens
taaagatgatc

SEQ ID NO: 4073384 - DNA, 13 bp, Homo sapiens
taaagatgatcta

SEQ ID NO: 4073385 - DNA, 13 bp, Homo sapiens
taaagatttgggt

SEQ ID NO: 4073386 - DNA, 16 bp, Homo sapiens
taaagcaaaaaatgaa

SEQ ID NO: 4073387 - DNA, 19 bp, Homo sapiens
taaagcaaaaaatgaatgt

SEQ ID NO: 4073388 - DNA, 21 bp, Homo sapiens
taaagcaaaaaatgaatgtct

SEQ ID NO: 4073389 - DNA, 15 bp, Homo sapiens
taaagcagacagtca

SEQ ID NO: 4073390 - DNA, 21 bp, Homo sapiens
taaagcataagtatacagttc

SEQ ID NO: 4073391 - DNA, 12 bp, Homo sapiens
taaagcatatag

SEQ ID NO: 4073392 - DNA, 23 bp, Homo sapiens
taaagcattgctgttatgtctgt

SEQ ID NO: 4073393 - DNA, 14 bp, Homo sapiens
taaagcatttccta

SEQ ID NO: 4073394 - DNA, 14 bp, Homo sapiens
taaagccagcctga

SEQ ID NO: 4073395 - DNA, 12 bp, Homo sapiens
taaagcctcctc

SEQ ID NO: 4073396 - DNA, 21 bp, Homo sapiens
taaagcctttagtatcagtgt

SEQ ID NO: 4073397 - DNA, 14 bp, Homo sapiens
taaagctatgttac

SEQ ID NO: 4073398 - DNA, 11 bp, Homo sapiens
taaagctggcc

SEQ ID NO: 4073399 - DNA, 15 bp, Homo sapiens
taaagctggccctgc

SEQ ID NO: 4073400 - DNA, 19 bp, Homo sapiens
taaagctggccctgcctcc

SEQ ID NO: 4073401 - DNA, 20 bp, Homo sapiens
taaagctggccctgcctcct

SEQ ID NO: 4073402 - DNA, 22 bp, Homo sapiens
taaagctggccctgcctcctgg

SEQ ID NO: 4073403 - DNA, 17 bp, Homo sapiens
taaagcttgtggcccct

SEQ ID NO: 4073404 - DNA, 12 bp, Homo sapiens
taaaggactgta

SEQ ID NO: 4073405 - DNA, 21 bp, Homo sapiens
taaaggagcatttttttattc

SEQ ID NO: 4073406 - DNA, 22 bp, Homo sapiens
taaaggagcatttttttattca

SEQ ID NO: 4073407 - DNA, 15 bp, Homo sapiens
taaaggatccagaga

SEQ ID NO: 4073408 - DNA, 16 bp, Homo sapiens
taaaggatccagagag

SEQ ID NO: 4073409 - DNA, 15 bp, Homo sapiens
taaaggggggagggg

SEQ ID NO: 4073410 - DNA, 17 bp, Homo sapiens
taaaggtttttaaattg

SEQ ID NO: 4073411 - DNA, 21 bp, Homo sapiens
taaaggtttttaaattgtttc

SEQ ID NO: 4073412 - DNA, 17 bp, Homo sapiens
taaagtaaagctaaaat

SEQ ID NO: 4073413 - DNA, 17 bp, Homo sapiens
taaagtaattgttccag

SEQ ID NO: 4073414 - DNA, 20 bp, Homo sapiens
taaagtaattgttccagaga

SEQ ID NO: 4073415 - DNA, 16 bp, Homo sapiens
taaagtacagcctgga

SEQ ID NO: 4073416 - DNA, 15 bp, Homo sapiens
taaagtacttgagtg

SEQ ID NO: 4073417 - DNA, 12 bp, Homo sapiens
taaagtattttt

SEQ ID NO: 4073418 - DNA, 12 bp, Homo sapiens
taaagtgacttt

SEQ ID NO: 4073419 - DNA, 18 bp, Homo sapiens
taaagtgtaagttcacaa

SEQ ID NO: 4073420 - DNA, 17 bp, Homo sapiens
taaagtgtgttgttgct

SEQ ID NO: 4073421 - DNA, 20 bp, Homo sapiens
taaagtgttctgccagatct

SEQ ID NO: 4073422 - DNA, 12 bp, Homo sapiens
taaagtgtttca

SEQ ID NO: 4073423 - DNA, 18 bp, Homo sapiens
taaagtgtttcagctaag

SEQ ID NO: 4073424 - DNA, 17 bp, Homo sapiens
taaagttctgagtgttt

SEQ ID NO: 4073425 - DNA, 14 bp, Homo sapiens
taaagttggaattt

SEQ ID NO: 4073426 - DNA, 18 bp, Homo sapiens
taaagttggaatttacca

SEQ ID NO: 4073427 - DNA, 17 bp, Homo sapiens
taaagtttgcttagaaa

SEQ ID NO: 4073428 - DNA, 14 bp, Homo sapiens
taaataaaaatgga

SEQ ID NO: 4073429 - DNA, 17 bp, Homo sapiens
taaataaaagtgatcaa

SEQ ID NO: 4073430 - DNA, 14 bp, Homo sapiens
taaataaaccactg

SEQ ID NO: 4073431 - DNA, 20 bp, Homo sapiens
taaataaactgttgctcgtt

SEQ ID NO: 4073432 - DNA, 22 bp, Homo sapiens
taaataaatgtatcttattcac

SEQ ID NO: 4073433 - DNA, 12 bp, Homo sapiens
taaataatgaat

SEQ ID NO: 4073434 - DNA, 18 bp, Homo sapiens
taaataatgaataaactg

SEQ ID NO: 4073435 - DNA, 17 bp, Homo sapiens
taaataatgcttcagat

SEQ ID NO: 4073436 - DNA, 14 bp, Homo sapiens
taaataatttattt

SEQ ID NO: 4073437 - DNA, 17 bp, Homo sapiens
taaatacaaaacttcca

SEQ ID NO: 4073438 - DNA, 14 bp, Homo sapiens
taaatacaaatctg

SEQ ID NO: 4073439 - DNA, 20 bp, Homo sapiens
taaatacaaatctgtataaa

SEQ ID NO: 4073440 - DNA, 14 bp, Homo sapiens
taaatacaagactg

SEQ ID NO: 4073441 - DNA, 23 bp, Homo sapiens
taaatacaagactgttgtgatct

SEQ ID NO: 4073442 - DNA, 19 bp, Homo sapiens
taaatacacatagcatgta

SEQ ID NO: 4073443 - DNA, 17 bp, Homo sapiens
taaatacagacactaag

SEQ ID NO: 4073444 - DNA, 19 bp, Homo sapiens
taaatacagacactaagtt

SEQ ID NO: 4073445 - DNA, 20 bp, Homo sapiens
taaatactgtgcagaataat

SEQ ID NO: 4073446 - DNA, 14 bp, Homo sapiens
taaatacttcatga

SEQ ID NO: 4073447 - DNA, 15 bp, Homo sapiens
taaatagctatatcc

SEQ ID NO: 4073448 - DNA, 22 bp, Homo sapiens
taaatagctatatccatgtact

SEQ ID NO: 4073449 - DNA, 20 bp, Homo sapiens
taaatatagattagaaaaat

SEQ ID NO: 4073450 - DNA, 17 bp, Homo sapiens
taaatatatgtctgata

SEQ ID NO: 4073451 - DNA, 12 bp, Homo sapiens
taagaaatatgt

SEQ ID NO: 4073452 - DNA, 19 bp, Homo sapiens
taagaagagactgggaaga

SEQ ID NO: 4073453 - DNA, 22 bp, Homo sapiens
taagaagcctataagaggaatt

SEQ ID NO: 4073454 - DNA, 17 bp, Homo sapiens
taagaaggcaaaaatgt

SEQ ID NO: 4073455 - DNA, 18 bp, Homo sapiens
taagaaggcaaaaatgta

SEQ ID NO: 4073456 - DNA, 15 bp, Homo sapiens
taagaaggcaatatt

SEQ ID NO: 4073457 - DNA, 21 bp, Homo sapiens
taagaagttttaaaaagccag

SEQ ID NO: 4073458 - DNA, 19 bp, Homo sapiens
taagaatcagagtagaaat

SEQ ID NO: 4073459 - DNA, 20 bp, Homo sapiens
taagaatcagagtagaaata

SEQ ID NO: 4073460 - DNA, 23 bp, Homo sapiens
taagaatgctggttttcctaaat

SEQ ID NO: 4073461 - DNA, 14 bp, Homo sapiens
taagaattcaaact

SEQ ID NO: 4073462 - DNA, 22 bp, Homo sapiens
taagaattcaaactggggcctc

SEQ ID NO: 4073463 - DNA, 19 bp, Homo sapiens
taagaattgaccatctgct

SEQ ID NO: 4073464 - DNA, 21 bp, Homo sapiens
taagaattgagtaatggtgta

SEQ ID NO: 4073465 - DNA, 13 bp, Homo sapiens
taagaattgtttt

SEQ ID NO: 4073466 - DNA, 21 bp, Homo sapiens
taagaattgtttttgaattta

SEQ ID NO: 4073467 - DNA, 23 bp, Homo sapiens
taagacactgaaaaatctaagtg

SEQ ID NO: 4073468 - DNA, 12 bp, Homo sapiens
taagacataacg

SEQ ID NO: 4073469 - DNA, 20 bp, Homo sapiens
taagacatactccttccatc

SEQ ID NO: 4073470 - DNA, 16 bp, Homo sapiens
taagacatatctctaa

SEQ ID NO: 4073471 - DNA, 19 bp, Homo sapiens
taagacatgatttccttga

SEQ ID NO: 4073472 - DNA, 20 bp, Homo sapiens
taagacatgatttccttgaa

SEQ ID NO: 4073473 - DNA, 20 bp, Homo sapiens
taagacatttgtttgctgta

SEQ ID NO: 4073474 - DNA, 19 bp, Homo sapiens
taagaccataacagccaac

SEQ ID NO: 4073475 - DNA, 13 bp, Homo sapiens
taagacctggcag

SEQ ID NO: 4073476 - DNA, 19 bp, Homo sapiens
taagactgaatgttttatt

SEQ ID NO: 4073477 - DNA, 23 bp, Homo sapiens
taagagaaactttatacattagt

SEQ ID NO: 4073478 - DNA, 21 bp, Homo sapiens
taagagaattatatatttcta

SEQ ID NO: 4073479 - DNA, 20 bp, Homo sapiens
taagagcaccttcctcactt

SEQ ID NO: 4073480 - DNA, 22 bp, Homo sapiens
taagagcaccttcctcacttcc

SEQ ID NO: 4073481 - DNA, 15 bp, Homo sapiens
taagagggcagactg

SEQ ID NO: 4073482 - DNA, 23 bp, Homo sapiens
taagagtgtagaagcattccttc

SEQ ID NO: 4073483 - DNA, 17 bp, Homo sapiens
taagataaatgtgctga

SEQ ID NO: 4073484 - DNA, 23 bp, Homo sapiens
taagatacaagtttcagacaggg

SEQ ID NO: 4073485 - DNA, 15 bp, Homo sapiens
taagatagtgtaact

SEQ ID NO: 4073486 - DNA, 16 bp, Homo sapiens
taagatagtgtaactt

SEQ ID NO: 4073487 - DNA, 16 bp, Homo sapiens
taagatatccatcttt

SEQ ID NO: 4073488 - DNA, 20 bp, Homo sapiens
taagatatccatctttttct

SEQ ID NO: 4073489 - DNA, 17 bp, Homo sapiens
taagatctatgggaaga

SEQ ID NO: 4073490 - DNA, 18 bp, Homo sapiens
taagatggattctcagat

SEQ ID NO: 4073491 - DNA, 20 bp, Homo sapiens
taagatggattctcagatat

SEQ ID NO: 4073492 - DNA, 23 bp, Homo sapiens
taagcaaaaacaaaaagaaaaga

SEQ ID NO: 4073493 - DNA, 12 bp, Homo sapiens
taagcaaatgca

SEQ ID NO: 4073494 - DNA, 15 bp, Homo sapiens
taagcaaatgcattc

SEQ ID NO: 4073495 - DNA, 14 bp, Homo sapiens
taagcaacatcttt

SEQ ID NO: 4073496 - DNA, 13 bp, Homo sapiens
taagcaagagaga

SEQ ID NO: 4073497 - DNA, 17 bp, Homo sapiens
taagcactacataaact

SEQ ID NO: 4073498 - DNA, 13 bp, Homo sapiens
taagcactcttaa

SEQ ID NO: 4073499 - DNA, 17 bp, Homo sapiens
taagcactcttaaagca

SEQ ID NO: 4073500 - DNA, 17 bp, Homo sapiens
taagcagcatggaaaaa

SEQ ID NO: 4073501 - DNA, 17 bp, Homo sapiens
taagcagctaaattttc

SEQ ID NO: 4073502 - DNA, 22 bp, Homo sapiens
taagcagctaaattttctgaaa

SEQ ID NO: 4073503 - DNA, 21 bp, Homo sapiens
taagcataagcttatgcttaa

SEQ ID NO: 4073504 - DNA, 13 bp, Homo sapiens
taagcatattttc

SEQ ID NO: 4073505 - DNA, 18 bp, Homo sapiens
taagcattaccactcagg

SEQ ID NO: 4073506 - DNA, 19 bp, Homo sapiens
taagcattaccactcaggc

SEQ ID NO: 4073507 - DNA, 20 bp, Homo sapiens
taagcattgaaattatagtt

SEQ ID NO: 4073508 - DNA, 13 bp, Homo sapiens
taagccaggcctg

SEQ ID NO: 4073509 - DNA, 17 bp, Homo sapiens
taagccaggcctggctg

SEQ ID NO: 4073510 - DNA, 19 bp, Homo sapiens
taagccatagaccctgagg

SEQ ID NO: 4073511 - DNA, 14 bp, Homo sapiens
taagcccccagggc

SEQ ID NO: 4073512 - DNA, 16 bp, Homo sapiens
taagcccccagggcct

SEQ ID NO: 4073513 - DNA, 17 bp, Homo sapiens
taagcccccagggcctc

SEQ ID NO: 4073514 - DNA, 20 bp, Homo sapiens
taagcctcatatttaaagac

SEQ ID NO: 4073515 - DNA, 20 bp, Homo sapiens
taagcctccatttagttctt

SEQ ID NO: 4073516 - DNA, 21 bp, Homo sapiens
taagcctccatttagttcttt

SEQ ID NO: 4073517 - DNA, 22 bp, Homo sapiens
taagcgaagtctttgccttctc

SEQ ID NO: 4073518 - DNA, 23 bp, Homo sapiens
taagcgaagtctttgccttctct

SEQ ID NO: 4073519 - DNA, 20 bp, Homo sapiens
taagcggctcaagcccagga

SEQ ID NO: 4073520 - DNA, 16 bp, Homo sapiens
taagctaacccccttc

SEQ ID NO: 4073521 - DNA, 22 bp, Homo sapiens
taagctaacccccttctactga

SEQ ID NO: 4073522 - DNA, 18 bp, Homo sapiens
taagctgatcctgcggag

SEQ ID NO: 4073523 - DNA, 10 bp, Homo sapiens
taagctgcaa

SEQ ID NO: 4073524 - DNA, 23 bp, Homo sapiens
taagctgcaaatctgatggcctt

SEQ ID NO: 4073525 - DNA, 17 bp, Homo sapiens
taagctggctctgtttg

SEQ ID NO: 4073526 - DNA, 18 bp, Homo sapiens
taagctggctctgtttga

SEQ ID NO: 4073527 - DNA, 21 bp, Homo sapiens
taagctgtgccttcagctgtt

SEQ ID NO: 4073528 - DNA, 16 bp, Homo sapiens
taagcttatgtcagac

SEQ ID NO: 4073529 - DNA, 19 bp, Homo sapiens
taagctttgccagctgctg

SEQ ID NO: 4073530 - DNA, 22 bp, Homo sapiens
taagctttgccagctgctgctg

SEQ ID NO: 4073531 - DNA, 19 bp, Homo sapiens
taaggaatgtagctggttt

SEQ ID NO: 4073532 - DNA, 21 bp, Homo sapiens
taaggaatttgatgattttca

SEQ ID NO: 4073533 - DNA, 16 bp, Homo sapiens
taaggagatgggcctt

SEQ ID NO: 4073534 - DNA, 19 bp, Homo sapiens
taaggatcagaacagcaga

SEQ ID NO: 4073535 - DNA, 16 bp, Homo sapiens
taaggatctctcagga

SEQ ID NO: 4073536 - DNA, 19 bp, Homo sapiens
taaggatggagccagctct

SEQ ID NO: 4073537 - DNA, 15 bp, Homo sapiens
taaggattgtgatat

SEQ ID NO: 4073538 - DNA, 16 bp, Homo sapiens
taaggccgtgtctctg

SEQ ID NO: 4073539 - DNA, 13 bp, Homo sapiens
taaggctcctcct

SEQ ID NO: 4073540 - DNA, 16 bp, Homo sapiens
taagggaagacatttc

SEQ ID NO: 4073541 - DNA, 12 bp, Homo sapiens
taagggagagct

SEQ ID NO: 4073542 - DNA, 18 bp, Homo sapiens
taagggagagctgagcca

SEQ ID NO: 4073543 - DNA, 21 bp, Homo sapiens
taagggagagctgagccagtt

SEQ ID NO: 4073544 - DNA, 15 bp, Homo sapiens
taagggcatgccttg

SEQ ID NO: 4073545 - DNA, 18 bp, Homo sapiens
taagggcatgccttgtgc

SEQ ID NO: 4073546 - DNA, 15 bp, Homo sapiens
taagggttaagaaaa

SEQ ID NO: 4073547 - DNA, 18 bp, Homo sapiens
taaggtatttcgaaactg

SEQ ID NO: 4073548 - DNA, 20 bp, Homo sapiens
taaggtccaacaagaatgca

SEQ ID NO: 4073549 - DNA, 16 bp, Homo sapiens
taaggttctcatagga

SEQ ID NO: 4073550 - DNA, 20 bp, Homo sapiens
taaggttgaactttgccaaa

SEQ ID NO: 4073551 - DNA, 18 bp, Homo sapiens
taagtaaatctcttctgt

SEQ ID NO: 4073552 - DNA, 21 bp, Homo sapiens
taagtaattatcgggaacagt

SEQ ID NO: 4073553 - DNA, 23 bp, Homo sapiens
taagtaattatcgggaacagtgt

SEQ ID NO: 4073554 - DNA, 21 bp, Homo sapiens
taagtactagatgcatcactg

SEQ ID NO: 4073555 - DNA, 13 bp, Homo sapiens
taagtactatgta

SEQ ID NO: 4073556 - DNA, 16 bp, Homo sapiens
taagtactatgtatca

SEQ ID NO: 4073557 - DNA, 19 bp, Homo sapiens
taagtactatgtatcaatg

SEQ ID NO: 4073558 - DNA, 13 bp, Homo sapiens
taagtatacagtt

SEQ ID NO: 4073559 - DNA, 15 bp, Homo sapiens
taagtatatcatgta

SEQ ID NO: 4073560 - DNA, 17 bp, Homo sapiens
taagtatatcatgtaaa

SEQ ID NO: 4073561 - DNA, 22 bp, Homo sapiens
taagtatatcatgtaaagaaat

SEQ ID NO: 4073562 - DNA, 20 bp, Homo sapiens
taagtatgtgtaaaatgtga

SEQ ID NO: 4073563 - DNA, 14 bp, Homo sapiens
taagtatttataat

SEQ ID NO: 4073564 - DNA, 15 bp, Homo sapiens
taagtatttatatat

SEQ ID NO: 4073565 - DNA, 19 bp, Homo sapiens
taagtatttatatatttat

SEQ ID NO: 4073566 - DNA, 12 bp, Homo sapiens
taagtcagtgtt

SEQ ID NO: 4073567 - DNA, 14 bp, Homo sapiens
taagtcagtgttga

SEQ ID NO: 4073568 - DNA, 20 bp, Homo sapiens
taagtcatctacttaataaa

SEQ ID NO: 4073569 - DNA, 12 bp, Homo sapiens
taagtccagtgt

SEQ ID NO: 4073570 - DNA, 21 bp, Homo sapiens
taagtctcctgtcttatggtc

SEQ ID NO: 4073571 - DNA, 15 bp, Homo sapiens
taagtgaaaatctta

SEQ ID NO: 4073572 - DNA, 14 bp, Homo sapiens
taagtgaatttata

SEQ ID NO: 4073573 - DNA, 15 bp, Homo sapiens
taagtgacatttgta

SEQ ID NO: 4073574 - DNA, 18 bp, Homo sapiens
taagtgcgtgtgtagagt

SEQ ID NO: 4073575 - DNA, 23 bp, Homo sapiens
taagtgcgtgtgtagagttaaga

SEQ ID NO: 4073576 - DNA, 15 bp, Homo sapiens
taagtgctttgtaat

SEQ ID NO: 4073577 - DNA, 19 bp, Homo sapiens
taagtggaggcactttagg

SEQ ID NO: 4073578 - DNA, 16 bp, Homo sapiens
taagtggctgccttct

SEQ ID NO: 4073579 - DNA, 20 bp, Homo sapiens
taagtgtatttttcaataaa

SEQ ID NO: 4073580 - DNA, 16 bp, Homo sapiens
taagtgtcaagtcctg

SEQ ID NO: 4073581 - DNA, 17 bp, Homo sapiens
taagtgtcaagtcctga

SEQ ID NO: 4073582 - DNA, 21 bp, Homo sapiens
taagtgtgagtaagagctggt

SEQ ID NO: 4073583 - DNA, 16 bp, Homo sapiens
taagtgtgtcttccta

SEQ ID NO: 4073584 - DNA, 24 bp, Homo sapiens
taagtgtgtcttcctagaattcga

SEQ ID NO: 4073585 - DNA, 19 bp, Homo sapiens
taagttaataatgtattgt

SEQ ID NO: 4073586 - DNA, 18 bp, Homo sapiens
taagttatagtgaatact

SEQ ID NO: 4073587 - DNA, 17 bp, Homo sapiens
taagttatttcttgttt

SEQ ID NO: 4073588 - DNA, 17 bp, Homo sapiens
taagttatttttgtaca

SEQ ID NO: 4073589 - DNA, 19 bp, Homo sapiens
taagttatttttgtacatg

SEQ ID NO: 4073590 - DNA, 13 bp, Homo sapiens
taagttcacatta

SEQ ID NO: 4073591 - DNA, 17 bp, Homo sapiens
taagttcacattagaat

SEQ ID NO: 4073592 - DNA, 20 bp, Homo sapiens
taagttctatgaagagtatt

SEQ ID NO: 4073593 - DNA, 13 bp, Homo sapiens
taagttgcattta

SEQ ID NO: 4073594 - DNA, 19 bp, Homo sapiens
taagttgcatttagaaatc

SEQ ID NO: 4073595 - DNA, 20 bp, Homo sapiens
taagttgtacaaatgtattt

SEQ ID NO: 4073596 - DNA, 22 bp, Homo sapiens
taagtttaaaaaacagaaaaac

SEQ ID NO: 4073597 - DNA, 16 bp, Homo sapiens
taataaaaaaagaaag

SEQ ID NO: 4073598 - DNA, 20 bp, Homo sapiens
taataaaaaatggaaagaat

SEQ ID NO: 4073599 - DNA, 18 bp, Homo sapiens
taataaaataattctaaa

SEQ ID NO: 4073600 - DNA, 17 bp, Homo sapiens
taataaagaaatattta

SEQ ID NO: 4073601 - DNA, 16 bp, Homo sapiens
taataaagcaatctga

SEQ ID NO: 4073602 - DNA, 17 bp, Homo sapiens
taataaagcaatctgat

SEQ ID NO: 4073603 - DNA, 15 bp, Homo sapiens
taataaagctactga

SEQ ID NO: 4073604 - DNA, 13 bp, Homo sapiens
taataaaggactg

SEQ ID NO: 4073605 - DNA, 19 bp, Homo sapiens
taataaaggtcttaaataa

SEQ ID NO: 4073606 - DNA, 15 bp, Homo sapiens
taataaatcacacat

SEQ ID NO: 4073607 - DNA, 19 bp, Homo sapiens
taataaatgtacattaatt

SEQ ID NO: 4073608 - DNA, 19 bp, Homo sapiens
taataaattgaaattgtga

SEQ ID NO: 4073609 - DNA, 21 bp, Homo sapiens
taataacattaccttactgtg

SEQ ID NO: 4073610 - DNA, 20 bp, Homo sapiens
taataactcggattccagcc

SEQ ID NO: 4073611 - DNA, 19 bp, Homo sapiens
taataagacataacgtttt

SEQ ID NO: 4073612 - DNA, 14 bp, Homo sapiens
taataatagttatt

SEQ ID NO: 4073613 - DNA, 13 bp, Homo sapiens
taataatgtattg

SEQ ID NO: 4073614 - DNA, 20 bp, Homo sapiens
taataatgtattgtaatctt

SEQ ID NO: 4073615 - DNA, 15 bp, Homo sapiens
taataatgtttaata

SEQ ID NO: 4073616 - DNA, 20 bp, Homo sapiens
taatacaaaagggtcttgac

SEQ ID NO: 4073617 - DNA, 18 bp, Homo sapiens
taatactcaaatgagtaa

SEQ ID NO: 4073618 - DNA, 17 bp, Homo sapiens
taatactggaataattt

SEQ ID NO: 4073619 - DNA, 14 bp, Homo sapiens
taatactttctatg

SEQ ID NO: 4073620 - DNA, 20 bp, Homo sapiens
taatagcaacttttgtgtaa

SEQ ID NO: 4073621 - DNA, 15 bp, Homo sapiens
taatagcagcctttc

SEQ ID NO: 4073622 - DNA, 21 bp, Homo sapiens
taatagcagcctttctctctt

SEQ ID NO: 4073623 - DNA, 15 bp, Homo sapiens
taatagtagttagct

SEQ ID NO: 4073624 - DNA, 21 bp, Homo sapiens
taatataccagcttgtatgca

SEQ ID NO: 4073625 - DNA, 16 bp, Homo sapiens
taatatagtagatttt

SEQ ID NO: 4073626 - DNA, 22 bp, Homo sapiens
taatatatagtccagacactta

SEQ ID NO: 4073627 - DNA, 18 bp, Homo sapiens
taatatggaaccttccct

SEQ ID NO: 4073628 - DNA, 18 bp, Homo sapiens
taatatgggcattgtagt

SEQ ID NO: 4073629 - DNA, 11 bp, Homo sapiens
taatattatta

SEQ ID NO: 4073630 - DNA, 19 bp, Homo sapiens
taatattcttttgtttcca

SEQ ID NO: 4073631 - DNA, 18 bp, Homo sapiens
taatattgtattgctgct

SEQ ID NO: 4073632 - DNA, 13 bp, Homo sapiens
taatatttaaaca

SEQ ID NO: 4073633 - DNA, 13 bp, Homo sapiens
taatatttaacat

SEQ ID NO: 4073634 - DNA, 21 bp, Homo sapiens
taatatttaacattatttata

SEQ ID NO: 4073635 - DNA, 22 bp, Homo sapiens
taatatttagctgtaaactgaa

SEQ ID NO: 4073636 - DNA, 23 bp, Homo sapiens
taatatttagctgtaaactgaat

SEQ ID NO: 4073637 - DNA, 19 bp, Homo sapiens
taatcaaaattgtctcttc

SEQ ID NO: 4073638 - DNA, 13 bp, Homo sapiens
taatcaagatttt

SEQ ID NO: 4073639 - DNA, 18 bp, Homo sapiens
taatcaatgaatttgttc

SEQ ID NO: 4073640 - DNA, 20 bp, Homo sapiens
taatcaatgaatttgttctt

SEQ ID NO: 4073641 - DNA, 15 bp, Homo sapiens
taatcagaaattttt

SEQ ID NO: 4073642 - DNA, 18 bp, Homo sapiens
taatcagaaatttttatc

SEQ ID NO: 4073643 - DNA, 20 bp, Homo sapiens
taatcagcaagaatttgatc

SEQ ID NO: 4073644 - DNA, 20 bp, Homo sapiens
taatcatatgtgtctttata

SEQ ID NO: 4073645 - DNA, 16 bp, Homo sapiens
taatcatctataaaga

SEQ ID NO: 4073646 - DNA, 13 bp, Homo sapiens
taatcatgtgaaa

SEQ ID NO: 4073647 - DNA, 17 bp, Homo sapiens
taatcattagttttaga

SEQ ID NO: 4073648 - DNA, 22 bp, Homo sapiens
taatccaggcagatccaggact

SEQ ID NO: 4073649 - DNA, 19 bp, Homo sapiens
taatccctgggcattgctt

SEQ ID NO: 4073650 - DNA, 20 bp, Homo sapiens
taatccctgggcattgcttt

SEQ ID NO: 4073651 - DNA, 22 bp, Homo sapiens
taatccctgggcattgctttcc

SEQ ID NO: 4073652 - DNA, 19 bp, Homo sapiens
taatcctattaaaacacag

SEQ ID NO: 4073653 - DNA, 14 bp, Homo sapiens
taatcctgtaccaa

SEQ ID NO: 4073654 - DNA, 14 bp, Homo sapiens
taatcctttggaaa

SEQ ID NO: 4073655 - DNA, 15 bp, Homo sapiens
tacacaataagcaaa

SEQ ID NO: 4073656 - DNA, 18 bp, Homo sapiens
tacacacacccaggccca

SEQ ID NO: 4073657 - DNA, 12 bp, Homo sapiens
tacacactcagg

SEQ ID NO: 4073658 - DNA, 15 bp, Homo sapiens
tacacactcaggcct

SEQ ID NO: 4073659 - DNA, 19 bp, Homo sapiens
tacacactcaggcctgtgc

SEQ ID NO: 4073660 - DNA, 15 bp, Homo sapiens
tacacagaaatgctg

SEQ ID NO: 4073661 - DNA, 17 bp, Homo sapiens
tacacagaaatgctgct

SEQ ID NO: 4073662 - DNA, 18 bp, Homo sapiens
tacacagaaatgctgctg

SEQ ID NO: 4073663 - DNA, 20 bp, Homo sapiens
tacacagaaatgctgctggc

SEQ ID NO: 4073664 - DNA, 23 bp, Homo sapiens
tacacagaaatgctgctggccaa

SEQ ID NO: 4073665 - DNA, 20 bp, Homo sapiens
tacacagaggagtgcagcct

SEQ ID NO: 4073666 - DNA, 13 bp, Homo sapiens
tacacagcctgga

SEQ ID NO: 4073667 - DNA, 15 bp, Homo sapiens
tacacattagatttt

SEQ ID NO: 4073668 - DNA, 16 bp, Homo sapiens
tacacatttgtacaga

SEQ ID NO: 4073669 - DNA, 18 bp, Homo sapiens
tacacatttgtacagaat

SEQ ID NO: 4073670 - DNA, 16 bp, Homo sapiens
tacacatttttaaatt

SEQ ID NO: 4073671 - DNA, 16 bp, Homo sapiens
tacaccatatactgtt

SEQ ID NO: 4073672 - DNA, 17 bp, Homo sapiens
tacaccgggcctggaga

SEQ ID NO: 4073673 - DNA, 15 bp, Homo sapiens
tacacctaaaggtgt

SEQ ID NO: 4073674 - DNA, 14 bp, Homo sapiens
tacaccttgccttg

SEQ ID NO: 4073675 - DNA, 15 bp, Homo sapiens
tacactaaaaggtga

SEQ ID NO: 4073676 - DNA, 20 bp, Homo sapiens
tacactaagggtgtaagtaa

SEQ ID NO: 4073677 - DNA, 23 bp, Homo sapiens
tacactctgctgtttgacacctc

SEQ ID NO: 4073678 - DNA, 20 bp, Homo sapiens
tacactgaagttaacagaga

SEQ ID NO: 4073679 - DNA, 21 bp, Homo sapiens
tacactgctgtacccagatgc

SEQ ID NO: 4073680 - DNA, 16 bp, Homo sapiens
tacacttacactttat

SEQ ID NO: 4073681 - DNA, 15 bp, Homo sapiens
tacactttgttgcaa

SEQ ID NO: 4073682 - DNA, 22 bp, Homo sapiens
tacactttgttgcaagatgtga

SEQ ID NO: 4073683 - DNA, 22 bp, Homo sapiens
tacagaaatactataacatatg

SEQ ID NO: 4073684 - DNA, 11 bp, Homo sapiens
tacagaactac

SEQ ID NO: 4073685 - DNA, 18 bp, Homo sapiens
tacagaatatttctattg

SEQ ID NO: 4073686 - DNA, 11 bp, Homo sapiens
tacagacacta

SEQ ID NO: 4073687 - DNA, 14 bp, Homo sapiens
tacagacactaagt

SEQ ID NO: 4073688 - DNA, 18 bp, Homo sapiens
tacagacactaagttata

SEQ ID NO: 4073689 - DNA, 15 bp, Homo sapiens
tacagactccatctc

SEQ ID NO: 4073690 - DNA, 19 bp, Homo sapiens
tacagactccatctcttct

SEQ ID NO: 4073691 - DNA, 15 bp, Homo sapiens
tacagacttctccag

SEQ ID NO: 4073692 - DNA, 16 bp, Homo sapiens
tacagagatgtctctt

SEQ ID NO: 4073693 - DNA, 22 bp, Homo sapiens
tacagagcagctccccaggagc

SEQ ID NO: 4073694 - DNA, 15 bp, Homo sapiens
tacagaggaaatctg

SEQ ID NO: 4073695 - DNA, 17 bp, Homo sapiens
tacagaggaaatctgta

SEQ ID NO: 4073696 - DNA, 13 bp, Homo sapiens
tacagataacatt

SEQ ID NO: 4073697 - DNA, 19 bp, Homo sapiens
tacagatcctttttccatc

SEQ ID NO: 4073698 - DNA, 16 bp, Homo sapiens
tacagatctcagggct

SEQ ID NO: 4073699 - DNA, 12 bp, Homo sapiens
tacagatgaaaa

SEQ ID NO: 4073700 - DNA, 22 bp, Homo sapiens
tacagatgaatgtatttatttg

SEQ ID NO: 4073701 - DNA, 14 bp, Homo sapiens
tacagatgcctttt

SEQ ID NO: 4073702 - DNA, 18 bp, Homo sapiens
tacagcactactgggtgt

SEQ ID NO: 4073703 - DNA, 20 bp, Homo sapiens
tacagccacatccccaagcc

SEQ ID NO: 4073704 - DNA, 21 bp, Homo sapiens
tacagccacatccccaagccc

SEQ ID NO: 4073705 - DNA, 20 bp, Homo sapiens
tacagccctaagtggctgcc

SEQ ID NO: 4073706 - DNA, 22 bp, Homo sapiens
tacagccctaagtggctgcctt

SEQ ID NO: 4073707 - DNA, 14 bp, Homo sapiens
tacagcgagaggca

SEQ ID NO: 4073708 - DNA, 19 bp, Homo sapiens
tacagcgagaggcagagaa

SEQ ID NO: 4073709 - DNA, 16 bp, Homo sapiens
tacagctaatcagcat

SEQ ID NO: 4073710 - DNA, 21 bp, Homo sapiens
tacagctcattaaactttttt

SEQ ID NO: 4073711 - DNA, 20 bp, Homo sapiens
tacagctctggccacaacag

SEQ ID NO: 4073712 - DNA, 14 bp, Homo sapiens
tacagctgtattgt

SEQ ID NO: 4073713 - DNA, 19 bp, Homo sapiens
tacagctgtattgtctgaa

SEQ ID NO: 4073714 - DNA, 12 bp, Homo sapiens
tacagctgtgtt

SEQ ID NO: 4073715 - DNA, 17 bp, Homo sapiens
tacagctgtgttattct

SEQ ID NO: 4073716 - DNA, 14 bp, Homo sapiens
tacagcttcaccct

SEQ ID NO: 4073717 - DNA, 23 bp, Homo sapiens
tacagctttcttgctcccttcag

SEQ ID NO: 4073718 - DNA, 21 bp, Homo sapiens
tacaggaagcaccccatgcca

SEQ ID NO: 4073719 - DNA, 18 bp, Homo sapiens
tacaggacttttaaatgg

SEQ ID NO: 4073720 - DNA, 14 bp, Homo sapiens
tacaggccctgctc

SEQ ID NO: 4073721 - DNA, 15 bp, Homo sapiens
tacagggtttttacc

SEQ ID NO: 4073722 - DNA, 20 bp, Homo sapiens
tacaggttaacctgcagaaa

SEQ ID NO: 4073723 - DNA, 12 bp, Homo sapiens
tacagtgagcca

SEQ ID NO: 4073724 - DNA, 14 bp, Homo sapiens
tacagtgagccaag

SEQ ID NO: 4073725 - DNA, 16 bp, Homo sapiens
tacagtgcagacaggc

SEQ ID NO: 4073726 - DNA, 20 bp, Homo sapiens
tacagtgcagacaggccatg

SEQ ID NO: 4073727 - DNA, 21 bp, Homo sapiens
tacagtgcagagccttctcag

SEQ ID NO: 4073728 - DNA, 22 bp, Homo sapiens
tacagtgcagagccttctcaga

SEQ ID NO: 4073729 - DNA, 13 bp, Homo sapiens
tacagtgccttgc

SEQ ID NO: 4073730 - DNA, 14 bp, Homo sapiens
tacagtgccttgct

SEQ ID NO: 4073731 - DNA, 18 bp, Homo sapiens
tacagtgtctgtgccatg

SEQ ID NO: 4073732 - DNA, 15 bp, Homo sapiens
tacagttattttgga

SEQ ID NO: 4073733 - DNA, 17 bp, Homo sapiens
tacagttattttggata

SEQ ID NO: 4073734 - DNA, 16 bp, Homo sapiens
tacagttcaataaact

SEQ ID NO: 4073735 - DNA, 17 bp, Homo sapiens
tacagttgtgttagcct

SEQ ID NO: 4073736 - DNA, 20 bp, Homo sapiens
tacagttgtgttagcctctt

SEQ ID NO: 4073737 - DNA, 20 bp, Homo sapiens
tacagttgttttttgaaaac

SEQ ID NO: 4073738 - DNA, 23 bp, Homo sapiens
tacagtttatttttaaagataga

SEQ ID NO: 4073739 - DNA, 22 bp, Homo sapiens
tacataaattgcataaagcata

SEQ ID NO: 4073740 - DNA, 20 bp, Homo sapiens
tacataacggaaagttttta

SEQ ID NO: 4073741 - DNA, 13 bp, Homo sapiens
tacataactcctg

SEQ ID NO: 4073742 - DNA, 22 bp, Homo sapiens
tacataactcctgtcccttttc

SEQ ID NO: 4073743 - DNA, 23 bp, Homo sapiens
tacataactctgtaaaaacactg

SEQ ID NO: 4073744 - DNA, 14 bp, Homo sapiens
tacataactgcctt

SEQ ID NO: 4073745 - DNA, 18 bp, Homo sapiens
tacataagataaatgtgc

SEQ ID NO: 4073746 - DNA, 22 bp, Homo sapiens
tacataagataaatgtgctgaa

SEQ ID NO: 4073747 - DNA, 15 bp, Homo sapiens
tacataagtttagga

SEQ ID NO: 4073748 - DNA, 13 bp, Homo sapiens
tacataatgctta

SEQ ID NO: 4073749 - DNA, 22 bp, Homo sapiens
tacataatgcttaatttctaaa

SEQ ID NO: 4073750 - DNA, 19 bp, Homo sapiens
tacatagttttaaactcat

SEQ ID NO: 4073751 - DNA, 20 bp, Homo sapiens
tacatataaaatgtaattac

SEQ ID NO: 4073752 - DNA, 18 bp, Homo sapiens
tacatatcacctcatggc

SEQ ID NO: 4073753 - DNA, 15 bp, Homo sapiens
tacatatcgctgact

SEQ ID NO: 4073754 - DNA, 20 bp, Homo sapiens
tacatatcgctgacttcatg

SEQ ID NO: 4073755 - DNA, 23 bp, Homo sapiens
tacatatcgctgacttcatggaa

SEQ ID NO: 4073756 - DNA, 22 bp, Homo sapiens
tacatatctttattaatcacta

SEQ ID NO: 4073757 - DNA, 16 bp, Homo sapiens
tactcagcctgctgcc

SEQ ID NO: 4073758 - DNA, 18 bp, Homo sapiens
tactcagggttcatctgt

SEQ ID NO: 4073759 - DNA, 20 bp, Homo sapiens
tactcagggttcatctgtcc

SEQ ID NO: 4073760 - DNA, 22 bp, Homo sapiens
tactccacagcggaggagacca

SEQ ID NO: 4073761 - DNA, 17 bp, Homo sapiens
tactcctgcaaaatttt

SEQ ID NO: 4073762 - DNA, 22 bp, Homo sapiens
tactcctgcaaaattttatagc

SEQ ID NO: 4073763 - DNA, 12 bp, Homo sapiens
tactcctgggct

SEQ ID NO: 4073764 - DNA, 18 bp, Homo sapiens
tactccttgcttcctgat

SEQ ID NO: 4073765 - DNA, 22 bp, Homo sapiens
tactcgtgcattaaaatttctt

SEQ ID NO: 4073766 - DNA, 18 bp, Homo sapiens
tactctcacccataaaca

SEQ ID NO: 4073767 - DNA, 13 bp, Homo sapiens
tactctccatatc

SEQ ID NO: 4073768 - DNA, 15 bp, Homo sapiens
tactctccccacgag

SEQ ID NO: 4073769 - DNA, 23 bp, Homo sapiens
tactctcctggaaatattaagaa

SEQ ID NO: 4073770 - DNA, 12 bp, Homo sapiens
tactctctgcct

SEQ ID NO: 4073771 - DNA, 21 bp, Homo sapiens
tactctggaatgtttttccct

SEQ ID NO: 4073772 - DNA, 17 bp, Homo sapiens
tactctggggtgctgcc

SEQ ID NO: 4073773 - DNA, 15 bp, Homo sapiens
tactctggttctttg

SEQ ID NO: 4073774 - DNA, 18 bp, Homo sapiens
tactctgtcttaaatgag

SEQ ID NO: 4073775 - DNA, 18 bp, Homo sapiens
tactcttaggaagagaaa

SEQ ID NO: 4073776 - DNA, 15 bp, Homo sapiens
tactcttcagggtct

SEQ ID NO: 4073777 - DNA, 13 bp, Homo sapiens
tactcttctctct

SEQ ID NO: 4073778 - DNA, 16 bp, Homo sapiens
tactcttctctctgct

SEQ ID NO: 4073779 - DNA, 17 bp, Homo sapiens
tactcttctctctgctc

SEQ ID NO: 4073780 - DNA, 17 bp, Homo sapiens
tactcttgttgagttct

SEQ ID NO: 4073781 - DNA, 13 bp, Homo sapiens
tactctttctgta

SEQ ID NO: 4073782 - DNA, 14 bp, Homo sapiens
tactctttttgttt

SEQ ID NO: 4073783 - DNA, 12 bp, Homo sapiens
tactgaaggaaa

SEQ ID NO: 4073784 - DNA, 18 bp, Homo sapiens
tactgaaggaaaaacaca

SEQ ID NO: 4073785 - DNA, 19 bp, Homo sapiens
tactgaagtcttttctgtc

SEQ ID NO: 4073786 - DNA, 23 bp, Homo sapiens
tactgaatataaaaacatttgta

SEQ ID NO: 4073787 - DNA, 17 bp, Homo sapiens
tactgaccagacaagct

SEQ ID NO: 4073788 - DNA, 17 bp, Homo sapiens
tactgactttgcttgct

SEQ ID NO: 4073789 - DNA, 15 bp, Homo sapiens
tactgagccttgtaa

SEQ ID NO: 4073790 - DNA, 18 bp, Homo sapiens
tactgagccttgtaattc

SEQ ID NO: 4073791 - DNA, 23 bp, Homo sapiens
tactgagccttgtaattctaaat

SEQ ID NO: 4073792 - DNA, 14 bp, Homo sapiens
tactgagcttctct

SEQ ID NO: 4073793 - DNA, 22 bp, Homo sapiens
tactgaggcctaaaagtaaaca

SEQ ID NO: 4073794 - DNA, 16 bp, Homo sapiens
tactgatcatgcattg

SEQ ID NO: 4073795 - DNA, 12 bp, Homo sapiens
tactgatgaaat

SEQ ID NO: 4073796 - DNA, 22 bp, Homo sapiens
tactgattattttcttcatcca

SEQ ID NO: 4073797 - DNA, 15 bp, Homo sapiens
tactgattctgtgta

SEQ ID NO: 4073798 - DNA, 14 bp, Homo sapiens
tactgattgtttca

SEQ ID NO: 4073799 - DNA, 15 bp, Homo sapiens
tactgattgtttcat

SEQ ID NO: 4073800 - DNA, 15 bp, Homo sapiens
tactgcaagaaaatg

SEQ ID NO: 4073801 - DNA, 13 bp, Homo sapiens
tactgcttaattc

SEQ ID NO: 4073802 - DNA, 20 bp, Homo sapiens
tactgcttaattcaaataat

SEQ ID NO: 4073803 - DNA, 14 bp, Homo sapiens
tactgcttgatttt

SEQ ID NO: 4073804 - DNA, 18 bp, Homo sapiens
tactggaagttttgcatt

SEQ ID NO: 4073805 - DNA, 23 bp, Homo sapiens
tactggaagttttgcatttatgg

SEQ ID NO: 4073806 - DNA, 20 bp, Homo sapiens
tactggaataatttgtaaat

SEQ ID NO: 4073807 - DNA, 22 bp, Homo sapiens
tactggaataatttgtaaatga

SEQ ID NO: 4073808 - DNA, 19 bp, Homo sapiens
tactggaattcttctgcaa

SEQ ID NO: 4073809 - DNA, 23 bp, Homo sapiens
tactggaattcttctgcaacatt

SEQ ID NO: 4073810 - DNA, 23 bp, Homo sapiens
tactggagtggaaggtctattgg

SEQ ID NO: 4073811 - DNA, 15 bp, Homo sapiens
tactgggagaatcac

SEQ ID NO: 4073812 - DNA, 22 bp, Homo sapiens
tactgggccttagtgggccagg

SEQ ID NO: 4073813 - DNA, 19 bp, Homo sapiens
tactgggtgaggaaatcca

SEQ ID NO: 4073814 - DNA, 22 bp, Homo sapiens
tactgggtgaggaaatccattg

SEQ ID NO: 4073815 - DNA, 14 bp, Homo sapiens
tactgggtgtcatt

SEQ ID NO: 4073816 - DNA, 15 bp, Homo sapiens
tactgggtgtcattt

SEQ ID NO: 4073817 - DNA, 17 bp, Homo sapiens
tactgggtgtcatttca

SEQ ID NO: 4073818 - DNA, 23 bp, Homo sapiens
tactgggtgtcatttcattccat

SEQ ID NO: 4073819 - DNA, 15 bp, Homo sapiens
tactggttggctccc

SEQ ID NO: 4073820 - DNA, 13 bp, Homo sapiens
tactgtaattcct

SEQ ID NO: 4073821 - DNA, 14 bp, Homo sapiens
tactgtacttaata

SEQ ID NO: 4073822 - DNA, 18 bp, Homo sapiens
tactgtatggaaacactg

SEQ ID NO: 4073823 - DNA, 22 bp, Homo sapiens
tactgtatggaaacactgattt

SEQ ID NO: 4073824 - DNA, 14 bp, Homo sapiens
tactgtcaataaac

SEQ ID NO: 4073825 - DNA, 15 bp, Homo sapiens
tactgtgcagaataa

SEQ ID NO: 4073826 - DNA, 16 bp, Homo sapiens
tactgtgcagaataat

SEQ ID NO: 4073827 - DNA, 20 bp, Homo sapiens
tactgtgcagaataatggaa

SEQ ID NO: 4073828 - DNA, 12 bp, Homo sapiens
tactgtggagga

SEQ ID NO: 4073829 - DNA, 17 bp, Homo sapiens
tactgttcttcatttta

SEQ ID NO: 4073830 - DNA, 15 bp, Homo sapiens
tactgttttgtatca

SEQ ID NO: 4073831 - DNA, 16 bp, Homo sapiens
tactgttttgtatcaa

SEQ ID NO: 4073832 - DNA, 18 bp, Homo sapiens
tacttaaatgaaagcatg

SEQ ID NO: 4073833 - DNA, 13 bp, Homo sapiens
tacttaataaatt

SEQ ID NO: 4073834 - DNA, 17 bp, Homo sapiens
tacttaataaattcaga

SEQ ID NO: 4073835 - DNA, 18 bp, Homo sapiens
tacttaattcctttctca

SEQ ID NO: 4073836 - DNA, 22 bp, Homo sapiens
tacttacctaaacagatataaa

SEQ ID NO: 4073837 - DNA, 15 bp, Homo sapiens
tacttactataattt

SEQ ID NO: 4073838 - DNA, 16 bp, Homo sapiens
tacttagagtttctgt

SEQ ID NO: 4073839 - DNA, 19 bp, Homo sapiens
tacttagagtttctgtttg

SEQ ID NO: 4073840 - DNA, 17 bp, Homo sapiens
tacttagcacttggcct

SEQ ID NO: 4073841 - DNA, 22 bp, Homo sapiens
tacttccacctcgggcacattt

SEQ ID NO: 4073842 - DNA, 23 bp, Homo sapiens
tacttcccattttggaagttttc

SEQ ID NO: 4073843 - DNA, 19 bp, Homo sapiens
tacttcccgggccagggct

SEQ ID NO: 4073844 - DNA, 12 bp, Homo sapiens
tacttccttatg

SEQ ID NO: 4073845 - DNA, 16 bp, Homo sapiens
tacttctaatcttaaa

SEQ ID NO: 4073846 - DNA, 15 bp, Homo sapiens
tacttcttatacatt

SEQ ID NO: 4073847 - DNA, 18 bp, Homo sapiens
tacttcttcattcaatac

SEQ ID NO: 4073848 - DNA, 15 bp, Homo sapiens
tacttgaaaaagtaa

SEQ ID NO: 4073849 - DNA, 18 bp, Homo sapiens
tacttgaagggccagagc

SEQ ID NO: 4073850 - DNA, 21 bp, Homo sapiens
tacttgaagggccagagccag

SEQ ID NO: 4073851 - DNA, 12 bp, Homo sapiens
tacttgggaggc

SEQ ID NO: 4073852 - DNA, 18 bp, Homo sapiens
tacttgggaggctgaggc

SEQ ID NO: 4073853 - DNA, 18 bp, Homo sapiens
tacttggtcacagccagg

SEQ ID NO: 4073854 - DNA, 13 bp, Homo sapiens
tacttggtttgtg

SEQ ID NO: 4073855 - DNA, 20 bp, Homo sapiens
tacttggtttgtgttcttct

SEQ ID NO: 4073856 - DNA, 18 bp, Homo sapiens
tacttgtgaaacacagct

SEQ ID NO: 4073857 - DNA, 20 bp, Homo sapiens
tacttgtgaaacacagctgt

SEQ ID NO: 4073858 - DNA, 20 bp, Homo sapiens
tacttgtgtttgcttaaaca

SEQ ID NO: 4073859 - DNA, 14 bp, Homo sapiens
tactttaaaggaaa

SEQ ID NO: 4073860 - DNA, 14 bp, Homo sapiens
tagctctcccagtg

SEQ ID NO: 4073861 - DNA, 19 bp, Homo sapiens
tagctcttttttgtttgtt

SEQ ID NO: 4073862 - DNA, 23 bp, Homo sapiens
tagctcttttttgtttgtttctt

SEQ ID NO: 4073863 - DNA, 17 bp, Homo sapiens
tagctgacagaatctct

SEQ ID NO: 4073864 - DNA, 23 bp, Homo sapiens
tagctgacccagccccttgagaa

SEQ ID NO: 4073865 - DNA, 23 bp, Homo sapiens
tagctgcctagcaagctggcctc

SEQ ID NO: 4073866 - DNA, 15 bp, Homo sapiens
tagctgggattacag

SEQ ID NO: 4073867 - DNA, 22 bp, Homo sapiens
tagctggtttcctcattcctga

SEQ ID NO: 4073868 - DNA, 21 bp, Homo sapiens
tagctgtatgatttgttttga

SEQ ID NO: 4073869 - DNA, 13 bp, Homo sapiens
tagctgttgagct

SEQ ID NO: 4073870 - DNA, 17 bp, Homo sapiens
tagctgttgagctgttt

SEQ ID NO: 4073871 - DNA, 12 bp, Homo sapiens
tagcttaagtag

SEQ ID NO: 4073872 - DNA, 16 bp, Homo sapiens
tagcttaagtagtttc

SEQ ID NO: 4073873 - DNA, 19 bp, Homo sapiens
tagcttgggaggcttcccc

SEQ ID NO: 4073874 - DNA, 14 bp, Homo sapiens
tagctttaccctca

SEQ ID NO: 4073875 - DNA, 14 bp, Homo sapiens
tagctttattcttc

SEQ ID NO: 4073876 - DNA, 19 bp, Homo sapiens
tagctttattttttaagta

SEQ ID NO: 4073877 - DNA, 13 bp, Homo sapiens
tagctttgtgttt

SEQ ID NO: 4073878 - DNA, 15 bp, Homo sapiens
tagctttgtgtttgg

SEQ ID NO: 4073879 - DNA, 21 bp, Homo sapiens
tagctttgtgtttggtttaca

SEQ ID NO: 4073880 - DNA, 20 bp, Homo sapiens
tagcttttgccagtattatg

SEQ ID NO: 4073881 - DNA, 18 bp, Homo sapiens
tagctttttaaaacatta

SEQ ID NO: 4073882 - DNA, 11 bp, Homo sapiens
taggaaaacca

SEQ ID NO: 4073883 - DNA, 20 bp, Homo sapiens
taggaaatctagaagtagtc

SEQ ID NO: 4073884 - DNA, 23 bp, Homo sapiens
taggaacagcagtgttctcacag

SEQ ID NO: 4073885 - DNA, 16 bp, Homo sapiens
taggaacatatgaaaa

SEQ ID NO: 4073886 - DNA, 22 bp, Homo sapiens
taggaaccgtggtatgtctgcc

SEQ ID NO: 4073887 - DNA, 21 bp, Homo sapiens
taggaaggcacttctgcctga

SEQ ID NO: 4073888 - DNA, 15 bp, Homo sapiens
taggaaggttaatgt

SEQ ID NO: 4073889 - DNA, 17 bp, Homo sapiens
taggaagtgtaacagct

SEQ ID NO: 4073890 - DNA, 20 bp, Homo sapiens
taggaagtgtaacagctgag

SEQ ID NO: 4073891 - DNA, 21 bp, Homo sapiens
taggaagtgtaacagctgagg

SEQ ID NO: 4073892 - DNA, 22 bp, Homo sapiens
taggaagttgacttatagtaca

SEQ ID NO: 4073893 - DNA, 17 bp, Homo sapiens
taggaattcatcttttg

SEQ ID NO: 4073894 - DNA, 15 bp, Homo sapiens
taggacaaggtgcag

SEQ ID NO: 4073895 - DNA, 20 bp, Homo sapiens
taggacaaggtgcaggcagg

SEQ ID NO: 4073896 - DNA, 14 bp, Homo sapiens
taggaccaagaaag

SEQ ID NO: 4073897 - DNA, 15 bp, Homo sapiens
taggagaagccagga

SEQ ID NO: 4073898 - DNA, 16 bp, Homo sapiens
taggagaagccaggaa

SEQ ID NO: 4073899 - DNA, 14 bp, Homo sapiens
taggagaccaaggc

SEQ ID NO: 4073900 - DNA, 16 bp, Homo sapiens
taggagagccaacctc

SEQ ID NO: 4073901 - DNA, 16 bp, Homo sapiens
taggagataccaggtt

SEQ ID NO: 4073902 - DNA, 18 bp, Homo sapiens
taggagctgccttggctc

SEQ ID NO: 4073903 - DNA, 16 bp, Homo sapiens
taggagggagttatct

SEQ ID NO: 4073904 - DNA, 19 bp, Homo sapiens
taggatcagccctcatttt

SEQ ID NO: 4073905 - DNA, 18 bp, Homo sapiens
taggatgtttttcatgaa

SEQ ID NO: 4073906 - DNA, 12 bp, Homo sapiens
taggatttaaca

SEQ ID NO: 4073907 - DNA, 22 bp, Homo sapiens
taggatttaacagtcatttaaa

SEQ ID NO: 4073908 - DNA, 17 bp, Homo sapiens
taggcaagcaggacctg

SEQ ID NO: 4073909 - DNA, 13 bp, Homo sapiens
taggcagagcctt

SEQ ID NO: 4073910 - DNA, 13 bp, Homo sapiens
taggcagcagctt

SEQ ID NO: 4073911 - DNA, 20 bp, Homo sapiens
taggcattaacacaaaggag

SEQ ID NO: 4073912 - DNA, 19 bp, Homo sapiens
taggcattaatgtttctat

SEQ ID NO: 4073913 - DNA, 20 bp, Homo sapiens
taggccagggcatgtgtatg

SEQ ID NO: 4073914 - DNA, 17 bp, Homo sapiens
taggcccaggcctgggt

SEQ ID NO: 4073915 - DNA, 20 bp, Homo sapiens
taggcccctcctagacccag

SEQ ID NO: 4073916 - DNA, 15 bp, Homo sapiens
taggccctttcagtg

SEQ ID NO: 4073917 - DNA, 20 bp, Homo sapiens
taggcctgtcccttgcctct

SEQ ID NO: 4073918 - DNA, 21 bp, Homo sapiens
taggcctgtcccttgcctctg

SEQ ID NO: 4073919 - DNA, 21 bp, Homo sapiens
taggccttcctctctccagat

SEQ ID NO: 4073920 - DNA, 23 bp, Homo sapiens
taggccttcctctctccagatgt

SEQ ID NO: 4073921 - DNA, 17 bp, Homo sapiens
taggcggcgatttttgt

SEQ ID NO: 4073922 - DNA, 20 bp, Homo sapiens
taggcggcgatttttgtatg

SEQ ID NO: 4073923 - DNA, 20 bp, Homo sapiens
taggctatttgtaaatctgc

SEQ ID NO: 4073924 - DNA, 20 bp, Homo sapiens
taggctctgcacagatggat

SEQ ID NO: 4073925 - DNA, 14 bp, Homo sapiens
taggctggagaagc

SEQ ID NO: 4073926 - DNA, 16 bp, Homo sapiens
tagggaaaagttcata

SEQ ID NO: 4073927 - DNA, 18 bp, Homo sapiens
tagggaaaggttttgtat

SEQ ID NO: 4073928 - DNA, 23 bp, Homo sapiens
tagggagacagggtaggaaaggg

SEQ ID NO: 4073929 - DNA, 11 bp, Homo sapiens
tagggagcctc

SEQ ID NO: 4073930 - DNA, 20 bp, Homo sapiens
tagggagcctcccctccctg

SEQ ID NO: 4073931 - DNA, 17 bp, Homo sapiens
tagggaggcagcctcca

SEQ ID NO: 4073932 - DNA, 15 bp, Homo sapiens
tagggattcaggctg

SEQ ID NO: 4073933 - DNA, 14 bp, Homo sapiens
tagggccaggcagg

SEQ ID NO: 4073934 - DNA, 21 bp, Homo sapiens
tagggcctggtccctgggagg

SEQ ID NO: 4073935 - DNA, 23 bp, Homo sapiens
tagggctacaaaacctgatgtta

SEQ ID NO: 4073936 - DNA, 14 bp, Homo sapiens
tagggctggaccta

SEQ ID NO: 4073937 - DNA, 15 bp, Homo sapiens
taggggtagggagcc

SEQ ID NO: 4073938 - DNA, 17 bp, Homo sapiens
taggggtcaggctccat

SEQ ID NO: 4073939 - DNA, 13 bp, Homo sapiens
taggggttgctaa

SEQ ID NO: 4073940 - DNA, 13 bp, Homo sapiens
tagggtaaatcag

SEQ ID NO: 4073941 - DNA, 14 bp, Homo sapiens
tagggtactaaatt

SEQ ID NO: 4073942 - DNA, 18 bp, Homo sapiens
tagggtactaaatttaaa

SEQ ID NO: 4073943 - DNA, 13 bp, Homo sapiens
tagggtagaatga

SEQ ID NO: 4073944 - DNA, 15 bp, Homo sapiens
tagggtcggaaccca

SEQ ID NO: 4073945 - DNA, 15 bp, Homo sapiens
tagggtctcttcagg

SEQ ID NO: 4073946 - DNA, 12 bp, Homo sapiens
tagggtggccct

SEQ ID NO: 4073947 - DNA, 15 bp, Homo sapiens
tagggttataataat

SEQ ID NO: 4073948 - DNA, 19 bp, Homo sapiens
tagggttttgcaataactt

SEQ ID NO: 4073949 - DNA, 22 bp, Homo sapiens
taggtaaatttttaggcaaaga

SEQ ID NO: 4073950 - DNA, 23 bp, Homo sapiens
taggtaaatttttaggcaaagat

SEQ ID NO: 4073951 - DNA, 23 bp, Homo sapiens
taggtaagctgtgccttcagctg

SEQ ID NO: 4073952 - DNA, 23 bp, Homo sapiens
taggtagccttgtgttctgagta

SEQ ID NO: 4073953 - DNA, 15 bp, Homo sapiens
taggtatgaataagt

SEQ ID NO: 4073954 - DNA, 13 bp, Homo sapiens
taggtcagatgga

SEQ ID NO: 4073955 - DNA, 12 bp, Homo sapiens
taggtcctcact

SEQ ID NO: 4073956 - DNA, 19 bp, Homo sapiens
taggtcctcacttggggga

SEQ ID NO: 4073957 - DNA, 12 bp, Homo sapiens
taggtctccagt

SEQ ID NO: 4073958 - DNA, 21 bp, Homo sapiens
taggtctcctcagggtggggg

SEQ ID NO: 4073959 - DNA, 15 bp, Homo sapiens
taggtgagaaaaaaa

SEQ ID NO: 4073960 - DNA, 22 bp, Homo sapiens
taggttaattccaattatatga

SEQ ID NO: 4073961 - DNA, 15 bp, Homo sapiens
taggttatttaaaat

SEQ ID NO: 4073962 - DNA, 14 bp, Homo sapiens
tatagtaggcatgt

SEQ ID NO: 4073963 - DNA, 18 bp, Homo sapiens
tatagttgttttatatgt

SEQ ID NO: 4073964 - DNA, 20 bp, Homo sapiens
tatataaaaagaaaagataa

SEQ ID NO: 4073965 - DNA, 18 bp, Homo sapiens
tatataaatgtaaaaata

SEQ ID NO: 4073966 - DNA, 19 bp, Homo sapiens
tatataagtgtacatatgt

SEQ ID NO: 4073967 - DNA, 13 bp, Homo sapiens
tatataattttat

SEQ ID NO: 4073968 - DNA, 16 bp, Homo sapiens
tatatacaaaaagaaa

SEQ ID NO: 4073969 - DNA, 18 bp, Homo sapiens
tatatacaaaaagaaaat

SEQ ID NO: 4073970 - DNA, 22 bp, Homo sapiens
tatatacaaggtgagtgtgact

SEQ ID NO: 4073971 - DNA, 14 bp, Homo sapiens
tatatacagttatt

SEQ ID NO: 4073972 - DNA, 19 bp, Homo sapiens
tatatacagttattttgga

SEQ ID NO: 4073973 - DNA, 19 bp, Homo sapiens
tatatacctggcttttact

SEQ ID NO: 4073974 - DNA, 22 bp, Homo sapiens
tatatacctggcttttacttta

SEQ ID NO: 4073975 - DNA, 21 bp, Homo sapiens
tatatacttgtggttttcaaa

SEQ ID NO: 4073976 - DNA, 13 bp, Homo sapiens
tatatatgaaaac

SEQ ID NO: 4073977 - DNA, 15 bp, Homo sapiens
tatatatgaaaacta

SEQ ID NO: 4073978 - DNA, 16 bp, Homo sapiens
tatatatgaaaactat

SEQ ID NO: 4073979 - DNA, 23 bp, Homo sapiens
tatatatgtgtatgcacagtaaa

SEQ ID NO: 4073980 - DNA, 23 bp, Homo sapiens
tatatcagcctgagtctcctgtg

SEQ ID NO: 4073981 - DNA, 16 bp, Homo sapiens
tatatcagtacctctc

SEQ ID NO: 4073982 - DNA, 15 bp, Homo sapiens
tatatcatatgtata

SEQ ID NO: 4073983 - DNA, 18 bp, Homo sapiens
tatatcatgtaaagaaat

SEQ ID NO: 4073984 - DNA, 19 bp, Homo sapiens
tatatcatgtaaagaaatg

SEQ ID NO: 4073985 - DNA, 21 bp, Homo sapiens
tatatcattctacagaataat

SEQ ID NO: 4073986 - DNA, 18 bp, Homo sapiens
tatatccatgtactgtag

SEQ ID NO: 4073987 - DNA, 19 bp, Homo sapiens
tatatccatgtactgtagt

SEQ ID NO: 4073988 - DNA, 14 bp, Homo sapiens
tatatcctgtgact

SEQ ID NO: 4073989 - DNA, 16 bp, Homo sapiens
tatatcctttctaaca

SEQ ID NO: 4073990 - DNA, 19 bp, Homo sapiens
tatatgaccagaagccttg

SEQ ID NO: 4073991 - DNA, 20 bp, Homo sapiens
tatatgctctgcatgttaca

SEQ ID NO: 4073992 - DNA, 21 bp, Homo sapiens
tatatgctctgcatgttacat

SEQ ID NO: 4073993 - DNA, 16 bp, Homo sapiens
tatatggatgattcag

SEQ ID NO: 4073994 - DNA, 18 bp, Homo sapiens
tatatggatgattcagaa

SEQ ID NO: 4073995 - DNA, 12 bp, Homo sapiens
tatatgtacatg

SEQ ID NO: 4073996 - DNA, 19 bp, Homo sapiens
tatatgtaccgtaggcttt

SEQ ID NO: 4073997 - DNA, 12 bp, Homo sapiens
tatatgtctgat

SEQ ID NO: 4073998 - DNA, 18 bp, Homo sapiens
tatatgtgaaacattttt

SEQ ID NO: 4073999 - DNA, 13 bp, Homo sapiens
tatatgtgtccat

SEQ ID NO: 4074000 - DNA, 19 bp, Homo sapiens
tatatgtgtgtgtatgttt

SEQ ID NO: 4074001 - DNA, 14 bp, Homo sapiens
tatatgtttatata

SEQ ID NO: 4074002 - DNA, 13 bp, Homo sapiens
tatattaagcaga

SEQ ID NO: 4074003 - DNA, 14 bp, Homo sapiens
tatattaagcagaa

SEQ ID NO: 4074004 - DNA, 15 bp, Homo sapiens
tatattaagcagaaa

SEQ ID NO: 4074005 - DNA, 17 bp, Homo sapiens
tatattacacatttgta

SEQ ID NO: 4074006 - DNA, 17 bp, Homo sapiens
tatattacagatatttg

SEQ ID NO: 4074007 - DNA, 18 bp, Homo sapiens
tatattatcataagaatt

SEQ ID NO: 4074008 - DNA, 17 bp, Homo sapiens
tatattattgtaagttg

SEQ ID NO: 4074009 - DNA, 12 bp, Homo sapiens
tatattgaactt

SEQ ID NO: 4074010 - DNA, 20 bp, Homo sapiens
tatattgagaatcccttaaa

SEQ ID NO: 4074011 - DNA, 19 bp, Homo sapiens
tatattgtcagatattttt

SEQ ID NO: 4074012 - DNA, 16 bp, Homo sapiens
tatattgtttttgtat

SEQ ID NO: 4074013 - DNA, 20 bp, Homo sapiens
tatattgtttttgtatttat

SEQ ID NO: 4074014 - DNA, 13 bp, Homo sapiens
tatatttaagcct

SEQ ID NO: 4074015 - DNA, 11 bp, Homo sapiens
tatatttacaa

SEQ ID NO: 4074016 - DNA, 13 bp, Homo sapiens
tatatttacaata

SEQ ID NO: 4074017 - DNA, 16 bp, Homo sapiens
tatatttataactcat

SEQ ID NO: 4074018 - DNA, 22 bp, Homo sapiens
tatatttataactcatcataaa

SEQ ID NO: 4074019 - DNA, 23 bp, Homo sapiens
tatatttataactcatcataaaa

SEQ ID NO: 4074020 - DNA, 24 bp, Homo sapiens
tatatttataactcatcataaaat

SEQ ID NO: 4074021 - DNA, 12 bp, Homo sapiens
tatatttattgt

SEQ ID NO: 4074022 - DNA, 20 bp, Homo sapiens
tatatttcacttttgttctg

SEQ ID NO: 4074023 - DNA, 22 bp, Homo sapiens
tatatttcacttttgttctgct

SEQ ID NO: 4074024 - DNA, 22 bp, Homo sapiens
tatatttcctttatgtgaattt

SEQ ID NO: 4074025 - DNA, 23 bp, Homo sapiens
tatatttgtgatagcactttcta

SEQ ID NO: 4074026 - DNA, 15 bp, Homo sapiens
tatattttaatagaa

SEQ ID NO: 4074027 - DNA, 18 bp, Homo sapiens
tatatttttaaaaaatga

SEQ ID NO: 4074028 - DNA, 19 bp, Homo sapiens
tatatttttggttgtcaat

SEQ ID NO: 4074029 - DNA, 19 bp, Homo sapiens
tatattttttaatttgatg

SEQ ID NO: 4074030 - DNA, 18 bp, Homo sapiens
tatatttttttaatttaa

SEQ ID NO: 4074031 - DNA, 18 bp, Homo sapiens
tatcaaaacgagggctga

SEQ ID NO: 4074032 - DNA, 19 bp, Homo sapiens
tatcaaaactttcttttct

SEQ ID NO: 4074033 - DNA, 14 bp, Homo sapiens
tatcaaaatcacta

SEQ ID NO: 4074034 - DNA, 23 bp, Homo sapiens
tatcaaaatcactatctttctga

SEQ ID NO: 4074035 - DNA, 13 bp, Homo sapiens
tatcaactttaat

SEQ ID NO: 4074036 - DNA, 18 bp, Homo sapiens
tatcaagcaacattcttg

SEQ ID NO: 4074037 - DNA, 22 bp, Homo sapiens
tatcaaggaagaaatggttcag

SEQ ID NO: 4074038 - DNA, 22 bp, Homo sapiens
tatcaaggactctggtttctca

SEQ ID NO: 4074039 - DNA, 15 bp, Homo sapiens
tatcaagtggcatgt

SEQ ID NO: 4074040 - DNA, 21 bp, Homo sapiens
tatcaatatctaatatatatg

SEQ ID NO: 4074041 - DNA, 15 bp, Homo sapiens
tatcaatgagttctt

SEQ ID NO: 4074042 - DNA, 16 bp, Homo sapiens
tatcaattggcagtga

SEQ ID NO: 4074043 - DNA, 21 bp, Homo sapiens
tatcaattggcagtgactttg

SEQ ID NO: 4074044 - DNA, 13 bp, Homo sapiens
tatcacacttctg

SEQ ID NO: 4074045 - DNA, 12 bp, Homo sapiens
tatcacagtatt

SEQ ID NO: 4074046 - DNA, 18 bp, Homo sapiens
tatcacagtattatctgt

SEQ ID NO: 4074047 - DNA, 20 bp, Homo sapiens
tatcacattggagtcactgc

SEQ ID NO: 4074048 - DNA, 15 bp, Homo sapiens
tatcactctaaaaaa

SEQ ID NO: 4074049 - DNA, 20 bp, Homo sapiens
tatcactctaaaaaacattt

SEQ ID NO: 4074050 - DNA, 17 bp, Homo sapiens
tatcagaattctcagaa

SEQ ID NO: 4074051 - DNA, 23 bp, Homo sapiens
tatcaggtctcccacgtgggaga

SEQ ID NO: 4074052 - DNA, 15 bp, Homo sapiens
tatcagtgacagagt

SEQ ID NO: 4074053 - DNA, 17 bp, Homo sapiens
tatcagtgacagagttc

SEQ ID NO: 4074054 - DNA, 20 bp, Homo sapiens
tatcagtgttttaaattctg

SEQ ID NO: 4074055 - DNA, 21 bp, Homo sapiens
tatcagttgagcttcatatac

SEQ ID NO: 4074056 - DNA, 16 bp, Homo sapiens
tatcataaaatcaaaa

SEQ ID NO: 4074057 - DNA, 22 bp, Homo sapiens
tatcatacaaatcagttagttt

SEQ ID NO: 4074058 - DNA, 18 bp, Homo sapiens
tatcatgcccctgtactc

SEQ ID NO: 4074059 - DNA, 20 bp, Homo sapiens
tatcatgctaaaattctata

SEQ ID NO: 4074060 - DNA, 22 bp, Homo sapiens
tatcatgtaaagaaatgtctta

SEQ ID NO: 4074061 - DNA, 18 bp, Homo sapiens
tatcattctacagaataa

SEQ ID NO: 4074062 - DNA, 18 bp, Homo sapiens
tatccaaaatgtgtattt

SEQ ID NO: 4074063 - DNA, 22 bp, Homo sapiens
tatccaaaatgtgtatttctta

SEQ ID NO: 4074064 - DNA, 23 bp, Homo sapiens
tattgacacagaaaatgttgaga

SEQ ID NO: 4074065 - DNA, 12 bp, Homo sapiens
tattgacactga

SEQ ID NO: 4074066 - DNA, 19 bp, Homo sapiens
tattgacactgaacttaat

SEQ ID NO: 4074067 - DNA, 18 bp, Homo sapiens
tattgagaatcccttaaa

SEQ ID NO: 4074068 - DNA, 15 bp, Homo sapiens
tattgatagtactct

SEQ ID NO: 4074069 - DNA, 23 bp, Homo sapiens
tattgatgaaaagatttaagcac

SEQ ID NO: 4074070 - DNA, 16 bp, Homo sapiens
tattgccttctttgaa

SEQ ID NO: 4074071 - DNA, 17 bp, Homo sapiens
tattgccttctttgaag

SEQ ID NO: 4074072 - DNA, 18 bp, Homo sapiens
tattgccttctttgaaga

SEQ ID NO: 4074073 - DNA, 19 bp, Homo sapiens
tattgccttctttgaagaa

SEQ ID NO: 4074074 - DNA, 14 bp, Homo sapiens
tattgcgctgctac

SEQ ID NO: 4074075 - DNA, 14 bp, Homo sapiens
tattgctagtattt

SEQ ID NO: 4074076 - DNA, 18 bp, Homo sapiens
tattgctagtatttgaat

SEQ ID NO: 4074077 - DNA, 13 bp, Homo sapiens
tattgctgctgcc

SEQ ID NO: 4074078 - DNA, 22 bp, Homo sapiens
tattgctgctgtgcgtggaaaa

SEQ ID NO: 4074079 - DNA, 22 bp, Homo sapiens
tattggaaatttgttataatga

SEQ ID NO: 4074080 - DNA, 16 bp, Homo sapiens
tattggaattaacctg

SEQ ID NO: 4074081 - DNA, 21 bp, Homo sapiens
tattggaattaacctggtgct

SEQ ID NO: 4074082 - DNA, 21 bp, Homo sapiens
tattggagggtaaatgatgtg

SEQ ID NO: 4074083 - DNA, 16 bp, Homo sapiens
tattggctgctttgcc

SEQ ID NO: 4074084 - DNA, 17 bp, Homo sapiens
tattggggtctgacccc

SEQ ID NO: 4074085 - DNA, 18 bp, Homo sapiens
tattgggttcattattgg

SEQ ID NO: 4074086 - DNA, 19 bp, Homo sapiens
tattggtatatccttttct

SEQ ID NO: 4074087 - DNA, 15 bp, Homo sapiens
tattgtaaatatgtt

SEQ ID NO: 4074088 - DNA, 16 bp, Homo sapiens
tattgtaactatgttt

SEQ ID NO: 4074089 - DNA, 12 bp, Homo sapiens
tattgtaagttg

SEQ ID NO: 4074090 - DNA, 16 bp, Homo sapiens
tattgtaagttgtaca

SEQ ID NO: 4074091 - DNA, 17 bp, Homo sapiens
tattgtaagttgtacaa

SEQ ID NO: 4074092 - DNA, 18 bp, Homo sapiens
tattgtaagttgtacaaa

SEQ ID NO: 4074093 - DNA, 13 bp, Homo sapiens
tattgtacataaa

SEQ ID NO: 4074094 - DNA, 16 bp, Homo sapiens
tattgtacataaaaga

SEQ ID NO: 4074095 - DNA, 13 bp, Homo sapiens
tattgtaccattt

SEQ ID NO: 4074096 - DNA, 11 bp, Homo sapiens
tattgtacctc

SEQ ID NO: 4074097 - DNA, 14 bp, Homo sapiens
tattgtacctctct

SEQ ID NO: 4074098 - DNA, 13 bp, Homo sapiens
tattgtataaaaa

SEQ ID NO: 4074099 - DNA, 14 bp, Homo sapiens
tattgtataaaaag

SEQ ID NO: 4074100 - DNA, 15 bp, Homo sapiens
tattgtataaaaagt

SEQ ID NO: 4074101 - DNA, 15 bp, Homo sapiens
tattgtattatttgg

SEQ ID NO: 4074102 - DNA, 15 bp, Homo sapiens
tattgtattgctgct

SEQ ID NO: 4074103 - DNA, 20 bp, Homo sapiens
tattgtccctggcttcctta

SEQ ID NO: 4074104 - DNA, 17 bp, Homo sapiens
tattgtcctaagtgtca

SEQ ID NO: 4074105 - DNA, 17 bp, Homo sapiens
tattgtgaagtacatat

SEQ ID NO: 4074106 - DNA, 16 bp, Homo sapiens
tattgtgattctgttt

SEQ ID NO: 4074107 - DNA, 16 bp, Homo sapiens
tattgtgtttgtgtat

SEQ ID NO: 4074108 - DNA, 17 bp, Homo sapiens
tattgttaactcttgtc

SEQ ID NO: 4074109 - DNA, 16 bp, Homo sapiens
tattgttagaaaatga

SEQ ID NO: 4074110 - DNA, 14 bp, Homo sapiens
tattgttcaaacaa

SEQ ID NO: 4074111 - DNA, 13 bp, Homo sapiens
tattgttccaaga

SEQ ID NO: 4074112 - DNA, 17 bp, Homo sapiens
tattgttccaagacatt

SEQ ID NO: 4074113 - DNA, 23 bp, Homo sapiens
tattgttccaagacattgtcaat

SEQ ID NO: 4074114 - DNA, 21 bp, Homo sapiens
tattgttcccagtgacacttc

SEQ ID NO: 4074115 - DNA, 19 bp, Homo sapiens
tattgttgacaactgtgac

SEQ ID NO: 4074116 - DNA, 14 bp, Homo sapiens
tattgtttatgtaa

SEQ ID NO: 4074117 - DNA, 18 bp, Homo sapiens
tattgttttcagtgtaca

SEQ ID NO: 4074118 - DNA, 14 bp, Homo sapiens
tattgttttctgta

SEQ ID NO: 4074119 - DNA, 18 bp, Homo sapiens
tattgttttctgtaaata

SEQ ID NO: 4074120 - DNA, 15 bp, Homo sapiens
tatttaaaaatattt

SEQ ID NO: 4074121 - DNA, 17 bp, Homo sapiens
tatttaaaaatatttca

SEQ ID NO: 4074122 - DNA, 19 bp, Homo sapiens
tatttaaaaatatttcaga

SEQ ID NO: 4074123 - DNA, 20 bp, Homo sapiens
tatttaaaattccattatct

SEQ ID NO: 4074124 - DNA, 20 bp, Homo sapiens
tatttaaacctttttcttga

SEQ ID NO: 4074125 - DNA, 15 bp, Homo sapiens
tatttaaactatctt

SEQ ID NO: 4074126 - DNA, 24 bp, Homo sapiens
tatttaaactctgttgcaagtgca

SEQ ID NO: 4074127 - DNA, 15 bp, Homo sapiens
tatttaaataaaatc

SEQ ID NO: 4074128 - DNA, 21 bp, Homo sapiens
tatttaacagctgaattatct

SEQ ID NO: 4074129 - DNA, 23 bp, Homo sapiens
tatttaacagctgaattatctat

SEQ ID NO: 4074130 - DNA, 15 bp, Homo sapiens
tatttaacattattt

SEQ ID NO: 4074131 - DNA, 22 bp, Homo sapiens
tatttaagaaaagcacttttgt

SEQ ID NO: 4074132 - DNA, 21 bp, Homo sapiens
tatttaagaaaatacaataaa

SEQ ID NO: 4074133 - DNA, 17 bp, Homo sapiens
tatttaagataattata

SEQ ID NO: 4074134 - DNA, 20 bp, Homo sapiens
tatttaagataattataata

SEQ ID NO: 4074135 - DNA, 17 bp, Homo sapiens
tatttaagcaacatctt

SEQ ID NO: 4074136 - DNA, 18 bp, Homo sapiens
tatttaagcaacatcttt

SEQ ID NO: 4074137 - DNA, 20 bp, Homo sapiens
tatttaagcaacatcttttt

SEQ ID NO: 4074138 - DNA, 21 bp, Homo sapiens
tatttaagcaacatcttttta

SEQ ID NO: 4074139 - DNA, 20 bp, Homo sapiens
tatttaagcctcatatttaa

SEQ ID NO: 4074140 - DNA, 21 bp, Homo sapiens
tatttaagcctcatatttaaa

SEQ ID NO: 4074141 - DNA, 18 bp, Homo sapiens
tatttaaggtagcttcag

SEQ ID NO: 4074142 - DNA, 11 bp, Homo sapiens
tatttaataac

SEQ ID NO: 4074143 - DNA, 21 bp, Homo sapiens
tatttaatgaaagactgtaca

SEQ ID NO: 4074144 - DNA, 13 bp, Homo sapiens
tatttacaataaa

SEQ ID NO: 4074145 - DNA, 16 bp, Homo sapiens
tatttacaataaatga

SEQ ID NO: 4074146 - DNA, 15 bp, Homo sapiens
tatttacccttttcc

SEQ ID NO: 4074147 - DNA, 21 bp, Homo sapiens
tatttaccgttgcttgaaatt

SEQ ID NO: 4074148 - DNA, 19 bp, Homo sapiens
tatttacgctttgattcat

SEQ ID NO: 4074149 - DNA, 14 bp, Homo sapiens
tatttactacctta

SEQ ID NO: 4074150 - DNA, 19 bp, Homo sapiens
tatttactgagcttctctg

SEQ ID NO: 4074151 - DNA, 19 bp, Homo sapiens
tatttacttctaatcttaa

SEQ ID NO: 4074152 - DNA, 18 bp, Homo sapiens
tatttacttcttatacat

SEQ ID NO: 4074153 - DNA, 23 bp, Homo sapiens
tatttactttttcggtttcaaag

SEQ ID NO: 4074154 - DNA, 13 bp, Homo sapiens
tatttagacaaga

SEQ ID NO: 4074155 - DNA, 15 bp, Homo sapiens
tatttagacaagaga

SEQ ID NO: 4074156 - DNA, 20 bp, Homo sapiens
tatttataactcatcataaa

SEQ ID NO: 4074157 - DNA, 23 bp, Homo sapiens
tatttataactcatcataaaata

SEQ ID NO: 4074158 - DNA, 14 bp, Homo sapiens
tatttataagcaga

SEQ ID NO: 4074159 - DNA, 17 bp, Homo sapiens
tatttataagcagattt

SEQ ID NO: 4074160 - DNA, 15 bp, Homo sapiens
tatttataattccta

SEQ ID NO: 4074161 - DNA, 19 bp, Homo sapiens
tatttatacccccaggaaa

SEQ ID NO: 4074162 - DNA, 23 bp, Homo sapiens
tatttatatatgtatttataaat

SEQ ID NO: 4074163 - DNA, 15 bp, Homo sapiens
tatttatatttcact

SEQ ID NO: 4074164 - DNA, 14 bp, Homo sapiens
tatttatcaaaatg

SEQ ID NO: 4074165 - DNA, 15 bp, Homo sapiens
tatttatcagtgaca

SEQ ID NO: 4074166 - DNA, 15 bp, Homo sapiens
tatttatctgattaa

SEQ ID NO: 4074167 - DNA, 18 bp, Homo sapiens
tcacacacacagctgggc

SEQ ID NO: 4074168 - DNA, 15 bp, Homo sapiens
tcacacaccctgagg

SEQ ID NO: 4074169 - DNA, 16 bp, Homo sapiens
tcacacaccctgaggt

SEQ ID NO: 4074170 - DNA, 17 bp, Homo sapiens
tcacacattcccccacc

SEQ ID NO: 4074171 - DNA, 21 bp, Homo sapiens
tcacaccattcattctggtca

SEQ ID NO: 4074172 - DNA, 14 bp, Homo sapiens
tcacacccactccc

SEQ ID NO: 4074173 - DNA, 12 bp, Homo sapiens
tcacaccccagg

SEQ ID NO: 4074174 - DNA, 13 bp, Homo sapiens
tcacacccctgtc

SEQ ID NO: 4074175 - DNA, 15 bp, Homo sapiens
tcacacccctgtccc

SEQ ID NO: 4074176 - DNA, 19 bp, Homo sapiens
tcacacctgtaatcccaac

SEQ ID NO: 4074177 - DNA, 16 bp, Homo sapiens
tcacacgaccggggcc

SEQ ID NO: 4074178 - DNA, 18 bp, Homo sapiens
tcacacggccacccgccc

SEQ ID NO: 4074179 - DNA, 22 bp, Homo sapiens
tcacactccagtggcagacaaa

SEQ ID NO: 4074180 - DNA, 13 bp, Homo sapiens
tcacactctgggt

SEQ ID NO: 4074181 - DNA, 18 bp, Homo sapiens
tcacactggtctgctgtc

SEQ ID NO: 4074182 - DNA, 18 bp, Homo sapiens
tcacactgttactccaca

SEQ ID NO: 4074183 - DNA, 13 bp, Homo sapiens
tcacactttttat

SEQ ID NO: 4074184 - DNA, 16 bp, Homo sapiens
tcacagaaatcagagg

SEQ ID NO: 4074185 - DNA, 22 bp, Homo sapiens
tcacagattgaggtaataatga

SEQ ID NO: 4074186 - DNA, 17 bp, Homo sapiens
tcacagcctccagggcc

SEQ ID NO: 4074187 - DNA, 13 bp, Homo sapiens
tcacagcctcctc

SEQ ID NO: 4074188 - DNA, 20 bp, Homo sapiens
tcacagcctcctctgtctgc

SEQ ID NO: 4074189 - DNA, 16 bp, Homo sapiens
tcacagctcctcccac

SEQ ID NO: 4074190 - DNA, 15 bp, Homo sapiens
tcacagctggatctg

SEQ ID NO: 4074191 - DNA, 18 bp, Homo sapiens
tcacagctggatctgctt

SEQ ID NO: 4074192 - DNA, 24 bp, Homo sapiens
tcacagggttgggcccagatctgg

SEQ ID NO: 4074193 - DNA, 11 bp, Homo sapiens
tcacagtatta

SEQ ID NO: 4074194 - DNA, 23 bp, Homo sapiens
tcacagtctctttaatcttcagt

SEQ ID NO: 4074195 - DNA, 14 bp, Homo sapiens
tcacagtgctgtgt

SEQ ID NO: 4074196 - DNA, 22 bp, Homo sapiens
tcacagtgtttgcaatggtgtt

SEQ ID NO: 4074197 - DNA, 20 bp, Homo sapiens
tcacagttctttgggccaga

SEQ ID NO: 4074198 - DNA, 15 bp, Homo sapiens
tcacatcccacccca

SEQ ID NO: 4074199 - DNA, 13 bp, Homo sapiens
tcacatccctcta

SEQ ID NO: 4074200 - DNA, 23 bp, Homo sapiens
tcacatgagctatttccattcca

SEQ ID NO: 4074201 - DNA, 19 bp, Homo sapiens
tcacatgtggcaaaatatg

SEQ ID NO: 4074202 - DNA, 15 bp, Homo sapiens
tcacattagaattag

SEQ ID NO: 4074203 - DNA, 23 bp, Homo sapiens
tcacattgaccgcaactcacaca

SEQ ID NO: 4074204 - DNA, 21 bp, Homo sapiens
tcacattgagctgatataaat

SEQ ID NO: 4074205 - DNA, 17 bp, Homo sapiens
tcacattgcattctatt

SEQ ID NO: 4074206 - DNA, 18 bp, Homo sapiens
tcacattgtttgctgcta

SEQ ID NO: 4074207 - DNA, 19 bp, Homo sapiens
tcaccaaatcagctgctac

SEQ ID NO: 4074208 - DNA, 12 bp, Homo sapiens
tcaccaaggaaa

SEQ ID NO: 4074209 - DNA, 13 bp, Homo sapiens
tcaccaaggaaac

SEQ ID NO: 4074210 - DNA, 22 bp, Homo sapiens
tcaccaaggatcggactctgcc

SEQ ID NO: 4074211 - DNA, 18 bp, Homo sapiens
tcaccacgactggccagg

SEQ ID NO: 4074212 - DNA, 19 bp, Homo sapiens
tcaccagcccggcctgctc

SEQ ID NO: 4074213 - DNA, 11 bp, Homo sapiens
tcaccagccct

SEQ ID NO: 4074214 - DNA, 15 bp, Homo sapiens
tcaccagccctgcag

SEQ ID NO: 4074215 - DNA, 16 bp, Homo sapiens
tcaccagccctgcagc

SEQ ID NO: 4074216 - DNA, 18 bp, Homo sapiens
tcaccagccctgcagccc

SEQ ID NO: 4074217 - DNA, 17 bp, Homo sapiens
tcaccagctatctgtca

SEQ ID NO: 4074218 - DNA, 16 bp, Homo sapiens
tcaccaggtgcatgca

SEQ ID NO: 4074219 - DNA, 17 bp, Homo sapiens
tcaccaggtgcatgcat

SEQ ID NO: 4074220 - DNA, 17 bp, Homo sapiens
tcaccagtgtcccctcc

SEQ ID NO: 4074221 - DNA, 20 bp, Homo sapiens
tcaccagtgtcccctccact

SEQ ID NO: 4074222 - DNA, 14 bp, Homo sapiens
tcaccataacctct

SEQ ID NO: 4074223 - DNA, 21 bp, Homo sapiens
tcaccatgtaagcactctgga

SEQ ID NO: 4074224 - DNA, 19 bp, Homo sapiens
tcacccaagcaaggccaaa

SEQ ID NO: 4074225 - DNA, 14 bp, Homo sapiens
tcacccacccctgc

SEQ ID NO: 4074226 - DNA, 17 bp, Homo sapiens
tcacccagctaatctgt

SEQ ID NO: 4074227 - DNA, 13 bp, Homo sapiens
tcacccataaaca

SEQ ID NO: 4074228 - DNA, 15 bp, Homo sapiens
tcacccattatctgg

SEQ ID NO: 4074229 - DNA, 13 bp, Homo sapiens
tcaccccaccctt

SEQ ID NO: 4074230 - DNA, 13 bp, Homo sapiens
tcaccccccactc

SEQ ID NO: 4074231 - DNA, 14 bp, Homo sapiens
tcaccccccactca

SEQ ID NO: 4074232 - DNA, 14 bp, Homo sapiens
tcaccccctgagat

SEQ ID NO: 4074233 - DNA, 13 bp, Homo sapiens
tcacccctgggca

SEQ ID NO: 4074234 - DNA, 14 bp, Homo sapiens
tcacccctgggcag

SEQ ID NO: 4074235 - DNA, 16 bp, Homo sapiens
tcacccggtgacctct

SEQ ID NO: 4074236 - DNA, 13 bp, Homo sapiens
tcaccctccacct

SEQ ID NO: 4074237 - DNA, 15 bp, Homo sapiens
tcaccctgccttatc

SEQ ID NO: 4074238 - DNA, 13 bp, Homo sapiens
tcaccctttgctg

SEQ ID NO: 4074239 - DNA, 17 bp, Homo sapiens
tcaccgacgcgtctcct

SEQ ID NO: 4074240 - DNA, 15 bp, Homo sapiens
tcaccgcccatcagg

SEQ ID NO: 4074241 - DNA, 23 bp, Homo sapiens
tcacctactcaatgcctggagac

SEQ ID NO: 4074242 - DNA, 16 bp, Homo sapiens
tcacctatgttatttt

SEQ ID NO: 4074243 - DNA, 20 bp, Homo sapiens
tcacctatttccattcaaca

SEQ ID NO: 4074244 - DNA, 24 bp, Homo sapiens
tcacctccccacatcgcacactgg

SEQ ID NO: 4074245 - DNA, 12 bp, Homo sapiens
tcacctctatcc

SEQ ID NO: 4074246 - DNA, 14 bp, Homo sapiens
tcacctctctcaga

SEQ ID NO: 4074247 - DNA, 20 bp, Homo sapiens
tcacctctctcagagcatct

SEQ ID NO: 4074248 - DNA, 18 bp, Homo sapiens
tcacctctggactggcta

SEQ ID NO: 4074249 - DNA, 21 bp, Homo sapiens
tcacctgagcccggatgcttc

SEQ ID NO: 4074250 - DNA, 16 bp, Homo sapiens
tcacctgccccaactc

SEQ ID NO: 4074251 - DNA, 12 bp, Homo sapiens
tcacctgctcca

SEQ ID NO: 4074252 - DNA, 16 bp, Homo sapiens
tcacctgctccagaag

SEQ ID NO: 4074253 - DNA, 21 bp, Homo sapiens
tcacctgctccagaagatgcc

SEQ ID NO: 4074254 - DNA, 15 bp, Homo sapiens
tcacctgcttctctg

SEQ ID NO: 4074255 - DNA, 22 bp, Homo sapiens
tcacctgcttctctgcccagct

SEQ ID NO: 4074256 - DNA, 15 bp, Homo sapiens
tcacctgttatgtat

SEQ ID NO: 4074257 - DNA, 19 bp, Homo sapiens
tcacctgtttttaagctgt

SEQ ID NO: 4074258 - DNA, 13 bp, Homo sapiens
tcaccttcctgtg

SEQ ID NO: 4074259 - DNA, 20 bp, Homo sapiens
tcaccttctagtcttggcca

SEQ ID NO: 4074260 - DNA, 19 bp, Homo sapiens
tcaccttggcaccagacac

SEQ ID NO: 4074261 - DNA, 18 bp, Homo sapiens
tcaccttttctgtggctg

SEQ ID NO: 4074262 - DNA, 16 bp, Homo sapiens
tcacgacgctgcagag

SEQ ID NO: 4074263 - DNA, 19 bp, Homo sapiens
tcacgcctgtaatcccagc

SEQ ID NO: 4074264 - DNA, 14 bp, Homo sapiens
tcacgctcacccag

SEQ ID NO: 4074265 - DNA, 20 bp, Homo sapiens
tcacgggcatgggcactccc

SEQ ID NO: 4074266 - DNA, 13 bp, Homo sapiens
tcacgtaccccac

SEQ ID NO: 4074267 - DNA, 20 bp, Homo sapiens
tcactaaaccgataatgcat

SEQ ID NO: 4074268 - DNA, 18 bp, Homo sapiens
tcactacaagtcagctcc

SEQ ID NO: 4074269 - DNA, 20 bp, Homo sapiens
tcactaccctattctctctt

SEQ ID NO: 4074270 - DNA, 13 bp, Homo sapiens
tcagtcacagcca

SEQ ID NO: 4074271 - DNA, 15 bp, Homo sapiens
tcagtcagaaaactt

SEQ ID NO: 4074272 - DNA, 20 bp, Homo sapiens
tcagtcagaaaactttaaaa

SEQ ID NO: 4074273 - DNA, 14 bp, Homo sapiens
tcagtcatgcataa

SEQ ID NO: 4074274 - DNA, 16 bp, Homo sapiens
tcagtcatgcataaat

SEQ ID NO: 4074275 - DNA, 20 bp, Homo sapiens
tcagtcatgcataaatatgc

SEQ ID NO: 4074276 - DNA, 19 bp, Homo sapiens
tcagtccagaagaattgac

SEQ ID NO: 4074277 - DNA, 16 bp, Homo sapiens
tcagtccatttatata

SEQ ID NO: 4074278 - DNA, 16 bp, Homo sapiens
tcagtccccctgtgca

SEQ ID NO: 4074279 - DNA, 19 bp, Homo sapiens
tcagtctggtgggaggacg

SEQ ID NO: 4074280 - DNA, 22 bp, Homo sapiens
tcagtgaaaagattttatttat

SEQ ID NO: 4074281 - DNA, 11 bp, Homo sapiens
tcagtgacaga

SEQ ID NO: 4074282 - DNA, 19 bp, Homo sapiens
tcagtgacagagttcacta

SEQ ID NO: 4074283 - DNA, 23 bp, Homo sapiens
tcagtgccccgtctacagctccc

SEQ ID NO: 4074284 - DNA, 12 bp, Homo sapiens
tcagtggcttcc

SEQ ID NO: 4074285 - DNA, 14 bp, Homo sapiens
tcagtgtagttaat

SEQ ID NO: 4074286 - DNA, 18 bp, Homo sapiens
tcagtgtagttaatttat

SEQ ID NO: 4074287 - DNA, 19 bp, Homo sapiens
tcagtgtcctcttgctcaa

SEQ ID NO: 4074288 - DNA, 14 bp, Homo sapiens
tcagtgtctggctt

SEQ ID NO: 4074289 - DNA, 16 bp, Homo sapiens
tcagtgttagagaaat

SEQ ID NO: 4074290 - DNA, 20 bp, Homo sapiens
tcagtgttccctttcctact

SEQ ID NO: 4074291 - DNA, 16 bp, Homo sapiens
tcagtgttttggactc

SEQ ID NO: 4074292 - DNA, 18 bp, Homo sapiens
tcagttacccactcggtc

SEQ ID NO: 4074293 - DNA, 23 bp, Homo sapiens
tcagttattgtccctggcttcct

SEQ ID NO: 4074294 - DNA, 22 bp, Homo sapiens
tcagttcccttggcctcagaat

SEQ ID NO: 4074295 - DNA, 23 bp, Homo sapiens
tcagttgagcttcatataccagc

SEQ ID NO: 4074296 - DNA, 18 bp, Homo sapiens
tcagttggttgtgtcttt

SEQ ID NO: 4074297 - DNA, 15 bp, Homo sapiens
tcagttgttcttttt

SEQ ID NO: 4074298 - DNA, 19 bp, Homo sapiens
tcagtttcataaaaggaga

SEQ ID NO: 4074299 - DNA, 23 bp, Homo sapiens
tcagttttcagctatacctgcac

SEQ ID NO: 4074300 - DNA, 13 bp, Homo sapiens
tcagttttcattt

SEQ ID NO: 4074301 - DNA, 17 bp, Homo sapiens
tcagtttttaaaatatt

SEQ ID NO: 4074302 - DNA, 20 bp, Homo sapiens
tcagttttttgttttacaat

SEQ ID NO: 4074303 - DNA, 20 bp, Homo sapiens
tcataaagggttgaaaatgt

SEQ ID NO: 4074304 - DNA, 16 bp, Homo sapiens
tcataaatttacttta

SEQ ID NO: 4074305 - DNA, 11 bp, Homo sapiens
tcataaccaac

SEQ ID NO: 4074306 - DNA, 15 bp, Homo sapiens
tcataaccaacaata

SEQ ID NO: 4074307 - DNA, 17 bp, Homo sapiens
tcataacttcctgtact

SEQ ID NO: 4074308 - DNA, 15 bp, Homo sapiens
tcataagaatttttc

SEQ ID NO: 4074309 - DNA, 20 bp, Homo sapiens
tcataataggtagtttggat

SEQ ID NO: 4074310 - DNA, 21 bp, Homo sapiens
tcataataggtagtttggata

SEQ ID NO: 4074311 - DNA, 22 bp, Homo sapiens
tcataattaaaatttatcttaa

SEQ ID NO: 4074312 - DNA, 20 bp, Homo sapiens
tcataattcctacagcacta

SEQ ID NO: 4074313 - DNA, 23 bp, Homo sapiens
tcataattcctacagcactactg

SEQ ID NO: 4074314 - DNA, 18 bp, Homo sapiens
tcatacctcagaatgtaa

SEQ ID NO: 4074315 - DNA, 21 bp, Homo sapiens
tcatactactgaaacagattt

SEQ ID NO: 4074316 - DNA, 20 bp, Homo sapiens
tcatagagatttgtctaatt

SEQ ID NO: 4074317 - DNA, 18 bp, Homo sapiens
tcatagctcactgcagcc

SEQ ID NO: 4074318 - DNA, 20 bp, Homo sapiens
tcatagctcactgcagcctc

SEQ ID NO: 4074319 - DNA, 20 bp, Homo sapiens
tcatagtactctttgtagca

SEQ ID NO: 4074320 - DNA, 14 bp, Homo sapiens
tcatagtagttttt

SEQ ID NO: 4074321 - DNA, 16 bp, Homo sapiens
tcatagtagtttttac

SEQ ID NO: 4074322 - DNA, 18 bp, Homo sapiens
tcatagtagtttttacag

SEQ ID NO: 4074323 - DNA, 18 bp, Homo sapiens
tcatagttatgtgatttt

SEQ ID NO: 4074324 - DNA, 22 bp, Homo sapiens
tcatagtttattattattaaag

SEQ ID NO: 4074325 - DNA, 15 bp, Homo sapiens
tcatataataaatgt

SEQ ID NO: 4074326 - DNA, 16 bp, Homo sapiens
tcatatccaagatcaa

SEQ ID NO: 4074327 - DNA, 21 bp, Homo sapiens
tcatatgtaccatgtacatga

SEQ ID NO: 4074328 - DNA, 15 bp, Homo sapiens
tcatatgttgctcag

SEQ ID NO: 4074329 - DNA, 16 bp, Homo sapiens
tcatattctgtctgga

SEQ ID NO: 4074330 - DNA, 14 bp, Homo sapiens
tcatattgatgaaa

SEQ ID NO: 4074331 - DNA, 16 bp, Homo sapiens
tcatattgatgaaaag

SEQ ID NO: 4074332 - DNA, 21 bp, Homo sapiens
tcatattggtatatccttttc

SEQ ID NO: 4074333 - DNA, 22 bp, Homo sapiens
tcatattggtatatccttttct

SEQ ID NO: 4074334 - DNA, 21 bp, Homo sapiens
tcatatttacttcttatacat

SEQ ID NO: 4074335 - DNA, 23 bp, Homo sapiens
tcatatttacttcttatacattt

SEQ ID NO: 4074336 - DNA, 17 bp, Homo sapiens
tcatcaaagaacaaaca

SEQ ID NO: 4074337 - DNA, 22 bp, Homo sapiens
tcatcaatatccctcttgtaag

SEQ ID NO: 4074338 - DNA, 13 bp, Homo sapiens
tcatcaatcaaat

SEQ ID NO: 4074339 - DNA, 15 bp, Homo sapiens
tcatcacagggattt

SEQ ID NO: 4074340 - DNA, 23 bp, Homo sapiens
tcatcacatttctatgccaaaca

SEQ ID NO: 4074341 - DNA, 15 bp, Homo sapiens
tcatcagaagataac

SEQ ID NO: 4074342 - DNA, 12 bp, Homo sapiens
tcatcagcattt

SEQ ID NO: 4074343 - DNA, 13 bp, Homo sapiens
tcatcaggatgaa

SEQ ID NO: 4074344 - DNA, 14 bp, Homo sapiens
tcatcaggatgaac

SEQ ID NO: 4074345 - DNA, 14 bp, Homo sapiens
tcatcagggcctgg

SEQ ID NO: 4074346 - DNA, 14 bp, Homo sapiens
tcatcatcagggcc

SEQ ID NO: 4074347 - DNA, 16 bp, Homo sapiens
tcatcatcagggcctg

SEQ ID NO: 4074348 - DNA, 14 bp, Homo sapiens
tcatcatcctaagc

SEQ ID NO: 4074349 - DNA, 14 bp, Homo sapiens
tcatcattccctct

SEQ ID NO: 4074350 - DNA, 13 bp, Homo sapiens
tcatccaaaatat

SEQ ID NO: 4074351 - DNA, 20 bp, Homo sapiens
tcatccaaaatattttttgc

SEQ ID NO: 4074352 - DNA, 20 bp, Homo sapiens
tcatccaacaagaagaaata

SEQ ID NO: 4074353 - DNA, 16 bp, Homo sapiens
tcatccaccccatccc

SEQ ID NO: 4074354 - DNA, 15 bp, Homo sapiens
tcatccagagttctt

SEQ ID NO: 4074355 - DNA, 16 bp, Homo sapiens
tcatccagagttctta

SEQ ID NO: 4074356 - DNA, 14 bp, Homo sapiens
tcatccagcagtgt

SEQ ID NO: 4074357 - DNA, 22 bp, Homo sapiens
tcatccagtttgttctccgggt

SEQ ID NO: 4074358 - DNA, 12 bp, Homo sapiens
tcatccccaggg

SEQ ID NO: 4074359 - DNA, 20 bp, Homo sapiens
tcatccccaggggtcccagc

SEQ ID NO: 4074360 - DNA, 17 bp, Homo sapiens
tcatccccatcctccag

SEQ ID NO: 4074361 - DNA, 21 bp, Homo sapiens
tcatccctatgggattcagtg

SEQ ID NO: 4074362 - DNA, 21 bp, Homo sapiens
tcatcccttctcttccaggca

SEQ ID NO: 4074363 - DNA, 23 bp, Homo sapiens
tcatcccttctcttccaggcagc

SEQ ID NO: 4074364 - DNA, 17 bp, Homo sapiens
tcatcctgactctgccc

SEQ ID NO: 4074365 - DNA, 20 bp, Homo sapiens
tcatcctttcacttctttcc

SEQ ID NO: 4074366 - DNA, 23 bp, Homo sapiens
tcatcctttcacttctttccctt

SEQ ID NO: 4074367 - DNA, 19 bp, Homo sapiens
tcatcggaggctgggcccc

SEQ ID NO: 4074368 - DNA, 13 bp, Homo sapiens
tcatctacttttt

SEQ ID NO: 4074369 - DNA, 23 bp, Homo sapiens
tcatctataaagaagaacttgca

SEQ ID NO: 4074370 - DNA, 17 bp, Homo sapiens
tcatctatgaggaaagg

SEQ ID NO: 4074371 - DNA, 15 bp, Homo sapiens
tcatctattcaagca

SEQ ID NO: 4074372 - DNA, 14 bp, Homo sapiens
tccagcctgaagag

SEQ ID NO: 4074373 - DNA, 19 bp, Homo sapiens
tccagcctgggcagccagg

SEQ ID NO: 4074374 - DNA, 22 bp, Homo sapiens
tccagcctgggcagccaggctg

SEQ ID NO: 4074375 - DNA, 19 bp, Homo sapiens
tccagctccaacctgcaaa

SEQ ID NO: 4074376 - DNA, 10 bp, Homo sapiens
tccagctctt

SEQ ID NO: 4074377 - DNA, 16 bp, Homo sapiens
tccagctgcaccagag

SEQ ID NO: 4074378 - DNA, 12 bp, Homo sapiens
tccagctgcccc

SEQ ID NO: 4074379 - DNA, 17 bp, Homo sapiens
tccagctgcctgggccc

SEQ ID NO: 4074380 - DNA, 18 bp, Homo sapiens
tccagctggggccagagg

SEQ ID NO: 4074381 - DNA, 21 bp, Homo sapiens
tccagctggggccagaggctg

SEQ ID NO: 4074382 - DNA, 15 bp, Homo sapiens
tccagctgtgcagca

SEQ ID NO: 4074383 - DNA, 20 bp, Homo sapiens
tccagcttcaggcaccagca

SEQ ID NO: 4074384 - DNA, 22 bp, Homo sapiens
tccagcttcaggcaccagcatc

SEQ ID NO: 4074385 - DNA, 15 bp, Homo sapiens
tccaggaaagagcag

SEQ ID NO: 4074386 - DNA, 18 bp, Homo sapiens
tccaggaagaagcagggg

SEQ ID NO: 4074387 - DNA, 23 bp, Homo sapiens
tccaggacaccacgattctccca

SEQ ID NO: 4074388 - DNA, 23 bp, Homo sapiens
tccaggactatatttgggcctgc

SEQ ID NO: 4074389 - DNA, 23 bp, Homo sapiens
tccaggagcttcttgtttccttg

SEQ ID NO: 4074390 - DNA, 18 bp, Homo sapiens
tccaggagggaccaccct

SEQ ID NO: 4074391 - DNA, 20 bp, Homo sapiens
tccaggagggaccaccctcc

SEQ ID NO: 4074392 - DNA, 22 bp, Homo sapiens
tccaggatgctaacatctaaaa

SEQ ID NO: 4074393 - DNA, 22 bp, Homo sapiens
tccaggcaccctcagggagcct

SEQ ID NO: 4074394 - DNA, 20 bp, Homo sapiens
tccaggcagatccaggacta

SEQ ID NO: 4074395 - DNA, 21 bp, Homo sapiens
tccaggcagatccaggactat

SEQ ID NO: 4074396 - DNA, 18 bp, Homo sapiens
tccaggcccaaggctccc

SEQ ID NO: 4074397 - DNA, 20 bp, Homo sapiens
tccaggcccaaggctcccgg

SEQ ID NO: 4074398 - DNA, 16 bp, Homo sapiens
tccagggaagctggcc

SEQ ID NO: 4074399 - DNA, 19 bp, Homo sapiens
tccagggacagaggcccca

SEQ ID NO: 4074400 - DNA, 17 bp, Homo sapiens
tccagggctcaacactg

SEQ ID NO: 4074401 - DNA, 20 bp, Homo sapiens
tccagggctcaacactgtga

SEQ ID NO: 4074402 - DNA, 11 bp, Homo sapiens
tccagggctcc

SEQ ID NO: 4074403 - DNA, 15 bp, Homo sapiens
tccagggctcccgga

SEQ ID NO: 4074404 - DNA, 17 bp, Homo sapiens
tccagggtgtgtgctcg

SEQ ID NO: 4074405 - DNA, 16 bp, Homo sapiens
tccaggtatctccagg

SEQ ID NO: 4074406 - DNA, 18 bp, Homo sapiens
tccaggtatctccaggat

SEQ ID NO: 4074407 - DNA, 18 bp, Homo sapiens
tccaggtgctcattgtaa

SEQ ID NO: 4074408 - DNA, 14 bp, Homo sapiens
tccagtaaaataat

SEQ ID NO: 4074409 - DNA, 17 bp, Homo sapiens
tccagtacctttgtcac

SEQ ID NO: 4074410 - DNA, 13 bp, Homo sapiens
tccagtattgctg

SEQ ID NO: 4074411 - DNA, 15 bp, Homo sapiens
tccagtattgctgat

SEQ ID NO: 4074412 - DNA, 14 bp, Homo sapiens
tccagtccccagaa

SEQ ID NO: 4074413 - DNA, 16 bp, Homo sapiens
tccagtccccagaact

SEQ ID NO: 4074414 - DNA, 14 bp, Homo sapiens
tccagtgctctgcc

SEQ ID NO: 4074415 - DNA, 18 bp, Homo sapiens
tccagtgctctgcctcag

SEQ ID NO: 4074416 - DNA, 17 bp, Homo sapiens
tccagtggatcataaga

SEQ ID NO: 4074417 - DNA, 13 bp, Homo sapiens
tccagtggttctg

SEQ ID NO: 4074418 - DNA, 17 bp, Homo sapiens
tccagtgtccttagaac

SEQ ID NO: 4074419 - DNA, 18 bp, Homo sapiens
tccagtgtccttagaaca

SEQ ID NO: 4074420 - DNA, 23 bp, Homo sapiens
tccagtgtctataaaagaaacac

SEQ ID NO: 4074421 - DNA, 16 bp, Homo sapiens
tccagtgtctcggagg

SEQ ID NO: 4074422 - DNA, 21 bp, Homo sapiens
tccagttcatcgattttctat

SEQ ID NO: 4074423 - DNA, 16 bp, Homo sapiens
tccagttgggactcag

SEQ ID NO: 4074424 - DNA, 15 bp, Homo sapiens
tccagtttattccag

SEQ ID NO: 4074425 - DNA, 17 bp, Homo sapiens
tccagtttgcacctgtc

SEQ ID NO: 4074426 - DNA, 19 bp, Homo sapiens
tccagtttgcacctgtccc

SEQ ID NO: 4074427 - DNA, 20 bp, Homo sapiens
tccagttttttgttatatag

SEQ ID NO: 4074428 - DNA, 22 bp, Homo sapiens
tccataatgcattcttctctgt

SEQ ID NO: 4074429 - DNA, 20 bp, Homo sapiens
tccataatgtataaagaaca

SEQ ID NO: 4074430 - DNA, 13 bp, Homo sapiens
tccatacagctct

SEQ ID NO: 4074431 - DNA, 14 bp, Homo sapiens
tccatacagctcta

SEQ ID NO: 4074432 - DNA, 22 bp, Homo sapiens
tccataccagctcgcacccccc

SEQ ID NO: 4074433 - DNA, 14 bp, Homo sapiens
tccataccttttct

SEQ ID NO: 4074434 - DNA, 20 bp, Homo sapiens
tccataccttttctcttttc

SEQ ID NO: 4074435 - DNA, 13 bp, Homo sapiens
tccatactcagga

SEQ ID NO: 4074436 - DNA, 15 bp, Homo sapiens
tccatagcaacagga

SEQ ID NO: 4074437 - DNA, 16 bp, Homo sapiens
tccatagcaacaggaa

SEQ ID NO: 4074438 - DNA, 22 bp, Homo sapiens
tccatagcctaatccctgggca

SEQ ID NO: 4074439 - DNA, 13 bp, Homo sapiens
tccatatggattt

SEQ ID NO: 4074440 - DNA, 13 bp, Homo sapiens
tccatatttacat

SEQ ID NO: 4074441 - DNA, 20 bp, Homo sapiens
tccatatttacattctagtt

SEQ ID NO: 4074442 - DNA, 14 bp, Homo sapiens
tccatatttattca

SEQ ID NO: 4074443 - DNA, 14 bp, Homo sapiens
tccatatttggaag

SEQ ID NO: 4074444 - DNA, 15 bp, Homo sapiens
tccatatttggaaga

SEQ ID NO: 4074445 - DNA, 22 bp, Homo sapiens
tccatcaactcccaacttcttc

SEQ ID NO: 4074446 - DNA, 13 bp, Homo sapiens
tccatcaataaat

SEQ ID NO: 4074447 - DNA, 12 bp, Homo sapiens
tccatccatcct

SEQ ID NO: 4074448 - DNA, 21 bp, Homo sapiens
tccatccattacctccatcca

SEQ ID NO: 4074449 - DNA, 14 bp, Homo sapiens
tccatcccatcatc

SEQ ID NO: 4074450 - DNA, 14 bp, Homo sapiens
tccatccctacccc

SEQ ID NO: 4074451 - DNA, 18 bp, Homo sapiens
tccatccctccattcatc

SEQ ID NO: 4074452 - DNA, 19 bp, Homo sapiens
tccatctcctgctcaccac

SEQ ID NO: 4074453 - DNA, 22 bp, Homo sapiens
tccatctcctgctcaccacctg

SEQ ID NO: 4074454 - DNA, 24 bp, Homo sapiens
tccatctgggcttatatgtacttt

SEQ ID NO: 4074455 - DNA, 18 bp, Homo sapiens
tccatgaaaacgttttat

SEQ ID NO: 4074456 - DNA, 21 bp, Homo sapiens
tccatgaaaacgttttattgt

SEQ ID NO: 4074457 - DNA, 21 bp, Homo sapiens
tccatgaagagcttgtgtcct

SEQ ID NO: 4074458 - DNA, 22 bp, Homo sapiens
tccatgaagagcttgtgtcctg

SEQ ID NO: 4074459 - DNA, 15 bp, Homo sapiens
tccatgagcacccca

SEQ ID NO: 4074460 - DNA, 19 bp, Homo sapiens
tccatgagcaccccaaggc

SEQ ID NO: 4074461 - DNA, 10 bp, Homo sapiens
tccatgccca

SEQ ID NO: 4074462 - DNA, 12 bp, Homo sapiens
tccatgcccact

SEQ ID NO: 4074463 - DNA, 18 bp, Homo sapiens
tccatgcccactgctggt

SEQ ID NO: 4074464 - DNA, 21 bp, Homo sapiens
tccatgcccactgctggtgcc

SEQ ID NO: 4074465 - DNA, 14 bp, Homo sapiens
tccatgcctgaggg

SEQ ID NO: 4074466 - DNA, 17 bp, Homo sapiens
tccatggccctgtccca

SEQ ID NO: 4074467 - DNA, 19 bp, Homo sapiens
tccatggccctgtcccagg

SEQ ID NO: 4074468 - DNA, 14 bp, Homo sapiens
tccatggcctttct

SEQ ID NO: 4074469 - DNA, 15 bp, Homo sapiens
tccatggcctttcta

SEQ ID NO: 4074470 - DNA, 23 bp, Homo sapiens
tccatggcgaaaacatctcctta

SEQ ID NO: 4074471 - DNA, 14 bp, Homo sapiens
tccatgggagccag

SEQ ID NO: 4074472 - DNA, 17 bp, Homo sapiens
tccatgtacttgtttgc

SEQ ID NO: 4074473 - DNA, 12 bp, Homo sapiens
tccatgtgcctt

SEQ ID NO: 4074474 - DNA, 19 bp, Homo sapiens
tccatgtgcctttctttgc

SEQ ID NO: 4074475 - DNA, 16 bp, Homo sapiens
tccctgggcccctcca

SEQ ID NO: 4074476 - DNA, 20 bp, Homo sapiens
tccctgggcccctccacgcc

SEQ ID NO: 4074477 - DNA, 22 bp, Homo sapiens
tccctgggctgccaccagcccc

SEQ ID NO: 4074478 - DNA, 20 bp, Homo sapiens
tccctggggctagggggagc

SEQ ID NO: 4074479 - DNA, 22 bp, Homo sapiens
tccctgggggccttgggtgagt

SEQ ID NO: 4074480 - DNA, 13 bp, Homo sapiens
tccctggtccctt

SEQ ID NO: 4074481 - DNA, 14 bp, Homo sapiens
tccctggtcccttg

SEQ ID NO: 4074482 - DNA, 19 bp, Homo sapiens
tccctgtatcaccccctcc

SEQ ID NO: 4074483 - DNA, 11 bp, Homo sapiens
tccctgtcctc

SEQ ID NO: 4074484 - DNA, 13 bp, Homo sapiens
tccctgtctccag

SEQ ID NO: 4074485 - DNA, 15 bp, Homo sapiens
tccctgtctccagct

SEQ ID NO: 4074486 - DNA, 16 bp, Homo sapiens
tccctgtctccagctg

SEQ ID NO: 4074487 - DNA, 21 bp, Homo sapiens
tccctgtctccagctgcctgg

SEQ ID NO: 4074488 - DNA, 22 bp, Homo sapiens
tccctgtctccagctgcctggg

SEQ ID NO: 4074489 - DNA, 23 bp, Homo sapiens
tccctgtctccagctgcctgggc

SEQ ID NO: 4074490 - DNA, 16 bp, Homo sapiens
tccctgtgggggtggc

SEQ ID NO: 4074491 - DNA, 20 bp, Homo sapiens
tccctgtgggggtggccatc

SEQ ID NO: 4074492 - DNA, 17 bp, Homo sapiens
tccctgtgtcatttcaa

SEQ ID NO: 4074493 - DNA, 20 bp, Homo sapiens
tccctgtgtccacctgtggg

SEQ ID NO: 4074494 - DNA, 19 bp, Homo sapiens
tccctgtgtgtaggctggg

SEQ ID NO: 4074495 - DNA, 17 bp, Homo sapiens
tccctgtgttgtctcta

SEQ ID NO: 4074496 - DNA, 15 bp, Homo sapiens
tccctgttccccaga

SEQ ID NO: 4074497 - DNA, 18 bp, Homo sapiens
tccctgttccccagagaa

SEQ ID NO: 4074498 - DNA, 15 bp, Homo sapiens
tccctgttcttcctc

SEQ ID NO: 4074499 - DNA, 18 bp, Homo sapiens
tccctgttggtcggtggg

SEQ ID NO: 4074500 - DNA, 11 bp, Homo sapiens
tcccttcaacc

SEQ ID NO: 4074501 - DNA, 21 bp, Homo sapiens
tcccttcaaccattccccatg

SEQ ID NO: 4074502 - DNA, 14 bp, Homo sapiens
tcccttcagccccc

SEQ ID NO: 4074503 - DNA, 17 bp, Homo sapiens
tcccttcagcccccagc

SEQ ID NO: 4074504 - DNA, 19 bp, Homo sapiens
tcccttcagtaccctctca

SEQ ID NO: 4074505 - DNA, 20 bp, Homo sapiens
tcccttcccacatgcctgcg

SEQ ID NO: 4074506 - DNA, 20 bp, Homo sapiens
tcccttcccctccctggctc

SEQ ID NO: 4074507 - DNA, 17 bp, Homo sapiens
tcccttccttttccctg

SEQ ID NO: 4074508 - DNA, 14 bp, Homo sapiens
tcccttctcttcca

SEQ ID NO: 4074509 - DNA, 16 bp, Homo sapiens
tcccttctcttccagg

SEQ ID NO: 4074510 - DNA, 21 bp, Homo sapiens
tcccttctcttccaggcagcc

SEQ ID NO: 4074511 - DNA, 14 bp, Homo sapiens
tcccttgaccttaa

SEQ ID NO: 4074512 - DNA, 21 bp, Homo sapiens
tcccttgcaggggtcccccct

SEQ ID NO: 4074513 - DNA, 12 bp, Homo sapiens
tcccttgcctct

SEQ ID NO: 4074514 - DNA, 14 bp, Homo sapiens
tcccttgcctctgc

SEQ ID NO: 4074515 - DNA, 16 bp, Homo sapiens
tcccttgcctctgccc

SEQ ID NO: 4074516 - DNA, 22 bp, Homo sapiens
tcccttgcctctgccctggatt

SEQ ID NO: 4074517 - DNA, 21 bp, Homo sapiens
tcccttgcctttcgaggcctg

SEQ ID NO: 4074518 - DNA, 22 bp, Homo sapiens
tcccttgcctttcgaggcctga

SEQ ID NO: 4074519 - DNA, 17 bp, Homo sapiens
tcccttgctgaacacac

SEQ ID NO: 4074520 - DNA, 13 bp, Homo sapiens
tcccttggcctca

SEQ ID NO: 4074521 - DNA, 14 bp, Homo sapiens
tcccttggcctcag

SEQ ID NO: 4074522 - DNA, 16 bp, Homo sapiens
tcccttggcctcagaa

SEQ ID NO: 4074523 - DNA, 18 bp, Homo sapiens
tcccttgggctggaagaa

SEQ ID NO: 4074524 - DNA, 19 bp, Homo sapiens
tcccttggtggcaagagcc

SEQ ID NO: 4074525 - DNA, 15 bp, Homo sapiens
tccctttcccttggt

SEQ ID NO: 4074526 - DNA, 18 bp, Homo sapiens
tccctttccttccatccc

SEQ ID NO: 4074527 - DNA, 19 bp, Homo sapiens
tccctttccttccatccct

SEQ ID NO: 4074528 - DNA, 13 bp, Homo sapiens
tccctttctcagg

SEQ ID NO: 4074529 - DNA, 13 bp, Homo sapiens
tccctttcttggc

SEQ ID NO: 4074530 - DNA, 21 bp, Homo sapiens
tccctttcttggccagttatc

SEQ ID NO: 4074531 - DNA, 23 bp, Homo sapiens
tccctttgacttcagctgcctga

SEQ ID NO: 4074532 - DNA, 14 bp, Homo sapiens
tcccttttccctta

SEQ ID NO: 4074533 - DNA, 14 bp, Homo sapiens
tcccttttctgttc

SEQ ID NO: 4074534 - DNA, 20 bp, Homo sapiens
tccctttttatatcccattt

SEQ ID NO: 4074535 - DNA, 18 bp, Homo sapiens
tccgaagctacttctcca

SEQ ID NO: 4074536 - DNA, 21 bp, Homo sapiens
tccgaagtatgagggaaaatg

SEQ ID NO: 4074537 - DNA, 20 bp, Homo sapiens
tccgaccactaattgccaag

SEQ ID NO: 4074538 - DNA, 15 bp, Homo sapiens
tccgaccctcatggc

SEQ ID NO: 4074539 - DNA, 20 bp, Homo sapiens
tccgaccctcatggccccca

SEQ ID NO: 4074540 - DNA, 19 bp, Homo sapiens
tccgacctggcctgtctgt

SEQ ID NO: 4074541 - DNA, 14 bp, Homo sapiens
tccgagagggagag

SEQ ID NO: 4074542 - DNA, 24 bp, Homo sapiens
tccgagatccccagggcagcctgg

SEQ ID NO: 4074543 - DNA, 19 bp, Homo sapiens
tccgagtgtgtttcatcct

SEQ ID NO: 4074544 - DNA, 23 bp, Homo sapiens
tccgagtgtgtttcatccttccc

SEQ ID NO: 4074545 - DNA, 15 bp, Homo sapiens
tccgcaggtgctggt

SEQ ID NO: 4074546 - DNA, 16 bp, Homo sapiens
tccgccaatctggccc

SEQ ID NO: 4074547 - DNA, 16 bp, Homo sapiens
tccgccagcctcctct

SEQ ID NO: 4074548 - DNA, 17 bp, Homo sapiens
tccgccagcctcctctg

SEQ ID NO: 4074549 - DNA, 21 bp, Homo sapiens
tccgcccgctcctgccgcaga

SEQ ID NO: 4074550 - DNA, 15 bp, Homo sapiens
tccgccctcctcggg

SEQ ID NO: 4074551 - DNA, 19 bp, Homo sapiens
tccgctgaggggtctcgga

SEQ ID NO: 4074552 - DNA, 16 bp, Homo sapiens
tccgctgctccttggc

SEQ ID NO: 4074553 - DNA, 18 bp, Homo sapiens
tccgctgtcgccccaggc

SEQ ID NO: 4074554 - DNA, 20 bp, Homo sapiens
tccgctgtcgccccaggccc

SEQ ID NO: 4074555 - DNA, 15 bp, Homo sapiens
tccggacactcctag

SEQ ID NO: 4074556 - DNA, 14 bp, Homo sapiens
tccggactggtgcc

SEQ ID NO: 4074557 - DNA, 21 bp, Homo sapiens
tccggcctgatgacagagcga

SEQ ID NO: 4074558 - DNA, 21 bp, Homo sapiens
tccggtggcctattccaggaa

SEQ ID NO: 4074559 - DNA, 14 bp, Homo sapiens
tccggtgtgtcaga

SEQ ID NO: 4074560 - DNA, 21 bp, Homo sapiens
tccgtagggtctttcttggga

SEQ ID NO: 4074561 - DNA, 20 bp, Homo sapiens
tccgtgagtgaaccatcatt

SEQ ID NO: 4074562 - DNA, 19 bp, Homo sapiens
tccgtgatccatccatctc

SEQ ID NO: 4074563 - DNA, 21 bp, Homo sapiens
tccgtttattataaactgtat

SEQ ID NO: 4074564 - DNA, 21 bp, Homo sapiens
tcctaaaactgggattaagaa

SEQ ID NO: 4074565 - DNA, 20 bp, Homo sapiens
tcctaacaaaagatgaaagc

SEQ ID NO: 4074566 - DNA, 16 bp, Homo sapiens
tcctaacaggatgaaa

SEQ ID NO: 4074567 - DNA, 19 bp, Homo sapiens
tcctaagagtgctgggcat

SEQ ID NO: 4074568 - DNA, 16 bp, Homo sapiens
tcctaagctattcagt

SEQ ID NO: 4074569 - DNA, 16 bp, Homo sapiens
tcctaatcactcagag

SEQ ID NO: 4074570 - DNA, 14 bp, Homo sapiens
tcctacaaagatgt

SEQ ID NO: 4074571 - DNA, 19 bp, Homo sapiens
tcctacaagagcagcctgt

SEQ ID NO: 4074572 - DNA, 23 bp, Homo sapiens
tcctacaagagcagcctgtggca

SEQ ID NO: 4074573 - DNA, 21 bp, Homo sapiens
tcctacagcactactgggtgt

SEQ ID NO: 4074574 - DNA, 13 bp, Homo sapiens
tcctacagcccct

SEQ ID NO: 4074575 - DNA, 19 bp, Homo sapiens
tcctacatcttcttcccag

SEQ ID NO: 4074576 - DNA, 20 bp, Homo sapiens
tcctacatcttcttcccagt

SEQ ID NO: 4074577 - DNA, 17 bp, Homo sapiens
tccttgttggtcagagg

SEQ ID NO: 4074578 - DNA, 16 bp, Homo sapiens
tccttgttgtttgctt

SEQ ID NO: 4074579 - DNA, 20 bp, Homo sapiens
tccttgtttatcagatacat

SEQ ID NO: 4074580 - DNA, 16 bp, Homo sapiens
tcctttatactgtgaa

SEQ ID NO: 4074581 - DNA, 20 bp, Homo sapiens
tcctttatactgtgaagtta

SEQ ID NO: 4074582 - DNA, 22 bp, Homo sapiens
tcctttatactgtgaagttaca

SEQ ID NO: 4074583 - DNA, 12 bp, Homo sapiens
tcctttatagag

SEQ ID NO: 4074584 - DNA, 13 bp, Homo sapiens
tcctttatgtgaa

SEQ ID NO: 4074585 - DNA, 23 bp, Homo sapiens
tcctttatgtgaatttttaagct

SEQ ID NO: 4074586 - DNA, 16 bp, Homo sapiens
tcctttcacaaccttc

SEQ ID NO: 4074587 - DNA, 18 bp, Homo sapiens
tcctttcacaaccttctg

SEQ ID NO: 4074588 - DNA, 16 bp, Homo sapiens
tcctttcacttctttc

SEQ ID NO: 4074589 - DNA, 18 bp, Homo sapiens
tcctttcacttctttccc

SEQ ID NO: 4074590 - DNA, 15 bp, Homo sapiens
tcctttctcatccca

SEQ ID NO: 4074591 - DNA, 15 bp, Homo sapiens
tcctttctccaggac

SEQ ID NO: 4074592 - DNA, 15 bp, Homo sapiens
tcctttctctttctc

SEQ ID NO: 4074593 - DNA, 23 bp, Homo sapiens
tcctttctctttctctcttccct

SEQ ID NO: 4074594 - DNA, 16 bp, Homo sapiens
tcctttctgccgaccc

SEQ ID NO: 4074595 - DNA, 20 bp, Homo sapiens
tcctttcttggttcataaat

SEQ ID NO: 4074596 - DNA, 16 bp, Homo sapiens
tcctttgacaaaagta

SEQ ID NO: 4074597 - DNA, 22 bp, Homo sapiens
tcctttgacaaaagtaaatggg

SEQ ID NO: 4074598 - DNA, 15 bp, Homo sapiens
tcctttgcactgagg

SEQ ID NO: 4074599 - DNA, 14 bp, Homo sapiens
tcctttgcagggca

SEQ ID NO: 4074600 - DNA, 16 bp, Homo sapiens
tcctttgtagctactt

SEQ ID NO: 4074601 - DNA, 12 bp, Homo sapiens
tcctttgtcttc

SEQ ID NO: 4074602 - DNA, 17 bp, Homo sapiens
tcctttgtgaatatttt

SEQ ID NO: 4074603 - DNA, 20 bp, Homo sapiens
tcctttgtgtgtactcactg

SEQ ID NO: 4074604 - DNA, 17 bp, Homo sapiens
tcctttgtgtgtgtgtc

SEQ ID NO: 4074605 - DNA, 20 bp, Homo sapiens
tcctttgttttctgactaat

SEQ ID NO: 4074606 - DNA, 22 bp, Homo sapiens
tcctttgttttctgactaatta

SEQ ID NO: 4074607 - DNA, 20 bp, Homo sapiens
tccttttcccctacagaatt

SEQ ID NO: 4074608 - DNA, 23 bp, Homo sapiens
tccttttccgttctgttctgctg

SEQ ID NO: 4074609 - DNA, 16 bp, Homo sapiens
tccttttcctatcctt

SEQ ID NO: 4074610 - DNA, 15 bp, Homo sapiens
tccttttcctctctc

SEQ ID NO: 4074611 - DNA, 13 bp, Homo sapiens
tccttttgcttga

SEQ ID NO: 4074612 - DNA, 13 bp, Homo sapiens
tccttttgtgttc

SEQ ID NO: 4074613 - DNA, 16 bp, Homo sapiens
tccttttgtgttccaa

SEQ ID NO: 4074614 - DNA, 15 bp, Homo sapiens
tcctttttccatcat

SEQ ID NO: 4074615 - DNA, 17 bp, Homo sapiens
tcctttttccatcattt

SEQ ID NO: 4074616 - DNA, 14 bp, Homo sapiens
tcctttttctgatt

SEQ ID NO: 4074617 - DNA, 15 bp, Homo sapiens
tcctttttctgatta

SEQ ID NO: 4074618 - DNA, 21 bp, Homo sapiens
tcctttttttccatctttaca

SEQ ID NO: 4074619 - DNA, 12 bp, Homo sapiens
tcgaaactgcca

SEQ ID NO: 4074620 - DNA, 14 bp, Homo sapiens
tcgaaactgccaag

SEQ ID NO: 4074621 - DNA, 12 bp, Homo sapiens
tcgaagtgctga

SEQ ID NO: 4074622 - DNA, 13 bp, Homo sapiens
tcgaagtgctgag

SEQ ID NO: 4074623 - DNA, 21 bp, Homo sapiens
tcgaatcttaatttattattt

SEQ ID NO: 4074624 - DNA, 23 bp, Homo sapiens
tcgaattttgtctttaaaattca

SEQ ID NO: 4074625 - DNA, 15 bp, Homo sapiens
tcgacagcgcccctg

SEQ ID NO: 4074626 - DNA, 15 bp, Homo sapiens
tcgacagggcctgga

SEQ ID NO: 4074627 - DNA, 21 bp, Homo sapiens
tcgacagggcctggagcccca

SEQ ID NO: 4074628 - DNA, 20 bp, Homo sapiens
tcgacataccccactgggca

SEQ ID NO: 4074629 - DNA, 22 bp, Homo sapiens
tcgacgcccgagttagcctcac

SEQ ID NO: 4074630 - DNA, 14 bp, Homo sapiens
tcgactcaggatcc

SEQ ID NO: 4074631 - DNA, 21 bp, Homo sapiens
tcgactcaggatccagtccct

SEQ ID NO: 4074632 - DNA, 14 bp, Homo sapiens
tcgagacacttgcc

SEQ ID NO: 4074633 - DNA, 22 bp, Homo sapiens
tcgagcagtcctgcctcagcct

SEQ ID NO: 4074634 - DNA, 16 bp, Homo sapiens
tcgagcccagatggaa

SEQ ID NO: 4074635 - DNA, 17 bp, Homo sapiens
tcgaggagtaacaatac

SEQ ID NO: 4074636 - DNA, 20 bp, Homo sapiens
tcgaggagtaacaatacaaa

SEQ ID NO: 4074637 - DNA, 20 bp, Homo sapiens
tcgaggcctgaagccagctg

SEQ ID NO: 4074638 - DNA, 14 bp, Homo sapiens
tcgaggggctctca

SEQ ID NO: 4074639 - DNA, 23 bp, Homo sapiens
tcgatacctggagcagaggaggg

SEQ ID NO: 4074640 - DNA, 21 bp, Homo sapiens
tcgattgtgtagcaattgaca

SEQ ID NO: 4074641 - DNA, 11 bp, Homo sapiens
tcgcacactgg

SEQ ID NO: 4074642 - DNA, 14 bp, Homo sapiens
tcgcagaccagagc

SEQ ID NO: 4074643 - DNA, 19 bp, Homo sapiens
tcgcaggagtctctgccac

SEQ ID NO: 4074644 - DNA, 15 bp, Homo sapiens
tcgcaggcctccctg

SEQ ID NO: 4074645 - DNA, 20 bp, Homo sapiens
tcgcaggcctccctgccagt

SEQ ID NO: 4074646 - DNA, 15 bp, Homo sapiens
tcgccatctcctggg

SEQ ID NO: 4074647 - DNA, 16 bp, Homo sapiens
tcgccatctcctgggc

SEQ ID NO: 4074648 - DNA, 22 bp, Homo sapiens
tcgccatctgatccccatgcct

SEQ ID NO: 4074649 - DNA, 15 bp, Homo sapiens
tcgcccagcaggaga

SEQ ID NO: 4074650 - DNA, 18 bp, Homo sapiens
tcgccccagatcaccagc

SEQ ID NO: 4074651 - DNA, 20 bp, Homo sapiens
tcgccccagatcaccagccc

SEQ ID NO: 4074652 - DNA, 22 bp, Homo sapiens
tcgccccagatcaccagcccgg

SEQ ID NO: 4074653 - DNA, 16 bp, Homo sapiens
tcgccctcctttctgt

SEQ ID NO: 4074654 - DNA, 12 bp, Homo sapiens
tcgcctcagcct

SEQ ID NO: 4074655 - DNA, 23 bp, Homo sapiens
tcgcctcggatcagctgagcctt

SEQ ID NO: 4074656 - DNA, 22 bp, Homo sapiens
tcgcctgacaaccactggtctg

SEQ ID NO: 4074657 - DNA, 14 bp, Homo sapiens
tcgcctgtcacccc

SEQ ID NO: 4074658 - DNA, 20 bp, Homo sapiens
tcgcctgtggagctcagccc

SEQ ID NO: 4074659 - DNA, 15 bp, Homo sapiens
tcgccttgaacaaaa

SEQ ID NO: 4074660 - DNA, 20 bp, Homo sapiens
tcgcctttcagcaggcagcc

SEQ ID NO: 4074661 - DNA, 14 bp, Homo sapiens
tcgcctttcccacc

SEQ ID NO: 4074662 - DNA, 16 bp, Homo sapiens
tcgcctttcccaccct

SEQ ID NO: 4074663 - DNA, 22 bp, Homo sapiens
tcgcgggcagcgggccaggccc

SEQ ID NO: 4074664 - DNA, 16 bp, Homo sapiens
tcgcgtgccctcgctg

SEQ ID NO: 4074665 - DNA, 17 bp, Homo sapiens
tcgctaagctggctctg

SEQ ID NO: 4074666 - DNA, 18 bp, Homo sapiens
tcgctcaatcaagaaaat

SEQ ID NO: 4074667 - DNA, 18 bp, Homo sapiens
tcgctgacttcatggaat

SEQ ID NO: 4074668 - DNA, 22 bp, Homo sapiens
tcgctgagggcagactggggca

SEQ ID NO: 4074669 - DNA, 20 bp, Homo sapiens
tcgctgtaccctttaagata

SEQ ID NO: 4074670 - DNA, 18 bp, Homo sapiens
tcgctgtcactggctggc

SEQ ID NO: 4074671 - DNA, 21 bp, Homo sapiens
tcgctgttaccgcctgtctct

SEQ ID NO: 4074672 - DNA, 18 bp, Homo sapiens
tcggaactgtcctttcct

SEQ ID NO: 4074673 - DNA, 15 bp, Homo sapiens
tcggactctgcccct

SEQ ID NO: 4074674 - DNA, 20 bp, Homo sapiens
tcggagaggctgtctggggc

SEQ ID NO: 4074675 - DNA, 13 bp, Homo sapiens
tcggaggccccac

SEQ ID NO: 4074676 - DNA, 23 bp, Homo sapiens
tcggaggctgcccccggccccct

SEQ ID NO: 4074677 - DNA, 12 bp, Homo sapiens
tcggagttcttc

SEQ ID NO: 4074678 - DNA, 13 bp, Homo sapiens
tcggagttcttct

SEQ ID NO: 4074679 - DNA, 19 bp, Homo sapiens
tcggatcagctgagccttc

SEQ ID NO: 4074680 - DNA, 19 bp, Homo sapiens
tctccaagtctctctgtga

SEQ ID NO: 4074681 - DNA, 21 bp, Homo sapiens
tctccaagtctctctgtgaat

SEQ ID NO: 4074682 - DNA, 23 bp, Homo sapiens
tctccaagtctctctgtgaatac

SEQ ID NO: 4074683 - DNA, 14 bp, Homo sapiens
tctccacagcaacc

SEQ ID NO: 4074684 - DNA, 20 bp, Homo sapiens
tctccactaaatgagctcct

SEQ ID NO: 4074685 - DNA, 22 bp, Homo sapiens
tctccactaaatgagctcctgc

SEQ ID NO: 4074686 - DNA, 22 bp, Homo sapiens
tctccactaccccacaccagcc

SEQ ID NO: 4074687 - DNA, 13 bp, Homo sapiens
tctccagaatgta

SEQ ID NO: 4074688 - DNA, 19 bp, Homo sapiens
tctccagaatgtaagaaaa

SEQ ID NO: 4074689 - DNA, 14 bp, Homo sapiens
tctccagatgtttc

SEQ ID NO: 4074690 - DNA, 15 bp, Homo sapiens
tctccagatgtttcc

SEQ ID NO: 4074691 - DNA, 18 bp, Homo sapiens
tctccagatgtttccaga

SEQ ID NO: 4074692 - DNA, 21 bp, Homo sapiens
tctccagatttttcggaggcc

SEQ ID NO: 4074693 - DNA, 12 bp, Homo sapiens
tctccagccagc

SEQ ID NO: 4074694 - DNA, 16 bp, Homo sapiens
tctccagccagcaatg

SEQ ID NO: 4074695 - DNA, 13 bp, Homo sapiens
tctccagctgcct

SEQ ID NO: 4074696 - DNA, 14 bp, Homo sapiens
tctccagctgcctg

SEQ ID NO: 4074697 - DNA, 18 bp, Homo sapiens
tctccagctgcctgggcc

SEQ ID NO: 4074698 - DNA, 11 bp, Homo sapiens
tctccagctgg

SEQ ID NO: 4074699 - DNA, 19 bp, Homo sapiens
tctccaggattgaagagca

SEQ ID NO: 4074700 - DNA, 12 bp, Homo sapiens
tctccaggtgct

SEQ ID NO: 4074701 - DNA, 15 bp, Homo sapiens
tctccaggtgctcat

SEQ ID NO: 4074702 - DNA, 16 bp, Homo sapiens
tctccaggtgctcatt

SEQ ID NO: 4074703 - DNA, 23 bp, Homo sapiens
tctccagttgggactcaggatat

SEQ ID NO: 4074704 - DNA, 14 bp, Homo sapiens
tctccatatgttac

SEQ ID NO: 4074705 - DNA, 15 bp, Homo sapiens
tctccatgaagagct

SEQ ID NO: 4074706 - DNA, 17 bp, Homo sapiens
tctccatgaagagcttg

SEQ ID NO: 4074707 - DNA, 18 bp, Homo sapiens
tctccatggccctgtccc

SEQ ID NO: 4074708 - DNA, 19 bp, Homo sapiens
tctccatggccctgtccca

SEQ ID NO: 4074709 - DNA, 19 bp, Homo sapiens
tctccattgtgcctaagtc

SEQ ID NO: 4074710 - DNA, 16 bp, Homo sapiens
tctccattttcaagct

SEQ ID NO: 4074711 - DNA, 18 bp, Homo sapiens
tctcccaaaaaactactt

SEQ ID NO: 4074712 - DNA, 14 bp, Homo sapiens
tctcccaagaaacc

SEQ ID NO: 4074713 - DNA, 14 bp, Homo sapiens
tctcccacatgagg

SEQ ID NO: 4074714 - DNA, 17 bp, Homo sapiens
tctcccacatgaggcca

SEQ ID NO: 4074715 - DNA, 21 bp, Homo sapiens
tctcccacatgaggccatctc

SEQ ID NO: 4074716 - DNA, 24 bp, Homo sapiens
tctcccacatgaggccatctcagg

SEQ ID NO: 4074717 - DNA, 12 bp, Homo sapiens
tctcccaccctg

SEQ ID NO: 4074718 - DNA, 14 bp, Homo sapiens
tctcccacctagca

SEQ ID NO: 4074719 - DNA, 18 bp, Homo sapiens
tctcccactccagcgctg

SEQ ID NO: 4074720 - DNA, 12 bp, Homo sapiens
tctcccaggccc

SEQ ID NO: 4074721 - DNA, 15 bp, Homo sapiens
tctcccaggccccct

SEQ ID NO: 4074722 - DNA, 17 bp, Homo sapiens
tctcccaggtaccagct

SEQ ID NO: 4074723 - DNA, 14 bp, Homo sapiens
tctcccatttcagg

SEQ ID NO: 4074724 - DNA, 16 bp, Homo sapiens
tctcccatttcaggaa

SEQ ID NO: 4074725 - DNA, 22 bp, Homo sapiens
tctccccaaccctaggttccct

SEQ ID NO: 4074726 - DNA, 11 bp, Homo sapiens
tctccccacac

SEQ ID NO: 4074727 - DNA, 13 bp, Homo sapiens
tctccccacacta

SEQ ID NO: 4074728 - DNA, 22 bp, Homo sapiens
tctccccacactaacctgggtt

SEQ ID NO: 4074729 - DNA, 19 bp, Homo sapiens
tctccccacgagggctggc

SEQ ID NO: 4074730 - DNA, 19 bp, Homo sapiens
tctccccagcccagagaca

SEQ ID NO: 4074731 - DNA, 16 bp, Homo sapiens
tctccccgcagtgttt

SEQ ID NO: 4074732 - DNA, 12 bp, Homo sapiens
tctcccctccag

SEQ ID NO: 4074733 - DNA, 14 bp, Homo sapiens
tctcccctccagcc

SEQ ID NO: 4074734 - DNA, 15 bp, Homo sapiens
tctcccctccagcct

SEQ ID NO: 4074735 - DNA, 18 bp, Homo sapiens
tctcccgcaccaggccgg

SEQ ID NO: 4074736 - DNA, 14 bp, Homo sapiens
tctcccgctgctgc

SEQ ID NO: 4074737 - DNA, 15 bp, Homo sapiens
tctcccgctgctgct

SEQ ID NO: 4074738 - DNA, 11 bp, Homo sapiens
tctccctctga

SEQ ID NO: 4074739 - DNA, 14 bp, Homo sapiens
tctccctgccagag

SEQ ID NO: 4074740 - DNA, 15 bp, Homo sapiens
tctccctgcctggcc

SEQ ID NO: 4074741 - DNA, 13 bp, Homo sapiens
tctccctggctcc

SEQ ID NO: 4074742 - DNA, 17 bp, Homo sapiens
tctccctttatgtatct

SEQ ID NO: 4074743 - DNA, 15 bp, Homo sapiens
tctccctttcccttc

SEQ ID NO: 4074744 - DNA, 23 bp, Homo sapiens
tctccgggtgtggcctcagccct

SEQ ID NO: 4074745 - DNA, 12 bp, Homo sapiens
tctcctcagggt

SEQ ID NO: 4074746 - DNA, 13 bp, Homo sapiens
tctcctcatctcc

SEQ ID NO: 4074747 - DNA, 17 bp, Homo sapiens
tctcctccatactcagg

SEQ ID NO: 4074748 - DNA, 18 bp, Homo sapiens
tctcctccccacccgccc

SEQ ID NO: 4074749 - DNA, 14 bp, Homo sapiens
tctcctccctcagc

SEQ ID NO: 4074750 - DNA, 13 bp, Homo sapiens
tctcctcccttcc

SEQ ID NO: 4074751 - DNA, 19 bp, Homo sapiens
tctcctctctctttcctcc

SEQ ID NO: 4074752 - DNA, 20 bp, Homo sapiens
tctcctctctctttcctcca

SEQ ID NO: 4074753 - DNA, 18 bp, Homo sapiens
tctcctgctctttctaca

SEQ ID NO: 4074754 - DNA, 21 bp, Homo sapiens
tctcctggaaatattaagaaa

SEQ ID NO: 4074755 - DNA, 12 bp, Homo sapiens
tctcctggagga

SEQ ID NO: 4074756 - DNA, 19 bp, Homo sapiens
tctcctggcctatccgctg

SEQ ID NO: 4074757 - DNA, 23 bp, Homo sapiens
tctcctggcctatccgctgccag

SEQ ID NO: 4074758 - DNA, 20 bp, Homo sapiens
tctcctgggggtggcaggca

SEQ ID NO: 4074759 - DNA, 20 bp, Homo sapiens
tctcctgtataaccccacct

SEQ ID NO: 4074760 - DNA, 17 bp, Homo sapiens
tctcctgtgcatgggtg

SEQ ID NO: 4074761 - DNA, 14 bp, Homo sapiens
tctcctgtttttct

SEQ ID NO: 4074762 - DNA, 14 bp, Homo sapiens
tctccttcccaccc

SEQ ID NO: 4074763 - DNA, 19 bp, Homo sapiens
tctccttcccacccctaca

SEQ ID NO: 4074764 - DNA, 17 bp, Homo sapiens
tctccttccccaggatg

SEQ ID NO: 4074765 - DNA, 19 bp, Homo sapiens
tctccttcccctttcccca

SEQ ID NO: 4074766 - DNA, 17 bp, Homo sapiens
tctccttctccttccca

SEQ ID NO: 4074767 - DNA, 20 bp, Homo sapiens
tctcctttagggacagctta

SEQ ID NO: 4074768 - DNA, 16 bp, Homo sapiens
tctcctttcacaacct

SEQ ID NO: 4074769 - DNA, 21 bp, Homo sapiens
tctcctttgcactgagggcca

SEQ ID NO: 4074770 - DNA, 23 bp, Homo sapiens
tctcctttgcactgagggccaca

SEQ ID NO: 4074771 - DNA, 22 bp, Homo sapiens
tctccttttacttcacttcaaa

SEQ ID NO: 4074772 - DNA, 13 bp, Homo sapiens
tctccttttccta

SEQ ID NO: 4074773 - DNA, 17 bp, Homo sapiens
tctccttttcctatcct

SEQ ID NO: 4074774 - DNA, 15 bp, Homo sapiens
tctccttttgaggct

SEQ ID NO: 4074775 - DNA, 23 bp, Homo sapiens
tctccttttgaggcttctccttc

SEQ ID NO: 4074776 - DNA, 13 bp, Homo sapiens
tctcgagcccaga

SEQ ID NO: 4074777 - DNA, 18 bp, Homo sapiens
tctcgagcccagatggaa

SEQ ID NO: 4074778 - DNA, 18 bp, Homo sapiens
tctcggatgacaccctgg

SEQ ID NO: 4074779 - DNA, 13 bp, Homo sapiens
tctcggctcaggc

SEQ ID NO: 4074780 - DNA, 15 bp, Homo sapiens
tctcggctcaggctc

SEQ ID NO: 4074781 - DNA, 15 bp, Homo sapiens
tctcgtgagtcattt

SEQ ID NO: 4074782 - DNA, 16 bp, Homo sapiens
tctcgttcccaaagaa

SEQ ID NO: 4074783 - DNA, 19 bp, Homo sapiens
tctgcatatgttgaatact

SEQ ID NO: 4074784 - DNA, 21 bp, Homo sapiens
tctgcatatgttgaatacttt

SEQ ID NO: 4074785 - DNA, 16 bp, Homo sapiens
tctgcatcatctgtag

SEQ ID NO: 4074786 - DNA, 14 bp, Homo sapiens
tctgcatcccagca

SEQ ID NO: 4074787 - DNA, 19 bp, Homo sapiens
tctgcatcccagcacctgc

SEQ ID NO: 4074788 - DNA, 24 bp, Homo sapiens
tctgcatcccagcacctgcctcct

SEQ ID NO: 4074789 - DNA, 18 bp, Homo sapiens
tctgcatctcctgtcttt

SEQ ID NO: 4074790 - DNA, 17 bp, Homo sapiens
tctgcattttcacccca

SEQ ID NO: 4074791 - DNA, 13 bp, Homo sapiens
tctgccacccact

SEQ ID NO: 4074792 - DNA, 12 bp, Homo sapiens
tctgccagacct

SEQ ID NO: 4074793 - DNA, 14 bp, Homo sapiens
tctgccagggagct

SEQ ID NO: 4074794 - DNA, 19 bp, Homo sapiens
tctgccagggagcttgaaa

SEQ ID NO: 4074795 - DNA, 19 bp, Homo sapiens
tctgccagtgacagacagg

SEQ ID NO: 4074796 - DNA, 17 bp, Homo sapiens
tctgccccacgctgtgg

SEQ ID NO: 4074797 - DNA, 20 bp, Homo sapiens
tctgccccagcccagattcc

SEQ ID NO: 4074798 - DNA, 16 bp, Homo sapiens
tctgccccctgctggc

SEQ ID NO: 4074799 - DNA, 13 bp, Homo sapiens
tctgcccctcccc

SEQ ID NO: 4074800 - DNA, 16 bp, Homo sapiens
tctgcccctcccccaa

SEQ ID NO: 4074801 - DNA, 10 bp, Homo sapiens
tctgcccggg

SEQ ID NO: 4074802 - DNA, 23 bp, Homo sapiens
tctgcccgggaaggtcaccagca

SEQ ID NO: 4074803 - DNA, 19 bp, Homo sapiens
tctgccctatggatttgaa

SEQ ID NO: 4074804 - DNA, 18 bp, Homo sapiens
tctgccctcattactggg

SEQ ID NO: 4074805 - DNA, 16 bp, Homo sapiens
tctgccctggctgctg

SEQ ID NO: 4074806 - DNA, 21 bp, Homo sapiens
tctgccctggctgctgccccc

SEQ ID NO: 4074807 - DNA, 20 bp, Homo sapiens
tctgccgctacctccctccc

SEQ ID NO: 4074808 - DNA, 19 bp, Homo sapiens
tctgccggtcgggcagcca

SEQ ID NO: 4074809 - DNA, 22 bp, Homo sapiens
tctgccggtcgggcagccagca

SEQ ID NO: 4074810 - DNA, 20 bp, Homo sapiens
tctgcctcagacgttgcctg

SEQ ID NO: 4074811 - DNA, 21 bp, Homo sapiens
tctgcctgaggggcagcctgc

SEQ ID NO: 4074812 - DNA, 22 bp, Homo sapiens
tctgcctgaggggcagcctgcc

SEQ ID NO: 4074813 - DNA, 12 bp, Homo sapiens
tctgcctgcccc

SEQ ID NO: 4074814 - DNA, 12 bp, Homo sapiens
tctgcctgccct

SEQ ID NO: 4074815 - DNA, 21 bp, Homo sapiens
tctgcctggtggtcagatgca

SEQ ID NO: 4074816 - DNA, 15 bp, Homo sapiens
tctgccttagtctca

SEQ ID NO: 4074817 - DNA, 17 bp, Homo sapiens
tctgccttcaggcttct

SEQ ID NO: 4074818 - DNA, 13 bp, Homo sapiens
tctgcgccttggg

SEQ ID NO: 4074819 - DNA, 14 bp, Homo sapiens
tctgctaatgtaaa

SEQ ID NO: 4074820 - DNA, 15 bp, Homo sapiens
tctgctagaaagtta

SEQ ID NO: 4074821 - DNA, 15 bp, Homo sapiens
tctgctatatataaa

SEQ ID NO: 4074822 - DNA, 15 bp, Homo sapiens
tctgctcagccaagc

SEQ ID NO: 4074823 - DNA, 16 bp, Homo sapiens
tctgctcagccaagct

SEQ ID NO: 4074824 - DNA, 12 bp, Homo sapiens
tctgctccacca

SEQ ID NO: 4074825 - DNA, 16 bp, Homo sapiens
tctgctccacccttgg

SEQ ID NO: 4074826 - DNA, 20 bp, Homo sapiens
tctgctccacccttggcctg

SEQ ID NO: 4074827 - DNA, 21 bp, Homo sapiens
tctgctccacccttggcctgt

SEQ ID NO: 4074828 - DNA, 16 bp, Homo sapiens
tctgctcccccttttc

SEQ ID NO: 4074829 - DNA, 20 bp, Homo sapiens
tctgctcccccttttccctc

SEQ ID NO: 4074830 - DNA, 17 bp, Homo sapiens
tctgctcctgcttttct

SEQ ID NO: 4074831 - DNA, 23 bp, Homo sapiens
tctgctcctgcttttctgtcctg

SEQ ID NO: 4074832 - DNA, 13 bp, Homo sapiens
tctgctctggaat

SEQ ID NO: 4074833 - DNA, 18 bp, Homo sapiens
tctgctctggttgtttct

SEQ ID NO: 4074834 - DNA, 14 bp, Homo sapiens
tctgctctttctct

SEQ ID NO: 4074835 - DNA, 18 bp, Homo sapiens
tctgctctttctctgcca

SEQ ID NO: 4074836 - DNA, 22 bp, Homo sapiens
tctgctgatgacccccccagct

SEQ ID NO: 4074837 - DNA, 16 bp, Homo sapiens
tctgctgcccctgcag

SEQ ID NO: 4074838 - DNA, 17 bp, Homo sapiens
tctgctgcccctgcagt

SEQ ID NO: 4074839 - DNA, 18 bp, Homo sapiens
tctgctgccgcccttcct

SEQ ID NO: 4074840 - DNA, 18 bp, Homo sapiens
tctgctgctgtccctccc

SEQ ID NO: 4074841 - DNA, 13 bp, Homo sapiens
tctgctggagttt

SEQ ID NO: 4074842 - DNA, 19 bp, Homo sapiens
tctgctggagtttcatgta

SEQ ID NO: 4074843 - DNA, 23 bp, Homo sapiens
tctgctggagtttcatgtacaag

SEQ ID NO: 4074844 - DNA, 14 bp, Homo sapiens
tctgctggcccagc

SEQ ID NO: 4074845 - DNA, 15 bp, Homo sapiens
tctgctggcctggat

SEQ ID NO: 4074846 - DNA, 15 bp, Homo sapiens
tctgctgggagttct

SEQ ID NO: 4074847 - DNA, 19 bp, Homo sapiens
tctgctgggagttctagaa

SEQ ID NO: 4074848 - DNA, 22 bp, Homo sapiens
tctgctgtgggcacaggtcagg

SEQ ID NO: 4074849 - DNA, 17 bp, Homo sapiens
tctgcttaggagagacc

SEQ ID NO: 4074850 - DNA, 16 bp, Homo sapiens
tctgcttctctcacct

SEQ ID NO: 4074851 - DNA, 17 bp, Homo sapiens
tctgcttgtcaaaagaa

SEQ ID NO: 4074852 - DNA, 16 bp, Homo sapiens
tctgcttttctgccct

SEQ ID NO: 4074853 - DNA, 17 bp, Homo sapiens
tctgcttttctgccctg

SEQ ID NO: 4074854 - DNA, 18 bp, Homo sapiens
tctgcttttctgccctgg

SEQ ID NO: 4074855 - DNA, 14 bp, Homo sapiens
tctggaacccagac

SEQ ID NO: 4074856 - DNA, 15 bp, Homo sapiens
tctggaacccagact

SEQ ID NO: 4074857 - DNA, 23 bp, Homo sapiens
tctggaacctcagcctggccaga

SEQ ID NO: 4074858 - DNA, 13 bp, Homo sapiens
tctggaagagagg

SEQ ID NO: 4074859 - DNA, 19 bp, Homo sapiens
tctggaatctggagaccag

SEQ ID NO: 4074860 - DNA, 15 bp, Homo sapiens
tctggaatgtaatca

SEQ ID NO: 4074861 - DNA, 18 bp, Homo sapiens
tctggaatgtaatcaatg

SEQ ID NO: 4074862 - DNA, 22 bp, Homo sapiens
tctggaatgtaatcaatgtttc

SEQ ID NO: 4074863 - DNA, 23 bp, Homo sapiens
tctggacaagccaacttgtaaat

SEQ ID NO: 4074864 - DNA, 14 bp, Homo sapiens
tctggacagcagaa

SEQ ID NO: 4074865 - DNA, 13 bp, Homo sapiens
tctggactgaagc

SEQ ID NO: 4074866 - DNA, 20 bp, Homo sapiens
tctggactgaagcctgcagg

SEQ ID NO: 4074867 - DNA, 19 bp, Homo sapiens
tctggactgccccagaaaa

SEQ ID NO: 4074868 - DNA, 15 bp, Homo sapiens
tctggactggctaga

SEQ ID NO: 4074869 - DNA, 15 bp, Homo sapiens
tctggagaccaggga

SEQ ID NO: 4074870 - DNA, 21 bp, Homo sapiens
tctggagaccagggagccttt

SEQ ID NO: 4074871 - DNA, 21 bp, Homo sapiens
tctggaggccttccagctgct

SEQ ID NO: 4074872 - DNA, 22 bp, Homo sapiens
tctggaggccttccagctgctg

SEQ ID NO: 4074873 - DNA, 17 bp, Homo sapiens
tctggaggggagagctt

SEQ ID NO: 4074874 - DNA, 22 bp, Homo sapiens
tctggagtttttgtttggagag

SEQ ID NO: 4074875 - DNA, 24 bp, Homo sapiens
tctggagtttttgtttggagagca

SEQ ID NO: 4074876 - DNA, 14 bp, Homo sapiens
tctggataggagcc

SEQ ID NO: 4074877 - DNA, 16 bp, Homo sapiens
tctggcagcctcccat

SEQ ID NO: 4074878 - DNA, 14 bp, Homo sapiens
tctggccaggcact

SEQ ID NO: 4074879 - DNA, 23 bp, Homo sapiens
tctggccaggcactgccttctcc

SEQ ID NO: 4074880 - DNA, 21 bp, Homo sapiens
tctggcccttacacactcagg

SEQ ID NO: 4074881 - DNA, 22 bp, Homo sapiens
tctggcccttacacactcaggc

SEQ ID NO: 4074882 - DNA, 22 bp, Homo sapiens
tctggcctaaaatcttggaagt

SEQ ID NO: 4074883 - DNA, 20 bp, Homo sapiens
tctggcctcagaccaactct

SEQ ID NO: 4074884 - DNA, 12 bp, Homo sapiens
tctggcctgagg

SEQ ID NO: 4074885 - DNA, 14 bp, Homo sapiens
tcttcaggttctta

SEQ ID NO: 4074886 - DNA, 16 bp, Homo sapiens
tcttcagtcagaaaac

SEQ ID NO: 4074887 - DNA, 20 bp, Homo sapiens
tcttcataaagtacttgagt

SEQ ID NO: 4074888 - DNA, 20 bp, Homo sapiens
tcttcataacaattttagga

SEQ ID NO: 4074889 - DNA, 17 bp, Homo sapiens
tcttcatccaacttcca

SEQ ID NO: 4074890 - DNA, 19 bp, Homo sapiens
tcttcatgttcccacttca

SEQ ID NO: 4074891 - DNA, 20 bp, Homo sapiens
tcttcattctatcaagccca

SEQ ID NO: 4074892 - DNA, 14 bp, Homo sapiens
tcttccaaagcaca

SEQ ID NO: 4074893 - DNA, 15 bp, Homo sapiens
tcttccaaaggcata

SEQ ID NO: 4074894 - DNA, 13 bp, Homo sapiens
tcttccagaatgc

SEQ ID NO: 4074895 - DNA, 17 bp, Homo sapiens
tcttccagaatgctgaa

SEQ ID NO: 4074896 - DNA, 18 bp, Homo sapiens
tcttccagttactttcca

SEQ ID NO: 4074897 - DNA, 12 bp, Homo sapiens
tcttccataatg

SEQ ID NO: 4074898 - DNA, 16 bp, Homo sapiens
tcttccataatgtata

SEQ ID NO: 4074899 - DNA, 22 bp, Homo sapiens
tcttcccatgactgcacccagc

SEQ ID NO: 4074900 - DNA, 15 bp, Homo sapiens
tcttccccaccgcag

SEQ ID NO: 4074901 - DNA, 14 bp, Homo sapiens
tcttccccagagag

SEQ ID NO: 4074902 - DNA, 14 bp, Homo sapiens
tcttccccttcctg

SEQ ID NO: 4074903 - DNA, 15 bp, Homo sapiens
tcttccccttcctgt

SEQ ID NO: 4074904 - DNA, 13 bp, Homo sapiens
tcttccctacctc

SEQ ID NO: 4074905 - DNA, 22 bp, Homo sapiens
tcttccctgctttgcatctttg

SEQ ID NO: 4074906 - DNA, 13 bp, Homo sapiens
tcttccctgggct

SEQ ID NO: 4074907 - DNA, 19 bp, Homo sapiens
tcttccctttccccagcat

SEQ ID NO: 4074908 - DNA, 21 bp, Homo sapiens
tcttccggagatgtagcaaaa

SEQ ID NO: 4074909 - DNA, 18 bp, Homo sapiens
tcttcctaggtccaagcc

SEQ ID NO: 4074910 - DNA, 19 bp, Homo sapiens
tcttcctccagctgcacca

SEQ ID NO: 4074911 - DNA, 18 bp, Homo sapiens
tcttcctgagtggtgcca

SEQ ID NO: 4074912 - DNA, 23 bp, Homo sapiens
tcttcctgtgaagtttaattgtc

SEQ ID NO: 4074913 - DNA, 15 bp, Homo sapiens
tcttcctgtgtcctg

SEQ ID NO: 4074914 - DNA, 16 bp, Homo sapiens
tcttcctgtgtcctga

SEQ ID NO: 4074915 - DNA, 15 bp, Homo sapiens
tcttccttgtgagga

SEQ ID NO: 4074916 - DNA, 20 bp, Homo sapiens
tcttccttgttgtttgcttt

SEQ ID NO: 4074917 - DNA, 20 bp, Homo sapiens
tcttcgcctttcccaccctc

SEQ ID NO: 4074918 - DNA, 21 bp, Homo sapiens
tcttcgcctttcccaccctcc

SEQ ID NO: 4074919 - DNA, 19 bp, Homo sapiens
tcttcgctggactattgtg

SEQ ID NO: 4074920 - DNA, 20 bp, Homo sapiens
tcttcgctggactattgtgc

SEQ ID NO: 4074921 - DNA, 13 bp, Homo sapiens
tcttcgtcctttt

SEQ ID NO: 4074922 - DNA, 16 bp, Homo sapiens
tcttctaaaacttgta

SEQ ID NO: 4074923 - DNA, 15 bp, Homo sapiens
tcttctaatttcaaa

SEQ ID NO: 4074924 - DNA, 18 bp, Homo sapiens
tcttctacaaccagagcc

SEQ ID NO: 4074925 - DNA, 19 bp, Homo sapiens
tcttctacaaccagagccc

SEQ ID NO: 4074926 - DNA, 20 bp, Homo sapiens
tcttctacaaccagagcccc

SEQ ID NO: 4074927 - DNA, 20 bp, Homo sapiens
tcttctcatagcattaacta

SEQ ID NO: 4074928 - DNA, 13 bp, Homo sapiens
tcttctccactgg

SEQ ID NO: 4074929 - DNA, 23 bp, Homo sapiens
tcttctccagatttttcggaggc

SEQ ID NO: 4074930 - DNA, 12 bp, Homo sapiens
tcttctccccca

SEQ ID NO: 4074931 - DNA, 16 bp, Homo sapiens
tcttctccccttccat

SEQ ID NO: 4074932 - DNA, 20 bp, Homo sapiens
tcttctctctcaattttatc

SEQ ID NO: 4074933 - DNA, 13 bp, Homo sapiens
tcttctctgttgt

SEQ ID NO: 4074934 - DNA, 20 bp, Homo sapiens
tcttctgcaagcctcatgcc

SEQ ID NO: 4074935 - DNA, 19 bp, Homo sapiens
tcttctgctaatacctctt

SEQ ID NO: 4074936 - DNA, 12 bp, Homo sapiens
tcttctgctcca

SEQ ID NO: 4074937 - DNA, 14 bp, Homo sapiens
tcttctgctccacc

SEQ ID NO: 4074938 - DNA, 17 bp, Homo sapiens
tcttctgctccaccctt

SEQ ID NO: 4074939 - DNA, 17 bp, Homo sapiens
tcttctgctcttttcct

SEQ ID NO: 4074940 - DNA, 18 bp, Homo sapiens
tcttctgcttaggagaga

SEQ ID NO: 4074941 - DNA, 18 bp, Homo sapiens
tcttctggggcaggctgg

SEQ ID NO: 4074942 - DNA, 14 bp, Homo sapiens
tcttctgtattttt

SEQ ID NO: 4074943 - DNA, 18 bp, Homo sapiens
tcttcttaagacttttgg

SEQ ID NO: 4074944 - DNA, 14 bp, Homo sapiens
tcttcttcttcaga

SEQ ID NO: 4074945 - DNA, 18 bp, Homo sapiens
tcttcttgctgcagcctg

SEQ ID NO: 4074946 - DNA, 15 bp, Homo sapiens
tcttctttgtgcctt

SEQ ID NO: 4074947 - DNA, 17 bp, Homo sapiens
tcttctttgtgcctttg

SEQ ID NO: 4074948 - DNA, 21 bp, Homo sapiens
tcttctttgtgcctttggcct

SEQ ID NO: 4074949 - DNA, 20 bp, Homo sapiens
tcttgaaattaagaaggcaa

SEQ ID NO: 4074950 - DNA, 22 bp, Homo sapiens
tcttgaagaatgaagacatttc

SEQ ID NO: 4074951 - DNA, 19 bp, Homo sapiens
tcttgaaggaaaatgatac

SEQ ID NO: 4074952 - DNA, 13 bp, Homo sapiens
tcttgaaggtgct

SEQ ID NO: 4074953 - DNA, 23 bp, Homo sapiens
tcttgaatggcaatgttttgctt

SEQ ID NO: 4074954 - DNA, 12 bp, Homo sapiens
tcttgaatgtgg

SEQ ID NO: 4074955 - DNA, 18 bp, Homo sapiens
tcttgaatgtggtctcag

SEQ ID NO: 4074956 - DNA, 13 bp, Homo sapiens
tcttgactctaaa

SEQ ID NO: 4074957 - DNA, 17 bp, Homo sapiens
tcttgactctaaatgca

SEQ ID NO: 4074958 - DNA, 21 bp, Homo sapiens
tcttgactctaaatgcagttt

SEQ ID NO: 4074959 - DNA, 16 bp, Homo sapiens
tcttgaggccaggagt

SEQ ID NO: 4074960 - DNA, 20 bp, Homo sapiens
tcttgagtataagaaatgca

SEQ ID NO: 4074961 - DNA, 15 bp, Homo sapiens
tcttgatcttaaaga

SEQ ID NO: 4074962 - DNA, 12 bp, Homo sapiens
tcttgatgacca

SEQ ID NO: 4074963 - DNA, 16 bp, Homo sapiens
tcttgatgtgaagata

SEQ ID NO: 4074964 - DNA, 14 bp, Homo sapiens
tcttgattatccat

SEQ ID NO: 4074965 - DNA, 11 bp, Homo sapiens
tcttgattttt

SEQ ID NO: 4074966 - DNA, 13 bp, Homo sapiens
tcttgcattcatt

SEQ ID NO: 4074967 - DNA, 16 bp, Homo sapiens
tcttgccacatttctg

SEQ ID NO: 4074968 - DNA, 18 bp, Homo sapiens
tcttgccacatttctgat

SEQ ID NO: 4074969 - DNA, 14 bp, Homo sapiens
tcttgcccatcctg

SEQ ID NO: 4074970 - DNA, 22 bp, Homo sapiens
tcttgcgtgtcaatttccctca

SEQ ID NO: 4074971 - DNA, 18 bp, Homo sapiens
tcttgctcccttcagccc

SEQ ID NO: 4074972 - DNA, 19 bp, Homo sapiens
tcttgctgtctctgctcgc

SEQ ID NO: 4074973 - DNA, 13 bp, Homo sapiens
tcttgctttctat

SEQ ID NO: 4074974 - DNA, 16 bp, Homo sapiens
tcttggaaagaaacaa

SEQ ID NO: 4074975 - DNA, 22 bp, Homo sapiens
tcttggcaaaagccttgtgtat

SEQ ID NO: 4074976 - DNA, 14 bp, Homo sapiens
tcttggccagccaa

SEQ ID NO: 4074977 - DNA, 14 bp, Homo sapiens
tcttggcctttgca

SEQ ID NO: 4074978 - DNA, 16 bp, Homo sapiens
tcttggcctttgcatt

SEQ ID NO: 4074979 - DNA, 20 bp, Homo sapiens
tcttggcctttgcatttatt

SEQ ID NO: 4074980 - DNA, 14 bp, Homo sapiens
tcttggctgacccc

SEQ ID NO: 4074981 - DNA, 19 bp, Homo sapiens
tcttggcttactgcagcct

SEQ ID NO: 4074982 - DNA, 13 bp, Homo sapiens
tcttgggaactga

SEQ ID NO: 4074983 - DNA, 14 bp, Homo sapiens
tcttgggaactgaa

SEQ ID NO: 4074984 - DNA, 17 bp, Homo sapiens
tcttgggatacagatct

SEQ ID NO: 4074985 - DNA, 17 bp, Homo sapiens
tcttggggcaagactgc

SEQ ID NO: 4074986 - DNA, 23 bp, Homo sapiens
tcttggggcaagactgcaaactt

SEQ ID NO: 4074987 - DNA, 21 bp, Homo sapiens
tcttgggggtcaggggggaga

SEQ ID NO: 4074988 - DNA, 23 bp, Homo sapiens
tgaaattaagaaggcaaaaatgt

SEQ ID NO: 4074989 - DNA, 18 bp, Homo sapiens
tgaaattactgtgtaaat

SEQ ID NO: 4074990 - DNA, 19 bp, Homo sapiens
tgaaattactgtgtaaata

SEQ ID NO: 4074991 - DNA, 23 bp, Homo sapiens
tgaaattactgtgtaaatatatg

SEQ ID NO: 4074992 - DNA, 13 bp, Homo sapiens
tgaaattatagtt

SEQ ID NO: 4074993 - DNA, 18 bp, Homo sapiens
tgaaattatgtatgttta

SEQ ID NO: 4074994 - DNA, 13 bp, Homo sapiens
tgaaattcacaga

SEQ ID NO: 4074995 - DNA, 15 bp, Homo sapiens
tgaaattccagcaat

SEQ ID NO: 4074996 - DNA, 23 bp, Homo sapiens
tgaaattccagcaataagaaatg

SEQ ID NO: 4074997 - DNA, 22 bp, Homo sapiens
tgaaattgataatgctttcaca

SEQ ID NO: 4074998 - DNA, 13 bp, Homo sapiens
tgaaatttgcaaa

SEQ ID NO: 4074999 - DNA, 17 bp, Homo sapiens
tgaaatttgcaaaatca

SEQ ID NO: 4075000 - DNA, 16 bp, Homo sapiens
tgaaattttgcaaata

SEQ ID NO: 4075001 - DNA, 22 bp, Homo sapiens
tgaaattttgcaaatataaaca

SEQ ID NO: 4075002 - DNA, 20 bp, Homo sapiens
tgaaatttttattaaattat

SEQ ID NO: 4075003 - DNA, 19 bp, Homo sapiens
tgaacaacgagccttttca

SEQ ID NO: 4075004 - DNA, 19 bp, Homo sapiens
tgaacacaaactgtaaata

SEQ ID NO: 4075005 - DNA, 15 bp, Homo sapiens
tgaacacaggcagct

SEQ ID NO: 4075006 - DNA, 21 bp, Homo sapiens
tgaacagatgacccctgccca

SEQ ID NO: 4075007 - DNA, 21 bp, Homo sapiens
tgaacatacttcaaaaataat

SEQ ID NO: 4075008 - DNA, 18 bp, Homo sapiens
tgaacatgtttaatgggt

SEQ ID NO: 4075009 - DNA, 20 bp, Homo sapiens
tgaaccagagggtgtggctt

SEQ ID NO: 4075010 - DNA, 20 bp, Homo sapiens
tgaacccaggacgcttctga

SEQ ID NO: 4075011 - DNA, 15 bp, Homo sapiens
tgaacccttgcttgc

SEQ ID NO: 4075012 - DNA, 14 bp, Homo sapiens
tgaacctaccttca

SEQ ID NO: 4075013 - DNA, 20 bp, Homo sapiens
tgaacctaccttcatttcag

SEQ ID NO: 4075014 - DNA, 13 bp, Homo sapiens
tgaacctgtgagt

SEQ ID NO: 4075015 - DNA, 19 bp, Homo sapiens
tgaacctgtgagtaaatat

SEQ ID NO: 4075016 - DNA, 20 bp, Homo sapiens
tgaacctgtgagtaaatatt

SEQ ID NO: 4075017 - DNA, 16 bp, Homo sapiens
tgaacgtccacatgaa

SEQ ID NO: 4075018 - DNA, 16 bp, Homo sapiens
tgaactataaaaagca

SEQ ID NO: 4075019 - DNA, 21 bp, Homo sapiens
tgaactccaccgaccaactgc

SEQ ID NO: 4075020 - DNA, 22 bp, Homo sapiens
tgaactccaccgaccaactgcc

SEQ ID NO: 4075021 - DNA, 13 bp, Homo sapiens
tgaactcctgcca

SEQ ID NO: 4075022 - DNA, 12 bp, Homo sapiens
tgaactctcaaa

SEQ ID NO: 4075023 - DNA, 22 bp, Homo sapiens
tgaactctcaaaagtctatttt

SEQ ID NO: 4075024 - DNA, 18 bp, Homo sapiens
tgaactctgaactttgga

SEQ ID NO: 4075025 - DNA, 21 bp, Homo sapiens
tgaactctgttcccccaccct

SEQ ID NO: 4075026 - DNA, 15 bp, Homo sapiens
tgaactcttcaatct

SEQ ID NO: 4075027 - DNA, 18 bp, Homo sapiens
tgaactcttcaatctctt

SEQ ID NO: 4075028 - DNA, 23 bp, Homo sapiens
tgaactgaggagatgaccaggga

SEQ ID NO: 4075029 - DNA, 14 bp, Homo sapiens
tgaactgctttcaa

SEQ ID NO: 4075030 - DNA, 15 bp, Homo sapiens
tgaactgctttcaag

SEQ ID NO: 4075031 - DNA, 23 bp, Homo sapiens
tgaacttaataactgtgtactgt

SEQ ID NO: 4075032 - DNA, 17 bp, Homo sapiens
tgaacttctttgaattt

SEQ ID NO: 4075033 - DNA, 14 bp, Homo sapiens
tgaactttggagag

SEQ ID NO: 4075034 - DNA, 22 bp, Homo sapiens
tgaagaagctaaatcctttact

SEQ ID NO: 4075035 - DNA, 23 bp, Homo sapiens
tgaagaaggtggaccttttaaag

SEQ ID NO: 4075036 - DNA, 16 bp, Homo sapiens
tgaagaatagaaacaa

SEQ ID NO: 4075037 - DNA, 14 bp, Homo sapiens
tgaagaatatttaa

SEQ ID NO: 4075038 - DNA, 18 bp, Homo sapiens
tgaagaatatttaagaaa

SEQ ID NO: 4075039 - DNA, 11 bp, Homo sapiens
tgaagaatctt

SEQ ID NO: 4075040 - DNA, 12 bp, Homo sapiens
tgaagaatctta

SEQ ID NO: 4075041 - DNA, 14 bp, Homo sapiens
tgaagaattaagat

SEQ ID NO: 4075042 - DNA, 19 bp, Homo sapiens
tgaagacattttttgctat

SEQ ID NO: 4075043 - DNA, 21 bp, Homo sapiens
tgaagacattttttgctataa

SEQ ID NO: 4075044 - DNA, 15 bp, Homo sapiens
tgaagacccagcagg

SEQ ID NO: 4075045 - DNA, 13 bp, Homo sapiens
tgaagactccaga

SEQ ID NO: 4075046 - DNA, 15 bp, Homo sapiens
tgaagactggaagct

SEQ ID NO: 4075047 - DNA, 23 bp, Homo sapiens
tgaagagaaccgagcaaagatca

SEQ ID NO: 4075048 - DNA, 24 bp, Homo sapiens
tgaagagaaccgagcaaagatcaa

SEQ ID NO: 4075049 - DNA, 23 bp, Homo sapiens
tgaagagaccaagactctgaaat

SEQ ID NO: 4075050 - DNA, 18 bp, Homo sapiens
tgaagagcttgctttgat

SEQ ID NO: 4075051 - DNA, 13 bp, Homo sapiens
tgaagagcttgtg

SEQ ID NO: 4075052 - DNA, 17 bp, Homo sapiens
tgaagagggagaaggga

SEQ ID NO: 4075053 - DNA, 20 bp, Homo sapiens
tgaagagtatccttccttca

SEQ ID NO: 4075054 - DNA, 22 bp, Homo sapiens
tgaagagtgactagtacaaatt

SEQ ID NO: 4075055 - DNA, 17 bp, Homo sapiens
tgaagataatttgcata

SEQ ID NO: 4075056 - DNA, 22 bp, Homo sapiens
tgaagatgggggcctctttcag

SEQ ID NO: 4075057 - DNA, 21 bp, Homo sapiens
tgaagattaggagaaacacat

SEQ ID NO: 4075058 - DNA, 13 bp, Homo sapiens
tgaagcaaagaag

SEQ ID NO: 4075059 - DNA, 18 bp, Homo sapiens
tgaagcaaatcagaaact

SEQ ID NO: 4075060 - DNA, 19 bp, Homo sapiens
tgaagcaggttcccaagct

SEQ ID NO: 4075061 - DNA, 13 bp, Homo sapiens
tgaagcagtcttg

SEQ ID NO: 4075062 - DNA, 14 bp, Homo sapiens
tgaagccaagtggg

SEQ ID NO: 4075063 - DNA, 23 bp, Homo sapiens
tgaagccaagtggggtgctggga

SEQ ID NO: 4075064 - DNA, 23 bp, Homo sapiens
tgaagccagctcacagtgctgtg

SEQ ID NO: 4075065 - DNA, 15 bp, Homo sapiens
tgaagccgactctgg

SEQ ID NO: 4075066 - DNA, 15 bp, Homo sapiens
tgaagcctgctcctt

SEQ ID NO: 4075067 - DNA, 18 bp, Homo sapiens
tgaagcctgctccttccc

SEQ ID NO: 4075068 - DNA, 18 bp, Homo sapiens
tgaagcttgactcccaag

SEQ ID NO: 4075069 - DNA, 21 bp, Homo sapiens
tgaaggaaaaacacaagcaaa

SEQ ID NO: 4075070 - DNA, 19 bp, Homo sapiens
tgaaggaacattccttagt

SEQ ID NO: 4075071 - DNA, 19 bp, Homo sapiens
tgaaggaatcattccagtg

SEQ ID NO: 4075072 - DNA, 13 bp, Homo sapiens
tgaaggacctgag

SEQ ID NO: 4075073 - DNA, 19 bp, Homo sapiens
tgaaggaggctccaggcag

SEQ ID NO: 4075074 - DNA, 20 bp, Homo sapiens
tgaaggaggctccaggcagc

SEQ ID NO: 4075075 - DNA, 13 bp, Homo sapiens
tgaaggaggtgag

SEQ ID NO: 4075076 - DNA, 22 bp, Homo sapiens
tgaaggcccaagagcagagtct

SEQ ID NO: 4075077 - DNA, 16 bp, Homo sapiens
tgaaggcctggctgga

SEQ ID NO: 4075078 - DNA, 14 bp, Homo sapiens
tgaagggagagcca

SEQ ID NO: 4075079 - DNA, 16 bp, Homo sapiens
tgaagggagagccagc

SEQ ID NO: 4075080 - DNA, 12 bp, Homo sapiens
tgaagggccaga

SEQ ID NO: 4075081 - DNA, 17 bp, Homo sapiens
tgaagggccagagccag

SEQ ID NO: 4075082 - DNA, 16 bp, Homo sapiens
tgaaggttaggattta

SEQ ID NO: 4075083 - DNA, 15 bp, Homo sapiens
tgaagtaaattatgt

SEQ ID NO: 4075084 - DNA, 18 bp, Homo sapiens
tgaagtaaattatgtaac

SEQ ID NO: 4075085 - DNA, 14 bp, Homo sapiens
tgaagtaatgaatt

SEQ ID NO: 4075086 - DNA, 22 bp, Homo sapiens
tgaagtcacccctttctgtccc

SEQ ID NO: 4075087 - DNA, 21 bp, Homo sapiens
tgaagtgcgtgaatgtatgta

SEQ ID NO: 4075088 - DNA, 16 bp, Homo sapiens
tgaagtgtacctgtgt

SEQ ID NO: 4075089 - DNA, 14 bp, Homo sapiens
tgaagttaacagag

SEQ ID NO: 4075090 - DNA, 18 bp, Homo sapiens
tgacctcttgctgtctct

SEQ ID NO: 4075091 - DNA, 22 bp, Homo sapiens
tgacctcttgctgtctctgctc

SEQ ID NO: 4075092 - DNA, 12 bp, Homo sapiens
tgacctgctccg

SEQ ID NO: 4075093 - DNA, 23 bp, Homo sapiens
tgacctgctccgctgctccttgg

SEQ ID NO: 4075094 - DNA, 15 bp, Homo sapiens
tgacctgtgaccagc

SEQ ID NO: 4075095 - DNA, 22 bp, Homo sapiens
tgacctgtgaccagcactgtct

SEQ ID NO: 4075096 - DNA, 16 bp, Homo sapiens
tgacctgtttctctgc

SEQ ID NO: 4075097 - DNA, 18 bp, Homo sapiens
tgaccttttatgtagtaa

SEQ ID NO: 4075098 - DNA, 15 bp, Homo sapiens
tgaccttttcttcat

SEQ ID NO: 4075099 - DNA, 17 bp, Homo sapiens
tgacgattccttctctg

SEQ ID NO: 4075100 - DNA, 20 bp, Homo sapiens
tgacggccctcatctatgag

SEQ ID NO: 4075101 - DNA, 18 bp, Homo sapiens
tgacggcgcccccagtgt

SEQ ID NO: 4075102 - DNA, 22 bp, Homo sapiens
tgactaaaaatattataactta

SEQ ID NO: 4075103 - DNA, 16 bp, Homo sapiens
tgactaaagctatgtt

SEQ ID NO: 4075104 - DNA, 17 bp, Homo sapiens
tgactaaagctatgtta

SEQ ID NO: 4075105 - DNA, 11 bp, Homo sapiens
tgactaattag

SEQ ID NO: 4075106 - DNA, 21 bp, Homo sapiens
tgactaattagggtacattta

SEQ ID NO: 4075107 - DNA, 19 bp, Homo sapiens
tgactacttagcatcctaa

SEQ ID NO: 4075108 - DNA, 22 bp, Homo sapiens
tgactacttagcatcctaagaa

SEQ ID NO: 4075109 - DNA, 15 bp, Homo sapiens
tgactactttgcctt

SEQ ID NO: 4075110 - DNA, 21 bp, Homo sapiens
tgactagaagggccagtcctg

SEQ ID NO: 4075111 - DNA, 17 bp, Homo sapiens
tgactagggattcaggc

SEQ ID NO: 4075112 - DNA, 15 bp, Homo sapiens
tgactagtacaaatt

SEQ ID NO: 4075113 - DNA, 16 bp, Homo sapiens
tgactagtacaaatta

SEQ ID NO: 4075114 - DNA, 23 bp, Homo sapiens
tgactagtacaaattataaaaag

SEQ ID NO: 4075115 - DNA, 15 bp, Homo sapiens
tgactcaacatgtta

SEQ ID NO: 4075116 - DNA, 22 bp, Homo sapiens
tgactcacaggccctggagaag

SEQ ID NO: 4075117 - DNA, 18 bp, Homo sapiens
tgactcacttatcccaag

SEQ ID NO: 4075118 - DNA, 13 bp, Homo sapiens
tgactcagttcca

SEQ ID NO: 4075119 - DNA, 20 bp, Homo sapiens
tgactcagttccaggcctga

SEQ ID NO: 4075120 - DNA, 18 bp, Homo sapiens
tgactcatccccacagct

SEQ ID NO: 4075121 - DNA, 22 bp, Homo sapiens
tgactcatccccacagctggct

SEQ ID NO: 4075122 - DNA, 16 bp, Homo sapiens
tgactcatggcagctg

SEQ ID NO: 4075123 - DNA, 21 bp, Homo sapiens
tgactcatggcagctgtttct

SEQ ID NO: 4075124 - DNA, 18 bp, Homo sapiens
tgactcccccagtcccct

SEQ ID NO: 4075125 - DNA, 19 bp, Homo sapiens
tgactcccccagtcccctt

SEQ ID NO: 4075126 - DNA, 18 bp, Homo sapiens
tgactcctacctgccctg

SEQ ID NO: 4075127 - DNA, 19 bp, Homo sapiens
tgactcctacctgccctgg

SEQ ID NO: 4075128 - DNA, 22 bp, Homo sapiens
tgactcctacctgccctggaac

SEQ ID NO: 4075129 - DNA, 13 bp, Homo sapiens
tgactcctctggc

SEQ ID NO: 4075130 - DNA, 16 bp, Homo sapiens
tgactcctctggcttt

SEQ ID NO: 4075131 - DNA, 20 bp, Homo sapiens
tgactctaagctcagtgctc

SEQ ID NO: 4075132 - DNA, 11 bp, Homo sapiens
tgactctccac

SEQ ID NO: 4075133 - DNA, 19 bp, Homo sapiens
tgactctgccccctgctgg

SEQ ID NO: 4075134 - DNA, 14 bp, Homo sapiens
tgactcttgcgtgt

SEQ ID NO: 4075135 - DNA, 22 bp, Homo sapiens
tgactctttttagggccaggca

SEQ ID NO: 4075136 - DNA, 15 bp, Homo sapiens
tgactgatgattttc

SEQ ID NO: 4075137 - DNA, 22 bp, Homo sapiens
tgactgctcagaacttgctgct

SEQ ID NO: 4075138 - DNA, 21 bp, Homo sapiens
tgactgctccccagccctggc

SEQ ID NO: 4075139 - DNA, 14 bp, Homo sapiens
tgactggaggaggc

SEQ ID NO: 4075140 - DNA, 13 bp, Homo sapiens
tgactgggctggg

SEQ ID NO: 4075141 - DNA, 20 bp, Homo sapiens
tgactgggctgggtttgctg

SEQ ID NO: 4075142 - DNA, 14 bp, Homo sapiens
tgactggggctggg

SEQ ID NO: 4075143 - DNA, 17 bp, Homo sapiens
tgactgggtgagaccca

SEQ ID NO: 4075144 - DNA, 19 bp, Homo sapiens
tgactggtttacaggccct

SEQ ID NO: 4075145 - DNA, 16 bp, Homo sapiens
tgactgtagccacagc

SEQ ID NO: 4075146 - DNA, 22 bp, Homo sapiens
tgactgtcccaccgggagcctc

SEQ ID NO: 4075147 - DNA, 15 bp, Homo sapiens
tgactgtgaccacct

SEQ ID NO: 4075148 - DNA, 18 bp, Homo sapiens
tgactgtgaccaccttct

SEQ ID NO: 4075149 - DNA, 19 bp, Homo sapiens
tgactgtttggcttataaa

SEQ ID NO: 4075150 - DNA, 22 bp, Homo sapiens
tgactgtttggcttataaacac

SEQ ID NO: 4075151 - DNA, 16 bp, Homo sapiens
tgacttaactgcattt

SEQ ID NO: 4075152 - DNA, 20 bp, Homo sapiens
tgacttatttctgctctgga

SEQ ID NO: 4075153 - DNA, 16 bp, Homo sapiens
tgacttcagctgcctg

SEQ ID NO: 4075154 - DNA, 13 bp, Homo sapiens
tgacttcatggaa

SEQ ID NO: 4075155 - DNA, 15 bp, Homo sapiens
tgacttctccaggtc

SEQ ID NO: 4075156 - DNA, 12 bp, Homo sapiens
tgacttggggga

SEQ ID NO: 4075157 - DNA, 15 bp, Homo sapiens
tgacttgtttgtctt

SEQ ID NO: 4075158 - DNA, 13 bp, Homo sapiens
tgactttaaaaga

SEQ ID NO: 4075159 - DNA, 22 bp, Homo sapiens
tgactttacgcccatctcagga

SEQ ID NO: 4075160 - DNA, 15 bp, Homo sapiens
tgactttctgattgg

SEQ ID NO: 4075161 - DNA, 16 bp, Homo sapiens
tgactttgcttgcttt

SEQ ID NO: 4075162 - DNA, 18 bp, Homo sapiens
tgactttgtctctcctgg

SEQ ID NO: 4075163 - DNA, 15 bp, Homo sapiens
tgactttttgtttct

SEQ ID NO: 4075164 - DNA, 15 bp, Homo sapiens
tgactttttttgtat

SEQ ID NO: 4075165 - DNA, 19 bp, Homo sapiens
tgagaaaaaaaaaaaagac

SEQ ID NO: 4075166 - DNA, 18 bp, Homo sapiens
tgagaaaaagctcctgtc

SEQ ID NO: 4075167 - DNA, 18 bp, Homo sapiens
tgagaaaaccccttccca

SEQ ID NO: 4075168 - DNA, 15 bp, Homo sapiens
tgagaaactgctgca

SEQ ID NO: 4075169 - DNA, 14 bp, Homo sapiens
tgagaaagaaagta

SEQ ID NO: 4075170 - DNA, 18 bp, Homo sapiens
tgagaaatgaaatattgt

SEQ ID NO: 4075171 - DNA, 13 bp, Homo sapiens
tgagaactcctga

SEQ ID NO: 4075172 - DNA, 15 bp, Homo sapiens
tgagaacttgacaag

SEQ ID NO: 4075173 - DNA, 18 bp, Homo sapiens
tgagaagaagtggctgcc

SEQ ID NO: 4075174 - DNA, 16 bp, Homo sapiens
tgagaagattgtgaat

SEQ ID NO: 4075175 - DNA, 14 bp, Homo sapiens
tgagaagcggtcat

SEQ ID NO: 4075176 - DNA, 16 bp, Homo sapiens
tgagaaggcagccacc

SEQ ID NO: 4075177 - DNA, 17 bp, Homo sapiens
tgagaaggcagccacca

SEQ ID NO: 4075178 - DNA, 20 bp, Homo sapiens
tgagaaggcagccaccagcg

SEQ ID NO: 4075179 - DNA, 16 bp, Homo sapiens
tgagaagtgccttctc

SEQ ID NO: 4075180 - DNA, 18 bp, Homo sapiens
tgagaatcccttaaaatt

SEQ ID NO: 4075181 - DNA, 20 bp, Homo sapiens
tgagaatcctctcctttctt

SEQ ID NO: 4075182 - DNA, 22 bp, Homo sapiens
tgagaatcctctcctttcttat

SEQ ID NO: 4075183 - DNA, 16 bp, Homo sapiens
tgagaattccaaggag

SEQ ID NO: 4075184 - DNA, 14 bp, Homo sapiens
tgagaatttctaaa

SEQ ID NO: 4075185 - DNA, 13 bp, Homo sapiens
tgagaattttaaa

SEQ ID NO: 4075186 - DNA, 15 bp, Homo sapiens
tgagaattttaaatt

SEQ ID NO: 4075187 - DNA, 23 bp, Homo sapiens
tgagaattttaaattataactta

SEQ ID NO: 4075188 - DNA, 12 bp, Homo sapiens
tgagacaatgtt

SEQ ID NO: 4075189 - DNA, 15 bp, Homo sapiens
tgagacagcagtctt

SEQ ID NO: 4075190 - DNA, 20 bp, Homo sapiens
tgagacagtttcttagcttt

SEQ ID NO: 4075191 - DNA, 23 bp, Homo sapiens
tgagacagtttcttagcttttta

SEQ ID NO: 4075192 - DNA, 17 bp, Homo sapiens
tgagaccagcctgggca

SEQ ID NO: 4075193 - DNA, 17 bp, Homo sapiens
tgagtgggagaaggcag

SEQ ID NO: 4075194 - DNA, 21 bp, Homo sapiens
tgagtggggttatctctgtgt

SEQ ID NO: 4075195 - DNA, 15 bp, Homo sapiens
tgagtgtaagtgtga

SEQ ID NO: 4075196 - DNA, 15 bp, Homo sapiens
tgagtgtctgtgaga

SEQ ID NO: 4075197 - DNA, 13 bp, Homo sapiens
tgagtgtgacagg

SEQ ID NO: 4075198 - DNA, 17 bp, Homo sapiens
tgagtgtgacagggcca

SEQ ID NO: 4075199 - DNA, 24 bp, Homo sapiens
tgagtgttcctttttaaatgtgaa

SEQ ID NO: 4075200 - DNA, 15 bp, Homo sapiens
tgagttacttcctat

SEQ ID NO: 4075201 - DNA, 22 bp, Homo sapiens
tgagttctacataagtaattca

SEQ ID NO: 4075202 - DNA, 15 bp, Homo sapiens
tgagttctccctgta

SEQ ID NO: 4075203 - DNA, 16 bp, Homo sapiens
tgagttctgggtttct

SEQ ID NO: 4075204 - DNA, 20 bp, Homo sapiens
tgagttgatgggggccagga

SEQ ID NO: 4075205 - DNA, 21 bp, Homo sapiens
tgagttggggtctggcagcct

SEQ ID NO: 4075206 - DNA, 15 bp, Homo sapiens
tgagtttaccatttg

SEQ ID NO: 4075207 - DNA, 16 bp, Homo sapiens
tgagtttaccttgtat

SEQ ID NO: 4075208 - DNA, 18 bp, Homo sapiens
tgagtttgagctgccttc

SEQ ID NO: 4075209 - DNA, 13 bp, Homo sapiens
tgagttttaaatt

SEQ ID NO: 4075210 - DNA, 14 bp, Homo sapiens
tgagtttttcctcc

SEQ ID NO: 4075211 - DNA, 13 bp, Homo sapiens
tgagtttttgata

SEQ ID NO: 4075212 - DNA, 18 bp, Homo sapiens
tgagtttttgatagcttt

SEQ ID NO: 4075213 - DNA, 18 bp, Homo sapiens
tgataaaagggcaaatct

SEQ ID NO: 4075214 - DNA, 15 bp, Homo sapiens
tgataaagagacagt

SEQ ID NO: 4075215 - DNA, 15 bp, Homo sapiens
tgataacttggggag

SEQ ID NO: 4075216 - DNA, 20 bp, Homo sapiens
tgataagactgtttttaagt

SEQ ID NO: 4075217 - DNA, 16 bp, Homo sapiens
tgataaggatcagaac

SEQ ID NO: 4075218 - DNA, 14 bp, Homo sapiens
tgataataaattga

SEQ ID NO: 4075219 - DNA, 18 bp, Homo sapiens
tgataataaattgaaatt

SEQ ID NO: 4075220 - DNA, 15 bp, Homo sapiens
tgataatgttaaatt

SEQ ID NO: 4075221 - DNA, 17 bp, Homo sapiens
tgataatgttaaatttg

SEQ ID NO: 4075222 - DNA, 18 bp, Homo sapiens
tgataatgttaaatttgt

SEQ ID NO: 4075223 - DNA, 22 bp, Homo sapiens
tgataatgttaaatttgtaagt

SEQ ID NO: 4075224 - DNA, 22 bp, Homo sapiens
tgataattgtttgaggggagga

SEQ ID NO: 4075225 - DNA, 18 bp, Homo sapiens
tgataatttaagagctaa

SEQ ID NO: 4075226 - DNA, 16 bp, Homo sapiens
tgatacatccaaagca

SEQ ID NO: 4075227 - DNA, 21 bp, Homo sapiens
tgataccagaagggaaagctt

SEQ ID NO: 4075228 - DNA, 18 bp, Homo sapiens
tgatacccccctctgtct

SEQ ID NO: 4075229 - DNA, 19 bp, Homo sapiens
tgatacccccctctgtctt

SEQ ID NO: 4075230 - DNA, 19 bp, Homo sapiens
tgatacgcaacataattaa

SEQ ID NO: 4075231 - DNA, 18 bp, Homo sapiens
tgatactatccagttact

SEQ ID NO: 4075232 - DNA, 15 bp, Homo sapiens
tgatacttttaagag

SEQ ID NO: 4075233 - DNA, 14 bp, Homo sapiens
tgatagaaaagtgt

SEQ ID NO: 4075234 - DNA, 14 bp, Homo sapiens
tgatagcactttct

SEQ ID NO: 4075235 - DNA, 11 bp, Homo sapiens
tgatagcttta

SEQ ID NO: 4075236 - DNA, 12 bp, Homo sapiens
tgatataaattc

SEQ ID NO: 4075237 - DNA, 14 bp, Homo sapiens
tgatataaattctg

SEQ ID NO: 4075238 - DNA, 19 bp, Homo sapiens
tgatatataagtgtacata

SEQ ID NO: 4075239 - DNA, 21 bp, Homo sapiens
tgatatcatgcccctgtactc

SEQ ID NO: 4075240 - DNA, 19 bp, Homo sapiens
tgatatggcagaagacacc

SEQ ID NO: 4075241 - DNA, 21 bp, Homo sapiens
tgatatgtaaacataattctt

SEQ ID NO: 4075242 - DNA, 14 bp, Homo sapiens
tgatattaatcaaa

SEQ ID NO: 4075243 - DNA, 21 bp, Homo sapiens
tgatattaatcaaaattgtct

SEQ ID NO: 4075244 - DNA, 22 bp, Homo sapiens
tgatattccatgaatgtatcag

SEQ ID NO: 4075245 - DNA, 14 bp, Homo sapiens
tgatattgtttaaa

SEQ ID NO: 4075246 - DNA, 15 bp, Homo sapiens
tgatattgtttaaaa

SEQ ID NO: 4075247 - DNA, 16 bp, Homo sapiens
tgatattgtttaaaat

SEQ ID NO: 4075248 - DNA, 16 bp, Homo sapiens
tgatatttgcattgag

SEQ ID NO: 4075249 - DNA, 21 bp, Homo sapiens
tgatattttcaacgcagccct

SEQ ID NO: 4075250 - DNA, 16 bp, Homo sapiens
tgatcaaattcatttt

SEQ ID NO: 4075251 - DNA, 21 bp, Homo sapiens
tgatcaagtcctttgtgaata

SEQ ID NO: 4075252 - DNA, 13 bp, Homo sapiens
tgatcaataaaat

SEQ ID NO: 4075253 - DNA, 18 bp, Homo sapiens
tgatcaataaaatgtgat

SEQ ID NO: 4075254 - DNA, 15 bp, Homo sapiens
tgatcaattaaatgt

SEQ ID NO: 4075255 - DNA, 12 bp, Homo sapiens
tgatcacactct

SEQ ID NO: 4075256 - DNA, 13 bp, Homo sapiens
tgatcacactctg

SEQ ID NO: 4075257 - DNA, 15 bp, Homo sapiens
tgatcacccaatgca

SEQ ID NO: 4075258 - DNA, 15 bp, Homo sapiens
tgatcacgcctggct

SEQ ID NO: 4075259 - DNA, 16 bp, Homo sapiens
tgatcagctgtttgtc

SEQ ID NO: 4075260 - DNA, 18 bp, Homo sapiens
tgatcagctgtttgtcat

SEQ ID NO: 4075261 - DNA, 18 bp, Homo sapiens
tgatcagtgttgttgctc

SEQ ID NO: 4075262 - DNA, 20 bp, Homo sapiens
tgatcataaactgactatca

SEQ ID NO: 4075263 - DNA, 17 bp, Homo sapiens
tgatcataagtgaattt

SEQ ID NO: 4075264 - DNA, 22 bp, Homo sapiens
tgatcatagctcactgcagcct

SEQ ID NO: 4075265 - DNA, 16 bp, Homo sapiens
tgatcatcgccagagg

SEQ ID NO: 4075266 - DNA, 16 bp, Homo sapiens
tgatcatgcattgttg

SEQ ID NO: 4075267 - DNA, 23 bp, Homo sapiens
tgatcatgcattgttgaggtggt

SEQ ID NO: 4075268 - DNA, 18 bp, Homo sapiens
tgatcattttccccccac

SEQ ID NO: 4075269 - DNA, 22 bp, Homo sapiens
tgatcattttccccccactctc

SEQ ID NO: 4075270 - DNA, 15 bp, Homo sapiens
tgatccagaacagtg

SEQ ID NO: 4075271 - DNA, 18 bp, Homo sapiens
tgatccagaagagcccat

SEQ ID NO: 4075272 - DNA, 22 bp, Homo sapiens
tgatccagaagagcccatatca

SEQ ID NO: 4075273 - DNA, 14 bp, Homo sapiens
tgatccatccatct

SEQ ID NO: 4075274 - DNA, 16 bp, Homo sapiens
tgatccatccatctcc

SEQ ID NO: 4075275 - DNA, 20 bp, Homo sapiens
tgatccccaagtggtgaatg

SEQ ID NO: 4075276 - DNA, 17 bp, Homo sapiens
tgatccccatgcctagc

SEQ ID NO: 4075277 - DNA, 23 bp, Homo sapiens
tgatcccttccacctgctctgct

SEQ ID NO: 4075278 - DNA, 14 bp, Homo sapiens
tgatcctggaggcc

SEQ ID NO: 4075279 - DNA, 15 bp, Homo sapiens
tgatcctggaggccc

SEQ ID NO: 4075280 - DNA, 17 bp, Homo sapiens
tgatcctggaggcccag

SEQ ID NO: 4075281 - DNA, 19 bp, Homo sapiens
tgatctccatatgttacac

SEQ ID NO: 4075282 - DNA, 20 bp, Homo sapiens
tgatctctactaccacaagg

SEQ ID NO: 4075283 - DNA, 23 bp, Homo sapiens
tgatctctactaccacaaggaaa

SEQ ID NO: 4075284 - DNA, 14 bp, Homo sapiens
tgatctctccacgg

SEQ ID NO: 4075285 - DNA, 15 bp, Homo sapiens
tgatctctcttgtcc

SEQ ID NO: 4075286 - DNA, 16 bp, Homo sapiens
tgatctctcttgtcct

SEQ ID NO: 4075287 - DNA, 24 bp, Homo sapiens
tgatctctcttgtcctcttctgct

SEQ ID NO: 4075288 - DNA, 20 bp, Homo sapiens
tgatctcttctggtgttgac

SEQ ID NO: 4075289 - DNA, 21 bp, Homo sapiens
tgatctcttctggtgttgact

SEQ ID NO: 4075290 - DNA, 22 bp, Homo sapiens
tgatctcttctggtgttgactg

SEQ ID NO: 4075291 - DNA, 20 bp, Homo sapiens
tgatctgggcattttcctcc

SEQ ID NO: 4075292 - DNA, 23 bp, Homo sapiens
tgatctgtatttaatggttttta

SEQ ID NO: 4075293 - DNA, 18 bp, Homo sapiens
tgatcttaatatatttga

SEQ ID NO: 4075294 - DNA, 23 bp, Homo sapiens
tgatcttacaagatattgatgat

SEQ ID NO: 4075295 - DNA, 19 bp, Homo sapiens
tgcactccagcctgggcga

SEQ ID NO: 4075296 - DNA, 17 bp, Homo sapiens
tgcactccagcctgggg

SEQ ID NO: 4075297 - DNA, 16 bp, Homo sapiens
tgcactctaaactgca

SEQ ID NO: 4075298 - DNA, 14 bp, Homo sapiens
tgcactctgctaat

SEQ ID NO: 4075299 - DNA, 23 bp, Homo sapiens
tgcactcttgtttctcccgtgct

SEQ ID NO: 4075300 - DNA, 16 bp, Homo sapiens
tgcactgagggccaca

SEQ ID NO: 4075301 - DNA, 22 bp, Homo sapiens
tgcactgatatatcatgagtga

SEQ ID NO: 4075302 - DNA, 16 bp, Homo sapiens
tgcactgatgctgccc

SEQ ID NO: 4075303 - DNA, 19 bp, Homo sapiens
tgcactgcccatggacagg

SEQ ID NO: 4075304 - DNA, 12 bp, Homo sapiens
tgcactgccctg

SEQ ID NO: 4075305 - DNA, 23 bp, Homo sapiens
tgcactgtcactttgctctgggt

SEQ ID NO: 4075306 - DNA, 21 bp, Homo sapiens
tgcacttggggcacagggaga

SEQ ID NO: 4075307 - DNA, 14 bp, Homo sapiens
tgcagaaaaagaaa

SEQ ID NO: 4075308 - DNA, 14 bp, Homo sapiens
tgcagaactcccaa

SEQ ID NO: 4075309 - DNA, 22 bp, Homo sapiens
tgcagaagggagctggctccag

SEQ ID NO: 4075310 - DNA, 21 bp, Homo sapiens
tgcagacagggggccagaaca

SEQ ID NO: 4075311 - DNA, 15 bp, Homo sapiens
tgcagacctcaagcc

SEQ ID NO: 4075312 - DNA, 18 bp, Homo sapiens
tgcagacctcaagccatc

SEQ ID NO: 4075313 - DNA, 16 bp, Homo sapiens
tgcagacttcccagct

SEQ ID NO: 4075314 - DNA, 19 bp, Homo sapiens
tgcagagaaacttaagcaa

SEQ ID NO: 4075315 - DNA, 16 bp, Homo sapiens
tgcagagaagctggac

SEQ ID NO: 4075316 - DNA, 17 bp, Homo sapiens
tgcagagaagctggact

SEQ ID NO: 4075317 - DNA, 18 bp, Homo sapiens
tgcagagaagctggactt

SEQ ID NO: 4075318 - DNA, 16 bp, Homo sapiens
tgcagagagccatttt

SEQ ID NO: 4075319 - DNA, 17 bp, Homo sapiens
tgcagagccttctcaga

SEQ ID NO: 4075320 - DNA, 22 bp, Homo sapiens
tgcagagccttctcagaagcac

SEQ ID NO: 4075321 - DNA, 14 bp, Homo sapiens
tgcagagtccattt

SEQ ID NO: 4075322 - DNA, 19 bp, Homo sapiens
tgcagatactactgaccag

SEQ ID NO: 4075323 - DNA, 23 bp, Homo sapiens
tgcagatactactgaccagacaa

SEQ ID NO: 4075324 - DNA, 13 bp, Homo sapiens
tgcagatgaaatg

SEQ ID NO: 4075325 - DNA, 17 bp, Homo sapiens
tgcagatgaaatgttct

SEQ ID NO: 4075326 - DNA, 15 bp, Homo sapiens
tgcagatgcaattgt

SEQ ID NO: 4075327 - DNA, 16 bp, Homo sapiens
tgcagatgtgagccac

SEQ ID NO: 4075328 - DNA, 18 bp, Homo sapiens
tgcagatttatttagtga

SEQ ID NO: 4075329 - DNA, 14 bp, Homo sapiens
tgcagatttgatat

SEQ ID NO: 4075330 - DNA, 19 bp, Homo sapiens
tgcagcaaggccctgctgc

SEQ ID NO: 4075331 - DNA, 18 bp, Homo sapiens
tgcagcacctccaggcct

SEQ ID NO: 4075332 - DNA, 19 bp, Homo sapiens
tgcagcacctccaggcctg

SEQ ID NO: 4075333 - DNA, 20 bp, Homo sapiens
tgcagcacctccaggcctgt

SEQ ID NO: 4075334 - DNA, 18 bp, Homo sapiens
tgcagcacgtctcagaga

SEQ ID NO: 4075335 - DNA, 20 bp, Homo sapiens
tgcagcaggagtggtgcaga

SEQ ID NO: 4075336 - DNA, 22 bp, Homo sapiens
tgcagcaggagtggtgcagaca

SEQ ID NO: 4075337 - DNA, 23 bp, Homo sapiens
tgcagcaggagtggtgcagacag

SEQ ID NO: 4075338 - DNA, 10 bp, Homo sapiens
tgcagcaggc

SEQ ID NO: 4075339 - DNA, 22 bp, Homo sapiens
tgcagcagtgagtctcttcaga

SEQ ID NO: 4075340 - DNA, 14 bp, Homo sapiens
tgcagcatgagact

SEQ ID NO: 4075341 - DNA, 18 bp, Homo sapiens
tgcagcatggtccctgcc

SEQ ID NO: 4075342 - DNA, 14 bp, Homo sapiens
tgcagccacatggc

SEQ ID NO: 4075343 - DNA, 16 bp, Homo sapiens
tgcagccacatggccc

SEQ ID NO: 4075344 - DNA, 18 bp, Homo sapiens
tgcagccacatggcccca

SEQ ID NO: 4075345 - DNA, 22 bp, Homo sapiens
tgcagccacatggccccatccc

SEQ ID NO: 4075346 - DNA, 18 bp, Homo sapiens
tgcagccacgattggaga

SEQ ID NO: 4075347 - DNA, 13 bp, Homo sapiens
tgcagcccaaaac

SEQ ID NO: 4075348 - DNA, 22 bp, Homo sapiens
tgcagcccaaaacccagggcaa

SEQ ID NO: 4075349 - DNA, 10 bp, Homo sapiens
tgcagcccac

SEQ ID NO: 4075350 - DNA, 13 bp, Homo sapiens
tgcagcccatgcc

SEQ ID NO: 4075351 - DNA, 14 bp, Homo sapiens
tgcagcccatgccc

SEQ ID NO: 4075352 - DNA, 19 bp, Homo sapiens
tgcagcccatgcccacctg

SEQ ID NO: 4075353 - DNA, 23 bp, Homo sapiens
tgcagcccatgcccacctgccca

SEQ ID NO: 4075354 - DNA, 14 bp, Homo sapiens
tgcagcccttgggc

SEQ ID NO: 4075355 - DNA, 15 bp, Homo sapiens
tgcagcccttgggca

SEQ ID NO: 4075356 - DNA, 23 bp, Homo sapiens
tgcagcctaaagtacagcctgga

SEQ ID NO: 4075357 - DNA, 21 bp, Homo sapiens
tgcagcctcatactcctgggc

SEQ ID NO: 4075358 - DNA, 19 bp, Homo sapiens
tgcagcctgcccctagaca

SEQ ID NO: 4075359 - DNA, 22 bp, Homo sapiens
tgcagcctgctctagtgggaca

SEQ ID NO: 4075360 - DNA, 19 bp, Homo sapiens
tgcagcctggctggtcctc

SEQ ID NO: 4075361 - DNA, 21 bp, Homo sapiens
tgcagcctggctggtcctccc

SEQ ID NO: 4075362 - DNA, 23 bp, Homo sapiens
tgcagcctggctggtcctcccat

SEQ ID NO: 4075363 - DNA, 12 bp, Homo sapiens
tgcagcgcagct

SEQ ID NO: 4075364 - DNA, 19 bp, Homo sapiens
tgcagcgcagctggactct

SEQ ID NO: 4075365 - DNA, 16 bp, Homo sapiens
tgcagctcactaccct

SEQ ID NO: 4075366 - DNA, 16 bp, Homo sapiens
tgcagctcttcctgga

SEQ ID NO: 4075367 - DNA, 16 bp, Homo sapiens
tgcagctgagcctgag

SEQ ID NO: 4075368 - DNA, 16 bp, Homo sapiens
tgcagctgattttaac

SEQ ID NO: 4075369 - DNA, 22 bp, Homo sapiens
tgcagctttatgttcatttgtt

SEQ ID NO: 4075370 - DNA, 16 bp, Homo sapiens
tgcaggaataaggcct

SEQ ID NO: 4075371 - DNA, 12 bp, Homo sapiens
tgcaggaatcaa

SEQ ID NO: 4075372 - DNA, 14 bp, Homo sapiens
tgcaggaatcaaaa

SEQ ID NO: 4075373 - DNA, 19 bp, Homo sapiens
tgcaggacaggaggcggcc

SEQ ID NO: 4075374 - DNA, 15 bp, Homo sapiens
tgcaggacttgagaa

SEQ ID NO: 4075375 - DNA, 18 bp, Homo sapiens
tgcaggacttgagaagac

SEQ ID NO: 4075376 - DNA, 12 bp, Homo sapiens
tgcaggaggcca

SEQ ID NO: 4075377 - DNA, 23 bp, Homo sapiens
tgcaggaggccaaactgtccctc

SEQ ID NO: 4075378 - DNA, 17 bp, Homo sapiens
tgcaggattctcaccag

SEQ ID NO: 4075379 - DNA, 21 bp, Homo sapiens
tgcaggcagagctggagcccc

SEQ ID NO: 4075380 - DNA, 22 bp, Homo sapiens
tgcaggccctttgaagcctcag

SEQ ID NO: 4075381 - DNA, 18 bp, Homo sapiens
tgcagggaggggaggcag

SEQ ID NO: 4075382 - DNA, 12 bp, Homo sapiens
tgcagggcagcc

SEQ ID NO: 4075383 - DNA, 13 bp, Homo sapiens
tgcagggcagccc

SEQ ID NO: 4075384 - DNA, 18 bp, Homo sapiens
tgcaggggtcccccctca

SEQ ID NO: 4075385 - DNA, 15 bp, Homo sapiens
tgcagggtcctcttc

SEQ ID NO: 4075386 - DNA, 22 bp, Homo sapiens
tgcagggtcctcttctgggcct

SEQ ID NO: 4075387 - DNA, 15 bp, Homo sapiens
tgcaggtgggcactg

SEQ ID NO: 4075388 - DNA, 23 bp, Homo sapiens
tgcaggttggaaggggccttgct

SEQ ID NO: 4075389 - DNA, 16 bp, Homo sapiens
tgcaggtttgttacat

SEQ ID NO: 4075390 - DNA, 15 bp, Homo sapiens
tgcagtaaatctttt

SEQ ID NO: 4075391 - DNA, 21 bp, Homo sapiens
tgcagtaaatcttttacaact

SEQ ID NO: 4075392 - DNA, 11 bp, Homo sapiens
tgcagtaactg

SEQ ID NO: 4075393 - DNA, 21 bp, Homo sapiens
tgcagtaactgttttttaagt

SEQ ID NO: 4075394 - DNA, 16 bp, Homo sapiens
tgcagtacagtcttat

SEQ ID NO: 4075395 - DNA, 19 bp, Homo sapiens
tgcagtcagccaagatctt

SEQ ID NO: 4075396 - DNA, 15 bp, Homo sapiens
tgcagtcatcagaag

SEQ ID NO: 4075397 - DNA, 15 bp, Homo sapiens
cggtcacacggccac

SEQ ID NO: 4075398 - DNA, 19 bp, Homo sapiens
cggtcagtgccttttggaa

SEQ ID NO: 4075399 - DNA, 14 bp, Homo sapiens
cggtcccacactgg

SEQ ID NO: 4075400 - DNA, 20 bp, Homo sapiens
cggtccccatccccaccagc

SEQ ID NO: 4075401 - DNA, 15 bp, Homo sapiens
cggtctgacagtcct

SEQ ID NO: 4075402 - DNA, 17 bp, Homo sapiens
cggtgctagcttgacac

SEQ ID NO: 4075403 - DNA, 16 bp, Homo sapiens
cggtgctgtgagggag

SEQ ID NO: 4075404 - DNA, 16 bp, Homo sapiens
cggtgcttctggaaac

SEQ ID NO: 4075405 - DNA, 13 bp, Homo sapiens
cggtggctgcccc

SEQ ID NO: 4075406 - DNA, 18 bp, Homo sapiens
cggtgtggtgcagtgtga

SEQ ID NO: 4075407 - DNA, 20 bp, Homo sapiens
cggttataaaaaatggttca

SEQ ID NO: 4075408 - DNA, 17 bp, Homo sapiens
cggttcagacccctgcc

SEQ ID NO: 4075409 - DNA, 13 bp, Homo sapiens
cggttcagtgttt

SEQ ID NO: 4075410 - DNA, 18 bp, Homo sapiens
cggttcctcatctgagag

SEQ ID NO: 4075411 - DNA, 20 bp, Homo sapiens
cggtttatcgccctggcagg

SEQ ID NO: 4075412 - DNA, 18 bp, Homo sapiens
cggtttgtcagttcttgg

SEQ ID NO: 4075413 - DNA, 15 bp, Homo sapiens
cggttttttcacttc

SEQ ID NO: 4075414 - DNA, 19 bp, Homo sapiens
cgtaaaagagataataaga

SEQ ID NO: 4075415 - DNA, 22 bp, Homo sapiens
cgtaaaagagataataagatta

SEQ ID NO: 4075416 - DNA, 15 bp, Homo sapiens
ctaaggtaatcctat

SEQ ID NO: 4075417 - DNA, 14 bp, Homo sapiens
ctaaggttctcata

SEQ ID NO: 4075418 - DNA, 20 bp, Homo sapiens
ctaagtacacaataagcaaa

SEQ ID NO: 4075419 - DNA, 17 bp, Homo sapiens
ctaagtaggggcagtga

SEQ ID NO: 4075420 - DNA, 19 bp, Homo sapiens
ctaagtaggggcagtgatg

SEQ ID NO: 4075421 - DNA, 22 bp, Homo sapiens
ctaagtggctgccttctttcca

SEQ ID NO: 4075422 - DNA, 16 bp, Homo sapiens
ctaagttatagtatat

SEQ ID NO: 4075423 - DNA, 19 bp, Homo sapiens
ctaataaaattcgctttct

SEQ ID NO: 4075424 - DNA, 20 bp, Homo sapiens
ctaatacctcttactttgct

SEQ ID NO: 4075425 - DNA, 21 bp, Homo sapiens
ctaatacctcttactttgctt

SEQ ID NO: 4075426 - DNA, 20 bp, Homo sapiens
ctaatatggccacagtagtc

SEQ ID NO: 4075427 - DNA, 20 bp, Homo sapiens
ctaatcaaagccagggtctc

SEQ ID NO: 4075428 - DNA, 15 bp, Homo sapiens
ctaatcaccatgtaa

SEQ ID NO: 4075429 - DNA, 19 bp, Homo sapiens
ctaatcaccatgtaagcac

SEQ ID NO: 4075430 - DNA, 23 bp, Homo sapiens
ctaatcagaaatttttatcagtt

SEQ ID NO: 4075431 - DNA, 17 bp, Homo sapiens
ctaatccaggcagatcc

SEQ ID NO: 4075432 - DNA, 18 bp, Homo sapiens
ctaatccaggcagatcca

SEQ ID NO: 4075433 - DNA, 21 bp, Homo sapiens
ctaatccctgggcattgcttt

SEQ ID NO: 4075434 - DNA, 21 bp, Homo sapiens
ctaatccttctcattacccac

SEQ ID NO: 4075435 - DNA, 19 bp, Homo sapiens
ctaatctgagctgcagcct

SEQ ID NO: 4075436 - DNA, 22 bp, Homo sapiens
ctaatctgtagggctggaccta

SEQ ID NO: 4075437 - DNA, 22 bp, Homo sapiens
ctaatcttaaatcagaataaat

SEQ ID NO: 4075438 - DNA, 11 bp, Homo sapiens
ctaatctttca

SEQ ID NO: 4075439 - DNA, 12 bp, Homo sapiens
ctaatgaagaca

SEQ ID NO: 4075440 - DNA, 12 bp, Homo sapiens
ctaatgatgttt

SEQ ID NO: 4075441 - DNA, 13 bp, Homo sapiens
ctaatgatgtttt

SEQ ID NO: 4075442 - DNA, 17 bp, Homo sapiens
ctaatgcttgtttatga

SEQ ID NO: 4075443 - DNA, 14 bp, Homo sapiens
ctaatgtaaaatga

SEQ ID NO: 4075444 - DNA, 15 bp, Homo sapiens
ctaatgtctcactgt

SEQ ID NO: 4075445 - DNA, 16 bp, Homo sapiens
ctaatgtctcactgtt

SEQ ID NO: 4075446 - DNA, 21 bp, Homo sapiens
ctaatgtctcactgttctgca

SEQ ID NO: 4075447 - DNA, 17 bp, Homo sapiens
ctaatgtttatgagcca

SEQ ID NO: 4075448 - DNA, 18 bp, Homo sapiens
ctaatgtttatgagccag

SEQ ID NO: 4075449 - DNA, 16 bp, Homo sapiens
ctaattaaaaagttaa

SEQ ID NO: 4075450 - DNA, 16 bp, Homo sapiens
ctaattaatctggaat

SEQ ID NO: 4075451 - DNA, 17 bp, Homo sapiens
ctaattaattgtaatct

SEQ ID NO: 4075452 - DNA, 18 bp, Homo sapiens
ctaattagggtacattta

SEQ ID NO: 4075453 - DNA, 20 bp, Homo sapiens
ctaattgcatctcaaaatta

SEQ ID NO: 4075454 - DNA, 20 bp, Homo sapiens
ctaatttatattatccatag

SEQ ID NO: 4075455 - DNA, 16 bp, Homo sapiens
ctaatttatttcccca

SEQ ID NO: 4075456 - DNA, 22 bp, Homo sapiens
ctaatttatttccccaggtgtg

SEQ ID NO: 4075457 - DNA, 19 bp, Homo sapiens
ctaatttcaaaaatataac

SEQ ID NO: 4075458 - DNA, 19 bp, Homo sapiens
ctaatttcaaaatgctttt

SEQ ID NO: 4075459 - DNA, 20 bp, Homo sapiens
ctaatttctcctcccttcct

SEQ ID NO: 4075460 - DNA, 12 bp, Homo sapiens
ctaatttgcatt

SEQ ID NO: 4075461 - DNA, 13 bp, Homo sapiens
ctaatttgcatta

SEQ ID NO: 4075462 - DNA, 21 bp, Homo sapiens
ctaatttgcattaaattcaca

SEQ ID NO: 4075463 - DNA, 22 bp, Homo sapiens
ctaatttgcattaaattcacaa

SEQ ID NO: 4075464 - DNA, 15 bp, Homo sapiens
ctaattttagtattc

SEQ ID NO: 4075465 - DNA, 12 bp, Homo sapiens
ctaatttttaag

SEQ ID NO: 4075466 - DNA, 17 bp, Homo sapiens
ctaatttttaagcaaaa

SEQ ID NO: 4075467 - DNA, 13 bp, Homo sapiens
ctaatttttgtat

SEQ ID NO: 4075468 - DNA, 21 bp, Homo sapiens
ctaatttttgtattttttagt

SEQ ID NO: 4075469 - DNA, 22 bp, Homo sapiens
ctaatttttttttatttttagt

SEQ ID NO: 4075470 - DNA, 20 bp, Homo sapiens
ctacaaaacctgatgttaaa

SEQ ID NO: 4075471 - DNA, 14 bp, Homo sapiens
ctacaaccagagcc

SEQ ID NO: 4075472 - DNA, 16 bp, Homo sapiens
ctacaaccatccctgc

SEQ ID NO: 4075473 - DNA, 20 bp, Homo sapiens
ctacaaccatccctgccaca

SEQ ID NO: 4075474 - DNA, 21 bp, Homo sapiens
ctacaaccatccctgccacat

SEQ ID NO: 4075475 - DNA, 16 bp, Homo sapiens
ctacaacttaatggaa

SEQ ID NO: 4075476 - DNA, 18 bp, Homo sapiens
ctacaagagcagcctgtg

SEQ ID NO: 4075477 - DNA, 19 bp, Homo sapiens
ctacaagagcagcctgtgg

SEQ ID NO: 4075478 - DNA, 22 bp, Homo sapiens
ctacaagagcagcctgtggcat

SEQ ID NO: 4075479 - DNA, 19 bp, Homo sapiens
ctacaagctaaaattagat

SEQ ID NO: 4075480 - DNA, 19 bp, Homo sapiens
ctacaatgtgaactttatt

SEQ ID NO: 4075481 - DNA, 22 bp, Homo sapiens
ctacaattaatagtttgtctat

SEQ ID NO: 4075482 - DNA, 15 bp, Homo sapiens
ctacacacacacaca

SEQ ID NO: 4075483 - DNA, 14 bp, Homo sapiens
ctacacacacactc

SEQ ID NO: 4075484 - DNA, 18 bp, Homo sapiens
ctacacacacactccctg

SEQ ID NO: 4075485 - DNA, 13 bp, Homo sapiens
ctacacagcctgg

SEQ ID NO: 4075486 - DNA, 14 bp, Homo sapiens
ctacacagcctgga

SEQ ID NO: 4075487 - DNA, 14 bp, Homo sapiens
ctacacatttttaa

SEQ ID NO: 4075488 - DNA, 19 bp, Homo sapiens
ctacacatttttaaattgt

SEQ ID NO: 4075489 - DNA, 12 bp, Homo sapiens
ctacacctggct

SEQ ID NO: 4075490 - DNA, 20 bp, Homo sapiens
ctacagaacttcagaaagac

SEQ ID NO: 4075491 - DNA, 15 bp, Homo sapiens
ctacagactccatct

SEQ ID NO: 4075492 - DNA, 19 bp, Homo sapiens
ctacagactccatctcttc

SEQ ID NO: 4075493 - DNA, 17 bp, Homo sapiens
ctacagagcagctcccc

SEQ ID NO: 4075494 - DNA, 20 bp, Homo sapiens
ctacagagcagctccccagg

SEQ ID NO: 4075495 - DNA, 13 bp, Homo sapiens
ctacagagctgtg

SEQ ID NO: 4075496 - DNA, 14 bp, Homo sapiens
ctacagagctgtgg

SEQ ID NO: 4075497 - DNA, 19 bp, Homo sapiens
ctacagatcctttttccat

SEQ ID NO: 4075498 - DNA, 21 bp, Homo sapiens
ctacagatcctttttccatca

SEQ ID NO: 4075499 - DNA, 20 bp, Homo sapiens
ctacagcactactgggtgtc

SEQ ID NO: 4075500 - DNA, 21 bp, Homo sapiens
ctacagccacatccccaagcc

SEQ ID NO: 4075501 - DNA, 18 bp, Homo sapiens
ctacagccttgtccccct

SEQ ID NO: 4075502 - DNA, 18 bp, Homo sapiens
ctacagctaatcagcatt

SEQ ID NO: 4075503 - DNA, 19 bp, Homo sapiens
ctacagctcccccagctcc

SEQ ID NO: 4075504 - DNA, 11 bp, Homo sapiens
ctacagctctt

SEQ ID NO: 4075505 - DNA, 21 bp, Homo sapiens
ctacaggagagggaagagtgc

SEQ ID NO: 4075506 - DNA, 17 bp, Homo sapiens
ctacaggaggggtctca

SEQ ID NO: 4075507 - DNA, 22 bp, Homo sapiens
ctacaggtgaaggctctcaccc

SEQ ID NO: 4075508 - DNA, 22 bp, Homo sapiens
ctacaggtgcgcgccaccgtgc

SEQ ID NO: 4075509 - DNA, 23 bp, Homo sapiens
ctacaggtgcgcgccaccgtgcc

SEQ ID NO: 4075510 - DNA, 16 bp, Homo sapiens
ctacagtcgtaaaaga

SEQ ID NO: 4075511 - DNA, 19 bp, Homo sapiens
ctacagtcgtaaaagagat

SEQ ID NO: 4075512 - DNA, 16 bp, Homo sapiens
ctacagtttcttactg

SEQ ID NO: 4075513 - DNA, 15 bp, Homo sapiens
ctacataaactgact

SEQ ID NO: 4075514 - DNA, 17 bp, Homo sapiens
ctacataaactgacttt

SEQ ID NO: 4075515 - DNA, 18 bp, Homo sapiens
ctacataaactgacttta

SEQ ID NO: 4075516 - DNA, 20 bp, Homo sapiens
ctacataaactgactttatc

SEQ ID NO: 4075517 - DNA, 16 bp, Homo sapiens
ctacatcttctgcctt

SEQ ID NO: 4075518 - DNA, 24 bp, Homo sapiens
ctagtatttgaattaaaacttctt

SEQ ID NO: 4075519 - DNA, 20 bp, Homo sapiens
ctagtctcctttgcactgag

SEQ ID NO: 4075520 - DNA, 21 bp, Homo sapiens
ctagtctcctttgcactgagg

SEQ ID NO: 4075521 - DNA, 19 bp, Homo sapiens
ctagtcttgaatttctgac

SEQ ID NO: 4075522 - DNA, 22 bp, Homo sapiens
ctagtgaccatcttcataattt

SEQ ID NO: 4075523 - DNA, 13 bp, Homo sapiens
ctagtgcagctga

SEQ ID NO: 4075524 - DNA, 21 bp, Homo sapiens
ctagtgcagctgattttaaca

SEQ ID NO: 4075525 - DNA, 23 bp, Homo sapiens
ctagtgcagctgattttaacaat

SEQ ID NO: 4075526 - DNA, 15 bp, Homo sapiens
ctagtggatgactgt

SEQ ID NO: 4075527 - DNA, 16 bp, Homo sapiens
ctagtggatgactgtt

SEQ ID NO: 4075528 - DNA, 21 bp, Homo sapiens
ctagtggctctcagttaaaat

SEQ ID NO: 4075529 - DNA, 18 bp, Homo sapiens
ctagtggtctttgtaaga

SEQ ID NO: 4075530 - DNA, 19 bp, Homo sapiens
ctagtggtctttgtaagag

SEQ ID NO: 4075531 - DNA, 22 bp, Homo sapiens
ctagtggtctttgtaagagtgt

SEQ ID NO: 4075532 - DNA, 19 bp, Homo sapiens
ctagtgtacctcctctcag

SEQ ID NO: 4075533 - DNA, 15 bp, Homo sapiens
ctagtgtcaggcccc

SEQ ID NO: 4075534 - DNA, 19 bp, Homo sapiens
ctagtgtcaggcccccagt

SEQ ID NO: 4075535 - DNA, 20 bp, Homo sapiens
ctagtgtcaggcccccagtg

SEQ ID NO: 4075536 - DNA, 15 bp, Homo sapiens
ctagtgtctttaaat

SEQ ID NO: 4075537 - DNA, 18 bp, Homo sapiens
ctagtgttctgtttgtta

SEQ ID NO: 4075538 - DNA, 13 bp, Homo sapiens
ctagtgtttctag

SEQ ID NO: 4075539 - DNA, 21 bp, Homo sapiens
ctagtgtttctagctaaataa

SEQ ID NO: 4075540 - DNA, 14 bp, Homo sapiens
ctagttattttata

SEQ ID NO: 4075541 - DNA, 19 bp, Homo sapiens
ctagttcagagccaagcct

SEQ ID NO: 4075542 - DNA, 22 bp, Homo sapiens
ctagttcagagccaagccttaa

SEQ ID NO: 4075543 - DNA, 21 bp, Homo sapiens
ctagttcatccaatcctcact

SEQ ID NO: 4075544 - DNA, 17 bp, Homo sapiens
ctagttcatcccttctc

SEQ ID NO: 4075545 - DNA, 19 bp, Homo sapiens
ctagttcatcccttctctt

SEQ ID NO: 4075546 - DNA, 23 bp, Homo sapiens
ctagttcatcccttctcttccag

SEQ ID NO: 4075547 - DNA, 18 bp, Homo sapiens
ctagttccctctgctcag

SEQ ID NO: 4075548 - DNA, 13 bp, Homo sapiens
ctagttctttcct

SEQ ID NO: 4075549 - DNA, 16 bp, Homo sapiens
ctagttctttcctccc

SEQ ID NO: 4075550 - DNA, 20 bp, Homo sapiens
ctagttgccaaatctggctc

SEQ ID NO: 4075551 - DNA, 11 bp, Homo sapiens
ctagtttttta

SEQ ID NO: 4075552 - DNA, 14 bp, Homo sapiens
ctataaatacaaat

SEQ ID NO: 4075553 - DNA, 16 bp, Homo sapiens
ctataaatacaaatct

SEQ ID NO: 4075554 - DNA, 18 bp, Homo sapiens
ctataaccccagctccct

SEQ ID NO: 4075555 - DNA, 22 bp, Homo sapiens
ctataaccccagctccctagga

SEQ ID NO: 4075556 - DNA, 11 bp, Homo sapiens
ctataatcatt

SEQ ID NO: 4075557 - DNA, 21 bp, Homo sapiens
ctataatcattagttttagag

SEQ ID NO: 4075558 - DNA, 20 bp, Homo sapiens
ctataattccctatctttta

SEQ ID NO: 4075559 - DNA, 21 bp, Homo sapiens
ctatacaaattttcagaaggt

SEQ ID NO: 4075560 - DNA, 15 bp, Homo sapiens
ctatacaactggaca

SEQ ID NO: 4075561 - DNA, 17 bp, Homo sapiens
ctatacatatctttatt

SEQ ID NO: 4075562 - DNA, 20 bp, Homo sapiens
ctatacatatctttattaat

SEQ ID NO: 4075563 - DNA, 22 bp, Homo sapiens
ctatacatatctttattaatca

SEQ ID NO: 4075564 - DNA, 14 bp, Homo sapiens
ctatagcactgagc

SEQ ID NO: 4075565 - DNA, 15 bp, Homo sapiens
ctatagcccaggtcc

SEQ ID NO: 4075566 - DNA, 16 bp, Homo sapiens
ctataggctggagaag

SEQ ID NO: 4075567 - DNA, 18 bp, Homo sapiens
ctataggctggagaagct

SEQ ID NO: 4075568 - DNA, 21 bp, Homo sapiens
ctataggttttggttccacaa

SEQ ID NO: 4075569 - DNA, 19 bp, Homo sapiens
ctatagtttaaaacacatt

SEQ ID NO: 4075570 - DNA, 19 bp, Homo sapiens
ctatatataaaacggtgct

SEQ ID NO: 4075571 - DNA, 22 bp, Homo sapiens
ctatatataaaacggtgctgtg

SEQ ID NO: 4075572 - DNA, 13 bp, Homo sapiens
ctatatccatgta

SEQ ID NO: 4075573 - DNA, 14 bp, Homo sapiens
ctatatccatgtac

SEQ ID NO: 4075574 - DNA, 16 bp, Homo sapiens
ctatatgaatttaaat

SEQ ID NO: 4075575 - DNA, 20 bp, Homo sapiens
ctatatgaatttaaatataa

SEQ ID NO: 4075576 - DNA, 21 bp, Homo sapiens
ctatatgtagtataaagaaaa

SEQ ID NO: 4075577 - DNA, 21 bp, Homo sapiens
ctatatgtgaaacattttttc

SEQ ID NO: 4075578 - DNA, 18 bp, Homo sapiens
ctatattatcataagaat

SEQ ID NO: 4075579 - DNA, 20 bp, Homo sapiens
ctatattatcataagaattt

SEQ ID NO: 4075580 - DNA, 23 bp, Homo sapiens
ctatattgttttcagtgtacatg

SEQ ID NO: 4075581 - DNA, 13 bp, Homo sapiens
ctatatttacaaa

SEQ ID NO: 4075582 - DNA, 14 bp, Homo sapiens
ctatattttaatag

SEQ ID NO: 4075583 - DNA, 19 bp, Homo sapiens
ctatcagcagctagaaaac

SEQ ID NO: 4075584 - DNA, 23 bp, Homo sapiens
ctatcatttattggatgggtggg

SEQ ID NO: 4075585 - DNA, 19 bp, Homo sapiens
ctatccaaagaacttgatt

SEQ ID NO: 4075586 - DNA, 18 bp, Homo sapiens
ctatccccaatcagctcc

SEQ ID NO: 4075587 - DNA, 14 bp, Homo sapiens
ctatccccatccag

SEQ ID NO: 4075588 - DNA, 17 bp, Homo sapiens
ctatccccatctccctg

SEQ ID NO: 4075589 - DNA, 19 bp, Homo sapiens
ctatccccatctccctgcc

SEQ ID NO: 4075590 - DNA, 14 bp, Homo sapiens
ctatccgctgccag

SEQ ID NO: 4075591 - DNA, 17 bp, Homo sapiens
ctatccgctgccagcct

SEQ ID NO: 4075592 - DNA, 22 bp, Homo sapiens
ctatccgctgccagccttgagc

SEQ ID NO: 4075593 - DNA, 13 bp, Homo sapiens
ctatcctacccca

SEQ ID NO: 4075594 - DNA, 14 bp, Homo sapiens
ctatcctcactgcc

SEQ ID NO: 4075595 - DNA, 15 bp, Homo sapiens
ctatcgttattataa

SEQ ID NO: 4075596 - DNA, 13 bp, Homo sapiens
ctatctaaagttt

SEQ ID NO: 4075597 - DNA, 21 bp, Homo sapiens
ctatctcatctatctcaatcc

SEQ ID NO: 4075598 - DNA, 18 bp, Homo sapiens
ctatctgattttgtgcaa

SEQ ID NO: 4075599 - DNA, 21 bp, Homo sapiens
ctatctgcactctaaactgca

SEQ ID NO: 4075600 - DNA, 15 bp, Homo sapiens
ctatctgcattatct

SEQ ID NO: 4075601 - DNA, 22 bp, Homo sapiens
ctatctgtcatctctctggggc

SEQ ID NO: 4075602 - DNA, 16 bp, Homo sapiens
ctatcttcttcaaata

SEQ ID NO: 4075603 - DNA, 14 bp, Homo sapiens
ctatgacactgagc

SEQ ID NO: 4075604 - DNA, 16 bp, Homo sapiens
ctatgacagatatatt

SEQ ID NO: 4075605 - DNA, 23 bp, Homo sapiens
ctatgacagatatatttaagcct

SEQ ID NO: 4075606 - DNA, 21 bp, Homo sapiens
ctatgacctcgccctccacaa

SEQ ID NO: 4075607 - DNA, 20 bp, Homo sapiens
ctatgcatatcagttgagct

SEQ ID NO: 4075608 - DNA, 13 bp, Homo sapiens
ctatgcatggtgc

SEQ ID NO: 4075609 - DNA, 19 bp, Homo sapiens
ctatgcatggtgccccagg

SEQ ID NO: 4075610 - DNA, 21 bp, Homo sapiens
ctatgcatggtgccccaggac

SEQ ID NO: 4075611 - DNA, 20 bp, Homo sapiens
ctatgccagctcagtcccat

SEQ ID NO: 4075612 - DNA, 13 bp, Homo sapiens
ctatgctgtttgt

SEQ ID NO: 4075613 - DNA, 14 bp, Homo sapiens
ctatggcccagaaa

SEQ ID NO: 4075614 - DNA, 13 bp, Homo sapiens
ctatgggagcccc

SEQ ID NO: 4075615 - DNA, 19 bp, Homo sapiens
ctatgggagccccagggtc

SEQ ID NO: 4075616 - DNA, 18 bp, Homo sapiens
ctatggggtggggtgggt

SEQ ID NO: 4075617 - DNA, 21 bp, Homo sapiens
ctatggggtggggtgggtgta

SEQ ID NO: 4075618 - DNA, 17 bp, Homo sapiens
ctatggtatgctggcca

SEQ ID NO: 4075619 - DNA, 20 bp, Homo sapiens
ctatggtatgctggccagca

SEQ ID NO: 4075620 - DNA, 23 bp, Homo sapiens
ctcagtgttttggactccatctc

SEQ ID NO: 4075621 - DNA, 16 bp, Homo sapiens
ctcagttcccttggcc

SEQ ID NO: 4075622 - DNA, 20 bp, Homo sapiens
ctcagttcccttggcctcag

SEQ ID NO: 4075623 - DNA, 15 bp, Homo sapiens
ctcagttctctccct

SEQ ID NO: 4075624 - DNA, 16 bp, Homo sapiens
ctcagttctctccctt

SEQ ID NO: 4075625 - DNA, 20 bp, Homo sapiens
ctcagttctctcccttcctc

SEQ ID NO: 4075626 - DNA, 14 bp, Homo sapiens
ctcataaaaagcaa

SEQ ID NO: 4075627 - DNA, 17 bp, Homo sapiens
ctcataaaaagcaaaac

SEQ ID NO: 4075628 - DNA, 21 bp, Homo sapiens
ctcataattcctacagcacta

SEQ ID NO: 4075629 - DNA, 16 bp, Homo sapiens
ctcataattttgcaaa

SEQ ID NO: 4075630 - DNA, 16 bp, Homo sapiens
ctcatactcctgggct

SEQ ID NO: 4075631 - DNA, 16 bp, Homo sapiens
ctcatagcattaacta

SEQ ID NO: 4075632 - DNA, 20 bp, Homo sapiens
ctcatatggtctaccagttt

SEQ ID NO: 4075633 - DNA, 12 bp, Homo sapiens
ctcatatttaaa

SEQ ID NO: 4075634 - DNA, 15 bp, Homo sapiens
ctcatatttaaagac

SEQ ID NO: 4075635 - DNA, 13 bp, Homo sapiens
ctcatcaggatga

SEQ ID NO: 4075636 - DNA, 24 bp, Homo sapiens
ctcatcagtgtcctcttgctcaaa

SEQ ID NO: 4075637 - DNA, 12 bp, Homo sapiens
ctcatcataaaa

SEQ ID NO: 4075638 - DNA, 15 bp, Homo sapiens
ctcatcataaaataa

SEQ ID NO: 4075639 - DNA, 16 bp, Homo sapiens
ctcatccaccccatcc

SEQ ID NO: 4075640 - DNA, 13 bp, Homo sapiens
ctcatcccaacct

SEQ ID NO: 4075641 - DNA, 19 bp, Homo sapiens
ctcatcccacgcactccat

SEQ ID NO: 4075642 - DNA, 13 bp, Homo sapiens
ctcatccccaggg

SEQ ID NO: 4075643 - DNA, 19 bp, Homo sapiens
ctcatcccgtgttctcctt

SEQ ID NO: 4075644 - DNA, 13 bp, Homo sapiens
ctcatcctccagt

SEQ ID NO: 4075645 - DNA, 15 bp, Homo sapiens
ctcatctatgaggaa

SEQ ID NO: 4075646 - DNA, 22 bp, Homo sapiens
ctcatctccaaggatcctctcc

SEQ ID NO: 4075647 - DNA, 15 bp, Homo sapiens
ctcatctgagaggct

SEQ ID NO: 4075648 - DNA, 16 bp, Homo sapiens
ctcatctgagaggctc

SEQ ID NO: 4075649 - DNA, 18 bp, Homo sapiens
ctcatcttagtgcctgag

SEQ ID NO: 4075650 - DNA, 22 bp, Homo sapiens
ctcatcttgacagagcctgccc

SEQ ID NO: 4075651 - DNA, 15 bp, Homo sapiens
ctcatgaggggagag

SEQ ID NO: 4075652 - DNA, 13 bp, Homo sapiens
ctcatgcccaccc

SEQ ID NO: 4075653 - DNA, 21 bp, Homo sapiens
ctcatgcccaccccctgccct

SEQ ID NO: 4075654 - DNA, 18 bp, Homo sapiens
ctcatgcgtacgtcccac

SEQ ID NO: 4075655 - DNA, 19 bp, Homo sapiens
ctcatgctgcccctgcctt

SEQ ID NO: 4075656 - DNA, 15 bp, Homo sapiens
ctcatggcagctgtt

SEQ ID NO: 4075657 - DNA, 21 bp, Homo sapiens
ctcatggcagctgtttctcat

SEQ ID NO: 4075658 - DNA, 22 bp, Homo sapiens
ctcatggcagctgtttctcatg

SEQ ID NO: 4075659 - DNA, 17 bp, Homo sapiens
ctcatggcccccagggg

SEQ ID NO: 4075660 - DNA, 19 bp, Homo sapiens
ctcatggcccccaggggca

SEQ ID NO: 4075661 - DNA, 19 bp, Homo sapiens
ctcatggcccctctgacct

SEQ ID NO: 4075662 - DNA, 16 bp, Homo sapiens
ctcatgtcctgctggc

SEQ ID NO: 4075663 - DNA, 17 bp, Homo sapiens
ctcatgtcctgctggct

SEQ ID NO: 4075664 - DNA, 18 bp, Homo sapiens
ctcattactgggccttag

SEQ ID NO: 4075665 - DNA, 15 bp, Homo sapiens
ctcattcagtattaa

SEQ ID NO: 4075666 - DNA, 20 bp, Homo sapiens
ctcattccctcgtctttccc

SEQ ID NO: 4075667 - DNA, 20 bp, Homo sapiens
ctcattcgtggcatgttttg

SEQ ID NO: 4075668 - DNA, 12 bp, Homo sapiens
ctcattgtagaa

SEQ ID NO: 4075669 - DNA, 20 bp, Homo sapiens
ctcatttctcataattttgc

SEQ ID NO: 4075670 - DNA, 19 bp, Homo sapiens
ctcatttggtctgccagaa

SEQ ID NO: 4075671 - DNA, 17 bp, Homo sapiens
ctcatttgttaaaatta

SEQ ID NO: 4075672 - DNA, 14 bp, Homo sapiens
ctcattttctggtt

SEQ ID NO: 4075673 - DNA, 13 bp, Homo sapiens
ctccaaacctcca

SEQ ID NO: 4075674 - DNA, 22 bp, Homo sapiens
ctccaaacctccagcctccctg

SEQ ID NO: 4075675 - DNA, 15 bp, Homo sapiens
ctccaaatgagatct

SEQ ID NO: 4075676 - DNA, 23 bp, Homo sapiens
ctccaacacaaggctccaagacc

SEQ ID NO: 4075677 - DNA, 18 bp, Homo sapiens
ctccaacaccaagcacag

SEQ ID NO: 4075678 - DNA, 22 bp, Homo sapiens
ctccaacaccaagcacagcagc

SEQ ID NO: 4075679 - DNA, 23 bp, Homo sapiens
ctccaacaccaagcacagcagcc

SEQ ID NO: 4075680 - DNA, 22 bp, Homo sapiens
ctccaacagaactaaatgttct

SEQ ID NO: 4075681 - DNA, 17 bp, Homo sapiens
ctccaagcctgcctccc

SEQ ID NO: 4075682 - DNA, 17 bp, Homo sapiens
ctccaaggacagaaggc

SEQ ID NO: 4075683 - DNA, 14 bp, Homo sapiens
ctccaaggaccagg

SEQ ID NO: 4075684 - DNA, 16 bp, Homo sapiens
ctccaaggcagggacc

SEQ ID NO: 4075685 - DNA, 21 bp, Homo sapiens
ctccaagggaccctttgcctt

SEQ ID NO: 4075686 - DNA, 16 bp, Homo sapiens
ctccaagtctcagtgg

SEQ ID NO: 4075687 - DNA, 13 bp, Homo sapiens
ctccaagtctctc

SEQ ID NO: 4075688 - DNA, 16 bp, Homo sapiens
ctccaagtctctctgt

SEQ ID NO: 4075689 - DNA, 22 bp, Homo sapiens
ctccaatcccaccaaccctcag

SEQ ID NO: 4075690 - DNA, 16 bp, Homo sapiens
ctccacaacccaagca

SEQ ID NO: 4075691 - DNA, 14 bp, Homo sapiens
ctccacacacacaa

SEQ ID NO: 4075692 - DNA, 21 bp, Homo sapiens
ctccacacacacaaaaaaaga

SEQ ID NO: 4075693 - DNA, 19 bp, Homo sapiens
ctccacagcaaccccaggc

SEQ ID NO: 4075694 - DNA, 21 bp, Homo sapiens
ctccacatcccagcagcccaa

SEQ ID NO: 4075695 - DNA, 13 bp, Homo sapiens
ctccacatctgcc

SEQ ID NO: 4075696 - DNA, 18 bp, Homo sapiens
ctccaccacatctgccag

SEQ ID NO: 4075697 - DNA, 13 bp, Homo sapiens
ctccaccagcagc

SEQ ID NO: 4075698 - DNA, 13 bp, Homo sapiens
ctccacccagccc

SEQ ID NO: 4075699 - DNA, 16 bp, Homo sapiens
ctccacccagcccctg

SEQ ID NO: 4075700 - DNA, 21 bp, Homo sapiens
ctccacccataataagagaat

SEQ ID NO: 4075701 - DNA, 18 bp, Homo sapiens
ctccaccccacagaacct

SEQ ID NO: 4075702 - DNA, 14 bp, Homo sapiens
ctccaccctcctcc

SEQ ID NO: 4075703 - DNA, 14 bp, Homo sapiens
ctccaccctggccg

SEQ ID NO: 4075704 - DNA, 21 bp, Homo sapiens
ctccacccttggcctgtctca

SEQ ID NO: 4075705 - DNA, 16 bp, Homo sapiens
ctccaccgaccaactg

SEQ ID NO: 4075706 - DNA, 21 bp, Homo sapiens
ctccacgaagccttaagccat

SEQ ID NO: 4075707 - DNA, 20 bp, Homo sapiens
ctccacgcctcctggccaga

SEQ ID NO: 4075708 - DNA, 20 bp, Homo sapiens
ctccactaaatgagctcctg

SEQ ID NO: 4075709 - DNA, 15 bp, Homo sapiens
ctccactcagctgtc

SEQ ID NO: 4075710 - DNA, 18 bp, Homo sapiens
ctccactcagctgtcctg

SEQ ID NO: 4075711 - DNA, 23 bp, Homo sapiens
ctccactcagctgtcctgcagca

SEQ ID NO: 4075712 - DNA, 12 bp, Homo sapiens
ctccactccatg

SEQ ID NO: 4075713 - DNA, 15 bp, Homo sapiens
ctccactcccacctc

SEQ ID NO: 4075714 - DNA, 20 bp, Homo sapiens
ctccactcttgatctctctt

SEQ ID NO: 4075715 - DNA, 24 bp, Homo sapiens
ctccactcttgatctctcttgtcc

SEQ ID NO: 4075716 - DNA, 15 bp, Homo sapiens
ctccactgccttcga

SEQ ID NO: 4075717 - DNA, 19 bp, Homo sapiens
ctccagaaatgtccctttc

SEQ ID NO: 4075718 - DNA, 22 bp, Homo sapiens
ctccagaaatgtctaaatgctg

SEQ ID NO: 4075719 - DNA, 16 bp, Homo sapiens
ctccagaagatgccag

SEQ ID NO: 4075720 - DNA, 16 bp, Homo sapiens
ctccagaagcctctgg

SEQ ID NO: 4075721 - DNA, 21 bp, Homo sapiens
ctccagaagcctctggctaga

SEQ ID NO: 4075722 - DNA, 13 bp, Homo sapiens
ctcctgccgcaga

SEQ ID NO: 4075723 - DNA, 18 bp, Homo sapiens
ctcctgccgcagacgggc

SEQ ID NO: 4075724 - DNA, 23 bp, Homo sapiens
ctcctgccgcagacgggcacaga

SEQ ID NO: 4075725 - DNA, 16 bp, Homo sapiens
ctcctgcctcagcctc

SEQ ID NO: 4075726 - DNA, 16 bp, Homo sapiens
ctcctgcctcagcctt

SEQ ID NO: 4075727 - DNA, 19 bp, Homo sapiens
ctcctgcctcagccttcca

SEQ ID NO: 4075728 - DNA, 14 bp, Homo sapiens
ctcctgcctgcccc

SEQ ID NO: 4075729 - DNA, 15 bp, Homo sapiens
ctcctgcctgtagca

SEQ ID NO: 4075730 - DNA, 16 bp, Homo sapiens
ctcctgcctgtagcag

SEQ ID NO: 4075731 - DNA, 18 bp, Homo sapiens
ctcctgcctgtagcagtg

SEQ ID NO: 4075732 - DNA, 23 bp, Homo sapiens
ctcctgcgggagtagttggaaag

SEQ ID NO: 4075733 - DNA, 22 bp, Homo sapiens
ctcctgctcaccacctgcctct

SEQ ID NO: 4075734 - DNA, 13 bp, Homo sapiens
ctcctgctgccag

SEQ ID NO: 4075735 - DNA, 14 bp, Homo sapiens
ctcctgcttttctg

SEQ ID NO: 4075736 - DNA, 19 bp, Homo sapiens
ctcctgcttttctgtcctg

SEQ ID NO: 4075737 - DNA, 22 bp, Homo sapiens
ctcctggaaccttgctgtcctg

SEQ ID NO: 4075738 - DNA, 13 bp, Homo sapiens
ctcctggcctatc

SEQ ID NO: 4075739 - DNA, 11 bp, Homo sapiens
ctcctggctgg

SEQ ID NO: 4075740 - DNA, 15 bp, Homo sapiens
ctcctggctgggcca

SEQ ID NO: 4075741 - DNA, 23 bp, Homo sapiens
ctcctgggccgttacatctgtgc

SEQ ID NO: 4075742 - DNA, 19 bp, Homo sapiens
ctcctgggctcaagcaatc

SEQ ID NO: 4075743 - DNA, 13 bp, Homo sapiens
ctcctgggctcag

SEQ ID NO: 4075744 - DNA, 15 bp, Homo sapiens
ctcctggtcttgaga

SEQ ID NO: 4075745 - DNA, 23 bp, Homo sapiens
ctcctggtcttgagatgtcttct

SEQ ID NO: 4075746 - DNA, 21 bp, Homo sapiens
ctcctgtaaatggtgtacata

SEQ ID NO: 4075747 - DNA, 20 bp, Homo sapiens
ctcctgtataaccccacctt

SEQ ID NO: 4075748 - DNA, 15 bp, Homo sapiens
ctcctgtcctcccat

SEQ ID NO: 4075749 - DNA, 14 bp, Homo sapiens
ctcctgtgcccaca

SEQ ID NO: 4075750 - DNA, 21 bp, Homo sapiens
ctcctgtgcccacatcccagg

SEQ ID NO: 4075751 - DNA, 22 bp, Homo sapiens
ctcctgtgcctggccccagcct

SEQ ID NO: 4075752 - DNA, 13 bp, Homo sapiens
ctcctgtgctggg

SEQ ID NO: 4075753 - DNA, 18 bp, Homo sapiens
ctcctgtggcctgccagt

SEQ ID NO: 4075754 - DNA, 18 bp, Homo sapiens
ctcctgtttattcccatc

SEQ ID NO: 4075755 - DNA, 13 bp, Homo sapiens
ctccttagaaaaa

SEQ ID NO: 4075756 - DNA, 18 bp, Homo sapiens
ctccttagggttttctct

SEQ ID NO: 4075757 - DNA, 20 bp, Homo sapiens
ctccttagggttttctctct

SEQ ID NO: 4075758 - DNA, 18 bp, Homo sapiens
ctccttaggtgcccagaa

SEQ ID NO: 4075759 - DNA, 20 bp, Homo sapiens
ctccttatagacacttgctc

SEQ ID NO: 4075760 - DNA, 23 bp, Homo sapiens
ctccttatgggtagggctctgac

SEQ ID NO: 4075761 - DNA, 15 bp, Homo sapiens
ctccttccacctccc

SEQ ID NO: 4075762 - DNA, 10 bp, Homo sapiens
ctccttccca

SEQ ID NO: 4075763 - DNA, 16 bp, Homo sapiens
ctccttcccaccccta

SEQ ID NO: 4075764 - DNA, 23 bp, Homo sapiens
ctccttcccacccctacacacac

SEQ ID NO: 4075765 - DNA, 16 bp, Homo sapiens
ctccttcccatcgctg

SEQ ID NO: 4075766 - DNA, 13 bp, Homo sapiens
ctccttccccagg

SEQ ID NO: 4075767 - DNA, 15 bp, Homo sapiens
ctccttccccaggat

SEQ ID NO: 4075768 - DNA, 19 bp, Homo sapiens
ctccttccctcacccccag

SEQ ID NO: 4075769 - DNA, 14 bp, Homo sapiens
ctccttcccttgct

SEQ ID NO: 4075770 - DNA, 14 bp, Homo sapiens
ctccttcctggcct

SEQ ID NO: 4075771 - DNA, 15 bp, Homo sapiens
ctccttgaatatctt

SEQ ID NO: 4075772 - DNA, 14 bp, Homo sapiens
ctccttgcccagac

SEQ ID NO: 4075773 - DNA, 17 bp, Homo sapiens
ctccttggcttacctga

SEQ ID NO: 4075774 - DNA, 21 bp, Homo sapiens
ctccttggcttacctgacctc

SEQ ID NO: 4075775 - DNA, 16 bp, Homo sapiens
ctccttgtaaagactg

SEQ ID NO: 4075776 - DNA, 14 bp, Homo sapiens
ctcctttagcaggt

SEQ ID NO: 4075777 - DNA, 18 bp, Homo sapiens
ctcctttcatcacactgg

SEQ ID NO: 4075778 - DNA, 17 bp, Homo sapiens
ctcctttctccagccag

SEQ ID NO: 4075779 - DNA, 16 bp, Homo sapiens
ctcctttctgtgccct

SEQ ID NO: 4075780 - DNA, 14 bp, Homo sapiens
ctcctttgcactga

SEQ ID NO: 4075781 - DNA, 20 bp, Homo sapiens
ctcctttgcactgagggcca

SEQ ID NO: 4075782 - DNA, 23 bp, Homo sapiens
ctcctttgctgaggcctccagct

SEQ ID NO: 4075783 - DNA, 12 bp, Homo sapiens
ctcctttgtgtg

SEQ ID NO: 4075784 - DNA, 17 bp, Homo sapiens
ctccttttccagagcat

SEQ ID NO: 4075785 - DNA, 12 bp, Homo sapiens
ctccttttccta

SEQ ID NO: 4075786 - DNA, 20 bp, Homo sapiens
ctcgacagcgcccctgctgt

SEQ ID NO: 4075787 - DNA, 13 bp, Homo sapiens
ctcgacccagaat

SEQ ID NO: 4075788 - DNA, 23 bp, Homo sapiens
ctcgagggcagggaccacaccct

SEQ ID NO: 4075789 - DNA, 14 bp, Homo sapiens
ctcgaggggtgggc

SEQ ID NO: 4075790 - DNA, 19 bp, Homo sapiens
ctcgcacccccctgttcta

SEQ ID NO: 4075791 - DNA, 20 bp, Homo sapiens
ctcgcacccccctgttctaa

SEQ ID NO: 4075792 - DNA, 21 bp, Homo sapiens
ctcgcatttgtcaatgacagt

SEQ ID NO: 4075793 - DNA, 14 bp, Homo sapiens
ctcgccccagcagg

SEQ ID NO: 4075794 - DNA, 19 bp, Homo sapiens
ctcgccctcctttctgtgc

SEQ ID NO: 4075795 - DNA, 15 bp, Homo sapiens
ctcgcctgtcacccc

SEQ ID NO: 4075796 - DNA, 19 bp, Homo sapiens
ctcgcctgtcacccccact

SEQ ID NO: 4075797 - DNA, 14 bp, Homo sapiens
ctcgcgggcagcgg

SEQ ID NO: 4075798 - DNA, 15 bp, Homo sapiens
ctcgcgggcagcggg

SEQ ID NO: 4075799 - DNA, 16 bp, Homo sapiens
ctcgcgggcagcgggc

SEQ ID NO: 4075800 - DNA, 20 bp, Homo sapiens
ctcgcgggcagcgggccagg

SEQ ID NO: 4075801 - DNA, 22 bp, Homo sapiens
ctcgctcaccgctggcccttag

SEQ ID NO: 4075802 - DNA, 12 bp, Homo sapiens
ctcgctgagggc

SEQ ID NO: 4075803 - DNA, 22 bp, Homo sapiens
ctcgctgagggcagactggggc

SEQ ID NO: 4075804 - DNA, 16 bp, Homo sapiens
ctcgctgtcactggct

SEQ ID NO: 4075805 - DNA, 17 bp, Homo sapiens
ctcggacagcccatctg

SEQ ID NO: 4075806 - DNA, 20 bp, Homo sapiens
ctcggagagcagcagcacca

SEQ ID NO: 4075807 - DNA, 13 bp, Homo sapiens
ctcggaggctgcc

SEQ ID NO: 4075808 - DNA, 16 bp, Homo sapiens
ctcggaggctgccccc

SEQ ID NO: 4075809 - DNA, 21 bp, Homo sapiens
ctcggatgacaccctggcctg

SEQ ID NO: 4075810 - DNA, 22 bp, Homo sapiens
ctcggatggaccaacctgctct

SEQ ID NO: 4075811 - DNA, 15 bp, Homo sapiens
ctcggcctcccaaag

SEQ ID NO: 4075812 - DNA, 14 bp, Homo sapiens
ctcggctcaggctc

SEQ ID NO: 4075813 - DNA, 20 bp, Homo sapiens
ctcgggacacctgccctgcc

SEQ ID NO: 4075814 - DNA, 15 bp, Homo sapiens
ctcgggaggctgaga

SEQ ID NO: 4075815 - DNA, 18 bp, Homo sapiens
ctcgggagtcctctagca

SEQ ID NO: 4075816 - DNA, 15 bp, Homo sapiens
ctcgggccgaggccc

SEQ ID NO: 4075817 - DNA, 17 bp, Homo sapiens
ctcgggccgaggcccag

SEQ ID NO: 4075818 - DNA, 14 bp, Homo sapiens
ctcgggtgcatttg

SEQ ID NO: 4075819 - DNA, 21 bp, Homo sapiens
ctcgtatcccaaatctgtcag

SEQ ID NO: 4075820 - DNA, 17 bp, Homo sapiens
ctcgtccaccccccaca

SEQ ID NO: 4075821 - DNA, 23 bp, Homo sapiens
ctcgtccaccccccacacacact

SEQ ID NO: 4075822 - DNA, 20 bp, Homo sapiens
ctcgtgagtcatttaaatgt

SEQ ID NO: 4075823 - DNA, 19 bp, Homo sapiens
ctcgtgcatccctgagaca

SEQ ID NO: 4075824 - DNA, 21 bp, Homo sapiens
ctcgtgcattaaaatttctta

SEQ ID NO: 4075825 - DNA, 17 bp, Homo sapiens
ctgaactcaagctgcgt

SEQ ID NO: 4075826 - DNA, 23 bp, Homo sapiens
ctgaactccaccgaccaactgcc

SEQ ID NO: 4075827 - DNA, 20 bp, Homo sapiens
ctgaacttaataactgtgta

SEQ ID NO: 4075828 - DNA, 22 bp, Homo sapiens
ctgaacttcaggataataaagt

SEQ ID NO: 4075829 - DNA, 14 bp, Homo sapiens
ctgaagaaccagtc

SEQ ID NO: 4075830 - DNA, 22 bp, Homo sapiens
ctgaagaaccagtccccccacc

SEQ ID NO: 4075831 - DNA, 17 bp, Homo sapiens
ctgaagaattaagatac

SEQ ID NO: 4075832 - DNA, 14 bp, Homo sapiens
ctgaagactgagga

SEQ ID NO: 4075833 - DNA, 20 bp, Homo sapiens
ctgaagagctattatataaa

SEQ ID NO: 4075834 - DNA, 20 bp, Homo sapiens
ctgaagagtatccttccttc

SEQ ID NO: 4075835 - DNA, 17 bp, Homo sapiens
ctgaagatgatcatttg

SEQ ID NO: 4075836 - DNA, 19 bp, Homo sapiens
ctgaagcaggttcccaagc

SEQ ID NO: 4075837 - DNA, 14 bp, Homo sapiens
ctgaagccagctgc

SEQ ID NO: 4075838 - DNA, 12 bp, Homo sapiens
ctgaagcctctg

SEQ ID NO: 4075839 - DNA, 15 bp, Homo sapiens
ctgaagcctctggga

SEQ ID NO: 4075840 - DNA, 23 bp, Homo sapiens
ctgaagcctttgcattttggaga

SEQ ID NO: 4075841 - DNA, 15 bp, Homo sapiens
ctgaagcttgactcc

SEQ ID NO: 4075842 - DNA, 16 bp, Homo sapiens
ctgaaggaaaaacaca

SEQ ID NO: 4075843 - DNA, 16 bp, Homo sapiens
ctgaaggacctgagct

SEQ ID NO: 4075844 - DNA, 14 bp, Homo sapiens
ctgaagtcactgca

SEQ ID NO: 4075845 - DNA, 14 bp, Homo sapiens
ctgaagtctgtatt

SEQ ID NO: 4075846 - DNA, 18 bp, Homo sapiens
ctgaagtcttttctgtca

SEQ ID NO: 4075847 - DNA, 18 bp, Homo sapiens
ctgaagtgcatccaaagg

SEQ ID NO: 4075848 - DNA, 13 bp, Homo sapiens
ctgaagtttcaca

SEQ ID NO: 4075849 - DNA, 18 bp, Homo sapiens
ctgaataaagtgtaacaa

SEQ ID NO: 4075850 - DNA, 22 bp, Homo sapiens
ctgaatataaagcttaataaaa

SEQ ID NO: 4075851 - DNA, 16 bp, Homo sapiens
ctgaatatttatattt

SEQ ID NO: 4075852 - DNA, 18 bp, Homo sapiens
ctgaatcatgagcctgct

SEQ ID NO: 4075853 - DNA, 20 bp, Homo sapiens
ctgaatccattaaaaatggg

SEQ ID NO: 4075854 - DNA, 19 bp, Homo sapiens
ctgaatcccccttgccacc

SEQ ID NO: 4075855 - DNA, 20 bp, Homo sapiens
ctgaatcccccttgccaccc

SEQ ID NO: 4075856 - DNA, 21 bp, Homo sapiens
ctgaatcccccttgccacccc

SEQ ID NO: 4075857 - DNA, 17 bp, Homo sapiens
ctgaatgaaatatcaga

SEQ ID NO: 4075858 - DNA, 22 bp, Homo sapiens
ctgaatgcctcaatgtgaccag

SEQ ID NO: 4075859 - DNA, 16 bp, Homo sapiens
ctgaatgctgctactt

SEQ ID NO: 4075860 - DNA, 14 bp, Homo sapiens
ctgaatggtccagg

SEQ ID NO: 4075861 - DNA, 22 bp, Homo sapiens
ctgaatggttccatgcctgagg

SEQ ID NO: 4075862 - DNA, 23 bp, Homo sapiens
ctgaatgtcaaacagtgccaaat

SEQ ID NO: 4075863 - DNA, 11 bp, Homo sapiens
ctgaatgttct

SEQ ID NO: 4075864 - DNA, 16 bp, Homo sapiens
ctgaatgttctgacat

SEQ ID NO: 4075865 - DNA, 23 bp, Homo sapiens
ctgaatgttctgacattaacagt

SEQ ID NO: 4075866 - DNA, 17 bp, Homo sapiens
ctgaatgttttatttat

SEQ ID NO: 4075867 - DNA, 15 bp, Homo sapiens
ctgaattaaataaat

SEQ ID NO: 4075868 - DNA, 16 bp, Homo sapiens
ctgaattaaataaata

SEQ ID NO: 4075869 - DNA, 23 bp, Homo sapiens
ctgaattatctatacatatcttt

SEQ ID NO: 4075870 - DNA, 14 bp, Homo sapiens
ctgacactgagccc

SEQ ID NO: 4075871 - DNA, 14 bp, Homo sapiens
ctgacagccagaac

SEQ ID NO: 4075872 - DNA, 15 bp, Homo sapiens
ctgacagccagaact

SEQ ID NO: 4075873 - DNA, 16 bp, Homo sapiens
ctgacagccagaactc

SEQ ID NO: 4075874 - DNA, 20 bp, Homo sapiens
ctgacagcctcccaccccca

SEQ ID NO: 4075875 - DNA, 13 bp, Homo sapiens
ctgacatcacagc

SEQ ID NO: 4075876 - DNA, 15 bp, Homo sapiens
ctgacatcacagcag

SEQ ID NO: 4075877 - DNA, 16 bp, Homo sapiens
ctgacatcacagcagc

SEQ ID NO: 4075878 - DNA, 18 bp, Homo sapiens
ctgacatcacagcagcct

SEQ ID NO: 4075879 - DNA, 14 bp, Homo sapiens
ctgacatgtggggc

SEQ ID NO: 4075880 - DNA, 21 bp, Homo sapiens
ctgacatgtggggccaggtca

SEQ ID NO: 4075881 - DNA, 15 bp, Homo sapiens
ctgacattaacagtt

SEQ ID NO: 4075882 - DNA, 23 bp, Homo sapiens
ctgacattcacctgccccaactc

SEQ ID NO: 4075883 - DNA, 19 bp, Homo sapiens
ctgaccaattgtgctgcca

SEQ ID NO: 4075884 - DNA, 20 bp, Homo sapiens
ctgaccaattgtgctgccat

SEQ ID NO: 4075885 - DNA, 15 bp, Homo sapiens
ctgacccactgatct

SEQ ID NO: 4075886 - DNA, 21 bp, Homo sapiens
ctgacccagccccttgagaaa

SEQ ID NO: 4075887 - DNA, 12 bp, Homo sapiens
ctgacccagtgc

SEQ ID NO: 4075888 - DNA, 18 bp, Homo sapiens
ctgacccagtgcccccac

SEQ ID NO: 4075889 - DNA, 20 bp, Homo sapiens
ctgacccagtgcccccactg

SEQ ID NO: 4075890 - DNA, 21 bp, Homo sapiens
ctgaccccaaacaccttccag

SEQ ID NO: 4075891 - DNA, 22 bp, Homo sapiens
ctgaccccaaacaccttccagc

SEQ ID NO: 4075892 - DNA, 18 bp, Homo sapiens
ctgaccccgagaagtgct

SEQ ID NO: 4075893 - DNA, 19 bp, Homo sapiens
ctgaccccgagaagtgctc

SEQ ID NO: 4075894 - DNA, 13 bp, Homo sapiens
ctgacccctctgg

SEQ ID NO: 4075895 - DNA, 16 bp, Homo sapiens
ctgacccctctggtgt

SEQ ID NO: 4075896 - DNA, 14 bp, Homo sapiens
ctgacccggcctct

SEQ ID NO: 4075897 - DNA, 20 bp, Homo sapiens
ctgaccctactcccttgccc

SEQ ID NO: 4075898 - DNA, 18 bp, Homo sapiens
ctgacctccctctaattt

SEQ ID NO: 4075899 - DNA, 20 bp, Homo sapiens
ctgacctccctctaatttat

SEQ ID NO: 4075900 - DNA, 18 bp, Homo sapiens
ctgacctccgcccctgcc

SEQ ID NO: 4075901 - DNA, 18 bp, Homo sapiens
ctgacctgtgagcccagc

SEQ ID NO: 4075902 - DNA, 20 bp, Homo sapiens
ctgacctgtgagcccagctg

SEQ ID NO: 4075903 - DNA, 20 bp, Homo sapiens
ctgacggccagggagaagct

SEQ ID NO: 4075904 - DNA, 20 bp, Homo sapiens
ctgacggcgcccccagtgtg

SEQ ID NO: 4075905 - DNA, 19 bp, Homo sapiens
ctgacgtagaaagatcctt

SEQ ID NO: 4075906 - DNA, 13 bp, Homo sapiens
ctgacgtccacct

SEQ ID NO: 4075907 - DNA, 13 bp, Homo sapiens
ctgactaaaatgt

SEQ ID NO: 4075908 - DNA, 22 bp, Homo sapiens
ctgactagaagggccagtcctg

SEQ ID NO: 4075909 - DNA, 23 bp, Homo sapiens
ctgactagaagggccagtcctgc

SEQ ID NO: 4075910 - DNA, 15 bp, Homo sapiens
ctgactccctgtggg

SEQ ID NO: 4075911 - DNA, 16 bp, Homo sapiens
ctgactccctgtgggg

SEQ ID NO: 4075912 - DNA, 17 bp, Homo sapiens
ctgactccctgtggggg

SEQ ID NO: 4075913 - DNA, 17 bp, Homo sapiens
ctgactcctctaagcca

SEQ ID NO: 4075914 - DNA, 13 bp, Homo sapiens
ctgactcctctgg

SEQ ID NO: 4075915 - DNA, 20 bp, Homo sapiens
ctgactcctctggctttccc

SEQ ID NO: 4075916 - DNA, 15 bp, Homo sapiens
ctgactctgactcat

SEQ ID NO: 4075917 - DNA, 19 bp, Homo sapiens
ctgactctgagtccactgc

SEQ ID NO: 4075918 - DNA, 20 bp, Homo sapiens
ctgactctgagtccactgct

SEQ ID NO: 4075919 - DNA, 19 bp, Homo sapiens
ctgactctgccccctgctg

SEQ ID NO: 4075920 - DNA, 21 bp, Homo sapiens
ctgactgctcagaacttgctg

SEQ ID NO: 4075921 - DNA, 18 bp, Homo sapiens
ctgactggaggaggcctg

SEQ ID NO: 4075922 - DNA, 23 bp, Homo sapiens
ctgactggaggaggcctgtccca

SEQ ID NO: 4075923 - DNA, 12 bp, Homo sapiens
ctgactggggct

SEQ ID NO: 4075924 - DNA, 20 bp, Homo sapiens
ctgactggttaacagcagtc

SEQ ID NO: 4075925 - DNA, 17 bp, Homo sapiens
ctgactgtactcctccc

SEQ ID NO: 4075926 - DNA, 13 bp, Homo sapiens
ctgactgtcctct

SEQ ID NO: 4075927 - DNA, 16 bp, Homo sapiens
ctgatggaggaaaaag

SEQ ID NO: 4075928 - DNA, 17 bp, Homo sapiens
ctgatggaggaaaaagg

SEQ ID NO: 4075929 - DNA, 18 bp, Homo sapiens
ctgatggcagaactccca

SEQ ID NO: 4075930 - DNA, 14 bp, Homo sapiens
ctgatggcagctgg

SEQ ID NO: 4075931 - DNA, 22 bp, Homo sapiens
ctgatggccaggcaagtgggac

SEQ ID NO: 4075932 - DNA, 17 bp, Homo sapiens
ctgatggcttgacatgt

SEQ ID NO: 4075933 - DNA, 18 bp, Homo sapiens
ctgatggcttgacatgtg

SEQ ID NO: 4075934 - DNA, 22 bp, Homo sapiens
ctgatggggaagggacttttat

SEQ ID NO: 4075935 - DNA, 14 bp, Homo sapiens
ctgatgtcccagtg

SEQ ID NO: 4075936 - DNA, 19 bp, Homo sapiens
ctgatgtccctagaaaaca

SEQ ID NO: 4075937 - DNA, 20 bp, Homo sapiens
ctgatgtgtcctcagggagc

SEQ ID NO: 4075938 - DNA, 21 bp, Homo sapiens
ctgattaagttgtctaaacaa

SEQ ID NO: 4075939 - DNA, 13 bp, Homo sapiens
ctgattactgtca

SEQ ID NO: 4075940 - DNA, 17 bp, Homo sapiens
ctgattactgtcaataa

SEQ ID NO: 4075941 - DNA, 12 bp, Homo sapiens
ctgattagcttt

SEQ ID NO: 4075942 - DNA, 17 bp, Homo sapiens
ctgattagctttgtgtt

SEQ ID NO: 4075943 - DNA, 23 bp, Homo sapiens
ctgattatgtcttttatatttgt

SEQ ID NO: 4075944 - DNA, 18 bp, Homo sapiens
ctgattcagcatcactaa

SEQ ID NO: 4075945 - DNA, 22 bp, Homo sapiens
ctgattcataataaatatctgt

SEQ ID NO: 4075946 - DNA, 13 bp, Homo sapiens
ctgattctgtgta

SEQ ID NO: 4075947 - DNA, 16 bp, Homo sapiens
ctgattgacctgctcc

SEQ ID NO: 4075948 - DNA, 17 bp, Homo sapiens
ctgattggtgcaaccct

SEQ ID NO: 4075949 - DNA, 18 bp, Homo sapiens
ctgattggtttctcttct

SEQ ID NO: 4075950 - DNA, 23 bp, Homo sapiens
ctgattggttttggggaaatgtg

SEQ ID NO: 4075951 - DNA, 17 bp, Homo sapiens
ctgattgtttcattgcg

SEQ ID NO: 4075952 - DNA, 22 bp, Homo sapiens
ctgatttaaaaagtgagaaaga

SEQ ID NO: 4075953 - DNA, 16 bp, Homo sapiens
ctgatttaggagaagc

SEQ ID NO: 4075954 - DNA, 17 bp, Homo sapiens
ctgatttaggagaagcc

SEQ ID NO: 4075955 - DNA, 21 bp, Homo sapiens
ctgatttaggagaagccagga

SEQ ID NO: 4075956 - DNA, 13 bp, Homo sapiens
ctgatttcccctc

SEQ ID NO: 4075957 - DNA, 11 bp, Homo sapiens
ctgatttgcaa

SEQ ID NO: 4075958 - DNA, 19 bp, Homo sapiens
ctgattttaaaggcagaga

SEQ ID NO: 4075959 - DNA, 14 bp, Homo sapiens
ctgattttaacaat

SEQ ID NO: 4075960 - DNA, 22 bp, Homo sapiens
ctgattttaagtttgcagattt

SEQ ID NO: 4075961 - DNA, 15 bp, Homo sapiens
ctgcaaaaatattta

SEQ ID NO: 4075962 - DNA, 20 bp, Homo sapiens
ctgcaaaaatatttataaaa

SEQ ID NO: 4075963 - DNA, 21 bp, Homo sapiens
ctgcaaaaatggatattatta

SEQ ID NO: 4075964 - DNA, 16 bp, Homo sapiens
ctgcaaaaccaggttt

SEQ ID NO: 4075965 - DNA, 21 bp, Homo sapiens
ctgcaaaaggcctcttgtaaa

SEQ ID NO: 4075966 - DNA, 13 bp, Homo sapiens
ctgcaaaatctgt

SEQ ID NO: 4075967 - DNA, 11 bp, Homo sapiens
ctgcaaaattt

SEQ ID NO: 4075968 - DNA, 23 bp, Homo sapiens
ctgcaaaatttgatgccaggaca

SEQ ID NO: 4075969 - DNA, 13 bp, Homo sapiens
ctgcaaaatttta

SEQ ID NO: 4075970 - DNA, 14 bp, Homo sapiens
ctgcaaacagaaat

SEQ ID NO: 4075971 - DNA, 15 bp, Homo sapiens
ctgcaaacagaacag

SEQ ID NO: 4075972 - DNA, 19 bp, Homo sapiens
ctgcaaacagaacagggtc

SEQ ID NO: 4075973 - DNA, 21 bp, Homo sapiens
ctgcaaacagaacagggtcat

SEQ ID NO: 4075974 - DNA, 20 bp, Homo sapiens
ctgcaaaggtggcaatgctt

SEQ ID NO: 4075975 - DNA, 23 bp, Homo sapiens
ctgcaaaggtggcaatgcttaaa

SEQ ID NO: 4075976 - DNA, 12 bp, Homo sapiens
ctgcaacaggct

SEQ ID NO: 4075977 - DNA, 21 bp, Homo sapiens
ctgcaaccaaactcccatcag

SEQ ID NO: 4075978 - DNA, 23 bp, Homo sapiens
ctgcaactcaaggactttgcagc

SEQ ID NO: 4075979 - DNA, 18 bp, Homo sapiens
ctgcaacttccgctgagg

SEQ ID NO: 4075980 - DNA, 20 bp, Homo sapiens
ctgcaagcacatctgcattt

SEQ ID NO: 4075981 - DNA, 19 bp, Homo sapiens
ctgcaagtcagtccaggat

SEQ ID NO: 4075982 - DNA, 19 bp, Homo sapiens
ctgcaagtgaggtgtgtca

SEQ ID NO: 4075983 - DNA, 16 bp, Homo sapiens
ctgcaataacttctga

SEQ ID NO: 4075984 - DNA, 18 bp, Homo sapiens
ctgcaataacttctgacc

SEQ ID NO: 4075985 - DNA, 18 bp, Homo sapiens
ctgcaatatttgaatttt

SEQ ID NO: 4075986 - DNA, 15 bp, Homo sapiens
ctgcaatgcctagac

SEQ ID NO: 4075987 - DNA, 15 bp, Homo sapiens
ctgcaattcccctct

SEQ ID NO: 4075988 - DNA, 20 bp, Homo sapiens
ctgcaattcccctctgctgc

SEQ ID NO: 4075989 - DNA, 18 bp, Homo sapiens
ctgcaatttcatatgctg

SEQ ID NO: 4075990 - DNA, 20 bp, Homo sapiens
ctgcaatttcatatgctgta

SEQ ID NO: 4075991 - DNA, 17 bp, Homo sapiens
ctgcacacacctccgag

SEQ ID NO: 4075992 - DNA, 13 bp, Homo sapiens
ctgcacactccag

SEQ ID NO: 4075993 - DNA, 19 bp, Homo sapiens
ctgcacactccaggcctct

SEQ ID NO: 4075994 - DNA, 20 bp, Homo sapiens
ctgcacactccatctcctgc

SEQ ID NO: 4075995 - DNA, 22 bp, Homo sapiens
ctgcacagatatttccatttct

SEQ ID NO: 4075996 - DNA, 20 bp, Homo sapiens
ctgcacagatggatttgcct

SEQ ID NO: 4075997 - DNA, 13 bp, Homo sapiens
ctgcacagcggcc

SEQ ID NO: 4075998 - DNA, 20 bp, Homo sapiens
ctgcaccagagcaacctctc

SEQ ID NO: 4075999 - DNA, 22 bp, Homo sapiens
ctgcaccaggtagaacgccagg

SEQ ID NO: 4076000 - DNA, 13 bp, Homo sapiens
ctgcacccagctc

SEQ ID NO: 4076001 - DNA, 20 bp, Homo sapiens
ctgcacccagctccaggggc

SEQ ID NO: 4076002 - DNA, 13 bp, Homo sapiens
ctgcacccagggg

SEQ ID NO: 4076003 - DNA, 16 bp, Homo sapiens
ctgcacccctgggcca

SEQ ID NO: 4076004 - DNA, 17 bp, Homo sapiens
ctgcacccctgggccag

SEQ ID NO: 4076005 - DNA, 16 bp, Homo sapiens
ctgcaccctgcgcctc

SEQ ID NO: 4076006 - DNA, 17 bp, Homo sapiens
ctgcaccctgcgcctcc

SEQ ID NO: 4076007 - DNA, 21 bp, Homo sapiens
ctgcaccctgcgcctccagag

SEQ ID NO: 4076008 - DNA, 16 bp, Homo sapiens
ctgcaccctggggcct

SEQ ID NO: 4076009 - DNA, 21 bp, Homo sapiens
ctgcaccctggggcctggacc

SEQ ID NO: 4076010 - DNA, 22 bp, Homo sapiens
ctgcaccctggggcctggacct

SEQ ID NO: 4076011 - DNA, 19 bp, Homo sapiens
ctgcacccttgtacagtgt

SEQ ID NO: 4076012 - DNA, 21 bp, Homo sapiens
ctgcacctgattagttgaaag

SEQ ID NO: 4076013 - DNA, 14 bp, Homo sapiens
ctgcacctgtgcag

SEQ ID NO: 4076014 - DNA, 22 bp, Homo sapiens
ctgcactaaagccagcctgacc

SEQ ID NO: 4076015 - DNA, 23 bp, Homo sapiens
ctgcactaaagccagcctgacct

SEQ ID NO: 4076016 - DNA, 13 bp, Homo sapiens
ctgcactaagaga

SEQ ID NO: 4076017 - DNA, 22 bp, Homo sapiens
ctgcactaagagaaaattgcac

SEQ ID NO: 4076018 - DNA, 16 bp, Homo sapiens
ctgcactactgacatg

SEQ ID NO: 4076019 - DNA, 16 bp, Homo sapiens
ctgcactccagcctgg

SEQ ID NO: 4076020 - DNA, 17 bp, Homo sapiens
ctgcactccagcctggg

SEQ ID NO: 4076021 - DNA, 20 bp, Homo sapiens
ctgcactccagcctggggga

SEQ ID NO: 4076022 - DNA, 14 bp, Homo sapiens
ctgcactgagaggg

SEQ ID NO: 4076023 - DNA, 21 bp, Homo sapiens
ctgcactgagagggcaaggaa

SEQ ID NO: 4076024 - DNA, 15 bp, Homo sapiens
ctgcagacttcccag

SEQ ID NO: 4076025 - DNA, 21 bp, Homo sapiens
ctgcagagaaacttaagcaaa

SEQ ID NO: 4076026 - DNA, 24 bp, Homo sapiens
ctgcagattagttctttttgccag

SEQ ID NO: 4076027 - DNA, 14 bp, Homo sapiens
ctgcagcacctcca

SEQ ID NO: 4076028 - DNA, 21 bp, Homo sapiens
ctgcagcaggagtggtgcaga

SEQ ID NO: 4076029 - DNA, 13 bp, Homo sapiens
ctgctccagacct

SEQ ID NO: 4076030 - DNA, 14 bp, Homo sapiens
ctgctccagacctg

SEQ ID NO: 4076031 - DNA, 15 bp, Homo sapiens
ctgctccagacctga

SEQ ID NO: 4076032 - DNA, 14 bp, Homo sapiens
ctgctccagctctg

SEQ ID NO: 4076033 - DNA, 13 bp, Homo sapiens
ctgctccaggcct

SEQ ID NO: 4076034 - DNA, 19 bp, Homo sapiens
ctgctccaggcctgcagca

SEQ ID NO: 4076035 - DNA, 20 bp, Homo sapiens
ctgctccataccttttctct

SEQ ID NO: 4076036 - DNA, 15 bp, Homo sapiens
ctgctcccagcagcc

SEQ ID NO: 4076037 - DNA, 16 bp, Homo sapiens
ctgctcccagcagccc

SEQ ID NO: 4076038 - DNA, 21 bp, Homo sapiens
ctgctcccagcagccctaagg

SEQ ID NO: 4076039 - DNA, 22 bp, Homo sapiens
ctgctcccagcagccctaagga

SEQ ID NO: 4076040 - DNA, 14 bp, Homo sapiens
ctgctcccagcctg

SEQ ID NO: 4076041 - DNA, 16 bp, Homo sapiens
ctgctcccagcctgct

SEQ ID NO: 4076042 - DNA, 18 bp, Homo sapiens
ctgctccccagccctggc

SEQ ID NO: 4076043 - DNA, 14 bp, Homo sapiens
ctgctccccctttt

SEQ ID NO: 4076044 - DNA, 14 bp, Homo sapiens
ctgctccctccaga

SEQ ID NO: 4076045 - DNA, 23 bp, Homo sapiens
ctgctccctccagaatggaactc

SEQ ID NO: 4076046 - DNA, 15 bp, Homo sapiens
ctgctccctggcatt

SEQ ID NO: 4076047 - DNA, 20 bp, Homo sapiens
ctgctccctgtggcactcag

SEQ ID NO: 4076048 - DNA, 15 bp, Homo sapiens
ctgctccgcccgctc

SEQ ID NO: 4076049 - DNA, 14 bp, Homo sapiens
ctgctcctcatggt

SEQ ID NO: 4076050 - DNA, 14 bp, Homo sapiens
ctgctcctgcagca

SEQ ID NO: 4076051 - DNA, 13 bp, Homo sapiens
ctgctcctgcttt

SEQ ID NO: 4076052 - DNA, 16 bp, Homo sapiens
ctgctcctgcttttct

SEQ ID NO: 4076053 - DNA, 15 bp, Homo sapiens
ctgctcctggagcct

SEQ ID NO: 4076054 - DNA, 20 bp, Homo sapiens
ctgctcctggagcctttgaa

SEQ ID NO: 4076055 - DNA, 23 bp, Homo sapiens
ctgctcgaaatggcccctgtctt

SEQ ID NO: 4076056 - DNA, 18 bp, Homo sapiens
ctgctcgccctcctttct

SEQ ID NO: 4076057 - DNA, 19 bp, Homo sapiens
ctgctcgccctcctttctg

SEQ ID NO: 4076058 - DNA, 21 bp, Homo sapiens
ctgctctacccatgagcctgc

SEQ ID NO: 4076059 - DNA, 19 bp, Homo sapiens
ctgctctccgcgcctaccc

SEQ ID NO: 4076060 - DNA, 13 bp, Homo sapiens
ctgctctgagcca

SEQ ID NO: 4076061 - DNA, 16 bp, Homo sapiens
ctgctctgagccacag

SEQ ID NO: 4076062 - DNA, 15 bp, Homo sapiens
ctgctctgctcgcct

SEQ ID NO: 4076063 - DNA, 19 bp, Homo sapiens
ctgctcttgcagttgctct

SEQ ID NO: 4076064 - DNA, 14 bp, Homo sapiens
ctgctctttctctg

SEQ ID NO: 4076065 - DNA, 17 bp, Homo sapiens
ctgctctttctctgcca

SEQ ID NO: 4076066 - DNA, 18 bp, Homo sapiens
ctgctctttctctgccag

SEQ ID NO: 4076067 - DNA, 20 bp, Homo sapiens
ctgctctttctctgccagtg

SEQ ID NO: 4076068 - DNA, 22 bp, Homo sapiens
ctgctctttctctgccagtgac

SEQ ID NO: 4076069 - DNA, 9 bp, Homo sapiens
ctgctgacc

SEQ ID NO: 4076070 - DNA, 19 bp, Homo sapiens
ctgctgagtccgacctggc

SEQ ID NO: 4076071 - DNA, 19 bp, Homo sapiens
ctgctgcacccaactactg

SEQ ID NO: 4076072 - DNA, 14 bp, Homo sapiens
ctgctgcaccctgc

SEQ ID NO: 4076073 - DNA, 11 bp, Homo sapiens
ctgctgccagt

SEQ ID NO: 4076074 - DNA, 18 bp, Homo sapiens
ctgctgccagtaccagcc

SEQ ID NO: 4076075 - DNA, 16 bp, Homo sapiens
ctgctgccatgaactg

SEQ ID NO: 4076076 - DNA, 14 bp, Homo sapiens
ctgctgcccaatct

SEQ ID NO: 4076077 - DNA, 13 bp, Homo sapiens
ctgctgcccaggc

SEQ ID NO: 4076078 - DNA, 13 bp, Homo sapiens
ctgctgccccagc

SEQ ID NO: 4076079 - DNA, 16 bp, Homo sapiens
ctgctgccccagctga

SEQ ID NO: 4076080 - DNA, 15 bp, Homo sapiens
ctgctgcccccaccc

SEQ ID NO: 4076081 - DNA, 21 bp, Homo sapiens
ctgctgcccccaccccgggga

SEQ ID NO: 4076082 - DNA, 13 bp, Homo sapiens
ctgctgcccctgc

SEQ ID NO: 4076083 - DNA, 14 bp, Homo sapiens
ctgctgcccctgca

SEQ ID NO: 4076084 - DNA, 21 bp, Homo sapiens
ctgctgccgcccttcctggag

SEQ ID NO: 4076085 - DNA, 12 bp, Homo sapiens
ctgctgcctctt

SEQ ID NO: 4076086 - DNA, 13 bp, Homo sapiens
ctgctgcctcttt

SEQ ID NO: 4076087 - DNA, 15 bp, Homo sapiens
ctgctgcctgctgag

SEQ ID NO: 4076088 - DNA, 15 bp, Homo sapiens
ctgctgctgcaccca

SEQ ID NO: 4076089 - DNA, 16 bp, Homo sapiens
ctgctgctgctgcgcc

SEQ ID NO: 4076090 - DNA, 13 bp, Homo sapiens
ctgctggaagccc

SEQ ID NO: 4076091 - DNA, 16 bp, Homo sapiens
ctgctggaggcctcag

SEQ ID NO: 4076092 - DNA, 21 bp, Homo sapiens
ctgctggaggcctcaggtgct

SEQ ID NO: 4076093 - DNA, 21 bp, Homo sapiens
ctgctggatcacagctgcttt

SEQ ID NO: 4076094 - DNA, 20 bp, Homo sapiens
ctgctggccaaatagcaaag

SEQ ID NO: 4076095 - DNA, 22 bp, Homo sapiens
ctgctggccgacccactgaccc

SEQ ID NO: 4076096 - DNA, 13 bp, Homo sapiens
ctgctggcctgga

SEQ ID NO: 4076097 - DNA, 18 bp, Homo sapiens
ctgctggcttccagcttc

SEQ ID NO: 4076098 - DNA, 22 bp, Homo sapiens
ctgctggcttccagcttcaggc

SEQ ID NO: 4076099 - DNA, 16 bp, Homo sapiens
ctgctggcttgcagtg

SEQ ID NO: 4076100 - DNA, 16 bp, Homo sapiens
ctgctgggagttctag

SEQ ID NO: 4076101 - DNA, 14 bp, Homo sapiens
ctgctgggatcctt

SEQ ID NO: 4076102 - DNA, 21 bp, Homo sapiens
ctgctgggctccccccagtgg

SEQ ID NO: 4076103 - DNA, 15 bp, Homo sapiens
ctgctggtcacagcc

SEQ ID NO: 4076104 - DNA, 18 bp, Homo sapiens
ctgctggtcacagcctcc

SEQ ID NO: 4076105 - DNA, 18 bp, Homo sapiens
ctgctggtcacttcttct

SEQ ID NO: 4076106 - DNA, 20 bp, Homo sapiens
ctgctggtgccagggtgggt

SEQ ID NO: 4076107 - DNA, 14 bp, Homo sapiens
ctgctgtacccaga

SEQ ID NO: 4076108 - DNA, 15 bp, Homo sapiens
ctgctgtacccagat

SEQ ID NO: 4076109 - DNA, 17 bp, Homo sapiens
ctgctgtacccagatgc

SEQ ID NO: 4076110 - DNA, 18 bp, Homo sapiens
ctgctgtacccagatgcc

SEQ ID NO: 4076111 - DNA, 20 bp, Homo sapiens
ctgctgtacccagatgccta

SEQ ID NO: 4076112 - DNA, 23 bp, Homo sapiens
ctgctgtacccagatgcctacaa

SEQ ID NO: 4076113 - DNA, 18 bp, Homo sapiens
ctgctgtccccttggcag

SEQ ID NO: 4076114 - DNA, 18 bp, Homo sapiens
ctgctgtcgctctcagtt

SEQ ID NO: 4076115 - DNA, 15 bp, Homo sapiens
ctgctgtcttcccca

SEQ ID NO: 4076116 - DNA, 21 bp, Homo sapiens
ctgctgtgatacgatgcttca

SEQ ID NO: 4076117 - DNA, 23 bp, Homo sapiens
ctgctgtgccatgctgggccact

SEQ ID NO: 4076118 - DNA, 17 bp, Homo sapiens
ctgctgtgcgtggaaaa

SEQ ID NO: 4076119 - DNA, 21 bp, Homo sapiens
ctgctgtgcgtggaaaaagac

SEQ ID NO: 4076120 - DNA, 22 bp, Homo sapiens
ctgctgtgggcacaggtcaggc

SEQ ID NO: 4076121 - DNA, 14 bp, Homo sapiens
ctgctgttctcagg

SEQ ID NO: 4076122 - DNA, 22 bp, Homo sapiens
ctgctgttctcaggacagcatc

SEQ ID NO: 4076123 - DNA, 23 bp, Homo sapiens
ctgctgttctcaggacagcatcc

SEQ ID NO: 4076124 - DNA, 20 bp, Homo sapiens
ctgcttagctgccttgagct

SEQ ID NO: 4076125 - DNA, 18 bp, Homo sapiens
ctgcttaggagagaccga

SEQ ID NO: 4076126 - DNA, 19 bp, Homo sapiens
ctgcttcaaatatttccct

SEQ ID NO: 4076127 - DNA, 21 bp, Homo sapiens
ctgcttcatgctcagccctga

SEQ ID NO: 4076128 - DNA, 15 bp, Homo sapiens
ctgcttcattttgga

SEQ ID NO: 4076129 - DNA, 11 bp, Homo sapiens
ctgcttccagg

SEQ ID NO: 4076130 - DNA, 22 bp, Homo sapiens
ctgcttccggtagggaggcagc

SEQ ID NO: 4076131 - DNA, 20 bp, Homo sapiens
ctgcttgagttcccagatgg

SEQ ID NO: 4076132 - DNA, 12 bp, Homo sapiens
ctgggagaggat

SEQ ID NO: 4076133 - DNA, 11 bp, Homo sapiens
ctgggagcaga

SEQ ID NO: 4076134 - DNA, 14 bp, Homo sapiens
ctgggagcagaaac

SEQ ID NO: 4076135 - DNA, 15 bp, Homo sapiens
ctgggagcagaaaca

SEQ ID NO: 4076136 - DNA, 20 bp, Homo sapiens
ctgggagccacttctcccca

SEQ ID NO: 4076137 - DNA, 15 bp, Homo sapiens
ctgggaggagggaga

SEQ ID NO: 4076138 - DNA, 16 bp, Homo sapiens
ctgggaggagggagag

SEQ ID NO: 4076139 - DNA, 19 bp, Homo sapiens
ctgggaggcaagaaaagga

SEQ ID NO: 4076140 - DNA, 13 bp, Homo sapiens
ctgggaggcatgg

SEQ ID NO: 4076141 - DNA, 20 bp, Homo sapiens
ctgggaggccctgagacagg

SEQ ID NO: 4076142 - DNA, 23 bp, Homo sapiens
ctgggagtagttgtctttcctgg

SEQ ID NO: 4076143 - DNA, 21 bp, Homo sapiens
ctgggagtgtccttagtgtat

SEQ ID NO: 4076144 - DNA, 22 bp, Homo sapiens
ctgggagttctagaaccacttc

SEQ ID NO: 4076145 - DNA, 21 bp, Homo sapiens
ctgggatatggctgcccagga

SEQ ID NO: 4076146 - DNA, 22 bp, Homo sapiens
ctgggatatggctgcccaggag

SEQ ID NO: 4076147 - DNA, 22 bp, Homo sapiens
ctgggatgacaggcgcctgcca

SEQ ID NO: 4076148 - DNA, 17 bp, Homo sapiens
ctgggatggaggggagt

SEQ ID NO: 4076149 - DNA, 19 bp, Homo sapiens
ctgggatgggaacactggt

SEQ ID NO: 4076150 - DNA, 15 bp, Homo sapiens
ctgggatgggaccag

SEQ ID NO: 4076151 - DNA, 16 bp, Homo sapiens
ctgggatgggaccagg

SEQ ID NO: 4076152 - DNA, 17 bp, Homo sapiens
ctgggatgggaccaggg

SEQ ID NO: 4076153 - DNA, 23 bp, Homo sapiens
ctgggattaagaaaccttgctct

SEQ ID NO: 4076154 - DNA, 21 bp, Homo sapiens
ctgggattacaggcgtgagcc

SEQ ID NO: 4076155 - DNA, 17 bp, Homo sapiens
ctgggattcccaccaag

SEQ ID NO: 4076156 - DNA, 22 bp, Homo sapiens
ctgggattctactttaagcact

SEQ ID NO: 4076157 - DNA, 13 bp, Homo sapiens
ctgggcaaagcca

SEQ ID NO: 4076158 - DNA, 19 bp, Homo sapiens
ctgggcaaagccacaaggc

SEQ ID NO: 4076159 - DNA, 17 bp, Homo sapiens
ctgggcaatgaggcaga

SEQ ID NO: 4076160 - DNA, 14 bp, Homo sapiens
ctgggcacagctct

SEQ ID NO: 4076161 - DNA, 19 bp, Homo sapiens
ctgggcacgcctgctggcc

SEQ ID NO: 4076162 - DNA, 17 bp, Homo sapiens
ctgggcagcatagcaag

SEQ ID NO: 4076163 - DNA, 16 bp, Homo sapiens
ctgggcagccaggctg

SEQ ID NO: 4076164 - DNA, 15 bp, Homo sapiens
ctgggcagccccaga

SEQ ID NO: 4076165 - DNA, 18 bp, Homo sapiens
ctgggcatgggtccaggg

SEQ ID NO: 4076166 - DNA, 21 bp, Homo sapiens
ctgggcatgggtccagggcct

SEQ ID NO: 4076167 - DNA, 15 bp, Homo sapiens
ctgggcattttcctc

SEQ ID NO: 4076168 - DNA, 17 bp, Homo sapiens
ctgggcattttcctcct

SEQ ID NO: 4076169 - DNA, 20 bp, Homo sapiens
ctgggcattttcctcctctg

SEQ ID NO: 4076170 - DNA, 21 bp, Homo sapiens
ctgggcattttcctcctctgc

SEQ ID NO: 4076171 - DNA, 14 bp, Homo sapiens
ctgggccagccctg

SEQ ID NO: 4076172 - DNA, 19 bp, Homo sapiens
ctgggccagccctgcagcc

SEQ ID NO: 4076173 - DNA, 13 bp, Homo sapiens
ctgggccagggtc

SEQ ID NO: 4076174 - DNA, 14 bp, Homo sapiens
ctgggccagggtct

SEQ ID NO: 4076175 - DNA, 15 bp, Homo sapiens
ctgggccagggtctg

SEQ ID NO: 4076176 - DNA, 19 bp, Homo sapiens
ctgggccagggtctgtgtg

SEQ ID NO: 4076177 - DNA, 13 bp, Homo sapiens
ctgggccatctct

SEQ ID NO: 4076178 - DNA, 17 bp, Homo sapiens
ctgggccatgtccaaag

SEQ ID NO: 4076179 - DNA, 19 bp, Homo sapiens
ctgggccattctccacagc

SEQ ID NO: 4076180 - DNA, 20 bp, Homo sapiens
ctgggccattctccacagca

SEQ ID NO: 4076181 - DNA, 21 bp, Homo sapiens
ctgggccattctccacagcaa

SEQ ID NO: 4076182 - DNA, 22 bp, Homo sapiens
ctgggccattctccacagcaac

SEQ ID NO: 4076183 - DNA, 23 bp, Homo sapiens
ctgggcccacccaagcaggaggc

SEQ ID NO: 4076184 - DNA, 13 bp, Homo sapiens
ctgggcccagggg

SEQ ID NO: 4076185 - DNA, 20 bp, Homo sapiens
ctgggccctctttccctgcg

SEQ ID NO: 4076186 - DNA, 22 bp, Homo sapiens
ctgggccctctttccctgcgag

SEQ ID NO: 4076187 - DNA, 23 bp, Homo sapiens
ctgggccctctttccctgcgaga

SEQ ID NO: 4076188 - DNA, 15 bp, Homo sapiens
ctgggccctggagga

SEQ ID NO: 4076189 - DNA, 22 bp, Homo sapiens
ctgggccgttacatctgtgcag

SEQ ID NO: 4076190 - DNA, 21 bp, Homo sapiens
ctgggcctcagttcaacctgg

SEQ ID NO: 4076191 - DNA, 19 bp, Homo sapiens
ctgggcctcccttgggctg

SEQ ID NO: 4076192 - DNA, 13 bp, Homo sapiens
ctgggcctctgac

SEQ ID NO: 4076193 - DNA, 16 bp, Homo sapiens
ctgggcctttgcaaga

SEQ ID NO: 4076194 - DNA, 22 bp, Homo sapiens
ctgggcggcgggcggctgggtc

SEQ ID NO: 4076195 - DNA, 22 bp, Homo sapiens
ctgggctcaagcaatcctcctg

SEQ ID NO: 4076196 - DNA, 17 bp, Homo sapiens
ctgggctccccccagtg

SEQ ID NO: 4076197 - DNA, 15 bp, Homo sapiens
ctgggctccctgatg

SEQ ID NO: 4076198 - DNA, 18 bp, Homo sapiens
ctgggctccctgatgaca

SEQ ID NO: 4076199 - DNA, 14 bp, Homo sapiens
ctgggctcctggaa

SEQ ID NO: 4076200 - DNA, 17 bp, Homo sapiens
ctgggctcctggaacca

SEQ ID NO: 4076201 - DNA, 13 bp, Homo sapiens
ctgggctcggagg

SEQ ID NO: 4076202 - DNA, 15 bp, Homo sapiens
ctgggctcggaggct

SEQ ID NO: 4076203 - DNA, 18 bp, Homo sapiens
ctgggctcggaggctgcc

SEQ ID NO: 4076204 - DNA, 21 bp, Homo sapiens
ctgggctcggaggctgccccc

SEQ ID NO: 4076205 - DNA, 22 bp, Homo sapiens
ctgggctctgcaattcccctct

SEQ ID NO: 4076206 - DNA, 23 bp, Homo sapiens
ctgggctctgcaattcccctctg

SEQ ID NO: 4076207 - DNA, 15 bp, Homo sapiens
ctgggctgccaccag

SEQ ID NO: 4076208 - DNA, 20 bp, Homo sapiens
ctgggctgccaccagccccc

SEQ ID NO: 4076209 - DNA, 20 bp, Homo sapiens
ctgggctgccatgtgaagag

SEQ ID NO: 4076210 - DNA, 17 bp, Homo sapiens
ctgggctggactggagg

SEQ ID NO: 4076211 - DNA, 19 bp, Homo sapiens
ctgggctggactggaggtg

SEQ ID NO: 4076212 - DNA, 21 bp, Homo sapiens
ctgggctggactggaggtggg

SEQ ID NO: 4076213 - DNA, 14 bp, Homo sapiens
ctgggctgggccct

SEQ ID NO: 4076214 - DNA, 16 bp, Homo sapiens
ctgggctgggccctct

SEQ ID NO: 4076215 - DNA, 17 bp, Homo sapiens
ctgggctgggccctctt

SEQ ID NO: 4076216 - DNA, 22 bp, Homo sapiens
ctgggctggggccaccatccct

SEQ ID NO: 4076217 - DNA, 15 bp, Homo sapiens
ctgggctgggtgctg

SEQ ID NO: 4076218 - DNA, 19 bp, Homo sapiens
ctgggctgggtgctgggaa

SEQ ID NO: 4076219 - DNA, 19 bp, Homo sapiens
ctgggctgggtttgctgtc

SEQ ID NO: 4076220 - DNA, 13 bp, Homo sapiens
ctgggctgtctgt

SEQ ID NO: 4076221 - DNA, 20 bp, Homo sapiens
ctgggctgtctgtcaccagc

SEQ ID NO: 4076222 - DNA, 13 bp, Homo sapiens
ctgggcttggcct

SEQ ID NO: 4076223 - DNA, 14 bp, Homo sapiens
ctgggcttggcctg

SEQ ID NO: 4076224 - DNA, 16 bp, Homo sapiens
ctgggcttggcctgct

SEQ ID NO: 4076225 - DNA, 17 bp, Homo sapiens
ctgggcttggcctgctg

SEQ ID NO: 4076226 - DNA, 20 bp, Homo sapiens
ctgggcttttgttttgcttt

SEQ ID NO: 4076227 - DNA, 21 bp, Homo sapiens
ctgggcttttgttttgctttt

SEQ ID NO: 4076228 - DNA, 18 bp, Homo sapiens
ctggggaaggagccagtt

SEQ ID NO: 4076229 - DNA, 15 bp, Homo sapiens
ctggggacagcttcc

SEQ ID NO: 4076230 - DNA, 19 bp, Homo sapiens
ctggggacagcttcctcac

SEQ ID NO: 4076231 - DNA, 20 bp, Homo sapiens
ctggggacctggtaccctcc

SEQ ID NO: 4076232 - DNA, 22 bp, Homo sapiens
ctggggacctggtaccctcctg

SEQ ID NO: 4076233 - DNA, 17 bp, Homo sapiens
ctggggactcagggacc

SEQ ID NO: 4076234 - DNA, 22 bp, Homo sapiens
ctgtgagaatagtggaggaagg

SEQ ID NO: 4076235 - DNA, 16 bp, Homo sapiens
ctgtgagacccccaca

SEQ ID NO: 4076236 - DNA, 23 bp, Homo sapiens
ctgtgagcaaggagcacaagcca

SEQ ID NO: 4076237 - DNA, 17 bp, Homo sapiens
ctgtgagcccagctggg

SEQ ID NO: 4076238 - DNA, 15 bp, Homo sapiens
ctgtgagcccctggt

SEQ ID NO: 4076239 - DNA, 15 bp, Homo sapiens
ctgtgaggctgtcct

SEQ ID NO: 4076240 - DNA, 16 bp, Homo sapiens
ctgtgaggctgtcctg

SEQ ID NO: 4076241 - DNA, 14 bp, Homo sapiens
ctgtgagggagggg

SEQ ID NO: 4076242 - DNA, 22 bp, Homo sapiens
ctgtgagggaggggaaaagcat

SEQ ID NO: 4076243 - DNA, 20 bp, Homo sapiens
ctgtgagtgtaagtgtgagt

SEQ ID NO: 4076244 - DNA, 21 bp, Homo sapiens
ctgtgagtgtaagtgtgagta

SEQ ID NO: 4076245 - DNA, 16 bp, Homo sapiens
ctgtgagttctccctg

SEQ ID NO: 4076246 - DNA, 16 bp, Homo sapiens
ctgtgatatgccatag

SEQ ID NO: 4076247 - DNA, 23 bp, Homo sapiens
ctgtgatcaatatttttatatca

SEQ ID NO: 4076248 - DNA, 15 bp, Homo sapiens
ctgtgatcatttatt

SEQ ID NO: 4076249 - DNA, 14 bp, Homo sapiens
ctgtgatgctgggc

SEQ ID NO: 4076250 - DNA, 16 bp, Homo sapiens
ctgtgattcagaaaat

SEQ ID NO: 4076251 - DNA, 22 bp, Homo sapiens
ctgtgattccactacacctggc

SEQ ID NO: 4076252 - DNA, 16 bp, Homo sapiens
ctgtgcaaggcctggt

SEQ ID NO: 4076253 - DNA, 12 bp, Homo sapiens
ctgtgcactgcc

SEQ ID NO: 4076254 - DNA, 19 bp, Homo sapiens
ctgtgcactgccctgttca

SEQ ID NO: 4076255 - DNA, 23 bp, Homo sapiens
ctgtgcagaagggagctggctcc

SEQ ID NO: 4076256 - DNA, 14 bp, Homo sapiens
ctgtgcagaataat

SEQ ID NO: 4076257 - DNA, 17 bp, Homo sapiens
ctgtgcatgggtgaagg

SEQ ID NO: 4076258 - DNA, 22 bp, Homo sapiens
ctgtgcatgggtgaagggagag

SEQ ID NO: 4076259 - DNA, 17 bp, Homo sapiens
ctgtgccaataaaagtt

SEQ ID NO: 4076260 - DNA, 18 bp, Homo sapiens
ctgtgccacccaccaggg

SEQ ID NO: 4076261 - DNA, 13 bp, Homo sapiens
ctgtgccagaggc

SEQ ID NO: 4076262 - DNA, 14 bp, Homo sapiens
ctgtgccagggcag

SEQ ID NO: 4076263 - DNA, 14 bp, Homo sapiens
ctgtgccaggtgaa

SEQ ID NO: 4076264 - DNA, 20 bp, Homo sapiens
ctgtgccatgctgggccact

SEQ ID NO: 4076265 - DNA, 17 bp, Homo sapiens
ctgtgcccactccctat

SEQ ID NO: 4076266 - DNA, 17 bp, Homo sapiens
ctgtgccccatgcctgt

SEQ ID NO: 4076267 - DNA, 13 bp, Homo sapiens
ctgtgcctcccag

SEQ ID NO: 4076268 - DNA, 16 bp, Homo sapiens
ctgtgcctcccagctt

SEQ ID NO: 4076269 - DNA, 17 bp, Homo sapiens
ctgtgcctctgggactg

SEQ ID NO: 4076270 - DNA, 18 bp, Homo sapiens
ctgtgcctctgggactgg

SEQ ID NO: 4076271 - DNA, 21 bp, Homo sapiens
ctgtgcctggccccagcctgg

SEQ ID NO: 4076272 - DNA, 17 bp, Homo sapiens
ctgtgccttcagctgtt

SEQ ID NO: 4076273 - DNA, 23 bp, Homo sapiens
ctgtgccttgttttttgtttgtt

SEQ ID NO: 4076274 - DNA, 21 bp, Homo sapiens
ctgtgcgcataggcctgcttt

SEQ ID NO: 4076275 - DNA, 19 bp, Homo sapiens
ctgtgcgtcttggtgtaat

SEQ ID NO: 4076276 - DNA, 14 bp, Homo sapiens
ctgtgcgtgaaaca

SEQ ID NO: 4076277 - DNA, 15 bp, Homo sapiens
ctgtgctatgaattt

SEQ ID NO: 4076278 - DNA, 16 bp, Homo sapiens
ctgtgctatgaatttt

SEQ ID NO: 4076279 - DNA, 21 bp, Homo sapiens
ctgtgctcggaggccatctcg

SEQ ID NO: 4076280 - DNA, 18 bp, Homo sapiens
ctgtgcttcaattaataa

SEQ ID NO: 4076281 - DNA, 20 bp, Homo sapiens
ctgtgcttgaaggccctgct

SEQ ID NO: 4076282 - DNA, 13 bp, Homo sapiens
ctgtggaatgaag

SEQ ID NO: 4076283 - DNA, 17 bp, Homo sapiens
ctgtggaccgtggacag

SEQ ID NO: 4076284 - DNA, 21 bp, Homo sapiens
ctgtggaccgtggacaggccc

SEQ ID NO: 4076285 - DNA, 15 bp, Homo sapiens
ctgtggagcaaaagg

SEQ ID NO: 4076286 - DNA, 23 bp, Homo sapiens
ctgtggagcaaaaggcagctcac

SEQ ID NO: 4076287 - DNA, 15 bp, Homo sapiens
ctgtggagctcagcc

SEQ ID NO: 4076288 - DNA, 15 bp, Homo sapiens
ctgtggaggaaggat

SEQ ID NO: 4076289 - DNA, 17 bp, Homo sapiens
ctgtggaggaaggattg

SEQ ID NO: 4076290 - DNA, 20 bp, Homo sapiens
ctgtggaggaaggattgtaa

SEQ ID NO: 4076291 - DNA, 21 bp, Homo sapiens
ctgtggaggaaggattgtaaa

SEQ ID NO: 4076292 - DNA, 23 bp, Homo sapiens
ctgtggaggaaggattgtaaaaa

SEQ ID NO: 4076293 - DNA, 17 bp, Homo sapiens
ctgtggcatctttgcct

SEQ ID NO: 4076294 - DNA, 16 bp, Homo sapiens
ctgtggcattgaaatg

SEQ ID NO: 4076295 - DNA, 23 bp, Homo sapiens
ctgtggccagcttgttatttata

SEQ ID NO: 4076296 - DNA, 13 bp, Homo sapiens
ctgtggccctggc

SEQ ID NO: 4076297 - DNA, 16 bp, Homo sapiens
ctgtggccctggctct

SEQ ID NO: 4076298 - DNA, 19 bp, Homo sapiens
ctgtggcgttctgctgccc

SEQ ID NO: 4076299 - DNA, 20 bp, Homo sapiens
ctgtgggagggactttgctg

SEQ ID NO: 4076300 - DNA, 17 bp, Homo sapiens
ctgtgggcagcaccctc

SEQ ID NO: 4076301 - DNA, 23 bp, Homo sapiens
ctgtgggcagcaccctcccccgc

SEQ ID NO: 4076302 - DNA, 19 bp, Homo sapiens
ctgtgggcctcaaggactt

SEQ ID NO: 4076303 - DNA, 20 bp, Homo sapiens
ctgtgggcctcaaggacttg

SEQ ID NO: 4076304 - DNA, 14 bp, Homo sapiens
ctgtggggaaaggg

SEQ ID NO: 4076305 - DNA, 19 bp, Homo sapiens
ctgtgggtgttctttcctg

SEQ ID NO: 4076306 - DNA, 22 bp, Homo sapiens
ctgtgggtgttctttcctgccc

SEQ ID NO: 4076307 - DNA, 22 bp, Homo sapiens
ctgtggtcttcaaattgtcttt

SEQ ID NO: 4076308 - DNA, 14 bp, Homo sapiens
ctgtggttacagtg

SEQ ID NO: 4076309 - DNA, 11 bp, Homo sapiens
ctgtgtactgt

SEQ ID NO: 4076310 - DNA, 16 bp, Homo sapiens
ctgtgtacttcccggg

SEQ ID NO: 4076311 - DNA, 13 bp, Homo sapiens
ctgtgtatctttt

SEQ ID NO: 4076312 - DNA, 14 bp, Homo sapiens
ctgtgtatgtacat

SEQ ID NO: 4076313 - DNA, 15 bp, Homo sapiens
ctgtgtcatttcttc

SEQ ID NO: 4076314 - DNA, 20 bp, Homo sapiens
ctgtgtcccagatgggccac

SEQ ID NO: 4076315 - DNA, 18 bp, Homo sapiens
ctgtgtgaaacatggttg

SEQ ID NO: 4076316 - DNA, 12 bp, Homo sapiens
ctgtgtgaaata

SEQ ID NO: 4076317 - DNA, 21 bp, Homo sapiens
ctgtgtgaaataccagtgtgg

SEQ ID NO: 4076318 - DNA, 17 bp, Homo sapiens
ctgtgtgaatgtgggca

SEQ ID NO: 4076319 - DNA, 17 bp, Homo sapiens
ctgtgtgtaggctgggg

SEQ ID NO: 4076320 - DNA, 14 bp, Homo sapiens
ctgtgtgtgccctg

SEQ ID NO: 4076321 - DNA, 12 bp, Homo sapiens
ctgtgtgtgtga

SEQ ID NO: 4076322 - DNA, 15 bp, Homo sapiens
ctgtgtgtgttgccc

SEQ ID NO: 4076323 - DNA, 16 bp, Homo sapiens
ctgtgtgttttcataa

SEQ ID NO: 4076324 - DNA, 13 bp, Homo sapiens
ctgtgttcccaga

SEQ ID NO: 4076325 - DNA, 16 bp, Homo sapiens
ctgtgttcccagaggc

SEQ ID NO: 4076326 - DNA, 22 bp, Homo sapiens
ctgtgttgccacagtagaactg

SEQ ID NO: 4076327 - DNA, 15 bp, Homo sapiens
ctgtgttgtacagct

SEQ ID NO: 4076328 - DNA, 19 bp, Homo sapiens
ctgtgttgtctctagagca

SEQ ID NO: 4076329 - DNA, 19 bp, Homo sapiens
ctgtgtttaaaaagtaagt

SEQ ID NO: 4076330 - DNA, 14 bp, Homo sapiens
ctgtgtttaatttg

SEQ ID NO: 4076331 - DNA, 17 bp, Homo sapiens
ctgtgtttacagagatg

SEQ ID NO: 4076332 - DNA, 23 bp, Homo sapiens
ctgtgtttccatctcaaagaagg

SEQ ID NO: 4076333 - DNA, 15 bp, Homo sapiens
ctgtgtttgcagcct

SEQ ID NO: 4076334 - DNA, 23 bp, Homo sapiens
ctgtgtttttgctatcacacagt

SEQ ID NO: 4076335 - DNA, 13 bp, Homo sapiens
ctgttaaacagta

SEQ ID NO: 4076336 - DNA, 13 bp, Homo sapiens
cttcaagtgcctt

SEQ ID NO: 4076337 - DNA, 15 bp, Homo sapiens
cttcaagtgcctttt

SEQ ID NO: 4076338 - DNA, 12 bp, Homo sapiens
cttcaagttgta

SEQ ID NO: 4076339 - DNA, 16 bp, Homo sapiens
cttcaatgacttctaa

SEQ ID NO: 4076340 - DNA, 18 bp, Homo sapiens
cttcacaccccaggccct

SEQ ID NO: 4076341 - DNA, 14 bp, Homo sapiens
cttcacaggcactc

SEQ ID NO: 4076342 - DNA, 17 bp, Homo sapiens
cttcacattaaaaaatg

SEQ ID NO: 4076343 - DNA, 19 bp, Homo sapiens
cttcaccagagcatttcca

SEQ ID NO: 4076344 - DNA, 18 bp, Homo sapiens
cttcaccagagcccatgc

SEQ ID NO: 4076345 - DNA, 15 bp, Homo sapiens
cttcaccctgagttt

SEQ ID NO: 4076346 - DNA, 15 bp, Homo sapiens
cttcaccctggagcc

SEQ ID NO: 4076347 - DNA, 15 bp, Homo sapiens
cttcacgcccttggc

SEQ ID NO: 4076348 - DNA, 12 bp, Homo sapiens
cttcactacttt

SEQ ID NO: 4076349 - DNA, 13 bp, Homo sapiens
cttcactctctcc

SEQ ID NO: 4076350 - DNA, 22 bp, Homo sapiens
cttcactctctccgtctgtttt

SEQ ID NO: 4076351 - DNA, 13 bp, Homo sapiens
cttcactgtataa

SEQ ID NO: 4076352 - DNA, 23 bp, Homo sapiens
cttcactgtataaataggagagg

SEQ ID NO: 4076353 - DNA, 16 bp, Homo sapiens
cttcacttcaagctgt

SEQ ID NO: 4076354 - DNA, 15 bp, Homo sapiens
cttcagaagctagtg

SEQ ID NO: 4076355 - DNA, 17 bp, Homo sapiens
cttcagagtacgtcctg

SEQ ID NO: 4076356 - DNA, 18 bp, Homo sapiens
cttcagagtacgtcctgc

SEQ ID NO: 4076357 - DNA, 21 bp, Homo sapiens
cttcagcagtacctataaagt

SEQ ID NO: 4076358 - DNA, 20 bp, Homo sapiens
cttcagcccccagcccctcc

SEQ ID NO: 4076359 - DNA, 20 bp, Homo sapiens
cttcagctagcttttaggaa

SEQ ID NO: 4076360 - DNA, 14 bp, Homo sapiens
cttcagctgcctga

SEQ ID NO: 4076361 - DNA, 18 bp, Homo sapiens
cttcagctgcctgaaaca

SEQ ID NO: 4076362 - DNA, 20 bp, Homo sapiens
cttcagctgttgcagatgaa

SEQ ID NO: 4076363 - DNA, 12 bp, Homo sapiens
cttcaggcctcc

SEQ ID NO: 4076364 - DNA, 15 bp, Homo sapiens
cttcaggctctgccc

SEQ ID NO: 4076365 - DNA, 16 bp, Homo sapiens
cttcaggctctgccca

SEQ ID NO: 4076366 - DNA, 17 bp, Homo sapiens
cttcaggctctgcccag

SEQ ID NO: 4076367 - DNA, 20 bp, Homo sapiens
cttcagggagtcagctgttt

SEQ ID NO: 4076368 - DNA, 18 bp, Homo sapiens
cttcagggcagggctctg

SEQ ID NO: 4076369 - DNA, 20 bp, Homo sapiens
cttcagggcagggctctgat

SEQ ID NO: 4076370 - DNA, 23 bp, Homo sapiens
cttcagggctgagttctgggttt

SEQ ID NO: 4076371 - DNA, 20 bp, Homo sapiens
cttcaggtggatgaggagac

SEQ ID NO: 4076372 - DNA, 15 bp, Homo sapiens
cttcaggttcttagt

SEQ ID NO: 4076373 - DNA, 23 bp, Homo sapiens
cttcagtaccctctcagctccag

SEQ ID NO: 4076374 - DNA, 16 bp, Homo sapiens
cttcagtcagaaaact

SEQ ID NO: 4076375 - DNA, 22 bp, Homo sapiens
cttcagttggttgtgtcttttt

SEQ ID NO: 4076376 - DNA, 18 bp, Homo sapiens
cttcatagcagattttaa

SEQ ID NO: 4076377 - DNA, 16 bp, Homo sapiens
cttcatagctccttgg

SEQ ID NO: 4076378 - DNA, 15 bp, Homo sapiens
cttcatatatttctc

SEQ ID NO: 4076379 - DNA, 17 bp, Homo sapiens
cttcatcattccctctc

SEQ ID NO: 4076380 - DNA, 19 bp, Homo sapiens
cttcatcattccctctcat

SEQ ID NO: 4076381 - DNA, 11 bp, Homo sapiens
cttcatcctct

SEQ ID NO: 4076382 - DNA, 22 bp, Homo sapiens
cttcatctggggttggcaacag

SEQ ID NO: 4076383 - DNA, 13 bp, Homo sapiens
cttcatcttcctg

SEQ ID NO: 4076384 - DNA, 14 bp, Homo sapiens
cttcatcttcctgt

SEQ ID NO: 4076385 - DNA, 19 bp, Homo sapiens
cttcatcttcctgtgtcct

SEQ ID NO: 4076386 - DNA, 21 bp, Homo sapiens
cttcatcttcctgtgtcctga

SEQ ID NO: 4076387 - DNA, 13 bp, Homo sapiens
cttcatgcaatga

SEQ ID NO: 4076388 - DNA, 14 bp, Homo sapiens
cttcatgccagcta

SEQ ID NO: 4076389 - DNA, 17 bp, Homo sapiens
cttcatgctcagccctg

SEQ ID NO: 4076390 - DNA, 21 bp, Homo sapiens
cttcatggaactcagctgtct

SEQ ID NO: 4076391 - DNA, 13 bp, Homo sapiens
cttcatggatggg

SEQ ID NO: 4076392 - DNA, 15 bp, Homo sapiens
cttcatgttcccact

SEQ ID NO: 4076393 - DNA, 13 bp, Homo sapiens
cttcattctatca

SEQ ID NO: 4076394 - DNA, 12 bp, Homo sapiens
cttcattctcgt

SEQ ID NO: 4076395 - DNA, 14 bp, Homo sapiens
cttcattctcgtga

SEQ ID NO: 4076396 - DNA, 15 bp, Homo sapiens
cttcattctgcaggg

SEQ ID NO: 4076397 - DNA, 21 bp, Homo sapiens
cttcattcttgaaagctgtgg

SEQ ID NO: 4076398 - DNA, 22 bp, Homo sapiens
cttcattgtactacctgtgtat

SEQ ID NO: 4076399 - DNA, 23 bp, Homo sapiens
cttcattgtactacctgtgtata

SEQ ID NO: 4076400 - DNA, 20 bp, Homo sapiens
cttcattgtccctcttcact

SEQ ID NO: 4076401 - DNA, 14 bp, Homo sapiens
cttcatttaaaaaa

SEQ ID NO: 4076402 - DNA, 19 bp, Homo sapiens
cttcattttggtttatttt

SEQ ID NO: 4076403 - DNA, 23 bp, Homo sapiens
cttcattttggtttatttttgta

SEQ ID NO: 4076404 - DNA, 15 bp, Homo sapiens
cttccaaaaaattaa

SEQ ID NO: 4076405 - DNA, 13 bp, Homo sapiens
cttccaaagcaca

SEQ ID NO: 4076406 - DNA, 21 bp, Homo sapiens
cttccaaagcagagagcatta

SEQ ID NO: 4076407 - DNA, 20 bp, Homo sapiens
cttccaacatatatttattg

SEQ ID NO: 4076408 - DNA, 21 bp, Homo sapiens
cttccaacatatatttattga

SEQ ID NO: 4076409 - DNA, 12 bp, Homo sapiens
cttccaaggaga

SEQ ID NO: 4076410 - DNA, 13 bp, Homo sapiens
cttccaaggagac

SEQ ID NO: 4076411 - DNA, 15 bp, Homo sapiens
cttccaaggagacca

SEQ ID NO: 4076412 - DNA, 18 bp, Homo sapiens
cttccaaggagaccaagt

SEQ ID NO: 4076413 - DNA, 20 bp, Homo sapiens
cttccaaggagaccaagtcc

SEQ ID NO: 4076414 - DNA, 21 bp, Homo sapiens
cttccaaggagaccaagtcct

SEQ ID NO: 4076415 - DNA, 14 bp, Homo sapiens
cttccacctccctc

SEQ ID NO: 4076416 - DNA, 18 bp, Homo sapiens
cttccacctgctctgctg

SEQ ID NO: 4076417 - DNA, 16 bp, Homo sapiens
cttccacttgagtgtc

SEQ ID NO: 4076418 - DNA, 12 bp, Homo sapiens
cttccagatcct

SEQ ID NO: 4076419 - DNA, 12 bp, Homo sapiens
cttccagcccat

SEQ ID NO: 4076420 - DNA, 15 bp, Homo sapiens
cttccagcccatcca

SEQ ID NO: 4076421 - DNA, 12 bp, Homo sapiens
cttccagctgct

SEQ ID NO: 4076422 - DNA, 13 bp, Homo sapiens
cttccagctgctg

SEQ ID NO: 4076423 - DNA, 13 bp, Homo sapiens
cttccaggaaact

SEQ ID NO: 4076424 - DNA, 17 bp, Homo sapiens
cttccaggaaactccac

SEQ ID NO: 4076425 - DNA, 18 bp, Homo sapiens
cttccaggaaactccaca

SEQ ID NO: 4076426 - DNA, 23 bp, Homo sapiens
cttccaggaaactccacatctgc

SEQ ID NO: 4076427 - DNA, 22 bp, Homo sapiens
cttccaggataaggagactgag

SEQ ID NO: 4076428 - DNA, 13 bp, Homo sapiens
cttccaggcagcc

SEQ ID NO: 4076429 - DNA, 13 bp, Homo sapiens
cttccagggccct

SEQ ID NO: 4076430 - DNA, 18 bp, Homo sapiens
cttccaggtatctccagg

SEQ ID NO: 4076431 - DNA, 16 bp, Homo sapiens
cttccaggtgttactg

SEQ ID NO: 4076432 - DNA, 18 bp, Homo sapiens
cttccagtgtccttagaa

SEQ ID NO: 4076433 - DNA, 23 bp, Homo sapiens
cttccagtttattccagagctgc

SEQ ID NO: 4076434 - DNA, 11 bp, Homo sapiens
cttccataatt

SEQ ID NO: 4076435 - DNA, 18 bp, Homo sapiens
cttccatacacagaggag

SEQ ID NO: 4076436 - DNA, 14 bp, Homo sapiens
cttccatagcctaa

SEQ ID NO: 4076437 - DNA, 16 bp, Homo sapiens
cttccatatttggaag

SEQ ID NO: 4076438 - DNA, 19 bp, Homo sapiens
cttccatatttggaagaaa

SEQ ID NO: 4076439 - DNA, 13 bp, Homo sapiens
cttcttcctgtga

SEQ ID NO: 4076440 - DNA, 19 bp, Homo sapiens
cttcttcctttctctttct

SEQ ID NO: 4076441 - DNA, 19 bp, Homo sapiens
cttcttctgtccaagcaga

SEQ ID NO: 4076442 - DNA, 21 bp, Homo sapiens
cttcttctgtccaagcagatt

SEQ ID NO: 4076443 - DNA, 15 bp, Homo sapiens
cttcttgctgcagcc

SEQ ID NO: 4076444 - DNA, 13 bp, Homo sapiens
cttcttgggcccc

SEQ ID NO: 4076445 - DNA, 22 bp, Homo sapiens
cttcttgtgattgctgccataa

SEQ ID NO: 4076446 - DNA, 17 bp, Homo sapiens
cttcttgtttccttgtt

SEQ ID NO: 4076447 - DNA, 19 bp, Homo sapiens
cttctttagaccctcgggc

SEQ ID NO: 4076448 - DNA, 13 bp, Homo sapiens
cttctttccatca

SEQ ID NO: 4076449 - DNA, 20 bp, Homo sapiens
cttctttcccttagtgactc

SEQ ID NO: 4076450 - DNA, 23 bp, Homo sapiens
cttctttcccttcctccatcctc

SEQ ID NO: 4076451 - DNA, 12 bp, Homo sapiens
cttctttgaaga

SEQ ID NO: 4076452 - DNA, 13 bp, Homo sapiens
cttctttgaagaa

SEQ ID NO: 4076453 - DNA, 19 bp, Homo sapiens
cttctttgataatgttaaa

SEQ ID NO: 4076454 - DNA, 15 bp, Homo sapiens
cttctttgtgccttt

SEQ ID NO: 4076455 - DNA, 20 bp, Homo sapiens
cttctttgtgcctttggcct

SEQ ID NO: 4076456 - DNA, 12 bp, Homo sapiens
cttcttttactt

SEQ ID NO: 4076457 - DNA, 20 bp, Homo sapiens
cttgaaaagttcagggaccg

SEQ ID NO: 4076458 - DNA, 17 bp, Homo sapiens
cttgaaattatatctgt

SEQ ID NO: 4076459 - DNA, 21 bp, Homo sapiens
cttgaaattatatctgtggtc

SEQ ID NO: 4076460 - DNA, 14 bp, Homo sapiens
cttgaacaaaaagt

SEQ ID NO: 4076461 - DNA, 16 bp, Homo sapiens
cttgaacctgtgagta

SEQ ID NO: 4076462 - DNA, 20 bp, Homo sapiens
cttgaagatcgttagtatct

SEQ ID NO: 4076463 - DNA, 16 bp, Homo sapiens
cttgaagcctgctcct

SEQ ID NO: 4076464 - DNA, 17 bp, Homo sapiens
cttgaaggccctgctga

SEQ ID NO: 4076465 - DNA, 16 bp, Homo sapiens
cttgaagggccagagc

SEQ ID NO: 4076466 - DNA, 21 bp, Homo sapiens
cttgaagggccagagccaggg

SEQ ID NO: 4076467 - DNA, 14 bp, Homo sapiens
cttgaaggtgctga

SEQ ID NO: 4076468 - DNA, 19 bp, Homo sapiens
cttgaagtctaaaagcaga

SEQ ID NO: 4076469 - DNA, 14 bp, Homo sapiens
cttgaatatgtagc

SEQ ID NO: 4076470 - DNA, 13 bp, Homo sapiens
cttgaatgctgcc

SEQ ID NO: 4076471 - DNA, 19 bp, Homo sapiens
cttgaatgtggcttgagaa

SEQ ID NO: 4076472 - DNA, 20 bp, Homo sapiens
cttgaatgtggcttgagaaa

SEQ ID NO: 4076473 - DNA, 22 bp, Homo sapiens
cttgaatgtggcttgagaaata

SEQ ID NO: 4076474 - DNA, 15 bp, Homo sapiens
cttgacacctgctga

SEQ ID NO: 4076475 - DNA, 12 bp, Homo sapiens
cttgacagctca

SEQ ID NO: 4076476 - DNA, 18 bp, Homo sapiens
cttgacatgtagcttctt

SEQ ID NO: 4076477 - DNA, 17 bp, Homo sapiens
cttgaccaggcttggcc

SEQ ID NO: 4076478 - DNA, 17 bp, Homo sapiens
cttgactcatggcagct

SEQ ID NO: 4076479 - DNA, 21 bp, Homo sapiens
cttgactcccaagtttccata

SEQ ID NO: 4076480 - DNA, 18 bp, Homo sapiens
cttgactctaaatgcagt

SEQ ID NO: 4076481 - DNA, 19 bp, Homo sapiens
cttgactgggtgagaccca

SEQ ID NO: 4076482 - DNA, 22 bp, Homo sapiens
cttgactttggctgatttaaaa

SEQ ID NO: 4076483 - DNA, 22 bp, Homo sapiens
cttgagaaatatggacacttaa

SEQ ID NO: 4076484 - DNA, 21 bp, Homo sapiens
cttgagacaatgttttcttca

SEQ ID NO: 4076485 - DNA, 17 bp, Homo sapiens
cttgagacacggagccc

SEQ ID NO: 4076486 - DNA, 22 bp, Homo sapiens
cttgagagtatcaggtctccca

SEQ ID NO: 4076487 - DNA, 15 bp, Homo sapiens
cttgagatgtcttct

SEQ ID NO: 4076488 - DNA, 14 bp, Homo sapiens
cttgagcagtggct

SEQ ID NO: 4076489 - DNA, 14 bp, Homo sapiens
cttgagcccaggag

SEQ ID NO: 4076490 - DNA, 15 bp, Homo sapiens
cttgagcccaggagt

SEQ ID NO: 4076491 - DNA, 17 bp, Homo sapiens
cttgagccgggcccctg

SEQ ID NO: 4076492 - DNA, 20 bp, Homo sapiens
cttgagccgggcccctgggc

SEQ ID NO: 4076493 - DNA, 14 bp, Homo sapiens
cttgaggccaggag

SEQ ID NO: 4076494 - DNA, 17 bp, Homo sapiens
cttgagggcccagagca

SEQ ID NO: 4076495 - DNA, 16 bp, Homo sapiens
cttgaggggagccagg

SEQ ID NO: 4076496 - DNA, 17 bp, Homo sapiens
cttgaggtcttttgaca

SEQ ID NO: 4076497 - DNA, 22 bp, Homo sapiens
cttgaggtcttttgacatgtgg

SEQ ID NO: 4076498 - DNA, 17 bp, Homo sapiens
cttgagttcccagatgg

SEQ ID NO: 4076499 - DNA, 16 bp, Homo sapiens
cttgagttttatttat

SEQ ID NO: 4076500 - DNA, 21 bp, Homo sapiens
cttgatacccccctctgtctt

SEQ ID NO: 4076501 - DNA, 18 bp, Homo sapiens
cttgatccagaagagccc

SEQ ID NO: 4076502 - DNA, 13 bp, Homo sapiens
cttgatctctctt

SEQ ID NO: 4076503 - DNA, 17 bp, Homo sapiens
cttgatctctcttgtcc

SEQ ID NO: 4076504 - DNA, 20 bp, Homo sapiens
cttgatctctcttgtcctct

SEQ ID NO: 4076505 - DNA, 21 bp, Homo sapiens
cttgatgaccaaagtcctttt

SEQ ID NO: 4076506 - DNA, 20 bp, Homo sapiens
cttgatggtgacagctgcaa

SEQ ID NO: 4076507 - DNA, 23 bp, Homo sapiens
cttgatggtgacagctgcaagcc

SEQ ID NO: 4076508 - DNA, 13 bp, Homo sapiens
cttgatgtacata

SEQ ID NO: 4076509 - DNA, 22 bp, Homo sapiens
cttgatgtgaagataatttgca

SEQ ID NO: 4076510 - DNA, 22 bp, Homo sapiens
cttgatgtgccattttaaaaaa

SEQ ID NO: 4076511 - DNA, 17 bp, Homo sapiens
cttgatgtttggggtct

SEQ ID NO: 4076512 - DNA, 22 bp, Homo sapiens
cttgattaagattttacaaaag

SEQ ID NO: 4076513 - DNA, 16 bp, Homo sapiens
cttgattatccatatt

SEQ ID NO: 4076514 - DNA, 19 bp, Homo sapiens
cttgatttgatgtgacttt

SEQ ID NO: 4076515 - DNA, 17 bp, Homo sapiens
cttgatttgcatggatt

SEQ ID NO: 4076516 - DNA, 18 bp, Homo sapiens
cttgatttgcatggattt

SEQ ID NO: 4076517 - DNA, 19 bp, Homo sapiens
cttgcaacctcaccttcct

SEQ ID NO: 4076518 - DNA, 21 bp, Homo sapiens
cttgcaacctcaccttcctgt

SEQ ID NO: 4076519 - DNA, 22 bp, Homo sapiens
cttgcaccccaaagctttcctg

SEQ ID NO: 4076520 - DNA, 23 bp, Homo sapiens
cttgcaccccaaagctttcctgc

SEQ ID NO: 4076521 - DNA, 18 bp, Homo sapiens
cttgcactctcttggctg

SEQ ID NO: 4076522 - DNA, 16 bp, Homo sapiens
cttgcagattctattt

SEQ ID NO: 4076523 - DNA, 15 bp, Homo sapiens
cttgcaggaggccaa

SEQ ID NO: 4076524 - DNA, 22 bp, Homo sapiens
cttgcaggaggccaaactgtcc

SEQ ID NO: 4076525 - DNA, 21 bp, Homo sapiens
cttgcaggggtcccccctcaa

SEQ ID NO: 4076526 - DNA, 18 bp, Homo sapiens
cttgcagttcagcaccac

SEQ ID NO: 4076527 - DNA, 14 bp, Homo sapiens
cttgcattcatttt

SEQ ID NO: 4076528 - DNA, 14 bp, Homo sapiens
cttgcattcccagt

SEQ ID NO: 4076529 - DNA, 20 bp, Homo sapiens
cttgccaagctttcttctac

SEQ ID NO: 4076530 - DNA, 14 bp, Homo sapiens
cttgccacatttct

SEQ ID NO: 4076531 - DNA, 20 bp, Homo sapiens
cttgccacatttctgatcag

SEQ ID NO: 4076532 - DNA, 23 bp, Homo sapiens
cttgccacatttctgatcagagg

SEQ ID NO: 4076533 - DNA, 23 bp, Homo sapiens
cttgccaccccaccctccctgga

SEQ ID NO: 4076534 - DNA, 23 bp, Homo sapiens
cttgccagagatccaaaagaagc

SEQ ID NO: 4076535 - DNA, 12 bp, Homo sapiens
cttgccagtctt

SEQ ID NO: 4076536 - DNA, 22 bp, Homo sapiens
cttgcccactcctgctctgctc

SEQ ID NO: 4076537 - DNA, 19 bp, Homo sapiens
cttgccctagatagtttat

SEQ ID NO: 4076538 - DNA, 17 bp, Homo sapiens
cttgcctcaatgccagt

SEQ ID NO: 4076539 - DNA, 18 bp, Homo sapiens
cttgcctggggtctgagc

SEQ ID NO: 4076540 - DNA, 21 bp, Homo sapiens
cttgcctggggtctgagcatg

SEQ ID NO: 4076541 - DNA, 15 bp, Homo sapiens
ctttctgtcttgtta

SEQ ID NO: 4076542 - DNA, 13 bp, Homo sapiens
ctttctgtgccct

SEQ ID NO: 4076543 - DNA, 14 bp, Homo sapiens
ctttctgttccaaa

SEQ ID NO: 4076544 - DNA, 23 bp, Homo sapiens
ctttctgttccaaattcagtttc

SEQ ID NO: 4076545 - DNA, 21 bp, Homo sapiens
ctttctgttgtcattgctgtt

SEQ ID NO: 4076546 - DNA, 13 bp, Homo sapiens
ctttctgttttct

SEQ ID NO: 4076547 - DNA, 23 bp, Homo sapiens
ctttctgttttctgtttgtaaat

SEQ ID NO: 4076548 - DNA, 22 bp, Homo sapiens
ctttcttacctactattggccc

SEQ ID NO: 4076549 - DNA, 16 bp, Homo sapiens
ctttcttattctgtat

SEQ ID NO: 4076550 - DNA, 17 bp, Homo sapiens
ctttcttcctcattccc

SEQ ID NO: 4076551 - DNA, 21 bp, Homo sapiens
ctttcttcctcattccctcgt

SEQ ID NO: 4076552 - DNA, 20 bp, Homo sapiens
ctttcttctacaaccagagc

SEQ ID NO: 4076553 - DNA, 22 bp, Homo sapiens
ctttcttctacaaccagagccc

SEQ ID NO: 4076554 - DNA, 12 bp, Homo sapiens
ctttcttctccc

SEQ ID NO: 4076555 - DNA, 14 bp, Homo sapiens
ctttcttctgccct

SEQ ID NO: 4076556 - DNA, 16 bp, Homo sapiens
ctttcttgctcccttc

SEQ ID NO: 4076557 - DNA, 13 bp, Homo sapiens
ctttcttggccag

SEQ ID NO: 4076558 - DNA, 22 bp, Homo sapiens
ctttcttttctggaatgtaatc

SEQ ID NO: 4076559 - DNA, 22 bp, Homo sapiens
ctttctttttcttttttgcttt

SEQ ID NO: 4076560 - DNA, 15 bp, Homo sapiens
ctttgaaacctcagg

SEQ ID NO: 4076561 - DNA, 15 bp, Homo sapiens
ctttgaaattgttta

SEQ ID NO: 4076562 - DNA, 21 bp, Homo sapiens
ctttgacaattcctagataaa

SEQ ID NO: 4076563 - DNA, 14 bp, Homo sapiens
ctttgacttcagct

SEQ ID NO: 4076564 - DNA, 20 bp, Homo sapiens
ctttgacttcagctgcctga

SEQ ID NO: 4076565 - DNA, 22 bp, Homo sapiens
ctttgactttatctcctgctct

SEQ ID NO: 4076566 - DNA, 16 bp, Homo sapiens
ctttgagacagtttct

SEQ ID NO: 4076567 - DNA, 17 bp, Homo sapiens
ctttgagacagtttctt

SEQ ID NO: 4076568 - DNA, 15 bp, Homo sapiens
ctttgagagacgcca

SEQ ID NO: 4076569 - DNA, 18 bp, Homo sapiens
ctttgagggtggaaggat

SEQ ID NO: 4076570 - DNA, 15 bp, Homo sapiens
ctttgagttttaaat

SEQ ID NO: 4076571 - DNA, 15 bp, Homo sapiens
ctttgataattgttt

SEQ ID NO: 4076572 - DNA, 18 bp, Homo sapiens
ctttgatttacagcaagt

SEQ ID NO: 4076573 - DNA, 21 bp, Homo sapiens
ctttgcacaggaaagagtcac

SEQ ID NO: 4076574 - DNA, 16 bp, Homo sapiens
ctttgcactgagggcc

SEQ ID NO: 4076575 - DNA, 16 bp, Homo sapiens
ctttgcactgatatat

SEQ ID NO: 4076576 - DNA, 18 bp, Homo sapiens
ctttgcagggcagcccca

SEQ ID NO: 4076577 - DNA, 20 bp, Homo sapiens
ctttgcagttggactctcag

SEQ ID NO: 4076578 - DNA, 21 bp, Homo sapiens
ctttgcagttggactctcagg

SEQ ID NO: 4076579 - DNA, 18 bp, Homo sapiens
ctttgccagaaagcataa

SEQ ID NO: 4076580 - DNA, 17 bp, Homo sapiens
ctttgccagctgctgct

SEQ ID NO: 4076581 - DNA, 18 bp, Homo sapiens
ctttgccagctgctgctg

SEQ ID NO: 4076582 - DNA, 12 bp, Homo sapiens
ctttgcctctgc

SEQ ID NO: 4076583 - DNA, 11 bp, Homo sapiens
ctttgcctctt

SEQ ID NO: 4076584 - DNA, 16 bp, Homo sapiens
ctttgcctcttctttg

SEQ ID NO: 4076585 - DNA, 17 bp, Homo sapiens
ctttgccttgcagccac

SEQ ID NO: 4076586 - DNA, 19 bp, Homo sapiens
ctttgccttgggctgctcc

SEQ ID NO: 4076587 - DNA, 23 bp, Homo sapiens
ctttgccttgggctgctcctcat

SEQ ID NO: 4076588 - DNA, 21 bp, Homo sapiens
ctttgcctttcttctgccctt

SEQ ID NO: 4076589 - DNA, 22 bp, Homo sapiens
ctttgctctcaattaaagtcta

SEQ ID NO: 4076590 - DNA, 13 bp, Homo sapiens
ctttgctctgggt

SEQ ID NO: 4076591 - DNA, 19 bp, Homo sapiens
ctttgctgatttcccctct

SEQ ID NO: 4076592 - DNA, 12 bp, Homo sapiens
ctttgctgcaga

SEQ ID NO: 4076593 - DNA, 19 bp, Homo sapiens
ctttgctgcagagatcaag

SEQ ID NO: 4076594 - DNA, 11 bp, Homo sapiens
ctttgctgcca

SEQ ID NO: 4076595 - DNA, 20 bp, Homo sapiens
ctttgcttcaaatccatcca

SEQ ID NO: 4076596 - DNA, 12 bp, Homo sapiens
ctttgcttcata

SEQ ID NO: 4076597 - DNA, 20 bp, Homo sapiens
ctttgcttcccctccaggag

SEQ ID NO: 4076598 - DNA, 17 bp, Homo sapiens
ctttgcttgagaatcct

SEQ ID NO: 4076599 - DNA, 18 bp, Homo sapiens
ctttgcttgctttgaagt

SEQ ID NO: 4076600 - DNA, 17 bp, Homo sapiens
ctttggaaacaggacca

SEQ ID NO: 4076601 - DNA, 24 bp, Homo sapiens
ctttggaaagtacactctgctgtt

SEQ ID NO: 4076602 - DNA, 15 bp, Homo sapiens
ctttggaaggagtga

SEQ ID NO: 4076603 - DNA, 22 bp, Homo sapiens
ctttggagtcccctcacctcct

SEQ ID NO: 4076604 - DNA, 15 bp, Homo sapiens
ctttggatttgacat

SEQ ID NO: 4076605 - DNA, 17 bp, Homo sapiens
ctttggatttgacattg

SEQ ID NO: 4076606 - DNA, 12 bp, Homo sapiens
ctttggcagttg

SEQ ID NO: 4076607 - DNA, 20 bp, Homo sapiens
ctttggcctggggtgcatct

SEQ ID NO: 4076608 - DNA, 21 bp, Homo sapiens
ctttggcctggggtgcatctc

SEQ ID NO: 4076609 - DNA, 19 bp, Homo sapiens
ctttggctgaggggcttgg

SEQ ID NO: 4076610 - DNA, 20 bp, Homo sapiens
ctttggctgaggggcttggg

SEQ ID NO: 4076611 - DNA, 18 bp, Homo sapiens
ctttgggatcccaccctg

SEQ ID NO: 4076612 - DNA, 20 bp, Homo sapiens
ctttgggatttaatttccag

SEQ ID NO: 4076613 - DNA, 21 bp, Homo sapiens
ctttgggccagacatgccaca

SEQ ID NO: 4076614 - DNA, 17 bp, Homo sapiens
ctttgggttaagcatta

SEQ ID NO: 4076615 - DNA, 22 bp, Homo sapiens
ctttgggttaagcattaccact

SEQ ID NO: 4076616 - DNA, 14 bp, Homo sapiens
ctttggtccttcaa

SEQ ID NO: 4076617 - DNA, 18 bp, Homo sapiens
ctttggtgaacagttttg

SEQ ID NO: 4076618 - DNA, 16 bp, Homo sapiens
ctttggttccttctct

SEQ ID NO: 4076619 - DNA, 16 bp, Homo sapiens
ctttggttctctccag

SEQ ID NO: 4076620 - DNA, 14 bp, Homo sapiens
ctttggttctggcc

SEQ ID NO: 4076621 - DNA, 23 bp, Homo sapiens
ctttggtttatggttttcattca

SEQ ID NO: 4076622 - DNA, 17 bp, Homo sapiens
ctttggtttttttcttc

SEQ ID NO: 4076623 - DNA, 17 bp, Homo sapiens
ctttgtaagagtgtaga

SEQ ID NO: 4076624 - DNA, 22 bp, Homo sapiens
ctttgtaagagtgtagaagcat

SEQ ID NO: 4076625 - DNA, 22 bp, Homo sapiens
ctttgtaagtcagtgttgagat

SEQ ID NO: 4076626 - DNA, 18 bp, Homo sapiens
ctttgtaatttttgggga

SEQ ID NO: 4076627 - DNA, 19 bp, Homo sapiens
ctttgtacagagtgctttt

SEQ ID NO: 4076628 - DNA, 13 bp, Homo sapiens
ctttgtagctact

SEQ ID NO: 4076629 - DNA, 14 bp, Homo sapiens
ctttgtagctactt

SEQ ID NO: 4076630 - DNA, 15 bp, Homo sapiens
ctttgtatcttccat

SEQ ID NO: 4076631 - DNA, 15 bp, Homo sapiens
ctttgtcctcctgct

SEQ ID NO: 4076632 - DNA, 13 bp, Homo sapiens
ctttgtgaatatt

SEQ ID NO: 4076633 - DNA, 17 bp, Homo sapiens
ctttgtgcctttggcct

SEQ ID NO: 4076634 - DNA, 21 bp, Homo sapiens
ctttgtgcttgtcattccaga

SEQ ID NO: 4076635 - DNA, 16 bp, Homo sapiens
ctttgtgtatctcatt

SEQ ID NO: 4076636 - DNA, 14 bp, Homo sapiens
ctttgtgtttgctt

SEQ ID NO: 4076637 - DNA, 17 bp, Homo sapiens
ctttgtgtttggtttac

SEQ ID NO: 4076638 - DNA, 21 bp, Homo sapiens
ctttgtgtttggtttacattt

SEQ ID NO: 4076639 - DNA, 15 bp, Homo sapiens
ctttgttacaggcac

SEQ ID NO: 4076640 - DNA, 14 bp, Homo sapiens
ctttgttataccat

SEQ ID NO: 4076641 - DNA, 14 bp, Homo sapiens
ctttgttctgagca

SEQ ID NO: 4076642 - DNA, 19 bp, Homo sapiens
ctttgttgcaagatgtgaa

SEQ ID NO: 4076643 - DNA, 21 bp, Homo sapiens
gacaggcccagcgcggccagc

SEQ ID NO: 4076644 - DNA, 22 bp, Homo sapiens
gacaggcccagcgcggccagcg

SEQ ID NO: 4076645 - DNA, 15 bp, Homo sapiens
gacaggcgagagagg

SEQ ID NO: 4076646 - DNA, 19 bp, Homo sapiens
gacaggcgagagaggagcc

SEQ ID NO: 4076647 - DNA, 21 bp, Homo sapiens
gacaggcgagagaggagccag

SEQ ID NO: 4076648 - DNA, 24 bp, Homo sapiens
gacaggcgagagaggagccagaca

SEQ ID NO: 4076649 - DNA, 17 bp, Homo sapiens
gacaggctcttagcagc

SEQ ID NO: 4076650 - DNA, 14 bp, Homo sapiens
gacaggctggctcc

SEQ ID NO: 4076651 - DNA, 21 bp, Homo sapiens
gacaggctggctccagatgca

SEQ ID NO: 4076652 - DNA, 15 bp, Homo sapiens
gacagggaggccaca

SEQ ID NO: 4076653 - DNA, 15 bp, Homo sapiens
gacagggcatggcca

SEQ ID NO: 4076654 - DNA, 20 bp, Homo sapiens
gacagggcatggccaggtgg

SEQ ID NO: 4076655 - DNA, 11 bp, Homo sapiens
gacagggccag

SEQ ID NO: 4076656 - DNA, 19 bp, Homo sapiens
gacagggccagtggggcct

SEQ ID NO: 4076657 - DNA, 16 bp, Homo sapiens
gacagggcctggagcc

SEQ ID NO: 4076658 - DNA, 17 bp, Homo sapiens
gacagggtaggaaaggg

SEQ ID NO: 4076659 - DNA, 15 bp, Homo sapiens
gacagggtgggcttc

SEQ ID NO: 4076660 - DNA, 17 bp, Homo sapiens
gacagggtgggcttcct

SEQ ID NO: 4076661 - DNA, 22 bp, Homo sapiens
gacagggtgggcttcctgccct

SEQ ID NO: 4076662 - DNA, 21 bp, Homo sapiens
gacagtatgagtcaatgtgca

SEQ ID NO: 4076663 - DNA, 21 bp, Homo sapiens
gacagtcatcatcagggcctg

SEQ ID NO: 4076664 - DNA, 22 bp, Homo sapiens
gacagtcatcatcagggcctgg

SEQ ID NO: 4076665 - DNA, 21 bp, Homo sapiens
gacagtgataggcccaaggtc

SEQ ID NO: 4076666 - DNA, 16 bp, Homo sapiens
gacagtgatctccata

SEQ ID NO: 4076667 - DNA, 13 bp, Homo sapiens
gacagtgcctggg

SEQ ID NO: 4076668 - DNA, 21 bp, Homo sapiens
gacagtgcctgggaatgtatt

SEQ ID NO: 4076669 - DNA, 20 bp, Homo sapiens
gacagtggattgcatttctt

SEQ ID NO: 4076670 - DNA, 15 bp, Homo sapiens
gacagttcatatgta

SEQ ID NO: 4076671 - DNA, 17 bp, Homo sapiens
gacagttcatatgtacc

SEQ ID NO: 4076672 - DNA, 21 bp, Homo sapiens
gacagtttaccagttgccttt

SEQ ID NO: 4076673 - DNA, 12 bp, Homo sapiens
gacagtttctta

SEQ ID NO: 4076674 - DNA, 21 bp, Homo sapiens
gacagtttcttagctttttaa

SEQ ID NO: 4076675 - DNA, 23 bp, Homo sapiens
gacagtttcttagctttttaatt

SEQ ID NO: 4076676 - DNA, 14 bp, Homo sapiens
gacataacgttttt

SEQ ID NO: 4076677 - DNA, 21 bp, Homo sapiens
gacataacgtttttcctttaa

SEQ ID NO: 4076678 - DNA, 19 bp, Homo sapiens
gacatactctctgcctggt

SEQ ID NO: 4076679 - DNA, 22 bp, Homo sapiens
gacatactctctgcctggtggt

SEQ ID NO: 4076680 - DNA, 18 bp, Homo sapiens
gacatacttgaagggcca

SEQ ID NO: 4076681 - DNA, 22 bp, Homo sapiens
gacatacttgaagggccagagc

SEQ ID NO: 4076682 - DNA, 23 bp, Homo sapiens
gacatacttgaagggccagagcc

SEQ ID NO: 4076683 - DNA, 14 bp, Homo sapiens
gacatagatatttt

SEQ ID NO: 4076684 - DNA, 20 bp, Homo sapiens
gacatagatattttcacaat

SEQ ID NO: 4076685 - DNA, 13 bp, Homo sapiens
gacatattatgcc

SEQ ID NO: 4076686 - DNA, 16 bp, Homo sapiens
gacatattatgcctga

SEQ ID NO: 4076687 - DNA, 14 bp, Homo sapiens
gacatcacagcagc

SEQ ID NO: 4076688 - DNA, 16 bp, Homo sapiens
gacatccgttgtgctt

SEQ ID NO: 4076689 - DNA, 18 bp, Homo sapiens
gacatctcaggggccaga

SEQ ID NO: 4076690 - DNA, 14 bp, Homo sapiens
gacatctggaatct

SEQ ID NO: 4076691 - DNA, 21 bp, Homo sapiens
gacatcttcaaagcttgaaga

SEQ ID NO: 4076692 - DNA, 16 bp, Homo sapiens
gacatgaatgcacact

SEQ ID NO: 4076693 - DNA, 14 bp, Homo sapiens
gacatgatcttctt

SEQ ID NO: 4076694 - DNA, 22 bp, Homo sapiens
gacatgatttccttgaatgtgg

SEQ ID NO: 4076695 - DNA, 22 bp, Homo sapiens
gacatgcattgttggctatttg

SEQ ID NO: 4076696 - DNA, 18 bp, Homo sapiens
gacatgcggtagccagca

SEQ ID NO: 4076697 - DNA, 20 bp, Homo sapiens
gacatggagactcctgccct

SEQ ID NO: 4076698 - DNA, 17 bp, Homo sapiens
gacatggtgcctgagag

SEQ ID NO: 4076699 - DNA, 18 bp, Homo sapiens
gacatggtgcctgagagg

SEQ ID NO: 4076700 - DNA, 21 bp, Homo sapiens
gacatggtgcctgagaggcag

SEQ ID NO: 4076701 - DNA, 23 bp, Homo sapiens
gacatggtgcctgagaggcaggc

SEQ ID NO: 4076702 - DNA, 17 bp, Homo sapiens
gacatgtagcttcttct

SEQ ID NO: 4076703 - DNA, 15 bp, Homo sapiens
gacatgtgaaacctt

SEQ ID NO: 4076704 - DNA, 20 bp, Homo sapiens
gacatgtgaggaggaaaagg

SEQ ID NO: 4076705 - DNA, 22 bp, Homo sapiens
gacatgtgcaattgtgagggac

SEQ ID NO: 4076706 - DNA, 19 bp, Homo sapiens
gacatgtggaaagtgaatt

SEQ ID NO: 4076707 - DNA, 21 bp, Homo sapiens
gacattaaatgcaataatttt

SEQ ID NO: 4076708 - DNA, 18 bp, Homo sapiens
gacattcacctgccccaa

SEQ ID NO: 4076709 - DNA, 15 bp, Homo sapiens
gacattcccctccca

SEQ ID NO: 4076710 - DNA, 15 bp, Homo sapiens
gacattgccccaaga

SEQ ID NO: 4076711 - DNA, 20 bp, Homo sapiens
gacattgtttggatttcctt

SEQ ID NO: 4076712 - DNA, 14 bp, Homo sapiens
gacatttagaactt

SEQ ID NO: 4076713 - DNA, 15 bp, Homo sapiens
gacatttgccttgct

SEQ ID NO: 4076714 - DNA, 16 bp, Homo sapiens
gacatttggagagggg

SEQ ID NO: 4076715 - DNA, 14 bp, Homo sapiens
gacattttacatta

SEQ ID NO: 4076716 - DNA, 15 bp, Homo sapiens
gacattttacattaa

SEQ ID NO: 4076717 - DNA, 23 bp, Homo sapiens
gacatttttccgtttgcttttgt

SEQ ID NO: 4076718 - DNA, 12 bp, Homo sapiens
gaccaagaactg

SEQ ID NO: 4076719 - DNA, 16 bp, Homo sapiens
gaccaatagcccacag

SEQ ID NO: 4076720 - DNA, 20 bp, Homo sapiens
gaccaatattatactaagaa

SEQ ID NO: 4076721 - DNA, 15 bp, Homo sapiens
gaccacagcacagcc

SEQ ID NO: 4076722 - DNA, 16 bp, Homo sapiens
gaccacatgccactgc

SEQ ID NO: 4076723 - DNA, 20 bp, Homo sapiens
gaccacatgccactgcctgc

SEQ ID NO: 4076724 - DNA, 18 bp, Homo sapiens
gaccacattttatattta

SEQ ID NO: 4076725 - DNA, 18 bp, Homo sapiens
gaccaccccgcctgccct

SEQ ID NO: 4076726 - DNA, 19 bp, Homo sapiens
gaccaccccgcctgccctc

SEQ ID NO: 4076727 - DNA, 21 bp, Homo sapiens
gaccaccctccctgactggcc

SEQ ID NO: 4076728 - DNA, 22 bp, Homo sapiens
gaccaccctccctgactggcct

SEQ ID NO: 4076729 - DNA, 14 bp, Homo sapiens
gaccacctgcttct

SEQ ID NO: 4076730 - DNA, 15 bp, Homo sapiens
gaccacctgcttctg

SEQ ID NO: 4076731 - DNA, 17 bp, Homo sapiens
gaccacctgcttctgaa

SEQ ID NO: 4076732 - DNA, 20 bp, Homo sapiens
gaccaccttctgtccccagc

SEQ ID NO: 4076733 - DNA, 14 bp, Homo sapiens
gaccacgctttcta

SEQ ID NO: 4076734 - DNA, 13 bp, Homo sapiens
gaccacggctcga

SEQ ID NO: 4076735 - DNA, 21 bp, Homo sapiens
gaccacggggagcaaaccagc

SEQ ID NO: 4076736 - DNA, 21 bp, Homo sapiens
gaccactgagtaccaggggct

SEQ ID NO: 4076737 - DNA, 14 bp, Homo sapiens
gaccactgttatca

SEQ ID NO: 4076738 - DNA, 23 bp, Homo sapiens
gaccacttccaggggaacctgcc

SEQ ID NO: 4076739 - DNA, 14 bp, Homo sapiens
gaccagagcagttt

SEQ ID NO: 4076740 - DNA, 17 bp, Homo sapiens
gaccagagccagatgca

SEQ ID NO: 4076741 - DNA, 21 bp, Homo sapiens
gaccagagccagatgcaggac

SEQ ID NO: 4076742 - DNA, 15 bp, Homo sapiens
gaccagagctgtctg

SEQ ID NO: 4076743 - DNA, 16 bp, Homo sapiens
gaccagagctgtctga

SEQ ID NO: 4076744 - DNA, 17 bp, Homo sapiens
gaccagataaatagaac

SEQ ID NO: 4076745 - DNA, 17 bp, Homo sapiens
gagactcctgccctgtt

SEQ ID NO: 4076746 - DNA, 16 bp, Homo sapiens
gagactctagggtcca

SEQ ID NO: 4076747 - DNA, 14 bp, Homo sapiens
gagactgagcagcc

SEQ ID NO: 4076748 - DNA, 16 bp, Homo sapiens
gagactgagcagccgc

SEQ ID NO: 4076749 - DNA, 11 bp, Homo sapiens
gagactgcccc

SEQ ID NO: 4076750 - DNA, 14 bp, Homo sapiens
gagactgctaagta

SEQ ID NO: 4076751 - DNA, 22 bp, Homo sapiens
gagactgggaaggcttgggatt

SEQ ID NO: 4076752 - DNA, 23 bp, Homo sapiens
gagactgtctcaagagggcactg

SEQ ID NO: 4076753 - DNA, 14 bp, Homo sapiens
gagacttactgggt

SEQ ID NO: 4076754 - DNA, 20 bp, Homo sapiens
gagacttccaaacctgacag

SEQ ID NO: 4076755 - DNA, 11 bp, Homo sapiens
gagagaaaaaa

SEQ ID NO: 4076756 - DNA, 22 bp, Homo sapiens
gagagaaagtgtgagcaaacta

SEQ ID NO: 4076757 - DNA, 14 bp, Homo sapiens
gagagaagctcttc

SEQ ID NO: 4076758 - DNA, 13 bp, Homo sapiens
gagagacaggcag

SEQ ID NO: 4076759 - DNA, 11 bp, Homo sapiens
gagagagaaat

SEQ ID NO: 4076760 - DNA, 10 bp, Homo sapiens
gagagagaga

SEQ ID NO: 4076761 - DNA, 14 bp, Homo sapiens
gagagagagagaaa

SEQ ID NO: 4076762 - DNA, 13 bp, Homo sapiens
gagagagagagag

SEQ ID NO: 4076763 - DNA, 14 bp, Homo sapiens
gagagagagaggac

SEQ ID NO: 4076764 - DNA, 13 bp, Homo sapiens
gagagagaggaca

SEQ ID NO: 4076765 - DNA, 20 bp, Homo sapiens
gagagcaactctgagatcta

SEQ ID NO: 4076766 - DNA, 12 bp, Homo sapiens
gagagcagcagc

SEQ ID NO: 4076767 - DNA, 21 bp, Homo sapiens
gagagcagctccctttctcag

SEQ ID NO: 4076768 - DNA, 22 bp, Homo sapiens
gagagcagctccctttctcagg

SEQ ID NO: 4076769 - DNA, 22 bp, Homo sapiens
gagagcattataatcaccaggg

SEQ ID NO: 4076770 - DNA, 23 bp, Homo sapiens
gagagcccagaggtaacagaaca

SEQ ID NO: 4076771 - DNA, 20 bp, Homo sapiens
gagagcccggcgcccctgcc

SEQ ID NO: 4076772 - DNA, 19 bp, Homo sapiens
gagagccgtggtccctgag

SEQ ID NO: 4076773 - DNA, 12 bp, Homo sapiens
gagagcctgctg

SEQ ID NO: 4076774 - DNA, 14 bp, Homo sapiens
gagagcctgctggc

SEQ ID NO: 4076775 - DNA, 14 bp, Homo sapiens
gagagctggtgccc

SEQ ID NO: 4076776 - DNA, 13 bp, Homo sapiens
gagaggacagagg

SEQ ID NO: 4076777 - DNA, 15 bp, Homo sapiens
gagaggacagcttga

SEQ ID NO: 4076778 - DNA, 15 bp, Homo sapiens
gagaggagaaacaca

SEQ ID NO: 4076779 - DNA, 13 bp, Homo sapiens
gagaggagccaga

SEQ ID NO: 4076780 - DNA, 13 bp, Homo sapiens
gagaggaggcagc

SEQ ID NO: 4076781 - DNA, 21 bp, Homo sapiens
gagaggatgagagcccagagg

SEQ ID NO: 4076782 - DNA, 18 bp, Homo sapiens
gagaggcactcagtgagc

SEQ ID NO: 4076783 - DNA, 22 bp, Homo sapiens
gagaggcactcagtgagcctcc

SEQ ID NO: 4076784 - DNA, 16 bp, Homo sapiens
gagaggcagagaaaga

SEQ ID NO: 4076785 - DNA, 11 bp, Homo sapiens
gagaggcagct

SEQ ID NO: 4076786 - DNA, 15 bp, Homo sapiens
gagaggcatggctgg

SEQ ID NO: 4076787 - DNA, 17 bp, Homo sapiens
gagaggccaaaggctgg

SEQ ID NO: 4076788 - DNA, 15 bp, Homo sapiens
gagaggcggcctcgt

SEQ ID NO: 4076789 - DNA, 16 bp, Homo sapiens
gagaggctctggggca

SEQ ID NO: 4076790 - DNA, 19 bp, Homo sapiens
gagagggacagcccactga

SEQ ID NO: 4076791 - DNA, 23 bp, Homo sapiens
gagagggaggtcactggaaaggg

SEQ ID NO: 4076792 - DNA, 13 bp, Homo sapiens
gagagggagtcag

SEQ ID NO: 4076793 - DNA, 17 bp, Homo sapiens
gagagggatttccctgc

SEQ ID NO: 4076794 - DNA, 15 bp, Homo sapiens
gagaggggaaagtgt

SEQ ID NO: 4076795 - DNA, 16 bp, Homo sapiens
gagaggggaagggcca

SEQ ID NO: 4076796 - DNA, 17 bp, Homo sapiens
gagaggggaagggccag

SEQ ID NO: 4076797 - DNA, 23 bp, Homo sapiens
gagagggtgagtcctccagaact

SEQ ID NO: 4076798 - DNA, 23 bp, Homo sapiens
gagagtcagctctctgccctgtg

SEQ ID NO: 4076799 - DNA, 13 bp, Homo sapiens
gagagtcaggcag

SEQ ID NO: 4076800 - DNA, 14 bp, Homo sapiens
gagagtcaggcagg

SEQ ID NO: 4076801 - DNA, 16 bp, Homo sapiens
gagagtttagctgtaa

SEQ ID NO: 4076802 - DNA, 13 bp, Homo sapiens
gagataataagat

SEQ ID NO: 4076803 - DNA, 14 bp, Homo sapiens
gagataataagatt

SEQ ID NO: 4076804 - DNA, 18 bp, Homo sapiens
gagatatatctgaaaact

SEQ ID NO: 4076805 - DNA, 14 bp, Homo sapiens
gagatattataagg

SEQ ID NO: 4076806 - DNA, 19 bp, Homo sapiens
gagatattataagggagag

SEQ ID NO: 4076807 - DNA, 11 bp, Homo sapiens
gagatatttac

SEQ ID NO: 4076808 - DNA, 15 bp, Homo sapiens
gagatcacagcctcc

SEQ ID NO: 4076809 - DNA, 17 bp, Homo sapiens
gagatcacagcctccag

SEQ ID NO: 4076810 - DNA, 19 bp, Homo sapiens
gagatcacagcctccaggg

SEQ ID NO: 4076811 - DNA, 18 bp, Homo sapiens
gagatccagggcaaggcc

SEQ ID NO: 4076812 - DNA, 17 bp, Homo sapiens
gagatcgagaccatcct

SEQ ID NO: 4076813 - DNA, 20 bp, Homo sapiens
gagatcgcgccactgcactc

SEQ ID NO: 4076814 - DNA, 19 bp, Homo sapiens
gagatctaagcctttccat

SEQ ID NO: 4076815 - DNA, 19 bp, Homo sapiens
gagatcttcccataataaa

SEQ ID NO: 4076816 - DNA, 14 bp, Homo sapiens
gagatgaccaggga

SEQ ID NO: 4076817 - DNA, 21 bp, Homo sapiens
gagatgaccagggatgctggg

SEQ ID NO: 4076818 - DNA, 22 bp, Homo sapiens
gagatgaccagggatgctgggc

SEQ ID NO: 4076819 - DNA, 18 bp, Homo sapiens
gagatgagaaatgatgaa

SEQ ID NO: 4076820 - DNA, 21 bp, Homo sapiens
gagatgagaggtagccgggct

SEQ ID NO: 4076821 - DNA, 18 bp, Homo sapiens
gagatgaggaggggagcg

SEQ ID NO: 4076822 - DNA, 14 bp, Homo sapiens
gagatgcagaggta

SEQ ID NO: 4076823 - DNA, 16 bp, Homo sapiens
gagatgctgagggtgt

SEQ ID NO: 4076824 - DNA, 13 bp, Homo sapiens
gagatgcttctct

SEQ ID NO: 4076825 - DNA, 21 bp, Homo sapiens
gagatggaaacaatgtggagt

SEQ ID NO: 4076826 - DNA, 17 bp, Homo sapiens
gagatggagggcttggc

SEQ ID NO: 4076827 - DNA, 14 bp, Homo sapiens
gagattgaatttca

SEQ ID NO: 4076828 - DNA, 12 bp, Homo sapiens
gagatttgtcta

SEQ ID NO: 4076829 - DNA, 16 bp, Homo sapiens
gagatttttaagaact

SEQ ID NO: 4076830 - DNA, 18 bp, Homo sapiens
gagatttttaagaacttc

SEQ ID NO: 4076831 - DNA, 17 bp, Homo sapiens
gagattttttattgcta

SEQ ID NO: 4076832 - DNA, 17 bp, Homo sapiens
gagcaaaaggcagctca

SEQ ID NO: 4076833 - DNA, 24 bp, Homo sapiens
gagcaaaaggcagctcacccctgg

SEQ ID NO: 4076834 - DNA, 22 bp, Homo sapiens
gagcaaaatatgccccttcttg

SEQ ID NO: 4076835 - DNA, 23 bp, Homo sapiens
gagcaaaccagcttgttctgggc

SEQ ID NO: 4076836 - DNA, 18 bp, Homo sapiens
gagcaaagatcaaaataa

SEQ ID NO: 4076837 - DNA, 22 bp, Homo sapiens
gagcaaagatcaaaataaaaag

SEQ ID NO: 4076838 - DNA, 15 bp, Homo sapiens
gagcaagagagcagc

SEQ ID NO: 4076839 - DNA, 12 bp, Homo sapiens
gagcaagagctg

SEQ ID NO: 4076840 - DNA, 12 bp, Homo sapiens
gagcaaggacat

SEQ ID NO: 4076841 - DNA, 13 bp, Homo sapiens
gagcaaggacatt

SEQ ID NO: 4076842 - DNA, 17 bp, Homo sapiens
gagcaaggacattgccc

SEQ ID NO: 4076843 - DNA, 12 bp, Homo sapiens
gagcaagggctt

SEQ ID NO: 4076844 - DNA, 16 bp, Homo sapiens
gagcaatatttatgga

SEQ ID NO: 4076845 - DNA, 15 bp, Homo sapiens
gagcaatggcgcctg

SEQ ID NO: 4076846 - DNA, 15 bp, Homo sapiens
gagcaatgggactgg

SEQ ID NO: 4076847 - DNA, 21 bp, Homo sapiens
gagcaatgggactggagtcag

SEQ ID NO: 4076848 - DNA, 13 bp, Homo sapiens
gagcacaggcagc

SEQ ID NO: 4076849 - DNA, 20 bp, Homo sapiens
gaggctgggggagagccgtg

SEQ ID NO: 4076850 - DNA, 22 bp, Homo sapiens
gaggctggtgctgtggccaggg

SEQ ID NO: 4076851 - DNA, 13 bp, Homo sapiens
gaggctgtctggg

SEQ ID NO: 4076852 - DNA, 17 bp, Homo sapiens
gaggctgtgtgcctggg

SEQ ID NO: 4076853 - DNA, 21 bp, Homo sapiens
gaggctgtgtgcctgggggag

SEQ ID NO: 4076854 - DNA, 20 bp, Homo sapiens
gaggcttctccgccagcctc

SEQ ID NO: 4076855 - DNA, 23 bp, Homo sapiens
gaggcttctccgccagcctcctc

SEQ ID NO: 4076856 - DNA, 16 bp, Homo sapiens
gagggaaaagggaagt

SEQ ID NO: 4076857 - DNA, 14 bp, Homo sapiens
gagggaagggacgg

SEQ ID NO: 4076858 - DNA, 19 bp, Homo sapiens
gagggaagtgtgagcgcct

SEQ ID NO: 4076859 - DNA, 19 bp, Homo sapiens
gagggacatatcagtgacc

SEQ ID NO: 4076860 - DNA, 18 bp, Homo sapiens
gagggaccaactgggccc

SEQ ID NO: 4076861 - DNA, 14 bp, Homo sapiens
gagggactctgaag

SEQ ID NO: 4076862 - DNA, 22 bp, Homo sapiens
gagggagaatccaagggttgag

SEQ ID NO: 4076863 - DNA, 13 bp, Homo sapiens
gagggagagagag

SEQ ID NO: 4076864 - DNA, 15 bp, Homo sapiens
gagggagagagagag

SEQ ID NO: 4076865 - DNA, 13 bp, Homo sapiens
gagggagagggag

SEQ ID NO: 4076866 - DNA, 18 bp, Homo sapiens
gagggaggggaaatgtaa

SEQ ID NO: 4076867 - DNA, 15 bp, Homo sapiens
gagggaggtgtttaa

SEQ ID NO: 4076868 - DNA, 12 bp, Homo sapiens
gagggagtcagt

SEQ ID NO: 4076869 - DNA, 21 bp, Homo sapiens
gagggatggagaggcggcctc

SEQ ID NO: 4076870 - DNA, 21 bp, Homo sapiens
gagggatttccctgcagacct

SEQ ID NO: 4076871 - DNA, 15 bp, Homo sapiens
gagggcacagccctc

SEQ ID NO: 4076872 - DNA, 19 bp, Homo sapiens
gagggcacagccctccgac

SEQ ID NO: 4076873 - DNA, 18 bp, Homo sapiens
gagggcactggtggcccg

SEQ ID NO: 4076874 - DNA, 13 bp, Homo sapiens
gagggcccagagc

SEQ ID NO: 4076875 - DNA, 12 bp, Homo sapiens
gagggcccagcc

SEQ ID NO: 4076876 - DNA, 16 bp, Homo sapiens
gagggcccagcccaga

SEQ ID NO: 4076877 - DNA, 20 bp, Homo sapiens
gagggcccagcccagagcca

SEQ ID NO: 4076878 - DNA, 21 bp, Homo sapiens
gagggcccagcccagagccac

SEQ ID NO: 4076879 - DNA, 20 bp, Homo sapiens
gagggcccctgcgtgggggc

SEQ ID NO: 4076880 - DNA, 15 bp, Homo sapiens
gagggccctacctga

SEQ ID NO: 4076881 - DNA, 22 bp, Homo sapiens
gagggcctcaaaggcccgctct

SEQ ID NO: 4076882 - DNA, 20 bp, Homo sapiens
gagggcctgctggaggcctc

SEQ ID NO: 4076883 - DNA, 16 bp, Homo sapiens
gagggcggagccggcc

SEQ ID NO: 4076884 - DNA, 20 bp, Homo sapiens
gagggctgatggaggaaaaa

SEQ ID NO: 4076885 - DNA, 15 bp, Homo sapiens
gagggctgccagcag

SEQ ID NO: 4076886 - DNA, 16 bp, Homo sapiens
gagggctgccagcagc

SEQ ID NO: 4076887 - DNA, 17 bp, Homo sapiens
gagggctggaggcccag

SEQ ID NO: 4076888 - DNA, 13 bp, Homo sapiens
gagggctggctgg

SEQ ID NO: 4076889 - DNA, 14 bp, Homo sapiens
gagggctggctggc

SEQ ID NO: 4076890 - DNA, 21 bp, Homo sapiens
gagggcttcctctagaagcca

SEQ ID NO: 4076891 - DNA, 16 bp, Homo sapiens
gagggcttggcccagc

SEQ ID NO: 4076892 - DNA, 14 bp, Homo sapiens
gaggggaaatgtaa

SEQ ID NO: 4076893 - DNA, 22 bp, Homo sapiens
gaggggaaatgtaatactggaa

SEQ ID NO: 4076894 - DNA, 16 bp, Homo sapiens
gaggggaactgagtca

SEQ ID NO: 4076895 - DNA, 14 bp, Homo sapiens
gaggggaagggcca

SEQ ID NO: 4076896 - DNA, 16 bp, Homo sapiens
gaggggaaggggcggt

SEQ ID NO: 4076897 - DNA, 14 bp, Homo sapiens
gaggggagagacag

SEQ ID NO: 4076898 - DNA, 18 bp, Homo sapiens
gaggggcaacgaagaaaa

SEQ ID NO: 4076899 - DNA, 18 bp, Homo sapiens
gaggggccctggccagga

SEQ ID NO: 4076900 - DNA, 13 bp, Homo sapiens
gaggggcctggca

SEQ ID NO: 4076901 - DNA, 19 bp, Homo sapiens
gaggggctctcagctcagc

SEQ ID NO: 4076902 - DNA, 13 bp, Homo sapiens
gaggggcttggga

SEQ ID NO: 4076903 - DNA, 14 bp, Homo sapiens
gagggggccgggcg

SEQ ID NO: 4076904 - DNA, 21 bp, Homo sapiens
gagggggctatagctacagga

SEQ ID NO: 4076905 - DNA, 14 bp, Homo sapiens
gagggggctggcca

SEQ ID NO: 4076906 - DNA, 21 bp, Homo sapiens
gagggggcttgaagccaaaga

SEQ ID NO: 4076907 - DNA, 19 bp, Homo sapiens
gagggtctcgctgtcactg

SEQ ID NO: 4076908 - DNA, 17 bp, Homo sapiens
gagggtgaaaggcaggg

SEQ ID NO: 4076909 - DNA, 24 bp, Homo sapiens
gagggtgtgagaagtgccttctcc

SEQ ID NO: 4076910 - DNA, 21 bp, Homo sapiens
gagggttcctcttaggtcaga

SEQ ID NO: 4076911 - DNA, 12 bp, Homo sapiens
gagggttcctgt

SEQ ID NO: 4076912 - DNA, 12 bp, Homo sapiens
gaggtaagtttt

SEQ ID NO: 4076913 - DNA, 20 bp, Homo sapiens
gaggtagaaatgcaaggggg

SEQ ID NO: 4076914 - DNA, 14 bp, Homo sapiens
gaggtagccgggct

SEQ ID NO: 4076915 - DNA, 17 bp, Homo sapiens
gaggtaggggtggggag

SEQ ID NO: 4076916 - DNA, 20 bp, Homo sapiens
gaggtcacagctggatctgc

SEQ ID NO: 4076917 - DNA, 21 bp, Homo sapiens
gaggtcacattcaggaagatg

SEQ ID NO: 4076918 - DNA, 18 bp, Homo sapiens
gaggtcactggaaagggg

SEQ ID NO: 4076919 - DNA, 21 bp, Homo sapiens
gaggtcactggaaaggggaga

SEQ ID NO: 4076920 - DNA, 11 bp, Homo sapiens
gaggtcaggga

SEQ ID NO: 4076921 - DNA, 23 bp, Homo sapiens
gaggtcagggagtgctggctcac

SEQ ID NO: 4076922 - DNA, 17 bp, Homo sapiens
gaggtctcttgagggag

SEQ ID NO: 4076923 - DNA, 16 bp, Homo sapiens
gaggtctgttcctttt

SEQ ID NO: 4076924 - DNA, 18 bp, Homo sapiens
gaggtcttttgacatgtg

SEQ ID NO: 4076925 - DNA, 17 bp, Homo sapiens
gaggtgctgatgagtga

SEQ ID NO: 4076926 - DNA, 12 bp, Homo sapiens
gaggtgcttcac

SEQ ID NO: 4076927 - DNA, 18 bp, Homo sapiens
gaggtggaagaagggaga

SEQ ID NO: 4076928 - DNA, 13 bp, Homo sapiens
gaggtggagaact

SEQ ID NO: 4076929 - DNA, 16 bp, Homo sapiens
gaggtggagggaggga

SEQ ID NO: 4076930 - DNA, 17 bp, Homo sapiens
gaggtggccagagctgg

SEQ ID NO: 4076931 - DNA, 19 bp, Homo sapiens
gaggtggccagagctggga

SEQ ID NO: 4076932 - DNA, 18 bp, Homo sapiens
gaggtggggcgaggcagg

SEQ ID NO: 4076933 - DNA, 22 bp, Homo sapiens
gaggtgggtgtgggtggaaggg

SEQ ID NO: 4076934 - DNA, 17 bp, Homo sapiens
gaggtggtctgaatgtt

SEQ ID NO: 4076935 - DNA, 20 bp, Homo sapiens
gaggtggtctgaatgttctg

SEQ ID NO: 4076936 - DNA, 14 bp, Homo sapiens
gaggtgtacactaa

SEQ ID NO: 4076937 - DNA, 20 bp, Homo sapiens
gaggtgtgcctggcctctgc

SEQ ID NO: 4076938 - DNA, 13 bp, Homo sapiens
gaggtgttgtgca

SEQ ID NO: 4076939 - DNA, 20 bp, Homo sapiens
gaggtgttgtgcatttgttc

SEQ ID NO: 4076940 - DNA, 18 bp, Homo sapiens
gaggttaaacggtgccca

SEQ ID NO: 4076941 - DNA, 21 bp, Homo sapiens
gaggttacaggtaccagttct

SEQ ID NO: 4076942 - DNA, 22 bp, Homo sapiens
gaggttataggtcactcctggg

SEQ ID NO: 4076943 - DNA, 18 bp, Homo sapiens
gaggttcctctgcctgcc

SEQ ID NO: 4076944 - DNA, 14 bp, Homo sapiens
gaggttctcagagc

SEQ ID NO: 4076945 - DNA, 16 bp, Homo sapiens
gaggttctgagaccag

SEQ ID NO: 4076946 - DNA, 17 bp, Homo sapiens
gaggttctgagaccagt

SEQ ID NO: 4076947 - DNA, 18 bp, Homo sapiens
gaggttgaaaaacaaaat

SEQ ID NO: 4076948 - DNA, 15 bp, Homo sapiens
gaggttgcagcatga

SEQ ID NO: 4076949 - DNA, 23 bp, Homo sapiens
gaggtttgtcgggcaccagccag

SEQ ID NO: 4076950 - DNA, 16 bp, Homo sapiens
gagtaaatacaggtag

SEQ ID NO: 4076951 - DNA, 15 bp, Homo sapiens
gagtaaatattgagg

SEQ ID NO: 4076952 - DNA, 23 bp, Homo sapiens
gatgaagcaaggaagatatacat

SEQ ID NO: 4076953 - DNA, 15 bp, Homo sapiens
gatgaagtatacttt

SEQ ID NO: 4076954 - DNA, 15 bp, Homo sapiens
gatgaatgccgtgga

SEQ ID NO: 4076955 - DNA, 14 bp, Homo sapiens
gatgaatgtattta

SEQ ID NO: 4076956 - DNA, 15 bp, Homo sapiens
gatgacaccctggcc

SEQ ID NO: 4076957 - DNA, 17 bp, Homo sapiens
gatgaccagggatgctg

SEQ ID NO: 4076958 - DNA, 18 bp, Homo sapiens
gatgaccagggatgctgg

SEQ ID NO: 4076959 - DNA, 23 bp, Homo sapiens
gatgaccagggatgctgggctgg

SEQ ID NO: 4076960 - DNA, 14 bp, Homo sapiens
gatgagagcccaga

SEQ ID NO: 4076961 - DNA, 18 bp, Homo sapiens
gatgagcaaggacattgc

SEQ ID NO: 4076962 - DNA, 19 bp, Homo sapiens
gatgagcaaggacattgcc

SEQ ID NO: 4076963 - DNA, 17 bp, Homo sapiens
gatgaggttctgagacc

SEQ ID NO: 4076964 - DNA, 20 bp, Homo sapiens
gatgataagttcctttcctt

SEQ ID NO: 4076965 - DNA, 18 bp, Homo sapiens
gatgatagaggattttat

SEQ ID NO: 4076966 - DNA, 15 bp, Homo sapiens
gatgatctactcaga

SEQ ID NO: 4076967 - DNA, 13 bp, Homo sapiens
gatgatctctcca

SEQ ID NO: 4076968 - DNA, 16 bp, Homo sapiens
gatgattaaacacctg

SEQ ID NO: 4076969 - DNA, 17 bp, Homo sapiens
gatgattaaacacctga

SEQ ID NO: 4076970 - DNA, 19 bp, Homo sapiens
gatgattaaacacctgaca

SEQ ID NO: 4076971 - DNA, 23 bp, Homo sapiens
gatgattaaacacctgacacatc

SEQ ID NO: 4076972 - DNA, 15 bp, Homo sapiens
gatgatttgggggag

SEQ ID NO: 4076973 - DNA, 21 bp, Homo sapiens
gatgattttcatttcatgaaa

SEQ ID NO: 4076974 - DNA, 20 bp, Homo sapiens
gatgcaacacgcatggtcaa

SEQ ID NO: 4076975 - DNA, 21 bp, Homo sapiens
gatgcagacagggggccagaa

SEQ ID NO: 4076976 - DNA, 23 bp, Homo sapiens
gatgcagaggtaaaagtgtgagc

SEQ ID NO: 4076977 - DNA, 22 bp, Homo sapiens
gatgcaggttggaaggggcctt

SEQ ID NO: 4076978 - DNA, 22 bp, Homo sapiens
gatgcatcactgggtgttgatc

SEQ ID NO: 4076979 - DNA, 22 bp, Homo sapiens
gatgccacgctttgctgctacc

SEQ ID NO: 4076980 - DNA, 15 bp, Homo sapiens
gatgccactcctccc

SEQ ID NO: 4076981 - DNA, 15 bp, Homo sapiens
gatgccagctgtgtc

SEQ ID NO: 4076982 - DNA, 12 bp, Homo sapiens
gatgccagcttc

SEQ ID NO: 4076983 - DNA, 19 bp, Homo sapiens
gatgccagcttctctctcc

SEQ ID NO: 4076984 - DNA, 16 bp, Homo sapiens
gatgccccagagctgt

SEQ ID NO: 4076985 - DNA, 14 bp, Homo sapiens
gatgcgcagtgcct

SEQ ID NO: 4076986 - DNA, 21 bp, Homo sapiens
gatgctcaggcttgaaatgca

SEQ ID NO: 4076987 - DNA, 17 bp, Homo sapiens
gatgctccctcagcctc

SEQ ID NO: 4076988 - DNA, 15 bp, Homo sapiens
gatgctccctcccct

SEQ ID NO: 4076989 - DNA, 20 bp, Homo sapiens
gatgctccctcccctgccct

SEQ ID NO: 4076990 - DNA, 20 bp, Homo sapiens
gatgctgacattcacctgcc

SEQ ID NO: 4076991 - DNA, 23 bp, Homo sapiens
gatgctgccagggcgccatcgcc

SEQ ID NO: 4076992 - DNA, 19 bp, Homo sapiens
gatgctgctccgcccgctc

SEQ ID NO: 4076993 - DNA, 22 bp, Homo sapiens
gatgctgcttccggtagggagg

SEQ ID NO: 4076994 - DNA, 15 bp, Homo sapiens
gatgctggcccaggg

SEQ ID NO: 4076995 - DNA, 19 bp, Homo sapiens
gatgctggcccagggccca

SEQ ID NO: 4076996 - DNA, 22 bp, Homo sapiens
gatgctggcccagggcccagag

SEQ ID NO: 4076997 - DNA, 19 bp, Homo sapiens
gatgctgggcaatgaggca

SEQ ID NO: 4076998 - DNA, 14 bp, Homo sapiens
gatgctgggctggg

SEQ ID NO: 4076999 - DNA, 19 bp, Homo sapiens
gatgctgtaacttaaaata

SEQ ID NO: 4077000 - DNA, 17 bp, Homo sapiens
gatgcttataataaaga

SEQ ID NO: 4077001 - DNA, 19 bp, Homo sapiens
gatgcttataataaagaaa

SEQ ID NO: 4077002 - DNA, 14 bp, Homo sapiens
gatgcttctctcct

SEQ ID NO: 4077003 - DNA, 18 bp, Homo sapiens
gatggaaaaactgaggct

SEQ ID NO: 4077004 - DNA, 17 bp, Homo sapiens
gatggaaaaggaagact

SEQ ID NO: 4077005 - DNA, 15 bp, Homo sapiens
gatggaaaataaaca

SEQ ID NO: 4077006 - DNA, 16 bp, Homo sapiens
gatggaaacaatgtgg

SEQ ID NO: 4077007 - DNA, 16 bp, Homo sapiens
gatggaattattgtac

SEQ ID NO: 4077008 - DNA, 19 bp, Homo sapiens
gatggacactaatgcagcc

SEQ ID NO: 4077009 - DNA, 19 bp, Homo sapiens
gatggaccaacctgctctg

SEQ ID NO: 4077010 - DNA, 13 bp, Homo sapiens
gatggagagaata

SEQ ID NO: 4077011 - DNA, 15 bp, Homo sapiens
gatggagaggcggcc

SEQ ID NO: 4077012 - DNA, 15 bp, Homo sapiens
gatggagggcttggc

SEQ ID NO: 4077013 - DNA, 18 bp, Homo sapiens
gatggagggcttggccca

SEQ ID NO: 4077014 - DNA, 22 bp, Homo sapiens
gatggaggggtggtcctgactc

SEQ ID NO: 4077015 - DNA, 16 bp, Homo sapiens
gatggattctcagata

SEQ ID NO: 4077016 - DNA, 15 bp, Homo sapiens
gatggatttgaagca

SEQ ID NO: 4077017 - DNA, 17 bp, Homo sapiens
gatggcaacagatctgg

SEQ ID NO: 4077018 - DNA, 20 bp, Homo sapiens
gatggccagcccctggggcc

SEQ ID NO: 4077019 - DNA, 18 bp, Homo sapiens
gatggcctttccttccct

SEQ ID NO: 4077020 - DNA, 16 bp, Homo sapiens
gatggcttatttttta

SEQ ID NO: 4077021 - DNA, 12 bp, Homo sapiens
gatgggaaaata

SEQ ID NO: 4077022 - DNA, 19 bp, Homo sapiens
gatgggaacactggtgggc

SEQ ID NO: 4077023 - DNA, 23 bp, Homo sapiens
gatgggaatgaggtgggaggtgg

SEQ ID NO: 4077024 - DNA, 22 bp, Homo sapiens
gatgggagctcctctcctggag

SEQ ID NO: 4077025 - DNA, 15 bp, Homo sapiens
gatgggagtgggcac

SEQ ID NO: 4077026 - DNA, 20 bp, Homo sapiens
gatgggagtgggcacctcag

SEQ ID NO: 4077027 - DNA, 19 bp, Homo sapiens
gatgggcggacggctgtgg

SEQ ID NO: 4077028 - DNA, 14 bp, Homo sapiens
gatggggagtccca

SEQ ID NO: 4077029 - DNA, 23 bp, Homo sapiens
gatggggataaaatgactactta

SEQ ID NO: 4077030 - DNA, 16 bp, Homo sapiens
gatggggcaagacaga

SEQ ID NO: 4077031 - DNA, 18 bp, Homo sapiens
gatggggcaagacagaaa

SEQ ID NO: 4077032 - DNA, 22 bp, Homo sapiens
gatgggggaactcagatccagg

SEQ ID NO: 4077033 - DNA, 16 bp, Homo sapiens
gatgggggaactgtga

SEQ ID NO: 4077034 - DNA, 16 bp, Homo sapiens
gatgggggcagggctg

SEQ ID NO: 4077035 - DNA, 20 bp, Homo sapiens
gatgggggcagggctgtgct

SEQ ID NO: 4077036 - DNA, 18 bp, Homo sapiens
gatggtccatttgttcct

SEQ ID NO: 4077037 - DNA, 20 bp, Homo sapiens
gatggtccatttgttcctgc

SEQ ID NO: 4077038 - DNA, 13 bp, Homo sapiens
gatggtcgtgtgt

SEQ ID NO: 4077039 - DNA, 17 bp, Homo sapiens
gatggtgacagctgcaa

SEQ ID NO: 4077040 - DNA, 18 bp, Homo sapiens
gatggtgtgggtgtcctg

SEQ ID NO: 4077041 - DNA, 18 bp, Homo sapiens
gatggttcttcacctcct

SEQ ID NO: 4077042 - DNA, 21 bp, Homo sapiens
gatgtaatctctctgcagctg

SEQ ID NO: 4077043 - DNA, 23 bp, Homo sapiens
gatgtaatctctctgcagctgcc

SEQ ID NO: 4077044 - DNA, 22 bp, Homo sapiens
gatgtacataactcctgtccct

SEQ ID NO: 4077045 - DNA, 19 bp, Homo sapiens
gatgtaccatgaaacaaag

SEQ ID NO: 4077046 - DNA, 15 bp, Homo sapiens
gatgtagttctgcca

SEQ ID NO: 4077047 - DNA, 18 bp, Homo sapiens
gatgtatgatctctctag

SEQ ID NO: 4077048 - DNA, 13 bp, Homo sapiens
gatgtcagcagac

SEQ ID NO: 4077049 - DNA, 21 bp, Homo sapiens
gatgtcagcagacacacatgg

SEQ ID NO: 4077050 - DNA, 22 bp, Homo sapiens
gatgtcagccgagccgggcctg

SEQ ID NO: 4077051 - DNA, 18 bp, Homo sapiens
gatgtcatgtctgcttgt

SEQ ID NO: 4077052 - DNA, 11 bp, Homo sapiens
gatgtcccagt

SEQ ID NO: 4077053 - DNA, 22 bp, Homo sapiens
gatgtccctgggccagggtctg

SEQ ID NO: 4077054 - DNA, 23 bp, Homo sapiens
gcacagggtctgctctttctctg

SEQ ID NO: 4077055 - DNA, 14 bp, Homo sapiens
gcacagtcaggttg

SEQ ID NO: 4077056 - DNA, 20 bp, Homo sapiens
gcacagtgcatctcagccca

SEQ ID NO: 4077057 - DNA, 21 bp, Homo sapiens
gcacagttgaagggaggggct

SEQ ID NO: 4077058 - DNA, 14 bp, Homo sapiens
gcacataaactttg

SEQ ID NO: 4077059 - DNA, 11 bp, Homo sapiens
gcacatacatt

SEQ ID NO: 4077060 - DNA, 21 bp, Homo sapiens
gcacatagctatcaagtgtgc

SEQ ID NO: 4077061 - DNA, 13 bp, Homo sapiens
gcacatgaaagtt

SEQ ID NO: 4077062 - DNA, 22 bp, Homo sapiens
gcacatgattgtataagcatgc

SEQ ID NO: 4077063 - DNA, 17 bp, Homo sapiens
gcacatgccacctggca

SEQ ID NO: 4077064 - DNA, 19 bp, Homo sapiens
gcacatgcctgtagtccca

SEQ ID NO: 4077065 - DNA, 20 bp, Homo sapiens
gcacatgttactgcttcatt

SEQ ID NO: 4077066 - DNA, 15 bp, Homo sapiens
gcaccaaccacagca

SEQ ID NO: 4077067 - DNA, 12 bp, Homo sapiens
gcaccaatgccc

SEQ ID NO: 4077068 - DNA, 20 bp, Homo sapiens
gcaccacggcgtttttttac

SEQ ID NO: 4077069 - DNA, 12 bp, Homo sapiens
gcaccagcatcc

SEQ ID NO: 4077070 - DNA, 11 bp, Homo sapiens
gcaccagccag

SEQ ID NO: 4077071 - DNA, 16 bp, Homo sapiens
gcaccagcttctccag

SEQ ID NO: 4077072 - DNA, 18 bp, Homo sapiens
gcaccagcttctccaggc

SEQ ID NO: 4077073 - DNA, 16 bp, Homo sapiens
gcacccaactactgag

SEQ ID NO: 4077074 - DNA, 14 bp, Homo sapiens
gcaccccagctacc

SEQ ID NO: 4077075 - DNA, 13 bp, Homo sapiens
gcacccccaccca

SEQ ID NO: 4077076 - DNA, 14 bp, Homo sapiens
gcacccccacccac

SEQ ID NO: 4077077 - DNA, 17 bp, Homo sapiens
gcacccccctgttctaa

SEQ ID NO: 4077078 - DNA, 19 bp, Homo sapiens
gcaccccctgctccaccag

SEQ ID NO: 4077079 - DNA, 23 bp, Homo sapiens
gcaccccctgctccaccagcagc

SEQ ID NO: 4077080 - DNA, 18 bp, Homo sapiens
gcacccctgggccagcgg

SEQ ID NO: 4077081 - DNA, 13 bp, Homo sapiens
gcaccccttctct

SEQ ID NO: 4077082 - DNA, 14 bp, Homo sapiens
gcacccggcctgga

SEQ ID NO: 4077083 - DNA, 20 bp, Homo sapiens
gcacccggcctggatgccag

SEQ ID NO: 4077084 - DNA, 13 bp, Homo sapiens
gcaccctcaggga

SEQ ID NO: 4077085 - DNA, 22 bp, Homo sapiens
gcaccctcagggagcctcccca

SEQ ID NO: 4077086 - DNA, 17 bp, Homo sapiens
gcaccctctcctggggg

SEQ ID NO: 4077087 - DNA, 18 bp, Homo sapiens
gcaccctctcctgggggt

SEQ ID NO: 4077088 - DNA, 21 bp, Homo sapiens
gcaccctgccccaccccacct

SEQ ID NO: 4077089 - DNA, 22 bp, Homo sapiens
gcaccctgccccaccccacctc

SEQ ID NO: 4077090 - DNA, 15 bp, Homo sapiens
gcaccctgcgcctcc

SEQ ID NO: 4077091 - DNA, 18 bp, Homo sapiens
gcaccctgcgcctccaga

SEQ ID NO: 4077092 - DNA, 14 bp, Homo sapiens
gcaccctggggcct

SEQ ID NO: 4077093 - DNA, 17 bp, Homo sapiens
gcaccctgtggccctgg

SEQ ID NO: 4077094 - DNA, 21 bp, Homo sapiens
gcaccggcctggctgcagctg

SEQ ID NO: 4077095 - DNA, 17 bp, Homo sapiens
gcaccgtcatggcttaa

SEQ ID NO: 4077096 - DNA, 19 bp, Homo sapiens
gcaccgtgtcaagctgctc

SEQ ID NO: 4077097 - DNA, 15 bp, Homo sapiens
gcaccgttctgtgca

SEQ ID NO: 4077098 - DNA, 15 bp, Homo sapiens
gcacctaccatcagg

SEQ ID NO: 4077099 - DNA, 17 bp, Homo sapiens
gcacctaccatcaggga

SEQ ID NO: 4077100 - DNA, 20 bp, Homo sapiens
gcacctaccatcagggacag

SEQ ID NO: 4077101 - DNA, 23 bp, Homo sapiens
gcacctaccatcagggacaggat

SEQ ID NO: 4077102 - DNA, 21 bp, Homo sapiens
gcacctcagaaagtcaccagg

SEQ ID NO: 4077103 - DNA, 15 bp, Homo sapiens
gcacctccaggcctg

SEQ ID NO: 4077104 - DNA, 20 bp, Homo sapiens
gcacctccaggcctgttgct

SEQ ID NO: 4077105 - DNA, 17 bp, Homo sapiens
gcacctccttgtcactt

SEQ ID NO: 4077106 - DNA, 18 bp, Homo sapiens
gcacctgattagttgaaa

SEQ ID NO: 4077107 - DNA, 11 bp, Homo sapiens
gcacctgcaca

SEQ ID NO: 4077108 - DNA, 12 bp, Homo sapiens
gcacctgcacac

SEQ ID NO: 4077109 - DNA, 13 bp, Homo sapiens
gcacctgcacact

SEQ ID NO: 4077110 - DNA, 15 bp, Homo sapiens
gcacctgcacactcc

SEQ ID NO: 4077111 - DNA, 17 bp, Homo sapiens
gcacctgtagtcccagc

SEQ ID NO: 4077112 - DNA, 18 bp, Homo sapiens
gcacctgtccccaccctc

SEQ ID NO: 4077113 - DNA, 16 bp, Homo sapiens
gcaccttcagggctga

SEQ ID NO: 4077114 - DNA, 10 bp, Homo sapiens
gcacgcacac

SEQ ID NO: 4077115 - DNA, 11 bp, Homo sapiens
gcacgcacaca

SEQ ID NO: 4077116 - DNA, 13 bp, Homo sapiens
gcacgcctgcccc

SEQ ID NO: 4077117 - DNA, 16 bp, Homo sapiens
gcacgcctgctggccg

SEQ ID NO: 4077118 - DNA, 12 bp, Homo sapiens
gcacggactctt

SEQ ID NO: 4077119 - DNA, 14 bp, Homo sapiens
gcacgggtccctgc

SEQ ID NO: 4077120 - DNA, 19 bp, Homo sapiens
gcacggtcacacggccacc

SEQ ID NO: 4077121 - DNA, 22 bp, Homo sapiens
gcacgtagctgaggccggatgc

SEQ ID NO: 4077122 - DNA, 13 bp, Homo sapiens
gcacgtctcagag

SEQ ID NO: 4077123 - DNA, 14 bp, Homo sapiens
gcacgtctcagaga

SEQ ID NO: 4077124 - DNA, 16 bp, Homo sapiens
gcacgtctcagagatt

SEQ ID NO: 4077125 - DNA, 16 bp, Homo sapiens
gcacgtggagagctgg

SEQ ID NO: 4077126 - DNA, 17 bp, Homo sapiens
gcacgtggcctcttgag

SEQ ID NO: 4077127 - DNA, 17 bp, Homo sapiens
gcacgttcataaccaac

SEQ ID NO: 4077128 - DNA, 15 bp, Homo sapiens
gcactaaagccagcc

SEQ ID NO: 4077129 - DNA, 19 bp, Homo sapiens
gcactaacgttgagcccct

SEQ ID NO: 4077130 - DNA, 19 bp, Homo sapiens
gcactaaggccgtgtctct

SEQ ID NO: 4077131 - DNA, 16 bp, Homo sapiens
gcactaccgattcttt

SEQ ID NO: 4077132 - DNA, 21 bp, Homo sapiens
gcactaggggatataggagag

SEQ ID NO: 4077133 - DNA, 15 bp, Homo sapiens
gcactataatgtaag

SEQ ID NO: 4077134 - DNA, 15 bp, Homo sapiens
gcactattgagtctt

SEQ ID NO: 4077135 - DNA, 19 bp, Homo sapiens
gcactcacccatgtgccaa

SEQ ID NO: 4077136 - DNA, 20 bp, Homo sapiens
gcactcacccatgtgccaag

SEQ ID NO: 4077137 - DNA, 17 bp, Homo sapiens
gcactcattttctataa

SEQ ID NO: 4077138 - DNA, 14 bp, Homo sapiens
gcactccagcctgg

SEQ ID NO: 4077139 - DNA, 16 bp, Homo sapiens
gcactccagcctgggc

SEQ ID NO: 4077140 - DNA, 17 bp, Homo sapiens
gcactccagcctgggca

SEQ ID NO: 4077141 - DNA, 16 bp, Homo sapiens
gcactccatgagcacc

SEQ ID NO: 4077142 - DNA, 17 bp, Homo sapiens
gcactctaaactgcaaa

SEQ ID NO: 4077143 - DNA, 23 bp, Homo sapiens
gcactctaaactgcaaacagaaa

SEQ ID NO: 4077144 - DNA, 22 bp, Homo sapiens
gcactctctaaatcttccttgt

SEQ ID NO: 4077145 - DNA, 20 bp, Homo sapiens
gcactgaataaagcacgtgc

SEQ ID NO: 4077146 - DNA, 13 bp, Homo sapiens
gcactgagagggc

SEQ ID NO: 4077147 - DNA, 15 bp, Homo sapiens
gcactgagagggcaa

SEQ ID NO: 4077148 - DNA, 19 bp, Homo sapiens
gcactgagctcacatggga

SEQ ID NO: 4077149 - DNA, 23 bp, Homo sapiens
gcactgagctcacatgggactgg

SEQ ID NO: 4077150 - DNA, 11 bp, Homo sapiens
gcactgagggc

SEQ ID NO: 4077151 - DNA, 16 bp, Homo sapiens
gcactgagggccacac

SEQ ID NO: 4077152 - DNA, 22 bp, Homo sapiens
gcactgatatatttaaaaacaa

SEQ ID NO: 4077153 - DNA, 21 bp, Homo sapiens
gcactgcccatggacaggctg

SEQ ID NO: 4077154 - DNA, 22 bp, Homo sapiens
gcactgccctgttcatgtgcct

SEQ ID NO: 4077155 - DNA, 18 bp, Homo sapiens
gcactgccttctcctctc

SEQ ID NO: 4077156 - DNA, 23 bp, Homo sapiens
gcactgccttctcctctctgggc

SEQ ID NO: 4077157 - DNA, 23 bp, Homo sapiens
gcaggaggattgcttgagcccag

SEQ ID NO: 4077158 - DNA, 21 bp, Homo sapiens
gcaggaggccaaactgtccct

SEQ ID NO: 4077159 - DNA, 16 bp, Homo sapiens
gcaggaggccaataaa

SEQ ID NO: 4077160 - DNA, 22 bp, Homo sapiens
gcaggagggccctacctgattg

SEQ ID NO: 4077161 - DNA, 17 bp, Homo sapiens
gcaggagtctctgccac

SEQ ID NO: 4077162 - DNA, 20 bp, Homo sapiens
gcaggagtctctgccaccca

SEQ ID NO: 4077163 - DNA, 21 bp, Homo sapiens
gcaggagtctctgccacccac

SEQ ID NO: 4077164 - DNA, 22 bp, Homo sapiens
gcaggagtctctgccacccact

SEQ ID NO: 4077165 - DNA, 18 bp, Homo sapiens
gcaggagtggtgcagaca

SEQ ID NO: 4077166 - DNA, 15 bp, Homo sapiens
gcaggagtgtcctgc

SEQ ID NO: 4077167 - DNA, 14 bp, Homo sapiens
gcaggatggccttt

SEQ ID NO: 4077168 - DNA, 18 bp, Homo sapiens
gcaggattcagccggagg

SEQ ID NO: 4077169 - DNA, 18 bp, Homo sapiens
gcaggcaaaaaagggaca

SEQ ID NO: 4077170 - DNA, 18 bp, Homo sapiens
gcaggcacacagcagccc

SEQ ID NO: 4077171 - DNA, 19 bp, Homo sapiens
gcaggcacacagcagcccc

SEQ ID NO: 4077172 - DNA, 16 bp, Homo sapiens
gcaggcaccgccacgt

SEQ ID NO: 4077173 - DNA, 13 bp, Homo sapiens
gcaggcagcgcca

SEQ ID NO: 4077174 - DNA, 11 bp, Homo sapiens
gcaggcagggg

SEQ ID NO: 4077175 - DNA, 14 bp, Homo sapiens
gcaggcggtcccca

SEQ ID NO: 4077176 - DNA, 14 bp, Homo sapiens
gcaggctcactgcc

SEQ ID NO: 4077177 - DNA, 18 bp, Homo sapiens
gcaggctcactgccaggc

SEQ ID NO: 4077178 - DNA, 17 bp, Homo sapiens
gcaggctgagccactct

SEQ ID NO: 4077179 - DNA, 20 bp, Homo sapiens
gcaggctgagtccagagctt

SEQ ID NO: 4077180 - DNA, 11 bp, Homo sapiens
gcaggctgggc

SEQ ID NO: 4077181 - DNA, 12 bp, Homo sapiens
gcaggctgggcc

SEQ ID NO: 4077182 - DNA, 13 bp, Homo sapiens
gcaggctgggcca

SEQ ID NO: 4077183 - DNA, 14 bp, Homo sapiens
gcaggctgggccat

SEQ ID NO: 4077184 - DNA, 19 bp, Homo sapiens
gcagggagcggccggccag

SEQ ID NO: 4077185 - DNA, 15 bp, Homo sapiens
gcagggcatctcctg

SEQ ID NO: 4077186 - DNA, 19 bp, Homo sapiens
gcagggcatctcctgtgca

SEQ ID NO: 4077187 - DNA, 18 bp, Homo sapiens
gcagggcgggcagagggc

SEQ ID NO: 4077188 - DNA, 21 bp, Homo sapiens
gcagggctggccccagggcac

SEQ ID NO: 4077189 - DNA, 16 bp, Homo sapiens
gcagggctggtttgtt

SEQ ID NO: 4077190 - DNA, 15 bp, Homo sapiens
gcagggctgtgcttg

SEQ ID NO: 4077191 - DNA, 22 bp, Homo sapiens
gcagggggccccgccagggctg

SEQ ID NO: 4077192 - DNA, 23 bp, Homo sapiens
gcaggggtaggggtagggagcct

SEQ ID NO: 4077193 - DNA, 20 bp, Homo sapiens
gcaggggtgacggccctcat

SEQ ID NO: 4077194 - DNA, 17 bp, Homo sapiens
gcaggggtgggggtgga

SEQ ID NO: 4077195 - DNA, 23 bp, Homo sapiens
gcaggggtgggggtggaggcttc

SEQ ID NO: 4077196 - DNA, 21 bp, Homo sapiens
gcagggtcctcttctgggcct

SEQ ID NO: 4077197 - DNA, 21 bp, Homo sapiens
gcagggtctgtttggactgca

SEQ ID NO: 4077198 - DNA, 22 bp, Homo sapiens
gcagggtgcagtatcatgccct

SEQ ID NO: 4077199 - DNA, 15 bp, Homo sapiens
gcaggtcctgcccat

SEQ ID NO: 4077200 - DNA, 16 bp, Homo sapiens
gcaggtcctgcccatg

SEQ ID NO: 4077201 - DNA, 22 bp, Homo sapiens
gcaggtgccagggcccacccca

SEQ ID NO: 4077202 - DNA, 17 bp, Homo sapiens
gcaggtgctggtcccgg

SEQ ID NO: 4077203 - DNA, 13 bp, Homo sapiens
gcaggtggatcta

SEQ ID NO: 4077204 - DNA, 14 bp, Homo sapiens
gcaggtgggtgctg

SEQ ID NO: 4077205 - DNA, 19 bp, Homo sapiens
gcaggtgggtgctgccctg

SEQ ID NO: 4077206 - DNA, 15 bp, Homo sapiens
gcaggtgtttggcac

SEQ ID NO: 4077207 - DNA, 18 bp, Homo sapiens
gcaggttcccaagctcag

SEQ ID NO: 4077208 - DNA, 23 bp, Homo sapiens
gcaggttggatgggagtgggcac

SEQ ID NO: 4077209 - DNA, 18 bp, Homo sapiens
gcagtagatgtgcttctg

SEQ ID NO: 4077210 - DNA, 15 bp, Homo sapiens
gcagtcctttgtaaa

SEQ ID NO: 4077211 - DNA, 16 bp, Homo sapiens
gcagtcgcctgcctgc

SEQ ID NO: 4077212 - DNA, 19 bp, Homo sapiens
gcagtcgtggctttggcag

SEQ ID NO: 4077213 - DNA, 18 bp, Homo sapiens
gcagtcttatgcttccag

SEQ ID NO: 4077214 - DNA, 19 bp, Homo sapiens
gcagtcttatgcttccaga

SEQ ID NO: 4077215 - DNA, 14 bp, Homo sapiens
gcagtcttgctctg

SEQ ID NO: 4077216 - DNA, 14 bp, Homo sapiens
gcagtgaattgtga

SEQ ID NO: 4077217 - DNA, 15 bp, Homo sapiens
gcagtgactttgtat

SEQ ID NO: 4077218 - DNA, 20 bp, Homo sapiens
gcagtgagaaaaagctcctg

SEQ ID NO: 4077219 - DNA, 22 bp, Homo sapiens
gcagtgagaaaaagctcctgtc

SEQ ID NO: 4077220 - DNA, 16 bp, Homo sapiens
gcagtgatatggcaga

SEQ ID NO: 4077221 - DNA, 19 bp, Homo sapiens
gcagtgatatggcagaaga

SEQ ID NO: 4077222 - DNA, 21 bp, Homo sapiens
gcagtgatatggcagaagaca

SEQ ID NO: 4077223 - DNA, 19 bp, Homo sapiens
gcagtgatctcagggcaga

SEQ ID NO: 4077224 - DNA, 21 bp, Homo sapiens
gcagtgatggttgccaggacg

SEQ ID NO: 4077225 - DNA, 13 bp, Homo sapiens
gcagtgccccagg

SEQ ID NO: 4077226 - DNA, 15 bp, Homo sapiens
gcagtgccttccata

SEQ ID NO: 4077227 - DNA, 16 bp, Homo sapiens
gcagtgctgggaccag

SEQ ID NO: 4077228 - DNA, 19 bp, Homo sapiens
gcagtgctgggaccagagc

SEQ ID NO: 4077229 - DNA, 23 bp, Homo sapiens
gcagtgctgggaccagagccaga

SEQ ID NO: 4077230 - DNA, 14 bp, Homo sapiens
gcagtggagaggga

SEQ ID NO: 4077231 - DNA, 15 bp, Homo sapiens
gcagtggagagggac

SEQ ID NO: 4077232 - DNA, 18 bp, Homo sapiens
gcagtgtagcccacactt

SEQ ID NO: 4077233 - DNA, 18 bp, Homo sapiens
gcagtgtcatcagaagat

SEQ ID NO: 4077234 - DNA, 15 bp, Homo sapiens
gcagtgtcttccata

SEQ ID NO: 4077235 - DNA, 12 bp, Homo sapiens
gcagtgtggaga

SEQ ID NO: 4077236 - DNA, 23 bp, Homo sapiens
gcagtgtggagaccctgccacag

SEQ ID NO: 4077237 - DNA, 20 bp, Homo sapiens
gcagtgttccccatctgggt

SEQ ID NO: 4077238 - DNA, 21 bp, Homo sapiens
gcagtgttccccatctgggtc

SEQ ID NO: 4077239 - DNA, 18 bp, Homo sapiens
gcagtgttctcacagtgt

SEQ ID NO: 4077240 - DNA, 19 bp, Homo sapiens
gcagtgttctcacagtgtg

SEQ ID NO: 4077241 - DNA, 17 bp, Homo sapiens
gcagtgttttggttcag

SEQ ID NO: 4077242 - DNA, 21 bp, Homo sapiens
gcagttcccctggagcccctt

SEQ ID NO: 4077243 - DNA, 14 bp, Homo sapiens
gcagttgcccagcc

SEQ ID NO: 4077244 - DNA, 14 bp, Homo sapiens
gcagttggccagag

SEQ ID NO: 4077245 - DNA, 22 bp, Homo sapiens
gcagttggccagagagcctggt

SEQ ID NO: 4077246 - DNA, 15 bp, Homo sapiens
gcagtttaacaaaat

SEQ ID NO: 4077247 - DNA, 14 bp, Homo sapiens
gcagtttcctggaa

SEQ ID NO: 4077248 - DNA, 22 bp, Homo sapiens
gcagtttgccacccctgtccag

SEQ ID NO: 4077249 - DNA, 17 bp, Homo sapiens
gcagttttcaagtcaaa

SEQ ID NO: 4077250 - DNA, 21 bp, Homo sapiens
gcataaaagggtcaaacctgt

SEQ ID NO: 4077251 - DNA, 18 bp, Homo sapiens
gcataaataaaactgaat

SEQ ID NO: 4077252 - DNA, 16 bp, Homo sapiens
gcatacaacagagggg

SEQ ID NO: 4077253 - DNA, 22 bp, Homo sapiens
gcataggcctgctttgtctcct

SEQ ID NO: 4077254 - DNA, 19 bp, Homo sapiens
gcataggtaagctgtgcct

SEQ ID NO: 4077255 - DNA, 17 bp, Homo sapiens
gcatataggtgatgttt

SEQ ID NO: 4077256 - DNA, 19 bp, Homo sapiens
gcatataggtgatgtttgc

SEQ ID NO: 4077257 - DNA, 20 bp, Homo sapiens
gcatatgttgaatacttttt

SEQ ID NO: 4077258 - DNA, 21 bp, Homo sapiens
gcatatgttgaatacttttta

SEQ ID NO: 4077259 - DNA, 13 bp, Homo sapiens
gccaatctggccc

SEQ ID NO: 4077260 - DNA, 15 bp, Homo sapiens
gccaatctggccctt

SEQ ID NO: 4077261 - DNA, 12 bp, Homo sapiens
gccaatgaggtc

SEQ ID NO: 4077262 - DNA, 15 bp, Homo sapiens
gccaatgatgtgacc

SEQ ID NO: 4077263 - DNA, 16 bp, Homo sapiens
gccaatggagactgtc

SEQ ID NO: 4077264 - DNA, 21 bp, Homo sapiens
gccaatggagactgtctcaag

SEQ ID NO: 4077265 - DNA, 15 bp, Homo sapiens
gccacaaaaacaggt

SEQ ID NO: 4077266 - DNA, 21 bp, Homo sapiens
gccacaaccctgttttatact

SEQ ID NO: 4077267 - DNA, 20 bp, Homo sapiens
gccacaactcctacatgatg

SEQ ID NO: 4077268 - DNA, 14 bp, Homo sapiens
gccacaaggacttc

SEQ ID NO: 4077269 - DNA, 18 bp, Homo sapiens
gccacaaggacttcctgt

SEQ ID NO: 4077270 - DNA, 14 bp, Homo sapiens
gccacaaggctggc

SEQ ID NO: 4077271 - DNA, 12 bp, Homo sapiens
gccacacccagg

SEQ ID NO: 4077272 - DNA, 23 bp, Homo sapiens
gccacacccaggggaaggccctg

SEQ ID NO: 4077273 - DNA, 16 bp, Homo sapiens
gccacaccctcccccg

SEQ ID NO: 4077274 - DNA, 22 bp, Homo sapiens
gccacaccctcccccgccactc

SEQ ID NO: 4077275 - DNA, 19 bp, Homo sapiens
gccacacgcactggtgcca

SEQ ID NO: 4077276 - DNA, 20 bp, Homo sapiens
gccacacttcaggctcttct

SEQ ID NO: 4077277 - DNA, 20 bp, Homo sapiens
gccacagaccacctgcttct

SEQ ID NO: 4077278 - DNA, 15 bp, Homo sapiens
gccacagcctcccca

SEQ ID NO: 4077279 - DNA, 18 bp, Homo sapiens
gccacagcctccccaccc

SEQ ID NO: 4077280 - DNA, 18 bp, Homo sapiens
gccacagcttttgcaact

SEQ ID NO: 4077281 - DNA, 15 bp, Homo sapiens
gccacaggaaggagg

SEQ ID NO: 4077282 - DNA, 15 bp, Homo sapiens
gccacatacaggtgc

SEQ ID NO: 4077283 - DNA, 16 bp, Homo sapiens
gccacatccccaagcc

SEQ ID NO: 4077284 - DNA, 21 bp, Homo sapiens
gccacatggagccccctctgc

SEQ ID NO: 4077285 - DNA, 12 bp, Homo sapiens
gccacatttaat

SEQ ID NO: 4077286 - DNA, 18 bp, Homo sapiens
gccacatttctgatcaga

SEQ ID NO: 4077287 - DNA, 21 bp, Homo sapiens
gccacatttctgatcagaggt

SEQ ID NO: 4077288 - DNA, 22 bp, Homo sapiens
gccacatttctgatcagaggtg

SEQ ID NO: 4077289 - DNA, 14 bp, Homo sapiens
gccacatttggaat

SEQ ID NO: 4077290 - DNA, 12 bp, Homo sapiens
gccaccacctct

SEQ ID NO: 4077291 - DNA, 14 bp, Homo sapiens
gccaccacctctgt

SEQ ID NO: 4077292 - DNA, 21 bp, Homo sapiens
gccaccagatgtgacagtgtt

SEQ ID NO: 4077293 - DNA, 14 bp, Homo sapiens
gccaccagccatcc

SEQ ID NO: 4077294 - DNA, 13 bp, Homo sapiens
gccaccagccccc

SEQ ID NO: 4077295 - DNA, 14 bp, Homo sapiens
gccaccatccctga

SEQ ID NO: 4077296 - DNA, 14 bp, Homo sapiens
gccaccatcctgct

SEQ ID NO: 4077297 - DNA, 18 bp, Homo sapiens
gccaccatggccagccaa

SEQ ID NO: 4077298 - DNA, 21 bp, Homo sapiens
gccacccgttctgctggcctg

SEQ ID NO: 4077299 - DNA, 22 bp, Homo sapiens
gccacccgttctgctggcctgg

SEQ ID NO: 4077300 - DNA, 21 bp, Homo sapiens
gccaccctcacacacacagct

SEQ ID NO: 4077301 - DNA, 12 bp, Homo sapiens
gccaccctgtgc

SEQ ID NO: 4077302 - DNA, 13 bp, Homo sapiens
gccaccctgtgca

SEQ ID NO: 4077303 - DNA, 15 bp, Homo sapiens
gccaccgctgccagc

SEQ ID NO: 4077304 - DNA, 16 bp, Homo sapiens
gccaccgctgccagca

SEQ ID NO: 4077305 - DNA, 13 bp, Homo sapiens
gccaccgtgcctg

SEQ ID NO: 4077306 - DNA, 15 bp, Homo sapiens
gccaccgtgcctggc

SEQ ID NO: 4077307 - DNA, 18 bp, Homo sapiens
gccaccgtgcctggccag

SEQ ID NO: 4077308 - DNA, 17 bp, Homo sapiens
gccaccgtgcctggcta

SEQ ID NO: 4077309 - DNA, 20 bp, Homo sapiens
gccacctatctcgtgggaga

SEQ ID NO: 4077310 - DNA, 14 bp, Homo sapiens
gccacctcagggca

SEQ ID NO: 4077311 - DNA, 15 bp, Homo sapiens
gccacctctccctca

SEQ ID NO: 4077312 - DNA, 16 bp, Homo sapiens
gccacctctgtcattt

SEQ ID NO: 4077313 - DNA, 21 bp, Homo sapiens
gccacgattggagaatacttt

SEQ ID NO: 4077314 - DNA, 14 bp, Homo sapiens
gccacgcactgggc

SEQ ID NO: 4077315 - DNA, 16 bp, Homo sapiens
gccacgcactgggcca

SEQ ID NO: 4077316 - DNA, 17 bp, Homo sapiens
gccacgcactgggccac

SEQ ID NO: 4077317 - DNA, 22 bp, Homo sapiens
gccacgcactgggccacggagg

SEQ ID NO: 4077318 - DNA, 17 bp, Homo sapiens
gccacgccccagcccga

SEQ ID NO: 4077319 - DNA, 13 bp, Homo sapiens
gccacgctccagc

SEQ ID NO: 4077320 - DNA, 21 bp, Homo sapiens
gccacgctgtcctctcgagcc

SEQ ID NO: 4077321 - DNA, 19 bp, Homo sapiens
gccacggctgagccttcag

SEQ ID NO: 4077322 - DNA, 21 bp, Homo sapiens
gccacgtgggcaaacaggcag

SEQ ID NO: 4077323 - DNA, 15 bp, Homo sapiens
gccacgttccacagt

SEQ ID NO: 4077324 - DNA, 15 bp, Homo sapiens
gccactaaagcttca

SEQ ID NO: 4077325 - DNA, 23 bp, Homo sapiens
gccactaattttagtattcattc

SEQ ID NO: 4077326 - DNA, 15 bp, Homo sapiens
gccactcagcttcct

SEQ ID NO: 4077327 - DNA, 18 bp, Homo sapiens
gccactccagacccctgg

SEQ ID NO: 4077328 - DNA, 21 bp, Homo sapiens
gccactccagacccctggctt

SEQ ID NO: 4077329 - DNA, 12 bp, Homo sapiens
gccactcctccc

SEQ ID NO: 4077330 - DNA, 23 bp, Homo sapiens
gccactcgggaggctgagacagg

SEQ ID NO: 4077331 - DNA, 19 bp, Homo sapiens
gccactctcttccctttcc

SEQ ID NO: 4077332 - DNA, 16 bp, Homo sapiens
gccactgcccgagctg

SEQ ID NO: 4077333 - DNA, 17 bp, Homo sapiens
gccactgcccgagctgg

SEQ ID NO: 4077334 - DNA, 15 bp, Homo sapiens
gccactgcctgcacc

SEQ ID NO: 4077335 - DNA, 15 bp, Homo sapiens
gccactggaaggaac

SEQ ID NO: 4077336 - DNA, 16 bp, Homo sapiens
gccactggaaggaaca

SEQ ID NO: 4077337 - DNA, 13 bp, Homo sapiens
gccacttctcccc

SEQ ID NO: 4077338 - DNA, 18 bp, Homo sapiens
gccagacatgccacaagg

SEQ ID NO: 4077339 - DNA, 22 bp, Homo sapiens
gccagacctagcaggctgttcc

SEQ ID NO: 4077340 - DNA, 19 bp, Homo sapiens
gccagacgctgccgctgcc

SEQ ID NO: 4077341 - DNA, 21 bp, Homo sapiens
gccagagagcctggtgctgct

SEQ ID NO: 4077342 - DNA, 16 bp, Homo sapiens
gccagagatccaaaag

SEQ ID NO: 4077343 - DNA, 23 bp, Homo sapiens
gccagagatccaaaagaagcccc

SEQ ID NO: 4077344 - DNA, 15 bp, Homo sapiens
gccagagctgggagg

SEQ ID NO: 4077345 - DNA, 13 bp, Homo sapiens
gccagaggagggc

SEQ ID NO: 4077346 - DNA, 22 bp, Homo sapiens
gccagaggagggcagagggaga

SEQ ID NO: 4077347 - DNA, 16 bp, Homo sapiens
gccagaggctgggagt

SEQ ID NO: 4077348 - DNA, 15 bp, Homo sapiens
gccagagggcttgtg

SEQ ID NO: 4077349 - DNA, 16 bp, Homo sapiens
gccagaggtgcttcac

SEQ ID NO: 4077350 - DNA, 19 bp, Homo sapiens
gccagaggtgcttcaccct

SEQ ID NO: 4077351 - DNA, 18 bp, Homo sapiens
gccagagtggcctggcca

SEQ ID NO: 4077352 - DNA, 19 bp, Homo sapiens
gccagagtggcctggccag

SEQ ID NO: 4077353 - DNA, 15 bp, Homo sapiens
gccagatcctcttgg

SEQ ID NO: 4077354 - DNA, 14 bp, Homo sapiens
gccagatcttaggt

SEQ ID NO: 4077355 - DNA, 20 bp, Homo sapiens
gccagatgcaggacaggagg

SEQ ID NO: 4077356 - DNA, 15 bp, Homo sapiens
gccagattctgcctc

SEQ ID NO: 4077357 - DNA, 18 bp, Homo sapiens
gccagattctgcctctct

SEQ ID NO: 4077358 - DNA, 13 bp, Homo sapiens
gccagcaacgctt

SEQ ID NO: 4077359 - DNA, 14 bp, Homo sapiens
gccagcaacgcttg

SEQ ID NO: 4077360 - DNA, 15 bp, Homo sapiens
gccagcaaggcaggt

SEQ ID NO: 4077361 - DNA, 16 bp, Homo sapiens
gccagcaaggcaggtt

SEQ ID NO: 4077362 - DNA, 18 bp, Homo sapiens
gccccggtggctgggcag

SEQ ID NO: 4077363 - DNA, 17 bp, Homo sapiens
gccccgtctgcccacca

SEQ ID NO: 4077364 - DNA, 22 bp, Homo sapiens
gccccgtctgcccaccattccc

SEQ ID NO: 4077365 - DNA, 17 bp, Homo sapiens
gcccctaatctctgtag

SEQ ID NO: 4077366 - DNA, 15 bp, Homo sapiens
gcccctactgctgtg

SEQ ID NO: 4077367 - DNA, 19 bp, Homo sapiens
gcccctatagcactgagct

SEQ ID NO: 4077368 - DNA, 19 bp, Homo sapiens
gcccctcaacagccaagtg

SEQ ID NO: 4077369 - DNA, 20 bp, Homo sapiens
gcccctcaccttgggctggg

SEQ ID NO: 4077370 - DNA, 22 bp, Homo sapiens
gcccctcagagccctgccctgc

SEQ ID NO: 4077371 - DNA, 17 bp, Homo sapiens
gcccctccaaacctcca

SEQ ID NO: 4077372 - DNA, 20 bp, Homo sapiens
gcccctccaaacctccagcc

SEQ ID NO: 4077373 - DNA, 15 bp, Homo sapiens
gcccctccacgcctc

SEQ ID NO: 4077374 - DNA, 20 bp, Homo sapiens
gcccctccacgcctcctggc

SEQ ID NO: 4077375 - DNA, 23 bp, Homo sapiens
gcccctccacgcctcctggccag

SEQ ID NO: 4077376 - DNA, 20 bp, Homo sapiens
gcccctcctagacccaggtg

SEQ ID NO: 4077377 - DNA, 21 bp, Homo sapiens
gcccctcctccagcccctgtc

SEQ ID NO: 4077378 - DNA, 22 bp, Homo sapiens
gcccctcttattcctctaggca

SEQ ID NO: 4077379 - DNA, 23 bp, Homo sapiens
gcccctcttattcctctaggcaa

SEQ ID NO: 4077380 - DNA, 14 bp, Homo sapiens
gcccctcttcccca

SEQ ID NO: 4077381 - DNA, 14 bp, Homo sapiens
gcccctgcagttgg

SEQ ID NO: 4077382 - DNA, 23 bp, Homo sapiens
gcccctgcatccccttggctgtg

SEQ ID NO: 4077383 - DNA, 21 bp, Homo sapiens
gcccctgcgtgggggccagtc

SEQ ID NO: 4077384 - DNA, 13 bp, Homo sapiens
gcccctgctgtct

SEQ ID NO: 4077385 - DNA, 14 bp, Homo sapiens
gcccctggagccag

SEQ ID NO: 4077386 - DNA, 14 bp, Homo sapiens
gcccctggccccag

SEQ ID NO: 4077387 - DNA, 14 bp, Homo sapiens
gcccctggctggga

SEQ ID NO: 4077388 - DNA, 16 bp, Homo sapiens
gcccctggctttgcct

SEQ ID NO: 4077389 - DNA, 19 bp, Homo sapiens
gcccctggctttgcctctt

SEQ ID NO: 4077390 - DNA, 20 bp, Homo sapiens
gcccctgggatgggaccagg

SEQ ID NO: 4077391 - DNA, 20 bp, Homo sapiens
gcccctgggcttggcctgct

SEQ ID NO: 4077392 - DNA, 22 bp, Homo sapiens
gcccctgggcttggcctgctgt

SEQ ID NO: 4077393 - DNA, 16 bp, Homo sapiens
gcccctggggcccagc

SEQ ID NO: 4077394 - DNA, 13 bp, Homo sapiens
aaaactatacaac

SEQ ID NO: 4077395 - DNA, 17 bp, Homo sapiens
aaaactatggttcccaa

SEQ ID NO: 4077396 - DNA, 13 bp, Homo sapiens
aaaactgaatctc

SEQ ID NO: 4077397 - DNA, 17 bp, Homo sapiens
aaaactggaataagaag

SEQ ID NO: 4077398 - DNA, 21 bp, Homo sapiens
aaaactggaataagaagcaaa

SEQ ID NO: 4077399 - DNA, 16 bp, Homo sapiens
aaaactgttacctaaa

SEQ ID NO: 4077400 - DNA, 13 bp, Homo sapiens
aaaacttcagaag

SEQ ID NO: 4077401 - DNA, 18 bp, Homo sapiens
aaaacttcattctcgtga

SEQ ID NO: 4077402 - DNA, 18 bp, Homo sapiens
aaaacttgacatgtagct

SEQ ID NO: 4077403 - DNA, 15 bp, Homo sapiens
aaaacttggcacttt

SEQ ID NO: 4077404 - DNA, 11 bp, Homo sapiens
aaaagaaaaaa

SEQ ID NO: 4077405 - DNA, 11 bp, Homo sapiens
aaaagaaaaac

SEQ ID NO: 4077406 - DNA, 15 bp, Homo sapiens
aaaagaaaatttttg

SEQ ID NO: 4077407 - DNA, 15 bp, Homo sapiens
aaaagaagttacttt

SEQ ID NO: 4077408 - DNA, 16 bp, Homo sapiens
aaaagaagttactttg

SEQ ID NO: 4077409 - DNA, 23 bp, Homo sapiens
aaaagaatgacgtttacatataa

SEQ ID NO: 4077410 - DNA, 15 bp, Homo sapiens
aaaagacgatgttta

SEQ ID NO: 4077411 - DNA, 20 bp, Homo sapiens
aaaagacgatgtttatgttc

SEQ ID NO: 4077412 - DNA, 14 bp, Homo sapiens
aaaagagaattaga

SEQ ID NO: 4077413 - DNA, 23 bp, Homo sapiens
aaaagagaattagattatattgg

SEQ ID NO: 4077414 - DNA, 15 bp, Homo sapiens
aaaagagataataag

SEQ ID NO: 4077415 - DNA, 21 bp, Homo sapiens
aaaagagatattttaaaatga

SEQ ID NO: 4077416 - DNA, 15 bp, Homo sapiens
aaaagaggagcactt

SEQ ID NO: 4077417 - DNA, 13 bp, Homo sapiens
aaaagattaatgt

SEQ ID NO: 4077418 - DNA, 16 bp, Homo sapiens
aaaagattggagctga

SEQ ID NO: 4077419 - DNA, 13 bp, Homo sapiens
aaaagatttaagc

SEQ ID NO: 4077420 - DNA, 15 bp, Homo sapiens
aaaagattttattta

SEQ ID NO: 4077421 - DNA, 16 bp, Homo sapiens
aaaagcaaaaagcaag

SEQ ID NO: 4077422 - DNA, 13 bp, Homo sapiens
aaaagcaaatcta

SEQ ID NO: 4077423 - DNA, 19 bp, Homo sapiens
aaaagcacatacattaaaa

SEQ ID NO: 4077424 - DNA, 20 bp, Homo sapiens
aaaagcacatacattaaaac

SEQ ID NO: 4077425 - DNA, 13 bp, Homo sapiens
aaaagccttgtgt

SEQ ID NO: 4077426 - DNA, 20 bp, Homo sapiens
aaaagctattagccaggatc

SEQ ID NO: 4077427 - DNA, 12 bp, Homo sapiens
aaaagctcctgt

SEQ ID NO: 4077428 - DNA, 23 bp, Homo sapiens
aaaagctctgttccatgcaactg

SEQ ID NO: 4077429 - DNA, 23 bp, Homo sapiens
aaaagctgatcataagtgaattt

SEQ ID NO: 4077430 - DNA, 14 bp, Homo sapiens
aaaagcttcaaatt

SEQ ID NO: 4077431 - DNA, 15 bp, Homo sapiens
aaaagcttcttaatt

SEQ ID NO: 4077432 - DNA, 16 bp, Homo sapiens
aaaagcttcttaatta

SEQ ID NO: 4077433 - DNA, 10 bp, Homo sapiens
aaaaggaaaa

SEQ ID NO: 4077434 - DNA, 13 bp, Homo sapiens
aaaaggaaagtca

SEQ ID NO: 4077435 - DNA, 13 bp, Homo sapiens
aaaaggaagacta

SEQ ID NO: 4077436 - DNA, 17 bp, Homo sapiens
aaaaggacatcagcaaa

SEQ ID NO: 4077437 - DNA, 19 bp, Homo sapiens
aaaaggacatcagcaaaca

SEQ ID NO: 4077438 - DNA, 21 bp, Homo sapiens
aaaaggcctcttgtaaagact

SEQ ID NO: 4077439 - DNA, 12 bp, Homo sapiens
aaaagggaagta

SEQ ID NO: 4077440 - DNA, 16 bp, Homo sapiens
aaaagggagaaaaaga

SEQ ID NO: 4077441 - DNA, 17 bp, Homo sapiens
aaaagggtcaaacctgt

SEQ ID NO: 4077442 - DNA, 19 bp, Homo sapiens
aaaaggtatgcaatcaaat

SEQ ID NO: 4077443 - DNA, 17 bp, Homo sapiens
aaaaggttaataaagta

SEQ ID NO: 4077444 - DNA, 19 bp, Homo sapiens
aaaaggttcactaaagcag

SEQ ID NO: 4077445 - DNA, 12 bp, Homo sapiens
aaaagtaaatgg

SEQ ID NO: 4077446 - DNA, 18 bp, Homo sapiens
aaaagtatcactctaaaa

SEQ ID NO: 4077447 - DNA, 15 bp, Homo sapiens
aaaagtattttgaag

SEQ ID NO: 4077448 - DNA, 19 bp, Homo sapiens
aaaagtattttgaagttta

SEQ ID NO: 4077449 - DNA, 16 bp, Homo sapiens
aaaagtcaacaaactg

SEQ ID NO: 4077450 - DNA, 13 bp, Homo sapiens
aaaagtccctccc

SEQ ID NO: 4077451 - DNA, 16 bp, Homo sapiens
aaaagtccctccctgc

SEQ ID NO: 4077452 - DNA, 21 bp, Homo sapiens
aaaagtccctccctgcctgag

SEQ ID NO: 4077453 - DNA, 19 bp, Homo sapiens
aaaagtctatttttttaac

SEQ ID NO: 4077454 - DNA, 14 bp, Homo sapiens
aaaagtctgtcttt

SEQ ID NO: 4077455 - DNA, 18 bp, Homo sapiens
aaaagtctgtctttcctg

SEQ ID NO: 4077456 - DNA, 17 bp, Homo sapiens
aaaagtgaatgaaagat

SEQ ID NO: 4077457 - DNA, 13 bp, Homo sapiens
aaaagtgacacag

SEQ ID NO: 4077458 - DNA, 17 bp, Homo sapiens
aaaagtgactctcagcg

SEQ ID NO: 4077459 - DNA, 16 bp, Homo sapiens
aaaagtgctccccaaa

SEQ ID NO: 4077460 - DNA, 17 bp, Homo sapiens
aaaagtgggcttgattc

SEQ ID NO: 4077461 - DNA, 13 bp, Homo sapiens
aaaagtgtccttc

SEQ ID NO: 4077462 - DNA, 22 bp, Homo sapiens
aaaagttttttttttgtttgtt

SEQ ID NO: 4077463 - DNA, 13 bp, Homo sapiens
aaaataaaactaa

SEQ ID NO: 4077464 - DNA, 17 bp, Homo sapiens
aaaataaataattttaa

SEQ ID NO: 4077465 - DNA, 12 bp, Homo sapiens
aaaataaattat

SEQ ID NO: 4077466 - DNA, 14 bp, Homo sapiens
aaaataacacacat

SEQ ID NO: 4077467 - DNA, 19 bp, Homo sapiens
aaaataagcaggtggatct

SEQ ID NO: 4077468 - DNA, 16 bp, Homo sapiens
aaaataatcaagattt

SEQ ID NO: 4077469 - DNA, 14 bp, Homo sapiens
aaaataatgctgca

SEQ ID NO: 4077470 - DNA, 17 bp, Homo sapiens
aaaataattagttaggc

SEQ ID NO: 4077471 - DNA, 13 bp, Homo sapiens
aaaataattctaa

SEQ ID NO: 4077472 - DNA, 14 bp, Homo sapiens
aaaataattctaaa

SEQ ID NO: 4077473 - DNA, 17 bp, Homo sapiens
aaaataatttctctaca

SEQ ID NO: 4077474 - DNA, 15 bp, Homo sapiens
aaaatacaataaact

SEQ ID NO: 4077475 - DNA, 19 bp, Homo sapiens
aaaatacaatcctgtttat

SEQ ID NO: 4077476 - DNA, 12 bp, Homo sapiens
aaaatacattta

SEQ ID NO: 4077477 - DNA, 21 bp, Homo sapiens
aaaatagaatgtggccactta

SEQ ID NO: 4077478 - DNA, 13 bp, Homo sapiens
aaaatagccctgc

SEQ ID NO: 4077479 - DNA, 13 bp, Homo sapiens
aaaatataaaata

SEQ ID NO: 4077480 - DNA, 10 bp, Homo sapiens
aaaatataac

SEQ ID NO: 4077481 - DNA, 11 bp, Homo sapiens
aaaatataatt

SEQ ID NO: 4077482 - DNA, 18 bp, Homo sapiens
aaaatatataccccccca

SEQ ID NO: 4077483 - DNA, 14 bp, Homo sapiens
aaaatatatactaa

SEQ ID NO: 4077484 - DNA, 15 bp, Homo sapiens
aaaatatatttaatg

SEQ ID NO: 4077485 - DNA, 16 bp, Homo sapiens
aaaatattataactta

SEQ ID NO: 4077486 - DNA, 19 bp, Homo sapiens
aaaatattataacttaaaa

SEQ ID NO: 4077487 - DNA, 11 bp, Homo sapiens
aaaatatttat

SEQ ID NO: 4077488 - DNA, 17 bp, Homo sapiens
aaaatatttcagatatc

SEQ ID NO: 4077489 - DNA, 22 bp, Homo sapiens
aaaatatttcctgacttgagtg

SEQ ID NO: 4077490 - DNA, 14 bp, Homo sapiens
aaaatcaaaacaag

SEQ ID NO: 4077491 - DNA, 14 bp, Homo sapiens
aaaatcacaaaaat

SEQ ID NO: 4077492 - DNA, 19 bp, Homo sapiens
aaaatcactatctttctga

SEQ ID NO: 4077493 - DNA, 13 bp, Homo sapiens
aaaatctattctg

SEQ ID NO: 4077494 - DNA, 19 bp, Homo sapiens
aaaatctgtttgatccctg

SEQ ID NO: 4077495 - DNA, 17 bp, Homo sapiens
aaaatcttggcacagaa

SEQ ID NO: 4077496 - DNA, 15 bp, Homo sapiens
aaaatgaaaattgta

SEQ ID NO: 4077497 - DNA, 13 bp, Homo sapiens
aaaatgaagggat

SEQ ID NO: 4077498 - DNA, 14 bp, Homo sapiens
aaaatgaatatcta

SEQ ID NO: 4077499 - DNA, 22 bp, Homo sapiens
aaaatgaatatctattaatata

SEQ ID NO: 4077500 - DNA, 17 bp, Homo sapiens
aaaatgacagatgttga

SEQ ID NO: 4077501 - DNA, 21 bp, Homo sapiens
aaaatgactaaaaatattata

SEQ ID NO: 4077502 - DNA, 14 bp, Homo sapiens
aaaatgactactta

SEQ ID NO: 4077503 - DNA, 23 bp, Homo sapiens
aaaatgatgtgtacccaaacgtg

SEQ ID NO: 4077504 - DNA, 14 bp, Homo sapiens
aaaatgcaacaaat

SEQ ID NO: 4077505 - DNA, 17 bp, Homo sapiens
aaaatgcaacaaatgaa

SEQ ID NO: 4077506 - DNA, 11 bp, Homo sapiens
aaaatgccttt

SEQ ID NO: 4077507 - DNA, 14 bp, Homo sapiens
aaaatgcctttgag

SEQ ID NO: 4077508 - DNA, 17 bp, Homo sapiens
aaaatgcctttgagaca

SEQ ID NO: 4077509 - DNA, 18 bp, Homo sapiens
aaaatgcggttataaaaa

SEQ ID NO: 4077510 - DNA, 18 bp, Homo sapiens
aaaatgctccccacagcg

SEQ ID NO: 4077511 - DNA, 22 bp, Homo sapiens
aaaatgctttttatttctgcat

SEQ ID NO: 4077512 - DNA, 16 bp, Homo sapiens
aaaatggttgatggaa

SEQ ID NO: 4077513 - DNA, 17 bp, Homo sapiens
aaaatggttgatggaaa

SEQ ID NO: 4077514 - DNA, 18 bp, Homo sapiens
aaaatggttgatggaaaa

SEQ ID NO: 4077515 - DNA, 19 bp, Homo sapiens
aaaatgtaaaggagtcaaa

SEQ ID NO: 4077516 - DNA, 11 bp, Homo sapiens
aaaatgtaaat

SEQ ID NO: 4077517 - DNA, 16 bp, Homo sapiens
aaaatgtaatttagaa

SEQ ID NO: 4077518 - DNA, 18 bp, Homo sapiens
aaaatgtaatttagaaac

SEQ ID NO: 4077519 - DNA, 17 bp, Homo sapiens
aaaatgtcacattctat

SEQ ID NO: 4077520 - DNA, 18 bp, Homo sapiens
aaaatgtcctgcctttta

SEQ ID NO: 4077521 - DNA, 16 bp, Homo sapiens
aaaatgtgacccagat

SEQ ID NO: 4077522 - DNA, 12 bp, Homo sapiens
aaaatgtgattt

SEQ ID NO: 4077523 - DNA, 15 bp, Homo sapiens
aaaatgtgtaattca

SEQ ID NO: 4077524 - DNA, 14 bp, Homo sapiens
aaaatgtgtttgct

SEQ ID NO: 4077525 - DNA, 15 bp, Homo sapiens
aaaatgttggattta

SEQ ID NO: 4077526 - DNA, 17 bp, Homo sapiens
aaaattaagtagaacaa

SEQ ID NO: 4077527 - DNA, 19 bp, Homo sapiens
aaaattaagtagaacaaaa

SEQ ID NO: 4077528 - DNA, 21 bp, Homo sapiens
aaaattacgtttgttattcct

SEQ ID NO: 4077529 - DNA, 15 bp, Homo sapiens
aaaattactaatttt

SEQ ID NO: 4077530 - DNA, 23 bp, Homo sapiens
aaaattagactgtgattcagaaa

SEQ ID NO: 4077531 - DNA, 18 bp, Homo sapiens
aaaattagccgggcgtgg

SEQ ID NO: 4077532 - DNA, 22 bp, Homo sapiens
aaaattatactaacttatttat

SEQ ID NO: 4077533 - DNA, 14 bp, Homo sapiens
aaaattcaattgta

SEQ ID NO: 4077534 - DNA, 18 bp, Homo sapiens
aaaattcagcaaaccatt

SEQ ID NO: 4077535 - DNA, 15 bp, Homo sapiens
aaaattcagtttttg

SEQ ID NO: 4077536 - DNA, 23 bp, Homo sapiens
aaaattcagtttttgtatcttgg

SEQ ID NO: 4077537 - DNA, 16 bp, Homo sapiens
aaaattccagaaagga

SEQ ID NO: 4077538 - DNA, 20 bp, Homo sapiens
aaaattccagaaaggatatt

SEQ ID NO: 4077539 - DNA, 17 bp, Homo sapiens
aaaattccattatctta

SEQ ID NO: 4077540 - DNA, 19 bp, Homo sapiens
aaaattccattatcttatg

SEQ ID NO: 4077541 - DNA, 15 bp, Homo sapiens
aaaattctgaatgta

SEQ ID NO: 4077542 - DNA, 20 bp, Homo sapiens
aaaattctgtaggttctgtg

SEQ ID NO: 4077543 - DNA, 14 bp, Homo sapiens
aaaattgatgtgtt

SEQ ID NO: 4077544 - DNA, 20 bp, Homo sapiens
aaaattgctatgttactatt

SEQ ID NO: 4077545 - DNA, 16 bp, Homo sapiens
aaaattggttggagaa

SEQ ID NO: 4077546 - DNA, 19 bp, Homo sapiens
aaaattgtaacctgcattt

SEQ ID NO: 4077547 - DNA, 17 bp, Homo sapiens
aaaattgtcacctctgt

SEQ ID NO: 4077548 - DNA, 14 bp, Homo sapiens
aaaatttaagcatt

SEQ ID NO: 4077549 - DNA, 21 bp, Homo sapiens
aaaatttaagcattgtttgct

SEQ ID NO: 4077550 - DNA, 12 bp, Homo sapiens
aaaatttatctt

SEQ ID NO: 4077551 - DNA, 23 bp, Homo sapiens
aaaatttatcttaagttctatga

SEQ ID NO: 4077552 - DNA, 17 bp, Homo sapiens
aaaatttccagtacctt

SEQ ID NO: 4077553 - DNA, 23 bp, Homo sapiens
aaaatttccagtacctttgtcac

SEQ ID NO: 4077554 - DNA, 13 bp, Homo sapiens
aaaatttgtattt

SEQ ID NO: 4077555 - DNA, 16 bp, Homo sapiens
aaaatttgttttgacg

SEQ ID NO: 4077556 - DNA, 21 bp, Homo sapiens
aaaattttaggcactcttaaa

SEQ ID NO: 4077557 - DNA, 21 bp, Homo sapiens
aaaattttataaaattaagca

SEQ ID NO: 4077558 - DNA, 15 bp, Homo sapiens
aaaatttttacattc

SEQ ID NO: 4077559 - DNA, 13 bp, Homo sapiens
aaacaaaattgca

SEQ ID NO: 4077560 - DNA, 18 bp, Homo sapiens
aaacaaaattgcaatttc

SEQ ID NO: 4077561 - DNA, 13 bp, Homo sapiens
aaacaaatatgca

SEQ ID NO: 4077562 - DNA, 21 bp, Homo sapiens
aaacaaattcatattctgtct

SEQ ID NO: 4077563 - DNA, 15 bp, Homo sapiens
aaacaacagctgaag

SEQ ID NO: 4077564 - DNA, 19 bp, Homo sapiens
aaacaacttcaatatccaa

SEQ ID NO: 4077565 - DNA, 12 bp, Homo sapiens
aaacaatgtgga

SEQ ID NO: 4077566 - DNA, 13 bp, Homo sapiens
aaacacagctgtt

SEQ ID NO: 4077567 - DNA, 20 bp, Homo sapiens
aaacacagtcaaaataattc

SEQ ID NO: 4077568 - DNA, 14 bp, Homo sapiens
aaacacatcttccc

SEQ ID NO: 4077569 - DNA, 20 bp, Homo sapiens
aaacacattatgtatcttag

SEQ ID NO: 4077570 - DNA, 21 bp, Homo sapiens
aaacacattatgtatcttagt

SEQ ID NO: 4077571 - DNA, 23 bp, Homo sapiens
aaacacattgcctaactactagt

SEQ ID NO: 4077572 - DNA, 15 bp, Homo sapiens
aaacacctagcttta

SEQ ID NO: 4077573 - DNA, 14 bp, Homo sapiens
aaacacctgacaca

SEQ ID NO: 4077574 - DNA, 18 bp, Homo sapiens
aaacacctgacagcccct

SEQ ID NO: 4077575 - DNA, 14 bp, Homo sapiens
aaacactaaaagca

SEQ ID NO: 4077576 - DNA, 24 bp, Homo sapiens
aaacactcagttgttcaataataa

SEQ ID NO: 4077577 - DNA, 18 bp, Homo sapiens
aaacactgcagtttcctg

SEQ ID NO: 4077578 - DNA, 13 bp, Homo sapiens
aaacactttcaaa

SEQ ID NO: 4077579 - DNA, 14 bp, Homo sapiens
aaacagaaaaaaag

SEQ ID NO: 4077580 - DNA, 12 bp, Homo sapiens
aaacagaacagg

SEQ ID NO: 4077581 - DNA, 12 bp, Homo sapiens
aaacagaagcct

SEQ ID NO: 4077582 - DNA, 12 bp, Homo sapiens
aaacagacaaaa

SEQ ID NO: 4077583 - DNA, 14 bp, Homo sapiens
aaacagacaaaaca

SEQ ID NO: 4077584 - DNA, 16 bp, Homo sapiens
aaacagagatgtgata

SEQ ID NO: 4077585 - DNA, 15 bp, Homo sapiens
aaacagagtggcctc

SEQ ID NO: 4077586 - DNA, 12 bp, Homo sapiens
aaacagatataa

SEQ ID NO: 4077587 - DNA, 20 bp, Homo sapiens
aaacagattcaggccagccc

SEQ ID NO: 4077588 - DNA, 14 bp, Homo sapiens
aaacagatttttac

SEQ ID NO: 4077589 - DNA, 14 bp, Homo sapiens
aaacagccagcaag

SEQ ID NO: 4077590 - DNA, 23 bp, Homo sapiens
aaacagccattgcggccccagga

SEQ ID NO: 4077591 - DNA, 16 bp, Homo sapiens
aaacagctgtctctaa

SEQ ID NO: 4077592 - DNA, 22 bp, Homo sapiens
aaacagcttcatgcctttgtaa

SEQ ID NO: 4077593 - DNA, 11 bp, Homo sapiens
aaacaggacca

SEQ ID NO: 4077594 - DNA, 12 bp, Homo sapiens
aaacaggatcag

SEQ ID NO: 4077595 - DNA, 18 bp, Homo sapiens
aaacaggtatatactttg

SEQ ID NO: 4077596 - DNA, 22 bp, Homo sapiens
aaacagtacttaggtaattgta

SEQ ID NO: 4077597 - DNA, 19 bp, Homo sapiens
aaacagtatattctttggt

SEQ ID NO: 4077598 - DNA, 15 bp, Homo sapiens
aaacagtatttattt

SEQ ID NO: 4077599 - DNA, 19 bp, Homo sapiens
aaacagtatttattttgta

SEQ ID NO: 4077600 - DNA, 18 bp, Homo sapiens
aaacagttaactttcaga

SEQ ID NO: 4077601 - DNA, 15 bp, Homo sapiens
aaacataaaaagcag

SEQ ID NO: 4077602 - DNA, 18 bp, Homo sapiens
aaacataagttgcattta

SEQ ID NO: 4077603 - DNA, 13 bp, Homo sapiens
aaaaaaaaagttc

SEQ ID NO: 4077604 - DNA, 11 bp, Homo sapiens
aaaaaaagaaa

SEQ ID NO: 4077605 - DNA, 13 bp, Homo sapiens
aaaaaaagaaaag

SEQ ID NO: 4077606 - DNA, 14 bp, Homo sapiens
aaaaaaagaagtta

SEQ ID NO: 4077607 - DNA, 12 bp, Homo sapiens
aaaaaaagcata

SEQ ID NO: 4077608 - DNA, 12 bp, Homo sapiens
aaaaaaatcaca

SEQ ID NO: 4077609 - DNA, 12 bp, Homo sapiens
aaaaaaatgact

SEQ ID NO: 4077610 - DNA, 11 bp, Homo sapiens
aaaaaaatttg

SEQ ID NO: 4077611 - DNA, 13 bp, Homo sapiens
aaaaaacagaaaa

SEQ ID NO: 4077612 - DNA, 15 bp, Homo sapiens
aaaaaacagaggcca

SEQ ID NO: 4077613 - DNA, 12 bp, Homo sapiens
aaaaaacatttt

SEQ ID NO: 4077614 - DNA, 20 bp, Homo sapiens
aaaaaactcttaatctgtgt

SEQ ID NO: 4077615 - DNA, 11 bp, Homo sapiens
aaaaaagcaaa

SEQ ID NO: 4077616 - DNA, 19 bp, Homo sapiens
aaaaaagggacagcatgcc

SEQ ID NO: 4077617 - DNA, 12 bp, Homo sapiens
aaaaaataacac

SEQ ID NO: 4077618 - DNA, 13 bp, Homo sapiens
aaaaaatctatcc

SEQ ID NO: 4077619 - DNA, 11 bp, Homo sapiens
aaaaaatcttc

SEQ ID NO: 4077620 - DNA, 12 bp, Homo sapiens
aaaaaatggttc

SEQ ID NO: 4077621 - DNA, 11 bp, Homo sapiens
aaaaaattggt

SEQ ID NO: 4077622 - DNA, 17 bp, Homo sapiens
aaaaacacctagcttta

SEQ ID NO: 4077623 - DNA, 12 bp, Homo sapiens
aaaaacactagt

SEQ ID NO: 4077624 - DNA, 15 bp, Homo sapiens
aaaaacagaaaaaca

SEQ ID NO: 4077625 - DNA, 14 bp, Homo sapiens
aaaaacagaggcca

SEQ ID NO: 4077626 - DNA, 19 bp, Homo sapiens
aaaaacagcattgctttct

SEQ ID NO: 4077627 - DNA, 20 bp, Homo sapiens
aaaaacagcattgctttctg

SEQ ID NO: 4077628 - DNA, 18 bp, Homo sapiens
aaaaacaggtatatactt

SEQ ID NO: 4077629 - DNA, 19 bp, Homo sapiens
aaaaacaggtatatacttt

SEQ ID NO: 4077630 - DNA, 14 bp, Homo sapiens
aaaaacatattctt

SEQ ID NO: 4077631 - DNA, 13 bp, Homo sapiens
aaaaacatgtatg

SEQ ID NO: 4077632 - DNA, 16 bp, Homo sapiens
aaaaacatgtatgtgc

SEQ ID NO: 4077633 - DNA, 16 bp, Homo sapiens
aaaaacattttgaagt

SEQ ID NO: 4077634 - DNA, 22 bp, Homo sapiens
aaaaaccgtgtttgtctcttct

SEQ ID NO: 4077635 - DNA, 11 bp, Homo sapiens
aaaaactattt

SEQ ID NO: 4077636 - DNA, 20 bp, Homo sapiens
aaaaactctgggaaataaga

SEQ ID NO: 4077637 - DNA, 15 bp, Homo sapiens
aaaaactctttattt

SEQ ID NO: 4077638 - DNA, 15 bp, Homo sapiens
aaaaactgtctttaa

SEQ ID NO: 4077639 - DNA, 19 bp, Homo sapiens
aaaaacttcagtaagtacg

SEQ ID NO: 4077640 - DNA, 11 bp, Homo sapiens
aaaaagaaaag

SEQ ID NO: 4077641 - DNA, 14 bp, Homo sapiens
aaaaagaaaagata

SEQ ID NO: 4077642 - DNA, 15 bp, Homo sapiens
aaaaagaaatgacta

SEQ ID NO: 4077643 - DNA, 16 bp, Homo sapiens
aaaaagaacttttgta

SEQ ID NO: 4077644 - DNA, 15 bp, Homo sapiens
aaaaagaagttactt

SEQ ID NO: 4077645 - DNA, 12 bp, Homo sapiens
aaaaagcacata

SEQ ID NO: 4077646 - DNA, 21 bp, Homo sapiens
aaaaagcagctaccaggtgtt

SEQ ID NO: 4077647 - DNA, 16 bp, Homo sapiens
aaaaagcagtcctctt

SEQ ID NO: 4077648 - DNA, 17 bp, Homo sapiens
aaaaagccagtttgggt

SEQ ID NO: 4077649 - DNA, 12 bp, Homo sapiens
aaaaagccttcc

SEQ ID NO: 4077650 - DNA, 19 bp, Homo sapiens
aaaaaggaaaaaattaata

SEQ ID NO: 4077651 - DNA, 14 bp, Homo sapiens
aaaaaggaaaaata

SEQ ID NO: 4077652 - DNA, 21 bp, Homo sapiens
aaaaagggatccgtacattca

SEQ ID NO: 4077653 - DNA, 16 bp, Homo sapiens
aaaaaggttaattttt

SEQ ID NO: 4077654 - DNA, 21 bp, Homo sapiens
aaaaagtaagttaataatgta

SEQ ID NO: 4077655 - DNA, 16 bp, Homo sapiens
aaaaagtgacacagca

SEQ ID NO: 4077656 - DNA, 19 bp, Homo sapiens
aaaaagtgacacagcagct

SEQ ID NO: 4077657 - DNA, 12 bp, Homo sapiens
aaaaataatcaa

SEQ ID NO: 4077658 - DNA, 13 bp, Homo sapiens
aaaaatacaaaat

SEQ ID NO: 4077659 - DNA, 14 bp, Homo sapiens
aaaaatacatgttc

SEQ ID NO: 4077660 - DNA, 18 bp, Homo sapiens
aaaaatagtcttccacaa

SEQ ID NO: 4077661 - DNA, 15 bp, Homo sapiens
aaaaatatatactaa

SEQ ID NO: 4077662 - DNA, 19 bp, Homo sapiens
aaaaatatatattttaagt

SEQ ID NO: 4077663 - DNA, 19 bp, Homo sapiens
aaaaatatatttaatgata

SEQ ID NO: 4077664 - DNA, 22 bp, Homo sapiens
aaaaatattcctccaaatctct

SEQ ID NO: 4077665 - DNA, 15 bp, Homo sapiens
aaaaatgaaagtgac

SEQ ID NO: 4077666 - DNA, 21 bp, Homo sapiens
aaaaatgaaagtgactttaaa

SEQ ID NO: 4077667 - DNA, 17 bp, Homo sapiens
aaaaatgacagatgttg

SEQ ID NO: 4077668 - DNA, 15 bp, Homo sapiens
aaaaatgattttgct

SEQ ID NO: 4077669 - DNA, 17 bp, Homo sapiens
aaaaatgcaacaaatga

SEQ ID NO: 4077670 - DNA, 18 bp, Homo sapiens
aaaaatgcccttaaatca

SEQ ID NO: 4077671 - DNA, 12 bp, Homo sapiens
aaaaatgccttt

SEQ ID NO: 4077672 - DNA, 14 bp, Homo sapiens
aaaaatgcctttga

SEQ ID NO: 4077673 - DNA, 22 bp, Homo sapiens
aaaaatgcctttgagacagttt

SEQ ID NO: 4077674 - DNA, 21 bp, Homo sapiens
aaaaatggttgatggaaaata

SEQ ID NO: 4077675 - DNA, 12 bp, Homo sapiens
aaaaatgtaaat

SEQ ID NO: 4077676 - DNA, 19 bp, Homo sapiens
aaaaatgtaatttagaaac

SEQ ID NO: 4077677 - DNA, 21 bp, Homo sapiens
aaaaatttaaaattacgtttg

SEQ ID NO: 4077678 - DNA, 18 bp, Homo sapiens
aaaaatttaagcattgtt

SEQ ID NO: 4077679 - DNA, 13 bp, Homo sapiens
aaaaatttaagtg

SEQ ID NO: 4077680 - DNA, 22 bp, Homo sapiens
aaaaattttataaaattaagca

SEQ ID NO: 4077681 - DNA, 18 bp, Homo sapiens
aaaacaaaatctgaactc

SEQ ID NO: 4077682 - DNA, 19 bp, Homo sapiens
aaaacaatctggaagaaaa

SEQ ID NO: 4077683 - DNA, 15 bp, Homo sapiens
aaaacacctagcttt

SEQ ID NO: 4077684 - DNA, 22 bp, Homo sapiens
aaaacacctagctttattcttc

SEQ ID NO: 4077685 - DNA, 12 bp, Homo sapiens
aaaacagaaaaa

SEQ ID NO: 4077686 - DNA, 16 bp, Homo sapiens
aaaacagcattgcttt

SEQ ID NO: 4077687 - DNA, 15 bp, Homo sapiens
aaaacaggcaaattc

SEQ ID NO: 4077688 - DNA, 18 bp, Homo sapiens
aaaacaggtatatacttt

SEQ ID NO: 4077689 - DNA, 21 bp, Homo sapiens
aaaacaggtcttcatcgaatc

SEQ ID NO: 4077690 - DNA, 19 bp, Homo sapiens
aaaacatattcttgtgctt

SEQ ID NO: 4077691 - DNA, 15 bp, Homo sapiens
aaaacatgtttctgc

SEQ ID NO: 4077692 - DNA, 15 bp, Homo sapiens
aaaacattttgaagt

SEQ ID NO: 4077693 - DNA, 21 bp, Homo sapiens
aaaaccgtgtttgtctcttct

SEQ ID NO: 4077694 - DNA, 17 bp, Homo sapiens
aaaacgcaaagggctga

SEQ ID NO: 4077695 - DNA, 17 bp, Homo sapiens
aaaacgcatggagtgtg

SEQ ID NO: 4077696 - DNA, 15 bp, Homo sapiens
aaaacgttttattgt

SEQ ID NO: 4077697 - DNA, 16 bp, Homo sapiens
aaaacgttttattgtg

SEQ ID NO: 4077698 - DNA, 12 bp, Homo sapiens
aaaactatacaa

SEQ ID NO: 4077699 - DNA, 23 bp, Homo sapiens
aaagcttgtggccccttttactt

SEQ ID NO: 4077700 - DNA, 12 bp, Homo sapiens
aaagctttcctg

SEQ ID NO: 4077701 - DNA, 14 bp, Homo sapiens
aaagctttcctgcc

SEQ ID NO: 4077702 - DNA, 22 bp, Homo sapiens
aaagctttcctgccccaggcct

SEQ ID NO: 4077703 - DNA, 15 bp, Homo sapiens
aaaggaaaaataatc

SEQ ID NO: 4077704 - DNA, 16 bp, Homo sapiens
aaaggaaagaaaacat

SEQ ID NO: 4077705 - DNA, 13 bp, Homo sapiens
aaaggaagactag

SEQ ID NO: 4077706 - DNA, 22 bp, Homo sapiens
aaaggacaccttttaactcacc

SEQ ID NO: 4077707 - DNA, 15 bp, Homo sapiens
aaaggacaggaggag

SEQ ID NO: 4077708 - DNA, 19 bp, Homo sapiens
aaaggagccttttgctctc

SEQ ID NO: 4077709 - DNA, 14 bp, Homo sapiens
aaaggaggctggca

SEQ ID NO: 4077710 - DNA, 16 bp, Homo sapiens
aaaggagtcaaaacta

SEQ ID NO: 4077711 - DNA, 12 bp, Homo sapiens
aaaggatatttt

SEQ ID NO: 4077712 - DNA, 18 bp, Homo sapiens
aaaggcagtattttgtgt

SEQ ID NO: 4077713 - DNA, 17 bp, Homo sapiens
aaaggcatattgctttt

SEQ ID NO: 4077714 - DNA, 19 bp, Homo sapiens
aaaggcatcccagcctggg

SEQ ID NO: 4077715 - DNA, 18 bp, Homo sapiens
aaaggcctcaagaacaaa

SEQ ID NO: 4077716 - DNA, 13 bp, Homo sapiens
aaaggcctcttgt

SEQ ID NO: 4077717 - DNA, 14 bp, Homo sapiens
aaagggaagaaact

SEQ ID NO: 4077718 - DNA, 14 bp, Homo sapiens
aaaggggagagcct

SEQ ID NO: 4077719 - DNA, 17 bp, Homo sapiens
aaagggggtccgtggaa

SEQ ID NO: 4077720 - DNA, 19 bp, Homo sapiens
aaagggtgaagctatttat

SEQ ID NO: 4077721 - DNA, 21 bp, Homo sapiens
aaagggtgaagctatttatct

SEQ ID NO: 4077722 - DNA, 20 bp, Homo sapiens
aaagggttgaaaatgtgttt

SEQ ID NO: 4077723 - DNA, 15 bp, Homo sapiens
aaaggtcctgccctc

SEQ ID NO: 4077724 - DNA, 23 bp, Homo sapiens
aaaggtgagtttgagctgccttc

SEQ ID NO: 4077725 - DNA, 18 bp, Homo sapiens
aaaggtggagtttctctg

SEQ ID NO: 4077726 - DNA, 23 bp, Homo sapiens
aaaggtggtatgtaatttatgca

SEQ ID NO: 4077727 - DNA, 13 bp, Homo sapiens
aaaggtgtattta

SEQ ID NO: 4077728 - DNA, 12 bp, Homo sapiens
aaaggttttgta

SEQ ID NO: 4077729 - DNA, 12 bp, Homo sapiens
aaagtaaataca

SEQ ID NO: 4077730 - DNA, 15 bp, Homo sapiens
aaagtaactcatttg

SEQ ID NO: 4077731 - DNA, 22 bp, Homo sapiens
aaagtaactcatttgttaaaat

SEQ ID NO: 4077732 - DNA, 13 bp, Homo sapiens
aaagtaagttaat

SEQ ID NO: 4077733 - DNA, 17 bp, Homo sapiens
aaagtacatatttattt

SEQ ID NO: 4077734 - DNA, 13 bp, Homo sapiens
aaagtacatttaa

SEQ ID NO: 4077735 - DNA, 14 bp, Homo sapiens
aaagtacatttaat

SEQ ID NO: 4077736 - DNA, 20 bp, Homo sapiens
aaagtatcactctaaaaaac

SEQ ID NO: 4077737 - DNA, 20 bp, Homo sapiens
aaagtccctccctgcctgag

SEQ ID NO: 4077738 - DNA, 22 bp, Homo sapiens
aaagtcctttttttccatcttt

SEQ ID NO: 4077739 - DNA, 13 bp, Homo sapiens
aaagtctattttt

SEQ ID NO: 4077740 - DNA, 22 bp, Homo sapiens
aaagtctatttttttaactgaa

SEQ ID NO: 4077741 - DNA, 16 bp, Homo sapiens
aaagtctgtctttcct

SEQ ID NO: 4077742 - DNA, 20 bp, Homo sapiens
aaagtcttcactctctgaag

SEQ ID NO: 4077743 - DNA, 23 bp, Homo sapiens
aaagtgaagcaaatcagaaactt

SEQ ID NO: 4077744 - DNA, 22 bp, Homo sapiens
aaagtgaatgaaagattaaaca

SEQ ID NO: 4077745 - DNA, 20 bp, Homo sapiens
aaagtgaatttgaatgaaaa

SEQ ID NO: 4077746 - DNA, 21 bp, Homo sapiens
aaagtgaatttgaatgaaaaa

SEQ ID NO: 4077747 - DNA, 13 bp, Homo sapiens
aaagtgacacagc

SEQ ID NO: 4077748 - DNA, 19 bp, Homo sapiens
aaagtgagaaagaaagtaa

SEQ ID NO: 4077749 - DNA, 23 bp, Homo sapiens
aaagtgatcaataaaatgtgatt

SEQ ID NO: 4077750 - DNA, 20 bp, Homo sapiens
aaagtgtaaatcctttttct

SEQ ID NO: 4077751 - DNA, 18 bp, Homo sapiens
aaagtgtgagcaaactaa

SEQ ID NO: 4077752 - DNA, 22 bp, Homo sapiens
aaagtgtgagcagtgagttaca

SEQ ID NO: 4077753 - DNA, 19 bp, Homo sapiens
aaagtgtgagctcttccct

SEQ ID NO: 4077754 - DNA, 13 bp, Homo sapiens
aaagtgtttcagc

SEQ ID NO: 4077755 - DNA, 13 bp, Homo sapiens
aaagtgttttatt

SEQ ID NO: 4077756 - DNA, 22 bp, Homo sapiens
aaagttaaacattgaagtaatg

SEQ ID NO: 4077757 - DNA, 20 bp, Homo sapiens
aaagttaattcacctatgtt

SEQ ID NO: 4077758 - DNA, 16 bp, Homo sapiens
aaagttagggggttct

SEQ ID NO: 4077759 - DNA, 22 bp, Homo sapiens
aaagttcatagggtctcttcag

SEQ ID NO: 4077760 - DNA, 23 bp, Homo sapiens
aaagttgcacatgattgtataag

SEQ ID NO: 4077761 - DNA, 23 bp, Homo sapiens
aaagttgcagatgtattgactgt

SEQ ID NO: 4077762 - DNA, 23 bp, Homo sapiens
aaagttgcctttatttgctgtta

SEQ ID NO: 4077763 - DNA, 12 bp, Homo sapiens
aaagtttaaatg

SEQ ID NO: 4077764 - DNA, 17 bp, Homo sapiens
aaagtttaaatgtattt

SEQ ID NO: 4077765 - DNA, 21 bp, Homo sapiens
aaagtttaaatgtattttaca

SEQ ID NO: 4077766 - DNA, 23 bp, Homo sapiens
aaagtttcacaggtcaataaact

SEQ ID NO: 4077767 - DNA, 14 bp, Homo sapiens
aaagtttccatatg

SEQ ID NO: 4077768 - DNA, 15 bp, Homo sapiens
aaagtttgcttagaa

SEQ ID NO: 4077769 - DNA, 13 bp, Homo sapiens
aaagttttgcaaa

SEQ ID NO: 4077770 - DNA, 21 bp, Homo sapiens
aaataaaaaagctcttttaat

SEQ ID NO: 4077771 - DNA, 18 bp, Homo sapiens
aaataaaaacaaacgttt

SEQ ID NO: 4077772 - DNA, 14 bp, Homo sapiens
aaataaaaatggca

SEQ ID NO: 4077773 - DNA, 17 bp, Homo sapiens
aaataaaaggaagccaa

SEQ ID NO: 4077774 - DNA, 16 bp, Homo sapiens
aaataaaagtgatcaa

SEQ ID NO: 4077775 - DNA, 14 bp, Homo sapiens
aaataaacatcagt

SEQ ID NO: 4077776 - DNA, 16 bp, Homo sapiens
aaataaacatcagttt

SEQ ID NO: 4077777 - DNA, 20 bp, Homo sapiens
aaataaagtatatatagaat

SEQ ID NO: 4077778 - DNA, 14 bp, Homo sapiens
aaataaataatttt

SEQ ID NO: 4077779 - DNA, 12 bp, Homo sapiens
aaataaattagt

SEQ ID NO: 4077780 - DNA, 17 bp, Homo sapiens
aaataaattctgattct

SEQ ID NO: 4077781 - DNA, 19 bp, Homo sapiens
aaataaatttggttctaat

SEQ ID NO: 4077782 - DNA, 18 bp, Homo sapiens
aaataacaatgttaagga

SEQ ID NO: 4077783 - DNA, 12 bp, Homo sapiens
aaataaccacaa

SEQ ID NO: 4077784 - DNA, 17 bp, Homo sapiens
aaataagaatagaaata

SEQ ID NO: 4077785 - DNA, 12 bp, Homo sapiens
aaataagagaga

SEQ ID NO: 4077786 - DNA, 13 bp, Homo sapiens
aaataagcaggtg

SEQ ID NO: 4077787 - DNA, 17 bp, Homo sapiens
aaataagtatttataat

SEQ ID NO: 4077788 - DNA, 17 bp, Homo sapiens
aaataagtatttctgat

SEQ ID NO: 4077789 - DNA, 13 bp, Homo sapiens
aaataataatttt

SEQ ID NO: 4077790 - DNA, 12 bp, Homo sapiens
aaataatatgca

SEQ ID NO: 4077791 - DNA, 14 bp, Homo sapiens
aaataatatgcatt

SEQ ID NO: 4077792 - DNA, 14 bp, Homo sapiens
aaataatcaagatt

SEQ ID NO: 4077793 - DNA, 19 bp, Homo sapiens
aaataatgaataaactgaa

SEQ ID NO: 4077794 - DNA, 19 bp, Homo sapiens
aaataattttatctctttc

SEQ ID NO: 4077795 - DNA, 16 bp, Homo sapiens
aaatacaaagtaaata

SEQ ID NO: 4077796 - DNA, 16 bp, Homo sapiens
aaatacaaatctgtat

SEQ ID NO: 4077797 - DNA, 18 bp, Homo sapiens
aaatacaaatctgtataa

SEQ ID NO: 4077798 - DNA, 14 bp, Homo sapiens
aaatacaagactgt

SEQ ID NO: 4077799 - DNA, 17 bp, Homo sapiens
aaatacaagactgttgt

SEQ ID NO: 4077800 - DNA, 15 bp, Homo sapiens
aaatacaataaacta

SEQ ID NO: 4077801 - DNA, 22 bp, Homo sapiens
aaatacaataaactattggaaa

SEQ ID NO: 4077802 - DNA, 12 bp, Homo sapiens
aaacataataaa

SEQ ID NO: 4077803 - DNA, 22 bp, Homo sapiens
aaacataataaatcacacattc

SEQ ID NO: 4077804 - DNA, 18 bp, Homo sapiens
aaacataatgaaaatatt

SEQ ID NO: 4077805 - DNA, 17 bp, Homo sapiens
aaacatatacagaaaaa

SEQ ID NO: 4077806 - DNA, 22 bp, Homo sapiens
aaacatcacacacacagacaga

SEQ ID NO: 4077807 - DNA, 16 bp, Homo sapiens
aaacatcagacctgtc

SEQ ID NO: 4077808 - DNA, 19 bp, Homo sapiens
aaacatccaatattttctt

SEQ ID NO: 4077809 - DNA, 20 bp, Homo sapiens
aaacatccttcaagaactct

SEQ ID NO: 4077810 - DNA, 21 bp, Homo sapiens
aaacatggtagaattggagag

SEQ ID NO: 4077811 - DNA, 16 bp, Homo sapiens
aaacatgttagaagca

SEQ ID NO: 4077812 - DNA, 20 bp, Homo sapiens
aaacatgtttatttttcttg

SEQ ID NO: 4077813 - DNA, 21 bp, Homo sapiens
aaacattaatagcagcctttc

SEQ ID NO: 4077814 - DNA, 21 bp, Homo sapiens
aaacattcaattccagagaac

SEQ ID NO: 4077815 - DNA, 20 bp, Homo sapiens
aaacattttatttttaaaat

SEQ ID NO: 4077816 - DNA, 23 bp, Homo sapiens
aaacattttatttttaaaatatt

SEQ ID NO: 4077817 - DNA, 20 bp, Homo sapiens
aaacatttttaatttaacaa

SEQ ID NO: 4077818 - DNA, 22 bp, Homo sapiens
aaacatttttaatttaacaaac

SEQ ID NO: 4077819 - DNA, 17 bp, Homo sapiens
aaaccaaagagggcttc

SEQ ID NO: 4077820 - DNA, 16 bp, Homo sapiens
aaaccaagccgtggct

SEQ ID NO: 4077821 - DNA, 21 bp, Homo sapiens
aaaccaatggtgatcctctat

SEQ ID NO: 4077822 - DNA, 15 bp, Homo sapiens
aaaccaggcctctgc

SEQ ID NO: 4077823 - DNA, 17 bp, Homo sapiens
aaaccatttttaaagta

SEQ ID NO: 4077824 - DNA, 13 bp, Homo sapiens
aaacccaagtccc

SEQ ID NO: 4077825 - DNA, 22 bp, Homo sapiens
aaaccgataatgcatgaagcaa

SEQ ID NO: 4077826 - DNA, 21 bp, Homo sapiens
aaaccgtggtctcatgtaaca

SEQ ID NO: 4077827 - DNA, 20 bp, Homo sapiens
aaaccgtgtttgtctcttct

SEQ ID NO: 4077828 - DNA, 17 bp, Homo sapiens
aaacctagagaagataa

SEQ ID NO: 4077829 - DNA, 11 bp, Homo sapiens
aaacctaggtc

SEQ ID NO: 4077830 - DNA, 17 bp, Homo sapiens
aaacctatcctcactgc

SEQ ID NO: 4077831 - DNA, 20 bp, Homo sapiens
aaacctcagggctgtcccag

SEQ ID NO: 4077832 - DNA, 12 bp, Homo sapiens
aaacctccagcc

SEQ ID NO: 4077833 - DNA, 18 bp, Homo sapiens
aaacctgaagactgagga

SEQ ID NO: 4077834 - DNA, 12 bp, Homo sapiens
aaacctgggacc

SEQ ID NO: 4077835 - DNA, 18 bp, Homo sapiens
aaacctgggattcaggaa

SEQ ID NO: 4077836 - DNA, 22 bp, Homo sapiens
aaacctgtagatgcagaaaaag

SEQ ID NO: 4077837 - DNA, 18 bp, Homo sapiens
aaaccttattgtacctct

SEQ ID NO: 4077838 - DNA, 22 bp, Homo sapiens
aaaccttgctctcctcatctcc

SEQ ID NO: 4077839 - DNA, 15 bp, Homo sapiens
aaaccttttttaaga

SEQ ID NO: 4077840 - DNA, 16 bp, Homo sapiens
aaaccttttttaagat

SEQ ID NO: 4077841 - DNA, 22 bp, Homo sapiens
aaaccttttttaagatttttct

SEQ ID NO: 4077842 - DNA, 19 bp, Homo sapiens
aaacgagggctgatggagg

SEQ ID NO: 4077843 - DNA, 22 bp, Homo sapiens
aaacgctaaagagcccttgcct

SEQ ID NO: 4077844 - DNA, 12 bp, Homo sapiens
aaactaaaaata

SEQ ID NO: 4077845 - DNA, 14 bp, Homo sapiens
aaactaaaaatatt

SEQ ID NO: 4077846 - DNA, 15 bp, Homo sapiens
aaactaaaagacatt

SEQ ID NO: 4077847 - DNA, 20 bp, Homo sapiens
aaactaacagataagcaaga

SEQ ID NO: 4077848 - DNA, 17 bp, Homo sapiens
aaactaaccttgaataa

SEQ ID NO: 4077849 - DNA, 13 bp, Homo sapiens
aaactaagccagg

SEQ ID NO: 4077850 - DNA, 14 bp, Homo sapiens
aaactaagccaggc

SEQ ID NO: 4077851 - DNA, 14 bp, Homo sapiens
aaactaagctcttt

SEQ ID NO: 4077852 - DNA, 22 bp, Homo sapiens
aaactaattctcacatccctct

SEQ ID NO: 4077853 - DNA, 23 bp, Homo sapiens
aaactaattctcacatccctcta

SEQ ID NO: 4077854 - DNA, 13 bp, Homo sapiens
aaactactctttg

SEQ ID NO: 4077855 - DNA, 14 bp, Homo sapiens
aaactaggtaatgt

SEQ ID NO: 4077856 - DNA, 16 bp, Homo sapiens
aaactaggtaatgttt

SEQ ID NO: 4077857 - DNA, 19 bp, Homo sapiens
aaactagttattttataat

SEQ ID NO: 4077858 - DNA, 14 bp, Homo sapiens
aaactataaataca

SEQ ID NO: 4077859 - DNA, 16 bp, Homo sapiens
aaactataaatacaaa

SEQ ID NO: 4077860 - DNA, 14 bp, Homo sapiens
aaactatcttgtgt

SEQ ID NO: 4077861 - DNA, 18 bp, Homo sapiens
aaactatggttcccaata

SEQ ID NO: 4077862 - DNA, 21 bp, Homo sapiens
aaactatggttcccaataaaa

SEQ ID NO: 4077863 - DNA, 15 bp, Homo sapiens
aaactcacaaatgat

SEQ ID NO: 4077864 - DNA, 15 bp, Homo sapiens
aaactcactgctcaa

SEQ ID NO: 4077865 - DNA, 16 bp, Homo sapiens
aaactcactgctcaag

SEQ ID NO: 4077866 - DNA, 23 bp, Homo sapiens
aaactcaggatggtcatcttgga

SEQ ID NO: 4077867 - DNA, 22 bp, Homo sapiens
aaactcatattacaaaaacaaa

SEQ ID NO: 4077868 - DNA, 14 bp, Homo sapiens
aaactccttcctgg

SEQ ID NO: 4077869 - DNA, 14 bp, Homo sapiens
aaactctgggaaat

SEQ ID NO: 4077870 - DNA, 20 bp, Homo sapiens
aaactctgttgcaagtgcaa

SEQ ID NO: 4077871 - DNA, 15 bp, Homo sapiens
aaactcttaatctgt

SEQ ID NO: 4077872 - DNA, 13 bp, Homo sapiens
aaactcttatctc

SEQ ID NO: 4077873 - DNA, 15 bp, Homo sapiens
aaactcttatctcag

SEQ ID NO: 4077874 - DNA, 18 bp, Homo sapiens
aaactgagcctcacttgc

SEQ ID NO: 4077875 - DNA, 13 bp, Homo sapiens
aaactgcaggagc

SEQ ID NO: 4077876 - DNA, 15 bp, Homo sapiens
aaactgctaaattct

SEQ ID NO: 4077877 - DNA, 16 bp, Homo sapiens
aaactgctaaattcta

SEQ ID NO: 4077878 - DNA, 16 bp, Homo sapiens
aaactgctgcagatta

SEQ ID NO: 4077879 - DNA, 16 bp, Homo sapiens
aaactgctgtcgttgt

SEQ ID NO: 4077880 - DNA, 16 bp, Homo sapiens
aaactggattaaaaca

SEQ ID NO: 4077881 - DNA, 20 bp, Homo sapiens
aaactggggcctccagaact

SEQ ID NO: 4077882 - DNA, 16 bp, Homo sapiens
aaactggggcctccct

SEQ ID NO: 4077883 - DNA, 16 bp, Homo sapiens
aaactgtacatttaaa

SEQ ID NO: 4077884 - DNA, 14 bp, Homo sapiens
aaactgtgcaatcc

SEQ ID NO: 4077885 - DNA, 20 bp, Homo sapiens
aaactgtgtggactgtgatg

SEQ ID NO: 4077886 - DNA, 15 bp, Homo sapiens
aaacttactattttg

SEQ ID NO: 4077887 - DNA, 15 bp, Homo sapiens
aaacttagaggaaaa

SEQ ID NO: 4077888 - DNA, 17 bp, Homo sapiens
aaacttcattctcgtga

SEQ ID NO: 4077889 - DNA, 15 bp, Homo sapiens
aaacttcttaaatat

SEQ ID NO: 4077890 - DNA, 21 bp, Homo sapiens
aaacttcttaaatatctttta

SEQ ID NO: 4077891 - DNA, 13 bp, Homo sapiens
aaacttgaaaata

SEQ ID NO: 4077892 - DNA, 14 bp, Homo sapiens
aaacttgaaaatat

SEQ ID NO: 4077893 - DNA, 13 bp, Homo sapiens
aaacttggatact

SEQ ID NO: 4077894 - DNA, 19 bp, Homo sapiens
aaacttggatacttggatt

SEQ ID NO: 4077895 - DNA, 20 bp, Homo sapiens
aaacttggatacttggattt

SEQ ID NO: 4077896 - DNA, 15 bp, Homo sapiens
aaacttggattctct

SEQ ID NO: 4077897 - DNA, 14 bp, Homo sapiens
aaacttggcacttt

SEQ ID NO: 4077898 - DNA, 23 bp, Homo sapiens
aaactttatacattagtaaatgt

SEQ ID NO: 4077899 - DNA, 20 bp, Homo sapiens
aaactttcattccttcagat

SEQ ID NO: 4077900 - DNA, 18 bp, Homo sapiens
aaacttttttatatcttt

SEQ ID NO: 4077901 - DNA, 17 bp, Homo sapiens
aaagaaaaaaaaagaat

SEQ ID NO: 4077902 - DNA, 9 bp, Homo sapiens
aaagaaaag

SEQ ID NO: 4077903 - DNA, 22 bp, Homo sapiens
aaagaaaataggggatggtcca

SEQ ID NO: 4077904 - DNA, 15 bp, Homo sapiens
aaagaaagggaaaag

SEQ ID NO: 4077905 - DNA, 22 bp, Homo sapiens
acaatgttaaggaaactcttat

SEQ ID NO: 4077906 - DNA, 12 bp, Homo sapiens
acaatgttttct

SEQ ID NO: 4077907 - DNA, 16 bp, Homo sapiens
acaattcatgcctttc

SEQ ID NO: 4077908 - DNA, 14 bp, Homo sapiens
acaattccaaagga

SEQ ID NO: 4077909 - DNA, 18 bp, Homo sapiens
acaattccaaaggaatct

SEQ ID NO: 4077910 - DNA, 19 bp, Homo sapiens
acaattcctagataaaaag

SEQ ID NO: 4077911 - DNA, 22 bp, Homo sapiens
acaattgaagtaaactttttgt

SEQ ID NO: 4077912 - DNA, 22 bp, Homo sapiens
acaattgaggtaagttttttga

SEQ ID NO: 4077913 - DNA, 16 bp, Homo sapiens
acaattgtgtagcctt

SEQ ID NO: 4077914 - DNA, 18 bp, Homo sapiens
acaattttttttttcctc

SEQ ID NO: 4077915 - DNA, 22 bp, Homo sapiens
acacaaatgctcaaagaaatct

SEQ ID NO: 4077916 - DNA, 18 bp, Homo sapiens
acacaactatttttccaa

SEQ ID NO: 4077917 - DNA, 13 bp, Homo sapiens
acacaagtaaaca

SEQ ID NO: 4077918 - DNA, 14 bp, Homo sapiens
acacaagtaaacat

SEQ ID NO: 4077919 - DNA, 12 bp, Homo sapiens
acacaatatgta

SEQ ID NO: 4077920 - DNA, 22 bp, Homo sapiens
acacaatccctggggctgtgca

SEQ ID NO: 4077921 - DNA, 13 bp, Homo sapiens
acacacaaagcag

SEQ ID NO: 4077922 - DNA, 11 bp, Homo sapiens
acacacacaca

SEQ ID NO: 4077923 - DNA, 13 bp, Homo sapiens
acacacacacagg

SEQ ID NO: 4077924 - DNA, 16 bp, Homo sapiens
acacacacacgcacgc

SEQ ID NO: 4077925 - DNA, 14 bp, Homo sapiens
acacacacactccc

SEQ ID NO: 4077926 - DNA, 13 bp, Homo sapiens
acacacacagctg

SEQ ID NO: 4077927 - DNA, 12 bp, Homo sapiens
acacacacccag

SEQ ID NO: 4077928 - DNA, 13 bp, Homo sapiens
acacacactccct

SEQ ID NO: 4077929 - DNA, 16 bp, Homo sapiens
acacacactgcctccc

SEQ ID NO: 4077930 - DNA, 15 bp, Homo sapiens
acacacagatacaca

SEQ ID NO: 4077931 - DNA, 22 bp, Homo sapiens
acacacaggtggggactgggca

SEQ ID NO: 4077932 - DNA, 12 bp, Homo sapiens
acacaccaggct

SEQ ID NO: 4077933 - DNA, 18 bp, Homo sapiens
acacaccaggctgtgggc

SEQ ID NO: 4077934 - DNA, 23 bp, Homo sapiens
acacaccccacaccccagcccac

SEQ ID NO: 4077935 - DNA, 14 bp, Homo sapiens
acacacctccgaga

SEQ ID NO: 4077936 - DNA, 21 bp, Homo sapiens
acacacctccgagacagtcca

SEQ ID NO: 4077937 - DNA, 16 bp, Homo sapiens
acacacgcacgcacac

SEQ ID NO: 4077938 - DNA, 17 bp, Homo sapiens
acacacgcacgcacaca

SEQ ID NO: 4077939 - DNA, 14 bp, Homo sapiens
acacacgcaggaac

SEQ ID NO: 4077940 - DNA, 16 bp, Homo sapiens
acacacgcaggaactc

SEQ ID NO: 4077941 - DNA, 20 bp, Homo sapiens
acacacgcaggaactcccag

SEQ ID NO: 4077942 - DNA, 21 bp, Homo sapiens
acacacgcaggaactcccagc

SEQ ID NO: 4077943 - DNA, 19 bp, Homo sapiens
acacactcaggcctgtgcc

SEQ ID NO: 4077944 - DNA, 12 bp, Homo sapiens
acacactgaaag

SEQ ID NO: 4077945 - DNA, 14 bp, Homo sapiens
acacactgaaagct

SEQ ID NO: 4077946 - DNA, 13 bp, Homo sapiens
acacactgatgct

SEQ ID NO: 4077947 - DNA, 15 bp, Homo sapiens
acacactgcctccca

SEQ ID NO: 4077948 - DNA, 19 bp, Homo sapiens
acacactgtcatgcttcat

SEQ ID NO: 4077949 - DNA, 14 bp, Homo sapiens
acacagaaaccaat

SEQ ID NO: 4077950 - DNA, 13 bp, Homo sapiens
acacagaaacctt

SEQ ID NO: 4077951 - DNA, 19 bp, Homo sapiens
acacagaaacctttttaaa

SEQ ID NO: 4077952 - DNA, 20 bp, Homo sapiens
acacagaaatgctgctggcc

SEQ ID NO: 4077953 - DNA, 14 bp, Homo sapiens
acacagacccagga

SEQ ID NO: 4077954 - DNA, 17 bp, Homo sapiens
acacagacccctaggga

SEQ ID NO: 4077955 - DNA, 14 bp, Homo sapiens
acacagcagcagtt

SEQ ID NO: 4077956 - DNA, 15 bp, Homo sapiens
acacagcagtgagta

SEQ ID NO: 4077957 - DNA, 14 bp, Homo sapiens
acacagcatttcaa

SEQ ID NO: 4077958 - DNA, 20 bp, Homo sapiens
acacagcccctatagcactg

SEQ ID NO: 4077959 - DNA, 14 bp, Homo sapiens
acacagcctggact

SEQ ID NO: 4077960 - DNA, 14 bp, Homo sapiens
acacagctgcccta

SEQ ID NO: 4077961 - DNA, 19 bp, Homo sapiens
acacagctgccctagctga

SEQ ID NO: 4077962 - DNA, 13 bp, Homo sapiens
acacagctgggca

SEQ ID NO: 4077963 - DNA, 14 bp, Homo sapiens
acacagctgggcaa

SEQ ID NO: 4077964 - DNA, 11 bp, Homo sapiens
acacagctgtt

SEQ ID NO: 4077965 - DNA, 18 bp, Homo sapiens
acacagctgttcttctgt

SEQ ID NO: 4077966 - DNA, 24 bp, Homo sapiens
acacaggatcctattctcaccagg

SEQ ID NO: 4077967 - DNA, 11 bp, Homo sapiens
acacaggcagc

SEQ ID NO: 4077968 - DNA, 12 bp, Homo sapiens
acacaggcagct

SEQ ID NO: 4077969 - DNA, 13 bp, Homo sapiens
acacaggccctcc

SEQ ID NO: 4077970 - DNA, 12 bp, Homo sapiens
acacaggctgtc

SEQ ID NO: 4077971 - DNA, 13 bp, Homo sapiens
acacaggtgggga

SEQ ID NO: 4077972 - DNA, 18 bp, Homo sapiens
acacagtcaaaataattc

SEQ ID NO: 4077973 - DNA, 15 bp, Homo sapiens
acacagtcagcatgc

SEQ ID NO: 4077974 - DNA, 22 bp, Homo sapiens
acacagtgctgaccagacagcc

SEQ ID NO: 4077975 - DNA, 20 bp, Homo sapiens
acacagttgggacccaaaac

SEQ ID NO: 4077976 - DNA, 13 bp, Homo sapiens
acacataaacaat

SEQ ID NO: 4077977 - DNA, 22 bp, Homo sapiens
acacatataaacatcacacaca

SEQ ID NO: 4077978 - DNA, 13 bp, Homo sapiens
acacatcttccct

SEQ ID NO: 4077979 - DNA, 15 bp, Homo sapiens
acacatcttccctag

SEQ ID NO: 4077980 - DNA, 15 bp, Homo sapiens
acacatgggcagccc

SEQ ID NO: 4077981 - DNA, 23 bp, Homo sapiens
acacattagattttattttacta

SEQ ID NO: 4077982 - DNA, 18 bp, Homo sapiens
acacattatgtatcttag

SEQ ID NO: 4077983 - DNA, 20 bp, Homo sapiens
acacattggaatgccttgga

SEQ ID NO: 4077984 - DNA, 18 bp, Homo sapiens
acacatttcactgtctgt

SEQ ID NO: 4077985 - DNA, 12 bp, Homo sapiens
acacatttgtac

SEQ ID NO: 4077986 - DNA, 19 bp, Homo sapiens
acacatttttaaattgtta

SEQ ID NO: 4077987 - DNA, 21 bp, Homo sapiens
acaccaagcacagcagcctgg

SEQ ID NO: 4077988 - DNA, 15 bp, Homo sapiens
acaccaatcccaggg

SEQ ID NO: 4077989 - DNA, 22 bp, Homo sapiens
acaccaatcccagggctggctc

SEQ ID NO: 4077990 - DNA, 17 bp, Homo sapiens
acaccacagacacacac

SEQ ID NO: 4077991 - DNA, 18 bp, Homo sapiens
acaccacctcactcctgt

SEQ ID NO: 4077992 - DNA, 15 bp, Homo sapiens
acacccaccctgtgc

SEQ ID NO: 4077993 - DNA, 21 bp, Homo sapiens
acacccaccctgtgccatcac

SEQ ID NO: 4077994 - DNA, 16 bp, Homo sapiens
acacccaggcccatgc

SEQ ID NO: 4077995 - DNA, 12 bp, Homo sapiens
acacccagggaa

SEQ ID NO: 4077996 - DNA, 19 bp, Homo sapiens
acacccaggggaaggccct

SEQ ID NO: 4077997 - DNA, 23 bp, Homo sapiens
acacccaggggaaggccctgagg

SEQ ID NO: 4077998 - DNA, 13 bp, Homo sapiens
acaccccagccca

SEQ ID NO: 4077999 - DNA, 14 bp, Homo sapiens
acaccccagcccac

SEQ ID NO: 4078000 - DNA, 12 bp, Homo sapiens
acaccccaggcc

SEQ ID NO: 4078001 - DNA, 13 bp, Homo sapiens
acacccctacaca

SEQ ID NO: 4078002 - DNA, 17 bp, Homo sapiens
acacccctacacacacc

SEQ ID NO: 4078003 - DNA, 19 bp, Homo sapiens
acacccctacacacaccca

SEQ ID NO: 4078004 - DNA, 19 bp, Homo sapiens
acaccctcccccgccactc

SEQ ID NO: 4078005 - DNA, 14 bp, Homo sapiens
acaccctggcctga

SEQ ID NO: 4078006 - DNA, 15 bp, Homo sapiens
acacccttagaaaat

SEQ ID NO: 4078007 - DNA, 20 bp, Homo sapiens
acaccggctggcagggctgg

SEQ ID NO: 4078008 - DNA, 19 bp, Homo sapiens
acaccggggtggtgggaac

SEQ ID NO: 4078009 - DNA, 18 bp, Homo sapiens
acaccgttcattcaggca

SEQ ID NO: 4078010 - DNA, 12 bp, Homo sapiens
aattaacctggt

SEQ ID NO: 4078011 - DNA, 13 bp, Homo sapiens
aattaacctggtg

SEQ ID NO: 4078012 - DNA, 16 bp, Homo sapiens
aattaacctggtgctg

SEQ ID NO: 4078013 - DNA, 11 bp, Homo sapiens
aattaacttga

SEQ ID NO: 4078014 - DNA, 14 bp, Homo sapiens
aattaagaaggcaa

SEQ ID NO: 4078015 - DNA, 16 bp, Homo sapiens
aattaagaaggcaaaa

SEQ ID NO: 4078016 - DNA, 16 bp, Homo sapiens
aattaaggcataagaa

SEQ ID NO: 4078017 - DNA, 16 bp, Homo sapiens
aattaagtactatgta

SEQ ID NO: 4078018 - DNA, 13 bp, Homo sapiens
aattaagtagaac

SEQ ID NO: 4078019 - DNA, 14 bp, Homo sapiens
aattaagttatctt

SEQ ID NO: 4078020 - DNA, 23 bp, Homo sapiens
aattaataaaaaatggaaagaat

SEQ ID NO: 4078021 - DNA, 22 bp, Homo sapiens
aattaatagtttgtctatttta

SEQ ID NO: 4078022 - DNA, 21 bp, Homo sapiens
aattaatatccctacatgtat

SEQ ID NO: 4078023 - DNA, 18 bp, Homo sapiens
aattaatcatctggattt

SEQ ID NO: 4078024 - DNA, 18 bp, Homo sapiens
aattaatggcttcgttaa

SEQ ID NO: 4078025 - DNA, 14 bp, Homo sapiens
aattaatttgatta

SEQ ID NO: 4078026 - DNA, 15 bp, Homo sapiens
aattaatttgattaa

SEQ ID NO: 4078027 - DNA, 16 bp, Homo sapiens
aattaatttgattaac

SEQ ID NO: 4078028 - DNA, 12 bp, Homo sapiens
aattaattttac

SEQ ID NO: 4078029 - DNA, 24 bp, Homo sapiens
aattacatggaacttttctgtaat

SEQ ID NO: 4078030 - DNA, 19 bp, Homo sapiens
aattacgtttgttattcct

SEQ ID NO: 4078031 - DNA, 13 bp, Homo sapiens
aattactaatttt

SEQ ID NO: 4078032 - DNA, 15 bp, Homo sapiens
aattactaattttac

SEQ ID NO: 4078033 - DNA, 20 bp, Homo sapiens
aattagactgtgattcagaa

SEQ ID NO: 4078034 - DNA, 17 bp, Homo sapiens
aattagataaattgtag

SEQ ID NO: 4078035 - DNA, 16 bp, Homo sapiens
aattagctgtgtgaaa

SEQ ID NO: 4078036 - DNA, 17 bp, Homo sapiens
aattaggaagtgattat

SEQ ID NO: 4078037 - DNA, 20 bp, Homo sapiens
aattaggaataaataaaaat

SEQ ID NO: 4078038 - DNA, 23 bp, Homo sapiens
aattaggcaaggctatgtgatta

SEQ ID NO: 4078039 - DNA, 17 bp, Homo sapiens
aattaggggttaaagca

SEQ ID NO: 4078040 - DNA, 21 bp, Homo sapiens
aattagggtacatttataatt

SEQ ID NO: 4078041 - DNA, 17 bp, Homo sapiens
aattaggtttttcctta

SEQ ID NO: 4078042 - DNA, 17 bp, Homo sapiens
aattagtatttatttaa

SEQ ID NO: 4078043 - DNA, 14 bp, Homo sapiens
aattagtttccttt

SEQ ID NO: 4078044 - DNA, 15 bp, Homo sapiens
aattagtttcctttt

SEQ ID NO: 4078045 - DNA, 23 bp, Homo sapiens
aattagtttcctttttaatatgc

SEQ ID NO: 4078046 - DNA, 12 bp, Homo sapiens
aattatactaac

SEQ ID NO: 4078047 - DNA, 21 bp, Homo sapiens
aattatatctgtggtcttcaa

SEQ ID NO: 4078048 - DNA, 23 bp, Homo sapiens
aattatattttgttgctttctta

SEQ ID NO: 4078049 - DNA, 15 bp, Homo sapiens
aattatcggaagcag

SEQ ID NO: 4078050 - DNA, 20 bp, Homo sapiens
aattatcggaagcagtgcct

SEQ ID NO: 4078051 - DNA, 22 bp, Homo sapiens
aattatctatacatatctttat

SEQ ID NO: 4078052 - DNA, 15 bp, Homo sapiens
aattatgtatgttta

SEQ ID NO: 4078053 - DNA, 18 bp, Homo sapiens
aattatgtcgtaagtcac

SEQ ID NO: 4078054 - DNA, 20 bp, Homo sapiens
aattatgtgacattttacat

SEQ ID NO: 4078055 - DNA, 20 bp, Homo sapiens
aattatgttggtactttcca

SEQ ID NO: 4078056 - DNA, 19 bp, Homo sapiens
aattatgttttaaacacat

SEQ ID NO: 4078057 - DNA, 19 bp, Homo sapiens
aattattaactacatttat

SEQ ID NO: 4078058 - DNA, 11 bp, Homo sapiens
aattattattt

SEQ ID NO: 4078059 - DNA, 18 bp, Homo sapiens
aattattatttgtgtttt

SEQ ID NO: 4078060 - DNA, 13 bp, Homo sapiens
aattattgacact

SEQ ID NO: 4078061 - DNA, 19 bp, Homo sapiens
aattattgacactgaactt

SEQ ID NO: 4078062 - DNA, 19 bp, Homo sapiens
aattatttaaataaaatca

SEQ ID NO: 4078063 - DNA, 13 bp, Homo sapiens
aattatttgctaa

SEQ ID NO: 4078064 - DNA, 21 bp, Homo sapiens
aattattttaaaatatttaaa

SEQ ID NO: 4078065 - DNA, 20 bp, Homo sapiens
aattcaagaaaacaacttca

SEQ ID NO: 4078066 - DNA, 21 bp, Homo sapiens
aattcaatgtgaacactggca

SEQ ID NO: 4078067 - DNA, 22 bp, Homo sapiens
aattcaatgtgaacactggcac

SEQ ID NO: 4078068 - DNA, 19 bp, Homo sapiens
aattcaattgtaaattgaa

SEQ ID NO: 4078069 - DNA, 17 bp, Homo sapiens
aattcaattttaaagac

SEQ ID NO: 4078070 - DNA, 14 bp, Homo sapiens
aattcacctatgtt

SEQ ID NO: 4078071 - DNA, 21 bp, Homo sapiens
aattcacctatgttattttgt

SEQ ID NO: 4078072 - DNA, 23 bp, Homo sapiens
aattcacctatgttattttgtgt

SEQ ID NO: 4078073 - DNA, 14 bp, Homo sapiens
aattcagagtcctt

SEQ ID NO: 4078074 - DNA, 18 bp, Homo sapiens
aattcagattgtcttgca

SEQ ID NO: 4078075 - DNA, 14 bp, Homo sapiens
aattcagtttcata

SEQ ID NO: 4078076 - DNA, 20 bp, Homo sapiens
aattcagtttttgtatcttg

SEQ ID NO: 4078077 - DNA, 13 bp, Homo sapiens
aattcatattctg

SEQ ID NO: 4078078 - DNA, 18 bp, Homo sapiens
aattcatcccaactgtct

SEQ ID NO: 4078079 - DNA, 13 bp, Homo sapiens
aattcatgccttt

SEQ ID NO: 4078080 - DNA, 18 bp, Homo sapiens
aattcatgcctttcatag

SEQ ID NO: 4078081 - DNA, 19 bp, Homo sapiens
aattcatgcctttcatagt

SEQ ID NO: 4078082 - DNA, 17 bp, Homo sapiens
aattcattttcatcact

SEQ ID NO: 4078083 - DNA, 14 bp, Homo sapiens
aattccaaaggaat

SEQ ID NO: 4078084 - DNA, 20 bp, Homo sapiens
aattccacaccttttattga

SEQ ID NO: 4078085 - DNA, 15 bp, Homo sapiens
aattccattatctta

SEQ ID NO: 4078086 - DNA, 16 bp, Homo sapiens
aattccctctctcagc

SEQ ID NO: 4078087 - DNA, 22 bp, Homo sapiens
aattccctctctcagcacagcc

SEQ ID NO: 4078088 - DNA, 23 bp, Homo sapiens
aattccctctctcagcacagcct

SEQ ID NO: 4078089 - DNA, 13 bp, Homo sapiens
aattcctaacttt

SEQ ID NO: 4078090 - DNA, 10 bp, Homo sapiens
aattcctaca

SEQ ID NO: 4078091 - DNA, 22 bp, Homo sapiens
aattcctacaacttaatggaaa

SEQ ID NO: 4078092 - DNA, 19 bp, Homo sapiens
aattcctacagcactactg

SEQ ID NO: 4078093 - DNA, 19 bp, Homo sapiens
aattccttttctaactctc

SEQ ID NO: 4078094 - DNA, 22 bp, Homo sapiens
aattcgtgtgtttttttatgaa

SEQ ID NO: 4078095 - DNA, 19 bp, Homo sapiens
aattctaaatgaatgttta

SEQ ID NO: 4078096 - DNA, 14 bp, Homo sapiens
aattctacagtttc

SEQ ID NO: 4078097 - DNA, 23 bp, Homo sapiens
aattctaccaaggtcttcttaat

SEQ ID NO: 4078098 - DNA, 14 bp, Homo sapiens
aattctactttgag

SEQ ID NO: 4078099 - DNA, 21 bp, Homo sapiens
aattctatagagatagatatt

SEQ ID NO: 4078100 - DNA, 14 bp, Homo sapiens
aattctatgttaaa

SEQ ID NO: 4078101 - DNA, 17 bp, Homo sapiens
aattctatgttaaatac

SEQ ID NO: 4078102 - DNA, 23 bp, Homo sapiens
aattctatgttaaatactgtgca

SEQ ID NO: 4078103 - DNA, 19 bp, Homo sapiens
aattctcagaatctcaaat

SEQ ID NO: 4078104 - DNA, 13 bp, Homo sapiens
aattctcatttgt

SEQ ID NO: 4078105 - DNA, 21 bp, Homo sapiens
aattctcccctccctccagta

SEQ ID NO: 4078106 - DNA, 15 bp, Homo sapiens
aattctcttatccaa

SEQ ID NO: 4078107 - DNA, 15 bp, Homo sapiens
aattctgttaaaatc

SEQ ID NO: 4078108 - DNA, 18 bp, Homo sapiens
aattcttaaaaaattgaa

SEQ ID NO: 4078109 - DNA, 14 bp, Homo sapiens
aattcttaaaatat

SEQ ID NO: 4078110 - DNA, 21 bp, Homo sapiens
aattcttcagcgtaaaatggt

SEQ ID NO: 4078111 - DNA, 22 bp, Homo sapiens
aattcttctgcaacatttgaca

SEQ ID NO: 4078112 - DNA, 16 bp, Homo sapiens
aattcttgaaggaaaa

SEQ ID NO: 4078113 - DNA, 23 bp, Homo sapiens
acaaagttactaggtaacttcat

SEQ ID NO: 4078114 - DNA, 15 bp, Homo sapiens
acaaatactcttagg

SEQ ID NO: 4078115 - DNA, 17 bp, Homo sapiens
acaaatactcttaggaa

SEQ ID NO: 4078116 - DNA, 13 bp, Homo sapiens
acaaatagaaaat

SEQ ID NO: 4078117 - DNA, 16 bp, Homo sapiens
acaaatagaaaatggt

SEQ ID NO: 4078118 - DNA, 20 bp, Homo sapiens
acaaatatttctagacactt

SEQ ID NO: 4078119 - DNA, 17 bp, Homo sapiens
acaaatcagttagtttt

SEQ ID NO: 4078120 - DNA, 22 bp, Homo sapiens
acaaatctgtataaatgtctat

SEQ ID NO: 4078121 - DNA, 14 bp, Homo sapiens
acaaatctgtctgc

SEQ ID NO: 4078122 - DNA, 19 bp, Homo sapiens
acaaatgccttaaaatgga

SEQ ID NO: 4078123 - DNA, 21 bp, Homo sapiens
acaaatgctcaaagaaatcta

SEQ ID NO: 4078124 - DNA, 16 bp, Homo sapiens
acaaatgtattttgaa

SEQ ID NO: 4078125 - DNA, 22 bp, Homo sapiens
acaaattagaaaatgttattta

SEQ ID NO: 4078126 - DNA, 23 bp, Homo sapiens
acaacaaaggcaagttaagagaa

SEQ ID NO: 4078127 - DNA, 11 bp, Homo sapiens
acaacagaagt

SEQ ID NO: 4078128 - DNA, 15 bp, Homo sapiens
acaacagctgaagca

SEQ ID NO: 4078129 - DNA, 12 bp, Homo sapiens
acaaccagagcc

SEQ ID NO: 4078130 - DNA, 13 bp, Homo sapiens
acaaccagagccc

SEQ ID NO: 4078131 - DNA, 14 bp, Homo sapiens
acaaccagagcccc

SEQ ID NO: 4078132 - DNA, 13 bp, Homo sapiens
acaaccgttggaa

SEQ ID NO: 4078133 - DNA, 15 bp, Homo sapiens
acaacctgaaattta

SEQ ID NO: 4078134 - DNA, 15 bp, Homo sapiens
acaactaaaattagg

SEQ ID NO: 4078135 - DNA, 16 bp, Homo sapiens
acaactaggcttcagc

SEQ ID NO: 4078136 - DNA, 18 bp, Homo sapiens
acaactgcaataacttct

SEQ ID NO: 4078137 - DNA, 20 bp, Homo sapiens
acaactgcaataacttctga

SEQ ID NO: 4078138 - DNA, 18 bp, Homo sapiens
acaactgcacatgaaagt

SEQ ID NO: 4078139 - DNA, 11 bp, Homo sapiens
acaactgtgac

SEQ ID NO: 4078140 - DNA, 14 bp, Homo sapiens
acaacttaaataat

SEQ ID NO: 4078141 - DNA, 14 bp, Homo sapiens
acaacttagtgtaa

SEQ ID NO: 4078142 - DNA, 18 bp, Homo sapiens
acaacttcccagtgaatt

SEQ ID NO: 4078143 - DNA, 23 bp, Homo sapiens
acaagaaatccctgtttaatatt

SEQ ID NO: 4078144 - DNA, 14 bp, Homo sapiens
acaagaagaaatat

SEQ ID NO: 4078145 - DNA, 20 bp, Homo sapiens
acaagaagaaatatgaaatt

SEQ ID NO: 4078146 - DNA, 20 bp, Homo sapiens
acaagaagccacagacctag

SEQ ID NO: 4078147 - DNA, 14 bp, Homo sapiens
acaagaagtttatt

SEQ ID NO: 4078148 - DNA, 19 bp, Homo sapiens
acaagaatgcattccctga

SEQ ID NO: 4078149 - DNA, 15 bp, Homo sapiens
acaagacccccagca

SEQ ID NO: 4078150 - DNA, 13 bp, Homo sapiens
acaagactgttgt

SEQ ID NO: 4078151 - DNA, 20 bp, Homo sapiens
acaagagcccagcagggcct

SEQ ID NO: 4078152 - DNA, 22 bp, Homo sapiens
acaagagtggagagaagctctt

SEQ ID NO: 4078153 - DNA, 15 bp, Homo sapiens
acaagatattgtaca

SEQ ID NO: 4078154 - DNA, 16 bp, Homo sapiens
acaagatattgtacat

SEQ ID NO: 4078155 - DNA, 19 bp, Homo sapiens
acaagatattgtacataaa

SEQ ID NO: 4078156 - DNA, 22 bp, Homo sapiens
acaagatattgtacataaaaga

SEQ ID NO: 4078157 - DNA, 14 bp, Homo sapiens
acaagatccatttg

SEQ ID NO: 4078158 - DNA, 15 bp, Homo sapiens
acaagatccatttgc

SEQ ID NO: 4078159 - DNA, 19 bp, Homo sapiens
acaagatccatttgccttt

SEQ ID NO: 4078160 - DNA, 20 bp, Homo sapiens
acaagatccatttgcctttc

SEQ ID NO: 4078161 - DNA, 16 bp, Homo sapiens
acaagatctttcagga

SEQ ID NO: 4078162 - DNA, 20 bp, Homo sapiens
acaagatctttcaggaaaga

SEQ ID NO: 4078163 - DNA, 14 bp, Homo sapiens
acaagatggtccat

SEQ ID NO: 4078164 - DNA, 11 bp, Homo sapiens
acaagcagagg

SEQ ID NO: 4078165 - DNA, 22 bp, Homo sapiens
acaagcagagtgcacagctgtc

SEQ ID NO: 4078166 - DNA, 12 bp, Homo sapiens
acaagcaggcac

SEQ ID NO: 4078167 - DNA, 20 bp, Homo sapiens
acaagccaaaagtccctccc

SEQ ID NO: 4078168 - DNA, 22 bp, Homo sapiens
acaagccaaaagtccctccctg

SEQ ID NO: 4078169 - DNA, 22 bp, Homo sapiens
acaagctgttgaccaggcacct

SEQ ID NO: 4078170 - DNA, 13 bp, Homo sapiens
acaaggaataaat

SEQ ID NO: 4078171 - DNA, 19 bp, Homo sapiens
acaaggaatgcctgtgcca

SEQ ID NO: 4078172 - DNA, 17 bp, Homo sapiens
acaaggatagatgctgg

SEQ ID NO: 4078173 - DNA, 17 bp, Homo sapiens
acaaggcttgctgcaga

SEQ ID NO: 4078174 - DNA, 23 bp, Homo sapiens
acaagggaaaataaaaaaagaaa

SEQ ID NO: 4078175 - DNA, 20 bp, Homo sapiens
acaaggtccactccctgctc

SEQ ID NO: 4078176 - DNA, 19 bp, Homo sapiens
acaaggttccctctgagaa

SEQ ID NO: 4078177 - DNA, 17 bp, Homo sapiens
acaaggttggcacccca

SEQ ID NO: 4078178 - DNA, 19 bp, Homo sapiens
acaaggttggcaccccagc

SEQ ID NO: 4078179 - DNA, 19 bp, Homo sapiens
acaagtatacttatatttc

SEQ ID NO: 4078180 - DNA, 22 bp, Homo sapiens
acaagtgaagaacactactgct

SEQ ID NO: 4078181 - DNA, 12 bp, Homo sapiens
acaagtgccact

SEQ ID NO: 4078182 - DNA, 15 bp, Homo sapiens
acaagttaaataaat

SEQ ID NO: 4078183 - DNA, 22 bp, Homo sapiens
acaagttgcgacggagagaaaa

SEQ ID NO: 4078184 - DNA, 10 bp, Homo sapiens
acaataaact

SEQ ID NO: 4078185 - DNA, 15 bp, Homo sapiens
acaataaatgaagat

SEQ ID NO: 4078186 - DNA, 16 bp, Homo sapiens
acaataaatgtattca

SEQ ID NO: 4078187 - DNA, 20 bp, Homo sapiens
acaataaatgtattcaaata

SEQ ID NO: 4078188 - DNA, 22 bp, Homo sapiens
acaataactactgtgttcctgg

SEQ ID NO: 4078189 - DNA, 16 bp, Homo sapiens
acaataagcaaaaaca

SEQ ID NO: 4078190 - DNA, 21 bp, Homo sapiens
acaataatattgttgtataat

SEQ ID NO: 4078191 - DNA, 21 bp, Homo sapiens
acaataattctggagatactg

SEQ ID NO: 4078192 - DNA, 15 bp, Homo sapiens
acaatacaaatggat

SEQ ID NO: 4078193 - DNA, 14 bp, Homo sapiens
acaatacagataac

SEQ ID NO: 4078194 - DNA, 21 bp, Homo sapiens
acaatatgaatacagggcatg

SEQ ID NO: 4078195 - DNA, 19 bp, Homo sapiens
acaatattatgaaatttca

SEQ ID NO: 4078196 - DNA, 19 bp, Homo sapiens
acaatcaaaggaaaatagt

SEQ ID NO: 4078197 - DNA, 18 bp, Homo sapiens
acaatcatgaaatatgca

SEQ ID NO: 4078198 - DNA, 13 bp, Homo sapiens
acaatcattgctg

SEQ ID NO: 4078199 - DNA, 14 bp, Homo sapiens
acaatcattgctga

SEQ ID NO: 4078200 - DNA, 21 bp, Homo sapiens
acaatcattgctgaaaatggt

SEQ ID NO: 4078201 - DNA, 22 bp, Homo sapiens
acaatcattgctgaaaatggta

SEQ ID NO: 4078202 - DNA, 19 bp, Homo sapiens
acaatccctggggctgtgc

SEQ ID NO: 4078203 - DNA, 24 bp, Homo sapiens
acaatgaacatccctttttcaatg

SEQ ID NO: 4078204 - DNA, 17 bp, Homo sapiens
acaatgaagaagtttct

SEQ ID NO: 4078205 - DNA, 19 bp, Homo sapiens
acaatgatattgacactgt

SEQ ID NO: 4078206 - DNA, 19 bp, Homo sapiens
acaatgatgattaaacacc

SEQ ID NO: 4078207 - DNA, 13 bp, Homo sapiens
acaatgcagcaag

SEQ ID NO: 4078208 - DNA, 22 bp, Homo sapiens
acaatgcagcaaggccctgctg

SEQ ID NO: 4078209 - DNA, 22 bp, Homo sapiens
acaatgcagttctgagcaccgt

SEQ ID NO: 4078210 - DNA, 18 bp, Homo sapiens
acaatggaccctttttgt

SEQ ID NO: 4078211 - DNA, 18 bp, Homo sapiens
acaatgtcagtatttcag

SEQ ID NO: 4078212 - DNA, 22 bp, Homo sapiens
acaatgtcgagtatattattat

SEQ ID NO: 4078213 - DNA, 23 bp, Homo sapiens
acaatgtctggttagttaaaagc

SEQ ID NO: 4078214 - DNA, 17 bp, Homo sapiens
acaatgtgaactttatt

SEQ ID NO: 4078215 - DNA, 21 bp, Homo sapiens
acaatgtggagtctccctctg

SEQ ID NO: 4078216 - DNA, 20 bp, Homo sapiens
acagagaggagaaacacatc

SEQ ID NO: 4078217 - DNA, 14 bp, Homo sapiens
acagagcagctccc

SEQ ID NO: 4078218 - DNA, 15 bp, Homo sapiens
acagagcagctcccc

SEQ ID NO: 4078219 - DNA, 18 bp, Homo sapiens
acagagcagctccccagg

SEQ ID NO: 4078220 - DNA, 24 bp, Homo sapiens
acagagcagctccccaggagctca

SEQ ID NO: 4078221 - DNA, 16 bp, Homo sapiens
acagagcagttgagag

SEQ ID NO: 4078222 - DNA, 17 bp, Homo sapiens
acagagcatacaacaga

SEQ ID NO: 4078223 - DNA, 16 bp, Homo sapiens
acagagcgacagagca

SEQ ID NO: 4078224 - DNA, 14 bp, Homo sapiens
acagagctctgggt

SEQ ID NO: 4078225 - DNA, 21 bp, Homo sapiens
acagaggaaagggctggctcc

SEQ ID NO: 4078226 - DNA, 15 bp, Homo sapiens
acagaggagtgcagc

SEQ ID NO: 4078227 - DNA, 17 bp, Homo sapiens
acagaggccccagcctc

SEQ ID NO: 4078228 - DNA, 13 bp, Homo sapiens
acagaggcctgcc

SEQ ID NO: 4078229 - DNA, 14 bp, Homo sapiens
acagaggcctgccc

SEQ ID NO: 4078230 - DNA, 21 bp, Homo sapiens
acagaggctgcacccctgggc

SEQ ID NO: 4078231 - DNA, 23 bp, Homo sapiens
acagaggtcaggaagcaggggtg

SEQ ID NO: 4078232 - DNA, 17 bp, Homo sapiens
acagagtgagccagtga

SEQ ID NO: 4078233 - DNA, 18 bp, Homo sapiens
acagagtggtctttctgg

SEQ ID NO: 4078234 - DNA, 19 bp, Homo sapiens
acagagtggtctttctgga

SEQ ID NO: 4078235 - DNA, 24 bp, Homo sapiens
acagagtggtctttctggagaggt

SEQ ID NO: 4078236 - DNA, 14 bp, Homo sapiens
acagagttcacagg

SEQ ID NO: 4078237 - DNA, 15 bp, Homo sapiens
acagagttcacagga

SEQ ID NO: 4078238 - DNA, 16 bp, Homo sapiens
acagagttcacaggag

SEQ ID NO: 4078239 - DNA, 21 bp, Homo sapiens
acagagttcacaggaggccag

SEQ ID NO: 4078240 - DNA, 16 bp, Homo sapiens
acagagttgatttttt

SEQ ID NO: 4078241 - DNA, 19 bp, Homo sapiens
acagataagcaagagagat

SEQ ID NO: 4078242 - DNA, 22 bp, Homo sapiens
acagataataatgggtttcttt

SEQ ID NO: 4078243 - DNA, 15 bp, Homo sapiens
acagatacacacaca

SEQ ID NO: 4078244 - DNA, 21 bp, Homo sapiens
acagatagtatctagcaatca

SEQ ID NO: 4078245 - DNA, 14 bp, Homo sapiens
acagatataaatgg

SEQ ID NO: 4078246 - DNA, 22 bp, Homo sapiens
acagatcccatccatcagctcc

SEQ ID NO: 4078247 - DNA, 18 bp, Homo sapiens
acagatcctttttccatc

SEQ ID NO: 4078248 - DNA, 20 bp, Homo sapiens
acagatcctttttccatcat

SEQ ID NO: 4078249 - DNA, 23 bp, Homo sapiens
acagatcgaaccgttttgaagct

SEQ ID NO: 4078250 - DNA, 16 bp, Homo sapiens
acagatctggaacctc

SEQ ID NO: 4078251 - DNA, 15 bp, Homo sapiens
acagatgaaaatttg

SEQ ID NO: 4078252 - DNA, 16 bp, Homo sapiens
acagatgaaaatttga

SEQ ID NO: 4078253 - DNA, 18 bp, Homo sapiens
acagatgacccctgccca

SEQ ID NO: 4078254 - DNA, 19 bp, Homo sapiens
acagatgatgagaatttct

SEQ ID NO: 4078255 - DNA, 17 bp, Homo sapiens
acagatgcaatgtgcta

SEQ ID NO: 4078256 - DNA, 14 bp, Homo sapiens
acagatgccccaga

SEQ ID NO: 4078257 - DNA, 17 bp, Homo sapiens
acagatgccccagagct

SEQ ID NO: 4078258 - DNA, 17 bp, Homo sapiens
acagatgctaataaact

SEQ ID NO: 4078259 - DNA, 22 bp, Homo sapiens
acagatggcactttgaaggggc

SEQ ID NO: 4078260 - DNA, 15 bp, Homo sapiens
acagattgcctcctt

SEQ ID NO: 4078261 - DNA, 16 bp, Homo sapiens
acagattgcctcctta

SEQ ID NO: 4078262 - DNA, 20 bp, Homo sapiens
acagatttaatacagtttat

SEQ ID NO: 4078263 - DNA, 17 bp, Homo sapiens
acagatttttacaaatg

SEQ ID NO: 4078264 - DNA, 14 bp, Homo sapiens
acagcaaccccagg

SEQ ID NO: 4078265 - DNA, 13 bp, Homo sapiens
acagcaagaaata

SEQ ID NO: 4078266 - DNA, 19 bp, Homo sapiens
acagcaagtacagcggctc

SEQ ID NO: 4078267 - DNA, 15 bp, Homo sapiens
acagcaattcctcag

SEQ ID NO: 4078268 - DNA, 16 bp, Homo sapiens
acagcactactgggtg

SEQ ID NO: 4078269 - DNA, 22 bp, Homo sapiens
acagcactactgggtgtcattt

SEQ ID NO: 4078270 - DNA, 12 bp, Homo sapiens
acagcagaagcc

SEQ ID NO: 4078271 - DNA, 15 bp, Homo sapiens
acagcagcctccaac

SEQ ID NO: 4078272 - DNA, 22 bp, Homo sapiens
acagcagcctggggctggcctc

SEQ ID NO: 4078273 - DNA, 14 bp, Homo sapiens
acagcagctgaaca

SEQ ID NO: 4078274 - DNA, 16 bp, Homo sapiens
acagcaggcagcgcca

SEQ ID NO: 4078275 - DNA, 18 bp, Homo sapiens
acagcaggtcctccatcc

SEQ ID NO: 4078276 - DNA, 18 bp, Homo sapiens
acagcagtgatctcaggg

SEQ ID NO: 4078277 - DNA, 21 bp, Homo sapiens
acagcagtgatctcagggcag

SEQ ID NO: 4078278 - DNA, 19 bp, Homo sapiens
acagcagtgttccccatct

SEQ ID NO: 4078279 - DNA, 20 bp, Homo sapiens
acagcatcattttgcattca

SEQ ID NO: 4078280 - DNA, 20 bp, Homo sapiens
acagcatcgggagcacccag

SEQ ID NO: 4078281 - DNA, 15 bp, Homo sapiens
acagcattgctttct

SEQ ID NO: 4078282 - DNA, 23 bp, Homo sapiens
acagccaaatgcatggtgcagtt

SEQ ID NO: 4078283 - DNA, 20 bp, Homo sapiens
acagccaacacgcacctgcc

SEQ ID NO: 4078284 - DNA, 24 bp, Homo sapiens
acagccaacacgcacctgcctcag

SEQ ID NO: 4078285 - DNA, 17 bp, Homo sapiens
acagccaactagcccct

SEQ ID NO: 4078286 - DNA, 18 bp, Homo sapiens
acagccaactagcccctg

SEQ ID NO: 4078287 - DNA, 15 bp, Homo sapiens
acagccaagtgccaa

SEQ ID NO: 4078288 - DNA, 12 bp, Homo sapiens
acagccagagct

SEQ ID NO: 4078289 - DNA, 14 bp, Homo sapiens
acagccagagctgg

SEQ ID NO: 4078290 - DNA, 15 bp, Homo sapiens
acagccagaggaggg

SEQ ID NO: 4078291 - DNA, 20 bp, Homo sapiens
acagccataggccctttcag

SEQ ID NO: 4078292 - DNA, 16 bp, Homo sapiens
acagccatgtccaagt

SEQ ID NO: 4078293 - DNA, 21 bp, Homo sapiens
acagccattgcggccccagga

SEQ ID NO: 4078294 - DNA, 13 bp, Homo sapiens
acagcccagagcc

SEQ ID NO: 4078295 - DNA, 12 bp, Homo sapiens
acagccccaccc

SEQ ID NO: 4078296 - DNA, 15 bp, Homo sapiens
acagccccaccctgg

SEQ ID NO: 4078297 - DNA, 23 bp, Homo sapiens
acagcccctatagcactgagctc

SEQ ID NO: 4078298 - DNA, 18 bp, Homo sapiens
acagcccctccctcctct

SEQ ID NO: 4078299 - DNA, 18 bp, Homo sapiens
acagccctccactccagc

SEQ ID NO: 4078300 - DNA, 14 bp, Homo sapiens
acagccgctccaga

SEQ ID NO: 4078301 - DNA, 19 bp, Homo sapiens
acagccgtcagccaaatgt

SEQ ID NO: 4078302 - DNA, 12 bp, Homo sapiens
acagcctagggt

SEQ ID NO: 4078303 - DNA, 12 bp, Homo sapiens
acagcctccagg

SEQ ID NO: 4078304 - DNA, 13 bp, Homo sapiens
acagcctccaggg

SEQ ID NO: 4078305 - DNA, 15 bp, Homo sapiens
acagcctccagggcc

SEQ ID NO: 4078306 - DNA, 16 bp, Homo sapiens
acagcctccccaccca

SEQ ID NO: 4078307 - DNA, 15 bp, Homo sapiens
acagcctcctctgtc

SEQ ID NO: 4078308 - DNA, 20 bp, Homo sapiens
acagcctcctctgtctgccc

SEQ ID NO: 4078309 - DNA, 14 bp, Homo sapiens
acagcctggcacag

SEQ ID NO: 4078310 - DNA, 19 bp, Homo sapiens
acagccttagctgccagtg

SEQ ID NO: 4078311 - DNA, 15 bp, Homo sapiens
acagcgcccctgctg

SEQ ID NO: 4078312 - DNA, 16 bp, Homo sapiens
acagcgcccctgctgt

SEQ ID NO: 4078313 - DNA, 17 bp, Homo sapiens
acagcgcccctgctgtc

SEQ ID NO: 4078314 - DNA, 18 bp, Homo sapiens
acagcggagtctgtcctg

SEQ ID NO: 4078315 - DNA, 16 bp, Homo sapiens
acagcggcccctgcat

SEQ ID NO: 4078316 - DNA, 22 bp, Homo sapiens
acagctaatcagcattctcact

SEQ ID NO: 4078317 - DNA, 23 bp, Homo sapiens
acagctactctccccacgagggc

SEQ ID NO: 4078318 - DNA, 15 bp, Homo sapiens
acagctagtgaagac

SEQ ID NO: 4078319 - DNA, 22 bp, Homo sapiens
acacctaaaggtgtatttaaac

SEQ ID NO: 4078320 - DNA, 21 bp, Homo sapiens
acacctactctatcagagaaa

SEQ ID NO: 4078321 - DNA, 21 bp, Homo sapiens
acacctagacaaacaagggag

SEQ ID NO: 4078322 - DNA, 11 bp, Homo sapiens
acacctgacac

SEQ ID NO: 4078323 - DNA, 13 bp, Homo sapiens
acacctgccctgc

SEQ ID NO: 4078324 - DNA, 23 bp, Homo sapiens
acacctggctgaggttcctctgc

SEQ ID NO: 4078325 - DNA, 16 bp, Homo sapiens
acacctgttcacagaa

SEQ ID NO: 4078326 - DNA, 14 bp, Homo sapiens
acaccttccagctc

SEQ ID NO: 4078327 - DNA, 15 bp, Homo sapiens
acaccttttaactca

SEQ ID NO: 4078328 - DNA, 21 bp, Homo sapiens
acacgcacaaacacacacact

SEQ ID NO: 4078329 - DNA, 13 bp, Homo sapiens
acacgcacctgcc

SEQ ID NO: 4078330 - DNA, 16 bp, Homo sapiens
acacgcacctgcctca

SEQ ID NO: 4078331 - DNA, 17 bp, Homo sapiens
acacgcacctgcctcag

SEQ ID NO: 4078332 - DNA, 13 bp, Homo sapiens
acacgcacgcaca

SEQ ID NO: 4078333 - DNA, 18 bp, Homo sapiens
acacgcacgcacacacac

SEQ ID NO: 4078334 - DNA, 23 bp, Homo sapiens
acacgcgggcgcgatcccacaca

SEQ ID NO: 4078335 - DNA, 22 bp, Homo sapiens
acacgctcgcgggcagcgggcc

SEQ ID NO: 4078336 - DNA, 21 bp, Homo sapiens
acacggactcccgggccacgc

SEQ ID NO: 4078337 - DNA, 14 bp, Homo sapiens
acacggccacatca

SEQ ID NO: 4078338 - DNA, 20 bp, Homo sapiens
acacggccacatcaaagagg

SEQ ID NO: 4078339 - DNA, 14 bp, Homo sapiens
acactaaccaaatc

SEQ ID NO: 4078340 - DNA, 15 bp, Homo sapiens
acactaacctgggtt

SEQ ID NO: 4078341 - DNA, 17 bp, Homo sapiens
acactacagagcagctc

SEQ ID NO: 4078342 - DNA, 14 bp, Homo sapiens
acactaccccatat

SEQ ID NO: 4078343 - DNA, 19 bp, Homo sapiens
acactactgctaaatcctc

SEQ ID NO: 4078344 - DNA, 18 bp, Homo sapiens
acactagttttgtgccag

SEQ ID NO: 4078345 - DNA, 19 bp, Homo sapiens
acactagttttgtgccagc

SEQ ID NO: 4078346 - DNA, 21 bp, Homo sapiens
acactatggggtggggtgggt

SEQ ID NO: 4078347 - DNA, 23 bp, Homo sapiens
acactatggggtggggtgggtgt

SEQ ID NO: 4078348 - DNA, 19 bp, Homo sapiens
acactatggtatttgagtg

SEQ ID NO: 4078349 - DNA, 13 bp, Homo sapiens
acactcagcacaa

SEQ ID NO: 4078350 - DNA, 21 bp, Homo sapiens
acactcaggcctgtgcccact

SEQ ID NO: 4078351 - DNA, 17 bp, Homo sapiens
acactccaggcctctag

SEQ ID NO: 4078352 - DNA, 13 bp, Homo sapiens
acactccagtgcc

SEQ ID NO: 4078353 - DNA, 19 bp, Homo sapiens
acactccagtgccagcaat

SEQ ID NO: 4078354 - DNA, 13 bp, Homo sapiens
acactccagtggc

SEQ ID NO: 4078355 - DNA, 21 bp, Homo sapiens
acactcccaaggttggagccc

SEQ ID NO: 4078356 - DNA, 16 bp, Homo sapiens
acactccccgccttag

SEQ ID NO: 4078357 - DNA, 19 bp, Homo sapiens
acactccccgccttagagc

SEQ ID NO: 4078358 - DNA, 12 bp, Homo sapiens
acactgaaaatg

SEQ ID NO: 4078359 - DNA, 12 bp, Homo sapiens
acactgaactta

SEQ ID NO: 4078360 - DNA, 17 bp, Homo sapiens
acactgaagtcagttct

SEQ ID NO: 4078361 - DNA, 19 bp, Homo sapiens
acactgaagttaacagaga

SEQ ID NO: 4078362 - DNA, 15 bp, Homo sapiens
acactgagcaagatc

SEQ ID NO: 4078363 - DNA, 19 bp, Homo sapiens
acactgagcaagatcttgt

SEQ ID NO: 4078364 - DNA, 21 bp, Homo sapiens
acactgagcaagatcttgtct

SEQ ID NO: 4078365 - DNA, 11 bp, Homo sapiens
acactgagccc

SEQ ID NO: 4078366 - DNA, 17 bp, Homo sapiens
acactgaggcagccttg

SEQ ID NO: 4078367 - DNA, 22 bp, Homo sapiens
acactgcactcttaagcttccg

SEQ ID NO: 4078368 - DNA, 17 bp, Homo sapiens
acactgcagtttcctgg

SEQ ID NO: 4078369 - DNA, 15 bp, Homo sapiens
acactgctcttaaga

SEQ ID NO: 4078370 - DNA, 19 bp, Homo sapiens
acactgggtggtggcctgg

SEQ ID NO: 4078371 - DNA, 15 bp, Homo sapiens
acactggtctgctgt

SEQ ID NO: 4078372 - DNA, 20 bp, Homo sapiens
acactggtgggcagctgagg

SEQ ID NO: 4078373 - DNA, 21 bp, Homo sapiens
acactggtgggcagctgagga

SEQ ID NO: 4078374 - DNA, 16 bp, Homo sapiens
acactggtgtgacctg

SEQ ID NO: 4078375 - DNA, 22 bp, Homo sapiens
acactggtttggtcagttacaa

SEQ ID NO: 4078376 - DNA, 21 bp, Homo sapiens
acactgtgacatctctattcc

SEQ ID NO: 4078377 - DNA, 22 bp, Homo sapiens
acactgttactccacagcggag

SEQ ID NO: 4078378 - DNA, 14 bp, Homo sapiens
acactgttctgaaa

SEQ ID NO: 4078379 - DNA, 13 bp, Homo sapiens
acacttaacagat

SEQ ID NO: 4078380 - DNA, 16 bp, Homo sapiens
acacttaacagatgca

SEQ ID NO: 4078381 - DNA, 20 bp, Homo sapiens
acacttcagagagctggtag

SEQ ID NO: 4078382 - DNA, 21 bp, Homo sapiens
acacttgagaggatgaatgta

SEQ ID NO: 4078383 - DNA, 16 bp, Homo sapiens
acacttgctcccaacc

SEQ ID NO: 4078384 - DNA, 13 bp, Homo sapiens
acacttgctgggg

SEQ ID NO: 4078385 - DNA, 18 bp, Homo sapiens
acacttgtgtgtgggctg

SEQ ID NO: 4078386 - DNA, 22 bp, Homo sapiens
acacttgtgtgtgggctgtgag

SEQ ID NO: 4078387 - DNA, 23 bp, Homo sapiens
acacttgtgtgtgggctgtgagt

SEQ ID NO: 4078388 - DNA, 17 bp, Homo sapiens
acactttgcactgatat

SEQ ID NO: 4078389 - DNA, 13 bp, Homo sapiens
acagaaaaagcat

SEQ ID NO: 4078390 - DNA, 22 bp, Homo sapiens
acagaaaaagcatgatgggaaa

SEQ ID NO: 4078391 - DNA, 13 bp, Homo sapiens
acagaaaagcata

SEQ ID NO: 4078392 - DNA, 15 bp, Homo sapiens
acagaaaccttttta

SEQ ID NO: 4078393 - DNA, 12 bp, Homo sapiens
acagaacagctt

SEQ ID NO: 4078394 - DNA, 13 bp, Homo sapiens
acagaacagcttc

SEQ ID NO: 4078395 - DNA, 20 bp, Homo sapiens
acagaacagcttcaggttat

SEQ ID NO: 4078396 - DNA, 21 bp, Homo sapiens
acagaacatatgttgcaagac

SEQ ID NO: 4078397 - DNA, 17 bp, Homo sapiens
acagaaccttcaaccca

SEQ ID NO: 4078398 - DNA, 17 bp, Homo sapiens
acagaacttcagaaaga

SEQ ID NO: 4078399 - DNA, 20 bp, Homo sapiens
acagaacttgaatgtgtcag

SEQ ID NO: 4078400 - DNA, 19 bp, Homo sapiens
acagaaggaatctgtgcag

SEQ ID NO: 4078401 - DNA, 18 bp, Homo sapiens
acagaaggctcctgcccc

SEQ ID NO: 4078402 - DNA, 18 bp, Homo sapiens
acagaagtcatgaagccc

SEQ ID NO: 4078403 - DNA, 11 bp, Homo sapiens
acagaataatc

SEQ ID NO: 4078404 - DNA, 23 bp, Homo sapiens
acagaataatccagtattgctga

SEQ ID NO: 4078405 - DNA, 22 bp, Homo sapiens
acagaatatttttatatttcct

SEQ ID NO: 4078406 - DNA, 22 bp, Homo sapiens
acagacaaaacaatccccatca

SEQ ID NO: 4078407 - DNA, 15 bp, Homo sapiens
acagacacaatatgt

SEQ ID NO: 4078408 - DNA, 19 bp, Homo sapiens
acagacacaatatgtatgc

SEQ ID NO: 4078409 - DNA, 23 bp, Homo sapiens
acagacacaatatgtatgctttt

SEQ ID NO: 4078410 - DNA, 14 bp, Homo sapiens
acagacacacacac

SEQ ID NO: 4078411 - DNA, 17 bp, Homo sapiens
acagacacacacacgca

SEQ ID NO: 4078412 - DNA, 21 bp, Homo sapiens
acagacacgctcgcgggcagc

SEQ ID NO: 4078413 - DNA, 16 bp, Homo sapiens
acagacagacacacac

SEQ ID NO: 4078414 - DNA, 13 bp, Homo sapiens
acagacccaggac

SEQ ID NO: 4078415 - DNA, 16 bp, Homo sapiens
acagacctcagtttta

SEQ ID NO: 4078416 - DNA, 14 bp, Homo sapiens
acagactccatctc

SEQ ID NO: 4078417 - DNA, 15 bp, Homo sapiens
acagactgttaatta

SEQ ID NO: 4078418 - DNA, 16 bp, Homo sapiens
acagacttctccagac

SEQ ID NO: 4078419 - DNA, 17 bp, Homo sapiens
acagacttgagaacttg

SEQ ID NO: 4078420 - DNA, 20 bp, Homo sapiens
acagagagacagacttgaga

SEQ ID NO: 4078421 - DNA, 18 bp, Homo sapiens
acagagaggagaaacaca

SEQ ID NO: 4078422 - DNA, 16 bp, Homo sapiens
acagctagtgaagacc

SEQ ID NO: 4078423 - DNA, 19 bp, Homo sapiens
acagctagtgaagaccaga

SEQ ID NO: 4078424 - DNA, 16 bp, Homo sapiens
acagctcattaaactt

SEQ ID NO: 4078425 - DNA, 12 bp, Homo sapiens
acagctccccca

SEQ ID NO: 4078426 - DNA, 15 bp, Homo sapiens
acagctccttttcca

SEQ ID NO: 4078427 - DNA, 20 bp, Homo sapiens
acagctccttttccagagca

SEQ ID NO: 4078428 - DNA, 16 bp, Homo sapiens
acagctgagcacttag

SEQ ID NO: 4078429 - DNA, 19 bp, Homo sapiens
acagctgcaagccagggat

SEQ ID NO: 4078430 - DNA, 16 bp, Homo sapiens
acagctgcattagaaa

SEQ ID NO: 4078431 - DNA, 16 bp, Homo sapiens
acagctgccctagctg

SEQ ID NO: 4078432 - DNA, 17 bp, Homo sapiens
acagctgccctagctga

SEQ ID NO: 4078433 - DNA, 23 bp, Homo sapiens
acagctgctttctgttgtcattg

SEQ ID NO: 4078434 - DNA, 19 bp, Homo sapiens
acagctggctctgacaaga

SEQ ID NO: 4078435 - DNA, 15 bp, Homo sapiens
acagctgggcaaagc

SEQ ID NO: 4078436 - DNA, 17 bp, Homo sapiens
acagctgtattgtctga

SEQ ID NO: 4078437 - DNA, 20 bp, Homo sapiens
acagctgtattgtctgaact

SEQ ID NO: 4078438 - DNA, 16 bp, Homo sapiens
acagcttagatttcat

SEQ ID NO: 4078439 - DNA, 17 bp, Homo sapiens
acagcttcaccctgtca

SEQ ID NO: 4078440 - DNA, 22 bp, Homo sapiens
acagcttcaggttatcgaaata

SEQ ID NO: 4078441 - DNA, 14 bp, Homo sapiens
acagcttcctcaca

SEQ ID NO: 4078442 - DNA, 20 bp, Homo sapiens
acagcttcctcacacccctg

SEQ ID NO: 4078443 - DNA, 23 bp, Homo sapiens
acagcttcctcacacccctgtcc

SEQ ID NO: 4078444 - DNA, 19 bp, Homo sapiens
acagctttacaacttccat

SEQ ID NO: 4078445 - DNA, 20 bp, Homo sapiens
acagctttcatgattagcaa

SEQ ID NO: 4078446 - DNA, 12 bp, Homo sapiens
acagcttttgca

SEQ ID NO: 4078447 - DNA, 14 bp, Homo sapiens
acagcttttgcaac

SEQ ID NO: 4078448 - DNA, 15 bp, Homo sapiens
acagcttttgcaact

SEQ ID NO: 4078449 - DNA, 19 bp, Homo sapiens
acaggaaagccctccccct

SEQ ID NO: 4078450 - DNA, 18 bp, Homo sapiens
acaggacagagttcacag

SEQ ID NO: 4078451 - DNA, 14 bp, Homo sapiens
acaggagacctggc

SEQ ID NO: 4078452 - DNA, 20 bp, Homo sapiens
acaggaggcggcccggccag

SEQ ID NO: 4078453 - DNA, 23 bp, Homo sapiens
acaggaggcggcccggccagcgg

SEQ ID NO: 4078454 - DNA, 15 bp, Homo sapiens
acaggaggttggagg

SEQ ID NO: 4078455 - DNA, 17 bp, Homo sapiens
acaggaggttggaggga

SEQ ID NO: 4078456 - DNA, 19 bp, Homo sapiens
acaggatcagttaactatt

SEQ ID NO: 4078457 - DNA, 22 bp, Homo sapiens
acaggatcctattctcaccagg

SEQ ID NO: 4078458 - DNA, 21 bp, Homo sapiens
acaggatgaggtggtggagtg

SEQ ID NO: 4078459 - DNA, 14 bp, Homo sapiens
acaggcaccgagaa

SEQ ID NO: 4078460 - DNA, 17 bp, Homo sapiens
acaggcaccgagaatgt

SEQ ID NO: 4078461 - DNA, 20 bp, Homo sapiens
acaggcaccgagaatgttgt

SEQ ID NO: 4078462 - DNA, 21 bp, Homo sapiens
acaggcaccgagaatgttgta

SEQ ID NO: 4078463 - DNA, 11 bp, Homo sapiens
acaggcagccc

SEQ ID NO: 4078464 - DNA, 14 bp, Homo sapiens
acaggcagcccagc

SEQ ID NO: 4078465 - DNA, 17 bp, Homo sapiens
acaggcagcccagcagt

SEQ ID NO: 4078466 - DNA, 21 bp, Homo sapiens
acaggcagctggatgagactt

SEQ ID NO: 4078467 - DNA, 17 bp, Homo sapiens
acaggcatctacacagc

SEQ ID NO: 4078468 - DNA, 21 bp, Homo sapiens
acaggcatgggtgcaaggaaa

SEQ ID NO: 4078469 - DNA, 19 bp, Homo sapiens
acaggcatgtgtcaccatg

SEQ ID NO: 4078470 - DNA, 19 bp, Homo sapiens
acaggccaccctgtgcaga

SEQ ID NO: 4078471 - DNA, 21 bp, Homo sapiens
acaggccaccctgtgcagaag

SEQ ID NO: 4078472 - DNA, 18 bp, Homo sapiens
acaggccatgtgagccac

SEQ ID NO: 4078473 - DNA, 13 bp, Homo sapiens
acaggcccagcgc

SEQ ID NO: 4078474 - DNA, 15 bp, Homo sapiens
acaggcccagggagg

SEQ ID NO: 4078475 - DNA, 12 bp, Homo sapiens
acaggccccctt

SEQ ID NO: 4078476 - DNA, 17 bp, Homo sapiens
acaggcccctgggtttc

SEQ ID NO: 4078477 - DNA, 12 bp, Homo sapiens
acaggccctggc

SEQ ID NO: 4078478 - DNA, 17 bp, Homo sapiens
acaggcgggaggaggtg

SEQ ID NO: 4078479 - DNA, 15 bp, Homo sapiens
acaggctcttagcag

SEQ ID NO: 4078480 - DNA, 19 bp, Homo sapiens
acaggctcttagcagcttc

SEQ ID NO: 4078481 - DNA, 22 bp, Homo sapiens
acagggaaccctgcttgcactt

SEQ ID NO: 4078482 - DNA, 15 bp, Homo sapiens
acagggcaccagagg

SEQ ID NO: 4078483 - DNA, 19 bp, Homo sapiens
acagggccagtggggcctg

SEQ ID NO: 4078484 - DNA, 21 bp, Homo sapiens
acagggccagtggggcctgtg

SEQ ID NO: 4078485 - DNA, 22 bp, Homo sapiens
acagggtctgctctttctctgc

SEQ ID NO: 4078486 - DNA, 17 bp, Homo sapiens
acagggtcttgctctgt

SEQ ID NO: 4078487 - DNA, 20 bp, Homo sapiens
acagggtcttgctctgtccc

SEQ ID NO: 4078488 - DNA, 13 bp, Homo sapiens
acagggtgggctt

SEQ ID NO: 4078489 - DNA, 18 bp, Homo sapiens
acagggtgggcttcctgc

SEQ ID NO: 4078490 - DNA, 15 bp, Homo sapiens
acagggtttcaccat

SEQ ID NO: 4078491 - DNA, 14 bp, Homo sapiens
acagggtttttacc

SEQ ID NO: 4078492 - DNA, 15 bp, Homo sapiens
acaggtaatataaaa

SEQ ID NO: 4078493 - DNA, 17 bp, Homo sapiens
acaggtattttgtttct

SEQ ID NO: 4078494 - DNA, 18 bp, Homo sapiens
acaggtattttgtttctt

SEQ ID NO: 4078495 - DNA, 21 bp, Homo sapiens
acaggtattttgtttctttta

SEQ ID NO: 4078496 - DNA, 12 bp, Homo sapiens
acaggtcaataa

SEQ ID NO: 4078497 - DNA, 16 bp, Homo sapiens
acaggtggacacacaa

SEQ ID NO: 4078498 - DNA, 18 bp, Homo sapiens
acaggtggacacacaagg

SEQ ID NO: 4078499 - DNA, 15 bp, Homo sapiens
acaggtggcaggacc

SEQ ID NO: 4078500 - DNA, 16 bp, Homo sapiens
acaggtggggactggg

SEQ ID NO: 4078501 - DNA, 18 bp, Homo sapiens
acaggttaacctgcagaa

SEQ ID NO: 4078502 - DNA, 17 bp, Homo sapiens
acagtacagcatgtgcc

SEQ ID NO: 4078503 - DNA, 19 bp, Homo sapiens
acagtagaactgtctgtga

SEQ ID NO: 4078504 - DNA, 19 bp, Homo sapiens
acagtagttgtattcttct

SEQ ID NO: 4078505 - DNA, 21 bp, Homo sapiens
acagtagttgtattcttctgt

SEQ ID NO: 4078506 - DNA, 23 bp, Homo sapiens
acagtagttgtattcttctgtat

SEQ ID NO: 4078507 - DNA, 22 bp, Homo sapiens
acagtattatctgtgttaaaat

SEQ ID NO: 4078508 - DNA, 16 bp, Homo sapiens
acagtcactaatatag

SEQ ID NO: 4078509 - DNA, 21 bp, Homo sapiens
acagtcagcatgcttcccaga

SEQ ID NO: 4078510 - DNA, 14 bp, Homo sapiens
acagtcatttaaaa

SEQ ID NO: 4078511 - DNA, 23 bp, Homo sapiens
acagtccttcaaaatccttccaa

SEQ ID NO: 4078512 - DNA, 14 bp, Homo sapiens
acagtctctttaat

SEQ ID NO: 4078513 - DNA, 18 bp, Homo sapiens
acagtcttatcaactggt

SEQ ID NO: 4078514 - DNA, 16 bp, Homo sapiens
acagtgaatgtgtctg

SEQ ID NO: 4078515 - DNA, 22 bp, Homo sapiens
acagtgaccttttcttcatttt

SEQ ID NO: 4078516 - DNA, 13 bp, Homo sapiens
acagtgagccaag

SEQ ID NO: 4078517 - DNA, 18 bp, Homo sapiens
acagtgcatctcagccca

SEQ ID NO: 4078518 - DNA, 18 bp, Homo sapiens
acagtgccaaatgctggg

SEQ ID NO: 4078519 - DNA, 22 bp, Homo sapiens
acagtgccaaatgctggggcag

SEQ ID NO: 4078520 - DNA, 18 bp, Homo sapiens
acagtgccaactcctcac

SEQ ID NO: 4078521 - DNA, 12 bp, Homo sapiens
acagtgccttct

SEQ ID NO: 4078522 - DNA, 17 bp, Homo sapiens
acagtggagtgcaaaag

SEQ ID NO: 4078523 - DNA, 15 bp, Homo sapiens
acagtgggagccctg

SEQ ID NO: 4078524 - DNA, 13 bp, Homo sapiens
acagtgggcatca

SEQ ID NO: 4078525 - DNA, 16 bp, Homo sapiens
aagtttgatttcatta

SEQ ID NO: 4078526 - DNA, 19 bp, Homo sapiens
aagttttaaaaagccagtt

SEQ ID NO: 4078527 - DNA, 13 bp, Homo sapiens
aagttttatcaag

SEQ ID NO: 4078528 - DNA, 20 bp, Homo sapiens
aagttttcctacacttgaga

SEQ ID NO: 4078529 - DNA, 21 bp, Homo sapiens
aagttttctgtagtcatttac

SEQ ID NO: 4078530 - DNA, 12 bp, Homo sapiens
aagttttgaaaa

SEQ ID NO: 4078531 - DNA, 18 bp, Homo sapiens
aagttttgaaaagctatt

SEQ ID NO: 4078532 - DNA, 21 bp, Homo sapiens
aataaaaaattatgacaatgt

SEQ ID NO: 4078533 - DNA, 13 bp, Homo sapiens
aataaaaagtgac

SEQ ID NO: 4078534 - DNA, 20 bp, Homo sapiens
aataaaaagtgacacagcag

SEQ ID NO: 4078535 - DNA, 15 bp, Homo sapiens
aataaaaagttcaga

SEQ ID NO: 4078536 - DNA, 13 bp, Homo sapiens
aataaaaatggca

SEQ ID NO: 4078537 - DNA, 22 bp, Homo sapiens
aataaaactaagctctttgaga

SEQ ID NO: 4078538 - DNA, 23 bp, Homo sapiens
aataaaactaagctctttgagaa

SEQ ID NO: 4078539 - DNA, 17 bp, Homo sapiens
aataaaaggaaaagcaa

SEQ ID NO: 4078540 - DNA, 16 bp, Homo sapiens
aataaaagtgaccttt

SEQ ID NO: 4078541 - DNA, 17 bp, Homo sapiens
aataaaagtttacaact

SEQ ID NO: 4078542 - DNA, 13 bp, Homo sapiens
aataaaatcaatt

SEQ ID NO: 4078543 - DNA, 16 bp, Homo sapiens
aataaaatcaattttt

SEQ ID NO: 4078544 - DNA, 14 bp, Homo sapiens
aataaaatgaaaat

SEQ ID NO: 4078545 - DNA, 19 bp, Homo sapiens
aataaaatgaaaattgtat

SEQ ID NO: 4078546 - DNA, 21 bp, Homo sapiens
aataaaatttctaagagagct

SEQ ID NO: 4078547 - DNA, 22 bp, Homo sapiens
aataaacagcttcatgcctttg

SEQ ID NO: 4078548 - DNA, 17 bp, Homo sapiens
aataaacctcaaaatgt

SEQ ID NO: 4078549 - DNA, 20 bp, Homo sapiens
aataaactactctttgattt

SEQ ID NO: 4078550 - DNA, 22 bp, Homo sapiens
aataaactgaatattttggaaa

SEQ ID NO: 4078551 - DNA, 13 bp, Homo sapiens
aataaactgtttt

SEQ ID NO: 4078552 - DNA, 17 bp, Homo sapiens
aataaacttagaggaaa

SEQ ID NO: 4078553 - DNA, 19 bp, Homo sapiens
aataaacttagaggaaaat

SEQ ID NO: 4078554 - DNA, 14 bp, Homo sapiens
aataaagaaatatt

SEQ ID NO: 4078555 - DNA, 18 bp, Homo sapiens
aataaaggatgtgattgt

SEQ ID NO: 4078556 - DNA, 14 bp, Homo sapiens
aataaagtaattat

SEQ ID NO: 4078557 - DNA, 15 bp, Homo sapiens
aataaagtgtaacaa

SEQ ID NO: 4078558 - DNA, 15 bp, Homo sapiens
aataaagttgcagat

SEQ ID NO: 4078559 - DNA, 12 bp, Homo sapiens
aataaataattt

SEQ ID NO: 4078560 - DNA, 19 bp, Homo sapiens
aataaatagctatatccat

SEQ ID NO: 4078561 - DNA, 18 bp, Homo sapiens
aataaatatcacagtatt

SEQ ID NO: 4078562 - DNA, 21 bp, Homo sapiens
aataaatcattaatactcttc

SEQ ID NO: 4078563 - DNA, 22 bp, Homo sapiens
aataaatctcttctttgctgca

SEQ ID NO: 4078564 - DNA, 14 bp, Homo sapiens
aataaatctttcaa

SEQ ID NO: 4078565 - DNA, 15 bp, Homo sapiens
aataaatgccctctt

SEQ ID NO: 4078566 - DNA, 17 bp, Homo sapiens
aataaatgctctatttt

SEQ ID NO: 4078567 - DNA, 12 bp, Homo sapiens
aataaatgtctt

SEQ ID NO: 4078568 - DNA, 12 bp, Homo sapiens
aataaattattt

SEQ ID NO: 4078569 - DNA, 17 bp, Homo sapiens
aataaattcctaaactc

SEQ ID NO: 4078570 - DNA, 18 bp, Homo sapiens
aataaatttggttctaat

SEQ ID NO: 4078571 - DNA, 21 bp, Homo sapiens
aataaatttggttctaataga

SEQ ID NO: 4078572 - DNA, 14 bp, Homo sapiens
aataacaaaatgga

SEQ ID NO: 4078573 - DNA, 17 bp, Homo sapiens
aataacaaacgtgtttt

SEQ ID NO: 4078574 - DNA, 20 bp, Homo sapiens
aataacaatgttaaggaaac

SEQ ID NO: 4078575 - DNA, 20 bp, Homo sapiens
aataacacacatataaacat

SEQ ID NO: 4078576 - DNA, 22 bp, Homo sapiens
aataacatgtaattaagtacta

SEQ ID NO: 4078577 - DNA, 13 bp, Homo sapiens
aataacattacct

SEQ ID NO: 4078578 - DNA, 23 bp, Homo sapiens
aataaccaagtttattcagtaaa

SEQ ID NO: 4078579 - DNA, 14 bp, Homo sapiens
aataaccacttaaa

SEQ ID NO: 4078580 - DNA, 21 bp, Homo sapiens
aataaccacttaaaaaatgtc

SEQ ID NO: 4078581 - DNA, 18 bp, Homo sapiens
aataacctcaaagtgact

SEQ ID NO: 4078582 - DNA, 13 bp, Homo sapiens
aataactactgtg

SEQ ID NO: 4078583 - DNA, 18 bp, Homo sapiens
aataactactgtgttcct

SEQ ID NO: 4078584 - DNA, 19 bp, Homo sapiens
aataactactgtgttcctg

SEQ ID NO: 4078585 - DNA, 18 bp, Homo sapiens
aataactcagaatattgt

SEQ ID NO: 4078586 - DNA, 14 bp, Homo sapiens
aataactccttctt

SEQ ID NO: 4078587 - DNA, 19 bp, Homo sapiens
aataactctgtggcattat

SEQ ID NO: 4078588 - DNA, 14 bp, Homo sapiens
aataactgtgaagt

SEQ ID NO: 4078589 - DNA, 20 bp, Homo sapiens
aataactgtgaagtttacat

SEQ ID NO: 4078590 - DNA, 20 bp, Homo sapiens
aataacttagcttgcacatg

SEQ ID NO: 4078591 - DNA, 11 bp, Homo sapiens
aataacttcta

SEQ ID NO: 4078592 - DNA, 18 bp, Homo sapiens
aataacttctatatttta

SEQ ID NO: 4078593 - DNA, 13 bp, Homo sapiens
aataagaaatgaa

SEQ ID NO: 4078594 - DNA, 14 bp, Homo sapiens
aataagaaatgaac

SEQ ID NO: 4078595 - DNA, 15 bp, Homo sapiens
aataagaagcaaata

SEQ ID NO: 4078596 - DNA, 18 bp, Homo sapiens
aataagaatagaaataaa

SEQ ID NO: 4078597 - DNA, 14 bp, Homo sapiens
aataagaatttagg

SEQ ID NO: 4078598 - DNA, 18 bp, Homo sapiens
aataagagaatgttccta

SEQ ID NO: 4078599 - DNA, 14 bp, Homo sapiens
aataagcaggtgga

SEQ ID NO: 4078600 - DNA, 18 bp, Homo sapiens
aataagcaggtggatcta

SEQ ID NO: 4078601 - DNA, 23 bp, Homo sapiens
aataagcaggtggatctatttca

SEQ ID NO: 4078602 - DNA, 13 bp, Homo sapiens
aataagctaaaga

SEQ ID NO: 4078603 - DNA, 22 bp, Homo sapiens
aataaggaagagggctgagctg

SEQ ID NO: 4078604 - DNA, 17 bp, Homo sapiens
aataaggccttaatatg

SEQ ID NO: 4078605 - DNA, 21 bp, Homo sapiens
aataagtgtgtggtagaaaca

SEQ ID NO: 4078606 - DNA, 11 bp, Homo sapiens
aataataatta

SEQ ID NO: 4078607 - DNA, 18 bp, Homo sapiens
aataatacctaagccttc

SEQ ID NO: 4078608 - DNA, 19 bp, Homo sapiens
aataatagttattatttaa

SEQ ID NO: 4078609 - DNA, 11 bp, Homo sapiens
aataatcaaga

SEQ ID NO: 4078610 - DNA, 23 bp, Homo sapiens
aataatcttattagggagaaaat

SEQ ID NO: 4078611 - DNA, 12 bp, Homo sapiens
aataatggaaac

SEQ ID NO: 4078612 - DNA, 22 bp, Homo sapiens
aataatgtagttttgtttatgc

SEQ ID NO: 4078613 - DNA, 19 bp, Homo sapiens
aataatgttaacatggaca

SEQ ID NO: 4078614 - DNA, 21 bp, Homo sapiens
aataattgatcaaattcattt

SEQ ID NO: 4078615 - DNA, 12 bp, Homo sapiens
aataatttctac

SEQ ID NO: 4078616 - DNA, 15 bp, Homo sapiens
aataatttctctaca

SEQ ID NO: 4078617 - DNA, 12 bp, Homo sapiens
aataatttgtaa

SEQ ID NO: 4078618 - DNA, 14 bp, Homo sapiens
aataatttgtaaat

SEQ ID NO: 4078619 - DNA, 23 bp, Homo sapiens
aataatttgtaaatgattttaat

SEQ ID NO: 4078620 - DNA, 22 bp, Homo sapiens
aataatttttatatttaattat

SEQ ID NO: 4078621 - DNA, 20 bp, Homo sapiens
aatacaaaaattagccgggc

SEQ ID NO: 4078622 - DNA, 19 bp, Homo sapiens
aatacaaagtaaatacaag

SEQ ID NO: 4078623 - DNA, 14 bp, Homo sapiens
aatacaaatctgta

SEQ ID NO: 4078624 - DNA, 15 bp, Homo sapiens
aatacaaatctgtat

SEQ ID NO: 4078625 - DNA, 12 bp, Homo sapiens
aatacaaatgga

SEQ ID NO: 4078626 - DNA, 18 bp, Homo sapiens
aatacaaatggattttgg

SEQ ID NO: 4078627 - DNA, 20 bp, Homo sapiens
aatacaagactgttgtgatc

SEQ ID NO: 4078628 - DNA, 12 bp, Homo sapiens
aatacaataaac

SEQ ID NO: 4078629 - DNA, 14 bp, Homo sapiens
aatacaattaaagg

SEQ ID NO: 4078630 - DNA, 17 bp, Homo sapiens
aatacacaagtaaacat

SEQ ID NO: 4078631 - DNA, 23 bp, Homo sapiens
aatacacatagcatgtaatggta

SEQ ID NO: 4078632 - DNA, 18 bp, Homo sapiens
aatacaggacttttaaat

SEQ ID NO: 4078633 - DNA, 17 bp, Homo sapiens
aatacagttctgctctg

SEQ ID NO: 4078634 - DNA, 21 bp, Homo sapiens
aatactaaaagcaaatctaca

SEQ ID NO: 4078635 - DNA, 13 bp, Homo sapiens
aatactgggttct

SEQ ID NO: 4078636 - DNA, 15 bp, Homo sapiens
aatactgtgcagaat

SEQ ID NO: 4078637 - DNA, 22 bp, Homo sapiens
aatactgtgcagaataatggaa

SEQ ID NO: 4078638 - DNA, 19 bp, Homo sapiens
aatacttactataatttga

SEQ ID NO: 4078639 - DNA, 17 bp, Homo sapiens
aatacttgtcaatattt

SEQ ID NO: 4078640 - DNA, 18 bp, Homo sapiens
aatacttgtcaatattta

SEQ ID NO: 4078641 - DNA, 15 bp, Homo sapiens
aatactttgcttcat

SEQ ID NO: 4078642 - DNA, 20 bp, Homo sapiens
aatacttttactctgcctac

SEQ ID NO: 4078643 - DNA, 14 bp, Homo sapiens
aatagaaaatggtc

SEQ ID NO: 4078644 - DNA, 14 bp, Homo sapiens
aatagaaataaatt

SEQ ID NO: 4078645 - DNA, 17 bp, Homo sapiens
aatagaatataattatc

SEQ ID NO: 4078646 - DNA, 16 bp, Homo sapiens
aatagacttaaatctc

SEQ ID NO: 4078647 - DNA, 15 bp, Homo sapiens
aatagagactgtaga

SEQ ID NO: 4078648 - DNA, 17 bp, Homo sapiens
aatagagtatatgcact

SEQ ID NO: 4078649 - DNA, 20 bp, Homo sapiens
aatagccacatttggaatac

SEQ ID NO: 4078650 - DNA, 22 bp, Homo sapiens
aatagccacatttggaatactt

SEQ ID NO: 4078651 - DNA, 13 bp, Homo sapiens
aatagcctggcca

SEQ ID NO: 4078652 - DNA, 16 bp, Homo sapiens
aatagctaagcatctc

SEQ ID NO: 4078653 - DNA, 19 bp, Homo sapiens
aatagctaatttatttccc

SEQ ID NO: 4078654 - DNA, 17 bp, Homo sapiens
aatagctatatccatgt

SEQ ID NO: 4078655 - DNA, 18 bp, Homo sapiens
aatagctatatccatgta

SEQ ID NO: 4078656 - DNA, 20 bp, Homo sapiens
aatagctatatccatgtact

SEQ ID NO: 4078657 - DNA, 21 bp, Homo sapiens
aatagctttaccctcaggcat

SEQ ID NO: 4078658 - DNA, 13 bp, Homo sapiens
aataggagaggat

SEQ ID NO: 4078659 - DNA, 23 bp, Homo sapiens
aataggagaggatgagagcccag

SEQ ID NO: 4078660 - DNA, 16 bp, Homo sapiens
aataggcattaacaca

SEQ ID NO: 4078661 - DNA, 22 bp, Homo sapiens
aataggcattaacacaaaggag

SEQ ID NO: 4078662 - DNA, 18 bp, Homo sapiens
aatagggagacagggtag

SEQ ID NO: 4078663 - DNA, 19 bp, Homo sapiens
aatagggtagaatgattaa

SEQ ID NO: 4078664 - DNA, 23 bp, Homo sapiens
aatagggtagaatgattaatcaa

SEQ ID NO: 4078665 - DNA, 14 bp, Homo sapiens
aataggtagtttgg

SEQ ID NO: 4078666 - DNA, 22 bp, Homo sapiens
aatagtaaaagataacaagatc

SEQ ID NO: 4078667 - DNA, 13 bp, Homo sapiens
aatagtctgtgtg

SEQ ID NO: 4078668 - DNA, 15 bp, Homo sapiens
aatagtctgtgtgaa

SEQ ID NO: 4078669 - DNA, 20 bp, Homo sapiens
aatagtgcttaaaaatcatt

SEQ ID NO: 4078670 - DNA, 13 bp, Homo sapiens
aatagtgtgttct

SEQ ID NO: 4078671 - DNA, 15 bp, Homo sapiens
aatagtgtgttctga

SEQ ID NO: 4078672 - DNA, 17 bp, Homo sapiens
aatagtgtgttctgatt

SEQ ID NO: 4078673 - DNA, 21 bp, Homo sapiens
aatagtgtgttctgattagaa

SEQ ID NO: 4078674 - DNA, 22 bp, Homo sapiens
aatagttaagacatgatttcct

SEQ ID NO: 4078675 - DNA, 14 bp, Homo sapiens
aatagttattattt

SEQ ID NO: 4078676 - DNA, 16 bp, Homo sapiens
aatataagacatttgt

SEQ ID NO: 4078677 - DNA, 13 bp, Homo sapiens
aatataagatttt

SEQ ID NO: 4078678 - DNA, 23 bp, Homo sapiens
aatataaggaaagcaataaatga

SEQ ID NO: 4078679 - DNA, 13 bp, Homo sapiens
aatataattctgt

SEQ ID NO: 4078680 - DNA, 21 bp, Homo sapiens
aatatataaaaagaaaagata

SEQ ID NO: 4078681 - DNA, 18 bp, Homo sapiens
aatatatgtattatttat

SEQ ID NO: 4078682 - DNA, 14 bp, Homo sapiens
aatatatgtctgat

SEQ ID NO: 4078683 - DNA, 18 bp, Homo sapiens
aatatatgtctgataatg

SEQ ID NO: 4078684 - DNA, 16 bp, Homo sapiens
aatatattcaggagtt

SEQ ID NO: 4078685 - DNA, 23 bp, Homo sapiens
aatatattcctgagatttcctcc

SEQ ID NO: 4078686 - DNA, 13 bp, Homo sapiens
aatatattgaact

SEQ ID NO: 4078687 - DNA, 18 bp, Homo sapiens
aatatattgaacttttgt

SEQ ID NO: 4078688 - DNA, 19 bp, Homo sapiens
aatatatttaagataatta

SEQ ID NO: 4078689 - DNA, 20 bp, Homo sapiens
aatatatttaagataattat

SEQ ID NO: 4078690 - DNA, 14 bp, Homo sapiens
aatatatttttaga

SEQ ID NO: 4078691 - DNA, 15 bp, Homo sapiens
aatatatttttagac

SEQ ID NO: 4078692 - DNA, 15 bp, Homo sapiens
aatatcagactagtg

SEQ ID NO: 4078693 - DNA, 16 bp, Homo sapiens
aatatccctacatgta

SEQ ID NO: 4078694 - DNA, 18 bp, Homo sapiens
aatatccctacatgtatt

SEQ ID NO: 4078695 - DNA, 18 bp, Homo sapiens
aatatccctcttgtaagt

SEQ ID NO: 4078696 - DNA, 20 bp, Homo sapiens
aatatctaatatatatgaat

SEQ ID NO: 4078697 - DNA, 14 bp, Homo sapiens
aatatctattaata

SEQ ID NO: 4078698 - DNA, 13 bp, Homo sapiens
aatatctgggatt

SEQ ID NO: 4078699 - DNA, 21 bp, Homo sapiens
aatatctgggattctacttta

SEQ ID NO: 4078700 - DNA, 20 bp, Homo sapiens
aatatctgtgaggtgctgat

SEQ ID NO: 4078701 - DNA, 19 bp, Homo sapiens
aatatcttttatgtttgaa

SEQ ID NO: 4078702 - DNA, 17 bp, Homo sapiens
aatatgaaattccagca

SEQ ID NO: 4078703 - DNA, 18 bp, Homo sapiens
aatatgaatacagggcat

SEQ ID NO: 4078704 - DNA, 17 bp, Homo sapiens
aatatgacggaagaaca

SEQ ID NO: 4078705 - DNA, 19 bp, Homo sapiens
aatatgacggaagaacata

SEQ ID NO: 4078706 - DNA, 16 bp, Homo sapiens
aatatgagtacaaatg

SEQ ID NO: 4078707 - DNA, 21 bp, Homo sapiens
aatatgagtacaaatgcctta

SEQ ID NO: 4078708 - DNA, 12 bp, Homo sapiens
aatatgatttta

SEQ ID NO: 4078709 - DNA, 22 bp, Homo sapiens
aatatgcagtgatatggcagaa

SEQ ID NO: 4078710 - DNA, 13 bp, Homo sapiens
aatatgctaattt

SEQ ID NO: 4078711 - DNA, 14 bp, Homo sapiens
aatatgctaatttg

SEQ ID NO: 4078712 - DNA, 15 bp, Homo sapiens
aatatgctaatttgg

SEQ ID NO: 4078713 - DNA, 19 bp, Homo sapiens
aatatgcttaaaataagca

SEQ ID NO: 4078714 - DNA, 15 bp, Homo sapiens
aatatggaacttaca

SEQ ID NO: 4078715 - DNA, 17 bp, Homo sapiens
aatatggaacttacatt

SEQ ID NO: 4078716 - DNA, 20 bp, Homo sapiens
aatatggaacttacattgtt

SEQ ID NO: 4078717 - DNA, 15 bp, Homo sapiens
aatatggacaagagg

SEQ ID NO: 4078718 - DNA, 14 bp, Homo sapiens
aatatggatttgtt

SEQ ID NO: 4078719 - DNA, 15 bp, Homo sapiens
aatatggctataaat

SEQ ID NO: 4078720 - DNA, 19 bp, Homo sapiens
aatatgggcattgtagtta

SEQ ID NO: 4078721 - DNA, 21 bp, Homo sapiens
aatatgggggccttttgggaa

SEQ ID NO: 4078722 - DNA, 16 bp, Homo sapiens
aatatgtattttccta

SEQ ID NO: 4078723 - DNA, 17 bp, Homo sapiens
aatatgtattttcctaa

SEQ ID NO: 4078724 - DNA, 18 bp, Homo sapiens
aatatgtgagatttttta

SEQ ID NO: 4078725 - DNA, 14 bp, Homo sapiens
aatatgtgtttact

SEQ ID NO: 4078726 - DNA, 15 bp, Homo sapiens
aatatgtttaaaata

SEQ ID NO: 4078727 - DNA, 13 bp, Homo sapiens
aatattaaataca

SEQ ID NO: 4078728 - DNA, 19 bp, Homo sapiens
aatattaaatacagacact

SEQ ID NO: 4078729 - DNA, 13 bp, Homo sapiens
aatattaagaaag

SEQ ID NO: 4078730 - DNA, 20 bp, Homo sapiens
aatattactgtttatttctg

SEQ ID NO: 4078731 - DNA, 16 bp, Homo sapiens
aatattatactaagaa

SEQ ID NO: 4078732 - DNA, 11 bp, Homo sapiens
aatattattat

SEQ ID NO: 4078733 - DNA, 17 bp, Homo sapiens
aatattccaagcttcat

SEQ ID NO: 4078734 - DNA, 20 bp, Homo sapiens
aatattcccctatctctaga

SEQ ID NO: 4078735 - DNA, 15 bp, Homo sapiens
aatattcctgaatga

SEQ ID NO: 4078736 - DNA, 16 bp, Homo sapiens
aatattctatatgaat

SEQ ID NO: 4078737 - DNA, 17 bp, Homo sapiens
aatattcttttgtttcc

SEQ ID NO: 4078738 - DNA, 16 bp, Homo sapiens
aatattgagaaagaaa

SEQ ID NO: 4078739 - DNA, 19 bp, Homo sapiens
aatattgagaaagaaacta

SEQ ID NO: 4078740 - DNA, 20 bp, Homo sapiens
aatattgagaaagaaactaa

SEQ ID NO: 4078741 - DNA, 16 bp, Homo sapiens
aatattgaggctttgt

SEQ ID NO: 4078742 - DNA, 17 bp, Homo sapiens
aatattgaggctttgtg

SEQ ID NO: 4078743 - DNA, 18 bp, Homo sapiens
aatattgaggctttgtgt

SEQ ID NO: 4078744 - DNA, 20 bp, Homo sapiens
aatattgctttggtcatatg

SEQ ID NO: 4078745 - DNA, 16 bp, Homo sapiens
aatattgttgacaact

SEQ ID NO: 4078746 - DNA, 15 bp, Homo sapiens
aatatttaaacatgg

SEQ ID NO: 4078747 - DNA, 17 bp, Homo sapiens
aatatttaagaaaagca

SEQ ID NO: 4078748 - DNA, 14 bp, Homo sapiens
aatatttagctgta

SEQ ID NO: 4078749 - DNA, 16 bp, Homo sapiens
aatatttagctgtaaa

SEQ ID NO: 4078750 - DNA, 14 bp, Homo sapiens
aatatttatatatt

SEQ ID NO: 4078751 - DNA, 17 bp, Homo sapiens
aatatttatatttcact

SEQ ID NO: 4078752 - DNA, 17 bp, Homo sapiens
aatatttattaaataaa

SEQ ID NO: 4078753 - DNA, 12 bp, Homo sapiens
aatatttattac

SEQ ID NO: 4078754 - DNA, 16 bp, Homo sapiens
aatatttattacctct

SEQ ID NO: 4078755 - DNA, 11 bp, Homo sapiens
aatatttattt

SEQ ID NO: 4078756 - DNA, 22 bp, Homo sapiens
aatatttcctgacttgagtgtt

SEQ ID NO: 4078757 - DNA, 21 bp, Homo sapiens
aatatttccttaaactgtgtg

SEQ ID NO: 4078758 - DNA, 12 bp, Homo sapiens
aatatttctatt

SEQ ID NO: 4078759 - DNA, 19 bp, Homo sapiens
aatattttctttaatgctt

SEQ ID NO: 4078760 - DNA, 20 bp, Homo sapiens
aatattttgataataaattg

SEQ ID NO: 4078761 - DNA, 13 bp, Homo sapiens
aatattttttgca

SEQ ID NO: 4078762 - DNA, 17 bp, Homo sapiens
aatcaagagctgccctc

SEQ ID NO: 4078763 - DNA, 18 bp, Homo sapiens
aatcaagattttagggct

SEQ ID NO: 4078764 - DNA, 18 bp, Homo sapiens
aatcaaggttataatttt

SEQ ID NO: 4078765 - DNA, 14 bp, Homo sapiens
aatcaagtattttg

SEQ ID NO: 4078766 - DNA, 15 bp, Homo sapiens
aatcaagtattttgt

SEQ ID NO: 4078767 - DNA, 15 bp, Homo sapiens
aatcaataaagaaaa

SEQ ID NO: 4078768 - DNA, 14 bp, Homo sapiens
aatcaatacactag

SEQ ID NO: 4078769 - DNA, 18 bp, Homo sapiens
aatcaatacactagttgt

SEQ ID NO: 4078770 - DNA, 19 bp, Homo sapiens
aatcaatacactagttgtt

SEQ ID NO: 4078771 - DNA, 15 bp, Homo sapiens
aatcaatacagacaa

SEQ ID NO: 4078772 - DNA, 21 bp, Homo sapiens
aatcaatctgcagtttaacaa

SEQ ID NO: 4078773 - DNA, 19 bp, Homo sapiens
aatcaatgaaaaatgtaat

SEQ ID NO: 4078774 - DNA, 21 bp, Homo sapiens
aatcaatgaaaaatgtaattt

SEQ ID NO: 4078775 - DNA, 13 bp, Homo sapiens
aatcaatgaatat

SEQ ID NO: 4078776 - DNA, 16 bp, Homo sapiens
aatcaatgaatattga

SEQ ID NO: 4078777 - DNA, 19 bp, Homo sapiens
aatcaccatgtaagcactc

SEQ ID NO: 4078778 - DNA, 16 bp, Homo sapiens
aatcactaggtaactt

SEQ ID NO: 4078779 - DNA, 13 bp, Homo sapiens
aatcagaaatttt

SEQ ID NO: 4078780 - DNA, 11 bp, Homo sapiens
aatcagaactc

SEQ ID NO: 4078781 - DNA, 12 bp, Homo sapiens
aatcagaactca

SEQ ID NO: 4078782 - DNA, 23 bp, Homo sapiens
aatcagaactcaaatggggccag

SEQ ID NO: 4078783 - DNA, 12 bp, Homo sapiens
aatcagcattct

SEQ ID NO: 4078784 - DNA, 14 bp, Homo sapiens
aatcagcatttagt

SEQ ID NO: 4078785 - DNA, 23 bp, Homo sapiens
aatcagctatttactgccaaagg

SEQ ID NO: 4078786 - DNA, 23 bp, Homo sapiens
aatcagctccttttccgttctgt

SEQ ID NO: 4078787 - DNA, 18 bp, Homo sapiens
aatcagggaggtcatttt

SEQ ID NO: 4078788 - DNA, 19 bp, Homo sapiens
aatcagggaggtcattttg

SEQ ID NO: 4078789 - DNA, 18 bp, Homo sapiens
aatcaggtcctgctcagc

SEQ ID NO: 4078790 - DNA, 14 bp, Homo sapiens
aatcagtaagaggt

SEQ ID NO: 4078791 - DNA, 14 bp, Homo sapiens
aatcagtataaaca

SEQ ID NO: 4078792 - DNA, 21 bp, Homo sapiens
aatcagtgactgaaaccattt

SEQ ID NO: 4078793 - DNA, 19 bp, Homo sapiens
aatcagtgggcaggataaa

SEQ ID NO: 4078794 - DNA, 14 bp, Homo sapiens
aatcagtgtgtcta

SEQ ID NO: 4078795 - DNA, 22 bp, Homo sapiens
aatcagtgtgtctaaatttgaa

SEQ ID NO: 4078796 - DNA, 20 bp, Homo sapiens
aatcagtttttaaaatattt

SEQ ID NO: 4078797 - DNA, 21 bp, Homo sapiens
aatcatataataaatgtacat

SEQ ID NO: 4078798 - DNA, 15 bp, Homo sapiens
aatcatatgtgtctt

SEQ ID NO: 4078799 - DNA, 17 bp, Homo sapiens
aatcatgaaatatgcat

SEQ ID NO: 4078800 - DNA, 22 bp, Homo sapiens
aatcatgtccatacactttgtt

SEQ ID NO: 4078801 - DNA, 21 bp, Homo sapiens
aatcatgtgggtgagccagtg

SEQ ID NO: 4078802 - DNA, 23 bp, Homo sapiens
aatcatgtgggtgagccagtgga

SEQ ID NO: 4078803 - DNA, 20 bp, Homo sapiens
aatcattagttttagaggca

SEQ ID NO: 4078804 - DNA, 17 bp, Homo sapiens
aatcattgtccagagct

SEQ ID NO: 4078805 - DNA, 14 bp, Homo sapiens
aatcattgttgcct

SEQ ID NO: 4078806 - DNA, 20 bp, Homo sapiens
aatcatttccccataactca

SEQ ID NO: 4078807 - DNA, 19 bp, Homo sapiens
aatcattttgcctcttttc

SEQ ID NO: 4078808 - DNA, 13 bp, Homo sapiens
aatccacctgcct

SEQ ID NO: 4078809 - DNA, 16 bp, Homo sapiens
aatccaccttcaggcc

SEQ ID NO: 4078810 - DNA, 19 bp, Homo sapiens
aatccagaaacttgttctt

SEQ ID NO: 4078811 - DNA, 11 bp, Homo sapiens
aatccagagag

SEQ ID NO: 4078812 - DNA, 23 bp, Homo sapiens
aatccagagagcttaaattgtca

SEQ ID NO: 4078813 - DNA, 17 bp, Homo sapiens
aatccaggcacagctga

SEQ ID NO: 4078814 - DNA, 17 bp, Homo sapiens
aatccaggcagatccag

SEQ ID NO: 4078815 - DNA, 20 bp, Homo sapiens
aatccaggcagatccaggac

SEQ ID NO: 4078816 - DNA, 21 bp, Homo sapiens
aatccaggcagatccaggact

SEQ ID NO: 4078817 - DNA, 22 bp, Homo sapiens
aatccaggcagatccaggacta

SEQ ID NO: 4078818 - DNA, 19 bp, Homo sapiens
aatccatcagtgccaaact

SEQ ID NO: 4078819 - DNA, 17 bp, Homo sapiens
aatccatgttagttttt

SEQ ID NO: 4078820 - DNA, 16 bp, Homo sapiens
aatcccaaatttgatt

SEQ ID NO: 4078821 - DNA, 21 bp, Homo sapiens
aatcccaaatttgattgattt

SEQ ID NO: 4078822 - DNA, 15 bp, Homo sapiens
aatcccaccttccca

SEQ ID NO: 4078823 - DNA, 14 bp, Homo sapiens
aatcccactgtatg

SEQ ID NO: 4078824 - DNA, 15 bp, Homo sapiens
aatcccagcactttg

SEQ ID NO: 4078825 - DNA, 21 bp, Homo sapiens
aatcccagggaaggacttgga

SEQ ID NO: 4078826 - DNA, 22 bp, Homo sapiens
aatcccagggaaggacttggag

SEQ ID NO: 4078827 - DNA, 17 bp, Homo sapiens
aatcccagggctggctc

SEQ ID NO: 4078828 - DNA, 15 bp, Homo sapiens
aatcccccttgccac

SEQ ID NO: 4078829 - DNA, 17 bp, Homo sapiens
aatccccttatgacttg

SEQ ID NO: 4078830 - DNA, 13 bp, Homo sapiens
aatccctgtttaa

SEQ ID NO: 4078831 - DNA, 17 bp, Homo sapiens
aatcctatatagaatgc

SEQ ID NO: 4078832 - DNA, 22 bp, Homo sapiens
aatcctatatagaatgctgcac

SEQ ID NO: 4078833 - DNA, 15 bp, Homo sapiens
aatcctcactgggtg

SEQ ID NO: 4078834 - DNA, 13 bp, Homo sapiens
aatcctcctgcct

SEQ ID NO: 4078835 - DNA, 16 bp, Homo sapiens
aatcctcctgcctcag

SEQ ID NO: 4078836 - DNA, 14 bp, Homo sapiens
aatcctgcaatgaa

SEQ ID NO: 4078837 - DNA, 16 bp, Homo sapiens
aatcctgccatttaaa

SEQ ID NO: 4078838 - DNA, 11 bp, Homo sapiens
aatcctgtacc

SEQ ID NO: 4078839 - DNA, 17 bp, Homo sapiens
aatcctgtaccaaatct

SEQ ID NO: 4078840 - DNA, 12 bp, Homo sapiens
aatccttccaaa

SEQ ID NO: 4078841 - DNA, 20 bp, Homo sapiens
aatccttccaaaaattatta

SEQ ID NO: 4078842 - DNA, 21 bp, Homo sapiens
aatccttccaaaaattattat

SEQ ID NO: 4078843 - DNA, 16 bp, Homo sapiens
aatccttccctgctct

SEQ ID NO: 4078844 - DNA, 17 bp, Homo sapiens
aatccttccctgctctt

SEQ ID NO: 4078845 - DNA, 20 bp, Homo sapiens
aatccttcctaaacccaatg

SEQ ID NO: 4078846 - DNA, 13 bp, Homo sapiens
aatccttctttgt

SEQ ID NO: 4078847 - DNA, 16 bp, Homo sapiens
aatcctttctgcccac

SEQ ID NO: 4078848 - DNA, 22 bp, Homo sapiens
aatcctttgttttctgactaat

SEQ ID NO: 4078849 - DNA, 20 bp, Homo sapiens
aatcctttttctttataaac

SEQ ID NO: 4078850 - DNA, 18 bp, Homo sapiens
aatcggagcgaagcagag

SEQ ID NO: 4078851 - DNA, 21 bp, Homo sapiens
aatcggatctggggctctggg

SEQ ID NO: 4078852 - DNA, 22 bp, Homo sapiens
aatcggatctggggctctggga

SEQ ID NO: 4078853 - DNA, 23 bp, Homo sapiens
aatcggatctggggctctgggat

SEQ ID NO: 4078854 - DNA, 23 bp, Homo sapiens
aatctaaaacaaaatctgaactc

SEQ ID NO: 4078855 - DNA, 14 bp, Homo sapiens
aatctaaatctatt

SEQ ID NO: 4078856 - DNA, 15 bp, Homo sapiens
aatctaaatctattt

SEQ ID NO: 4078857 - DNA, 16 bp, Homo sapiens
aatctaaatctattta

SEQ ID NO: 4078858 - DNA, 14 bp, Homo sapiens
aatctaaggataat

SEQ ID NO: 4078859 - DNA, 19 bp, Homo sapiens
aatctacagatcctttttc

SEQ ID NO: 4078860 - DNA, 17 bp, Homo sapiens
aatctaggtgtggctgt

SEQ ID NO: 4078861 - DNA, 12 bp, Homo sapiens
aatctattcaga

SEQ ID NO: 4078862 - DNA, 13 bp, Homo sapiens
aatctattcagac

SEQ ID NO: 4078863 - DNA, 18 bp, Homo sapiens
aatctattcagacaagca

SEQ ID NO: 4078864 - DNA, 21 bp, Homo sapiens
aatctattctgtgttgcatta

SEQ ID NO: 4078865 - DNA, 18 bp, Homo sapiens
aatctattgggttcatta

SEQ ID NO: 4078866 - DNA, 21 bp, Homo sapiens
aatctatttattaatatttaa

SEQ ID NO: 4078867 - DNA, 22 bp, Homo sapiens
aatctcaccccatcccacaccc

SEQ ID NO: 4078868 - DNA, 22 bp, Homo sapiens
aatctcccattttggaatttgc

SEQ ID NO: 4078869 - DNA, 14 bp, Homo sapiens
aatctcgttcccaa

SEQ ID NO: 4078870 - DNA, 18 bp, Homo sapiens
aatctcgttcccaaagaa

SEQ ID NO: 4078871 - DNA, 20 bp, Homo sapiens
aatctctacgactaatcacc

SEQ ID NO: 4078872 - DNA, 12 bp, Homo sapiens
aatctcttctgt

SEQ ID NO: 4078873 - DNA, 16 bp, Homo sapiens
aatctcttctgtgttt

SEQ ID NO: 4078874 - DNA, 16 bp, Homo sapiens
aatctgaactctcaaa

SEQ ID NO: 4078875 - DNA, 12 bp, Homo sapiens
aatctgaagata

SEQ ID NO: 4078876 - DNA, 23 bp, Homo sapiens
aatctgaagatatatttcacttt

SEQ ID NO: 4078877 - DNA, 13 bp, Homo sapiens
aatctgacccagt

SEQ ID NO: 4078878 - DNA, 14 bp, Homo sapiens
aatctgacccagtg

SEQ ID NO: 4078879 - DNA, 20 bp, Homo sapiens
aatctgagctgcagcctggc

SEQ ID NO: 4078880 - DNA, 16 bp, Homo sapiens
aatctgagggagctga

SEQ ID NO: 4078881 - DNA, 17 bp, Homo sapiens
aatctgctagaaagtta

SEQ ID NO: 4078882 - DNA, 15 bp, Homo sapiens
aatctggaagaaaaa

SEQ ID NO: 4078883 - DNA, 20 bp, Homo sapiens
aatctggtccatatttacat

SEQ ID NO: 4078884 - DNA, 20 bp, Homo sapiens
aatctggtcttgttagaaaa

SEQ ID NO: 4078885 - DNA, 15 bp, Homo sapiens
aatctgtagggctgg

SEQ ID NO: 4078886 - DNA, 16 bp, Homo sapiens
aatctgtataaatgtc

SEQ ID NO: 4078887 - DNA, 20 bp, Homo sapiens
aatctgtccaaaggaggctg

SEQ ID NO: 4078888 - DNA, 23 bp, Homo sapiens
aatctgtgtgaaactttcattcc

SEQ ID NO: 4078889 - DNA, 17 bp, Homo sapiens
aatctgtgtgtgccctg

SEQ ID NO: 4078890 - DNA, 17 bp, Homo sapiens
aatctgtttgatccctg

SEQ ID NO: 4078891 - DNA, 20 bp, Homo sapiens
aatcttaaacataataaatc

SEQ ID NO: 4078892 - DNA, 15 bp, Homo sapiens
aatcttaaatcagaa

SEQ ID NO: 4078893 - DNA, 12 bp, Homo sapiens
aatcttctactt

SEQ ID NO: 4078894 - DNA, 22 bp, Homo sapiens
aatcttgctttgtgtatctcat

SEQ ID NO: 4078895 - DNA, 17 bp, Homo sapiens
aatcttgggtgggtgaa

SEQ ID NO: 4078896 - DNA, 20 bp, Homo sapiens
aatcttgttttaagcaaatg

SEQ ID NO: 4078897 - DNA, 17 bp, Homo sapiens
aatctttagaaaaggca

SEQ ID NO: 4078898 - DNA, 22 bp, Homo sapiens
aatctttagagaagtatacata

SEQ ID NO: 4078899 - DNA, 12 bp, Homo sapiens
aatctttcaaaa

SEQ ID NO: 4078900 - DNA, 15 bp, Homo sapiens
aatctttctttacct

SEQ ID NO: 4078901 - DNA, 12 bp, Homo sapiens
aatcttttacaa

SEQ ID NO: 4078902 - DNA, 22 bp, Homo sapiens
aatgaaaaatttaagcattgtt

SEQ ID NO: 4078903 - DNA, 13 bp, Homo sapiens
aatgaaaatgtca

SEQ ID NO: 4078904 - DNA, 16 bp, Homo sapiens
aatgaaagattaaaca

SEQ ID NO: 4078905 - DNA, 20 bp, Homo sapiens
aatgaaagattaaacagatg

SEQ ID NO: 4078906 - DNA, 13 bp, Homo sapiens
aatgaaagtgact

SEQ ID NO: 4078907 - DNA, 21 bp, Homo sapiens
aatgaaataatgtacatctgg

SEQ ID NO: 4078908 - DNA, 14 bp, Homo sapiens
aatgaaatgtatgt

SEQ ID NO: 4078909 - DNA, 16 bp, Homo sapiens
aatgaaatgtatgtgc

SEQ ID NO: 4078910 - DNA, 22 bp, Homo sapiens
aatgaaattaacacaaaggaag

SEQ ID NO: 4078911 - DNA, 17 bp, Homo sapiens
aatgaaattactacaaa

SEQ ID NO: 4078912 - DNA, 23 bp, Homo sapiens
aatgaaattactacaaaatttga

SEQ ID NO: 4078913 - DNA, 21 bp, Homo sapiens
aatgaacatccctttttcaat

SEQ ID NO: 4078914 - DNA, 22 bp, Homo sapiens
aatgaagacatttctgctctca

SEQ ID NO: 4078915 - DNA, 17 bp, Homo sapiens
aatgaagcagctttaaa

SEQ ID NO: 4078916 - DNA, 13 bp, Homo sapiens
aatgaagccagct

SEQ ID NO: 4078917 - DNA, 21 bp, Homo sapiens
aatgaaggttaggatttaaca

SEQ ID NO: 4078918 - DNA, 15 bp, Homo sapiens
aatgaataaactgaa

SEQ ID NO: 4078919 - DNA, 15 bp, Homo sapiens
aatgaatatctatta

SEQ ID NO: 4078920 - DNA, 13 bp, Homo sapiens
aatgaatattgaa

SEQ ID NO: 4078921 - DNA, 15 bp, Homo sapiens
aatgaatattgaagt

SEQ ID NO: 4078922 - DNA, 21 bp, Homo sapiens
aatgaatctcgttcccaaaga

SEQ ID NO: 4078923 - DNA, 17 bp, Homo sapiens
aatgaatttgttctttc

SEQ ID NO: 4078924 - DNA, 17 bp, Homo sapiens
aatgaattttccacgca

SEQ ID NO: 4078925 - DNA, 13 bp, Homo sapiens
aatgacatcttca

SEQ ID NO: 4078926 - DNA, 21 bp, Homo sapiens
aatgacattaaatgcaataat

SEQ ID NO: 4078927 - DNA, 23 bp, Homo sapiens
aatgacattaaatgcaataattt

SEQ ID NO: 4078928 - DNA, 14 bp, Homo sapiens
aatgacattcccct

SEQ ID NO: 4078929 - DNA, 14 bp, Homo sapiens
aatgactacttagc

SEQ ID NO: 4078930 - DNA, 17 bp, Homo sapiens
aatgactctctgaccct

SEQ ID NO: 4078931 - DNA, 15 bp, Homo sapiens
aatgacttatttctg

SEQ ID NO: 4078932 - DNA, 20 bp, Homo sapiens
aatgacttatttctgctctg

SEQ ID NO: 4078933 - DNA, 13 bp, Homo sapiens
aatgacttctaat

SEQ ID NO: 4078934 - DNA, 15 bp, Homo sapiens
aatgagaaggcagcc

SEQ ID NO: 4078935 - DNA, 17 bp, Homo sapiens
aatgagaaggcagccac

SEQ ID NO: 4078936 - DNA, 22 bp, Homo sapiens
aatgagacagcagtcttatgct

SEQ ID NO: 4078937 - DNA, 17 bp, Homo sapiens
aatgagatcccgcctct

SEQ ID NO: 4078938 - DNA, 15 bp, Homo sapiens
aatgagattgaattt

SEQ ID NO: 4078939 - DNA, 17 bp, Homo sapiens
aatgagccatcactaga

SEQ ID NO: 4078940 - DNA, 15 bp, Homo sapiens
aatgaggattattga

SEQ ID NO: 4078941 - DNA, 21 bp, Homo sapiens
aatgagggactggaaccaggg

SEQ ID NO: 4078942 - DNA, 14 bp, Homo sapiens
aatgagggccaaga

SEQ ID NO: 4078943 - DNA, 19 bp, Homo sapiens
aatgaggtctgaaatggag

SEQ ID NO: 4078944 - DNA, 16 bp, Homo sapiens
aatgaggtctgtttaa

SEQ ID NO: 4078945 - DNA, 12 bp, Homo sapiens
aatgagtaacat

SEQ ID NO: 4078946 - DNA, 21 bp, Homo sapiens
aatgatattgacactgtccct

SEQ ID NO: 4078947 - DNA, 15 bp, Homo sapiens
aatgatgagtattag

SEQ ID NO: 4078948 - DNA, 21 bp, Homo sapiens
aatgatgatgtggaagaactt

SEQ ID NO: 4078949 - DNA, 15 bp, Homo sapiens
aatgatgattaaaca

SEQ ID NO: 4078950 - DNA, 16 bp, Homo sapiens
aatgattaatcaaagg

SEQ ID NO: 4078951 - DNA, 14 bp, Homo sapiens
aatgcaaaaccttt

SEQ ID NO: 4078952 - DNA, 19 bp, Homo sapiens
aatgcaagagtgattgcag

SEQ ID NO: 4078953 - DNA, 21 bp, Homo sapiens
aatgcaagagtgattgcagct

SEQ ID NO: 4078954 - DNA, 22 bp, Homo sapiens
aatgcaagagtgattgcagctt

SEQ ID NO: 4078955 - DNA, 17 bp, Homo sapiens
aatgcaagctagtggct

SEQ ID NO: 4078956 - DNA, 13 bp, Homo sapiens
aatgcaataattt

SEQ ID NO: 4078957 - DNA, 24 bp, Homo sapiens
aatgcaatctccccttgatttaaa

SEQ ID NO: 4078958 - DNA, 17 bp, Homo sapiens
aatgcacaagaatggat

SEQ ID NO: 4078959 - DNA, 17 bp, Homo sapiens
aatgcacactagcctct

SEQ ID NO: 4078960 - DNA, 19 bp, Homo sapiens
aatgcacgtagctgaggcc

SEQ ID NO: 4078961 - DNA, 12 bp, Homo sapiens
aatgcagaactc

SEQ ID NO: 4078962 - DNA, 23 bp, Homo sapiens
aatgcagcaaggccctgctgccc

SEQ ID NO: 4078963 - DNA, 17 bp, Homo sapiens
aatgcagtgaattgtga

SEQ ID NO: 4078964 - DNA, 16 bp, Homo sapiens
aatgcagtttcttcat

SEQ ID NO: 4078965 - DNA, 19 bp, Homo sapiens
aatgcatatcctgagccat

SEQ ID NO: 4078966 - DNA, 16 bp, Homo sapiens
aatgcatctagattat

SEQ ID NO: 4078967 - DNA, 19 bp, Homo sapiens
aatgcatctagattatgga

SEQ ID NO: 4078968 - DNA, 14 bp, Homo sapiens
aatgcattcttctc

SEQ ID NO: 4078969 - DNA, 22 bp, Homo sapiens
aatgccctcaggggacttgaat

SEQ ID NO: 4078970 - DNA, 11 bp, Homo sapiens
aatgccctctt

SEQ ID NO: 4078971 - DNA, 16 bp, Homo sapiens
aatgcctaataaacaa

SEQ ID NO: 4078972 - DNA, 12 bp, Homo sapiens
aatgcctcctcc

SEQ ID NO: 4078973 - DNA, 15 bp, Homo sapiens
aatgcctcctccctg

SEQ ID NO: 4078974 - DNA, 17 bp, Homo sapiens
aatgcctcctgtgggga

SEQ ID NO: 4078975 - DNA, 13 bp, Homo sapiens
aatgcctggagac

SEQ ID NO: 4078976 - DNA, 12 bp, Homo sapiens
aatgcctttgag

SEQ ID NO: 4078977 - DNA, 13 bp, Homo sapiens
aatgcctttgaga

SEQ ID NO: 4078978 - DNA, 14 bp, Homo sapiens
aatgcctttgagac

SEQ ID NO: 4078979 - DNA, 19 bp, Homo sapiens
aatgcctttgagacagttt

SEQ ID NO: 4078980 - DNA, 15 bp, Homo sapiens
aatgcgatttcttcc

SEQ ID NO: 4078981 - DNA, 17 bp, Homo sapiens
aatgcgatttcttcctt

SEQ ID NO: 4078982 - DNA, 20 bp, Homo sapiens
aatgcgctttattgcccatg

SEQ ID NO: 4078983 - DNA, 21 bp, Homo sapiens
aatgcggttataaaaaatggt

SEQ ID NO: 4078984 - DNA, 20 bp, Homo sapiens
aatgctattttttattttac

SEQ ID NO: 4078985 - DNA, 14 bp, Homo sapiens
aatgctcaaagaaa

SEQ ID NO: 4078986 - DNA, 18 bp, Homo sapiens
aatgctcattttctggtt

SEQ ID NO: 4078987 - DNA, 16 bp, Homo sapiens
aatgctccccacagcg

SEQ ID NO: 4078988 - DNA, 20 bp, Homo sapiens
aatgctccccacagcgtccc

SEQ ID NO: 4078989 - DNA, 14 bp, Homo sapiens
aatgctctgtgcca

SEQ ID NO: 4078990 - DNA, 23 bp, Homo sapiens
aatgctctttacttcatggactt

SEQ ID NO: 4078991 - DNA, 13 bp, Homo sapiens
aatgctgcactaa

SEQ ID NO: 4078992 - DNA, 17 bp, Homo sapiens
aatgctgccagtgtgga

SEQ ID NO: 4078993 - DNA, 17 bp, Homo sapiens
aatgctgcgcttcgctt

SEQ ID NO: 4078994 - DNA, 17 bp, Homo sapiens
aatgctggactggaggc

SEQ ID NO: 4078995 - DNA, 23 bp, Homo sapiens
aatgctggactggaggcccctgg

SEQ ID NO: 4078996 - DNA, 15 bp, Homo sapiens
aatgctggttttcct

SEQ ID NO: 4078997 - DNA, 12 bp, Homo sapiens
aatgctgtacat

SEQ ID NO: 4078998 - DNA, 15 bp, Homo sapiens
aatgctgtacatcta

SEQ ID NO: 4078999 - DNA, 20 bp, Homo sapiens
aatgcttaaactaaataatg

SEQ ID NO: 4079000 - DNA, 15 bp, Homo sapiens
aatgcttaatttcta

SEQ ID NO: 4079001 - DNA, 20 bp, Homo sapiens
aatgcttaatttctaaagat

SEQ ID NO: 4079002 - DNA, 20 bp, Homo sapiens
aatgcttatcatctaaagat

SEQ ID NO: 4079003 - DNA, 11 bp, Homo sapiens
aatgcttcaga

SEQ ID NO: 4079004 - DNA, 18 bp, Homo sapiens
aatgcttcagatattatt

SEQ ID NO: 4079005 - DNA, 13 bp, Homo sapiens
aatgcttcattca

SEQ ID NO: 4079006 - DNA, 21 bp, Homo sapiens
aatgcttcctgacaatcaact

SEQ ID NO: 4079007 - DNA, 16 bp, Homo sapiens
aatggaaaaaaacata

SEQ ID NO: 4079008 - DNA, 19 bp, Homo sapiens
aatggaaaaaaacataaaa

SEQ ID NO: 4079009 - DNA, 17 bp, Homo sapiens
aatggaaacattacagt

SEQ ID NO: 4079010 - DNA, 20 bp, Homo sapiens
aatggaaggtttgtatattg

SEQ ID NO: 4079011 - DNA, 16 bp, Homo sapiens
aatggaatcgatttcc

SEQ ID NO: 4079012 - DNA, 22 bp, Homo sapiens
aatggacatcctgtataagcac

SEQ ID NO: 4079013 - DNA, 14 bp, Homo sapiens
aatggacatggtgg

SEQ ID NO: 4079014 - DNA, 23 bp, Homo sapiens
aatggactggaaggggaagggac

SEQ ID NO: 4079015 - DNA, 13 bp, Homo sapiens
aatggatcacaag

SEQ ID NO: 4079016 - DNA, 16 bp, Homo sapiens
aatggatcacaagatg

SEQ ID NO: 4079017 - DNA, 22 bp, Homo sapiens
aatggattggattatttaataa

SEQ ID NO: 4079018 - DNA, 13 bp, Homo sapiens
aatggcaaatgca

SEQ ID NO: 4079019 - DNA, 15 bp, Homo sapiens
aatggcagtatttca

SEQ ID NO: 4079020 - DNA, 14 bp, Homo sapiens
aatggcctggaggg

SEQ ID NO: 4079021 - DNA, 21 bp, Homo sapiens
aatggcgcctgctccctccag

SEQ ID NO: 4079022 - DNA, 20 bp, Homo sapiens
aatggctatttttgaagcaa

SEQ ID NO: 4079023 - DNA, 23 bp, Homo sapiens
aatggcttcgttaattaatgtca

SEQ ID NO: 4079024 - DNA, 16 bp, Homo sapiens
aatgggaatattttat

SEQ ID NO: 4079025 - DNA, 18 bp, Homo sapiens
aatgggagacagcctctt

SEQ ID NO: 4079026 - DNA, 15 bp, Homo sapiens
aatgggctcttccaa

SEQ ID NO: 4079027 - DNA, 21 bp, Homo sapiens
aatggggtttgggcccctcag

SEQ ID NO: 4079028 - DNA, 15 bp, Homo sapiens
aatgggttacttgat

SEQ ID NO: 4079029 - DNA, 17 bp, Homo sapiens
aatggtaggcatttcct

SEQ ID NO: 4079030 - DNA, 16 bp, Homo sapiens
aatggtcgcccaggag

SEQ ID NO: 4079031 - DNA, 15 bp, Homo sapiens
aatggttcagaatta

SEQ ID NO: 4079032 - DNA, 14 bp, Homo sapiens
aatggttccatgcc

SEQ ID NO: 4079033 - DNA, 19 bp, Homo sapiens
aatggttccatgcctgagg

SEQ ID NO: 4079034 - DNA, 18 bp, Homo sapiens
aatggttgatggaaaata

SEQ ID NO: 4079035 - DNA, 19 bp, Homo sapiens
aatggttgatggaaaataa

SEQ ID NO: 4079036 - DNA, 17 bp, Homo sapiens
aatgtaaaaaagaaaaa

SEQ ID NO: 4079037 - DNA, 12 bp, Homo sapiens
aatgtaaaatga

SEQ ID NO: 4079038 - DNA, 12 bp, Homo sapiens
aatgtaaatatt

SEQ ID NO: 4079039 - DNA, 14 bp, Homo sapiens
aatgtaaatttata

SEQ ID NO: 4079040 - DNA, 22 bp, Homo sapiens
aatgtaactccagatagagaaa

SEQ ID NO: 4079041 - DNA, 12 bp, Homo sapiens
aatgtaagaaaa

SEQ ID NO: 4079042 - DNA, 16 bp, Homo sapiens
aatgtaagaaaacaaa

SEQ ID NO: 4079043 - DNA, 14 bp, Homo sapiens
aatgtaatactgga

SEQ ID NO: 4079044 - DNA, 16 bp, Homo sapiens
aatgtaatactggaat

SEQ ID NO: 4079045 - DNA, 20 bp, Homo sapiens
aatgtaatactggaataatt

SEQ ID NO: 4079046 - DNA, 17 bp, Homo sapiens
aatgtaatttagaaact

SEQ ID NO: 4079047 - DNA, 19 bp, Homo sapiens
aatgtacttgtttctctgt

SEQ ID NO: 4079048 - DNA, 23 bp, Homo sapiens
aatgtagcgactgtcaacagcgt

SEQ ID NO: 4079049 - DNA, 20 bp, Homo sapiens
aatgtaggtatgaataagtt

SEQ ID NO: 4079050 - DNA, 18 bp, Homo sapiens
aatgtagttttgtttatg

SEQ ID NO: 4079051 - DNA, 13 bp, Homo sapiens
aatgtatgtgcac

SEQ ID NO: 4079052 - DNA, 16 bp, Homo sapiens
aatgtattattctgca

SEQ ID NO: 4079053 - DNA, 19 bp, Homo sapiens
aatgtattgttggtaatta

SEQ ID NO: 4079054 - DNA, 13 bp, Homo sapiens
aatgtattttaca

SEQ ID NO: 4079055 - DNA, 12 bp, Homo sapiens
aatgtattttga

SEQ ID NO: 4079056 - DNA, 17 bp, Homo sapiens
aatgtcaaggaagactt

SEQ ID NO: 4079057 - DNA, 18 bp, Homo sapiens
aatgtcacaacctctctg

SEQ ID NO: 4079058 - DNA, 17 bp, Homo sapiens
aatgtcacttaaaggct

SEQ ID NO: 4079059 - DNA, 17 bp, Homo sapiens
aatgtcagatttctggt

SEQ ID NO: 4079060 - DNA, 18 bp, Homo sapiens
aatgtcagatttctggtt

SEQ ID NO: 4079061 - DNA, 20 bp, Homo sapiens
aatgtcaggaacagaaggat

SEQ ID NO: 4079062 - DNA, 13 bp, Homo sapiens
aatgtcagtattt

SEQ ID NO: 4079063 - DNA, 19 bp, Homo sapiens
aatgtcatatactgccatg

SEQ ID NO: 4079064 - DNA, 18 bp, Homo sapiens
aatgtcctccagaagcct

SEQ ID NO: 4079065 - DNA, 23 bp, Homo sapiens
aatgtcctccagaagcctctggc

SEQ ID NO: 4079066 - DNA, 18 bp, Homo sapiens
aatgtcgagtatattatt

SEQ ID NO: 4079067 - DNA, 14 bp, Homo sapiens
aatgtctattaagg

SEQ ID NO: 4079068 - DNA, 20 bp, Homo sapiens
aatgtctcagttttcagcta

SEQ ID NO: 4079069 - DNA, 15 bp, Homo sapiens
aatgtctgctgagga

SEQ ID NO: 4079070 - DNA, 22 bp, Homo sapiens
aatgtctttgtaagtcagtgtt

SEQ ID NO: 4079071 - DNA, 14 bp, Homo sapiens
aatgtgaaaagtat

SEQ ID NO: 4079072 - DNA, 15 bp, Homo sapiens
aatgtgaaaagtatc

SEQ ID NO: 4079073 - DNA, 13 bp, Homo sapiens
aatgtgaaagcac

SEQ ID NO: 4079074 - DNA, 15 bp, Homo sapiens
aatgtgaagacattt

SEQ ID NO: 4079075 - DNA, 15 bp, Homo sapiens
aatgtgaccaggggt

SEQ ID NO: 4079076 - DNA, 17 bp, Homo sapiens
aatgtgaccaggggtga

SEQ ID NO: 4079077 - DNA, 15 bp, Homo sapiens
aatgtgagaagccag

SEQ ID NO: 4079078 - DNA, 21 bp, Homo sapiens
aatgtgagaagccagccagag

SEQ ID NO: 4079079 - DNA, 19 bp, Homo sapiens
aatgtgcaggtttgttaca

SEQ ID NO: 4079080 - DNA, 17 bp, Homo sapiens
aatgtgcataatgataa

SEQ ID NO: 4079081 - DNA, 15 bp, Homo sapiens
aatgtgcccctggcc

SEQ ID NO: 4079082 - DNA, 18 bp, Homo sapiens
aatgtgcccctggcccat

SEQ ID NO: 4079083 - DNA, 21 bp, Homo sapiens
aatgtgctgaatggttttcaa

SEQ ID NO: 4079084 - DNA, 11 bp, Homo sapiens
aatgtggagaa

SEQ ID NO: 4079085 - DNA, 16 bp, Homo sapiens
aatgtggagaagagtg

SEQ ID NO: 4079086 - DNA, 22 bp, Homo sapiens
aatgtggagaagagtgccctgc

SEQ ID NO: 4079087 - DNA, 19 bp, Homo sapiens
aatgtggagtctccctctg

SEQ ID NO: 4079088 - DNA, 19 bp, Homo sapiens
aatgtggatttgattcatt

SEQ ID NO: 4079089 - DNA, 16 bp, Homo sapiens
aatgtggccacttatt

SEQ ID NO: 4079090 - DNA, 12 bp, Homo sapiens
aatgtggcttga

SEQ ID NO: 4079091 - DNA, 15 bp, Homo sapiens
aatgtggtctcagga

SEQ ID NO: 4079092 - DNA, 21 bp, Homo sapiens
aatgtggttatttctctgatt

SEQ ID NO: 4079093 - DNA, 14 bp, Homo sapiens
aatgtgtcctatct

SEQ ID NO: 4079094 - DNA, 23 bp, Homo sapiens
aatgtgtcctatctatcttccaa

SEQ ID NO: 4079095 - DNA, 16 bp, Homo sapiens
aatgtgtggcctgcac

SEQ ID NO: 4079096 - DNA, 21 bp, Homo sapiens
aatgtgtggtggcctcagctg

SEQ ID NO: 4079097 - DNA, 22 bp, Homo sapiens
aatgttaaatttgtaagtttca

SEQ ID NO: 4079098 - DNA, 14 bp, Homo sapiens
aatgttaagaattg

SEQ ID NO: 4079099 - DNA, 15 bp, Homo sapiens
aatgttaagaattga

SEQ ID NO: 4079100 - DNA, 13 bp, Homo sapiens
aatgttaagcaga

SEQ ID NO: 4079101 - DNA, 23 bp, Homo sapiens
aatgttaattcagcactgatttc

SEQ ID NO: 4079102 - DNA, 15 bp, Homo sapiens
aatgttacattatta

SEQ ID NO: 4079103 - DNA, 16 bp, Homo sapiens
aatgttagtcattgtt

SEQ ID NO: 4079104 - DNA, 17 bp, Homo sapiens
aatgttatatcatatgt

SEQ ID NO: 4079105 - DNA, 19 bp, Homo sapiens
aatgttatgactatgtaaa

SEQ ID NO: 4079106 - DNA, 22 bp, Homo sapiens
aatgttatgttgtgttctaata

SEQ ID NO: 4079107 - DNA, 20 bp, Homo sapiens
aatgttattttttaattatt

SEQ ID NO: 4079108 - DNA, 12 bp, Homo sapiens
aatgttcattgt

SEQ ID NO: 4079109 - DNA, 17 bp, Homo sapiens
aatgttcattgtaatgt

SEQ ID NO: 4079110 - DNA, 24 bp, Homo sapiens
aatgttcattgtaatgttactgat

SEQ ID NO: 4079111 - DNA, 15 bp, Homo sapiens
aatgttccttttgct

SEQ ID NO: 4079112 - DNA, 20 bp, Homo sapiens
aatgttctatggttatgaaa

SEQ ID NO: 4079113 - DNA, 21 bp, Homo sapiens
aatgttctatggttatgaaag

SEQ ID NO: 4079114 - DNA, 15 bp, Homo sapiens
aatgttctgacatta

SEQ ID NO: 4079115 - DNA, 19 bp, Homo sapiens
aatgttctgacattaacag

SEQ ID NO: 4079116 - DNA, 22 bp, Homo sapiens
aatgttcttatgcaaaatggaa

SEQ ID NO: 4079117 - DNA, 14 bp, Homo sapiens
aatgttctttggaa

SEQ ID NO: 4079118 - DNA, 22 bp, Homo sapiens
aatgttctttggaaagtacact

SEQ ID NO: 4079119 - DNA, 17 bp, Homo sapiens
aatgttgaaaagtaatt

SEQ ID NO: 4079120 - DNA, 18 bp, Homo sapiens
aatgttgagaatcccaaa

SEQ ID NO: 4079121 - DNA, 19 bp, Homo sapiens
aatgttggatttataaatg

SEQ ID NO: 4079122 - DNA, 23 bp, Homo sapiens
aatgttggcagatgcagctcttc

SEQ ID NO: 4079123 - DNA, 22 bp, Homo sapiens
aatgttgtagttacctactgag

SEQ ID NO: 4079124 - DNA, 15 bp, Homo sapiens
aatgttgttatttaa

SEQ ID NO: 4079125 - DNA, 16 bp, Homo sapiens
aatgtttaaatcatgt

SEQ ID NO: 4079126 - DNA, 18 bp, Homo sapiens
aatgtttaaatcatgtat

SEQ ID NO: 4079127 - DNA, 20 bp, Homo sapiens
aatgtttacactctttgtaa

SEQ ID NO: 4079128 - DNA, 18 bp, Homo sapiens
aatgtttatgagccagac

SEQ ID NO: 4079129 - DNA, 13 bp, Homo sapiens
aatgttttaaatt

SEQ ID NO: 4079130 - DNA, 14 bp, Homo sapiens
aatgttttaaattc

SEQ ID NO: 4079131 - DNA, 15 bp, Homo sapiens
aatgttttaaattct

SEQ ID NO: 4079132 - DNA, 22 bp, Homo sapiens
aatgttttactgtgaaactggc

SEQ ID NO: 4079133 - DNA, 18 bp, Homo sapiens
aatgttttgtatatacag

SEQ ID NO: 4079134 - DNA, 19 bp, Homo sapiens
aatgttttgtatatacagt

SEQ ID NO: 4079135 - DNA, 21 bp, Homo sapiens
aatgtttttccctccccagaa

SEQ ID NO: 4079136 - DNA, 15 bp, Homo sapiens
aatgtttttctgcca

SEQ ID NO: 4079137 - DNA, 23 bp, Homo sapiens
aatgttttttgccacagcttttg

SEQ ID NO: 4079138 - DNA, 16 bp, Homo sapiens
aattaaaacagctgca

SEQ ID NO: 4079139 - DNA, 21 bp, Homo sapiens
aattaaaacgaaaataaagta

SEQ ID NO: 4079140 - DNA, 16 bp, Homo sapiens
aattaaaacttcttaa

SEQ ID NO: 4079141 - DNA, 20 bp, Homo sapiens
aattaaaacttcttaaatat

SEQ ID NO: 4079142 - DNA, 12 bp, Homo sapiens
aattaaatgtat

SEQ ID NO: 4079143 - DNA, 14 bp, Homo sapiens
aattaaatgtattt

SEQ ID NO: 4079144 - DNA, 12 bp, Homo sapiens
aattaaatttaa

SEQ ID NO: 4079145 - DNA, 14 bp, Homo sapiens
aattcttgtatatt

SEQ ID NO: 4079146 - DNA, 20 bp, Homo sapiens
aattcttgtatattatggaa

SEQ ID NO: 4079147 - DNA, 22 bp, Homo sapiens
aattctttaaaattacaactaa

SEQ ID NO: 4079148 - DNA, 22 bp, Homo sapiens
aattgaaactagttattttata

SEQ ID NO: 4079149 - DNA, 18 bp, Homo sapiens
aattgaagtaaacttttt

SEQ ID NO: 4079150 - DNA, 21 bp, Homo sapiens
aattgaatcagtataaacaaa

SEQ ID NO: 4079151 - DNA, 18 bp, Homo sapiens
aattgaccatctgctttt

SEQ ID NO: 4079152 - DNA, 19 bp, Homo sapiens
aattgaccatctgctttta

SEQ ID NO: 4079153 - DNA, 23 bp, Homo sapiens
aattgaccgacagctttccagta

SEQ ID NO: 4079154 - DNA, 20 bp, Homo sapiens
aattgagataatatctgtga

SEQ ID NO: 4079155 - DNA, 22 bp, Homo sapiens
aattgatcattttccccccact

SEQ ID NO: 4079156 - DNA, 14 bp, Homo sapiens
aattgatgtgttta

SEQ ID NO: 4079157 - DNA, 16 bp, Homo sapiens
aattgatttgcattga

SEQ ID NO: 4079158 - DNA, 20 bp, Homo sapiens
aattgatttgcattgaacac

SEQ ID NO: 4079159 - DNA, 23 bp, Homo sapiens
aattgatttgcattgaacacaaa

SEQ ID NO: 4079160 - DNA, 16 bp, Homo sapiens
aattgatttttcttct

SEQ ID NO: 4079161 - DNA, 16 bp, Homo sapiens
aattgcaatttcttag

SEQ ID NO: 4079162 - DNA, 13 bp, Homo sapiens
aattgcactaaat

SEQ ID NO: 4079163 - DNA, 16 bp, Homo sapiens
aattgcatttgctttt

SEQ ID NO: 4079164 - DNA, 13 bp, Homo sapiens
aattgctatgtta

SEQ ID NO: 4079165 - DNA, 21 bp, Homo sapiens
aattgctatgttactattttc

SEQ ID NO: 4079166 - DNA, 21 bp, Homo sapiens
aattgcttacatttttacaat

SEQ ID NO: 4079167 - DNA, 19 bp, Homo sapiens
aattgcttaccaaaggata

SEQ ID NO: 4079168 - DNA, 16 bp, Homo sapiens
aattggaggaaagcaa

SEQ ID NO: 4079169 - DNA, 15 bp, Homo sapiens
aattggcagtgactt

SEQ ID NO: 4079170 - DNA, 16 bp, Homo sapiens
aattgggacaacagtg

SEQ ID NO: 4079171 - DNA, 18 bp, Homo sapiens
aattggtatcaagaaagt

SEQ ID NO: 4079172 - DNA, 21 bp, Homo sapiens
aattggttggagaatttaggt

SEQ ID NO: 4079173 - DNA, 20 bp, Homo sapiens
aattgtatctagtgcagctg

SEQ ID NO: 4079174 - DNA, 18 bp, Homo sapiens
aattgtctaaaatgtcag

SEQ ID NO: 4079175 - DNA, 14 bp, Homo sapiens
aattgtctatttat

SEQ ID NO: 4079176 - DNA, 17 bp, Homo sapiens
aattgtctatttatctt

SEQ ID NO: 4079177 - DNA, 18 bp, Homo sapiens
aattgtctcaacgcctcc

SEQ ID NO: 4079178 - DNA, 20 bp, Homo sapiens
aattgtctcaacgcctcccc

SEQ ID NO: 4079179 - DNA, 15 bp, Homo sapiens
aattgtgaactcatt

SEQ ID NO: 4079180 - DNA, 14 bp, Homo sapiens
aattgtgctgccat

SEQ ID NO: 4079181 - DNA, 16 bp, Homo sapiens
aattgtgctgccattt

SEQ ID NO: 4079182 - DNA, 19 bp, Homo sapiens
aattgtgctgccatttgat

SEQ ID NO: 4079183 - DNA, 23 bp, Homo sapiens
aattgtgtaaaaaatggaaaaaa

SEQ ID NO: 4079184 - DNA, 15 bp, Homo sapiens
aattgtgtagccttt

SEQ ID NO: 4079185 - DNA, 19 bp, Homo sapiens
aattgtgttgtcttcagca

SEQ ID NO: 4079186 - DNA, 24 bp, Homo sapiens
aattgttaccactggtaacatgtg

SEQ ID NO: 4079187 - DNA, 18 bp, Homo sapiens
aattgttgaaattttgca

SEQ ID NO: 4079188 - DNA, 20 bp, Homo sapiens
aattgttgaaattttgcaaa

SEQ ID NO: 4079189 - DNA, 15 bp, Homo sapiens
aattgttgtttcttt

SEQ ID NO: 4079190 - DNA, 18 bp, Homo sapiens
aattgttgtttctttcta

SEQ ID NO: 4079191 - DNA, 15 bp, Homo sapiens
aattgtttaagtgtt

SEQ ID NO: 4079192 - DNA, 20 bp, Homo sapiens
aattgtttaagtgttgtaaa

SEQ ID NO: 4079193 - DNA, 15 bp, Homo sapiens
aattgtttcatatct

SEQ ID NO: 4079194 - DNA, 15 bp, Homo sapiens
aattgttttctttaa

SEQ ID NO: 4079195 - DNA, 19 bp, Homo sapiens
aattgttttctttaaagat

SEQ ID NO: 4079196 - DNA, 17 bp, Homo sapiens
aattgttttgcactttt

SEQ ID NO: 4079197 - DNA, 23 bp, Homo sapiens
aattgtttttgaatttaaataaa

SEQ ID NO: 4079198 - DNA, 16 bp, Homo sapiens
aatttaaaattaagta

SEQ ID NO: 4079199 - DNA, 16 bp, Homo sapiens
aatttaaaattacgtt

SEQ ID NO: 4079200 - DNA, 10 bp, Homo sapiens
aatttaaaca

SEQ ID NO: 4079201 - DNA, 16 bp, Homo sapiens
aatttaaacatttgtt

SEQ ID NO: 4079202 - DNA, 22 bp, Homo sapiens
aatttaaacatttgttcctgga

SEQ ID NO: 4079203 - DNA, 21 bp, Homo sapiens
aatttaaagggtgtacttata

SEQ ID NO: 4079204 - DNA, 14 bp, Homo sapiens
aatttaaataaagt

SEQ ID NO: 4079205 - DNA, 15 bp, Homo sapiens
aatttaaataaagtt

SEQ ID NO: 4079206 - DNA, 18 bp, Homo sapiens
aatttaaataaagttact

SEQ ID NO: 4079207 - DNA, 13 bp, Homo sapiens
aatttaaatgtta

SEQ ID NO: 4079208 - DNA, 18 bp, Homo sapiens
aatttaaatttaaagata

SEQ ID NO: 4079209 - DNA, 17 bp, Homo sapiens
aatttaacaaactaaaa

SEQ ID NO: 4079210 - DNA, 19 bp, Homo sapiens
aatttaacaccctttagaa

SEQ ID NO: 4079211 - DNA, 15 bp, Homo sapiens
aatttaagcattgtt

SEQ ID NO: 4079212 - DNA, 23 bp, Homo sapiens
aatttaagtgcgtgtgtagagtt

SEQ ID NO: 4079213 - DNA, 18 bp, Homo sapiens
aatttaatccttctttgt

SEQ ID NO: 4079214 - DNA, 21 bp, Homo sapiens
aatttaatccttctttgtaat

SEQ ID NO: 4079215 - DNA, 21 bp, Homo sapiens
aatttacaaaaatataaaata

SEQ ID NO: 4079216 - DNA, 16 bp, Homo sapiens
aatttaccatcatctc

SEQ ID NO: 4079217 - DNA, 19 bp, Homo sapiens
aatttagaaactgatttct

SEQ ID NO: 4079218 - DNA, 20 bp, Homo sapiens
aatttagaaactgatttctt

SEQ ID NO: 4079219 - DNA, 17 bp, Homo sapiens
aatttagaaatataatt

SEQ ID NO: 4079220 - DNA, 17 bp, Homo sapiens
aatttagggtactaaat

SEQ ID NO: 4079221 - DNA, 21 bp, Homo sapiens
aatttagggtactaaatttaa

SEQ ID NO: 4079222 - DNA, 21 bp, Homo sapiens
aatttagtgatcttagcatag

SEQ ID NO: 4079223 - DNA, 23 bp, Homo sapiens
aatttagtgatcttagcatagct

SEQ ID NO: 4079224 - DNA, 16 bp, Homo sapiens
aatttagtgtatccat

SEQ ID NO: 4079225 - DNA, 16 bp, Homo sapiens
aatttatatgtatatt

SEQ ID NO: 4079226 - DNA, 16 bp, Homo sapiens
aatttatattatccat

SEQ ID NO: 4079227 - DNA, 12 bp, Homo sapiens
aatttatctaaa

SEQ ID NO: 4079228 - DNA, 14 bp, Homo sapiens
aatttatcttaagt

SEQ ID NO: 4079229 - DNA, 19 bp, Homo sapiens
aatttatcttgtctctggg

SEQ ID NO: 4079230 - DNA, 16 bp, Homo sapiens
aatttatgagtttttg

SEQ ID NO: 4079231 - DNA, 19 bp, Homo sapiens
aatttatgagtttttgata

SEQ ID NO: 4079232 - DNA, 15 bp, Homo sapiens
aatttatgtgaaatg

SEQ ID NO: 4079233 - DNA, 12 bp, Homo sapiens
aatttattcaat

SEQ ID NO: 4079234 - DNA, 12 bp, Homo sapiens
aatttatttcaa

SEQ ID NO: 4079235 - DNA, 14 bp, Homo sapiens
aatttatttcaata

SEQ ID NO: 4079236 - DNA, 15 bp, Homo sapiens
aatttatttccccag

SEQ ID NO: 4079237 - DNA, 12 bp, Homo sapiens
aatttcaaaatg

SEQ ID NO: 4079238 - DNA, 23 bp, Homo sapiens
aatttcactgtctttaattctgt

SEQ ID NO: 4079239 - DNA, 21 bp, Homo sapiens
aatttcacttcaggagaaact

SEQ ID NO: 4079240 - DNA, 13 bp, Homo sapiens
aatttcagactcc

SEQ ID NO: 4079241 - DNA, 14 bp, Homo sapiens
aatttcagtccaga

SEQ ID NO: 4079242 - DNA, 18 bp, Homo sapiens
aatttcatatgctgtata

SEQ ID NO: 4079243 - DNA, 21 bp, Homo sapiens
aatttccacaaaatctgtcca

SEQ ID NO: 4079244 - DNA, 14 bp, Homo sapiens
aatttccactgtaa

SEQ ID NO: 4079245 - DNA, 14 bp, Homo sapiens
aatttcccaggacc

SEQ ID NO: 4079246 - DNA, 16 bp, Homo sapiens
aatttccctcaggttc

SEQ ID NO: 4079247 - DNA, 13 bp, Homo sapiens
aatttctgtcctt

SEQ ID NO: 4079248 - DNA, 14 bp, Homo sapiens
aatttcttatgtga

SEQ ID NO: 4079249 - DNA, 20 bp, Homo sapiens
aatttcttatgtgacattaa

SEQ ID NO: 4079250 - DNA, 20 bp, Homo sapiens
aatttcttttccttcattca

SEQ ID NO: 4079251 - DNA, 23 bp, Homo sapiens
aatttcttttccttcattcatag

SEQ ID NO: 4079252 - DNA, 14 bp, Homo sapiens
aatttgaaatttag

SEQ ID NO: 4079253 - DNA, 14 bp, Homo sapiens
aatttgaagtaatg

SEQ ID NO: 4079254 - DNA, 13 bp, Homo sapiens
aatttgaatgaaa

SEQ ID NO: 4079255 - DNA, 13 bp, Homo sapiens
aatttgatacata

SEQ ID NO: 4079256 - DNA, 14 bp, Homo sapiens
aatttgatacataa

SEQ ID NO: 4079257 - DNA, 17 bp, Homo sapiens
aatttgatacataataa

SEQ ID NO: 4079258 - DNA, 14 bp, Homo sapiens
aatttgattgattt

SEQ ID NO: 4079259 - DNA, 22 bp, Homo sapiens
aatttgcacatcttggctatgt

SEQ ID NO: 4079260 - DNA, 16 bp, Homo sapiens
aatttgcatattctat

SEQ ID NO: 4079261 - DNA, 15 bp, Homo sapiens
aatttgcattaaatt

SEQ ID NO: 4079262 - DNA, 18 bp, Homo sapiens
aatttgcattaaattcac

SEQ ID NO: 4079263 - DNA, 16 bp, Homo sapiens
aatttggattgctaat

SEQ ID NO: 4079264 - DNA, 16 bp, Homo sapiens
aatttggttctaatag

SEQ ID NO: 4079265 - DNA, 17 bp, Homo sapiens
aatttggttctaggccg

SEQ ID NO: 4079266 - DNA, 16 bp, Homo sapiens
aatttgtaacctcagc

SEQ ID NO: 4079267 - DNA, 13 bp, Homo sapiens
aatttgtaagttt

SEQ ID NO: 4079268 - DNA, 16 bp, Homo sapiens
aatttgtaagtttcag

SEQ ID NO: 4079269 - DNA, 19 bp, Homo sapiens
aatttgtaattgcttacat

SEQ ID NO: 4079270 - DNA, 10 bp, Homo sapiens
aatttgtcag

SEQ ID NO: 4079271 - DNA, 15 bp, Homo sapiens
aatttgtttaaagaa

SEQ ID NO: 4079272 - DNA, 17 bp, Homo sapiens
aattttaaataatttct

SEQ ID NO: 4079273 - DNA, 13 bp, Homo sapiens
aattttaactgta

SEQ ID NO: 4079274 - DNA, 19 bp, Homo sapiens
aattttaagtgctttgtaa

SEQ ID NO: 4079275 - DNA, 14 bp, Homo sapiens
aattttaatgtgaa

SEQ ID NO: 4079276 - DNA, 13 bp, Homo sapiens
aattttagaactt

SEQ ID NO: 4079277 - DNA, 17 bp, Homo sapiens
aattttagtccaaataa

SEQ ID NO: 4079278 - DNA, 21 bp, Homo sapiens
aattttataaggacttcctga

SEQ ID NO: 4079279 - DNA, 12 bp, Homo sapiens
aattttatgaat

SEQ ID NO: 4079280 - DNA, 20 bp, Homo sapiens
aattttattttgtgctcatt

SEQ ID NO: 4079281 - DNA, 15 bp, Homo sapiens
aattttcaagtaatt

SEQ ID NO: 4079282 - DNA, 15 bp, Homo sapiens
aattttccacgcagt

SEQ ID NO: 4079283 - DNA, 17 bp, Homo sapiens
aattttctcaaaagcat

SEQ ID NO: 4079284 - DNA, 13 bp, Homo sapiens
aattttctccctt

SEQ ID NO: 4079285 - DNA, 13 bp, Homo sapiens
aattttcttcatg

SEQ ID NO: 4079286 - DNA, 19 bp, Homo sapiens
aattttcttcatgcaatga

SEQ ID NO: 4079287 - DNA, 21 bp, Homo sapiens
aattttgaataaataaatgta

SEQ ID NO: 4079288 - DNA, 20 bp, Homo sapiens
aattttgagttctacataag

SEQ ID NO: 4079289 - DNA, 15 bp, Homo sapiens
aattttgcaaatata

SEQ ID NO: 4079290 - DNA, 21 bp, Homo sapiens
aattttgcaaatataaacatc

SEQ ID NO: 4079291 - DNA, 20 bp, Homo sapiens
aattttgctggaattcctaa

SEQ ID NO: 4079292 - DNA, 12 bp, Homo sapiens
aattttggattt

SEQ ID NO: 4079293 - DNA, 17 bp, Homo sapiens
aattttggccaaagtgt

SEQ ID NO: 4079294 - DNA, 21 bp, Homo sapiens
aattttgtttttattttcaag

SEQ ID NO: 4079295 - DNA, 22 bp, Homo sapiens
aattttgtttttattttcaaga

SEQ ID NO: 4079296 - DNA, 13 bp, Homo sapiens
aatttttaaagta

SEQ ID NO: 4079297 - DNA, 20 bp, Homo sapiens
aatttttaaagtatatattt

SEQ ID NO: 4079298 - DNA, 13 bp, Homo sapiens
aatttttaagcaa

SEQ ID NO: 4079299 - DNA, 11 bp, Homo sapiens
aatttttaatt

SEQ ID NO: 4079300 - DNA, 14 bp, Homo sapiens
aatttttacattca

SEQ ID NO: 4079301 - DNA, 13 bp, Homo sapiens
aatttttagaaag

SEQ ID NO: 4079302 - DNA, 16 bp, Homo sapiens
aatttttaggaagttt

SEQ ID NO: 4079303 - DNA, 21 bp, Homo sapiens
aatttttatttctttttaatt

SEQ ID NO: 4079304 - DNA, 19 bp, Homo sapiens
aatttttcagcacttaact

SEQ ID NO: 4079305 - DNA, 19 bp, Homo sapiens
aatttttggggaaaaaagc

SEQ ID NO: 4079306 - DNA, 13 bp, Homo sapiens
aatttttgtagta

SEQ ID NO: 4079307 - DNA, 17 bp, Homo sapiens
aatttttgtctcagaag

SEQ ID NO: 4079308 - DNA, 15 bp, Homo sapiens
aatttttttcaatat

SEQ ID NO: 4079309 - DNA, 16 bp, Homo sapiens
aattttttttacattt

SEQ ID NO: 4079310 - DNA, 14 bp, Homo sapiens
aattttttttttcc

SEQ ID NO: 4079311 - DNA, 21 bp, Homo sapiens
acaaaaaaaaagttttatttt

SEQ ID NO: 4079312 - DNA, 13 bp, Homo sapiens
acaaaaaaatata

SEQ ID NO: 4079313 - DNA, 20 bp, Homo sapiens
acaaaaaaatatatttaatg

SEQ ID NO: 4079314 - DNA, 21 bp, Homo sapiens
acaaaaaagacttgagacaat

SEQ ID NO: 4079315 - DNA, 22 bp, Homo sapiens
acaaaaacaggtatatactttg

SEQ ID NO: 4079316 - DNA, 14 bp, Homo sapiens
acaaaaagcttccc

SEQ ID NO: 4079317 - DNA, 15 bp, Homo sapiens
acaaaaagttttttt

SEQ ID NO: 4079318 - DNA, 21 bp, Homo sapiens
acaaaaagttttttttttgtt

SEQ ID NO: 4079319 - DNA, 14 bp, Homo sapiens
acaaaaattaggta

SEQ ID NO: 4079320 - DNA, 17 bp, Homo sapiens
acaaaacccatgcattt

SEQ ID NO: 4079321 - DNA, 17 bp, Homo sapiens
acaaaactacatgagaa

SEQ ID NO: 4079322 - DNA, 11 bp, Homo sapiens
acaaaacttcc

SEQ ID NO: 4079323 - DNA, 15 bp, Homo sapiens
acaaaagaaaagact

SEQ ID NO: 4079324 - DNA, 20 bp, Homo sapiens
acaaaagaaaagacttgtaa

SEQ ID NO: 4079325 - DNA, 18 bp, Homo sapiens
acaaaagaaataccttga

SEQ ID NO: 4079326 - DNA, 16 bp, Homo sapiens
acaaaagagcagcatt

SEQ ID NO: 4079327 - DNA, 23 bp, Homo sapiens
acaaaagcaagactgttgctcaa

SEQ ID NO: 4079328 - DNA, 21 bp, Homo sapiens
acaaaagggtttaaactgatt

SEQ ID NO: 4079329 - DNA, 15 bp, Homo sapiens
acaaaagtctgtctt

SEQ ID NO: 4079330 - DNA, 20 bp, Homo sapiens
acaaaatccagctatgaata

SEQ ID NO: 4079331 - DNA, 18 bp, Homo sapiens
acaaaatctaaaacaaaa

SEQ ID NO: 4079332 - DNA, 16 bp, Homo sapiens
acaaaatgtctcagtt

SEQ ID NO: 4079333 - DNA, 16 bp, Homo sapiens
acaaaattttctcatt

SEQ ID NO: 4079334 - DNA, 14 bp, Homo sapiens
acaaacaaaagcat

SEQ ID NO: 4079335 - DNA, 22 bp, Homo sapiens
acaaaccaacatctttgcgaaa

SEQ ID NO: 4079336 - DNA, 18 bp, Homo sapiens
acaaacctagaattttct

SEQ ID NO: 4079337 - DNA, 16 bp, Homo sapiens
acaaacgtgtttttta

SEQ ID NO: 4079338 - DNA, 15 bp, Homo sapiens
acaaactaaaaatat

SEQ ID NO: 4079339 - DNA, 10 bp, Homo sapiens
acaaactgca

SEQ ID NO: 4079340 - DNA, 21 bp, Homo sapiens
acaaactttagggtaaaaatt

SEQ ID NO: 4079341 - DNA, 22 bp, Homo sapiens
acaaactttagggtaaaaattg

SEQ ID NO: 4079342 - DNA, 12 bp, Homo sapiens
acaaagaaatat

SEQ ID NO: 4079343 - DNA, 22 bp, Homo sapiens
acaaagaaatccggagaagctg

SEQ ID NO: 4079344 - DNA, 14 bp, Homo sapiens
acaaagcagccacg

SEQ ID NO: 4079345 - DNA, 18 bp, Homo sapiens
acaaagcgtttctttact

SEQ ID NO: 4079346 - DNA, 20 bp, Homo sapiens
acaaagcgtttctttacttc

SEQ ID NO: 4079347 - DNA, 19 bp, Homo sapiens
acaaaggcaagttaagaga

SEQ ID NO: 4079348 - DNA, 19 bp, Homo sapiens
acaaaggtataattttatg

SEQ ID NO: 4079349 - DNA, 20 bp, Homo sapiens
acaaagtaaatacaagactg

SEQ ID NO: 4079350 - DNA, 22 bp, Homo sapiens
acaaagtaaatacaagactgtt

SEQ ID NO: 4079351 - DNA, 18 bp, Homo sapiens
acaaagtgactgtttggc

SEQ ID NO: 4079352 - DNA, 19 bp, Homo sapiens
aagggccatgctgaaggga

SEQ ID NO: 4079353 - DNA, 18 bp, Homo sapiens
aagggctttgagggtgga

SEQ ID NO: 4079354 - DNA, 16 bp, Homo sapiens
aaggggaatctggagg

SEQ ID NO: 4079355 - DNA, 16 bp, Homo sapiens
aaggggagaagggaat

SEQ ID NO: 4079356 - DNA, 19 bp, Homo sapiens
aaggggagagcctgctggc

SEQ ID NO: 4079357 - DNA, 16 bp, Homo sapiens
aaggggagcccactgt

SEQ ID NO: 4079358 - DNA, 14 bp, Homo sapiens
aaggggaggcagcc

SEQ ID NO: 4079359 - DNA, 20 bp, Homo sapiens
aaggggcggtgcccacaccg

SEQ ID NO: 4079360 - DNA, 19 bp, Homo sapiens
aagggggggctacattata

SEQ ID NO: 4079361 - DNA, 16 bp, Homo sapiens
aagggggtccacccag

SEQ ID NO: 4079362 - DNA, 19 bp, Homo sapiens
aaggggttcctcaaatttt

SEQ ID NO: 4079363 - DNA, 15 bp, Homo sapiens
aaggggttggggtga

SEQ ID NO: 4079364 - DNA, 19 bp, Homo sapiens
aaggggttggggtgacagt

SEQ ID NO: 4079365 - DNA, 22 bp, Homo sapiens
aaggggttggggtgacagtcat

SEQ ID NO: 4079366 - DNA, 13 bp, Homo sapiens
aagggtaaagaag

SEQ ID NO: 4079367 - DNA, 15 bp, Homo sapiens
aagggtcaaacctgt

SEQ ID NO: 4079368 - DNA, 15 bp, Homo sapiens
aagggttaaggcctg

SEQ ID NO: 4079369 - DNA, 16 bp, Homo sapiens
aagggttaaggcctga

SEQ ID NO: 4079370 - DNA, 22 bp, Homo sapiens
aagggttgagagccagtggcgg

SEQ ID NO: 4079371 - DNA, 20 bp, Homo sapiens
aaggtagaaatatctgaaaa

SEQ ID NO: 4079372 - DNA, 22 bp, Homo sapiens
aaggtagtttttacctaccaca

SEQ ID NO: 4079373 - DNA, 20 bp, Homo sapiens
aaggtccactccctgctcca

SEQ ID NO: 4079374 - DNA, 18 bp, Homo sapiens
aaggtcttacattgcctg

SEQ ID NO: 4079375 - DNA, 14 bp, Homo sapiens
aaggtgcagttccc

SEQ ID NO: 4079376 - DNA, 15 bp, Homo sapiens
aaggtgcctcagact

SEQ ID NO: 4079377 - DNA, 22 bp, Homo sapiens
aaggtggaccttttaaagtgtt

SEQ ID NO: 4079378 - DNA, 22 bp, Homo sapiens
aaggtggtatgtaatttatgca

SEQ ID NO: 4079379 - DNA, 15 bp, Homo sapiens
aaggtgtgagactgg

SEQ ID NO: 4079380 - DNA, 17 bp, Homo sapiens
aaggttcactaaagcag

SEQ ID NO: 4079381 - DNA, 18 bp, Homo sapiens
aaggttggagcccagggc

SEQ ID NO: 4079382 - DNA, 22 bp, Homo sapiens
aaggttttggatcttgaatgtg

SEQ ID NO: 4079383 - DNA, 12 bp, Homo sapiens
aaggttttgtat

SEQ ID NO: 4079384 - DNA, 17 bp, Homo sapiens
aaggttttttttcagtt

SEQ ID NO: 4079385 - DNA, 12 bp, Homo sapiens
aagtaaactttt

SEQ ID NO: 4079386 - DNA, 17 bp, Homo sapiens
aagtaaatctcttctgt

SEQ ID NO: 4079387 - DNA, 21 bp, Homo sapiens
aagtaaattgcctgatttgtt

SEQ ID NO: 4079388 - DNA, 15 bp, Homo sapiens
aagtaacgcaataaa

SEQ ID NO: 4079389 - DNA, 20 bp, Homo sapiens
aagtaagaaagtgaagcaaa

SEQ ID NO: 4079390 - DNA, 13 bp, Homo sapiens
aagtaagaagaca

SEQ ID NO: 4079391 - DNA, 12 bp, Homo sapiens
aagtaagttaat

SEQ ID NO: 4079392 - DNA, 19 bp, Homo sapiens
aagtaagttaataatgtat

SEQ ID NO: 4079393 - DNA, 21 bp, Homo sapiens
aagtaatgaatttttatgata

SEQ ID NO: 4079394 - DNA, 11 bp, Homo sapiens
aagtaattatc

SEQ ID NO: 4079395 - DNA, 20 bp, Homo sapiens
aagtacatattaggaaaata

SEQ ID NO: 4079396 - DNA, 22 bp, Homo sapiens
aagtacttgagtgtaatgtttg

SEQ ID NO: 4079397 - DNA, 18 bp, Homo sapiens
aagtagaaaagttgcaga

SEQ ID NO: 4079398 - DNA, 12 bp, Homo sapiens
aagtagaagagg

SEQ ID NO: 4079399 - DNA, 16 bp, Homo sapiens
aagtagaagcatgttt

SEQ ID NO: 4079400 - DNA, 18 bp, Homo sapiens
aagtaggggcagtgatgg

SEQ ID NO: 4079401 - DNA, 17 bp, Homo sapiens
aagtagtccttggcata

SEQ ID NO: 4079402 - DNA, 12 bp, Homo sapiens
aagtatacagtt

SEQ ID NO: 4079403 - DNA, 21 bp, Homo sapiens
aagtatacagttcaataaact

SEQ ID NO: 4079404 - DNA, 12 bp, Homo sapiens
aagtatactttt

SEQ ID NO: 4079405 - DNA, 14 bp, Homo sapiens
aagtatacttttcc

SEQ ID NO: 4079406 - DNA, 13 bp, Homo sapiens
aagtatcactcta

SEQ ID NO: 4079407 - DNA, 20 bp, Homo sapiens
aagtatcactctaaaaaaca

SEQ ID NO: 4079408 - DNA, 22 bp, Homo sapiens
aagtatcactctaaaaaacatt

SEQ ID NO: 4079409 - DNA, 15 bp, Homo sapiens
aagtatcctgcgacc

SEQ ID NO: 4079410 - DNA, 19 bp, Homo sapiens
aagtatcttctatttttat

SEQ ID NO: 4079411 - DNA, 21 bp, Homo sapiens
aagtatcttctatttttatca

SEQ ID NO: 4079412 - DNA, 18 bp, Homo sapiens
aagtatcttttttcaaaa

SEQ ID NO: 4079413 - DNA, 21 bp, Homo sapiens
aagtatgagggaaaatgagta

SEQ ID NO: 4079414 - DNA, 18 bp, Homo sapiens
aagtatgtgtaaaatgtg

SEQ ID NO: 4079415 - DNA, 15 bp, Homo sapiens
aagtattaacttaca

SEQ ID NO: 4079416 - DNA, 19 bp, Homo sapiens
aagtattcttatttaatga

SEQ ID NO: 4079417 - DNA, 14 bp, Homo sapiens
aagtatttatatat

SEQ ID NO: 4079418 - DNA, 20 bp, Homo sapiens
aagtatttatatatttataa

SEQ ID NO: 4079419 - DNA, 21 bp, Homo sapiens
aagtatttatatatttataac

SEQ ID NO: 4079420 - DNA, 21 bp, Homo sapiens
aagtatttttataaatataag

SEQ ID NO: 4079421 - DNA, 15 bp, Homo sapiens
aagtcaaacttggat

SEQ ID NO: 4079422 - DNA, 19 bp, Homo sapiens
aagtcaaattaataatctt

SEQ ID NO: 4079423 - DNA, 23 bp, Homo sapiens
aagtcacacagctagtgaagacc

SEQ ID NO: 4079424 - DNA, 19 bp, Homo sapiens
aagtcactgcaaaaccagg

SEQ ID NO: 4079425 - DNA, 22 bp, Homo sapiens
aagtcactgcaaaaccaggttt

SEQ ID NO: 4079426 - DNA, 22 bp, Homo sapiens
aagtcactgcacagtgcatctc

SEQ ID NO: 4079427 - DNA, 12 bp, Homo sapiens
aagtcagtcacg

SEQ ID NO: 4079428 - DNA, 23 bp, Homo sapiens
aagtcagtccaggatgctaacat

SEQ ID NO: 4079429 - DNA, 16 bp, Homo sapiens
aagtcagtgttgagat

SEQ ID NO: 4079430 - DNA, 17 bp, Homo sapiens
aagtcagtgttgagatg

SEQ ID NO: 4079431 - DNA, 19 bp, Homo sapiens
aagtcatctacttaataaa

SEQ ID NO: 4079432 - DNA, 15 bp, Homo sapiens
aagtcatgaagccca

SEQ ID NO: 4079433 - DNA, 17 bp, Homo sapiens
aagtcatgaagcccaag

SEQ ID NO: 4079434 - DNA, 14 bp, Homo sapiens
aagtcatgtgcatt

SEQ ID NO: 4079435 - DNA, 16 bp, Homo sapiens
aagtcattttaacttt

SEQ ID NO: 4079436 - DNA, 22 bp, Homo sapiens
aagtcattttaactttatcaca

SEQ ID NO: 4079437 - DNA, 14 bp, Homo sapiens
aagtccaataagac

SEQ ID NO: 4079438 - DNA, 12 bp, Homo sapiens
aagtccaatgtg

SEQ ID NO: 4079439 - DNA, 20 bp, Homo sapiens
aagtccagtgtttctttttt

SEQ ID NO: 4079440 - DNA, 18 bp, Homo sapiens
aagtccctccctgcctga

SEQ ID NO: 4079441 - DNA, 17 bp, Homo sapiens
aagtcctacaagctaaa

SEQ ID NO: 4079442 - DNA, 17 bp, Homo sapiens
aagtcctgactgggctg

SEQ ID NO: 4079443 - DNA, 22 bp, Homo sapiens
aagtcctgactgggctgggttt

SEQ ID NO: 4079444 - DNA, 12 bp, Homo sapiens
aagtcctggcta

SEQ ID NO: 4079445 - DNA, 15 bp, Homo sapiens
aagtcctggctacat

SEQ ID NO: 4079446 - DNA, 22 bp, Homo sapiens
aagtccttggactgttttgaaa

SEQ ID NO: 4079447 - DNA, 16 bp, Homo sapiens
aagtcggaacagcaga

SEQ ID NO: 4079448 - DNA, 19 bp, Homo sapiens
aagtctaaacaaaattgca

SEQ ID NO: 4079449 - DNA, 23 bp, Homo sapiens
aagtctaaacaaaattgcaattt

SEQ ID NO: 4079450 - DNA, 17 bp, Homo sapiens
aagtctaaatatttcct

SEQ ID NO: 4079451 - DNA, 13 bp, Homo sapiens
aagtctataaaaa

SEQ ID NO: 4079452 - DNA, 11 bp, Homo sapiens
aagtctatttt

SEQ ID NO: 4079453 - DNA, 23 bp, Homo sapiens
aagtctatttttttaactgaaaa

SEQ ID NO: 4079454 - DNA, 14 bp, Homo sapiens
aagtctccttcccc

SEQ ID NO: 4079455 - DNA, 13 bp, Homo sapiens
aagatgaggttct

SEQ ID NO: 4079456 - DNA, 22 bp, Homo sapiens
aagatgattcaaagtagtttta

SEQ ID NO: 4079457 - DNA, 23 bp, Homo sapiens
aagatgattcaaagtagttttat

SEQ ID NO: 4079458 - DNA, 15 bp, Homo sapiens
aagatgcaaggacca

SEQ ID NO: 4079459 - DNA, 12 bp, Homo sapiens
aagatgcttggt

SEQ ID NO: 4079460 - DNA, 15 bp, Homo sapiens
aagatggaaaggatt

SEQ ID NO: 4079461 - DNA, 16 bp, Homo sapiens
aagatggattctcaga

SEQ ID NO: 4079462 - DNA, 18 bp, Homo sapiens
aagatgggggcagggctg

SEQ ID NO: 4079463 - DNA, 19 bp, Homo sapiens
aagatgggggcagggctgt

SEQ ID NO: 4079464 - DNA, 23 bp, Homo sapiens
aagatggtccatttgttcctgct

SEQ ID NO: 4079465 - DNA, 17 bp, Homo sapiens
aagatgtacctggtgga

SEQ ID NO: 4079466 - DNA, 16 bp, Homo sapiens
aagatgtgaattattg

SEQ ID NO: 4079467 - DNA, 23 bp, Homo sapiens
aagatgtgaattattgacactga

SEQ ID NO: 4079468 - DNA, 16 bp, Homo sapiens
aagatgtttgtcagat

SEQ ID NO: 4079469 - DNA, 17 bp, Homo sapiens
aagattaaacagatgat

SEQ ID NO: 4079470 - DNA, 21 bp, Homo sapiens
aagattagcaaggtcatttct

SEQ ID NO: 4079471 - DNA, 13 bp, Homo sapiens
aagattggagctg

SEQ ID NO: 4079472 - DNA, 21 bp, Homo sapiens
aagattggtgggattttttgt

SEQ ID NO: 4079473 - DNA, 17 bp, Homo sapiens
aagatttggaaagatat

SEQ ID NO: 4079474 - DNA, 22 bp, Homo sapiens
aagatttgtgtttttctttttc

SEQ ID NO: 4079475 - DNA, 18 bp, Homo sapiens
aagattttaatcaagttg

SEQ ID NO: 4079476 - DNA, 23 bp, Homo sapiens
aagattttattgtataaaaagtt

SEQ ID NO: 4079477 - DNA, 13 bp, Homo sapiens
aagattttcagaa

SEQ ID NO: 4079478 - DNA, 19 bp, Homo sapiens
aagattttcctcttgtgat

SEQ ID NO: 4079479 - DNA, 23 bp, Homo sapiens
aagattttctgggcctaaaggat

SEQ ID NO: 4079480 - DNA, 13 bp, Homo sapiens
aagatttttctca

SEQ ID NO: 4079481 - DNA, 13 bp, Homo sapiens
aagcaaaaaatga

SEQ ID NO: 4079482 - DNA, 20 bp, Homo sapiens
aagcaaaaaatgaatgtcta

SEQ ID NO: 4079483 - DNA, 11 bp, Homo sapiens
aagcaaaagaa

SEQ ID NO: 4079484 - DNA, 14 bp, Homo sapiens
aagcaaaagaaaaa

SEQ ID NO: 4079485 - DNA, 15 bp, Homo sapiens
aagcaaaagaaaaag

SEQ ID NO: 4079486 - DNA, 13 bp, Homo sapiens
aagcaaaatatta

SEQ ID NO: 4079487 - DNA, 21 bp, Homo sapiens
aagcaaaggggacagctgtgt

SEQ ID NO: 4079488 - DNA, 14 bp, Homo sapiens
aagcaaataaatat

SEQ ID NO: 4079489 - DNA, 17 bp, Homo sapiens
aagcaaatcagaaactt

SEQ ID NO: 4079490 - DNA, 15 bp, Homo sapiens
aagcaaatctacaga

SEQ ID NO: 4079491 - DNA, 14 bp, Homo sapiens
aagcaacatttgta

SEQ ID NO: 4079492 - DNA, 18 bp, Homo sapiens
aagcaacatttgtatgga

SEQ ID NO: 4079493 - DNA, 14 bp, Homo sapiens
aagcaacgataaaa

SEQ ID NO: 4079494 - DNA, 17 bp, Homo sapiens
aagcaagagagatgttt

SEQ ID NO: 4079495 - DNA, 13 bp, Homo sapiens
aagcaagtagctt

SEQ ID NO: 4079496 - DNA, 19 bp, Homo sapiens
aagcaagttcgtctgttgt

SEQ ID NO: 4079497 - DNA, 16 bp, Homo sapiens
aagcaataaatgaatg

SEQ ID NO: 4079498 - DNA, 20 bp, Homo sapiens
aagcaatccacctgccttgg

SEQ ID NO: 4079499 - DNA, 17 bp, Homo sapiens
aagcaatcctcctgcct

SEQ ID NO: 4079500 - DNA, 21 bp, Homo sapiens
aagcaatcctcctgcctcagc

SEQ ID NO: 4079501 - DNA, 21 bp, Homo sapiens
aagcaatctgattcagcatca

SEQ ID NO: 4079502 - DNA, 23 bp, Homo sapiens
aagcaatctgattcagcatcact

SEQ ID NO: 4079503 - DNA, 23 bp, Homo sapiens
aagcaattagtctgaaactggct

SEQ ID NO: 4079504 - DNA, 23 bp, Homo sapiens
aagcacaagcagagtgcacagct

SEQ ID NO: 4079505 - DNA, 14 bp, Homo sapiens
aagcacacttgtag

SEQ ID NO: 4079506 - DNA, 15 bp, Homo sapiens
aagcacagaatattt

SEQ ID NO: 4079507 - DNA, 12 bp, Homo sapiens
aagcacagagcc

SEQ ID NO: 4079508 - DNA, 13 bp, Homo sapiens
aagcacagagcct

SEQ ID NO: 4079509 - DNA, 11 bp, Homo sapiens
aagcacagctg

SEQ ID NO: 4079510 - DNA, 19 bp, Homo sapiens
aagcacatacattaaaact

SEQ ID NO: 4079511 - DNA, 19 bp, Homo sapiens
aagcacctactatgtgctg

SEQ ID NO: 4079512 - DNA, 23 bp, Homo sapiens
aagcactacataaactgacttta

SEQ ID NO: 4079513 - DNA, 12 bp, Homo sapiens
aagcactgagca

SEQ ID NO: 4079514 - DNA, 11 bp, Homo sapiens
aagcactgata

SEQ ID NO: 4079515 - DNA, 19 bp, Homo sapiens
aagcacttgaatcagtttt

SEQ ID NO: 4079516 - DNA, 15 bp, Homo sapiens
aagcacttttgttat

SEQ ID NO: 4079517 - DNA, 13 bp, Homo sapiens
aagcactttttgg

SEQ ID NO: 4079518 - DNA, 14 bp, Homo sapiens
aagcagacagctcc

SEQ ID NO: 4079519 - DNA, 15 bp, Homo sapiens
aagcagacagctcca

SEQ ID NO: 4079520 - DNA, 16 bp, Homo sapiens
aagcagagaggtggag

SEQ ID NO: 4079521 - DNA, 17 bp, Homo sapiens
aagcagagtgcacagct

SEQ ID NO: 4079522 - DNA, 18 bp, Homo sapiens
aagcagagtgcacagctg

SEQ ID NO: 4079523 - DNA, 19 bp, Homo sapiens
aagcagagtgcacagctgt

SEQ ID NO: 4079524 - DNA, 21 bp, Homo sapiens
aagcagagtgcacagctgtcc

SEQ ID NO: 4079525 - DNA, 17 bp, Homo sapiens
aagcagcatggaaaaat

SEQ ID NO: 4079526 - DNA, 20 bp, Homo sapiens
aagcagcatggaaaaatggt

SEQ ID NO: 4079527 - DNA, 20 bp, Homo sapiens
aagcagcgggctaacgggag

SEQ ID NO: 4079528 - DNA, 14 bp, Homo sapiens
aagcaggtggatct

SEQ ID NO: 4079529 - DNA, 22 bp, Homo sapiens
aagcaggtggatctatttcatg

SEQ ID NO: 4079530 - DNA, 18 bp, Homo sapiens
aagcaggttcccaagctc

SEQ ID NO: 4079531 - DNA, 22 bp, Homo sapiens
aagcagtaaaaactgttctcta

SEQ ID NO: 4079532 - DNA, 21 bp, Homo sapiens
aagcagtagaaataatatgca

SEQ ID NO: 4079533 - DNA, 20 bp, Homo sapiens
aagcagtcctcttattccta

SEQ ID NO: 4079534 - DNA, 17 bp, Homo sapiens
aagcataaaaacatttt

SEQ ID NO: 4079535 - DNA, 22 bp, Homo sapiens
aagcataaaaacattttaaaaa

SEQ ID NO: 4079536 - DNA, 13 bp, Homo sapiens
aagcataaatcac

SEQ ID NO: 4079537 - DNA, 12 bp, Homo sapiens
aagcatccatgt

SEQ ID NO: 4079538 - DNA, 17 bp, Homo sapiens
aagcatccatgtgtgga

SEQ ID NO: 4079539 - DNA, 17 bp, Homo sapiens
aagcatgatgggaaaat

SEQ ID NO: 4079540 - DNA, 19 bp, Homo sapiens
aagcatgatgggaaaatat

SEQ ID NO: 4079541 - DNA, 15 bp, Homo sapiens
aagcatgctttcttt

SEQ ID NO: 4079542 - DNA, 21 bp, Homo sapiens
aagcatgctttctttgagttt

SEQ ID NO: 4079543 - DNA, 17 bp, Homo sapiens
aagcatgtctcaatagt

SEQ ID NO: 4079544 - DNA, 21 bp, Homo sapiens
aagcatgtggatgacacaatc

SEQ ID NO: 4079545 - DNA, 17 bp, Homo sapiens
aagcattccttctttga

SEQ ID NO: 4079546 - DNA, 18 bp, Homo sapiens
aagcattctccccagtgt

SEQ ID NO: 4079547 - DNA, 17 bp, Homo sapiens
aagcattgaaattatag

SEQ ID NO: 4079548 - DNA, 21 bp, Homo sapiens
aagcattgctgttatgtctgt

SEQ ID NO: 4079549 - DNA, 22 bp, Homo sapiens
aagcattgggtgggtaaattca

SEQ ID NO: 4079550 - DNA, 15 bp, Homo sapiens
aagcatttatcattc

SEQ ID NO: 4079551 - DNA, 19 bp, Homo sapiens
aagcatttgatattatcta

SEQ ID NO: 4079552 - DNA, 19 bp, Homo sapiens
aagcatttttcaatatatt

SEQ ID NO: 4079553 - DNA, 16 bp, Homo sapiens
aagccaaagacttagt

SEQ ID NO: 4079554 - DNA, 16 bp, Homo sapiens
aagccaagggaaaggg

SEQ ID NO: 4079555 - DNA, 23 bp, Homo sapiens
aagccaagggaaaggggtgcttt

SEQ ID NO: 4079556 - DNA, 19 bp, Homo sapiens
aagccaagtggggtgctgg

SEQ ID NO: 4079557 - DNA, 18 bp, Homo sapiens
aagccacaaggctggcca

SEQ ID NO: 4079558 - DNA, 13 bp, Homo sapiens
aagtctctctgtg

SEQ ID NO: 4079559 - DNA, 14 bp, Homo sapiens
aagtctctctgtga

SEQ ID NO: 4079560 - DNA, 21 bp, Homo sapiens
aagtctctgctggcccagcca

SEQ ID NO: 4079561 - DNA, 17 bp, Homo sapiens
aagtcttagatgtatat

SEQ ID NO: 4079562 - DNA, 18 bp, Homo sapiens
aagtcttagatgtatata

SEQ ID NO: 4079563 - DNA, 20 bp, Homo sapiens
aagtcttcactctctgaaga

SEQ ID NO: 4079564 - DNA, 22 bp, Homo sapiens
aagtcttgggtctgaatttatt

SEQ ID NO: 4079565 - DNA, 14 bp, Homo sapiens
aagtcttttctgtc

SEQ ID NO: 4079566 - DNA, 19 bp, Homo sapiens
aagtgaaataacaaaatgg

SEQ ID NO: 4079567 - DNA, 16 bp, Homo sapiens
aagtgaatgaaagatt

SEQ ID NO: 4079568 - DNA, 17 bp, Homo sapiens
aagtgaatttgaatgaa

SEQ ID NO: 4079569 - DNA, 19 bp, Homo sapiens
aagtgaatttgaatgaaaa

SEQ ID NO: 4079570 - DNA, 23 bp, Homo sapiens
aagtgactgtttggcttataaac

SEQ ID NO: 4079571 - DNA, 13 bp, Homo sapiens
aagtgactttaaa

SEQ ID NO: 4079572 - DNA, 14 bp, Homo sapiens
aagtgatcaataaa

SEQ ID NO: 4079573 - DNA, 15 bp, Homo sapiens
aagtgcactttctaa

SEQ ID NO: 4079574 - DNA, 18 bp, Homo sapiens
aagtgcatatgaaatcct

SEQ ID NO: 4079575 - DNA, 15 bp, Homo sapiens
aagtgcatccaaagg

SEQ ID NO: 4079576 - DNA, 13 bp, Homo sapiens
aagtgcatttctg

SEQ ID NO: 4079577 - DNA, 14 bp, Homo sapiens
aagtgcatttctga

SEQ ID NO: 4079578 - DNA, 22 bp, Homo sapiens
aagtgcatttctgaatagaaat

SEQ ID NO: 4079579 - DNA, 23 bp, Homo sapiens
aagtgcatttctgaatagaaatg

SEQ ID NO: 4079580 - DNA, 15 bp, Homo sapiens
aagtgccaaatgctc

SEQ ID NO: 4079581 - DNA, 17 bp, Homo sapiens
aagtgccccctcacctc

SEQ ID NO: 4079582 - DNA, 20 bp, Homo sapiens
aagtgccccctcacctctcc

SEQ ID NO: 4079583 - DNA, 19 bp, Homo sapiens
aagtgcctgagctggggaa

SEQ ID NO: 4079584 - DNA, 12 bp, Homo sapiens
aagtgccttctc

SEQ ID NO: 4079585 - DNA, 16 bp, Homo sapiens
aagtgcgtgtgtagag

SEQ ID NO: 4079586 - DNA, 17 bp, Homo sapiens
aagtgcgtgtgtagagt

SEQ ID NO: 4079587 - DNA, 19 bp, Homo sapiens
aagtgcgtgtgtagagtta

SEQ ID NO: 4079588 - DNA, 21 bp, Homo sapiens
aagtgcgtgtgtagagttaag

SEQ ID NO: 4079589 - DNA, 21 bp, Homo sapiens
aagtgctcttggctgacccct

SEQ ID NO: 4079590 - DNA, 13 bp, Homo sapiens
aagtggaaatgtt

SEQ ID NO: 4079591 - DNA, 18 bp, Homo sapiens
aagtggacaaattttgag

SEQ ID NO: 4079592 - DNA, 17 bp, Homo sapiens
aagtggactcagggcag

SEQ ID NO: 4079593 - DNA, 18 bp, Homo sapiens
aagtggactggcccctgg

SEQ ID NO: 4079594 - DNA, 14 bp, Homo sapiens
aagtggatgggaat

SEQ ID NO: 4079595 - DNA, 19 bp, Homo sapiens
aagtggcaaagctgttctt

SEQ ID NO: 4079596 - DNA, 22 bp, Homo sapiens
aagtggcaatctcagatgcagt

SEQ ID NO: 4079597 - DNA, 21 bp, Homo sapiens
aagtggcacctgtctgctcca

SEQ ID NO: 4079598 - DNA, 14 bp, Homo sapiens
aagtggcatgtttt

SEQ ID NO: 4079599 - DNA, 20 bp, Homo sapiens
aagtggggtgttcttcttgg

SEQ ID NO: 4079600 - DNA, 20 bp, Homo sapiens
aagtggggttgcaaccactg

SEQ ID NO: 4079601 - DNA, 19 bp, Homo sapiens
aagtgggttattctggagt

SEQ ID NO: 4079602 - DNA, 16 bp, Homo sapiens
aagtggtgtttattgc

SEQ ID NO: 4079603 - DNA, 18 bp, Homo sapiens
aagtgtaagttcacaact

SEQ ID NO: 4079604 - DNA, 14 bp, Homo sapiens
aagtgtacatatgt

SEQ ID NO: 4079605 - DNA, 13 bp, Homo sapiens
aagtgtatttttc

SEQ ID NO: 4079606 - DNA, 22 bp, Homo sapiens
aagtgtcatatgtaggtgtctg

SEQ ID NO: 4079607 - DNA, 24 bp, Homo sapiens
aagtgtcatatgtaggtgtctgca

SEQ ID NO: 4079608 - DNA, 15 bp, Homo sapiens
aagtgtccgagaact

SEQ ID NO: 4079609 - DNA, 16 bp, Homo sapiens
aagtgtctctgccttg

SEQ ID NO: 4079610 - DNA, 19 bp, Homo sapiens
aagtgtgtttcttcccctt

SEQ ID NO: 4079611 - DNA, 11 bp, Homo sapiens
aagtgttactt

SEQ ID NO: 4079612 - DNA, 18 bp, Homo sapiens
aagtgttgtgttcctggc

SEQ ID NO: 4079613 - DNA, 17 bp, Homo sapiens
aagttaaagtgaataac

SEQ ID NO: 4079614 - DNA, 22 bp, Homo sapiens
aagttaagagaaactttataca

SEQ ID NO: 4079615 - DNA, 18 bp, Homo sapiens
aagttaataatgtattgt

SEQ ID NO: 4079616 - DNA, 19 bp, Homo sapiens
aagttaattcacctatgtt

SEQ ID NO: 4079617 - DNA, 19 bp, Homo sapiens
aagttacacagaaatgctg

SEQ ID NO: 4079618 - DNA, 22 bp, Homo sapiens
aagttacacagaaatgctgctg

SEQ ID NO: 4079619 - DNA, 13 bp, Homo sapiens
aagttacagaaat

SEQ ID NO: 4079620 - DNA, 18 bp, Homo sapiens
aagttacatgcataaaag

SEQ ID NO: 4079621 - DNA, 20 bp, Homo sapiens
aagttactaggtaacttcat

SEQ ID NO: 4079622 - DNA, 15 bp, Homo sapiens
aagttacttattcta

SEQ ID NO: 4079623 - DNA, 16 bp, Homo sapiens
aagttacttattctag

SEQ ID NO: 4079624 - DNA, 16 bp, Homo sapiens
aagttactttgtaatt

SEQ ID NO: 4079625 - DNA, 19 bp, Homo sapiens
aagttactttgtcagaggc

SEQ ID NO: 4079626 - DNA, 16 bp, Homo sapiens
aagttatagtatatct

SEQ ID NO: 4079627 - DNA, 15 bp, Homo sapiens
aagttatagtgaata

SEQ ID NO: 4079628 - DNA, 13 bp, Homo sapiens
aagttatcaactt

SEQ ID NO: 4079629 - DNA, 23 bp, Homo sapiens
aagttatttacttttaccactat

SEQ ID NO: 4079630 - DNA, 21 bp, Homo sapiens
aagttattttctacagtggtt

SEQ ID NO: 4079631 - DNA, 14 bp, Homo sapiens
aagttcatagggtc

SEQ ID NO: 4079632 - DNA, 14 bp, Homo sapiens
aagttccaagtcca

SEQ ID NO: 4079633 - DNA, 19 bp, Homo sapiens
aagttccagtgttctctct

SEQ ID NO: 4079634 - DNA, 21 bp, Homo sapiens
aagttctagagaagaggctgg

SEQ ID NO: 4079635 - DNA, 20 bp, Homo sapiens
aagttctatgaagagtatta

SEQ ID NO: 4079636 - DNA, 12 bp, Homo sapiens
aagttctcaaag

SEQ ID NO: 4079637 - DNA, 16 bp, Homo sapiens
aagttctcaaagttaa

SEQ ID NO: 4079638 - DNA, 19 bp, Homo sapiens
aagttctcaaagttaattc

SEQ ID NO: 4079639 - DNA, 22 bp, Homo sapiens
aagttcttatgaggaggggagg

SEQ ID NO: 4079640 - DNA, 18 bp, Homo sapiens
aagttgaagctaagattt

SEQ ID NO: 4079641 - DNA, 18 bp, Homo sapiens
aagttgaggattgttgaa

SEQ ID NO: 4079642 - DNA, 18 bp, Homo sapiens
aagttgtacaaatgtatt

SEQ ID NO: 4079643 - DNA, 20 bp, Homo sapiens
aagttgtacaaatgtatttt

SEQ ID NO: 4079644 - DNA, 14 bp, Homo sapiens
aagttgtcttaaaa

SEQ ID NO: 4079645 - DNA, 13 bp, Homo sapiens
aagttgttattgt

SEQ ID NO: 4079646 - DNA, 13 bp, Homo sapiens
aagttgttttttt

SEQ ID NO: 4079647 - DNA, 16 bp, Homo sapiens
aagtttaaagttgcac

SEQ ID NO: 4079648 - DNA, 17 bp, Homo sapiens
aagtttaaagttgcaca

SEQ ID NO: 4079649 - DNA, 12 bp, Homo sapiens
aagtttaaatgt

SEQ ID NO: 4079650 - DNA, 15 bp, Homo sapiens
aagtttaaatgtatt

SEQ ID NO: 4079651 - DNA, 20 bp, Homo sapiens
aagtttacacctttatcttt

SEQ ID NO: 4079652 - DNA, 22 bp, Homo sapiens
aagtttagtttgaggaattctt

SEQ ID NO: 4079653 - DNA, 17 bp, Homo sapiens
aagtttattcagtaaac

SEQ ID NO: 4079654 - DNA, 12 bp, Homo sapiens
aagtttattctc

SEQ ID NO: 4079655 - DNA, 20 bp, Homo sapiens
aagtttcaaacttactattt

SEQ ID NO: 4079656 - DNA, 21 bp, Homo sapiens
aagtttcacaggtcaataaac

SEQ ID NO: 4079657 - DNA, 12 bp, Homo sapiens
aagtttcaggtg

SEQ ID NO: 4079658 - DNA, 18 bp, Homo sapiens
aagtttccatatgttata

SEQ ID NO: 4079659 - DNA, 19 bp, Homo sapiens
aagtttcccctctggcttg

SEQ ID NO: 4079660 - DNA, 12 bp, Homo sapiens
aagtttcccttc

SEQ ID NO: 4079661 - DNA, 16 bp, Homo sapiens
aacttgaatgtgtcag

SEQ ID NO: 4079662 - DNA, 21 bp, Homo sapiens
aacttgaatttggtctgtata

SEQ ID NO: 4079663 - DNA, 16 bp, Homo sapiens
aacttgactccatttc

SEQ ID NO: 4079664 - DNA, 21 bp, Homo sapiens
aacttgactgggtgagaccca

SEQ ID NO: 4079665 - DNA, 22 bp, Homo sapiens
aacttgagggcccagagcagga

SEQ ID NO: 4079666 - DNA, 15 bp, Homo sapiens
aacttgatttgcatg

SEQ ID NO: 4079667 - DNA, 18 bp, Homo sapiens
aacttgcttaaatttctt

SEQ ID NO: 4079668 - DNA, 20 bp, Homo sapiens
aacttgcttaaatttcttat

SEQ ID NO: 4079669 - DNA, 21 bp, Homo sapiens
aacttgcttaaatttcttatg

SEQ ID NO: 4079670 - DNA, 11 bp, Homo sapiens
aacttggcact

SEQ ID NO: 4079671 - DNA, 15 bp, Homo sapiens
aacttgtcaggcatg

SEQ ID NO: 4079672 - DNA, 18 bp, Homo sapiens
aactttaagtttcaggat

SEQ ID NO: 4079673 - DNA, 21 bp, Homo sapiens
aactttaagtttcaggataca

SEQ ID NO: 4079674 - DNA, 16 bp, Homo sapiens
aactttaatcaagttg

SEQ ID NO: 4079675 - DNA, 21 bp, Homo sapiens
aactttaattctctttcaaag

SEQ ID NO: 4079676 - DNA, 15 bp, Homo sapiens
aactttactctgtgt

SEQ ID NO: 4079677 - DNA, 21 bp, Homo sapiens
aactttagaagtgcatttctg

SEQ ID NO: 4079678 - DNA, 14 bp, Homo sapiens
aactttattaaata

SEQ ID NO: 4079679 - DNA, 19 bp, Homo sapiens
aactttcattccttcagat

SEQ ID NO: 4079680 - DNA, 23 bp, Homo sapiens
aactttcccaggttctgtttatg

SEQ ID NO: 4079681 - DNA, 15 bp, Homo sapiens
aactttgccaaaaaa

SEQ ID NO: 4079682 - DNA, 15 bp, Homo sapiens
aacttttaaagctca

SEQ ID NO: 4079683 - DNA, 14 bp, Homo sapiens
aacttttgtaaata

SEQ ID NO: 4079684 - DNA, 11 bp, Homo sapiens
aacttttgtac

SEQ ID NO: 4079685 - DNA, 20 bp, Homo sapiens
aagaaaaaaaataacacaga

SEQ ID NO: 4079686 - DNA, 12 bp, Homo sapiens
aagaaaaagatt

SEQ ID NO: 4079687 - DNA, 13 bp, Homo sapiens
aagaaaaagcaaa

SEQ ID NO: 4079688 - DNA, 12 bp, Homo sapiens
aagaaaagattt

SEQ ID NO: 4079689 - DNA, 11 bp, Homo sapiens
aagaaaagcac

SEQ ID NO: 4079690 - DNA, 13 bp, Homo sapiens
aagaaaagcactt

SEQ ID NO: 4079691 - DNA, 14 bp, Homo sapiens
aagaaaagccaagc

SEQ ID NO: 4079692 - DNA, 13 bp, Homo sapiens
aagaaaaggacaa

SEQ ID NO: 4079693 - DNA, 22 bp, Homo sapiens
aagaaaagtattttgaagttta

SEQ ID NO: 4079694 - DNA, 20 bp, Homo sapiens
aagaaaagtgcatatttatc

SEQ ID NO: 4079695 - DNA, 16 bp, Homo sapiens
aagaaaatacaataaa

SEQ ID NO: 4079696 - DNA, 12 bp, Homo sapiens
aagaaaatgaag

SEQ ID NO: 4079697 - DNA, 13 bp, Homo sapiens
aagaaagaaggaa

SEQ ID NO: 4079698 - DNA, 14 bp, Homo sapiens
aagaaagaaggaag

SEQ ID NO: 4079699 - DNA, 21 bp, Homo sapiens
aagaaagtgttttattttcaa

SEQ ID NO: 4079700 - DNA, 15 bp, Homo sapiens
aagaaataaatcaga

SEQ ID NO: 4079701 - DNA, 14 bp, Homo sapiens
aagaaatatttacc

SEQ ID NO: 4079702 - DNA, 15 bp, Homo sapiens
aagaaatatttacct

SEQ ID NO: 4079703 - DNA, 19 bp, Homo sapiens
aagaaatccggagaagctg

SEQ ID NO: 4079704 - DNA, 15 bp, Homo sapiens
aagaaatgactaatt

SEQ ID NO: 4079705 - DNA, 21 bp, Homo sapiens
aagaacaccctatattttgca

SEQ ID NO: 4079706 - DNA, 12 bp, Homo sapiens
aagaacatagaa

SEQ ID NO: 4079707 - DNA, 18 bp, Homo sapiens
aagaacatggacttgtat

SEQ ID NO: 4079708 - DNA, 17 bp, Homo sapiens
aagaaccagtcccccca

SEQ ID NO: 4079709 - DNA, 20 bp, Homo sapiens
aagaaccagtccccccaccc

SEQ ID NO: 4079710 - DNA, 14 bp, Homo sapiens
aagaaccctctgtc

SEQ ID NO: 4079711 - DNA, 23 bp, Homo sapiens
aagaacctacagactccatctct

SEQ ID NO: 4079712 - DNA, 13 bp, Homo sapiens
aagaacctggaaa

SEQ ID NO: 4079713 - DNA, 13 bp, Homo sapiens
aagaactgcatgg

SEQ ID NO: 4079714 - DNA, 21 bp, Homo sapiens
aagaactgtttactgcttgat

SEQ ID NO: 4079715 - DNA, 22 bp, Homo sapiens
aagaacttgatttgcatggatt

SEQ ID NO: 4079716 - DNA, 23 bp, Homo sapiens
aagaacttgatttgcatggattt

SEQ ID NO: 4079717 - DNA, 15 bp, Homo sapiens
aagaagaaagactct

SEQ ID NO: 4079718 - DNA, 11 bp, Homo sapiens
aagaagaaata

SEQ ID NO: 4079719 - DNA, 13 bp, Homo sapiens
aagaagaagggca

SEQ ID NO: 4079720 - DNA, 16 bp, Homo sapiens
aagaagacatgaacca

SEQ ID NO: 4079721 - DNA, 17 bp, Homo sapiens
aagaagacatggagact

SEQ ID NO: 4079722 - DNA, 19 bp, Homo sapiens
aagaagagaagctgctgac

SEQ ID NO: 4079723 - DNA, 16 bp, Homo sapiens
aagaagcaaataaata

SEQ ID NO: 4079724 - DNA, 23 bp, Homo sapiens
aagaagccatatatgaccagaag

SEQ ID NO: 4079725 - DNA, 15 bp, Homo sapiens
aagaagcccccagct

SEQ ID NO: 4079726 - DNA, 19 bp, Homo sapiens
aagaagcccccagctaaga

SEQ ID NO: 4079727 - DNA, 15 bp, Homo sapiens
aagaaggcaatatta

SEQ ID NO: 4079728 - DNA, 14 bp, Homo sapiens
aagaagggagaaga

SEQ ID NO: 4079729 - DNA, 23 bp, Homo sapiens
aagaaggtgatttttttattatt

SEQ ID NO: 4079730 - DNA, 22 bp, Homo sapiens
aagaaggtggaccttttaaagt

SEQ ID NO: 4079731 - DNA, 23 bp, Homo sapiens
aagaagtcttctctgcctgtaag

SEQ ID NO: 4079732 - DNA, 16 bp, Homo sapiens
aagaagtgtccgagaa

SEQ ID NO: 4079733 - DNA, 12 bp, Homo sapiens
aagaagtttatt

SEQ ID NO: 4079734 - DNA, 21 bp, Homo sapiens
aagaataatatgctgccaaat

SEQ ID NO: 4079735 - DNA, 21 bp, Homo sapiens
aagaataattcaattttaaag

SEQ ID NO: 4079736 - DNA, 13 bp, Homo sapiens
aagaatacagtta

SEQ ID NO: 4079737 - DNA, 12 bp, Homo sapiens
aagaatacttga

SEQ ID NO: 4079738 - DNA, 17 bp, Homo sapiens
aagaatatctgtaatgg

SEQ ID NO: 4079739 - DNA, 14 bp, Homo sapiens
aagaatatttaaga

SEQ ID NO: 4079740 - DNA, 22 bp, Homo sapiens
aagaatcagagtagaaataaaa

SEQ ID NO: 4079741 - DNA, 19 bp, Homo sapiens
aagaatgcacaagaatgga

SEQ ID NO: 4079742 - DNA, 21 bp, Homo sapiens
aagaatgcacaagaatggatc

SEQ ID NO: 4079743 - DNA, 18 bp, Homo sapiens
aagaatgtcgattaaaat

SEQ ID NO: 4079744 - DNA, 15 bp, Homo sapiens
aagaatgtttatagc

SEQ ID NO: 4079745 - DNA, 19 bp, Homo sapiens
aagaattaagatacaaatt

SEQ ID NO: 4079746 - DNA, 20 bp, Homo sapiens
aagaattatttgccttctga

SEQ ID NO: 4079747 - DNA, 19 bp, Homo sapiens
aagaattcttatacacatt

SEQ ID NO: 4079748 - DNA, 20 bp, Homo sapiens
aagaattgtttttgaattta

SEQ ID NO: 4079749 - DNA, 14 bp, Homo sapiens
aagaatttcacaag

SEQ ID NO: 4079750 - DNA, 15 bp, Homo sapiens
aagaatttttttgtc

SEQ ID NO: 4079751 - DNA, 14 bp, Homo sapiens
aagacaaaagtctg

SEQ ID NO: 4079752 - DNA, 22 bp, Homo sapiens
aagacaagaactcccctttttt

SEQ ID NO: 4079753 - DNA, 14 bp, Homo sapiens
aagacaccagagca

SEQ ID NO: 4079754 - DNA, 17 bp, Homo sapiens
aagacactcaaatatga

SEQ ID NO: 4079755 - DNA, 20 bp, Homo sapiens
aagacagaaaagtgcctgag

SEQ ID NO: 4079756 - DNA, 20 bp, Homo sapiens
aagacagatgccccagagct

SEQ ID NO: 4079757 - DNA, 14 bp, Homo sapiens
aagacataacgttt

SEQ ID NO: 4079758 - DNA, 22 bp, Homo sapiens
aagacataacgtttttccttta

SEQ ID NO: 4079759 - DNA, 16 bp, Homo sapiens
aagacatgatttcctt

SEQ ID NO: 4079760 - DNA, 23 bp, Homo sapiens
aagacatttcttttctttttaca

SEQ ID NO: 4079761 - DNA, 15 bp, Homo sapiens
aagacccgagctggg

SEQ ID NO: 4079762 - DNA, 16 bp, Homo sapiens
aagaccctcttgccca

SEQ ID NO: 4079763 - DNA, 22 bp, Homo sapiens
aagaccctcttgcccatcctga

SEQ ID NO: 4079764 - DNA, 22 bp, Homo sapiens
aagacctaaccagggccagaag

SEQ ID NO: 4079765 - DNA, 17 bp, Homo sapiens
aagacctacattccctc

SEQ ID NO: 4079766 - DNA, 17 bp, Homo sapiens
aagacctggcagctctg

SEQ ID NO: 4079767 - DNA, 15 bp, Homo sapiens
aagacgatgtttatg

SEQ ID NO: 4079768 - DNA, 15 bp, Homo sapiens
aagacgcctgagctc

SEQ ID NO: 4079769 - DNA, 13 bp, Homo sapiens
aagactccagaaa

SEQ ID NO: 4079770 - DNA, 14 bp, Homo sapiens
aagactccagaaat

SEQ ID NO: 4079771 - DNA, 19 bp, Homo sapiens
aagactgagcacctgcttc

SEQ ID NO: 4079772 - DNA, 18 bp, Homo sapiens
aagactgcaaactttttt

SEQ ID NO: 4079773 - DNA, 17 bp, Homo sapiens
aagactggttttctgcc

SEQ ID NO: 4079774 - DNA, 17 bp, Homo sapiens
aagactgttgtgatctt

SEQ ID NO: 4079775 - DNA, 21 bp, Homo sapiens
aagactgtttttaagtaactt

SEQ ID NO: 4079776 - DNA, 13 bp, Homo sapiens
aagacttgagaca

SEQ ID NO: 4079777 - DNA, 15 bp, Homo sapiens
aagacttgagacaat

SEQ ID NO: 4079778 - DNA, 20 bp, Homo sapiens
aagacttgagacaatgtttt

SEQ ID NO: 4079779 - DNA, 22 bp, Homo sapiens
aagacttgagacaatgttttct

SEQ ID NO: 4079780 - DNA, 22 bp, Homo sapiens
aagagaaactttatacattagt

SEQ ID NO: 4079781 - DNA, 16 bp, Homo sapiens
aagagaaccgagcaaa

SEQ ID NO: 4079782 - DNA, 22 bp, Homo sapiens
aagagaagagggcccagcccag

SEQ ID NO: 4079783 - DNA, 15 bp, Homo sapiens
aagagaagggcttac

SEQ ID NO: 4079784 - DNA, 22 bp, Homo sapiens
aagagaaggggacttctcttcc

SEQ ID NO: 4079785 - DNA, 14 bp, Homo sapiens
aagagaagttattt

SEQ ID NO: 4079786 - DNA, 15 bp, Homo sapiens
aagagaatgttccta

SEQ ID NO: 4079787 - DNA, 13 bp, Homo sapiens
aagagacactcca

SEQ ID NO: 4079788 - DNA, 22 bp, Homo sapiens
aagagacaggagggcaagggcc

SEQ ID NO: 4079789 - DNA, 13 bp, Homo sapiens
aagagagaatgta

SEQ ID NO: 4079790 - DNA, 19 bp, Homo sapiens
aagagagagagagaaaaaa

SEQ ID NO: 4079791 - DNA, 16 bp, Homo sapiens
aagagagatatatctg

SEQ ID NO: 4079792 - DNA, 19 bp, Homo sapiens
aagagaggatgtgcaagcg

SEQ ID NO: 4079793 - DNA, 14 bp, Homo sapiens
aagagataataaga

SEQ ID NO: 4079794 - DNA, 20 bp, Homo sapiens
aagagatattttaaaatgag

SEQ ID NO: 4079795 - DNA, 18 bp, Homo sapiens
aagagatgggcttgtttt

SEQ ID NO: 4079796 - DNA, 13 bp, Homo sapiens
aagagcacactgc

SEQ ID NO: 4079797 - DNA, 19 bp, Homo sapiens
aagagcaccttcctcactt

SEQ ID NO: 4079798 - DNA, 13 bp, Homo sapiens
aagagcagagtct

SEQ ID NO: 4079799 - DNA, 15 bp, Homo sapiens
aagagcagagtctgg

SEQ ID NO: 4079800 - DNA, 19 bp, Homo sapiens
aagagcagagtctgggcct

SEQ ID NO: 4079801 - DNA, 17 bp, Homo sapiens
aagagcagcatttttaa

SEQ ID NO: 4079802 - DNA, 17 bp, Homo sapiens
aagagcagcctgtggca

SEQ ID NO: 4079803 - DNA, 18 bp, Homo sapiens
aagagcccagtctgttga

SEQ ID NO: 4079804 - DNA, 23 bp, Homo sapiens
aagagcccagtctgttgagttag

SEQ ID NO: 4079805 - DNA, 17 bp, Homo sapiens
aagagcctggagaagct

SEQ ID NO: 4079806 - DNA, 13 bp, Homo sapiens
aagagctaggcag

SEQ ID NO: 4079807 - DNA, 16 bp, Homo sapiens
aagagctaggcagggt

SEQ ID NO: 4079808 - DNA, 20 bp, Homo sapiens
aagaggaacagcactgggga

SEQ ID NO: 4079809 - DNA, 13 bp, Homo sapiens
aagaggaagcaaa

SEQ ID NO: 4079810 - DNA, 18 bp, Homo sapiens
aagaggagcacttccaaa

SEQ ID NO: 4079811 - DNA, 21 bp, Homo sapiens
aagaggagtttcgaggtagag

SEQ ID NO: 4079812 - DNA, 13 bp, Homo sapiens
aagaggcagagtt

SEQ ID NO: 4079813 - DNA, 19 bp, Homo sapiens
aagaggcagttgcccagcc

SEQ ID NO: 4079814 - DNA, 15 bp, Homo sapiens
aagaggccaatgccc

SEQ ID NO: 4079815 - DNA, 23 bp, Homo sapiens
aagaggccacttagggaaagatg

SEQ ID NO: 4079816 - DNA, 16 bp, Homo sapiens
aagaggctctggacag

SEQ ID NO: 4079817 - DNA, 22 bp, Homo sapiens
aagaggctgcccctctcaccaa

SEQ ID NO: 4079818 - DNA, 14 bp, Homo sapiens
aagagggcccagcc

SEQ ID NO: 4079819 - DNA, 15 bp, Homo sapiens
aagagggcccagccc

SEQ ID NO: 4079820 - DNA, 21 bp, Homo sapiens
aagagggcccagcccagagcc

SEQ ID NO: 4079821 - DNA, 19 bp, Homo sapiens
aagagggcctgtgggagcc

SEQ ID NO: 4079822 - DNA, 19 bp, Homo sapiens
aagaggggaccagaagcca

SEQ ID NO: 4079823 - DNA, 17 bp, Homo sapiens
aagagggtgaaaggcag

SEQ ID NO: 4079824 - DNA, 22 bp, Homo sapiens
aagagggttttaggtagaaaaa

SEQ ID NO: 4079825 - DNA, 16 bp, Homo sapiens
aagaggtacagggttt

SEQ ID NO: 4079826 - DNA, 17 bp, Homo sapiens
aagaggtacagggtttt

SEQ ID NO: 4079827 - DNA, 15 bp, Homo sapiens
aagaggtgggagggc

SEQ ID NO: 4079828 - DNA, 23 bp, Homo sapiens
aagagtaactttactctgtgttt

SEQ ID NO: 4079829 - DNA, 15 bp, Homo sapiens
aagagtagaattgca

SEQ ID NO: 4079830 - DNA, 23 bp, Homo sapiens
aagagtagcaagttctagagaag

SEQ ID NO: 4079831 - DNA, 16 bp, Homo sapiens
aagagtagtaatagag

SEQ ID NO: 4079832 - DNA, 13 bp, Homo sapiens
aagagtattaatg

SEQ ID NO: 4079833 - DNA, 15 bp, Homo sapiens
aagagtattaatgta

SEQ ID NO: 4079834 - DNA, 14 bp, Homo sapiens
aagagtgattgcag

SEQ ID NO: 4079835 - DNA, 14 bp, Homo sapiens
aagagtgcattttc

SEQ ID NO: 4079836 - DNA, 16 bp, Homo sapiens
aagagtgccctgcttt

SEQ ID NO: 4079837 - DNA, 17 bp, Homo sapiens
aagagtgccctgctttg

SEQ ID NO: 4079838 - DNA, 22 bp, Homo sapiens
aagagtgccctgctttgcaaac

SEQ ID NO: 4079839 - DNA, 23 bp, Homo sapiens
aagagtgccctgctttgcaaaca

SEQ ID NO: 4079840 - DNA, 17 bp, Homo sapiens
aagagtggagagaagct

SEQ ID NO: 4079841 - DNA, 14 bp, Homo sapiens
aagagtgtagaagc

SEQ ID NO: 4079842 - DNA, 14 bp, Homo sapiens
aagataaatgtgct

SEQ ID NO: 4079843 - DNA, 12 bp, Homo sapiens
aagataattata

SEQ ID NO: 4079844 - DNA, 13 bp, Homo sapiens
aagataattgcta

SEQ ID NO: 4079845 - DNA, 17 bp, Homo sapiens
aagataattgctattta

SEQ ID NO: 4079846 - DNA, 21 bp, Homo sapiens
aagataattgctatttatttt

SEQ ID NO: 4079847 - DNA, 19 bp, Homo sapiens
aagataattgttgaaattt

SEQ ID NO: 4079848 - DNA, 16 bp, Homo sapiens
aagataatttatttca

SEQ ID NO: 4079849 - DNA, 14 bp, Homo sapiens
aagataatttgcat

SEQ ID NO: 4079850 - DNA, 20 bp, Homo sapiens
aagatacaaattaattttac

SEQ ID NO: 4079851 - DNA, 22 bp, Homo sapiens
aagataccggtgcttctggaaa

SEQ ID NO: 4079852 - DNA, 15 bp, Homo sapiens
aagatacgactttat

SEQ ID NO: 4079853 - DNA, 18 bp, Homo sapiens
aagatacgactttatttt

SEQ ID NO: 4079854 - DNA, 15 bp, Homo sapiens
aagataggctctgca

SEQ ID NO: 4079855 - DNA, 17 bp, Homo sapiens
aagataggctctgcaca

SEQ ID NO: 4079856 - DNA, 21 bp, Homo sapiens
aagatagtgtaacttgcttaa

SEQ ID NO: 4079857 - DNA, 20 bp, Homo sapiens
aagatatccatctttttctt

SEQ ID NO: 4079858 - DNA, 15 bp, Homo sapiens
aagatattgttcaaa

SEQ ID NO: 4079859 - DNA, 13 bp, Homo sapiens
aagatatttatat

SEQ ID NO: 4079860 - DNA, 15 bp, Homo sapiens
aagatatttatatat

SEQ ID NO: 4079861 - DNA, 20 bp, Homo sapiens
aagatcaattccctctctca

SEQ ID NO: 4079862 - DNA, 23 bp, Homo sapiens
aagatccatttgcctttctggga

SEQ ID NO: 4079863 - DNA, 16 bp, Homo sapiens
aagatcccctcaggac

SEQ ID NO: 4079864 - DNA, 20 bp, Homo sapiens
aagatctgttttgaaggcaa

SEQ ID NO: 4079865 - DNA, 24 bp, Homo sapiens
aagatcttgtctccactaaatgag

SEQ ID NO: 4079866 - DNA, 21 bp, Homo sapiens
aagatcttttcgaagctgtta

SEQ ID NO: 4079867 - DNA, 14 bp, Homo sapiens
aagatgaactctga

SEQ ID NO: 4079868 - DNA, 17 bp, Homo sapiens
aagccactagactcttc

SEQ ID NO: 4079869 - DNA, 19 bp, Homo sapiens
aagccagacctagcaggct

SEQ ID NO: 4079870 - DNA, 20 bp, Homo sapiens
aagccagacctagcaggctg

SEQ ID NO: 4079871 - DNA, 12 bp, Homo sapiens
aagccagagccc

SEQ ID NO: 4079872 - DNA, 17 bp, Homo sapiens
aagccaggcctggctgg

SEQ ID NO: 4079873 - DNA, 17 bp, Homo sapiens
aagccagtgaaatgtga

SEQ ID NO: 4079874 - DNA, 20 bp, Homo sapiens
aagccagtttgggtaaaata

SEQ ID NO: 4079875 - DNA, 18 bp, Homo sapiens
aagccataattgttctta

SEQ ID NO: 4079876 - DNA, 17 bp, Homo sapiens
aagccataggcccagga

SEQ ID NO: 4079877 - DNA, 21 bp, Homo sapiens
aagccatgtataaatgtgata

SEQ ID NO: 4079878 - DNA, 16 bp, Homo sapiens
aagcccaacctcctga

SEQ ID NO: 4079879 - DNA, 17 bp, Homo sapiens
aagcccaacctcctgac

SEQ ID NO: 4079880 - DNA, 22 bp, Homo sapiens
aagcccaacctcctgacctgtc

SEQ ID NO: 4079881 - DNA, 19 bp, Homo sapiens
aagcccaccaggtgtcagg

SEQ ID NO: 4079882 - DNA, 22 bp, Homo sapiens
aagcccagcccctactgctgtg

SEQ ID NO: 4079883 - DNA, 13 bp, Homo sapiens
aagcccaggaggg

SEQ ID NO: 4079884 - DNA, 22 bp, Homo sapiens
aagcccattttcaactgctttg

SEQ ID NO: 4079885 - DNA, 13 bp, Homo sapiens
aagccccagcagc

SEQ ID NO: 4079886 - DNA, 14 bp, Homo sapiens
aagcccccaccgtg

SEQ ID NO: 4079887 - DNA, 12 bp, Homo sapiens
aagcccccaggg

SEQ ID NO: 4079888 - DNA, 13 bp, Homo sapiens
aagcccccagggc

SEQ ID NO: 4079889 - DNA, 15 bp, Homo sapiens
aagcccccagggcct

SEQ ID NO: 4079890 - DNA, 20 bp, Homo sapiens
aagcccccagggcctccagg

SEQ ID NO: 4079891 - DNA, 16 bp, Homo sapiens
aagccctacagagctg

SEQ ID NO: 4079892 - DNA, 17 bp, Homo sapiens
aagccctacagagctgt

SEQ ID NO: 4079893 - DNA, 19 bp, Homo sapiens
aagccctacagagctgtgg

SEQ ID NO: 4079894 - DNA, 23 bp, Homo sapiens
aagccctgattgtgtatattcat

SEQ ID NO: 4079895 - DNA, 18 bp, Homo sapiens
aagccgactctggccctg

SEQ ID NO: 4079896 - DNA, 22 bp, Homo sapiens
aagccgtgctcgccccagcagg

SEQ ID NO: 4079897 - DNA, 13 bp, Homo sapiens
aagccgtggcttc

SEQ ID NO: 4079898 - DNA, 15 bp, Homo sapiens
aagccgtggcttccc

SEQ ID NO: 4079899 - DNA, 14 bp, Homo sapiens
aagcctaagaatct

SEQ ID NO: 4079900 - DNA, 19 bp, Homo sapiens
aagcctccaagcctgcctc

SEQ ID NO: 4079901 - DNA, 19 bp, Homo sapiens
aagcctccatttagttctt

SEQ ID NO: 4079902 - DNA, 22 bp, Homo sapiens
aagcctgcaatttcatatgctg

SEQ ID NO: 4079903 - DNA, 22 bp, Homo sapiens
aagcctgcgttggtccagagcg

SEQ ID NO: 4079904 - DNA, 16 bp, Homo sapiens
aagcctgctccttccc

SEQ ID NO: 4079905 - DNA, 14 bp, Homo sapiens
aagcctggactctg

SEQ ID NO: 4079906 - DNA, 15 bp, Homo sapiens
aagcctggtttttct

SEQ ID NO: 4079907 - DNA, 17 bp, Homo sapiens
aagcctgtgcctcccag

SEQ ID NO: 4079908 - DNA, 19 bp, Homo sapiens
aagcctgttttgttggaag

SEQ ID NO: 4079909 - DNA, 19 bp, Homo sapiens
aagccttaaactgtacaga

SEQ ID NO: 4079910 - DNA, 14 bp, Homo sapiens
aagccttaagccat

SEQ ID NO: 4079911 - DNA, 14 bp, Homo sapiens
aagccttagggaag

SEQ ID NO: 4079912 - DNA, 11 bp, Homo sapiens
aagccttccta

SEQ ID NO: 4079913 - DNA, 13 bp, Homo sapiens
aagccttgctcat

SEQ ID NO: 4079914 - DNA, 11 bp, Homo sapiens
aagccttgtgt

SEQ ID NO: 4079915 - DNA, 20 bp, Homo sapiens
aagcctttagtatcagtgtt

SEQ ID NO: 4079916 - DNA, 15 bp, Homo sapiens
aagcgattcactgta

SEQ ID NO: 4079917 - DNA, 12 bp, Homo sapiens
aagcgccctcac

SEQ ID NO: 4079918 - DNA, 21 bp, Homo sapiens
aagcggccctaagggagtgtc

SEQ ID NO: 4079919 - DNA, 13 bp, Homo sapiens
aagcggggggagg

SEQ ID NO: 4079920 - DNA, 14 bp, Homo sapiens
aagcggggggaggg

SEQ ID NO: 4079921 - DNA, 15 bp, Homo sapiens
aagctaatttgcatt

SEQ ID NO: 4079922 - DNA, 19 bp, Homo sapiens
aagctacctcaaacttcca

SEQ ID NO: 4079923 - DNA, 16 bp, Homo sapiens
aagctagcaaatagta

SEQ ID NO: 4079924 - DNA, 22 bp, Homo sapiens
aagctagggtggcccttgcagt

SEQ ID NO: 4079925 - DNA, 21 bp, Homo sapiens
aagctagtgtacctcctctca

SEQ ID NO: 4079926 - DNA, 15 bp, Homo sapiens
aagctagtgtttcta

SEQ ID NO: 4079927 - DNA, 17 bp, Homo sapiens
aagctatccaaataact

SEQ ID NO: 4079928 - DNA, 22 bp, Homo sapiens
aagctcagaggcgcactgtgac

SEQ ID NO: 4079929 - DNA, 12 bp, Homo sapiens
aagctcagtgct

SEQ ID NO: 4079930 - DNA, 16 bp, Homo sapiens
aagctcctctccccag

SEQ ID NO: 4079931 - DNA, 21 bp, Homo sapiens
aagctcctctccccagcccag

SEQ ID NO: 4079932 - DNA, 11 bp, Homo sapiens
aagctctggct

SEQ ID NO: 4079933 - DNA, 17 bp, Homo sapiens
aagctgaagtgcatcca

SEQ ID NO: 4079934 - DNA, 19 bp, Homo sapiens
aagctgaagtgcatccaaa

SEQ ID NO: 4079935 - DNA, 14 bp, Homo sapiens
aagctgagtttcct

SEQ ID NO: 4079936 - DNA, 16 bp, Homo sapiens
aagctgattactgtca

SEQ ID NO: 4079937 - DNA, 23 bp, Homo sapiens
aagctgattactgtcaataaaca

SEQ ID NO: 4079938 - DNA, 22 bp, Homo sapiens
aagctgcaggtgccagggccca

SEQ ID NO: 4079939 - DNA, 11 bp, Homo sapiens
aagctgccagc

SEQ ID NO: 4079940 - DNA, 21 bp, Homo sapiens
aagctgccgaaccaaaagaat

SEQ ID NO: 4079941 - DNA, 14 bp, Homo sapiens
aagctgcctctggg

SEQ ID NO: 4079942 - DNA, 16 bp, Homo sapiens
aagctgctctgagcca

SEQ ID NO: 4079943 - DNA, 21 bp, Homo sapiens
aagctgctgaccaattgtgct

SEQ ID NO: 4079944 - DNA, 22 bp, Homo sapiens
aagctgctgaccaattgtgctg

SEQ ID NO: 4079945 - DNA, 19 bp, Homo sapiens
aagctgcttgtcctgggcc

SEQ ID NO: 4079946 - DNA, 16 bp, Homo sapiens
aagctggacttctgtg

SEQ ID NO: 4079947 - DNA, 15 bp, Homo sapiens
aagctggccctgcct

SEQ ID NO: 4079948 - DNA, 16 bp, Homo sapiens
aagctggccctgcctc

SEQ ID NO: 4079949 - DNA, 22 bp, Homo sapiens
aagctggccctgcctcctggga

SEQ ID NO: 4079950 - DNA, 23 bp, Homo sapiens
aagctggccctgcctcctgggaa

SEQ ID NO: 4079951 - DNA, 13 bp, Homo sapiens
aagctgtgccttc

SEQ ID NO: 4079952 - DNA, 14 bp, Homo sapiens
aagctgtgccttca

SEQ ID NO: 4079953 - DNA, 14 bp, Homo sapiens
aagctgttcttcct

SEQ ID NO: 4079954 - DNA, 13 bp, Homo sapiens
aagctgttgtaca

SEQ ID NO: 4079955 - DNA, 17 bp, Homo sapiens
aagcttaatagccctcc

SEQ ID NO: 4079956 - DNA, 10 bp, Homo sapiens
aagcttagaa

SEQ ID NO: 4079957 - DNA, 18 bp, Homo sapiens
aagcttatgcttaaattc

SEQ ID NO: 4079958 - DNA, 18 bp, Homo sapiens
aagcttcaaattaaaaca

SEQ ID NO: 4079959 - DNA, 16 bp, Homo sapiens
aagcttccatgattct

SEQ ID NO: 4079960 - DNA, 21 bp, Homo sapiens
aagcttccatgattctattta

SEQ ID NO: 4079961 - DNA, 11 bp, Homo sapiens
aagcttccctc

SEQ ID NO: 4079962 - DNA, 12 bp, Homo sapiens
aagcttcttaat

SEQ ID NO: 4079963 - DNA, 15 bp, Homo sapiens
aagcttgactcccaa

SEQ ID NO: 4079964 - DNA, 23 bp, Homo sapiens
aagcttgtggccccttttacttt

SEQ ID NO: 4079965 - DNA, 16 bp, Homo sapiens
aagctttattaccagt

SEQ ID NO: 4079966 - DNA, 16 bp, Homo sapiens
aagctttcctgcccca

SEQ ID NO: 4079967 - DNA, 18 bp, Homo sapiens
aagctttcctgccccagg

SEQ ID NO: 4079968 - DNA, 22 bp, Homo sapiens
aagctttcctgccccaggcctg

SEQ ID NO: 4079969 - DNA, 20 bp, Homo sapiens
aaggaaaaacacaagcaaaa

SEQ ID NO: 4079970 - DNA, 19 bp, Homo sapiens
aaggaaaaataatcaagat

SEQ ID NO: 4079971 - DNA, 18 bp, Homo sapiens
aaggaaaacctgaagact

SEQ ID NO: 4079972 - DNA, 22 bp, Homo sapiens
aaattattataagcattgaaat

SEQ ID NO: 4079973 - DNA, 17 bp, Homo sapiens
aaattcacaaactttta

SEQ ID NO: 4079974 - DNA, 16 bp, Homo sapiens
aaattcacaatagaaa

SEQ ID NO: 4079975 - DNA, 22 bp, Homo sapiens
aaattcaccccctttcctggac

SEQ ID NO: 4079976 - DNA, 19 bp, Homo sapiens
aaattcactgtttcactga

SEQ ID NO: 4079977 - DNA, 21 bp, Homo sapiens
aaattcactgtttcactgaaa

SEQ ID NO: 4079978 - DNA, 22 bp, Homo sapiens
aaattcactgtttcactgaaat

SEQ ID NO: 4079979 - DNA, 19 bp, Homo sapiens
aaattcagtttttgtatct

SEQ ID NO: 4079980 - DNA, 21 bp, Homo sapiens
aaattcagtttttgtatcttg

SEQ ID NO: 4079981 - DNA, 13 bp, Homo sapiens
aaattcatttttt

SEQ ID NO: 4079982 - DNA, 18 bp, Homo sapiens
aaattccagcaataagaa

SEQ ID NO: 4079983 - DNA, 22 bp, Homo sapiens
aaattctataggaacatatgaa

SEQ ID NO: 4079984 - DNA, 12 bp, Homo sapiens
aaattctatgtt

SEQ ID NO: 4079985 - DNA, 21 bp, Homo sapiens
aaattctatgttaaatactgt

SEQ ID NO: 4079986 - DNA, 19 bp, Homo sapiens
aaattctattacagtatgt

SEQ ID NO: 4079987 - DNA, 21 bp, Homo sapiens
aaattctattctgatcttatt

SEQ ID NO: 4079988 - DNA, 20 bp, Homo sapiens
aaattctcagtcagtaattg

SEQ ID NO: 4079989 - DNA, 14 bp, Homo sapiens
aaattctgattctt

SEQ ID NO: 4079990 - DNA, 22 bp, Homo sapiens
aaattctgtgccttgttttttg

SEQ ID NO: 4079991 - DNA, 11 bp, Homo sapiens
aaattctgtgg

SEQ ID NO: 4079992 - DNA, 20 bp, Homo sapiens
aaattctgttaaaatctatt

SEQ ID NO: 4079993 - DNA, 13 bp, Homo sapiens
aaattgaaattgt

SEQ ID NO: 4079994 - DNA, 21 bp, Homo sapiens
aaattgaagagagatatatct

SEQ ID NO: 4079995 - DNA, 14 bp, Homo sapiens
aaattgatgtgttt

SEQ ID NO: 4079996 - DNA, 21 bp, Homo sapiens
aaattgatgtgtttatttata

SEQ ID NO: 4079997 - DNA, 16 bp, Homo sapiens
aaattgcataaagcat

SEQ ID NO: 4079998 - DNA, 18 bp, Homo sapiens
aaattgcatttcctgaca

SEQ ID NO: 4079999 - DNA, 22 bp, Homo sapiens
aaattgctatgttactattttc

SEQ ID NO: 4080000 - DNA, 19 bp, Homo sapiens
aaattggaacagaatgttt

SEQ ID NO: 4080001 - DNA, 23 bp, Homo sapiens
aaattggactttcaaaattaaat

SEQ ID NO: 4080002 - DNA, 17 bp, Homo sapiens
aaattgggacaacagtg

SEQ ID NO: 4080003 - DNA, 20 bp, Homo sapiens
aaattggtatcaagaaagtc

SEQ ID NO: 4080004 - DNA, 22 bp, Homo sapiens
aaattgtatctagtgcagctga

SEQ ID NO: 4080005 - DNA, 18 bp, Homo sapiens
aaattgtcttttgtcatg

SEQ ID NO: 4080006 - DNA, 13 bp, Homo sapiens
aaatttaaagata

SEQ ID NO: 4080007 - DNA, 15 bp, Homo sapiens
aaatttaaagatatt

SEQ ID NO: 4080008 - DNA, 15 bp, Homo sapiens
aaatttaagcattgt

SEQ ID NO: 4080009 - DNA, 15 bp, Homo sapiens
aaatttaagtatctt

SEQ ID NO: 4080010 - DNA, 19 bp, Homo sapiens
aaatttaatccttctttgt

SEQ ID NO: 4080011 - DNA, 12 bp, Homo sapiens
aaatttaattct

SEQ ID NO: 4080012 - DNA, 14 bp, Homo sapiens
aaatttactttaca

SEQ ID NO: 4080013 - DNA, 12 bp, Homo sapiens
aaatttagaaca

SEQ ID NO: 4080014 - DNA, 18 bp, Homo sapiens
aaatttagccctttaaaa

SEQ ID NO: 4080015 - DNA, 19 bp, Homo sapiens
aaatttagccctttaaaac

SEQ ID NO: 4080016 - DNA, 16 bp, Homo sapiens
aaatttagccgggcgc

SEQ ID NO: 4080017 - DNA, 23 bp, Homo sapiens
aaatttatcaaagcatagatgtt

SEQ ID NO: 4080018 - DNA, 16 bp, Homo sapiens
aaatttccagtacctt

SEQ ID NO: 4080019 - DNA, 22 bp, Homo sapiens
aaatttccagtacctttgtcac

SEQ ID NO: 4080020 - DNA, 10 bp, Homo sapiens
aaatttgaat

SEQ ID NO: 4080021 - DNA, 22 bp, Homo sapiens
aaatttgatttacatatattat

SEQ ID NO: 4080022 - DNA, 12 bp, Homo sapiens
aaatttgcaaaa

SEQ ID NO: 4080023 - DNA, 13 bp, Homo sapiens
aaatttgcaaaat

SEQ ID NO: 4080024 - DNA, 22 bp, Homo sapiens
aaatttgttttgacggatgatt

SEQ ID NO: 4080025 - DNA, 15 bp, Homo sapiens
aaattttagtccaaa

SEQ ID NO: 4080026 - DNA, 15 bp, Homo sapiens
aaattttgcaaatat

SEQ ID NO: 4080027 - DNA, 20 bp, Homo sapiens
aaattttgcaaatataaaca

SEQ ID NO: 4080028 - DNA, 17 bp, Homo sapiens
aaatttttcagatgctt

SEQ ID NO: 4080029 - DNA, 21 bp, Homo sapiens
aaatttttcagatgcttctgg

SEQ ID NO: 4080030 - DNA, 17 bp, Homo sapiens
aaatttttgtagtagcg

SEQ ID NO: 4080031 - DNA, 12 bp, Homo sapiens
aaattttttgac

SEQ ID NO: 4080032 - DNA, 23 bp, Homo sapiens
aaattttttgactttttttgtat

SEQ ID NO: 4080033 - DNA, 17 bp, Homo sapiens
aaattttttttacattt

SEQ ID NO: 4080034 - DNA, 17 bp, Homo sapiens
aaattttttttttaata

SEQ ID NO: 4080035 - DNA, 11 bp, Homo sapiens
aacaaaaggca

SEQ ID NO: 4080036 - DNA, 13 bp, Homo sapiens
aacaaaatctgaa

SEQ ID NO: 4080037 - DNA, 15 bp, Homo sapiens
aacaaaccaacatct

SEQ ID NO: 4080038 - DNA, 10 bp, Homo sapiens
aacaaaccat

SEQ ID NO: 4080039 - DNA, 16 bp, Homo sapiens
aacaaacgtgtttttt

SEQ ID NO: 4080040 - DNA, 18 bp, Homo sapiens
aacaaactaaaaatattc

SEQ ID NO: 4080041 - DNA, 12 bp, Homo sapiens
aacaaagaaata

SEQ ID NO: 4080042 - DNA, 19 bp, Homo sapiens
aacaaagagaaaaaataca

SEQ ID NO: 4080043 - DNA, 17 bp, Homo sapiens
aacaaaggcaagttaag

SEQ ID NO: 4080044 - DNA, 21 bp, Homo sapiens
aacaaagtgactgtttggctt

SEQ ID NO: 4080045 - DNA, 16 bp, Homo sapiens
aacaaatatgctaatt

SEQ ID NO: 4080046 - DNA, 18 bp, Homo sapiens
aacaaatatgctaatttg

SEQ ID NO: 4080047 - DNA, 14 bp, Homo sapiens
aacaacaattggta

SEQ ID NO: 4080048 - DNA, 13 bp, Homo sapiens
aacaagaagaaat

SEQ ID NO: 4080049 - DNA, 21 bp, Homo sapiens
aacaagaagccacagacctag

SEQ ID NO: 4080050 - DNA, 20 bp, Homo sapiens
aacaaggaatgcctgtgcca

SEQ ID NO: 4080051 - DNA, 20 bp, Homo sapiens
aacaagggagagacctcatc

SEQ ID NO: 4080052 - DNA, 23 bp, Homo sapiens
aacaagtgaaataacaaaatgga

SEQ ID NO: 4080053 - DNA, 20 bp, Homo sapiens
aacaataactactgtgttcc

SEQ ID NO: 4080054 - DNA, 14 bp, Homo sapiens
aacaatacaaatgg

SEQ ID NO: 4080055 - DNA, 13 bp, Homo sapiens
aacaatatcatat

SEQ ID NO: 4080056 - DNA, 14 bp, Homo sapiens
aacaatcctttctg

SEQ ID NO: 4080057 - DNA, 14 bp, Homo sapiens
aacaatgaagataa

SEQ ID NO: 4080058 - DNA, 20 bp, Homo sapiens
aacaatgacactagaaaact

SEQ ID NO: 4080059 - DNA, 21 bp, Homo sapiens
aacaatgtggagtctccctct

SEQ ID NO: 4080060 - DNA, 12 bp, Homo sapiens
aacaatgttaag

SEQ ID NO: 4080061 - DNA, 22 bp, Homo sapiens
aacaatgttaaggaaactctta

SEQ ID NO: 4080062 - DNA, 16 bp, Homo sapiens
aacaattcatgccttt

SEQ ID NO: 4080063 - DNA, 17 bp, Homo sapiens
aacaattgaagtaaact

SEQ ID NO: 4080064 - DNA, 18 bp, Homo sapiens
aacaattgtgtagccttt

SEQ ID NO: 4080065 - DNA, 23 bp, Homo sapiens
aacaattgtgtagcctttttgta

SEQ ID NO: 4080066 - DNA, 16 bp, Homo sapiens
aacaattgtgtgaatt

SEQ ID NO: 4080067 - DNA, 23 bp, Homo sapiens
aacaattttaggaggaccagagc

SEQ ID NO: 4080068 - DNA, 16 bp, Homo sapiens
aacacaaactgtaaat

SEQ ID NO: 4080069 - DNA, 19 bp, Homo sapiens
aacacaaactgtaaataaa

SEQ ID NO: 4080070 - DNA, 19 bp, Homo sapiens
aacacaaagcggggggagg

SEQ ID NO: 4080071 - DNA, 16 bp, Homo sapiens
aacacaagcaaaaaaa

SEQ ID NO: 4080072 - DNA, 15 bp, Homo sapiens
aacacaagctggaag

SEQ ID NO: 4080073 - DNA, 14 bp, Homo sapiens
aacacacaaaggta

SEQ ID NO: 4080074 - DNA, 12 bp, Homo sapiens
aacacacacaca

SEQ ID NO: 4080075 - DNA, 13 bp, Homo sapiens
aaatcttggaagt

SEQ ID NO: 4080076 - DNA, 19 bp, Homo sapiens
aaatcttggaagtacatga

SEQ ID NO: 4080077 - DNA, 20 bp, Homo sapiens
aaatcttggaagtacatgaa

SEQ ID NO: 4080078 - DNA, 22 bp, Homo sapiens
aaatcttttaaaaattcaaatg

SEQ ID NO: 4080079 - DNA, 15 bp, Homo sapiens
aaatgaaagcatgtg

SEQ ID NO: 4080080 - DNA, 13 bp, Homo sapiens
aaatgaaatattt

SEQ ID NO: 4080081 - DNA, 17 bp, Homo sapiens
aaatgaaatttgcaaaa

SEQ ID NO: 4080082 - DNA, 13 bp, Homo sapiens
aaatgaacaaaag

SEQ ID NO: 4080083 - DNA, 21 bp, Homo sapiens
aaatgaactgaagtttcacat

SEQ ID NO: 4080084 - DNA, 22 bp, Homo sapiens
aaatgaaggttaggatttaaca

SEQ ID NO: 4080085 - DNA, 16 bp, Homo sapiens
aaatgaatatctatta

SEQ ID NO: 4080086 - DNA, 17 bp, Homo sapiens
aaatgaatatctattaa

SEQ ID NO: 4080087 - DNA, 18 bp, Homo sapiens
aaatgacactttataact

SEQ ID NO: 4080088 - DNA, 20 bp, Homo sapiens
aaatgactaaaaatattata

SEQ ID NO: 4080089 - DNA, 20 bp, Homo sapiens
aaatgagaattttatattct

SEQ ID NO: 4080090 - DNA, 17 bp, Homo sapiens
aaatgagattatatgtg

SEQ ID NO: 4080091 - DNA, 14 bp, Homo sapiens
aaatgagctcctgc

SEQ ID NO: 4080092 - DNA, 18 bp, Homo sapiens
aaatgaggattattgata

SEQ ID NO: 4080093 - DNA, 15 bp, Homo sapiens
aaatgaggtctgttt

SEQ ID NO: 4080094 - DNA, 16 bp, Homo sapiens
aaatgaggtctgttta

SEQ ID NO: 4080095 - DNA, 13 bp, Homo sapiens
aaatgagtaacat

SEQ ID NO: 4080096 - DNA, 15 bp, Homo sapiens
aaatgagtaacattt

SEQ ID NO: 4080097 - DNA, 20 bp, Homo sapiens
aaatgagttgtgatgaatca

SEQ ID NO: 4080098 - DNA, 19 bp, Homo sapiens
aaatgatgatgtggaagaa

SEQ ID NO: 4080099 - DNA, 21 bp, Homo sapiens
aaatgatttgtagtggaaaca

SEQ ID NO: 4080100 - DNA, 18 bp, Homo sapiens
aaatgattttaattttat

SEQ ID NO: 4080101 - DNA, 23 bp, Homo sapiens
aaatgcaacaaatgaattttcca

SEQ ID NO: 4080102 - DNA, 17 bp, Homo sapiens
aaatgcaagtgcctaga

SEQ ID NO: 4080103 - DNA, 19 bp, Homo sapiens
aaatgcacatagctatcaa

SEQ ID NO: 4080104 - DNA, 21 bp, Homo sapiens
aaatgcagggaggggaggcag

SEQ ID NO: 4080105 - DNA, 16 bp, Homo sapiens
aaatgcagttttaaga

SEQ ID NO: 4080106 - DNA, 20 bp, Homo sapiens
aaatgcatgattttgtaacc

SEQ ID NO: 4080107 - DNA, 13 bp, Homo sapiens
aaatgcatggagg

SEQ ID NO: 4080108 - DNA, 20 bp, Homo sapiens
aaatgcattctatcgttatt

SEQ ID NO: 4080109 - DNA, 23 bp, Homo sapiens
aaatgcattctatcgttattata

SEQ ID NO: 4080110 - DNA, 13 bp, Homo sapiens
aaatgcctttgag

SEQ ID NO: 4080111 - DNA, 14 bp, Homo sapiens
aaatgcctttgaga

SEQ ID NO: 4080112 - DNA, 17 bp, Homo sapiens
aaatgcctttgagacag

SEQ ID NO: 4080113 - DNA, 19 bp, Homo sapiens
aaatgcctttgagacagtt

SEQ ID NO: 4080114 - DNA, 18 bp, Homo sapiens
aaatgctcattttctggt

SEQ ID NO: 4080115 - DNA, 21 bp, Homo sapiens
aaatgctcattttctggtttg

SEQ ID NO: 4080116 - DNA, 18 bp, Homo sapiens
aaatgctgttagtaaatt

SEQ ID NO: 4080117 - DNA, 18 bp, Homo sapiens
aaatgctttttatttctg

SEQ ID NO: 4080118 - DNA, 20 bp, Homo sapiens
aaatgctttttatttctgca

SEQ ID NO: 4080119 - DNA, 20 bp, Homo sapiens
aaatggaaagtaactcattt

SEQ ID NO: 4080120 - DNA, 23 bp, Homo sapiens
aaatggactggagctcatctgca

SEQ ID NO: 4080121 - DNA, 17 bp, Homo sapiens
aaatggagctttctgta

SEQ ID NO: 4080122 - DNA, 16 bp, Homo sapiens
aaatggcaaatgcact

SEQ ID NO: 4080123 - DNA, 18 bp, Homo sapiens
aaatggcatcaaccacca

SEQ ID NO: 4080124 - DNA, 17 bp, Homo sapiens
aaatggctggtttttag

SEQ ID NO: 4080125 - DNA, 16 bp, Homo sapiens
aaatgggacttaactc

SEQ ID NO: 4080126 - DNA, 20 bp, Homo sapiens
aaatgggagctgagcagcct

SEQ ID NO: 4080127 - DNA, 17 bp, Homo sapiens
aaatggggccagatcca

SEQ ID NO: 4080128 - DNA, 22 bp, Homo sapiens
aaatggggccagatccagcctg

SEQ ID NO: 4080129 - DNA, 22 bp, Homo sapiens
aaatgggtgtatataattttat

SEQ ID NO: 4080130 - DNA, 19 bp, Homo sapiens
aaatggtaggcatttccta

SEQ ID NO: 4080131 - DNA, 21 bp, Homo sapiens
aaatggtccaattagtttcct

SEQ ID NO: 4080132 - DNA, 19 bp, Homo sapiens
aaatggtgctgcagatttg

SEQ ID NO: 4080133 - DNA, 23 bp, Homo sapiens
aaatggttcagaattaaactttt

SEQ ID NO: 4080134 - DNA, 17 bp, Homo sapiens
aaatgtaaatttataaa

SEQ ID NO: 4080135 - DNA, 18 bp, Homo sapiens
aaatgtaatactggaata

SEQ ID NO: 4080136 - DNA, 20 bp, Homo sapiens
aaatgtagcttttggggagg

SEQ ID NO: 4080137 - DNA, 11 bp, Homo sapiens
aaatgtatact

SEQ ID NO: 4080138 - DNA, 14 bp, Homo sapiens
aaatgtattttaca

SEQ ID NO: 4080139 - DNA, 20 bp, Homo sapiens
aaatgtattttgaagaatat

SEQ ID NO: 4080140 - DNA, 17 bp, Homo sapiens
aaatgtcacagaagcag

SEQ ID NO: 4080141 - DNA, 21 bp, Homo sapiens
aaatgtcagtgtttgggaaat

SEQ ID NO: 4080142 - DNA, 16 bp, Homo sapiens
aaatgtctattattat

SEQ ID NO: 4080143 - DNA, 12 bp, Homo sapiens
aaatgtctcagt

SEQ ID NO: 4080144 - DNA, 13 bp, Homo sapiens
aaatgtctttgta

SEQ ID NO: 4080145 - DNA, 17 bp, Homo sapiens
aaatgtcttttagaaga

SEQ ID NO: 4080146 - DNA, 14 bp, Homo sapiens
aaatgtgaggaaga

SEQ ID NO: 4080147 - DNA, 23 bp, Homo sapiens
aaatgtgtacaatgtacacactg

SEQ ID NO: 4080148 - DNA, 21 bp, Homo sapiens
aaatgtgtcctatctatcttc

SEQ ID NO: 4080149 - DNA, 13 bp, Homo sapiens
aaatgtgtttgct

SEQ ID NO: 4080150 - DNA, 16 bp, Homo sapiens
aaatgttagtatttta

SEQ ID NO: 4080151 - DNA, 13 bp, Homo sapiens
aaatgttagttct

SEQ ID NO: 4080152 - DNA, 22 bp, Homo sapiens
aaatgttatgactatgtaaact

SEQ ID NO: 4080153 - DNA, 21 bp, Homo sapiens
aaatgttattttttaattatt

SEQ ID NO: 4080154 - DNA, 15 bp, Homo sapiens
aaatgttctttgggg

SEQ ID NO: 4080155 - DNA, 18 bp, Homo sapiens
aaatgttggatttataaa

SEQ ID NO: 4080156 - DNA, 20 bp, Homo sapiens
aaatgttggatttataaatg

SEQ ID NO: 4080157 - DNA, 21 bp, Homo sapiens
aaattaaaacgaaaataaagt

SEQ ID NO: 4080158 - DNA, 22 bp, Homo sapiens
aaattaaagcctttagtatcag

SEQ ID NO: 4080159 - DNA, 19 bp, Homo sapiens
aaattaacacaaaggaagt

SEQ ID NO: 4080160 - DNA, 17 bp, Homo sapiens
aaattaagggttaagaa

SEQ ID NO: 4080161 - DNA, 15 bp, Homo sapiens
aaattaatattgtat

SEQ ID NO: 4080162 - DNA, 16 bp, Homo sapiens
aaattaatcatagtca

SEQ ID NO: 4080163 - DNA, 16 bp, Homo sapiens
aaattacaaaagagca

SEQ ID NO: 4080164 - DNA, 21 bp, Homo sapiens
aaattacaaaagagcagcatt

SEQ ID NO: 4080165 - DNA, 15 bp, Homo sapiens
aaattactacaaaat

SEQ ID NO: 4080166 - DNA, 14 bp, Homo sapiens
aaattactgtgtaa

SEQ ID NO: 4080167 - DNA, 14 bp, Homo sapiens
aaattagatgaact

SEQ ID NO: 4080168 - DNA, 18 bp, Homo sapiens
aaattaggggttaaagca

SEQ ID NO: 4080169 - DNA, 17 bp, Homo sapiens
aaattataacttaaaat

SEQ ID NO: 4080170 - DNA, 18 bp, Homo sapiens
aaattatacctgttgctt

SEQ ID NO: 4080171 - DNA, 16 bp, Homo sapiens
aaattatcaatatcta

SEQ ID NO: 4080172 - DNA, 16 bp, Homo sapiens
aaattatctatagcta

SEQ ID NO: 4080173 - DNA, 13 bp, Homo sapiens
aaattatgtataa

SEQ ID NO: 4080174 - DNA, 14 bp, Homo sapiens
aaattatgtataaa

SEQ ID NO: 4080175 - DNA, 16 bp, Homo sapiens
aaattatgtataaaca

SEQ ID NO: 4080176 - DNA, 20 bp, Homo sapiens
aaattatgttacatctgttt

SEQ ID NO: 4080177 - DNA, 19 bp, Homo sapiens
aaattattataagcattga

SEQ ID NO: 4080178 - DNA, 14 bp, Homo sapiens
aaagaaataccttg

SEQ ID NO: 4080179 - DNA, 18 bp, Homo sapiens
aaagaacttaaattatgt

SEQ ID NO: 4080180 - DNA, 19 bp, Homo sapiens
aaagaacttgatttgcatg

SEQ ID NO: 4080181 - DNA, 14 bp, Homo sapiens
aaagaagaaacttt

SEQ ID NO: 4080182 - DNA, 13 bp, Homo sapiens
aaagaagagaagt

SEQ ID NO: 4080183 - DNA, 18 bp, Homo sapiens
aaagaatatatttattta

SEQ ID NO: 4080184 - DNA, 20 bp, Homo sapiens
aaagaatgccatttctcacg

SEQ ID NO: 4080185 - DNA, 19 bp, Homo sapiens
aaagacacctactgagtgg

SEQ ID NO: 4080186 - DNA, 19 bp, Homo sapiens
aaagacactggcagagaga

SEQ ID NO: 4080187 - DNA, 20 bp, Homo sapiens
aaagacctacattccctctc

SEQ ID NO: 4080188 - DNA, 22 bp, Homo sapiens
aaagacctttggagcaaagctg

SEQ ID NO: 4080189 - DNA, 22 bp, Homo sapiens
aaagacgtctctttttggtaat

SEQ ID NO: 4080190 - DNA, 14 bp, Homo sapiens
aaagactcagccaa

SEQ ID NO: 4080191 - DNA, 15 bp, Homo sapiens
aaagactcagtgttc

SEQ ID NO: 4080192 - DNA, 14 bp, Homo sapiens
aaagactgtacaaa

SEQ ID NO: 4080193 - DNA, 23 bp, Homo sapiens
aaagacttgagacaatgttttct

SEQ ID NO: 4080194 - DNA, 18 bp, Homo sapiens
aaagacttggttggtagg

SEQ ID NO: 4080195 - DNA, 13 bp, Homo sapiens
aaagagacagtga

SEQ ID NO: 4080196 - DNA, 15 bp, Homo sapiens
aaagagacagtgata

SEQ ID NO: 4080197 - DNA, 11 bp, Homo sapiens
aaagagaggtt

SEQ ID NO: 4080198 - DNA, 12 bp, Homo sapiens
aaagagaggtta

SEQ ID NO: 4080199 - DNA, 16 bp, Homo sapiens
aaagagatattttaaa

SEQ ID NO: 4080200 - DNA, 14 bp, Homo sapiens
aaagagcagcattt

SEQ ID NO: 4080201 - DNA, 19 bp, Homo sapiens
aaagaggagaaaatttata

SEQ ID NO: 4080202 - DNA, 19 bp, Homo sapiens
aaagaggctgaggctggca

SEQ ID NO: 4080203 - DNA, 18 bp, Homo sapiens
aaagaggctgcccctctc

SEQ ID NO: 4080204 - DNA, 20 bp, Homo sapiens
aaagaggctgcccctctcac

SEQ ID NO: 4080205 - DNA, 23 bp, Homo sapiens
aaagaggctgcccctctcaccaa

SEQ ID NO: 4080206 - DNA, 14 bp, Homo sapiens
aaagagtcacacaa

SEQ ID NO: 4080207 - DNA, 20 bp, Homo sapiens
aaagataattgctatttatt

SEQ ID NO: 4080208 - DNA, 20 bp, Homo sapiens
aaagatacgactttattttc

SEQ ID NO: 4080209 - DNA, 22 bp, Homo sapiens
aaagatattgttcaaacaatat

SEQ ID NO: 4080210 - DNA, 14 bp, Homo sapiens
aaagatcaaaataa

SEQ ID NO: 4080211 - DNA, 15 bp, Homo sapiens
aaagatcaaaataaa

SEQ ID NO: 4080212 - DNA, 13 bp, Homo sapiens
aaagatctgtttt

SEQ ID NO: 4080213 - DNA, 20 bp, Homo sapiens
aaagatgccccattccttgc

SEQ ID NO: 4080214 - DNA, 12 bp, Homo sapiens
aaagatggcctt

SEQ ID NO: 4080215 - DNA, 22 bp, Homo sapiens
aaagatgtaatgtccctttcag

SEQ ID NO: 4080216 - DNA, 20 bp, Homo sapiens
aaagatgtttgtcagatatg

SEQ ID NO: 4080217 - DNA, 13 bp, Homo sapiens
aaagattaaacag

SEQ ID NO: 4080218 - DNA, 16 bp, Homo sapiens
aaagattggagctgaa

SEQ ID NO: 4080219 - DNA, 20 bp, Homo sapiens
aaagatttaagcacaaactt

SEQ ID NO: 4080220 - DNA, 14 bp, Homo sapiens
aaagattttaatca

SEQ ID NO: 4080221 - DNA, 18 bp, Homo sapiens
aaagattttaatcaagtt

SEQ ID NO: 4080222 - DNA, 21 bp, Homo sapiens
aaagattttattgtataaaaa

SEQ ID NO: 4080223 - DNA, 15 bp, Homo sapiens
aaagattttcagaaa

SEQ ID NO: 4080224 - DNA, 21 bp, Homo sapiens
aaagattttcagaaaatatta

SEQ ID NO: 4080225 - DNA, 14 bp, Homo sapiens
aaagcaaaacaaaa

SEQ ID NO: 4080226 - DNA, 15 bp, Homo sapiens
aaagcaacaaagaaa

SEQ ID NO: 4080227 - DNA, 15 bp, Homo sapiens
aaagcaagggagaaa

SEQ ID NO: 4080228 - DNA, 18 bp, Homo sapiens
aaagcacatacattaaaa

SEQ ID NO: 4080229 - DNA, 21 bp, Homo sapiens
aaagcacatacattaaaacta

SEQ ID NO: 4080230 - DNA, 16 bp, Homo sapiens
aaagcacattgaaaga

SEQ ID NO: 4080231 - DNA, 15 bp, Homo sapiens
aaagcacttttgtta

SEQ ID NO: 4080232 - DNA, 16 bp, Homo sapiens
aaagcacttttgttat

SEQ ID NO: 4080233 - DNA, 17 bp, Homo sapiens
aaagcacttttgttatt

SEQ ID NO: 4080234 - DNA, 23 bp, Homo sapiens
aaagcacttttgttattccatca

SEQ ID NO: 4080235 - DNA, 14 bp, Homo sapiens
aaagcactttttgg

SEQ ID NO: 4080236 - DNA, 23 bp, Homo sapiens
aaagcagaattttaatgtgaaga

SEQ ID NO: 4080237 - DNA, 13 bp, Homo sapiens
aaagcagcatctg

SEQ ID NO: 4080238 - DNA, 22 bp, Homo sapiens
aaagcagtagaaataatatgca

SEQ ID NO: 4080239 - DNA, 18 bp, Homo sapiens
aaagcataagtatacagt

SEQ ID NO: 4080240 - DNA, 17 bp, Homo sapiens
aaagcatacatgcaaaa

SEQ ID NO: 4080241 - DNA, 23 bp, Homo sapiens
aaagcatgatgggaaaatatttc

SEQ ID NO: 4080242 - DNA, 18 bp, Homo sapiens
aaagcattgctgttatgt

SEQ ID NO: 4080243 - DNA, 21 bp, Homo sapiens
aaagcattgcttttattttga

SEQ ID NO: 4080244 - DNA, 22 bp, Homo sapiens
aaagcattgcttttattttgaa

SEQ ID NO: 4080245 - DNA, 12 bp, Homo sapiens
aaagcatttata

SEQ ID NO: 4080246 - DNA, 13 bp, Homo sapiens
aaagcatttccta

SEQ ID NO: 4080247 - DNA, 10 bp, Homo sapiens
aaagccaagc

SEQ ID NO: 4080248 - DNA, 23 bp, Homo sapiens
aaagccaagcaaaccaatggtga

SEQ ID NO: 4080249 - DNA, 15 bp, Homo sapiens
aaagccacaaggctg

SEQ ID NO: 4080250 - DNA, 21 bp, Homo sapiens
aaagccacattatttctagtc

SEQ ID NO: 4080251 - DNA, 16 bp, Homo sapiens
aaagccactagactct

SEQ ID NO: 4080252 - DNA, 17 bp, Homo sapiens
aaagccactagactctt

SEQ ID NO: 4080253 - DNA, 14 bp, Homo sapiens
aaagccagggtctc

SEQ ID NO: 4080254 - DNA, 13 bp, Homo sapiens
aaagcctgttccc

SEQ ID NO: 4080255 - DNA, 20 bp, Homo sapiens
aaagcctgttcccctcactg

SEQ ID NO: 4080256 - DNA, 19 bp, Homo sapiens
aaagccttagggaagctgg

SEQ ID NO: 4080257 - DNA, 11 bp, Homo sapiens
aaagccttgtg

SEQ ID NO: 4080258 - DNA, 17 bp, Homo sapiens
aaagcgatatacagatg

SEQ ID NO: 4080259 - DNA, 16 bp, Homo sapiens
aaagcggggggagggt

SEQ ID NO: 4080260 - DNA, 18 bp, Homo sapiens
aaagcggggggagggttg

SEQ ID NO: 4080261 - DNA, 17 bp, Homo sapiens
aaagcgtttctttactt

SEQ ID NO: 4080262 - DNA, 17 bp, Homo sapiens
aaagctaaaatgatttt

SEQ ID NO: 4080263 - DNA, 14 bp, Homo sapiens
aaagctatgttaca

SEQ ID NO: 4080264 - DNA, 19 bp, Homo sapiens
aaagctattagccaggatc

SEQ ID NO: 4080265 - DNA, 20 bp, Homo sapiens
aaagctattagccaggatca

SEQ ID NO: 4080266 - DNA, 22 bp, Homo sapiens
aaagctctgttgcaattaggat

SEQ ID NO: 4080267 - DNA, 16 bp, Homo sapiens
aaagctgaatgtcaaa

SEQ ID NO: 4080268 - DNA, 20 bp, Homo sapiens
aaagctgagaactcctgact

SEQ ID NO: 4080269 - DNA, 19 bp, Homo sapiens
aaagctgattactgtcaat

SEQ ID NO: 4080270 - DNA, 22 bp, Homo sapiens
aaagctgattactgtcaataaa

SEQ ID NO: 4080271 - DNA, 11 bp, Homo sapiens
aaagctggccc

SEQ ID NO: 4080272 - DNA, 12 bp, Homo sapiens
aaagctggccct

SEQ ID NO: 4080273 - DNA, 20 bp, Homo sapiens
aaagctggccctgcctcctg

SEQ ID NO: 4080274 - DNA, 13 bp, Homo sapiens
aaagctgttcttc

SEQ ID NO: 4080275 - DNA, 16 bp, Homo sapiens
aaagctgttcttcctg

SEQ ID NO: 4080276 - DNA, 17 bp, Homo sapiens
aaagctgttcttcctgg

SEQ ID NO: 4080277 - DNA, 13 bp, Homo sapiens
aaagcttaataaa

SEQ ID NO: 4080278 - DNA, 18 bp, Homo sapiens
aaagcttatttttctgtg

SEQ ID NO: 4080279 - DNA, 20 bp, Homo sapiens
aaagcttccatgattctatt

SEQ ID NO: 4080280 - DNA, 19 bp, Homo sapiens
aaagcttgcaacaaaattc

SEQ ID NO: 4080281 - DNA, 18 bp, Homo sapiens
aaatacacatagcatgta

SEQ ID NO: 4080282 - DNA, 14 bp, Homo sapiens
aaatacagacacta

SEQ ID NO: 4080283 - DNA, 14 bp, Homo sapiens
aaatactaaaagca

SEQ ID NO: 4080284 - DNA, 17 bp, Homo sapiens
aaatactaaaagcaaat

SEQ ID NO: 4080285 - DNA, 19 bp, Homo sapiens
aaatactaaaagcaaatct

SEQ ID NO: 4080286 - DNA, 13 bp, Homo sapiens
aaatactgtgcag

SEQ ID NO: 4080287 - DNA, 20 bp, Homo sapiens
aaatacttgtcaatatttaa

SEQ ID NO: 4080288 - DNA, 22 bp, Homo sapiens
aaatacttgtcaatatttaaac

SEQ ID NO: 4080289 - DNA, 15 bp, Homo sapiens
aaatactttaaagga

SEQ ID NO: 4080290 - DNA, 16 bp, Homo sapiens
aaatactttaaaggaa

SEQ ID NO: 4080291 - DNA, 17 bp, Homo sapiens
aaatacttttactctgc

SEQ ID NO: 4080292 - DNA, 16 bp, Homo sapiens
aaatagaaagaagcca

SEQ ID NO: 4080293 - DNA, 14 bp, Homo sapiens
aaatagaaattttg

SEQ ID NO: 4080294 - DNA, 16 bp, Homo sapiens
aaatagacagtatatt

SEQ ID NO: 4080295 - DNA, 15 bp, Homo sapiens
aaatagagcttttaa

SEQ ID NO: 4080296 - DNA, 20 bp, Homo sapiens
aaatagagcttttaaaaatg

SEQ ID NO: 4080297 - DNA, 22 bp, Homo sapiens
aaatagccttcaaaaagagaga

SEQ ID NO: 4080298 - DNA, 14 bp, Homo sapiens
aaatagtatttgag

SEQ ID NO: 4080299 - DNA, 15 bp, Homo sapiens
aaatagtatttgcat

SEQ ID NO: 4080300 - DNA, 19 bp, Homo sapiens
aaatagtgacataatatat

SEQ ID NO: 4080301 - DNA, 13 bp, Homo sapiens
aaatataaacatc

SEQ ID NO: 4080302 - DNA, 14 bp, Homo sapiens
aaatataagacatt

SEQ ID NO: 4080303 - DNA, 17 bp, Homo sapiens
aaatataagacatttgt

SEQ ID NO: 4080304 - DNA, 19 bp, Homo sapiens
aaatataagacatttgttt

SEQ ID NO: 4080305 - DNA, 16 bp, Homo sapiens
aaatataattctgtaa

SEQ ID NO: 4080306 - DNA, 19 bp, Homo sapiens
aaatataattctgtaaatg

SEQ ID NO: 4080307 - DNA, 16 bp, Homo sapiens
aaatataatttttaat

SEQ ID NO: 4080308 - DNA, 12 bp, Homo sapiens
aaatatagatta

SEQ ID NO: 4080309 - DNA, 13 bp, Homo sapiens
aaatatagattag

SEQ ID NO: 4080310 - DNA, 19 bp, Homo sapiens
aaatatagattagaaaaat

SEQ ID NO: 4080311 - DNA, 23 bp, Homo sapiens
aaatatattcaggagttggaatg

SEQ ID NO: 4080312 - DNA, 12 bp, Homo sapiens
aaatatatttaa

SEQ ID NO: 4080313 - DNA, 21 bp, Homo sapiens
aaatatatttaagataattat

SEQ ID NO: 4080314 - DNA, 19 bp, Homo sapiens
aaatatcacagtattatct

SEQ ID NO: 4080315 - DNA, 20 bp, Homo sapiens
aaatatcacagtattatctg

SEQ ID NO: 4080316 - DNA, 19 bp, Homo sapiens
aaatatctgaaaatgtatg

SEQ ID NO: 4080317 - DNA, 22 bp, Homo sapiens
aaatatctgaaaatgtatgtgt

SEQ ID NO: 4080318 - DNA, 13 bp, Homo sapiens
aaatatcttttat

SEQ ID NO: 4080319 - DNA, 14 bp, Homo sapiens
aaatatcttttatg

SEQ ID NO: 4080320 - DNA, 20 bp, Homo sapiens
aaatatgattttatttgaca

SEQ ID NO: 4080321 - DNA, 10 bp, Homo sapiens
aaatatgcaa

SEQ ID NO: 4080322 - DNA, 23 bp, Homo sapiens
aaatatgccccttcttgggcccc

SEQ ID NO: 4080323 - DNA, 19 bp, Homo sapiens
aaatatgctaatttgggga

SEQ ID NO: 4080324 - DNA, 17 bp, Homo sapiens
aaatatggaacttacat

SEQ ID NO: 4080325 - DNA, 16 bp, Homo sapiens
aaatatggacacttaa

SEQ ID NO: 4080326 - DNA, 19 bp, Homo sapiens
aaatatggctataaatata

SEQ ID NO: 4080327 - DNA, 22 bp, Homo sapiens
aaatatgtaatgcttccaatct

SEQ ID NO: 4080328 - DNA, 16 bp, Homo sapiens
aaatatgtacatttgt

SEQ ID NO: 4080329 - DNA, 16 bp, Homo sapiens
aaatatgtcctggggt

SEQ ID NO: 4080330 - DNA, 14 bp, Homo sapiens
aaatattacagtga

SEQ ID NO: 4080331 - DNA, 15 bp, Homo sapiens
aaatattatgtgttt

SEQ ID NO: 4080332 - DNA, 15 bp, Homo sapiens
aaatattgaggcttt

SEQ ID NO: 4080333 - DNA, 20 bp, Homo sapiens
aaatattgaggctttgtgtt

SEQ ID NO: 4080334 - DNA, 20 bp, Homo sapiens
aaatattgtgttgtgaatgt

SEQ ID NO: 4080335 - DNA, 17 bp, Homo sapiens
aaatattgttgacaact

SEQ ID NO: 4080336 - DNA, 15 bp, Homo sapiens
aaatattgtttctgc

SEQ ID NO: 4080337 - DNA, 16 bp, Homo sapiens
aaatattgtttctgca

SEQ ID NO: 4080338 - DNA, 21 bp, Homo sapiens
aaatattgtttctgcattcat

SEQ ID NO: 4080339 - DNA, 15 bp, Homo sapiens
aaatatttatttatt

SEQ ID NO: 4080340 - DNA, 16 bp, Homo sapiens
aaatatttcagatatc

SEQ ID NO: 4080341 - DNA, 13 bp, Homo sapiens
aaatatttcctga

SEQ ID NO: 4080342 - DNA, 21 bp, Homo sapiens
aaatatttcctgacttgagtg

SEQ ID NO: 4080343 - DNA, 20 bp, Homo sapiens
aaatatttgacttgcatgaa

SEQ ID NO: 4080344 - DNA, 21 bp, Homo sapiens
aaatattttgataataaattg

SEQ ID NO: 4080345 - DNA, 12 bp, Homo sapiens
aaatatttttgg

SEQ ID NO: 4080346 - DNA, 21 bp, Homo sapiens
aaatatttttttttctttcag

SEQ ID NO: 4080347 - DNA, 19 bp, Homo sapiens
aaatcaagcataaatcact

SEQ ID NO: 4080348 - DNA, 20 bp, Homo sapiens
aaatcaatcctgttaagaga

SEQ ID NO: 4080349 - DNA, 17 bp, Homo sapiens
aaatcagaataaattaa

SEQ ID NO: 4080350 - DNA, 20 bp, Homo sapiens
aaatcagaggagagacggtg

SEQ ID NO: 4080351 - DNA, 20 bp, Homo sapiens
aaatcaggtgttttaagact

SEQ ID NO: 4080352 - DNA, 22 bp, Homo sapiens
aaatcaggtgttttaagactga

SEQ ID NO: 4080353 - DNA, 19 bp, Homo sapiens
aaatcagtaagaggtgtta

SEQ ID NO: 4080354 - DNA, 22 bp, Homo sapiens
aaatcatattagtattaatact

SEQ ID NO: 4080355 - DNA, 13 bp, Homo sapiens
aaatcatgtatgt

SEQ ID NO: 4080356 - DNA, 14 bp, Homo sapiens
aaatcatgtatgtt

SEQ ID NO: 4080357 - DNA, 21 bp, Homo sapiens
aaatcatgtatgttatgatat

SEQ ID NO: 4080358 - DNA, 19 bp, Homo sapiens
aaatcattaatactcttct

SEQ ID NO: 4080359 - DNA, 12 bp, Homo sapiens
aaatcatttcag

SEQ ID NO: 4080360 - DNA, 22 bp, Homo sapiens
aaatccagaaacttgttcttcc

SEQ ID NO: 4080361 - DNA, 23 bp, Homo sapiens
aaatccagaaacttgttcttcca

SEQ ID NO: 4080362 - DNA, 17 bp, Homo sapiens
aaatcctttttctttat

SEQ ID NO: 4080363 - DNA, 18 bp, Homo sapiens
aaatcctttttctttata

SEQ ID NO: 4080364 - DNA, 20 bp, Homo sapiens
aaatctaaatctatttatta

SEQ ID NO: 4080365 - DNA, 17 bp, Homo sapiens
aaatctacagatccttt

SEQ ID NO: 4080366 - DNA, 21 bp, Homo sapiens
aaatctataaagaaggataaa

SEQ ID NO: 4080367 - DNA, 17 bp, Homo sapiens
aaatctatttattaata

SEQ ID NO: 4080368 - DNA, 23 bp, Homo sapiens
aaatctcaaatttggattgctaa

SEQ ID NO: 4080369 - DNA, 16 bp, Homo sapiens
aaatctcccattttgg

SEQ ID NO: 4080370 - DNA, 20 bp, Homo sapiens
aaatctgaactctcaaaagt

SEQ ID NO: 4080371 - DNA, 13 bp, Homo sapiens
aaatctgacatat

SEQ ID NO: 4080372 - DNA, 15 bp, Homo sapiens
aaatctgacatatta

SEQ ID NO: 4080373 - DNA, 11 bp, Homo sapiens
aaatctgccac

SEQ ID NO: 4080374 - DNA, 19 bp, Homo sapiens
aaatctgccacaaaaacag

SEQ ID NO: 4080375 - DNA, 16 bp, Homo sapiens
aaatctgctagaaagt

SEQ ID NO: 4080376 - DNA, 17 bp, Homo sapiens
aaatctgctagaaagtt

SEQ ID NO: 4080377 - DNA, 19 bp, Homo sapiens
aaatctgggtatctttcca

SEQ ID NO: 4080378 - DNA, 19 bp, Homo sapiens
aaatctggtccatatttac

SEQ ID NO: 4080379 - DNA, 18 bp, Homo sapiens
aaatctgtaacaggtatt

SEQ ID NO: 4080380 - DNA, 16 bp, Homo sapiens
aaatctgtataaatgt

SEQ ID NO: 4080381 - DNA, 19 bp, Homo sapiens
aaatctgtataaatgtcta

SEQ ID NO: 4080382 - DNA, 19 bp, Homo sapiens
aaatctgtttgatccctgt

SEQ ID NO: 4080383 - DNA, 18 bp, Homo sapiens
aaatcttccttgtgagga

SEQ ID NO: 4080384 - DNA, 15 bp, Homo sapiens
aacacaccaggctgt

SEQ ID NO: 4080385 - DNA, 16 bp, Homo sapiens
aacacaccaggctgtg

SEQ ID NO: 4080386 - DNA, 17 bp, Homo sapiens
aacacagacccctaggg

SEQ ID NO: 4080387 - DNA, 23 bp, Homo sapiens
aacacagagaagcggatttccag

SEQ ID NO: 4080388 - DNA, 11 bp, Homo sapiens
aacacagctgt

SEQ ID NO: 4080389 - DNA, 15 bp, Homo sapiens
aacacagctttacaa

SEQ ID NO: 4080390 - DNA, 22 bp, Homo sapiens
aacacagctttacaacttccat

SEQ ID NO: 4080391 - DNA, 15 bp, Homo sapiens
aacacaggcagcttt

SEQ ID NO: 4080392 - DNA, 22 bp, Homo sapiens
aacacaggcagctttctagaag

SEQ ID NO: 4080393 - DNA, 16 bp, Homo sapiens
aacacagtcaaaataa

SEQ ID NO: 4080394 - DNA, 19 bp, Homo sapiens
aacacagtcaaaataattc

SEQ ID NO: 4080395 - DNA, 18 bp, Homo sapiens
aacacattgaatgcgctt

SEQ ID NO: 4080396 - DNA, 23 bp, Homo sapiens
aacacattgaatgcgctttattg

SEQ ID NO: 4080397 - DNA, 17 bp, Homo sapiens
aacaccaatcccagggc

SEQ ID NO: 4080398 - DNA, 15 bp, Homo sapiens
aacaccacagacaca

SEQ ID NO: 4080399 - DNA, 16 bp, Homo sapiens
aacaccacagacacac

SEQ ID NO: 4080400 - DNA, 17 bp, Homo sapiens
aacaccacagacacaca

SEQ ID NO: 4080401 - DNA, 15 bp, Homo sapiens
aacacccacaggcat

SEQ ID NO: 4080402 - DNA, 15 bp, Homo sapiens
aacacccttagaaaa

SEQ ID NO: 4080403 - DNA, 16 bp, Homo sapiens
aacacctcctcatgta

SEQ ID NO: 4080404 - DNA, 17 bp, Homo sapiens
aacaccttccagctcct

SEQ ID NO: 4080405 - DNA, 21 bp, Homo sapiens
aacacggccacatcaaagagg

SEQ ID NO: 4080406 - DNA, 19 bp, Homo sapiens
aacactcttttgctttatt

SEQ ID NO: 4080407 - DNA, 16 bp, Homo sapiens
aacactgcagtttcct

SEQ ID NO: 4080408 - DNA, 18 bp, Homo sapiens
aacactgcagtttcctgg

SEQ ID NO: 4080409 - DNA, 23 bp, Homo sapiens
aacactggcacactgctcttaag

SEQ ID NO: 4080410 - DNA, 21 bp, Homo sapiens
aacactgggggcaccttaaga

SEQ ID NO: 4080411 - DNA, 17 bp, Homo sapiens
aacacttgtagagcaga

SEQ ID NO: 4080412 - DNA, 11 bp, Homo sapiens
aacagaaaaac

SEQ ID NO: 4080413 - DNA, 21 bp, Homo sapiens
aacagaaatcaggtgttttaa

SEQ ID NO: 4080414 - DNA, 15 bp, Homo sapiens
aacagaacagcttca

SEQ ID NO: 4080415 - DNA, 11 bp, Homo sapiens
aacagaacagg

SEQ ID NO: 4080416 - DNA, 12 bp, Homo sapiens
aacagaacaggg

SEQ ID NO: 4080417 - DNA, 17 bp, Homo sapiens
aacagaacagggtcatg

SEQ ID NO: 4080418 - DNA, 13 bp, Homo sapiens
aacagaactaaat

SEQ ID NO: 4080419 - DNA, 21 bp, Homo sapiens
aacagaactaaatgttctatg

SEQ ID NO: 4080420 - DNA, 16 bp, Homo sapiens
aacagaagcttccatt

SEQ ID NO: 4080421 - DNA, 13 bp, Homo sapiens
aacagaaggatga

SEQ ID NO: 4080422 - DNA, 13 bp, Homo sapiens
aacagagatgtga

SEQ ID NO: 4080423 - DNA, 21 bp, Homo sapiens
aacagaggccatggcagaata

SEQ ID NO: 4080424 - DNA, 15 bp, Homo sapiens
aacagagtggcctcc

SEQ ID NO: 4080425 - DNA, 18 bp, Homo sapiens
aacagagtggcctccctg

SEQ ID NO: 4080426 - DNA, 13 bp, Homo sapiens
aacagataatcag

SEQ ID NO: 4080427 - DNA, 16 bp, Homo sapiens
aacagatcaatttgta

SEQ ID NO: 4080428 - DNA, 22 bp, Homo sapiens
aacagatgcaatgtgctactga

SEQ ID NO: 4080429 - DNA, 23 bp, Homo sapiens
aacagatgcaatgtgctactgat

SEQ ID NO: 4080430 - DNA, 14 bp, Homo sapiens
aacagatgctctga

SEQ ID NO: 4080431 - DNA, 23 bp, Homo sapiens
aacagattcaggccagcccagcc

SEQ ID NO: 4080432 - DNA, 13 bp, Homo sapiens
aacagatttttac

SEQ ID NO: 4080433 - DNA, 14 bp, Homo sapiens
aacagatttttaca

SEQ ID NO: 4080434 - DNA, 17 bp, Homo sapiens
aacagatttttacaaat

SEQ ID NO: 4080435 - DNA, 17 bp, Homo sapiens
aacagcaagaaataaat

SEQ ID NO: 4080436 - DNA, 18 bp, Homo sapiens
aacagcagtgttctcaca

SEQ ID NO: 4080437 - DNA, 20 bp, Homo sapiens
aacagcagtgttctcacagt

SEQ ID NO: 4080438 - DNA, 14 bp, Homo sapiens
aacagcattgcttt

SEQ ID NO: 4080439 - DNA, 15 bp, Homo sapiens
aacagcattgctttc

SEQ ID NO: 4080440 - DNA, 15 bp, Homo sapiens
aacagccaacaggtg

SEQ ID NO: 4080441 - DNA, 16 bp, Homo sapiens
aacagccaacaggtgg

SEQ ID NO: 4080442 - DNA, 15 bp, Homo sapiens
aacagccaagtgtga

SEQ ID NO: 4080443 - DNA, 16 bp, Homo sapiens
aacagccaagtgtgac

SEQ ID NO: 4080444 - DNA, 16 bp, Homo sapiens
aacagccatgcccgca

SEQ ID NO: 4080445 - DNA, 19 bp, Homo sapiens
aacagctgaggtctcttga

SEQ ID NO: 4080446 - DNA, 14 bp, Homo sapiens
aacagcttcaggtt

SEQ ID NO: 4080447 - DNA, 15 bp, Homo sapiens
aacagcttcaggtta

SEQ ID NO: 4080448 - DNA, 20 bp, Homo sapiens
aacaggaatcaagagctgcc

SEQ ID NO: 4080449 - DNA, 15 bp, Homo sapiens
aacaggtaatataaa

SEQ ID NO: 4080450 - DNA, 15 bp, Homo sapiens
aacaggtatatactt

SEQ ID NO: 4080451 - DNA, 16 bp, Homo sapiens
aacaggttttataatt

SEQ ID NO: 4080452 - DNA, 14 bp, Homo sapiens
aacagtaaatgtgc

SEQ ID NO: 4080453 - DNA, 23 bp, Homo sapiens
aacagtataacaactatttacat

SEQ ID NO: 4080454 - DNA, 19 bp, Homo sapiens
aacagtatttattttgtaa

SEQ ID NO: 4080455 - DNA, 23 bp, Homo sapiens
aacagtatttattttgtaattat

SEQ ID NO: 4080456 - DNA, 17 bp, Homo sapiens
aacagtcttcaggcaaa

SEQ ID NO: 4080457 - DNA, 19 bp, Homo sapiens
aacagtgccaaatgctggg

SEQ ID NO: 4080458 - DNA, 17 bp, Homo sapiens
aacagtgctttgtaaat

SEQ ID NO: 4080459 - DNA, 18 bp, Homo sapiens
aacagtgtttcccataat

SEQ ID NO: 4080460 - DNA, 21 bp, Homo sapiens
aacagtgtttcccataatttt

SEQ ID NO: 4080461 - DNA, 23 bp, Homo sapiens
aacagtgtttcccataattttct

SEQ ID NO: 4080462 - DNA, 13 bp, Homo sapiens
aacagttaacttt

SEQ ID NO: 4080463 - DNA, 17 bp, Homo sapiens
aacagttaactttcaga

SEQ ID NO: 4080464 - DNA, 23 bp, Homo sapiens
aacagttcatgtttgcttcataa

SEQ ID NO: 4080465 - DNA, 22 bp, Homo sapiens
aacagttgtgaaccaagatcta

SEQ ID NO: 4080466 - DNA, 15 bp, Homo sapiens
aacagttttccatga

SEQ ID NO: 4080467 - DNA, 18 bp, Homo sapiens
aacagttttccatgaaaa

SEQ ID NO: 4080468 - DNA, 22 bp, Homo sapiens
aacataaaaaggacatcagcaa

SEQ ID NO: 4080469 - DNA, 21 bp, Homo sapiens
aacataaccattacagggagc

SEQ ID NO: 4080470 - DNA, 17 bp, Homo sapiens
aacataagttgcattta

SEQ ID NO: 4080471 - DNA, 12 bp, Homo sapiens
aacataatgaaa

SEQ ID NO: 4080472 - DNA, 18 bp, Homo sapiens
aacataattcttgtatat

SEQ ID NO: 4080473 - DNA, 21 bp, Homo sapiens
aacatataatgttgttattta

SEQ ID NO: 4080474 - DNA, 22 bp, Homo sapiens
aacatataatgttgttatttaa

SEQ ID NO: 4080475 - DNA, 18 bp, Homo sapiens
aacatatatttattgagt

SEQ ID NO: 4080476 - DNA, 17 bp, Homo sapiens
aacatatgaaaatacaa

SEQ ID NO: 4080477 - DNA, 21 bp, Homo sapiens
aacatatgtacataaattgca

SEQ ID NO: 4080478 - DNA, 14 bp, Homo sapiens
aacatcaatgttca

SEQ ID NO: 4080479 - DNA, 11 bp, Homo sapiens
aacatccaaaa

SEQ ID NO: 4080480 - DNA, 16 bp, Homo sapiens
aacatccaaccttccc

SEQ ID NO: 4080481 - DNA, 12 bp, Homo sapiens
aacatcctgcca

SEQ ID NO: 4080482 - DNA, 22 bp, Homo sapiens
aacatcctttgcagggcagccc

SEQ ID NO: 4080483 - DNA, 19 bp, Homo sapiens
aacatcgatatgtatatca

SEQ ID NO: 4080484 - DNA, 18 bp, Homo sapiens
aacatctttaaggggagg

SEQ ID NO: 4080485 - DNA, 15 bp, Homo sapiens
aacatctttgcgaaa

SEQ ID NO: 4080486 - DNA, 21 bp, Homo sapiens
aacatctttttaacctgcaaa

SEQ ID NO: 4080487 - DNA, 20 bp, Homo sapiens
aacatgaaagtctagaaata

SEQ ID NO: 4080488 - DNA, 18 bp, Homo sapiens
aacatgaggggacatttt

SEQ ID NO: 4080489 - DNA, 21 bp, Homo sapiens
aacatgaggggacattttggt

SEQ ID NO: 4080490 - DNA, 16 bp, Homo sapiens
aacatgtatgtgcatt

SEQ ID NO: 4080491 - DNA, 21 bp, Homo sapiens
aacattaagattgaggcctgc

SEQ ID NO: 4080492 - DNA, 20 bp, Homo sapiens
aacattacagttcataatag

SEQ ID NO: 4080493 - DNA, 22 bp, Homo sapiens
aacattcccgaggtcagccagg

SEQ ID NO: 4080494 - DNA, 19 bp, Homo sapiens
aacattcgtgagctgggga

SEQ ID NO: 4080495 - DNA, 16 bp, Homo sapiens
aacattgaagtaatga

SEQ ID NO: 4080496 - DNA, 22 bp, Homo sapiens
aacattgaccaagaactgcatg

SEQ ID NO: 4080497 - DNA, 23 bp, Homo sapiens
aacattgaccaagaactgcatgg

SEQ ID NO: 4080498 - DNA, 21 bp, Homo sapiens
aacattggcacatgccacctg

SEQ ID NO: 4080499 - DNA, 16 bp, Homo sapiens
aacatttgctgtttta

SEQ ID NO: 4080500 - DNA, 13 bp, Homo sapiens
aacatttgttcct

SEQ ID NO: 4080501 - DNA, 22 bp, Homo sapiens
aacattttatttttaaaatatt

SEQ ID NO: 4080502 - DNA, 22 bp, Homo sapiens
aacattttgtggtcattaagca

SEQ ID NO: 4080503 - DNA, 23 bp, Homo sapiens
aacattttttcttctgaagattc

SEQ ID NO: 4080504 - DNA, 23 bp, Homo sapiens
aacattttttttttaaatcaagt

SEQ ID NO: 4080505 - DNA, 19 bp, Homo sapiens
aaccaaagagggcttcctc

SEQ ID NO: 4080506 - DNA, 16 bp, Homo sapiens
aaccaagccgtggctt

SEQ ID NO: 4080507 - DNA, 18 bp, Homo sapiens
aaccaagccgtggcttcc

SEQ ID NO: 4080508 - DNA, 20 bp, Homo sapiens
aaccaagctgagtttcctat

SEQ ID NO: 4080509 - DNA, 21 bp, Homo sapiens
aaccaagtcggaacagcagat

SEQ ID NO: 4080510 - DNA, 20 bp, Homo sapiens
aaccaagtgatcaaactaca

SEQ ID NO: 4080511 - DNA, 23 bp, Homo sapiens
aaccaatcccgtgaaagaattat

SEQ ID NO: 4080512 - DNA, 20 bp, Homo sapiens
aaccaattcaccaacacagt

SEQ ID NO: 4080513 - DNA, 15 bp, Homo sapiens
aaccacacaaagaca

SEQ ID NO: 4080514 - DNA, 12 bp, Homo sapiens
aaccacagagaa

SEQ ID NO: 4080515 - DNA, 18 bp, Homo sapiens
aaccacagctccttttcc

SEQ ID NO: 4080516 - DNA, 19 bp, Homo sapiens
aaccacagctccttttcca

SEQ ID NO: 4080517 - DNA, 20 bp, Homo sapiens
aaccacagggccagagggag

SEQ ID NO: 4080518 - DNA, 21 bp, Homo sapiens
aaccacagggccagagggagc

SEQ ID NO: 4080519 - DNA, 13 bp, Homo sapiens
aaccaccatggat

SEQ ID NO: 4080520 - DNA, 14 bp, Homo sapiens
aaccactgcaacgg

SEQ ID NO: 4080521 - DNA, 15 bp, Homo sapiens
aaccactgtaaaatg

SEQ ID NO: 4080522 - DNA, 16 bp, Homo sapiens
aaccactgtaaaatga

SEQ ID NO: 4080523 - DNA, 10 bp, Homo sapiens
aaccagagcc

SEQ ID NO: 4080524 - DNA, 17 bp, Homo sapiens
aaccagagccccccaca

SEQ ID NO: 4080525 - DNA, 13 bp, Homo sapiens
aaccagataacat

SEQ ID NO: 4080526 - DNA, 23 bp, Homo sapiens
aaccagcacagcttagatttcat

SEQ ID NO: 4080527 - DNA, 14 bp, Homo sapiens
aaccagccggggcc

SEQ ID NO: 4080528 - DNA, 21 bp, Homo sapiens
aaccaggagctgatggcagct

SEQ ID NO: 4080529 - DNA, 16 bp, Homo sapiens
aaccaggcctctgctg

SEQ ID NO: 4080530 - DNA, 21 bp, Homo sapiens
aaccagggagcccctttgatg

SEQ ID NO: 4080531 - DNA, 13 bp, Homo sapiens
aaccatatgatac

SEQ ID NO: 4080532 - DNA, 16 bp, Homo sapiens
aaccatgaagacagga

SEQ ID NO: 4080533 - DNA, 22 bp, Homo sapiens
aaccattaagtcatgtgtgaac

SEQ ID NO: 4080534 - DNA, 17 bp, Homo sapiens
aaccattccatttccaa

SEQ ID NO: 4080535 - DNA, 23 bp, Homo sapiens
aaccattccatttccaagcactt

SEQ ID NO: 4080536 - DNA, 17 bp, Homo sapiens
aaccatttaataaagaa

SEQ ID NO: 4080537 - DNA, 20 bp, Homo sapiens
aaccatttaataaagaaata

SEQ ID NO: 4080538 - DNA, 23 bp, Homo sapiens
aaccatttgaagtgtacctgtgt

SEQ ID NO: 4080539 - DNA, 23 bp, Homo sapiens
aacccaatctgcacactccaggc

SEQ ID NO: 4080540 - DNA, 19 bp, Homo sapiens
aacccacctctcctgccct

SEQ ID NO: 4080541 - DNA, 21 bp, Homo sapiens
aacccacctctcctgccctgt

SEQ ID NO: 4080542 - DNA, 23 bp, Homo sapiens
aacccagacctgttagcagacag

SEQ ID NO: 4080543 - DNA, 12 bp, Homo sapiens
aacccagactca

SEQ ID NO: 4080544 - DNA, 14 bp, Homo sapiens
aacccagactcaga

SEQ ID NO: 4080545 - DNA, 18 bp, Homo sapiens
aacccagactcagacatt

SEQ ID NO: 4080546 - DNA, 17 bp, Homo sapiens
aacccaggacgcttctg

SEQ ID NO: 4080547 - DNA, 19 bp, Homo sapiens
aacccaggacgcttctgaa

SEQ ID NO: 4080548 - DNA, 15 bp, Homo sapiens
aacccatgagattca

SEQ ID NO: 4080549 - DNA, 17 bp, Homo sapiens
aaccccatgtcctcagc

SEQ ID NO: 4080550 - DNA, 10 bp, Homo sapiens
aacccccacc

SEQ ID NO: 4080551 - DNA, 22 bp, Homo sapiens
aacccccaccagacatcaccct

SEQ ID NO: 4080552 - DNA, 19 bp, Homo sapiens
aacccccaccccacacttg

SEQ ID NO: 4080553 - DNA, 12 bp, Homo sapiens
aacccccagctc

SEQ ID NO: 4080554 - DNA, 13 bp, Homo sapiens
aacccccagctgg

SEQ ID NO: 4080555 - DNA, 15 bp, Homo sapiens
aacccccagctgggt

SEQ ID NO: 4080556 - DNA, 18 bp, Homo sapiens
aacccccgccacctcagg

SEQ ID NO: 4080557 - DNA, 12 bp, Homo sapiens
aacccctgtccc

SEQ ID NO: 4080558 - DNA, 23 bp, Homo sapiens
aacccctgtcccatgcaggccct

SEQ ID NO: 4080559 - DNA, 19 bp, Homo sapiens
aaccctagccttgcttgtt

SEQ ID NO: 4080560 - DNA, 17 bp, Homo sapiens
aaccctaggaatttaga

SEQ ID NO: 4080561 - DNA, 19 bp, Homo sapiens
aaccctcagagccacccct

SEQ ID NO: 4080562 - DNA, 23 bp, Homo sapiens
aaccctcaggggaaaactgttac

SEQ ID NO: 4080563 - DNA, 19 bp, Homo sapiens
aaccctgggctattgctgc

SEQ ID NO: 4080564 - DNA, 16 bp, Homo sapiens
aaccctggggaaggag

SEQ ID NO: 4080565 - DNA, 16 bp, Homo sapiens
aaccctgttttatact

SEQ ID NO: 4080566 - DNA, 22 bp, Homo sapiens
aaccctgttttatactgtactt

SEQ ID NO: 4080567 - DNA, 21 bp, Homo sapiens
aacccttggagccaatggaga

SEQ ID NO: 4080568 - DNA, 13 bp, Homo sapiens
aaccgaggccctc

SEQ ID NO: 4080569 - DNA, 18 bp, Homo sapiens
aaccgataatgcatgaag

SEQ ID NO: 4080570 - DNA, 18 bp, Homo sapiens
aaccgggagaaggcatga

SEQ ID NO: 4080571 - DNA, 18 bp, Homo sapiens
aaccgtcccctccttccc

SEQ ID NO: 4080572 - DNA, 18 bp, Homo sapiens
aaccgttttgaagctact

SEQ ID NO: 4080573 - DNA, 20 bp, Homo sapiens
aacctaaaataattggttct

SEQ ID NO: 4080574 - DNA, 18 bp, Homo sapiens
aacctacacactgtcatg

SEQ ID NO: 4080575 - DNA, 23 bp, Homo sapiens
aacctacagactccatctcttct

SEQ ID NO: 4080576 - DNA, 16 bp, Homo sapiens
aacctagaatgtcaga

SEQ ID NO: 4080577 - DNA, 14 bp, Homo sapiens
aacctagagaagat

SEQ ID NO: 4080578 - DNA, 17 bp, Homo sapiens
aacctagtactgccccc

SEQ ID NO: 4080579 - DNA, 15 bp, Homo sapiens
aacctcagaggcagc

SEQ ID NO: 4080580 - DNA, 14 bp, Homo sapiens
aacctcagcctggc

SEQ ID NO: 4080581 - DNA, 18 bp, Homo sapiens
aacctcagggctgtccca

SEQ ID NO: 4080582 - DNA, 18 bp, Homo sapiens
aacctcagtgtcatttat

SEQ ID NO: 4080583 - DNA, 14 bp, Homo sapiens
aacctcattcccca

SEQ ID NO: 4080584 - DNA, 19 bp, Homo sapiens
aacctccagcctccctgtc

SEQ ID NO: 4080585 - DNA, 23 bp, Homo sapiens
aacctccagcctccctgtctcca

SEQ ID NO: 4080586 - DNA, 23 bp, Homo sapiens
aacctctctgatcttgtgctcag

SEQ ID NO: 4080587 - DNA, 14 bp, Homo sapiens
aacctcttccccag

SEQ ID NO: 4080588 - DNA, 16 bp, Homo sapiens
aacctcttttctgcat

SEQ ID NO: 4080589 - DNA, 15 bp, Homo sapiens
aacctctttttcctc

SEQ ID NO: 4080590 - DNA, 17 bp, Homo sapiens
aacctctttttcctcct

SEQ ID NO: 4080591 - DNA, 15 bp, Homo sapiens
aacctgaagtttttt

SEQ ID NO: 4080592 - DNA, 22 bp, Homo sapiens
aacctgactcaattatttgcat

SEQ ID NO: 4080593 - DNA, 18 bp, Homo sapiens
aacctgatgttaaaattc

SEQ ID NO: 4080594 - DNA, 18 bp, Homo sapiens
aacctgctctgtccccaa

SEQ ID NO: 4080595 - DNA, 11 bp, Homo sapiens
aacctggaaag

SEQ ID NO: 4080596 - DNA, 18 bp, Homo sapiens
aacctggcaaaaatgcaa

SEQ ID NO: 4080597 - DNA, 22 bp, Homo sapiens
aacctgggaggcggagagtaca

SEQ ID NO: 4080598 - DNA, 20 bp, Homo sapiens
aacctgggattcaggaatgt

SEQ ID NO: 4080599 - DNA, 16 bp, Homo sapiens
aacctggtggcaccag

SEQ ID NO: 4080600 - DNA, 21 bp, Homo sapiens
aacctggtggcaccagatgca

SEQ ID NO: 4080601 - DNA, 14 bp, Homo sapiens
aacctgtagatgca

SEQ ID NO: 4080602 - DNA, 16 bp, Homo sapiens
aacctgtagatgcaga

SEQ ID NO: 4080603 - DNA, 22 bp, Homo sapiens
aacctgtagatgcagaaaaaga

SEQ ID NO: 4080604 - DNA, 22 bp, Homo sapiens
aacctgtataagtggaggcact

SEQ ID NO: 4080605 - DNA, 13 bp, Homo sapiens
aacctgtattttt

SEQ ID NO: 4080606 - DNA, 23 bp, Homo sapiens
aacctgtcctaaggaaccttcct

SEQ ID NO: 4080607 - DNA, 16 bp, Homo sapiens
aacctgtcttttggga

SEQ ID NO: 4080608 - DNA, 23 bp, Homo sapiens
aacctgttgctgtgtttaatttg

SEQ ID NO: 4080609 - DNA, 19 bp, Homo sapiens
aaccttattgtacctctct

SEQ ID NO: 4080610 - DNA, 14 bp, Homo sapiens
aaccttcaacccag

SEQ ID NO: 4080611 - DNA, 14 bp, Homo sapiens
aaccttccctccaa

SEQ ID NO: 4080612 - DNA, 19 bp, Homo sapiens
aaccttccttcctgcttga

SEQ ID NO: 4080613 - DNA, 13 bp, Homo sapiens
aaccttgaatgct

SEQ ID NO: 4080614 - DNA, 17 bp, Homo sapiens
aaccttgaatgctgcca

SEQ ID NO: 4080615 - DNA, 18 bp, Homo sapiens
aaccttgaatgctgccag

SEQ ID NO: 4080616 - DNA, 23 bp, Homo sapiens
aaccttgtctctatgccagctca

SEQ ID NO: 4080617 - DNA, 15 bp, Homo sapiens
aaccttgttttggac

SEQ ID NO: 4080618 - DNA, 13 bp, Homo sapiens
aacctttttgtaa

SEQ ID NO: 4080619 - DNA, 22 bp, Homo sapiens
aaccttttttaagatttttctc

SEQ ID NO: 4080620 - DNA, 14 bp, Homo sapiens
aacgaagaaaaaaa

SEQ ID NO: 4080621 - DNA, 11 bp, Homo sapiens
aacgaatgaag

SEQ ID NO: 4080622 - DNA, 17 bp, Homo sapiens
aacgacaaatctgtctg

SEQ ID NO: 4080623 - DNA, 18 bp, Homo sapiens
aacgacaaatctgtctgc

SEQ ID NO: 4080624 - DNA, 23 bp, Homo sapiens
aacgagggctgatggaggaaaaa

SEQ ID NO: 4080625 - DNA, 17 bp, Homo sapiens
aacgatgaatttcttct

SEQ ID NO: 4080626 - DNA, 13 bp, Homo sapiens
aacgatgtgtctg

SEQ ID NO: 4080627 - DNA, 12 bp, Homo sapiens
aacgcagccctg

SEQ ID NO: 4080628 - DNA, 13 bp, Homo sapiens
aacgcatggagtg

SEQ ID NO: 4080629 - DNA, 18 bp, Homo sapiens
aacgcatggagtgtgtat

SEQ ID NO: 4080630 - DNA, 22 bp, Homo sapiens
aacgcatggagtgtgtattgtt

SEQ ID NO: 4080631 - DNA, 23 bp, Homo sapiens
aacgcatggagtgtgtattgttc

SEQ ID NO: 4080632 - DNA, 15 bp, Homo sapiens
aacgccagtctccca

SEQ ID NO: 4080633 - DNA, 21 bp, Homo sapiens
aacgcccctccaaacctccag

SEQ ID NO: 4080634 - DNA, 17 bp, Homo sapiens
aacgcctcccctgcccc

SEQ ID NO: 4080635 - DNA, 15 bp, Homo sapiens
aacggattccaaaga

SEQ ID NO: 4080636 - DNA, 14 bp, Homo sapiens
aacggccccagctt

SEQ ID NO: 4080637 - DNA, 18 bp, Homo sapiens
aacgggaggctgggcaca

SEQ ID NO: 4080638 - DNA, 19 bp, Homo sapiens
aacggtgcccatcctgcca

SEQ ID NO: 4080639 - DNA, 17 bp, Homo sapiens
aacgtaaccacggaaaa

SEQ ID NO: 4080640 - DNA, 21 bp, Homo sapiens
aacgtagtcggcacagcctgg

SEQ ID NO: 4080641 - DNA, 15 bp, Homo sapiens
aacgtgatgatcagc

SEQ ID NO: 4080642 - DNA, 16 bp, Homo sapiens
aacgtgtgctgtgttt

SEQ ID NO: 4080643 - DNA, 14 bp, Homo sapiens
aacgttgctcccca

SEQ ID NO: 4080644 - DNA, 15 bp, Homo sapiens
aacgttttattgtgt

SEQ ID NO: 4080645 - DNA, 15 bp, Homo sapiens
aactaaataatgaat

SEQ ID NO: 4080646 - DNA, 13 bp, Homo sapiens
aactaaatgttct

SEQ ID NO: 4080647 - DNA, 18 bp, Homo sapiens
aactaaatgttctatggt

SEQ ID NO: 4080648 - DNA, 16 bp, Homo sapiens
aactaagctctttgag

SEQ ID NO: 4080649 - DNA, 17 bp, Homo sapiens
aactaagctctttgaga

SEQ ID NO: 4080650 - DNA, 15 bp, Homo sapiens
aactaattctcacat

SEQ ID NO: 4080651 - DNA, 13 bp, Homo sapiens
aactacatgagaa

SEQ ID NO: 4080652 - DNA, 16 bp, Homo sapiens
aactacccccttttca

SEQ ID NO: 4080653 - DNA, 15 bp, Homo sapiens
aactactgtgttcct

SEQ ID NO: 4080654 - DNA, 22 bp, Homo sapiens
aactagaatttattcaattcct

SEQ ID NO: 4080655 - DNA, 13 bp, Homo sapiens
aactagcccctgg

SEQ ID NO: 4080656 - DNA, 18 bp, Homo sapiens
aactaggaaggcacttct

SEQ ID NO: 4080657 - DNA, 15 bp, Homo sapiens
aactaggctccttca

SEQ ID NO: 4080658 - DNA, 13 bp, Homo sapiens
aactaggctctta

SEQ ID NO: 4080659 - DNA, 14 bp, Homo sapiens
aactagttatttta

SEQ ID NO: 4080660 - DNA, 18 bp, Homo sapiens
aactagttattttataat

SEQ ID NO: 4080661 - DNA, 14 bp, Homo sapiens
aactataaatacaa

SEQ ID NO: 4080662 - DNA, 21 bp, Homo sapiens
aactatcctgcgggttttaat

SEQ ID NO: 4080663 - DNA, 18 bp, Homo sapiens
aactatctgcattatcta

SEQ ID NO: 4080664 - DNA, 13 bp, Homo sapiens
aactatcttgtgt

SEQ ID NO: 4080665 - DNA, 18 bp, Homo sapiens
aactatgatatggtaaaa

SEQ ID NO: 4080666 - DNA, 18 bp, Homo sapiens
aactatggatcagaatag

SEQ ID NO: 4080667 - DNA, 16 bp, Homo sapiens
aactatggttcccaat

SEQ ID NO: 4080668 - DNA, 22 bp, Homo sapiens
aactatggttcccaataaaagt

SEQ ID NO: 4080669 - DNA, 23 bp, Homo sapiens
aactatggttcccaataaaagtg

SEQ ID NO: 4080670 - DNA, 17 bp, Homo sapiens
aactatgtttaaagtaa

SEQ ID NO: 4080671 - DNA, 18 bp, Homo sapiens
aactatgtttaaagtaat

SEQ ID NO: 4080672 - DNA, 15 bp, Homo sapiens
aactattgcatttat

SEQ ID NO: 4080673 - DNA, 21 bp, Homo sapiens
aactattgcatttatatgtac

SEQ ID NO: 4080674 - DNA, 23 bp, Homo sapiens
aactatttagtgttagttataaa

SEQ ID NO: 4080675 - DNA, 23 bp, Homo sapiens
aactcaaatggggccagatccag

SEQ ID NO: 4080676 - DNA, 21 bp, Homo sapiens
aactcaaatgtgagtgttttt

SEQ ID NO: 4080677 - DNA, 16 bp, Homo sapiens
aactcaccatgtaaaa

SEQ ID NO: 4080678 - DNA, 21 bp, Homo sapiens
aactcactgctcaagaagaca

SEQ ID NO: 4080679 - DNA, 15 bp, Homo sapiens
aactcactgtgatca

SEQ ID NO: 4080680 - DNA, 23 bp, Homo sapiens
aactcagagaaaaatgctcccca

SEQ ID NO: 4080681 - DNA, 17 bp, Homo sapiens
aactcagatctgtctga

SEQ ID NO: 4080682 - DNA, 16 bp, Homo sapiens
aactcagggacagagc

SEQ ID NO: 4080683 - DNA, 14 bp, Homo sapiens
aactcagtatttta

SEQ ID NO: 4080684 - DNA, 13 bp, Homo sapiens
aactcctaatttt

SEQ ID NO: 4080685 - DNA, 17 bp, Homo sapiens
aactcctaattttaaat

SEQ ID NO: 4080686 - DNA, 14 bp, Homo sapiens
aactcctggccttt

SEQ ID NO: 4080687 - DNA, 17 bp, Homo sapiens
aactcctgtcccttttc

SEQ ID NO: 4080688 - DNA, 18 bp, Homo sapiens
aactcctttagcaggtgg

SEQ ID NO: 4080689 - DNA, 15 bp, Homo sapiens
aactcgcacctgtgc

SEQ ID NO: 4080690 - DNA, 20 bp, Homo sapiens
aactctaagtgtttgctgca

SEQ ID NO: 4080691 - DNA, 15 bp, Homo sapiens
aactctaatagtgct

SEQ ID NO: 4080692 - DNA, 21 bp, Homo sapiens
aactctaattcccattttgca

SEQ ID NO: 4080693 - DNA, 15 bp, Homo sapiens
aactctacccctgct

SEQ ID NO: 4080694 - DNA, 17 bp, Homo sapiens
aactctacccctgctcc

SEQ ID NO: 4080695 - DNA, 15 bp, Homo sapiens
aactctcaaaagtct

SEQ ID NO: 4080696 - DNA, 20 bp, Homo sapiens
aactctcaaaagtctatttt

SEQ ID NO: 4080697 - DNA, 16 bp, Homo sapiens
aactctgaactttgga

SEQ ID NO: 4080698 - DNA, 17 bp, Homo sapiens
aactctgaactttggag

SEQ ID NO: 4080699 - DNA, 16 bp, Homo sapiens
aactctggcttccagg

SEQ ID NO: 4080700 - DNA, 18 bp, Homo sapiens
aactctggcttccaggta

SEQ ID NO: 4080701 - DNA, 20 bp, Homo sapiens
aactctggcttccaggtatc

SEQ ID NO: 4080702 - DNA, 18 bp, Homo sapiens
aactctgttcccccaccc

SEQ ID NO: 4080703 - DNA, 19 bp, Homo sapiens
aactctgttcccccaccct

SEQ ID NO: 4080704 - DNA, 17 bp, Homo sapiens
aactcttaatctgtgtg

SEQ ID NO: 4080705 - DNA, 11 bp, Homo sapiens
aactcttcctc

SEQ ID NO: 4080706 - DNA, 22 bp, Homo sapiens
aactcttggttcgatacctgga

SEQ ID NO: 4080707 - DNA, 15 bp, Homo sapiens
aactgaaaatgtaaa

SEQ ID NO: 4080708 - DNA, 14 bp, Homo sapiens
aactgaagacaatt

SEQ ID NO: 4080709 - DNA, 17 bp, Homo sapiens
aactgaatattttggaa

SEQ ID NO: 4080710 - DNA, 20 bp, Homo sapiens
aactgaatattttggaaact

SEQ ID NO: 4080711 - DNA, 13 bp, Homo sapiens
aactgacttgtat

SEQ ID NO: 4080712 - DNA, 19 bp, Homo sapiens
aactgaggagatgaccagg

SEQ ID NO: 4080713 - DNA, 20 bp, Homo sapiens
aactgaggagatgaccaggg

SEQ ID NO: 4080714 - DNA, 13 bp, Homo sapiens
aactgcaatagag

SEQ ID NO: 4080715 - DNA, 17 bp, Homo sapiens
aactgcacatgaaagtt

SEQ ID NO: 4080716 - DNA, 19 bp, Homo sapiens
aactgcaggagcagtttgc

SEQ ID NO: 4080717 - DNA, 21 bp, Homo sapiens
aactgcatggacctaacattc

SEQ ID NO: 4080718 - DNA, 16 bp, Homo sapiens
aactgcattagaaatt

SEQ ID NO: 4080719 - DNA, 17 bp, Homo sapiens
aactgccaggctgcctc

SEQ ID NO: 4080720 - DNA, 17 bp, Homo sapiens
aactgccctaagccccc

SEQ ID NO: 4080721 - DNA, 16 bp, Homo sapiens
aactgccctactggga

SEQ ID NO: 4080722 - DNA, 20 bp, Homo sapiens
aactgcctcgaaacacagaa

SEQ ID NO: 4080723 - DNA, 15 bp, Homo sapiens
aactgctttcaagtc

SEQ ID NO: 4080724 - DNA, 14 bp, Homo sapiens
aactgctttctgtt

SEQ ID NO: 4080725 - DNA, 14 bp, Homo sapiens
aactggaataagaa

SEQ ID NO: 4080726 - DNA, 16 bp, Homo sapiens
aactggactcacattc

SEQ ID NO: 4080727 - DNA, 16 bp, Homo sapiens
aactggagttccttat

SEQ ID NO: 4080728 - DNA, 19 bp, Homo sapiens
aactggcaattgtctattt

SEQ ID NO: 4080729 - DNA, 18 bp, Homo sapiens
aactggccctatttagat

SEQ ID NO: 4080730 - DNA, 15 bp, Homo sapiens
aactggggctttgcc

SEQ ID NO: 4080731 - DNA, 16 bp, Homo sapiens
aactggggctttgcct

SEQ ID NO: 4080732 - DNA, 20 bp, Homo sapiens
aactggggctttgccttgca

SEQ ID NO: 4080733 - DNA, 21 bp, Homo sapiens
aactggtattctgttctggag

SEQ ID NO: 4080734 - DNA, 21 bp, Homo sapiens
aactggtttgttgcagccaaa

SEQ ID NO: 4080735 - DNA, 14 bp, Homo sapiens
aactgtacatttaa

SEQ ID NO: 4080736 - DNA, 17 bp, Homo sapiens
aactgtagaaatgatga

SEQ ID NO: 4080737 - DNA, 14 bp, Homo sapiens
aactgtccctccct

SEQ ID NO: 4080738 - DNA, 19 bp, Homo sapiens
aactgtccctcccttgctg

SEQ ID NO: 4080739 - DNA, 16 bp, Homo sapiens
aactgtcctgtcctgc

SEQ ID NO: 4080740 - DNA, 14 bp, Homo sapiens
aactgtcctttcct

SEQ ID NO: 4080741 - DNA, 14 bp, Homo sapiens
aactgtcttcctca

SEQ ID NO: 4080742 - DNA, 15 bp, Homo sapiens
aactgtcttcctcaa

SEQ ID NO: 4080743 - DNA, 19 bp, Homo sapiens
aactgtctttaaaagagag

SEQ ID NO: 4080744 - DNA, 22 bp, Homo sapiens
aactgtggatacccttaccctt

SEQ ID NO: 4080745 - DNA, 14 bp, Homo sapiens
aactgtgtactgtt

SEQ ID NO: 4080746 - DNA, 13 bp, Homo sapiens
aactgtgtatgta

SEQ ID NO: 4080747 - DNA, 22 bp, Homo sapiens
aactgtgtttcaagttcaatcc

SEQ ID NO: 4080748 - DNA, 20 bp, Homo sapiens
aactgttacctaaagtattt

SEQ ID NO: 4080749 - DNA, 22 bp, Homo sapiens
aactgttcaagtgtccccagac

SEQ ID NO: 4080750 - DNA, 19 bp, Homo sapiens
aactgttgtagaagacaaa

SEQ ID NO: 4080751 - DNA, 17 bp, Homo sapiens
aacttaaaaatgtaaat

SEQ ID NO: 4080752 - DNA, 11 bp, Homo sapiens
aacttaaaata

SEQ ID NO: 4080753 - DNA, 13 bp, Homo sapiens
aacttaaaatatt

SEQ ID NO: 4080754 - DNA, 16 bp, Homo sapiens
aacttaaaatatttta

SEQ ID NO: 4080755 - DNA, 14 bp, Homo sapiens
aacttaaattatgt

SEQ ID NO: 4080756 - DNA, 13 bp, Homo sapiens
aacttaactttaa

SEQ ID NO: 4080757 - DNA, 21 bp, Homo sapiens
aacttaagcaaaggggacagc

SEQ ID NO: 4080758 - DNA, 22 bp, Homo sapiens
aacttaatgttcttatgcaaaa

SEQ ID NO: 4080759 - DNA, 23 bp, Homo sapiens
aacttacctaagtgacatttgta

SEQ ID NO: 4080760 - DNA, 20 bp, Homo sapiens
aacttagatcatcagtcacc

SEQ ID NO: 4080761 - DNA, 19 bp, Homo sapiens
aacttagcatgtgttgaaa

SEQ ID NO: 4080762 - DNA, 15 bp, Homo sapiens
aacttagccagagtt

SEQ ID NO: 4080763 - DNA, 16 bp, Homo sapiens
aacttaggtggcaagc

SEQ ID NO: 4080764 - DNA, 22 bp, Homo sapiens
aacttagtgcggacaagtttta

SEQ ID NO: 4080765 - DNA, 23 bp, Homo sapiens
aacttagtgcggacaagttttaa

SEQ ID NO: 4080766 - DNA, 19 bp, Homo sapiens
aacttagtgtaatatacca

SEQ ID NO: 4080767 - DNA, 13 bp, Homo sapiens
aacttatattgaa

SEQ ID NO: 4080768 - DNA, 14 bp, Homo sapiens
aacttattagaaac

SEQ ID NO: 4080769 - DNA, 17 bp, Homo sapiens
aacttatttaaaaatat

SEQ ID NO: 4080770 - DNA, 19 bp, Homo sapiens
aacttatttaaaaatattt

SEQ ID NO: 4080771 - DNA, 19 bp, Homo sapiens
aacttattttaaatatgcc

SEQ ID NO: 4080772 - DNA, 16 bp, Homo sapiens
aacttcacattaaaaa

SEQ ID NO: 4080773 - DNA, 16 bp, Homo sapiens
aacttcacatttatgt

SEQ ID NO: 4080774 - DNA, 17 bp, Homo sapiens
aacttcacatttatgtg

SEQ ID NO: 4080775 - DNA, 22 bp, Homo sapiens
aacttcagttttatttttgcca

SEQ ID NO: 4080776 - DNA, 14 bp, Homo sapiens
aacttcatttgatg

SEQ ID NO: 4080777 - DNA, 18 bp, Homo sapiens
aacttcccagtgaattct

SEQ ID NO: 4080778 - DNA, 11 bp, Homo sapiens
aacttccctga

SEQ ID NO: 4080779 - DNA, 14 bp, Homo sapiens
aacttccgctgagg

SEQ ID NO: 4080780 - DNA, 15 bp, Homo sapiens
aacttccgctgaggg

SEQ ID NO: 4080781 - DNA, 22 bp, Homo sapiens
aacttcctcccttacagagcat

SEQ ID NO: 4080782 - DNA, 17 bp, Homo sapiens
aacttcctgctgcaccc

SEQ ID NO: 4080783 - DNA, 19 bp, Homo sapiens
aacttcctgctgcaccctg

SEQ ID NO: 4080784 - DNA, 21 bp, Homo sapiens
aacttcctgctgcaccctgcg

SEQ ID NO: 4080785 - DNA, 16 bp, Homo sapiens
aacttctatattttaa

SEQ ID NO: 4080786 - DNA, 18 bp, Homo sapiens
aacttctcttgaaaagtt

SEQ ID NO: 4080787 - DNA, 13 bp, Homo sapiens
aacttcttaaata

SEQ ID NO: 4080788 - DNA, 15 bp, Homo sapiens
aacttcttaaatatc

SEQ ID NO: 4080789 - DNA, 17 bp, Homo sapiens
aacttcttaaatatctt

SEQ ID NO: 4080790 - DNA, 18 bp, Homo sapiens
aacttcttaaatatcttt

SEQ ID NO: 4080791 - DNA, 16 bp, Homo sapiens
aacttcttatggaatt

SEQ ID NO: 4080792 - DNA, 19 bp, Homo sapiens
aacttcttatggaattgat

SEQ ID NO: 4080793 - DNA, 24 bp, Homo sapiens
aacttcttatggaattgatttgca

SEQ ID NO: 4080794 - DNA, 18 bp, Homo sapiens
aacttcttcctgtgaagt

SEQ ID NO: 4080795 - DNA, 13 bp, Homo sapiens
gccacgctgtcct

SEQ ID NO: 4080796 - DNA, 15 bp, Homo sapiens
gccacgctgtcctct

SEQ ID NO: 4080797 - DNA, 19 bp, Homo sapiens
gccacgctgtcctctcgag

SEQ ID NO: 4080798 - DNA, 19 bp, Homo sapiens
gccacgctttgctgctacc

SEQ ID NO: 4080799 - DNA, 15 bp, Homo sapiens
gccacggaggaggga

SEQ ID NO: 4080800 - DNA, 20 bp, Homo sapiens
gccacggaggagggatgctg

SEQ ID NO: 4080801 - DNA, 22 bp, Homo sapiens
gccacggaggagggatgctgct

SEQ ID NO: 4080802 - DNA, 15 bp, Homo sapiens
gccacggctgagcct

SEQ ID NO: 4080803 - DNA, 23 bp, Homo sapiens
gccacgtccatagttctgaggtc

SEQ ID NO: 4080804 - DNA, 22 bp, Homo sapiens
gccacgtcccagcatccctgga

SEQ ID NO: 4080805 - DNA, 23 bp, Homo sapiens
gccacgtcccagcatccctggag

SEQ ID NO: 4080806 - DNA, 22 bp, Homo sapiens
gccactaaagcttcagactcaa

SEQ ID NO: 4080807 - DNA, 21 bp, Homo sapiens
gccactagactcttcactgtt

SEQ ID NO: 4080808 - DNA, 20 bp, Homo sapiens
gccactcatattctgggctc

SEQ ID NO: 4080809 - DNA, 20 bp, Homo sapiens
gccactccagacccctggct

SEQ ID NO: 4080810 - DNA, 16 bp, Homo sapiens
gccactcctccctccg

SEQ ID NO: 4080811 - DNA, 13 bp, Homo sapiens
gccactcttccaa

SEQ ID NO: 4080812 - DNA, 18 bp, Homo sapiens
gccactgcccgagctggt

SEQ ID NO: 4080813 - DNA, 23 bp, Homo sapiens
gccactggaaggaacatggagct

SEQ ID NO: 4080814 - DNA, 15 bp, Homo sapiens
gccactgtactccag

SEQ ID NO: 4080815 - DNA, 16 bp, Homo sapiens
gccactgtggtggcag

SEQ ID NO: 4080816 - DNA, 16 bp, Homo sapiens
gccacttcggccaggt

SEQ ID NO: 4080817 - DNA, 15 bp, Homo sapiens
gccacttgaaatgtt

SEQ ID NO: 4080818 - DNA, 16 bp, Homo sapiens
gccagaagtagctttg

SEQ ID NO: 4080819 - DNA, 18 bp, Homo sapiens
gccagaagtagctttgca

SEQ ID NO: 4080820 - DNA, 16 bp, Homo sapiens
gccagacacaggccct

SEQ ID NO: 4080821 - DNA, 17 bp, Homo sapiens
gccagacacaggccctc

SEQ ID NO: 4080822 - DNA, 15 bp, Homo sapiens
gccagacctagcagg

SEQ ID NO: 4080823 - DNA, 16 bp, Homo sapiens
gccagacctagcaggc

SEQ ID NO: 4080824 - DNA, 19 bp, Homo sapiens
gccagacctagcaggctgt

SEQ ID NO: 4080825 - DNA, 19 bp, Homo sapiens
gccagaccttaataaaggc

SEQ ID NO: 4080826 - DNA, 13 bp, Homo sapiens
gccagagatccaa

SEQ ID NO: 4080827 - DNA, 17 bp, Homo sapiens
gccagagccccaagcag

SEQ ID NO: 4080828 - DNA, 18 bp, Homo sapiens
gccagagccccaagcagg

SEQ ID NO: 4080829 - DNA, 21 bp, Homo sapiens
gccagagctgggtggggacag

SEQ ID NO: 4080830 - DNA, 21 bp, Homo sapiens
gccagaggaactgtccagaga

SEQ ID NO: 4080831 - DNA, 24 bp, Homo sapiens
gccagaggaactgtccagagagca

SEQ ID NO: 4080832 - DNA, 16 bp, Homo sapiens
gccagaggagggcaga

SEQ ID NO: 4080833 - DNA, 20 bp, Homo sapiens
gccagaggagggcagaggga

SEQ ID NO: 4080834 - DNA, 13 bp, Homo sapiens
gccagaggctggg

SEQ ID NO: 4080835 - DNA, 19 bp, Homo sapiens
gccagagggcttgtgaaca

SEQ ID NO: 4080836 - DNA, 14 bp, Homo sapiens
gccagaggggaagg

SEQ ID NO: 4080837 - DNA, 15 bp, Homo sapiens
gccagaggtgcttca

SEQ ID NO: 4080838 - DNA, 15 bp, Homo sapiens
gccagagtggcctgg

SEQ ID NO: 4080839 - DNA, 23 bp, Homo sapiens
gccagagttaggttgtctccagg

SEQ ID NO: 4080840 - DNA, 15 bp, Homo sapiens
gccagatccagcctg

SEQ ID NO: 4080841 - DNA, 16 bp, Homo sapiens
gccagatccagcctgg

SEQ ID NO: 4080842 - DNA, 20 bp, Homo sapiens
gccagatccagcctggggtc

SEQ ID NO: 4080843 - DNA, 21 bp, Homo sapiens
gccagatgcacatccctggaa

SEQ ID NO: 4080844 - DNA, 15 bp, Homo sapiens
gccagatggcccgga

SEQ ID NO: 4080845 - DNA, 20 bp, Homo sapiens
gccagattctgcctctctgg

SEQ ID NO: 4080846 - DNA, 20 bp, Homo sapiens
gccagcaaaacttagatgtg

SEQ ID NO: 4080847 - DNA, 12 bp, Homo sapiens
gccagcaacgct

SEQ ID NO: 4080848 - DNA, 18 bp, Homo sapiens
gccagcaacgcttgtaga

SEQ ID NO: 4080849 - DNA, 19 bp, Homo sapiens
gccttggaaatagaaagaa

SEQ ID NO: 4080850 - DNA, 13 bp, Homo sapiens
gccttggaaccag

SEQ ID NO: 4080851 - DNA, 23 bp, Homo sapiens
gccttggaaccagccccatcaga

SEQ ID NO: 4080852 - DNA, 17 bp, Homo sapiens
gccttggcctcccaaag

SEQ ID NO: 4080853 - DNA, 12 bp, Homo sapiens
gccttggctcag

SEQ ID NO: 4080854 - DNA, 15 bp, Homo sapiens
gccttggctcagaca

SEQ ID NO: 4080855 - DNA, 14 bp, Homo sapiens
gccttgggatgggg

SEQ ID NO: 4080856 - DNA, 22 bp, Homo sapiens
gccttgggctatttggactcag

SEQ ID NO: 4080857 - DNA, 14 bp, Homo sapiens
gccttgggctctgc

SEQ ID NO: 4080858 - DNA, 15 bp, Homo sapiens
gccttgggctctgct

SEQ ID NO: 4080859 - DNA, 16 bp, Homo sapiens
gccttgggctctgctg

SEQ ID NO: 4080860 - DNA, 15 bp, Homo sapiens
gccttgggctgctcc

SEQ ID NO: 4080861 - DNA, 17 bp, Homo sapiens
gccttggggtcaggttg

SEQ ID NO: 4080862 - DNA, 22 bp, Homo sapiens
gccttgggttccaaccaggcag

SEQ ID NO: 4080863 - DNA, 20 bp, Homo sapiens
gccttgtaattctaaatgaa

SEQ ID NO: 4080864 - DNA, 22 bp, Homo sapiens
gccttgtcctacgtccaaggtg

SEQ ID NO: 4080865 - DNA, 14 bp, Homo sapiens
gccttgtctcctac

SEQ ID NO: 4080866 - DNA, 19 bp, Homo sapiens
gccttgtttgagtttttcc

SEQ ID NO: 4080867 - DNA, 17 bp, Homo sapiens
gcctttaaaggttttta

SEQ ID NO: 4080868 - DNA, 18 bp, Homo sapiens
gcctttcagcaggcagcc

SEQ ID NO: 4080869 - DNA, 18 bp, Homo sapiens
gcctttccgcggagccct

SEQ ID NO: 4080870 - DNA, 13 bp, Homo sapiens
gcctttccttccc

SEQ ID NO: 4080871 - DNA, 23 bp, Homo sapiens
gcctttctaagactcacttacat

SEQ ID NO: 4080872 - DNA, 22 bp, Homo sapiens
gcctttctacaactgattgcaa

SEQ ID NO: 4080873 - DNA, 15 bp, Homo sapiens
gcctttcttctgccc

SEQ ID NO: 4080874 - DNA, 17 bp, Homo sapiens
gcctttcttctgccctt

SEQ ID NO: 4080875 - DNA, 19 bp, Homo sapiens
gcctttgagacagtttctt

SEQ ID NO: 4080876 - DNA, 20 bp, Homo sapiens
gcctttgagacagtttctta

SEQ ID NO: 4080877 - DNA, 23 bp, Homo sapiens
gcctttgagacagtttcttagct

SEQ ID NO: 4080878 - DNA, 15 bp, Homo sapiens
gcctttgcctccccg

SEQ ID NO: 4080879 - DNA, 16 bp, Homo sapiens
gcctttggccttggct

SEQ ID NO: 4080880 - DNA, 16 bp, Homo sapiens
gcctttgtgctgcgcc

SEQ ID NO: 4080881 - DNA, 16 bp, Homo sapiens
gccttttatctgcaga

SEQ ID NO: 4080882 - DNA, 20 bp, Homo sapiens
gccttttccctctttggctc

SEQ ID NO: 4080883 - DNA, 15 bp, Homo sapiens
gccttttgctctctg

SEQ ID NO: 4080884 - DNA, 13 bp, Homo sapiens
gccttttgtgtga

SEQ ID NO: 4080885 - DNA, 17 bp, Homo sapiens
gcctttttgtttcaatg

SEQ ID NO: 4080886 - DNA, 16 bp, Homo sapiens
gcgaagtagcttgctc

SEQ ID NO: 4080887 - DNA, 20 bp, Homo sapiens
gcgaagtagcttgctccctg

SEQ ID NO: 4080888 - DNA, 15 bp, Homo sapiens
gcgaccgccccctcc

SEQ ID NO: 4080889 - DNA, 16 bp, Homo sapiens
gcgacggagagaaaaa

SEQ ID NO: 4080890 - DNA, 18 bp, Homo sapiens
gcgagactccgtctcaaa

SEQ ID NO: 4080891 - DNA, 16 bp, Homo sapiens
gcgagaggcagagaaa

SEQ ID NO: 4080892 - DNA, 14 bp, Homo sapiens
gcgagtccaaggcc

SEQ ID NO: 4080893 - DNA, 19 bp, Homo sapiens
gcgatatacagatgaaaat

SEQ ID NO: 4080894 - DNA, 16 bp, Homo sapiens
gcgatctctcctggcc

SEQ ID NO: 4080895 - DNA, 18 bp, Homo sapiens
gcgatctctcctggccta

SEQ ID NO: 4080896 - DNA, 21 bp, Homo sapiens
gcgatggggcaagacagaaaa

SEQ ID NO: 4080897 - DNA, 17 bp, Homo sapiens
gcgattctcctgcctca

SEQ ID NO: 4080898 - DNA, 14 bp, Homo sapiens
gcgatttcttcctt

SEQ ID NO: 4080899 - DNA, 15 bp, Homo sapiens
gcgcaccccacgccc

SEQ ID NO: 4080900 - DNA, 16 bp, Homo sapiens
gcgcaccccacgccct

SEQ ID NO: 4080901 - DNA, 18 bp, Homo sapiens
gcgcaccccacgccctgt

SEQ ID NO: 4080902 - DNA, 19 bp, Homo sapiens
gcgcaccccacgccctgtt

SEQ ID NO: 4080903 - DNA, 18 bp, Homo sapiens
gcgcaggtgggctggact

SEQ ID NO: 4080904 - DNA, 18 bp, Homo sapiens
gcgcagtgcttctctaca

SEQ ID NO: 4080905 - DNA, 23 bp, Homo sapiens
gcgcataggcctgctttgtctcc

SEQ ID NO: 4080906 - DNA, 17 bp, Homo sapiens
gcgccaggaagccagag

SEQ ID NO: 4080907 - DNA, 15 bp, Homo sapiens
gcgccaggctgacca

SEQ ID NO: 4080908 - DNA, 22 bp, Homo sapiens
gcgccaggctgaccacagcaca

SEQ ID NO: 4080909 - DNA, 13 bp, Homo sapiens
gcgcccctgctgt

SEQ ID NO: 4080910 - DNA, 11 bp, Homo sapiens
gcgcctcagcc

SEQ ID NO: 4080911 - DNA, 16 bp, Homo sapiens
gcgcctcagccctcag

SEQ ID NO: 4080912 - DNA, 13 bp, Homo sapiens
gcgcctccagagg

SEQ ID NO: 4080913 - DNA, 15 bp, Homo sapiens
gcgcctccagaggtc

SEQ ID NO: 4080914 - DNA, 14 bp, Homo sapiens
gcgcctgcaggcag

SEQ ID NO: 4080915 - DNA, 18 bp, Homo sapiens
gcgcctgcaggcagagct

SEQ ID NO: 4080916 - DNA, 14 bp, Homo sapiens
gcgcctgctgcctg

SEQ ID NO: 4080917 - DNA, 16 bp, Homo sapiens
gcgcctgtgatgctgg

SEQ ID NO: 4080918 - DNA, 17 bp, Homo sapiens
gcgcgccaccgtgcctg

SEQ ID NO: 4080919 - DNA, 20 bp, Homo sapiens
gcgcgccctcccttggcgtg

SEQ ID NO: 4080920 - DNA, 14 bp, Homo sapiens
gcgcggccagcccc

SEQ ID NO: 4080921 - DNA, 15 bp, Homo sapiens
gcgcggtggctcacg

SEQ ID NO: 4080922 - DNA, 16 bp, Homo sapiens
gcgctacccacttcta

SEQ ID NO: 4080923 - DNA, 13 bp, Homo sapiens
gcgctagaggcca

SEQ ID NO: 4080924 - DNA, 14 bp, Homo sapiens
gcgctcgcccagca

SEQ ID NO: 4080925 - DNA, 16 bp, Homo sapiens
gcgctcgcccagcagg

SEQ ID NO: 4080926 - DNA, 12 bp, Homo sapiens
gcgctctcaaga

SEQ ID NO: 4080927 - DNA, 17 bp, Homo sapiens
gcgctctcaagaccaga

SEQ ID NO: 4080928 - DNA, 20 bp, Homo sapiens
gcgctgaggtgtctggcctg

SEQ ID NO: 4080929 - DNA, 13 bp, Homo sapiens
gcgctggggagac

SEQ ID NO: 4080930 - DNA, 21 bp, Homo sapiens
gcgctgtttttgttgtgtgtg

SEQ ID NO: 4080931 - DNA, 18 bp, Homo sapiens
gcgcttcgcttggtgagt

SEQ ID NO: 4080932 - DNA, 15 bp, Homo sapiens
gcgctttctggaaaa

SEQ ID NO: 4080933 - DNA, 15 bp, Homo sapiens
gcggagcccttggcc

SEQ ID NO: 4080934 - DNA, 13 bp, Homo sapiens
gcggagcgggagg

SEQ ID NO: 4080935 - DNA, 16 bp, Homo sapiens
gcggagcttgcagtga

SEQ ID NO: 4080936 - DNA, 15 bp, Homo sapiens
gcggaggagaccagc

SEQ ID NO: 4080937 - DNA, 13 bp, Homo sapiens
gcggaggagctgc

SEQ ID NO: 4080938 - DNA, 19 bp, Homo sapiens
gcggaggttgcagtgagct

SEQ ID NO: 4080939 - DNA, 13 bp, Homo sapiens
gcggatggccgga

SEQ ID NO: 4080940 - DNA, 22 bp, Homo sapiens
gcggcaggagggaggtttgtga

SEQ ID NO: 4080941 - DNA, 17 bp, Homo sapiens
gcggccagccccggccc

SEQ ID NO: 4080942 - DNA, 18 bp, Homo sapiens
gcggccagccccggccct

SEQ ID NO: 4080943 - DNA, 19 bp, Homo sapiens
gcggccagccccggccctg

SEQ ID NO: 4080944 - DNA, 15 bp, Homo sapiens
gcggccaggcacagg

SEQ ID NO: 4080945 - DNA, 18 bp, Homo sapiens
gcggccaggcacagggcc

SEQ ID NO: 4080946 - DNA, 20 bp, Homo sapiens
gcggccaggcacagggcccg

SEQ ID NO: 4080947 - DNA, 18 bp, Homo sapiens
gcggccccaggaggggaa

SEQ ID NO: 4080948 - DNA, 12 bp, Homo sapiens
gcggcccggcca

SEQ ID NO: 4080949 - DNA, 13 bp, Homo sapiens
gcggcccggccag

SEQ ID NO: 4080950 - DNA, 22 bp, Homo sapiens
gcggcccggccagcgggcacag

SEQ ID NO: 4080951 - DNA, 22 bp, Homo sapiens
gcggcggtggactgcgctggac

SEQ ID NO: 4080952 - DNA, 22 bp, Homo sapiens
gcggctcaaaaggaaaccaagt

SEQ ID NO: 4080953 - DNA, 17 bp, Homo sapiens
gcctggggcctgagaga

SEQ ID NO: 4080954 - DNA, 18 bp, Homo sapiens
gcctggggcctgagagaa

SEQ ID NO: 4080955 - DNA, 22 bp, Homo sapiens
gcctggggctcctttctccagc

SEQ ID NO: 4080956 - DNA, 23 bp, Homo sapiens
gcctggggctcctttctccagcc

SEQ ID NO: 4080957 - DNA, 17 bp, Homo sapiens
gcctggggctggcctcc

SEQ ID NO: 4080958 - DNA, 20 bp, Homo sapiens
gcctgggggacagaaagaga

SEQ ID NO: 4080959 - DNA, 15 bp, Homo sapiens
gcctgggggccagtg

SEQ ID NO: 4080960 - DNA, 16 bp, Homo sapiens
gcctgggggccagtgg

SEQ ID NO: 4080961 - DNA, 14 bp, Homo sapiens
gcctggggtcaggc

SEQ ID NO: 4080962 - DNA, 18 bp, Homo sapiens
gcctggggtgcatctcct

SEQ ID NO: 4080963 - DNA, 19 bp, Homo sapiens
gcctggggtgcatctcctc

SEQ ID NO: 4080964 - DNA, 20 bp, Homo sapiens
gcctggggtgcatctcctcc

SEQ ID NO: 4080965 - DNA, 16 bp, Homo sapiens
gcctgggtctgtgtct

SEQ ID NO: 4080966 - DNA, 23 bp, Homo sapiens
gcctgggtgacaaagtgagactc

SEQ ID NO: 4080967 - DNA, 12 bp, Homo sapiens
gcctgggtgctg

SEQ ID NO: 4080968 - DNA, 21 bp, Homo sapiens
gcctgggtgctggctgcccag

SEQ ID NO: 4080969 - DNA, 18 bp, Homo sapiens
gcctggtcgccttccacc

SEQ ID NO: 4080970 - DNA, 19 bp, Homo sapiens
gcctggtggtcagatgcag

SEQ ID NO: 4080971 - DNA, 15 bp, Homo sapiens
gcctgtaatcccagc

SEQ ID NO: 4080972 - DNA, 15 bp, Homo sapiens
gcctgtagagttgct

SEQ ID NO: 4080973 - DNA, 16 bp, Homo sapiens
gcctgtagagttgctg

SEQ ID NO: 4080974 - DNA, 13 bp, Homo sapiens
gcctgtcaccccc

SEQ ID NO: 4080975 - DNA, 20 bp, Homo sapiens
gcctgtcacccccactcccg

SEQ ID NO: 4080976 - DNA, 19 bp, Homo sapiens
gcctgtcatccttggtctt

SEQ ID NO: 4080977 - DNA, 12 bp, Homo sapiens
gcctgtccagcc

SEQ ID NO: 4080978 - DNA, 15 bp, Homo sapiens
gcctgtccagcctgg

SEQ ID NO: 4080979 - DNA, 17 bp, Homo sapiens
gcctgtccagcctgggc

SEQ ID NO: 4080980 - DNA, 20 bp, Homo sapiens
gcctgtcccaattctgcccg

SEQ ID NO: 4080981 - DNA, 20 bp, Homo sapiens
gcctgtcccacccccacccc

SEQ ID NO: 4080982 - DNA, 22 bp, Homo sapiens
gcctgtcccatggacactccag

SEQ ID NO: 4080983 - DNA, 16 bp, Homo sapiens
gcctgtcccttgcctc

SEQ ID NO: 4080984 - DNA, 17 bp, Homo sapiens
gcctgtcccttgcctct

SEQ ID NO: 4080985 - DNA, 18 bp, Homo sapiens
gcctgtcccttgcctctg

SEQ ID NO: 4080986 - DNA, 19 bp, Homo sapiens
gcctgtcccttgcctctgc

SEQ ID NO: 4080987 - DNA, 19 bp, Homo sapiens
gcctgtctctttaagggca

SEQ ID NO: 4080988 - DNA, 21 bp, Homo sapiens
gcctgtctgccccagcccaga

SEQ ID NO: 4080989 - DNA, 19 bp, Homo sapiens
gcctgtgcctctgggactg

SEQ ID NO: 4080990 - DNA, 16 bp, Homo sapiens
gcctgtggaatgagtg

SEQ ID NO: 4080991 - DNA, 18 bp, Homo sapiens
gcctgtggaatgagtgtg

SEQ ID NO: 4080992 - DNA, 19 bp, Homo sapiens
gcctgtggaatgagtgtgc

SEQ ID NO: 4080993 - DNA, 22 bp, Homo sapiens
gcctgtgggtccccactcaccc

SEQ ID NO: 4080994 - DNA, 19 bp, Homo sapiens
gcctgtggttacagtgcag

SEQ ID NO: 4080995 - DNA, 18 bp, Homo sapiens
gcctgtttctgcagccct

SEQ ID NO: 4080996 - DNA, 22 bp, Homo sapiens
gcctgtttggcgtttcccagag

SEQ ID NO: 4080997 - DNA, 20 bp, Homo sapiens
gccttaaacactcaccttct

SEQ ID NO: 4080998 - DNA, 13 bp, Homo sapiens
gccttaaatttgt

SEQ ID NO: 4080999 - DNA, 16 bp, Homo sapiens
gccttaagctgatcct

SEQ ID NO: 4081000 - DNA, 18 bp, Homo sapiens
gccttaagctgatcctgc

SEQ ID NO: 4081001 - DNA, 17 bp, Homo sapiens
gccttaatttccttttt

SEQ ID NO: 4081002 - DNA, 13 bp, Homo sapiens
gccttacactgaa

SEQ ID NO: 4081003 - DNA, 15 bp, Homo sapiens
gccttacatttgtga

SEQ ID NO: 4081004 - DNA, 14 bp, Homo sapiens
gccttagcaggggt

SEQ ID NO: 4081005 - DNA, 15 bp, Homo sapiens
gccttagtctcagtt

SEQ ID NO: 4081006 - DNA, 18 bp, Homo sapiens
gccttagtctcagtttgt

SEQ ID NO: 4081007 - DNA, 12 bp, Homo sapiens
gccttagtgggc

SEQ ID NO: 4081008 - DNA, 20 bp, Homo sapiens
gccttataaaccaatcttaa

SEQ ID NO: 4081009 - DNA, 23 bp, Homo sapiens
gccttatcgggctccagccatct

SEQ ID NO: 4081010 - DNA, 22 bp, Homo sapiens
gccttcagagtacgtcctgcct

SEQ ID NO: 4081011 - DNA, 16 bp, Homo sapiens
gccttcagctgttgca

SEQ ID NO: 4081012 - DNA, 21 bp, Homo sapiens
gccttcaggcttctgtcaatt

SEQ ID NO: 4081013 - DNA, 16 bp, Homo sapiens
gccttccagctgctgt

SEQ ID NO: 4081014 - DNA, 17 bp, Homo sapiens
gccttccagctgctgtc

SEQ ID NO: 4081015 - DNA, 13 bp, Homo sapiens
gccttccataatt

SEQ ID NO: 4081016 - DNA, 21 bp, Homo sapiens
gccttccataattatgacagt

SEQ ID NO: 4081017 - DNA, 12 bp, Homo sapiens
gccttcccctca

SEQ ID NO: 4081018 - DNA, 24 bp, Homo sapiens
gccttccctagctttagaccctgg

SEQ ID NO: 4081019 - DNA, 20 bp, Homo sapiens
gccttcctcagctgcctcct

SEQ ID NO: 4081020 - DNA, 23 bp, Homo sapiens
gccttcctggttttgtacactgc

SEQ ID NO: 4081021 - DNA, 23 bp, Homo sapiens
gccttccttcccgccagagggct

SEQ ID NO: 4081022 - DNA, 20 bp, Homo sapiens
gccttcctttctccaggacc

SEQ ID NO: 4081023 - DNA, 23 bp, Homo sapiens
gccttcgatacaccgggcctgga

SEQ ID NO: 4081024 - DNA, 16 bp, Homo sapiens
gccttctcagaagcac

SEQ ID NO: 4081025 - DNA, 15 bp, Homo sapiens
gccttctccatatct

SEQ ID NO: 4081026 - DNA, 15 bp, Homo sapiens
gccttctcccacatg

SEQ ID NO: 4081027 - DNA, 20 bp, Homo sapiens
gccttctcccacatgaggcc

SEQ ID NO: 4081028 - DNA, 19 bp, Homo sapiens
gccttctcctctctgggcc

SEQ ID NO: 4081029 - DNA, 21 bp, Homo sapiens
gccttctcctctctgggcctt

SEQ ID NO: 4081030 - DNA, 19 bp, Homo sapiens
gccttctgaaatgtgaccc

SEQ ID NO: 4081031 - DNA, 14 bp, Homo sapiens
gccttctgatgtct

SEQ ID NO: 4081032 - DNA, 15 bp, Homo sapiens
gccttctttgaagaa

SEQ ID NO: 4081033 - DNA, 14 bp, Homo sapiens
gccttgcaagatgg

SEQ ID NO: 4081034 - DNA, 14 bp, Homo sapiens
gccttgcataccca

SEQ ID NO: 4081035 - DNA, 14 bp, Homo sapiens
gccttgccagagat

SEQ ID NO: 4081036 - DNA, 18 bp, Homo sapiens
gccttgctcattcttgag

SEQ ID NO: 4081037 - DNA, 19 bp, Homo sapiens
gccttgctcctagcagaca

SEQ ID NO: 4081038 - DNA, 21 bp, Homo sapiens
gccttgctcctagcagacaga

SEQ ID NO: 4081039 - DNA, 22 bp, Homo sapiens
gccttgctgatggcttgacatg

SEQ ID NO: 4081040 - DNA, 13 bp, Homo sapiens
gccttgctgctgc

SEQ ID NO: 4081041 - DNA, 15 bp, Homo sapiens
gccttgctgctgctg

SEQ ID NO: 4081042 - DNA, 17 bp, Homo sapiens
gccttgctgctgctgca

SEQ ID NO: 4081043 - DNA, 18 bp, Homo sapiens
gccttgctgctgctgcac

SEQ ID NO: 4081044 - DNA, 17 bp, Homo sapiens
gccgtctcctccctcag

SEQ ID NO: 4081045 - DNA, 15 bp, Homo sapiens
gccgtgaactgtgca

SEQ ID NO: 4081046 - DNA, 16 bp, Homo sapiens
gccgtgaactgtgcat

SEQ ID NO: 4081047 - DNA, 15 bp, Homo sapiens
gccgtgcccaggggc

SEQ ID NO: 4081048 - DNA, 14 bp, Homo sapiens
gccgtgccttcagc

SEQ ID NO: 4081049 - DNA, 17 bp, Homo sapiens
gccgtgctcgccccagc

SEQ ID NO: 4081050 - DNA, 20 bp, Homo sapiens
gccgtgctcgccccagcagg

SEQ ID NO: 4081051 - DNA, 21 bp, Homo sapiens
gccgtgctcgccccagcaggt

SEQ ID NO: 4081052 - DNA, 21 bp, Homo sapiens
gccgtggattgcacgtggcct

SEQ ID NO: 4081053 - DNA, 13 bp, Homo sapiens
gccgtggcttccc

SEQ ID NO: 4081054 - DNA, 21 bp, Homo sapiens
gccgtggcttcccgctcagcc

SEQ ID NO: 4081055 - DNA, 23 bp, Homo sapiens
gccgtggtccaaccaggagctga

SEQ ID NO: 4081056 - DNA, 17 bp, Homo sapiens
gccgtggtccagctctt

SEQ ID NO: 4081057 - DNA, 18 bp, Homo sapiens
gccgtgtgagtgtgacag

SEQ ID NO: 4081058 - DNA, 15 bp, Homo sapiens
gcctaaaagtaaaca

SEQ ID NO: 4081059 - DNA, 23 bp, Homo sapiens
gcctaaaagtgggcttgattctg

SEQ ID NO: 4081060 - DNA, 16 bp, Homo sapiens
gcctgacagccagaac

SEQ ID NO: 4081061 - DNA, 17 bp, Homo sapiens
gcctgacagccagaact

SEQ ID NO: 4081062 - DNA, 21 bp, Homo sapiens
gcctgactcccccagtcccct

SEQ ID NO: 4081063 - DNA, 23 bp, Homo sapiens
gcctgactcccccagtccccttc

SEQ ID NO: 4081064 - DNA, 13 bp, Homo sapiens
gcctgacttgggg

SEQ ID NO: 4081065 - DNA, 14 bp, Homo sapiens
gcctgagaggcagg

SEQ ID NO: 4081066 - DNA, 16 bp, Homo sapiens
gcctgagaggcaggca

SEQ ID NO: 4081067 - DNA, 21 bp, Homo sapiens
gcctgagagtatttaggcaga

SEQ ID NO: 4081068 - DNA, 18 bp, Homo sapiens
gcctgagcaactcttgat

SEQ ID NO: 4081069 - DNA, 23 bp, Homo sapiens
gcctgagctcactcggcaccctg

SEQ ID NO: 4081070 - DNA, 13 bp, Homo sapiens
gcctgagctcctg

SEQ ID NO: 4081071 - DNA, 14 bp, Homo sapiens
gcctgagctcctgc

SEQ ID NO: 4081072 - DNA, 19 bp, Homo sapiens
gcctgagctcctgctgcgg

SEQ ID NO: 4081073 - DNA, 13 bp, Homo sapiens
gcctgaggggcag

SEQ ID NO: 4081074 - DNA, 19 bp, Homo sapiens
gcctgaggggcagcctgcc

SEQ ID NO: 4081075 - DNA, 15 bp, Homo sapiens
gcctgagggtggaga

SEQ ID NO: 4081076 - DNA, 13 bp, Homo sapiens
gcctgaggtcaat

SEQ ID NO: 4081077 - DNA, 18 bp, Homo sapiens
gcctgaggtctgtacgtt

SEQ ID NO: 4081078 - DNA, 15 bp, Homo sapiens
gcctgagtctcctgt

SEQ ID NO: 4081079 - DNA, 16 bp, Homo sapiens
gcctgagtctcctgtg

SEQ ID NO: 4081080 - DNA, 20 bp, Homo sapiens
gcctgatcagaccacggctc

SEQ ID NO: 4081081 - DNA, 15 bp, Homo sapiens
gcctgatcttgcctg

SEQ ID NO: 4081082 - DNA, 17 bp, Homo sapiens
gcctgatgacagagcga

SEQ ID NO: 4081083 - DNA, 19 bp, Homo sapiens
gcctgatgctccctcccct

SEQ ID NO: 4081084 - DNA, 21 bp, Homo sapiens
gcctgcacctttcggcagagg

SEQ ID NO: 4081085 - DNA, 19 bp, Homo sapiens
gcctgcactgagagggcaa

SEQ ID NO: 4081086 - DNA, 16 bp, Homo sapiens
gcctgcagaatttggg

SEQ ID NO: 4081087 - DNA, 11 bp, Homo sapiens
gcctgcagaga

SEQ ID NO: 4081088 - DNA, 12 bp, Homo sapiens
gcctgcagagag

SEQ ID NO: 4081089 - DNA, 14 bp, Homo sapiens
gcctgcagagagaa

SEQ ID NO: 4081090 - DNA, 17 bp, Homo sapiens
gcctgcagagagaagcc

SEQ ID NO: 4081091 - DNA, 12 bp, Homo sapiens
gcctgcagcagg

SEQ ID NO: 4081092 - DNA, 16 bp, Homo sapiens
gcctgcagcaggcagc

SEQ ID NO: 4081093 - DNA, 17 bp, Homo sapiens
gcctgcagcaggcagct

SEQ ID NO: 4081094 - DNA, 14 bp, Homo sapiens
gcctgcaggcagag

SEQ ID NO: 4081095 - DNA, 15 bp, Homo sapiens
gcctgcaggcagagc

SEQ ID NO: 4081096 - DNA, 17 bp, Homo sapiens
gcctgcccaagcccagg

SEQ ID NO: 4081097 - DNA, 20 bp, Homo sapiens
gcctgcccaagcccaggcca

SEQ ID NO: 4081098 - DNA, 21 bp, Homo sapiens
gcctgcccaagcccaggccac

SEQ ID NO: 4081099 - DNA, 13 bp, Homo sapiens
gcctgccctgtca

SEQ ID NO: 4081100 - DNA, 19 bp, Homo sapiens
gcctgccctttgtcctcct

SEQ ID NO: 4081101 - DNA, 22 bp, Homo sapiens
gcctgccctttgtcctcctgct

SEQ ID NO: 4081102 - DNA, 14 bp, Homo sapiens
gcctgccgggctga

SEQ ID NO: 4081103 - DNA, 17 bp, Homo sapiens
gcctgccgggctgaggg

SEQ ID NO: 4081104 - DNA, 18 bp, Homo sapiens
gcctgcctcccaaggtcc

SEQ ID NO: 4081105 - DNA, 13 bp, Homo sapiens
gcctgcctcccac

SEQ ID NO: 4081106 - DNA, 16 bp, Homo sapiens
gcctgcctgcagcagg

SEQ ID NO: 4081107 - DNA, 20 bp, Homo sapiens
gcctgcctgcagcaggcagc

SEQ ID NO: 4081108 - DNA, 21 bp, Homo sapiens
gcctgcctgcagcaggcagct

SEQ ID NO: 4081109 - DNA, 15 bp, Homo sapiens
gcctgcctggcccct

SEQ ID NO: 4081110 - DNA, 13 bp, Homo sapiens
gcctgcgcctgct

SEQ ID NO: 4081111 - DNA, 19 bp, Homo sapiens
gcctgcgttggtccagagc

SEQ ID NO: 4081112 - DNA, 15 bp, Homo sapiens
gcctgctccagacct

SEQ ID NO: 4081113 - DNA, 16 bp, Homo sapiens
gcctgctccagacctg

SEQ ID NO: 4081114 - DNA, 14 bp, Homo sapiens
gcctgctccttccc

SEQ ID NO: 4081115 - DNA, 15 bp, Homo sapiens
gcctgctccttccct

SEQ ID NO: 4081116 - DNA, 19 bp, Homo sapiens
gcctgctctagtgggacag

SEQ ID NO: 4081117 - DNA, 16 bp, Homo sapiens
gcctgctgccagtgca

SEQ ID NO: 4081118 - DNA, 22 bp, Homo sapiens
gcctgctgccagtgcagccact

SEQ ID NO: 4081119 - DNA, 19 bp, Homo sapiens
gcctgctggaggcctcagg

SEQ ID NO: 4081120 - DNA, 11 bp, Homo sapiens
gcctgctgggc

SEQ ID NO: 4081121 - DNA, 19 bp, Homo sapiens
gcctgctgggctcccccca

SEQ ID NO: 4081122 - DNA, 22 bp, Homo sapiens
gcctgctgggctccccccagtg

SEQ ID NO: 4081123 - DNA, 22 bp, Homo sapiens
gcctgctgtgattccactacac

SEQ ID NO: 4081124 - DNA, 23 bp, Homo sapiens
gcctgcttggcccggccggcctg

SEQ ID NO: 4081125 - DNA, 15 bp, Homo sapiens
gcctggacctgcctc

SEQ ID NO: 4081126 - DNA, 17 bp, Homo sapiens
gcctggacctgcctcct

SEQ ID NO: 4081127 - DNA, 13 bp, Homo sapiens
gcctggactctgc

SEQ ID NO: 4081128 - DNA, 14 bp, Homo sapiens
gcctggactctgcc

SEQ ID NO: 4081129 - DNA, 18 bp, Homo sapiens
gcctggactttcctgcaa

SEQ ID NO: 4081130 - DNA, 13 bp, Homo sapiens
gcctggagcccca

SEQ ID NO: 4081131 - DNA, 18 bp, Homo sapiens
gcctggagccccatcggc

SEQ ID NO: 4081132 - DNA, 13 bp, Homo sapiens
gcctggagctaat

SEQ ID NO: 4081133 - DNA, 19 bp, Homo sapiens
gcctggagtgctgtgctgt

SEQ ID NO: 4081134 - DNA, 18 bp, Homo sapiens
gcctggatccctgccctt

SEQ ID NO: 4081135 - DNA, 22 bp, Homo sapiens
gcctggatgccagctgtgtcct

SEQ ID NO: 4081136 - DNA, 18 bp, Homo sapiens
gcctggcaagtgggtgaa

SEQ ID NO: 4081137 - DNA, 18 bp, Homo sapiens
gcctggcacagggcagtg

SEQ ID NO: 4081138 - DNA, 14 bp, Homo sapiens
gcctggcaggccag

SEQ ID NO: 4081139 - DNA, 15 bp, Homo sapiens
gcctggcaggccagt

SEQ ID NO: 4081140 - DNA, 17 bp, Homo sapiens
gcctggcaggccagtgt

SEQ ID NO: 4081141 - DNA, 16 bp, Homo sapiens
gcctggccaccagcca

SEQ ID NO: 4081142 - DNA, 18 bp, Homo sapiens
gcctggccaccagccatc

SEQ ID NO: 4081143 - DNA, 19 bp, Homo sapiens
gcctggccaggagctcttc

SEQ ID NO: 4081144 - DNA, 15 bp, Homo sapiens
gcctggccaggcaga

SEQ ID NO: 4081145 - DNA, 23 bp, Homo sapiens
gcctggccaggcagatctgtgcc

SEQ ID NO: 4081146 - DNA, 16 bp, Homo sapiens
gcctggccatttccaa

SEQ ID NO: 4081147 - DNA, 15 bp, Homo sapiens
gcctggccccagcct

SEQ ID NO: 4081148 - DNA, 18 bp, Homo sapiens
gcctggccccagcctggg

SEQ ID NO: 4081149 - DNA, 14 bp, Homo sapiens
gatgatgctgccag

SEQ ID NO: 4081150 - DNA, 19 bp, Homo sapiens
gatgattttcatttcatga

SEQ ID NO: 4081151 - DNA, 23 bp, Homo sapiens
gatgattttgcaaaatgagttgt

SEQ ID NO: 4081152 - DNA, 14 bp, Homo sapiens
gatgcaaggaccag

SEQ ID NO: 4081153 - DNA, 18 bp, Homo sapiens
gatgcaatcagacaagtg

SEQ ID NO: 4081154 - DNA, 21 bp, Homo sapiens
gatgcactgaaaacttagcca

SEQ ID NO: 4081155 - DNA, 16 bp, Homo sapiens
gatgcagctcttcctg

SEQ ID NO: 4081156 - DNA, 13 bp, Homo sapiens
gatgcaggacagg

SEQ ID NO: 4081157 - DNA, 14 bp, Homo sapiens
gatgcaggacagga

SEQ ID NO: 4081158 - DNA, 14 bp, Homo sapiens
gatgcagggcagtc

SEQ ID NO: 4081159 - DNA, 13 bp, Homo sapiens
gatgcatcactgg

SEQ ID NO: 4081160 - DNA, 19 bp, Homo sapiens
gatgccaatattaaatctg

SEQ ID NO: 4081161 - DNA, 15 bp, Homo sapiens
gatgccacacaagga

SEQ ID NO: 4081162 - DNA, 18 bp, Homo sapiens
gatgccactcctccctcc

SEQ ID NO: 4081163 - DNA, 14 bp, Homo sapiens
gatgccagctgtgt

SEQ ID NO: 4081164 - DNA, 20 bp, Homo sapiens
gatgccagcttctctctcca

SEQ ID NO: 4081165 - DNA, 21 bp, Homo sapiens
gatgccagcttctctctccag

SEQ ID NO: 4081166 - DNA, 23 bp, Homo sapiens
gatgccagcttctctctccaggg

SEQ ID NO: 4081167 - DNA, 20 bp, Homo sapiens
gatgccattcttccttgcaa

SEQ ID NO: 4081168 - DNA, 18 bp, Homo sapiens
gatgcccagaggactccc

SEQ ID NO: 4081169 - DNA, 23 bp, Homo sapiens
gatgcctacaaccatccctgcca

SEQ ID NO: 4081170 - DNA, 22 bp, Homo sapiens
gatgccttttttgtagtttttt

SEQ ID NO: 4081171 - DNA, 16 bp, Homo sapiens
gatgcggtggctcacg

SEQ ID NO: 4081172 - DNA, 20 bp, Homo sapiens
gatgctagaaaaatgttctt

SEQ ID NO: 4081173 - DNA, 16 bp, Homo sapiens
gatgctccctcagcct

SEQ ID NO: 4081174 - DNA, 22 bp, Homo sapiens
gatgctccctcagcctcagagg

SEQ ID NO: 4081175 - DNA, 21 bp, Homo sapiens
gatgctccctcccctgccctg

SEQ ID NO: 4081176 - DNA, 13 bp, Homo sapiens
gatgctctttccc

SEQ ID NO: 4081177 - DNA, 20 bp, Homo sapiens
gatgctgactgtactcctcc

SEQ ID NO: 4081178 - DNA, 12 bp, Homo sapiens
gatgctgcccct

SEQ ID NO: 4081179 - DNA, 13 bp, Homo sapiens
gatgctgcccctc

SEQ ID NO: 4081180 - DNA, 15 bp, Homo sapiens
gatgctggagaggtt

SEQ ID NO: 4081181 - DNA, 16 bp, Homo sapiens
gatgctggagaggtta

SEQ ID NO: 4081182 - DNA, 13 bp, Homo sapiens
gatgctggcccag

SEQ ID NO: 4081183 - DNA, 23 bp, Homo sapiens
gatgctggcccagggcccagagc

SEQ ID NO: 4081184 - DNA, 23 bp, Homo sapiens
gatgctgggcacttcatctgatc

SEQ ID NO: 4081185 - DNA, 13 bp, Homo sapiens
gatgctgggctgg

SEQ ID NO: 4081186 - DNA, 20 bp, Homo sapiens
gatgctgggctgggccctct

SEQ ID NO: 4081187 - DNA, 22 bp, Homo sapiens
gatgctgtgacaataagtttga

SEQ ID NO: 4081188 - DNA, 16 bp, Homo sapiens
gatgcttttgtctaat

SEQ ID NO: 4081189 - DNA, 18 bp, Homo sapiens
gatggaaaagtgtccttc

SEQ ID NO: 4081190 - DNA, 16 bp, Homo sapiens
gatggaaaataaacat

SEQ ID NO: 4081191 - DNA, 17 bp, Homo sapiens
gatggaaaataaacatc

SEQ ID NO: 4081192 - DNA, 18 bp, Homo sapiens
gatggaaaataaacatca

SEQ ID NO: 4081193 - DNA, 14 bp, Homo sapiens
gatggaaacaatgt

SEQ ID NO: 4081194 - DNA, 18 bp, Homo sapiens
gatggaaacaatgtggag

SEQ ID NO: 4081195 - DNA, 17 bp, Homo sapiens
gatggaagtaaagcctc

SEQ ID NO: 4081196 - DNA, 21 bp, Homo sapiens
gatggaagttgcagtgagctg

SEQ ID NO: 4081197 - DNA, 21 bp, Homo sapiens
gatggagaggcggcctcgtgc

SEQ ID NO: 4081198 - DNA, 15 bp, Homo sapiens
gatggaggaaaaagg

SEQ ID NO: 4081199 - DNA, 16 bp, Homo sapiens
gatggaggggagtgtt

SEQ ID NO: 4081200 - DNA, 16 bp, Homo sapiens
gatggaggtatttgaa

SEQ ID NO: 4081201 - DNA, 22 bp, Homo sapiens
gatggattctcagatatttata

SEQ ID NO: 4081202 - DNA, 15 bp, Homo sapiens
gatggcaacagatct

SEQ ID NO: 4081203 - DNA, 16 bp, Homo sapiens
gatggcaacagatctg

SEQ ID NO: 4081204 - DNA, 21 bp, Homo sapiens
gatggcaacagatctggaacc

SEQ ID NO: 4081205 - DNA, 13 bp, Homo sapiens
gatggccagcccc

SEQ ID NO: 4081206 - DNA, 20 bp, Homo sapiens
gatggcccggatgctgcttc

SEQ ID NO: 4081207 - DNA, 22 bp, Homo sapiens
gatggcccttcccactggaggt

SEQ ID NO: 4081208 - DNA, 18 bp, Homo sapiens
gatggccgtggatggccg

SEQ ID NO: 4081209 - DNA, 14 bp, Homo sapiens
gatgggaaaatatt

SEQ ID NO: 4081210 - DNA, 18 bp, Homo sapiens
gatgggaaaatatttcct

SEQ ID NO: 4081211 - DNA, 14 bp, Homo sapiens
gatgggaccaggga

SEQ ID NO: 4081212 - DNA, 21 bp, Homo sapiens
gatgggagctcctctcctgga

SEQ ID NO: 4081213 - DNA, 15 bp, Homo sapiens
gatgggcacttgaga

SEQ ID NO: 4081214 - DNA, 21 bp, Homo sapiens
gatggggataaaatgactact

SEQ ID NO: 4081215 - DNA, 14 bp, Homo sapiens
gatggggcctccct

SEQ ID NO: 4081216 - DNA, 22 bp, Homo sapiens
gatggggcctccctccttgggt

SEQ ID NO: 4081217 - DNA, 17 bp, Homo sapiens
gatgggggatgggccag

SEQ ID NO: 4081218 - DNA, 14 bp, Homo sapiens
gatgggggccagga

SEQ ID NO: 4081219 - DNA, 18 bp, Homo sapiens
gatgggggtttcaccata

SEQ ID NO: 4081220 - DNA, 23 bp, Homo sapiens
gatggggtctcacagtgttgccc

SEQ ID NO: 4081221 - DNA, 15 bp, Homo sapiens
gatgggtccaggggt

SEQ ID NO: 4081222 - DNA, 21 bp, Homo sapiens
gatgggttctaattttggatg

SEQ ID NO: 4081223 - DNA, 19 bp, Homo sapiens
gatggtccatttgttcctg

SEQ ID NO: 4081224 - DNA, 19 bp, Homo sapiens
gatggtctcgatctcctga

SEQ ID NO: 4081225 - DNA, 23 bp, Homo sapiens
gatggtgacagctgcaagccagg

SEQ ID NO: 4081226 - DNA, 21 bp, Homo sapiens
gatggttcccctgttcactct

SEQ ID NO: 4081227 - DNA, 17 bp, Homo sapiens
gatggttttaaactttc

SEQ ID NO: 4081228 - DNA, 13 bp, Homo sapiens
gcacatctgcatt

SEQ ID NO: 4081229 - DNA, 21 bp, Homo sapiens
gcacatctgcattttcacccc

SEQ ID NO: 4081230 - DNA, 13 bp, Homo sapiens
gcaccaaccacag

SEQ ID NO: 4081231 - DNA, 14 bp, Homo sapiens
gcaccaatgcccag

SEQ ID NO: 4081232 - DNA, 23 bp, Homo sapiens
gcaccaccctagtcccttcccct

SEQ ID NO: 4081233 - DNA, 23 bp, Homo sapiens
gcaccactgcactccagcctggg

SEQ ID NO: 4081234 - DNA, 17 bp, Homo sapiens
gcaccagacacccagga

SEQ ID NO: 4081235 - DNA, 20 bp, Homo sapiens
gcaccagacacccaggactt

SEQ ID NO: 4081236 - DNA, 21 bp, Homo sapiens
gcaccagacacccaggactta

SEQ ID NO: 4081237 - DNA, 17 bp, Homo sapiens
gcaccagcatccacctt

SEQ ID NO: 4081238 - DNA, 20 bp, Homo sapiens
gcaccagcttctccaggctc

SEQ ID NO: 4081239 - DNA, 15 bp, Homo sapiens
gcaccaggccgggct

SEQ ID NO: 4081240 - DNA, 20 bp, Homo sapiens
gcaccaggccgggcttgggc

SEQ ID NO: 4081241 - DNA, 19 bp, Homo sapiens
gcaccatgtgggcacggag

SEQ ID NO: 4081242 - DNA, 20 bp, Homo sapiens
gcacccaccgtggaggagga

SEQ ID NO: 4081243 - DNA, 12 bp, Homo sapiens
gcacccagagca

SEQ ID NO: 4081244 - DNA, 22 bp, Homo sapiens
gcacccagagcaccccctgctc

SEQ ID NO: 4081245 - DNA, 16 bp, Homo sapiens
gcacccagctccaggg

SEQ ID NO: 4081246 - DNA, 17 bp, Homo sapiens
gcaccccaaagctttcc

SEQ ID NO: 4081247 - DNA, 13 bp, Homo sapiens
gcaccccacgccc

SEQ ID NO: 4081248 - DNA, 19 bp, Homo sapiens
gcaccccagctaccccttc

SEQ ID NO: 4081249 - DNA, 20 bp, Homo sapiens
gcaccccagctaccccttct

SEQ ID NO: 4081250 - DNA, 12 bp, Homo sapiens
gcacccccaccc

SEQ ID NO: 4081251 - DNA, 15 bp, Homo sapiens
gcacccccacccacc

SEQ ID NO: 4081252 - DNA, 16 bp, Homo sapiens
gcacccccacccacct

SEQ ID NO: 4081253 - DNA, 19 bp, Homo sapiens
gcacccccctgttctaagg

SEQ ID NO: 4081254 - DNA, 21 bp, Homo sapiens
gcacccccctgttctaagggg

SEQ ID NO: 4081255 - DNA, 18 bp, Homo sapiens
gcaccccggcctcagggc

SEQ ID NO: 4081256 - DNA, 14 bp, Homo sapiens
gcacccctgggcca

SEQ ID NO: 4081257 - DNA, 18 bp, Homo sapiens
gcaccccttctctcctcc

SEQ ID NO: 4081258 - DNA, 12 bp, Homo sapiens
gcaccctcaggg

SEQ ID NO: 4081259 - DNA, 16 bp, Homo sapiens
gcaccctcccccgcag

SEQ ID NO: 4081260 - DNA, 15 bp, Homo sapiens
gcaccctctcctggg

SEQ ID NO: 4081261 - DNA, 16 bp, Homo sapiens
gcaccctctcctgggg

SEQ ID NO: 4081262 - DNA, 19 bp, Homo sapiens
gcaccctgcgcctccagag

SEQ ID NO: 4081263 - DNA, 20 bp, Homo sapiens
gcaccctggggcctggacct

SEQ ID NO: 4081264 - DNA, 21 bp, Homo sapiens
gcaccctggggcctggacctg

SEQ ID NO: 4081265 - DNA, 22 bp, Homo sapiens
gcaccgcggcgcttcccagcac

SEQ ID NO: 4081266 - DNA, 22 bp, Homo sapiens
gcaccgcttttgttctcgcaaa

SEQ ID NO: 4081267 - DNA, 14 bp, Homo sapiens
gcaccggcctggct

SEQ ID NO: 4081268 - DNA, 21 bp, Homo sapiens
gcaccgtcatggcttaatgtt

SEQ ID NO: 4081269 - DNA, 23 bp, Homo sapiens
gcacctaatccaggcagatccag

SEQ ID NO: 4081270 - DNA, 19 bp, Homo sapiens
gcacctactatgtgctggg

SEQ ID NO: 4081271 - DNA, 22 bp, Homo sapiens
gcacctactatgtgctgggtgc

SEQ ID NO: 4081272 - DNA, 11 bp, Homo sapiens
gcacctcagaa

SEQ ID NO: 4081273 - DNA, 24 bp, Homo sapiens
gcacctcagaaagtcaccaggact

SEQ ID NO: 4081274 - DNA, 15 bp, Homo sapiens
gcacctccagcctga

SEQ ID NO: 4081275 - DNA, 16 bp, Homo sapiens
gcacctccaggcctgt

SEQ ID NO: 4081276 - DNA, 16 bp, Homo sapiens
gcacctccccgctggg

SEQ ID NO: 4081277 - DNA, 15 bp, Homo sapiens
gcacctgtagtccca

SEQ ID NO: 4081278 - DNA, 16 bp, Homo sapiens
gcacctgtagtcccag

SEQ ID NO: 4081279 - DNA, 14 bp, Homo sapiens
gcacctgtctgctc

SEQ ID NO: 4081280 - DNA, 21 bp, Homo sapiens
gcacctgtctgctccagctct

SEQ ID NO: 4081281 - DNA, 14 bp, Homo sapiens
gcacctgtgctgga

SEQ ID NO: 4081282 - DNA, 15 bp, Homo sapiens
gcaccttcagggctg

SEQ ID NO: 4081283 - DNA, 20 bp, Homo sapiens
gcacgagtgggaaggacttg

SEQ ID NO: 4081284 - DNA, 13 bp, Homo sapiens
gcacgcacacaca

SEQ ID NO: 4081285 - DNA, 20 bp, Homo sapiens
gcacgcttgcgtatgtctgt

SEQ ID NO: 4081286 - DNA, 15 bp, Homo sapiens
gcacgtgcaaggact

SEQ ID NO: 4081287 - DNA, 15 bp, Homo sapiens
gcacgtggagagctg

SEQ ID NO: 4081288 - DNA, 13 bp, Homo sapiens
gcacgtggcctct

SEQ ID NO: 4081289 - DNA, 14 bp, Homo sapiens
gcacgtggcctctt

SEQ ID NO: 4081290 - DNA, 17 bp, Homo sapiens
gcactaaagccagcctg

SEQ ID NO: 4081291 - DNA, 19 bp, Homo sapiens
gcactaaagccagcctgac

SEQ ID NO: 4081292 - DNA, 23 bp, Homo sapiens
gcactaaagccagcctgaccttc

SEQ ID NO: 4081293 - DNA, 14 bp, Homo sapiens
gcactaaggccgtg

SEQ ID NO: 4081294 - DNA, 23 bp, Homo sapiens
gcactaaggccgtgtctctgagg

SEQ ID NO: 4081295 - DNA, 17 bp, Homo sapiens
gcactacaccttgcctt

SEQ ID NO: 4081296 - DNA, 16 bp, Homo sapiens
gcactactgggtgtca

SEQ ID NO: 4081297 - DNA, 20 bp, Homo sapiens
gcactataatgtaagctcta

SEQ ID NO: 4081298 - DNA, 17 bp, Homo sapiens
gcactcacccatgtgcc

SEQ ID NO: 4081299 - DNA, 22 bp, Homo sapiens
gcactcagtgagcctcctgtgc

SEQ ID NO: 4081300 - DNA, 12 bp, Homo sapiens
gcactccagcct

SEQ ID NO: 4081301 - DNA, 17 bp, Homo sapiens
gcactccagcctggggg

SEQ ID NO: 4081302 - DNA, 15 bp, Homo sapiens
gcactctaaactgca

SEQ ID NO: 4081303 - DNA, 19 bp, Homo sapiens
gcactctctaaatcttcct

SEQ ID NO: 4081304 - DNA, 22 bp, Homo sapiens
gcactctggatgatggattcca

SEQ ID NO: 4081305 - DNA, 15 bp, Homo sapiens
gcactcttaaagcaa

SEQ ID NO: 4081306 - DNA, 17 bp, Homo sapiens
gcactgaagtgcttagt

SEQ ID NO: 4081307 - DNA, 16 bp, Homo sapiens
gcactgactgggcata

SEQ ID NO: 4081308 - DNA, 17 bp, Homo sapiens
gcactgactgggcatag

SEQ ID NO: 4081309 - DNA, 15 bp, Homo sapiens
gcactgagatattta

SEQ ID NO: 4081310 - DNA, 20 bp, Homo sapiens
gcactgagctcacatgggac

SEQ ID NO: 4081311 - DNA, 13 bp, Homo sapiens
gcactgagggcca

SEQ ID NO: 4081312 - DNA, 12 bp, Homo sapiens
gcactgatttca

SEQ ID NO: 4081313 - DNA, 15 bp, Homo sapiens
gcactgatttcacaa

SEQ ID NO: 4081314 - DNA, 13 bp, Homo sapiens
gcactgccttctc

SEQ ID NO: 4081315 - DNA, 22 bp, Homo sapiens
gcactgccttctcctctctggg

SEQ ID NO: 4081316 - DNA, 14 bp, Homo sapiens
gcactggagtgcag

SEQ ID NO: 4081317 - DNA, 12 bp, Homo sapiens
gcactggcccag

SEQ ID NO: 4081318 - DNA, 14 bp, Homo sapiens
gcactgggaggcag

SEQ ID NO: 4081319 - DNA, 19 bp, Homo sapiens
gcactgggaggcagggctc

SEQ ID NO: 4081320 - DNA, 23 bp, Homo sapiens
gcactgggatgagccgctgtgag

SEQ ID NO: 4081321 - DNA, 13 bp, Homo sapiens
gcactgggccacg

SEQ ID NO: 4081322 - DNA, 15 bp, Homo sapiens
gcactggggagcccg

SEQ ID NO: 4081323 - DNA, 18 bp, Homo sapiens
gcactggggagcccgtct

SEQ ID NO: 4081324 - DNA, 23 bp, Homo sapiens
gcactggtaggttgggacaccag

SEQ ID NO: 4081325 - DNA, 14 bp, Homo sapiens
gcactggtgccaaa

SEQ ID NO: 4081326 - DNA, 21 bp, Homo sapiens
gcactggtgccaaaaccaggc

SEQ ID NO: 4081327 - DNA, 19 bp, Homo sapiens
gcactggtggcccgacagc

SEQ ID NO: 4081328 - DNA, 20 bp, Homo sapiens
gcactggtgtgaactcaccc

SEQ ID NO: 4081329 - DNA, 16 bp, Homo sapiens
gcactgtcactttgct

SEQ ID NO: 4081330 - DNA, 11 bp, Homo sapiens
gcactgtgaag

SEQ ID NO: 4081331 - DNA, 19 bp, Homo sapiens
gcgggcagagggctggagg

SEQ ID NO: 4081332 - DNA, 17 bp, Homo sapiens
gcgggcagcgggccagg

SEQ ID NO: 4081333 - DNA, 18 bp, Homo sapiens
gcgggcaggttctgcctg

SEQ ID NO: 4081334 - DNA, 23 bp, Homo sapiens
gcgggccaggcccgcaccccggc

SEQ ID NO: 4081335 - DNA, 18 bp, Homo sapiens
gcgggccatgagggacag

SEQ ID NO: 4081336 - DNA, 19 bp, Homo sapiens
gcgggcggctgggtctgtg

SEQ ID NO: 4081337 - DNA, 19 bp, Homo sapiens
gcgggctaacgggaggctg

SEQ ID NO: 4081338 - DNA, 21 bp, Homo sapiens
gcgggctaacgggaggctggg

SEQ ID NO: 4081339 - DNA, 23 bp, Homo sapiens
gcgggctaacgggaggctgggca

SEQ ID NO: 4081340 - DNA, 15 bp, Homo sapiens
gcgggctgaggccag

SEQ ID NO: 4081341 - DNA, 17 bp, Homo sapiens
gcgggctgaggccagag

SEQ ID NO: 4081342 - DNA, 14 bp, Homo sapiens
gcggggtgctgtgg

SEQ ID NO: 4081343 - DNA, 19 bp, Homo sapiens
gcgggtggatcacgaggtc

SEQ ID NO: 4081344 - DNA, 21 bp, Homo sapiens
gcggtagccagcacacagggc

SEQ ID NO: 4081345 - DNA, 18 bp, Homo sapiens
gcggtccctgtccctcta

SEQ ID NO: 4081346 - DNA, 21 bp, Homo sapiens
gcggtccctgtccctctagtg

SEQ ID NO: 4081347 - DNA, 15 bp, Homo sapiens
gcggtgccatgtctg

SEQ ID NO: 4081348 - DNA, 21 bp, Homo sapiens
gcggtgccatgtctgcagtgt

SEQ ID NO: 4081349 - DNA, 18 bp, Homo sapiens
gcggtgcccaaccacact

SEQ ID NO: 4081350 - DNA, 15 bp, Homo sapiens
gcggtggctcacgcc

SEQ ID NO: 4081351 - DNA, 13 bp, Homo sapiens
gcggtgggtgctg

SEQ ID NO: 4081352 - DNA, 19 bp, Homo sapiens
gcggttcctcatctgagag

SEQ ID NO: 4081353 - DNA, 14 bp, Homo sapiens
gcgtcatctggtcc

SEQ ID NO: 4081354 - DNA, 20 bp, Homo sapiens
gcgtcctcctcacctcatgc

SEQ ID NO: 4081355 - DNA, 11 bp, Homo sapiens
gcgtctcctgt

SEQ ID NO: 4081356 - DNA, 11 bp, Homo sapiens
gcgtgaaacac

SEQ ID NO: 4081357 - DNA, 12 bp, Homo sapiens
gcgtgaaacaca

SEQ ID NO: 4081358 - DNA, 23 bp, Homo sapiens
gcgtgaaacacaccaggctgtgg

SEQ ID NO: 4081359 - DNA, 23 bp, Homo sapiens
gcgtgaacccgggaggcggagct

SEQ ID NO: 4081360 - DNA, 23 bp, Homo sapiens
gcgtgccagtcaagaagaaaaag

SEQ ID NO: 4081361 - DNA, 14 bp, Homo sapiens
gcgtgccctcgctg

SEQ ID NO: 4081362 - DNA, 17 bp, Homo sapiens
gcgtgccgtgtgagtgt

SEQ ID NO: 4081363 - DNA, 14 bp, Homo sapiens
gcgtggaaaaagac

SEQ ID NO: 4081364 - DNA, 15 bp, Homo sapiens
gcgtgggagccagcc

SEQ ID NO: 4081365 - DNA, 20 bp, Homo sapiens
gcgtgggctgaccaggcttc

SEQ ID NO: 4081366 - DNA, 22 bp, Homo sapiens
gcgtgtgtagagttaagaagct

SEQ ID NO: 4081367 - DNA, 14 bp, Homo sapiens
gcgttcccagcagg

SEQ ID NO: 4081368 - DNA, 18 bp, Homo sapiens
gcgttctgctgcccctgc

SEQ ID NO: 4081369 - DNA, 20 bp, Homo sapiens
gcgtttttttacaacattca

SEQ ID NO: 4081370 - DNA, 17 bp, Homo sapiens
gctaaactccttcctgg

SEQ ID NO: 4081371 - DNA, 14 bp, Homo sapiens
gctaaagagccctt

SEQ ID NO: 4081372 - DNA, 23 bp, Homo sapiens
gctaaagagcccttgcctcccca

SEQ ID NO: 4081373 - DNA, 12 bp, Homo sapiens
gctaaataaatg

SEQ ID NO: 4081374 - DNA, 19 bp, Homo sapiens
gctaaatgcctaataaaca

SEQ ID NO: 4081375 - DNA, 19 bp, Homo sapiens
gctaaatggtcgcccagga

SEQ ID NO: 4081376 - DNA, 16 bp, Homo sapiens
gctaaattctatgtta

SEQ ID NO: 4081377 - DNA, 22 bp, Homo sapiens
gctaaattctatgttaaatact

SEQ ID NO: 4081378 - DNA, 14 bp, Homo sapiens
gctaacaaagacaa

SEQ ID NO: 4081379 - DNA, 16 bp, Homo sapiens
gctaacaatgtctggt

SEQ ID NO: 4081380 - DNA, 20 bp, Homo sapiens
gctaacacggtgaaaccccg

SEQ ID NO: 4081381 - DNA, 22 bp, Homo sapiens
gctaaccccaagctgcctctgg

SEQ ID NO: 4081382 - DNA, 21 bp, Homo sapiens
gctaacccccttctactgagc

SEQ ID NO: 4081383 - DNA, 19 bp, Homo sapiens
gctaacgggaggctgggca

SEQ ID NO: 4081384 - DNA, 18 bp, Homo sapiens
gctaagcatattttctct

SEQ ID NO: 4081385 - DNA, 15 bp, Homo sapiens
gctaagctggctctg

SEQ ID NO: 4081386 - DNA, 17 bp, Homo sapiens
gctaaggacatttccca

SEQ ID NO: 4081387 - DNA, 23 bp, Homo sapiens
gctaaggcccccaaacatagccc

SEQ ID NO: 4081388 - DNA, 22 bp, Homo sapiens
gctaagggtgggtgctcagaat

SEQ ID NO: 4081389 - DNA, 13 bp, Homo sapiens
gctaagtgaaaag

SEQ ID NO: 4081390 - DNA, 13 bp, Homo sapiens
gctaataaactgt

SEQ ID NO: 4081391 - DNA, 14 bp, Homo sapiens
gctaataaactgtt

SEQ ID NO: 4081392 - DNA, 15 bp, Homo sapiens
gctaataaactgttt

SEQ ID NO: 4081393 - DNA, 18 bp, Homo sapiens
gctaataaactgtttttt

SEQ ID NO: 4081394 - DNA, 20 bp, Homo sapiens
gctaatcaaagccagggtct

SEQ ID NO: 4081395 - DNA, 16 bp, Homo sapiens
gctaatcagcattctc

SEQ ID NO: 4081396 - DNA, 17 bp, Homo sapiens
gctaatctgtagggctg

SEQ ID NO: 4081397 - DNA, 20 bp, Homo sapiens
gctaattcccagagtgtgaa

SEQ ID NO: 4081398 - DNA, 15 bp, Homo sapiens
gctaatttaaagaga

SEQ ID NO: 4081399 - DNA, 16 bp, Homo sapiens
gctaatttaaagagac

SEQ ID NO: 4081400 - DNA, 23 bp, Homo sapiens
gctaatttagagataggaaactg

SEQ ID NO: 4081401 - DNA, 13 bp, Homo sapiens
gctaatttgcatt

SEQ ID NO: 4081402 - DNA, 14 bp, Homo sapiens
gctaattttctcaa

SEQ ID NO: 4081403 - DNA, 19 bp, Homo sapiens
gctacagctttcttgctcc

SEQ ID NO: 4081404 - DNA, 21 bp, Homo sapiens
gctacagctttcttgctccct

SEQ ID NO: 4081405 - DNA, 20 bp, Homo sapiens
gctacaggaggggtctcatg

SEQ ID NO: 4081406 - DNA, 13 bp, Homo sapiens
gctacattataaa

SEQ ID NO: 4081407 - DNA, 21 bp, Homo sapiens
gctaccctttttctccagctg

SEQ ID NO: 4081408 - DNA, 19 bp, Homo sapiens
gctaccgccctgggctgga

SEQ ID NO: 4081409 - DNA, 12 bp, Homo sapiens
gctacctccctc

SEQ ID NO: 4081410 - DNA, 14 bp, Homo sapiens
gctacctctctgtc

SEQ ID NO: 4081411 - DNA, 16 bp, Homo sapiens
gctacctctctgtccc

SEQ ID NO: 4081412 - DNA, 22 bp, Homo sapiens
gctacctctctgtcccttgctg

SEQ ID NO: 4081413 - DNA, 14 bp, Homo sapiens
gctacgaatcttcc

SEQ ID NO: 4081414 - DNA, 23 bp, Homo sapiens
gctactctccccacgagggctgg

SEQ ID NO: 4081415 - DNA, 16 bp, Homo sapiens
gctactgatgaaatct

SEQ ID NO: 4081416 - DNA, 20 bp, Homo sapiens
gctactgcactccagcctgg

SEQ ID NO: 4081417 - DNA, 21 bp, Homo sapiens
gctacttaattcctttctcat

SEQ ID NO: 4081418 - DNA, 23 bp, Homo sapiens
gctacttaattcctttctcatcc

SEQ ID NO: 4081419 - DNA, 19 bp, Homo sapiens
gctacttcctcctccccac

SEQ ID NO: 4081420 - DNA, 15 bp, Homo sapiens
gctacttggtttgtg

SEQ ID NO: 4081421 - DNA, 18 bp, Homo sapiens
gctagaaaaatgttcttt

SEQ ID NO: 4081422 - DNA, 18 bp, Homo sapiens
gctagaaatatgatttta

SEQ ID NO: 4081423 - DNA, 21 bp, Homo sapiens
gctagagaaatcagctgctat

SEQ ID NO: 4081424 - DNA, 21 bp, Homo sapiens
gctagaggccagccccaccca

SEQ ID NO: 4081425 - DNA, 16 bp, Homo sapiens
gctagagtcctcactc

SEQ ID NO: 4081426 - DNA, 18 bp, Homo sapiens
gctagagtcctcactccc

SEQ ID NO: 4081427 - DNA, 20 bp, Homo sapiens
gctagagtcctcactcccag

SEQ ID NO: 4081428 - DNA, 17 bp, Homo sapiens
gctagagtgggaagagg

SEQ ID NO: 4081429 - DNA, 23 bp, Homo sapiens
gctagcagaaatctagaagactg

SEQ ID NO: 4081430 - DNA, 14 bp, Homo sapiens
gctagcatccctga

SEQ ID NO: 4081431 - DNA, 22 bp, Homo sapiens
gctccatcccaaccaggcacct

SEQ ID NO: 4081432 - DNA, 19 bp, Homo sapiens
gctcccacagaacacagca

SEQ ID NO: 4081433 - DNA, 17 bp, Homo sapiens
gctcccacaggcccttc

SEQ ID NO: 4081434 - DNA, 20 bp, Homo sapiens
gctcccacaggcccttcctc

SEQ ID NO: 4081435 - DNA, 22 bp, Homo sapiens
gctcccacaggcccttcctctc

SEQ ID NO: 4081436 - DNA, 15 bp, Homo sapiens
gctcccagcctgctg

SEQ ID NO: 4081437 - DNA, 12 bp, Homo sapiens
gctcccagggca

SEQ ID NO: 4081438 - DNA, 16 bp, Homo sapiens
gctcccaggggtctcc

SEQ ID NO: 4081439 - DNA, 20 bp, Homo sapiens
gctcccaggttcccccagca

SEQ ID NO: 4081440 - DNA, 19 bp, Homo sapiens
gctccccacagcgtccctg

SEQ ID NO: 4081441 - DNA, 20 bp, Homo sapiens
gctccccacagcgtccctgg

SEQ ID NO: 4081442 - DNA, 18 bp, Homo sapiens
gctccccagccctggctc

SEQ ID NO: 4081443 - DNA, 14 bp, Homo sapiens
gctccccaggagct

SEQ ID NO: 4081444 - DNA, 19 bp, Homo sapiens
gctccccaggagctcaggt

SEQ ID NO: 4081445 - DNA, 12 bp, Homo sapiens
gctccccatgtg

SEQ ID NO: 4081446 - DNA, 14 bp, Homo sapiens
gctcccccagctcc

SEQ ID NO: 4081447 - DNA, 13 bp, Homo sapiens
gctcccccttttc

SEQ ID NO: 4081448 - DNA, 18 bp, Homo sapiens
gctcccctctgcttctca

SEQ ID NO: 4081449 - DNA, 21 bp, Homo sapiens
gctcccctctgcttctcatcc

SEQ ID NO: 4081450 - DNA, 18 bp, Homo sapiens
gctccctaaactttggcc

SEQ ID NO: 4081451 - DNA, 20 bp, Homo sapiens
gctccctaccccagggccct

SEQ ID NO: 4081452 - DNA, 21 bp, Homo sapiens
gctccctagactgcatcccgt

SEQ ID NO: 4081453 - DNA, 11 bp, Homo sapiens
gctccctcagc

SEQ ID NO: 4081454 - DNA, 12 bp, Homo sapiens
gctccctcagcc

SEQ ID NO: 4081455 - DNA, 13 bp, Homo sapiens
gctccctcagcct

SEQ ID NO: 4081456 - DNA, 18 bp, Homo sapiens
gctccctcagcctcagag

SEQ ID NO: 4081457 - DNA, 19 bp, Homo sapiens
gctccctcagcctcagagg

SEQ ID NO: 4081458 - DNA, 21 bp, Homo sapiens
gctccctcagcctcagaggag

SEQ ID NO: 4081459 - DNA, 12 bp, Homo sapiens
gctccctccaga

SEQ ID NO: 4081460 - DNA, 13 bp, Homo sapiens
gctccctccagaa

SEQ ID NO: 4081461 - DNA, 20 bp, Homo sapiens
gctccctgctttggctgagg

SEQ ID NO: 4081462 - DNA, 21 bp, Homo sapiens
gctccctgtgtccacctgtgg

SEQ ID NO: 4081463 - DNA, 20 bp, Homo sapiens
gctcccttcagcccccagcc

SEQ ID NO: 4081464 - DNA, 15 bp, Homo sapiens
gctccgggctccgac

SEQ ID NO: 4081465 - DNA, 16 bp, Homo sapiens
gctcctacctctgtgc

SEQ ID NO: 4081466 - DNA, 19 bp, Homo sapiens
gctcctacctctgtgccag

SEQ ID NO: 4081467 - DNA, 17 bp, Homo sapiens
gctcctagcagacagaa

SEQ ID NO: 4081468 - DNA, 22 bp, Homo sapiens
gctcctagcagacagaaactgg

SEQ ID NO: 4081469 - DNA, 13 bp, Homo sapiens
gctcctcagagcg

SEQ ID NO: 4081470 - DNA, 11 bp, Homo sapiens
gctcctcccac

SEQ ID NO: 4081471 - DNA, 14 bp, Homo sapiens
gctcctcctgccct

SEQ ID NO: 4081472 - DNA, 19 bp, Homo sapiens
gctcctctccccagcccag

SEQ ID NO: 4081473 - DNA, 21 bp, Homo sapiens
gctcctctccccagcccagag

SEQ ID NO: 4081474 - DNA, 22 bp, Homo sapiens
gctcctctccccagcccagaga

SEQ ID NO: 4081475 - DNA, 23 bp, Homo sapiens
gctcctctccccagcccagagac

SEQ ID NO: 4081476 - DNA, 14 bp, Homo sapiens
gctcctctcctgga

SEQ ID NO: 4081477 - DNA, 17 bp, Homo sapiens
gctcctctcctggagga

SEQ ID NO: 4081478 - DNA, 18 bp, Homo sapiens
gctcctcttgattcctgg

SEQ ID NO: 4081479 - DNA, 14 bp, Homo sapiens
gctcctgcagcatg

SEQ ID NO: 4081480 - DNA, 20 bp, Homo sapiens
gctcctgcatctcatgagtg

SEQ ID NO: 4081481 - DNA, 11 bp, Homo sapiens
gctcctgccca

SEQ ID NO: 4081482 - DNA, 21 bp, Homo sapiens
gctcctgccgcagacgggcac

SEQ ID NO: 4081483 - DNA, 23 bp, Homo sapiens
gctcctgccgcagacgggcacag

SEQ ID NO: 4081484 - DNA, 14 bp, Homo sapiens
gctcctgctgcgga

SEQ ID NO: 4081485 - DNA, 21 bp, Homo sapiens
gctcctgcttttctgtcctgg

SEQ ID NO: 4081486 - DNA, 23 bp, Homo sapiens
gctcctgcttttctgtcctgggc

SEQ ID NO: 4081487 - DNA, 22 bp, Homo sapiens
gctcctggaaccaatcccgtga

SEQ ID NO: 4081488 - DNA, 13 bp, Homo sapiens
gctcctgtcctcc

SEQ ID NO: 4081489 - DNA, 19 bp, Homo sapiens
gctccttagggttttctct

SEQ ID NO: 4081490 - DNA, 22 bp, Homo sapiens
gctccttagggttttctctcta

SEQ ID NO: 4081491 - DNA, 18 bp, Homo sapiens
gctccttcccatcgctgt

SEQ ID NO: 4081492 - DNA, 18 bp, Homo sapiens
gctccttgagtaaaaagg

SEQ ID NO: 4081493 - DNA, 16 bp, Homo sapiens
gctcctttctccagcc

SEQ ID NO: 4081494 - DNA, 18 bp, Homo sapiens
gctcctttctccagccag

SEQ ID NO: 4081495 - DNA, 20 bp, Homo sapiens
gctcctttgtgtgtgtgtca

SEQ ID NO: 4081496 - DNA, 18 bp, Homo sapiens
gctcgaaatggcccctgt

SEQ ID NO: 4081497 - DNA, 17 bp, Homo sapiens
gctcgagcagtcctgcc

SEQ ID NO: 4081498 - DNA, 21 bp, Homo sapiens
gctcgagcagtcctgcctcag

SEQ ID NO: 4081499 - DNA, 17 bp, Homo sapiens
gctcgatgcagacaggg

SEQ ID NO: 4081500 - DNA, 16 bp, Homo sapiens
gctcgcacccccctgt

SEQ ID NO: 4081501 - DNA, 14 bp, Homo sapiens
gctcgcgggcagcg

SEQ ID NO: 4081502 - DNA, 17 bp, Homo sapiens
gctcggaggctgccccc

SEQ ID NO: 4081503 - DNA, 18 bp, Homo sapiens
gctcggaggctgcccccg

SEQ ID NO: 4081504 - DNA, 18 bp, Homo sapiens
gctcgtttttcagcaccc

SEQ ID NO: 4081505 - DNA, 21 bp, Homo sapiens
gctcgtttttcagcaccccca

SEQ ID NO: 4081506 - DNA, 23 bp, Homo sapiens
gctcgtttttcagcacccccacc

SEQ ID NO: 4081507 - DNA, 12 bp, Homo sapiens
gctctaataaaa

SEQ ID NO: 4081508 - DNA, 20 bp, Homo sapiens
gctctacatcttctgcctta

SEQ ID NO: 4081509 - DNA, 20 bp, Homo sapiens
gctctacccatgagcctgcc

SEQ ID NO: 4081510 - DNA, 15 bp, Homo sapiens
gctctaccctgctcc

SEQ ID NO: 4081511 - DNA, 18 bp, Homo sapiens
gctctaccttcctgtccc

SEQ ID NO: 4081512 - DNA, 22 bp, Homo sapiens
gctctaccttcctgtccctgag

SEQ ID NO: 4081513 - DNA, 13 bp, Homo sapiens
gctctatttactt

SEQ ID NO: 4081514 - DNA, 21 bp, Homo sapiens
gctctatttacttctaatctt

SEQ ID NO: 4081515 - DNA, 18 bp, Homo sapiens
gctctcacccccatccct

SEQ ID NO: 4081516 - DNA, 11 bp, Homo sapiens
gctctcagaag

SEQ ID NO: 4081517 - DNA, 16 bp, Homo sapiens
gctctcagctcagcgc

SEQ ID NO: 4081518 - DNA, 14 bp, Homo sapiens
gctctcagctccgg

SEQ ID NO: 4081519 - DNA, 15 bp, Homo sapiens
gctctcagctccggg

SEQ ID NO: 4081520 - DNA, 13 bp, Homo sapiens
gctctctgagact

SEQ ID NO: 4081521 - DNA, 18 bp, Homo sapiens
gctctctgccctgtgtac

SEQ ID NO: 4081522 - DNA, 17 bp, Homo sapiens
gctctctgggacctcct

SEQ ID NO: 4081523 - DNA, 16 bp, Homo sapiens
gctctgacaagatggt

SEQ ID NO: 4081524 - DNA, 20 bp, Homo sapiens
gctctgacagaaagcagata

SEQ ID NO: 4081525 - DNA, 22 bp, Homo sapiens
gctctgacgtagaaagatcctt

SEQ ID NO: 4081526 - DNA, 21 bp, Homo sapiens
gctctgatattccatgaatgt

SEQ ID NO: 4081527 - DNA, 20 bp, Homo sapiens
gctggcccagggcccagagc

SEQ ID NO: 4081528 - DNA, 20 bp, Homo sapiens
gctggccccagggcaccctg

SEQ ID NO: 4081529 - DNA, 20 bp, Homo sapiens
gctggccctgcctcctggga

SEQ ID NO: 4081530 - DNA, 15 bp, Homo sapiens
gctggccgagggtcc

SEQ ID NO: 4081531 - DNA, 24 bp, Homo sapiens
gctggccgagggtcctggctcctg

SEQ ID NO: 4081532 - DNA, 15 bp, Homo sapiens
gctggccgggggagg

SEQ ID NO: 4081533 - DNA, 22 bp, Homo sapiens
gctggcctcccaaatgagccat

SEQ ID NO: 4081534 - DNA, 12 bp, Homo sapiens
gctggcctgagc

SEQ ID NO: 4081535 - DNA, 14 bp, Homo sapiens
gctggcctggatct

SEQ ID NO: 4081536 - DNA, 20 bp, Homo sapiens
gctggcgcatattaagcact

SEQ ID NO: 4081537 - DNA, 16 bp, Homo sapiens
gctggctcacagtaca

SEQ ID NO: 4081538 - DNA, 14 bp, Homo sapiens
gctggctccagatg

SEQ ID NO: 4081539 - DNA, 15 bp, Homo sapiens
gctggctccagcctg

SEQ ID NO: 4081540 - DNA, 18 bp, Homo sapiens
gctggctccccctcccca

SEQ ID NO: 4081541 - DNA, 22 bp, Homo sapiens
gctggctccccctccccaggct

SEQ ID NO: 4081542 - DNA, 13 bp, Homo sapiens
gctggctcctagg

SEQ ID NO: 4081543 - DNA, 14 bp, Homo sapiens
gctggctcctaggg

SEQ ID NO: 4081544 - DNA, 22 bp, Homo sapiens
gctggctctaccttcctgtccc

SEQ ID NO: 4081545 - DNA, 16 bp, Homo sapiens
gctggctcttctgccc

SEQ ID NO: 4081546 - DNA, 11 bp, Homo sapiens
gctggctgcct

SEQ ID NO: 4081547 - DNA, 16 bp, Homo sapiens
gctggcttccagcttc

SEQ ID NO: 4081548 - DNA, 19 bp, Homo sapiens
gctggcttccagcttcagg

SEQ ID NO: 4081549 - DNA, 20 bp, Homo sapiens
gctggcttccagcttcaggc

SEQ ID NO: 4081550 - DNA, 20 bp, Homo sapiens
gctggctttgaaacctcagg

SEQ ID NO: 4081551 - DNA, 23 bp, Homo sapiens
gctgggaagagaagagggcccag

SEQ ID NO: 4081552 - DNA, 14 bp, Homo sapiens
gctgggaccagagc

SEQ ID NO: 4081553 - DNA, 16 bp, Homo sapiens
gctgggaccagagcca

SEQ ID NO: 4081554 - DNA, 16 bp, Homo sapiens
gctgggacgctctgct

SEQ ID NO: 4081555 - DNA, 21 bp, Homo sapiens
gctgggacgtggctcagccag

SEQ ID NO: 4081556 - DNA, 18 bp, Homo sapiens
gctgggaggagggagagg

SEQ ID NO: 4081557 - DNA, 22 bp, Homo sapiens
gctgggaggagggagagggagg

SEQ ID NO: 4081558 - DNA, 20 bp, Homo sapiens
gctgggaggcatggccctgg

SEQ ID NO: 4081559 - DNA, 13 bp, Homo sapiens
gctgggagtccct

SEQ ID NO: 4081560 - DNA, 21 bp, Homo sapiens
gctgggagtccctacctgctt

SEQ ID NO: 4081561 - DNA, 13 bp, Homo sapiens
gctgggagttcta

SEQ ID NO: 4081562 - DNA, 21 bp, Homo sapiens
gctgggagttctagaaccact

SEQ ID NO: 4081563 - DNA, 22 bp, Homo sapiens
gctgggagttctagaaccactt

SEQ ID NO: 4081564 - DNA, 18 bp, Homo sapiens
gctgggcagccccagaga

SEQ ID NO: 4081565 - DNA, 17 bp, Homo sapiens
gctgggccatgtccaaa

SEQ ID NO: 4081566 - DNA, 13 bp, Homo sapiens
gctgggcccctgg

SEQ ID NO: 4081567 - DNA, 15 bp, Homo sapiens
gctgggcccctggga

SEQ ID NO: 4081568 - DNA, 18 bp, Homo sapiens
gctgggcccctgggatgg

SEQ ID NO: 4081569 - DNA, 13 bp, Homo sapiens
gctgggctccctg

SEQ ID NO: 4081570 - DNA, 21 bp, Homo sapiens
gctgggctccctgatgacacc

SEQ ID NO: 4081571 - DNA, 13 bp, Homo sapiens
gctgggctctgca

SEQ ID NO: 4081572 - DNA, 14 bp, Homo sapiens
gctgggctgagtga

SEQ ID NO: 4081573 - DNA, 12 bp, Homo sapiens
gctgggctgggc

SEQ ID NO: 4081574 - DNA, 13 bp, Homo sapiens
gctggggacagag

SEQ ID NO: 4081575 - DNA, 13 bp, Homo sapiens
gctggggactcag

SEQ ID NO: 4081576 - DNA, 15 bp, Homo sapiens
gctggggcagcctct

SEQ ID NO: 4081577 - DNA, 17 bp, Homo sapiens
gctggggcagggggtga

SEQ ID NO: 4081578 - DNA, 13 bp, Homo sapiens
gctggggccacca

SEQ ID NO: 4081579 - DNA, 20 bp, Homo sapiens
gctgggggaatgagcccaga

SEQ ID NO: 4081580 - DNA, 21 bp, Homo sapiens
gctgggggaggtccaagcaga

SEQ ID NO: 4081581 - DNA, 13 bp, Homo sapiens
gctgggggcagga

SEQ ID NO: 4081582 - DNA, 20 bp, Homo sapiens
gctggggggttggcagccca

SEQ ID NO: 4081583 - DNA, 12 bp, Homo sapiens
gctggggtgtca

SEQ ID NO: 4081584 - DNA, 14 bp, Homo sapiens
gctggggtgtcaat

SEQ ID NO: 4081585 - DNA, 13 bp, Homo sapiens
gctgggtcaggca

SEQ ID NO: 4081586 - DNA, 14 bp, Homo sapiens
gctgggtcaggcag

SEQ ID NO: 4081587 - DNA, 20 bp, Homo sapiens
gctgggtctaatccttctca

SEQ ID NO: 4081588 - DNA, 15 bp, Homo sapiens
gctgggtggggacag

SEQ ID NO: 4081589 - DNA, 13 bp, Homo sapiens
gctgggtgtttca

SEQ ID NO: 4081590 - DNA, 17 bp, Homo sapiens
gctgggtttgctgtctt

SEQ ID NO: 4081591 - DNA, 18 bp, Homo sapiens
gctggtaacagtggctgc

SEQ ID NO: 4081592 - DNA, 13 bp, Homo sapiens
gctggtaacagtt

SEQ ID NO: 4081593 - DNA, 16 bp, Homo sapiens
gctggtatctcagaaa

SEQ ID NO: 4081594 - DNA, 18 bp, Homo sapiens
gctggtcacagcctcctc

SEQ ID NO: 4081595 - DNA, 21 bp, Homo sapiens
gctggtcacttcttctgtcca

SEQ ID NO: 4081596 - DNA, 22 bp, Homo sapiens
gctggtcacttcttctgtccaa

SEQ ID NO: 4081597 - DNA, 14 bp, Homo sapiens
gctggtccagggct

SEQ ID NO: 4081598 - DNA, 22 bp, Homo sapiens
gctggtcccctccctctgtctt

SEQ ID NO: 4081599 - DNA, 13 bp, Homo sapiens
gctggtgcattac

SEQ ID NO: 4081600 - DNA, 14 bp, Homo sapiens
gctggtgccccaca

SEQ ID NO: 4081601 - DNA, 13 bp, Homo sapiens
gctggtgcccgga

SEQ ID NO: 4081602 - DNA, 19 bp, Homo sapiens
gctggtgctgtggccaggg

SEQ ID NO: 4081603 - DNA, 12 bp, Homo sapiens
gctgtaaaagca

SEQ ID NO: 4081604 - DNA, 14 bp, Homo sapiens
gctgtaaaatcttg

SEQ ID NO: 4081605 - DNA, 20 bp, Homo sapiens
gctgtaaaatgcatgatttt

SEQ ID NO: 4081606 - DNA, 16 bp, Homo sapiens
gctgtaagaagagact

SEQ ID NO: 4081607 - DNA, 12 bp, Homo sapiens
gctgtacatcta

SEQ ID NO: 4081608 - DNA, 16 bp, Homo sapiens
gctgtacatctatttt

SEQ ID NO: 4081609 - DNA, 15 bp, Homo sapiens
gctgtatgctgatca

SEQ ID NO: 4081610 - DNA, 15 bp, Homo sapiens
gctgtattgtctgaa

SEQ ID NO: 4081611 - DNA, 13 bp, Homo sapiens
gctgtcactggct

SEQ ID NO: 4081612 - DNA, 14 bp, Homo sapiens
gctgtcactggctg

SEQ ID NO: 4081613 - DNA, 11 bp, Homo sapiens
gctgtcccagc

SEQ ID NO: 4081614 - DNA, 23 bp, Homo sapiens
gctgtccccttggcaggtcctgg

SEQ ID NO: 4081615 - DNA, 14 bp, Homo sapiens
gctgtcctgatctg

SEQ ID NO: 4081616 - DNA, 14 bp, Homo sapiens
gctgtcgccccagg

SEQ ID NO: 4081617 - DNA, 17 bp, Homo sapiens
gctgtcgccccaggccc

SEQ ID NO: 4081618 - DNA, 19 bp, Homo sapiens
gctgtctaacccccagctg

SEQ ID NO: 4081619 - DNA, 13 bp, Homo sapiens
gctgtctagaatg

SEQ ID NO: 4081620 - DNA, 17 bp, Homo sapiens
gctgtctccatgtttga

SEQ ID NO: 4081621 - DNA, 14 bp, Homo sapiens
gctgtctctgctcg

SEQ ID NO: 4081622 - DNA, 16 bp, Homo sapiens
gctgtctgtcaccagc

SEQ ID NO: 4081623 - DNA, 21 bp, Homo sapiens
gctgtctgtcaccagctatct

SEQ ID NO: 4081624 - DNA, 16 bp, Homo sapiens
gctgtcttccccaccg

SEQ ID NO: 4081625 - DNA, 19 bp, Homo sapiens
gctgtgaaccctggggcct

SEQ ID NO: 4081626 - DNA, 17 bp, Homo sapiens
gctgtgacttctccagg

SEQ ID NO: 4081627 - DNA, 16 bp, Homo sapiens
gctgtgaggcccctgg

SEQ ID NO: 4081628 - DNA, 15 bp, Homo sapiens
gctgtgaggctgtcc

SEQ ID NO: 4081629 - DNA, 16 bp, Homo sapiens
gctgtgaggctgtcct

SEQ ID NO: 4081630 - DNA, 13 bp, Homo sapiens
gctgtgagggagg

SEQ ID NO: 4081631 - DNA, 18 bp, Homo sapiens
gctctggacagcagaagc

SEQ ID NO: 4081632 - DNA, 19 bp, Homo sapiens
gctctggacagccccaccc

SEQ ID NO: 4081633 - DNA, 22 bp, Homo sapiens
gctctggacagccccaccctgg

SEQ ID NO: 4081634 - DNA, 20 bp, Homo sapiens
gctctggggacagcttcctc

SEQ ID NO: 4081635 - DNA, 19 bp, Homo sapiens
gctctggttgtttctgttc

SEQ ID NO: 4081636 - DNA, 15 bp, Homo sapiens
gctctgtccccaaag

SEQ ID NO: 4081637 - DNA, 16 bp, Homo sapiens
gctctgtccccaaagg

SEQ ID NO: 4081638 - DNA, 19 bp, Homo sapiens
gctctgtcccccaggctgg

SEQ ID NO: 4081639 - DNA, 14 bp, Homo sapiens
gctctgtgcagtca

SEQ ID NO: 4081640 - DNA, 21 bp, Homo sapiens
gctctgtgcagtcactggagg

SEQ ID NO: 4081641 - DNA, 18 bp, Homo sapiens
gctctgtgttcccagagg

SEQ ID NO: 4081642 - DNA, 16 bp, Homo sapiens
gctcttagcagcttcc

SEQ ID NO: 4081643 - DNA, 18 bp, Homo sapiens
gctcttagcagcttccag

SEQ ID NO: 4081644 - DNA, 16 bp, Homo sapiens
gctcttagtcccaagc

SEQ ID NO: 4081645 - DNA, 18 bp, Homo sapiens
gctcttagtcccaagcta

SEQ ID NO: 4081646 - DNA, 19 bp, Homo sapiens
gctcttatgtgtgcctttg

SEQ ID NO: 4081647 - DNA, 12 bp, Homo sapiens
gctcttcaggcc

SEQ ID NO: 4081648 - DNA, 23 bp, Homo sapiens
gctcttctcctttcacaaccttc

SEQ ID NO: 4081649 - DNA, 23 bp, Homo sapiens
gctcttctgcccaattggaggaa

SEQ ID NO: 4081650 - DNA, 20 bp, Homo sapiens
gctcttgatacccccctctg

SEQ ID NO: 4081651 - DNA, 23 bp, Homo sapiens
gctcttgatacccccctctgtct

SEQ ID NO: 4081652 - DNA, 14 bp, Homo sapiens
gctcttggcccctg

SEQ ID NO: 4081653 - DNA, 19 bp, Homo sapiens
gctcttggcccctgtgtga

SEQ ID NO: 4081654 - DNA, 17 bp, Homo sapiens
gctcttggcctttgcat

SEQ ID NO: 4081655 - DNA, 16 bp, Homo sapiens
gctcttggctgacccc

SEQ ID NO: 4081656 - DNA, 18 bp, Homo sapiens
gctcttggctgacccctc

SEQ ID NO: 4081657 - DNA, 15 bp, Homo sapiens
gctcttgtcccacgt

SEQ ID NO: 4081658 - DNA, 23 bp, Homo sapiens
gctcttgtttttattaatttata

SEQ ID NO: 4081659 - DNA, 12 bp, Homo sapiens
gctctttcaggg

SEQ ID NO: 4081660 - DNA, 13 bp, Homo sapiens
gctctttcagggg

SEQ ID NO: 4081661 - DNA, 17 bp, Homo sapiens
gctctttcgtcaccctt

SEQ ID NO: 4081662 - DNA, 21 bp, Homo sapiens
gctctttgaaatagtctgtgt

SEQ ID NO: 4081663 - DNA, 23 bp, Homo sapiens
gctctttgagaactgcttctaag

SEQ ID NO: 4081664 - DNA, 22 bp, Homo sapiens
gctctttggggtcagccagggc

SEQ ID NO: 4081665 - DNA, 13 bp, Homo sapiens
gctcttttcctgg

SEQ ID NO: 4081666 - DNA, 21 bp, Homo sapiens
gctcttttcctggtgctcttt

SEQ ID NO: 4081667 - DNA, 20 bp, Homo sapiens
gctcttttttgtttgtttct

SEQ ID NO: 4081668 - DNA, 22 bp, Homo sapiens
gctcttttttgtttgtttcttt

SEQ ID NO: 4081669 - DNA, 12 bp, Homo sapiens
gctgaacacaca

SEQ ID NO: 4081670 - DNA, 15 bp, Homo sapiens
gctgaactccttgtt

SEQ ID NO: 4081671 - DNA, 17 bp, Homo sapiens
gctgaatggttttcaaa

SEQ ID NO: 4081672 - DNA, 14 bp, Homo sapiens
gctgaattatctat

SEQ ID NO: 4081673 - DNA, 13 bp, Homo sapiens
gctgaccacagca

SEQ ID NO: 4081674 - DNA, 12 bp, Homo sapiens
gctgaccagaca

SEQ ID NO: 4081675 - DNA, 22 bp, Homo sapiens
gctgaccccgagaagtgctctt

SEQ ID NO: 4081676 - DNA, 18 bp, Homo sapiens
gctgacctcccagtgacc

SEQ ID NO: 4081677 - DNA, 14 bp, Homo sapiens
gctgaccttgctga

SEQ ID NO: 4081678 - DNA, 15 bp, Homo sapiens
gctgacgtgtgaggg

SEQ ID NO: 4081679 - DNA, 23 bp, Homo sapiens
gctgactagaagggccagtcctg

SEQ ID NO: 4081680 - DNA, 16 bp, Homo sapiens
gctgactgggccaggg

SEQ ID NO: 4081681 - DNA, 20 bp, Homo sapiens
gctgactgtggccccctccg

SEQ ID NO: 4081682 - DNA, 19 bp, Homo sapiens
gctgacttcatctcccacc

SEQ ID NO: 4081683 - DNA, 14 bp, Homo sapiens
gctgagaactcctg

SEQ ID NO: 4081684 - DNA, 16 bp, Homo sapiens
gctgagaatgtggaat

SEQ ID NO: 4081685 - DNA, 15 bp, Homo sapiens
gctgagacaggagaa

SEQ ID NO: 4081686 - DNA, 21 bp, Homo sapiens
gctgagaccactgagtaccag

SEQ ID NO: 4081687 - DNA, 14 bp, Homo sapiens
gctgagcagcctct

SEQ ID NO: 4081688 - DNA, 11 bp, Homo sapiens
gctgagccctg

SEQ ID NO: 4081689 - DNA, 14 bp, Homo sapiens
gctgagccctgggg

SEQ ID NO: 4081690 - DNA, 20 bp, Homo sapiens
gctgagcctctgctccccag

SEQ ID NO: 4081691 - DNA, 18 bp, Homo sapiens
gctgagctgagtggccag

SEQ ID NO: 4081692 - DNA, 21 bp, Homo sapiens
gctgagcttcggttctccaga

SEQ ID NO: 4081693 - DNA, 16 bp, Homo sapiens
gctgaggaggcctcca

SEQ ID NO: 4081694 - DNA, 12 bp, Homo sapiens
gctgaggccagg

SEQ ID NO: 4081695 - DNA, 15 bp, Homo sapiens
gctgaggccagggct

SEQ ID NO: 4081696 - DNA, 22 bp, Homo sapiens
gctgaggccggatgcggtggct

SEQ ID NO: 4081697 - DNA, 16 bp, Homo sapiens
gctgaggcgggagaat

SEQ ID NO: 4081698 - DNA, 13 bp, Homo sapiens
gctgaggctggca

SEQ ID NO: 4081699 - DNA, 18 bp, Homo sapiens
gctgaggctggcacagga

SEQ ID NO: 4081700 - DNA, 15 bp, Homo sapiens
gctgagggcctgctg

SEQ ID NO: 4081701 - DNA, 16 bp, Homo sapiens
gctgagggcctgctgg

SEQ ID NO: 4081702 - DNA, 14 bp, Homo sapiens
gctgaggggcttgg

SEQ ID NO: 4081703 - DNA, 17 bp, Homo sapiens
gctgaggggcttgggaa

SEQ ID NO: 4081704 - DNA, 23 bp, Homo sapiens
gctgaggggggccgtgcccaggg

SEQ ID NO: 4081705 - DNA, 17 bp, Homo sapiens
gctgaggggtctcggat

SEQ ID NO: 4081706 - DNA, 17 bp, Homo sapiens
gctgaggtctcttgagg

SEQ ID NO: 4081707 - DNA, 17 bp, Homo sapiens
gctgagtgagccacaga

SEQ ID NO: 4081708 - DNA, 18 bp, Homo sapiens
gctgagtggccagccagt

SEQ ID NO: 4081709 - DNA, 19 bp, Homo sapiens
gctgagtggccagccagtg

SEQ ID NO: 4081710 - DNA, 17 bp, Homo sapiens
gctgagtgggagaaggc

SEQ ID NO: 4081711 - DNA, 15 bp, Homo sapiens
gctgagttctgggtt

SEQ ID NO: 4081712 - DNA, 14 bp, Homo sapiens
gctgagttggcctg

SEQ ID NO: 4081713 - DNA, 12 bp, Homo sapiens
gctgagtttcct

SEQ ID NO: 4081714 - DNA, 13 bp, Homo sapiens
gctgagtttccta

SEQ ID NO: 4081715 - DNA, 20 bp, Homo sapiens
gctgatcagagttcctccta

SEQ ID NO: 4081716 - DNA, 15 bp, Homo sapiens
gctgatgatccagaa

SEQ ID NO: 4081717 - DNA, 18 bp, Homo sapiens
gctgatggaggaaaaagg

SEQ ID NO: 4081718 - DNA, 13 bp, Homo sapiens
gctgatggcagct

SEQ ID NO: 4081719 - DNA, 20 bp, Homo sapiens
gctgatggcttgacatgtgc

SEQ ID NO: 4081720 - DNA, 14 bp, Homo sapiens
gctgattactgtca

SEQ ID NO: 4081721 - DNA, 21 bp, Homo sapiens
gctgattactgtcaataaaca

SEQ ID NO: 4081722 - DNA, 15 bp, Homo sapiens
gctgattttaacaat

SEQ ID NO: 4081723 - DNA, 14 bp, Homo sapiens
gctgcaagccaggg

SEQ ID NO: 4081724 - DNA, 15 bp, Homo sapiens
gctgcaatgcctaga

SEQ ID NO: 4081725 - DNA, 18 bp, Homo sapiens
gcttccccttttgccaat

SEQ ID NO: 4081726 - DNA, 16 bp, Homo sapiens
gcttcccgctcagccc

SEQ ID NO: 4081727 - DNA, 23 bp, Homo sapiens
gcttcccgctcagccctccctgc

SEQ ID NO: 4081728 - DNA, 17 bp, Homo sapiens
gcttccctccatccccc

SEQ ID NO: 4081729 - DNA, 17 bp, Homo sapiens
gcttccctgacttgctt

SEQ ID NO: 4081730 - DNA, 19 bp, Homo sapiens
gcttccctgacttgcttta

SEQ ID NO: 4081731 - DNA, 22 bp, Homo sapiens
gcttccgagatccccagggcag

SEQ ID NO: 4081732 - DNA, 23 bp, Homo sapiens
gcttccgagatccccagggcagc

SEQ ID NO: 4081733 - DNA, 17 bp, Homo sapiens
gcttccggtagggaggc

SEQ ID NO: 4081734 - DNA, 22 bp, Homo sapiens
gcttccggtagggaggcagcct

SEQ ID NO: 4081735 - DNA, 13 bp, Homo sapiens
gcttcctcacacc

SEQ ID NO: 4081736 - DNA, 16 bp, Homo sapiens
gcttcctcacacccct

SEQ ID NO: 4081737 - DNA, 17 bp, Homo sapiens
gcttcctcacacccctg

SEQ ID NO: 4081738 - DNA, 18 bp, Homo sapiens
gcttcctcacacccctgt

SEQ ID NO: 4081739 - DNA, 18 bp, Homo sapiens
gcttcctgacaatcaact

SEQ ID NO: 4081740 - DNA, 21 bp, Homo sapiens
gcttcctgcccttccctctgg

SEQ ID NO: 4081741 - DNA, 20 bp, Homo sapiens
gcttcctgcgtcctcctcac

SEQ ID NO: 4081742 - DNA, 22 bp, Homo sapiens
ggactttgcttcccctccagga

SEQ ID NO: 4081743 - DNA, 23 bp, Homo sapiens
ggactttgcttcccctccaggag

SEQ ID NO: 4081744 - DNA, 19 bp, Homo sapiens
ggagaaaatcaaaccgagc

SEQ ID NO: 4081745 - DNA, 20 bp, Homo sapiens
ggagaaaattcaattgtaaa

SEQ ID NO: 4081746 - DNA, 11 bp, Homo sapiens
ggagaaacaca

SEQ ID NO: 4081747 - DNA, 14 bp, Homo sapiens
ggagaaaccagctt

SEQ ID NO: 4081748 - DNA, 17 bp, Homo sapiens
ggagaagagtgccctgc

SEQ ID NO: 4081749 - DNA, 19 bp, Homo sapiens
ggagaagagtgccctgctt

SEQ ID NO: 4081750 - DNA, 22 bp, Homo sapiens
ggagaagcagctaacaatgtct

SEQ ID NO: 4081751 - DNA, 19 bp, Homo sapiens
ggagaagctcctctcccca

SEQ ID NO: 4081752 - DNA, 12 bp, Homo sapiens
ggagaaggatct

SEQ ID NO: 4081753 - DNA, 20 bp, Homo sapiens
ggagaaggatctagaatgtg

SEQ ID NO: 4081754 - DNA, 18 bp, Homo sapiens
ggagaatactttgcttca

SEQ ID NO: 4081755 - DNA, 23 bp, Homo sapiens
ggagaatactttgcttcatagta

SEQ ID NO: 4081756 - DNA, 12 bp, Homo sapiens
ggagaatatgat

SEQ ID NO: 4081757 - DNA, 17 bp, Homo sapiens
ggagaatcatgtgaacc

SEQ ID NO: 4081758 - DNA, 13 bp, Homo sapiens
ggagacagtgatc

SEQ ID NO: 4081759 - DNA, 16 bp, Homo sapiens
ggagaccacggggagc

SEQ ID NO: 4081760 - DNA, 15 bp, Homo sapiens
ggagaccagctcaga

SEQ ID NO: 4081761 - DNA, 15 bp, Homo sapiens
ggagaccccccccca

SEQ ID NO: 4081762 - DNA, 16 bp, Homo sapiens
ggagaccctgccacag

SEQ ID NO: 4081763 - DNA, 19 bp, Homo sapiens
ggagaccctgccacagcca

SEQ ID NO: 4081764 - DNA, 22 bp, Homo sapiens
ggagaccctgccacagccagag

SEQ ID NO: 4081765 - DNA, 23 bp, Homo sapiens
ggagaccctgccacagccagagg

SEQ ID NO: 4081766 - DNA, 14 bp, Homo sapiens
ggagacctgtgcta

SEQ ID NO: 4081767 - DNA, 15 bp, Homo sapiens
ggagacctgtgctag

SEQ ID NO: 4081768 - DNA, 19 bp, Homo sapiens
ggagacgtggaacctctgt

SEQ ID NO: 4081769 - DNA, 15 bp, Homo sapiens
gcagccccccagcac

SEQ ID NO: 4081770 - DNA, 16 bp, Homo sapiens
gcagccccctccacac

SEQ ID NO: 4081771 - DNA, 14 bp, Homo sapiens
gcagccccgggagg

SEQ ID NO: 4081772 - DNA, 20 bp, Homo sapiens
gcagccccgtctgcccacca

SEQ ID NO: 4081773 - DNA, 24 bp, Homo sapiens
gcagccctaaggatctctcaggag

SEQ ID NO: 4081774 - DNA, 19 bp, Homo sapiens
gcagccctagagcctgcct

SEQ ID NO: 4081775 - DNA, 18 bp, Homo sapiens
gcagccctcaacaggccc

SEQ ID NO: 4081776 - DNA, 14 bp, Homo sapiens
gcagccctgctttg

SEQ ID NO: 4081777 - DNA, 12 bp, Homo sapiens
gcagcccttggg

SEQ ID NO: 4081778 - DNA, 14 bp, Homo sapiens
gcagcccttgggca

SEQ ID NO: 4081779 - DNA, 14 bp, Homo sapiens
gcagccgccagctg

SEQ ID NO: 4081780 - DNA, 18 bp, Homo sapiens
gcagccgtgccttcagct

SEQ ID NO: 4081781 - DNA, 18 bp, Homo sapiens
gcagcctccaacacaagg

SEQ ID NO: 4081782 - DNA, 21 bp, Homo sapiens
gcagcctcccatccagggccc

SEQ ID NO: 4081783 - DNA, 18 bp, Homo sapiens
gcagcctctggacagcca

SEQ ID NO: 4081784 - DNA, 12 bp, Homo sapiens
gcagcctgcccc

SEQ ID NO: 4081785 - DNA, 16 bp, Homo sapiens
gcagcctgcccctaga

SEQ ID NO: 4081786 - DNA, 22 bp, Homo sapiens
gcagcctggctggtcctcccat

SEQ ID NO: 4081787 - DNA, 14 bp, Homo sapiens
gcagcctggggctg

SEQ ID NO: 4081788 - DNA, 16 bp, Homo sapiens
gcagcctgtggcatct

SEQ ID NO: 4081789 - DNA, 15 bp, Homo sapiens
gcagccttggggaac

SEQ ID NO: 4081790 - DNA, 18 bp, Homo sapiens
gcagcctttgcctccccg

SEQ ID NO: 4081791 - DNA, 16 bp, Homo sapiens
gcagcgaccgccccct

SEQ ID NO: 4081792 - DNA, 13 bp, Homo sapiens
gcagcgagggcgg

SEQ ID NO: 4081793 - DNA, 14 bp, Homo sapiens
gcagcgagggcgga

SEQ ID NO: 4081794 - DNA, 15 bp, Homo sapiens
gcagcgggccaggcc

SEQ ID NO: 4081795 - DNA, 18 bp, Homo sapiens
gcagcgggccaggcccgc

SEQ ID NO: 4081796 - DNA, 15 bp, Homo sapiens
gcagctagtgccttt

SEQ ID NO: 4081797 - DNA, 14 bp, Homo sapiens
gcagctagttttct

SEQ ID NO: 4081798 - DNA, 14 bp, Homo sapiens
gcagctatctgcac

SEQ ID NO: 4081799 - DNA, 21 bp, Homo sapiens
gcagctatgcgcaatgtggca

SEQ ID NO: 4081800 - DNA, 15 bp, Homo sapiens
gcagctcacccctgg

SEQ ID NO: 4081801 - DNA, 18 bp, Homo sapiens
gcagctcacccctgggca

SEQ ID NO: 4081802 - DNA, 19 bp, Homo sapiens
gcagctcacccctgggcag

SEQ ID NO: 4081803 - DNA, 16 bp, Homo sapiens
gcagctcactacccta

SEQ ID NO: 4081804 - DNA, 12 bp, Homo sapiens
gcagctccccag

SEQ ID NO: 4081805 - DNA, 13 bp, Homo sapiens
gcagctccccagg

SEQ ID NO: 4081806 - DNA, 15 bp, Homo sapiens
gcagctccccaggag

SEQ ID NO: 4081807 - DNA, 17 bp, Homo sapiens
gcagctcccgcagggct

SEQ ID NO: 4081808 - DNA, 12 bp, Homo sapiens
gcagctccctca

SEQ ID NO: 4081809 - DNA, 16 bp, Homo sapiens
gcagctccctttctca

SEQ ID NO: 4081810 - DNA, 17 bp, Homo sapiens
gcagctgaagaaaaaat

SEQ ID NO: 4081811 - DNA, 15 bp, Homo sapiens
gcagctgagcctgag

SEQ ID NO: 4081812 - DNA, 15 bp, Homo sapiens
gcagctgcgcgggct

SEQ ID NO: 4081813 - DNA, 23 bp, Homo sapiens
gcagctgctatccccatctccct

SEQ ID NO: 4081814 - DNA, 16 bp, Homo sapiens
gcagctgttgtctctt

SEQ ID NO: 4081815 - DNA, 18 bp, Homo sapiens
gcagctgttgtctcttct

SEQ ID NO: 4081816 - DNA, 18 bp, Homo sapiens
gcagctgtttctcatgaa

SEQ ID NO: 4081817 - DNA, 17 bp, Homo sapiens
gcagcttcaagtgcctt

SEQ ID NO: 4081818 - DNA, 18 bp, Homo sapiens
gcagcttctactcctgcc

SEQ ID NO: 4081819 - DNA, 21 bp, Homo sapiens
gcagcttctactcctgcctca

SEQ ID NO: 4081820 - DNA, 17 bp, Homo sapiens
gcagctttaaactcagg

SEQ ID NO: 4081821 - DNA, 19 bp, Homo sapiens
gcagctttaaactcaggga

SEQ ID NO: 4081822 - DNA, 20 bp, Homo sapiens
gcagctttaaactcagggac

SEQ ID NO: 4081823 - DNA, 15 bp, Homo sapiens
gcaggaactcccagc

SEQ ID NO: 4081824 - DNA, 21 bp, Homo sapiens
gcaggaaggacaggaagctgg

SEQ ID NO: 4081825 - DNA, 12 bp, Homo sapiens
gcaggaaggaga

SEQ ID NO: 4081826 - DNA, 16 bp, Homo sapiens
gcaggaaggagagcct

SEQ ID NO: 4081827 - DNA, 19 bp, Homo sapiens
gcaggaatatatgtgtgcc

SEQ ID NO: 4081828 - DNA, 10 bp, Homo sapiens
gcaggaatgg

SEQ ID NO: 4081829 - DNA, 19 bp, Homo sapiens
gcaggaattggtggcagat

SEQ ID NO: 4081830 - DNA, 14 bp, Homo sapiens
gcaggacaggaggc

SEQ ID NO: 4081831 - DNA, 23 bp, Homo sapiens
gcaggacaggaggcggcccggcc

SEQ ID NO: 4081832 - DNA, 22 bp, Homo sapiens
gcaggaccagccagcagcagcc

SEQ ID NO: 4081833 - DNA, 13 bp, Homo sapiens
gcaggaccaggac

SEQ ID NO: 4081834 - DNA, 12 bp, Homo sapiens
gcatgtgtattt

SEQ ID NO: 4081835 - DNA, 20 bp, Homo sapiens
gcatgtgtatttccagtgca

SEQ ID NO: 4081836 - DNA, 11 bp, Homo sapiens
gcatgtgtgtg

SEQ ID NO: 4081837 - DNA, 13 bp, Homo sapiens
gcatgtgtgtgtg

SEQ ID NO: 4081838 - DNA, 13 bp, Homo sapiens
gcatgttacataa

SEQ ID NO: 4081839 - DNA, 21 bp, Homo sapiens
gcatgttactacagaggaaag

SEQ ID NO: 4081840 - DNA, 15 bp, Homo sapiens
gcatgtttccagcag

SEQ ID NO: 4081841 - DNA, 18 bp, Homo sapiens
gcattaaattcacaaact

SEQ ID NO: 4081842 - DNA, 18 bp, Homo sapiens
gcattagtaactttgaaa

SEQ ID NO: 4081843 - DNA, 14 bp, Homo sapiens
gcattatgcaatta

SEQ ID NO: 4081844 - DNA, 13 bp, Homo sapiens
gcattattcattt

SEQ ID NO: 4081845 - DNA, 15 bp, Homo sapiens
gcattattgcattat

SEQ ID NO: 4081846 - DNA, 13 bp, Homo sapiens
gcattcagagagc

SEQ ID NO: 4081847 - DNA, 23 bp, Homo sapiens
gcattcattttctgacatgcatt

SEQ ID NO: 4081848 - DNA, 14 bp, Homo sapiens
gcattcatttttat

SEQ ID NO: 4081849 - DNA, 19 bp, Homo sapiens
gcattcatttttatagcaa

SEQ ID NO: 4081850 - DNA, 22 bp, Homo sapiens
gcattcatttttatagcaacaa

SEQ ID NO: 4081851 - DNA, 14 bp, Homo sapiens
gcattccagaatct

SEQ ID NO: 4081852 - DNA, 16 bp, Homo sapiens
gcattccagaatcttg

SEQ ID NO: 4081853 - DNA, 13 bp, Homo sapiens
gcattcccagtgg

SEQ ID NO: 4081854 - DNA, 15 bp, Homo sapiens
gcattccttctttga

SEQ ID NO: 4081855 - DNA, 19 bp, Homo sapiens
gcattccttctttgataat

SEQ ID NO: 4081856 - DNA, 16 bp, Homo sapiens
gcattcctttgtcttc

SEQ ID NO: 4081857 - DNA, 21 bp, Homo sapiens
gcattctatcgttattataaa

SEQ ID NO: 4081858 - DNA, 14 bp, Homo sapiens
gcattctattgcct

SEQ ID NO: 4081859 - DNA, 18 bp, Homo sapiens
gcattctcactcctacct

SEQ ID NO: 4081860 - DNA, 21 bp, Homo sapiens
gcattctccccagtgtatgtc

SEQ ID NO: 4081861 - DNA, 19 bp, Homo sapiens
gcattcttgtcacaataaa

SEQ ID NO: 4081862 - DNA, 21 bp, Homo sapiens
gcattgaacacaaactgtaaa

SEQ ID NO: 4081863 - DNA, 22 bp, Homo sapiens
gcattgaacacaaactgtaaat

SEQ ID NO: 4081864 - DNA, 22 bp, Homo sapiens
gcattgactttcagtaaacata

SEQ ID NO: 4081865 - DNA, 18 bp, Homo sapiens
gcattgaggaagagtctt

SEQ ID NO: 4081866 - DNA, 20 bp, Homo sapiens
gcattgccgctgtataaagc

SEQ ID NO: 4081867 - DNA, 14 bp, Homo sapiens
gcattgctagataa

SEQ ID NO: 4081868 - DNA, 16 bp, Homo sapiens
gcattgctagataaaa

SEQ ID NO: 4081869 - DNA, 15 bp, Homo sapiens
gcattgctttccact

SEQ ID NO: 4081870 - DNA, 12 bp, Homo sapiens
gcattgctttct

SEQ ID NO: 4081871 - DNA, 20 bp, Homo sapiens
gcattgcttttattttgaaa

SEQ ID NO: 4081872 - DNA, 19 bp, Homo sapiens
gcattggggatgtttttct

SEQ ID NO: 4081873 - DNA, 16 bp, Homo sapiens
gcattggggggccggg

SEQ ID NO: 4081874 - DNA, 15 bp, Homo sapiens
gcattgttagtttag

SEQ ID NO: 4081875 - DNA, 21 bp, Homo sapiens
gcattgttagtttagtgtgtg

SEQ ID NO: 4081876 - DNA, 15 bp, Homo sapiens
gcattgttgaggtgg

SEQ ID NO: 4081877 - DNA, 23 bp, Homo sapiens
gcattgttgaggtggtctgaatg

SEQ ID NO: 4081878 - DNA, 19 bp, Homo sapiens
gaggccaataaaaagttca

SEQ ID NO: 4081879 - DNA, 23 bp, Homo sapiens
gaggccaccgggacagacctgga

SEQ ID NO: 4081880 - DNA, 16 bp, Homo sapiens
gaggccagccccaccc

SEQ ID NO: 4081881 - DNA, 12 bp, Homo sapiens
gaggccaggagt

SEQ ID NO: 4081882 - DNA, 12 bp, Homo sapiens
gaggccagtggg

SEQ ID NO: 4081883 - DNA, 16 bp, Homo sapiens
gaggccatctcaggag

SEQ ID NO: 4081884 - DNA, 18 bp, Homo sapiens
gaggccatctcaggagat

SEQ ID NO: 4081885 - DNA, 13 bp, Homo sapiens
gaggcccaggctg

SEQ ID NO: 4081886 - DNA, 23 bp, Homo sapiens
gaggccccagcctccctgaagcc

SEQ ID NO: 4081887 - DNA, 21 bp, Homo sapiens
gaggccctcaatccaccttca

SEQ ID NO: 4081888 - DNA, 18 bp, Homo sapiens
gaggccctgcccaatgag

SEQ ID NO: 4081889 - DNA, 13 bp, Homo sapiens
gaggccctgggct

SEQ ID NO: 4081890 - DNA, 18 bp, Homo sapiens
gaggccgaaggtgcctca

SEQ ID NO: 4081891 - DNA, 19 bp, Homo sapiens
gaggccgaaggtgcctcag

SEQ ID NO: 4081892 - DNA, 21 bp, Homo sapiens
gaggccgaaggtgcctcagac

SEQ ID NO: 4081893 - DNA, 15 bp, Homo sapiens
gaggccgtgcagtgg

SEQ ID NO: 4081894 - DNA, 19 bp, Homo sapiens
gaggcctaaaagtaaacat

SEQ ID NO: 4081895 - DNA, 9 bp, Homo sapiens
gaggcctga

SEQ ID NO: 4081896 - DNA, 20 bp, Homo sapiens
gaggcctgaagccagctgcc

SEQ ID NO: 4081897 - DNA, 22 bp, Homo sapiens
gaggcctgaagccagctgccct

SEQ ID NO: 4081898 - DNA, 23 bp, Homo sapiens
gaggcctgaagccagctgcccta

SEQ ID NO: 4081899 - DNA, 16 bp, Homo sapiens
gaggcctgcccgggcg

SEQ ID NO: 4081900 - DNA, 23 bp, Homo sapiens
gaggcctgccctcagggatcttg

SEQ ID NO: 4081901 - DNA, 13 bp, Homo sapiens
gaggcctggactt

SEQ ID NO: 4081902 - DNA, 16 bp, Homo sapiens
gaggcctggccaggca

SEQ ID NO: 4081903 - DNA, 15 bp, Homo sapiens
gaggccttccagctg

SEQ ID NO: 4081904 - DNA, 16 bp, Homo sapiens
gaggccttccagctgc

SEQ ID NO: 4081905 - DNA, 18 bp, Homo sapiens
gaggcggaggctgtgctc

SEQ ID NO: 4081906 - DNA, 18 bp, Homo sapiens
gaggcggcccggccagcg

SEQ ID NO: 4081907 - DNA, 15 bp, Homo sapiens
gaggcgggagaatca

SEQ ID NO: 4081908 - DNA, 15 bp, Homo sapiens
gaggctccaggcagc

SEQ ID NO: 4081909 - DNA, 19 bp, Homo sapiens
gaggctgacgtgtgaggga

SEQ ID NO: 4081910 - DNA, 15 bp, Homo sapiens
gaggctgaggcagga

SEQ ID NO: 4081911 - DNA, 15 bp, Homo sapiens
gaggctgaggctggc

SEQ ID NO: 4081912 - DNA, 19 bp, Homo sapiens
gaggctgaggctggcacag

SEQ ID NO: 4081913 - DNA, 16 bp, Homo sapiens
gaggctgcacccctgg

SEQ ID NO: 4081914 - DNA, 19 bp, Homo sapiens
gaggctgcccccggccccc

SEQ ID NO: 4081915 - DNA, 22 bp, Homo sapiens
gaggctgcccccggccccctgg

SEQ ID NO: 4081916 - DNA, 23 bp, Homo sapiens
gaggctgcccccggccccctggt

SEQ ID NO: 4081917 - DNA, 14 bp, Homo sapiens
gaggctgcccctct

SEQ ID NO: 4081918 - DNA, 12 bp, Homo sapiens
gaggctggcagg

SEQ ID NO: 4081919 - DNA, 18 bp, Homo sapiens
gaggctgggacgctctgc

SEQ ID NO: 4081920 - DNA, 19 bp, Homo sapiens
gaggctgggacgctctgct

SEQ ID NO: 4081921 - DNA, 20 bp, Homo sapiens
gaggctgggacgctctgctg

SEQ ID NO: 4081922 - DNA, 21 bp, Homo sapiens
gaggctgggacgctctgctgt

SEQ ID NO: 4081923 - DNA, 14 bp, Homo sapiens
gaggctgggcccct

SEQ ID NO: 4081924 - DNA, 20 bp, Homo sapiens
gaggctggtgctgtggccag

SEQ ID NO: 4081925 - DNA, 14 bp, Homo sapiens
gaggctgtcctgta

SEQ ID NO: 4081926 - DNA, 15 bp, Homo sapiens
gaggctgtctggggc

SEQ ID NO: 4081927 - DNA, 15 bp, Homo sapiens
gaggcttctccgcca

SEQ ID NO: 4081928 - DNA, 21 bp, Homo sapiens
gaggcttctccgccagcctcc

SEQ ID NO: 4081929 - DNA, 22 bp, Homo sapiens
gaggcttctccgccagcctcct

SEQ ID NO: 4081930 - DNA, 14 bp, Homo sapiens
gaggctttggattt

SEQ ID NO: 4081931 - DNA, 16 bp, Homo sapiens
gaggctttggatttga

SEQ ID NO: 4081932 - DNA, 11 bp, Homo sapiens
gaggctttgtg

SEQ ID NO: 4081933 - DNA, 22 bp, Homo sapiens
gagggaaagccttaagctgcag

SEQ ID NO: 4081934 - DNA, 20 bp, Homo sapiens
gagggaagggtttctctatt

SEQ ID NO: 4081935 - DNA, 18 bp, Homo sapiens
gagggacatatcagtgac

SEQ ID NO: 4081936 - DNA, 19 bp, Homo sapiens
gagggaccaactgggccca

SEQ ID NO: 4081937 - DNA, 15 bp, Homo sapiens
gagggaccatgtgtc

SEQ ID NO: 4081938 - DNA, 20 bp, Homo sapiens
gagggactctgaagcctctg

SEQ ID NO: 4081939 - DNA, 21 bp, Homo sapiens
gagggactctgaagcctctgg

SEQ ID NO: 4081940 - DNA, 21 bp, Homo sapiens
gagggactttgctgatttccc

SEQ ID NO: 4081941 - DNA, 21 bp, Homo sapiens
gagggacttttaatcagtgaa

SEQ ID NO: 4081942 - DNA, 22 bp, Homo sapiens
gagggagagagagagagagagg

SEQ ID NO: 4081943 - DNA, 12 bp, Homo sapiens
gagggagcagac

SEQ ID NO: 4081944 - DNA, 20 bp, Homo sapiens
gagggagcagacaggaggaa

SEQ ID NO: 4081945 - DNA, 15 bp, Homo sapiens
gagggagcttagcca

SEQ ID NO: 4081946 - DNA, 18 bp, Homo sapiens
gagggagggcggtggaca

SEQ ID NO: 4081947 - DNA, 19 bp, Homo sapiens
gagggatgctgctccgccc

SEQ ID NO: 4081948 - DNA, 17 bp, Homo sapiens
gagggcacagccctccg

SEQ ID NO: 4081949 - DNA, 17 bp, Homo sapiens
gagggcagaaaggttct

SEQ ID NO: 4081950 - DNA, 20 bp, Homo sapiens
gagggcagaaaggttctgcc

SEQ ID NO: 4081951 - DNA, 18 bp, Homo sapiens
gagggcagactggggcat

SEQ ID NO: 4081952 - DNA, 21 bp, Homo sapiens
gagggcagactggggcatcct

SEQ ID NO: 4081953 - DNA, 14 bp, Homo sapiens
gagggcccagccag

SEQ ID NO: 4081954 - DNA, 13 bp, Homo sapiens
gagggcccagccc

SEQ ID NO: 4081955 - DNA, 19 bp, Homo sapiens
gagggcccagcccagagcc

SEQ ID NO: 4081956 - DNA, 23 bp, Homo sapiens
gagggcccagcccagagccacct

SEQ ID NO: 4081957 - DNA, 13 bp, Homo sapiens
gagggcccctgcg

SEQ ID NO: 4081958 - DNA, 14 bp, Homo sapiens
gagggcctgctgga

SEQ ID NO: 4081959 - DNA, 19 bp, Homo sapiens
gagggcctgtgggagcctg

SEQ ID NO: 4081960 - DNA, 18 bp, Homo sapiens
gagggctgccagcagccc

SEQ ID NO: 4081961 - DNA, 10 bp, Homo sapiens
gagggctgga

SEQ ID NO: 4081962 - DNA, 20 bp, Homo sapiens
gagggctggaggcccaggct

SEQ ID NO: 4081963 - DNA, 17 bp, Homo sapiens
gagggcttggcccagcg

SEQ ID NO: 4081964 - DNA, 15 bp, Homo sapiens
gagggcttgtgaaca

SEQ ID NO: 4081965 - DNA, 15 bp, Homo sapiens
gaggggaagggccag

SEQ ID NO: 4081966 - DNA, 14 bp, Homo sapiens
gaggggagccagga

SEQ ID NO: 4081967 - DNA, 19 bp, Homo sapiens
gaggggagcgtctgggaac

SEQ ID NO: 4081968 - DNA, 17 bp, Homo sapiens
gaggggcatctgcccct

SEQ ID NO: 4081969 - DNA, 22 bp, Homo sapiens
gaggggcatctgcccctccccc

SEQ ID NO: 4081970 - DNA, 12 bp, Homo sapiens
gaggggctctca

SEQ ID NO: 4081971 - DNA, 23 bp, Homo sapiens
gaggggctctcagctcagcgcca

SEQ ID NO: 4081972 - DNA, 22 bp, Homo sapiens
gagtctagcactcattttctat

SEQ ID NO: 4081973 - DNA, 21 bp, Homo sapiens
gagtctcagaaactcccctgg

SEQ ID NO: 4081974 - DNA, 22 bp, Homo sapiens
gagtctcagaaactcccctggg

SEQ ID NO: 4081975 - DNA, 15 bp, Homo sapiens
gagtctcctctctga

SEQ ID NO: 4081976 - DNA, 17 bp, Homo sapiens
gagtctcctctctgaga

SEQ ID NO: 4081977 - DNA, 17 bp, Homo sapiens
gagtctctgccacccac

SEQ ID NO: 4081978 - DNA, 20 bp, Homo sapiens
gagtctctgccacccactca

SEQ ID NO: 4081979 - DNA, 12 bp, Homo sapiens
gagtctcttctc

SEQ ID NO: 4081980 - DNA, 15 bp, Homo sapiens
gagtctcttctccac

SEQ ID NO: 4081981 - DNA, 17 bp, Homo sapiens
gagtctcttctccactg

SEQ ID NO: 4081982 - DNA, 12 bp, Homo sapiens
gagtctggactt

SEQ ID NO: 4081983 - DNA, 15 bp, Homo sapiens
gagtctggactttgc

SEQ ID NO: 4081984 - DNA, 18 bp, Homo sapiens
gagtctgggcctctgact

SEQ ID NO: 4081985 - DNA, 21 bp, Homo sapiens
gagtctggggacctggcactg

SEQ ID NO: 4081986 - DNA, 18 bp, Homo sapiens
gagtgacggtcccacact

SEQ ID NO: 4081987 - DNA, 23 bp, Homo sapiens
gagtgactcaagaagtgaagaat

SEQ ID NO: 4081988 - DNA, 19 bp, Homo sapiens
gagtgagacaaaattttag

SEQ ID NO: 4081989 - DNA, 23 bp, Homo sapiens
gagtgagccacagaccacctgct

SEQ ID NO: 4081990 - DNA, 22 bp, Homo sapiens
gagtgagctacagagccgagca

SEQ ID NO: 4081991 - DNA, 21 bp, Homo sapiens
gagtgagtcacctgctccaga

SEQ ID NO: 4081992 - DNA, 24 bp, Homo sapiens
gagtgattgaaccagctcatctcc

SEQ ID NO: 4081993 - DNA, 12 bp, Homo sapiens
gagtgcacagct

SEQ ID NO: 4081994 - DNA, 14 bp, Homo sapiens
gagtgcacagctgt

SEQ ID NO: 4081995 - DNA, 23 bp, Homo sapiens
gagtgcccaccctgggagacaga

SEQ ID NO: 4081996 - DNA, 13 bp, Homo sapiens
gagtgccctgctt

SEQ ID NO: 4081997 - DNA, 18 bp, Homo sapiens
gagtgccctgctttgcaa

SEQ ID NO: 4081998 - DNA, 18 bp, Homo sapiens
gagtgccttttgcagaag

SEQ ID NO: 4081999 - DNA, 20 bp, Homo sapiens
gagtgcgggctgaggccaga

SEQ ID NO: 4082000 - DNA, 23 bp, Homo sapiens
gagtgcgggctgaggccagagtc

SEQ ID NO: 4082001 - DNA, 19 bp, Homo sapiens
gagtgctgaaggaatggaa

SEQ ID NO: 4082002 - DNA, 14 bp, Homo sapiens
gagtgctggcactt

SEQ ID NO: 4082003 - DNA, 14 bp, Homo sapiens
gagtgctgtgctgt

SEQ ID NO: 4082004 - DNA, 17 bp, Homo sapiens
gagtggatctccaagga

SEQ ID NO: 4082005 - DNA, 10 bp, Homo sapiens
gagtggccca

SEQ ID NO: 4082006 - DNA, 11 bp, Homo sapiens
gagtggcccac

SEQ ID NO: 4082007 - DNA, 15 bp, Homo sapiens
gagtggcctccctgc

SEQ ID NO: 4082008 - DNA, 10 bp, Homo sapiens
gagtggcctg

SEQ ID NO: 4082009 - DNA, 13 bp, Homo sapiens
gagtggcctggcc

SEQ ID NO: 4082010 - DNA, 20 bp, Homo sapiens
gagtggcctggccaggagct

SEQ ID NO: 4082011 - DNA, 15 bp, Homo sapiens
gagtggctcctcccg

SEQ ID NO: 4082012 - DNA, 23 bp, Homo sapiens
gagtgggaagagggggctggcca

SEQ ID NO: 4082013 - DNA, 17 bp, Homo sapiens
gagtgggaaggacttgg

SEQ ID NO: 4082014 - DNA, 15 bp, Homo sapiens
gagtgggcacctcag

SEQ ID NO: 4082015 - DNA, 13 bp, Homo sapiens
gagtgggcagagc

SEQ ID NO: 4082016 - DNA, 14 bp, Homo sapiens
gagtggtctttctg

SEQ ID NO: 4082017 - DNA, 15 bp, Homo sapiens
gagtggtgcagacag

SEQ ID NO: 4082018 - DNA, 16 bp, Homo sapiens
gagtggtgcagacaga

SEQ ID NO: 4082019 - DNA, 16 bp, Homo sapiens
gagtggttctcatttg

SEQ ID NO: 4082020 - DNA, 14 bp, Homo sapiens
gagtgtaagtgtga

SEQ ID NO: 4082021 - DNA, 20 bp, Homo sapiens
gagtgtaagtgtgagtaaga

SEQ ID NO: 4082022 - DNA, 17 bp, Homo sapiens
gagtgtaatgtttgtta

SEQ ID NO: 4082023 - DNA, 18 bp, Homo sapiens
gagtgtacttaactattc

SEQ ID NO: 4082024 - DNA, 14 bp, Homo sapiens
gagtgtagaagcat

SEQ ID NO: 4082025 - DNA, 17 bp, Homo sapiens
gagtgtagactgtggct

SEQ ID NO: 4082026 - DNA, 18 bp, Homo sapiens
gagtgtcctgcccatgcc

SEQ ID NO: 4082027 - DNA, 16 bp, Homo sapiens
gagtgtctgtgagagg

SEQ ID NO: 4082028 - DNA, 17 bp, Homo sapiens
gagtgtgacagggccag

SEQ ID NO: 4082029 - DNA, 17 bp, Homo sapiens
gagtgtggaagccggag

SEQ ID NO: 4082030 - DNA, 17 bp, Homo sapiens
gagtgtgtattgttccc

SEQ ID NO: 4082031 - DNA, 18 bp, Homo sapiens
gagtgtgtattgttccca

SEQ ID NO: 4082032 - DNA, 14 bp, Homo sapiens
gagtgtgtgtgtgt

SEQ ID NO: 4082033 - DNA, 22 bp, Homo sapiens
gagtgtttctaataaacttgga

SEQ ID NO: 4082034 - DNA, 14 bp, Homo sapiens
gagttaagaagctg

SEQ ID NO: 4082035 - DNA, 16 bp, Homo sapiens
gagttaagaagctgtt

SEQ ID NO: 4082036 - DNA, 21 bp, Homo sapiens
gagttaagaagctgttgtaca

SEQ ID NO: 4082037 - DNA, 14 bp, Homo sapiens
gagttaagacctgg

SEQ ID NO: 4082038 - DNA, 20 bp, Homo sapiens
gagttatgataacaccagtg

SEQ ID NO: 4082039 - DNA, 19 bp, Homo sapiens
gagttcacaggaggccagt

SEQ ID NO: 4082040 - DNA, 15 bp, Homo sapiens
gagttccatgaagac

SEQ ID NO: 4082041 - DNA, 23 bp, Homo sapiens
gagttccttatccctctcttccc

SEQ ID NO: 4082042 - DNA, 14 bp, Homo sapiens
gagttctagaacca

SEQ ID NO: 4082043 - DNA, 16 bp, Homo sapiens
gagttctccctgtaca

SEQ ID NO: 4082044 - DNA, 22 bp, Homo sapiens
gagttgaaagagttaagaatgt

SEQ ID NO: 4082045 - DNA, 22 bp, Homo sapiens
gagttgagtctcctctctgaga

SEQ ID NO: 4082046 - DNA, 13 bp, Homo sapiens
gagtttaaagcaa

SEQ ID NO: 4082047 - DNA, 14 bp, Homo sapiens
gagtttaccatttg

SEQ ID NO: 4082048 - DNA, 20 bp, Homo sapiens
gagtttaccatttgtaataa

SEQ ID NO: 4082049 - DNA, 22 bp, Homo sapiens
gagtttaccatttgtaataaag

SEQ ID NO: 4082050 - DNA, 20 bp, Homo sapiens
gagtttcattctcctgcctg

SEQ ID NO: 4082051 - DNA, 14 bp, Homo sapiens
gagtttctgtttga

SEQ ID NO: 4082052 - DNA, 20 bp, Homo sapiens
gagtttttcctcccagtgag

SEQ ID NO: 4082053 - DNA, 14 bp, Homo sapiens
gataaaaagatggc

SEQ ID NO: 4082054 - DNA, 18 bp, Homo sapiens
gataaaataaataatttt

SEQ ID NO: 4082055 - DNA, 19 bp, Homo sapiens
gataaaataaataatttta

SEQ ID NO: 4082056 - DNA, 18 bp, Homo sapiens
gataaacaacaaggtggt

SEQ ID NO: 4082057 - DNA, 16 bp, Homo sapiens
gataaaccaataaatc

SEQ ID NO: 4082058 - DNA, 11 bp, Homo sapiens
gataaactgac

SEQ ID NO: 4082059 - DNA, 22 bp, Homo sapiens
gataaactgagcctcacttgcc

SEQ ID NO: 4082060 - DNA, 14 bp, Homo sapiens
gataaagagacagt

SEQ ID NO: 4082061 - DNA, 19 bp, Homo sapiens
gatcattttccccccactc

SEQ ID NO: 4082062 - DNA, 13 bp, Homo sapiens
gatcattttctta

SEQ ID NO: 4082063 - DNA, 21 bp, Homo sapiens
gatcatttttaactgattctt

SEQ ID NO: 4082064 - DNA, 16 bp, Homo sapiens
gatccaaaagaagccc

SEQ ID NO: 4082065 - DNA, 19 bp, Homo sapiens
gatccaaaagaagccccca

SEQ ID NO: 4082066 - DNA, 14 bp, Homo sapiens
gatccacctgtctc

SEQ ID NO: 4082067 - DNA, 18 bp, Homo sapiens
gatccacctgtctcagcc

SEQ ID NO: 4082068 - DNA, 18 bp, Homo sapiens
gatccactcgcctcagcc

SEQ ID NO: 4082069 - DNA, 16 bp, Homo sapiens
gatccagaagagccca

SEQ ID NO: 4082070 - DNA, 19 bp, Homo sapiens
gatccagagagcagctccc

SEQ ID NO: 4082071 - DNA, 13 bp, Homo sapiens
gatccagcactgg

SEQ ID NO: 4082072 - DNA, 12 bp, Homo sapiens
gatccaggacta

SEQ ID NO: 4082073 - DNA, 13 bp, Homo sapiens
gatccagggacag

SEQ ID NO: 4082074 - DNA, 16 bp, Homo sapiens
gatccatttgcctttc

SEQ ID NO: 4082075 - DNA, 21 bp, Homo sapiens
gatccatttgcctttctggga

SEQ ID NO: 4082076 - DNA, 23 bp, Homo sapiens
gatccatttgcctttctgggagc

SEQ ID NO: 4082077 - DNA, 12 bp, Homo sapiens
gatcccaccctg

SEQ ID NO: 4082078 - DNA, 21 bp, Homo sapiens
gatcccatccatcagctccct

SEQ ID NO: 4082079 - DNA, 14 bp, Homo sapiens
gatcccatggccag

SEQ ID NO: 4082080 - DNA, 14 bp, Homo sapiens
gatccccagggcag

SEQ ID NO: 4082081 - DNA, 15 bp, Homo sapiens
gatccccagggcagc

SEQ ID NO: 4082082 - DNA, 17 bp, Homo sapiens
gatccccatgcctagca

SEQ ID NO: 4082083 - DNA, 14 bp, Homo sapiens
gatcccctgagccc

SEQ ID NO: 4082084 - DNA, 21 bp, Homo sapiens
gatccctgtgttgtctctaga

SEQ ID NO: 4082085 - DNA, 20 bp, Homo sapiens
gatcccttccacctgctctg

SEQ ID NO: 4082086 - DNA, 20 bp, Homo sapiens
gatccgcctacctcagcctc

SEQ ID NO: 4082087 - DNA, 20 bp, Homo sapiens
gatcctagtgtctttaaata

SEQ ID NO: 4082088 - DNA, 19 bp, Homo sapiens
gatcctattctcaccagga

SEQ ID NO: 4082089 - DNA, 13 bp, Homo sapiens
gatcctctatttt

SEQ ID NO: 4082090 - DNA, 14 bp, Homo sapiens
gatcctctattttg

SEQ ID NO: 4082091 - DNA, 15 bp, Homo sapiens
gatcctctattttgt

SEQ ID NO: 4082092 - DNA, 22 bp, Homo sapiens
gatcctgggtactgaaagcctt

SEQ ID NO: 4082093 - DNA, 22 bp, Homo sapiens
gatcctgggtcaaaaaaaagaa

SEQ ID NO: 4082094 - DNA, 16 bp, Homo sapiens
gatcctgtctttaagg

SEQ ID NO: 4082095 - DNA, 16 bp, Homo sapiens
gatcctttttccatca

SEQ ID NO: 4082096 - DNA, 19 bp, Homo sapiens
gatcgagaccatcctggct

SEQ ID NO: 4082097 - DNA, 15 bp, Homo sapiens
gatcggactctgccc

SEQ ID NO: 4082098 - DNA, 19 bp, Homo sapiens
gatcggactctgcccctgg

SEQ ID NO: 4082099 - DNA, 20 bp, Homo sapiens
gatcggagcctcctctctca

SEQ ID NO: 4082100 - DNA, 18 bp, Homo sapiens
gatcgtgctaaattttca

SEQ ID NO: 4082101 - DNA, 21 bp, Homo sapiens
gatctaaggatgtcacagggc

SEQ ID NO: 4082102 - DNA, 23 bp, Homo sapiens
gatctaaggatgtcacagggcca

SEQ ID NO: 4082103 - DNA, 17 bp, Homo sapiens
gatctacttcatagctc

SEQ ID NO: 4082104 - DNA, 21 bp, Homo sapiens
gatctagaatgtgttttctga

SEQ ID NO: 4082105 - DNA, 22 bp, Homo sapiens
gatctagaatgtgttttctgaa

SEQ ID NO: 4082106 - DNA, 14 bp, Homo sapiens
gatctcagggcaga

SEQ ID NO: 4082107 - DNA, 16 bp, Homo sapiens
gatctccaaggaccag

SEQ ID NO: 4082108 - DNA, 19 bp, Homo sapiens
gatctccaaggaccaggtt

SEQ ID NO: 4082109 - DNA, 17 bp, Homo sapiens
gatctccatatgttaca

SEQ ID NO: 4082110 - DNA, 18 bp, Homo sapiens
gatctctattatatcttg

SEQ ID NO: 4082111 - DNA, 13 bp, Homo sapiens
gatctctcaggag

SEQ ID NO: 4082112 - DNA, 20 bp, Homo sapiens
gatctctcaggagcacaggc

SEQ ID NO: 4082113 - DNA, 23 bp, Homo sapiens
gatctctcaggagcacaggcagc

SEQ ID NO: 4082114 - DNA, 20 bp, Homo sapiens
gatctctcttgtcctcttct

SEQ ID NO: 4082115 - DNA, 16 bp, Homo sapiens
gatctggaacccagac

SEQ ID NO: 4082116 - DNA, 20 bp, Homo sapiens
gatctggaacccagactcag

SEQ ID NO: 4082117 - DNA, 12 bp, Homo sapiens
gatctggaacct

SEQ ID NO: 4082118 - DNA, 20 bp, Homo sapiens
gatctggaacctcagcctgg

SEQ ID NO: 4082119 - DNA, 18 bp, Homo sapiens
gatctgggcattttcctc

SEQ ID NO: 4082120 - DNA, 17 bp, Homo sapiens
gatctgtcacaccagcc

SEQ ID NO: 4082121 - DNA, 15 bp, Homo sapiens
gatctgtcctcagcc

SEQ ID NO: 4082122 - DNA, 16 bp, Homo sapiens
gatctgtcctcagcct

SEQ ID NO: 4082123 - DNA, 18 bp, Homo sapiens
gatctgtcctcagccttg

SEQ ID NO: 4082124 - DNA, 13 bp, Homo sapiens
gatctgtgcccca

SEQ ID NO: 4082125 - DNA, 18 bp, Homo sapiens
gatctgtgccccatgcct

SEQ ID NO: 4082126 - DNA, 19 bp, Homo sapiens
gatctgttttgaaggcaaa

SEQ ID NO: 4082127 - DNA, 15 bp, Homo sapiens
gatcttcaatggctt

SEQ ID NO: 4082128 - DNA, 14 bp, Homo sapiens
gatcttcttcatcc

SEQ ID NO: 4082129 - DNA, 22 bp, Homo sapiens
gatcttgaatgtggtctcagga

SEQ ID NO: 4082130 - DNA, 23 bp, Homo sapiens
gatcttgagtataagaaatgcat

SEQ ID NO: 4082131 - DNA, 18 bp, Homo sapiens
gatcttgcattcattttc

SEQ ID NO: 4082132 - DNA, 17 bp, Homo sapiens
gatcttgccacatttct

SEQ ID NO: 4082133 - DNA, 13 bp, Homo sapiens
gatcttgcctgtc

SEQ ID NO: 4082134 - DNA, 18 bp, Homo sapiens
gatcttgcctgtctggct

SEQ ID NO: 4082135 - DNA, 19 bp, Homo sapiens
gatcttggcttactgcagc

SEQ ID NO: 4082136 - DNA, 16 bp, Homo sapiens
gatcttgtctccacta

SEQ ID NO: 4082137 - DNA, 15 bp, Homo sapiens
gatcttgtgctcagc

SEQ ID NO: 4082138 - DNA, 13 bp, Homo sapiens
gatcttttaaagt

SEQ ID NO: 4082139 - DNA, 15 bp, Homo sapiens
gatgaaaatttgaga

SEQ ID NO: 4082140 - DNA, 14 bp, Homo sapiens
gatgaaagaggagg

SEQ ID NO: 4082141 - DNA, 21 bp, Homo sapiens
gatgaaatctgctagaaagtt

SEQ ID NO: 4082142 - DNA, 14 bp, Homo sapiens
gatgaacatctaac

SEQ ID NO: 4082143 - DNA, 13 bp, Homo sapiens
gatgaacccagga

SEQ ID NO: 4082144 - DNA, 16 bp, Homo sapiens
gacggcaggctcactg

SEQ ID NO: 4082145 - DNA, 15 bp, Homo sapiens
gacggctcctcagag

SEQ ID NO: 4082146 - DNA, 23 bp, Homo sapiens
gacggctgggtgtttcagtttga

SEQ ID NO: 4082147 - DNA, 18 bp, Homo sapiens
gacgggaggggaaaggct

SEQ ID NO: 4082148 - DNA, 10 bp, Homo sapiens
gacgggcaca

SEQ ID NO: 4082149 - DNA, 17 bp, Homo sapiens
gacggggtttcaccatg

SEQ ID NO: 4082150 - DNA, 14 bp, Homo sapiens
gacgtcaagtctcc

SEQ ID NO: 4082151 - DNA, 20 bp, Homo sapiens
gacgtcaggccctgactcct

SEQ ID NO: 4082152 - DNA, 23 bp, Homo sapiens
gacgtcaggccctgactcctctg

SEQ ID NO: 4082153 - DNA, 22 bp, Homo sapiens
gacgtggaacctctgtctcatc

SEQ ID NO: 4082154 - DNA, 20 bp, Homo sapiens
gacgtggagcggggtatgaa

SEQ ID NO: 4082155 - DNA, 16 bp, Homo sapiens
gacgtggctcagccag

SEQ ID NO: 4082156 - DNA, 17 bp, Homo sapiens
gacgtgtgtaaatatgt

SEQ ID NO: 4082157 - DNA, 17 bp, Homo sapiens
gacgtttttgtgctgtg

SEQ ID NO: 4082158 - DNA, 19 bp, Homo sapiens
gacgtttttgtgctgtggg

SEQ ID NO: 4082159 - DNA, 23 bp, Homo sapiens
gacgtttttgtgctgtgggcagc

SEQ ID NO: 4082160 - DNA, 18 bp, Homo sapiens
gactaaaaatattataac

SEQ ID NO: 4082161 - DNA, 13 bp, Homo sapiens
gactaaaatgttt

SEQ ID NO: 4082162 - DNA, 10 bp, Homo sapiens
gactaaagag

SEQ ID NO: 4082163 - DNA, 14 bp, Homo sapiens
gactaaagagagaa

SEQ ID NO: 4082164 - DNA, 17 bp, Homo sapiens
gactaaagagagaatgt

SEQ ID NO: 4082165 - DNA, 16 bp, Homo sapiens
gactaaagctatgtta

SEQ ID NO: 4082166 - DNA, 13 bp, Homo sapiens
gactaacaagaat

SEQ ID NO: 4082167 - DNA, 19 bp, Homo sapiens
gactaagaataagaagcat

SEQ ID NO: 4082168 - DNA, 22 bp, Homo sapiens
gactaagccctgtcgagacact

SEQ ID NO: 4082169 - DNA, 23 bp, Homo sapiens
gactaagccctgtcgagacactt

SEQ ID NO: 4082170 - DNA, 21 bp, Homo sapiens
gactaagcctacctgctctcc

SEQ ID NO: 4082171 - DNA, 21 bp, Homo sapiens
gactaattagggtacatttat

SEQ ID NO: 4082172 - DNA, 22 bp, Homo sapiens
gactaattagggtacatttata

SEQ ID NO: 4082173 - DNA, 15 bp, Homo sapiens
gactacaaaatacaa

SEQ ID NO: 4082174 - DNA, 19 bp, Homo sapiens
gactagacacacaaagcag

SEQ ID NO: 4082175 - DNA, 21 bp, Homo sapiens
gactatatttgggcctgctcc

SEQ ID NO: 4082176 - DNA, 13 bp, Homo sapiens
gactatctttgct

SEQ ID NO: 4082177 - DNA, 16 bp, Homo sapiens
gactatctttgctgca

SEQ ID NO: 4082178 - DNA, 12 bp, Homo sapiens
gactatggtgct

SEQ ID NO: 4082179 - DNA, 14 bp, Homo sapiens
gactattcagtttt

SEQ ID NO: 4082180 - DNA, 18 bp, Homo sapiens
gactcaagaagtgaagaa

SEQ ID NO: 4082181 - DNA, 23 bp, Homo sapiens
gactcaaggactgaattgtttta

SEQ ID NO: 4082182 - DNA, 14 bp, Homo sapiens
gactcaagtaccca

SEQ ID NO: 4082183 - DNA, 22 bp, Homo sapiens
gactcaagtacccattctgttt

SEQ ID NO: 4082184 - DNA, 18 bp, Homo sapiens
gactcaattatttgcata

SEQ ID NO: 4082185 - DNA, 23 bp, Homo sapiens
gactcacttatcccaagagaatg

SEQ ID NO: 4082186 - DNA, 13 bp, Homo sapiens
gactcagcagtga

SEQ ID NO: 4082187 - DNA, 22 bp, Homo sapiens
gactcagggaccggtgctgcag

SEQ ID NO: 4082188 - DNA, 23 bp, Homo sapiens
gactcagggaccggtgctgcagg

SEQ ID NO: 4082189 - DNA, 12 bp, Homo sapiens
gactcagggcag

SEQ ID NO: 4082190 - DNA, 13 bp, Homo sapiens
gactcagggcagc

SEQ ID NO: 4082191 - DNA, 16 bp, Homo sapiens
gactcaggtgggccct

SEQ ID NO: 4082192 - DNA, 22 bp, Homo sapiens
gactcatcaatcaaataagtat

SEQ ID NO: 4082193 - DNA, 14 bp, Homo sapiens
gactcatcatttgt

SEQ ID NO: 4082194 - DNA, 15 bp, Homo sapiens
gactcatggcagctg

SEQ ID NO: 4082195 - DNA, 23 bp, Homo sapiens
gactcatggcagctgtttctcat

SEQ ID NO: 4082196 - DNA, 22 bp, Homo sapiens
gactcattgtagaaaggaagcc

SEQ ID NO: 4082197 - DNA, 11 bp, Homo sapiens
gactccagaaa

SEQ ID NO: 4082198 - DNA, 22 bp, Homo sapiens
gactccagaaatgtccctttct

SEQ ID NO: 4082199 - DNA, 15 bp, Homo sapiens
gactccatctcttct

SEQ ID NO: 4082200 - DNA, 16 bp, Homo sapiens
gactccatctcttctg

SEQ ID NO: 4082201 - DNA, 19 bp, Homo sapiens
gactccctcctcacctctg

SEQ ID NO: 4082202 - DNA, 14 bp, Homo sapiens
gactccctgtgggg

SEQ ID NO: 4082203 - DNA, 23 bp, Homo sapiens
gactccctgtgggggtggccatc

SEQ ID NO: 4082204 - DNA, 15 bp, Homo sapiens
gactccgccctcctc

SEQ ID NO: 4082205 - DNA, 19 bp, Homo sapiens
gactcctacctgccctgga

SEQ ID NO: 4082206 - DNA, 16 bp, Homo sapiens
gactcctcctttttcc

SEQ ID NO: 4082207 - DNA, 20 bp, Homo sapiens
gactcctctggctttcccag

SEQ ID NO: 4082208 - DNA, 23 bp, Homo sapiens
gactctaaatgcagttttaagaa

SEQ ID NO: 4082209 - DNA, 16 bp, Homo sapiens
gactctaagctcagtg

SEQ ID NO: 4082210 - DNA, 23 bp, Homo sapiens
gactctacctcatatcagtttgc

SEQ ID NO: 4082211 - DNA, 16 bp, Homo sapiens
gactctgaagcctctg

SEQ ID NO: 4082212 - DNA, 18 bp, Homo sapiens
gactctgaagcctctggg

SEQ ID NO: 4082213 - DNA, 18 bp, Homo sapiens
gactctgagatgtggaga

SEQ ID NO: 4082214 - DNA, 18 bp, Homo sapiens
gactctgagtccactgct

SEQ ID NO: 4082215 - DNA, 20 bp, Homo sapiens
gactctgagtccactgctcc

SEQ ID NO: 4082216 - DNA, 19 bp, Homo sapiens
gactctgcatcccagcacc

SEQ ID NO: 4082217 - DNA, 12 bp, Homo sapiens
gactctgccccc

SEQ ID NO: 4082218 - DNA, 18 bp, Homo sapiens
gactctgccccctgctgg

SEQ ID NO: 4082219 - DNA, 22 bp, Homo sapiens
gactctgccccctgctggctct

SEQ ID NO: 4082220 - DNA, 16 bp, Homo sapiens
gactctggcaaagctt

SEQ ID NO: 4082221 - DNA, 12 bp, Homo sapiens
gactctggccct

SEQ ID NO: 4082222 - DNA, 18 bp, Homo sapiens
gactcttctcggctcagg

SEQ ID NO: 4082223 - DNA, 17 bp, Homo sapiens
gactcttttgccattaa

SEQ ID NO: 4082224 - DNA, 16 bp, Homo sapiens
gactgaagcctgcagg

SEQ ID NO: 4082225 - DNA, 12 bp, Homo sapiens
gactgaatgttt

SEQ ID NO: 4082226 - DNA, 17 bp, Homo sapiens
gactgaatgttttattt

SEQ ID NO: 4082227 - DNA, 18 bp, Homo sapiens
gactgaatgttttattta

SEQ ID NO: 4082228 - DNA, 18 bp, Homo sapiens
gactgagcaccctctgga

SEQ ID NO: 4082229 - DNA, 15 bp, Homo sapiens
gactgagcacctgct

SEQ ID NO: 4082230 - DNA, 15 bp, Homo sapiens
gactgagcagccgcc

SEQ ID NO: 4082231 - DNA, 14 bp, Homo sapiens
gactgagtcagatg

SEQ ID NO: 4082232 - DNA, 21 bp, Homo sapiens
gactgagtcccctccaggaag

SEQ ID NO: 4082233 - DNA, 17 bp, Homo sapiens
gactgatgattttcctt

SEQ ID NO: 4082234 - DNA, 15 bp, Homo sapiens
gactgcacagcggcc

SEQ ID NO: 4082235 - DNA, 15 bp, Homo sapiens
gactgcattgccgct

SEQ ID NO: 4082236 - DNA, 14 bp, Homo sapiens
gactgcgctggacg

SEQ ID NO: 4082237 - DNA, 15 bp, Homo sapiens
gactgctcagaactt

SEQ ID NO: 4082238 - DNA, 23 bp, Homo sapiens
gactgctcagaacttgctgctgt

SEQ ID NO: 4082239 - DNA, 21 bp, Homo sapiens
gactgctccccagccctggct

SEQ ID NO: 4082240 - DNA, 24 bp, Homo sapiens
gactgctccccagccctggctctg

SEQ ID NO: 4082241 - DNA, 18 bp, Homo sapiens
gactggacctggtggcta

SEQ ID NO: 4082242 - DNA, 13 bp, Homo sapiens
gactggaggaggc

SEQ ID NO: 4082243 - DNA, 14 bp, Homo sapiens
gactggaggaggcc

SEQ ID NO: 4082244 - DNA, 16 bp, Homo sapiens
gactggaggcccctgg

SEQ ID NO: 4082245 - DNA, 23 bp, Homo sapiens
gactggaggcccctggagccaga

SEQ ID NO: 4082246 - DNA, 15 bp, Homo sapiens
gactggaggtgggca

SEQ ID NO: 4082247 - DNA, 23 bp, Homo sapiens
gaaggcatttgcagggtcctctt

SEQ ID NO: 4082248 - DNA, 16 bp, Homo sapiens
gaaggccagcaacatt

SEQ ID NO: 4082249 - DNA, 14 bp, Homo sapiens
gaaggccctgaggc

SEQ ID NO: 4082250 - DNA, 14 bp, Homo sapiens
gaaggcctccctct

SEQ ID NO: 4082251 - DNA, 13 bp, Homo sapiens
gaaggcctgactt

SEQ ID NO: 4082252 - DNA, 22 bp, Homo sapiens
gaaggcctggctggaagagggt

SEQ ID NO: 4082253 - DNA, 18 bp, Homo sapiens
gaaggcgagtctggggac

SEQ ID NO: 4082254 - DNA, 20 bp, Homo sapiens
gaaggcttgggatttgctgt

SEQ ID NO: 4082255 - DNA, 20 bp, Homo sapiens
gaagggaatcctcctccagg

SEQ ID NO: 4082256 - DNA, 23 bp, Homo sapiens
gaagggaattgctcagagaagga

SEQ ID NO: 4082257 - DNA, 12 bp, Homo sapiens
gaagggagaagg

SEQ ID NO: 4082258 - DNA, 16 bp, Homo sapiens
gaagggagagccagct

SEQ ID NO: 4082259 - DNA, 23 bp, Homo sapiens
gaagggcaggaaggagagcctgc

SEQ ID NO: 4082260 - DNA, 10 bp, Homo sapiens
gaagggccag

SEQ ID NO: 4082261 - DNA, 14 bp, Homo sapiens
gaagggccagagcc

SEQ ID NO: 4082262 - DNA, 18 bp, Homo sapiens
gaagggccagagccaggg

SEQ ID NO: 4082263 - DNA, 11 bp, Homo sapiens
gaagggccagt

SEQ ID NO: 4082264 - DNA, 22 bp, Homo sapiens
gaagggccagtcctgcctggcc

SEQ ID NO: 4082265 - DNA, 14 bp, Homo sapiens
gaagggccagtctg

SEQ ID NO: 4082266 - DNA, 18 bp, Homo sapiens
gaagggccagtctgggct

SEQ ID NO: 4082267 - DNA, 20 bp, Homo sapiens
gaagggccagtctgggctgc

SEQ ID NO: 4082268 - DNA, 23 bp, Homo sapiens
gaaggggaggcagccggcaccca

SEQ ID NO: 4082269 - DNA, 19 bp, Homo sapiens
gaagggggggctacattat

SEQ ID NO: 4082270 - DNA, 18 bp, Homo sapiens
gaaggggggttgcagtgg

SEQ ID NO: 4082271 - DNA, 21 bp, Homo sapiens
gaagggtggatgacagggcag

SEQ ID NO: 4082272 - DNA, 14 bp, Homo sapiens
gaagggtttctcta

SEQ ID NO: 4082273 - DNA, 19 bp, Homo sapiens
gaaggtagcccagcactgt

SEQ ID NO: 4082274 - DNA, 21 bp, Homo sapiens
gaaggtagcccagcactgtga

SEQ ID NO: 4082275 - DNA, 14 bp, Homo sapiens
gaaggtcaccagca

SEQ ID NO: 4082276 - DNA, 13 bp, Homo sapiens
gaaggtgattttt

SEQ ID NO: 4082277 - DNA, 18 bp, Homo sapiens
gaaggtgctgacggccag

SEQ ID NO: 4082278 - DNA, 14 bp, Homo sapiens
gaaggtggccacag

SEQ ID NO: 4082279 - DNA, 18 bp, Homo sapiens
gaaggtggccacagcaag

SEQ ID NO: 4082280 - DNA, 23 bp, Homo sapiens
gaaggtggccacagcaagtacag

SEQ ID NO: 4082281 - DNA, 20 bp, Homo sapiens
gaaggtttggtgtgtggaga

SEQ ID NO: 4082282 - DNA, 12 bp, Homo sapiens
gaagtaaagcct

SEQ ID NO: 4082283 - DNA, 15 bp, Homo sapiens
gaagtaaagcctcaa

SEQ ID NO: 4082284 - DNA, 15 bp, Homo sapiens
gaagtatacttttcc

SEQ ID NO: 4082285 - DNA, 15 bp, Homo sapiens
gaagtcaaacatttc

SEQ ID NO: 4082286 - DNA, 12 bp, Homo sapiens
gaagtcatatgt

SEQ ID NO: 4082287 - DNA, 19 bp, Homo sapiens
gaagtcatgaagcccaagt

SEQ ID NO: 4082288 - DNA, 16 bp, Homo sapiens
gaagtcttttctgtca

SEQ ID NO: 4082289 - DNA, 14 bp, Homo sapiens
gaagtgaacatttc

SEQ ID NO: 4082290 - DNA, 16 bp, Homo sapiens
gaagtgagcacagcct

SEQ ID NO: 4082291 - DNA, 14 bp, Homo sapiens
gaagtgcatccaaa

SEQ ID NO: 4082292 - DNA, 16 bp, Homo sapiens
gaagtgcatttctgaa

SEQ ID NO: 4082293 - DNA, 21 bp, Homo sapiens
gaagtgccttctccttcccca

SEQ ID NO: 4082294 - DNA, 23 bp, Homo sapiens
gaagtgccttctccttccccagg

SEQ ID NO: 4082295 - DNA, 21 bp, Homo sapiens
gaagtgctctaacttttctta

SEQ ID NO: 4082296 - DNA, 21 bp, Homo sapiens
gaagtgcttagtgtacttgga

SEQ ID NO: 4082297 - DNA, 18 bp, Homo sapiens
gaagtggggtgttcttct

SEQ ID NO: 4082298 - DNA, 14 bp, Homo sapiens
gaagtggtccatct

SEQ ID NO: 4082299 - DNA, 17 bp, Homo sapiens
gaagtgtaacagctgag

SEQ ID NO: 4082300 - DNA, 19 bp, Homo sapiens
gaagtgtgagcgccttggt

SEQ ID NO: 4082301 - DNA, 22 bp, Homo sapiens
gaagttacacagaaatgctgct

SEQ ID NO: 4082302 - DNA, 20 bp, Homo sapiens
gaagttactttatgtttgtc

SEQ ID NO: 4082303 - DNA, 20 bp, Homo sapiens
gaagttactttgtaattttt

SEQ ID NO: 4082304 - DNA, 16 bp, Homo sapiens
gaagttctatttattt

SEQ ID NO: 4082305 - DNA, 13 bp, Homo sapiens
gaagtttaaaaca

SEQ ID NO: 4082306 - DNA, 16 bp, Homo sapiens
gagaggtggagaactg

SEQ ID NO: 4082307 - DNA, 19 bp, Homo sapiens
gagagtacagtgagccaag

SEQ ID NO: 4082308 - DNA, 23 bp, Homo sapiens
gagagtctagcactcattttcta

SEQ ID NO: 4082309 - DNA, 17 bp, Homo sapiens
gagagtgagctacagag

SEQ ID NO: 4082310 - DNA, 13 bp, Homo sapiens
gagagtggctcct

SEQ ID NO: 4082311 - DNA, 16 bp, Homo sapiens
gagagtggctcctccc

SEQ ID NO: 4082312 - DNA, 23 bp, Homo sapiens
gagataaaaggtggagtttctct

SEQ ID NO: 4082313 - DNA, 14 bp, Homo sapiens
gagatactggtgga

SEQ ID NO: 4082314 - DNA, 21 bp, Homo sapiens
gagatacttggtcacagccag

SEQ ID NO: 4082315 - DNA, 16 bp, Homo sapiens
gagatcacagcctcca

SEQ ID NO: 4082316 - DNA, 21 bp, Homo sapiens
gagatcacagcctccagggcc

SEQ ID NO: 4082317 - DNA, 21 bp, Homo sapiens
gagatccaaaagaagccccca

SEQ ID NO: 4082318 - DNA, 15 bp, Homo sapiens
gagatcccctgagcc

SEQ ID NO: 4082319 - DNA, 18 bp, Homo sapiens
gagatcgagaccatcctg

SEQ ID NO: 4082320 - DNA, 19 bp, Homo sapiens
gagatcgagaccatcctgg

SEQ ID NO: 4082321 - DNA, 21 bp, Homo sapiens
gagatcgtgctactgcactcc

SEQ ID NO: 4082322 - DNA, 20 bp, Homo sapiens
gagatctaagcctttccata

SEQ ID NO: 4082323 - DNA, 21 bp, Homo sapiens
gagatctaagcctttccataa

SEQ ID NO: 4082324 - DNA, 16 bp, Homo sapiens
gagatgagaggtagcc

SEQ ID NO: 4082325 - DNA, 14 bp, Homo sapiens
gagatgcttctctc

SEQ ID NO: 4082326 - DNA, 14 bp, Homo sapiens
gagatggagggctt

SEQ ID NO: 4082327 - DNA, 16 bp, Homo sapiens
gagatggagggcttgg

SEQ ID NO: 4082328 - DNA, 20 bp, Homo sapiens
gagatgggaatgaggtggga

SEQ ID NO: 4082329 - DNA, 14 bp, Homo sapiens
gagatgggagctcc

SEQ ID NO: 4082330 - DNA, 18 bp, Homo sapiens
gagatggggataaaatga

SEQ ID NO: 4082331 - DNA, 12 bp, Homo sapiens
gagatgtctctt

SEQ ID NO: 4082332 - DNA, 15 bp, Homo sapiens
gagatgtcttggaac

SEQ ID NO: 4082333 - DNA, 14 bp, Homo sapiens
gagatgtgcaccca

SEQ ID NO: 4082334 - DNA, 21 bp, Homo sapiens
gagattgtgccacttcactcc

SEQ ID NO: 4082335 - DNA, 16 bp, Homo sapiens
gagatttatataaatg

SEQ ID NO: 4082336 - DNA, 18 bp, Homo sapiens
gagatttcttgttgctca

SEQ ID NO: 4082337 - DNA, 11 bp, Homo sapiens
gagatttttaa

SEQ ID NO: 4082338 - DNA, 15 bp, Homo sapiens
gagcaaaaggcagct

SEQ ID NO: 4082339 - DNA, 19 bp, Homo sapiens
gagcaaaataaggaagagg

SEQ ID NO: 4082340 - DNA, 19 bp, Homo sapiens
gagcaaaatcgatgcagtg

SEQ ID NO: 4082341 - DNA, 19 bp, Homo sapiens
gagcaacctctcactcccc

SEQ ID NO: 4082342 - DNA, 20 bp, Homo sapiens
gagcaacgaccagggccgag

SEQ ID NO: 4082343 - DNA, 14 bp, Homo sapiens
gagcaagagagcag

SEQ ID NO: 4082344 - DNA, 20 bp, Homo sapiens
gagcaagcatttatgtttat

SEQ ID NO: 4082345 - DNA, 13 bp, Homo sapiens
gagcaatgggact

SEQ ID NO: 4082346 - DNA, 18 bp, Homo sapiens
gagcacaacccccagctc

SEQ ID NO: 4082347 - DNA, 19 bp, Homo sapiens
gagcacaacccccagctcc

SEQ ID NO: 4082348 - DNA, 15 bp, Homo sapiens
gagcacaggcagctg

SEQ ID NO: 4082349 - DNA, 13 bp, Homo sapiens
gagcacccagagc

SEQ ID NO: 4082350 - DNA, 22 bp, Homo sapiens
gagcacccagagcaccccctgc

SEQ ID NO: 4082351 - DNA, 22 bp, Homo sapiens
gagcaccccctgctccaccagc

SEQ ID NO: 4082352 - DNA, 23 bp, Homo sapiens
gagcaccgtgtcaagctgctctg

SEQ ID NO: 4082353 - DNA, 23 bp, Homo sapiens
gagcacctgcttcatgctcagcc

SEQ ID NO: 4082354 - DNA, 19 bp, Homo sapiens
gagcactgcgcgctatccc

SEQ ID NO: 4082355 - DNA, 14 bp, Homo sapiens
gagcactggagtgc

SEQ ID NO: 4082356 - DNA, 14 bp, Homo sapiens
gagcacttagcagg

SEQ ID NO: 4082357 - DNA, 23 bp, Homo sapiens
gagcagaacggagccccaggcct

SEQ ID NO: 4082358 - DNA, 14 bp, Homo sapiens
gagcagacaggagg

SEQ ID NO: 4082359 - DNA, 15 bp, Homo sapiens
gagcagacaggagga

SEQ ID NO: 4082360 - DNA, 15 bp, Homo sapiens
gagcagagcaggcaa

SEQ ID NO: 4082361 - DNA, 13 bp, Homo sapiens
gagcagagtctgg

SEQ ID NO: 4082362 - DNA, 16 bp, Homo sapiens
gagcagagtctgggcc

SEQ ID NO: 4082363 - DNA, 14 bp, Homo sapiens
gagcagcagcacca

SEQ ID NO: 4082364 - DNA, 15 bp, Homo sapiens
gagcagcagcttggg

SEQ ID NO: 4082365 - DNA, 13 bp, Homo sapiens
gagcagcctctgg

SEQ ID NO: 4082366 - DNA, 14 bp, Homo sapiens
gagcagcctctgga

SEQ ID NO: 4082367 - DNA, 24 bp, Homo sapiens
gagcagcctctggacagccagtga

SEQ ID NO: 4082368 - DNA, 11 bp, Homo sapiens
gagcagcctgt

SEQ ID NO: 4082369 - DNA, 14 bp, Homo sapiens
gagcagcctgtggc

SEQ ID NO: 4082370 - DNA, 15 bp, Homo sapiens
gagcagctccccagg

SEQ ID NO: 4082371 - DNA, 16 bp, Homo sapiens
gagcagctccccagga

SEQ ID NO: 4082372 - DNA, 12 bp, Homo sapiens
gagcagctccct

SEQ ID NO: 4082373 - DNA, 18 bp, Homo sapiens
gagcagctccctttctca

SEQ ID NO: 4082374 - DNA, 18 bp, Homo sapiens
gagcagctttaaactcag

SEQ ID NO: 4082375 - DNA, 21 bp, Homo sapiens
gagcagctttaaactcaggga

SEQ ID NO: 4082376 - DNA, 20 bp, Homo sapiens
gagcaggactccaggcccaa

SEQ ID NO: 4082377 - DNA, 13 bp, Homo sapiens
gagcaggagcccc

SEQ ID NO: 4082378 - DNA, 20 bp, Homo sapiens
gagcaggagccccgccacag

SEQ ID NO: 4082379 - DNA, 18 bp, Homo sapiens
gagcaggaggccaataaa

SEQ ID NO: 4082380 - DNA, 14 bp, Homo sapiens
gagcaggccggaac

SEQ ID NO: 4082381 - DNA, 18 bp, Homo sapiens
gagcaggccggaaccaca

SEQ ID NO: 4082382 - DNA, 19 bp, Homo sapiens
gagcaggccggaaccacag

SEQ ID NO: 4082383 - DNA, 16 bp, Homo sapiens
gagcagggaaggcctg

SEQ ID NO: 4082384 - DNA, 14 bp, Homo sapiens
gagcagtcacactg

SEQ ID NO: 4082385 - DNA, 15 bp, Homo sapiens
gagcagtcagagtcc

SEQ ID NO: 4082386 - DNA, 16 bp, Homo sapiens
gagcagtcagagtcca

SEQ ID NO: 4082387 - DNA, 18 bp, Homo sapiens
gagcagtcagagtccagt

SEQ ID NO: 4082388 - DNA, 20 bp, Homo sapiens
gagcagtcctgcctcagcct

SEQ ID NO: 4082389 - DNA, 12 bp, Homo sapiens
gagcagtgtctt

SEQ ID NO: 4082390 - DNA, 17 bp, Homo sapiens
gagcagtgtcttccata

SEQ ID NO: 4082391 - DNA, 13 bp, Homo sapiens
gagcagtttgcca

SEQ ID NO: 4082392 - DNA, 17 bp, Homo sapiens
gagcatgaaatttttaa

SEQ ID NO: 4082393 - DNA, 15 bp, Homo sapiens
gagcatgggcctggc

SEQ ID NO: 4082394 - DNA, 22 bp, Homo sapiens
gagcatgtactgagccttgtaa

SEQ ID NO: 4082395 - DNA, 17 bp, Homo sapiens
gagcattacgtgagcca

SEQ ID NO: 4082396 - DNA, 22 bp, Homo sapiens
gagcattataatcaccagggcc

SEQ ID NO: 4082397 - DNA, 23 bp, Homo sapiens
gagcattataatcaccagggcca

SEQ ID NO: 4082398 - DNA, 13 bp, Homo sapiens
gagcattccagtc

SEQ ID NO: 4082399 - DNA, 20 bp, Homo sapiens
gagccaagccttaaactgta

SEQ ID NO: 4082400 - DNA, 13 bp, Homo sapiens
gagccacaaaaga

SEQ ID NO: 4082401 - DNA, 14 bp, Homo sapiens
gagccaccgctgcc

SEQ ID NO: 4082402 - DNA, 16 bp, Homo sapiens
gagccaccgtgcctgg

SEQ ID NO: 4082403 - DNA, 15 bp, Homo sapiens
gagccacctggatct

SEQ ID NO: 4082404 - DNA, 21 bp, Homo sapiens
gactgggctgggtttgctgtc

SEQ ID NO: 4082405 - DNA, 18 bp, Homo sapiens
gactggggatgtgggagg

SEQ ID NO: 4082406 - DNA, 16 bp, Homo sapiens
gactggggtgggaggt

SEQ ID NO: 4082407 - DNA, 23 bp, Homo sapiens
gactgggtctcgctttgttgccc

SEQ ID NO: 4082408 - DNA, 10 bp, Homo sapiens
gactggtgcc

SEQ ID NO: 4082409 - DNA, 19 bp, Homo sapiens
gactggtgctataggctgg

SEQ ID NO: 4082410 - DNA, 22 bp, Homo sapiens
gactggtgctataggctggaga

SEQ ID NO: 4082411 - DNA, 18 bp, Homo sapiens
gactggtttacaggccct

SEQ ID NO: 4082412 - DNA, 15 bp, Homo sapiens
gactggttttctgcc

SEQ ID NO: 4082413 - DNA, 16 bp, Homo sapiens
gactggttttctgcca

SEQ ID NO: 4082414 - DNA, 22 bp, Homo sapiens
gactgtacaaagtagaagtctt

SEQ ID NO: 4082415 - DNA, 18 bp, Homo sapiens
gactgtactcctcccagg

SEQ ID NO: 4082416 - DNA, 23 bp, Homo sapiens
gactgtactcctcccaggcgccc

SEQ ID NO: 4082417 - DNA, 21 bp, Homo sapiens
gactgtagattgcttctgtag

SEQ ID NO: 4082418 - DNA, 21 bp, Homo sapiens
gactgtcacggggttccctcc

SEQ ID NO: 4082419 - DNA, 16 bp, Homo sapiens
gactgtcctctcccct

SEQ ID NO: 4082420 - DNA, 19 bp, Homo sapiens
gactgtcctctcccctcca

SEQ ID NO: 4082421 - DNA, 23 bp, Homo sapiens
gactgtcggagaggctgtctggg

SEQ ID NO: 4082422 - DNA, 13 bp, Homo sapiens
gactgtctttcag

SEQ ID NO: 4082423 - DNA, 22 bp, Homo sapiens
gactgtgtattctagttttgtc

SEQ ID NO: 4082424 - DNA, 16 bp, Homo sapiens
gactgttccaaagcca

SEQ ID NO: 4082425 - DNA, 13 bp, Homo sapiens
gactgttgtgatc

SEQ ID NO: 4082426 - DNA, 14 bp, Homo sapiens
gactgttgtgatct

SEQ ID NO: 4082427 - DNA, 22 bp, Homo sapiens
gactgttgtgatcttgcattca

SEQ ID NO: 4082428 - DNA, 20 bp, Homo sapiens
gacttaaaattggaaatgtc

SEQ ID NO: 4082429 - DNA, 14 bp, Homo sapiens
gacttaaaggacag

SEQ ID NO: 4082430 - DNA, 20 bp, Homo sapiens
gacttaaaggacaggaggag

SEQ ID NO: 4082431 - DNA, 15 bp, Homo sapiens
gacttaatgtgatta

SEQ ID NO: 4082432 - DNA, 16 bp, Homo sapiens
gacttatagtacatga

SEQ ID NO: 4082433 - DNA, 17 bp, Homo sapiens
gacttatagtacatgat

SEQ ID NO: 4082434 - DNA, 15 bp, Homo sapiens
gacttattacaattt

SEQ ID NO: 4082435 - DNA, 15 bp, Homo sapiens
gacttatttctgctc

SEQ ID NO: 4082436 - DNA, 19 bp, Homo sapiens
gacttatttctgctctgga

SEQ ID NO: 4082437 - DNA, 17 bp, Homo sapiens
gacttatttcttcaaat

SEQ ID NO: 4082438 - DNA, 22 bp, Homo sapiens
gacttcagggcagggctctgat

SEQ ID NO: 4082439 - DNA, 21 bp, Homo sapiens
gacttcatctggggttggcaa

SEQ ID NO: 4082440 - DNA, 23 bp, Homo sapiens
gacttcattgtccctcttcactc

SEQ ID NO: 4082441 - DNA, 15 bp, Homo sapiens
gacttccatgcctta

SEQ ID NO: 4082442 - DNA, 17 bp, Homo sapiens
gacttcccaacagcctt

SEQ ID NO: 4082443 - DNA, 13 bp, Homo sapiens
gacttcccagcta

SEQ ID NO: 4082444 - DNA, 22 bp, Homo sapiens
gacttcctgtccagctccaacc

SEQ ID NO: 4082445 - DNA, 14 bp, Homo sapiens
gacttccttgagac

SEQ ID NO: 4082446 - DNA, 16 bp, Homo sapiens
gacttccttgagacac

SEQ ID NO: 4082447 - DNA, 15 bp, Homo sapiens
gacttcgactcagga

SEQ ID NO: 4082448 - DNA, 17 bp, Homo sapiens
gacttctaatttatatt

SEQ ID NO: 4082449 - DNA, 15 bp, Homo sapiens
gacttctacctgccc

SEQ ID NO: 4082450 - DNA, 22 bp, Homo sapiens
gacttctccaggtctcacgggc

SEQ ID NO: 4082451 - DNA, 13 bp, Homo sapiens
gacttgaaagcat

SEQ ID NO: 4082452 - DNA, 17 bp, Homo sapiens
gacttgaaagcatccat

SEQ ID NO: 4082453 - DNA, 23 bp, Homo sapiens
gacttgagtgttcctttttaaat

SEQ ID NO: 4082454 - DNA, 22 bp, Homo sapiens
gacttgccaacaccacagaaat

SEQ ID NO: 4082455 - DNA, 14 bp, Homo sapiens
gacttggtctgatt

SEQ ID NO: 4082456 - DNA, 17 bp, Homo sapiens
gacttgtgcacaggcag

SEQ ID NO: 4082457 - DNA, 13 bp, Homo sapiens
gacttgtgtccca

SEQ ID NO: 4082458 - DNA, 17 bp, Homo sapiens
gactttagaaataaatg

SEQ ID NO: 4082459 - DNA, 18 bp, Homo sapiens
gactttagaaataaatgt

SEQ ID NO: 4082460 - DNA, 17 bp, Homo sapiens
gactttatttatttcta

SEQ ID NO: 4082461 - DNA, 21 bp, Homo sapiens
gactttatttatttctagttc

SEQ ID NO: 4082462 - DNA, 23 bp, Homo sapiens
gactttctgttttctgtttgtaa

SEQ ID NO: 4082463 - DNA, 15 bp, Homo sapiens
gactttgcttagtat

SEQ ID NO: 4082464 - DNA, 17 bp, Homo sapiens
gactttgcttcccctcc

SEQ ID NO: 4082465 - DNA, 22 bp, Homo sapiens
gactttgcttcccctccaggag

SEQ ID NO: 4082466 - DNA, 18 bp, Homo sapiens
gacttttcgttaacattg

SEQ ID NO: 4082467 - DNA, 17 bp, Homo sapiens
gacttttggtagagaag

SEQ ID NO: 4082468 - DNA, 17 bp, Homo sapiens
gagaaaaagctcctgtc

SEQ ID NO: 4082469 - DNA, 17 bp, Homo sapiens
gagaaaattgcactaaa

SEQ ID NO: 4082470 - DNA, 15 bp, Homo sapiens
gagaaaccgggagaa

SEQ ID NO: 4082471 - DNA, 15 bp, Homo sapiens
gagaaactgctgcag

SEQ ID NO: 4082472 - DNA, 17 bp, Homo sapiens
gagaaactgctgcagat

SEQ ID NO: 4082473 - DNA, 18 bp, Homo sapiens
gagaaacttaagcaaagg

SEQ ID NO: 4082474 - DNA, 13 bp, Homo sapiens
gagaaagaagaga

SEQ ID NO: 4082475 - DNA, 18 bp, Homo sapiens
gagaaaggggagcccact

SEQ ID NO: 4082476 - DNA, 17 bp, Homo sapiens
gagaacaaacagatcga

SEQ ID NO: 4082477 - DNA, 18 bp, Homo sapiens
gagaacaggtggttttta

SEQ ID NO: 4082478 - DNA, 19 bp, Homo sapiens
gagaaccactacatgcagc

SEQ ID NO: 4082479 - DNA, 15 bp, Homo sapiens
gagaacgcagcccta

SEQ ID NO: 4082480 - DNA, 16 bp, Homo sapiens
gagaacgcagccctag

SEQ ID NO: 4082481 - DNA, 24 bp, Homo sapiens
gagaacgcagccctagagcctgcc

SEQ ID NO: 4082482 - DNA, 15 bp, Homo sapiens
gagaacgccagtctc

SEQ ID NO: 4082483 - DNA, 16 bp, Homo sapiens
gagaacgccagtctcc

SEQ ID NO: 4082484 - DNA, 11 bp, Homo sapiens
gagaagaaaat

SEQ ID NO: 4082485 - DNA, 13 bp, Homo sapiens
gagaagagccctg

SEQ ID NO: 4082486 - DNA, 21 bp, Homo sapiens
gagaagagggcccagcccaga

SEQ ID NO: 4082487 - DNA, 15 bp, Homo sapiens
gagaagagggcctgt

SEQ ID NO: 4082488 - DNA, 22 bp, Homo sapiens
gagaagcaagtaaaaaggctaa

SEQ ID NO: 4082489 - DNA, 20 bp, Homo sapiens
gagaagccacgctgtcctct

SEQ ID NO: 4082490 - DNA, 22 bp, Homo sapiens
gagaagccaggaatttcccagg

SEQ ID NO: 4082491 - DNA, 23 bp, Homo sapiens
gagaagctgatgctttgcttcaa

SEQ ID NO: 4082492 - DNA, 11 bp, Homo sapiens
gagaagctgct

SEQ ID NO: 4082493 - DNA, 12 bp, Homo sapiens
gagaagctgctg

SEQ ID NO: 4082494 - DNA, 14 bp, Homo sapiens
gagaagctggactt

SEQ ID NO: 4082495 - DNA, 18 bp, Homo sapiens
gagaaggcatgagaaaga

SEQ ID NO: 4082496 - DNA, 20 bp, Homo sapiens
gagaagggaatcctcctcca

SEQ ID NO: 4082497 - DNA, 15 bp, Homo sapiens
gagccacttctcccc

SEQ ID NO: 4082498 - DNA, 18 bp, Homo sapiens
gagccagatgcaggacag

SEQ ID NO: 4082499 - DNA, 21 bp, Homo sapiens
gagccagatgcaggacaggag

SEQ ID NO: 4082500 - DNA, 12 bp, Homo sapiens
gagccaggcctg

SEQ ID NO: 4082501 - DNA, 19 bp, Homo sapiens
gagccaggtaatgagggac

SEQ ID NO: 4082502 - DNA, 23 bp, Homo sapiens
gagccagtcctccactcgaccca

SEQ ID NO: 4082503 - DNA, 22 bp, Homo sapiens
gagccagttgtcctatggacaa

SEQ ID NO: 4082504 - DNA, 23 bp, Homo sapiens
gagccagttgtcctatggacaac

SEQ ID NO: 4082505 - DNA, 18 bp, Homo sapiens
gagccatcactagaagaa

SEQ ID NO: 4082506 - DNA, 14 bp, Homo sapiens
gagccatgctggga

SEQ ID NO: 4082507 - DNA, 11 bp, Homo sapiens
gagcccactgt

SEQ ID NO: 4082508 - DNA, 22 bp, Homo sapiens
gagcccagaggtaacagaacag

SEQ ID NO: 4082509 - DNA, 17 bp, Homo sapiens
gagcccagcctgggagc

SEQ ID NO: 4082510 - DNA, 21 bp, Homo sapiens
gagcccagcctgggagcccag

SEQ ID NO: 4082511 - DNA, 12 bp, Homo sapiens
gagcccagctgc

SEQ ID NO: 4082512 - DNA, 16 bp, Homo sapiens
gagcccagctgcctgg

SEQ ID NO: 4082513 - DNA, 21 bp, Homo sapiens
gagcccagctgcctggagagg

SEQ ID NO: 4082514 - DNA, 22 bp, Homo sapiens
gagcccagctgcctggagaggg

SEQ ID NO: 4082515 - DNA, 22 bp, Homo sapiens
gagcccagctgggtcaggcagg

SEQ ID NO: 4082516 - DNA, 17 bp, Homo sapiens
gagcccagtgaagcctc

SEQ ID NO: 4082517 - DNA, 20 bp, Homo sapiens
gagcccagtgaagcctctga

SEQ ID NO: 4082518 - DNA, 13 bp, Homo sapiens
gagcccatactca

SEQ ID NO: 4082519 - DNA, 13 bp, Homo sapiens
gagcccattccca

SEQ ID NO: 4082520 - DNA, 13 bp, Homo sapiens
gagcccccagcag

SEQ ID NO: 4082521 - DNA, 18 bp, Homo sapiens
gagcccccagcagaggca

SEQ ID NO: 4082522 - DNA, 19 bp, Homo sapiens
gagcccccagcagaggcag

SEQ ID NO: 4082523 - DNA, 13 bp, Homo sapiens
gagccccccacaa

SEQ ID NO: 4082524 - DNA, 15 bp, Homo sapiens
gagcccctcctccag

SEQ ID NO: 4082525 - DNA, 14 bp, Homo sapiens
gagcccctggtcct

SEQ ID NO: 4082526 - DNA, 23 bp, Homo sapiens
gagccccttcgggagcagggctg

SEQ ID NO: 4082527 - DNA, 21 bp, Homo sapiens
gagccccttctgctcagctct

SEQ ID NO: 4082528 - DNA, 17 bp, Homo sapiens
gagcccggatgcttctc

SEQ ID NO: 4082529 - DNA, 18 bp, Homo sapiens
gagccctgaccttggctg

SEQ ID NO: 4082530 - DNA, 15 bp, Homo sapiens
gagccctgccctgca

SEQ ID NO: 4082531 - DNA, 14 bp, Homo sapiens
gagccctgctccct

SEQ ID NO: 4082532 - DNA, 21 bp, Homo sapiens
gagccctggacacccctgctc

SEQ ID NO: 4082533 - DNA, 18 bp, Homo sapiens
gagccctggctgggttca

SEQ ID NO: 4082534 - DNA, 23 bp, Homo sapiens
gagccctggggactgttccaaag

SEQ ID NO: 4082535 - DNA, 20 bp, Homo sapiens
gagccctgttcctccctccc

SEQ ID NO: 4082536 - DNA, 16 bp, Homo sapiens
gagcccttgcctcccc

SEQ ID NO: 4082537 - DNA, 17 bp, Homo sapiens
gagcccttgcctcccca

SEQ ID NO: 4082538 - DNA, 22 bp, Homo sapiens
gagccgccaccgggcatgtctg

SEQ ID NO: 4082539 - DNA, 12 bp, Homo sapiens
gagccgcgggga

SEQ ID NO: 4082540 - DNA, 15 bp, Homo sapiens
gagccgggcccctgg

SEQ ID NO: 4082541 - DNA, 16 bp, Homo sapiens
gagccgggcccctggg

SEQ ID NO: 4082542 - DNA, 18 bp, Homo sapiens
gagccggtaactgtcctg

SEQ ID NO: 4082543 - DNA, 21 bp, Homo sapiens
gagccggtaactgtcctgtcc

SEQ ID NO: 4082544 - DNA, 20 bp, Homo sapiens
gagcctacctgtatgtcaat

SEQ ID NO: 4082545 - DNA, 17 bp, Homo sapiens
gagcctagcggagccca

SEQ ID NO: 4082546 - DNA, 16 bp, Homo sapiens
gagcctagctcctgcc

SEQ ID NO: 4082547 - DNA, 11 bp, Homo sapiens
gagcctcccca

SEQ ID NO: 4082548 - DNA, 21 bp, Homo sapiens
gagcctccccatctgtccagc

SEQ ID NO: 4082549 - DNA, 15 bp, Homo sapiens
gagcctcctgtgcct

SEQ ID NO: 4082550 - DNA, 19 bp, Homo sapiens
gagcctcctgtgcctggcc

SEQ ID NO: 4082551 - DNA, 21 bp, Homo sapiens
gagcctcgtccctccctcact

SEQ ID NO: 4082552 - DNA, 13 bp, Homo sapiens
gagcctgccccag

SEQ ID NO: 4082553 - DNA, 16 bp, Homo sapiens
gagcctgcctggagcg

SEQ ID NO: 4082554 - DNA, 12 bp, Homo sapiens
gagcctgctgga

SEQ ID NO: 4082555 - DNA, 12 bp, Homo sapiens
gagcctgctggc

SEQ ID NO: 4082556 - DNA, 21 bp, Homo sapiens
gagcctgctggtcacagcctc

SEQ ID NO: 4082557 - DNA, 13 bp, Homo sapiens
gagcctggagaag

SEQ ID NO: 4082558 - DNA, 14 bp, Homo sapiens
gagcctggagaagc

SEQ ID NO: 4082559 - DNA, 12 bp, Homo sapiens
gagcctggcccc

SEQ ID NO: 4082560 - DNA, 20 bp, Homo sapiens
gagcctggccccaggcccca

SEQ ID NO: 4082561 - DNA, 15 bp, Homo sapiens
gagcctggtcctggc

SEQ ID NO: 4082562 - DNA, 17 bp, Homo sapiens
gagccttctcagaagca

SEQ ID NO: 4082563 - DNA, 18 bp, Homo sapiens
gagcctttggttctggcc

SEQ ID NO: 4082564 - DNA, 23 bp, Homo sapiens
gagcctttggttctggccagaat

SEQ ID NO: 4082565 - DNA, 18 bp, Homo sapiens
gagccttttatctgcaga

SEQ ID NO: 4082566 - DNA, 23 bp, Homo sapiens
gagccttttccctctttggctcc

SEQ ID NO: 4082567 - DNA, 18 bp, Homo sapiens
gagccttttgctctctgt

SEQ ID NO: 4082568 - DNA, 15 bp, Homo sapiens
gagcgccaggaagcc

SEQ ID NO: 4082569 - DNA, 16 bp, Homo sapiens
gagcgccaggaagcca

SEQ ID NO: 4082570 - DNA, 17 bp, Homo sapiens
gagcgccaggaagccag

SEQ ID NO: 4082571 - DNA, 18 bp, Homo sapiens
gagcgccaggaagccaga

SEQ ID NO: 4082572 - DNA, 21 bp, Homo sapiens
gagcgccaggaagccagagcc

SEQ ID NO: 4082573 - DNA, 18 bp, Homo sapiens
gagcgctggtcccctccc

SEQ ID NO: 4082574 - DNA, 12 bp, Homo sapiens
gagcgggaggca

SEQ ID NO: 4082575 - DNA, 13 bp, Homo sapiens
gagcgggaggcag

SEQ ID NO: 4082576 - DNA, 16 bp, Homo sapiens
gagcgggaggcagagt

SEQ ID NO: 4082577 - DNA, 13 bp, Homo sapiens
gagcggtggggga

SEQ ID NO: 4082578 - DNA, 16 bp, Homo sapiens
gagcgtagcatacagg

SEQ ID NO: 4082579 - DNA, 19 bp, Homo sapiens
gagctaaactccttcctgg

SEQ ID NO: 4082580 - DNA, 15 bp, Homo sapiens
gagctaagggtgggt

SEQ ID NO: 4082581 - DNA, 20 bp, Homo sapiens
gagctaagggtgggtgctca

SEQ ID NO: 4082582 - DNA, 22 bp, Homo sapiens
gagctaagggtgggtgctcaga

SEQ ID NO: 4082583 - DNA, 23 bp, Homo sapiens
gagctaagggtgggtgctcagaa

SEQ ID NO: 4082584 - DNA, 14 bp, Homo sapiens
gagctactgatgaa

SEQ ID NO: 4082585 - DNA, 18 bp, Homo sapiens
gagctactgatgaaatct

SEQ ID NO: 4082586 - DNA, 19 bp, Homo sapiens
gagctatggcccagaaaca

SEQ ID NO: 4082587 - DNA, 13 bp, Homo sapiens
gagctatttccat

SEQ ID NO: 4082588 - DNA, 21 bp, Homo sapiens
gagctatttccattccagaat

SEQ ID NO: 4082589 - DNA, 14 bp, Homo sapiens
gagctattttcctc

SEQ ID NO: 4082590 - DNA, 15 bp, Homo sapiens
gagctattttcctct

SEQ ID NO: 4082591 - DNA, 17 bp, Homo sapiens
gagctcacatgggactg

SEQ ID NO: 4082592 - DNA, 14 bp, Homo sapiens
gagctccccagatc

SEQ ID NO: 4082593 - DNA, 16 bp, Homo sapiens
gagctccccagatctc

SEQ ID NO: 4082594 - DNA, 22 bp, Homo sapiens
gagctccccagatctcccactg

SEQ ID NO: 4082595 - DNA, 17 bp, Homo sapiens
gagctccccccaggtct

SEQ ID NO: 4082596 - DNA, 17 bp, Homo sapiens
gagctcctctcctggag

SEQ ID NO: 4082597 - DNA, 23 bp, Homo sapiens
gagctcctgctgcggaggagctg

SEQ ID NO: 4082598 - DNA, 17 bp, Homo sapiens
gagctctaccctgctcc

SEQ ID NO: 4082599 - DNA, 18 bp, Homo sapiens
gagctctggggacagctt

SEQ ID NO: 4082600 - DNA, 20 bp, Homo sapiens
cttcctgctgcaccctgcgc

SEQ ID NO: 4082601 - DNA, 15 bp, Homo sapiens
cttcctggcctgaga

SEQ ID NO: 4082602 - DNA, 13 bp, Homo sapiens
cttcctgtcccca

SEQ ID NO: 4082603 - DNA, 14 bp, Homo sapiens
cttcctgtccctga

SEQ ID NO: 4082604 - DNA, 18 bp, Homo sapiens
cttcctgtggctttgttt

SEQ ID NO: 4082605 - DNA, 21 bp, Homo sapiens
cttcctgtggctttgttttct

SEQ ID NO: 4082606 - DNA, 23 bp, Homo sapiens
cttcctgtggctttgttttctta

SEQ ID NO: 4082607 - DNA, 12 bp, Homo sapiens
cttcctgtgtcc

SEQ ID NO: 4082608 - DNA, 14 bp, Homo sapiens
cttcctgtgtcctg

SEQ ID NO: 4082609 - DNA, 23 bp, Homo sapiens
cttcctgtttcagacccccccat

SEQ ID NO: 4082610 - DNA, 22 bp, Homo sapiens
cttccttcagggtttaatagac

SEQ ID NO: 4082611 - DNA, 13 bp, Homo sapiens
cttccttcctgtt

SEQ ID NO: 4082612 - DNA, 18 bp, Homo sapiens
cttccttgagacacggag

SEQ ID NO: 4082613 - DNA, 20 bp, Homo sapiens
cttccttgttgtttgctttg

SEQ ID NO: 4082614 - DNA, 15 bp, Homo sapiens
cttcctttaaaaaac

SEQ ID NO: 4082615 - DNA, 16 bp, Homo sapiens
cttcctttaaaaaact

SEQ ID NO: 4082616 - DNA, 17 bp, Homo sapiens
cttcctttctccaggac

SEQ ID NO: 4082617 - DNA, 14 bp, Homo sapiens
cttccttttccctg

SEQ ID NO: 4082618 - DNA, 19 bp, Homo sapiens
cttccttttccctgcttcc

SEQ ID NO: 4082619 - DNA, 15 bp, Homo sapiens
cttcgaaacctggga

SEQ ID NO: 4082620 - DNA, 18 bp, Homo sapiens
cttcgactcaggatccag

SEQ ID NO: 4082621 - DNA, 15 bp, Homo sapiens
cttcgcctttcccac

SEQ ID NO: 4082622 - DNA, 12 bp, Homo sapiens
cttcgctggact

SEQ ID NO: 4082623 - DNA, 17 bp, Homo sapiens
cttcggacagacatatg

SEQ ID NO: 4082624 - DNA, 22 bp, Homo sapiens
cttcgggagcagggctgtgtcc

SEQ ID NO: 4082625 - DNA, 18 bp, Homo sapiens
cttcggggcgatgctccc

SEQ ID NO: 4082626 - DNA, 14 bp, Homo sapiens
cttcgtccttttgg

SEQ ID NO: 4082627 - DNA, 18 bp, Homo sapiens
cttcgtccttttggttta

SEQ ID NO: 4082628 - DNA, 23 bp, Homo sapiens
cttcgtgaacatcccctcccatc

SEQ ID NO: 4082629 - DNA, 13 bp, Homo sapiens
cttctaaaaactt

SEQ ID NO: 4082630 - DNA, 15 bp, Homo sapiens
cttctaaatgcatat

SEQ ID NO: 4082631 - DNA, 16 bp, Homo sapiens
cttctaacccaactga

SEQ ID NO: 4082632 - DNA, 19 bp, Homo sapiens
cttctaatgaagacaatga

SEQ ID NO: 4082633 - DNA, 20 bp, Homo sapiens
cttctaatttatattatcca

SEQ ID NO: 4082634 - DNA, 17 bp, Homo sapiens
cttctacaaccagagcc

SEQ ID NO: 4082635 - DNA, 19 bp, Homo sapiens
cttctacaaccagagcccc

SEQ ID NO: 4082636 - DNA, 20 bp, Homo sapiens
cttctacaaccagagccccc

SEQ ID NO: 4082637 - DNA, 18 bp, Homo sapiens
cttctacatttgagggcc

SEQ ID NO: 4082638 - DNA, 15 bp, Homo sapiens
cttctacctgccctc

SEQ ID NO: 4082639 - DNA, 15 bp, Homo sapiens
cttctactcccctta

SEQ ID NO: 4082640 - DNA, 17 bp, Homo sapiens
cttctactcctgcctca

SEQ ID NO: 4082641 - DNA, 21 bp, Homo sapiens
cttctacttttaagttgctga

SEQ ID NO: 4082642 - DNA, 15 bp, Homo sapiens
cttctagaattataa

SEQ ID NO: 4082643 - DNA, 13 bp, Homo sapiens
cttctatatttta

SEQ ID NO: 4082644 - DNA, 19 bp, Homo sapiens
cttctatattttaatagaa

SEQ ID NO: 4082645 - DNA, 18 bp, Homo sapiens
cttctcaaaaaataatta

SEQ ID NO: 4082646 - DNA, 15 bp, Homo sapiens
cttctcaagatactg

SEQ ID NO: 4082647 - DNA, 15 bp, Homo sapiens
cttctcatagcatta

SEQ ID NO: 4082648 - DNA, 22 bp, Homo sapiens
cttctcatagcattaactaatc

SEQ ID NO: 4082649 - DNA, 20 bp, Homo sapiens
cttctcatcttgacagagcc

SEQ ID NO: 4082650 - DNA, 18 bp, Homo sapiens
cttctcattacccacccg

SEQ ID NO: 4082651 - DNA, 13 bp, Homo sapiens
cttctccactgga

SEQ ID NO: 4082652 - DNA, 17 bp, Homo sapiens
cttctccactggatgga

SEQ ID NO: 4082653 - DNA, 17 bp, Homo sapiens
cttctcccacatgaggc

SEQ ID NO: 4082654 - DNA, 14 bp, Homo sapiens
cttctccccttcca

SEQ ID NO: 4082655 - DNA, 15 bp, Homo sapiens
cttctccccttccat

SEQ ID NO: 4082656 - DNA, 19 bp, Homo sapiens
cttctccccttccatttct

SEQ ID NO: 4082657 - DNA, 15 bp, Homo sapiens
cttctccgccagcct

SEQ ID NO: 4082658 - DNA, 18 bp, Homo sapiens
cttctcctccccacccgc

SEQ ID NO: 4082659 - DNA, 17 bp, Homo sapiens
cttctccttccccagga

SEQ ID NO: 4082660 - DNA, 19 bp, Homo sapiens
cttctccttccccaggatg

SEQ ID NO: 4082661 - DNA, 14 bp, Homo sapiens
cttctcctttcaca

SEQ ID NO: 4082662 - DNA, 17 bp, Homo sapiens
cttctcctttcacaacc

SEQ ID NO: 4082663 - DNA, 20 bp, Homo sapiens
cttctcctttcacaaccttc

SEQ ID NO: 4082664 - DNA, 22 bp, Homo sapiens
cttctcctttcacaaccttctg

SEQ ID NO: 4082665 - DNA, 13 bp, Homo sapiens
cttctcggctcag

SEQ ID NO: 4082666 - DNA, 14 bp, Homo sapiens
cttctctctccagg

SEQ ID NO: 4082667 - DNA, 14 bp, Homo sapiens
cttctctctgctct

SEQ ID NO: 4082668 - DNA, 13 bp, Homo sapiens
cttctctgaacac

SEQ ID NO: 4082669 - DNA, 21 bp, Homo sapiens
cttctctgaacacaggcagct

SEQ ID NO: 4082670 - DNA, 19 bp, Homo sapiens
cttctctgcctttgacatt

SEQ ID NO: 4082671 - DNA, 13 bp, Homo sapiens
cttctctgctcca

SEQ ID NO: 4082672 - DNA, 21 bp, Homo sapiens
cttctctgctccaccacatcc

SEQ ID NO: 4082673 - DNA, 21 bp, Homo sapiens
cttctctgggtctgattttct

SEQ ID NO: 4082674 - DNA, 21 bp, Homo sapiens
cttctctgttcccttgcaggg

SEQ ID NO: 4082675 - DNA, 15 bp, Homo sapiens
cttctcttaatttaa

SEQ ID NO: 4082676 - DNA, 16 bp, Homo sapiens
cttctcttccaggcag

SEQ ID NO: 4082677 - DNA, 17 bp, Homo sapiens
cttctcttccaggcagc

SEQ ID NO: 4082678 - DNA, 17 bp, Homo sapiens
cttctcttgaaaagttc

SEQ ID NO: 4082679 - DNA, 13 bp, Homo sapiens
cttctcttgcttt

SEQ ID NO: 4082680 - DNA, 18 bp, Homo sapiens
cttctgaaccgcaaggag

SEQ ID NO: 4082681 - DNA, 12 bp, Homo sapiens
cttctgaactca

SEQ ID NO: 4082682 - DNA, 15 bp, Homo sapiens
cttctgaatatttta

SEQ ID NO: 4082683 - DNA, 19 bp, Homo sapiens
cttctgacataatccagta

SEQ ID NO: 4082684 - DNA, 16 bp, Homo sapiens
cttctgactcttcccc

SEQ ID NO: 4082685 - DNA, 17 bp, Homo sapiens
cttctgactcttcccca

SEQ ID NO: 4082686 - DNA, 21 bp, Homo sapiens
cttctgactgctgattctccc

SEQ ID NO: 4082687 - DNA, 16 bp, Homo sapiens
cttctgcaagcctcat

SEQ ID NO: 4082688 - DNA, 18 bp, Homo sapiens
cttctgcaagcctcatgc

SEQ ID NO: 4082689 - DNA, 11 bp, Homo sapiens
cttctgccctt

SEQ ID NO: 4082690 - DNA, 23 bp, Homo sapiens
cttctgcctgaggggcagcctgc

SEQ ID NO: 4082691 - DNA, 14 bp, Homo sapiens
cttctgctccaccc

SEQ ID NO: 4082692 - DNA, 18 bp, Homo sapiens
cttctgctcttttcctgg

SEQ ID NO: 4082693 - DNA, 14 bp, Homo sapiens
cttctgcttttctg

SEQ ID NO: 4082694 - DNA, 22 bp, Homo sapiens
cttctgcttttctgccctggct

SEQ ID NO: 4082695 - DNA, 15 bp, Homo sapiens
cttctggacactgag

SEQ ID NO: 4082696 - DNA, 15 bp, Homo sapiens
cttctggcctctgct

SEQ ID NO: 4082697 - DNA, 22 bp, Homo sapiens
cttgatctctcttgtcctcttc

SEQ ID NO: 4082698 - DNA, 13 bp, Homo sapiens
cttgatcttaaag

SEQ ID NO: 4082699 - DNA, 15 bp, Homo sapiens
cttgatcttaaagat

SEQ ID NO: 4082700 - DNA, 17 bp, Homo sapiens
cttgatggtgacagctg

SEQ ID NO: 4082701 - DNA, 15 bp, Homo sapiens
cttgatgtgttatct

SEQ ID NO: 4082702 - DNA, 18 bp, Homo sapiens
cttgatgtgttatctctt

SEQ ID NO: 4082703 - DNA, 15 bp, Homo sapiens
cttgattaagatttt

SEQ ID NO: 4082704 - DNA, 18 bp, Homo sapiens
cttgattaagattttaca

SEQ ID NO: 4082705 - DNA, 13 bp, Homo sapiens
cttgattctgcag

SEQ ID NO: 4082706 - DNA, 17 bp, Homo sapiens
cttgattctgcagtaaa

SEQ ID NO: 4082707 - DNA, 20 bp, Homo sapiens
cttgattctgcagtaaatct

SEQ ID NO: 4082708 - DNA, 18 bp, Homo sapiens
cttgatttaaacacacag

SEQ ID NO: 4082709 - DNA, 12 bp, Homo sapiens
cttgatttgcat

SEQ ID NO: 4082710 - DNA, 18 bp, Homo sapiens
cttgattttaatacattg

SEQ ID NO: 4082711 - DNA, 18 bp, Homo sapiens
cttgatttttttaaacat

SEQ ID NO: 4082712 - DNA, 22 bp, Homo sapiens
cttggcttacctgacctcttgc

SEQ ID NO: 4082713 - DNA, 22 bp, Homo sapiens
cttgggaagctgaggcgggaga

SEQ ID NO: 4082714 - DNA, 11 bp, Homo sapiens
cttgggacagc

SEQ ID NO: 4082715 - DNA, 20 bp, Homo sapiens
cttgggacccccactaagac

SEQ ID NO: 4082716 - DNA, 14 bp, Homo sapiens
cttgggaggctgag

SEQ ID NO: 4082717 - DNA, 14 bp, Homo sapiens
cttgggagttttga

SEQ ID NO: 4082718 - DNA, 17 bp, Homo sapiens
cttgggatagtgttctg

SEQ ID NO: 4082719 - DNA, 20 bp, Homo sapiens
cttgggatagtgttctgctc

SEQ ID NO: 4082720 - DNA, 22 bp, Homo sapiens
cttgggatggggagtcccaaag

SEQ ID NO: 4082721 - DNA, 20 bp, Homo sapiens
cttgggcagtgccccaggga

SEQ ID NO: 4082722 - DNA, 23 bp, Homo sapiens
cttgggccccagaccccagggca

SEQ ID NO: 4082723 - DNA, 17 bp, Homo sapiens
cttgggccctgcacaga

SEQ ID NO: 4082724 - DNA, 12 bp, Homo sapiens
cttgggcctggg

SEQ ID NO: 4082725 - DNA, 22 bp, Homo sapiens
cttgggccttgctgctgctgca

SEQ ID NO: 4082726 - DNA, 21 bp, Homo sapiens
cttgggctatttggactcagg

SEQ ID NO: 4082727 - DNA, 13 bp, Homo sapiens
cttgggctctgct

SEQ ID NO: 4082728 - DNA, 14 bp, Homo sapiens
cttgggctgctcct

SEQ ID NO: 4082729 - DNA, 17 bp, Homo sapiens
cttggggaacccatgag

SEQ ID NO: 4082730 - DNA, 11 bp, Homo sapiens
cttggggaggc

SEQ ID NO: 4082731 - DNA, 13 bp, Homo sapiens
cttggggaggcaa

SEQ ID NO: 4082732 - DNA, 22 bp, Homo sapiens
cttgggggaacgatgtgtctgt

SEQ ID NO: 4082733 - DNA, 19 bp, Homo sapiens
cttgggggctcccagggca

SEQ ID NO: 4082734 - DNA, 14 bp, Homo sapiens
cttggggtactctt

SEQ ID NO: 4082735 - DNA, 22 bp, Homo sapiens
cttggggtcaggaacagtggct

SEQ ID NO: 4082736 - DNA, 22 bp, Homo sapiens
cttggggtcaggttgacaggag

SEQ ID NO: 4082737 - DNA, 18 bp, Homo sapiens
cttggggtccctccaccc

SEQ ID NO: 4082738 - DNA, 22 bp, Homo sapiens
cttggggttaagtctcctgtct

SEQ ID NO: 4082739 - DNA, 16 bp, Homo sapiens
cttgggtcattgacct

SEQ ID NO: 4082740 - DNA, 22 bp, Homo sapiens
cttgggtcattgacctctcagg

SEQ ID NO: 4082741 - DNA, 18 bp, Homo sapiens
cttgggtctgaatttatt

SEQ ID NO: 4082742 - DNA, 17 bp, Homo sapiens
cttgggtgggtgaaggc

SEQ ID NO: 4082743 - DNA, 17 bp, Homo sapiens
cttgggttccaaccagg

SEQ ID NO: 4082744 - DNA, 19 bp, Homo sapiens
cttgggttccaaccaggca

SEQ ID NO: 4082745 - DNA, 15 bp, Homo sapiens
cttggtaagaagccg

SEQ ID NO: 4082746 - DNA, 16 bp, Homo sapiens
cttggtcacagccagg

SEQ ID NO: 4082747 - DNA, 16 bp, Homo sapiens
cttggtctttgtatct

SEQ ID NO: 4082748 - DNA, 13 bp, Homo sapiens
cttggtgccacca

SEQ ID NO: 4082749 - DNA, 17 bp, Homo sapiens
cttggtgccttttgtgt

SEQ ID NO: 4082750 - DNA, 22 bp, Homo sapiens
cttggtggttctatcaggggtg

SEQ ID NO: 4082751 - DNA, 12 bp, Homo sapiens
cttggtgtaatt

SEQ ID NO: 4082752 - DNA, 16 bp, Homo sapiens
cttggtgtaatttgaa

SEQ ID NO: 4082753 - DNA, 15 bp, Homo sapiens
cttggtgtgattgca

SEQ ID NO: 4082754 - DNA, 18 bp, Homo sapiens
cttggtgtgattgcacag

SEQ ID NO: 4082755 - DNA, 23 bp, Homo sapiens
cttggttcaataaagcactgagc

SEQ ID NO: 4082756 - DNA, 17 bp, Homo sapiens
cttggttcataaatgaa

SEQ ID NO: 4082757 - DNA, 22 bp, Homo sapiens
cttggtttgtggcgtctccctc

SEQ ID NO: 4082758 - DNA, 21 bp, Homo sapiens
cttggtttgttatatcaggga

SEQ ID NO: 4082759 - DNA, 22 bp, Homo sapiens
cttggtttgttatatcagggaa

SEQ ID NO: 4082760 - DNA, 14 bp, Homo sapiens
cttgtaaagactgg

SEQ ID NO: 4082761 - DNA, 15 bp, Homo sapiens
cttgtaattctaaat

SEQ ID NO: 4082762 - DNA, 22 bp, Homo sapiens
cttgtaatttttttaatttaca

SEQ ID NO: 4082763 - DNA, 22 bp, Homo sapiens
cttgtacccccaggtggaaggc

SEQ ID NO: 4082764 - DNA, 18 bp, Homo sapiens
cttgtacttgtttcatct

SEQ ID NO: 4082765 - DNA, 19 bp, Homo sapiens
cttgtagaactcactctgg

SEQ ID NO: 4082766 - DNA, 23 bp, Homo sapiens
cttgtattaaactcttcacaaaa

SEQ ID NO: 4082767 - DNA, 17 bp, Homo sapiens
cttgtattaaagacaga

SEQ ID NO: 4082768 - DNA, 15 bp, Homo sapiens
cttgtcaatatttaa

SEQ ID NO: 4082769 - DNA, 15 bp, Homo sapiens
cttgtcacaataaat

SEQ ID NO: 4082770 - DNA, 17 bp, Homo sapiens
cttgtcacaataaatgt

SEQ ID NO: 4082771 - DNA, 14 bp, Homo sapiens
cttgtcattccaga

SEQ ID NO: 4082772 - DNA, 15 bp, Homo sapiens
cttgtcattccagag

SEQ ID NO: 4082773 - DNA, 14 bp, Homo sapiens
cttgtccctttccc

SEQ ID NO: 4082774 - DNA, 22 bp, Homo sapiens
cttgtcctcagtccatttatat

SEQ ID NO: 4082775 - DNA, 17 bp, Homo sapiens
cttgtcctgggcctgcc

SEQ ID NO: 4082776 - DNA, 19 bp, Homo sapiens
cttgtcgctttctcagtgt

SEQ ID NO: 4082777 - DNA, 12 bp, Homo sapiens
cttgtctccact

SEQ ID NO: 4082778 - DNA, 18 bp, Homo sapiens
cttgtctcctactcctga

SEQ ID NO: 4082779 - DNA, 14 bp, Homo sapiens
cttgtctctgggct

SEQ ID NO: 4082780 - DNA, 13 bp, Homo sapiens
cttgtctttattt

SEQ ID NO: 4082781 - DNA, 14 bp, Homo sapiens
cttgtgaaacacag

SEQ ID NO: 4082782 - DNA, 15 bp, Homo sapiens
cttgtgaagttgttt

SEQ ID NO: 4082783 - DNA, 19 bp, Homo sapiens
cttgtgagagcccattccc

SEQ ID NO: 4082784 - DNA, 22 bp, Homo sapiens
cttgtgagagcccattcccacc

SEQ ID NO: 4082785 - DNA, 17 bp, Homo sapiens
cttgtgattatttatta

SEQ ID NO: 4082786 - DNA, 16 bp, Homo sapiens
cttgtgatttctttaa

SEQ ID NO: 4082787 - DNA, 22 bp, Homo sapiens
cttgtgatttctttaaaagaat

SEQ ID NO: 4082788 - DNA, 16 bp, Homo sapiens
cttgtgctttgctctt

SEQ ID NO: 4082789 - DNA, 14 bp, Homo sapiens
cttgtggcctcaag

SEQ ID NO: 4082790 - DNA, 14 bp, Homo sapiens
cttgtgggctggtg

SEQ ID NO: 4082791 - DNA, 14 bp, Homo sapiens
cttgtgggtccatg

SEQ ID NO: 4082792 - DNA, 21 bp, Homo sapiens
cttgtggtgtaaagctggccc

SEQ ID NO: 4082793 - DNA, 19 bp, Homo sapiens
cttgtgtcctgtcctttct

SEQ ID NO: 4082794 - DNA, 21 bp, Homo sapiens
cttgtgtgtgggctgtgagtg

SEQ ID NO: 4082795 - DNA, 14 bp, Homo sapiens
cttgtgttctgctc

SEQ ID NO: 4082796 - DNA, 13 bp, Homo sapiens
cttgtgtttgctt

SEQ ID NO: 4082797 - DNA, 21 bp, Homo sapiens
cttgtgtttgcttaaacaaag

SEQ ID NO: 4082798 - DNA, 13 bp, Homo sapiens
cttgttagaaaac

SEQ ID NO: 4082799 - DNA, 20 bp, Homo sapiens
cttgttatattaagcagaaa

SEQ ID NO: 4082800 - DNA, 18 bp, Homo sapiens
cttgttcttccaaagcag

SEQ ID NO: 4082801 - DNA, 20 bp, Homo sapiens
cttgttcttccaaagcagag

SEQ ID NO: 4082802 - DNA, 14 bp, Homo sapiens
cttgttggtcagag

SEQ ID NO: 4082803 - DNA, 20 bp, Homo sapiens
cttgttgttggttgtttttt

SEQ ID NO: 4082804 - DNA, 20 bp, Homo sapiens
cttgttgtttgctttggtct

SEQ ID NO: 4082805 - DNA, 22 bp, Homo sapiens
cttgtttatcagatacatcact

SEQ ID NO: 4082806 - DNA, 22 bp, Homo sapiens
cttgtttcaattccacctgcaa

SEQ ID NO: 4082807 - DNA, 21 bp, Homo sapiens
cttgtttgagtttttcctccc

SEQ ID NO: 4082808 - DNA, 15 bp, Homo sapiens
cttgtttgtcttcca

SEQ ID NO: 4082809 - DNA, 13 bp, Homo sapiens
cttgttttataaa

SEQ ID NO: 4082810 - DNA, 14 bp, Homo sapiens
cttgttttcttgcc

SEQ ID NO: 4082811 - DNA, 20 bp, Homo sapiens
cttgttttctttctttaaat

SEQ ID NO: 4082812 - DNA, 22 bp, Homo sapiens
cttgttttgaggtagaaatgca

SEQ ID NO: 4082813 - DNA, 14 bp, Homo sapiens
cttgttttggacag

SEQ ID NO: 4082814 - DNA, 18 bp, Homo sapiens
cttgtttttattaattta

SEQ ID NO: 4082815 - DNA, 21 bp, Homo sapiens
cttgttttttttttccactta

SEQ ID NO: 4082816 - DNA, 20 bp, Homo sapiens
ctttaaaaaaaaaagttaca

SEQ ID NO: 4082817 - DNA, 19 bp, Homo sapiens
ctttaaaaaatatttatta

SEQ ID NO: 4082818 - DNA, 18 bp, Homo sapiens
ctttaaaaagcagtcctc

SEQ ID NO: 4082819 - DNA, 21 bp, Homo sapiens
ctttaaaaagggaagaaactg

SEQ ID NO: 4082820 - DNA, 13 bp, Homo sapiens
ctttaaaagagag

SEQ ID NO: 4082821 - DNA, 22 bp, Homo sapiens
ctttaaaagagagagagagaaa

SEQ ID NO: 4082822 - DNA, 16 bp, Homo sapiens
ctttaaaaggaaagaa

SEQ ID NO: 4082823 - DNA, 17 bp, Homo sapiens
ctttaaaattacaacta

SEQ ID NO: 4082824 - DNA, 17 bp, Homo sapiens
ctttaaacagtatttca

SEQ ID NO: 4082825 - DNA, 13 bp, Homo sapiens
ctttaaaggaaaa

SEQ ID NO: 4082826 - DNA, 14 bp, Homo sapiens
ctttaaaggaaaaa

SEQ ID NO: 4082827 - DNA, 18 bp, Homo sapiens
ctttaaaggaaaaaatgt

SEQ ID NO: 4082828 - DNA, 19 bp, Homo sapiens
ctttaaaggaaaaaatgtt

SEQ ID NO: 4082829 - DNA, 18 bp, Homo sapiens
ctttaaatgttttataag

SEQ ID NO: 4082830 - DNA, 22 bp, Homo sapiens
ctttaaatgttttataagttca

SEQ ID NO: 4082831 - DNA, 20 bp, Homo sapiens
ctttaacacagacccctagg

SEQ ID NO: 4082832 - DNA, 20 bp, Homo sapiens
ctttaacttttttttctctc

SEQ ID NO: 4082833 - DNA, 15 bp, Homo sapiens
ctttaagactgagca

SEQ ID NO: 4082834 - DNA, 12 bp, Homo sapiens
ctttaagccata

SEQ ID NO: 4082835 - DNA, 19 bp, Homo sapiens
ctttaatcaggtcctgctc

SEQ ID NO: 4082836 - DNA, 17 bp, Homo sapiens
ctttaatggcctggagg

SEQ ID NO: 4082837 - DNA, 21 bp, Homo sapiens
ctttaatgttttttgccacag

SEQ ID NO: 4082838 - DNA, 17 bp, Homo sapiens
ctttaattactggaatt

SEQ ID NO: 4082839 - DNA, 14 bp, Homo sapiens
ctttaattctgtat

SEQ ID NO: 4082840 - DNA, 20 bp, Homo sapiens
ctttacaaaagaaatacctt

SEQ ID NO: 4082841 - DNA, 18 bp, Homo sapiens
ctttacaaacaaaagcat

SEQ ID NO: 4082842 - DNA, 17 bp, Homo sapiens
ctttacaagcaggcact

SEQ ID NO: 4082843 - DNA, 13 bp, Homo sapiens
ctttactcccaag

SEQ ID NO: 4082844 - DNA, 20 bp, Homo sapiens
ctttagaccctcgggcccca

SEQ ID NO: 4082845 - DNA, 23 bp, Homo sapiens
ctttagaccctgggtgggctctg

SEQ ID NO: 4082846 - DNA, 20 bp, Homo sapiens
ctttagagaagatggatatg

SEQ ID NO: 4082847 - DNA, 17 bp, Homo sapiens
ctttagtatcagtgttt

SEQ ID NO: 4082848 - DNA, 13 bp, Homo sapiens
ctttataaacttt

SEQ ID NO: 4082849 - DNA, 19 bp, Homo sapiens
ctttataaggaaatgtatt

SEQ ID NO: 4082850 - DNA, 23 bp, Homo sapiens
ctttatacattagtaaatgtctt

SEQ ID NO: 4082851 - DNA, 23 bp, Homo sapiens
ctttatcacaaccaccgttacaa

SEQ ID NO: 4082852 - DNA, 17 bp, Homo sapiens
ctttatctctgaggcta

SEQ ID NO: 4082853 - DNA, 15 bp, Homo sapiens
ctttatgcacaaaat

SEQ ID NO: 4082854 - DNA, 15 bp, Homo sapiens
ctttatgtgaatttt

SEQ ID NO: 4082855 - DNA, 20 bp, Homo sapiens
ctttatgttcatttgtttgt

SEQ ID NO: 4082856 - DNA, 15 bp, Homo sapiens
ctttattaatcacta

SEQ ID NO: 4082857 - DNA, 23 bp, Homo sapiens
ctttattccagaatgctgtacat

SEQ ID NO: 4082858 - DNA, 11 bp, Homo sapiens
ctttatttctg

SEQ ID NO: 4082859 - DNA, 11 bp, Homo sapiens
ctttattttct

SEQ ID NO: 4082860 - DNA, 18 bp, Homo sapiens
ctttattttttaagtatt

SEQ ID NO: 4082861 - DNA, 22 bp, Homo sapiens
ctttattttttaagtatttata

SEQ ID NO: 4082862 - DNA, 14 bp, Homo sapiens
ctttcaaaaacatg

SEQ ID NO: 4082863 - DNA, 19 bp, Homo sapiens
ctttcaagggctttcctgt

SEQ ID NO: 4082864 - DNA, 20 bp, Homo sapiens
ctttcaagtctgactctcca

SEQ ID NO: 4082865 - DNA, 20 bp, Homo sapiens
ctttcaattgtcacttttta

SEQ ID NO: 4082866 - DNA, 12 bp, Homo sapiens
ctttcacttctt

SEQ ID NO: 4082867 - DNA, 20 bp, Homo sapiens
ctttcacttctttcccttcc

SEQ ID NO: 4082868 - DNA, 21 bp, Homo sapiens
ctttcacttctttcccttcct

SEQ ID NO: 4082869 - DNA, 12 bp, Homo sapiens
ctttcaggccta

SEQ ID NO: 4082870 - DNA, 20 bp, Homo sapiens
ctttcaggcctacagccaca

SEQ ID NO: 4082871 - DNA, 14 bp, Homo sapiens
ctttcatagtttat

SEQ ID NO: 4082872 - DNA, 19 bp, Homo sapiens
ctttcatcacactgggtgg

SEQ ID NO: 4082873 - DNA, 17 bp, Homo sapiens
ctttcatcctgactctg

SEQ ID NO: 4082874 - DNA, 18 bp, Homo sapiens
ctttcatcctgactctgc

SEQ ID NO: 4082875 - DNA, 20 bp, Homo sapiens
ctttcatcctgactctgccc

SEQ ID NO: 4082876 - DNA, 22 bp, Homo sapiens
ctttcatcctgactctgccccc

SEQ ID NO: 4082877 - DNA, 15 bp, Homo sapiens
ctttccaattctcct

SEQ ID NO: 4082878 - DNA, 18 bp, Homo sapiens
ctttccaattctccttta

SEQ ID NO: 4082879 - DNA, 22 bp, Homo sapiens
ctttccacatttgtcacagaaa

SEQ ID NO: 4082880 - DNA, 14 bp, Homo sapiens
ctttccacttcttc

SEQ ID NO: 4082881 - DNA, 17 bp, Homo sapiens
ctttccacttcttcctt

SEQ ID NO: 4082882 - DNA, 20 bp, Homo sapiens
ctttccacttcttcctttct

SEQ ID NO: 4082883 - DNA, 21 bp, Homo sapiens
ctttccaggcttccctgactt

SEQ ID NO: 4082884 - DNA, 13 bp, Homo sapiens
ctttccatcaact

SEQ ID NO: 4082885 - DNA, 17 bp, Homo sapiens
ctttcccacccagcctg

SEQ ID NO: 4082886 - DNA, 14 bp, Homo sapiens
ctttcccaccctcc

SEQ ID NO: 4082887 - DNA, 20 bp, Homo sapiens
gaaaaacaacaacacaataa

SEQ ID NO: 4082888 - DNA, 14 bp, Homo sapiens
gaaaaacagacaaa

SEQ ID NO: 4082889 - DNA, 15 bp, Homo sapiens
gaaaaacagacaaaa

SEQ ID NO: 4082890 - DNA, 11 bp, Homo sapiens
gaaaaacaggt

SEQ ID NO: 4082891 - DNA, 16 bp, Homo sapiens
gaaaaagcaaaaggca

SEQ ID NO: 4082892 - DNA, 18 bp, Homo sapiens
gaaaaagcatgatgggaa

SEQ ID NO: 4082893 - DNA, 19 bp, Homo sapiens
gaaaaataacttcaagcaa

SEQ ID NO: 4082894 - DNA, 23 bp, Homo sapiens
gaaaaataatcaagattttaggg

SEQ ID NO: 4082895 - DNA, 19 bp, Homo sapiens
gaaaaatatatactaaaca

SEQ ID NO: 4082896 - DNA, 16 bp, Homo sapiens
gaaaaatatttctgag

SEQ ID NO: 4082897 - DNA, 20 bp, Homo sapiens
gaaaaatgcccttaaatcat

SEQ ID NO: 4082898 - DNA, 17 bp, Homo sapiens
gaaaaatgctccccaca

SEQ ID NO: 4082899 - DNA, 18 bp, Homo sapiens
gaaaaatggttgatggaa

SEQ ID NO: 4082900 - DNA, 21 bp, Homo sapiens
gaaaaatggttgatggaaaat

SEQ ID NO: 4082901 - DNA, 15 bp, Homo sapiens
gaaaaatgttcttta

SEQ ID NO: 4082902 - DNA, 20 bp, Homo sapiens
gaaaaattcagcaaaccatt

SEQ ID NO: 4082903 - DNA, 16 bp, Homo sapiens
gaaaaattggggagga

SEQ ID NO: 4082904 - DNA, 19 bp, Homo sapiens
gaaaaatttaagcattgtt

SEQ ID NO: 4082905 - DNA, 20 bp, Homo sapiens
gaaaaatttaagcattgttt

SEQ ID NO: 4082906 - DNA, 19 bp, Homo sapiens
gaaaacaaaattttatttt

SEQ ID NO: 4082907 - DNA, 19 bp, Homo sapiens
gaaaacatctccttagaaa

SEQ ID NO: 4082908 - DNA, 15 bp, Homo sapiens
gaaaacatgtaataa

SEQ ID NO: 4082909 - DNA, 14 bp, Homo sapiens
gaaaacattttatt

SEQ ID NO: 4082910 - DNA, 21 bp, Homo sapiens
gaaaaccaagccgtggcttcc

SEQ ID NO: 4082911 - DNA, 15 bp, Homo sapiens
gaaaaccccttccca

SEQ ID NO: 4082912 - DNA, 13 bp, Homo sapiens
gaaaacctagaaa

SEQ ID NO: 4082913 - DNA, 15 bp, Homo sapiens
gaaaacctagaaaac

SEQ ID NO: 4082914 - DNA, 14 bp, Homo sapiens
gaaaacggagctga

SEQ ID NO: 4082915 - DNA, 18 bp, Homo sapiens
gaaaacgttttattgtgt

SEQ ID NO: 4082916 - DNA, 19 bp, Homo sapiens
gaaaacgttttattgtgtt

SEQ ID NO: 4082917 - DNA, 20 bp, Homo sapiens
gaaaactcctttagcaggtg

SEQ ID NO: 4082918 - DNA, 17 bp, Homo sapiens
gaaaactggaataagaa

SEQ ID NO: 4082919 - DNA, 12 bp, Homo sapiens
gaaaactgtgtt

SEQ ID NO: 4082920 - DNA, 11 bp, Homo sapiens
gaaaactgtta

SEQ ID NO: 4082921 - DNA, 23 bp, Homo sapiens
gaaaactgttacctaaagtattt

SEQ ID NO: 4082922 - DNA, 23 bp, Homo sapiens
gaaaacttatgacctcttccttt

SEQ ID NO: 4082923 - DNA, 16 bp, Homo sapiens
gaaaacttcttttaaa

SEQ ID NO: 4082924 - DNA, 20 bp, Homo sapiens
gaaaactttaaaaaatattt

SEQ ID NO: 4082925 - DNA, 21 bp, Homo sapiens
gaaaagaaagtgttttatttt

SEQ ID NO: 4082926 - DNA, 19 bp, Homo sapiens
gaaaagaactgtttactgc

SEQ ID NO: 4082927 - DNA, 14 bp, Homo sapiens
gaaaagaagaaact

SEQ ID NO: 4082928 - DNA, 18 bp, Homo sapiens
gaaaagacttgtaatatt

SEQ ID NO: 4082929 - DNA, 15 bp, Homo sapiens
gaaacacagctgttc

SEQ ID NO: 4082930 - DNA, 16 bp, Homo sapiens
gaaacaccaaaaaaat

SEQ ID NO: 4082931 - DNA, 19 bp, Homo sapiens
gaaacactgcaaattttaa

SEQ ID NO: 4082932 - DNA, 16 bp, Homo sapiens
gaaacagatttcatac

SEQ ID NO: 4082933 - DNA, 21 bp, Homo sapiens
gaaacagccattgcggcccca

SEQ ID NO: 4082934 - DNA, 22 bp, Homo sapiens
gaaacaggaccacaaaaatgaa

SEQ ID NO: 4082935 - DNA, 20 bp, Homo sapiens
gaaacatggttgtaatatgc

SEQ ID NO: 4082936 - DNA, 15 bp, Homo sapiens
gaaacatggttttga

SEQ ID NO: 4082937 - DNA, 16 bp, Homo sapiens
gaaacattacagttca

SEQ ID NO: 4082938 - DNA, 14 bp, Homo sapiens
gaaacatttatatt

SEQ ID NO: 4082939 - DNA, 19 bp, Homo sapiens
gaaacatttatatttttat

SEQ ID NO: 4082940 - DNA, 18 bp, Homo sapiens
gaaaccatgactgtgacc

SEQ ID NO: 4082941 - DNA, 20 bp, Homo sapiens
gaaaccattttcccatcatc

SEQ ID NO: 4082942 - DNA, 13 bp, Homo sapiens
gaaaccgggagaa

SEQ ID NO: 4082943 - DNA, 14 bp, Homo sapiens
gaaaccgggagaag

SEQ ID NO: 4082944 - DNA, 21 bp, Homo sapiens
gaaacctacacactgtcatgc

SEQ ID NO: 4082945 - DNA, 17 bp, Homo sapiens
gaaacctagtactgccc

SEQ ID NO: 4082946 - DNA, 18 bp, Homo sapiens
gaaacctagtactgcccc

SEQ ID NO: 4082947 - DNA, 16 bp, Homo sapiens
gaaacctgggattcag

SEQ ID NO: 4082948 - DNA, 19 bp, Homo sapiens
gaaaccttattgtacctct

SEQ ID NO: 4082949 - DNA, 15 bp, Homo sapiens
gaaaccttgctctcc

SEQ ID NO: 4082950 - DNA, 19 bp, Homo sapiens
gaaaccttgctctcctcat

SEQ ID NO: 4082951 - DNA, 14 bp, Homo sapiens
gaaaccttttttaa

SEQ ID NO: 4082952 - DNA, 19 bp, Homo sapiens
gaaaccttttttaagattt

SEQ ID NO: 4082953 - DNA, 20 bp, Homo sapiens
gaaacgctacctctctgtcc

SEQ ID NO: 4082954 - DNA, 12 bp, Homo sapiens
gaaactaacaga

SEQ ID NO: 4082955 - DNA, 14 bp, Homo sapiens
gaaactaagccagg

SEQ ID NO: 4082956 - DNA, 21 bp, Homo sapiens
gaaactcacactcccctaggg

SEQ ID NO: 4082957 - DNA, 17 bp, Homo sapiens
gaaactccacatctgcc

SEQ ID NO: 4082958 - DNA, 19 bp, Homo sapiens
gaaactccacatctgcctt

SEQ ID NO: 4082959 - DNA, 15 bp, Homo sapiens
gaaactcccctgggg

SEQ ID NO: 4082960 - DNA, 15 bp, Homo sapiens
gaaactcctgtttct

SEQ ID NO: 4082961 - DNA, 20 bp, Homo sapiens
gaaactcttatctcagtcat

SEQ ID NO: 4082962 - DNA, 15 bp, Homo sapiens
gaaactgccaagggt

SEQ ID NO: 4082963 - DNA, 17 bp, Homo sapiens
gaaactgctaaattcta

SEQ ID NO: 4082964 - DNA, 21 bp, Homo sapiens
gaaactgctaaattctatgtt

SEQ ID NO: 4082965 - DNA, 17 bp, Homo sapiens
gaaactgctgcagatta

SEQ ID NO: 4082966 - DNA, 17 bp, Homo sapiens
gaaactggactcacatt

SEQ ID NO: 4082967 - DNA, 22 bp, Homo sapiens
gaaactgtctagcacttccttg

SEQ ID NO: 4082968 - DNA, 21 bp, Homo sapiens
gaaacttcagttgatcttctt

SEQ ID NO: 4082969 - DNA, 15 bp, Homo sapiens
gaaactttatacatt

SEQ ID NO: 4082970 - DNA, 16 bp, Homo sapiens
gaaagaaagctgagaa

SEQ ID NO: 4082971 - DNA, 18 bp, Homo sapiens
gaaagaaagtaaaaaagg

SEQ ID NO: 4082972 - DNA, 20 bp, Homo sapiens
gaaagaacatggacttgtat

SEQ ID NO: 4082973 - DNA, 12 bp, Homo sapiens
gaaagaagccat

SEQ ID NO: 4082974 - DNA, 13 bp, Homo sapiens
gaaagaagccata

SEQ ID NO: 4082975 - DNA, 15 bp, Homo sapiens
gaaagaatatattta

SEQ ID NO: 4082976 - DNA, 21 bp, Homo sapiens
gaaagaattatttgccttctg

SEQ ID NO: 4082977 - DNA, 20 bp, Homo sapiens
gaaagactatctaaatgttg

SEQ ID NO: 4082978 - DNA, 19 bp, Homo sapiens
gaaagagcaccctcgagaa

SEQ ID NO: 4082979 - DNA, 21 bp, Homo sapiens
gaaagaggctgaggcctggac

SEQ ID NO: 4082980 - DNA, 22 bp, Homo sapiens
gaaagaggctgaggcctggact

SEQ ID NO: 4082981 - DNA, 17 bp, Homo sapiens
gaaagagttaagaatgt

SEQ ID NO: 4082982 - DNA, 18 bp, Homo sapiens
gaaagagttaagaatgtc

SEQ ID NO: 4082983 - DNA, 16 bp, Homo sapiens
gaaagatggataaact

SEQ ID NO: 4082984 - DNA, 22 bp, Homo sapiens
gaaagatgtgtttttgggaaga

SEQ ID NO: 4082985 - DNA, 22 bp, Homo sapiens
gaaagcatgtggcatgttcatc

SEQ ID NO: 4082986 - DNA, 14 bp, Homo sapiens
gaaagccccagcac

SEQ ID NO: 4082987 - DNA, 14 bp, Homo sapiens
gaaagccctccccc

SEQ ID NO: 4082988 - DNA, 21 bp, Homo sapiens
gaaagccctcccccttcccct

SEQ ID NO: 4082989 - DNA, 22 bp, Homo sapiens
gaaagcctgtaagcctgcaagc

SEQ ID NO: 4082990 - DNA, 20 bp, Homo sapiens
gaaagcctgttcccctcact

SEQ ID NO: 4082991 - DNA, 18 bp, Homo sapiens
gaaagccttaagctgcag

SEQ ID NO: 4082992 - DNA, 17 bp, Homo sapiens
gaaagcggagttcctaa

SEQ ID NO: 4082993 - DNA, 19 bp, Homo sapiens
gaaagctatataagacaag

SEQ ID NO: 4082994 - DNA, 18 bp, Homo sapiens
gaaagctctgttgcaatt

SEQ ID NO: 4082995 - DNA, 22 bp, Homo sapiens
gaaagctgagaactcctgactg

SEQ ID NO: 4082996 - DNA, 21 bp, Homo sapiens
gaaaggatatttaagaaaata

SEQ ID NO: 4082997 - DNA, 15 bp, Homo sapiens
gaaaggatgtggaag

SEQ ID NO: 4082998 - DNA, 21 bp, Homo sapiens
gaaaggctgccgaggaccctc

SEQ ID NO: 4082999 - DNA, 20 bp, Homo sapiens
gaaagggccttgacatcagt

SEQ ID NO: 4083000 - DNA, 15 bp, Homo sapiens
gaaaggggagagcct

SEQ ID NO: 4083001 - DNA, 18 bp, Homo sapiens
gaaaggggagagcctgct

SEQ ID NO: 4083002 - DNA, 21 bp, Homo sapiens
gaaaggggagagcctgctggc

SEQ ID NO: 4083003 - DNA, 13 bp, Homo sapiens
gaaaggggagccc

SEQ ID NO: 4083004 - DNA, 21 bp, Homo sapiens
gaaaggggttggggtgacagt

SEQ ID NO: 4083005 - DNA, 23 bp, Homo sapiens
gaaaggtgagtttgagctgcctt

SEQ ID NO: 4083006 - DNA, 14 bp, Homo sapiens
gaaaggttttgtat

SEQ ID NO: 4083007 - DNA, 18 bp, Homo sapiens
gaaagtacactctgctgt

SEQ ID NO: 4083008 - DNA, 15 bp, Homo sapiens
gaaagtcaccaggac

SEQ ID NO: 4083009 - DNA, 16 bp, Homo sapiens
gaaagtcaccaggact

SEQ ID NO: 4083010 - DNA, 20 bp, Homo sapiens
gaaagtcagccatatctcca

SEQ ID NO: 4083011 - DNA, 15 bp, Homo sapiens
gaaagtgactttaaa

SEQ ID NO: 4083012 - DNA, 17 bp, Homo sapiens
gaaagtgactttaaaag

SEQ ID NO: 4083013 - DNA, 22 bp, Homo sapiens
gaaagtgactttaaaagaaaat

SEQ ID NO: 4083014 - DNA, 21 bp, Homo sapiens
gaaagtgtgagctcttccctt

SEQ ID NO: 4083015 - DNA, 19 bp, Homo sapiens
gaaagttagggggttctta

SEQ ID NO: 4083016 - DNA, 22 bp, Homo sapiens
gaaagttttcagaacctcttcc

SEQ ID NO: 4083017 - DNA, 20 bp, Homo sapiens
gaaagttttgtaaaagaaat

SEQ ID NO: 4083018 - DNA, 21 bp, Homo sapiens
gaaataaaaatggcaaatgca

SEQ ID NO: 4083019 - DNA, 17 bp, Homo sapiens
gaaataaagtttgctta

SEQ ID NO: 4083020 - DNA, 15 bp, Homo sapiens
gaaataaatagctat

SEQ ID NO: 4083021 - DNA, 17 bp, Homo sapiens
gaaataaatagctatat

SEQ ID NO: 4083022 - DNA, 17 bp, Homo sapiens
gaaccgagcaaagatca

SEQ ID NO: 4083023 - DNA, 19 bp, Homo sapiens
gaaccgagcaaagatcaaa

SEQ ID NO: 4083024 - DNA, 17 bp, Homo sapiens
gaaccgtgtccagcaca

SEQ ID NO: 4083025 - DNA, 19 bp, Homo sapiens
gaaccgttttgaagctact

SEQ ID NO: 4083026 - DNA, 21 bp, Homo sapiens
gaacctacagactccatctct

SEQ ID NO: 4083027 - DNA, 18 bp, Homo sapiens
gaacctacctgccttgga

SEQ ID NO: 4083028 - DNA, 17 bp, Homo sapiens
gaacctcttccccagaa

SEQ ID NO: 4083029 - DNA, 12 bp, Homo sapiens
gaacctgagcta

SEQ ID NO: 4083030 - DNA, 18 bp, Homo sapiens
gaacctggatccagcact

SEQ ID NO: 4083031 - DNA, 17 bp, Homo sapiens
gaacctgtgagctgcac

SEQ ID NO: 4083032 - DNA, 12 bp, Homo sapiens
gaacctgtgagt

SEQ ID NO: 4083033 - DNA, 10 bp, Homo sapiens
gaaccttccc

SEQ ID NO: 4083034 - DNA, 19 bp, Homo sapiens
gaaccttccttcctgcttg

SEQ ID NO: 4083035 - DNA, 21 bp, Homo sapiens
gaacgacaatagctttaccct

SEQ ID NO: 4083036 - DNA, 18 bp, Homo sapiens
gaacgatttagaaagaag

SEQ ID NO: 4083037 - DNA, 12 bp, Homo sapiens
gaacgcagccct

SEQ ID NO: 4083038 - DNA, 22 bp, Homo sapiens
gaacgcagccctagagcctgcc

SEQ ID NO: 4083039 - DNA, 23 bp, Homo sapiens
gaacgcagccctagagcctgcct

SEQ ID NO: 4083040 - DNA, 13 bp, Homo sapiens
gaacgccagggac

SEQ ID NO: 4083041 - DNA, 15 bp, Homo sapiens
gaacgccagtctccc

SEQ ID NO: 4083042 - DNA, 22 bp, Homo sapiens
gaacgccagtctcccaggcccc

SEQ ID NO: 4083043 - DNA, 23 bp, Homo sapiens
gaacgtagtcggcacagcctggt

SEQ ID NO: 4083044 - DNA, 12 bp, Homo sapiens
gaactaaatgtt

SEQ ID NO: 4083045 - DNA, 15 bp, Homo sapiens
gaactaaatgttcta

SEQ ID NO: 4083046 - DNA, 13 bp, Homo sapiens
gaactcaagctgc

SEQ ID NO: 4083047 - DNA, 17 bp, Homo sapiens
gaactcaagctgcgttt

SEQ ID NO: 4083048 - DNA, 16 bp, Homo sapiens
gaactcaccctgggag

SEQ ID NO: 4083049 - DNA, 18 bp, Homo sapiens
gaactcactctgggctgt

SEQ ID NO: 4083050 - DNA, 14 bp, Homo sapiens
gaactcactggggc

SEQ ID NO: 4083051 - DNA, 13 bp, Homo sapiens
gaactcagatcca

SEQ ID NO: 4083052 - DNA, 14 bp, Homo sapiens
gaactcagatccag

SEQ ID NO: 4083053 - DNA, 18 bp, Homo sapiens
gaactcagatccagggac

SEQ ID NO: 4083054 - DNA, 21 bp, Homo sapiens
gaactcagctgtctgtggctt

SEQ ID NO: 4083055 - DNA, 12 bp, Homo sapiens
gaactcctgcca

SEQ ID NO: 4083056 - DNA, 18 bp, Homo sapiens
gaactcctgccaggcaca

SEQ ID NO: 4083057 - DNA, 18 bp, Homo sapiens
gaactcgcacctgtgctg

SEQ ID NO: 4083058 - DNA, 22 bp, Homo sapiens
gaactctcaaaagtctattttt

SEQ ID NO: 4083059 - DNA, 16 bp, Homo sapiens
gaactctggcttccag

SEQ ID NO: 4083060 - DNA, 20 bp, Homo sapiens
gaactctggcttccaggtat

SEQ ID NO: 4083061 - DNA, 18 bp, Homo sapiens
gaactctgggctgccatg

SEQ ID NO: 4083062 - DNA, 19 bp, Homo sapiens
gaactctgttcccccaccc

SEQ ID NO: 4083063 - DNA, 18 bp, Homo sapiens
gaactctttctggcctgc

SEQ ID NO: 4083064 - DNA, 17 bp, Homo sapiens
gaactgaagtttcacat

SEQ ID NO: 4083065 - DNA, 11 bp, Homo sapiens
gaactgaggag

SEQ ID NO: 4083066 - DNA, 22 bp, Homo sapiens
gaactgaggagatgaccaggga

SEQ ID NO: 4083067 - DNA, 18 bp, Homo sapiens
gaactgagtcacgctggg

SEQ ID NO: 4083068 - DNA, 17 bp, Homo sapiens
gaactgcctctttcctg

SEQ ID NO: 4083069 - DNA, 14 bp, Homo sapiens
gaactgctttcaag

SEQ ID NO: 4083070 - DNA, 18 bp, Homo sapiens
gaactggcaattgtctat

SEQ ID NO: 4083071 - DNA, 18 bp, Homo sapiens
gaactgggatttgaaccc

SEQ ID NO: 4083072 - DNA, 16 bp, Homo sapiens
gaactgtccagagagc

SEQ ID NO: 4083073 - DNA, 17 bp, Homo sapiens
gaactgtccagagagca

SEQ ID NO: 4083074 - DNA, 16 bp, Homo sapiens
gaactgtgccacaatg

SEQ ID NO: 4083075 - DNA, 20 bp, Homo sapiens
gaactgtgtttcaagttcaa

SEQ ID NO: 4083076 - DNA, 18 bp, Homo sapiens
gaactgttcaagtgtccc

SEQ ID NO: 4083077 - DNA, 14 bp, Homo sapiens
gaacttcagaaaga

SEQ ID NO: 4083078 - DNA, 23 bp, Homo sapiens
gaacttccaggtgttactgtaat

SEQ ID NO: 4083079 - DNA, 16 bp, Homo sapiens
gaacttgaagcctgct

SEQ ID NO: 4083080 - DNA, 19 bp, Homo sapiens
gaacttgaagcctgctcct

SEQ ID NO: 4083081 - DNA, 21 bp, Homo sapiens
gaacttgaagcctgctccttc

SEQ ID NO: 4083082 - DNA, 13 bp, Homo sapiens
gaacttgatttgc

SEQ ID NO: 4083083 - DNA, 17 bp, Homo sapiens
gaacttgatttgcatgg

SEQ ID NO: 4083084 - DNA, 15 bp, Homo sapiens
gaactttccattttg

SEQ ID NO: 4083085 - DNA, 16 bp, Homo sapiens
gaactttgccaaaaaa

SEQ ID NO: 4083086 - DNA, 22 bp, Homo sapiens
gaactttgccaaaaaaaaaaga

SEQ ID NO: 4083087 - DNA, 21 bp, Homo sapiens
gaagaaaaaaatcttctccag

SEQ ID NO: 4083088 - DNA, 14 bp, Homo sapiens
gaagaaaactatcc

SEQ ID NO: 4083089 - DNA, 13 bp, Homo sapiens
gaagaaatatgaa

SEQ ID NO: 4083090 - DNA, 17 bp, Homo sapiens
gaagaagagaagctgct

SEQ ID NO: 4083091 - DNA, 19 bp, Homo sapiens
gaagaagagaagctgctga

SEQ ID NO: 4083092 - DNA, 23 bp, Homo sapiens
gaagaaggaggaatgctggactg

SEQ ID NO: 4083093 - DNA, 12 bp, Homo sapiens
gaagaaggcagt

SEQ ID NO: 4083094 - DNA, 13 bp, Homo sapiens
gaagaaggcagtg

SEQ ID NO: 4083095 - DNA, 18 bp, Homo sapiens
gaagaagggagaagaaag

SEQ ID NO: 4083096 - DNA, 21 bp, Homo sapiens
gaagaaggtggaccttttaaa

SEQ ID NO: 4083097 - DNA, 23 bp, Homo sapiens
gaagaaggtggaccttttaaagt

SEQ ID NO: 4083098 - DNA, 14 bp, Homo sapiens
gaagaatattcagg

SEQ ID NO: 4083099 - DNA, 19 bp, Homo sapiens
gaagaatattcaggactta

SEQ ID NO: 4083100 - DNA, 14 bp, Homo sapiens
gaagaatatttaag

SEQ ID NO: 4083101 - DNA, 17 bp, Homo sapiens
gaagaatccagtattat

SEQ ID NO: 4083102 - DNA, 15 bp, Homo sapiens
gaagacaaaaagaca

SEQ ID NO: 4083103 - DNA, 20 bp, Homo sapiens
gaagacaaaaagacaaacat

SEQ ID NO: 4083104 - DNA, 19 bp, Homo sapiens
gaagacaatttgatacata

SEQ ID NO: 4083105 - DNA, 14 bp, Homo sapiens
gaagacaccagagc

SEQ ID NO: 4083106 - DNA, 15 bp, Homo sapiens
gaagacatggagact

SEQ ID NO: 4083107 - DNA, 20 bp, Homo sapiens
gaagaccacatccacacacg

SEQ ID NO: 4083108 - DNA, 21 bp, Homo sapiens
gaagaccacatccacacacgc

SEQ ID NO: 4083109 - DNA, 19 bp, Homo sapiens
gaagacccctgactcatca

SEQ ID NO: 4083110 - DNA, 17 bp, Homo sapiens
gaagaccctcttgccca

SEQ ID NO: 4083111 - DNA, 23 bp, Homo sapiens
gaagaccctcttgcccatcctga

SEQ ID NO: 4083112 - DNA, 16 bp, Homo sapiens
gaagacctaaagtgct

SEQ ID NO: 4083113 - DNA, 20 bp, Homo sapiens
gaagacctaaccagggccag

SEQ ID NO: 4083114 - DNA, 12 bp, Homo sapiens
gaagagaaacca

SEQ ID NO: 4083115 - DNA, 18 bp, Homo sapiens
gaagagacaggagggcaa

SEQ ID NO: 4083116 - DNA, 18 bp, Homo sapiens
gaagagagatatatctga

SEQ ID NO: 4083117 - DNA, 19 bp, Homo sapiens
gaagagagatatatctgaa

SEQ ID NO: 4083118 - DNA, 18 bp, Homo sapiens
gaagagatgggcttgttt

SEQ ID NO: 4083119 - DNA, 18 bp, Homo sapiens
gaagagcaggactccagg

SEQ ID NO: 4083120 - DNA, 19 bp, Homo sapiens
gaagagctatggcccagaa

SEQ ID NO: 4083121 - DNA, 14 bp, Homo sapiens
gaagagcttgcttt

SEQ ID NO: 4083122 - DNA, 20 bp, Homo sapiens
gaagagcttgctttgattta

SEQ ID NO: 4083123 - DNA, 14 bp, Homo sapiens
gaagaggaacagtg

SEQ ID NO: 4083124 - DNA, 20 bp, Homo sapiens
gaagagggcctgtgggagcc

SEQ ID NO: 4083125 - DNA, 21 bp, Homo sapiens
gaagagggctgagctgagctt

SEQ ID NO: 4083126 - DNA, 17 bp, Homo sapiens
gaagagggggctggcca

SEQ ID NO: 4083127 - DNA, 19 bp, Homo sapiens
gaagagggtgaaaggcagg

SEQ ID NO: 4083128 - DNA, 13 bp, Homo sapiens
gaagagtgtgtgt

SEQ ID NO: 4083129 - DNA, 13 bp, Homo sapiens
gaagataggctct

SEQ ID NO: 4083130 - DNA, 15 bp, Homo sapiens
gaagataggctctgc

SEQ ID NO: 4083131 - DNA, 18 bp, Homo sapiens
gaagataggctctgcaca

SEQ ID NO: 4083132 - DNA, 15 bp, Homo sapiens
gaagatatacatgaa

SEQ ID NO: 4083133 - DNA, 17 bp, Homo sapiens
gaagatatatttcactt

SEQ ID NO: 4083134 - DNA, 21 bp, Homo sapiens
gaagatcagcaccctaagaga

SEQ ID NO: 4083135 - DNA, 13 bp, Homo sapiens
gaagatgaaagag

SEQ ID NO: 4083136 - DNA, 19 bp, Homo sapiens
gaagatggtttcaattcag

SEQ ID NO: 4083137 - DNA, 15 bp, Homo sapiens
gaagatgtttcaaaa

SEQ ID NO: 4083138 - DNA, 19 bp, Homo sapiens
gaagattaggagaaacaca

SEQ ID NO: 4083139 - DNA, 13 bp, Homo sapiens
gaagattgtgaat

SEQ ID NO: 4083140 - DNA, 22 bp, Homo sapiens
gaagatttgatgctggagaggt

SEQ ID NO: 4083141 - DNA, 17 bp, Homo sapiens
gaagattttcagtctag

SEQ ID NO: 4083142 - DNA, 22 bp, Homo sapiens
gaagcaacgataaaattacaaa

SEQ ID NO: 4083143 - DNA, 14 bp, Homo sapiens
gaagcaagccagac

SEQ ID NO: 4083144 - DNA, 23 bp, Homo sapiens
gaagcaaggaagatatacatgaa

SEQ ID NO: 4083145 - DNA, 21 bp, Homo sapiens
gaagcaccccatgccaaagct

SEQ ID NO: 4083146 - DNA, 14 bp, Homo sapiens
gaagcagccagctc

SEQ ID NO: 4083147 - DNA, 18 bp, Homo sapiens
gaagcagcctcagagtgg

SEQ ID NO: 4083148 - DNA, 23 bp, Homo sapiens
gaagcagctaaaccaaggactga

SEQ ID NO: 4083149 - DNA, 16 bp, Homo sapiens
gaagcatgaaaaagca

SEQ ID NO: 4083150 - DNA, 16 bp, Homo sapiens
gaagcattcagagagc

SEQ ID NO: 4083151 - DNA, 18 bp, Homo sapiens
gaagcattccttctttga

SEQ ID NO: 4083152 - DNA, 13 bp, Homo sapiens
gaagccaaagaaa

SEQ ID NO: 4083153 - DNA, 14 bp, Homo sapiens
gaagccaaagaaaa

SEQ ID NO: 4083154 - DNA, 16 bp, Homo sapiens
gaagccaaatttatca

SEQ ID NO: 4083155 - DNA, 15 bp, Homo sapiens
gaagccaagggaaag

SEQ ID NO: 4083156 - DNA, 17 bp, Homo sapiens
gaagccaagggaaaggg

SEQ ID NO: 4083157 - DNA, 13 bp, Homo sapiens
gaagccaagtggg

SEQ ID NO: 4083158 - DNA, 22 bp, Homo sapiens
gaagccaagtggggtgctggga

SEQ ID NO: 4083159 - DNA, 23 bp, Homo sapiens
gaagccaagtggggtgctgggag

SEQ ID NO: 4083160 - DNA, 18 bp, Homo sapiens
gaagccaattcagacagg

SEQ ID NO: 4083161 - DNA, 15 bp, Homo sapiens
gaagccacgctgtcc

SEQ ID NO: 4083162 - DNA, 16 bp, Homo sapiens
gaagccacgctgtcct

SEQ ID NO: 4083163 - DNA, 18 bp, Homo sapiens
gaagccacgctgtcctct

SEQ ID NO: 4083164 - DNA, 15 bp, Homo sapiens
gaagccagctgccct

SEQ ID NO: 4083165 - DNA, 19 bp, Homo sapiens
gaagccaggaatttcccag

SEQ ID NO: 4083166 - DNA, 23 bp, Homo sapiens
gaagccaggaatttcccaggacc

SEQ ID NO: 4083167 - DNA, 24 bp, Homo sapiens
gaagccaggaatttcccaggaccc

SEQ ID NO: 4083168 - DNA, 15 bp, Homo sapiens
gaagcccaagtgaaa

SEQ ID NO: 4083169 - DNA, 20 bp, Homo sapiens
gaagcccccaccgtgggcag

SEQ ID NO: 4083170 - DNA, 17 bp, Homo sapiens
gaagccgactctggccc

SEQ ID NO: 4083171 - DNA, 19 bp, Homo sapiens
gaagccgactctggccctg

SEQ ID NO: 4083172 - DNA, 22 bp, Homo sapiens
gaagccgactctggccctggcc

SEQ ID NO: 4083173 - DNA, 20 bp, Homo sapiens
gaagccgtgctcgccccagc

SEQ ID NO: 4083174 - DNA, 17 bp, Homo sapiens
gaagcctccaagcacag

SEQ ID NO: 4083175 - DNA, 18 bp, Homo sapiens
gaagcctccaagcacaga

SEQ ID NO: 4083176 - DNA, 19 bp, Homo sapiens
gaagcctccaagcacagag

SEQ ID NO: 4083177 - DNA, 23 bp, Homo sapiens
gaagcctccaagcacagagcctg

SEQ ID NO: 4083178 - DNA, 20 bp, Homo sapiens
gaagcctccaagcctgcctc

SEQ ID NO: 4083179 - DNA, 12 bp, Homo sapiens
gaagcctctggc

SEQ ID NO: 4083180 - DNA, 15 bp, Homo sapiens
ctgtggccccctccg

SEQ ID NO: 4083181 - DNA, 19 bp, Homo sapiens
ctgtggccctggctctgct

SEQ ID NO: 4083182 - DNA, 15 bp, Homo sapiens
ctgtggccgtctcct

SEQ ID NO: 4083183 - DNA, 17 bp, Homo sapiens
ctgtggccgtctcctcc

SEQ ID NO: 4083184 - DNA, 18 bp, Homo sapiens
ctgtggccgtctcctccc

SEQ ID NO: 4083185 - DNA, 14 bp, Homo sapiens
ctgtggcctgccag

SEQ ID NO: 4083186 - DNA, 13 bp, Homo sapiens
ctgtggctggctc

SEQ ID NO: 4083187 - DNA, 23 bp, Homo sapiens
ctgtggctggctctaccttcctg

SEQ ID NO: 4083188 - DNA, 20 bp, Homo sapiens
ctgtggcttcccatgtcttt

SEQ ID NO: 4083189 - DNA, 14 bp, Homo sapiens
ctgtgggagcctgc

SEQ ID NO: 4083190 - DNA, 11 bp, Homo sapiens
ctgtgggcagc

SEQ ID NO: 4083191 - DNA, 13 bp, Homo sapiens
ctgtgggcagcac

SEQ ID NO: 4083192 - DNA, 15 bp, Homo sapiens
ctgtgggcagcaccc

SEQ ID NO: 4083193 - DNA, 16 bp, Homo sapiens
ctgtgggcagcaccct

SEQ ID NO: 4083194 - DNA, 18 bp, Homo sapiens
ctgtgggcccctcaacag

SEQ ID NO: 4083195 - DNA, 19 bp, Homo sapiens
ctgtgggcccctcaacagc

SEQ ID NO: 4083196 - DNA, 24 bp, Homo sapiens
ctgtgggcccctcaacagccaagt

SEQ ID NO: 4083197 - DNA, 14 bp, Homo sapiens
ctgtgggcctcaag

SEQ ID NO: 4083198 - DNA, 24 bp, Homo sapiens
ctgtgggggtgagggtcccatgtg

SEQ ID NO: 4083199 - DNA, 16 bp, Homo sapiens
ctgtgggggtggccat

SEQ ID NO: 4083200 - DNA, 21 bp, Homo sapiens
ctgtgggggtggccatccctg

SEQ ID NO: 4083201 - DNA, 19 bp, Homo sapiens
ctgtgggtccgataatatc

SEQ ID NO: 4083202 - DNA, 18 bp, Homo sapiens
ctgtgggtgttctttcct

SEQ ID NO: 4083203 - DNA, 18 bp, Homo sapiens
ctgtggtggggagaggca

SEQ ID NO: 4083204 - DNA, 16 bp, Homo sapiens
ctgtgtaaatatatgt

SEQ ID NO: 4083205 - DNA, 17 bp, Homo sapiens
ctgtgtaaatatatgtc

SEQ ID NO: 4083206 - DNA, 17 bp, Homo sapiens
ctgtgtacacctctgga

SEQ ID NO: 4083207 - DNA, 23 bp, Homo sapiens
ctgtgtacataactctgtaaaaa

SEQ ID NO: 4083208 - DNA, 20 bp, Homo sapiens
ctgtgtatcttttttataac

SEQ ID NO: 4083209 - DNA, 15 bp, Homo sapiens
ctgtgtatgtacata

SEQ ID NO: 4083210 - DNA, 18 bp, Homo sapiens
ctgtgtatgtacatatat

SEQ ID NO: 4083211 - DNA, 16 bp, Homo sapiens
ctgtgtcatttcttca

SEQ ID NO: 4083212 - DNA, 15 bp, Homo sapiens
ctgtgtccttccctg

SEQ ID NO: 4083213 - DNA, 16 bp, Homo sapiens
ctgtgtccttcggggg

SEQ ID NO: 4083214 - DNA, 18 bp, Homo sapiens
ctgtgtgcctgggggagt

SEQ ID NO: 4083215 - DNA, 15 bp, Homo sapiens
ctgtgtgcttggtct

SEQ ID NO: 4083216 - DNA, 15 bp, Homo sapiens
ctgtgtgtaggctgg

SEQ ID NO: 4083217 - DNA, 16 bp, Homo sapiens
ctgtgtgtgtgaatga

SEQ ID NO: 4083218 - DNA, 17 bp, Homo sapiens
ctgtgtgtgtgaatgaa

SEQ ID NO: 4083219 - DNA, 19 bp, Homo sapiens
ctgtgtgttttcataataa

SEQ ID NO: 4083220 - DNA, 16 bp, Homo sapiens
ctgtgttaaaatggtt

SEQ ID NO: 4083221 - DNA, 12 bp, Homo sapiens
ctgtgttcctgg

SEQ ID NO: 4083222 - DNA, 23 bp, Homo sapiens
ctgtgttgcattattcatttagt

SEQ ID NO: 4083223 - DNA, 13 bp, Homo sapiens
ctgtgttgccaca

SEQ ID NO: 4083224 - DNA, 13 bp, Homo sapiens
ctgtgtttaatca

SEQ ID NO: 4083225 - DNA, 15 bp, Homo sapiens
ctgtgtttccatctc

SEQ ID NO: 4083226 - DNA, 23 bp, Homo sapiens
ctgtgtttgcagcctgctctagt

SEQ ID NO: 4083227 - DNA, 12 bp, Homo sapiens
ctgttaaaatct

SEQ ID NO: 4083228 - DNA, 19 bp, Homo sapiens
ctgttaaaatctattctgt

SEQ ID NO: 4083229 - DNA, 19 bp, Homo sapiens
ctgttaatagatcttaggg

SEQ ID NO: 4083230 - DNA, 19 bp, Homo sapiens
ctgttaccatgtcactgtg

SEQ ID NO: 4083231 - DNA, 20 bp, Homo sapiens
ctgttaccatgtcactgtgg

SEQ ID NO: 4083232 - DNA, 16 bp, Homo sapiens
ctgttaccgcctgtct

SEQ ID NO: 4083233 - DNA, 15 bp, Homo sapiens
ctgttacttacctaa

SEQ ID NO: 4083234 - DNA, 15 bp, Homo sapiens
ctgttaggaacagca

SEQ ID NO: 4083235 - DNA, 17 bp, Homo sapiens
ctgttaggaacagcagt

SEQ ID NO: 4083236 - DNA, 18 bp, Homo sapiens
ctgttaggaacagcagtg

SEQ ID NO: 4083237 - DNA, 19 bp, Homo sapiens
ctgttatcaaaactttctt

SEQ ID NO: 4083238 - DNA, 19 bp, Homo sapiens
ctgttatgatttccttcaa

SEQ ID NO: 4083239 - DNA, 20 bp, Homo sapiens
ctgttatgatttccttcaat

SEQ ID NO: 4083240 - DNA, 16 bp, Homo sapiens
ctgttatttcttccct

SEQ ID NO: 4083241 - DNA, 18 bp, Homo sapiens
ctgttatttcttccctgc

SEQ ID NO: 4083242 - DNA, 16 bp, Homo sapiens
ctgttcacagaaaaag

SEQ ID NO: 4083243 - DNA, 21 bp, Homo sapiens
ctgttcacgctcacccagtca

SEQ ID NO: 4083244 - DNA, 14 bp, Homo sapiens
ctgttcagtgagat

SEQ ID NO: 4083245 - DNA, 21 bp, Homo sapiens
ctgttcatacactaaccaaat

SEQ ID NO: 4083246 - DNA, 16 bp, Homo sapiens
ctgttcatgtgcctct

SEQ ID NO: 4083247 - DNA, 11 bp, Homo sapiens
ctgttccaaat

SEQ ID NO: 4083248 - DNA, 17 bp, Homo sapiens
ctgttccaaattcagtt

SEQ ID NO: 4083249 - DNA, 21 bp, Homo sapiens
ctgttccatgttctatttttg

SEQ ID NO: 4083250 - DNA, 14 bp, Homo sapiens
ctgttcccccaccc

SEQ ID NO: 4083251 - DNA, 17 bp, Homo sapiens
ctgttccctctgctcct

SEQ ID NO: 4083252 - DNA, 17 bp, Homo sapiens
ctgttcctccctcccac

SEQ ID NO: 4083253 - DNA, 15 bp, Homo sapiens
ctggtccagggaagc

SEQ ID NO: 4083254 - DNA, 17 bp, Homo sapiens
ctggtccagggaagctg

SEQ ID NO: 4083255 - DNA, 21 bp, Homo sapiens
ctggtccagggaagctggccg

SEQ ID NO: 4083256 - DNA, 16 bp, Homo sapiens
ctggtccatatttaca

SEQ ID NO: 4083257 - DNA, 18 bp, Homo sapiens
ctggtccatatttacatt

SEQ ID NO: 4083258 - DNA, 15 bp, Homo sapiens
ctggtccctgggagg

SEQ ID NO: 4083259 - DNA, 21 bp, Homo sapiens
ctggtcccttgcagctagttt

SEQ ID NO: 4083260 - DNA, 16 bp, Homo sapiens
ctggtccggacactcc

SEQ ID NO: 4083261 - DNA, 20 bp, Homo sapiens
ctggtccggacactcctaga

SEQ ID NO: 4083262 - DNA, 13 bp, Homo sapiens
ctggtcctcccat

SEQ ID NO: 4083263 - DNA, 21 bp, Homo sapiens
ctggtcctgagggtccccacc

SEQ ID NO: 4083264 - DNA, 17 bp, Homo sapiens
ctggtccttaccagaga

SEQ ID NO: 4083265 - DNA, 18 bp, Homo sapiens
ctggtccttaccagagac

SEQ ID NO: 4083266 - DNA, 15 bp, Homo sapiens
ctggtcctttttggt

SEQ ID NO: 4083267 - DNA, 15 bp, Homo sapiens
ctggtcgccttccac

SEQ ID NO: 4083268 - DNA, 21 bp, Homo sapiens
ctggtctcaaactcctgggct

SEQ ID NO: 4083269 - DNA, 14 bp, Homo sapiens
ctggtctgtaggga

SEQ ID NO: 4083270 - DNA, 15 bp, Homo sapiens
ctggtcttgagatgt

SEQ ID NO: 4083271 - DNA, 20 bp, Homo sapiens
ctggtcttgttagaaaacaa

SEQ ID NO: 4083272 - DNA, 19 bp, Homo sapiens
ctggtgaatcacctggctg

SEQ ID NO: 4083273 - DNA, 22 bp, Homo sapiens
ctggtgactgcgatcttcagag

SEQ ID NO: 4083274 - DNA, 15 bp, Homo sapiens
ctggtgcattacaga

SEQ ID NO: 4083275 - DNA, 19 bp, Homo sapiens
ctggtgccaaaaccaggcc

SEQ ID NO: 4083276 - DNA, 14 bp, Homo sapiens
ctggtgccccacag

SEQ ID NO: 4083277 - DNA, 16 bp, Homo sapiens
ctggtgccccacagct

SEQ ID NO: 4083278 - DNA, 18 bp, Homo sapiens
ctggtgccccacagctac

SEQ ID NO: 4083279 - DNA, 20 bp, Homo sapiens
ctggtgccccccacccctgg

SEQ ID NO: 4083280 - DNA, 23 bp, Homo sapiens
ctggtgctataggctggagaagc

SEQ ID NO: 4083281 - DNA, 13 bp, Homo sapiens
ctggtgctcctgc

SEQ ID NO: 4083282 - DNA, 22 bp, Homo sapiens
ctggtgctgccacacttcaggc

SEQ ID NO: 4083283 - DNA, 12 bp, Homo sapiens
ctggtgctgctg

SEQ ID NO: 4083284 - DNA, 16 bp, Homo sapiens
ctggtgctgtggccag

SEQ ID NO: 4083285 - DNA, 22 bp, Homo sapiens
ctggtggaaagcgattcactgt

SEQ ID NO: 4083286 - DNA, 15 bp, Homo sapiens
ctggtggaccacagg

SEQ ID NO: 4083287 - DNA, 20 bp, Homo sapiens
ctggtggaccacaggcatct

SEQ ID NO: 4083288 - DNA, 14 bp, Homo sapiens
ctggtggcacagga

SEQ ID NO: 4083289 - DNA, 22 bp, Homo sapiens
ctggtggcaccagatgcaacct

SEQ ID NO: 4083290 - DNA, 21 bp, Homo sapiens
ctggtggcccgacagcctggc

SEQ ID NO: 4083291 - DNA, 13 bp, Homo sapiens
ctggtgggccaac

SEQ ID NO: 4083292 - DNA, 14 bp, Homo sapiens
ctggtggtcagatg

SEQ ID NO: 4083293 - DNA, 18 bp, Homo sapiens
ctggtgtgtggtgagggg

SEQ ID NO: 4083294 - DNA, 22 bp, Homo sapiens
ctggtgtttaggtgaattaatt

SEQ ID NO: 4083295 - DNA, 13 bp, Homo sapiens
ctggtgtttcttg

SEQ ID NO: 4083296 - DNA, 15 bp, Homo sapiens
ctggttactcagggt

SEQ ID NO: 4083297 - DNA, 22 bp, Homo sapiens
ctggttactcagggttcatctg

SEQ ID NO: 4083298 - DNA, 23 bp, Homo sapiens
ctggttactcagggttcatctgt

SEQ ID NO: 4083299 - DNA, 20 bp, Homo sapiens
ctggttagttaaaagcccat

SEQ ID NO: 4083300 - DNA, 19 bp, Homo sapiens
ctggttggccgtggtccag

SEQ ID NO: 4083301 - DNA, 21 bp, Homo sapiens
ctggttggctcccgcggtgcc

SEQ ID NO: 4083302 - DNA, 21 bp, Homo sapiens
ctggtttacaggccctgctcc

SEQ ID NO: 4083303 - DNA, 16 bp, Homo sapiens
ctggtttcctgcccag

SEQ ID NO: 4083304 - DNA, 22 bp, Homo sapiens
ctggtttcctgcccagcctggg

SEQ ID NO: 4083305 - DNA, 15 bp, Homo sapiens
ctggtttctcattct

SEQ ID NO: 4083306 - DNA, 18 bp, Homo sapiens
ctggtttctcattcttgt

SEQ ID NO: 4083307 - DNA, 21 bp, Homo sapiens
ctggttttaagtggaactgcc

SEQ ID NO: 4083308 - DNA, 19 bp, Homo sapiens
ctggttttattactctcac

SEQ ID NO: 4083309 - DNA, 18 bp, Homo sapiens
ctggttttgtacactgct

SEQ ID NO: 4083310 - DNA, 21 bp, Homo sapiens
ctggttttgtacactgctgta

SEQ ID NO: 4083311 - DNA, 19 bp, Homo sapiens
ctgtaaaaacactgaaaaa

SEQ ID NO: 4083312 - DNA, 22 bp, Homo sapiens
ctgtaaaaacactgaaaaatta

SEQ ID NO: 4083313 - DNA, 13 bp, Homo sapiens
ctgtaaaactaag

SEQ ID NO: 4083314 - DNA, 20 bp, Homo sapiens
ctgtaaaagcaagtcctgca

SEQ ID NO: 4083315 - DNA, 15 bp, Homo sapiens
ctgtaaagtgcctta

SEQ ID NO: 4083316 - DNA, 17 bp, Homo sapiens
ctgtaaatggtgtacat

SEQ ID NO: 4083317 - DNA, 21 bp, Homo sapiens
ctgtaaatggtgtacataatg

SEQ ID NO: 4083318 - DNA, 23 bp, Homo sapiens
ctgtaaatggtgtacataatgta

SEQ ID NO: 4083319 - DNA, 17 bp, Homo sapiens
ctgtaacaggtattttg

SEQ ID NO: 4083320 - DNA, 18 bp, Homo sapiens
ctgtaacagttctttttg

SEQ ID NO: 4083321 - DNA, 19 bp, Homo sapiens
ctgtaacatactggcctgg

SEQ ID NO: 4083322 - DNA, 16 bp, Homo sapiens
ctgtaacgtgtgctgt

SEQ ID NO: 4083323 - DNA, 15 bp, Homo sapiens
ctgtaacttaaaata

SEQ ID NO: 4083324 - DNA, 14 bp, Homo sapiens
ctgtaatcccagca

SEQ ID NO: 4083325 - DNA, 16 bp, Homo sapiens
ctgtaatcccagcact

SEQ ID NO: 4083326 - DNA, 14 bp, Homo sapiens
ctgtaatcccagct

SEQ ID NO: 4083327 - DNA, 22 bp, Homo sapiens
ctgtaatcccagctactcggga

SEQ ID NO: 4083328 - DNA, 18 bp, Homo sapiens
ctgtaatggtactgactt

SEQ ID NO: 4083329 - DNA, 16 bp, Homo sapiens
ctgtaattgtgtgtga

SEQ ID NO: 4083330 - DNA, 19 bp, Homo sapiens
ctgtacactgaatatttat

SEQ ID NO: 4083331 - DNA, 13 bp, Homo sapiens
ctgtacagtgtta

SEQ ID NO: 4083332 - DNA, 15 bp, Homo sapiens
ctgtacatatgtaaa

SEQ ID NO: 4083333 - DNA, 23 bp, Homo sapiens
ctgtacatattactgttgcattt

SEQ ID NO: 4083334 - DNA, 14 bp, Homo sapiens
ctgtacatttaaaa

SEQ ID NO: 4083335 - DNA, 13 bp, Homo sapiens
ctgtaccaaatct

SEQ ID NO: 4083336 - DNA, 14 bp, Homo sapiens
ctgtaccaaatctg

SEQ ID NO: 4083337 - DNA, 15 bp, Homo sapiens
ctgtaccaaatctga

SEQ ID NO: 4083338 - DNA, 21 bp, Homo sapiens
ctgtaccaaatctgacatatt

SEQ ID NO: 4083339 - DNA, 16 bp, Homo sapiens
ctgtaccacagacaca

SEQ ID NO: 4083340 - DNA, 16 bp, Homo sapiens
ctgtacccagatgcct

SEQ ID NO: 4083341 - DNA, 15 bp, Homo sapiens
ctgtaccctttaaga

SEQ ID NO: 4083342 - DNA, 18 bp, Homo sapiens
ctgtacctcatcccatga

SEQ ID NO: 4083343 - DNA, 22 bp, Homo sapiens
ctgtaccttttgaggagcccca

SEQ ID NO: 4083344 - DNA, 23 bp, Homo sapiens
ctgtaccttttgaggagccccag

SEQ ID NO: 4083345 - DNA, 15 bp, Homo sapiens
ctgtactcctcccag

SEQ ID NO: 4083346 - DNA, 17 bp, Homo sapiens
ctgtactgttctgtgtc

SEQ ID NO: 4083347 - DNA, 22 bp, Homo sapiens
ctgtagacctagggaggacctt

SEQ ID NO: 4083348 - DNA, 18 bp, Homo sapiens
ctgtagacggctcagtat

SEQ ID NO: 4083349 - DNA, 16 bp, Homo sapiens
ctgtagagttgctgag

SEQ ID NO: 4083350 - DNA, 18 bp, Homo sapiens
ctgtagatgcagaaaaag

SEQ ID NO: 4083351 - DNA, 13 bp, Homo sapiens
ctgtagccacagc

SEQ ID NO: 4083352 - DNA, 15 bp, Homo sapiens
ctgtagccatctgca

SEQ ID NO: 4083353 - DNA, 18 bp, Homo sapiens
ctgtagggagaagcttta

SEQ ID NO: 4083354 - DNA, 15 bp, Homo sapiens
ctgtagggctggacc

SEQ ID NO: 4083355 - DNA, 21 bp, Homo sapiens
ctgtagggctggacctatgtc

SEQ ID NO: 4083356 - DNA, 14 bp, Homo sapiens
ctgaaattctaaag

SEQ ID NO: 4083357 - DNA, 20 bp, Homo sapiens
ctgaacaaatcttgggtggg

SEQ ID NO: 4083358 - DNA, 12 bp, Homo sapiens
ctgaacacacac

SEQ ID NO: 4083359 - DNA, 13 bp, Homo sapiens
ctgaacacacaca

SEQ ID NO: 4083360 - DNA, 13 bp, Homo sapiens
ctgaacacaggca

SEQ ID NO: 4083361 - DNA, 18 bp, Homo sapiens
ctgaacacaggcagcttt

SEQ ID NO: 4083362 - DNA, 22 bp, Homo sapiens
ctgaacactgaagtcagttctc

SEQ ID NO: 4083363 - DNA, 13 bp, Homo sapiens
ctgaacctgtctt

SEQ ID NO: 4083364 - DNA, 14 bp, Homo sapiens
ctgaacctgtcttt

SEQ ID NO: 4083365 - DNA, 16 bp, Homo sapiens
ctgaactcaagctgcg

SEQ ID NO: 4083366 - DNA, 13 bp, Homo sapiens
ctgaactcacttt

SEQ ID NO: 4083367 - DNA, 21 bp, Homo sapiens
ctgaactccaccgaccaactg

SEQ ID NO: 4083368 - DNA, 12 bp, Homo sapiens
ctgaactctcaa

SEQ ID NO: 4083369 - DNA, 12 bp, Homo sapiens
ctgaactgagga

SEQ ID NO: 4083370 - DNA, 23 bp, Homo sapiens
ctgaactgaggagatgaccaggg

SEQ ID NO: 4083371 - DNA, 18 bp, Homo sapiens
ctgaacttgcattgtgat

SEQ ID NO: 4083372 - DNA, 13 bp, Homo sapiens
ctgaactttggag

SEQ ID NO: 4083373 - DNA, 14 bp, Homo sapiens
ctgaactttggaga

SEQ ID NO: 4083374 - DNA, 13 bp, Homo sapiens
ctgaagaaaaaat

SEQ ID NO: 4083375 - DNA, 14 bp, Homo sapiens
ctgaagaaaaaatc

SEQ ID NO: 4083376 - DNA, 23 bp, Homo sapiens
ctgaagacaccgttcattcaggc

SEQ ID NO: 4083377 - DNA, 15 bp, Homo sapiens
ctgaagactgaggac

SEQ ID NO: 4083378 - DNA, 21 bp, Homo sapiens
ctgaagagtatccttccttca

SEQ ID NO: 4083379 - DNA, 14 bp, Homo sapiens
ctgaagatatattt

SEQ ID NO: 4083380 - DNA, 16 bp, Homo sapiens
ctgaagatgatcattt

SEQ ID NO: 4083381 - DNA, 22 bp, Homo sapiens
ctgaagatgcagctcactaccc

SEQ ID NO: 4083382 - DNA, 22 bp, Homo sapiens
ctgaagattcttaaaaattgaa

SEQ ID NO: 4083383 - DNA, 17 bp, Homo sapiens
ctgaagccagctgccct

SEQ ID NO: 4083384 - DNA, 11 bp, Homo sapiens
ctgaaggaaaa

SEQ ID NO: 4083385 - DNA, 17 bp, Homo sapiens
ctgaaggaaaaacacaa

SEQ ID NO: 4083386 - DNA, 18 bp, Homo sapiens
ctgaaggaaaaacacaag

SEQ ID NO: 4083387 - DNA, 13 bp, Homo sapiens
ctgaaggactgga

SEQ ID NO: 4083388 - DNA, 19 bp, Homo sapiens
ctgaaggggccatgatggc

SEQ ID NO: 4083389 - DNA, 21 bp, Homo sapiens
ctgaagtcacatcacaggaca

SEQ ID NO: 4083390 - DNA, 17 bp, Homo sapiens
ctgaagtcactgcacag

SEQ ID NO: 4083391 - DNA, 22 bp, Homo sapiens
ctgaagtcactgcacagtgcat

SEQ ID NO: 4083392 - DNA, 18 bp, Homo sapiens
ctgaagtgagcacagcct

SEQ ID NO: 4083393 - DNA, 21 bp, Homo sapiens
ctgaagtgagcacagcctagg

SEQ ID NO: 4083394 - DNA, 16 bp, Homo sapiens
ctgaagtgcatccaaa

SEQ ID NO: 4083395 - DNA, 16 bp, Homo sapiens
ctgaagtgcttagtgt

SEQ ID NO: 4083396 - DNA, 15 bp, Homo sapiens
ctgaagttgaacatg

SEQ ID NO: 4083397 - DNA, 15 bp, Homo sapiens
ctgaataacatttgt

SEQ ID NO: 4083398 - DNA, 18 bp, Homo sapiens
ctgaatattttggaaact

SEQ ID NO: 4083399 - DNA, 21 bp, Homo sapiens
ctgaatcatgagcctgctgga

SEQ ID NO: 4083400 - DNA, 22 bp, Homo sapiens
ctgaatcattctcgatttaact

SEQ ID NO: 4083401 - DNA, 22 bp, Homo sapiens
ctgaatcccccttgccacccca

SEQ ID NO: 4083402 - DNA, 23 bp, Homo sapiens
ctgaatgactccactgtttttct

SEQ ID NO: 4083403 - DNA, 19 bp, Homo sapiens
ctgaatgcctcctgtgggg

SEQ ID NO: 4083404 - DNA, 20 bp, Homo sapiens
ctgaatgcctcctgtgggga

SEQ ID NO: 4083405 - DNA, 14 bp, Homo sapiens
ctgaatgctgccac

SEQ ID NO: 4083406 - DNA, 22 bp, Homo sapiens
ctgaatggaaggtttgtatatt

SEQ ID NO: 4083407 - DNA, 18 bp, Homo sapiens
ctgaatggttccatgcct

SEQ ID NO: 4083408 - DNA, 19 bp, Homo sapiens
ctgaatgtcaaacagtgcc

SEQ ID NO: 4083409 - DNA, 14 bp, Homo sapiens
ctgaatgttctgac

SEQ ID NO: 4083410 - DNA, 18 bp, Homo sapiens
ctgaatgttctgacatta

SEQ ID NO: 4083411 - DNA, 20 bp, Homo sapiens
ctgaatgttctgacattaac

SEQ ID NO: 4083412 - DNA, 22 bp, Homo sapiens
ctgaatgtttaaagatcatgac

SEQ ID NO: 4083413 - DNA, 20 bp, Homo sapiens
ctgaatgttttatttatcaa

SEQ ID NO: 4083414 - DNA, 17 bp, Homo sapiens
ctgaattaatcatctat

SEQ ID NO: 4083415 - DNA, 18 bp, Homo sapiens
ctgaatttttttgtaata

SEQ ID NO: 4083416 - DNA, 19 bp, Homo sapiens
ctgaatttttttgtaataa

SEQ ID NO: 4083417 - DNA, 23 bp, Homo sapiens
ctgaatttttttgtaataagcaa

SEQ ID NO: 4083418 - DNA, 18 bp, Homo sapiens
ctgacaaccactggtctg

SEQ ID NO: 4083419 - DNA, 20 bp, Homo sapiens
ctgacaaccactggtctgta

SEQ ID NO: 4083420 - DNA, 13 bp, Homo sapiens
ctgacacactaac

SEQ ID NO: 4083421 - DNA, 16 bp, Homo sapiens
ctgacacactaaccaa

SEQ ID NO: 4083422 - DNA, 19 bp, Homo sapiens
ctgacacactaaccaagct

SEQ ID NO: 4083423 - DNA, 22 bp, Homo sapiens
ctgacacactaaccaagctgag

SEQ ID NO: 4083424 - DNA, 14 bp, Homo sapiens
ctgacaccccctcc

SEQ ID NO: 4083425 - DNA, 17 bp, Homo sapiens
ctgacactgagccccac

SEQ ID NO: 4083426 - DNA, 19 bp, Homo sapiens
ctgacactgagccccacct

SEQ ID NO: 4083427 - DNA, 16 bp, Homo sapiens
ctgacagagctctggg

SEQ ID NO: 4083428 - DNA, 13 bp, Homo sapiens
ctgacagcctccc

SEQ ID NO: 4083429 - DNA, 21 bp, Homo sapiens
ctgacaggtgaggtctgttcc

SEQ ID NO: 4083430 - DNA, 14 bp, Homo sapiens
ctgacagtttttct

SEQ ID NO: 4083431 - DNA, 17 bp, Homo sapiens
ctgacatcacagcagcc

SEQ ID NO: 4083432 - DNA, 23 bp, Homo sapiens
ctgacatcacagcagcctccaac

SEQ ID NO: 4083433 - DNA, 16 bp, Homo sapiens
ctgacatctggaatct

SEQ ID NO: 4083434 - DNA, 21 bp, Homo sapiens
ctgacattaacagttttccat

SEQ ID NO: 4083435 - DNA, 23 bp, Homo sapiens
ctgacattaacagttttccatga

SEQ ID NO: 4083436 - DNA, 22 bp, Homo sapiens
ctgaccaattgtgctgccattt

SEQ ID NO: 4083437 - DNA, 15 bp, Homo sapiens
ctgaccacagcacag

SEQ ID NO: 4083438 - DNA, 15 bp, Homo sapiens
ctgaccatccactct

SEQ ID NO: 4083439 - DNA, 22 bp, Homo sapiens
ctgaccatccactctaccctcc

SEQ ID NO: 4083440 - DNA, 13 bp, Homo sapiens
ctgacccagtgcc

SEQ ID NO: 4083441 - DNA, 17 bp, Homo sapiens
ctgaccccattcctgat

SEQ ID NO: 4083442 - DNA, 14 bp, Homo sapiens
ctgacccccttcct

SEQ ID NO: 4083443 - DNA, 23 bp, Homo sapiens
ctgaccccgagaagtgctcttgg

SEQ ID NO: 4083444 - DNA, 13 bp, Homo sapiens
ctgaccccttgct

SEQ ID NO: 4083445 - DNA, 17 bp, Homo sapiens
ctgaccccttgctccct

SEQ ID NO: 4083446 - DNA, 18 bp, Homo sapiens
ctgaccctactcccttgc

SEQ ID NO: 4083447 - DNA, 19 bp, Homo sapiens
ctgaccctgcttcaaatat

SEQ ID NO: 4083448 - DNA, 23 bp, Homo sapiens
ctgacccttgggcctgggcctct

SEQ ID NO: 4083449 - DNA, 16 bp, Homo sapiens
ctgacctcttgctgtc

SEQ ID NO: 4083450 - DNA, 20 bp, Homo sapiens
ctgacctcttgctgtctctg

SEQ ID NO: 4083451 - DNA, 21 bp, Homo sapiens
ctgacctcttgctgtctctgc

SEQ ID NO: 4083452 - DNA, 19 bp, Homo sapiens
ctgacctgaccccattcct

SEQ ID NO: 4083453 - DNA, 20 bp, Homo sapiens
ctgacctgaccccattcctg

SEQ ID NO: 4083454 - DNA, 14 bp, Homo sapiens
ctgacctgagactg

SEQ ID NO: 4083455 - DNA, 14 bp, Homo sapiens
ctgacctgcactgg

SEQ ID NO: 4083456 - DNA, 21 bp, Homo sapiens
ctgaccttggctgactggggc

SEQ ID NO: 4083457 - DNA, 17 bp, Homo sapiens
ctgacgctgcatgagac

SEQ ID NO: 4083458 - DNA, 21 bp, Homo sapiens
ctgacggccagggagaagctc

SEQ ID NO: 4083459 - DNA, 14 bp, Homo sapiens
ctgacggcgccccc

SEQ ID NO: 4083460 - DNA, 22 bp, Homo sapiens
ctgacggcgcccccagtgtgca

SEQ ID NO: 4083461 - DNA, 23 bp, Homo sapiens
ctgacgtctgaagcttgactccc

SEQ ID NO: 4083462 - DNA, 14 bp, Homo sapiens
ctgactaaaatgtt

SEQ ID NO: 4083463 - DNA, 15 bp, Homo sapiens
ctgactactttgcct

SEQ ID NO: 4083464 - DNA, 20 bp, Homo sapiens
ctgactcaattatttgcata

SEQ ID NO: 4083465 - DNA, 16 bp, Homo sapiens
ctgactcatcatttgt

SEQ ID NO: 4083466 - DNA, 21 bp, Homo sapiens
ctgactcctacctgccctgga

SEQ ID NO: 4083467 - DNA, 22 bp, Homo sapiens
ctgactcctacctgccctggaa

SEQ ID NO: 4083468 - DNA, 21 bp, Homo sapiens
ctgactctgagtccactgctc

SEQ ID NO: 4083469 - DNA, 14 bp, Homo sapiens
ctgactctgccccc

SEQ ID NO: 4083470 - DNA, 20 bp, Homo sapiens
ctgactctgccccctgctgg

SEQ ID NO: 4083471 - DNA, 13 bp, Homo sapiens
ctgactgacatga

SEQ ID NO: 4083472 - DNA, 15 bp, Homo sapiens
ctgactggaggaggc

SEQ ID NO: 4083473 - DNA, 16 bp, Homo sapiens
ctgactggaggaggcc

SEQ ID NO: 4083474 - DNA, 21 bp, Homo sapiens
ctgactggattcattctcata

SEQ ID NO: 4083475 - DNA, 21 bp, Homo sapiens
ctgactggccaaacccttgct

SEQ ID NO: 4083476 - DNA, 12 bp, Homo sapiens
ctgactggcctg

SEQ ID NO: 4083477 - DNA, 14 bp, Homo sapiens
ctgactgggctggg

SEQ ID NO: 4083478 - DNA, 16 bp, Homo sapiens
ctgactgggctgggtt

SEQ ID NO: 4083479 - DNA, 23 bp, Homo sapiens
ctgactgggctgggtttgctgtc

SEQ ID NO: 4083480 - DNA, 22 bp, Homo sapiens
ctgactggtgctataggctgga

SEQ ID NO: 4083481 - DNA, 12 bp, Homo sapiens
ctgactgtggcc

SEQ ID NO: 4083482 - DNA, 19 bp, Homo sapiens
ctgactgtggccccctccg

SEQ ID NO: 4083483 - DNA, 17 bp, Homo sapiens
ctgacttcatctcccac

SEQ ID NO: 4083484 - DNA, 14 bp, Homo sapiens
ctgacttcatctgg

SEQ ID NO: 4083485 - DNA, 17 bp, Homo sapiens
ctgacttcatctggggt

SEQ ID NO: 4083486 - DNA, 22 bp, Homo sapiens
ctgacttcatggaatggacatc

SEQ ID NO: 4083487 - DNA, 22 bp, Homo sapiens
ctgacttgagtgttccttttta

SEQ ID NO: 4083488 - DNA, 12 bp, Homo sapiens
ctgacttgcttt

SEQ ID NO: 4083489 - DNA, 13 bp, Homo sapiens
ctgacttgcttta

SEQ ID NO: 4083490 - DNA, 22 bp, Homo sapiens
ctgacttgtatctgtccgtgga

SEQ ID NO: 4083491 - DNA, 20 bp, Homo sapiens
ctgacttgtttgtcttccat

SEQ ID NO: 4083492 - DNA, 17 bp, Homo sapiens
ctgactttgcttgcttt

SEQ ID NO: 4083493 - DNA, 18 bp, Homo sapiens
ctgactttgcttgctttg

SEQ ID NO: 4083494 - DNA, 18 bp, Homo sapiens
ctgagaagaagtggctgc

SEQ ID NO: 4083495 - DNA, 17 bp, Homo sapiens
ctgagaagattgtgaat

SEQ ID NO: 4083496 - DNA, 14 bp, Homo sapiens
ctgagaagctgctc

SEQ ID NO: 4083497 - DNA, 17 bp, Homo sapiens
ctgagaagctgctccag

SEQ ID NO: 4083498 - DNA, 21 bp, Homo sapiens
ctgagaagctgctccaggcct

SEQ ID NO: 4083499 - DNA, 22 bp, Homo sapiens
ctgagaatttaaaaataagaaa

SEQ ID NO: 4083500 - DNA, 13 bp, Homo sapiens
ctgagacaggaga

SEQ ID NO: 4083501 - DNA, 13 bp, Homo sapiens
ctgagaccactga

SEQ ID NO: 4083502 - DNA, 19 bp, Homo sapiens
ctgagacccttttctcagg

SEQ ID NO: 4083503 - DNA, 21 bp, Homo sapiens
ctgagacccttttctcaggac

SEQ ID NO: 4083504 - DNA, 17 bp, Homo sapiens
ctgagactctttagagc

SEQ ID NO: 4083505 - DNA, 12 bp, Homo sapiens
ctgagagaaata

SEQ ID NO: 4083506 - DNA, 20 bp, Homo sapiens
ctgagagaattggctcaata

SEQ ID NO: 4083507 - DNA, 12 bp, Homo sapiens
ctgagaggcagg

SEQ ID NO: 4083508 - DNA, 20 bp, Homo sapiens
ctgagagtatttaggcagat

SEQ ID NO: 4083509 - DNA, 22 bp, Homo sapiens
ctgagagtcagctctctgccct

SEQ ID NO: 4083510 - DNA, 22 bp, Homo sapiens
ctgagagtgaaaccatgactgt

SEQ ID NO: 4083511 - DNA, 17 bp, Homo sapiens
ctgagatcccctgagcc

SEQ ID NO: 4083512 - DNA, 19 bp, Homo sapiens
ctgagatcgtgctactgca

SEQ ID NO: 4083513 - DNA, 21 bp, Homo sapiens
ctgagatgagaggggagagct

SEQ ID NO: 4083514 - DNA, 22 bp, Homo sapiens
ctgagatgctcactttattatc

SEQ ID NO: 4083515 - DNA, 17 bp, Homo sapiens
ctgagattgcagatgtg

SEQ ID NO: 4083516 - DNA, 18 bp, Homo sapiens
ctgagatttttttgtgta

SEQ ID NO: 4083517 - DNA, 23 bp, Homo sapiens
ctgagcacctgcttcatgctcag

SEQ ID NO: 4083518 - DNA, 15 bp, Homo sapiens
ctgagcacttagcag

SEQ ID NO: 4083519 - DNA, 20 bp, Homo sapiens
ctgagcacttagcaggcacc

SEQ ID NO: 4083520 - DNA, 15 bp, Homo sapiens
ctgagcagccgccag

SEQ ID NO: 4083521 - DNA, 19 bp, Homo sapiens
ctgagcagccgccagctgg

SEQ ID NO: 4083522 - DNA, 13 bp, Homo sapiens
ctgagcagcctct

SEQ ID NO: 4083523 - DNA, 16 bp, Homo sapiens
ctgagcagcctctgga

SEQ ID NO: 4083524 - DNA, 13 bp, Homo sapiens
ctgagccacagtg

SEQ ID NO: 4083525 - DNA, 15 bp, Homo sapiens
ctgagccactctctt

SEQ ID NO: 4083526 - DNA, 12 bp, Homo sapiens
ctgagcccagct

SEQ ID NO: 4083527 - DNA, 15 bp, Homo sapiens
ctgagccccacctct

SEQ ID NO: 4083528 - DNA, 20 bp, Homo sapiens
ctgagccccagggtgcccag

SEQ ID NO: 4083529 - DNA, 23 bp, Homo sapiens
ctgagccctggggactgttccaa

SEQ ID NO: 4083530 - DNA, 17 bp, Homo sapiens
ctgagcctacagatgaa

SEQ ID NO: 4083531 - DNA, 14 bp, Homo sapiens
ctgagcctcacttg

SEQ ID NO: 4083532 - DNA, 15 bp, Homo sapiens
ctgagcctctgctcc

SEQ ID NO: 4083533 - DNA, 22 bp, Homo sapiens
ctgagcctgtgggtccccactc

SEQ ID NO: 4083534 - DNA, 17 bp, Homo sapiens
ctgagccttcagtcttg

SEQ ID NO: 4083535 - DNA, 13 bp, Homo sapiens
ctgagccttctga

SEQ ID NO: 4083536 - DNA, 14 bp, Homo sapiens
ctgagccttctgag

SEQ ID NO: 4083537 - DNA, 15 bp, Homo sapiens
ctgagccttctgagc

SEQ ID NO: 4083538 - DNA, 18 bp, Homo sapiens
ctgagcgggaggcagagt

SEQ ID NO: 4083539 - DNA, 22 bp, Homo sapiens
ctgagcggtgggggaggagggt

SEQ ID NO: 4083540 - DNA, 19 bp, Homo sapiens
ctgagctattttcctctgg

SEQ ID NO: 4083541 - DNA, 24 bp, Homo sapiens
ctgagctattttcctctggccgca

SEQ ID NO: 4083542 - DNA, 15 bp, Homo sapiens
ctgagctcacatggg

SEQ ID NO: 4083543 - DNA, 17 bp, Homo sapiens
ctgagctccccagatct

SEQ ID NO: 4083544 - DNA, 18 bp, Homo sapiens
ctgagctcctgctgcgga

SEQ ID NO: 4083545 - DNA, 23 bp, Homo sapiens
ctgagctgagtggccagccagtg

SEQ ID NO: 4083546 - DNA, 15 bp, Homo sapiens
ctgagctgcagcctg

SEQ ID NO: 4083547 - DNA, 21 bp, Homo sapiens
ctgagctgcagctgagcctga

SEQ ID NO: 4083548 - DNA, 15 bp, Homo sapiens
ctgagctgctcaccg

SEQ ID NO: 4083549 - DNA, 16 bp, Homo sapiens
ctgagctggccaggcc

SEQ ID NO: 4083550 - DNA, 15 bp, Homo sapiens
ctgagcttctctgtg

SEQ ID NO: 4083551 - DNA, 15 bp, Homo sapiens
ctgaggacaaagtgg

SEQ ID NO: 4083552 - DNA, 17 bp, Homo sapiens
ctgaggagatgaccagg

SEQ ID NO: 4083553 - DNA, 16 bp, Homo sapiens
ctgaggaggcctccat

SEQ ID NO: 4083554 - DNA, 11 bp, Homo sapiens
ctgaggattca

SEQ ID NO: 4083555 - DNA, 18 bp, Homo sapiens
ctgaggattcaggggctg

SEQ ID NO: 4083556 - DNA, 16 bp, Homo sapiens
ctgaggcaagagaatt

SEQ ID NO: 4083557 - DNA, 16 bp, Homo sapiens
ctgaggcagccttggg

SEQ ID NO: 4083558 - DNA, 12 bp, Homo sapiens
ctgaggccacac

SEQ ID NO: 4083559 - DNA, 15 bp, Homo sapiens
ctgaggccagagtca

SEQ ID NO: 4083560 - DNA, 23 bp, Homo sapiens
ctgaggccagagtcaccttttct

SEQ ID NO: 4083561 - DNA, 15 bp, Homo sapiens
ctgaggccctgggct

SEQ ID NO: 4083562 - DNA, 17 bp, Homo sapiens
ctcttcaggcctccctc

SEQ ID NO: 4083563 - DNA, 19 bp, Homo sapiens
ctcttcaggcctccctctc

SEQ ID NO: 4083564 - DNA, 14 bp, Homo sapiens
ctcttcaggttctt

SEQ ID NO: 4083565 - DNA, 15 bp, Homo sapiens
ctcttccaggcagcc

SEQ ID NO: 4083566 - DNA, 16 bp, Homo sapiens
ctcttcccatgactgc

SEQ ID NO: 4083567 - DNA, 13 bp, Homo sapiens
ctcttccccagag

SEQ ID NO: 4083568 - DNA, 14 bp, Homo sapiens
ctcttccccagaga

SEQ ID NO: 4083569 - DNA, 14 bp, Homo sapiens
ctcttcccttcaac

SEQ ID NO: 4083570 - DNA, 21 bp, Homo sapiens
ctcttccctttccccagcatc

SEQ ID NO: 4083571 - DNA, 22 bp, Homo sapiens
ctcttccggagatgtagcaaaa

SEQ ID NO: 4083572 - DNA, 16 bp, Homo sapiens
ctcttcctatttttgt

SEQ ID NO: 4083573 - DNA, 19 bp, Homo sapiens
ctcttcctggacaggccag

SEQ ID NO: 4083574 - DNA, 14 bp, Homo sapiens
ctcttctaacccaa

SEQ ID NO: 4083575 - DNA, 13 bp, Homo sapiens
ctcttctccactg

SEQ ID NO: 4083576 - DNA, 19 bp, Homo sapiens
ctcttctccactggatgga

SEQ ID NO: 4083577 - DNA, 20 bp, Homo sapiens
ctcttctccccttccatttc

SEQ ID NO: 4083578 - DNA, 19 bp, Homo sapiens
ctcttctcggctcaggctc

SEQ ID NO: 4083579 - DNA, 13 bp, Homo sapiens
ctcttctgctcca

SEQ ID NO: 4083580 - DNA, 18 bp, Homo sapiens
ctcttctgctccaccctt

SEQ ID NO: 4083581 - DNA, 19 bp, Homo sapiens
ctcttctgctcttttcctg

SEQ ID NO: 4083582 - DNA, 11 bp, Homo sapiens
ctcttctggct

SEQ ID NO: 4083583 - DNA, 15 bp, Homo sapiens
ctcttctgggcctga

SEQ ID NO: 4083584 - DNA, 19 bp, Homo sapiens
ctcttctggtgttgactgg

SEQ ID NO: 4083585 - DNA, 13 bp, Homo sapiens
ctcttctgtccct

SEQ ID NO: 4083586 - DNA, 17 bp, Homo sapiens
ctcttcttcttcagaag

SEQ ID NO: 4083587 - DNA, 14 bp, Homo sapiens
ctcttctttgtgcc

SEQ ID NO: 4083588 - DNA, 17 bp, Homo sapiens
ctcttctttgtgccttt

SEQ ID NO: 4083589 - DNA, 18 bp, Homo sapiens
ctcttctttgtgcctttg

SEQ ID NO: 4083590 - DNA, 23 bp, Homo sapiens
ctcttctttgtgcctttggcctg

SEQ ID NO: 4083591 - DNA, 22 bp, Homo sapiens
ctcttgaaaaatgcccatttgc

SEQ ID NO: 4083592 - DNA, 13 bp, Homo sapiens
ctcttgaaaagtt

SEQ ID NO: 4083593 - DNA, 22 bp, Homo sapiens
ctcttgaaaagttcagggaccg

SEQ ID NO: 4083594 - DNA, 18 bp, Homo sapiens
ctcttgagcagtggctgg

SEQ ID NO: 4083595 - DNA, 22 bp, Homo sapiens
ctcttgagcagtggctggtcca

SEQ ID NO: 4083596 - DNA, 17 bp, Homo sapiens
ctcttgaggccaggagt

SEQ ID NO: 4083597 - DNA, 14 bp, Homo sapiens
ctcttgagggagct

SEQ ID NO: 4083598 - DNA, 19 bp, Homo sapiens
ctcttgatacccccctctg

SEQ ID NO: 4083599 - DNA, 20 bp, Homo sapiens
ctcttgatctctcttgtcct

SEQ ID NO: 4083600 - DNA, 20 bp, Homo sapiens
ctcttgatggtggactaagc

SEQ ID NO: 4083601 - DNA, 14 bp, Homo sapiens
ctcttgatgtgaag

SEQ ID NO: 4083602 - DNA, 14 bp, Homo sapiens
ctcttgattcctgg

SEQ ID NO: 4083603 - DNA, 16 bp, Homo sapiens
ctcttgcccatcctga

SEQ ID NO: 4083604 - DNA, 20 bp, Homo sapiens
ctcttgcccatcctgactga

SEQ ID NO: 4083605 - DNA, 13 bp, Homo sapiens
ctcttgctgtctc

SEQ ID NO: 4083606 - DNA, 14 bp, Homo sapiens
ctcttgctgtctct

SEQ ID NO: 4083607 - DNA, 17 bp, Homo sapiens
ctcttggctgacccctc

SEQ ID NO: 4083608 - DNA, 18 bp, Homo sapiens
ctcttggctgacccctct

SEQ ID NO: 4083609 - DNA, 19 bp, Homo sapiens
ctcttggctgacccctctg

SEQ ID NO: 4083610 - DNA, 21 bp, Homo sapiens
ctcttggctgacccctctggt

SEQ ID NO: 4083611 - DNA, 21 bp, Homo sapiens
ctcttggtgtgattgcacaga

SEQ ID NO: 4083612 - DNA, 14 bp, Homo sapiens
ctcttgtaaagact

SEQ ID NO: 4083613 - DNA, 15 bp, Homo sapiens
ctcttgtaaagactg

SEQ ID NO: 4083614 - DNA, 16 bp, Homo sapiens
ctcttgtaaagactgg

SEQ ID NO: 4083615 - DNA, 22 bp, Homo sapiens
ctcttgtaaagactggttttct

SEQ ID NO: 4083616 - DNA, 15 bp, Homo sapiens
ctcttgtattaaact

SEQ ID NO: 4083617 - DNA, 21 bp, Homo sapiens
ctcttgtcccacgtgtcttcc

SEQ ID NO: 4083618 - DNA, 23 bp, Homo sapiens
ctcttgtcccacgtgtcttccac

SEQ ID NO: 4083619 - DNA, 16 bp, Homo sapiens
ctcttgtccctttccc

SEQ ID NO: 4083620 - DNA, 21 bp, Homo sapiens
ctcttgtccctttccctacct

SEQ ID NO: 4083621 - DNA, 20 bp, Homo sapiens
ctcttgtcctcttctgctct

SEQ ID NO: 4083622 - DNA, 14 bp, Homo sapiens
ctcttgtctgaggg

SEQ ID NO: 4083623 - DNA, 17 bp, Homo sapiens
ctcttgtgatttcttta

SEQ ID NO: 4083624 - DNA, 17 bp, Homo sapiens
ctcttgttgagttctgt

SEQ ID NO: 4083625 - DNA, 13 bp, Homo sapiens
ctcttgtttctcc

SEQ ID NO: 4083626 - DNA, 15 bp, Homo sapiens
ctctttaacttctcg

SEQ ID NO: 4083627 - DNA, 20 bp, Homo sapiens
ctctttagagcagctttggg

SEQ ID NO: 4083628 - DNA, 16 bp, Homo sapiens
ctctttagtataattg

SEQ ID NO: 4083629 - DNA, 22 bp, Homo sapiens
ctctttatcaagcaacattctt

SEQ ID NO: 4083630 - DNA, 20 bp, Homo sapiens
ctctttcccacccagcctgg

SEQ ID NO: 4083631 - DNA, 10 bp, Homo sapiens
ctctttccct

SEQ ID NO: 4083632 - DNA, 14 bp, Homo sapiens
ctctttccctgcga

SEQ ID NO: 4083633 - DNA, 13 bp, Homo sapiens
ctctttcccttcc

SEQ ID NO: 4083634 - DNA, 20 bp, Homo sapiens
ctctttcctatttcagtgtt

SEQ ID NO: 4083635 - DNA, 23 bp, Homo sapiens
ctctttctacatgactgggcctc

SEQ ID NO: 4083636 - DNA, 14 bp, Homo sapiens
ctctttctctcttc

SEQ ID NO: 4083637 - DNA, 13 bp, Homo sapiens
ctctttctctgcc

SEQ ID NO: 4083638 - DNA, 17 bp, Homo sapiens
ctctttctggcctgcct

SEQ ID NO: 4083639 - DNA, 13 bp, Homo sapiens
ctctttctgtata

SEQ ID NO: 4083640 - DNA, 19 bp, Homo sapiens
ctctttgacaactaaaatt

SEQ ID NO: 4083641 - DNA, 19 bp, Homo sapiens
ctcttttcccctttcctgt

SEQ ID NO: 4083642 - DNA, 21 bp, Homo sapiens
ctcttttcccctttcctgtcc

SEQ ID NO: 4083643 - DNA, 10 bp, Homo sapiens
ctcttttgta

SEQ ID NO: 4083644 - DNA, 18 bp, Homo sapiens
ctcttttgttaaataata

SEQ ID NO: 4083645 - DNA, 18 bp, Homo sapiens
ctctttttagggccaggc

SEQ ID NO: 4083646 - DNA, 13 bp, Homo sapiens
ctctttttcctcc

SEQ ID NO: 4083647 - DNA, 20 bp, Homo sapiens
ctctttttggtaataacaaa

SEQ ID NO: 4083648 - DNA, 14 bp, Homo sapiens
ctctttttgttttt

SEQ ID NO: 4083649 - DNA, 19 bp, Homo sapiens
ctcttttttgtttgtttct

SEQ ID NO: 4083650 - DNA, 15 bp, Homo sapiens
ctgaaaaagtagatt

SEQ ID NO: 4083651 - DNA, 13 bp, Homo sapiens
ctgaaaaatggga

SEQ ID NO: 4083652 - DNA, 12 bp, Homo sapiens
ctgaaaatgtaa

SEQ ID NO: 4083653 - DNA, 15 bp, Homo sapiens
ctgaaaatgtaaatt

SEQ ID NO: 4083654 - DNA, 16 bp, Homo sapiens
ctgaaaatgtcacatt

SEQ ID NO: 4083655 - DNA, 15 bp, Homo sapiens
ctgaaacaacttgga

SEQ ID NO: 4083656 - DNA, 16 bp, Homo sapiens
ctgaaacaacttggaa

SEQ ID NO: 4083657 - DNA, 12 bp, Homo sapiens
ctgaaaccattt

SEQ ID NO: 4083658 - DNA, 15 bp, Homo sapiens
ctgaaacccacagat

SEQ ID NO: 4083659 - DNA, 22 bp, Homo sapiens
ctgaaactggcttccccactcc

SEQ ID NO: 4083660 - DNA, 21 bp, Homo sapiens
ctgaaagaaacagttaacttt

SEQ ID NO: 4083661 - DNA, 14 bp, Homo sapiens
ctgaaagaggccaa

SEQ ID NO: 4083662 - DNA, 20 bp, Homo sapiens
ctgaaagttttgtaaaagaa

SEQ ID NO: 4083663 - DNA, 23 bp, Homo sapiens
ctgaaagttttgtaaaagaaatc

SEQ ID NO: 4083664 - DNA, 20 bp, Homo sapiens
ctgaaatgttcttaaatttt

SEQ ID NO: 4083665 - DNA, 14 bp, Homo sapiens
ctgaaatgtttgga

SEQ ID NO: 4083666 - DNA, 21 bp, Homo sapiens
ctgaggccctgggctgggtgc

SEQ ID NO: 4083667 - DNA, 15 bp, Homo sapiens
ctgaggcctccagct

SEQ ID NO: 4083668 - DNA, 12 bp, Homo sapiens
ctgaggcctgga

SEQ ID NO: 4083669 - DNA, 19 bp, Homo sapiens
ctgaggcctggactttcct

SEQ ID NO: 4083670 - DNA, 20 bp, Homo sapiens
ctgaggcctggactttcctg

SEQ ID NO: 4083671 - DNA, 17 bp, Homo sapiens
ctgaggcggaggctgtg

SEQ ID NO: 4083672 - DNA, 21 bp, Homo sapiens
ctgaggcggaggctgtgctcc

SEQ ID NO: 4083673 - DNA, 23 bp, Homo sapiens
ctgaggcggaggctgtgctccgc

SEQ ID NO: 4083674 - DNA, 13 bp, Homo sapiens
ctgaggctggcac

SEQ ID NO: 4083675 - DNA, 19 bp, Homo sapiens
ctgaggctggcacaggaca

SEQ ID NO: 4083676 - DNA, 20 bp, Homo sapiens
ctgaggctgggggagagccg

SEQ ID NO: 4083677 - DNA, 14 bp, Homo sapiens
ctgaggctttggat

SEQ ID NO: 4083678 - DNA, 21 bp, Homo sapiens
ctgaggctttggatttgacat

SEQ ID NO: 4083679 - DNA, 16 bp, Homo sapiens
ctgagggaaagtgcat

SEQ ID NO: 4083680 - DNA, 12 bp, Homo sapiens
ctgagggaccaa

SEQ ID NO: 4083681 - DNA, 21 bp, Homo sapiens
ctgagggaccaactgggccca

SEQ ID NO: 4083682 - DNA, 16 bp, Homo sapiens
ctgagggactctgaag

SEQ ID NO: 4083683 - DNA, 21 bp, Homo sapiens
ctgagggactctgaagcctct

SEQ ID NO: 4083684 - DNA, 19 bp, Homo sapiens
ctgagggcagactggggca

SEQ ID NO: 4083685 - DNA, 18 bp, Homo sapiens
ctgaggggcagcctgcct

SEQ ID NO: 4083686 - DNA, 19 bp, Homo sapiens
ctgaggggcagcctgcctt

SEQ ID NO: 4083687 - DNA, 16 bp, Homo sapiens
ctgaggggcttgggaa

SEQ ID NO: 4083688 - DNA, 23 bp, Homo sapiens
ctgaggggggccgtgcccagggg

SEQ ID NO: 4083689 - DNA, 20 bp, Homo sapiens
ctgagggtccccacctggga

SEQ ID NO: 4083690 - DNA, 15 bp, Homo sapiens
ctgagggtggagact

SEQ ID NO: 4083691 - DNA, 15 bp, Homo sapiens
ctgaggtcagggagt

SEQ ID NO: 4083692 - DNA, 19 bp, Homo sapiens
ctgaggtcagggagtgctg

SEQ ID NO: 4083693 - DNA, 21 bp, Homo sapiens
ctgaggtctcttgagggagct

SEQ ID NO: 4083694 - DNA, 22 bp, Homo sapiens
ctgaggtgcctgtcccaccccc

SEQ ID NO: 4083695 - DNA, 16 bp, Homo sapiens
ctgaggtgtctggcct

SEQ ID NO: 4083696 - DNA, 21 bp, Homo sapiens
ctgaggtgtctggcctgaggt

SEQ ID NO: 4083697 - DNA, 19 bp, Homo sapiens
ctgaggttaaacggtgccc

SEQ ID NO: 4083698 - DNA, 15 bp, Homo sapiens
ctgaggttcctctgc

SEQ ID NO: 4083699 - DNA, 17 bp, Homo sapiens
ctgaggttcctctgcct

SEQ ID NO: 4083700 - DNA, 18 bp, Homo sapiens
ctgaggttcctctgcctg

SEQ ID NO: 4083701 - DNA, 20 bp, Homo sapiens
ctgaggttcctctgcctgcc

SEQ ID NO: 4083702 - DNA, 20 bp, Homo sapiens
ctgaggttgggagaggtgca

SEQ ID NO: 4083703 - DNA, 20 bp, Homo sapiens
ctgagtaccaggggctgggc

SEQ ID NO: 4083704 - DNA, 20 bp, Homo sapiens
ctgagtcacgctggggctct

SEQ ID NO: 4083705 - DNA, 22 bp, Homo sapiens
ctgagtcatctgttagggcctt

SEQ ID NO: 4083706 - DNA, 20 bp, Homo sapiens
ctgagtcccctccaggaaga

SEQ ID NO: 4083707 - DNA, 13 bp, Homo sapiens
ctgagtccgacct

SEQ ID NO: 4083708 - DNA, 13 bp, Homo sapiens
ctgagtctggact

SEQ ID NO: 4083709 - DNA, 14 bp, Homo sapiens
ctgagtctggactt

SEQ ID NO: 4083710 - DNA, 17 bp, Homo sapiens
ctgagtgaacctgtata

SEQ ID NO: 4083711 - DNA, 20 bp, Homo sapiens
ctgagtgacacaagcacttt

SEQ ID NO: 4083712 - DNA, 20 bp, Homo sapiens
ctgagtgcgggctgaggcca

SEQ ID NO: 4083713 - DNA, 21 bp, Homo sapiens
ctgagtggccagccagtgcca

SEQ ID NO: 4083714 - DNA, 19 bp, Homo sapiens
ctgagttctgggtttctag

SEQ ID NO: 4083715 - DNA, 22 bp, Homo sapiens
ctgagttctgggtttctagagg

SEQ ID NO: 4083716 - DNA, 19 bp, Homo sapiens
ctgagtttaccatttgtaa

SEQ ID NO: 4083717 - DNA, 20 bp, Homo sapiens
ctgagtttaccatttgtaat

SEQ ID NO: 4083718 - DNA, 21 bp, Homo sapiens
ctgagtttaccatttgtaata

SEQ ID NO: 4083719 - DNA, 17 bp, Homo sapiens
ctgagtttcattctcct

SEQ ID NO: 4083720 - DNA, 19 bp, Homo sapiens
ctgagtttcattctcctgc

SEQ ID NO: 4083721 - DNA, 20 bp, Homo sapiens
ctgagtttcattctcctgcc

SEQ ID NO: 4083722 - DNA, 21 bp, Homo sapiens
ctgagtttcattctcctgcct

SEQ ID NO: 4083723 - DNA, 16 bp, Homo sapiens
ctgagtttccagcctg

SEQ ID NO: 4083724 - DNA, 14 bp, Homo sapiens
ctgataaactgacg

SEQ ID NO: 4083725 - DNA, 18 bp, Homo sapiens
ctgataacttggggaggc

SEQ ID NO: 4083726 - DNA, 19 bp, Homo sapiens
ctgataacttggggaggca

SEQ ID NO: 4083727 - DNA, 21 bp, Homo sapiens
ctgataagactgtttttaagt

SEQ ID NO: 4083728 - DNA, 14 bp, Homo sapiens
ctgataataattga

SEQ ID NO: 4083729 - DNA, 20 bp, Homo sapiens
ctgataatgatttgctcttt

SEQ ID NO: 4083730 - DNA, 17 bp, Homo sapiens
ctgatagcccctctccc

SEQ ID NO: 4083731 - DNA, 14 bp, Homo sapiens
ctgatataaattct

SEQ ID NO: 4083732 - DNA, 14 bp, Homo sapiens
ctgatatatttaaa

SEQ ID NO: 4083733 - DNA, 16 bp, Homo sapiens
ctgatatattttccag

SEQ ID NO: 4083734 - DNA, 12 bp, Homo sapiens
ctgatattaatc

SEQ ID NO: 4083735 - DNA, 14 bp, Homo sapiens
ctgatattaatcaa

SEQ ID NO: 4083736 - DNA, 21 bp, Homo sapiens
ctgatattaatcaaaattgtc

SEQ ID NO: 4083737 - DNA, 15 bp, Homo sapiens
ctgatcacccaatgc

SEQ ID NO: 4083738 - DNA, 23 bp, Homo sapiens
ctgatcagaggtgtacactaaca

SEQ ID NO: 4083739 - DNA, 12 bp, Homo sapiens
ctgatcccatgg

SEQ ID NO: 4083740 - DNA, 20 bp, Homo sapiens
ctgatccctgatcccttcca

SEQ ID NO: 4083741 - DNA, 18 bp, Homo sapiens
ctgatcccttccacctgc

SEQ ID NO: 4083742 - DNA, 21 bp, Homo sapiens
ctgatcccttccacctgctct

SEQ ID NO: 4083743 - DNA, 17 bp, Homo sapiens
ctgatcgtgctaaattt

SEQ ID NO: 4083744 - DNA, 21 bp, Homo sapiens
ctgatgaaactcacaaatgat

SEQ ID NO: 4083745 - DNA, 13 bp, Homo sapiens
ctgatgaaatctg

SEQ ID NO: 4083746 - DNA, 23 bp, Homo sapiens
ctgatgaaatctgctagaaagtt

SEQ ID NO: 4083747 - DNA, 14 bp, Homo sapiens
ctgatgaatctcaa

SEQ ID NO: 4083748 - DNA, 22 bp, Homo sapiens
ctgatgagtgattgacacacag

SEQ ID NO: 4083749 - DNA, 15 bp, Homo sapiens
ctgatgattttcctt

SEQ ID NO: 4083750 - DNA, 16 bp, Homo sapiens
ctgatgattttccttt

SEQ ID NO: 4083751 - DNA, 17 bp, Homo sapiens
ctgatgattttcctttt

SEQ ID NO: 4083752 - DNA, 22 bp, Homo sapiens
ctgatgctccctcccctgccct

SEQ ID NO: 4083753 - DNA, 12 bp, Homo sapiens
ctgatgctgaca

SEQ ID NO: 4083754 - DNA, 16 bp, Homo sapiens
ctgatgctgagattct

SEQ ID NO: 4083755 - DNA, 22 bp, Homo sapiens
ctgatgctgggcaatgaggcag

SEQ ID NO: 4083756 - DNA, 20 bp, Homo sapiens
ctgatggaagtaaagcctca

SEQ ID NO: 4083757 - DNA, 16 bp, Homo sapiens
ctgatggcttgacatg

SEQ ID NO: 4083758 - DNA, 19 bp, Homo sapiens
ctgatggcttgacatgtgc

SEQ ID NO: 4083759 - DNA, 20 bp, Homo sapiens
ctgatggcttgacatgtgca

SEQ ID NO: 4083760 - DNA, 22 bp, Homo sapiens
ctgatggcttgacatgtgcaat

SEQ ID NO: 4083761 - DNA, 13 bp, Homo sapiens
ctgatgtcccagt

SEQ ID NO: 4083762 - DNA, 18 bp, Homo sapiens
ctgatgtctctaaagcac

SEQ ID NO: 4083763 - DNA, 21 bp, Homo sapiens
ctgattaaaatgcttcctccc

SEQ ID NO: 4083764 - DNA, 13 bp, Homo sapiens
ctgattagaaatg

SEQ ID NO: 4083765 - DNA, 23 bp, Homo sapiens
ctgattagaaatgaccaatatta

SEQ ID NO: 4083766 - DNA, 15 bp, Homo sapiens
ctgattagctttgtg

SEQ ID NO: 4083767 - DNA, 16 bp, Homo sapiens
ctgattagctttgtgt

SEQ ID NO: 4083768 - DNA, 18 bp, Homo sapiens
ctgattagctttgtgttt

SEQ ID NO: 4083769 - DNA, 14 bp, Homo sapiens
ctgattatgtcttt

SEQ ID NO: 4083770 - DNA, 17 bp, Homo sapiens
ctgattattttcttcat

SEQ ID NO: 4083771 - DNA, 20 bp, Homo sapiens
ctgattgacctgctccgctg

SEQ ID NO: 4083772 - DNA, 16 bp, Homo sapiens
ctgattggtttctctt

SEQ ID NO: 4083773 - DNA, 19 bp, Homo sapiens
ctgattggtttctcttctc

SEQ ID NO: 4083774 - DNA, 21 bp, Homo sapiens
ctgattggtttctcttctccc

SEQ ID NO: 4083775 - DNA, 24 bp, Homo sapiens
ctgatttaaaaagtgagaaagaaa

SEQ ID NO: 4083776 - DNA, 23 bp, Homo sapiens
ctgatttgatgatacatttcatt

SEQ ID NO: 4083777 - DNA, 12 bp, Homo sapiens
ctgattttaaca

SEQ ID NO: 4083778 - DNA, 14 bp, Homo sapiens
ctgattttctcact

SEQ ID NO: 4083779 - DNA, 20 bp, Homo sapiens
ctgattttctcactgaactc

SEQ ID NO: 4083780 - DNA, 17 bp, Homo sapiens
ctgcaaaaatatttata

SEQ ID NO: 4083781 - DNA, 21 bp, Homo sapiens
ctgcaaaaatatttataaaac

SEQ ID NO: 4083782 - DNA, 15 bp, Homo sapiens
ctgcaaaaggcctct

SEQ ID NO: 4083783 - DNA, 19 bp, Homo sapiens
ctgcaaaaggcctcttgta

SEQ ID NO: 4083784 - DNA, 16 bp, Homo sapiens
ctgcaaacagaaatca

SEQ ID NO: 4083785 - DNA, 14 bp, Homo sapiens
ctgcaaacagaaca

SEQ ID NO: 4083786 - DNA, 20 bp, Homo sapiens
ctgcaaacagaacagggtca

SEQ ID NO: 4083787 - DNA, 19 bp, Homo sapiens
ctgcaaatctgatggcctt

SEQ ID NO: 4083788 - DNA, 15 bp, Homo sapiens
ctgcaactcaaggac

SEQ ID NO: 4083789 - DNA, 21 bp, Homo sapiens
ctgcaagcacctgttaataaa

SEQ ID NO: 4083790 - DNA, 14 bp, Homo sapiens
ctgcaagccaggga

SEQ ID NO: 4083791 - DNA, 22 bp, Homo sapiens
ctgcaagtgaggtgtgtcacaa

SEQ ID NO: 4083792 - DNA, 15 bp, Homo sapiens
ctgcaataacttctg

SEQ ID NO: 4083793 - DNA, 12 bp, Homo sapiens
ctgcaatagaga

SEQ ID NO: 4083794 - DNA, 15 bp, Homo sapiens
ctgcaatagagactg

SEQ ID NO: 4083795 - DNA, 18 bp, Homo sapiens
ctgcaatagagactgtag

SEQ ID NO: 4083796 - DNA, 12 bp, Homo sapiens
ctgcaatatttg

SEQ ID NO: 4083797 - DNA, 14 bp, Homo sapiens
ctgcaatgcctaga

SEQ ID NO: 4083798 - DNA, 22 bp, Homo sapiens
ctgcaatgcctagacttcccaa

SEQ ID NO: 4083799 - DNA, 21 bp, Homo sapiens
ctgcaatgggcactgggatga

SEQ ID NO: 4083800 - DNA, 16 bp, Homo sapiens
ctgcaattcccctctg

SEQ ID NO: 4083801 - DNA, 19 bp, Homo sapiens
ctgcaatttgtttaaagaa

SEQ ID NO: 4083802 - DNA, 20 bp, Homo sapiens
ctgcacacacctccgagaca

SEQ ID NO: 4083803 - DNA, 22 bp, Homo sapiens
ctgcacacacctccgagacagt

SEQ ID NO: 4083804 - DNA, 14 bp, Homo sapiens
ctgcacactccagg

SEQ ID NO: 4083805 - DNA, 13 bp, Homo sapiens
ctgcacaggcaga

SEQ ID NO: 4083806 - DNA, 21 bp, Homo sapiens
ctgcacagtgcatctcagccc

SEQ ID NO: 4083807 - DNA, 23 bp, Homo sapiens
ctgcacatgaaagttttgcaaag

SEQ ID NO: 4083808 - DNA, 12 bp, Homo sapiens
ctgcacccaact

SEQ ID NO: 4083809 - DNA, 14 bp, Homo sapiens
ctgcacccaactac

SEQ ID NO: 4083810 - DNA, 11 bp, Homo sapiens
ctgcacccagg

SEQ ID NO: 4083811 - DNA, 20 bp, Homo sapiens
ctgcaccccttctctcctcc

SEQ ID NO: 4083812 - DNA, 18 bp, Homo sapiens
ctgcaccctgcgcctcca

SEQ ID NO: 4083813 - DNA, 22 bp, Homo sapiens
ctgcaccctgcgcctccagagg

SEQ ID NO: 4083814 - DNA, 22 bp, Homo sapiens
ctgcacctttcggcagaggaac

SEQ ID NO: 4083815 - DNA, 18 bp, Homo sapiens
ctgcacgttcataaccaa

SEQ ID NO: 4083816 - DNA, 14 bp, Homo sapiens
ctgcactactgaca

SEQ ID NO: 4083817 - DNA, 20 bp, Homo sapiens
ctgcactctaaactgcaaac

SEQ ID NO: 4083818 - DNA, 17 bp, Homo sapiens
ctgcactgatgctgccc

SEQ ID NO: 4083819 - DNA, 22 bp, Homo sapiens
ctgcactggggagcccgtctca

SEQ ID NO: 4083820 - DNA, 13 bp, Homo sapiens
ctgcagacctcaa

SEQ ID NO: 4083821 - DNA, 18 bp, Homo sapiens
ctgcagacctcaagccat

SEQ ID NO: 4083822 - DNA, 19 bp, Homo sapiens
ctgcagacctcaagccatc

SEQ ID NO: 4083823 - DNA, 20 bp, Homo sapiens
ctgcagacctcaagccatca

SEQ ID NO: 4083824 - DNA, 16 bp, Homo sapiens
ctgcagacttcccagc

SEQ ID NO: 4083825 - DNA, 18 bp, Homo sapiens
ctgcagacttcccagcta

SEQ ID NO: 4083826 - DNA, 22 bp, Homo sapiens
ctgcagagaaacttaagcaaag

SEQ ID NO: 4083827 - DNA, 23 bp, Homo sapiens
ctgcagagaaacttaagcaaagg

SEQ ID NO: 4083828 - DNA, 14 bp, Homo sapiens
ctgcagagagaagc

SEQ ID NO: 4083829 - DNA, 15 bp, Homo sapiens
ctgcagagcaccttt

SEQ ID NO: 4083830 - DNA, 21 bp, Homo sapiens
ctgcagagtaaattgctctgt

SEQ ID NO: 4083831 - DNA, 20 bp, Homo sapiens
ctgcagattagttctttttg

SEQ ID NO: 4083832 - DNA, 17 bp, Homo sapiens
ctgcagcaaacactcca

SEQ ID NO: 4083833 - DNA, 12 bp, Homo sapiens
ctgcagcacctc

SEQ ID NO: 4083834 - DNA, 19 bp, Homo sapiens
ctgcagcacctccaggcct

SEQ ID NO: 4083835 - DNA, 13 bp, Homo sapiens
ctgcagcaggagt

SEQ ID NO: 4083836 - DNA, 21 bp, Homo sapiens
ctgcagcccaaaacccagggc

SEQ ID NO: 4083837 - DNA, 23 bp, Homo sapiens
ctgcagcccaaaacccagggcaa

SEQ ID NO: 4083838 - DNA, 19 bp, Homo sapiens
ctgcagcccaccagacgtc

SEQ ID NO: 4083839 - DNA, 14 bp, Homo sapiens
ctgcagcccttggg

SEQ ID NO: 4083840 - DNA, 20 bp, Homo sapiens
ctgcagcccttgggcagttc

SEQ ID NO: 4083841 - DNA, 15 bp, Homo sapiens
ctgcagcctcatact

SEQ ID NO: 4083842 - DNA, 20 bp, Homo sapiens
ctgcagcctcatactcctgg

SEQ ID NO: 4083843 - DNA, 21 bp, Homo sapiens
ctgcagcctcatactcctggg

SEQ ID NO: 4083844 - DNA, 18 bp, Homo sapiens
ctgcagcctggctggtcc

SEQ ID NO: 4083845 - DNA, 11 bp, Homo sapiens
ctgcagctccc

SEQ ID NO: 4083846 - DNA, 14 bp, Homo sapiens
ctgcagctccctca

SEQ ID NO: 4083847 - DNA, 23 bp, Homo sapiens
ctgcagctccctcaaagaggcag

SEQ ID NO: 4083848 - DNA, 15 bp, Homo sapiens
ctgcagctgagcctg

SEQ ID NO: 4083849 - DNA, 13 bp, Homo sapiens
ctgcagctgggca

SEQ ID NO: 4083850 - DNA, 22 bp, Homo sapiens
ctgcaggaatcaaaaattgaag

SEQ ID NO: 4083851 - DNA, 17 bp, Homo sapiens
ctgcaggagagagcagc

SEQ ID NO: 4083852 - DNA, 18 bp, Homo sapiens
ctgcaggagagagcagca

SEQ ID NO: 4083853 - DNA, 20 bp, Homo sapiens
ctgcaggagagagcagcact

SEQ ID NO: 4083854 - DNA, 16 bp, Homo sapiens
ctgcaggagcagtttg

SEQ ID NO: 4083855 - DNA, 20 bp, Homo sapiens
ctgcaggagtgtcctgccca

SEQ ID NO: 4083856 - DNA, 17 bp, Homo sapiens
ctgcagggacagagcat

SEQ ID NO: 4083857 - DNA, 13 bp, Homo sapiens
ctgcaggtgccag

SEQ ID NO: 4083858 - DNA, 15 bp, Homo sapiens
ctgcaggtgccaggg

SEQ ID NO: 4083859 - DNA, 17 bp, Homo sapiens
ctgcaggtgccagggcc

SEQ ID NO: 4083860 - DNA, 17 bp, Homo sapiens
ctgcagtaaatctttta

SEQ ID NO: 4083861 - DNA, 15 bp, Homo sapiens
ctgcagtgtgccccc

SEQ ID NO: 4083862 - DNA, 16 bp, Homo sapiens
ctgcagtttcctggaa

SEQ ID NO: 4083863 - DNA, 16 bp, Homo sapiens
ctgcatagctctattt

SEQ ID NO: 4083864 - DNA, 13 bp, Homo sapiens
ctgcatcacagcc

SEQ ID NO: 4083865 - DNA, 16 bp, Homo sapiens
ctgcatcccagcacct

SEQ ID NO: 4083866 - DNA, 20 bp, Homo sapiens
ctgcatcccagcacctgcct

SEQ ID NO: 4083867 - DNA, 12 bp, Homo sapiens
ctgcatcccctt

SEQ ID NO: 4083868 - DNA, 22 bp, Homo sapiens
ctgcatccccttggctgtgagg

SEQ ID NO: 4083869 - DNA, 21 bp, Homo sapiens
ctgcatctgggattcccacca

SEQ ID NO: 4083870 - DNA, 15 bp, Homo sapiens
ctgcatgaatatcat

SEQ ID NO: 4083871 - DNA, 12 bp, Homo sapiens
ctgcatggacct

SEQ ID NO: 4083872 - DNA, 17 bp, Homo sapiens
ctgcatggacctaacat

SEQ ID NO: 4083873 - DNA, 18 bp, Homo sapiens
ctgcatggacctaacatt

SEQ ID NO: 4083874 - DNA, 21 bp, Homo sapiens
ctgcatgtactgtatattaca

SEQ ID NO: 4083875 - DNA, 13 bp, Homo sapiens
ctgcatgttacat

SEQ ID NO: 4083876 - DNA, 17 bp, Homo sapiens
ctgcattacatgtgttt

SEQ ID NO: 4083877 - DNA, 15 bp, Homo sapiens
ctgcattagaaaaag

SEQ ID NO: 4083878 - DNA, 17 bp, Homo sapiens
ctgcattattctctttt

SEQ ID NO: 4083879 - DNA, 23 bp, Homo sapiens
ctgcattcatttttatagcaaca

SEQ ID NO: 4083880 - DNA, 21 bp, Homo sapiens
ctgcattgctagataaaagct

SEQ ID NO: 4083881 - DNA, 14 bp, Homo sapiens
ctgcatttctgagt

SEQ ID NO: 4083882 - DNA, 9 bp, Homo sapiens
ctgcatttt

SEQ ID NO: 4083883 - DNA, 21 bp, Homo sapiens
ctgcattttgctattgtaaat

SEQ ID NO: 4083884 - DNA, 18 bp, Homo sapiens
ctgcatttttagaccatt

SEQ ID NO: 4083885 - DNA, 22 bp, Homo sapiens
ctgcatttttcactttgctctc

SEQ ID NO: 4083886 - DNA, 18 bp, Homo sapiens
ctgccaaggccagagtgg

SEQ ID NO: 4083887 - DNA, 23 bp, Homo sapiens
ctgccaagtggggatggggcctc

SEQ ID NO: 4083888 - DNA, 13 bp, Homo sapiens
ctgccacacttca

SEQ ID NO: 4083889 - DNA, 22 bp, Homo sapiens
ctgccacacttcaggctcttct

SEQ ID NO: 4083890 - DNA, 14 bp, Homo sapiens
ctgccacatacagg

SEQ ID NO: 4083891 - DNA, 21 bp, Homo sapiens
ctgccacatacaggtgctcaa

SEQ ID NO: 4083892 - DNA, 14 bp, Homo sapiens
ctgccacatggagc

SEQ ID NO: 4083893 - DNA, 23 bp, Homo sapiens
ctgccacatggagccccctctgc

SEQ ID NO: 4083894 - DNA, 14 bp, Homo sapiens
ctgccaccagcccc

SEQ ID NO: 4083895 - DNA, 13 bp, Homo sapiens
ctgccacccactc

SEQ ID NO: 4083896 - DNA, 15 bp, Homo sapiens
ctgccacccactcag

SEQ ID NO: 4083897 - DNA, 17 bp, Homo sapiens
ctgccacccactcagga

SEQ ID NO: 4083898 - DNA, 13 bp, Homo sapiens
ctgccacctccct

SEQ ID NO: 4083899 - DNA, 21 bp, Homo sapiens
ctgccagaagatcccctcagg

SEQ ID NO: 4083900 - DNA, 23 bp, Homo sapiens
ctgccagaagatcccctcaggac

SEQ ID NO: 4083901 - DNA, 18 bp, Homo sapiens
ctgccagcagccccgtct

SEQ ID NO: 4083902 - DNA, 23 bp, Homo sapiens
ctgccagcagccccgtctgccca

SEQ ID NO: 4083903 - DNA, 12 bp, Homo sapiens
ctgccagcccag

SEQ ID NO: 4083904 - DNA, 17 bp, Homo sapiens
ctgccagccccacacag

SEQ ID NO: 4083905 - DNA, 16 bp, Homo sapiens
ctgccaggcacacaca

SEQ ID NO: 4083906 - DNA, 12 bp, Homo sapiens
ctgccaggcagg

SEQ ID NO: 4083907 - DNA, 17 bp, Homo sapiens
ctgccaggccagcctcc

SEQ ID NO: 4083908 - DNA, 18 bp, Homo sapiens
ctgccaggccagcctccg

SEQ ID NO: 4083909 - DNA, 16 bp, Homo sapiens
ctgccaggctgcctcc

SEQ ID NO: 4083910 - DNA, 20 bp, Homo sapiens
ctgccaggctgcctcctgcc

SEQ ID NO: 4083911 - DNA, 12 bp, Homo sapiens
ctgccagggagc

SEQ ID NO: 4083912 - DNA, 13 bp, Homo sapiens
ctgccagggagct

SEQ ID NO: 4083913 - DNA, 21 bp, Homo sapiens
ctgccagtgacagacaggctc

SEQ ID NO: 4083914 - DNA, 23 bp, Homo sapiens
ctgccagtgacagacaggctctt

SEQ ID NO: 4083915 - DNA, 13 bp, Homo sapiens
ctgccagtggatc

SEQ ID NO: 4083916 - DNA, 19 bp, Homo sapiens
ctgccataaatatttctca

SEQ ID NO: 4083917 - DNA, 15 bp, Homo sapiens
ctgccatcctcccaa

SEQ ID NO: 4083918 - DNA, 14 bp, Homo sapiens
ctgccatctagcca

SEQ ID NO: 4083919 - DNA, 20 bp, Homo sapiens
ctgccatgacagaggctgca

SEQ ID NO: 4083920 - DNA, 17 bp, Homo sapiens
ctgccatgccaggaacc

SEQ ID NO: 4083921 - DNA, 19 bp, Homo sapiens
ctgccatgtactagtttta

SEQ ID NO: 4083922 - DNA, 22 bp, Homo sapiens
ctgccatgttgcccctttctct

SEQ ID NO: 4083923 - DNA, 21 bp, Homo sapiens
ctgccatttcccttctggaca

SEQ ID NO: 4083924 - DNA, 21 bp, Homo sapiens
ctgcccagacccctctggcca

SEQ ID NO: 4083925 - DNA, 23 bp, Homo sapiens
ctgcccagacccctctggccagg

SEQ ID NO: 4083926 - DNA, 20 bp, Homo sapiens
ctgcccagatcagccagaag

SEQ ID NO: 4083927 - DNA, 22 bp, Homo sapiens
ctgcccagatcagccagaagcc

SEQ ID NO: 4083928 - DNA, 20 bp, Homo sapiens
ctgcccagcttttcattgct

SEQ ID NO: 4083929 - DNA, 13 bp, Homo sapiens
ctgcccaggagac

SEQ ID NO: 4083930 - DNA, 11 bp, Homo sapiens
ctgcccagtgt

SEQ ID NO: 4083931 - DNA, 20 bp, Homo sapiens
ctgcccagtgttgtttgtaa

SEQ ID NO: 4083932 - DNA, 21 bp, Homo sapiens
ctgcccagtgttgtttgtaaa

SEQ ID NO: 4083933 - DNA, 18 bp, Homo sapiens
ctgcccatcacagggttg

SEQ ID NO: 4083934 - DNA, 22 bp, Homo sapiens
ctgcccatcacagggttgggcc

SEQ ID NO: 4083935 - DNA, 16 bp, Homo sapiens
ctgcccatggacaggc

SEQ ID NO: 4083936 - DNA, 17 bp, Homo sapiens
ctgccccaacctgctga

SEQ ID NO: 4083937 - DNA, 12 bp, Homo sapiens
ctgccccacact

SEQ ID NO: 4083938 - DNA, 14 bp, Homo sapiens
ctgccccacactcc

SEQ ID NO: 4083939 - DNA, 23 bp, Homo sapiens
ctgccccacccaagcccaaactt

SEQ ID NO: 4083940 - DNA, 15 bp, Homo sapiens
ctgccccaccccacc

SEQ ID NO: 4083941 - DNA, 17 bp, Homo sapiens
ctgccccaccccacctc

SEQ ID NO: 4083942 - DNA, 16 bp, Homo sapiens
ctgccccagctgactg

SEQ ID NO: 4083943 - DNA, 14 bp, Homo sapiens
ctgccccaggcctg

SEQ ID NO: 4083944 - DNA, 21 bp, Homo sapiens
ctgcccccacgagggtcagga

SEQ ID NO: 4083945 - DNA, 13 bp, Homo sapiens
ctgcccccactgt

SEQ ID NO: 4083946 - DNA, 16 bp, Homo sapiens
ctgcccccagccccgg

SEQ ID NO: 4083947 - DNA, 12 bp, Homo sapiens
ctgccccccagc

SEQ ID NO: 4083948 - DNA, 16 bp, Homo sapiens
ctgccccccagcctct

SEQ ID NO: 4083949 - DNA, 23 bp, Homo sapiens
ctgcccccgctcccgctcccagg

SEQ ID NO: 4083950 - DNA, 18 bp, Homo sapiens
ctgcccccggccccctgg

SEQ ID NO: 4083951 - DNA, 15 bp, Homo sapiens
ctgccccctgctggc

SEQ ID NO: 4083952 - DNA, 13 bp, Homo sapiens
ctgcccctcacct

SEQ ID NO: 4083953 - DNA, 15 bp, Homo sapiens
ctgcccctcaccttg

SEQ ID NO: 4083954 - DNA, 20 bp, Homo sapiens
ctgcccctcccaacccagcc

SEQ ID NO: 4083955 - DNA, 13 bp, Homo sapiens
ctgcccctccctt

SEQ ID NO: 4083956 - DNA, 13 bp, Homo sapiens
ctgcccctctcac

SEQ ID NO: 4083957 - DNA, 17 bp, Homo sapiens
ctgcccctttcaggcct

SEQ ID NO: 4083958 - DNA, 14 bp, Homo sapiens
ctgcccgagctggt

SEQ ID NO: 4083959 - DNA, 17 bp, Homo sapiens
ctgcccgagctggtgca

SEQ ID NO: 4083960 - DNA, 21 bp, Homo sapiens
ctgcccgagctggtgcattac

SEQ ID NO: 4083961 - DNA, 15 bp, Homo sapiens
ctgcccgctgcaatg

SEQ ID NO: 4083962 - DNA, 21 bp, Homo sapiens
ctgcccgggcgcggccagccc

SEQ ID NO: 4083963 - DNA, 20 bp, Homo sapiens
ctgcccggtgggggggcaga

SEQ ID NO: 4083964 - DNA, 15 bp, Homo sapiens
ctgcccgtgccctgg

SEQ ID NO: 4083965 - DNA, 16 bp, Homo sapiens
ctgccctaagccccca

SEQ ID NO: 4083966 - DNA, 18 bp, Homo sapiens
ctgccctactgggagact

SEQ ID NO: 4083967 - DNA, 19 bp, Homo sapiens
ctgccctactgggagactg

SEQ ID NO: 4083968 - DNA, 20 bp, Homo sapiens
ctgccctagctgaccccgag

SEQ ID NO: 4083969 - DNA, 12 bp, Homo sapiens
ctgccctcaggg

SEQ ID NO: 4083970 - DNA, 19 bp, Homo sapiens
ctgccctcatggcccctct

SEQ ID NO: 4083971 - DNA, 17 bp, Homo sapiens
ctgccctccttaatttg

SEQ ID NO: 4083972 - DNA, 17 bp, Homo sapiens
ctgccctgcacgtcatg

SEQ ID NO: 4083973 - DNA, 22 bp, Homo sapiens
ctgccctggaacatcctttgca

SEQ ID NO: 4083974 - DNA, 20 bp, Homo sapiens
ctgccctggctgctgccccc

SEQ ID NO: 4083975 - DNA, 15 bp, Homo sapiens
ctgccctggtccagg

SEQ ID NO: 4083976 - DNA, 20 bp, Homo sapiens
ctgccctggtccagggaagc

SEQ ID NO: 4083977 - DNA, 14 bp, Homo sapiens
ctgccctggtgctg

SEQ ID NO: 4083978 - DNA, 15 bp, Homo sapiens
ctgccctggtgctgc

SEQ ID NO: 4083979 - DNA, 21 bp, Homo sapiens
ctgccctggtgctgccacact

SEQ ID NO: 4083980 - DNA, 12 bp, Homo sapiens
ctgccctgtgta

SEQ ID NO: 4083981 - DNA, 19 bp, Homo sapiens
ctgccctgttcatgtgcct

SEQ ID NO: 4083982 - DNA, 14 bp, Homo sapiens
ctgcccttccctct

SEQ ID NO: 4083983 - DNA, 15 bp, Homo sapiens
ctgcccttccctctg

SEQ ID NO: 4083984 - DNA, 18 bp, Homo sapiens
ctgcccttccctctgggc

SEQ ID NO: 4083985 - DNA, 16 bp, Homo sapiens
ctgcccttctcaagac

SEQ ID NO: 4083986 - DNA, 17 bp, Homo sapiens
ctgcccttctcaagact

SEQ ID NO: 4083987 - DNA, 17 bp, Homo sapiens
ctgcccttttcaggaag

SEQ ID NO: 4083988 - DNA, 21 bp, Homo sapiens
ctgcccttttctctcacccat

SEQ ID NO: 4083989 - DNA, 17 bp, Homo sapiens
ctgccgcaacagttttt

SEQ ID NO: 4083990 - DNA, 21 bp, Homo sapiens
ctgccgcagacgggcacagac

SEQ ID NO: 4083991 - DNA, 15 bp, Homo sapiens
ctgccgcccttcctg

SEQ ID NO: 4083992 - DNA, 13 bp, Homo sapiens
ctgccgctacctc

SEQ ID NO: 4083993 - DNA, 13 bp, Homo sapiens
ctgccgctgcacc

SEQ ID NO: 4083994 - DNA, 14 bp, Homo sapiens
ctgccgctgcacca

SEQ ID NO: 4083995 - DNA, 19 bp, Homo sapiens
ctgccgggctgagggcctg

SEQ ID NO: 4083996 - DNA, 22 bp, Homo sapiens
ctgccgggctgagggcctgctg

SEQ ID NO: 4083997 - DNA, 14 bp, Homo sapiens
ctgccgggttctag

SEQ ID NO: 4083998 - DNA, 21 bp, Homo sapiens
ctgccggtcgggcagccagca

SEQ ID NO: 4083999 - DNA, 20 bp, Homo sapiens
ctgcctagcaagctggcctc

SEQ ID NO: 4084000 - DNA, 21 bp, Homo sapiens
ctgcctagctgcctagcaagc

SEQ ID NO: 4084001 - DNA, 23 bp, Homo sapiens
ctgcctcacttcctacaagagca

SEQ ID NO: 4084002 - DNA, 17 bp, Homo sapiens
ctgcctcagctgacccg

SEQ ID NO: 4084003 - DNA, 22 bp, Homo sapiens
ctgcctcagctgacccggcctc

SEQ ID NO: 4084004 - DNA, 12 bp, Homo sapiens
ctgcctcaggac

SEQ ID NO: 4084005 - DNA, 14 bp, Homo sapiens
ctgcctcaggactg

SEQ ID NO: 4084006 - DNA, 12 bp, Homo sapiens
ctgcctcccact

SEQ ID NO: 4084007 - DNA, 11 bp, Homo sapiens
ctgcctcctcg

SEQ ID NO: 4084008 - DNA, 17 bp, Homo sapiens
ctgcctcctcgttcctt

SEQ ID NO: 4084009 - DNA, 14 bp, Homo sapiens
ctgcctcctgccct

SEQ ID NO: 4084010 - DNA, 19 bp, Homo sapiens
ctgcctcgaaacacagaaa

SEQ ID NO: 4084011 - DNA, 19 bp, Homo sapiens
ctgcctctttccctaggaa

SEQ ID NO: 4084012 - DNA, 16 bp, Homo sapiens
ctgcctgaaacagcca

SEQ ID NO: 4084013 - DNA, 20 bp, Homo sapiens
ctgcctgaggggcagcctgc

SEQ ID NO: 4084014 - DNA, 22 bp, Homo sapiens
ctgcctgaggggcagcctgcct

SEQ ID NO: 4084015 - DNA, 17 bp, Homo sapiens
ctgcctgcaatatttga

SEQ ID NO: 4084016 - DNA, 18 bp, Homo sapiens
ctgcctgcaatatttgaa

SEQ ID NO: 4084017 - DNA, 19 bp, Homo sapiens
ctgcctgcaatatttgaat

SEQ ID NO: 4084018 - DNA, 15 bp, Homo sapiens
ctgcctgcacctttc

SEQ ID NO: 4084019 - DNA, 17 bp, Homo sapiens
ctgcctgcagcaggcag

SEQ ID NO: 4084020 - DNA, 18 bp, Homo sapiens
ctgcctgcagcaggcagc

SEQ ID NO: 4084021 - DNA, 20 bp, Homo sapiens
ctgcctgccagctgcactga

SEQ ID NO: 4084022 - DNA, 16 bp, Homo sapiens
ctgcctgccccacacg

SEQ ID NO: 4084023 - DNA, 21 bp, Homo sapiens
ctgcctgccccgcccccagtc

SEQ ID NO: 4084024 - DNA, 11 bp, Homo sapiens
ctgcctgccct

SEQ ID NO: 4084025 - DNA, 21 bp, Homo sapiens
ctgcctgccctgtcaggaggc

SEQ ID NO: 4084026 - DNA, 15 bp, Homo sapiens
ctgcctgctgagatg

SEQ ID NO: 4084027 - DNA, 14 bp, Homo sapiens
ctgcctgcttggcc

SEQ ID NO: 4084028 - DNA, 13 bp, Homo sapiens
ctgcctgctttgg

SEQ ID NO: 4084029 - DNA, 16 bp, Homo sapiens
ctgcctggagagggtc

SEQ ID NO: 4084030 - DNA, 18 bp, Homo sapiens
ctgcctggagagggtctc

SEQ ID NO: 4084031 - DNA, 22 bp, Homo sapiens
ctgcctggagagggtctcgctg

SEQ ID NO: 4084032 - DNA, 18 bp, Homo sapiens
ctgcctggagtgctgtgc

SEQ ID NO: 4084033 - DNA, 12 bp, Homo sapiens
ctgcctggccag

SEQ ID NO: 4084034 - DNA, 21 bp, Homo sapiens
ctgcctggccaggcagatctg

SEQ ID NO: 4084035 - DNA, 11 bp, Homo sapiens
ctgcctggccc

SEQ ID NO: 4084036 - DNA, 14 bp, Homo sapiens
ctgcctgttctgag

SEQ ID NO: 4084037 - DNA, 18 bp, Homo sapiens
ctgcctgttctgaggatt

SEQ ID NO: 4084038 - DNA, 21 bp, Homo sapiens
ctgccttaatgacattcccct

SEQ ID NO: 4084039 - DNA, 15 bp, Homo sapiens
ctgccttatcttgca

SEQ ID NO: 4084040 - DNA, 18 bp, Homo sapiens
ctgccttcccatgaatct

SEQ ID NO: 4084041 - DNA, 12 bp, Homo sapiens
ctgccttcccta

SEQ ID NO: 4084042 - DNA, 20 bp, Homo sapiens
ctgccttctcctctctgggc

SEQ ID NO: 4084043 - DNA, 21 bp, Homo sapiens
ctgccttctcctctctgggcc

SEQ ID NO: 4084044 - DNA, 14 bp, Homo sapiens
ctgccttctttcca

SEQ ID NO: 4084045 - DNA, 16 bp, Homo sapiens
ctgccttgcttctgta

SEQ ID NO: 4084046 - DNA, 13 bp, Homo sapiens
ctgccttggcctc

SEQ ID NO: 4084047 - DNA, 16 bp, Homo sapiens
ctgccttggcctccca

SEQ ID NO: 4084048 - DNA, 15 bp, Homo sapiens
ctgccttggctcaga

SEQ ID NO: 4084049 - DNA, 23 bp, Homo sapiens
ctgccttgggccttgctgctgct

SEQ ID NO: 4084050 - DNA, 23 bp, Homo sapiens
ctgcctttgcagttggactctca

SEQ ID NO: 4084051 - DNA, 23 bp, Homo sapiens
ctgcgagacgcacacagctgagc

SEQ ID NO: 4084052 - DNA, 17 bp, Homo sapiens
ctgcgatcttcagagca

SEQ ID NO: 4084053 - DNA, 18 bp, Homo sapiens
ctgcgcaccaatgcccag

SEQ ID NO: 4084054 - DNA, 19 bp, Homo sapiens
ctgcgcaccaatgcccagc

SEQ ID NO: 4084055 - DNA, 16 bp, Homo sapiens
ctgcgccagtcctgct

SEQ ID NO: 4084056 - DNA, 12 bp, Homo sapiens
ctgcgcctccag

SEQ ID NO: 4084057 - DNA, 14 bp, Homo sapiens
ctgcgcctgcaggc

SEQ ID NO: 4084058 - DNA, 18 bp, Homo sapiens
ctgcgcctgctgcctgct

SEQ ID NO: 4084059 - DNA, 18 bp, Homo sapiens
ctgcggcagacgggaggg

SEQ ID NO: 4084060 - DNA, 14 bp, Homo sapiens
ctgcggcatcagat

SEQ ID NO: 4084061 - DNA, 14 bp, Homo sapiens
ctgcggggagacag

SEQ ID NO: 4084062 - DNA, 15 bp, Homo sapiens
ctgcggggagacaga

SEQ ID NO: 4084063 - DNA, 18 bp, Homo sapiens
ctgcggggagacagaagc

SEQ ID NO: 4084064 - DNA, 13 bp, Homo sapiens
ctgcgtcctcctc

SEQ ID NO: 4084065 - DNA, 19 bp, Homo sapiens
ctgcgtcctcctcacctca

SEQ ID NO: 4084066 - DNA, 22 bp, Homo sapiens
ctgcgtgccagtcaagaagaaa

SEQ ID NO: 4084067 - DNA, 18 bp, Homo sapiens
ctgcgttggtccagagcg

SEQ ID NO: 4084068 - DNA, 14 bp, Homo sapiens
ctgctaaatcctca

SEQ ID NO: 4084069 - DNA, 20 bp, Homo sapiens
ctgctaaattctatgttaaa

SEQ ID NO: 4084070 - DNA, 15 bp, Homo sapiens
ctgctaacctggaaa

SEQ ID NO: 4084071 - DNA, 23 bp, Homo sapiens
ctgctaatacctcttactttgct

SEQ ID NO: 4084072 - DNA, 23 bp, Homo sapiens
ctgctaatcatgtgggtgagcca

SEQ ID NO: 4084073 - DNA, 15 bp, Homo sapiens
ctgctaatgtaaact

SEQ ID NO: 4084074 - DNA, 15 bp, Homo sapiens
ctgctacaatgtcct

SEQ ID NO: 4084075 - DNA, 18 bp, Homo sapiens
ctgctaccgccctgggct

SEQ ID NO: 4084076 - DNA, 19 bp, Homo sapiens
ctgctaccgccctgggctg

SEQ ID NO: 4084077 - DNA, 20 bp, Homo sapiens
ctgctaccgccctgggctgg

SEQ ID NO: 4084078 - DNA, 17 bp, Homo sapiens
ctctcagggcctggcag

SEQ ID NO: 4084079 - DNA, 23 bp, Homo sapiens
ctctcagggcctggcaggccagt

SEQ ID NO: 4084080 - DNA, 13 bp, Homo sapiens
ctctcagtgtttt

SEQ ID NO: 4084081 - DNA, 18 bp, Homo sapiens
ctctcagtgttttggact

SEQ ID NO: 4084082 - DNA, 15 bp, Homo sapiens
ctctcagttctctcc

SEQ ID NO: 4084083 - DNA, 16 bp, Homo sapiens
ctctcagttctctccc

SEQ ID NO: 4084084 - DNA, 17 bp, Homo sapiens
ctctcagttctctccct

SEQ ID NO: 4084085 - DNA, 19 bp, Homo sapiens
ctctcatgctgcccctgcc

SEQ ID NO: 4084086 - DNA, 23 bp, Homo sapiens
ctctccaagtctcagtggcttca

SEQ ID NO: 4084087 - DNA, 17 bp, Homo sapiens
ctctccaagtctctctg

SEQ ID NO: 4084088 - DNA, 20 bp, Homo sapiens
ctctccaagtctctctgtga

SEQ ID NO: 4084089 - DNA, 21 bp, Homo sapiens
ctctccaagtctctctgtgaa

SEQ ID NO: 4084090 - DNA, 23 bp, Homo sapiens
ctctccacggtagcacttgacct

SEQ ID NO: 4084091 - DNA, 17 bp, Homo sapiens
ctctccagtttgcacct

SEQ ID NO: 4084092 - DNA, 17 bp, Homo sapiens
ctctcccagtgaactcc

SEQ ID NO: 4084093 - DNA, 23 bp, Homo sapiens
ctctcccagtgaactcctgccag

SEQ ID NO: 4084094 - DNA, 13 bp, Homo sapiens
ctctcccatcact

SEQ ID NO: 4084095 - DNA, 14 bp, Homo sapiens
ctctcccatcactt

SEQ ID NO: 4084096 - DNA, 18 bp, Homo sapiens
ctctcccatcacttccct

SEQ ID NO: 4084097 - DNA, 20 bp, Homo sapiens
ctctcccatcacttccctac

SEQ ID NO: 4084098 - DNA, 14 bp, Homo sapiens
ctctccccacacta

SEQ ID NO: 4084099 - DNA, 18 bp, Homo sapiens
ctctccccacgagggctg

SEQ ID NO: 4084100 - DNA, 11 bp, Homo sapiens
ctctccccagc

SEQ ID NO: 4084101 - DNA, 15 bp, Homo sapiens
ctctcccctccagcc

SEQ ID NO: 4084102 - DNA, 17 bp, Homo sapiens
ctctcccctccagcctt

SEQ ID NO: 4084103 - DNA, 17 bp, Homo sapiens
ctctcccctgacctgtg

SEQ ID NO: 4084104 - DNA, 16 bp, Homo sapiens
ctctcccgcaccaggc

SEQ ID NO: 4084105 - DNA, 17 bp, Homo sapiens
ctctccctcccctgcca

SEQ ID NO: 4084106 - DNA, 15 bp, Homo sapiens
ctctccgcgcctacc

SEQ ID NO: 4084107 - DNA, 21 bp, Homo sapiens
ctctccgtttattataaactg

SEQ ID NO: 4084108 - DNA, 15 bp, Homo sapiens
ctctcctccccaaat

SEQ ID NO: 4084109 - DNA, 12 bp, Homo sapiens
ctctcctgccca

SEQ ID NO: 4084110 - DNA, 18 bp, Homo sapiens
ctctcctgcccagatgcc

SEQ ID NO: 4084111 - DNA, 14 bp, Homo sapiens
ctctcctgccctgt

SEQ ID NO: 4084112 - DNA, 16 bp, Homo sapiens
ctctcctgccctgtga

SEQ ID NO: 4084113 - DNA, 17 bp, Homo sapiens
ctctcctgccctgtgat

SEQ ID NO: 4084114 - DNA, 12 bp, Homo sapiens
ctctcctggagg

SEQ ID NO: 4084115 - DNA, 13 bp, Homo sapiens
ctctcctggccta

SEQ ID NO: 4084116 - DNA, 20 bp, Homo sapiens
ctctcctggcctatccgctg

SEQ ID NO: 4084117 - DNA, 21 bp, Homo sapiens
ctctcctggcctatccgctgc

SEQ ID NO: 4084118 - DNA, 23 bp, Homo sapiens
ctctcctggcctatccgctgcca

SEQ ID NO: 4084119 - DNA, 13 bp, Homo sapiens
ctctcctggctgg

SEQ ID NO: 4084120 - DNA, 15 bp, Homo sapiens
ctctcctggctgggc

SEQ ID NO: 4084121 - DNA, 16 bp, Homo sapiens
ctctcctggctgggcc

SEQ ID NO: 4084122 - DNA, 18 bp, Homo sapiens
ctctcctggctgggccat

SEQ ID NO: 4084123 - DNA, 23 bp, Homo sapiens
ctctcctgggggtggcaggcaca

SEQ ID NO: 4084124 - DNA, 20 bp, Homo sapiens
ctctcctgtataatctctct

SEQ ID NO: 4084125 - DNA, 14 bp, Homo sapiens
ctctcggctcccca

SEQ ID NO: 4084126 - DNA, 15 bp, Homo sapiens
ctctcggctccccat

SEQ ID NO: 4084127 - DNA, 21 bp, Homo sapiens
ctctctaaatcttccttgtga

SEQ ID NO: 4084128 - DNA, 14 bp, Homo sapiens
ctctctactggtcc

SEQ ID NO: 4084129 - DNA, 14 bp, Homo sapiens
ctctctaggcctct

SEQ ID NO: 4084130 - DNA, 15 bp, Homo sapiens
ctctctcagagcatc

SEQ ID NO: 4084131 - DNA, 20 bp, Homo sapiens
ctctctcagagcatctggct

SEQ ID NO: 4084132 - DNA, 14 bp, Homo sapiens
ctctctccagatgt

SEQ ID NO: 4084133 - DNA, 24 bp, Homo sapiens
ctctctccagggtgcttagttggc

SEQ ID NO: 4084134 - DNA, 21 bp, Homo sapiens
ctctctcttctgctccaccct

SEQ ID NO: 4084135 - DNA, 18 bp, Homo sapiens
ctctctctttctagaggt

SEQ ID NO: 4084136 - DNA, 21 bp, Homo sapiens
ctctctgagactctttagagc

SEQ ID NO: 4084137 - DNA, 13 bp, Homo sapiens
ctctctgagactg

SEQ ID NO: 4084138 - DNA, 16 bp, Homo sapiens
ctctctgagtctggac

SEQ ID NO: 4084139 - DNA, 22 bp, Homo sapiens
ctctctgatcttgtgctcagca

SEQ ID NO: 4084140 - DNA, 18 bp, Homo sapiens
ctctctgatgtcccagtg

SEQ ID NO: 4084141 - DNA, 15 bp, Homo sapiens
ctctctgcagctgcc

SEQ ID NO: 4084142 - DNA, 14 bp, Homo sapiens
ctctctgccccacc

SEQ ID NO: 4084143 - DNA, 18 bp, Homo sapiens
ctctctgccccacccaag

SEQ ID NO: 4084144 - DNA, 19 bp, Homo sapiens
ctctctgccccacccaagc

SEQ ID NO: 4084145 - DNA, 16 bp, Homo sapiens
ctctctgccctgtgta

SEQ ID NO: 4084146 - DNA, 17 bp, Homo sapiens
ctctctgccctgtgtac

SEQ ID NO: 4084147 - DNA, 20 bp, Homo sapiens
ctctctggaaagaggctctg

SEQ ID NO: 4084148 - DNA, 21 bp, Homo sapiens
ctctctggaaagaggctctgg

SEQ ID NO: 4084149 - DNA, 22 bp, Homo sapiens
ctctctggaaagaggctctgga

SEQ ID NO: 4084150 - DNA, 16 bp, Homo sapiens
ctctctgggacctcct

SEQ ID NO: 4084151 - DNA, 20 bp, Homo sapiens
ctctctggggccctgggcct

SEQ ID NO: 4084152 - DNA, 23 bp, Homo sapiens
ctctctgtcccttgctgtatgct

SEQ ID NO: 4084153 - DNA, 15 bp, Homo sapiens
ctctctgtgaataca

SEQ ID NO: 4084154 - DNA, 17 bp, Homo sapiens
ctctctgtgaatacaat

SEQ ID NO: 4084155 - DNA, 21 bp, Homo sapiens
ctctctgtgaatacaattaaa

SEQ ID NO: 4084156 - DNA, 16 bp, Homo sapiens
ctctctgtgctgtgga

SEQ ID NO: 4084157 - DNA, 16 bp, Homo sapiens
ctctcttaaatgcaag

SEQ ID NO: 4084158 - DNA, 18 bp, Homo sapiens
ctctcttatagaatattt

SEQ ID NO: 4084159 - DNA, 21 bp, Homo sapiens
ctctcttatagaatatttatt

SEQ ID NO: 4084160 - DNA, 23 bp, Homo sapiens
ctctcttatagaatatttattac

SEQ ID NO: 4084161 - DNA, 13 bp, Homo sapiens
ctctcttccctca

SEQ ID NO: 4084162 - DNA, 14 bp, Homo sapiens
ctctcttccctcag

SEQ ID NO: 4084163 - DNA, 15 bp, Homo sapiens
ctctcttccctcaga

SEQ ID NO: 4084164 - DNA, 23 bp, Homo sapiens
ctctcttccctttccccagcatc

SEQ ID NO: 4084165 - DNA, 16 bp, Homo sapiens
ctctcttctgctccac

SEQ ID NO: 4084166 - DNA, 17 bp, Homo sapiens
ctctctttcctccaccc

SEQ ID NO: 4084167 - DNA, 16 bp, Homo sapiens
ctctctttctagaggt

SEQ ID NO: 4084168 - DNA, 14 bp, Homo sapiens
ctctcttttgttta

SEQ ID NO: 4084169 - DNA, 18 bp, Homo sapiens
ctctgaacacaggcagct

SEQ ID NO: 4084170 - DNA, 13 bp, Homo sapiens
ctctgaactttgg

SEQ ID NO: 4084171 - DNA, 14 bp, Homo sapiens
ctctgaactttgga

SEQ ID NO: 4084172 - DNA, 23 bp, Homo sapiens
ctctgaagtcacatcacaggaca

SEQ ID NO: 4084173 - DNA, 17 bp, Homo sapiens
ctctgaatgccccataa

SEQ ID NO: 4084174 - DNA, 15 bp, Homo sapiens
ctctgacccttgggc

SEQ ID NO: 4084175 - DNA, 21 bp, Homo sapiens
ctctgacccttgggcctgggc

SEQ ID NO: 4084176 - DNA, 12 bp, Homo sapiens
ctctgacctgca

SEQ ID NO: 4084177 - DNA, 21 bp, Homo sapiens
ctctgagaattccaaggagtt

SEQ ID NO: 4084178 - DNA, 22 bp, Homo sapiens
ctctgagactctttagagcagc

SEQ ID NO: 4084179 - DNA, 19 bp, Homo sapiens
ctctgagatgtggagactg

SEQ ID NO: 4084180 - DNA, 11 bp, Homo sapiens
ctatttatgca

SEQ ID NO: 4084181 - DNA, 21 bp, Homo sapiens
ctatttatgccttgatgattt

SEQ ID NO: 4084182 - DNA, 13 bp, Homo sapiens
ctatttattaata

SEQ ID NO: 4084183 - DNA, 15 bp, Homo sapiens
ctatttattaatatt

SEQ ID NO: 4084184 - DNA, 21 bp, Homo sapiens
ctatttcagtgttacctgtgt

SEQ ID NO: 4084185 - DNA, 23 bp, Homo sapiens
ctatttccccaggggaaaatgaa

SEQ ID NO: 4084186 - DNA, 18 bp, Homo sapiens
ctatttccccctttcttc

SEQ ID NO: 4084187 - DNA, 21 bp, Homo sapiens
ctatttccccctttcttcctc

SEQ ID NO: 4084188 - DNA, 17 bp, Homo sapiens
ctatttcccctcttctg

SEQ ID NO: 4084189 - DNA, 19 bp, Homo sapiens
ctatttcccctcttctgct

SEQ ID NO: 4084190 - DNA, 21 bp, Homo sapiens
ctatttctgggtcttttgcta

SEQ ID NO: 4084191 - DNA, 20 bp, Homo sapiens
ctattttaaaataaattagt

SEQ ID NO: 4084192 - DNA, 17 bp, Homo sapiens
ctattttggattgtata

SEQ ID NO: 4084193 - DNA, 17 bp, Homo sapiens
ctattttgtacagacaa

SEQ ID NO: 4084194 - DNA, 15 bp, Homo sapiens
ctatttttatcatga

SEQ ID NO: 4084195 - DNA, 17 bp, Homo sapiens
ctatttttatcatgaat

SEQ ID NO: 4084196 - DNA, 15 bp, Homo sapiens
ctatttttatttata

SEQ ID NO: 4084197 - DNA, 22 bp, Homo sapiens
ctatttttgactgtagccacag

SEQ ID NO: 4084198 - DNA, 17 bp, Homo sapiens
ctatttttttaactgaa

SEQ ID NO: 4084199 - DNA, 20 bp, Homo sapiens
ctatttttttaactgaaaat

SEQ ID NO: 4084200 - DNA, 19 bp, Homo sapiens
ctcaaaaaataattagtta

SEQ ID NO: 4084201 - DNA, 20 bp, Homo sapiens
ctcaaaaatacaaaataaaa

SEQ ID NO: 4084202 - DNA, 22 bp, Homo sapiens
ctcaaaagcatttatcattctt

SEQ ID NO: 4084203 - DNA, 14 bp, Homo sapiens
ctcaaaatgtgtaa

SEQ ID NO: 4084204 - DNA, 16 bp, Homo sapiens
ctcaaacgacagagga

SEQ ID NO: 4084205 - DNA, 15 bp, Homo sapiens
ctcaaacttgtggcc

SEQ ID NO: 4084206 - DNA, 14 bp, Homo sapiens
ctcaaagaggcctt

SEQ ID NO: 4084207 - DNA, 23 bp, Homo sapiens
ctcaaagtgactattcagttttc

SEQ ID NO: 4084208 - DNA, 17 bp, Homo sapiens
ctcaaagttttgaaaag

SEQ ID NO: 4084209 - DNA, 21 bp, Homo sapiens
ctcaaagttttgaaaagctat

SEQ ID NO: 4084210 - DNA, 19 bp, Homo sapiens
ctcaaatcgtccagcgacc

SEQ ID NO: 4084211 - DNA, 13 bp, Homo sapiens
ctcaaatctattc

SEQ ID NO: 4084212 - DNA, 15 bp, Homo sapiens
ctcaaatctattcag

SEQ ID NO: 4084213 - DNA, 15 bp, Homo sapiens
ctcaaatctgaggga

SEQ ID NO: 4084214 - DNA, 16 bp, Homo sapiens
ctcaaatgagtaacat

SEQ ID NO: 4084215 - DNA, 20 bp, Homo sapiens
ctcaaatgagtaacatttgc

SEQ ID NO: 4084216 - DNA, 22 bp, Homo sapiens
ctcaaatgagtaacatttgctg

SEQ ID NO: 4084217 - DNA, 15 bp, Homo sapiens
ctcaaatggggccag

SEQ ID NO: 4084218 - DNA, 16 bp, Homo sapiens
ctcaaattaatctttc

SEQ ID NO: 4084219 - DNA, 15 bp, Homo sapiens
ctcaacagccaagtg

SEQ ID NO: 4084220 - DNA, 22 bp, Homo sapiens
ctcaaccccaccatatgaattg

SEQ ID NO: 4084221 - DNA, 23 bp, Homo sapiens
ctctgccggtcgggcagccagca

SEQ ID NO: 4084222 - DNA, 16 bp, Homo sapiens
ctctgcctacagccag

SEQ ID NO: 4084223 - DNA, 16 bp, Homo sapiens
ctctgcctccaccctc

SEQ ID NO: 4084224 - DNA, 17 bp, Homo sapiens
ctctgcctccaccctcc

SEQ ID NO: 4084225 - DNA, 12 bp, Homo sapiens
ctctgcctgccc

SEQ ID NO: 4084226 - DNA, 20 bp, Homo sapiens
ctctgcctggtggtcagatg

SEQ ID NO: 4084227 - DNA, 18 bp, Homo sapiens
ctctgccttcaggcttct

SEQ ID NO: 4084228 - DNA, 19 bp, Homo sapiens
ctctgcctttgacatttaa

SEQ ID NO: 4084229 - DNA, 23 bp, Homo sapiens
ctctgcctttgacatttaattta

SEQ ID NO: 4084230 - DNA, 14 bp, Homo sapiens
ctctgctccaccac

SEQ ID NO: 4084231 - DNA, 16 bp, Homo sapiens
ctctgctccaccacat

SEQ ID NO: 4084232 - DNA, 13 bp, Homo sapiens
ctctgctccccct

SEQ ID NO: 4084233 - DNA, 16 bp, Homo sapiens
ctctgctgctgtccct

SEQ ID NO: 4084234 - DNA, 18 bp, Homo sapiens
ctctgctggcccagccaa

SEQ ID NO: 4084235 - DNA, 18 bp, Homo sapiens
ctctgcttctccaaggaa

SEQ ID NO: 4084236 - DNA, 18 bp, Homo sapiens
ctctgcttgcctggagac

SEQ ID NO: 4084237 - DNA, 19 bp, Homo sapiens
ctctggaaaatgtgaccca

SEQ ID NO: 4084238 - DNA, 20 bp, Homo sapiens
ctctggaaaatgtgacccag

SEQ ID NO: 4084239 - DNA, 21 bp, Homo sapiens
ctctggaaaatgtgacccaga

SEQ ID NO: 4084240 - DNA, 16 bp, Homo sapiens
ctctggaaatatgtaa

SEQ ID NO: 4084241 - DNA, 19 bp, Homo sapiens
ctctggaagccctggagac

SEQ ID NO: 4084242 - DNA, 15 bp, Homo sapiens
ctctggaatgttttt

SEQ ID NO: 4084243 - DNA, 19 bp, Homo sapiens
ctctggacagcagaagcct

SEQ ID NO: 4084244 - DNA, 16 bp, Homo sapiens
ctctggacagccagtg

SEQ ID NO: 4084245 - DNA, 15 bp, Homo sapiens
ctctggacagcccca

SEQ ID NO: 4084246 - DNA, 15 bp, Homo sapiens
ctctggacggcaggc

SEQ ID NO: 4084247 - DNA, 17 bp, Homo sapiens
ctctggacggcaggctc

SEQ ID NO: 4084248 - DNA, 20 bp, Homo sapiens
ctctggcattagaattattt

SEQ ID NO: 4084249 - DNA, 14 bp, Homo sapiens
ctctggccacaaca

SEQ ID NO: 4084250 - DNA, 10 bp, Homo sapiens
ctctggccag

SEQ ID NO: 4084251 - DNA, 13 bp, Homo sapiens
ctctggccctggc

SEQ ID NO: 4084252 - DNA, 15 bp, Homo sapiens
ctctggctagagtgg

SEQ ID NO: 4084253 - DNA, 13 bp, Homo sapiens
ctctggctctcat

SEQ ID NO: 4084254 - DNA, 17 bp, Homo sapiens
ctctggcttccaggtat

SEQ ID NO: 4084255 - DNA, 17 bp, Homo sapiens
ctctggcttgacagcat

SEQ ID NO: 4084256 - DNA, 15 bp, Homo sapiens
ctctggctttcccag

SEQ ID NO: 4084257 - DNA, 18 bp, Homo sapiens
ctctggctttcccaggag

SEQ ID NO: 4084258 - DNA, 22 bp, Homo sapiens
ctctgggaaatgagaaggcagc

SEQ ID NO: 4084259 - DNA, 22 bp, Homo sapiens
ctctgggcccaggggctgtggc

SEQ ID NO: 4084260 - DNA, 17 bp, Homo sapiens
ctctgggctgccatgtg

SEQ ID NO: 4084261 - DNA, 19 bp, Homo sapiens
ctctggggacagcttcctc

SEQ ID NO: 4084262 - DNA, 19 bp, Homo sapiens
ctctggggaccccaacctc

SEQ ID NO: 4084263 - DNA, 14 bp, Homo sapiens
ctctggggcagatc

SEQ ID NO: 4084264 - DNA, 15 bp, Homo sapiens
ctctggggcagatcc

SEQ ID NO: 4084265 - DNA, 15 bp, Homo sapiens
ctctggggccctggg

SEQ ID NO: 4084266 - DNA, 18 bp, Homo sapiens
ctctggggtgctgcctga

SEQ ID NO: 4084267 - DNA, 22 bp, Homo sapiens
ctctgggttgtgcacatttctt

SEQ ID NO: 4084268 - DNA, 16 bp, Homo sapiens
ctctggtgctcctgca

SEQ ID NO: 4084269 - DNA, 18 bp, Homo sapiens
ctctggtgtgtggtgagg

SEQ ID NO: 4084270 - DNA, 13 bp, Homo sapiens
ctctggttctttg

SEQ ID NO: 4084271 - DNA, 22 bp, Homo sapiens
ctctggttgtttctgttccaaa

SEQ ID NO: 4084272 - DNA, 23 bp, Homo sapiens
ctctggttgtttctgttccaaat

SEQ ID NO: 4084273 - DNA, 14 bp, Homo sapiens
ctctggtttctcat

SEQ ID NO: 4084274 - DNA, 13 bp, Homo sapiens
ctctgtaggcagc

SEQ ID NO: 4084275 - DNA, 17 bp, Homo sapiens
ctctgtaggcagcagag

SEQ ID NO: 4084276 - DNA, 18 bp, Homo sapiens
ctctgtagtttatggcag

SEQ ID NO: 4084277 - DNA, 13 bp, Homo sapiens
ctctgtcagatgg

SEQ ID NO: 4084278 - DNA, 17 bp, Homo sapiens
ctctgtcagccagccgc

SEQ ID NO: 4084279 - DNA, 14 bp, Homo sapiens
ctctgtcagtcaca

SEQ ID NO: 4084280 - DNA, 21 bp, Homo sapiens
ctctgtccatttatccacagg

SEQ ID NO: 4084281 - DNA, 20 bp, Homo sapiens
ctcccgagcaatggcgcctg

SEQ ID NO: 4084282 - DNA, 15 bp, Homo sapiens
ctcccgcaccaggcc

SEQ ID NO: 4084283 - DNA, 21 bp, Homo sapiens
ctcccgccagactgttagaaa

SEQ ID NO: 4084284 - DNA, 19 bp, Homo sapiens
ctcccgcctcagggccagg

SEQ ID NO: 4084285 - DNA, 20 bp, Homo sapiens
ctcccgcctcagggccaggc

SEQ ID NO: 4084286 - DNA, 11 bp, Homo sapiens
ctcccgcggtg

SEQ ID NO: 4084287 - DNA, 14 bp, Homo sapiens
ctcccgctcccagg

SEQ ID NO: 4084288 - DNA, 14 bp, Homo sapiens
ctcccgctgctgct

SEQ ID NO: 4084289 - DNA, 17 bp, Homo sapiens
ctcccgctgctgctgct

SEQ ID NO: 4084290 - DNA, 15 bp, Homo sapiens
ctcccggagcctgtg

SEQ ID NO: 4084291 - DNA, 19 bp, Homo sapiens
ctcccggaggttgggtggg

SEQ ID NO: 4084292 - DNA, 23 bp, Homo sapiens
ctcccgggccacgccccagcccg

SEQ ID NO: 4084293 - DNA, 20 bp, Homo sapiens
ctccctaaactttggccttt

SEQ ID NO: 4084294 - DNA, 19 bp, Homo sapiens
ctccctaccccagggccct

SEQ ID NO: 4084295 - DNA, 13 bp, Homo sapiens
ctccctcagcctc

SEQ ID NO: 4084296 - DNA, 15 bp, Homo sapiens
ctccctcagcctcag

SEQ ID NO: 4084297 - DNA, 17 bp, Homo sapiens
ctccctcagctctctgg

SEQ ID NO: 4084298 - DNA, 19 bp, Homo sapiens
ctccctcagctctctggga

SEQ ID NO: 4084299 - DNA, 18 bp, Homo sapiens
ctccctcccacactcgcc

SEQ ID NO: 4084300 - DNA, 15 bp, Homo sapiens
ctccctcccctgcca

SEQ ID NO: 4084301 - DNA, 21 bp, Homo sapiens
ctccctcccctgccctggtcc

SEQ ID NO: 4084302 - DNA, 17 bp, Homo sapiens
ctccctccggcttgacc

SEQ ID NO: 4084303 - DNA, 19 bp, Homo sapiens
ctccctccgggtcttccta

SEQ ID NO: 4084304 - DNA, 15 bp, Homo sapiens
ctccctcctcacctc

SEQ ID NO: 4084305 - DNA, 14 bp, Homo sapiens
ctccctccttgggt

SEQ ID NO: 4084306 - DNA, 17 bp, Homo sapiens
ctccctcgacagcgccc

SEQ ID NO: 4084307 - DNA, 21 bp, Homo sapiens
ctccctcgacagcgcccctgc

SEQ ID NO: 4084308 - DNA, 16 bp, Homo sapiens
ctccctctctcttctg

SEQ ID NO: 4084309 - DNA, 22 bp, Homo sapiens
ctccctctctcttctgctccac

SEQ ID NO: 4084310 - DNA, 11 bp, Homo sapiens
ctccctctgat

SEQ ID NO: 4084311 - DNA, 18 bp, Homo sapiens
ctccctgaagcctttgca

SEQ ID NO: 4084312 - DNA, 16 bp, Homo sapiens
ctccctgacccgtcta

SEQ ID NO: 4084313 - DNA, 19 bp, Homo sapiens
ctccctgactccctgtggg

SEQ ID NO: 4084314 - DNA, 20 bp, Homo sapiens
ctccctgactccctgtgggg

SEQ ID NO: 4084315 - DNA, 18 bp, Homo sapiens
ctccctgactggcctggg

SEQ ID NO: 4084316 - DNA, 14 bp, Homo sapiens
ctccctgatgacac

SEQ ID NO: 4084317 - DNA, 22 bp, Homo sapiens
ctccctgatgacacccaccctg

SEQ ID NO: 4084318 - DNA, 14 bp, Homo sapiens
ctccctgcccctcc

SEQ ID NO: 4084319 - DNA, 21 bp, Homo sapiens
ctccctgcccctcccttcaac

SEQ ID NO: 4084320 - DNA, 13 bp, Homo sapiens
ctccctgcctgag

SEQ ID NO: 4084321 - DNA, 18 bp, Homo sapiens
ctccctgcctggccccca

SEQ ID NO: 4084322 - DNA, 15 bp, Homo sapiens
ctccctgctttggct

SEQ ID NO: 4084323 - DNA, 11 bp, Homo sapiens
ctccctggagt

SEQ ID NO: 4084324 - DNA, 12 bp, Homo sapiens
ctccctggagtg

SEQ ID NO: 4084325 - DNA, 15 bp, Homo sapiens
ctccctggctcccat

SEQ ID NO: 4084326 - DNA, 18 bp, Homo sapiens
ctccctggctctcagaag

SEQ ID NO: 4084327 - DNA, 13 bp, Homo sapiens
ctccctgtctcca

SEQ ID NO: 4084328 - DNA, 24 bp, Homo sapiens
ctccctgtgggggtggccatccct

SEQ ID NO: 4084329 - DNA, 18 bp, Homo sapiens
ctccctgttccccagaga

SEQ ID NO: 4084330 - DNA, 19 bp, Homo sapiens
ctccctgttccccagagaa

SEQ ID NO: 4084331 - DNA, 18 bp, Homo sapiens
ctcccttcagcccccagc

SEQ ID NO: 4084332 - DNA, 19 bp, Homo sapiens
ctcccttcctctctcctta

SEQ ID NO: 4084333 - DNA, 20 bp, Homo sapiens
ctcccttccttttccctgct

SEQ ID NO: 4084334 - DNA, 14 bp, Homo sapiens
ctcccttgctgaac

SEQ ID NO: 4084335 - DNA, 15 bp, Homo sapiens
ctccctttcccttct

SEQ ID NO: 4084336 - DNA, 14 bp, Homo sapiens
ctccctttctcagg

SEQ ID NO: 4084337 - DNA, 15 bp, Homo sapiens
ctccgaccctcatgg

SEQ ID NO: 4084338 - DNA, 14 bp, Homo sapiens
ctccgagagggaga

SEQ ID NO: 4084339 - DNA, 16 bp, Homo sapiens
ctccgagagggagaga

SEQ ID NO: 4084340 - DNA, 14 bp, Homo sapiens
ctccgcatcacctc

SEQ ID NO: 4084341 - DNA, 12 bp, Homo sapiens
ctccgccagcct

SEQ ID NO: 4084342 - DNA, 14 bp, Homo sapiens
ctccgccagcctcc

SEQ ID NO: 4084343 - DNA, 18 bp, Homo sapiens
ctccgccagcctcctctg

SEQ ID NO: 4084344 - DNA, 23 bp, Homo sapiens
ctccgcccgctcctgccgcagac

SEQ ID NO: 4084345 - DNA, 12 bp, Homo sapiens
ctccgccctcct

SEQ ID NO: 4084346 - DNA, 13 bp, Homo sapiens
ctccgctgctcct

SEQ ID NO: 4084347 - DNA, 15 bp, Homo sapiens
ctccggactggtgcc

SEQ ID NO: 4084348 - DNA, 17 bp, Homo sapiens
ctccggccatactgcct

SEQ ID NO: 4084349 - DNA, 20 bp, Homo sapiens
ctccggcctgatgacagagc

SEQ ID NO: 4084350 - DNA, 22 bp, Homo sapiens
ctccggcctgatgacagagcga

SEQ ID NO: 4084351 - DNA, 18 bp, Homo sapiens
ctccggcttgacctgttt

SEQ ID NO: 4084352 - DNA, 16 bp, Homo sapiens
ctccgggtgtggcctc

SEQ ID NO: 4084353 - DNA, 20 bp, Homo sapiens
ctccgggtgtggcctcagcc

SEQ ID NO: 4084354 - DNA, 23 bp, Homo sapiens
ctccgggtgtggcctcagccctc

SEQ ID NO: 4084355 - DNA, 22 bp, Homo sapiens
ctccgtagggtctttcttggga

SEQ ID NO: 4084356 - DNA, 15 bp, Homo sapiens
ctccgtccagccgcc

SEQ ID NO: 4084357 - DNA, 23 bp, Homo sapiens
ctccgtccatatcagaactgtgc

SEQ ID NO: 4084358 - DNA, 15 bp, Homo sapiens
ctccgtgatccatcc

SEQ ID NO: 4084359 - DNA, 17 bp, Homo sapiens
ctcctaaaactgggatt

SEQ ID NO: 4084360 - DNA, 13 bp, Homo sapiens
ctcctactcctga

SEQ ID NO: 4084361 - DNA, 13 bp, Homo sapiens
ctcctagacccag

SEQ ID NO: 4084362 - DNA, 19 bp, Homo sapiens
ctcctagacccaggtggag

SEQ ID NO: 4084363 - DNA, 18 bp, Homo sapiens
ctcctagcagacagaaac

SEQ ID NO: 4084364 - DNA, 19 bp, Homo sapiens
ctcctagcagacagaaact

SEQ ID NO: 4084365 - DNA, 20 bp, Homo sapiens
ctcctagggaaaagttcata

SEQ ID NO: 4084366 - DNA, 14 bp, Homo sapiens
ctcctcaactcacc

SEQ ID NO: 4084367 - DNA, 20 bp, Homo sapiens
ctcctcaatttttgtctcag

SEQ ID NO: 4084368 - DNA, 21 bp, Homo sapiens
ctcctcaatttttgtctcaga

SEQ ID NO: 4084369 - DNA, 17 bp, Homo sapiens
ctcctcacctcatgccc

SEQ ID NO: 4084370 - DNA, 20 bp, Homo sapiens
ctcctcacctcatgcccacc

SEQ ID NO: 4084371 - DNA, 15 bp, Homo sapiens
ctcctcacctctgga

SEQ ID NO: 4084372 - DNA, 22 bp, Homo sapiens
ctcctcacctctggactggcta

SEQ ID NO: 4084373 - DNA, 18 bp, Homo sapiens
ctcctcaggcacacagct

SEQ ID NO: 4084374 - DNA, 19 bp, Homo sapiens
ctcctcaggcacacagcta

SEQ ID NO: 4084375 - DNA, 20 bp, Homo sapiens
ctcctcatgtacataccctg

SEQ ID NO: 4084376 - DNA, 15 bp, Homo sapiens
ctcctccagcccctg

SEQ ID NO: 4084377 - DNA, 18 bp, Homo sapiens
ctcctccagcccctgtcc

SEQ ID NO: 4084378 - DNA, 15 bp, Homo sapiens
ctcctccaggcctgc

SEQ ID NO: 4084379 - DNA, 23 bp, Homo sapiens
ctcctcccaggcgccccttcccc

SEQ ID NO: 4084380 - DNA, 10 bp, Homo sapiens
ctcctccctc

SEQ ID NO: 4084381 - DNA, 15 bp, Homo sapiens
ctcctcccttccttt

SEQ ID NO: 4084382 - DNA, 14 bp, Homo sapiens
ctcctcctcttcac

SEQ ID NO: 4084383 - DNA, 16 bp, Homo sapiens
ctcctcctcttcacca

SEQ ID NO: 4084384 - DNA, 14 bp, Homo sapiens
ctcgcacctgtgct

SEQ ID NO: 4084385 - DNA, 17 bp, Homo sapiens
ctcgcccagcaggagag

SEQ ID NO: 4084386 - DNA, 18 bp, Homo sapiens
ctcgcctcggatcagctg

SEQ ID NO: 4084387 - DNA, 18 bp, Homo sapiens
ctcgcctgtcacccccac

SEQ ID NO: 4084388 - DNA, 18 bp, Homo sapiens
ctcgcgggcagcgggcca

SEQ ID NO: 4084389 - DNA, 21 bp, Homo sapiens
ctcgcgggcagcgggccaggc

SEQ ID NO: 4084390 - DNA, 22 bp, Homo sapiens
ctcgcgggcagcgggccaggcc

SEQ ID NO: 4084391 - DNA, 18 bp, Homo sapiens
ctcgctgcacaaatactc

SEQ ID NO: 4084392 - DNA, 15 bp, Homo sapiens
ctcgctgtcactggc

SEQ ID NO: 4084393 - DNA, 20 bp, Homo sapiens
ctcgctgtcactggctggct

SEQ ID NO: 4084394 - DNA, 17 bp, Homo sapiens
ctcgctttgttgcccag

SEQ ID NO: 4084395 - DNA, 23 bp, Homo sapiens
ctcggaacctgtgagctgcacca

SEQ ID NO: 4084396 - DNA, 16 bp, Homo sapiens
ctcggagagcagcagc

SEQ ID NO: 4084397 - DNA, 17 bp, Homo sapiens
ctcggaggaagccccca

SEQ ID NO: 4084398 - DNA, 15 bp, Homo sapiens
ctcggaggctgcccc

SEQ ID NO: 4084399 - DNA, 17 bp, Homo sapiens
ctcggatgacaccctgg

SEQ ID NO: 4084400 - DNA, 19 bp, Homo sapiens
ctcggatgacaccctggcc

SEQ ID NO: 4084401 - DNA, 24 bp, Homo sapiens
ctcggatggaccaacctgctctgt

SEQ ID NO: 4084402 - DNA, 20 bp, Homo sapiens
ctcggcctcccaaagtgctg

SEQ ID NO: 4084403 - DNA, 22 bp, Homo sapiens
ctcggcctcccaaagtgctggg

SEQ ID NO: 4084404 - DNA, 14 bp, Homo sapiens
ctcggcgcccacca

SEQ ID NO: 4084405 - DNA, 12 bp, Homo sapiens
ctcggctcaggc

SEQ ID NO: 4084406 - DNA, 13 bp, Homo sapiens
ctcggctcaggct

SEQ ID NO: 4084407 - DNA, 16 bp, Homo sapiens
ctcggcttgtgggctg

SEQ ID NO: 4084408 - DNA, 17 bp, Homo sapiens
ctcggcttgtgggctgg

SEQ ID NO: 4084409 - DNA, 19 bp, Homo sapiens
ctcgggaagcagccagctc

SEQ ID NO: 4084410 - DNA, 15 bp, Homo sapiens
ctcgggacacctgcc

SEQ ID NO: 4084411 - DNA, 19 bp, Homo sapiens
ctcggtagcagaggccctg

SEQ ID NO: 4084412 - DNA, 20 bp, Homo sapiens
ctcggtgaccactcttcttt

SEQ ID NO: 4084413 - DNA, 22 bp, Homo sapiens
ctcgtccaccccccacacacac

SEQ ID NO: 4084414 - DNA, 18 bp, Homo sapiens
ctcgtgcgcatctcagaa

SEQ ID NO: 4084415 - DNA, 15 bp, Homo sapiens
ctcgtgggagagcca

SEQ ID NO: 4084416 - DNA, 19 bp, Homo sapiens
ctcgttattgttgttgcca

SEQ ID NO: 4084417 - DNA, 23 bp, Homo sapiens
ctcgtttttcagcacccccaccc

SEQ ID NO: 4084418 - DNA, 13 bp, Homo sapiens
ctctaataaaaca

SEQ ID NO: 4084419 - DNA, 23 bp, Homo sapiens
ctctaatctgagctgcagcctgg

SEQ ID NO: 4084420 - DNA, 13 bp, Homo sapiens
ctctacagtgcca

SEQ ID NO: 4084421 - DNA, 17 bp, Homo sapiens
cgccagcctcctctgga

SEQ ID NO: 4084422 - DNA, 21 bp, Homo sapiens
cgccagcctcctctggacggc

SEQ ID NO: 4084423 - DNA, 19 bp, Homo sapiens
cgccagctgggagcactgg

SEQ ID NO: 4084424 - DNA, 16 bp, Homo sapiens
cgccaggaagccagag

SEQ ID NO: 4084425 - DNA, 18 bp, Homo sapiens
cgccaggaagccagagcc

SEQ ID NO: 4084426 - DNA, 19 bp, Homo sapiens
cgccaggaagccagagccc

SEQ ID NO: 4084427 - DNA, 21 bp, Homo sapiens
cgccaggatggaacacggcca

SEQ ID NO: 4084428 - DNA, 23 bp, Homo sapiens
cgccaggatggaacacggccaca

SEQ ID NO: 4084429 - DNA, 21 bp, Homo sapiens
cgccaggctgaccacagcaca

SEQ ID NO: 4084430 - DNA, 23 bp, Homo sapiens
cgccaggctgaccacagcacagc

SEQ ID NO: 4084431 - DNA, 11 bp, Homo sapiens
cgccagggctg

SEQ ID NO: 4084432 - DNA, 13 bp, Homo sapiens
cgccagggctggg

SEQ ID NO: 4084433 - DNA, 17 bp, Homo sapiens
cgccatccttcaccaga

SEQ ID NO: 4084434 - DNA, 20 bp, Homo sapiens
cgccatccttcaccagagcc

SEQ ID NO: 4084435 - DNA, 23 bp, Homo sapiens
cgccatctgatccccatgcctag

SEQ ID NO: 4084436 - DNA, 20 bp, Homo sapiens
cgcccacaggaagcctgcag

SEQ ID NO: 4084437 - DNA, 22 bp, Homo sapiens
cgcccacaggaagcctgcagtc

SEQ ID NO: 4084438 - DNA, 17 bp, Homo sapiens
cgcccagccccatccct

SEQ ID NO: 4084439 - DNA, 14 bp, Homo sapiens
cctttccgctgtcg

SEQ ID NO: 4084440 - DNA, 20 bp, Homo sapiens
cctttcctaggcccaggcct

SEQ ID NO: 4084441 - DNA, 12 bp, Homo sapiens
cctttccttccc

SEQ ID NO: 4084442 - DNA, 15 bp, Homo sapiens
cctttcgaggcctga

SEQ ID NO: 4084443 - DNA, 13 bp, Homo sapiens
cctttctaataaa

SEQ ID NO: 4084444 - DNA, 11 bp, Homo sapiens
cctttctcagg

SEQ ID NO: 4084445 - DNA, 18 bp, Homo sapiens
cctttctccagccagcaa

SEQ ID NO: 4084446 - DNA, 12 bp, Homo sapiens
cctttctccagg

SEQ ID NO: 4084447 - DNA, 14 bp, Homo sapiens
cctttctctttctc

SEQ ID NO: 4084448 - DNA, 18 bp, Homo sapiens
cctttctctttctctctt

SEQ ID NO: 4084449 - DNA, 21 bp, Homo sapiens
cctttctctttctctcttccc

SEQ ID NO: 4084450 - DNA, 15 bp, Homo sapiens
cctttctgccgaccc

SEQ ID NO: 4084451 - DNA, 17 bp, Homo sapiens
cctttctgccgacccct

SEQ ID NO: 4084452 - DNA, 14 bp, Homo sapiens
cctttctgtcccac

SEQ ID NO: 4084453 - DNA, 20 bp, Homo sapiens
cctttctgtgccctactcat

SEQ ID NO: 4084454 - DNA, 18 bp, Homo sapiens
cctttcttggttcataaa

SEQ ID NO: 4084455 - DNA, 23 bp, Homo sapiens
cctttcttgtagccatggctggg

SEQ ID NO: 4084456 - DNA, 22 bp, Homo sapiens
cctttcttttaatgatgccatg

SEQ ID NO: 4084457 - DNA, 19 bp, Homo sapiens
cctttcttttccccctttg

SEQ ID NO: 4084458 - DNA, 15 bp, Homo sapiens
cctttgacctcggtg

SEQ ID NO: 4084459 - DNA, 20 bp, Homo sapiens
cctttgacttcagctgcctg

SEQ ID NO: 4084460 - DNA, 21 bp, Homo sapiens
cctttgacttcagctgcctga

SEQ ID NO: 4084461 - DNA, 19 bp, Homo sapiens
cctttgagacagtttctta

SEQ ID NO: 4084462 - DNA, 21 bp, Homo sapiens
cctttgagagacgccactccc

SEQ ID NO: 4084463 - DNA, 16 bp, Homo sapiens
cctttgcactgagggc

SEQ ID NO: 4084464 - DNA, 17 bp, Homo sapiens
cctttgcactgagggcc

SEQ ID NO: 4084465 - DNA, 14 bp, Homo sapiens
cctttgcagggcag

SEQ ID NO: 4084466 - DNA, 16 bp, Homo sapiens
cctttgcagggcagcc

SEQ ID NO: 4084467 - DNA, 18 bp, Homo sapiens
cctttgcagggcagcccc

SEQ ID NO: 4084468 - DNA, 19 bp, Homo sapiens
cctttgctgaggcctccag

SEQ ID NO: 4084469 - DNA, 13 bp, Homo sapiens
cctttgctgtgag

SEQ ID NO: 4084470 - DNA, 17 bp, Homo sapiens
cctttgctgtgaggctg

SEQ ID NO: 4084471 - DNA, 22 bp, Homo sapiens
cctttgctgtgaggctgtcctg

SEQ ID NO: 4084472 - DNA, 13 bp, Homo sapiens
cctttggaaagcc

SEQ ID NO: 4084473 - DNA, 21 bp, Homo sapiens
cctttggagaacgccagtctc

SEQ ID NO: 4084474 - DNA, 15 bp, Homo sapiens
cctttggagatgctg

SEQ ID NO: 4084475 - DNA, 20 bp, Homo sapiens
cctttggagatgctgagggt

SEQ ID NO: 4084476 - DNA, 16 bp, Homo sapiens
cctttggtttttttct

SEQ ID NO: 4084477 - DNA, 14 bp, Homo sapiens
cctttgtaagttat

SEQ ID NO: 4084478 - DNA, 15 bp, Homo sapiens
cctttgtagctactt

SEQ ID NO: 4084479 - DNA, 13 bp, Homo sapiens
cctttgtgaatat

SEQ ID NO: 4084480 - DNA, 19 bp, Homo sapiens
cctttgtgtgtactcactg

SEQ ID NO: 4084481 - DNA, 16 bp, Homo sapiens
cctttgtgtgtgtgtc

SEQ ID NO: 4084482 - DNA, 18 bp, Homo sapiens
cctttgtttccttgttgg

SEQ ID NO: 4084483 - DNA, 11 bp, Homo sapiens
ccttttacttt

SEQ ID NO: 4084484 - DNA, 19 bp, Homo sapiens
ccttttatcccaaagttgt

SEQ ID NO: 4084485 - DNA, 22 bp, Homo sapiens
ccttttatgtagtaattgacat

SEQ ID NO: 4084486 - DNA, 18 bp, Homo sapiens
ccttttcagctgagccct

SEQ ID NO: 4084487 - DNA, 20 bp, Homo sapiens
ccttttcagctgagccctgg

SEQ ID NO: 4084488 - DNA, 15 bp, Homo sapiens
ccttttccctgcttc

SEQ ID NO: 4084489 - DNA, 11 bp, Homo sapiens
ccttttctcag

SEQ ID NO: 4084490 - DNA, 22 bp, Homo sapiens
ccttttctgcattttgctattg

SEQ ID NO: 4084491 - DNA, 14 bp, Homo sapiens
ccttttctgtggct

SEQ ID NO: 4084492 - DNA, 14 bp, Homo sapiens
ccttttctgttcta

SEQ ID NO: 4084493 - DNA, 15 bp, Homo sapiens
ccttttcttcatttt

SEQ ID NO: 4084494 - DNA, 14 bp, Homo sapiens
ccttttctttttcc

SEQ ID NO: 4084495 - DNA, 21 bp, Homo sapiens
ccttttgaggagccccagcta

SEQ ID NO: 4084496 - DNA, 11 bp, Homo sapiens
ccttttgctct

SEQ ID NO: 4084497 - DNA, 12 bp, Homo sapiens
ccttttgctgcg

SEQ ID NO: 4084498 - DNA, 18 bp, Homo sapiens
ccttttgcttgaaaccaa

SEQ ID NO: 4084499 - DNA, 16 bp, Homo sapiens
cctttttaaatgtgaa

SEQ ID NO: 4084500 - DNA, 19 bp, Homo sapiens
cctttttaatatgcttaaa

SEQ ID NO: 4084501 - DNA, 22 bp, Homo sapiens
cctttttcatatgttgctcagt

SEQ ID NO: 4084502 - DNA, 20 bp, Homo sapiens
cctttttccatcattttaca

SEQ ID NO: 4084503 - DNA, 18 bp, Homo sapiens
cctttttctgagatgctc

SEQ ID NO: 4084504 - DNA, 13 bp, Homo sapiens
cctttttctgatt

SEQ ID NO: 4084505 - DNA, 19 bp, Homo sapiens
cctttttcttcgctggact

SEQ ID NO: 4084506 - DNA, 14 bp, Homo sapiens
cctttttgtaaata

SEQ ID NO: 4084507 - DNA, 19 bp, Homo sapiens
cctttttgtataaaataga

SEQ ID NO: 4084508 - DNA, 13 bp, Homo sapiens
ccttttttaagat

SEQ ID NO: 4084509 - DNA, 14 bp, Homo sapiens
ccttttttaagatt

SEQ ID NO: 4084510 - DNA, 14 bp, Homo sapiens
cctttttttccttt

SEQ ID NO: 4084511 - DNA, 16 bp, Homo sapiens
cctttttttccttttt

SEQ ID NO: 4084512 - DNA, 18 bp, Homo sapiens
cgaaacctgggattcagg

SEQ ID NO: 4084513 - DNA, 22 bp, Homo sapiens
cgaaactctaagtgtttgctgc

SEQ ID NO: 4084514 - DNA, 11 bp, Homo sapiens
cgaaactgcca

SEQ ID NO: 4084515 - DNA, 16 bp, Homo sapiens
cgaaactgccaagggt

SEQ ID NO: 4084516 - DNA, 11 bp, Homo sapiens
cgaaataacaa

SEQ ID NO: 4084517 - DNA, 18 bp, Homo sapiens
cgaaatagatatcctctc

SEQ ID NO: 4084518 - DNA, 14 bp, Homo sapiens
cgaaatgttatttt

SEQ ID NO: 4084519 - DNA, 21 bp, Homo sapiens
cgaactgttcaagtgtcccca

SEQ ID NO: 4084520 - DNA, 14 bp, Homo sapiens
cgaacttcacaact

SEQ ID NO: 4084521 - DNA, 14 bp, Homo sapiens
cgaaggtgcctcag

SEQ ID NO: 4084522 - DNA, 17 bp, Homo sapiens
cgaaggtgcctcagact

SEQ ID NO: 4084523 - DNA, 21 bp, Homo sapiens
cgaatgtgcaggtttgttaca

SEQ ID NO: 4084524 - DNA, 19 bp, Homo sapiens
cgaattatttttttaaagt

SEQ ID NO: 4084525 - DNA, 20 bp, Homo sapiens
cgaattgagataatatctgt

SEQ ID NO: 4084526 - DNA, 12 bp, Homo sapiens
cgacaagtgctg

SEQ ID NO: 4084527 - DNA, 23 bp, Homo sapiens
cgacaatgtcgagtatattatta

SEQ ID NO: 4084528 - DNA, 18 bp, Homo sapiens
cgacactcaccatgaagc

SEQ ID NO: 4084529 - DNA, 13 bp, Homo sapiens
cgacagcctggca

SEQ ID NO: 4084530 - DNA, 17 bp, Homo sapiens
cgacagcgcccctgctg

SEQ ID NO: 4084531 - DNA, 19 bp, Homo sapiens
cgacagcgcccctgctgtc

SEQ ID NO: 4084532 - DNA, 22 bp, Homo sapiens
cgacaggcgagagaggagccag

SEQ ID NO: 4084533 - DNA, 13 bp, Homo sapiens
cgacataccccac

SEQ ID NO: 4084534 - DNA, 15 bp, Homo sapiens
cgacataccccactg

SEQ ID NO: 4084535 - DNA, 19 bp, Homo sapiens
cgacataccccactgggca

SEQ ID NO: 4084536 - DNA, 22 bp, Homo sapiens
cgacataccccactgggcacac

SEQ ID NO: 4084537 - DNA, 14 bp, Homo sapiens
cgaccaactgccct

SEQ ID NO: 4084538 - DNA, 15 bp, Homo sapiens
cgaccaactgcccta

SEQ ID NO: 4084539 - DNA, 16 bp, Homo sapiens
cgaccagggccgagga

SEQ ID NO: 4084540 - DNA, 17 bp, Homo sapiens
cgacctggcctgtctgt

SEQ ID NO: 4084541 - DNA, 14 bp, Homo sapiens
cgactaatttcaaa

SEQ ID NO: 4084542 - DNA, 11 bp, Homo sapiens
cgactcaggat

SEQ ID NO: 4084543 - DNA, 20 bp, Homo sapiens
cgactctatagactctagga

SEQ ID NO: 4084544 - DNA, 16 bp, Homo sapiens
cgactgcacagcggcc

SEQ ID NO: 4084545 - DNA, 17 bp, Homo sapiens
cgactgcgaacactgaa

SEQ ID NO: 4084546 - DNA, 15 bp, Homo sapiens
cgactggccagggcc

SEQ ID NO: 4084547 - DNA, 20 bp, Homo sapiens
cgactggccagggccacgct

SEQ ID NO: 4084548 - DNA, 20 bp, Homo sapiens
cgagaaataaagtttgctta

SEQ ID NO: 4084549 - DNA, 21 bp, Homo sapiens
cgagaaattcgtgtgtttttt

SEQ ID NO: 4084550 - DNA, 12 bp, Homo sapiens
cgagaagtgctc

SEQ ID NO: 4084551 - DNA, 23 bp, Homo sapiens
cgagaagtgctcttggctgaccc

SEQ ID NO: 4084552 - DNA, 15 bp, Homo sapiens
cgagaccatcctggc

SEQ ID NO: 4084553 - DNA, 16 bp, Homo sapiens
cgagagaggagccaga

SEQ ID NO: 4084554 - DNA, 12 bp, Homo sapiens
cgagagcgcagc

SEQ ID NO: 4084555 - DNA, 15 bp, Homo sapiens
cgtgtcaagctgctc

SEQ ID NO: 4084556 - DNA, 17 bp, Homo sapiens
cgtgtcaagctgctctg

SEQ ID NO: 4084557 - DNA, 16 bp, Homo sapiens
cgtgtcaatttccctc

SEQ ID NO: 4084558 - DNA, 14 bp, Homo sapiens
cgtgtctctgagga

SEQ ID NO: 4084559 - DNA, 22 bp, Homo sapiens
cgtgtctgtatttatgtgtgag

SEQ ID NO: 4084560 - DNA, 21 bp, Homo sapiens
cgtgtgagtgtgacagggcca

SEQ ID NO: 4084561 - DNA, 18 bp, Homo sapiens
cgtgtggatcttgccaca

SEQ ID NO: 4084562 - DNA, 12 bp, Homo sapiens
cgtgtgtagagt

SEQ ID NO: 4084563 - DNA, 22 bp, Homo sapiens
cgtgtgtagagttaagaagctg

SEQ ID NO: 4084564 - DNA, 17 bp, Homo sapiens
cgtgtttgtctcttctg

SEQ ID NO: 4084565 - DNA, 20 bp, Homo sapiens
cgttattataaatgttagtt

SEQ ID NO: 4084566 - DNA, 12 bp, Homo sapiens
cgttcccaaaga

SEQ ID NO: 4084567 - DNA, 12 bp, Homo sapiens
cgttcccagcag

SEQ ID NO: 4084568 - DNA, 19 bp, Homo sapiens
cgttcctgacatcacagca

SEQ ID NO: 4084569 - DNA, 16 bp, Homo sapiens
cgttctgctgcccctg

SEQ ID NO: 4084570 - DNA, 12 bp, Homo sapiens
cgttctgttctg

SEQ ID NO: 4084571 - DNA, 18 bp, Homo sapiens
cgttggacttttcgttaa

SEQ ID NO: 4084572 - DNA, 13 bp, Homo sapiens
cgttgggagccta

SEQ ID NO: 4084573 - DNA, 14 bp, Homo sapiens
cgttggtccagagc

SEQ ID NO: 4084574 - DNA, 20 bp, Homo sapiens
cgtttattaatgcctctccc

SEQ ID NO: 4084575 - DNA, 20 bp, Homo sapiens
cgtttcctgagaagtgtcta

SEQ ID NO: 4084576 - DNA, 19 bp, Homo sapiens
cgtttgatttgtcactgct

SEQ ID NO: 4084577 - DNA, 20 bp, Homo sapiens
cgttttgaagctactgtgtg

SEQ ID NO: 4084578 - DNA, 22 bp, Homo sapiens
cgtttttgtgctgtgggcagca

SEQ ID NO: 4084579 - DNA, 18 bp, Homo sapiens
ctaaaactggcctgactt

SEQ ID NO: 4084580 - DNA, 18 bp, Homo sapiens
ctaaaattaggactgtat

SEQ ID NO: 4084581 - DNA, 19 bp, Homo sapiens
ctaaaattaggactgtata

SEQ ID NO: 4084582 - DNA, 18 bp, Homo sapiens
ctaaacaaaattgcaatt

SEQ ID NO: 4084583 - DNA, 17 bp, Homo sapiens
ctaaacagatataaatg

SEQ ID NO: 4084584 - DNA, 12 bp, Homo sapiens
ctaaacccaatg

SEQ ID NO: 4084585 - DNA, 21 bp, Homo sapiens
ctaaaccgtcccctccttccc

SEQ ID NO: 4084586 - DNA, 15 bp, Homo sapiens
ctaaactaggctcct

SEQ ID NO: 4084587 - DNA, 17 bp, Homo sapiens
ctaaactccttcctggc

SEQ ID NO: 4084588 - DNA, 16 bp, Homo sapiens
ctaaacttccccatct

SEQ ID NO: 4084589 - DNA, 15 bp, Homo sapiens
ctaaagagcccttgc

SEQ ID NO: 4084590 - DNA, 18 bp, Homo sapiens
ctaaagagcccttgcctc

SEQ ID NO: 4084591 - DNA, 20 bp, Homo sapiens
ctaaagagcccttgcctccc

SEQ ID NO: 4084592 - DNA, 15 bp, Homo sapiens
ctaaagataatatta

SEQ ID NO: 4084593 - DNA, 15 bp, Homo sapiens
ctaaagccagcctga

SEQ ID NO: 4084594 - DNA, 17 bp, Homo sapiens
ctaaagcccaacctcct

SEQ ID NO: 4084595 - DNA, 23 bp, Homo sapiens
ctaaagctgaatgtcaaacagtg

SEQ ID NO: 4084596 - DNA, 15 bp, Homo sapiens
ctaaagcttcagact

SEQ ID NO: 4084597 - DNA, 19 bp, Homo sapiens
ctaaagtacagcctggacc

SEQ ID NO: 4084598 - DNA, 23 bp, Homo sapiens
ctaaataaagcttgcaacaaaat

SEQ ID NO: 4084599 - DNA, 12 bp, Homo sapiens
ctaaataaatgg

SEQ ID NO: 4084600 - DNA, 12 bp, Homo sapiens
ctaaataatgaa

SEQ ID NO: 4084601 - DNA, 14 bp, Homo sapiens
ctaaatatctgtca

SEQ ID NO: 4084602 - DNA, 14 bp, Homo sapiens
ctaaatcctcatgt

SEQ ID NO: 4084603 - DNA, 17 bp, Homo sapiens
ctaaatcctttactgtt

SEQ ID NO: 4084604 - DNA, 21 bp, Homo sapiens
ctaaatcctttactgttagtc

SEQ ID NO: 4084605 - DNA, 12 bp, Homo sapiens
ctaaatctattt

SEQ ID NO: 4084606 - DNA, 18 bp, Homo sapiens
ctaaatcttccttgtgag

SEQ ID NO: 4084607 - DNA, 21 bp, Homo sapiens
ctaaatgaatctcgttcccaa

SEQ ID NO: 4084608 - DNA, 18 bp, Homo sapiens
ctaaatgcagttttaaga

SEQ ID NO: 4084609 - DNA, 22 bp, Homo sapiens
ctaaatgcatatcctgagccat

SEQ ID NO: 4084610 - DNA, 17 bp, Homo sapiens
ctaaatgcctaataaac

SEQ ID NO: 4084611 - DNA, 21 bp, Homo sapiens
ctaaatggtcgcccaggagac

SEQ ID NO: 4084612 - DNA, 22 bp, Homo sapiens
ctaaatgttctatggttatgaa

SEQ ID NO: 4084613 - DNA, 14 bp, Homo sapiens
ctaaattctatgtt

SEQ ID NO: 4084614 - DNA, 13 bp, Homo sapiens
ctaaattttctga

SEQ ID NO: 4084615 - DNA, 15 bp, Homo sapiens
ctaaattttctgaaa

SEQ ID NO: 4084616 - DNA, 16 bp, Homo sapiens
ctaaattttctgaaac

SEQ ID NO: 4084617 - DNA, 19 bp, Homo sapiens
ctaacaaaagatgaaagca

SEQ ID NO: 4084618 - DNA, 18 bp, Homo sapiens
ctaacaagaatgtaactc

SEQ ID NO: 4084619 - DNA, 22 bp, Homo sapiens
ctaacaagtcataggttaatat

SEQ ID NO: 4084620 - DNA, 16 bp, Homo sapiens
ctaacacagcatgtgt

SEQ ID NO: 4084621 - DNA, 17 bp, Homo sapiens
ctaacacattatcggga

SEQ ID NO: 4084622 - DNA, 20 bp, Homo sapiens
ctaacactggcatgttcaaa

SEQ ID NO: 4084623 - DNA, 17 bp, Homo sapiens
ctaacagataagcaaga

SEQ ID NO: 4084624 - DNA, 15 bp, Homo sapiens
ctaacatgttatcaa

SEQ ID NO: 4084625 - DNA, 17 bp, Homo sapiens
cggacatactctctgcc

SEQ ID NO: 4084626 - DNA, 21 bp, Homo sapiens
cggaccagcatctggaagatg

SEQ ID NO: 4084627 - DNA, 12 bp, Homo sapiens
cggacgggctgt

SEQ ID NO: 4084628 - DNA, 20 bp, Homo sapiens
cggactaagcctacctgctc

SEQ ID NO: 4084629 - DNA, 17 bp, Homo sapiens
cggactcccgggccacg

SEQ ID NO: 4084630 - DNA, 23 bp, Homo sapiens
cggactcccgggccacgccccag

SEQ ID NO: 4084631 - DNA, 12 bp, Homo sapiens
cggactctgccc

SEQ ID NO: 4084632 - DNA, 16 bp, Homo sapiens
cggagagaaaaaagaa

SEQ ID NO: 4084633 - DNA, 14 bp, Homo sapiens
cggagagcagcagc

SEQ ID NO: 4084634 - DNA, 15 bp, Homo sapiens
cggagagggagtcag

SEQ ID NO: 4084635 - DNA, 21 bp, Homo sapiens
cggagagtacagtgagccaag

SEQ ID NO: 4084636 - DNA, 19 bp, Homo sapiens
cggagattggacggcctga

SEQ ID NO: 4084637 - DNA, 13 bp, Homo sapiens
cggagcccagcct

SEQ ID NO: 4084638 - DNA, 19 bp, Homo sapiens
cggagcccagcctgggagc

SEQ ID NO: 4084639 - DNA, 21 bp, Homo sapiens
cggagcccagcctgggagccc

SEQ ID NO: 4084640 - DNA, 22 bp, Homo sapiens
cggagcccagcctgggagccca

SEQ ID NO: 4084641 - DNA, 14 bp, Homo sapiens
cggagccccaggcc

SEQ ID NO: 4084642 - DNA, 15 bp, Homo sapiens
cggagcccttggccc

SEQ ID NO: 4084643 - DNA, 19 bp, Homo sapiens
cggagcccttggcccctcg

SEQ ID NO: 4084644 - DNA, 14 bp, Homo sapiens
cggagcctgtgcag

SEQ ID NO: 4084645 - DNA, 20 bp, Homo sapiens
cggagcggattgcaaagcaa

SEQ ID NO: 4084646 - DNA, 22 bp, Homo sapiens
ctagttccctctgctcagccaa

SEQ ID NO: 4084647 - DNA, 15 bp, Homo sapiens
ctagttctttcctcc

SEQ ID NO: 4084648 - DNA, 20 bp, Homo sapiens
ctagttttagttttctctta

SEQ ID NO: 4084649 - DNA, 18 bp, Homo sapiens
ctataaaaaataaaataa

SEQ ID NO: 4084650 - DNA, 19 bp, Homo sapiens
ctataaagagaagacgaaa

SEQ ID NO: 4084651 - DNA, 20 bp, Homo sapiens
ctataaagcgatatacagat

SEQ ID NO: 4084652 - DNA, 9 bp, Homo sapiens
ctataaata

SEQ ID NO: 4084653 - DNA, 15 bp, Homo sapiens
ctataaatacaaatc

SEQ ID NO: 4084654 - DNA, 17 bp, Homo sapiens
ctataaatacaaatctg

SEQ ID NO: 4084655 - DNA, 12 bp, Homo sapiens
ctataacagata

SEQ ID NO: 4084656 - DNA, 20 bp, Homo sapiens
ctataaggctgagggctgcc

SEQ ID NO: 4084657 - DNA, 15 bp, Homo sapiens
ctataataaagaagt

SEQ ID NO: 4084658 - DNA, 19 bp, Homo sapiens
ctatagccatcgactcctg

SEQ ID NO: 4084659 - DNA, 15 bp, Homo sapiens
ctatagctaagtaca

SEQ ID NO: 4084660 - DNA, 17 bp, Homo sapiens
ctatagctaagtacaca

SEQ ID NO: 4084661 - DNA, 22 bp, Homo sapiens
ctataggctggagaagctcacc

SEQ ID NO: 4084662 - DNA, 16 bp, Homo sapiens
ctatatccatgtactg

SEQ ID NO: 4084663 - DNA, 15 bp, Homo sapiens
ctatatgaatttaaa

SEQ ID NO: 4084664 - DNA, 16 bp, Homo sapiens
ctatatgcagtccttt

SEQ ID NO: 4084665 - DNA, 19 bp, Homo sapiens
ctatatgtgaaacattttt

SEQ ID NO: 4084666 - DNA, 13 bp, Homo sapiens
ctatattatcata

SEQ ID NO: 4084667 - DNA, 22 bp, Homo sapiens
ctatattgttttcagtgtacat

SEQ ID NO: 4084668 - DNA, 22 bp, Homo sapiens
ctatatttgctagactctagac

SEQ ID NO: 4084669 - DNA, 12 bp, Homo sapiens
ctatatttgggc

SEQ ID NO: 4084670 - DNA, 14 bp, Homo sapiens
ctatcacacagtgg

SEQ ID NO: 4084671 - DNA, 12 bp, Homo sapiens
ctatcatttatt

SEQ ID NO: 4084672 - DNA, 20 bp, Homo sapiens
ctatccaaagaacttgattt

SEQ ID NO: 4084673 - DNA, 23 bp, Homo sapiens
ctatccaaagaacttgatttgca

SEQ ID NO: 4084674 - DNA, 14 bp, Homo sapiens
ctatccctcacaca

SEQ ID NO: 4084675 - DNA, 19 bp, Homo sapiens
ctatcctgaaaattctgta

SEQ ID NO: 4084676 - DNA, 14 bp, Homo sapiens
ctatcgagtttgca

SEQ ID NO: 4084677 - DNA, 18 bp, Homo sapiens
ctatcgagtttgcaatgt

SEQ ID NO: 4084678 - DNA, 17 bp, Homo sapiens
ctatcgttattataaat

SEQ ID NO: 4084679 - DNA, 20 bp, Homo sapiens
ctatctaggtggagttgaaa

SEQ ID NO: 4084680 - DNA, 12 bp, Homo sapiens
ctatctcatcta

SEQ ID NO: 4084681 - DNA, 18 bp, Homo sapiens
ctatctccgttccatctg

SEQ ID NO: 4084682 - DNA, 23 bp, Homo sapiens
ctatctccgttccatctgggctt

SEQ ID NO: 4084683 - DNA, 20 bp, Homo sapiens
ctatctccttcccaccccta

SEQ ID NO: 4084684 - DNA, 17 bp, Homo sapiens
ctatctgattttgtgca

SEQ ID NO: 4084685 - DNA, 19 bp, Homo sapiens
ctatctggaggccttccag

SEQ ID NO: 4084686 - DNA, 23 bp, Homo sapiens
ctatctggaggccttccagctgc

SEQ ID NO: 4084687 - DNA, 21 bp, Homo sapiens
ctatcttagtggttccccacc

SEQ ID NO: 4084688 - DNA, 18 bp, Homo sapiens
ctatcttcttcaaataca

SEQ ID NO: 4084689 - DNA, 15 bp, Homo sapiens
ctatgactgctcccc

SEQ ID NO: 4084690 - DNA, 20 bp, Homo sapiens
ctcagcacaaggccatctgg

SEQ ID NO: 4084691 - DNA, 13 bp, Homo sapiens
ctcagcacagcct

SEQ ID NO: 4084692 - DNA, 14 bp, Homo sapiens
ctcagcagtgacca

SEQ ID NO: 4084693 - DNA, 17 bp, Homo sapiens
ctcagcagtgagagcag

SEQ ID NO: 4084694 - DNA, 22 bp, Homo sapiens
ctcagcatttccttccagccca

SEQ ID NO: 4084695 - DNA, 21 bp, Homo sapiens
ctcagcatttccttgtcccgt

SEQ ID NO: 4084696 - DNA, 15 bp, Homo sapiens
ctcagcatttctttt

SEQ ID NO: 4084697 - DNA, 12 bp, Homo sapiens
ctcagccaagct

SEQ ID NO: 4084698 - DNA, 13 bp, Homo sapiens
ctcagccaagctt

SEQ ID NO: 4084699 - DNA, 14 bp, Homo sapiens
ctcagccaagcttg

SEQ ID NO: 4084700 - DNA, 17 bp, Homo sapiens
ctcagccacacccaggc

SEQ ID NO: 4084701 - DNA, 19 bp, Homo sapiens
ctcagccacacccaggcac

SEQ ID NO: 4084702 - DNA, 11 bp, Homo sapiens
ctcagccagca

SEQ ID NO: 4084703 - DNA, 16 bp, Homo sapiens
ctcagccctcagaaca

SEQ ID NO: 4084704 - DNA, 13 bp, Homo sapiens
ctcagccctcagt

SEQ ID NO: 4084705 - DNA, 14 bp, Homo sapiens
ctcagccctcagtt

SEQ ID NO: 4084706 - DNA, 20 bp, Homo sapiens
ctcagcctcagaggagctct

SEQ ID NO: 4084707 - DNA, 22 bp, Homo sapiens
ctcagcctcccaaagtgctggg

SEQ ID NO: 4084708 - DNA, 14 bp, Homo sapiens
ctcagcctgctgcc

SEQ ID NO: 4084709 - DNA, 16 bp, Homo sapiens
ctcagcctgctgccca

SEQ ID NO: 4084710 - DNA, 13 bp, Homo sapiens
ctcagcctggcca

SEQ ID NO: 4084711 - DNA, 14 bp, Homo sapiens
ctcagcctggccag

SEQ ID NO: 4084712 - DNA, 16 bp, Homo sapiens
ctcagcctggccagac

SEQ ID NO: 4084713 - DNA, 17 bp, Homo sapiens
ctcagcctggccagaca

SEQ ID NO: 4084714 - DNA, 15 bp, Homo sapiens
ctcagccttgccaga

SEQ ID NO: 4084715 - DNA, 16 bp, Homo sapiens
ctcagccttgccagag

SEQ ID NO: 4084716 - DNA, 17 bp, Homo sapiens
ctcagccttgccagaga

SEQ ID NO: 4084717 - DNA, 20 bp, Homo sapiens
ctcagccttgccagagatcc

SEQ ID NO: 4084718 - DNA, 21 bp, Homo sapiens
ctcagccttgccagagatcca

SEQ ID NO: 4084719 - DNA, 19 bp, Homo sapiens
ctcagctacccactatcct

SEQ ID NO: 4084720 - DNA, 18 bp, Homo sapiens
ctcagctcctacctctgt

SEQ ID NO: 4084721 - DNA, 14 bp, Homo sapiens
ctcagctctctggg

SEQ ID NO: 4084722 - DNA, 12 bp, Homo sapiens
ctcagctctggg

SEQ ID NO: 4084723 - DNA, 13 bp, Homo sapiens
ctcagctctggga

SEQ ID NO: 4084724 - DNA, 16 bp, Homo sapiens
ctcagctctgggagag

SEQ ID NO: 4084725 - DNA, 16 bp, Homo sapiens
ctcataaatttacttt

SEQ ID NO: 4084726 - DNA, 14 bp, Homo sapiens
ctcataattttgca

SEQ ID NO: 4084727 - DNA, 15 bp, Homo sapiens
ctcataattttgcaa

SEQ ID NO: 4084728 - DNA, 16 bp, Homo sapiens
ctcatacctttaaagg

SEQ ID NO: 4084729 - DNA, 14 bp, Homo sapiens
ctcatactcctggg

SEQ ID NO: 4084730 - DNA, 14 bp, Homo sapiens
ctcatagcattaac

SEQ ID NO: 4084731 - DNA, 18 bp, Homo sapiens
ctcatagcattaactaat

SEQ ID NO: 4084732 - DNA, 15 bp, Homo sapiens
ctcatatcagtttgc

SEQ ID NO: 4084733 - DNA, 17 bp, Homo sapiens
ctcatcaatcaaataag

SEQ ID NO: 4084734 - DNA, 21 bp, Homo sapiens
ctcatcaatcaaataagtatt

SEQ ID NO: 4084735 - DNA, 15 bp, Homo sapiens
ctcatcactggatga

SEQ ID NO: 4084736 - DNA, 14 bp, Homo sapiens
ctcatcataaaata

SEQ ID NO: 4084737 - DNA, 16 bp, Homo sapiens
ctcatcataaaataaa

SEQ ID NO: 4084738 - DNA, 22 bp, Homo sapiens
ctcatcccaacctctttttcct

SEQ ID NO: 4084739 - DNA, 14 bp, Homo sapiens
ctcatcccacgcac

SEQ ID NO: 4084740 - DNA, 22 bp, Homo sapiens
ctcatcccatgagaccctggtg

SEQ ID NO: 4084741 - DNA, 15 bp, Homo sapiens
ctcatcctcctggaa

SEQ ID NO: 4084742 - DNA, 23 bp, Homo sapiens
ctcatcctcctggaaccttgctg

SEQ ID NO: 4084743 - DNA, 14 bp, Homo sapiens
ctcatctatctcaa

SEQ ID NO: 4084744 - DNA, 20 bp, Homo sapiens
ctcatctatgaggaaaggtt

SEQ ID NO: 4084745 - DNA, 14 bp, Homo sapiens
ctcatctccaagga

SEQ ID NO: 4084746 - DNA, 21 bp, Homo sapiens
ctcatctccaaggatcctctc

SEQ ID NO: 4084747 - DNA, 13 bp, Homo sapiens
ctcatctgcaaaa

SEQ ID NO: 4084748 - DNA, 21 bp, Homo sapiens
ctcatcttgacagagcctgcc

SEQ ID NO: 4084749 - DNA, 12 bp, Homo sapiens
ctcatgaagcta

SEQ ID NO: 4084750 - DNA, 14 bp, Homo sapiens
ctcatgaggggaga

SEQ ID NO: 4084751 - DNA, 19 bp, Homo sapiens
ctcatgaggggagaggaga

SEQ ID NO: 4084752 - DNA, 15 bp, Homo sapiens
ctcatgagtgtgccc

SEQ ID NO: 4084753 - DNA, 17 bp, Homo sapiens
ctcatgcccaccccctg

SEQ ID NO: 4084754 - DNA, 14 bp, Homo sapiens
ctcatgcccctggc

SEQ ID NO: 4084755 - DNA, 16 bp, Homo sapiens
ctcatgcccctggctg

SEQ ID NO: 4084756 - DNA, 17 bp, Homo sapiens
ctcatgcccctggctgg

SEQ ID NO: 4084757 - DNA, 14 bp, Homo sapiens
ctcatgctgcccct

SEQ ID NO: 4084758 - DNA, 16 bp, Homo sapiens
ctcatggcccccaggg

SEQ ID NO: 4084759 - DNA, 14 bp, Homo sapiens
ctcatggcccctct

SEQ ID NO: 4084760 - DNA, 15 bp, Homo sapiens
ctcatggcccctctg

SEQ ID NO: 4084761 - DNA, 18 bp, Homo sapiens
ctcatgggaagcatgtgg

SEQ ID NO: 4084762 - DNA, 22 bp, Homo sapiens
ctcatgggaagcatgtggatga

SEQ ID NO: 4084763 - DNA, 22 bp, Homo sapiens
ctcatgggtcctagcccttccc

SEQ ID NO: 4084764 - DNA, 18 bp, Homo sapiens
ctcatgtaacacataaac

SEQ ID NO: 4084765 - DNA, 16 bp, Homo sapiens
ctcatgtacataccct

SEQ ID NO: 4084766 - DNA, 16 bp, Homo sapiens
ctcatgtatcatctgg

SEQ ID NO: 4084767 - DNA, 12 bp, Homo sapiens
ctcatgtatctt

SEQ ID NO: 4084768 - DNA, 22 bp, Homo sapiens
ctcattacccacccgacctggc

SEQ ID NO: 4084769 - DNA, 23 bp, Homo sapiens
ctcattacccacccgacctggct

SEQ ID NO: 4084770 - DNA, 15 bp, Homo sapiens
ctcattactgggcct

SEQ ID NO: 4084771 - DNA, 16 bp, Homo sapiens
ctcattactgggcctt

SEQ ID NO: 4084772 - DNA, 17 bp, Homo sapiens
ctcattcagtattaaag

SEQ ID NO: 4084773 - DNA, 19 bp, Homo sapiens
ctcattcagtattaaaggg

SEQ ID NO: 4084774 - DNA, 17 bp, Homo sapiens
ctcattcttgaggagca

SEQ ID NO: 4084775 - DNA, 14 bp, Homo sapiens
ctcattcttgtttt

SEQ ID NO: 4084776 - DNA, 17 bp, Homo sapiens
ctcattgacaagaactg

SEQ ID NO: 4084777 - DNA, 15 bp, Homo sapiens
ctcattgctgagcct

SEQ ID NO: 4084778 - DNA, 12 bp, Homo sapiens
ctcattggggtt

SEQ ID NO: 4084779 - DNA, 16 bp, Homo sapiens
ctcatttaatttgtta

SEQ ID NO: 4084780 - DNA, 20 bp, Homo sapiens
ctcatttggtctgccagaat

SEQ ID NO: 4084781 - DNA, 22 bp, Homo sapiens
ctcatttggtctgccagaatac

SEQ ID NO: 4084782 - DNA, 13 bp, Homo sapiens
ctcattttgcttg

SEQ ID NO: 4084783 - DNA, 14 bp, Homo sapiens
ctccaaacctccag

SEQ ID NO: 4084784 - DNA, 15 bp, Homo sapiens
ctccaaacctccagc

SEQ ID NO: 4084785 - DNA, 19 bp, Homo sapiens
ctccaaacctccagcctcc

SEQ ID NO: 4084786 - DNA, 14 bp, Homo sapiens
ctccaaaggccccc

SEQ ID NO: 4084787 - DNA, 23 bp, Homo sapiens
ctccaaatctcaatgaagccagc

SEQ ID NO: 4084788 - DNA, 20 bp, Homo sapiens
ctccaacacaaggctccaag

SEQ ID NO: 4084789 - DNA, 20 bp, Homo sapiens
ctccaacagaactaaatgtt

SEQ ID NO: 4084790 - DNA, 22 bp, Homo sapiens
ctccaacccccgccacctcagg

SEQ ID NO: 4084791 - DNA, 21 bp, Homo sapiens
ctccaacctgcaaagatctgt

SEQ ID NO: 4084792 - DNA, 20 bp, Homo sapiens
ctccaagcacagagcctggc

SEQ ID NO: 4084793 - DNA, 12 bp, Homo sapiens
ctccaaggacca

SEQ ID NO: 4084794 - DNA, 17 bp, Homo sapiens
ctccaaggatcctctcc

SEQ ID NO: 4084795 - DNA, 18 bp, Homo sapiens
ctccaagtctctctgtga

SEQ ID NO: 4084796 - DNA, 19 bp, Homo sapiens
ctccaagtctctctgtgaa

SEQ ID NO: 4084797 - DNA, 16 bp, Homo sapiens
ctccaagtgccccctc

SEQ ID NO: 4084798 - DNA, 12 bp, Homo sapiens
ctccacaaatga

SEQ ID NO: 4084799 - DNA, 15 bp, Homo sapiens
ctccacaccagtggc

SEQ ID NO: 4084800 - DNA, 13 bp, Homo sapiens
ctccacacctgaa

SEQ ID NO: 4084801 - DNA, 16 bp, Homo sapiens
ctccacagcaacccca

SEQ ID NO: 4084802 - DNA, 14 bp, Homo sapiens
ctccacatcccagc

SEQ ID NO: 4084803 - DNA, 17 bp, Homo sapiens
ctccacatcccagcagc

SEQ ID NO: 4084804 - DNA, 18 bp, Homo sapiens
ctccacatcccagcagcc

SEQ ID NO: 4084805 - DNA, 14 bp, Homo sapiens
ctccacatctgcct

SEQ ID NO: 4084806 - DNA, 17 bp, Homo sapiens
ctccacatctgccttaa

SEQ ID NO: 4084807 - DNA, 11 bp, Homo sapiens
ctccacccagc

SEQ ID NO: 4084808 - DNA, 15 bp, Homo sapiens
ctccacccagcccct

SEQ ID NO: 4084809 - DNA, 14 bp, Homo sapiens
ctccaccctccacc

SEQ ID NO: 4084810 - DNA, 23 bp, Homo sapiens
ctccaccctcctcctcttcacca

SEQ ID NO: 4084811 - DNA, 12 bp, Homo sapiens
ctccacccttgg

SEQ ID NO: 4084812 - DNA, 13 bp, Homo sapiens
ctccacccttggc

SEQ ID NO: 4084813 - DNA, 14 bp, Homo sapiens
ctccacccttggcc

SEQ ID NO: 4084814 - DNA, 16 bp, Homo sapiens
ctccacccttggcctg

SEQ ID NO: 4084815 - DNA, 17 bp, Homo sapiens
ctccacccttggcctgt

SEQ ID NO: 4084816 - DNA, 18 bp, Homo sapiens
ctccaccgaccaactgcc

SEQ ID NO: 4084817 - DNA, 12 bp, Homo sapiens
ctccaccttcca

SEQ ID NO: 4084818 - DNA, 14 bp, Homo sapiens
ctccacgcctcctg

SEQ ID NO: 4084819 - DNA, 18 bp, Homo sapiens
ctccacgcctcctggcca

SEQ ID NO: 4084820 - DNA, 19 bp, Homo sapiens
ctccacgcctcctggccag

SEQ ID NO: 4084821 - DNA, 21 bp, Homo sapiens
ctccacgcctcctggccagac

SEQ ID NO: 4084822 - DNA, 21 bp, Homo sapiens
ctccacggtagcacttgacct

SEQ ID NO: 4084823 - DNA, 18 bp, Homo sapiens
ctccactaaatgagctcc

SEQ ID NO: 4084824 - DNA, 21 bp, Homo sapiens
ctccactaaatgagctcctgc

SEQ ID NO: 4084825 - DNA, 20 bp, Homo sapiens
ctccactaccccacaccagc

SEQ ID NO: 4084826 - DNA, 21 bp, Homo sapiens
ctccactaccccacaccagcc

SEQ ID NO: 4084827 - DNA, 21 bp, Homo sapiens
ctccactcagctgtcctgcag

SEQ ID NO: 4084828 - DNA, 17 bp, Homo sapiens
ctccactccagctctga

SEQ ID NO: 4084829 - DNA, 19 bp, Homo sapiens
cagtgaagatgcaatcaga

SEQ ID NO: 4084830 - DNA, 17 bp, Homo sapiens
cagtgacacttcagaga

SEQ ID NO: 4084831 - DNA, 18 bp, Homo sapiens
cagtgacacttcagagag

SEQ ID NO: 4084832 - DNA, 19 bp, Homo sapiens
cagtgacacttcagagagc

SEQ ID NO: 4084833 - DNA, 22 bp, Homo sapiens
cagtgacacttcagagagctgg

SEQ ID NO: 4084834 - DNA, 18 bp, Homo sapiens
cagtgacagacaggctct

SEQ ID NO: 4084835 - DNA, 20 bp, Homo sapiens
cagtgacctggaaggcccag

SEQ ID NO: 4084836 - DNA, 14 bp, Homo sapiens
cagtgaccttttct

SEQ ID NO: 4084837 - DNA, 16 bp, Homo sapiens
cagtgaccttttcttc

SEQ ID NO: 4084838 - DNA, 17 bp, Homo sapiens
cagtgaccttttcttca

SEQ ID NO: 4084839 - DNA, 18 bp, Homo sapiens
cagtgaccttttcttcat

SEQ ID NO: 4084840 - DNA, 18 bp, Homo sapiens
cagtgactgaaaccattt

SEQ ID NO: 4084841 - DNA, 14 bp, Homo sapiens
cagtgactttgtat

SEQ ID NO: 4084842 - DNA, 15 bp, Homo sapiens
cagtgactttgtata

SEQ ID NO: 4084843 - DNA, 21 bp, Homo sapiens
cagtgagcctcctgtgcctgg

SEQ ID NO: 4084844 - DNA, 15 bp, Homo sapiens
cagtgataggcccaa

SEQ ID NO: 4084845 - DNA, 21 bp, Homo sapiens
cagtgatatggcagaagacac

SEQ ID NO: 4084846 - DNA, 16 bp, Homo sapiens
cagtgatctcagggca

SEQ ID NO: 4084847 - DNA, 16 bp, Homo sapiens
cagtgatctccatatg

SEQ ID NO: 4084848 - DNA, 14 bp, Homo sapiens
cagtgattagcact

SEQ ID NO: 4084849 - DNA, 13 bp, Homo sapiens
cagtgcagacagg

SEQ ID NO: 4084850 - DNA, 13 bp, Homo sapiens
cagtgcagccact

SEQ ID NO: 4084851 - DNA, 14 bp, Homo sapiens
cagtgcagccactg

SEQ ID NO: 4084852 - DNA, 16 bp, Homo sapiens
cagtgcatctcagccc

SEQ ID NO: 4084853 - DNA, 21 bp, Homo sapiens
cagtgccaaatgctggggcag

SEQ ID NO: 4084854 - DNA, 23 bp, Homo sapiens
cagtgccaaatgctggggcaggg

SEQ ID NO: 4084855 - DNA, 21 bp, Homo sapiens
cagtgccagcaatgacatctc

SEQ ID NO: 4084856 - DNA, 19 bp, Homo sapiens
cagtgccccagggagtcca

SEQ ID NO: 4084857 - DNA, 16 bp, Homo sapiens
cagagatgtgcaccca

SEQ ID NO: 4084858 - DNA, 21 bp, Homo sapiens
cagagattcttgaagaatgaa

SEQ ID NO: 4084859 - DNA, 17 bp, Homo sapiens
cagagattgaactccaa

SEQ ID NO: 4084860 - DNA, 19 bp, Homo sapiens
cagagattgaactccaaga

SEQ ID NO: 4084861 - DNA, 18 bp, Homo sapiens
cagagcaagatcctgtct

SEQ ID NO: 4084862 - DNA, 15 bp, Homo sapiens
cagagcaccccctgc

SEQ ID NO: 4084863 - DNA, 16 bp, Homo sapiens
cagagcaccccctgct

SEQ ID NO: 4084864 - DNA, 19 bp, Homo sapiens
cagagcaccccctgctcca

SEQ ID NO: 4084865 - DNA, 20 bp, Homo sapiens
cagagcaccccctgctccac

SEQ ID NO: 4084866 - DNA, 20 bp, Homo sapiens
cagagcacctttgcacagga

SEQ ID NO: 4084867 - DNA, 22 bp, Homo sapiens
cagagcacctttgcacaggatg

SEQ ID NO: 4084868 - DNA, 13 bp, Homo sapiens
cagagcagatgca

SEQ ID NO: 4084869 - DNA, 21 bp, Homo sapiens
cagagcaggaagcattcagag

SEQ ID NO: 4084870 - DNA, 23 bp, Homo sapiens
cagagcaggaaggacaggaagct

SEQ ID NO: 4084871 - DNA, 23 bp, Homo sapiens
cagagcaggggtccttggtgtga

SEQ ID NO: 4084872 - DNA, 12 bp, Homo sapiens
cagagcagtctg

SEQ ID NO: 4084873 - DNA, 19 bp, Homo sapiens
cagagcatacaacagaggg

SEQ ID NO: 4084874 - DNA, 19 bp, Homo sapiens
cagagcatctggctgttta

SEQ ID NO: 4084875 - DNA, 18 bp, Homo sapiens
cagagcatgtgtcagagt

SEQ ID NO: 4084876 - DNA, 18 bp, Homo sapiens
cagagcattacgtgagcc

SEQ ID NO: 4084877 - DNA, 21 bp, Homo sapiens
cagagcattacgtgagccagg

SEQ ID NO: 4084878 - DNA, 17 bp, Homo sapiens
cagagcattccagtcag

SEQ ID NO: 4084879 - DNA, 21 bp, Homo sapiens
cagagcattccagtcaggctc

SEQ ID NO: 4084880 - DNA, 21 bp, Homo sapiens
cagagccaagccttaaactgt

SEQ ID NO: 4084881 - DNA, 13 bp, Homo sapiens
cagagccacctgg

SEQ ID NO: 4084882 - DNA, 13 bp, Homo sapiens
cagagccagatgc

SEQ ID NO: 4084883 - DNA, 14 bp, Homo sapiens
cagagccagatgca

SEQ ID NO: 4084884 - DNA, 20 bp, Homo sapiens
cagagccagatgcaggacag

SEQ ID NO: 4084885 - DNA, 23 bp, Homo sapiens
cagagccagatgcaggacaggag

SEQ ID NO: 4084886 - DNA, 17 bp, Homo sapiens
cagagccatgctgggaa

SEQ ID NO: 4084887 - DNA, 14 bp, Homo sapiens
cagagcccagctcc

SEQ ID NO: 4084888 - DNA, 19 bp, Homo sapiens
cagagcccatgctcaacca

SEQ ID NO: 4084889 - DNA, 14 bp, Homo sapiens
cagagccccaagca

SEQ ID NO: 4084890 - DNA, 16 bp, Homo sapiens
cagagcccctcctcca

SEQ ID NO: 4084891 - DNA, 17 bp, Homo sapiens
cagagcccctcctccag

SEQ ID NO: 4084892 - DNA, 21 bp, Homo sapiens
cagagcccctcctccagcccc

SEQ ID NO: 4084893 - DNA, 15 bp, Homo sapiens
cagagccctgccctg

SEQ ID NO: 4084894 - DNA, 16 bp, Homo sapiens
cagagccctgccctgc

SEQ ID NO: 4084895 - DNA, 17 bp, Homo sapiens
cagagccctgctccctc

SEQ ID NO: 4084896 - DNA, 12 bp, Homo sapiens
cagagccctggc

SEQ ID NO: 4084897 - DNA, 15 bp, Homo sapiens
cagagccctggctgg

SEQ ID NO: 4084898 - DNA, 17 bp, Homo sapiens
cagagcctgccccagcg

SEQ ID NO: 4084899 - DNA, 13 bp, Homo sapiens
cagagcctggccc

SEQ ID NO: 4084900 - DNA, 16 bp, Homo sapiens
cagagcctttggatga

SEQ ID NO: 4084901 - DNA, 13 bp, Homo sapiens
cagagcgccagga

SEQ ID NO: 4084902 - DNA, 20 bp, Homo sapiens
cagagcgccaggaagccaga

SEQ ID NO: 4084903 - DNA, 21 bp, Homo sapiens
cagagcgccaggaagccagag

SEQ ID NO: 4084904 - DNA, 14 bp, Homo sapiens
cagagcgcccctcc

SEQ ID NO: 4084905 - DNA, 19 bp, Homo sapiens
cagagctaaactccttcct

SEQ ID NO: 4084906 - DNA, 13 bp, Homo sapiens
cagagctctgggt

SEQ ID NO: 4084907 - DNA, 21 bp, Homo sapiens
cagagctctgggttgtgcaca

SEQ ID NO: 4084908 - DNA, 13 bp, Homo sapiens
cagagctgggagg

SEQ ID NO: 4084909 - DNA, 15 bp, Homo sapiens
cagagctgggaggca

SEQ ID NO: 4084910 - DNA, 13 bp, Homo sapiens
cagagctgggtgg

SEQ ID NO: 4084911 - DNA, 20 bp, Homo sapiens
cagagctgtttatggcctca

SEQ ID NO: 4084912 - DNA, 20 bp, Homo sapiens
cagaggaaagggctggctcc

SEQ ID NO: 4084913 - DNA, 18 bp, Homo sapiens
cagaggaaatctgtaaca

SEQ ID NO: 4084914 - DNA, 19 bp, Homo sapiens
cagaggaactgtccagaga

SEQ ID NO: 4084915 - DNA, 22 bp, Homo sapiens
cagaggaactgtccagagagca

SEQ ID NO: 4084916 - DNA, 18 bp, Homo sapiens
cagaggaatttatacctc

SEQ ID NO: 4084917 - DNA, 19 bp, Homo sapiens
cagaggactcccaaccctg

SEQ ID NO: 4084918 - DNA, 22 bp, Homo sapiens
cagaggactcccaaccctggct

SEQ ID NO: 4084919 - DNA, 24 bp, Homo sapiens
cagaggagctctaccctgctccct

SEQ ID NO: 4084920 - DNA, 14 bp, Homo sapiens
cagaggcaataggt

SEQ ID NO: 4084921 - DNA, 22 bp, Homo sapiens
cagaggcagcttcaagtgcctt

SEQ ID NO: 4084922 - DNA, 13 bp, Homo sapiens
cagaggcccagga

SEQ ID NO: 4084923 - DNA, 14 bp, Homo sapiens
cagaggccccagcc

SEQ ID NO: 4084924 - DNA, 22 bp, Homo sapiens
cagaggccgaaggtgcctcaga

SEQ ID NO: 4084925 - DNA, 23 bp, Homo sapiens
cagaggccgaaggtgcctcagac

SEQ ID NO: 4084926 - DNA, 12 bp, Homo sapiens
cagaggcctcct

SEQ ID NO: 4084927 - DNA, 13 bp, Homo sapiens
cagaggcctcctg

SEQ ID NO: 4084928 - DNA, 13 bp, Homo sapiens
cagaggcctgccc

SEQ ID NO: 4084929 - DNA, 18 bp, Homo sapiens
cagaggcgcactgtgacc

SEQ ID NO: 4084930 - DNA, 18 bp, Homo sapiens
cagaggctcagagactgc

SEQ ID NO: 4084931 - DNA, 17 bp, Homo sapiens
cagggctcccggagagg

SEQ ID NO: 4084932 - DNA, 23 bp, Homo sapiens
cagggctcccggagagggagtca

SEQ ID NO: 4084933 - DNA, 11 bp, Homo sapiens
cagggctggct

SEQ ID NO: 4084934 - DNA, 15 bp, Homo sapiens
cagggctggctctgc

SEQ ID NO: 4084935 - DNA, 17 bp, Homo sapiens
cagggctggctctgcac

SEQ ID NO: 4084936 - DNA, 22 bp, Homo sapiens
cagggctggctctgcactaaga

SEQ ID NO: 4084937 - DNA, 11 bp, Homo sapiens
cagggctgggg

SEQ ID NO: 4084938 - DNA, 20 bp, Homo sapiens
cagggctggggacagagggt

SEQ ID NO: 4084939 - DNA, 13 bp, Homo sapiens
cagggctggtttg

SEQ ID NO: 4084940 - DNA, 12 bp, Homo sapiens
cagggctgtccc

SEQ ID NO: 4084941 - DNA, 23 bp, Homo sapiens
cagggctgtgcttgaaggccctg

SEQ ID NO: 4084942 - DNA, 16 bp, Homo sapiens
caggggaacctgccat

SEQ ID NO: 4084943 - DNA, 18 bp, Homo sapiens
caggggacacccagaaac

SEQ ID NO: 4084944 - DNA, 20 bp, Homo sapiens
caggggactcagccctgagg

SEQ ID NO: 4084945 - DNA, 21 bp, Homo sapiens
caggggactcagccctgaggt

SEQ ID NO: 4084946 - DNA, 22 bp, Homo sapiens
caggggagacaggagcctagcg

SEQ ID NO: 4084947 - DNA, 17 bp, Homo sapiens
caggggagatggggagg

SEQ ID NO: 4084948 - DNA, 17 bp, Homo sapiens
caggggagggggcaaag

SEQ ID NO: 4084949 - DNA, 11 bp, Homo sapiens
caggggcagga

SEQ ID NO: 4084950 - DNA, 15 bp, Homo sapiens
caggggccagaggaa

SEQ ID NO: 4084951 - DNA, 18 bp, Homo sapiens
caggggcccttgggacag

SEQ ID NO: 4084952 - DNA, 23 bp, Homo sapiens
caggggctgggggtgctggatgg

SEQ ID NO: 4084953 - DNA, 16 bp, Homo sapiens
cagggggaaggcttgg

SEQ ID NO: 4084954 - DNA, 16 bp, Homo sapiens
cagggggattctgagc

SEQ ID NO: 4084955 - DNA, 21 bp, Homo sapiens
cagggggattctgagcagtgc

SEQ ID NO: 4084956 - DNA, 22 bp, Homo sapiens
cagggggattctgagcagtgcc

SEQ ID NO: 4084957 - DNA, 19 bp, Homo sapiens
cagggggccccgccagggc

SEQ ID NO: 4084958 - DNA, 21 bp, Homo sapiens
cagggggtggacaaactggag

SEQ ID NO: 4084959 - DNA, 13 bp, Homo sapiens
caggggtctccct

SEQ ID NO: 4084960 - DNA, 16 bp, Homo sapiens
caggggtctccctggc

SEQ ID NO: 4084961 - DNA, 21 bp, Homo sapiens
caggggtctccctggctccct

SEQ ID NO: 4084962 - DNA, 23 bp, Homo sapiens
cagggaggtgtgaggcaggagag

SEQ ID NO: 4084963 - DNA, 13 bp, Homo sapiens
cagggagtccagg

SEQ ID NO: 4084964 - DNA, 15 bp, Homo sapiens
cagggagtccagggt

SEQ ID NO: 4084965 - DNA, 23 bp, Homo sapiens
cagggagtccagggtttctctgc

SEQ ID NO: 4084966 - DNA, 16 bp, Homo sapiens
cagggagtgctggctc

SEQ ID NO: 4084967 - DNA, 22 bp, Homo sapiens
cagggagtgctggctcacagta

SEQ ID NO: 4084968 - DNA, 19 bp, Homo sapiens
cagggatcactggctggcc

SEQ ID NO: 4084969 - DNA, 14 bp, Homo sapiens
cagggatctcagag

SEQ ID NO: 4084970 - DNA, 20 bp, Homo sapiens
cagggatgctgggctgggcc

SEQ ID NO: 4084971 - DNA, 21 bp, Homo sapiens
cagggatgctgggctgggccc

SEQ ID NO: 4084972 - DNA, 13 bp, Homo sapiens
cagggatggggga

SEQ ID NO: 4084973 - DNA, 16 bp, Homo sapiens
cagggcaccagaggcc

SEQ ID NO: 4084974 - DNA, 16 bp, Homo sapiens
cagggcacgcaggacc

SEQ ID NO: 4084975 - DNA, 13 bp, Homo sapiens
cagggcagagcag

SEQ ID NO: 4084976 - DNA, 17 bp, Homo sapiens
cagggcagcctggatcc

SEQ ID NO: 4084977 - DNA, 16 bp, Homo sapiens
cagggcagggctctga

SEQ ID NO: 4084978 - DNA, 15 bp, Homo sapiens
cagggcatctcctgt

SEQ ID NO: 4084979 - DNA, 18 bp, Homo sapiens
cagggcatcttgctggct

SEQ ID NO: 4084980 - DNA, 19 bp, Homo sapiens
cagggcatgcattttgcag

SEQ ID NO: 4084981 - DNA, 22 bp, Homo sapiens
cagggcatgtgtatgtgtctgc

SEQ ID NO: 4084982 - DNA, 22 bp, Homo sapiens
cagggcattcgggccacagggc

SEQ ID NO: 4084983 - DNA, 17 bp, Homo sapiens
cagggccacgctccagc

SEQ ID NO: 4084984 - DNA, 20 bp, Homo sapiens
cagggccacgctccagctgc

SEQ ID NO: 4084985 - DNA, 12 bp, Homo sapiens
cagggccagagg

SEQ ID NO: 4084986 - DNA, 13 bp, Homo sapiens
cagggccagaggg

SEQ ID NO: 4084987 - DNA, 14 bp, Homo sapiens
cagggccagaggga

SEQ ID NO: 4084988 - DNA, 16 bp, Homo sapiens
cagggccagagggagc

SEQ ID NO: 4084989 - DNA, 17 bp, Homo sapiens
cagggccagagggagct

SEQ ID NO: 4084990 - DNA, 20 bp, Homo sapiens
cagggccagagggagctgga

SEQ ID NO: 4084991 - DNA, 18 bp, Homo sapiens
cagggccagtggggcctg

SEQ ID NO: 4084992 - DNA, 19 bp, Homo sapiens
cagggccagtggggcctgt

SEQ ID NO: 4084993 - DNA, 16 bp, Homo sapiens
cagggccatgcctgcc

SEQ ID NO: 4084994 - DNA, 19 bp, Homo sapiens
cagggcccaccccagcctc

SEQ ID NO: 4084995 - DNA, 20 bp, Homo sapiens
cagggcccaccccagcctcg

SEQ ID NO: 4084996 - DNA, 21 bp, Homo sapiens
cagggcccaccccagcctcgc

SEQ ID NO: 4084997 - DNA, 12 bp, Homo sapiens
cagggcccagag

SEQ ID NO: 4084998 - DNA, 15 bp, Homo sapiens
cagggcccagagccc

SEQ ID NO: 4084999 - DNA, 16 bp, Homo sapiens
cagggcccagagccca

SEQ ID NO: 4085000 - DNA, 18 bp, Homo sapiens
cagggcccagagcccagc

SEQ ID NO: 4085001 - DNA, 21 bp, Homo sapiens
cagggcccccatctcatgccc

SEQ ID NO: 4085002 - DNA, 18 bp, Homo sapiens
cagggcccctcaccctgc

SEQ ID NO: 4085003 - DNA, 22 bp, Homo sapiens
cagggcccctcaccctgcctta

SEQ ID NO: 4085004 - DNA, 17 bp, Homo sapiens
cagggcccgcagtgctg

SEQ ID NO: 4085005 - DNA, 18 bp, Homo sapiens
cagggcccgcagtgctgg

SEQ ID NO: 4085006 - DNA, 21 bp, Homo sapiens
cagggcccgcagtgctgggac

SEQ ID NO: 4085007 - DNA, 15 bp, Homo sapiens
cagggccctggccag

SEQ ID NO: 4085008 - DNA, 16 bp, Homo sapiens
cagggccctggccagc

SEQ ID NO: 4085009 - DNA, 17 bp, Homo sapiens
cagggcccttggggctg

SEQ ID NO: 4085010 - DNA, 19 bp, Homo sapiens
cagggccgatggggcagtc

SEQ ID NO: 4085011 - DNA, 23 bp, Homo sapiens
cagggcctcccgcatcaaggtca

SEQ ID NO: 4085012 - DNA, 19 bp, Homo sapiens
cagggcctgacaccccctc

SEQ ID NO: 4085013 - DNA, 16 bp, Homo sapiens
cagggcctggagcccc

SEQ ID NO: 4085014 - DNA, 17 bp, Homo sapiens
cagggcctggagcccca

SEQ ID NO: 4085015 - DNA, 17 bp, Homo sapiens
cagggcctggcaggcca

SEQ ID NO: 4085016 - DNA, 12 bp, Homo sapiens
cagggcctgggg

SEQ ID NO: 4085017 - DNA, 13 bp, Homo sapiens
cagggcctggggc

SEQ ID NO: 4085018 - DNA, 14 bp, Homo sapiens
cagggcctggggcc

SEQ ID NO: 4085019 - DNA, 15 bp, Homo sapiens
cagggcctggggcct

SEQ ID NO: 4085020 - DNA, 22 bp, Homo sapiens
cagggcctggggcctgagagaa

SEQ ID NO: 4085021 - DNA, 13 bp, Homo sapiens
cagggcgctcaga

SEQ ID NO: 4085022 - DNA, 14 bp, Homo sapiens
cagggcgctcagac

SEQ ID NO: 4085023 - DNA, 15 bp, Homo sapiens
cagggcgctcagacg

SEQ ID NO: 4085024 - DNA, 16 bp, Homo sapiens
cagggcgctcagacgg

SEQ ID NO: 4085025 - DNA, 16 bp, Homo sapiens
cagggcgggcagaggg

SEQ ID NO: 4085026 - DNA, 21 bp, Homo sapiens
cagggcgggcagagggctgga

SEQ ID NO: 4085027 - DNA, 18 bp, Homo sapiens
cagggctagtgacttgtg

SEQ ID NO: 4085028 - DNA, 13 bp, Homo sapiens
cagggctcccgga

SEQ ID NO: 4085029 - DNA, 15 bp, Homo sapiens
cagggctcccggaga

SEQ ID NO: 4085030 - DNA, 18 bp, Homo sapiens
catactcctgggctcaag

SEQ ID NO: 4085031 - DNA, 20 bp, Homo sapiens
catactccttccatcaaata

SEQ ID NO: 4085032 - DNA, 19 bp, Homo sapiens
catactccttgcttcctga

SEQ ID NO: 4085033 - DNA, 14 bp, Homo sapiens
catactctctgcct

SEQ ID NO: 4085034 - DNA, 19 bp, Homo sapiens
catactctctgcctggtgg

SEQ ID NO: 4085035 - DNA, 11 bp, Homo sapiens
catactctgct

SEQ ID NO: 4085036 - DNA, 13 bp, Homo sapiens
catactggcctgg

SEQ ID NO: 4085037 - DNA, 18 bp, Homo sapiens
catactggcctggactgt

SEQ ID NO: 4085038 - DNA, 13 bp, Homo sapiens
catacttatctct

SEQ ID NO: 4085039 - DNA, 22 bp, Homo sapiens
catacttatctctctgtgctgt

SEQ ID NO: 4085040 - DNA, 18 bp, Homo sapiens
catacttcaaaaataatg

SEQ ID NO: 4085041 - DNA, 18 bp, Homo sapiens
catacttgaagggccaga

SEQ ID NO: 4085042 - DNA, 14 bp, Homo sapiens
catactttcctgta

SEQ ID NO: 4085043 - DNA, 15 bp, Homo sapiens
catacttttggctcc

SEQ ID NO: 4085044 - DNA, 11 bp, Homo sapiens
catagaaaaat

SEQ ID NO: 4085045 - DNA, 14 bp, Homo sapiens
catagaccctgagg

SEQ ID NO: 4085046 - DNA, 17 bp, Homo sapiens
catagagatttgtctaa

SEQ ID NO: 4085047 - DNA, 19 bp, Homo sapiens
catagaggcttctccgcca

SEQ ID NO: 4085048 - DNA, 21 bp, Homo sapiens
catagaggcttctccgccagc

SEQ ID NO: 4085049 - DNA, 21 bp, Homo sapiens
catagataggcccctggggct

SEQ ID NO: 4085050 - DNA, 23 bp, Homo sapiens
catagatcagcaaaccggggcct

SEQ ID NO: 4085051 - DNA, 23 bp, Homo sapiens
catcattccctctcatctcaggt

SEQ ID NO: 4085052 - DNA, 13 bp, Homo sapiens
catcattgtttct

SEQ ID NO: 4085053 - DNA, 14 bp, Homo sapiens
catcattttacagt

SEQ ID NO: 4085054 - DNA, 15 bp, Homo sapiens
catcattttattata

SEQ ID NO: 4085055 - DNA, 21 bp, Homo sapiens
catccaaagcagacagctcca

SEQ ID NO: 4085056 - DNA, 14 bp, Homo sapiens
catccaacaagaag

SEQ ID NO: 4085057 - DNA, 14 bp, Homo sapiens
catccaaccttccc

SEQ ID NO: 4085058 - DNA, 16 bp, Homo sapiens
catccaaccttcccaa

SEQ ID NO: 4085059 - DNA, 16 bp, Homo sapiens
catccaccttggctct

SEQ ID NO: 4085060 - DNA, 14 bp, Homo sapiens
catccactctaccc

SEQ ID NO: 4085061 - DNA, 19 bp, Homo sapiens
catccactctaccctccca

SEQ ID NO: 4085062 - DNA, 18 bp, Homo sapiens
catccacttacatatatt

SEQ ID NO: 4085063 - DNA, 21 bp, Homo sapiens
catccagggcccccatctcat

SEQ ID NO: 4085064 - DNA, 19 bp, Homo sapiens
catccagtgacaaaccatc

SEQ ID NO: 4085065 - DNA, 15 bp, Homo sapiens
catccagtttgttct

SEQ ID NO: 4085066 - DNA, 14 bp, Homo sapiens
catccatccttcca

SEQ ID NO: 4085067 - DNA, 22 bp, Homo sapiens
catccatctccagggagcaaga

SEQ ID NO: 4085068 - DNA, 16 bp, Homo sapiens
catccatgtgtggact

SEQ ID NO: 4085069 - DNA, 17 bp, Homo sapiens
catccatgtgtggactc

SEQ ID NO: 4085070 - DNA, 18 bp, Homo sapiens
catccatgttccgagaag

SEQ ID NO: 4085071 - DNA, 19 bp, Homo sapiens
catccattacctccatcca

SEQ ID NO: 4085072 - DNA, 13 bp, Homo sapiens
catccattaggcc

SEQ ID NO: 4085073 - DNA, 18 bp, Homo sapiens
catcccaaccaggcacct

SEQ ID NO: 4085074 - DNA, 16 bp, Homo sapiens
catcccaccccatcct

SEQ ID NO: 4085075 - DNA, 16 bp, Homo sapiens
catcccacccctccat

SEQ ID NO: 4085076 - DNA, 15 bp, Homo sapiens
catcccagcacctgc

SEQ ID NO: 4085077 - DNA, 15 bp, Homo sapiens
catcccagcctgtgg

SEQ ID NO: 4085078 - DNA, 17 bp, Homo sapiens
catcccagcctgtggtt

SEQ ID NO: 4085079 - DNA, 18 bp, Homo sapiens
catcccatgagaccctgg

SEQ ID NO: 4085080 - DNA, 15 bp, Homo sapiens
catcccatgtattta

SEQ ID NO: 4085081 - DNA, 13 bp, Homo sapiens
catccctccccag

SEQ ID NO: 4085082 - DNA, 14 bp, Homo sapiens
catccctccccagt

SEQ ID NO: 4085083 - DNA, 17 bp, Homo sapiens
catccctgaggagccag

SEQ ID NO: 4085084 - DNA, 12 bp, Homo sapiens
catccctgccac

SEQ ID NO: 4085085 - DNA, 18 bp, Homo sapiens
catccctgccacatacag

SEQ ID NO: 4085086 - DNA, 22 bp, Homo sapiens
catccctgccacatacaggtgc

SEQ ID NO: 4085087 - DNA, 18 bp, Homo sapiens
catccctggagcaggagc

SEQ ID NO: 4085088 - DNA, 22 bp, Homo sapiens
catccctggagcaggagccccg

SEQ ID NO: 4085089 - DNA, 11 bp, Homo sapiens
catccctgggc

SEQ ID NO: 4085090 - DNA, 12 bp, Homo sapiens
catccctgggcc

SEQ ID NO: 4085091 - DNA, 19 bp, Homo sapiens
catccctgggcccctccac

SEQ ID NO: 4085092 - DNA, 24 bp, Homo sapiens
catccctgggcccctccacgcctc

SEQ ID NO: 4085093 - DNA, 20 bp, Homo sapiens
catccctgggggccttgggt

SEQ ID NO: 4085094 - DNA, 12 bp, Homo sapiens
catcccttccca

SEQ ID NO: 4085095 - DNA, 18 bp, Homo sapiens
catcccttctcttccagg

SEQ ID NO: 4085096 - DNA, 16 bp, Homo sapiens
catccgaccaggttgt

SEQ ID NO: 4085097 - DNA, 20 bp, Homo sapiens
catccgaccaggttgtcact

SEQ ID NO: 4085098 - DNA, 13 bp, Homo sapiens
catccgcaggtgc

SEQ ID NO: 4085099 - DNA, 17 bp, Homo sapiens
catccggggccagctcc

SEQ ID NO: 4085100 - DNA, 18 bp, Homo sapiens
catccggtggcctattcc

SEQ ID NO: 4085101 - DNA, 20 bp, Homo sapiens
catcctaagaaatatgtgag

SEQ ID NO: 4085102 - DNA, 17 bp, Homo sapiens
catcctatccactgggc

SEQ ID NO: 4085103 - DNA, 22 bp, Homo sapiens
catcctcaaacgacagaggagc

SEQ ID NO: 4085104 - DNA, 17 bp, Homo sapiens
catcctcatccctgact

SEQ ID NO: 4085105 - DNA, 13 bp, Homo sapiens
catcctcccaagg

SEQ ID NO: 4085106 - DNA, 21 bp, Homo sapiens
catcctccctccacctcaaga

SEQ ID NO: 4085107 - DNA, 20 bp, Homo sapiens
catcctccgtccagccgcca

SEQ ID NO: 4085108 - DNA, 16 bp, Homo sapiens
catcctcctccttcct

SEQ ID NO: 4085109 - DNA, 17 bp, Homo sapiens
catcctcctccttccta

SEQ ID NO: 4085110 - DNA, 22 bp, Homo sapiens
catcctcctggaaccttgctgt

SEQ ID NO: 4085111 - DNA, 14 bp, Homo sapiens
catcctcttctgct

SEQ ID NO: 4085112 - DNA, 19 bp, Homo sapiens
catcctgactctgccccct

SEQ ID NO: 4085113 - DNA, 13 bp, Homo sapiens
catcctgccagcc

SEQ ID NO: 4085114 - DNA, 17 bp, Homo sapiens
catcctgccagccccac

SEQ ID NO: 4085115 - DNA, 19 bp, Homo sapiens
catcctgccagccccacac

SEQ ID NO: 4085116 - DNA, 12 bp, Homo sapiens
catcctggctgc

SEQ ID NO: 4085117 - DNA, 23 bp, Homo sapiens
catccttcaagaactctgggctg

SEQ ID NO: 4085118 - DNA, 14 bp, Homo sapiens
catccttcaccaga

SEQ ID NO: 4085119 - DNA, 21 bp, Homo sapiens
catccttcaccagagcccatg

SEQ ID NO: 4085120 - DNA, 22 bp, Homo sapiens
catccttcaccagagcccatgc

SEQ ID NO: 4085121 - DNA, 16 bp, Homo sapiens
catccttccaacatat

SEQ ID NO: 4085122 - DNA, 16 bp, Homo sapiens
catccttcccactctg

SEQ ID NO: 4085123 - DNA, 14 bp, Homo sapiens
catccttccctcat

SEQ ID NO: 4085124 - DNA, 17 bp, Homo sapiens
catccttccgccaatct

SEQ ID NO: 4085125 - DNA, 22 bp, Homo sapiens
catccttccgccaatctggccc

SEQ ID NO: 4085126 - DNA, 23 bp, Homo sapiens
catccttccgccaatctggccct

SEQ ID NO: 4085127 - DNA, 21 bp, Homo sapiens
catccttggtctttgtatctt

SEQ ID NO: 4085128 - DNA, 19 bp, Homo sapiens
catcctttacgtgtttaaa

SEQ ID NO: 4085129 - DNA, 19 bp, Homo sapiens
catcctttcacttctttcc

SEQ ID NO: 4085130 - DNA, 16 bp, Homo sapiens
catcctttgcagggca

SEQ ID NO: 4085131 - DNA, 17 bp, Homo sapiens
catcctttgcagggcag

SEQ ID NO: 4085132 - DNA, 18 bp, Homo sapiens
catcctttgttctgagca

SEQ ID NO: 4085133 - DNA, 21 bp, Homo sapiens
catcgaatctactaattccac

SEQ ID NO: 4085134 - DNA, 14 bp, Homo sapiens
catcgatatgtata

SEQ ID NO: 4085135 - DNA, 17 bp, Homo sapiens
cattgattgtcagctac

SEQ ID NO: 4085136 - DNA, 12 bp, Homo sapiens
cattgcagttta

SEQ ID NO: 4085137 - DNA, 21 bp, Homo sapiens
cattgcatgccgggtgcagca

SEQ ID NO: 4085138 - DNA, 19 bp, Homo sapiens
cattgcattctattgcctt

SEQ ID NO: 4085139 - DNA, 20 bp, Homo sapiens
cattgcattctattgccttc

SEQ ID NO: 4085140 - DNA, 15 bp, Homo sapiens
cattgccccaagata

SEQ ID NO: 4085141 - DNA, 14 bp, Homo sapiens
cattgcggccccag

SEQ ID NO: 4085142 - DNA, 23 bp, Homo sapiens
cattgcgtttgaccttttatgta

SEQ ID NO: 4085143 - DNA, 22 bp, Homo sapiens
cattgctgaaaatggtattttc

SEQ ID NO: 4085144 - DNA, 19 bp, Homo sapiens
ccaaatgctggggcagggg

SEQ ID NO: 4085145 - DNA, 19 bp, Homo sapiens
ccaaatggattcctgtttc

SEQ ID NO: 4085146 - DNA, 18 bp, Homo sapiens
ccaaatgtaattgaataa

SEQ ID NO: 4085147 - DNA, 13 bp, Homo sapiens
ccaaattcagttt

SEQ ID NO: 4085148 - DNA, 14 bp, Homo sapiens
ccaaattgtcacct

SEQ ID NO: 4085149 - DNA, 13 bp, Homo sapiens
ccacgcagttctt

SEQ ID NO: 4085150 - DNA, 17 bp, Homo sapiens
ccacgccccagcccgac

SEQ ID NO: 4085151 - DNA, 14 bp, Homo sapiens
ccacgccctgttca

SEQ ID NO: 4085152 - DNA, 17 bp, Homo sapiens
ccacgcctgtaatccca

SEQ ID NO: 4085153 - DNA, 13 bp, Homo sapiens
ccacgctccagct

SEQ ID NO: 4085154 - DNA, 16 bp, Homo sapiens
ccacgctccagctgcc

SEQ ID NO: 4085155 - DNA, 14 bp, Homo sapiens
ccacgctgtcctct

SEQ ID NO: 4085156 - DNA, 21 bp, Homo sapiens
ccacgctgtcctctcgagccc

SEQ ID NO: 4085157 - DNA, 17 bp, Homo sapiens
ccacgctgtggccctgg

SEQ ID NO: 4085158 - DNA, 22 bp, Homo sapiens
ccacggaggagggatgctgctc

SEQ ID NO: 4085159 - DNA, 16 bp, Homo sapiens
ccacggcctcctttcc

SEQ ID NO: 4085160 - DNA, 15 bp, Homo sapiens
ccacggggagcaaac

SEQ ID NO: 4085161 - DNA, 18 bp, Homo sapiens
ccacgtcgtggggtaaca

SEQ ID NO: 4085162 - DNA, 21 bp, Homo sapiens
ccacgtctggccaggcactgc

SEQ ID NO: 4085163 - DNA, 23 bp, Homo sapiens
ccacgtctggccaggcactgcct

SEQ ID NO: 4085164 - DNA, 21 bp, Homo sapiens
ccacgtcttcttgctgcagcc

SEQ ID NO: 4085165 - DNA, 15 bp, Homo sapiens
ccacgtgtcttccac

SEQ ID NO: 4085166 - DNA, 16 bp, Homo sapiens
ccacgtgtcttccact

SEQ ID NO: 4085167 - DNA, 12 bp, Homo sapiens
ccactaaaaata

SEQ ID NO: 4085168 - DNA, 13 bp, Homo sapiens
ccactaaaaatat

SEQ ID NO: 4085169 - DNA, 16 bp, Homo sapiens
ccactaaaaatattgt

SEQ ID NO: 4085170 - DNA, 23 bp, Homo sapiens
ccactaaaaatattgtttctgca

SEQ ID NO: 4085171 - DNA, 14 bp, Homo sapiens
ccactaaagcttca

SEQ ID NO: 4085172 - DNA, 20 bp, Homo sapiens
ccactaaagcttcagactca

SEQ ID NO: 4085173 - DNA, 15 bp, Homo sapiens
ccactacacctggct

SEQ ID NO: 4085174 - DNA, 20 bp, Homo sapiens
ccactaccccacaccagcct

SEQ ID NO: 4085175 - DNA, 23 bp, Homo sapiens
ccactaccccacaccagccttgg

SEQ ID NO: 4085176 - DNA, 12 bp, Homo sapiens
ccactactgcag

SEQ ID NO: 4085177 - DNA, 14 bp, Homo sapiens
ccactactgcagca

SEQ ID NO: 4085178 - DNA, 21 bp, Homo sapiens
ccactagaactctccatctta

SEQ ID NO: 4085179 - DNA, 16 bp, Homo sapiens
ccactcaccagtgtcc

SEQ ID NO: 4085180 - DNA, 13 bp, Homo sapiens
ccactcaccccct

SEQ ID NO: 4085181 - DNA, 13 bp, Homo sapiens
ccactcaccccgg

SEQ ID NO: 4085182 - DNA, 13 bp, Homo sapiens
ccactcagcttcc

SEQ ID NO: 4085183 - DNA, 19 bp, Homo sapiens
ccactccagacccctggct

SEQ ID NO: 4085184 - DNA, 21 bp, Homo sapiens
ccactccagacccctggcttt

SEQ ID NO: 4085185 - DNA, 14 bp, Homo sapiens
ccactccctatctc

SEQ ID NO: 4085186 - DNA, 21 bp, Homo sapiens
ccactccctatctccttccca

SEQ ID NO: 4085187 - DNA, 17 bp, Homo sapiens
ccactccctgctccacg

SEQ ID NO: 4085188 - DNA, 13 bp, Homo sapiens
ccactcctgctct

SEQ ID NO: 4085189 - DNA, 17 bp, Homo sapiens
ccactcctgctctgctc

SEQ ID NO: 4085190 - DNA, 23 bp, Homo sapiens
ccactcgacccagaatggagcct

SEQ ID NO: 4085191 - DNA, 23 bp, Homo sapiens
ccactcgggaggctgagacagga

SEQ ID NO: 4085192 - DNA, 16 bp, Homo sapiens
ccactctaccctccca

SEQ ID NO: 4085193 - DNA, 19 bp, Homo sapiens
ccactctaccctcccaccc

SEQ ID NO: 4085194 - DNA, 12 bp, Homo sapiens
ccactctcccca

SEQ ID NO: 4085195 - DNA, 17 bp, Homo sapiens
ccactctccccacacta

SEQ ID NO: 4085196 - DNA, 14 bp, Homo sapiens
ccactgagtaccag

SEQ ID NO: 4085197 - DNA, 18 bp, Homo sapiens
ccactgagtaccaggggc

SEQ ID NO: 4085198 - DNA, 17 bp, Homo sapiens
ccactgcccgagctggt

SEQ ID NO: 4085199 - DNA, 20 bp, Homo sapiens
ccactgcccgagctggtgca

SEQ ID NO: 4085200 - DNA, 13 bp, Homo sapiens
ccactgcctgcac

SEQ ID NO: 4085201 - DNA, 14 bp, Homo sapiens
ccactgcctgcacc

SEQ ID NO: 4085202 - DNA, 21 bp, Homo sapiens
ccactgcctgcacctttcggc

SEQ ID NO: 4085203 - DNA, 18 bp, Homo sapiens
ccactgcggggagacaga

SEQ ID NO: 4085204 - DNA, 23 bp, Homo sapiens
ccactgcggggagacagaagcct

SEQ ID NO: 4085205 - DNA, 17 bp, Homo sapiens
ccactgctcgaaatggc

SEQ ID NO: 4085206 - DNA, 13 bp, Homo sapiens
ccactgctggtgc

SEQ ID NO: 4085207 - DNA, 16 bp, Homo sapiens
ccactgctggtgccag

SEQ ID NO: 4085208 - DNA, 18 bp, Homo sapiens
ccactgctggtgccaggg

SEQ ID NO: 4085209 - DNA, 20 bp, Homo sapiens
ccactggaaggaacatggag

SEQ ID NO: 4085210 - DNA, 11 bp, Homo sapiens
ccactggaggt

SEQ ID NO: 4085211 - DNA, 17 bp, Homo sapiens
ccactgggaccaaccct

SEQ ID NO: 4085212 - DNA, 18 bp, Homo sapiens
ccactgggaccaaccctg

SEQ ID NO: 4085213 - DNA, 21 bp, Homo sapiens
ccactgtatgatttataaaca

SEQ ID NO: 4085214 - DNA, 22 bp, Homo sapiens
ccactgtcactgtttctctgct

SEQ ID NO: 4085215 - DNA, 22 bp, Homo sapiens
ccactgtcctaccagttgccct

SEQ ID NO: 4085216 - DNA, 19 bp, Homo sapiens
ccactgtggcgttctgctg

SEQ ID NO: 4085217 - DNA, 21 bp, Homo sapiens
ccactgtggcgttctgctgcc

SEQ ID NO: 4085218 - DNA, 17 bp, Homo sapiens
ccacttaaaaaatgtcc

SEQ ID NO: 4085219 - DNA, 19 bp, Homo sapiens
ccacttaaaaaatgtccat

SEQ ID NO: 4085220 - DNA, 20 bp, Homo sapiens
ccacttacatatatttttaa

SEQ ID NO: 4085221 - DNA, 21 bp, Homo sapiens
ccacttagaaattgcatttcc

SEQ ID NO: 4085222 - DNA, 14 bp, Homo sapiens
ccacttcaaaacaa

SEQ ID NO: 4085223 - DNA, 15 bp, Homo sapiens
ccacttcaaaacaaa

SEQ ID NO: 4085224 - DNA, 13 bp, Homo sapiens
ccacttcactgcg

SEQ ID NO: 4085225 - DNA, 21 bp, Homo sapiens
ccacttcattcttgaaagctg

SEQ ID NO: 4085226 - DNA, 13 bp, Homo sapiens
ccacttccagggg

SEQ ID NO: 4085227 - DNA, 18 bp, Homo sapiens
ccacttcggccaggtcac

SEQ ID NO: 4085228 - DNA, 12 bp, Homo sapiens
ccacttctcccc

SEQ ID NO: 4085229 - DNA, 15 bp, Homo sapiens
ccacttcttcctttc

SEQ ID NO: 4085230 - DNA, 17 bp, Homo sapiens
ccacttcttcctttctc

SEQ ID NO: 4085231 - DNA, 22 bp, Homo sapiens
ccacttcttcctttctctttct

SEQ ID NO: 4085232 - DNA, 14 bp, Homo sapiens
ccacttgaaatgtt

SEQ ID NO: 4085233 - DNA, 17 bp, Homo sapiens
ccacttgggtcttccct

SEQ ID NO: 4085234 - DNA, 18 bp, Homo sapiens
ccactttcatctaccttt

SEQ ID NO: 4085235 - DNA, 17 bp, Homo sapiens
ccactttcttattctgt

SEQ ID NO: 4085236 - DNA, 20 bp, Homo sapiens
ccactttgttctttaggaga

SEQ ID NO: 4085237 - DNA, 15 bp, Homo sapiens
ccagaaagccctctt

SEQ ID NO: 4085238 - DNA, 23 bp, Homo sapiens
ccagaaaggatatttaagaaaat

SEQ ID NO: 4085239 - DNA, 16 bp, Homo sapiens
ccagaaatcattttac

SEQ ID NO: 4085240 - DNA, 22 bp, Homo sapiens
ccagaaatgtctaaatgctgaa

SEQ ID NO: 4085241 - DNA, 17 bp, Homo sapiens
ccagaacaacaactatc

SEQ ID NO: 4085242 - DNA, 22 bp, Homo sapiens
ccagaacacccctaatgagggt

SEQ ID NO: 4085243 - DNA, 16 bp, Homo sapiens
ccagaactctgcctgc

SEQ ID NO: 4085244 - DNA, 19 bp, Homo sapiens
ccagaactctgcctgccct

SEQ ID NO: 4085245 - DNA, 20 bp, Homo sapiens
ccagaactctgcctgccctt

SEQ ID NO: 4085246 - DNA, 15 bp, Homo sapiens
ccagaactctgtgtc

SEQ ID NO: 4085247 - DNA, 14 bp, Homo sapiens
ccagaactgccccc

SEQ ID NO: 4085248 - DNA, 13 bp, Homo sapiens
ccagaacttccct

SEQ ID NO: 4085249 - DNA, 23 bp, Homo sapiens
ccagaagaagagaagctgctgac

SEQ ID NO: 4085250 - DNA, 20 bp, Homo sapiens
ccagcctgctgagagccccc

SEQ ID NO: 4085251 - DNA, 20 bp, Homo sapiens
ccagcctggaaacctgtctg

SEQ ID NO: 4085252 - DNA, 13 bp, Homo sapiens
ccagcctgggagc

SEQ ID NO: 4085253 - DNA, 18 bp, Homo sapiens
ccagcctgggagcccaga

SEQ ID NO: 4085254 - DNA, 22 bp, Homo sapiens
ccagcctgggcagccaggctgc

SEQ ID NO: 4085255 - DNA, 13 bp, Homo sapiens
ccagcctgggcca

SEQ ID NO: 4085256 - DNA, 20 bp, Homo sapiens
ccaaggttggagcccagggc

SEQ ID NO: 4085257 - DNA, 18 bp, Homo sapiens
ccaagtaaacagggtacc

SEQ ID NO: 4085258 - DNA, 14 bp, Homo sapiens
ccaagtatttatta

SEQ ID NO: 4085259 - DNA, 19 bp, Homo sapiens
ccagggtgggtgtccatgt

SEQ ID NO: 4085260 - DNA, 14 bp, Homo sapiens
ccagggtgtgtgct

SEQ ID NO: 4085261 - DNA, 20 bp, Homo sapiens
ccaggtaccacccttcagac

SEQ ID NO: 4085262 - DNA, 15 bp, Homo sapiens
ccaggtaccagctgc

SEQ ID NO: 4085263 - DNA, 19 bp, Homo sapiens
ccaggtaccagctgcgctt

SEQ ID NO: 4085264 - DNA, 23 bp, Homo sapiens
ccaggtaccagctgcgcttgctt

SEQ ID NO: 4085265 - DNA, 14 bp, Homo sapiens
ccaggtatggctct

SEQ ID NO: 4085266 - DNA, 15 bp, Homo sapiens
ccaggtatggctctg

SEQ ID NO: 4085267 - DNA, 20 bp, Homo sapiens
ccaggtcaccaagcagtggc

SEQ ID NO: 4085268 - DNA, 21 bp, Homo sapiens
caggcagatctgtgccccatg

SEQ ID NO: 4085269 - DNA, 18 bp, Homo sapiens
caggcagctttctagaag

SEQ ID NO: 4085270 - DNA, 16 bp, Homo sapiens
caggcaggggccctgc

SEQ ID NO: 4085271 - DNA, 21 bp, Homo sapiens
caggcaggggccctgcagctc

SEQ ID NO: 4085272 - DNA, 12 bp, Homo sapiens
caggcaggggtg

SEQ ID NO: 4085273 - DNA, 13 bp, Homo sapiens
caggcaggggtgg

SEQ ID NO: 4085274 - DNA, 17 bp, Homo sapiens
caggcaggggtgggggt

SEQ ID NO: 4085275 - DNA, 16 bp, Homo sapiens
caggcaggtgcctgga

SEQ ID NO: 4085276 - DNA, 18 bp, Homo sapiens
caggcatagaggcttctc

SEQ ID NO: 4085277 - DNA, 21 bp, Homo sapiens
caggcatagaggcttctccgc

SEQ ID NO: 4085278 - DNA, 15 bp, Homo sapiens
caggcataggcctgg

SEQ ID NO: 4085279 - DNA, 12 bp, Homo sapiens
caggcatcctcc

SEQ ID NO: 4085280 - DNA, 16 bp, Homo sapiens
caggcatctacacagc

SEQ ID NO: 4085281 - DNA, 22 bp, Homo sapiens
caggcatgaggaatctgggagg

SEQ ID NO: 4085282 - DNA, 17 bp, Homo sapiens
caggcatggacatgcag

SEQ ID NO: 4085283 - DNA, 14 bp, Homo sapiens
caggcattgaggaa

SEQ ID NO: 4085284 - DNA, 23 bp, Homo sapiens
caggcatttgactgaagatgcag

SEQ ID NO: 4085285 - DNA, 13 bp, Homo sapiens
caggcatttgttc

SEQ ID NO: 4085286 - DNA, 13 bp, Homo sapiens
caggccagcccag

SEQ ID NO: 4085287 - DNA, 16 bp, Homo sapiens
caggccagcccagcca

SEQ ID NO: 4085288 - DNA, 16 bp, Homo sapiens
caggccagcctccgag

SEQ ID NO: 4085289 - DNA, 19 bp, Homo sapiens
caggccagcctccgagagg

SEQ ID NO: 4085290 - DNA, 21 bp, Homo sapiens
caggccagcctccgagaggga

SEQ ID NO: 4085291 - DNA, 23 bp, Homo sapiens
caggccagcctccgagagggaga

SEQ ID NO: 4085292 - DNA, 18 bp, Homo sapiens
caggccaggccaccagga

SEQ ID NO: 4085293 - DNA, 15 bp, Homo sapiens
caggcccaactgtga

SEQ ID NO: 4085294 - DNA, 22 bp, Homo sapiens
caggcccaactgtgagcaagga

SEQ ID NO: 4085295 - DNA, 17 bp, Homo sapiens
caggcccaaggctcccg

SEQ ID NO: 4085296 - DNA, 15 bp, Homo sapiens
caggcccagcgcggc

SEQ ID NO: 4085297 - DNA, 12 bp, Homo sapiens
caggcccaggga

SEQ ID NO: 4085298 - DNA, 17 bp, Homo sapiens
caggcccagggagggaa

SEQ ID NO: 4085299 - DNA, 18 bp, Homo sapiens
caggcccatgccaaggcc

SEQ ID NO: 4085300 - DNA, 16 bp, Homo sapiens
caggccccagacaggg

SEQ ID NO: 4085301 - DNA, 15 bp, Homo sapiens
caggcccccagtggg

SEQ ID NO: 4085302 - DNA, 21 bp, Homo sapiens
caggcccgcaccccggcctca

SEQ ID NO: 4085303 - DNA, 16 bp, Homo sapiens
caggccctccctgact

SEQ ID NO: 4085304 - DNA, 23 bp, Homo sapiens
caggccctccctgactccctgtg

SEQ ID NO: 4085305 - DNA, 16 bp, Homo sapiens
caggccctcctctccc

SEQ ID NO: 4085306 - DNA, 13 bp, Homo sapiens
caggccctgactc

SEQ ID NO: 4085307 - DNA, 21 bp, Homo sapiens
caggccctgactcctctggct

SEQ ID NO: 4085308 - DNA, 16 bp, Homo sapiens
caggccctgctcctgc

SEQ ID NO: 4085309 - DNA, 17 bp, Homo sapiens
caggccctgctcctgca

SEQ ID NO: 4085310 - DNA, 19 bp, Homo sapiens
caggccctgctcctgcagc

SEQ ID NO: 4085311 - DNA, 15 bp, Homo sapiens
caggcccttcctctc

SEQ ID NO: 4085312 - DNA, 17 bp, Homo sapiens
caggcccttcctctcca

SEQ ID NO: 4085313 - DNA, 17 bp, Homo sapiens
caggccggaaccacagg

SEQ ID NO: 4085314 - DNA, 18 bp, Homo sapiens
caggccggaaccacaggg

SEQ ID NO: 4085315 - DNA, 19 bp, Homo sapiens
caggccggaaccacagggc

SEQ ID NO: 4085316 - DNA, 20 bp, Homo sapiens
caggccggaaccacagggcc

SEQ ID NO: 4085317 - DNA, 13 bp, Homo sapiens
caggccgggcaga

SEQ ID NO: 4085318 - DNA, 20 bp, Homo sapiens
caggccggggtggagcatgg

SEQ ID NO: 4085319 - DNA, 14 bp, Homo sapiens
caggccgtgccttg

SEQ ID NO: 4085320 - DNA, 16 bp, Homo sapiens
caggccgtgccttgtt

SEQ ID NO: 4085321 - DNA, 14 bp, Homo sapiens
caggcctccctctc

SEQ ID NO: 4085322 - DNA, 17 bp, Homo sapiens
caggcctccctctctct

SEQ ID NO: 4085323 - DNA, 22 bp, Homo sapiens
caggcctccctctctcttctgc

SEQ ID NO: 4085324 - DNA, 16 bp, Homo sapiens
caggcctccctgccag

SEQ ID NO: 4085325 - DNA, 15 bp, Homo sapiens
caggcctctgctgcc

SEQ ID NO: 4085326 - DNA, 15 bp, Homo sapiens
caggcctctgtgtcc

SEQ ID NO: 4085327 - DNA, 15 bp, Homo sapiens
caggcctgaaagagg

SEQ ID NO: 4085328 - DNA, 22 bp, Homo sapiens
caggcctgaaagaggctgaggc

SEQ ID NO: 4085329 - DNA, 18 bp, Homo sapiens
caggcctgatcttgcctg

SEQ ID NO: 4085330 - DNA, 17 bp, Homo sapiens
caggcctgcctcccact

SEQ ID NO: 4085331 - DNA, 21 bp, Homo sapiens
caggcctggctggaggagcag

SEQ ID NO: 4085332 - DNA, 14 bp, Homo sapiens
caggcctgggtctg

SEQ ID NO: 4085333 - DNA, 13 bp, Homo sapiens
caggcctgggttt

SEQ ID NO: 4085334 - DNA, 15 bp, Homo sapiens
caggcctgtgcccac

SEQ ID NO: 4085335 - DNA, 17 bp, Homo sapiens
caggcctgtgcccactc

SEQ ID NO: 4085336 - DNA, 13 bp, Homo sapiens
caggcctgttgct

SEQ ID NO: 4085337 - DNA, 23 bp, Homo sapiens
caggcctgttgctatagagccta

SEQ ID NO: 4085338 - DNA, 22 bp, Homo sapiens
caggcgatggggcaagacagaa

SEQ ID NO: 4085339 - DNA, 16 bp, Homo sapiens
caggcgctagcacagc

SEQ ID NO: 4085340 - DNA, 22 bp, Homo sapiens
caggcgctagcacagctccctt

SEQ ID NO: 4085341 - DNA, 15 bp, Homo sapiens
caggcggggtgctgt

SEQ ID NO: 4085342 - DNA, 21 bp, Homo sapiens
caggcggtccccatccccacc

SEQ ID NO: 4085343 - DNA, 22 bp, Homo sapiens
caggcggtccccatccccacca

SEQ ID NO: 4085344 - DNA, 23 bp, Homo sapiens
caggctaaacatccaatattttc

SEQ ID NO: 4085345 - DNA, 22 bp, Homo sapiens
caggctaaatgcaccaagaaag

SEQ ID NO: 4085346 - DNA, 15 bp, Homo sapiens
caggctcactgccag

SEQ ID NO: 4085347 - DNA, 16 bp, Homo sapiens
caggctcactgccagg

SEQ ID NO: 4085348 - DNA, 18 bp, Homo sapiens
caggctcactgccaggcc

SEQ ID NO: 4085349 - DNA, 15 bp, Homo sapiens
caggctctgtggagg

SEQ ID NO: 4085350 - DNA, 21 bp, Homo sapiens
caggctcttagcagcttccag

SEQ ID NO: 4085351 - DNA, 14 bp, Homo sapiens
caggctcttctcct

SEQ ID NO: 4085352 - DNA, 18 bp, Homo sapiens
caggctgaagcaggttcc

SEQ ID NO: 4085353 - DNA, 17 bp, Homo sapiens
caggctgaccacagcac

SEQ ID NO: 4085354 - DNA, 20 bp, Homo sapiens
caggctgagccactctcttc

SEQ ID NO: 4085355 - DNA, 16 bp, Homo sapiens
caggctgagtgagcca

SEQ ID NO: 4085356 - DNA, 15 bp, Homo sapiens
caggctgcagaggca

SEQ ID NO: 4085357 - DNA, 20 bp, Homo sapiens
caggctgcctcctgccctta

SEQ ID NO: 4085358 - DNA, 12 bp, Homo sapiens
caggctgcttgg

SEQ ID NO: 4085359 - DNA, 15 bp, Homo sapiens
caggctggagacccc

SEQ ID NO: 4085360 - DNA, 16 bp, Homo sapiens
caggctggagaccccc

SEQ ID NO: 4085361 - DNA, 18 bp, Homo sapiens
caggctgggaactcatct

SEQ ID NO: 4085362 - DNA, 20 bp, Homo sapiens
caggctgggacggaccagca

SEQ ID NO: 4085363 - DNA, 14 bp, Homo sapiens
caggctgggcagcc

SEQ ID NO: 4085364 - DNA, 16 bp, Homo sapiens
caggctgggcagcccc

SEQ ID NO: 4085365 - DNA, 17 bp, Homo sapiens
caggctgggcagcccca

SEQ ID NO: 4085366 - DNA, 18 bp, Homo sapiens
caggctgggccatgtcca

SEQ ID NO: 4085367 - DNA, 22 bp, Homo sapiens
caggctgggccatgtccaaaga

SEQ ID NO: 4085368 - DNA, 13 bp, Homo sapiens
caggctgtcctta

SEQ ID NO: 4085369 - DNA, 12 bp, Homo sapiens
caggctgttctc

SEQ ID NO: 4085370 - DNA, 18 bp, Homo sapiens
caggctgttctccaggct

SEQ ID NO: 4085371 - DNA, 19 bp, Homo sapiens
cagctgtaagaagagactg

SEQ ID NO: 4085372 - DNA, 21 bp, Homo sapiens
cagctgtaagaagagactggg

SEQ ID NO: 4085373 - DNA, 17 bp, Homo sapiens
cagctgtacttcgtctt

SEQ ID NO: 4085374 - DNA, 16 bp, Homo sapiens
cagctgtcctgcagca

SEQ ID NO: 4085375 - DNA, 13 bp, Homo sapiens
cagctgtgcactt

SEQ ID NO: 4085376 - DNA, 17 bp, Homo sapiens
cagctgtgcagcacgtc

SEQ ID NO: 4085377 - DNA, 23 bp, Homo sapiens
cagctgtgtccggcccagttttg

SEQ ID NO: 4085378 - DNA, 17 bp, Homo sapiens
cagctgttgtctcttct

SEQ ID NO: 4085379 - DNA, 24 bp, Homo sapiens
cagctgtttctagagttcctacca

SEQ ID NO: 4085380 - DNA, 13 bp, Homo sapiens
cagctgtttctca

SEQ ID NO: 4085381 - DNA, 14 bp, Homo sapiens
cagctgtttctcat

SEQ ID NO: 4085382 - DNA, 15 bp, Homo sapiens
cagctgtttgtcata

SEQ ID NO: 4085383 - DNA, 16 bp, Homo sapiens
cagcttagatttcata

SEQ ID NO: 4085384 - DNA, 19 bp, Homo sapiens
cagcttagatttcatagtt

SEQ ID NO: 4085385 - DNA, 18 bp, Homo sapiens
cagcttatctcttttata

SEQ ID NO: 4085386 - DNA, 21 bp, Homo sapiens
cagcttatctcttttatattt

SEQ ID NO: 4085387 - DNA, 16 bp, Homo sapiens
cagcttcaagtgcctt

SEQ ID NO: 4085388 - DNA, 14 bp, Homo sapiens
cagcttcaccagag

SEQ ID NO: 4085389 - DNA, 16 bp, Homo sapiens
cagcttcaccagagca

SEQ ID NO: 4085390 - DNA, 14 bp, Homo sapiens
cagcttcacttctg

SEQ ID NO: 4085391 - DNA, 15 bp, Homo sapiens
cagcttcacttctga

SEQ ID NO: 4085392 - DNA, 13 bp, Homo sapiens
cagcttcaggcac

SEQ ID NO: 4085393 - DNA, 23 bp, Homo sapiens
cagcttcaggcaccagcatccac

SEQ ID NO: 4085394 - DNA, 20 bp, Homo sapiens
cagcttcctacccacacctc

SEQ ID NO: 4085395 - DNA, 13 bp, Homo sapiens
cagcttcctcaca

SEQ ID NO: 4085396 - DNA, 14 bp, Homo sapiens
cagcttcctcacac

SEQ ID NO: 4085397 - DNA, 15 bp, Homo sapiens
cagcttcctcacacc

SEQ ID NO: 4085398 - DNA, 19 bp, Homo sapiens
cagcttcctcacacccctg

SEQ ID NO: 4085399 - DNA, 20 bp, Homo sapiens
cagcttcggagggcccctgc

SEQ ID NO: 4085400 - DNA, 16 bp, Homo sapiens
cagcttctactcctgc

SEQ ID NO: 4085401 - DNA, 17 bp, Homo sapiens
cagcttctactcctgcc

SEQ ID NO: 4085402 - DNA, 13 bp, Homo sapiens
cagcttctccagg

SEQ ID NO: 4085403 - DNA, 18 bp, Homo sapiens
cagcttctctctccaggg

SEQ ID NO: 4085404 - DNA, 20 bp, Homo sapiens
cagcttcttcctaggtccaa

SEQ ID NO: 4085405 - DNA, 18 bp, Homo sapiens
cagcttgagtttttagtg

SEQ ID NO: 4085406 - DNA, 17 bp, Homo sapiens
cagcttggccctttcct

SEQ ID NO: 4085407 - DNA, 17 bp, Homo sapiens
cagcttgttatttataa

SEQ ID NO: 4085408 - DNA, 19 bp, Homo sapiens
cagcttgttctgggctcag

SEQ ID NO: 4085409 - DNA, 19 bp, Homo sapiens
cagctttaaactcagggac

SEQ ID NO: 4085410 - DNA, 22 bp, Homo sapiens
cagctttaaactcagggacaga

SEQ ID NO: 4085411 - DNA, 14 bp, Homo sapiens
cagctttcagggcc

SEQ ID NO: 4085412 - DNA, 16 bp, Homo sapiens
cagctttcagggccat

SEQ ID NO: 4085413 - DNA, 16 bp, Homo sapiens
cagctttcatgattag

SEQ ID NO: 4085414 - DNA, 20 bp, Homo sapiens
cagctttcatgattagcaag

SEQ ID NO: 4085415 - DNA, 13 bp, Homo sapiens
cagctttccagta

SEQ ID NO: 4085416 - DNA, 16 bp, Homo sapiens
cagctttgatccctga

SEQ ID NO: 4085417 - DNA, 18 bp, Homo sapiens
cagcttttgttgtttata

SEQ ID NO: 4085418 - DNA, 21 bp, Homo sapiens
caggaaaaaaaaaaaaaagac

SEQ ID NO: 4085419 - DNA, 23 bp, Homo sapiens
caggaaaattgtttgaacccagg

SEQ ID NO: 4085420 - DNA, 19 bp, Homo sapiens
caggaaactccacatctgc

SEQ ID NO: 4085421 - DNA, 20 bp, Homo sapiens
caggaaactccacatctgcc

SEQ ID NO: 4085422 - DNA, 23 bp, Homo sapiens
caggaaactccacatctgcctta

SEQ ID NO: 4085423 - DNA, 23 bp, Homo sapiens
caggaaagccctcccccttcccc

SEQ ID NO: 4085424 - DNA, 13 bp, Homo sapiens
caggaaatatata

SEQ ID NO: 4085425 - DNA, 16 bp, Homo sapiens
caggaaatatatatgt

SEQ ID NO: 4085426 - DNA, 22 bp, Homo sapiens
caggaacacccgactcctcaaa

SEQ ID NO: 4085427 - DNA, 14 bp, Homo sapiens
caggaacagaagga

SEQ ID NO: 4085428 - DNA, 22 bp, Homo sapiens
caggaacagctatgggagcccc

SEQ ID NO: 4085429 - DNA, 16 bp, Homo sapiens
caggaacagtggctgg

SEQ ID NO: 4085430 - DNA, 15 bp, Homo sapiens
caggaactcccagca

SEQ ID NO: 4085431 - DNA, 22 bp, Homo sapiens
caggaactcgcacctgtgctgg

SEQ ID NO: 4085432 - DNA, 22 bp, Homo sapiens
caggaactggggctttgccttg

SEQ ID NO: 4085433 - DNA, 14 bp, Homo sapiens
caggaagagctatg

SEQ ID NO: 4085434 - DNA, 21 bp, Homo sapiens
caggaagatgaaagaggaggt

SEQ ID NO: 4085435 - DNA, 16 bp, Homo sapiens
caggaagcaccccatg

SEQ ID NO: 4085436 - DNA, 18 bp, Homo sapiens
caggaagcattcagagag

SEQ ID NO: 4085437 - DNA, 20 bp, Homo sapiens
caggaagcattcagagagca

SEQ ID NO: 4085438 - DNA, 22 bp, Homo sapiens
caggaagcattcagagagcagc

SEQ ID NO: 4085439 - DNA, 12 bp, Homo sapiens
caggaagccaga

SEQ ID NO: 4085440 - DNA, 19 bp, Homo sapiens
caggaagcctgcagtcctg

SEQ ID NO: 4085441 - DNA, 19 bp, Homo sapiens
caggaagctctcttaaaat

SEQ ID NO: 4085442 - DNA, 20 bp, Homo sapiens
caggaagctggcagaacgga

SEQ ID NO: 4085443 - DNA, 15 bp, Homo sapiens
caggaaggagagcct

SEQ ID NO: 4085444 - DNA, 17 bp, Homo sapiens
caggaaggaggggagag

SEQ ID NO: 4085445 - DNA, 22 bp, Homo sapiens
caggaagggcctacagcccatt

SEQ ID NO: 4085446 - DNA, 20 bp, Homo sapiens
caggaaggtagcccagcact

SEQ ID NO: 4085447 - DNA, 16 bp, Homo sapiens
caggaagtcttcaggg

SEQ ID NO: 4085448 - DNA, 23 bp, Homo sapiens
caggaataaggccttaatatgtt

SEQ ID NO: 4085449 - DNA, 18 bp, Homo sapiens
caggaatcaaaaattgaa

SEQ ID NO: 4085450 - DNA, 17 bp, Homo sapiens
caggaatcaagagctgc

SEQ ID NO: 4085451 - DNA, 16 bp, Homo sapiens
caggaatgtgtggcct

SEQ ID NO: 4085452 - DNA, 19 bp, Homo sapiens
caggaatgtgtggcctgca

SEQ ID NO: 4085453 - DNA, 19 bp, Homo sapiens
caggaatttcccaggaccc

SEQ ID NO: 4085454 - DNA, 21 bp, Homo sapiens
caggaatttcccaggaccctg

SEQ ID NO: 4085455 - DNA, 21 bp, Homo sapiens
caggacaccacgattctccca

SEQ ID NO: 4085456 - DNA, 15 bp, Homo sapiens
caggacagagttcac

SEQ ID NO: 4085457 - DNA, 17 bp, Homo sapiens
caggacagagttcacag

SEQ ID NO: 4085458 - DNA, 18 bp, Homo sapiens
caggacagagttcacagg

SEQ ID NO: 4085459 - DNA, 22 bp, Homo sapiens
caggacagagttcacaggaggc

SEQ ID NO: 4085460 - DNA, 20 bp, Homo sapiens
caggacagcatcccttccca

SEQ ID NO: 4085461 - DNA, 13 bp, Homo sapiens
caggacaggaggc

SEQ ID NO: 4085462 - DNA, 17 bp, Homo sapiens
caggacaggaggcggcc

SEQ ID NO: 4085463 - DNA, 21 bp, Homo sapiens
caggacaggaggcggcccggc

SEQ ID NO: 4085464 - DNA, 21 bp, Homo sapiens
caggacatgcggtagccagca

SEQ ID NO: 4085465 - DNA, 13 bp, Homo sapiens
caggaccaagcca

SEQ ID NO: 4085466 - DNA, 12 bp, Homo sapiens
caggaccacaaa

SEQ ID NO: 4085467 - DNA, 13 bp, Homo sapiens
caggaccagctca

SEQ ID NO: 4085468 - DNA, 15 bp, Homo sapiens
caggaccagctcagg

SEQ ID NO: 4085469 - DNA, 16 bp, Homo sapiens
caggaccagctcagga

SEQ ID NO: 4085470 - DNA, 14 bp, Homo sapiens
caggaccctgaagg

SEQ ID NO: 4085471 - DNA, 17 bp, Homo sapiens
caggaccctgaaggggc

SEQ ID NO: 4085472 - DNA, 20 bp, Homo sapiens
caggaccctgacctccgccc

SEQ ID NO: 4085473 - DNA, 19 bp, Homo sapiens
caggacctctgtaggcagc

SEQ ID NO: 4085474 - DNA, 13 bp, Homo sapiens
caggacctggcat

SEQ ID NO: 4085475 - DNA, 14 bp, Homo sapiens
caggacctggctgc

SEQ ID NO: 4085476 - DNA, 16 bp, Homo sapiens
caggacctggctgcca

SEQ ID NO: 4085477 - DNA, 21 bp, Homo sapiens
caggacggctcctcagagcgc

SEQ ID NO: 4085478 - DNA, 23 bp, Homo sapiens
caggacggctcctcagagcgcca

SEQ ID NO: 4085479 - DNA, 18 bp, Homo sapiens
caggactatagcccaggt

SEQ ID NO: 4085480 - DNA, 16 bp, Homo sapiens
caggactccaggccca

SEQ ID NO: 4085481 - DNA, 15 bp, Homo sapiens
caggactccccaggc

SEQ ID NO: 4085482 - DNA, 16 bp, Homo sapiens
caggactccccaggcc

SEQ ID NO: 4085483 - DNA, 17 bp, Homo sapiens
caggactccccaggcca

SEQ ID NO: 4085484 - DNA, 19 bp, Homo sapiens
caggactccccaggccagg

SEQ ID NO: 4085485 - DNA, 20 bp, Homo sapiens
caggactccccaggccaggc

SEQ ID NO: 4085486 - DNA, 17 bp, Homo sapiens
caggactccctcctcac

SEQ ID NO: 4085487 - DNA, 21 bp, Homo sapiens
caggactgagtcccctccagg

SEQ ID NO: 4085488 - DNA, 20 bp, Homo sapiens
caggacttaacggctccagg

SEQ ID NO: 4085489 - DNA, 17 bp, Homo sapiens
caggacttggggtcagg

SEQ ID NO: 4085490 - DNA, 19 bp, Homo sapiens
caggacttggggtcaggaa

SEQ ID NO: 4085491 - DNA, 14 bp, Homo sapiens
caggagaaactgct

SEQ ID NO: 4085492 - DNA, 13 bp, Homo sapiens
caggagacgacag

SEQ ID NO: 4085493 - DNA, 15 bp, Homo sapiens
caggagagagcagca

SEQ ID NO: 4085494 - DNA, 17 bp, Homo sapiens
caggagatggagggctt

SEQ ID NO: 4085495 - DNA, 18 bp, Homo sapiens
caggagcaatgggactgg

SEQ ID NO: 4085496 - DNA, 19 bp, Homo sapiens
caggagcaatgggactgga

SEQ ID NO: 4085497 - DNA, 16 bp, Homo sapiens
caggagcacaggcagc

SEQ ID NO: 4085498 - DNA, 17 bp, Homo sapiens
caggagcacaggcagct

SEQ ID NO: 4085499 - DNA, 18 bp, Homo sapiens
caggagcacaggcagctg

SEQ ID NO: 4085500 - DNA, 18 bp, Homo sapiens
caggagcagtttgccacc

SEQ ID NO: 4085501 - DNA, 16 bp, Homo sapiens
caggagcctagcggag

SEQ ID NO: 4085502 - DNA, 16 bp, Homo sapiens
caggagcgctcccttg

SEQ ID NO: 4085503 - DNA, 22 bp, Homo sapiens
caggagcgctcccttgacctgc

SEQ ID NO: 4085504 - DNA, 19 bp, Homo sapiens
caggagctcttcaggcctc

SEQ ID NO: 4085505 - DNA, 17 bp, Homo sapiens
caggagctgatggcagc

SEQ ID NO: 4085506 - DNA, 18 bp, Homo sapiens
caggagctgatggcagct

SEQ ID NO: 4085507 - DNA, 20 bp, Homo sapiens
caggagctgatggcagctgg

SEQ ID NO: 4085508 - DNA, 17 bp, Homo sapiens
caggagcttgggcagtg

SEQ ID NO: 4085509 - DNA, 18 bp, Homo sapiens
caggaggaggagatggcc

SEQ ID NO: 4085510 - DNA, 22 bp, Homo sapiens
caggaggattgcttgagcccag

SEQ ID NO: 4085511 - DNA, 14 bp, Homo sapiens
caggaggcagaagg

SEQ ID NO: 4085512 - DNA, 15 bp, Homo sapiens
caggaggccaataaa

SEQ ID NO: 4085513 - DNA, 19 bp, Homo sapiens
caggaggccaataaaaagt

SEQ ID NO: 4085514 - DNA, 22 bp, Homo sapiens
caggaggccaataaaaagttca

SEQ ID NO: 4085515 - DNA, 16 bp, Homo sapiens
caggaggcggcccggc

SEQ ID NO: 4085516 - DNA, 17 bp, Homo sapiens
caggaggcggcccggcc

SEQ ID NO: 4085517 - DNA, 12 bp, Homo sapiens
caggaggctgag

SEQ ID NO: 4085518 - DNA, 16 bp, Homo sapiens
caggaggctgaggcag

SEQ ID NO: 4085519 - DNA, 21 bp, Homo sapiens
caggaggctgaggcaggagga

SEQ ID NO: 4085520 - DNA, 23 bp, Homo sapiens
caggagggaggtttgtgagagcg

SEQ ID NO: 4085521 - DNA, 20 bp, Homo sapiens
caggaggggaactgagtcac

SEQ ID NO: 4085522 - DNA, 21 bp, Homo sapiens
caggaggggaactgagtcacg

SEQ ID NO: 4085523 - DNA, 16 bp, Homo sapiens
caggaggggtctcatg

SEQ ID NO: 4085524 - DNA, 20 bp, Homo sapiens
caggaggggtctcatgtcct

SEQ ID NO: 4085525 - DNA, 20 bp, Homo sapiens
caggaggtggaggctgcagt

SEQ ID NO: 4085526 - DNA, 22 bp, Homo sapiens
caggagtagtgaagactccaga

SEQ ID NO: 4085527 - DNA, 13 bp, Homo sapiens
caggagtcagtgt

SEQ ID NO: 4085528 - DNA, 14 bp, Homo sapiens
caggagtcagtgtc

SEQ ID NO: 4085529 - DNA, 21 bp, Homo sapiens
caggagtcagtgtctggcttt

SEQ ID NO: 4085530 - DNA, 15 bp, Homo sapiens
caggagtcccaagga

SEQ ID NO: 4085531 - DNA, 23 bp, Homo sapiens
caggagtctctgccacccactca

SEQ ID NO: 4085532 - DNA, 17 bp, Homo sapiens
caggagtggtgcagaca

SEQ ID NO: 4085533 - DNA, 17 bp, Homo sapiens
caggagtgtcctcttcc

SEQ ID NO: 4085534 - DNA, 19 bp, Homo sapiens
caggagtgtcctcttccct

SEQ ID NO: 4085535 - DNA, 21 bp, Homo sapiens
caggagtgtcctcttccctct

SEQ ID NO: 4085536 - DNA, 17 bp, Homo sapiens
caggagtgtcctgccca

SEQ ID NO: 4085537 - DNA, 19 bp, Homo sapiens
caggagttaaaaagggcag

SEQ ID NO: 4085538 - DNA, 19 bp, Homo sapiens
caggagttcgaggctgcag

SEQ ID NO: 4085539 - DNA, 20 bp, Homo sapiens
caggagttgtttctgaccca

SEQ ID NO: 4085540 - DNA, 14 bp, Homo sapiens
caggataaggagac

SEQ ID NO: 4085541 - DNA, 23 bp, Homo sapiens
caggatatcacattggagtcact

SEQ ID NO: 4085542 - DNA, 13 bp, Homo sapiens
caggatattagtt

SEQ ID NO: 4085543 - DNA, 20 bp, Homo sapiens
caggatattagttaatgagc

SEQ ID NO: 4085544 - DNA, 15 bp, Homo sapiens
caggatcagttaact

SEQ ID NO: 4085545 - DNA, 16 bp, Homo sapiens
caggatcatggtgtaa

SEQ ID NO: 4085546 - DNA, 16 bp, Homo sapiens
caggatcccaggggcc

SEQ ID NO: 4085547 - DNA, 17 bp, Homo sapiens
caggatgacctggataa

SEQ ID NO: 4085548 - DNA, 21 bp, Homo sapiens
caggatggaggggtggtcctg

SEQ ID NO: 4085549 - DNA, 22 bp, Homo sapiens
caggatggaggggtggtcctga

SEQ ID NO: 4085550 - DNA, 23 bp, Homo sapiens
caggatggaggggtggtcctgac

SEQ ID NO: 4085551 - DNA, 22 bp, Homo sapiens
caggatggcctttccttccctc

SEQ ID NO: 4085552 - DNA, 19 bp, Homo sapiens
caggatgggggctggcctc

SEQ ID NO: 4085553 - DNA, 21 bp, Homo sapiens
caggatgtagttctgccaggc

SEQ ID NO: 4085554 - DNA, 13 bp, Homo sapiens
caggattgaagag

SEQ ID NO: 4085555 - DNA, 12 bp, Homo sapiens
caggatttctaa

SEQ ID NO: 4085556 - DNA, 22 bp, Homo sapiens
caggattttaacaaaagcaaga

SEQ ID NO: 4085557 - DNA, 19 bp, Homo sapiens
caggcaaaaaagggacagc

SEQ ID NO: 4085558 - DNA, 15 bp, Homo sapiens
caggcacacacagcc

SEQ ID NO: 4085559 - DNA, 18 bp, Homo sapiens
caggcacacacagcccct

SEQ ID NO: 4085560 - DNA, 23 bp, Homo sapiens
caggcacacagctactctcccca

SEQ ID NO: 4085561 - DNA, 15 bp, Homo sapiens
caggcacagggcccg

SEQ ID NO: 4085562 - DNA, 18 bp, Homo sapiens
caggcacagggcccgcag

SEQ ID NO: 4085563 - DNA, 16 bp, Homo sapiens
caggcaccagcatcca

SEQ ID NO: 4085564 - DNA, 16 bp, Homo sapiens
caggcaccctcaggga

SEQ ID NO: 4085565 - DNA, 18 bp, Homo sapiens
caggcaccctcagggagc

SEQ ID NO: 4085566 - DNA, 22 bp, Homo sapiens
caggcaccctcagggagcctcc

SEQ ID NO: 4085567 - DNA, 21 bp, Homo sapiens
caggcaccgccacgtcccagc

SEQ ID NO: 4085568 - DNA, 22 bp, Homo sapiens
caggcaccgccacgtcccagca

SEQ ID NO: 4085569 - DNA, 23 bp, Homo sapiens
caggcaccgccacgtcccagcat

SEQ ID NO: 4085570 - DNA, 21 bp, Homo sapiens
caggcagactacacaggatga

SEQ ID NO: 4085571 - DNA, 15 bp, Homo sapiens
caggcagagaatcat

SEQ ID NO: 4085572 - DNA, 13 bp, Homo sapiens
caggcagatccag

SEQ ID NO: 4085573 - DNA, 15 bp, Homo sapiens
caggcagatccagga

SEQ ID NO: 4085574 - DNA, 13 bp, Homo sapiens
caggcagatctgt

SEQ ID NO: 4085575 - DNA, 15 bp, Homo sapiens
caggcagatctgtgc

SEQ ID NO: 4085576 - DNA, 15 bp, Homo sapiens
cactggatgcagaaa

SEQ ID NO: 4085577 - DNA, 16 bp, Homo sapiens
cactggctaaagataa

SEQ ID NO: 4085578 - DNA, 17 bp, Homo sapiens
cactggctggcctgagc

SEQ ID NO: 4085579 - DNA, 15 bp, Homo sapiens
cactggctggctcct

SEQ ID NO: 4085580 - DNA, 18 bp, Homo sapiens
cactggctggctcctagg

SEQ ID NO: 4085581 - DNA, 22 bp, Homo sapiens
cactggctgtcagtatgacatt

SEQ ID NO: 4085582 - DNA, 22 bp, Homo sapiens
cactggcttggaacaccttggg

SEQ ID NO: 4085583 - DNA, 17 bp, Homo sapiens
cactgggaggcagggct

SEQ ID NO: 4085584 - DNA, 23 bp, Homo sapiens
cactgggatgagccgctgtgagc

SEQ ID NO: 4085585 - DNA, 20 bp, Homo sapiens
cactgggccagccctgcagc

SEQ ID NO: 4085586 - DNA, 22 bp, Homo sapiens
cactgggctggggtccctgcct

SEQ ID NO: 4085587 - DNA, 23 bp, Homo sapiens
cactggggactttatttatttct

SEQ ID NO: 4085588 - DNA, 21 bp, Homo sapiens
cactggggagcccgtctcagt

SEQ ID NO: 4085589 - DNA, 19 bp, Homo sapiens
cactggggccccgggttca

SEQ ID NO: 4085590 - DNA, 14 bp, Homo sapiens
cactggggcctaca

SEQ ID NO: 4085591 - DNA, 15 bp, Homo sapiens
cactgggggaacaga

SEQ ID NO: 4085592 - DNA, 18 bp, Homo sapiens
cactgggtggggtgagga

SEQ ID NO: 4085593 - DNA, 14 bp, Homo sapiens
cactgggtggtggc

SEQ ID NO: 4085594 - DNA, 17 bp, Homo sapiens
cactgggtggtggcctg

SEQ ID NO: 4085595 - DNA, 18 bp, Homo sapiens
cactgggtgttgatctta

SEQ ID NO: 4085596 - DNA, 21 bp, Homo sapiens
cactggtaggttgggacacca

SEQ ID NO: 4085597 - DNA, 22 bp, Homo sapiens
cactggtaggttgggacaccag

SEQ ID NO: 4085598 - DNA, 15 bp, Homo sapiens
cactggtgaactgag

SEQ ID NO: 4085599 - DNA, 18 bp, Homo sapiens
cactggtgggcagctgag

SEQ ID NO: 4085600 - DNA, 19 bp, Homo sapiens
cactggtgtgaactcaccc

SEQ ID NO: 4085601 - DNA, 14 bp, Homo sapiens
cactgtaaaatgaa

SEQ ID NO: 4085602 - DNA, 17 bp, Homo sapiens
cactgtaaaatgaaatt

SEQ ID NO: 4085603 - DNA, 19 bp, Homo sapiens
cactgtaattaaaactatt

SEQ ID NO: 4085604 - DNA, 14 bp, Homo sapiens
cactgtataaactt

SEQ ID NO: 4085605 - DNA, 15 bp, Homo sapiens
cactgtataaatagg

SEQ ID NO: 4085606 - DNA, 17 bp, Homo sapiens
cactgtataaataggag

SEQ ID NO: 4085607 - DNA, 16 bp, Homo sapiens
cactgtcaccctccac

SEQ ID NO: 4085608 - DNA, 18 bp, Homo sapiens
cactgtcactgtttctct

SEQ ID NO: 4085609 - DNA, 19 bp, Homo sapiens
cactgtcactttgctctgg

SEQ ID NO: 4085610 - DNA, 14 bp, Homo sapiens
cactgtccccctac

SEQ ID NO: 4085611 - DNA, 12 bp, Homo sapiens
cactgtctcagt

SEQ ID NO: 4085612 - DNA, 19 bp, Homo sapiens
cactgtgaagacccagcag

SEQ ID NO: 4085613 - DNA, 23 bp, Homo sapiens
cactgtgaagacccagcaggaag

SEQ ID NO: 4085614 - DNA, 14 bp, Homo sapiens
cactgtgaaggacc

SEQ ID NO: 4085615 - DNA, 15 bp, Homo sapiens
cactgtgaaggaccc

SEQ ID NO: 4085616 - DNA, 17 bp, Homo sapiens
cactgtgaaggaccctt

SEQ ID NO: 4085617 - DNA, 15 bp, Homo sapiens
cactgtgacccccag

SEQ ID NO: 4085618 - DNA, 16 bp, Homo sapiens
cactgtgaccttgact

SEQ ID NO: 4085619 - DNA, 21 bp, Homo sapiens
cactgtggaaggcctccctct

SEQ ID NO: 4085620 - DNA, 20 bp, Homo sapiens
cactgtggcgttctgctgcc

SEQ ID NO: 4085621 - DNA, 16 bp, Homo sapiens
cactgttactccacag

SEQ ID NO: 4085622 - DNA, 18 bp, Homo sapiens
cactgttactccacagcg

SEQ ID NO: 4085623 - DNA, 23 bp, Homo sapiens
cactgttactttcgtacattggc

SEQ ID NO: 4085624 - DNA, 22 bp, Homo sapiens
cactgttccctctgctcctgga

SEQ ID NO: 4085625 - DNA, 11 bp, Homo sapiens
cactgttctgc

SEQ ID NO: 4085626 - DNA, 14 bp, Homo sapiens
cactgttctgcaaa

SEQ ID NO: 4085627 - DNA, 15 bp, Homo sapiens
cactgttctgcaaag

SEQ ID NO: 4085628 - DNA, 13 bp, Homo sapiens
cacttaacagatg

SEQ ID NO: 4085629 - DNA, 21 bp, Homo sapiens
cacttaagactgtgtattcta

SEQ ID NO: 4085630 - DNA, 18 bp, Homo sapiens
cacttacactttatgcac

SEQ ID NO: 4085631 - DNA, 13 bp, Homo sapiens
cacttagtaggtc

SEQ ID NO: 4085632 - DNA, 22 bp, Homo sapiens
cacttatttcactatcttcttc

SEQ ID NO: 4085633 - DNA, 13 bp, Homo sapiens
cacttcaaaacaa

SEQ ID NO: 4085634 - DNA, 23 bp, Homo sapiens
cacttcaagctgttatttcttcc

SEQ ID NO: 4085635 - DNA, 21 bp, Homo sapiens
cacttcaagtgaccaccagga

SEQ ID NO: 4085636 - DNA, 14 bp, Homo sapiens
cacttcaccctgga

SEQ ID NO: 4085637 - DNA, 21 bp, Homo sapiens
cacttcacgcccttggccatg

SEQ ID NO: 4085638 - DNA, 13 bp, Homo sapiens
cacttcagagagc

SEQ ID NO: 4085639 - DNA, 16 bp, Homo sapiens
cacttcagagagctgg

SEQ ID NO: 4085640 - DNA, 18 bp, Homo sapiens
cacttcagagagctggta

SEQ ID NO: 4085641 - DNA, 14 bp, Homo sapiens
cacttcaggctctt

SEQ ID NO: 4085642 - DNA, 23 bp, Homo sapiens
cacttcaggctcttctcctttca

SEQ ID NO: 4085643 - DNA, 22 bp, Homo sapiens
cacttcattcttgaaagctgtg

SEQ ID NO: 4085644 - DNA, 20 bp, Homo sapiens
cacttccaggggaacctgcc

SEQ ID NO: 4085645 - DNA, 13 bp, Homo sapiens
cacttccatggga

SEQ ID NO: 4085646 - DNA, 23 bp, Homo sapiens
cacttcctacaagagcagcctgt

SEQ ID NO: 4085647 - DNA, 15 bp, Homo sapiens
cacttccttttaact

SEQ ID NO: 4085648 - DNA, 17 bp, Homo sapiens
cacttctgactcttccc

SEQ ID NO: 4085649 - DNA, 13 bp, Homo sapiens
cacttcttccttt

SEQ ID NO: 4085650 - DNA, 22 bp, Homo sapiens
cacttgaatcagtttttaaaat

SEQ ID NO: 4085651 - DNA, 13 bp, Homo sapiens
cacttgagaggat

SEQ ID NO: 4085652 - DNA, 22 bp, Homo sapiens
cacttgaggtcaggagttccta

SEQ ID NO: 4085653 - DNA, 16 bp, Homo sapiens
cacttgatgtgccatt

SEQ ID NO: 4085654 - DNA, 14 bp, Homo sapiens
cacttgctggggct

SEQ ID NO: 4085655 - DNA, 14 bp, Homo sapiens
cacttgtccagctg

SEQ ID NO: 4085656 - DNA, 17 bp, Homo sapiens
cacttgtcggctccagt

SEQ ID NO: 4085657 - DNA, 17 bp, Homo sapiens
cacttgtgattatttat

SEQ ID NO: 4085658 - DNA, 16 bp, Homo sapiens
cacttgtgctttgctc

SEQ ID NO: 4085659 - DNA, 18 bp, Homo sapiens
cacttgtgctttgctctt

SEQ ID NO: 4085660 - DNA, 11 bp, Homo sapiens
cacccagaaac

SEQ ID NO: 4085661 - DNA, 21 bp, Homo sapiens
cacccagagcaccccctgctc

SEQ ID NO: 4085662 - DNA, 11 bp, Homo sapiens
cacccagcccc

SEQ ID NO: 4085663 - DNA, 12 bp, Homo sapiens
cacccaggccca

SEQ ID NO: 4085664 - DNA, 20 bp, Homo sapiens
cacccaggctggagtgcagt

SEQ ID NO: 4085665 - DNA, 16 bp, Homo sapiens
cacccagtcacctccc

SEQ ID NO: 4085666 - DNA, 20 bp, Homo sapiens
cacccagtcacctccccaca

SEQ ID NO: 4085667 - DNA, 23 bp, Homo sapiens
cacccagtcacctccccacatcg

SEQ ID NO: 4085668 - DNA, 17 bp, Homo sapiens
cacccagtctgttcccc

SEQ ID NO: 4085669 - DNA, 17 bp, Homo sapiens
cacccataaacagtaat

SEQ ID NO: 4085670 - DNA, 18 bp, Homo sapiens
cacccatgggctctgaca

SEQ ID NO: 4085671 - DNA, 19 bp, Homo sapiens
cacccatgggctctgacag

SEQ ID NO: 4085672 - DNA, 20 bp, Homo sapiens
caccccacaccccagcccac

SEQ ID NO: 4085673 - DNA, 11 bp, Homo sapiens
caccccacact

SEQ ID NO: 4085674 - DNA, 14 bp, Homo sapiens
caccccacgccctg

SEQ ID NO: 4085675 - DNA, 19 bp, Homo sapiens
caccccacgccctgttcac

SEQ ID NO: 4085676 - DNA, 11 bp, Homo sapiens
caccccagccc

SEQ ID NO: 4085677 - DNA, 12 bp, Homo sapiens
caccccagccca

SEQ ID NO: 4085678 - DNA, 15 bp, Homo sapiens
caccccagcctcgcc

SEQ ID NO: 4085679 - DNA, 18 bp, Homo sapiens
caccccagcctcgcctgt

SEQ ID NO: 4085680 - DNA, 19 bp, Homo sapiens
caccccagctaccccttct

SEQ ID NO: 4085681 - DNA, 18 bp, Homo sapiens
caccccaggcccttcagg

SEQ ID NO: 4085682 - DNA, 21 bp, Homo sapiens
caccccatcccacaccctgga

SEQ ID NO: 4085683 - DNA, 15 bp, Homo sapiens
caccccatgccaaag

SEQ ID NO: 4085684 - DNA, 17 bp, Homo sapiens
caccccatgccaaagct

SEQ ID NO: 4085685 - DNA, 13 bp, Homo sapiens
cacccccacccac

SEQ ID NO: 4085686 - DNA, 14 bp, Homo sapiens
cacccccacccacc

SEQ ID NO: 4085687 - DNA, 14 bp, Homo sapiens
cacccccaccccca

SEQ ID NO: 4085688 - DNA, 17 bp, Homo sapiens
cacccccacccccagct

SEQ ID NO: 4085689 - DNA, 13 bp, Homo sapiens
cacccccagcaca

SEQ ID NO: 4085690 - DNA, 13 bp, Homo sapiens
cacccccagctca

SEQ ID NO: 4085691 - DNA, 13 bp, Homo sapiens
cacccccatctct

SEQ ID NO: 4085692 - DNA, 12 bp, Homo sapiens
caccccccacac

SEQ ID NO: 4085693 - DNA, 15 bp, Homo sapiens
caccccccacacaca

SEQ ID NO: 4085694 - DNA, 16 bp, Homo sapiens
cacccccctgttctaa

SEQ ID NO: 4085695 - DNA, 13 bp, Homo sapiens
caccccctcaagc

SEQ ID NO: 4085696 - DNA, 20 bp, Homo sapiens
caccccctcaagccccagca

SEQ ID NO: 4085697 - DNA, 15 bp, Homo sapiens
caccccctccccgcc

SEQ ID NO: 4085698 - DNA, 14 bp, Homo sapiens
caccccctgccctg

SEQ ID NO: 4085699 - DNA, 13 bp, Homo sapiens
caccccctgctcc

SEQ ID NO: 4085700 - DNA, 12 bp, Homo sapiens
cacccccttccc

SEQ ID NO: 4085701 - DNA, 17 bp, Homo sapiens
cacccccttctctgctc

SEQ ID NO: 4085702 - DNA, 22 bp, Homo sapiens
cacccccttctctgctccacca

SEQ ID NO: 4085703 - DNA, 18 bp, Homo sapiens
caccccctttgctgtgag

SEQ ID NO: 4085704 - DNA, 16 bp, Homo sapiens
caccccgcctgccctc

SEQ ID NO: 4085705 - DNA, 14 bp, Homo sapiens
caccccggcctcag

SEQ ID NO: 4085706 - DNA, 17 bp, Homo sapiens
caccccggggaccctgt

SEQ ID NO: 4085707 - DNA, 20 bp, Homo sapiens
caccccggggaccctgtgac

SEQ ID NO: 4085708 - DNA, 16 bp, Homo sapiens
cacccctaatgagggt

SEQ ID NO: 4085709 - DNA, 14 bp, Homo sapiens
cacccctacacaca

SEQ ID NO: 4085710 - DNA, 19 bp, Homo sapiens
cacccctacacacacactc

SEQ ID NO: 4085711 - DNA, 19 bp, Homo sapiens
cacccctagccaccagtgt

SEQ ID NO: 4085712 - DNA, 20 bp, Homo sapiens
cacccctagccaccagtgtc

SEQ ID NO: 4085713 - DNA, 16 bp, Homo sapiens
cacccctctgccctca

SEQ ID NO: 4085714 - DNA, 18 bp, Homo sapiens
cacccctgcccccagccc

SEQ ID NO: 4085715 - DNA, 19 bp, Homo sapiens
cacccctggaagagcccag

SEQ ID NO: 4085716 - DNA, 20 bp, Homo sapiens
cacccctgtcccacccacac

SEQ ID NO: 4085717 - DNA, 18 bp, Homo sapiens
cacccctttctgtcccac

SEQ ID NO: 4085718 - DNA, 15 bp, Homo sapiens
cacccgacctggctg

SEQ ID NO: 4085719 - DNA, 19 bp, Homo sapiens
cacccgacctggctgcccc

SEQ ID NO: 4085720 - DNA, 20 bp, Homo sapiens
cacccgacctggctgcccct

SEQ ID NO: 4085721 - DNA, 16 bp, Homo sapiens
cacccgactcctcaaa

SEQ ID NO: 4085722 - DNA, 21 bp, Homo sapiens
cacccgccccgcgcaccccac

SEQ ID NO: 4085723 - DNA, 17 bp, Homo sapiens
cacccgggggagcccag

SEQ ID NO: 4085724 - DNA, 18 bp, Homo sapiens
cacccgggggagcccagt

SEQ ID NO: 4085725 - DNA, 23 bp, Homo sapiens
cacccgggggagcccagtgaagc

SEQ ID NO: 4085726 - DNA, 18 bp, Homo sapiens
caccctagtcccttcccc

SEQ ID NO: 4085727 - DNA, 17 bp, Homo sapiens
caccctagtttccctga

SEQ ID NO: 4085728 - DNA, 18 bp, Homo sapiens
caccctcaacctcttctg

SEQ ID NO: 4085729 - DNA, 18 bp, Homo sapiens
caccctcacacacacagc

SEQ ID NO: 4085730 - DNA, 20 bp, Homo sapiens
caccctcacacacacagctg

SEQ ID NO: 4085731 - DNA, 22 bp, Homo sapiens
caccctcacacacacagctggg

SEQ ID NO: 4085732 - DNA, 23 bp, Homo sapiens
caccctcacacacacagctgggc

SEQ ID NO: 4085733 - DNA, 14 bp, Homo sapiens
caccctccacctct

SEQ ID NO: 4085734 - DNA, 17 bp, Homo sapiens
caccctccaccttccat

SEQ ID NO: 4085735 - DNA, 20 bp, Homo sapiens
caccctccctgactggcctg

SEQ ID NO: 4085736 - DNA, 20 bp, Homo sapiens
caccctcctgccccacactc

SEQ ID NO: 4085737 - DNA, 21 bp, Homo sapiens
caccctgaacaacgagccttt

SEQ ID NO: 4085738 - DNA, 23 bp, Homo sapiens
caccctgaatggttccatgcctg

SEQ ID NO: 4085739 - DNA, 17 bp, Homo sapiens
caccctgacccccttcc

SEQ ID NO: 4085740 - DNA, 18 bp, Homo sapiens
caccctgcattacatgtg

SEQ ID NO: 4085741 - DNA, 16 bp, Homo sapiens
caccctgcgcctccag

SEQ ID NO: 4085742 - DNA, 20 bp, Homo sapiens
caccctgcgcctccagaggt

SEQ ID NO: 4085743 - DNA, 16 bp, Homo sapiens
caccctgctcctcctg

SEQ ID NO: 4085744 - DNA, 21 bp, Homo sapiens
caccctgctcctcctgccctg

SEQ ID NO: 4085745 - DNA, 21 bp, Homo sapiens
caccctggaggatttcatctc

SEQ ID NO: 4085746 - DNA, 21 bp, Homo sapiens
caccctggattgatcggagcc

SEQ ID NO: 4085747 - DNA, 12 bp, Homo sapiens
caccctggcctg

SEQ ID NO: 4085748 - DNA, 16 bp, Homo sapiens
caccctggcctgaact

SEQ ID NO: 4085749 - DNA, 16 bp, Homo sapiens
caccctgggagacaga

SEQ ID NO: 4085750 - DNA, 21 bp, Homo sapiens
caccctggggcctggacctgc

SEQ ID NO: 4085751 - DNA, 16 bp, Homo sapiens
caccctgtacctcatc

SEQ ID NO: 4085752 - DNA, 14 bp, Homo sapiens
caaggccatctggg

SEQ ID NO: 4085753 - DNA, 17 bp, Homo sapiens
caaggccatctgggctc

SEQ ID NO: 4085754 - DNA, 15 bp, Homo sapiens
caaggccccctgcct

SEQ ID NO: 4085755 - DNA, 20 bp, Homo sapiens
caaggccccctgcctgccct

SEQ ID NO: 4085756 - DNA, 12 bp, Homo sapiens
caaggccctgct

SEQ ID NO: 4085757 - DNA, 16 bp, Homo sapiens
caaggccctgctgccc

SEQ ID NO: 4085758 - DNA, 22 bp, Homo sapiens
caaggccctgctgcccaatctc

SEQ ID NO: 4085759 - DNA, 13 bp, Homo sapiens
caaggctggccag

SEQ ID NO: 4085760 - DNA, 15 bp, Homo sapiens
caaggctggccagca

SEQ ID NO: 4085761 - DNA, 23 bp, Homo sapiens
caaggctggccagcaaggcaggt

SEQ ID NO: 4085762 - DNA, 15 bp, Homo sapiens
caaggcttgctgcag

SEQ ID NO: 4085763 - DNA, 20 bp, Homo sapiens
caaggcttgctgcagatact

SEQ ID NO: 4085764 - DNA, 23 bp, Homo sapiens
caagggaaaataaaaaaagaaaa

SEQ ID NO: 4085765 - DNA, 12 bp, Homo sapiens
caagggaaaggg

SEQ ID NO: 4085766 - DNA, 21 bp, Homo sapiens
caagggaaaggggtgctttta

SEQ ID NO: 4085767 - DNA, 10 bp, Homo sapiens
caagggagaa

SEQ ID NO: 4085768 - DNA, 13 bp, Homo sapiens
caagggagaaaag

SEQ ID NO: 4085769 - DNA, 15 bp, Homo sapiens
caagggagaaaagag

SEQ ID NO: 4085770 - DNA, 17 bp, Homo sapiens
caagggagaaaagagaa

SEQ ID NO: 4085771 - DNA, 14 bp, Homo sapiens
caagggagagacct

SEQ ID NO: 4085772 - DNA, 19 bp, Homo sapiens
caagggagagacctcatca

SEQ ID NO: 4085773 - DNA, 14 bp, Homo sapiens
caagggatttgagg

SEQ ID NO: 4085774 - DNA, 18 bp, Homo sapiens
caaggggaatcagaactc

SEQ ID NO: 4085775 - DNA, 19 bp, Homo sapiens
caagggttgagagccagtg

SEQ ID NO: 4085776 - DNA, 17 bp, Homo sapiens
caaggtatttctccagt

SEQ ID NO: 4085777 - DNA, 15 bp, Homo sapiens
caaggtcatttcttc

SEQ ID NO: 4085778 - DNA, 19 bp, Homo sapiens
caaggtccactccctgctc

SEQ ID NO: 4085779 - DNA, 15 bp, Homo sapiens
caaggtcccctccac

SEQ ID NO: 4085780 - DNA, 17 bp, Homo sapiens
caaggtcccctccacat

SEQ ID NO: 4085781 - DNA, 18 bp, Homo sapiens
caaggtcccctccacatc

SEQ ID NO: 4085782 - DNA, 22 bp, Homo sapiens
caaggtcctctgtcagtcacag

SEQ ID NO: 4085783 - DNA, 14 bp, Homo sapiens
caaggtcctgctca

SEQ ID NO: 4085784 - DNA, 13 bp, Homo sapiens
caaggtcttgctc

SEQ ID NO: 4085785 - DNA, 15 bp, Homo sapiens
caaggtgcaggcagg

SEQ ID NO: 4085786 - DNA, 12 bp, Homo sapiens
caaggtggcaga

SEQ ID NO: 4085787 - DNA, 22 bp, Homo sapiens
caaggtgggccttgctacctca

SEQ ID NO: 4085788 - DNA, 23 bp, Homo sapiens
caaggtggggattgcccctggct

SEQ ID NO: 4085789 - DNA, 17 bp, Homo sapiens
caaggtggtcagtaaat

SEQ ID NO: 4085790 - DNA, 17 bp, Homo sapiens
caaggtggtgtgatctt

SEQ ID NO: 4085791 - DNA, 17 bp, Homo sapiens
caaggtgtgccccgtgg

SEQ ID NO: 4085792 - DNA, 13 bp, Homo sapiens
caaggttggagcc

SEQ ID NO: 4085793 - DNA, 14 bp, Homo sapiens
caaggttggagccc

SEQ ID NO: 4085794 - DNA, 21 bp, Homo sapiens
caaggttggagcccagggcat

SEQ ID NO: 4085795 - DNA, 22 bp, Homo sapiens
caaggttggcaccccagctacc

SEQ ID NO: 4085796 - DNA, 18 bp, Homo sapiens
caagtaagaagacatgaa

SEQ ID NO: 4085797 - DNA, 23 bp, Homo sapiens
caagtaattgtgaaaaagttaaa

SEQ ID NO: 4085798 - DNA, 16 bp, Homo sapiens
caagtaccaaagtttt

SEQ ID NO: 4085799 - DNA, 12 bp, Homo sapiens
caagtacccatt

SEQ ID NO: 4085800 - DNA, 17 bp, Homo sapiens
caagtagataaatattt

SEQ ID NO: 4085801 - DNA, 18 bp, Homo sapiens
caagtagataaatatttg

SEQ ID NO: 4085802 - DNA, 16 bp, Homo sapiens
caagtatcttctattt

SEQ ID NO: 4085803 - DNA, 16 bp, Homo sapiens
caagtatgaataaaga

SEQ ID NO: 4085804 - DNA, 21 bp, Homo sapiens
caagtatgaataaagacacct

SEQ ID NO: 4085805 - DNA, 11 bp, Homo sapiens
caagtattttg

SEQ ID NO: 4085806 - DNA, 15 bp, Homo sapiens
caagtcaaattaata

SEQ ID NO: 4085807 - DNA, 15 bp, Homo sapiens
caagtcaatcatttc

SEQ ID NO: 4085808 - DNA, 15 bp, Homo sapiens
caagtcacacagcta

SEQ ID NO: 4085809 - DNA, 18 bp, Homo sapiens
caagtcacacccactccc

SEQ ID NO: 4085810 - DNA, 23 bp, Homo sapiens
caagtcagtccaggatgctaaca

SEQ ID NO: 4085811 - DNA, 20 bp, Homo sapiens
caagtcatagccataaatga

SEQ ID NO: 4085812 - DNA, 20 bp, Homo sapiens
caagtcatggagaatctgct

SEQ ID NO: 4085813 - DNA, 17 bp, Homo sapiens
caagtcatgtgcatttc

SEQ ID NO: 4085814 - DNA, 16 bp, Homo sapiens
caagtccgcagaagcc

SEQ ID NO: 4085815 - DNA, 15 bp, Homo sapiens
caagtccttacctct

SEQ ID NO: 4085816 - DNA, 14 bp, Homo sapiens
caagtcctttgtga

SEQ ID NO: 4085817 - DNA, 14 bp, Homo sapiens
caagtctccttccc

SEQ ID NO: 4085818 - DNA, 17 bp, Homo sapiens
caagtctccttcccctt

SEQ ID NO: 4085819 - DNA, 18 bp, Homo sapiens
caagtctctctgtgaata

SEQ ID NO: 4085820 - DNA, 14 bp, Homo sapiens
caagtcttaacaaa

SEQ ID NO: 4085821 - DNA, 22 bp, Homo sapiens
caagtgaagaacactactgcta

SEQ ID NO: 4085822 - DNA, 20 bp, Homo sapiens
caagtgcacggggcacagcg

SEQ ID NO: 4085823 - DNA, 15 bp, Homo sapiens
caagtgccaaatgct

SEQ ID NO: 4085824 - DNA, 16 bp, Homo sapiens
caagtgccaaatgctc

SEQ ID NO: 4085825 - DNA, 22 bp, Homo sapiens
caagtgccactgcccgagctgg

SEQ ID NO: 4085826 - DNA, 23 bp, Homo sapiens
caagtgccactgcccgagctggt

SEQ ID NO: 4085827 - DNA, 20 bp, Homo sapiens
caagtgccccctcacctctc

SEQ ID NO: 4085828 - DNA, 22 bp, Homo sapiens
caagtgccccctcacctctcca

SEQ ID NO: 4085829 - DNA, 16 bp, Homo sapiens
caagtgctgaacagtg

SEQ ID NO: 4085830 - DNA, 12 bp, Homo sapiens
caagtggacctt

SEQ ID NO: 4085831 - DNA, 21 bp, Homo sapiens
caagtggatgggaatttgtca

SEQ ID NO: 4085832 - DNA, 22 bp, Homo sapiens
caagtggggatggggcctccct

SEQ ID NO: 4085833 - DNA, 21 bp, Homo sapiens
caagtggggtgctgggaggag

SEQ ID NO: 4085834 - DNA, 20 bp, Homo sapiens
caagtggtgtttattgcaat

SEQ ID NO: 4085835 - DNA, 19 bp, Homo sapiens
caagtgtgctttagcttga

SEQ ID NO: 4085836 - DNA, 14 bp, Homo sapiens
caagttaagagaaa

SEQ ID NO: 4085837 - DNA, 17 bp, Homo sapiens
caagttaagagaaactt

SEQ ID NO: 4085838 - DNA, 16 bp, Homo sapiens
caagttataaatcaat

SEQ ID NO: 4085839 - DNA, 13 bp, Homo sapiens
caagttctagaga

SEQ ID NO: 4085840 - DNA, 23 bp, Homo sapiens
caagttctagagaagaggctggt

SEQ ID NO: 4085841 - DNA, 17 bp, Homo sapiens
caagttcttcacctcta

SEQ ID NO: 4085842 - DNA, 17 bp, Homo sapiens
caagttgaagactttgt

SEQ ID NO: 4085843 - DNA, 15 bp, Homo sapiens
caagttgaattgagg

SEQ ID NO: 4085844 - DNA, 17 bp, Homo sapiens
caagttgagatttttaa

SEQ ID NO: 4085845 - DNA, 14 bp, Homo sapiens
caagttgtaaaaat

SEQ ID NO: 4085846 - DNA, 14 bp, Homo sapiens
caagtttcagacag

SEQ ID NO: 4085847 - DNA, 16 bp, Homo sapiens
caagtttcagacaggg

SEQ ID NO: 4085848 - DNA, 17 bp, Homo sapiens
caagtttccatagcaac

SEQ ID NO: 4085849 - DNA, 22 bp, Homo sapiens
caagtttctagctagaaatatg

SEQ ID NO: 4085850 - DNA, 17 bp, Homo sapiens
caagttttcttccatga

SEQ ID NO: 4085851 - DNA, 18 bp, Homo sapiens
caataaaaacattttgaa

SEQ ID NO: 4085852 - DNA, 19 bp, Homo sapiens
caataaaaacattttgaag

SEQ ID NO: 4085853 - DNA, 22 bp, Homo sapiens
cacaagatggaatttatcaaac

SEQ ID NO: 4085854 - DNA, 21 bp, Homo sapiens
cacaagcactttaatggcctg

SEQ ID NO: 4085855 - DNA, 13 bp, Homo sapiens
cacaagctggaag

SEQ ID NO: 4085856 - DNA, 15 bp, Homo sapiens
cacaaggaataaatg

SEQ ID NO: 4085857 - DNA, 17 bp, Homo sapiens
cacaaggatagatgctg

SEQ ID NO: 4085858 - DNA, 18 bp, Homo sapiens
cacagaaggaatctgtgc

SEQ ID NO: 4085859 - DNA, 19 bp, Homo sapiens
cacagaaggaatctgtgca

SEQ ID NO: 4085860 - DNA, 18 bp, Homo sapiens
cacagacacacacacgca

SEQ ID NO: 4085861 - DNA, 20 bp, Homo sapiens
cacagacacacacacgcacg

SEQ ID NO: 4085862 - DNA, 22 bp, Homo sapiens
cacagacacacacacgcacgca

SEQ ID NO: 4085863 - DNA, 21 bp, Homo sapiens
cacagacacgctcgcgggcag

SEQ ID NO: 4085864 - DNA, 14 bp, Homo sapiens
cacagaccacctgc

SEQ ID NO: 4085865 - DNA, 20 bp, Homo sapiens
cacagaccacctgcttctga

SEQ ID NO: 4085866 - DNA, 14 bp, Homo sapiens
cacagacccaggac

SEQ ID NO: 4085867 - DNA, 19 bp, Homo sapiens
cacagactggttttgcaac

SEQ ID NO: 4085868 - DNA, 22 bp, Homo sapiens
cacagagagacagacttgagaa

SEQ ID NO: 4085869 - DNA, 16 bp, Homo sapiens
cacagaggagtgcagc

SEQ ID NO: 4085870 - DNA, 16 bp, Homo sapiens
cacagatacacacaca

SEQ ID NO: 4085871 - DNA, 19 bp, Homo sapiens
cacagataccttgaaagga

SEQ ID NO: 4085872 - DNA, 18 bp, Homo sapiens
cacagatatttccatttc

SEQ ID NO: 4085873 - DNA, 15 bp, Homo sapiens
cacagatgtctctgg

SEQ ID NO: 4085874 - DNA, 17 bp, Homo sapiens
cacagatgtctctgggg

SEQ ID NO: 4085875 - DNA, 15 bp, Homo sapiens
cacagcaagtacagc

SEQ ID NO: 4085876 - DNA, 21 bp, Homo sapiens
cacagcaagtacagcggctcc

SEQ ID NO: 4085877 - DNA, 16 bp, Homo sapiens
cacagcaattcctcag

SEQ ID NO: 4085878 - DNA, 12 bp, Homo sapiens
cacagcacagcc

SEQ ID NO: 4085879 - DNA, 21 bp, Homo sapiens
cacagcagcctccaacacaag

SEQ ID NO: 4085880 - DNA, 14 bp, Homo sapiens
cacagcagcctggg

SEQ ID NO: 4085881 - DNA, 19 bp, Homo sapiens
cacagcagctgaacagcca

SEQ ID NO: 4085882 - DNA, 22 bp, Homo sapiens
cacagcagcttcaccagagcat

SEQ ID NO: 4085883 - DNA, 13 bp, Homo sapiens
cacagcagtgtga

SEQ ID NO: 4085884 - DNA, 22 bp, Homo sapiens
cacagcagtgtgaatagcctgg

SEQ ID NO: 4085885 - DNA, 13 bp, Homo sapiens
cacagcatgtgta

SEQ ID NO: 4085886 - DNA, 13 bp, Homo sapiens
cacagccacccct

SEQ ID NO: 4085887 - DNA, 11 bp, Homo sapiens
cacagccagag

SEQ ID NO: 4085888 - DNA, 12 bp, Homo sapiens
cacagccagagg

SEQ ID NO: 4085889 - DNA, 15 bp, Homo sapiens
cacagcccagcttgg

SEQ ID NO: 4085890 - DNA, 22 bp, Homo sapiens
cacagcccctatagcactgagc

SEQ ID NO: 4085891 - DNA, 14 bp, Homo sapiens
cacagccctccgac

SEQ ID NO: 4085892 - DNA, 23 bp, Homo sapiens
cacagccctccgaccctcatggc

SEQ ID NO: 4085893 - DNA, 18 bp, Homo sapiens
cacagcctccccacccag

SEQ ID NO: 4085894 - DNA, 21 bp, Homo sapiens
cacagcctcctctgtctgccc

SEQ ID NO: 4085895 - DNA, 23 bp, Homo sapiens
cacagcctcctctgtctgccctt

SEQ ID NO: 4085896 - DNA, 21 bp, Homo sapiens
cacagccttcggacagacata

SEQ ID NO: 4085897 - DNA, 19 bp, Homo sapiens
cacagcggaggagaccagc

SEQ ID NO: 4085898 - DNA, 21 bp, Homo sapiens
cacagcggaggagaccagctc

SEQ ID NO: 4085899 - DNA, 17 bp, Homo sapiens
cacagctcccttctgtt

SEQ ID NO: 4085900 - DNA, 15 bp, Homo sapiens
cacagctcctcccac

SEQ ID NO: 4085901 - DNA, 12 bp, Homo sapiens
cacagctccttt

SEQ ID NO: 4085902 - DNA, 13 bp, Homo sapiens
cacagctcttcac

SEQ ID NO: 4085903 - DNA, 18 bp, Homo sapiens
cacagctgccctagctga

SEQ ID NO: 4085904 - DNA, 19 bp, Homo sapiens
cacagctgctgttctcagg

SEQ ID NO: 4085905 - DNA, 14 bp, Homo sapiens
cacagctgggcaaa

SEQ ID NO: 4085906 - DNA, 19 bp, Homo sapiens
cacagctgggcaaagccac

SEQ ID NO: 4085907 - DNA, 14 bp, Homo sapiens
cacagctgtagtgg

SEQ ID NO: 4085908 - DNA, 13 bp, Homo sapiens
cacagcttttgca

SEQ ID NO: 4085909 - DNA, 15 bp, Homo sapiens
cacaggaaagagtca

SEQ ID NO: 4085910 - DNA, 22 bp, Homo sapiens
cacaggaagcctgcagtcctgg

SEQ ID NO: 4085911 - DNA, 20 bp, Homo sapiens
cacaggacatgcggtagcca

SEQ ID NO: 4085912 - DNA, 19 bp, Homo sapiens
cacaggagaggatggccca

SEQ ID NO: 4085913 - DNA, 22 bp, Homo sapiens
cacaggagtgtcctcttccctc

SEQ ID NO: 4085914 - DNA, 13 bp, Homo sapiens
cacaggcagcttt

SEQ ID NO: 4085915 - DNA, 18 bp, Homo sapiens
cacaggcagctttctaga

SEQ ID NO: 4085916 - DNA, 17 bp, Homo sapiens
cacaggcatctacacag

SEQ ID NO: 4085917 - DNA, 16 bp, Homo sapiens
cacaggccaccctgtg

SEQ ID NO: 4085918 - DNA, 13 bp, Homo sapiens
cacaggccccctt

SEQ ID NO: 4085919 - DNA, 21 bp, Homo sapiens
cacaggcccccttgagtgggg

SEQ ID NO: 4085920 - DNA, 18 bp, Homo sapiens
cacaggcccttcctctcc

SEQ ID NO: 4085921 - DNA, 20 bp, Homo sapiens
cacagggaaaattgccccat

SEQ ID NO: 4085922 - DNA, 14 bp, Homo sapiens
cacagggcaccaga

SEQ ID NO: 4085923 - DNA, 16 bp, Homo sapiens
cacagggcaccagagg

SEQ ID NO: 4085924 - DNA, 17 bp, Homo sapiens
cacagggcaccagaggc

SEQ ID NO: 4085925 - DNA, 19 bp, Homo sapiens
cacagggcaccagaggccg

SEQ ID NO: 4085926 - DNA, 14 bp, Homo sapiens
cacagggccagagg

SEQ ID NO: 4085927 - DNA, 17 bp, Homo sapiens
cacagggccagagggag

SEQ ID NO: 4085928 - DNA, 22 bp, Homo sapiens
cacagggcgaggggttggtggg

SEQ ID NO: 4085929 - DNA, 13 bp, Homo sapiens
cacaggtcaggct

SEQ ID NO: 4085930 - DNA, 18 bp, Homo sapiens
cacaggtcgggcgcagga

SEQ ID NO: 4085931 - DNA, 19 bp, Homo sapiens
cacaggtggggactgggca

SEQ ID NO: 4085932 - DNA, 17 bp, Homo sapiens
cacagtacagcatgtgc

SEQ ID NO: 4085933 - DNA, 18 bp, Homo sapiens
cacagtacagcatgtgcc

SEQ ID NO: 4085934 - DNA, 23 bp, Homo sapiens
cacagtcagcatgcttcccagag

SEQ ID NO: 4085935 - DNA, 17 bp, Homo sapiens
cacagtcaggttgaaga

SEQ ID NO: 4085936 - DNA, 17 bp, Homo sapiens
cacagtcattctaggat

SEQ ID NO: 4085937 - DNA, 14 bp, Homo sapiens
cacagtccagaccc

SEQ ID NO: 4085938 - DNA, 14 bp, Homo sapiens
cacagtctggtgct

SEQ ID NO: 4085939 - DNA, 14 bp, Homo sapiens
cacagtgcatctca

SEQ ID NO: 4085940 - DNA, 17 bp, Homo sapiens
cacagtggactcagcag

SEQ ID NO: 4085941 - DNA, 20 bp, Homo sapiens
cacagtgggatgaaccagcc

SEQ ID NO: 4085942 - DNA, 15 bp, Homo sapiens
cacagtgtgtgaact

SEQ ID NO: 4085943 - DNA, 21 bp, Homo sapiens
cacagttagttgtgaaagaaa

SEQ ID NO: 4085944 - DNA, 18 bp, Homo sapiens
cacagttctttgggccag

SEQ ID NO: 4085945 - DNA, 19 bp, Homo sapiens
cacagttctttgggccaga

SEQ ID NO: 4085946 - DNA, 23 bp, Homo sapiens
cacagttctttgggccagacatg

SEQ ID NO: 4085947 - DNA, 14 bp, Homo sapiens
cacagttgccacca

SEQ ID NO: 4085948 - DNA, 17 bp, Homo sapiens
cacagttgccaccacct

SEQ ID NO: 4085949 - DNA, 23 bp, Homo sapiens
cacagttgccaccacctctgtgg

SEQ ID NO: 4085950 - DNA, 18 bp, Homo sapiens
cacagttgggacccaaaa

SEQ ID NO: 4085951 - DNA, 22 bp, Homo sapiens
cacagttgggacccaaaacaca

SEQ ID NO: 4085952 - DNA, 15 bp, Homo sapiens
cacatacaggtgctc

SEQ ID NO: 4085953 - DNA, 18 bp, Homo sapiens
cacatacaggtgctcaat

SEQ ID NO: 4085954 - DNA, 19 bp, Homo sapiens
cacataccctcttcatgga

SEQ ID NO: 4085955 - DNA, 22 bp, Homo sapiens
cacatacgcagggggaaggctt

SEQ ID NO: 4085956 - DNA, 16 bp, Homo sapiens
cacatagactgtgcgc

SEQ ID NO: 4085957 - DNA, 13 bp, Homo sapiens
cacatagatttct

SEQ ID NO: 4085958 - DNA, 15 bp, Homo sapiens
cacatatttgatagt

SEQ ID NO: 4085959 - DNA, 15 bp, Homo sapiens
caagagcaagggctt

SEQ ID NO: 4085960 - DNA, 16 bp, Homo sapiens
caagagcagagtctgg

SEQ ID NO: 4085961 - DNA, 14 bp, Homo sapiens
caagagcagcctgt

SEQ ID NO: 4085962 - DNA, 15 bp, Homo sapiens
atttttgtgtttcta

SEQ ID NO: 4085963 - DNA, 19 bp, Homo sapiens
atttttgttagtttacaat

SEQ ID NO: 4085964 - DNA, 21 bp, Homo sapiens
atttttgttagtttacaatat

SEQ ID NO: 4085965 - DNA, 13 bp, Homo sapiens
attttttaaaaca

SEQ ID NO: 4085966 - DNA, 16 bp, Homo sapiens
attttttaaaacacta

SEQ ID NO: 4085967 - DNA, 20 bp, Homo sapiens
attttttaagtatttatata

SEQ ID NO: 4085968 - DNA, 20 bp, Homo sapiens
attttttaattattatttat

SEQ ID NO: 4085969 - DNA, 19 bp, Homo sapiens
attttttaatttaaagctt

SEQ ID NO: 4085970 - DNA, 21 bp, Homo sapiens
attttttaatttgatgaaagc

SEQ ID NO: 4085971 - DNA, 22 bp, Homo sapiens
attttttaatttgatgaaagct

SEQ ID NO: 4085972 - DNA, 13 bp, Homo sapiens
attttttccaaaa

SEQ ID NO: 4085973 - DNA, 12 bp, Homo sapiens
caaacatagccc

SEQ ID NO: 4085974 - DNA, 19 bp, Homo sapiens
caaacattcgtgagctggg

SEQ ID NO: 4085975 - DNA, 15 bp, Homo sapiens
caaaccaccaggcat

SEQ ID NO: 4085976 - DNA, 23 bp, Homo sapiens
caaaccattgctcttagtcccaa

SEQ ID NO: 4085977 - DNA, 21 bp, Homo sapiens
caaaccatttttaaagtagaa

SEQ ID NO: 4085978 - DNA, 17 bp, Homo sapiens
caaaccccaccctagtt

SEQ ID NO: 4085979 - DNA, 22 bp, Homo sapiens
caaacccccaaaatccaaaact

SEQ ID NO: 4085980 - DNA, 13 bp, Homo sapiens
caaacctccagcc

SEQ ID NO: 4085981 - DNA, 16 bp, Homo sapiens
caaacctccagcctcc

SEQ ID NO: 4085982 - DNA, 19 bp, Homo sapiens
caaacctgtagatgcagaa

SEQ ID NO: 4085983 - DNA, 22 bp, Homo sapiens
caaacctgtagatgcagaaaaa

SEQ ID NO: 4085984 - DNA, 18 bp, Homo sapiens
caaacctttattttagaa

SEQ ID NO: 4085985 - DNA, 14 bp, Homo sapiens
caaacgcctcccct

SEQ ID NO: 4085986 - DNA, 13 bp, Homo sapiens
caaacgctaaaga

SEQ ID NO: 4085987 - DNA, 22 bp, Homo sapiens
caaacgctaaagagcccttgcc

SEQ ID NO: 4085988 - DNA, 20 bp, Homo sapiens
caaactaaaaatattcctcc

SEQ ID NO: 4085989 - DNA, 16 bp, Homo sapiens
caaactaaaagacatt

SEQ ID NO: 4085990 - DNA, 16 bp, Homo sapiens
caaactaattctcaca

SEQ ID NO: 4085991 - DNA, 13 bp, Homo sapiens
caaactcatcttg

SEQ ID NO: 4085992 - DNA, 15 bp, Homo sapiens
caaactgcaatagag

SEQ ID NO: 4085993 - DNA, 12 bp, Homo sapiens
caaactggagtc

SEQ ID NO: 4085994 - DNA, 23 bp, Homo sapiens
caaactggagtctggagtgggca

SEQ ID NO: 4085995 - DNA, 19 bp, Homo sapiens
caaactggtattctgttct

SEQ ID NO: 4085996 - DNA, 12 bp, Homo sapiens
caaactgtaaat

SEQ ID NO: 4085997 - DNA, 17 bp, Homo sapiens
caaactgtccctccctt

SEQ ID NO: 4085998 - DNA, 14 bp, Homo sapiens
caaactgtgaagca

SEQ ID NO: 4085999 - DNA, 22 bp, Homo sapiens
caaactgtgaagcatttacaga

SEQ ID NO: 4086000 - DNA, 13 bp, Homo sapiens
caaactgttgatt

SEQ ID NO: 4086001 - DNA, 13 bp, Homo sapiens
caaacttactatt

SEQ ID NO: 4086002 - DNA, 16 bp, Homo sapiens
caaacttactattttg

SEQ ID NO: 4086003 - DNA, 16 bp, Homo sapiens
caaacttgtggcctca

SEQ ID NO: 4086004 - DNA, 18 bp, Homo sapiens
caaacttgtggcctcaag

SEQ ID NO: 4086005 - DNA, 21 bp, Homo sapiens
caaagaaggcatttgcagggt

SEQ ID NO: 4086006 - DNA, 15 bp, Homo sapiens
caaagaatgtttata

SEQ ID NO: 4086007 - DNA, 14 bp, Homo sapiens
caaagacaaaagtc

SEQ ID NO: 4086008 - DNA, 14 bp, Homo sapiens
caaagacagaatgg

SEQ ID NO: 4086009 - DNA, 19 bp, Homo sapiens
caaagacttagtatatttt

SEQ ID NO: 4086010 - DNA, 20 bp, Homo sapiens
caaagacttagtatattttc

SEQ ID NO: 4086011 - DNA, 18 bp, Homo sapiens
caaagagcctggagaagc

SEQ ID NO: 4086012 - DNA, 12 bp, Homo sapiens
caaagaggctgc

SEQ ID NO: 4086013 - DNA, 15 bp, Homo sapiens
caaagaggctgcccc

SEQ ID NO: 4086014 - DNA, 16 bp, Homo sapiens
caaagaggctgcccct

SEQ ID NO: 4086015 - DNA, 22 bp, Homo sapiens
caaagagggcttcctctagaag

SEQ ID NO: 4086016 - DNA, 20 bp, Homo sapiens
caaagagtgggctgcatctg

SEQ ID NO: 4086017 - DNA, 23 bp, Homo sapiens
caaagatatatacacaggatcct

SEQ ID NO: 4086018 - DNA, 14 bp, Homo sapiens
caaagatcaaaata

SEQ ID NO: 4086019 - DNA, 15 bp, Homo sapiens
caaagatcaaaataa

SEQ ID NO: 4086020 - DNA, 16 bp, Homo sapiens
caaagatcaaaataaa

SEQ ID NO: 4086021 - DNA, 17 bp, Homo sapiens
caaagatcaaaataaaa

SEQ ID NO: 4086022 - DNA, 20 bp, Homo sapiens
caaagatcaaaataaaaagt

SEQ ID NO: 4086023 - DNA, 23 bp, Homo sapiens
caaagatctgaattaaataaata

SEQ ID NO: 4086024 - DNA, 16 bp, Homo sapiens
caaagatgtttgtcag

SEQ ID NO: 4086025 - DNA, 20 bp, Homo sapiens
caaagcacgaaatgttattt

SEQ ID NO: 4086026 - DNA, 22 bp, Homo sapiens
caaagcacgaaatgttattttt

SEQ ID NO: 4086027 - DNA, 12 bp, Homo sapiens
caaagcagacag

SEQ ID NO: 4086028 - DNA, 13 bp, Homo sapiens
caaagcagacagc

SEQ ID NO: 4086029 - DNA, 13 bp, Homo sapiens
caaagcatagatg

SEQ ID NO: 4086030 - DNA, 19 bp, Homo sapiens
caaagcatagatgttttgg

SEQ ID NO: 4086031 - DNA, 17 bp, Homo sapiens
caaagccacaaggctgg

SEQ ID NO: 4086032 - DNA, 18 bp, Homo sapiens
caaagccacaaggctggc

SEQ ID NO: 4086033 - DNA, 22 bp, Homo sapiens
caaagccacaaggctggccagc

SEQ ID NO: 4086034 - DNA, 22 bp, Homo sapiens
caaagccagggtctctccctca

SEQ ID NO: 4086035 - DNA, 12 bp, Homo sapiens
caaagccagtga

SEQ ID NO: 4086036 - DNA, 23 bp, Homo sapiens
caaagccagtgaaatgtgaagga

SEQ ID NO: 4086037 - DNA, 15 bp, Homo sapiens
caaagccctaaaatt

SEQ ID NO: 4086038 - DNA, 17 bp, Homo sapiens
caaagcggtccctgtcc

SEQ ID NO: 4086039 - DNA, 20 bp, Homo sapiens
caaagcgtttctttacttct

SEQ ID NO: 4086040 - DNA, 21 bp, Homo sapiens
caaagctagggtggcccttgc

SEQ ID NO: 4086041 - DNA, 22 bp, Homo sapiens
caaagctagggtggcccttgca

SEQ ID NO: 4086042 - DNA, 13 bp, Homo sapiens
caaagctttcctg

SEQ ID NO: 4086043 - DNA, 19 bp, Homo sapiens
caaaggagctcgaaggata

SEQ ID NO: 4086044 - DNA, 14 bp, Homo sapiens
caaaggatgtgata

SEQ ID NO: 4086045 - DNA, 20 bp, Homo sapiens
caaaggcaagttaagagaaa

SEQ ID NO: 4086046 - DNA, 23 bp, Homo sapiens
caaaggcaagttaagagaaactt

SEQ ID NO: 4086047 - DNA, 13 bp, Homo sapiens
caaaggcatccca

SEQ ID NO: 4086048 - DNA, 21 bp, Homo sapiens
caaaggcattataaaaagaat

SEQ ID NO: 4086049 - DNA, 18 bp, Homo sapiens
caaagggaaatatcattt

SEQ ID NO: 4086050 - DNA, 17 bp, Homo sapiens
caaagggctgaaagcca

SEQ ID NO: 4086051 - DNA, 13 bp, Homo sapiens
caaaggggacagc

SEQ ID NO: 4086052 - DNA, 19 bp, Homo sapiens
caaagggtgaagctattta

SEQ ID NO: 4086053 - DNA, 17 bp, Homo sapiens
caaaggtggcaatgctt

SEQ ID NO: 4086054 - DNA, 13 bp, Homo sapiens
caaagtataacca

SEQ ID NO: 4086055 - DNA, 17 bp, Homo sapiens
caaagtcctttttttcc

SEQ ID NO: 4086056 - DNA, 15 bp, Homo sapiens
caaagtgatagaaaa

SEQ ID NO: 4086057 - DNA, 11 bp, Homo sapiens
caaagtgttaa

SEQ ID NO: 4086058 - DNA, 14 bp, Homo sapiens
caaagtgttgtgtt

SEQ ID NO: 4086059 - DNA, 19 bp, Homo sapiens
caaagtgttgtgttcctgg

SEQ ID NO: 4086060 - DNA, 22 bp, Homo sapiens
caaagttaattcacctatgtta

SEQ ID NO: 4086061 - DNA, 13 bp, Homo sapiens
caaagttatccag

SEQ ID NO: 4086062 - DNA, 17 bp, Homo sapiens
caaagttggggcaggct

SEQ ID NO: 4086063 - DNA, 22 bp, Homo sapiens
caaagtttcctaatcagaaatt

SEQ ID NO: 4086064 - DNA, 20 bp, Homo sapiens
caaagttttgaaaagctatt

SEQ ID NO: 4086065 - DNA, 15 bp, Homo sapiens
caaataaaaatattg

SEQ ID NO: 4086066 - DNA, 14 bp, Homo sapiens
caaataaaattggc

SEQ ID NO: 4086067 - DNA, 14 bp, Homo sapiens
atgttcattgtaat

SEQ ID NO: 4086068 - DNA, 21 bp, Homo sapiens
atgttcattgtaatgttactg

SEQ ID NO: 4086069 - DNA, 15 bp, Homo sapiens
atgttcccacttcaa

SEQ ID NO: 4086070 - DNA, 12 bp, Homo sapiens
atgttccccagg

SEQ ID NO: 4086071 - DNA, 11 bp, Homo sapiens
atgttccctct

SEQ ID NO: 4086072 - DNA, 19 bp, Homo sapiens
atgttccctcttgtccctt

SEQ ID NO: 4086073 - DNA, 11 bp, Homo sapiens
atgttctatta

SEQ ID NO: 4086074 - DNA, 13 bp, Homo sapiens
atgttctccattt

SEQ ID NO: 4086075 - DNA, 14 bp, Homo sapiens
atgttctgacatta

SEQ ID NO: 4086076 - DNA, 19 bp, Homo sapiens
atgttctgacattaacagt

SEQ ID NO: 4086077 - DNA, 22 bp, Homo sapiens
atgttctgaccctgcttcaaat

SEQ ID NO: 4086078 - DNA, 16 bp, Homo sapiens
atgttctgtttgctgt

SEQ ID NO: 4086079 - DNA, 17 bp, Homo sapiens
atgttctgtttgctgtg

SEQ ID NO: 4086080 - DNA, 19 bp, Homo sapiens
atgttcttatagaataaaa

SEQ ID NO: 4086081 - DNA, 11 bp, Homo sapiens
atgttcttcca

SEQ ID NO: 4086082 - DNA, 14 bp, Homo sapiens
atgttcttccagtt

SEQ ID NO: 4086083 - DNA, 13 bp, Homo sapiens
atgttctttggaa

SEQ ID NO: 4086084 - DNA, 19 bp, Homo sapiens
atgttctttggaaagtaca

SEQ ID NO: 4086085 - DNA, 12 bp, Homo sapiens
atgttgaaagat

SEQ ID NO: 4086086 - DNA, 14 bp, Homo sapiens
atgttgaatacttt

SEQ ID NO: 4086087 - DNA, 15 bp, Homo sapiens
atgttgaatactttt

SEQ ID NO: 4086088 - DNA, 22 bp, Homo sapiens
atgttgaatgcccacaggcaaa

SEQ ID NO: 4086089 - DNA, 18 bp, Homo sapiens
atgttgagccaggcctgg

SEQ ID NO: 4086090 - DNA, 14 bp, Homo sapiens
atgttgcttctcag

SEQ ID NO: 4086091 - DNA, 20 bp, Homo sapiens
atgttggatttataaatgct

SEQ ID NO: 4086092 - DNA, 19 bp, Homo sapiens
atgttggcagatgcagctc

SEQ ID NO: 4086093 - DNA, 17 bp, Homo sapiens
atgttggccaggctggt

SEQ ID NO: 4086094 - DNA, 21 bp, Homo sapiens
atgttgggggggaccctgcct

SEQ ID NO: 4086095 - DNA, 16 bp, Homo sapiens
atgttgtgttctaata

SEQ ID NO: 4086096 - DNA, 12 bp, Homo sapiens
atgttgttattt

SEQ ID NO: 4086097 - DNA, 13 bp, Homo sapiens
atgttgttattta

SEQ ID NO: 4086098 - DNA, 19 bp, Homo sapiens
atgttgttcaaatgcattt

SEQ ID NO: 4086099 - DNA, 19 bp, Homo sapiens
atgtttacactctttgtaa

SEQ ID NO: 4086100 - DNA, 23 bp, Homo sapiens
atgtttatatctgcaaaaaacct

SEQ ID NO: 4086101 - DNA, 14 bp, Homo sapiens
atgtttatgagcca

SEQ ID NO: 4086102 - DNA, 15 bp, Homo sapiens
atgtttatgagccag

SEQ ID NO: 4086103 - DNA, 12 bp, Homo sapiens
attaatttgaaa

SEQ ID NO: 4086104 - DNA, 21 bp, Homo sapiens
attaatttgaaaccaggacat

SEQ ID NO: 4086105 - DNA, 22 bp, Homo sapiens
attaatttgaaaccaggacatt

SEQ ID NO: 4086106 - DNA, 21 bp, Homo sapiens
attaatttgattaacaaatat

SEQ ID NO: 4086107 - DNA, 22 bp, Homo sapiens
attaatttgattaacaaatatg

SEQ ID NO: 4086108 - DNA, 13 bp, Homo sapiens
attaattttactc

SEQ ID NO: 4086109 - DNA, 18 bp, Homo sapiens
attaatttttaattgaaa

SEQ ID NO: 4086110 - DNA, 13 bp, Homo sapiens
attacaaaaacaa

SEQ ID NO: 4086111 - DNA, 15 bp, Homo sapiens
attacagagaggaga

SEQ ID NO: 4086112 - DNA, 18 bp, Homo sapiens
attacagagaggagaaac

SEQ ID NO: 4086113 - DNA, 19 bp, Homo sapiens
attacagatgggcaaatta

SEQ ID NO: 4086114 - DNA, 15 bp, Homo sapiens
attacattttcagtg

SEQ ID NO: 4086115 - DNA, 15 bp, Homo sapiens
attaccaccatcccg

SEQ ID NO: 4086116 - DNA, 16 bp, Homo sapiens
attaccagacaaaaaa

SEQ ID NO: 4086117 - DNA, 21 bp, Homo sapiens
attaccagggactatctttgc

SEQ ID NO: 4086118 - DNA, 22 bp, Homo sapiens
attaccccctcattgtttatta

SEQ ID NO: 4086119 - DNA, 13 bp, Homo sapiens
attaccccctcct

SEQ ID NO: 4086120 - DNA, 19 bp, Homo sapiens
attaccccctccttcagac

SEQ ID NO: 4086121 - DNA, 20 bp, Homo sapiens
attaccccctccttcagaca

SEQ ID NO: 4086122 - DNA, 21 bp, Homo sapiens
attaccccctccttcagacac

SEQ ID NO: 4086123 - DNA, 13 bp, Homo sapiens
attacgtgagcca

SEQ ID NO: 4086124 - DNA, 12 bp, Homo sapiens
attactaatttt

SEQ ID NO: 4086125 - DNA, 15 bp, Homo sapiens
attactaattttaca

SEQ ID NO: 4086126 - DNA, 15 bp, Homo sapiens
attactacaaaattt

SEQ ID NO: 4086127 - DNA, 18 bp, Homo sapiens
attactatgactgctccc

SEQ ID NO: 4086128 - DNA, 21 bp, Homo sapiens
attactattccctttgacttc

SEQ ID NO: 4086129 - DNA, 19 bp, Homo sapiens
attactctcacccataaac

SEQ ID NO: 4086130 - DNA, 20 bp, Homo sapiens
attactctcacccataaaca

SEQ ID NO: 4086131 - DNA, 22 bp, Homo sapiens
attactctcacccataaacagt

SEQ ID NO: 4086132 - DNA, 23 bp, Homo sapiens
attactctcacccataaacagta

SEQ ID NO: 4086133 - DNA, 17 bp, Homo sapiens
attactggaattcttct

SEQ ID NO: 4086134 - DNA, 12 bp, Homo sapiens
attactgggcct

SEQ ID NO: 4086135 - DNA, 15 bp, Homo sapiens
attactgggccttag

SEQ ID NO: 4086136 - DNA, 15 bp, Homo sapiens
attactgtgtaaata

SEQ ID NO: 4086137 - DNA, 21 bp, Homo sapiens
attactgttgcatttactttt

SEQ ID NO: 4086138 - DNA, 17 bp, Homo sapiens
attactgtttaagacac

SEQ ID NO: 4086139 - DNA, 16 bp, Homo sapiens
attactgtttatttct

SEQ ID NO: 4086140 - DNA, 18 bp, Homo sapiens
attactgtttatttctgt

SEQ ID NO: 4086141 - DNA, 22 bp, Homo sapiens
attagaaaatgttatttaacag

SEQ ID NO: 4086142 - DNA, 22 bp, Homo sapiens
attagaaatagacagtatattt

SEQ ID NO: 4086143 - DNA, 11 bp, Homo sapiens
attagaaatga

SEQ ID NO: 4086144 - DNA, 15 bp, Homo sapiens
attagaaattagaaa

SEQ ID NO: 4086145 - DNA, 23 bp, Homo sapiens
attagaaattagctgtgtgaaat

SEQ ID NO: 4086146 - DNA, 17 bp, Homo sapiens
attagaaattggctgga

SEQ ID NO: 4086147 - DNA, 13 bp, Homo sapiens
attagactcctcc

SEQ ID NO: 4086148 - DNA, 15 bp, Homo sapiens
attagactcctcctc

SEQ ID NO: 4086149 - DNA, 19 bp, Homo sapiens
attagactttagaaataaa

SEQ ID NO: 4086150 - DNA, 14 bp, Homo sapiens
attagatgtgccaa

SEQ ID NO: 4086151 - DNA, 21 bp, Homo sapiens
attagatgtgccaataaccaa

SEQ ID NO: 4086152 - DNA, 20 bp, Homo sapiens
attagattttattttactat

SEQ ID NO: 4086153 - DNA, 19 bp, Homo sapiens
attagcaaggtcatttctt

SEQ ID NO: 4086154 - DNA, 13 bp, Homo sapiens
attagccaggatc

SEQ ID NO: 4086155 - DNA, 15 bp, Homo sapiens
attagctgtgatttt

SEQ ID NO: 4086156 - DNA, 12 bp, Homo sapiens
attagctttgtg

SEQ ID NO: 4086157 - DNA, 14 bp, Homo sapiens
attagctttgtgtt

SEQ ID NO: 4086158 - DNA, 15 bp, Homo sapiens
attaggaaaatatgg

SEQ ID NO: 4086159 - DNA, 21 bp, Homo sapiens
attaggaagtgtaacagctga

SEQ ID NO: 4086160 - DNA, 19 bp, Homo sapiens
attaggatttgccccttcc

SEQ ID NO: 4086161 - DNA, 15 bp, Homo sapiens
attaggggttgctaa

SEQ ID NO: 4086162 - DNA, 14 bp, Homo sapiens
attaggtagacttt

SEQ ID NO: 4086163 - DNA, 15 bp, Homo sapiens
attagtaaatgtctt

SEQ ID NO: 4086164 - DNA, 20 bp, Homo sapiens
attagtaaatgtctttgtaa

SEQ ID NO: 4086165 - DNA, 22 bp, Homo sapiens
attagtattaatactacccata

SEQ ID NO: 4086166 - DNA, 18 bp, Homo sapiens
attagtatttatttaatg

SEQ ID NO: 4086167 - DNA, 16 bp, Homo sapiens
attagtgccagaattt

SEQ ID NO: 4086168 - DNA, 21 bp, Homo sapiens
attagtgccagaattttagga

SEQ ID NO: 4086169 - DNA, 18 bp, Homo sapiens
attagttccctgtctctt

SEQ ID NO: 4086170 - DNA, 21 bp, Homo sapiens
attagttccctgtctcttgaa

SEQ ID NO: 4086171 - DNA, 17 bp, Homo sapiens
attagttctttttgcca

SEQ ID NO: 4086172 - DNA, 18 bp, Homo sapiens
attataaaattaatcaca

SEQ ID NO: 4086173 - DNA, 13 bp, Homo sapiens
attataaacgctt

SEQ ID NO: 4086174 - DNA, 18 bp, Homo sapiens
atttgaatgttaagcaga

SEQ ID NO: 4086175 - DNA, 19 bp, Homo sapiens
atttgaatgttaagcagat

SEQ ID NO: 4086176 - DNA, 17 bp, Homo sapiens
atttgaattaaaacttc

SEQ ID NO: 4086177 - DNA, 19 bp, Homo sapiens
atttgaattaaaacttctt

SEQ ID NO: 4086178 - DNA, 20 bp, Homo sapiens
atttgaattaaaacttctta

SEQ ID NO: 4086179 - DNA, 14 bp, Homo sapiens
atttgagactattt

SEQ ID NO: 4086180 - DNA, 15 bp, Homo sapiens
atttgagagaagcca

SEQ ID NO: 4086181 - DNA, 20 bp, Homo sapiens
atttgagggcccagccagga

SEQ ID NO: 4086182 - DNA, 13 bp, Homo sapiens
atttgaggtcaag

SEQ ID NO: 4086183 - DNA, 19 bp, Homo sapiens
atttgatacataataaaaa

SEQ ID NO: 4086184 - DNA, 22 bp, Homo sapiens
atttgattcattttcctgttca

SEQ ID NO: 4086185 - DNA, 23 bp, Homo sapiens
atttgattctgtgtgttttcata

SEQ ID NO: 4086186 - DNA, 18 bp, Homo sapiens
atttgatttttgtctcaa

SEQ ID NO: 4086187 - DNA, 23 bp, Homo sapiens
atttgcaaaatcacttagcagca

SEQ ID NO: 4086188 - DNA, 12 bp, Homo sapiens
atttgcaacatt

SEQ ID NO: 4086189 - DNA, 22 bp, Homo sapiens
attttctaagcaatttcttgct

SEQ ID NO: 4086190 - DNA, 15 bp, Homo sapiens
attttctacaattaa

SEQ ID NO: 4086191 - DNA, 22 bp, Homo sapiens
attttctcaaaagcatttatca

SEQ ID NO: 4086192 - DNA, 23 bp, Homo sapiens
attttctcaaaagcatttatcat

SEQ ID NO: 4086193 - DNA, 18 bp, Homo sapiens
attttctcactgaactcc

SEQ ID NO: 4086194 - DNA, 17 bp, Homo sapiens
attttctgacatgcatt

SEQ ID NO: 4086195 - DNA, 17 bp, Homo sapiens
attttctggtagataga

SEQ ID NO: 4086196 - DNA, 18 bp, Homo sapiens
attttctggtagatagaa

SEQ ID NO: 4086197 - DNA, 15 bp, Homo sapiens
attttcttaaaccaa

SEQ ID NO: 4086198 - DNA, 20 bp, Homo sapiens
attttcttacccaatttccc

SEQ ID NO: 4086199 - DNA, 14 bp, Homo sapiens
attttcttcatgca

SEQ ID NO: 4086200 - DNA, 12 bp, Homo sapiens
attttctttaat

SEQ ID NO: 4086201 - DNA, 15 bp, Homo sapiens
attttctttaatgct

SEQ ID NO: 4086202 - DNA, 18 bp, Homo sapiens
attttctttaatgctttt

SEQ ID NO: 4086203 - DNA, 20 bp, Homo sapiens
attttcttttgaattgtttt

SEQ ID NO: 4086204 - DNA, 13 bp, Homo sapiens
attttgaaaagct

SEQ ID NO: 4086205 - DNA, 14 bp, Homo sapiens
attttgaaaagctt

SEQ ID NO: 4086206 - DNA, 19 bp, Homo sapiens
attttgaagtttacatttt

SEQ ID NO: 4086207 - DNA, 20 bp, Homo sapiens
attttgaataaataaatgta

SEQ ID NO: 4086208 - DNA, 21 bp, Homo sapiens
attttgagaaactgctgcaga

SEQ ID NO: 4086209 - DNA, 14 bp, Homo sapiens
attttgagtgactc

SEQ ID NO: 4086210 - DNA, 18 bp, Homo sapiens
attttgatgtgacaataa

SEQ ID NO: 4086211 - DNA, 22 bp, Homo sapiens
attttgcaaaaatcctattctg

SEQ ID NO: 4086212 - DNA, 14 bp, Homo sapiens
attttgcaaaattt

SEQ ID NO: 4086213 - DNA, 15 bp, Homo sapiens
attttgcaaaatttc

SEQ ID NO: 4086214 - DNA, 12 bp, Homo sapiens
attttgcagcag

SEQ ID NO: 4086215 - DNA, 15 bp, Homo sapiens
attttgcattccaga

SEQ ID NO: 4086216 - DNA, 19 bp, Homo sapiens
attttggaaaataaattat

SEQ ID NO: 4086217 - DNA, 20 bp, Homo sapiens
attttggaaaataaattatt

SEQ ID NO: 4086218 - DNA, 18 bp, Homo sapiens
attttggaaactgctaaa

SEQ ID NO: 4086219 - DNA, 22 bp, Homo sapiens
attttggataaatcatttcagt

SEQ ID NO: 4086220 - DNA, 17 bp, Homo sapiens
attttggattttgcaag

SEQ ID NO: 4086221 - DNA, 20 bp, Homo sapiens
attttggcgctattacaaat

SEQ ID NO: 4086222 - DNA, 21 bp, Homo sapiens
attttggcgctattacaaata

SEQ ID NO: 4086223 - DNA, 22 bp, Homo sapiens
attttgggggtttttaatcttt

SEQ ID NO: 4086224 - DNA, 17 bp, Homo sapiens
attttggggtctctttt

SEQ ID NO: 4086225 - DNA, 15 bp, Homo sapiens
attttggtactttta

SEQ ID NO: 4086226 - DNA, 16 bp, Homo sapiens
attttggtgagaaatg

SEQ ID NO: 4086227 - DNA, 21 bp, Homo sapiens
attttggtttatttttgtaat

SEQ ID NO: 4086228 - DNA, 12 bp, Homo sapiens
attttgtaagaa

SEQ ID NO: 4086229 - DNA, 17 bp, Homo sapiens
attttgtaagaaggcaa

SEQ ID NO: 4086230 - DNA, 20 bp, Homo sapiens
attttgtacaaatttgttat

SEQ ID NO: 4086231 - DNA, 16 bp, Homo sapiens
attttgtagatgtgat

SEQ ID NO: 4086232 - DNA, 20 bp, Homo sapiens
attttgtgatgatgctgtga

SEQ ID NO: 4086233 - DNA, 16 bp, Homo sapiens
attttgtgctcattta

SEQ ID NO: 4086234 - DNA, 16 bp, Homo sapiens
atttttaaaaaatgaa

SEQ ID NO: 4086235 - DNA, 13 bp, Homo sapiens
atttttaaaaaga

SEQ ID NO: 4086236 - DNA, 16 bp, Homo sapiens
atttttaaaatattta

SEQ ID NO: 4086237 - DNA, 15 bp, Homo sapiens
atttttaaagataga

SEQ ID NO: 4086238 - DNA, 12 bp, Homo sapiens
atttttaaattg

SEQ ID NO: 4086239 - DNA, 21 bp, Homo sapiens
atttttaagcaaaatattatt

SEQ ID NO: 4086240 - DNA, 12 bp, Homo sapiens
atttttaagctg

SEQ ID NO: 4086241 - DNA, 16 bp, Homo sapiens
atttttaatttaacaa

SEQ ID NO: 4086242 - DNA, 18 bp, Homo sapiens
atttttaatttaacaaac

SEQ ID NO: 4086243 - DNA, 19 bp, Homo sapiens
atttttacaagaagtttat

SEQ ID NO: 4086244 - DNA, 20 bp, Homo sapiens
atttttacaagaagtttatt

SEQ ID NO: 4086245 - DNA, 17 bp, Homo sapiens
atttttacaagatccat

SEQ ID NO: 4086246 - DNA, 20 bp, Homo sapiens
atttttacaagatccatttg

SEQ ID NO: 4086247 - DNA, 13 bp, Homo sapiens
atttttacaataa

SEQ ID NO: 4086248 - DNA, 19 bp, Homo sapiens
atttttacaataaataatc

SEQ ID NO: 4086249 - DNA, 22 bp, Homo sapiens
atttttaccctaatgtcttcat

SEQ ID NO: 4086250 - DNA, 12 bp, Homo sapiens
atttttacctaa

SEQ ID NO: 4086251 - DNA, 21 bp, Homo sapiens
atttttagatagttagaacct

SEQ ID NO: 4086252 - DNA, 16 bp, Homo sapiens
atttttagcctgtgtc

SEQ ID NO: 4086253 - DNA, 16 bp, Homo sapiens
atttttaggcaaagat

SEQ ID NO: 4086254 - DNA, 13 bp, Homo sapiens
atttttatagcaa

SEQ ID NO: 4086255 - DNA, 21 bp, Homo sapiens
atttttatagcaacaacaatt

SEQ ID NO: 4086256 - DNA, 13 bp, Homo sapiens
atttttatatcat

SEQ ID NO: 4086257 - DNA, 17 bp, Homo sapiens
atttttatatcatgcaa

SEQ ID NO: 4086258 - DNA, 19 bp, Homo sapiens
atttttatatcatgcaaaa

SEQ ID NO: 4086259 - DNA, 17 bp, Homo sapiens
atttttatatttccttt

SEQ ID NO: 4086260 - DNA, 14 bp, Homo sapiens
atttttatttatga

SEQ ID NO: 4086261 - DNA, 21 bp, Homo sapiens
atttttatttctttttaatta

SEQ ID NO: 4086262 - DNA, 16 bp, Homo sapiens
atttttcaataaagca

SEQ ID NO: 4086263 - DNA, 22 bp, Homo sapiens
atttttcaatatattgaacttt

SEQ ID NO: 4086264 - DNA, 15 bp, Homo sapiens
atttttcagatgctt

SEQ ID NO: 4086265 - DNA, 22 bp, Homo sapiens
atttttcagcacttaactactt

SEQ ID NO: 4086266 - DNA, 22 bp, Homo sapiens
atttttccttcctctgtaagat

SEQ ID NO: 4086267 - DNA, 23 bp, Homo sapiens
atttttcggaggccccactgatg

SEQ ID NO: 4086268 - DNA, 17 bp, Homo sapiens
atttttctaaaaaaaga

SEQ ID NO: 4086269 - DNA, 24 bp, Homo sapiens
atttttctcccaagaaacctgact

SEQ ID NO: 4086270 - DNA, 17 bp, Homo sapiens
atttttcttcttttact

SEQ ID NO: 4086271 - DNA, 19 bp, Homo sapiens
atttttgaagcaaagaagg

SEQ ID NO: 4086272 - DNA, 17 bp, Homo sapiens
atttttggggaaaaaag

SEQ ID NO: 4086273 - DNA, 22 bp, Homo sapiens
atttttggggaaaaaagcacat

SEQ ID NO: 4086274 - DNA, 18 bp, Homo sapiens
atttttgtaatgtgaaaa

SEQ ID NO: 4086275 - DNA, 15 bp, Homo sapiens
atttttgtacttgat

SEQ ID NO: 4086276 - DNA, 21 bp, Homo sapiens
atttttgtacttgatttgatg

SEQ ID NO: 4086277 - DNA, 20 bp, Homo sapiens
atttttgtatgttatgaaca

SEQ ID NO: 4086278 - DNA, 16 bp, Homo sapiens
atttttgtctcagaag

SEQ ID NO: 4086279 - DNA, 15 bp, Homo sapiens
attatgacagttata

SEQ ID NO: 4086280 - DNA, 20 bp, Homo sapiens
attatgagaggcaatgattg

SEQ ID NO: 4086281 - DNA, 14 bp, Homo sapiens
attatggaaaactg

SEQ ID NO: 4086282 - DNA, 16 bp, Homo sapiens
attatgggtcctgcaa

SEQ ID NO: 4086283 - DNA, 23 bp, Homo sapiens
attatgggttaggcattaatgtt

SEQ ID NO: 4086284 - DNA, 15 bp, Homo sapiens
attatgtatgtttac

SEQ ID NO: 4086285 - DNA, 19 bp, Homo sapiens
attatgtcttttatatttg

SEQ ID NO: 4086286 - DNA, 20 bp, Homo sapiens
attatgtgacattttacatt

SEQ ID NO: 4086287 - DNA, 13 bp, Homo sapiens
attatgttgttca

SEQ ID NO: 4086288 - DNA, 20 bp, Homo sapiens
attatgttttttaaaatatt

SEQ ID NO: 4086289 - DNA, 19 bp, Homo sapiens
attattaactacatttatg

SEQ ID NO: 4086290 - DNA, 22 bp, Homo sapiens
attattagccaggtaatgtgaa

SEQ ID NO: 4086291 - DNA, 20 bp, Homo sapiens
attattataagcattgaaat

SEQ ID NO: 4086292 - DNA, 14 bp, Homo sapiens
attattatgaagaa

SEQ ID NO: 4086293 - DNA, 15 bp, Homo sapiens
attattattcttcat

SEQ ID NO: 4086294 - DNA, 14 bp, Homo sapiens
attattcaaaaaca

SEQ ID NO: 4086295 - DNA, 12 bp, Homo sapiens
attattcattta

SEQ ID NO: 4086296 - DNA, 13 bp, Homo sapiens
attattcatttaa

SEQ ID NO: 4086297 - DNA, 12 bp, Homo sapiens
attattctcttt

SEQ ID NO: 4086298 - DNA, 14 bp, Homo sapiens
attattctctttta

SEQ ID NO: 4086299 - DNA, 14 bp, Homo sapiens
attattctgttttg

SEQ ID NO: 4086300 - DNA, 21 bp, Homo sapiens
attattgaaggaagccaaatt

SEQ ID NO: 4086301 - DNA, 13 bp, Homo sapiens
attattgacactg

SEQ ID NO: 4086302 - DNA, 14 bp, Homo sapiens
attattgacactga

SEQ ID NO: 4086303 - DNA, 15 bp, Homo sapiens
attattgacactgaa

SEQ ID NO: 4086304 - DNA, 16 bp, Homo sapiens
attattgacactgaac

SEQ ID NO: 4086305 - DNA, 12 bp, Homo sapiens
attattgcatta

SEQ ID NO: 4086306 - DNA, 18 bp, Homo sapiens
attattggctgctttgcc

SEQ ID NO: 4086307 - DNA, 21 bp, Homo sapiens
attattgtaagttgtacaaat

SEQ ID NO: 4086308 - DNA, 11 bp, Homo sapiens
attatttaaac

SEQ ID NO: 4086309 - DNA, 12 bp, Homo sapiens
attatttaaaca

SEQ ID NO: 4086310 - DNA, 12 bp, Homo sapiens
attatttaataa

SEQ ID NO: 4086311 - DNA, 18 bp, Homo sapiens
attatttaataacattac

SEQ ID NO: 4086312 - DNA, 15 bp, Homo sapiens
attatttaattgcaa

SEQ ID NO: 4086313 - DNA, 13 bp, Homo sapiens
attatttatatgg

SEQ ID NO: 4086314 - DNA, 19 bp, Homo sapiens
attatttctaatccttttc

SEQ ID NO: 4086315 - DNA, 12 bp, Homo sapiens
attatttgtgtt

SEQ ID NO: 4086316 - DNA, 13 bp, Homo sapiens
attattttaaaaa

SEQ ID NO: 4086317 - DNA, 13 bp, Homo sapiens
attattttaaaat

SEQ ID NO: 4086318 - DNA, 14 bp, Homo sapiens
attattttaaaata

SEQ ID NO: 4086319 - DNA, 16 bp, Homo sapiens
attattttaaaatatt

SEQ ID NO: 4086320 - DNA, 18 bp, Homo sapiens
attattttaaaatattta

SEQ ID NO: 4086321 - DNA, 19 bp, Homo sapiens
attattttggggtctcttt

SEQ ID NO: 4086322 - DNA, 21 bp, Homo sapiens
attattttggggtctcttttg

SEQ ID NO: 4086323 - DNA, 18 bp, Homo sapiens
attatttttacctaaaga

SEQ ID NO: 4086324 - DNA, 17 bp, Homo sapiens
attatttttgtgtttct

SEQ ID NO: 4086325 - DNA, 18 bp, Homo sapiens
attatttttgtgtttcta

SEQ ID NO: 4086326 - DNA, 22 bp, Homo sapiens
attattttttttatatttattg

SEQ ID NO: 4086327 - DNA, 23 bp, Homo sapiens
attcaaaaattatctatagctaa

SEQ ID NO: 4086328 - DNA, 15 bp, Homo sapiens
attcaaaagattaat

SEQ ID NO: 4086329 - DNA, 18 bp, Homo sapiens
attcaaagtagttttatt

SEQ ID NO: 4086330 - DNA, 12 bp, Homo sapiens
attcaaagtgtt

SEQ ID NO: 4086331 - DNA, 19 bp, Homo sapiens
attcaaccactgtaaaatg

SEQ ID NO: 4086332 - DNA, 22 bp, Homo sapiens
attcaagaaaacaacttcaata

SEQ ID NO: 4086333 - DNA, 19 bp, Homo sapiens
attcaaggagaatatgata

SEQ ID NO: 4086334 - DNA, 17 bp, Homo sapiens
attcaatattgacattt

SEQ ID NO: 4086335 - DNA, 21 bp, Homo sapiens
attcaatattgacatttgtag

SEQ ID NO: 4086336 - DNA, 22 bp, Homo sapiens
attcaatgtttatgcaaggaag

SEQ ID NO: 4086337 - DNA, 16 bp, Homo sapiens
attcaattcctctggg

SEQ ID NO: 4086338 - DNA, 13 bp, Homo sapiens
attcaattgtaaa

SEQ ID NO: 4086339 - DNA, 14 bp, Homo sapiens
attcaattgtaaat

SEQ ID NO: 4086340 - DNA, 18 bp, Homo sapiens
attcaattgtaaattgaa

SEQ ID NO: 4086341 - DNA, 13 bp, Homo sapiens
attcacaaacttt

SEQ ID NO: 4086342 - DNA, 21 bp, Homo sapiens
attcacactttttatttaatt

SEQ ID NO: 4086343 - DNA, 21 bp, Homo sapiens
attcacattgaccgcaactca

SEQ ID NO: 4086344 - DNA, 18 bp, Homo sapiens
attcacattgttaagaaa

SEQ ID NO: 4086345 - DNA, 21 bp, Homo sapiens
attcaccaaaatagtcttctc

SEQ ID NO: 4086346 - DNA, 16 bp, Homo sapiens
attcaccaaaattatc

SEQ ID NO: 4086347 - DNA, 16 bp, Homo sapiens
attcaccccctttcct

SEQ ID NO: 4086348 - DNA, 21 bp, Homo sapiens
attcacgccattggttggaag

SEQ ID NO: 4086349 - DNA, 16 bp, Homo sapiens
attcactcaagcactg

SEQ ID NO: 4086350 - DNA, 21 bp, Homo sapiens
attcactcaagcactgatatc

SEQ ID NO: 4086351 - DNA, 17 bp, Homo sapiens
attcactgtttcactga

SEQ ID NO: 4086352 - DNA, 13 bp, Homo sapiens
attcagacaggca

SEQ ID NO: 4086353 - DNA, 21 bp, Homo sapiens
attcagatatatttttcacag

SEQ ID NO: 4086354 - DNA, 23 bp, Homo sapiens
attcagatcactgaatttataaa

SEQ ID NO: 4086355 - DNA, 14 bp, Homo sapiens
attcagattttaaa

SEQ ID NO: 4086356 - DNA, 15 bp, Homo sapiens
attcagcaaaccatt

SEQ ID NO: 4086357 - DNA, 17 bp, Homo sapiens
attcagcactgatttca

SEQ ID NO: 4086358 - DNA, 15 bp, Homo sapiens
attcagcatcactaa

SEQ ID NO: 4086359 - DNA, 15 bp, Homo sapiens
attcagctcagcttc

SEQ ID NO: 4086360 - DNA, 22 bp, Homo sapiens
attcaggagagtagaacagata

SEQ ID NO: 4086361 - DNA, 20 bp, Homo sapiens
attcaggccagcccagccag

SEQ ID NO: 4086362 - DNA, 21 bp, Homo sapiens
attcaggccagcccagccagg

SEQ ID NO: 4086363 - DNA, 16 bp, Homo sapiens
attcaggctgcttggg

SEQ ID NO: 4086364 - DNA, 15 bp, Homo sapiens
attcagtaataactc

SEQ ID NO: 4086365 - DNA, 19 bp, Homo sapiens
attcagtattaaagggggg

SEQ ID NO: 4086366 - DNA, 14 bp, Homo sapiens
attcagtgaaaaga

SEQ ID NO: 4086367 - DNA, 17 bp, Homo sapiens
attcagtgattactgtc

SEQ ID NO: 4086368 - DNA, 13 bp, Homo sapiens
attcagtttcata

SEQ ID NO: 4086369 - DNA, 13 bp, Homo sapiens
attcagttttcat

SEQ ID NO: 4086370 - DNA, 14 bp, Homo sapiens
attcagttttcatt

SEQ ID NO: 4086371 - DNA, 16 bp, Homo sapiens
attcagtttttgtatc

SEQ ID NO: 4086372 - DNA, 18 bp, Homo sapiens
attcagtttttgtatctt

SEQ ID NO: 4086373 - DNA, 16 bp, Homo sapiens
attcataaaaactgct

SEQ ID NO: 4086374 - DNA, 23 bp, Homo sapiens
attcatagggaaaggttttgtat

SEQ ID NO: 4086375 - DNA, 16 bp, Homo sapiens
attcatagtaacttct

SEQ ID NO: 4086376 - DNA, 20 bp, Homo sapiens
attcatatttacttcttata

SEQ ID NO: 4086377 - DNA, 14 bp, Homo sapiens
attcatcagcattt

SEQ ID NO: 4086378 - DNA, 17 bp, Homo sapiens
attcatccagcagtgtt

SEQ ID NO: 4086379 - DNA, 16 bp, Homo sapiens
attcatcccaactgtc

SEQ ID NO: 4086380 - DNA, 20 bp, Homo sapiens
attcatctgtttttcttttt

SEQ ID NO: 4086381 - DNA, 16 bp, Homo sapiens
attcatgaggagggtg

SEQ ID NO: 4086382 - DNA, 14 bp, Homo sapiens
aggaataaggcctt

SEQ ID NO: 4086383 - DNA, 22 bp, Homo sapiens
aggaatatgacggaagaacata

SEQ ID NO: 4086384 - DNA, 20 bp, Homo sapiens
aggaatcaagagctgccctc

SEQ ID NO: 4086385 - DNA, 22 bp, Homo sapiens
aggaatcatgtcaggcctgtgt

SEQ ID NO: 4086386 - DNA, 23 bp, Homo sapiens
aggaatcatgtcaggcctgtgtg

SEQ ID NO: 4086387 - DNA, 21 bp, Homo sapiens
aggaatcattccagtgctaga

SEQ ID NO: 4086388 - DNA, 15 bp, Homo sapiens
aggaatcccagaggt

SEQ ID NO: 4086389 - DNA, 19 bp, Homo sapiens
aggaatctgtgggtctggg

SEQ ID NO: 4086390 - DNA, 24 bp, Homo sapiens
aggaatgcctcctccctgggcaga

SEQ ID NO: 4086391 - DNA, 13 bp, Homo sapiens
aggaatgcctgtg

SEQ ID NO: 4086392 - DNA, 15 bp, Homo sapiens
aggaatgctggactg

SEQ ID NO: 4086393 - DNA, 16 bp, Homo sapiens
aggaatgctggactgg

SEQ ID NO: 4086394 - DNA, 20 bp, Homo sapiens
aggaattccccaaagaatgt

SEQ ID NO: 4086395 - DNA, 13 bp, Homo sapiens
aggaatttaaaat

SEQ ID NO: 4086396 - DNA, 19 bp, Homo sapiens
aggaatttaaaattaagta

SEQ ID NO: 4086397 - DNA, 15 bp, Homo sapiens
aggaatttatacctc

SEQ ID NO: 4086398 - DNA, 18 bp, Homo sapiens
aggaatttcccaggaccc

SEQ ID NO: 4086399 - DNA, 19 bp, Homo sapiens
aggaatttcccaggaccct

SEQ ID NO: 4086400 - DNA, 18 bp, Homo sapiens
aggaatttgatgattttc

SEQ ID NO: 4086401 - DNA, 18 bp, Homo sapiens
aggacaaaaatgaactga

SEQ ID NO: 4086402 - DNA, 19 bp, Homo sapiens
aggacaaggtgcaggcagg

SEQ ID NO: 4086403 - DNA, 20 bp, Homo sapiens
aggacacaccccacacccca

SEQ ID NO: 4086404 - DNA, 16 bp, Homo sapiens
aggacagaaggctcct

SEQ ID NO: 4086405 - DNA, 14 bp, Homo sapiens
atcaattccctctc

SEQ ID NO: 4086406 - DNA, 24 bp, Homo sapiens
atcaattccctctctcagcacagc

SEQ ID NO: 4086407 - DNA, 19 bp, Homo sapiens
atcaattggcagtgacttt

SEQ ID NO: 4086408 - DNA, 23 bp, Homo sapiens
atcaattggcagtgactttgtat

SEQ ID NO: 4086409 - DNA, 20 bp, Homo sapiens
atcaatttgtaattgcttac

SEQ ID NO: 4086410 - DNA, 12 bp, Homo sapiens
atcaattttcat

SEQ ID NO: 4086411 - DNA, 22 bp, Homo sapiens
atcaattttcattaaacttgaa

SEQ ID NO: 4086412 - DNA, 17 bp, Homo sapiens
atcacaacactggctga

SEQ ID NO: 4086413 - DNA, 21 bp, Homo sapiens
atcacaaccaccgttacaagt

SEQ ID NO: 4086414 - DNA, 16 bp, Homo sapiens
atcacaagatggaatt

SEQ ID NO: 4086415 - DNA, 14 bp, Homo sapiens
atcacacttctgtg

SEQ ID NO: 4086416 - DNA, 16 bp, Homo sapiens
atcacacttctgtgag

SEQ ID NO: 4086417 - DNA, 10 bp, Homo sapiens
atcacagcct

SEQ ID NO: 4086418 - DNA, 18 bp, Homo sapiens
atcacagcctccagggcc

SEQ ID NO: 4086419 - DNA, 19 bp, Homo sapiens
atcacagcctccagggccc

SEQ ID NO: 4086420 - DNA, 20 bp, Homo sapiens
atcacagtattatctgtgtt

SEQ ID NO: 4086421 - DNA, 15 bp, Homo sapiens
atcacattatttgca

SEQ ID NO: 4086422 - DNA, 16 bp, Homo sapiens
atcacattatttgcat

SEQ ID NO: 4086423 - DNA, 24 bp, Homo sapiens
atcacattgagctgatataaattc

SEQ ID NO: 4086424 - DNA, 20 bp, Homo sapiens
atcaccccaaccccccaaaa

SEQ ID NO: 4086425 - DNA, 23 bp, Homo sapiens
atcaccccctccctacacacaca

SEQ ID NO: 4086426 - DNA, 14 bp, Homo sapiens
atcaccctttgcct

SEQ ID NO: 4086427 - DNA, 20 bp, Homo sapiens
atcaccgacgcgtctcctgt

SEQ ID NO: 4086428 - DNA, 14 bp, Homo sapiens
atcacctatttcca

SEQ ID NO: 4086429 - DNA, 15 bp, Homo sapiens
atcacctatttccat

SEQ ID NO: 4086430 - DNA, 15 bp, Homo sapiens
atcacctgcatcaca

SEQ ID NO: 4086431 - DNA, 13 bp, Homo sapiens
atcacctggctga

SEQ ID NO: 4086432 - DNA, 17 bp, Homo sapiens
atcacctggctgagcag

SEQ ID NO: 4086433 - DNA, 22 bp, Homo sapiens
atcacctggctgagcagttccc

SEQ ID NO: 4086434 - DNA, 22 bp, Homo sapiens
atcacggtcgccacctggcatt

SEQ ID NO: 4086435 - DNA, 17 bp, Homo sapiens
atcactagaagaaaagc

SEQ ID NO: 4086436 - DNA, 14 bp, Homo sapiens
atcactcagagcag

SEQ ID NO: 4086437 - DNA, 17 bp, Homo sapiens
atgcataaatatgcagt

SEQ ID NO: 4086438 - DNA, 21 bp, Homo sapiens
atgcataaatatgcagtgata

SEQ ID NO: 4086439 - DNA, 17 bp, Homo sapiens
atgcatatcctgagcca

SEQ ID NO: 4086440 - DNA, 18 bp, Homo sapiens
atgcatatcctgagccat

SEQ ID NO: 4086441 - DNA, 18 bp, Homo sapiens
atgcatatgtcactagaa

SEQ ID NO: 4086442 - DNA, 20 bp, Homo sapiens
atgcatatgtcactagaatg

SEQ ID NO: 4086443 - DNA, 21 bp, Homo sapiens
atgcatcacgtaccccactgg

SEQ ID NO: 4086444 - DNA, 12 bp, Homo sapiens
atgcatgaagca

SEQ ID NO: 4086445 - DNA, 14 bp, Homo sapiens
atgcatgaagcaac

SEQ ID NO: 4086446 - DNA, 14 bp, Homo sapiens
atgcatgccctctc

SEQ ID NO: 4086447 - DNA, 23 bp, Homo sapiens
atgcatggtgcagttgacagcag

SEQ ID NO: 4086448 - DNA, 16 bp, Homo sapiens
atgcatggtgccccag

SEQ ID NO: 4086449 - DNA, 21 bp, Homo sapiens
atgcatggtgccccaggacca

SEQ ID NO: 4086450 - DNA, 14 bp, Homo sapiens
atgcattctatcgt

SEQ ID NO: 4086451 - DNA, 15 bp, Homo sapiens
atgcattctatcgtt

SEQ ID NO: 4086452 - DNA, 22 bp, Homo sapiens
atgcattctatcgttattataa

SEQ ID NO: 4086453 - DNA, 21 bp, Homo sapiens
atgcattgttggctatttgaa

SEQ ID NO: 4086454 - DNA, 22 bp, Homo sapiens
atgcattgttggctatttgaaa

SEQ ID NO: 4086455 - DNA, 13 bp, Homo sapiens
atgcatttcaagc

SEQ ID NO: 4086456 - DNA, 18 bp, Homo sapiens
atgccacacagagtggtc

SEQ ID NO: 4086457 - DNA, 17 bp, Homo sapiens
atgccaccctcacacac

SEQ ID NO: 4086458 - DNA, 14 bp, Homo sapiens
atgccacctggcaa

SEQ ID NO: 4086459 - DNA, 21 bp, Homo sapiens
atgccacgtggtcactgtgca

SEQ ID NO: 4086460 - DNA, 17 bp, Homo sapiens
atgccagattctgcctc

SEQ ID NO: 4086461 - DNA, 14 bp, Homo sapiens
atgccagctgtgtc

SEQ ID NO: 4086462 - DNA, 16 bp, Homo sapiens
atgccagctgtgtcct

SEQ ID NO: 4086463 - DNA, 14 bp, Homo sapiens
atgccatttctcac

SEQ ID NO: 4086464 - DNA, 12 bp, Homo sapiens
atgcccaccccc

SEQ ID NO: 4086465 - DNA, 16 bp, Homo sapiens
atgcccaccccctgcc

SEQ ID NO: 4086466 - DNA, 16 bp, Homo sapiens
atgcccacctgcccat

SEQ ID NO: 4086467 - DNA, 11 bp, Homo sapiens
atgcccactgc

SEQ ID NO: 4086468 - DNA, 16 bp, Homo sapiens
atgcccactgctggtg

SEQ ID NO: 4086469 - DNA, 19 bp, Homo sapiens
atgcccactgctggtgcca

SEQ ID NO: 4086470 - DNA, 14 bp, Homo sapiens
atgcccagcagggg

SEQ ID NO: 4086471 - DNA, 16 bp, Homo sapiens
atgcccagtgagactg

SEQ ID NO: 4086472 - DNA, 12 bp, Homo sapiens
atgccccaagga

SEQ ID NO: 4086473 - DNA, 17 bp, Homo sapiens
atgcccggctaattttt

SEQ ID NO: 4086474 - DNA, 21 bp, Homo sapiens
atgccgaatgccctcagggga

SEQ ID NO: 4086475 - DNA, 22 bp, Homo sapiens
atgccgtggattgcacgtggcc

SEQ ID NO: 4086476 - DNA, 21 bp, Homo sapiens
atgcctacaaccatccctgcc

SEQ ID NO: 4086477 - DNA, 19 bp, Homo sapiens
atgcctagcacaagtacca

SEQ ID NO: 4086478 - DNA, 14 bp, Homo sapiens
atgcctatattatc

SEQ ID NO: 4086479 - DNA, 15 bp, Homo sapiens
atgcctatattatca

SEQ ID NO: 4086480 - DNA, 16 bp, Homo sapiens
atgcctcaattcacat

SEQ ID NO: 4086481 - DNA, 22 bp, Homo sapiens
atgcctcaattcacatagattt

SEQ ID NO: 4086482 - DNA, 14 bp, Homo sapiens
atgcctcctgtggg

SEQ ID NO: 4086483 - DNA, 17 bp, Homo sapiens
atgcctgcgcctgctgc

SEQ ID NO: 4086484 - DNA, 17 bp, Homo sapiens
atgcctgtccagcctgg

SEQ ID NO: 4086485 - DNA, 18 bp, Homo sapiens
atgcctgtccagcctggg

SEQ ID NO: 4086486 - DNA, 20 bp, Homo sapiens
atggtaactgctttctgttc

SEQ ID NO: 4086487 - DNA, 23 bp, Homo sapiens
atggtaactgctttctgttccaa

SEQ ID NO: 4086488 - DNA, 15 bp, Homo sapiens
atggtatgctggcca

SEQ ID NO: 4086489 - DNA, 17 bp, Homo sapiens
atggtatgctggccagc

SEQ ID NO: 4086490 - DNA, 19 bp, Homo sapiens
atggtcaccaaatcagctg

SEQ ID NO: 4086491 - DNA, 22 bp, Homo sapiens
atggtcatcttggagggaccaa

SEQ ID NO: 4086492 - DNA, 20 bp, Homo sapiens
atggtccagaaactcctgtt

SEQ ID NO: 4086493 - DNA, 18 bp, Homo sapiens
atggtccatttgttcctg

SEQ ID NO: 4086494 - DNA, 20 bp, Homo sapiens
atggtgcagagaagctggac

SEQ ID NO: 4086495 - DNA, 22 bp, Homo sapiens
atggtgcagagaagctggactt

SEQ ID NO: 4086496 - DNA, 14 bp, Homo sapiens
atggtgccccagga

SEQ ID NO: 4086497 - DNA, 18 bp, Homo sapiens
atggtgccccaggaccag

SEQ ID NO: 4086498 - DNA, 15 bp, Homo sapiens
atggtgcctgagagg

SEQ ID NO: 4086499 - DNA, 17 bp, Homo sapiens
atggtgcctgagaggca

SEQ ID NO: 4086500 - DNA, 23 bp, Homo sapiens
atggtgcctgagaggcaggcata

SEQ ID NO: 4086501 - DNA, 21 bp, Homo sapiens
atggtgctgcagatttgatat

SEQ ID NO: 4086502 - DNA, 18 bp, Homo sapiens
atggtggactacaaaata

SEQ ID NO: 4086503 - DNA, 16 bp, Homo sapiens
atggtggcgcgcacct

SEQ ID NO: 4086504 - DNA, 19 bp, Homo sapiens
atggtggggatatttttaa

SEQ ID NO: 4086505 - DNA, 12 bp, Homo sapiens
atggtgtaataa

SEQ ID NO: 4086506 - DNA, 20 bp, Homo sapiens
atggtgtaataagacataac

SEQ ID NO: 4086507 - DNA, 15 bp, Homo sapiens
atggttatgaaagaa

SEQ ID NO: 4086508 - DNA, 20 bp, Homo sapiens
atggttatgaaagaatatat

SEQ ID NO: 4086509 - DNA, 17 bp, Homo sapiens
atggttccatgcctgag

SEQ ID NO: 4086510 - DNA, 16 bp, Homo sapiens
atggttcccaataaaa

SEQ ID NO: 4086511 - DNA, 19 bp, Homo sapiens
atggttcccctgttcactc

SEQ ID NO: 4086512 - DNA, 14 bp, Homo sapiens
atggttcttcacct

SEQ ID NO: 4086513 - DNA, 19 bp, Homo sapiens
atggttgatggaaaataaa

SEQ ID NO: 4086514 - DNA, 16 bp, Homo sapiens
atggtttggtttttct

SEQ ID NO: 4086515 - DNA, 15 bp, Homo sapiens
atggttttcaaaata

SEQ ID NO: 4086516 - DNA, 16 bp, Homo sapiens
atggttttcaaaataa

SEQ ID NO: 4086517 - DNA, 21 bp, Homo sapiens
atggttttcattcattggtga

SEQ ID NO: 4086518 - DNA, 23 bp, Homo sapiens
atgtaaaagaacttactgattat

SEQ ID NO: 4086519 - DNA, 23 bp, Homo sapiens
atgtaaacataattcttgtatat

SEQ ID NO: 4086520 - DNA, 21 bp, Homo sapiens
atgtaaactttgtcatggttt

SEQ ID NO: 4086521 - DNA, 14 bp, Homo sapiens
atgtaaagaaatgt

SEQ ID NO: 4086522 - DNA, 17 bp, Homo sapiens
atgtaaagaacttaaat

SEQ ID NO: 4086523 - DNA, 20 bp, Homo sapiens
atgtaaagaacttaaattat

SEQ ID NO: 4086524 - DNA, 18 bp, Homo sapiens
atgtaacacataaacaat

SEQ ID NO: 4086525 - DNA, 21 bp, Homo sapiens
atgtaacagccaggagtgtta

SEQ ID NO: 4086526 - DNA, 22 bp, Homo sapiens
atgtaagaaaacaaaatctaaa

SEQ ID NO: 4086527 - DNA, 14 bp, Homo sapiens
atgtaatactggaa

SEQ ID NO: 4086528 - DNA, 15 bp, Homo sapiens
atgtaatcaatgttt

SEQ ID NO: 4086529 - DNA, 19 bp, Homo sapiens
atgtaatctctctgcagct

SEQ ID NO: 4086530 - DNA, 21 bp, Homo sapiens
atgtaatctctctgcagctgc

SEQ ID NO: 4086531 - DNA, 23 bp, Homo sapiens
atgtaatctctctgcagctgccg

SEQ ID NO: 4086532 - DNA, 22 bp, Homo sapiens
atgtaatgtgtggtggcctcag

SEQ ID NO: 4086533 - DNA, 15 bp, Homo sapiens
atgtaattaagtact

SEQ ID NO: 4086534 - DNA, 17 bp, Homo sapiens
atgtaattaagtactat

SEQ ID NO: 4086535 - DNA, 16 bp, Homo sapiens
atgtaatttagaaact

SEQ ID NO: 4086536 - DNA, 21 bp, Homo sapiens
atgtaatttagaaactgattt

SEQ ID NO: 4086537 - DNA, 14 bp, Homo sapiens
atgtacataactcc

SEQ ID NO: 4086538 - DNA, 18 bp, Homo sapiens
atgtaccatgaaacaaag

SEQ ID NO: 4086539 - DNA, 21 bp, Homo sapiens
atgtaccatgtacatgaagaa

SEQ ID NO: 4086540 - DNA, 18 bp, Homo sapiens
atgtaccatttgcatggc

SEQ ID NO: 4086541 - DNA, 18 bp, Homo sapiens
atgtactagtgttctgtt

SEQ ID NO: 4086542 - DNA, 22 bp, Homo sapiens
atgtactagtgttctgtttgtt

SEQ ID NO: 4086543 - DNA, 17 bp, Homo sapiens
atgtactcctctttaca

SEQ ID NO: 4086544 - DNA, 19 bp, Homo sapiens
atgtactgtatattacaga

SEQ ID NO: 4086545 - DNA, 15 bp, Homo sapiens
atgtagagaaaagca

SEQ ID NO: 4086546 - DNA, 16 bp, Homo sapiens
atgtagagagaacagg

SEQ ID NO: 4086547 - DNA, 22 bp, Homo sapiens
atgtagatattgttttctgtaa

SEQ ID NO: 4086548 - DNA, 20 bp, Homo sapiens
atgtagatttgtacaggagt

SEQ ID NO: 4086549 - DNA, 20 bp, Homo sapiens
atgtagcaaaacgcatggag

SEQ ID NO: 4086550 - DNA, 15 bp, Homo sapiens
atgtagcacataaac

SEQ ID NO: 4086551 - DNA, 16 bp, Homo sapiens
atgtagcacataaact

SEQ ID NO: 4086552 - DNA, 19 bp, Homo sapiens
atgtagcacataaactttg

SEQ ID NO: 4086553 - DNA, 14 bp, Homo sapiens
atgtagccagctgt

SEQ ID NO: 4086554 - DNA, 22 bp, Homo sapiens
atgtagctctgcatctcctgtc

SEQ ID NO: 4086555 - DNA, 14 bp, Homo sapiens
atgtagctggtttc

SEQ ID NO: 4086556 - DNA, 12 bp, Homo sapiens
atgtagcttttg

SEQ ID NO: 4086557 - DNA, 16 bp, Homo sapiens
atgtaggtatgaataa

SEQ ID NO: 4086558 - DNA, 21 bp, Homo sapiens
atgtaggtgtctgcacccagg

SEQ ID NO: 4086559 - DNA, 18 bp, Homo sapiens
atgtagtaattgacatgt

SEQ ID NO: 4086560 - DNA, 14 bp, Homo sapiens
atgtagtagtactt

SEQ ID NO: 4086561 - DNA, 19 bp, Homo sapiens
atgtagtataaagaaaagt

SEQ ID NO: 4086562 - DNA, 18 bp, Homo sapiens
atgtagttctgccaggca

SEQ ID NO: 4086563 - DNA, 20 bp, Homo sapiens
atgtataaacataagttgca

SEQ ID NO: 4086564 - DNA, 16 bp, Homo sapiens
atgtataaatgtgata

SEQ ID NO: 4086565 - DNA, 19 bp, Homo sapiens
atgtatactatagtaccag

SEQ ID NO: 4086566 - DNA, 23 bp, Homo sapiens
atgtatatcattctacagaataa

SEQ ID NO: 4086567 - DNA, 16 bp, Homo sapiens
atgtatatgtttatat

SEQ ID NO: 4086568 - DNA, 20 bp, Homo sapiens
atgtatatttttttaattta

SEQ ID NO: 4086569 - DNA, 13 bp, Homo sapiens
atgtatcaggaaa

SEQ ID NO: 4086570 - DNA, 17 bp, Homo sapiens
atgtatcagtgtccttt

SEQ ID NO: 4086571 - DNA, 18 bp, Homo sapiens
atgtatcagtgtcctttc

SEQ ID NO: 4086572 - DNA, 12 bp, Homo sapiens
atgtatcatctg

SEQ ID NO: 4086573 - DNA, 23 bp, Homo sapiens
atgtatgaaggaatcattccagt

SEQ ID NO: 4086574 - DNA, 15 bp, Homo sapiens
atgtatgatctctct

SEQ ID NO: 4086575 - DNA, 22 bp, Homo sapiens
atgtatgatctctctagctttg

SEQ ID NO: 4086576 - DNA, 16 bp, Homo sapiens
atgtatgtatgtatta

SEQ ID NO: 4086577 - DNA, 20 bp, Homo sapiens
atgtatgtgcactgtcactt

SEQ ID NO: 4086578 - DNA, 12 bp, Homo sapiens
atgtatgtgtaa

SEQ ID NO: 4086579 - DNA, 14 bp, Homo sapiens
atgtatgtttacat

SEQ ID NO: 4086580 - DNA, 17 bp, Homo sapiens
atgtattattctgcagc

SEQ ID NO: 4086581 - DNA, 15 bp, Homo sapiens
atgtattcatccaga

SEQ ID NO: 4086582 - DNA, 17 bp, Homo sapiens
atgtattcatccagagt

SEQ ID NO: 4086583 - DNA, 19 bp, Homo sapiens
atgtattctagctaatgta

SEQ ID NO: 4086584 - DNA, 20 bp, Homo sapiens
atgtattctagctaatgtaa

SEQ ID NO: 4086585 - DNA, 14 bp, Homo sapiens
atgtattgtaatct

SEQ ID NO: 4086586 - DNA, 22 bp, Homo sapiens
atgtatttattcctctgtccta

SEQ ID NO: 4086587 - DNA, 12 bp, Homo sapiens
atgtattttaca

SEQ ID NO: 4086588 - DNA, 23 bp, Homo sapiens
aggcacacagcagccccccagca

SEQ ID NO: 4086589 - DNA, 13 bp, Homo sapiens
aggcacagctgag

SEQ ID NO: 4086590 - DNA, 16 bp, Homo sapiens
aggcacagggcccgca

SEQ ID NO: 4086591 - DNA, 15 bp, Homo sapiens
aggcaccagcatcca

SEQ ID NO: 4086592 - DNA, 20 bp, Homo sapiens
aggcaccagcatccaccttg

SEQ ID NO: 4086593 - DNA, 17 bp, Homo sapiens
aggcaccccctggagag

SEQ ID NO: 4086594 - DNA, 14 bp, Homo sapiens
aggcaccctcaggg

SEQ ID NO: 4086595 - DNA, 15 bp, Homo sapiens
aggcaccctcaggga

SEQ ID NO: 4086596 - DNA, 15 bp, Homo sapiens
aggcaccgagaatgt

SEQ ID NO: 4086597 - DNA, 20 bp, Homo sapiens
aggcaccgccacgtcccagc

SEQ ID NO: 4086598 - DNA, 21 bp, Homo sapiens
aggcaccgccacgtcccagca

SEQ ID NO: 4086599 - DNA, 14 bp, Homo sapiens
aggcacctcttcct

SEQ ID NO: 4086600 - DNA, 14 bp, Homo sapiens
aggcacgggtccct

SEQ ID NO: 4086601 - DNA, 13 bp, Homo sapiens
aggcactcagtga

SEQ ID NO: 4086602 - DNA, 17 bp, Homo sapiens
aggcactcagtgagcct

SEQ ID NO: 4086603 - DNA, 19 bp, Homo sapiens
aggcactcagtgagcctcc

SEQ ID NO: 4086604 - DNA, 20 bp, Homo sapiens
aggcactcagtgagcctcct

SEQ ID NO: 4086605 - DNA, 18 bp, Homo sapiens
aggcactgcccttttcag

SEQ ID NO: 4086606 - DNA, 15 bp, Homo sapiens
atactggcctggact

SEQ ID NO: 4086607 - DNA, 23 bp, Homo sapiens
atactgtgaagttacatgcataa

SEQ ID NO: 4086608 - DNA, 14 bp, Homo sapiens
atactgtgcagaat

SEQ ID NO: 4086609 - DNA, 19 bp, Homo sapiens
atacttcatgagcattcat

SEQ ID NO: 4086610 - DNA, 16 bp, Homo sapiens
atacttgaagggccag

SEQ ID NO: 4086611 - DNA, 22 bp, Homo sapiens
atacttgaagggccagagccag

SEQ ID NO: 4086612 - DNA, 23 bp, Homo sapiens
atacttgaagggccagagccagg

SEQ ID NO: 4086613 - DNA, 14 bp, Homo sapiens
atactttaaaggaa

SEQ ID NO: 4086614 - DNA, 15 bp, Homo sapiens
atactttaaaggaaa

SEQ ID NO: 4086615 - DNA, 16 bp, Homo sapiens
atactttaaaggaaaa

SEQ ID NO: 4086616 - DNA, 23 bp, Homo sapiens
atactttaaaggaaaaaatgttg

SEQ ID NO: 4086617 - DNA, 23 bp, Homo sapiens
atactttgaaaggagatgtcttg

SEQ ID NO: 4086618 - DNA, 17 bp, Homo sapiens
atacttttactctgcct

SEQ ID NO: 4086619 - DNA, 20 bp, Homo sapiens
atacttttcccctgttaaac

SEQ ID NO: 4086620 - DNA, 22 bp, Homo sapiens
atacttttcccctgttaaacag

SEQ ID NO: 4086621 - DNA, 19 bp, Homo sapiens
atacttttttcttatttaa

SEQ ID NO: 4086622 - DNA, 21 bp, Homo sapiens
atagaaactcaccatgtaaaa

SEQ ID NO: 4086623 - DNA, 15 bp, Homo sapiens
atagaaagaagccat

SEQ ID NO: 4086624 - DNA, 20 bp, Homo sapiens
atagaaataaatagctatat

SEQ ID NO: 4086625 - DNA, 17 bp, Homo sapiens
atagaaattttgtaaga

SEQ ID NO: 4086626 - DNA, 11 bp, Homo sapiens
atagaataaaa

SEQ ID NO: 4086627 - DNA, 13 bp, Homo sapiens
atagaataaaagc

SEQ ID NO: 4086628 - DNA, 12 bp, Homo sapiens
atagaatattta

SEQ ID NO: 4086629 - DNA, 13 bp, Homo sapiens
atagaatatttat

SEQ ID NO: 4086630 - DNA, 19 bp, Homo sapiens
atagaatatttattacctc

SEQ ID NO: 4086631 - DNA, 12 bp, Homo sapiens
atagaatgctgc

SEQ ID NO: 4086632 - DNA, 16 bp, Homo sapiens
atagacaaatagaaaa

SEQ ID NO: 4086633 - DNA, 14 bp, Homo sapiens
atagacaattgagg

SEQ ID NO: 4086634 - DNA, 23 bp, Homo sapiens
atagagactgtagattgcttctg

SEQ ID NO: 4086635 - DNA, 22 bp, Homo sapiens
atagagatttgtctaattgcat

SEQ ID NO: 4086636 - DNA, 17 bp, Homo sapiens
atagagcaaaattgatg

SEQ ID NO: 4086637 - DNA, 21 bp, Homo sapiens
atagagcaaaattgatgtgtt

SEQ ID NO: 4086638 - DNA, 21 bp, Homo sapiens
atagagtgtacttaactattc

SEQ ID NO: 4086639 - DNA, 14 bp, Homo sapiens
atagagtgttatca

SEQ ID NO: 4086640 - DNA, 19 bp, Homo sapiens
atagatcaaagtcaaaaat

SEQ ID NO: 4086641 - DNA, 19 bp, Homo sapiens
atagatgcaagatatttat

SEQ ID NO: 4086642 - DNA, 20 bp, Homo sapiens
atagatgctggcccagggcc

SEQ ID NO: 4086643 - DNA, 23 bp, Homo sapiens
atagatgggtctggctgagctga

SEQ ID NO: 4086644 - DNA, 19 bp, Homo sapiens
atagatgtccctttcttgg

SEQ ID NO: 4086645 - DNA, 23 bp, Homo sapiens
atagatgtccctttcttggccag

SEQ ID NO: 4086646 - DNA, 23 bp, Homo sapiens
atagatgttttggtagattaaat

SEQ ID NO: 4086647 - DNA, 13 bp, Homo sapiens
atagattagaaaa

SEQ ID NO: 4086648 - DNA, 17 bp, Homo sapiens
atagatttttgtttttg

SEQ ID NO: 4086649 - DNA, 16 bp, Homo sapiens
atagcaaacttggaat

SEQ ID NO: 4086650 - DNA, 17 bp, Homo sapiens
atagcaacaacaattgg

SEQ ID NO: 4086651 - DNA, 19 bp, Homo sapiens
atagcaacaacaattggta

SEQ ID NO: 4086652 - DNA, 22 bp, Homo sapiens
atagcaatccatgttagttttt

SEQ ID NO: 4086653 - DNA, 16 bp, Homo sapiens
atagcagacagtgttt

SEQ ID NO: 4086654 - DNA, 14 bp, Homo sapiens
atagcagattttaa

SEQ ID NO: 4086655 - DNA, 13 bp, Homo sapiens
atagcagcctttc

SEQ ID NO: 4086656 - DNA, 23 bp, Homo sapiens
atagcatctcaggagatttcatg

SEQ ID NO: 4086657 - DNA, 13 bp, Homo sapiens
atagcatgtaatg

SEQ ID NO: 4086658 - DNA, 19 bp, Homo sapiens
atagccctgcaaaaattca

SEQ ID NO: 4086659 - DNA, 20 bp, Homo sapiens
atagcctggccaccagccat

SEQ ID NO: 4086660 - DNA, 16 bp, Homo sapiens
atagccttcaaaaaga

SEQ ID NO: 4086661 - DNA, 18 bp, Homo sapiens
atagctaagtacacaata

SEQ ID NO: 4086662 - DNA, 16 bp, Homo sapiens
atagctacaggaagca

SEQ ID NO: 4086663 - DNA, 22 bp, Homo sapiens
atagctatatccatgtactgta

SEQ ID NO: 4086664 - DNA, 17 bp, Homo sapiens
atagctcactgcagcct

SEQ ID NO: 4086665 - DNA, 20 bp, Homo sapiens
atagctcactgcagcctcat

SEQ ID NO: 4086666 - DNA, 22 bp, Homo sapiens
atagctcagtttatccaaggtg

SEQ ID NO: 4086667 - DNA, 22 bp, Homo sapiens
atagctttattttttaagtatt

SEQ ID NO: 4086668 - DNA, 18 bp, Homo sapiens
ataggaaaagtacattta

SEQ ID NO: 4086669 - DNA, 21 bp, Homo sapiens
ataggaaagtatttttttaag

SEQ ID NO: 4086670 - DNA, 18 bp, Homo sapiens
ataggaacatatgaaaat

SEQ ID NO: 4086671 - DNA, 21 bp, Homo sapiens
ataggaacatatgaaaataca

SEQ ID NO: 4086672 - DNA, 19 bp, Homo sapiens
ataggaagcgtctggcaga

SEQ ID NO: 4086673 - DNA, 13 bp, Homo sapiens
ataggaattcatc

SEQ ID NO: 4086674 - DNA, 18 bp, Homo sapiens
ataggacatactgcatgt

SEQ ID NO: 4086675 - DNA, 15 bp, Homo sapiens
ataggagaggagggt

SEQ ID NO: 4086676 - DNA, 14 bp, Homo sapiens
ataggagaggatga

SEQ ID NO: 4086677 - DNA, 23 bp, Homo sapiens
ataggagaggatgagagcccaga

SEQ ID NO: 4086678 - DNA, 20 bp, Homo sapiens
ataggccagggcatgtgtat

SEQ ID NO: 4086679 - DNA, 14 bp, Homo sapiens
ataggcccaaggtc

SEQ ID NO: 4086680 - DNA, 22 bp, Homo sapiens
ataggcctgctttgtctcctct

SEQ ID NO: 4086681 - DNA, 18 bp, Homo sapiens
ataggcctgtcccttgcc

SEQ ID NO: 4086682 - DNA, 11 bp, Homo sapiens
ataggctctgc

SEQ ID NO: 4086683 - DNA, 15 bp, Homo sapiens
ataggctctgcacag

SEQ ID NO: 4086684 - DNA, 13 bp, Homo sapiens
ataggctggagaa

SEQ ID NO: 4086685 - DNA, 17 bp, Homo sapiens
ataggggatatttaagg

SEQ ID NO: 4086686 - DNA, 16 bp, Homo sapiens
ataggtaagctgtgcc

SEQ ID NO: 4086687 - DNA, 23 bp, Homo sapiens
ataggtaatcaatgaatattgaa

SEQ ID NO: 4086688 - DNA, 16 bp, Homo sapiens
ataggtcactcctggg

SEQ ID NO: 4086689 - DNA, 23 bp, Homo sapiens
ataggttttcccctcttttgtta

SEQ ID NO: 4086690 - DNA, 22 bp, Homo sapiens
atagtagttagcttaagtagtt

SEQ ID NO: 4086691 - DNA, 12 bp, Homo sapiens
atagtattggag

SEQ ID NO: 4086692 - DNA, 20 bp, Homo sapiens
atagtatttgagagttctaa

SEQ ID NO: 4086693 - DNA, 22 bp, Homo sapiens
atagtcgggatgtcagcagaca

SEQ ID NO: 4086694 - DNA, 13 bp, Homo sapiens
atagtctttcagt

SEQ ID NO: 4086695 - DNA, 13 bp, Homo sapiens
atagtgaatactg

SEQ ID NO: 4086696 - DNA, 15 bp, Homo sapiens
atagtgaatacttac

SEQ ID NO: 4086697 - DNA, 20 bp, Homo sapiens
atagtgacaagtgaagaaca

SEQ ID NO: 4086698 - DNA, 15 bp, Homo sapiens
atagtgcaactatga

SEQ ID NO: 4086699 - DNA, 23 bp, Homo sapiens
atagtgtaacttgcttaaatttc

SEQ ID NO: 4086700 - DNA, 12 bp, Homo sapiens
atagtgtgttct

SEQ ID NO: 4086701 - DNA, 16 bp, Homo sapiens
atagtgttctgctcct

SEQ ID NO: 4086702 - DNA, 22 bp, Homo sapiens
atagttaagcgtgcataagtta

SEQ ID NO: 4086703 - DNA, 14 bp, Homo sapiens
atagtttacatgta

SEQ ID NO: 4086704 - DNA, 22 bp, Homo sapiens
atagtttattattattaaagtc

SEQ ID NO: 4086705 - DNA, 16 bp, Homo sapiens
atagtttgtctatttt

SEQ ID NO: 4086706 - DNA, 21 bp, Homo sapiens
atagtttttaccttttatgta

SEQ ID NO: 4086707 - DNA, 13 bp, Homo sapiens
atatgaatctgct

SEQ ID NO: 4086708 - DNA, 16 bp, Homo sapiens
atatgacatttaaatg

SEQ ID NO: 4086709 - DNA, 23 bp, Homo sapiens
atatgaccaaatatcaccaggac

SEQ ID NO: 4086710 - DNA, 16 bp, Homo sapiens
atatgaccagaagcct

SEQ ID NO: 4086711 - DNA, 16 bp, Homo sapiens
atatgacggaagaaca

SEQ ID NO: 4086712 - DNA, 22 bp, Homo sapiens
atatgagcttccttctgtgaaa

SEQ ID NO: 4086713 - DNA, 13 bp, Homo sapiens
atatgataaaaca

SEQ ID NO: 4086714 - DNA, 16 bp, Homo sapiens
atatgatatgtaaaca

SEQ ID NO: 4086715 - DNA, 22 bp, Homo sapiens
atatgattgtttctcaaatctt

SEQ ID NO: 4086716 - DNA, 22 bp, Homo sapiens
atatgattttatttgacaaaat

SEQ ID NO: 4086717 - DNA, 15 bp, Homo sapiens
atatgctaatttggg

SEQ ID NO: 4086718 - DNA, 17 bp, Homo sapiens
atatgctctgcatgtta

SEQ ID NO: 4086719 - DNA, 18 bp, Homo sapiens
atatgctgccaaattttg

SEQ ID NO: 4086720 - DNA, 19 bp, Homo sapiens
atatgcttaaaataagcag

SEQ ID NO: 4086721 - DNA, 15 bp, Homo sapiens
atatggacaagaggt

SEQ ID NO: 4086722 - DNA, 21 bp, Homo sapiens
atatggagtgagtcacctgct

SEQ ID NO: 4086723 - DNA, 23 bp, Homo sapiens
atatggagtgagtcacctgctcc

SEQ ID NO: 4086724 - DNA, 17 bp, Homo sapiens
atatggatttgttacag

SEQ ID NO: 4086725 - DNA, 13 bp, Homo sapiens
atatggccacagt

SEQ ID NO: 4086726 - DNA, 15 bp, Homo sapiens
atatggcccagcctt

SEQ ID NO: 4086727 - DNA, 11 bp, Homo sapiens
atatggctgcc

SEQ ID NO: 4086728 - DNA, 16 bp, Homo sapiens
atatggggaatatatt

SEQ ID NO: 4086729 - DNA, 22 bp, Homo sapiens
atatggggtattggacatagat

SEQ ID NO: 4086730 - DNA, 21 bp, Homo sapiens
atatggtgcagagaagctgga

SEQ ID NO: 4086731 - DNA, 14 bp, Homo sapiens
atatgtaccatgta

SEQ ID NO: 4086732 - DNA, 20 bp, Homo sapiens
atatgtagatattgttttct

SEQ ID NO: 4086733 - DNA, 23 bp, Homo sapiens
atatgtagatattgttttctgta

SEQ ID NO: 4086734 - DNA, 17 bp, Homo sapiens
atatgtaggtgtctgca

SEQ ID NO: 4086735 - DNA, 17 bp, Homo sapiens
agctggggccagaggct

SEQ ID NO: 4086736 - DNA, 20 bp, Homo sapiens
agctggggccagaggctggg

SEQ ID NO: 4086737 - DNA, 21 bp, Homo sapiens
agctggggccagaggctggga

SEQ ID NO: 4086738 - DNA, 19 bp, Homo sapiens
agctggggggttggcagcc

SEQ ID NO: 4086739 - DNA, 17 bp, Homo sapiens
agctgggtcaggcaggg

SEQ ID NO: 4086740 - DNA, 16 bp, Homo sapiens
agctgggtctaatcct

SEQ ID NO: 4086741 - DNA, 21 bp, Homo sapiens
agctggtagttagtagcatgt

SEQ ID NO: 4086742 - DNA, 13 bp, Homo sapiens
agctggtgcatta

SEQ ID NO: 4086743 - DNA, 21 bp, Homo sapiens
agctggtgcattacagagagg

SEQ ID NO: 4086744 - DNA, 10 bp, Homo sapiens
agctggtttc

SEQ ID NO: 4086745 - DNA, 15 bp, Homo sapiens
agctggtttcctcat

SEQ ID NO: 4086746 - DNA, 15 bp, Homo sapiens
agctggtttcctgcc

SEQ ID NO: 4086747 - DNA, 17 bp, Homo sapiens
agctgtaacagttcttt

SEQ ID NO: 4086748 - DNA, 17 bp, Homo sapiens
agctgtaagaagagact

SEQ ID NO: 4086749 - DNA, 19 bp, Homo sapiens
agctgtacttcgtcttcta

SEQ ID NO: 4086750 - DNA, 14 bp, Homo sapiens
agctgtatgatttg

SEQ ID NO: 4086751 - DNA, 16 bp, Homo sapiens
agctgtatgatttgtt

SEQ ID NO: 4086752 - DNA, 17 bp, Homo sapiens
agctgtatgatttgttt

SEQ ID NO: 4086753 - DNA, 22 bp, Homo sapiens
agctgtatgatttgttttgaat

SEQ ID NO: 4086754 - DNA, 20 bp, Homo sapiens
agctgtcacttttgctccga

SEQ ID NO: 4086755 - DNA, 16 bp, Homo sapiens
agctgtcctgcagcaa

SEQ ID NO: 4086756 - DNA, 22 bp, Homo sapiens
agctgtcctgcagcaaacactc

SEQ ID NO: 4086757 - DNA, 16 bp, Homo sapiens
agctgtctgtggcttc

SEQ ID NO: 4086758 - DNA, 12 bp, Homo sapiens
agctgtgatttt

SEQ ID NO: 4086759 - DNA, 22 bp, Homo sapiens
agctgtgcagcacgtctcagag

SEQ ID NO: 4086760 - DNA, 23 bp, Homo sapiens
agctgtgcagcacgtctcagaga

SEQ ID NO: 4086761 - DNA, 18 bp, Homo sapiens
agctgtgccttcagctgt

SEQ ID NO: 4086762 - DNA, 23 bp, Homo sapiens
agctgtgccttcagctgttgcag

SEQ ID NO: 4086763 - DNA, 14 bp, Homo sapiens
agctgtgtgaaata

SEQ ID NO: 4086764 - DNA, 23 bp, Homo sapiens
agctgtgtgaaataccagtgtgg

SEQ ID NO: 4086765 - DNA, 15 bp, Homo sapiens
agctgttatttcttc

SEQ ID NO: 4086766 - DNA, 20 bp, Homo sapiens
agctgttatttcttccctgc

SEQ ID NO: 4086767 - DNA, 21 bp, Homo sapiens
agctgttatttcttccctgct

SEQ ID NO: 4086768 - DNA, 15 bp, Homo sapiens
agctgttgaccaggc

SEQ ID NO: 4086769 - DNA, 13 bp, Homo sapiens
agctgttgagctg

SEQ ID NO: 4086770 - DNA, 14 bp, Homo sapiens
agctgttgagctgt

SEQ ID NO: 4086771 - DNA, 15 bp, Homo sapiens
agctgttgagctgtt

SEQ ID NO: 4086772 - DNA, 16 bp, Homo sapiens
agctgttgagctgttt

SEQ ID NO: 4086773 - DNA, 16 bp, Homo sapiens
agctgttgcagatgaa

SEQ ID NO: 4086774 - DNA, 20 bp, Homo sapiens
agctgttgtacatttatgat

SEQ ID NO: 4086775 - DNA, 19 bp, Homo sapiens
agctgttgtctcttctcct

SEQ ID NO: 4086776 - DNA, 18 bp, Homo sapiens
agctgtttatagagaatg

SEQ ID NO: 4086777 - DNA, 19 bp, Homo sapiens
agctgtttatggcctcagc

SEQ ID NO: 4086778 - DNA, 18 bp, Homo sapiens
agctgtttctcatgaagc

SEQ ID NO: 4086779 - DNA, 15 bp, Homo sapiens
agcttaaattgtcat

SEQ ID NO: 4086780 - DNA, 17 bp, Homo sapiens
agcttaactaatttgaa

SEQ ID NO: 4086781 - DNA, 14 bp, Homo sapiens
agcttaactttata

SEQ ID NO: 4086782 - DNA, 21 bp, Homo sapiens
agcttaatagccctccccctc

SEQ ID NO: 4086783 - DNA, 21 bp, Homo sapiens
agcttaatagtagttagctta

SEQ ID NO: 4086784 - DNA, 16 bp, Homo sapiens
agcttacatagtttta

SEQ ID NO: 4086785 - DNA, 15 bp, Homo sapiens
agcttagatttcata

SEQ ID NO: 4086786 - DNA, 17 bp, Homo sapiens
agcttatctcttttata

SEQ ID NO: 4086787 - DNA, 16 bp, Homo sapiens
agcttatttttctgtg

SEQ ID NO: 4086788 - DNA, 15 bp, Homo sapiens
agcttcaccagagca

SEQ ID NO: 4086789 - DNA, 16 bp, Homo sapiens
agcttcaccctgtcaa

SEQ ID NO: 4086790 - DNA, 18 bp, Homo sapiens
agcttcagctagctttta

SEQ ID NO: 4086791 - DNA, 16 bp, Homo sapiens
agcttcaggcaccagc

SEQ ID NO: 4086792 - DNA, 21 bp, Homo sapiens
agcttcaggcaccagcatcca

SEQ ID NO: 4086793 - DNA, 17 bp, Homo sapiens
agcttcatataccagca

SEQ ID NO: 4086794 - DNA, 18 bp, Homo sapiens
agcttcatgcctttgtaa

SEQ ID NO: 4086795 - DNA, 21 bp, Homo sapiens
agcttcatgcctttgtaagtt

SEQ ID NO: 4086796 - DNA, 15 bp, Homo sapiens
agcttccagctctaa

SEQ ID NO: 4086797 - DNA, 15 bp, Homo sapiens
agcttccctccctgc

SEQ ID NO: 4086798 - DNA, 16 bp, Homo sapiens
agcttccgagaatagc

SEQ ID NO: 4086799 - DNA, 20 bp, Homo sapiens
agcttcctcacacccctgtc

SEQ ID NO: 4086800 - DNA, 22 bp, Homo sapiens
agcttccttaagtatatcatgt

SEQ ID NO: 4086801 - DNA, 14 bp, Homo sapiens
agcttcggagggcc

SEQ ID NO: 4086802 - DNA, 18 bp, Homo sapiens
agcttcggttctccagaa

SEQ ID NO: 4086803 - DNA, 22 bp, Homo sapiens
agcttcggttctccagaatgta

SEQ ID NO: 4086804 - DNA, 18 bp, Homo sapiens
agcttctatcccaggagg

SEQ ID NO: 4086805 - DNA, 23 bp, Homo sapiens
agcttctattatagccacatccc

SEQ ID NO: 4086806 - DNA, 14 bp, Homo sapiens
agcttctctctcca

SEQ ID NO: 4086807 - DNA, 16 bp, Homo sapiens
agcttctctctccagg

SEQ ID NO: 4086808 - DNA, 17 bp, Homo sapiens
agcttctctctccaggg

SEQ ID NO: 4086809 - DNA, 18 bp, Homo sapiens
agcttctgaggcgctgct

SEQ ID NO: 4086810 - DNA, 15 bp, Homo sapiens
agcgaaataaaaatg

SEQ ID NO: 4086811 - DNA, 17 bp, Homo sapiens
agcgaaataaaaatggc

SEQ ID NO: 4086812 - DNA, 19 bp, Homo sapiens
agcgaagtctttgccttct

SEQ ID NO: 4086813 - DNA, 14 bp, Homo sapiens
agcgaccgccccct

SEQ ID NO: 4086814 - DNA, 15 bp, Homo sapiens
agcgaccgccccctc

SEQ ID NO: 4086815 - DNA, 17 bp, Homo sapiens
agcgatctctcctggcc

SEQ ID NO: 4086816 - DNA, 18 bp, Homo sapiens
agcgccaggaagccagag

SEQ ID NO: 4086817 - DNA, 19 bp, Homo sapiens
agcgccaggaagccagagc

SEQ ID NO: 4086818 - DNA, 21 bp, Homo sapiens
agcgccaggctgaccacagca

SEQ ID NO: 4086819 - DNA, 22 bp, Homo sapiens
agcgccctcactattcttggac

SEQ ID NO: 4086820 - DNA, 12 bp, Homo sapiens
agcgcggccagc

SEQ ID NO: 4086821 - DNA, 21 bp, Homo sapiens
agcgctttctggaaaagagga

SEQ ID NO: 4086822 - DNA, 20 bp, Homo sapiens
agcggagaggaagccagctg

SEQ ID NO: 4086823 - DNA, 13 bp, Homo sapiens
agcggagcccagc

SEQ ID NO: 4086824 - DNA, 15 bp, Homo sapiens
agcggagcccagcct

SEQ ID NO: 4086825 - DNA, 17 bp, Homo sapiens
agcggagcccagcctgg

SEQ ID NO: 4086826 - DNA, 18 bp, Homo sapiens
agcggaggagaccagctc

SEQ ID NO: 4086827 - DNA, 21 bp, Homo sapiens
agcggaggagaccagctcaga

SEQ ID NO: 4086828 - DNA, 22 bp, Homo sapiens
agcggaggttgcagtgagctga

SEQ ID NO: 4086829 - DNA, 19 bp, Homo sapiens
agcggagttcctaacagga

SEQ ID NO: 4086830 - DNA, 19 bp, Homo sapiens
agcggctcaagcccaggag

SEQ ID NO: 4086831 - DNA, 20 bp, Homo sapiens
agcgggacgccgcaggtgtt

SEQ ID NO: 4086832 - DNA, 21 bp, Homo sapiens
agcgggaggcagagtttgcct

SEQ ID NO: 4086833 - DNA, 16 bp, Homo sapiens
agcgggcacagggcac

SEQ ID NO: 4086834 - DNA, 23 bp, Homo sapiens
agcgggcaggttctgcctgcttt

SEQ ID NO: 4086835 - DNA, 13 bp, Homo sapiens
agcgggcgcctgt

SEQ ID NO: 4086836 - DNA, 20 bp, Homo sapiens
agcggtgggggaggagggtt

SEQ ID NO: 4086837 - DNA, 13 bp, Homo sapiens
agcgtaaaatggt

SEQ ID NO: 4086838 - DNA, 23 bp, Homo sapiens
agcgtagctaagtgaaaaggtca

SEQ ID NO: 4086839 - DNA, 21 bp, Homo sapiens
agcgtcagctgctccctggca

SEQ ID NO: 4086840 - DNA, 17 bp, Homo sapiens
agcgtcccagggtaccc

SEQ ID NO: 4086841 - DNA, 19 bp, Homo sapiens
agcgtcccagtctctggca

SEQ ID NO: 4086842 - DNA, 13 bp, Homo sapiens
agcgtccctggcg

SEQ ID NO: 4086843 - DNA, 14 bp, Homo sapiens
agcgtccctggcgc

SEQ ID NO: 4086844 - DNA, 15 bp, Homo sapiens
agcgtccctggcgca

SEQ ID NO: 4086845 - DNA, 16 bp, Homo sapiens
agcgtccttccccctg

SEQ ID NO: 4086846 - DNA, 14 bp, Homo sapiens
agcgttcccagcag

SEQ ID NO: 4086847 - DNA, 19 bp, Homo sapiens
agcgttttttaaatgtata

SEQ ID NO: 4086848 - DNA, 20 bp, Homo sapiens
agcgttttttaaatgtatac

SEQ ID NO: 4086849 - DNA, 20 bp, Homo sapiens
agctaaaatgattttatctg

SEQ ID NO: 4086850 - DNA, 19 bp, Homo sapiens
agctaaaccaaggactgag

SEQ ID NO: 4086851 - DNA, 23 bp, Homo sapiens
agctaaactccttcctggcctga

SEQ ID NO: 4086852 - DNA, 11 bp, Homo sapiens
agctaaataaa

SEQ ID NO: 4086853 - DNA, 23 bp, Homo sapiens
agctaacccccttctactgagcc

SEQ ID NO: 4086854 - DNA, 16 bp, Homo sapiens
agctaaggacatttcc

SEQ ID NO: 4086855 - DNA, 18 bp, Homo sapiens
agctaagggaagacattt

SEQ ID NO: 4086856 - DNA, 21 bp, Homo sapiens
agctaatcagcattctcactc

SEQ ID NO: 4086857 - DNA, 13 bp, Homo sapiens
agctaatctgtag

SEQ ID NO: 4086858 - DNA, 23 bp, Homo sapiens
agctaatgtaataactgtgaagt

SEQ ID NO: 4086859 - DNA, 17 bp, Homo sapiens
agctaatttatttcccc

SEQ ID NO: 4086860 - DNA, 20 bp, Homo sapiens
agctacacagtgcagaggct

SEQ ID NO: 4086861 - DNA, 22 bp, Homo sapiens
agctacagctttcttgctccct

SEQ ID NO: 4086862 - DNA, 21 bp, Homo sapiens
agctaccctttttctccagct

SEQ ID NO: 4086863 - DNA, 16 bp, Homo sapiens
agctacctcaaacttc

SEQ ID NO: 4086864 - DNA, 21 bp, Homo sapiens
agctacctgagacgggcatcg

SEQ ID NO: 4086865 - DNA, 18 bp, Homo sapiens
agctactaaggtgctagg

SEQ ID NO: 4086866 - DNA, 13 bp, Homo sapiens
agctactaatgat

SEQ ID NO: 4086867 - DNA, 18 bp, Homo sapiens
agctactgatgaaatctg

SEQ ID NO: 4086868 - DNA, 20 bp, Homo sapiens
agctactgatttcctttgga

SEQ ID NO: 4086869 - DNA, 19 bp, Homo sapiens
agctactgtgtgtgtgaat

SEQ ID NO: 4086870 - DNA, 16 bp, Homo sapiens
agctacttcctcctcc

SEQ ID NO: 4086871 - DNA, 22 bp, Homo sapiens
agctacttgggaagctgaggcg

SEQ ID NO: 4086872 - DNA, 21 bp, Homo sapiens
agctacttggtttgtgttctt

SEQ ID NO: 4086873 - DNA, 17 bp, Homo sapiens
agctagaaaacattttt

SEQ ID NO: 4086874 - DNA, 16 bp, Homo sapiens
agctagcttttaggaa

SEQ ID NO: 4086875 - DNA, 19 bp, Homo sapiens
agctagtaatatattctga

SEQ ID NO: 4086876 - DNA, 16 bp, Homo sapiens
agctagtgtacctcct

SEQ ID NO: 4086877 - DNA, 18 bp, Homo sapiens
agctagtgtacctcctct

SEQ ID NO: 4086878 - DNA, 21 bp, Homo sapiens
agctagtgtacctcctctcag

SEQ ID NO: 4086879 - DNA, 12 bp, Homo sapiens
agctagttttct

SEQ ID NO: 4086880 - DNA, 11 bp, Homo sapiens
agctatataag

SEQ ID NO: 4086881 - DNA, 15 bp, Homo sapiens
agctatatccatgta

SEQ ID NO: 4086882 - DNA, 22 bp, Homo sapiens
agctatatccatgtactgtagt

SEQ ID NO: 4086883 - DNA, 17 bp, Homo sapiens
agctatcaagtgtgctt

SEQ ID NO: 4086884 - DNA, 14 bp, Homo sapiens
agctatcaggaaca

SEQ ID NO: 4086885 - DNA, 16 bp, Homo sapiens
agctatctaaagtttg

SEQ ID NO: 4086886 - DNA, 18 bp, Homo sapiens
agctatgcgcaatgtggc

SEQ ID NO: 4086887 - DNA, 16 bp, Homo sapiens
agctatggcccagaaa

SEQ ID NO: 4086888 - DNA, 19 bp, Homo sapiens
agctatgggagccccaggg

SEQ ID NO: 4086889 - DNA, 14 bp, Homo sapiens
agctcaatggactg

SEQ ID NO: 4086890 - DNA, 19 bp, Homo sapiens
agctcacactccagtggca

SEQ ID NO: 4086891 - DNA, 21 bp, Homo sapiens
agctcacatgggactgggata

SEQ ID NO: 4086892 - DNA, 21 bp, Homo sapiens
agctcacccaataaacattaa

SEQ ID NO: 4086893 - DNA, 13 bp, Homo sapiens
agctcacccctgg

SEQ ID NO: 4086894 - DNA, 14 bp, Homo sapiens
agctcacccctggg

SEQ ID NO: 4086895 - DNA, 17 bp, Homo sapiens
agctcacccctgggcag

SEQ ID NO: 4086896 - DNA, 18 bp, Homo sapiens
agctcagaggcccaggaa

SEQ ID NO: 4086897 - DNA, 12 bp, Homo sapiens
agctcagcgcca

SEQ ID NO: 4086898 - DNA, 17 bp, Homo sapiens
agctcagcgccagcctg

SEQ ID NO: 4086899 - DNA, 18 bp, Homo sapiens
agctcaggacagatgcca

SEQ ID NO: 4086900 - DNA, 18 bp, Homo sapiens
agctcagtgctctctcca

SEQ ID NO: 4086901 - DNA, 21 bp, Homo sapiens
agctcatacaaaataaatggt

SEQ ID NO: 4086902 - DNA, 17 bp, Homo sapiens
agctcatctccaaggat

SEQ ID NO: 4086903 - DNA, 19 bp, Homo sapiens
agctcattaaactttttta

SEQ ID NO: 4086904 - DNA, 21 bp, Homo sapiens
agctcattaaacttttttaac

SEQ ID NO: 4086905 - DNA, 18 bp, Homo sapiens
agctccaacctgcaaaga

SEQ ID NO: 4086906 - DNA, 22 bp, Homo sapiens
agctccaacctgcaaagatctg

SEQ ID NO: 4086907 - DNA, 17 bp, Homo sapiens
agctccaccctggccga

SEQ ID NO: 4086908 - DNA, 21 bp, Homo sapiens
agctccactgtcaccctccac

SEQ ID NO: 4086909 - DNA, 20 bp, Homo sapiens
agctccaggggcccttggga

SEQ ID NO: 4086910 - DNA, 11 bp, Homo sapiens
agctccccagg

SEQ ID NO: 4086911 - DNA, 14 bp, Homo sapiens
agctcccccaggct

SEQ ID NO: 4086912 - DNA, 15 bp, Homo sapiens
agctcccccaggctg

SEQ ID NO: 4086913 - DNA, 12 bp, Homo sapiens
agctcttggcct

SEQ ID NO: 4086914 - DNA, 15 bp, Homo sapiens
agctcttggcctttg

SEQ ID NO: 4086915 - DNA, 18 bp, Homo sapiens
agctcttggcctttgcat

SEQ ID NO: 4086916 - DNA, 18 bp, Homo sapiens
agctcttttttgtttgtt

SEQ ID NO: 4086917 - DNA, 19 bp, Homo sapiens
agctgaacccattttgagt

SEQ ID NO: 4086918 - DNA, 15 bp, Homo sapiens
agctgaagaaaaaat

SEQ ID NO: 4086919 - DNA, 22 bp, Homo sapiens
agctgaagaaaaaatcagaact

SEQ ID NO: 4086920 - DNA, 17 bp, Homo sapiens
agctgaatgcctcctgt

SEQ ID NO: 4086921 - DNA, 19 bp, Homo sapiens
agctgaatgtcaaacagtg

SEQ ID NO: 4086922 - DNA, 23 bp, Homo sapiens
agctgaatgtcaaacagtgccaa

SEQ ID NO: 4086923 - DNA, 20 bp, Homo sapiens
agctgacccggcctctctgc

SEQ ID NO: 4086924 - DNA, 13 bp, Homo sapiens
agctgactgtggc

SEQ ID NO: 4086925 - DNA, 18 bp, Homo sapiens
agctgactgtggccccct

SEQ ID NO: 4086926 - DNA, 19 bp, Homo sapiens
agctgactgtggccccctc

SEQ ID NO: 4086927 - DNA, 16 bp, Homo sapiens
agctgagaactcctga

SEQ ID NO: 4086928 - DNA, 17 bp, Homo sapiens
agctgagaactcctgac

SEQ ID NO: 4086929 - DNA, 18 bp, Homo sapiens
agctgagaactcctgact

SEQ ID NO: 4086930 - DNA, 15 bp, Homo sapiens
agctgagaagaatga

SEQ ID NO: 4086931 - DNA, 15 bp, Homo sapiens
agctgagaccactga

SEQ ID NO: 4086932 - DNA, 12 bp, Homo sapiens
agctgagcagcc

SEQ ID NO: 4086933 - DNA, 18 bp, Homo sapiens
agctgagcagcctctgga

SEQ ID NO: 4086934 - DNA, 16 bp, Homo sapiens
agctgagccctgggga

SEQ ID NO: 4086935 - DNA, 12 bp, Homo sapiens
agctgagcctga

SEQ ID NO: 4086936 - DNA, 14 bp, Homo sapiens
agctgagcgccagg

SEQ ID NO: 4086937 - DNA, 21 bp, Homo sapiens
agctgagcttcggttctccag

SEQ ID NO: 4086938 - DNA, 13 bp, Homo sapiens
agctgaggggggc

SEQ ID NO: 4086939 - DNA, 22 bp, Homo sapiens
agctgaggggggccgtgcccag

SEQ ID NO: 4086940 - DNA, 23 bp, Homo sapiens
agctgaggggggccgtgcccagg

SEQ ID NO: 4086941 - DNA, 13 bp, Homo sapiens
agctgagtttcct

SEQ ID NO: 4086942 - DNA, 14 bp, Homo sapiens
agctgagtttccta

SEQ ID NO: 4086943 - DNA, 21 bp, Homo sapiens
agctgagtttcctatgggaac

SEQ ID NO: 4086944 - DNA, 16 bp, Homo sapiens
agctgatataaattct

SEQ ID NO: 4086945 - DNA, 11 bp, Homo sapiens
agctgatgaaa

SEQ ID NO: 4086946 - DNA, 16 bp, Homo sapiens
agctgatggcagctgg

SEQ ID NO: 4086947 - DNA, 18 bp, Homo sapiens
agctgattactgtcaata

SEQ ID NO: 4086948 - DNA, 20 bp, Homo sapiens
agctgattactgtcaataaa

SEQ ID NO: 4086949 - DNA, 22 bp, Homo sapiens
agctgattactgtcaataaaca

SEQ ID NO: 4086950 - DNA, 16 bp, Homo sapiens
agctgattttaacaat

SEQ ID NO: 4086951 - DNA, 16 bp, Homo sapiens
agctgcaccagagcaa

SEQ ID NO: 4086952 - DNA, 23 bp, Homo sapiens
agctgcaccagagcaacctctca

SEQ ID NO: 4086953 - DNA, 12 bp, Homo sapiens
agctgcacggca

SEQ ID NO: 4086954 - DNA, 22 bp, Homo sapiens
agctgcagccccttgctctcag

SEQ ID NO: 4086955 - DNA, 24 bp, Homo sapiens
agctgcagccccttgctctcagct

SEQ ID NO: 4086956 - DNA, 20 bp, Homo sapiens
agctgcaggaatcaaaaatt

SEQ ID NO: 4086957 - DNA, 22 bp, Homo sapiens
agctgcaggaatcaaaaattga

SEQ ID NO: 4086958 - DNA, 15 bp, Homo sapiens
agctgcaggtgccag

SEQ ID NO: 4086959 - DNA, 12 bp, Homo sapiens
agctgccagccc

SEQ ID NO: 4086960 - DNA, 15 bp, Homo sapiens
agctgccagcccaga

SEQ ID NO: 4086961 - DNA, 17 bp, Homo sapiens
agctgccagcccagaac

SEQ ID NO: 4086962 - DNA, 16 bp, Homo sapiens
agctgccatttccctt

SEQ ID NO: 4086963 - DNA, 19 bp, Homo sapiens
agctgccctagctgacccc

SEQ ID NO: 4086964 - DNA, 17 bp, Homo sapiens
agctgccctatgggcct

SEQ ID NO: 4086965 - DNA, 19 bp, Homo sapiens
agctgccctatgggcctgc

SEQ ID NO: 4086966 - DNA, 22 bp, Homo sapiens
agctgccctccttgtccaccca

SEQ ID NO: 4086967 - DNA, 15 bp, Homo sapiens
agctgcctagcaagc

SEQ ID NO: 4086968 - DNA, 19 bp, Homo sapiens
agctgcctagcaagctggc

SEQ ID NO: 4086969 - DNA, 22 bp, Homo sapiens
agctgcctagcaagctggcctc

SEQ ID NO: 4086970 - DNA, 19 bp, Homo sapiens
agctgcctcctgcgccctg

SEQ ID NO: 4086971 - DNA, 16 bp, Homo sapiens
agctgcctctgggcca

SEQ ID NO: 4086972 - DNA, 22 bp, Homo sapiens
agctgcctgaaacagccatgtc

SEQ ID NO: 4086973 - DNA, 19 bp, Homo sapiens
agctgcctgcttggcccgg

SEQ ID NO: 4086974 - DNA, 20 bp, Homo sapiens
agctgcctgcttggcccggc

SEQ ID NO: 4086975 - DNA, 15 bp, Homo sapiens
agctgcctgggcccg

SEQ ID NO: 4086976 - DNA, 19 bp, Homo sapiens
agctgccttggctcagaca

SEQ ID NO: 4086977 - DNA, 18 bp, Homo sapiens
agctgcgcttgcttttct

SEQ ID NO: 4086978 - DNA, 18 bp, Homo sapiens
agctgctatccccatctc

SEQ ID NO: 4086979 - DNA, 21 bp, Homo sapiens
agctgctatccccatctccct

SEQ ID NO: 4086980 - DNA, 17 bp, Homo sapiens
agcccatactcagcctg

SEQ ID NO: 4086981 - DNA, 21 bp, Homo sapiens
agcccatccattaggccagca

SEQ ID NO: 4086982 - DNA, 20 bp, Homo sapiens
agcccatgcccacctgccca

SEQ ID NO: 4086983 - DNA, 19 bp, Homo sapiens
agcccatgctcaaccactg

SEQ ID NO: 4086984 - DNA, 23 bp, Homo sapiens
agcccatggtgaatgtatgtttc

SEQ ID NO: 4086985 - DNA, 21 bp, Homo sapiens
agcccatgtggagtcagcctc

SEQ ID NO: 4086986 - DNA, 14 bp, Homo sapiens
agcccattcccacc

SEQ ID NO: 4086987 - DNA, 15 bp, Homo sapiens
agccccacctctcca

SEQ ID NO: 4086988 - DNA, 16 bp, Homo sapiens
agccccagagagagga

SEQ ID NO: 4086989 - DNA, 15 bp, Homo sapiens
agccccagcagccct

SEQ ID NO: 4086990 - DNA, 15 bp, Homo sapiens
agccccaggcctctg

SEQ ID NO: 4086991 - DNA, 12 bp, Homo sapiens
agccccatccct

SEQ ID NO: 4086992 - DNA, 18 bp, Homo sapiens
agccccatccctgtcctc

SEQ ID NO: 4086993 - DNA, 15 bp, Homo sapiens
agccccatttcctca

SEQ ID NO: 4086994 - DNA, 18 bp, Homo sapiens
agcccccaccacaaactt

SEQ ID NO: 4086995 - DNA, 19 bp, Homo sapiens
agcccccaccgtgggcagg

SEQ ID NO: 4086996 - DNA, 18 bp, Homo sapiens
agcccccagatagagctg

SEQ ID NO: 4086997 - DNA, 22 bp, Homo sapiens
agcccccagatagagctgggtg

SEQ ID NO: 4086998 - DNA, 18 bp, Homo sapiens
agcccccagcagaggcag

SEQ ID NO: 4086999 - DNA, 12 bp, Homo sapiens
agcccccagcta

SEQ ID NO: 4087000 - DNA, 22 bp, Homo sapiens
agcccccagctaagaacctgga

SEQ ID NO: 4087001 - DNA, 12 bp, Homo sapiens
agcccccaggaa

SEQ ID NO: 4087002 - DNA, 13 bp, Homo sapiens
agcccccagggcc

SEQ ID NO: 4087003 - DNA, 20 bp, Homo sapiens
agcccccagggcctccaggg

SEQ ID NO: 4087004 - DNA, 22 bp, Homo sapiens
agcccccatgggctcctgcccc

SEQ ID NO: 4087005 - DNA, 16 bp, Homo sapiens
agccccccacaatgat

SEQ ID NO: 4087006 - DNA, 14 bp, Homo sapiens
agccccccagcact

SEQ ID NO: 4087007 - DNA, 22 bp, Homo sapiens
agccccctccacaccagtggcc

SEQ ID NO: 4087008 - DNA, 14 bp, Homo sapiens
agccccctggcctc

SEQ ID NO: 4087009 - DNA, 15 bp, Homo sapiens
agccccctggcctct

SEQ ID NO: 4087010 - DNA, 16 bp, Homo sapiens
agccccctggcctctg

SEQ ID NO: 4087011 - DNA, 19 bp, Homo sapiens
agccccctggcctctgtgc

SEQ ID NO: 4087012 - DNA, 20 bp, Homo sapiens
agccccggcaagccacagga

SEQ ID NO: 4087013 - DNA, 14 bp, Homo sapiens
agccccggccctgg

SEQ ID NO: 4087014 - DNA, 16 bp, Homo sapiens
agccccggccctgggc

SEQ ID NO: 4087015 - DNA, 14 bp, Homo sapiens
agccccgtctgccc

SEQ ID NO: 4087016 - DNA, 15 bp, Homo sapiens
agccccgtctgccca

SEQ ID NO: 4087017 - DNA, 17 bp, Homo sapiens
agcccctactgctgtga

SEQ ID NO: 4087018 - DNA, 23 bp, Homo sapiens
agcccctactgctgtgaaccctg

SEQ ID NO: 4087019 - DNA, 15 bp, Homo sapiens
agcccctccctcctc

SEQ ID NO: 4087020 - DNA, 18 bp, Homo sapiens
agcccctccctcctctga

SEQ ID NO: 4087021 - DNA, 20 bp, Homo sapiens
agcccctcctccagcccctg

SEQ ID NO: 4087022 - DNA, 18 bp, Homo sapiens
actggtaggttgggacac

SEQ ID NO: 4087023 - DNA, 16 bp, Homo sapiens
actggtattctgttct

SEQ ID NO: 4087024 - DNA, 13 bp, Homo sapiens
actggtctgctgt

SEQ ID NO: 4087025 - DNA, 12 bp, Homo sapiens
actggtgactgc

SEQ ID NO: 4087026 - DNA, 21 bp, Homo sapiens
actggtgactgcgatcttcag

SEQ ID NO: 4087027 - DNA, 21 bp, Homo sapiens
actggtgccaaaaccaggcct

SEQ ID NO: 4087028 - DNA, 13 bp, Homo sapiens
actggtgccctcc

SEQ ID NO: 4087029 - DNA, 17 bp, Homo sapiens
actggtgtgacctgagg

SEQ ID NO: 4087030 - DNA, 21 bp, Homo sapiens
actggtgtgacctgagggcag

SEQ ID NO: 4087031 - DNA, 19 bp, Homo sapiens
actggtgtttgaaagtagg

SEQ ID NO: 4087032 - DNA, 17 bp, Homo sapiens
actggtttgttccctgt

SEQ ID NO: 4087033 - DNA, 15 bp, Homo sapiens
actggttttctgcca

SEQ ID NO: 4087034 - DNA, 13 bp, Homo sapiens
actgtaagggatt

SEQ ID NO: 4087035 - DNA, 22 bp, Homo sapiens
actgtaatacgtagctctctta

SEQ ID NO: 4087036 - DNA, 17 bp, Homo sapiens
actgtaattttatatga

SEQ ID NO: 4087037 - DNA, 14 bp, Homo sapiens
actgtacagaattt

SEQ ID NO: 4087038 - DNA, 16 bp, Homo sapiens
actgtacatttaaaat

SEQ ID NO: 4087039 - DNA, 16 bp, Homo sapiens
actgtacccaaatgga

SEQ ID NO: 4087040 - DNA, 17 bp, Homo sapiens
actgtacccaaatggaa

SEQ ID NO: 4087041 - DNA, 14 bp, Homo sapiens
actgtactcctccc

SEQ ID NO: 4087042 - DNA, 15 bp, Homo sapiens
actgtactcctccca

SEQ ID NO: 4087043 - DNA, 15 bp, Homo sapiens
actgtagaaatgatg

SEQ ID NO: 4087044 - DNA, 17 bp, Homo sapiens
actgtagattgcttctg

SEQ ID NO: 4087045 - DNA, 14 bp, Homo sapiens
actgtagtgtagtc

SEQ ID NO: 4087046 - DNA, 16 bp, Homo sapiens
actgtatattacagat

SEQ ID NO: 4087047 - DNA, 16 bp, Homo sapiens
actgtatggaaacact

SEQ ID NO: 4087048 - DNA, 21 bp, Homo sapiens
actgtatggaaacactgattt

SEQ ID NO: 4087049 - DNA, 23 bp, Homo sapiens
actgtatggaaacactgattttg

SEQ ID NO: 4087050 - DNA, 20 bp, Homo sapiens
actgtattcgtgcatttttg

SEQ ID NO: 4087051 - DNA, 20 bp, Homo sapiens
actgtcaaggctgcttagaa

SEQ ID NO: 4087052 - DNA, 14 bp, Homo sapiens
actgtcaataaaca

SEQ ID NO: 4087053 - DNA, 22 bp, Homo sapiens
actgtcacggggttccctccta

SEQ ID NO: 4087054 - DNA, 20 bp, Homo sapiens
actgtcactgtttctctgct

SEQ ID NO: 4087055 - DNA, 24 bp, Homo sapiens
actgtcatgcttcatcattccctc

SEQ ID NO: 4087056 - DNA, 15 bp, Homo sapiens
actgtccagagagca

SEQ ID NO: 4087057 - DNA, 18 bp, Homo sapiens
actgtccccctacccacc

SEQ ID NO: 4087058 - DNA, 19 bp, Homo sapiens
actgtccccctacccaccg

SEQ ID NO: 4087059 - DNA, 13 bp, Homo sapiens
actgtccctccct

SEQ ID NO: 4087060 - DNA, 17 bp, Homo sapiens
actgtccctcccttgct

SEQ ID NO: 4087061 - DNA, 17 bp, Homo sapiens
actgtcctctcccctcc

SEQ ID NO: 4087062 - DNA, 16 bp, Homo sapiens
actgtcctgggcctgc

SEQ ID NO: 4087063 - DNA, 21 bp, Homo sapiens
actgtcctttccttggcttta

SEQ ID NO: 4087064 - DNA, 14 bp, Homo sapiens
actgtcggagaggc

SEQ ID NO: 4087065 - DNA, 16 bp, Homo sapiens
actgtcggagaggctg

SEQ ID NO: 4087066 - DNA, 17 bp, Homo sapiens
actgtctagcacttcct

SEQ ID NO: 4087067 - DNA, 19 bp, Homo sapiens
actgtctagcacttccttg

SEQ ID NO: 4087068 - DNA, 24 bp, Homo sapiens
actgtctagcacttccttgccagt

SEQ ID NO: 4087069 - DNA, 21 bp, Homo sapiens
actgtctcaagagggcactgg

SEQ ID NO: 4087070 - DNA, 23 bp, Homo sapiens
actgtctcaagagggcactggtg

SEQ ID NO: 4087071 - DNA, 18 bp, Homo sapiens
actgtcttcctcaaaata

SEQ ID NO: 4087072 - DNA, 20 bp, Homo sapiens
actgtgaagacccagcagga

SEQ ID NO: 4087073 - DNA, 20 bp, Homo sapiens
actgtgaagttacatgcata

SEQ ID NO: 4087074 - DNA, 21 bp, Homo sapiens
actgtgaagttacatgcataa

SEQ ID NO: 4087075 - DNA, 22 bp, Homo sapiens
actgtgaagtttacattgtaaa

SEQ ID NO: 4087076 - DNA, 13 bp, Homo sapiens
actgtgaccacct

SEQ ID NO: 4087077 - DNA, 19 bp, Homo sapiens
actgtgacccccagctccg

SEQ ID NO: 4087078 - DNA, 15 bp, Homo sapiens
actgtgcagaataat

SEQ ID NO: 4087079 - DNA, 21 bp, Homo sapiens
actgtgcagaataatggaaac

SEQ ID NO: 4087080 - DNA, 16 bp, Homo sapiens
actgtgcatagtgctg

SEQ ID NO: 4087081 - DNA, 17 bp, Homo sapiens
actgtgcatagtgctgg

SEQ ID NO: 4087082 - DNA, 22 bp, Homo sapiens
actgtgcgtcttggtgtaattt

SEQ ID NO: 4087083 - DNA, 12 bp, Homo sapiens
actgtggaggaa

SEQ ID NO: 4087084 - DNA, 15 bp, Homo sapiens
actgtggaggaagga

SEQ ID NO: 4087085 - DNA, 23 bp, Homo sapiens
actgtggaggaaggattgtaaaa

SEQ ID NO: 4087086 - DNA, 17 bp, Homo sapiens
actgtggccagtaaaat

SEQ ID NO: 4087087 - DNA, 19 bp, Homo sapiens
actgtggccccctccgtga

SEQ ID NO: 4087088 - DNA, 18 bp, Homo sapiens
actgtggcgttctgctgc

SEQ ID NO: 4087089 - DNA, 14 bp, Homo sapiens
actgtggtcctatg

SEQ ID NO: 4087090 - DNA, 14 bp, Homo sapiens
actgtgtacataat

SEQ ID NO: 4087091 - DNA, 19 bp, Homo sapiens
actgtgtggactgtgatgc

SEQ ID NO: 4087092 - DNA, 16 bp, Homo sapiens
actgtgtgtgtgaatg

SEQ ID NO: 4087093 - DNA, 18 bp, Homo sapiens
actgtgtgtgtgaatgaa

SEQ ID NO: 4087094 - DNA, 15 bp, Homo sapiens
agacctagcaggctg

SEQ ID NO: 4087095 - DNA, 15 bp, Homo sapiens
agacctcaagccatc

SEQ ID NO: 4087096 - DNA, 19 bp, Homo sapiens
agacctcatcaggatgaac

SEQ ID NO: 4087097 - DNA, 18 bp, Homo sapiens
agacctctgtgcacttat

SEQ ID NO: 4087098 - DNA, 16 bp, Homo sapiens
agacctgatcctggag

SEQ ID NO: 4087099 - DNA, 17 bp, Homo sapiens
agacctggcagctctgg

SEQ ID NO: 4087100 - DNA, 18 bp, Homo sapiens
agacctggcagctctgga

SEQ ID NO: 4087101 - DNA, 17 bp, Homo sapiens
agacctggctccactct

SEQ ID NO: 4087102 - DNA, 13 bp, Homo sapiens
agacctgtaatca

SEQ ID NO: 4087103 - DNA, 18 bp, Homo sapiens
agacctgtcttccaagga

SEQ ID NO: 4087104 - DNA, 12 bp, Homo sapiens
agacctgtgcta

SEQ ID NO: 4087105 - DNA, 19 bp, Homo sapiens
agacctgttagcagacagg

SEQ ID NO: 4087106 - DNA, 19 bp, Homo sapiens
agaccttctccaaatgaga

SEQ ID NO: 4087107 - DNA, 20 bp, Homo sapiens
agacgcacacagctgagcac

SEQ ID NO: 4087108 - DNA, 16 bp, Homo sapiens
agacgctgccgctgcc

SEQ ID NO: 4087109 - DNA, 16 bp, Homo sapiens
agacggcggccaggca

SEQ ID NO: 4087110 - DNA, 19 bp, Homo sapiens
agacggcggccaggcacag

SEQ ID NO: 4087111 - DNA, 21 bp, Homo sapiens
agacgggaggggaaaggctgc

SEQ ID NO: 4087112 - DNA, 14 bp, Homo sapiens
agacgggcacagac

SEQ ID NO: 4087113 - DNA, 15 bp, Homo sapiens
agacgggcacagaca

SEQ ID NO: 4087114 - DNA, 14 bp, Homo sapiens
agacgttgcctgag

SEQ ID NO: 4087115 - DNA, 22 bp, Homo sapiens
agacgtttttgtgctgtgggca

SEQ ID NO: 4087116 - DNA, 18 bp, Homo sapiens
agactaaaggatccagag

SEQ ID NO: 4087117 - DNA, 13 bp, Homo sapiens
agactaagaaata

SEQ ID NO: 4087118 - DNA, 14 bp, Homo sapiens
agactaagaaatat

SEQ ID NO: 4087119 - DNA, 19 bp, Homo sapiens
agactaagaaatattccaa

SEQ ID NO: 4087120 - DNA, 18 bp, Homo sapiens
agactactattttctttt

SEQ ID NO: 4087121 - DNA, 14 bp, Homo sapiens
agactcacttacat

SEQ ID NO: 4087122 - DNA, 11 bp, Homo sapiens
agactcagcca

SEQ ID NO: 4087123 - DNA, 21 bp, Homo sapiens
agactcagccaagacaaggag

SEQ ID NO: 4087124 - DNA, 19 bp, Homo sapiens
agactcaggccaagaaacg

SEQ ID NO: 4087125 - DNA, 20 bp, Homo sapiens
agactcaggccaagaaacgt

SEQ ID NO: 4087126 - DNA, 13 bp, Homo sapiens
agactcagtgttc

SEQ ID NO: 4087127 - DNA, 16 bp, Homo sapiens
agactcagtttgtcag

SEQ ID NO: 4087128 - DNA, 17 bp, Homo sapiens
agactcagtttgtcaga

SEQ ID NO: 4087129 - DNA, 14 bp, Homo sapiens
agactcctgccctg

SEQ ID NO: 4087130 - DNA, 21 bp, Homo sapiens
agactctaggacataaattag

SEQ ID NO: 4087131 - DNA, 17 bp, Homo sapiens
agactctttagagcagc

SEQ ID NO: 4087132 - DNA, 15 bp, Homo sapiens
agactctttgcatat

SEQ ID NO: 4087133 - DNA, 21 bp, Homo sapiens
agactcttttccttccctttt

SEQ ID NO: 4087134 - DNA, 17 bp, Homo sapiens
agactgagcagccgcca

SEQ ID NO: 4087135 - DNA, 16 bp, Homo sapiens
agactgaggacaaagt

SEQ ID NO: 4087136 - DNA, 17 bp, Homo sapiens
agactgaggacaaagtg

SEQ ID NO: 4087137 - DNA, 14 bp, Homo sapiens
agactgagtcagat

SEQ ID NO: 4087138 - DNA, 21 bp, Homo sapiens
agactgcaaacttttttatat

SEQ ID NO: 4087139 - DNA, 21 bp, Homo sapiens
agactggaagctaatttgcat

SEQ ID NO: 4087140 - DNA, 20 bp, Homo sapiens
agactggcctgaaccacagg

SEQ ID NO: 4087141 - DNA, 23 bp, Homo sapiens
agactgggaagataggctctgca

SEQ ID NO: 4087142 - DNA, 19 bp, Homo sapiens
agactgggaaggcttggga

SEQ ID NO: 4087143 - DNA, 23 bp, Homo sapiens
agactgggaaggcttgggatttg

SEQ ID NO: 4087144 - DNA, 22 bp, Homo sapiens
agactgggacacctttaacaca

SEQ ID NO: 4087145 - DNA, 17 bp, Homo sapiens
agactgggagccacttc

SEQ ID NO: 4087146 - DNA, 16 bp, Homo sapiens
agactggttttctgcc

SEQ ID NO: 4087147 - DNA, 15 bp, Homo sapiens
agactgtacaaagta

SEQ ID NO: 4087148 - DNA, 24 bp, Homo sapiens
agactgtcggagaggctgtctggg

SEQ ID NO: 4087149 - DNA, 14 bp, Homo sapiens
agactgtctcaaga

SEQ ID NO: 4087150 - DNA, 18 bp, Homo sapiens
agactgtgaacttgactg

SEQ ID NO: 4087151 - DNA, 21 bp, Homo sapiens
agactgtgaacttgactgggt

SEQ ID NO: 4087152 - DNA, 12 bp, Homo sapiens
agagggacagat

SEQ ID NO: 4087153 - DNA, 16 bp, Homo sapiens
agagggagaagcatga

SEQ ID NO: 4087154 - DNA, 14 bp, Homo sapiens
agagggagcaggcc

SEQ ID NO: 4087155 - DNA, 16 bp, Homo sapiens
agagggagctggaacc

SEQ ID NO: 4087156 - DNA, 18 bp, Homo sapiens
agagggagctggaacccg

SEQ ID NO: 4087157 - DNA, 22 bp, Homo sapiens
agagggaggtcactggaaaggg

SEQ ID NO: 4087158 - DNA, 12 bp, Homo sapiens
agagggagtcag

SEQ ID NO: 4087159 - DNA, 17 bp, Homo sapiens
agagggatgggttcctg

SEQ ID NO: 4087160 - DNA, 18 bp, Homo sapiens
agagggatgggttcctgc

SEQ ID NO: 4087161 - DNA, 22 bp, Homo sapiens
agagggatttccctgcagacct

SEQ ID NO: 4087162 - DNA, 18 bp, Homo sapiens
agagggcagactgtgaac

SEQ ID NO: 4087163 - DNA, 19 bp, Homo sapiens
agagggcccagcccagagc

SEQ ID NO: 4087164 - DNA, 16 bp, Homo sapiens
agagggcccaggtccc

SEQ ID NO: 4087165 - DNA, 20 bp, Homo sapiens
agagggctcgaggggtgggc

SEQ ID NO: 4087166 - DNA, 22 bp, Homo sapiens
agagggcttcctctagaagcca

SEQ ID NO: 4087167 - DNA, 18 bp, Homo sapiens
agaggggaaaagctgaac

SEQ ID NO: 4087168 - DNA, 23 bp, Homo sapiens
agaggggactgggggactgggag

SEQ ID NO: 4087169 - DNA, 12 bp, Homo sapiens
agaggggctgca

SEQ ID NO: 4087170 - DNA, 19 bp, Homo sapiens
agagggggagtagccaagc

SEQ ID NO: 4087171 - DNA, 19 bp, Homo sapiens
agagggggtggaggggtgt

SEQ ID NO: 4087172 - DNA, 16 bp, Homo sapiens
agagggtatttttgta

SEQ ID NO: 4087173 - DNA, 20 bp, Homo sapiens
agagggtgagtcctccagaa

SEQ ID NO: 4087174 - DNA, 21 bp, Homo sapiens
agagggtgagtcctccagaac

SEQ ID NO: 4087175 - DNA, 22 bp, Homo sapiens
agagggtgtggctttccaggca

SEQ ID NO: 4087176 - DNA, 23 bp, Homo sapiens
agagggttttaggtagaaaaaca

SEQ ID NO: 4087177 - DNA, 16 bp, Homo sapiens
agaggtaaaagtgtga

SEQ ID NO: 4087178 - DNA, 18 bp, Homo sapiens
agaggtaaaagtgtgagc

SEQ ID NO: 4087179 - DNA, 19 bp, Homo sapiens
agaggtaaaagtgtgagca

SEQ ID NO: 4087180 - DNA, 20 bp, Homo sapiens
agaggtaaaagtgtgagcag

SEQ ID NO: 4087181 - DNA, 18 bp, Homo sapiens
agaggtaacagaacagct

SEQ ID NO: 4087182 - DNA, 18 bp, Homo sapiens
agaggtactagaatgctt

SEQ ID NO: 4087183 - DNA, 21 bp, Homo sapiens
agaggtcccaaggttctgggt

SEQ ID NO: 4087184 - DNA, 14 bp, Homo sapiens
agaggtgggagggc

SEQ ID NO: 4087185 - DNA, 16 bp, Homo sapiens
agaggtggggagcaga

SEQ ID NO: 4087186 - DNA, 16 bp, Homo sapiens
agaggtgttatttgga

SEQ ID NO: 4087187 - DNA, 23 bp, Homo sapiens
agagtaactttactctgtgttta

SEQ ID NO: 4087188 - DNA, 21 bp, Homo sapiens
agagtacgtcctgcctggcac

SEQ ID NO: 4087189 - DNA, 15 bp, Homo sapiens
agagtagaaataaaa

SEQ ID NO: 4087190 - DNA, 16 bp, Homo sapiens
agagtagaattgcatt

SEQ ID NO: 4087191 - DNA, 13 bp, Homo sapiens
agagtatatgcac

SEQ ID NO: 4087192 - DNA, 15 bp, Homo sapiens
agagtcagctctctg

SEQ ID NO: 4087193 - DNA, 16 bp, Homo sapiens
agagtcagctctctgc

SEQ ID NO: 4087194 - DNA, 18 bp, Homo sapiens
agagtcagctctctgccc

SEQ ID NO: 4087195 - DNA, 19 bp, Homo sapiens
agagtcagctctctgccct

SEQ ID NO: 4087196 - DNA, 18 bp, Homo sapiens
agagtcatctccatcagc

SEQ ID NO: 4087197 - DNA, 16 bp, Homo sapiens
agagtccagtgctctg

SEQ ID NO: 4087198 - DNA, 20 bp, Homo sapiens
agagtccagtgctctgcctc

SEQ ID NO: 4087199 - DNA, 23 bp, Homo sapiens
agagtccagtgctctgcctcaga

SEQ ID NO: 4087200 - DNA, 21 bp, Homo sapiens
agagtccatttcccacatctt

SEQ ID NO: 4087201 - DNA, 13 bp, Homo sapiens
agagtcctcactc

SEQ ID NO: 4087202 - DNA, 14 bp, Homo sapiens
agagtcctcactcc

SEQ ID NO: 4087203 - DNA, 21 bp, Homo sapiens
agagtccttgcaaaattgtct

SEQ ID NO: 4087204 - DNA, 20 bp, Homo sapiens
agagtctcagaaactcccct

SEQ ID NO: 4087205 - DNA, 13 bp, Homo sapiens
agagtctgaacag

SEQ ID NO: 4087206 - DNA, 16 bp, Homo sapiens
agagtctgaacagctg

SEQ ID NO: 4087207 - DNA, 17 bp, Homo sapiens
agagtctgaacagctgt

SEQ ID NO: 4087208 - DNA, 18 bp, Homo sapiens
agagtctgggcctctgac

SEQ ID NO: 4087209 - DNA, 17 bp, Homo sapiens
agagtgataatacaagt

SEQ ID NO: 4087210 - DNA, 18 bp, Homo sapiens
agagtgcattgtgagggt

SEQ ID NO: 4087211 - DNA, 21 bp, Homo sapiens
agagtgccctgctttgcaaac

SEQ ID NO: 4087212 - DNA, 18 bp, Homo sapiens
agagtggagagaagctct

SEQ ID NO: 4087213 - DNA, 16 bp, Homo sapiens
agagtggcctccctgc

SEQ ID NO: 4087214 - DNA, 12 bp, Homo sapiens
agagtggcctgg

SEQ ID NO: 4087215 - DNA, 14 bp, Homo sapiens
agagtggcctggcc

SEQ ID NO: 4087216 - DNA, 14 bp, Homo sapiens
agagtggctcctcc

SEQ ID NO: 4087217 - DNA, 19 bp, Homo sapiens
agagtggctcctcccggtg

SEQ ID NO: 4087218 - DNA, 18 bp, Homo sapiens
agagtgggctgcatctgg

SEQ ID NO: 4087219 - DNA, 14 bp, Homo sapiens
agagtgtagaagca

SEQ ID NO: 4087220 - DNA, 16 bp, Homo sapiens
agagtgtagaagcatt

SEQ ID NO: 4087221 - DNA, 22 bp, Homo sapiens
agagtgtagaagcattccttct

SEQ ID NO: 4087222 - DNA, 21 bp, Homo sapiens
agagtgtctcagggtgcagag

SEQ ID NO: 4087223 - DNA, 14 bp, Homo sapiens
agagtgtctctgat

SEQ ID NO: 4087224 - DNA, 18 bp, Homo sapiens
agagtgttggtgttggct

SEQ ID NO: 4087225 - DNA, 15 bp, Homo sapiens
agagttaagaagctg

SEQ ID NO: 4087226 - DNA, 17 bp, Homo sapiens
agagttaagaagctgtt

SEQ ID NO: 4087227 - DNA, 21 bp, Homo sapiens
agagttaagaagctgttgtac

SEQ ID NO: 4087228 - DNA, 13 bp, Homo sapiens
agagttaagaatg

SEQ ID NO: 4087229 - DNA, 14 bp, Homo sapiens
agagttcacaggag

SEQ ID NO: 4087230 - DNA, 22 bp, Homo sapiens
agagttcggtctgacagtcctt

SEQ ID NO: 4087231 - DNA, 21 bp, Homo sapiens
agagttgctgagagggctcga

SEQ ID NO: 4087232 - DNA, 19 bp, Homo sapiens
agagtttcgtggcttcagg

SEQ ID NO: 4087233 - DNA, 19 bp, Homo sapiens
agagtttgaaggaggtgag

SEQ ID NO: 4087234 - DNA, 17 bp, Homo sapiens
agagtttgccttataaa

SEQ ID NO: 4087235 - DNA, 21 bp, Homo sapiens
agagtttgccttcctttctcc

SEQ ID NO: 4087236 - DNA, 12 bp, Homo sapiens
agataaaaagat

SEQ ID NO: 4087237 - DNA, 18 bp, Homo sapiens
agataaaagctgaagtta

SEQ ID NO: 4087238 - DNA, 11 bp, Homo sapiens
agataaagatg

SEQ ID NO: 4087239 - DNA, 16 bp, Homo sapiens
agataaagatgatcta

SEQ ID NO: 4087240 - DNA, 16 bp, Homo sapiens
agataaatagaactat

SEQ ID NO: 4087241 - DNA, 14 bp, Homo sapiens
agataactgagaat

SEQ ID NO: 4087242 - DNA, 22 bp, Homo sapiens
agataagcaagagagatgtttt

SEQ ID NO: 4087243 - DNA, 13 bp, Homo sapiens
agataatagttta

SEQ ID NO: 4087244 - DNA, 16 bp, Homo sapiens
agataatattactgtt

SEQ ID NO: 4087245 - DNA, 17 bp, Homo sapiens
agataattgttgaaatt

SEQ ID NO: 4087246 - DNA, 22 bp, Homo sapiens
agataattgttgaaattttgca

SEQ ID NO: 4087247 - DNA, 20 bp, Homo sapiens
agataatttatttcaataaa

SEQ ID NO: 4087248 - DNA, 13 bp, Homo sapiens
agataatttgcat

SEQ ID NO: 4087249 - DNA, 14 bp, Homo sapiens
agatacaaattaat

SEQ ID NO: 4087250 - DNA, 20 bp, Homo sapiens
agatacatcactgcttgatg

SEQ ID NO: 4087251 - DNA, 19 bp, Homo sapiens
agataccaggttgaaagac

SEQ ID NO: 4087252 - DNA, 19 bp, Homo sapiens
agataccttgaaaggaaga

SEQ ID NO: 4087253 - DNA, 19 bp, Homo sapiens
agatacgactttattttct

SEQ ID NO: 4087254 - DNA, 12 bp, Homo sapiens
aaggaaaatgat

SEQ ID NO: 4087255 - DNA, 14 bp, Homo sapiens
aaggaaaatgatac

SEQ ID NO: 4087256 - DNA, 21 bp, Homo sapiens
aaggaaaccgcctagtttact

SEQ ID NO: 4087257 - DNA, 16 bp, Homo sapiens
aaggaaacgctacctc

SEQ ID NO: 4087258 - DNA, 12 bp, Homo sapiens
aaggaaagaaaa

SEQ ID NO: 4087259 - DNA, 20 bp, Homo sapiens
aaggaaagcaataaatgaat

SEQ ID NO: 4087260 - DNA, 21 bp, Homo sapiens
aaggaaagtcaagaagaatga

SEQ ID NO: 4087261 - DNA, 21 bp, Homo sapiens
aaggaacatggagctgtcatc

SEQ ID NO: 4087262 - DNA, 13 bp, Homo sapiens
aaggaacctggga

SEQ ID NO: 4087263 - DNA, 13 bp, Homo sapiens
aaggaaccttcct

SEQ ID NO: 4087264 - DNA, 23 bp, Homo sapiens
aaggaaccttccttcctgcttga

SEQ ID NO: 4087265 - DNA, 23 bp, Homo sapiens
aaggaactaggtcaaaaatctgt

SEQ ID NO: 4087266 - DNA, 18 bp, Homo sapiens
aaggaactctggcttcca

SEQ ID NO: 4087267 - DNA, 22 bp, Homo sapiens
aaggaactctggcttccaggta

SEQ ID NO: 4087268 - DNA, 17 bp, Homo sapiens
aaggaagccttgctcat

SEQ ID NO: 4087269 - DNA, 18 bp, Homo sapiens
aaggaagctccactgtca

SEQ ID NO: 4087270 - DNA, 16 bp, Homo sapiens
aaggaaggaaagaaag

SEQ ID NO: 4087271 - DNA, 14 bp, Homo sapiens
aaggaatctgtgca

SEQ ID NO: 4087272 - DNA, 17 bp, Homo sapiens
aaggaatgcctgtgcca

SEQ ID NO: 4087273 - DNA, 21 bp, Homo sapiens
aaggaatgtagctggtttcct

SEQ ID NO: 4087274 - DNA, 14 bp, Homo sapiens
aaggaatttgatga

SEQ ID NO: 4087275 - DNA, 13 bp, Homo sapiens
aaggacactagaa

SEQ ID NO: 4087276 - DNA, 16 bp, Homo sapiens
aaggacaggaggagga

SEQ ID NO: 4087277 - DNA, 13 bp, Homo sapiens
aaggacattgccc

SEQ ID NO: 4087278 - DNA, 15 bp, Homo sapiens
aaggacattgcccca

SEQ ID NO: 4087279 - DNA, 19 bp, Homo sapiens
aaggacattgccccaagat

SEQ ID NO: 4087280 - DNA, 20 bp, Homo sapiens
aaggaccacattttatattt

SEQ ID NO: 4087281 - DNA, 12 bp, Homo sapiens
aaggaccaggac

SEQ ID NO: 4087282 - DNA, 13 bp, Homo sapiens
aaggaccaggact

SEQ ID NO: 4087283 - DNA, 22 bp, Homo sapiens
aaggacccggaggggcctggca

SEQ ID NO: 4087284 - DNA, 17 bp, Homo sapiens
aaggacgggttggggcc

SEQ ID NO: 4087285 - DNA, 21 bp, Homo sapiens
aaggactacgttaagggaagg

SEQ ID NO: 4087286 - DNA, 17 bp, Homo sapiens
aaggactcccggagcct

SEQ ID NO: 4087287 - DNA, 20 bp, Homo sapiens
aaggactgagcaccctctgg

SEQ ID NO: 4087288 - DNA, 13 bp, Homo sapiens
aaggacttcctga

SEQ ID NO: 4087289 - DNA, 22 bp, Homo sapiens
aaggacttcctgattggtttct

SEQ ID NO: 4087290 - DNA, 17 bp, Homo sapiens
aaggacttgaaagcatc

SEQ ID NO: 4087291 - DNA, 16 bp, Homo sapiens
aaggagaatatgataa

SEQ ID NO: 4087292 - DNA, 13 bp, Homo sapiens
aaggagaatggga

SEQ ID NO: 4087293 - DNA, 13 bp, Homo sapiens
aaggagagcctgc

SEQ ID NO: 4087294 - DNA, 14 bp, Homo sapiens
aaggagagcctgct

SEQ ID NO: 4087295 - DNA, 22 bp, Homo sapiens
aaggagcatttttttattcagc

SEQ ID NO: 4087296 - DNA, 17 bp, Homo sapiens
aaggagccttttgctct

SEQ ID NO: 4087297 - DNA, 14 bp, Homo sapiens
aaggaggctccagg

SEQ ID NO: 4087298 - DNA, 17 bp, Homo sapiens
aaggaggctccaggcag

SEQ ID NO: 4087299 - DNA, 21 bp, Homo sapiens
aaggaggggagagacaggcag

SEQ ID NO: 4087300 - DNA, 15 bp, Homo sapiens
aaggaggtagagagg

SEQ ID NO: 4087301 - DNA, 15 bp, Homo sapiens
aaggaggtgagggat

SEQ ID NO: 4087302 - DNA, 16 bp, Homo sapiens
aaggagttacagggaa

SEQ ID NO: 4087303 - DNA, 13 bp, Homo sapiens
aaggataaattgt

SEQ ID NO: 4087304 - DNA, 19 bp, Homo sapiens
aaggataatgaaataatca

SEQ ID NO: 4087305 - DNA, 15 bp, Homo sapiens
aaggatagatgctgg

SEQ ID NO: 4087306 - DNA, 20 bp, Homo sapiens
aaggatagtgcgatgtttca

SEQ ID NO: 4087307 - DNA, 18 bp, Homo sapiens
aaggatcctctccactcc

SEQ ID NO: 4087308 - DNA, 16 bp, Homo sapiens
aaggatctctcaggag

SEQ ID NO: 4087309 - DNA, 21 bp, Homo sapiens
aaggatctctcaggagcacag

SEQ ID NO: 4087310 - DNA, 23 bp, Homo sapiens
aaggatgaatgaggtcccaggca

SEQ ID NO: 4087311 - DNA, 15 bp, Homo sapiens
aaggatgtcacaggg

SEQ ID NO: 4087312 - DNA, 16 bp, Homo sapiens
aaggatgtcacagggc

SEQ ID NO: 4087313 - DNA, 22 bp, Homo sapiens
aaggatgttttgtcccatttcc

SEQ ID NO: 4087314 - DNA, 14 bp, Homo sapiens
aaggattgtaaaaa

SEQ ID NO: 4087315 - DNA, 14 bp, Homo sapiens
aaggattgtgatat

SEQ ID NO: 4087316 - DNA, 17 bp, Homo sapiens
aaggattgtgatatttt

SEQ ID NO: 4087317 - DNA, 15 bp, Homo sapiens
aaggcaaaaatgtaa

SEQ ID NO: 4087318 - DNA, 21 bp, Homo sapiens
aaggcaagagggggtggaggg

SEQ ID NO: 4087319 - DNA, 17 bp, Homo sapiens
aaggcaagttaagagaa

SEQ ID NO: 4087320 - DNA, 19 bp, Homo sapiens
aaggcaagttaagagaaac

SEQ ID NO: 4087321 - DNA, 20 bp, Homo sapiens
aaggcagagaagttctcaaa

SEQ ID NO: 4087322 - DNA, 16 bp, Homo sapiens
aaggcagctcacccct

SEQ ID NO: 4087323 - DNA, 21 bp, Homo sapiens
aaggcagctgttgtctcttct

SEQ ID NO: 4087324 - DNA, 18 bp, Homo sapiens
aaggcatcccagcctggg

SEQ ID NO: 4087325 - DNA, 21 bp, Homo sapiens
aaggcatcccagcctgggggc

SEQ ID NO: 4087326 - DNA, 21 bp, Homo sapiens
aaggcatgatgttaaccagaa

SEQ ID NO: 4087327 - DNA, 15 bp, Homo sapiens
aaggcatttcccacc

SEQ ID NO: 4087328 - DNA, 22 bp, Homo sapiens
aaggccagagtggcctggccag

SEQ ID NO: 4087329 - DNA, 21 bp, Homo sapiens
aaggccagtccccatttctgc

SEQ ID NO: 4087330 - DNA, 14 bp, Homo sapiens
aaggccataaaaca

SEQ ID NO: 4087331 - DNA, 17 bp, Homo sapiens
aaggccataaaacaggt

SEQ ID NO: 4087332 - DNA, 15 bp, Homo sapiens
aaggccccctgcctg

SEQ ID NO: 4087333 - DNA, 18 bp, Homo sapiens
aaggccctgctgagtcat

SEQ ID NO: 4087334 - DNA, 15 bp, Homo sapiens
aaggccctgctgccc

SEQ ID NO: 4087335 - DNA, 20 bp, Homo sapiens
aaggcctccctcaggctctg

SEQ ID NO: 4087336 - DNA, 15 bp, Homo sapiens
aaggccttaatatgt

SEQ ID NO: 4087337 - DNA, 15 bp, Homo sapiens
aaggccttctcctcc

SEQ ID NO: 4087338 - DNA, 16 bp, Homo sapiens
aaggctaaaacttaac

SEQ ID NO: 4087339 - DNA, 20 bp, Homo sapiens
aaggctgccaacggggagcg

SEQ ID NO: 4087340 - DNA, 13 bp, Homo sapiens
aaggctgccgagg

SEQ ID NO: 4087341 - DNA, 22 bp, Homo sapiens
aagggaaagcttcattctcctt

SEQ ID NO: 4087342 - DNA, 15 bp, Homo sapiens
aagggaaatatcatt

SEQ ID NO: 4087343 - DNA, 17 bp, Homo sapiens
aagggaatcctcctcca

SEQ ID NO: 4087344 - DNA, 14 bp, Homo sapiens
aagggaattgctca

SEQ ID NO: 4087345 - DNA, 16 bp, Homo sapiens
aagggagaagaaaggt

SEQ ID NO: 4087346 - DNA, 17 bp, Homo sapiens
aagggagagacctcatc

SEQ ID NO: 4087347 - DNA, 17 bp, Homo sapiens
aagggagagctgagcca

SEQ ID NO: 4087348 - DNA, 18 bp, Homo sapiens
aagggagctggctccagc

SEQ ID NO: 4087349 - DNA, 21 bp, Homo sapiens
aagggcaggaaggagagcctg

SEQ ID NO: 4087350 - DNA, 22 bp, Homo sapiens
aagggcagggcatctcctgtgc

SEQ ID NO: 4087351 - DNA, 15 bp, Homo sapiens
aagggcatgccttgt

SEQ ID NO: 4087352 - DNA, 17 bp, Homo sapiens
aagggcatgccttgtgc

SEQ ID NO: 4087353 - DNA, 15 bp, Homo sapiens
aagggcattttaccc

SEQ ID NO: 4087354 - DNA, 9 bp, Homo sapiens
aagggccag

SEQ ID NO: 4087355 - DNA, 12 bp, Homo sapiens
aagggccagagc

SEQ ID NO: 4087356 - DNA, 17 bp, Homo sapiens
aagggccagagccaggg

SEQ ID NO: 4087357 - DNA, 22 bp, Homo sapiens
aagggccagtcctgcctggcca

SEQ ID NO: 4087358 - DNA, 15 bp, Homo sapiens
actaccacaaggaaa

SEQ ID NO: 4087359 - DNA, 21 bp, Homo sapiens
actaccaggtgtgcctggaag

SEQ ID NO: 4087360 - DNA, 20 bp, Homo sapiens
actaccccacaccagccttg

SEQ ID NO: 4087361 - DNA, 20 bp, Homo sapiens
actaccccatatacacctgg

SEQ ID NO: 4087362 - DNA, 16 bp, Homo sapiens
actacccccttttcag

SEQ ID NO: 4087363 - DNA, 17 bp, Homo sapiens
actacctcctctcctga

SEQ ID NO: 4087364 - DNA, 21 bp, Homo sapiens
actactagtttttacttttat

SEQ ID NO: 4087365 - DNA, 12 bp, Homo sapiens
actactgggtgt

SEQ ID NO: 4087366 - DNA, 16 bp, Homo sapiens
actactgggtgtcatt

SEQ ID NO: 4087367 - DNA, 21 bp, Homo sapiens
actactgggtgtcatttcatt

SEQ ID NO: 4087368 - DNA, 13 bp, Homo sapiens
actactgtgttcc

SEQ ID NO: 4087369 - DNA, 21 bp, Homo sapiens
actacttagcatcctaagaaa

SEQ ID NO: 4087370 - DNA, 17 bp, Homo sapiens
actacttgggagcaccg

SEQ ID NO: 4087371 - DNA, 13 bp, Homo sapiens
actagaactctcc

SEQ ID NO: 4087372 - DNA, 19 bp, Homo sapiens
actagaagattagaaacta

SEQ ID NO: 4087373 - DNA, 18 bp, Homo sapiens
actagacacacaaagcag

SEQ ID NO: 4087374 - DNA, 21 bp, Homo sapiens
actagacacacaaagcagttg

SEQ ID NO: 4087375 - DNA, 11 bp, Homo sapiens
actagactctt

SEQ ID NO: 4087376 - DNA, 17 bp, Homo sapiens
actagactcttcactgt

SEQ ID NO: 4087377 - DNA, 15 bp, Homo sapiens
actagagtctgaaca

SEQ ID NO: 4087378 - DNA, 15 bp, Homo sapiens
actagatggcgagca

SEQ ID NO: 4087379 - DNA, 21 bp, Homo sapiens
actagccaacggccccagctt

SEQ ID NO: 4087380 - DNA, 19 bp, Homo sapiens
actagctatctaggtggag

SEQ ID NO: 4087381 - DNA, 18 bp, Homo sapiens
actaggaaatccattcac

SEQ ID NO: 4087382 - DNA, 15 bp, Homo sapiens
actaggaatcccaga

SEQ ID NO: 4087383 - DNA, 19 bp, Homo sapiens
actagggattcaggctgct

SEQ ID NO: 4087384 - DNA, 22 bp, Homo sapiens
actaggggatataggagaggaa

SEQ ID NO: 4087385 - DNA, 21 bp, Homo sapiens
actaggtaacttattagaaac

SEQ ID NO: 4087386 - DNA, 13 bp, Homo sapiens
actagtacaaatt

SEQ ID NO: 4087387 - DNA, 21 bp, Homo sapiens
actagtgccaatgatgtgacc

SEQ ID NO: 4087388 - DNA, 16 bp, Homo sapiens
actagtgtcaggcccc

SEQ ID NO: 4087389 - DNA, 23 bp, Homo sapiens
actagtgtcaggcccccagtggg

SEQ ID NO: 4087390 - DNA, 22 bp, Homo sapiens
actagttacacatcttcaacag

SEQ ID NO: 4087391 - DNA, 20 bp, Homo sapiens
actataaagaagtaacaaaa

SEQ ID NO: 4087392 - DNA, 14 bp, Homo sapiens
actataatgtaagc

SEQ ID NO: 4087393 - DNA, 20 bp, Homo sapiens
actatagcccaggtcctctg

SEQ ID NO: 4087394 - DNA, 20 bp, Homo sapiens
actatagtttaaaacacatt

SEQ ID NO: 4087395 - DNA, 12 bp, Homo sapiens
actatatgtgaa

SEQ ID NO: 4087396 - DNA, 19 bp, Homo sapiens
actatattcatttccactc

SEQ ID NO: 4087397 - DNA, 22 bp, Homo sapiens
actatatttgggcctgctccag

SEQ ID NO: 4087398 - DNA, 16 bp, Homo sapiens
actatctaaatgttga

SEQ ID NO: 4087399 - DNA, 15 bp, Homo sapiens
actatctgcattatc

SEQ ID NO: 4087400 - DNA, 17 bp, Homo sapiens
actatctgcattatcta

SEQ ID NO: 4087401 - DNA, 17 bp, Homo sapiens
actatcttcttcaaata

SEQ ID NO: 4087402 - DNA, 11 bp, Homo sapiens
actatcttgtg

SEQ ID NO: 4087403 - DNA, 13 bp, Homo sapiens
actatctttctga

SEQ ID NO: 4087404 - DNA, 18 bp, Homo sapiens
actatgaactacaaagct

SEQ ID NO: 4087405 - DNA, 15 bp, Homo sapiens
actatgacactgagc

SEQ ID NO: 4087406 - DNA, 21 bp, Homo sapiens
actatgcatggtgccccagga

SEQ ID NO: 4087407 - DNA, 16 bp, Homo sapiens
actatgggatgtatat

SEQ ID NO: 4087408 - DNA, 21 bp, Homo sapiens
actatggtatgctggccagca

SEQ ID NO: 4087409 - DNA, 15 bp, Homo sapiens
actatggtatttgag

SEQ ID NO: 4087410 - DNA, 17 bp, Homo sapiens
actatggttcccaataa

SEQ ID NO: 4087411 - DNA, 19 bp, Homo sapiens
actatggttcccaataaaa

SEQ ID NO: 4087412 - DNA, 22 bp, Homo sapiens
actatggttcccaataaaagtg

SEQ ID NO: 4087413 - DNA, 23 bp, Homo sapiens
actatggttcccaataaaagtga

SEQ ID NO: 4087414 - DNA, 16 bp, Homo sapiens
actatgtaaactactt

SEQ ID NO: 4087415 - DNA, 15 bp, Homo sapiens
actatgtatatacat

SEQ ID NO: 4087416 - DNA, 18 bp, Homo sapiens
actatgtcgatgcacagt

SEQ ID NO: 4087417 - DNA, 11 bp, Homo sapiens
actatgtgctg

SEQ ID NO: 4087418 - DNA, 14 bp, Homo sapiens
actattaagcagta

SEQ ID NO: 4087419 - DNA, 22 bp, Homo sapiens
actattaagcagtaaaaactgt

SEQ ID NO: 4087420 - DNA, 16 bp, Homo sapiens
actattccctttgact

SEQ ID NO: 4087421 - DNA, 20 bp, Homo sapiens
actattccctttgacttcag

SEQ ID NO: 4087422 - DNA, 22 bp, Homo sapiens
actattccctttgacttcagct

SEQ ID NO: 4087423 - DNA, 16 bp, Homo sapiens
actattggaaagtact

SEQ ID NO: 4087424 - DNA, 16 bp, Homo sapiens
actattgtgccaactg

SEQ ID NO: 4087425 - DNA, 14 bp, Homo sapiens
actattgttacatt

SEQ ID NO: 4087426 - DNA, 14 bp, Homo sapiens
actatttaaactta

SEQ ID NO: 4087427 - DNA, 18 bp, Homo sapiens
actatttagtgttagtta

SEQ ID NO: 4087428 - DNA, 15 bp, Homo sapiens
actatttatctgtgt

SEQ ID NO: 4087429 - DNA, 15 bp, Homo sapiens
actcaaaaaaacaaa

SEQ ID NO: 4087430 - DNA, 20 bp, Homo sapiens
actcaaaaaaacaaaaaaga

SEQ ID NO: 4087431 - DNA, 16 bp, Homo sapiens
actcaaatgagtaaca

SEQ ID NO: 4087432 - DNA, 20 bp, Homo sapiens
actcaaatgtgagtgttttt

SEQ ID NO: 4087433 - DNA, 17 bp, Homo sapiens
actcaacatgttactga

SEQ ID NO: 4087434 - DNA, 15 bp, Homo sapiens
actcaactctgagcc

SEQ ID NO: 4087435 - DNA, 16 bp, Homo sapiens
actcaactctgagccc

SEQ ID NO: 4087436 - DNA, 13 bp, Homo sapiens
actcaagctgcgt

SEQ ID NO: 4087437 - DNA, 17 bp, Homo sapiens
actcaatgcctggagac

SEQ ID NO: 4087438 - DNA, 17 bp, Homo sapiens
actcaattatttgcata

SEQ ID NO: 4087439 - DNA, 11 bp, Homo sapiens
actcacaggcc

SEQ ID NO: 4087440 - DNA, 17 bp, Homo sapiens
actcaccagtgtcccct

SEQ ID NO: 4087441 - DNA, 17 bp, Homo sapiens
actcacccatgtgccaa

SEQ ID NO: 4087442 - DNA, 18 bp, Homo sapiens
actcacccatgtgccaag

SEQ ID NO: 4087443 - DNA, 15 bp, Homo sapiens
actcaccctgggagc

SEQ ID NO: 4087444 - DNA, 16 bp, Homo sapiens
actcaccctgggagcc

SEQ ID NO: 4087445 - DNA, 23 bp, Homo sapiens
actcacctaatgtttatgagcca

SEQ ID NO: 4087446 - DNA, 12 bp, Homo sapiens
actcaccttcta

SEQ ID NO: 4087447 - DNA, 13 bp, Homo sapiens
actcactctgggc

SEQ ID NO: 4087448 - DNA, 16 bp, Homo sapiens
actcactctgggctgt

SEQ ID NO: 4087449 - DNA, 12 bp, Homo sapiens
actcactgaagc

SEQ ID NO: 4087450 - DNA, 13 bp, Homo sapiens
actcactgaagcc

SEQ ID NO: 4087451 - DNA, 19 bp, Homo sapiens
actcactgaagcctgcgtt

SEQ ID NO: 4087452 - DNA, 15 bp, Homo sapiens
actcactgctcaaga

SEQ ID NO: 4087453 - DNA, 18 bp, Homo sapiens
actcactgtgatcaatat

SEQ ID NO: 4087454 - DNA, 14 bp, Homo sapiens
actcagaaattttt

SEQ ID NO: 4087455 - DNA, 18 bp, Homo sapiens
actcagacattggcacct

SEQ ID NO: 4087456 - DNA, 21 bp, Homo sapiens
actcagagaaaaatgctcccc

SEQ ID NO: 4087457 - DNA, 19 bp, Homo sapiens
actcagagcagtctgtgac

SEQ ID NO: 4087458 - DNA, 15 bp, Homo sapiens
actcagcacaaggcc

SEQ ID NO: 4087459 - DNA, 12 bp, Homo sapiens
actcagcctgct

SEQ ID NO: 4087460 - DNA, 16 bp, Homo sapiens
actcagcctgctgccc

SEQ ID NO: 4087461 - DNA, 18 bp, Homo sapiens
actcagcctgctgcccag

SEQ ID NO: 4087462 - DNA, 22 bp, Homo sapiens
actcagcctgctgcccaggctg

SEQ ID NO: 4087463 - DNA, 14 bp, Homo sapiens
actcagctgtcctg

SEQ ID NO: 4087464 - DNA, 14 bp, Homo sapiens
actcaggaggctga

SEQ ID NO: 4087465 - DNA, 17 bp, Homo sapiens
actcaggcctgtgccca

SEQ ID NO: 4087466 - DNA, 20 bp, Homo sapiens
actcagggacagagccatgc

SEQ ID NO: 4087467 - DNA, 23 bp, Homo sapiens
actcagggaccggtgctgcagga

SEQ ID NO: 4087468 - DNA, 19 bp, Homo sapiens
actcagggttcatctgtcc

SEQ ID NO: 4087469 - DNA, 12 bp, Homo sapiens
actcatcataaa

SEQ ID NO: 4087470 - DNA, 13 bp, Homo sapiens
actcatcataaaa

SEQ ID NO: 4087471 - DNA, 16 bp, Homo sapiens
actcatcataaaataa

SEQ ID NO: 4087472 - DNA, 22 bp, Homo sapiens
actcatcttagtgcctgagagt

SEQ ID NO: 4087473 - DNA, 15 bp, Homo sapiens
actcatggcagctgt

SEQ ID NO: 4087474 - DNA, 19 bp, Homo sapiens
actcatggcagctgtttct

SEQ ID NO: 4087475 - DNA, 23 bp, Homo sapiens
actcattgctgagcctctgctcc

SEQ ID NO: 4087476 - DNA, 14 bp, Homo sapiens
actcattgtagaaa

SEQ ID NO: 4087477 - DNA, 16 bp, Homo sapiens
actcattttctataac

SEQ ID NO: 4087478 - DNA, 21 bp, Homo sapiens
actcattttctataacagata

SEQ ID NO: 4087479 - DNA, 18 bp, Homo sapiens
actccaacagaagaactg

SEQ ID NO: 4087480 - DNA, 20 bp, Homo sapiens
actccacagcggaggagacc

SEQ ID NO: 4087481 - DNA, 23 bp, Homo sapiens
actccacagcggaggagaccagc

SEQ ID NO: 4087482 - DNA, 14 bp, Homo sapiens
actccaccgaccaa

SEQ ID NO: 4087483 - DNA, 18 bp, Homo sapiens
actccaccgaccaactgc

SEQ ID NO: 4087484 - DNA, 21 bp, Homo sapiens
actccaccgaccaactgccct

SEQ ID NO: 4087485 - DNA, 13 bp, Homo sapiens
actccagacccct

SEQ ID NO: 4087486 - DNA, 16 bp, Homo sapiens
actccagatagagaaa

SEQ ID NO: 4087487 - DNA, 14 bp, Homo sapiens
actccagcctgggc

SEQ ID NO: 4087488 - DNA, 23 bp, Homo sapiens
actccagcctgggcaacagagca

SEQ ID NO: 4087489 - DNA, 13 bp, Homo sapiens
actccaggcccaa

SEQ ID NO: 4087490 - DNA, 18 bp, Homo sapiens
actccaggccctcctctc

SEQ ID NO: 4087491 - DNA, 14 bp, Homo sapiens
actccagtgccagc

SEQ ID NO: 4087492 - DNA, 15 bp, Homo sapiens
actccagtgccagca

SEQ ID NO: 4087493 - DNA, 13 bp, Homo sapiens
actccatgagcac

SEQ ID NO: 4087494 - DNA, 18 bp, Homo sapiens
actcccaacttcttcctg

SEQ ID NO: 4087495 - DNA, 20 bp, Homo sapiens
actcccaacttcttcctgtg

SEQ ID NO: 4087496 - DNA, 21 bp, Homo sapiens
actcccaagacccgagctggg

SEQ ID NO: 4087497 - DNA, 17 bp, Homo sapiens
actcccacctcacccgg

SEQ ID NO: 4087498 - DNA, 22 bp, Homo sapiens
actcccacctcacccggcctct

SEQ ID NO: 4087499 - DNA, 13 bp, Homo sapiens
actcccattcctg

SEQ ID NO: 4087500 - DNA, 22 bp, Homo sapiens
actcccattcctgaagaaccag

SEQ ID NO: 4087501 - DNA, 14 bp, Homo sapiens
actccccaaggaag

SEQ ID NO: 4087502 - DNA, 13 bp, Homo sapiens
actccccaggcca

SEQ ID NO: 4087503 - DNA, 15 bp, Homo sapiens
actccccaggccagg

SEQ ID NO: 4087504 - DNA, 12 bp, Homo sapiens
actccccaggga

SEQ ID NO: 4087505 - DNA, 19 bp, Homo sapiens
actcccccgtttctccttt

SEQ ID NO: 4087506 - DNA, 16 bp, Homo sapiens
actccccgaagtcttt

SEQ ID NO: 4087507 - DNA, 22 bp, Homo sapiens
actcccggagcctgtgcagcct

SEQ ID NO: 4087508 - DNA, 16 bp, Homo sapiens
actcccgggccacgcc

SEQ ID NO: 4087509 - DNA, 18 bp, Homo sapiens
actcccgggccacgcccc

SEQ ID NO: 4087510 - DNA, 21 bp, Homo sapiens
actcccgggccacgccccagc

SEQ ID NO: 4087511 - DNA, 16 bp, Homo sapiens
actccctcctcacctc

SEQ ID NO: 4087512 - DNA, 20 bp, Homo sapiens
actccctcctcacctctgga

SEQ ID NO: 4087513 - DNA, 13 bp, Homo sapiens
actccctgctcca

SEQ ID NO: 4087514 - DNA, 21 bp, Homo sapiens
actccctgggacacagaccca

SEQ ID NO: 4087515 - DNA, 23 bp, Homo sapiens
actcccttccctctctcccattt

SEQ ID NO: 4087516 - DNA, 19 bp, Homo sapiens
actccgccctcctcgggcc

SEQ ID NO: 4087517 - DNA, 21 bp, Homo sapiens
actccgccctcctcgggccga

SEQ ID NO: 4087518 - DNA, 16 bp, Homo sapiens
actcctacctgccctg

SEQ ID NO: 4087519 - DNA, 20 bp, Homo sapiens
actcctagagaacgcagccc

SEQ ID NO: 4087520 - DNA, 20 bp, Homo sapiens
actcctaggagagccaacct

SEQ ID NO: 4087521 - DNA, 21 bp, Homo sapiens
actcctcaaaagcaaatgaga

SEQ ID NO: 4087522 - DNA, 12 bp, Homo sapiens
actcctccctcc

SEQ ID NO: 4087523 - DNA, 18 bp, Homo sapiens
actcctcctcactaaaaa

SEQ ID NO: 4087524 - DNA, 21 bp, Homo sapiens
actcctcctccaaaggccccc

SEQ ID NO: 4087525 - DNA, 19 bp, Homo sapiens
actcctctggctttcccag

SEQ ID NO: 4087526 - DNA, 21 bp, Homo sapiens
actcctgacgtctgaagcttg

SEQ ID NO: 4087527 - DNA, 23 bp, Homo sapiens
actcctgacgtctgaagcttgac

SEQ ID NO: 4087528 - DNA, 18 bp, Homo sapiens
actcctgcaaaattttat

SEQ ID NO: 4087529 - DNA, 15 bp, Homo sapiens
actcctgccaggcac

SEQ ID NO: 4087530 - DNA, 16 bp, Homo sapiens
actcctgccaggcaca

SEQ ID NO: 4087531 - DNA, 14 bp, Homo sapiens
actcctgccctgtt

SEQ ID NO: 4087532 - DNA, 20 bp, Homo sapiens
actcctgcctgagtttccag

SEQ ID NO: 4087533 - DNA, 21 bp, Homo sapiens
actcctgcctgagtttccagc

SEQ ID NO: 4087534 - DNA, 15 bp, Homo sapiens
actcctgggctcaag

SEQ ID NO: 4087535 - DNA, 21 bp, Homo sapiens
actcctggggcctcttgggtc

SEQ ID NO: 4087536 - DNA, 18 bp, Homo sapiens
actcctgtcccttttccc

SEQ ID NO: 4087537 - DNA, 19 bp, Homo sapiens
actcctgtcccttttccct

SEQ ID NO: 4087538 - DNA, 14 bp, Homo sapiens
actcctgtttctcc

SEQ ID NO: 4087539 - DNA, 20 bp, Homo sapiens
actccttcctggcctgagag

SEQ ID NO: 4087540 - DNA, 15 bp, Homo sapiens
actcgaatctgtgtg

SEQ ID NO: 4087541 - DNA, 16 bp, Homo sapiens
actcgagaccttttca

SEQ ID NO: 4087542 - DNA, 18 bp, Homo sapiens
actcgccatctcctgggc

SEQ ID NO: 4087543 - DNA, 22 bp, Homo sapiens
actcgtgcattaaaatttctta

SEQ ID NO: 4087544 - DNA, 20 bp, Homo sapiens
actctaaaaaacatttttaa

SEQ ID NO: 4087545 - DNA, 14 bp, Homo sapiens
actctaaactgcaa

SEQ ID NO: 4087546 - DNA, 16 bp, Homo sapiens
actctaaatgcagttt

SEQ ID NO: 4087547 - DNA, 21 bp, Homo sapiens
actctaaatgcagttttaaga

SEQ ID NO: 4087548 - DNA, 16 bp, Homo sapiens
actctaccctcccacc

SEQ ID NO: 4087549 - DNA, 21 bp, Homo sapiens
actctaggggtcaggctccat

SEQ ID NO: 4087550 - DNA, 14 bp, Homo sapiens
actctattctcaaa

SEQ ID NO: 4087551 - DNA, 11 bp, Homo sapiens
actctccccac

SEQ ID NO: 4087552 - DNA, 12 bp, Homo sapiens
actctccccaca

SEQ ID NO: 4087553 - DNA, 22 bp, Homo sapiens
actctccccacgagggctggct

SEQ ID NO: 4087554 - DNA, 18 bp, Homo sapiens
actctcctggaaatatta

SEQ ID NO: 4087555 - DNA, 13 bp, Homo sapiens
actctctccaccc

SEQ ID NO: 4087556 - DNA, 20 bp, Homo sapiens
actctcttccctttccccag

SEQ ID NO: 4087557 - DNA, 20 bp, Homo sapiens
actctgaaacacactgaaag

SEQ ID NO: 4087558 - DNA, 13 bp, Homo sapiens
actctgaactttg

SEQ ID NO: 4087559 - DNA, 16 bp, Homo sapiens
actctgaactttggag

SEQ ID NO: 4087560 - DNA, 18 bp, Homo sapiens
actctgaagcctctggga

SEQ ID NO: 4087561 - DNA, 21 bp, Homo sapiens
actctgagcgggaggcagagt

SEQ ID NO: 4087562 - DNA, 22 bp, Homo sapiens
actctgagcgggaggcagagtt

SEQ ID NO: 4087563 - DNA, 20 bp, Homo sapiens
actctgagtccactgctcca

SEQ ID NO: 4087564 - DNA, 21 bp, Homo sapiens
actctgagtttaccatttgta

SEQ ID NO: 4087565 - DNA, 22 bp, Homo sapiens
acgcttgtagaactcactctgg

SEQ ID NO: 4087566 - DNA, 23 bp, Homo sapiens
acgcttgtagaactcactctggg

SEQ ID NO: 4087567 - DNA, 17 bp, Homo sapiens
acgctttctagctgttg

SEQ ID NO: 4087568 - DNA, 14 bp, Homo sapiens
acgctttgattcat

SEQ ID NO: 4087569 - DNA, 23 bp, Homo sapiens
acgcttttaattctcatttgttc

SEQ ID NO: 4087570 - DNA, 15 bp, Homo sapiens
acggactcccgggcc

SEQ ID NO: 4087571 - DNA, 17 bp, Homo sapiens
acggactcccgggccac

SEQ ID NO: 4087572 - DNA, 12 bp, Homo sapiens
acggagagaaaa

SEQ ID NO: 4087573 - DNA, 13 bp, Homo sapiens
acggagagaaaaa

SEQ ID NO: 4087574 - DNA, 21 bp, Homo sapiens
acggagccccaggcctctgtg

SEQ ID NO: 4087575 - DNA, 20 bp, Homo sapiens
acggagcggattgcaaagca

SEQ ID NO: 4087576 - DNA, 21 bp, Homo sapiens
acggagcggattgcaaagcaa

SEQ ID NO: 4087577 - DNA, 18 bp, Homo sapiens
acggaggggagtagagaa

SEQ ID NO: 4087578 - DNA, 18 bp, Homo sapiens
acggcaggctcactgcca

SEQ ID NO: 4087579 - DNA, 22 bp, Homo sapiens
acggcaggctcactgccaggcc

SEQ ID NO: 4087580 - DNA, 17 bp, Homo sapiens
acggccagggagaagct

SEQ ID NO: 4087581 - DNA, 23 bp, Homo sapiens
acggccagggagaagctcctctc

SEQ ID NO: 4087582 - DNA, 20 bp, Homo sapiens
acggccatctctttgtacag

SEQ ID NO: 4087583 - DNA, 22 bp, Homo sapiens
acggccctcatctatgaggaaa

SEQ ID NO: 4087584 - DNA, 18 bp, Homo sapiens
acggcctgatgctccctc

SEQ ID NO: 4087585 - DNA, 20 bp, Homo sapiens
acggcctgatgctccctccc

SEQ ID NO: 4087586 - DNA, 16 bp, Homo sapiens
acggcgcccccagtgt

SEQ ID NO: 4087587 - DNA, 14 bp, Homo sapiens
acggcggccaggca

SEQ ID NO: 4087588 - DNA, 15 bp, Homo sapiens
acggcggccaggcac

SEQ ID NO: 4087589 - DNA, 16 bp, Homo sapiens
acggctgagccttcag

SEQ ID NO: 4087590 - DNA, 22 bp, Homo sapiens
acggctgggtgtttcagtttga

SEQ ID NO: 4087591 - DNA, 22 bp, Homo sapiens
acggctgtggaccgtggacagg

SEQ ID NO: 4087592 - DNA, 23 bp, Homo sapiens
acggcttagacttcgactcagga

SEQ ID NO: 4087593 - DNA, 10 bp, Homo sapiens
acgggcacag

SEQ ID NO: 4087594 - DNA, 11 bp, Homo sapiens
acggggcctcc

SEQ ID NO: 4087595 - DNA, 15 bp, Homo sapiens
acggggttccctcct

SEQ ID NO: 4087596 - DNA, 20 bp, Homo sapiens
acggtcacacggccacccgc

SEQ ID NO: 4087597 - DNA, 18 bp, Homo sapiens
acggtgctgtgagggagg

SEQ ID NO: 4087598 - DNA, 18 bp, Homo sapiens
acggtgggcatttgtgag

SEQ ID NO: 4087599 - DNA, 18 bp, Homo sapiens
acgtaaccacggaaaaga

SEQ ID NO: 4087600 - DNA, 20 bp, Homo sapiens
acgtagtcggcacagcctgg

SEQ ID NO: 4087601 - DNA, 19 bp, Homo sapiens
acgtcactttttggccatg

SEQ ID NO: 4087602 - DNA, 21 bp, Homo sapiens
acgtcatcggaggctgggccc

SEQ ID NO: 4087603 - DNA, 18 bp, Homo sapiens
acgtcccagcatccctgg

SEQ ID NO: 4087604 - DNA, 19 bp, Homo sapiens
acgtcccagcatccctgga

SEQ ID NO: 4087605 - DNA, 12 bp, Homo sapiens
acgtcctgcctg

SEQ ID NO: 4087606 - DNA, 23 bp, Homo sapiens
acgtcgcccgctgagctgagtgg

SEQ ID NO: 4087607 - DNA, 22 bp, Homo sapiens
acgtctgaagcttgactcccaa

SEQ ID NO: 4087608 - DNA, 17 bp, Homo sapiens
acgtgacagtgcctggg

SEQ ID NO: 4087609 - DNA, 20 bp, Homo sapiens
acgtgcaaggactcccggag

SEQ ID NO: 4087610 - DNA, 22 bp, Homo sapiens
acgtgcaaggactcccggagcc

SEQ ID NO: 4087611 - DNA, 14 bp, Homo sapiens
acgtggagagctgg

SEQ ID NO: 4087612 - DNA, 16 bp, Homo sapiens
acgtggcctcttgagc

SEQ ID NO: 4087613 - DNA, 14 bp, Homo sapiens
acgtggctcagcca

SEQ ID NO: 4087614 - DNA, 19 bp, Homo sapiens
acgtgggcaaacaggcagt

SEQ ID NO: 4087615 - DNA, 23 bp, Homo sapiens
acgtggtcactgtgcactgccct

SEQ ID NO: 4087616 - DNA, 18 bp, Homo sapiens
acgtgtgtaaatatgtac

SEQ ID NO: 4087617 - DNA, 21 bp, Homo sapiens
acgttaagggaaggaactctg

SEQ ID NO: 4087618 - DNA, 18 bp, Homo sapiens
acgttcacccatcttatc

SEQ ID NO: 4087619 - DNA, 14 bp, Homo sapiens
acgttcataaccaa

SEQ ID NO: 4087620 - DNA, 15 bp, Homo sapiens
acgttcataaccaac

SEQ ID NO: 4087621 - DNA, 16 bp, Homo sapiens
acgttcctattgtcat

SEQ ID NO: 4087622 - DNA, 16 bp, Homo sapiens
acgttgagcccctgga

SEQ ID NO: 4087623 - DNA, 12 bp, Homo sapiens
acgttggacttt

SEQ ID NO: 4087624 - DNA, 16 bp, Homo sapiens
acgttgggacagggag

SEQ ID NO: 4087625 - DNA, 15 bp, Homo sapiens
acgtttcctgagaag

SEQ ID NO: 4087626 - DNA, 15 bp, Homo sapiens
acgtttgatacaaca

SEQ ID NO: 4087627 - DNA, 13 bp, Homo sapiens
acgtttttccttt

SEQ ID NO: 4087628 - DNA, 19 bp, Homo sapiens
acgtttttgtgctgtgggc

SEQ ID NO: 4087629 - DNA, 15 bp, Homo sapiens
actaaaaatattgtt

SEQ ID NO: 4087630 - DNA, 13 bp, Homo sapiens
actaaaagacatt

SEQ ID NO: 4087631 - DNA, 15 bp, Homo sapiens
actaaaagacatttg

SEQ ID NO: 4087632 - DNA, 23 bp, Homo sapiens
actaaaattaggactgtataagt

SEQ ID NO: 4087633 - DNA, 19 bp, Homo sapiens
actaaacatatgatttcac

SEQ ID NO: 4087634 - DNA, 19 bp, Homo sapiens
actaaaccgataatgcatg

SEQ ID NO: 4087635 - DNA, 16 bp, Homo sapiens
actaaagagagaatgt

SEQ ID NO: 4087636 - DNA, 13 bp, Homo sapiens
actaaagccaagg

SEQ ID NO: 4087637 - DNA, 14 bp, Homo sapiens
actaaagcttcaga

SEQ ID NO: 4087638 - DNA, 16 bp, Homo sapiens
actaaagcttcagact

SEQ ID NO: 4087639 - DNA, 12 bp, Homo sapiens
actaaataatga

SEQ ID NO: 4087640 - DNA, 13 bp, Homo sapiens
actaaatatctgt

SEQ ID NO: 4087641 - DNA, 14 bp, Homo sapiens
actaaatgttctat

SEQ ID NO: 4087642 - DNA, 22 bp, Homo sapiens
actaaatttaaatttaaagata

SEQ ID NO: 4087643 - DNA, 13 bp, Homo sapiens
actaacagataag

SEQ ID NO: 4087644 - DNA, 16 bp, Homo sapiens
actaacagataagcaa

SEQ ID NO: 4087645 - DNA, 17 bp, Homo sapiens
actaacatataatgttg

SEQ ID NO: 4087646 - DNA, 18 bp, Homo sapiens
actaacgttgagcccctg

SEQ ID NO: 4087647 - DNA, 21 bp, Homo sapiens
actaactcctgagaaatgtta

SEQ ID NO: 4087648 - DNA, 23 bp, Homo sapiens
actaacttatttatgttaaaaga

SEQ ID NO: 4087649 - DNA, 17 bp, Homo sapiens
actaacttgacttttaa

SEQ ID NO: 4087650 - DNA, 19 bp, Homo sapiens
actaagagaaaattgcact

SEQ ID NO: 4087651 - DNA, 13 bp, Homo sapiens
actaagccctgtc

SEQ ID NO: 4087652 - DNA, 22 bp, Homo sapiens
actaagccctgtcgagacactt

SEQ ID NO: 4087653 - DNA, 17 bp, Homo sapiens
actaagctctttgagaa

SEQ ID NO: 4087654 - DNA, 18 bp, Homo sapiens
actaatataaaatgagta

SEQ ID NO: 4087655 - DNA, 18 bp, Homo sapiens
actaatctattgggttca

SEQ ID NO: 4087656 - DNA, 13 bp, Homo sapiens
actaattccacac

SEQ ID NO: 4087657 - DNA, 17 bp, Homo sapiens
actaatttgatgtttac

SEQ ID NO: 4087658 - DNA, 21 bp, Homo sapiens
actaattttagtattcattct

SEQ ID NO: 4087659 - DNA, 20 bp, Homo sapiens
actacaaaatacaatcctgt

SEQ ID NO: 4087660 - DNA, 18 bp, Homo sapiens
actacaaaatttgaaatt

SEQ ID NO: 4087661 - DNA, 13 bp, Homo sapiens
actacaagtcagc

SEQ ID NO: 4087662 - DNA, 22 bp, Homo sapiens
actacagagcagctccccagga

SEQ ID NO: 4087663 - DNA, 13 bp, Homo sapiens
actacataaactg

SEQ ID NO: 4087664 - DNA, 16 bp, Homo sapiens
actacataaactgact

SEQ ID NO: 4087665 - DNA, 11 bp, Homo sapiens
actacatttat

SEQ ID NO: 4087666 - DNA, 13 bp, Homo sapiens
actacatttatga

SEQ ID NO: 4087667 - DNA, 15 bp, Homo sapiens
actaccaaaggacac

SEQ ID NO: 4087668 - DNA, 23 bp, Homo sapiens
acctgtgaccagcactgtctcag

SEQ ID NO: 4087669 - DNA, 15 bp, Homo sapiens
acctgtgagcccagc

SEQ ID NO: 4087670 - DNA, 21 bp, Homo sapiens
acctgtgagctgcaccaggta

SEQ ID NO: 4087671 - DNA, 23 bp, Homo sapiens
acctgtgagctgcaccaggtaga

SEQ ID NO: 4087672 - DNA, 16 bp, Homo sapiens
acctgtgagtaaatat

SEQ ID NO: 4087673 - DNA, 11 bp, Homo sapiens
acctgtgtgct

SEQ ID NO: 4087674 - DNA, 20 bp, Homo sapiens
acctgtgtggtactctgaaa

SEQ ID NO: 4087675 - DNA, 18 bp, Homo sapiens
acctgttttcgcacctac

SEQ ID NO: 4087676 - DNA, 16 bp, Homo sapiens
acctgtttttaagctg

SEQ ID NO: 4087677 - DNA, 18 bp, Homo sapiens
accttaggccttcctctc

SEQ ID NO: 4087678 - DNA, 23 bp, Homo sapiens
accttatcactgcattattctct

SEQ ID NO: 4087679 - DNA, 23 bp, Homo sapiens
accttatctgtgcgtgaaacaca

SEQ ID NO: 4087680 - DNA, 17 bp, Homo sapiens
accttattgtacctctc

SEQ ID NO: 4087681 - DNA, 22 bp, Homo sapiens
accttatttgctaatcaaagcc

SEQ ID NO: 4087682 - DNA, 16 bp, Homo sapiens
accttcaacccagtgg

SEQ ID NO: 4087683 - DNA, 20 bp, Homo sapiens
accttcaggccccgccccat

SEQ ID NO: 4087684 - DNA, 22 bp, Homo sapiens
accttccatacacagaggagtg

SEQ ID NO: 4087685 - DNA, 13 bp, Homo sapiens
accttccctccaa

SEQ ID NO: 4087686 - DNA, 16 bp, Homo sapiens
accttcctcacttcca

SEQ ID NO: 4087687 - DNA, 15 bp, Homo sapiens
accttcctgtccctg

SEQ ID NO: 4087688 - DNA, 18 bp, Homo sapiens
accttcctgtccctgagg

SEQ ID NO: 4087689 - DNA, 22 bp, Homo sapiens
accttcctgtgggtgttctttc

SEQ ID NO: 4087690 - DNA, 24 bp, Homo sapiens
accttcctgtgggtgttctttcct

SEQ ID NO: 4087691 - DNA, 12 bp, Homo sapiens
accttccttcct

SEQ ID NO: 4087692 - DNA, 16 bp, Homo sapiens
accttctagaattata

SEQ ID NO: 4087693 - DNA, 19 bp, Homo sapiens
accttctgtccccagccct

SEQ ID NO: 4087694 - DNA, 20 bp, Homo sapiens
accttgaaaataagaataga

SEQ ID NO: 4087695 - DNA, 23 bp, Homo sapiens
accttgaataaggcccactgtaa

SEQ ID NO: 4087696 - DNA, 15 bp, Homo sapiens
accttgaatgctgcc

SEQ ID NO: 4087697 - DNA, 17 bp, Homo sapiens
accttgcaacctcacct

SEQ ID NO: 4087698 - DNA, 21 bp, Homo sapiens
accttgccaagctttcttcta

SEQ ID NO: 4087699 - DNA, 19 bp, Homo sapiens
accttgctctcctcatctc

SEQ ID NO: 4087700 - DNA, 12 bp, Homo sapiens
accttgcttctt

SEQ ID NO: 4087701 - DNA, 16 bp, Homo sapiens
accttggctctgccag

SEQ ID NO: 4087702 - DNA, 16 bp, Homo sapiens
accttgggctggggga

SEQ ID NO: 4087703 - DNA, 16 bp, Homo sapiens
acctttaaaattgtca

SEQ ID NO: 4087704 - DNA, 24 bp, Homo sapiens
acctttaacacagacccctaggga

SEQ ID NO: 4087705 - DNA, 13 bp, Homo sapiens
acctttcccatct

SEQ ID NO: 4087706 - DNA, 21 bp, Homo sapiens
acctttccgctgtcgccccag

SEQ ID NO: 4087707 - DNA, 14 bp, Homo sapiens
accttttaactcac

SEQ ID NO: 4087708 - DNA, 14 bp, Homo sapiens
accttttattacat

SEQ ID NO: 4087709 - DNA, 13 bp, Homo sapiens
accttttcttcat

SEQ ID NO: 4087710 - DNA, 15 bp, Homo sapiens
accttttcttcattt

SEQ ID NO: 4087711 - DNA, 16 bp, Homo sapiens
accttttcttcatttt

SEQ ID NO: 4087712 - DNA, 17 bp, Homo sapiens
accttttgaggagcccc

SEQ ID NO: 4087713 - DNA, 21 bp, Homo sapiens
accttttgaggagccccagct

SEQ ID NO: 4087714 - DNA, 16 bp, Homo sapiens
accttttgggaatgtt

SEQ ID NO: 4087715 - DNA, 22 bp, Homo sapiens
accttttgggaatgttttaaat

SEQ ID NO: 4087716 - DNA, 13 bp, Homo sapiens
acctttttgtaaa

SEQ ID NO: 4087717 - DNA, 15 bp, Homo sapiens
acctttttgtaaata

SEQ ID NO: 4087718 - DNA, 17 bp, Homo sapiens
acctttttgtaaatact

SEQ ID NO: 4087719 - DNA, 20 bp, Homo sapiens
accttttttaagatttttct

SEQ ID NO: 4087720 - DNA, 22 bp, Homo sapiens
accttttttaagatttttctca

SEQ ID NO: 4087721 - DNA, 11 bp, Homo sapiens
acgaagaaaaa

SEQ ID NO: 4087722 - DNA, 12 bp, Homo sapiens
acgaagaaaaaa

SEQ ID NO: 4087723 - DNA, 21 bp, Homo sapiens
acgaaggtaaaaagtattttt

SEQ ID NO: 4087724 - DNA, 20 bp, Homo sapiens
acgacaatagctttaccctc

SEQ ID NO: 4087725 - DNA, 18 bp, Homo sapiens
acgacctttactgtcgta

SEQ ID NO: 4087726 - DNA, 14 bp, Homo sapiens
acgacgctgcagag

SEQ ID NO: 4087727 - DNA, 20 bp, Homo sapiens
acgagatgggaaggcacagg

SEQ ID NO: 4087728 - DNA, 13 bp, Homo sapiens
acgagccttttca

SEQ ID NO: 4087729 - DNA, 20 bp, Homo sapiens
acgaggaatctgtgggtctg

SEQ ID NO: 4087730 - DNA, 21 bp, Homo sapiens
acgagggctgatggaggaaaa

SEQ ID NO: 4087731 - DNA, 14 bp, Homo sapiens
acgagggctggctg

SEQ ID NO: 4087732 - DNA, 20 bp, Homo sapiens
acgaggtcaggagatcgaga

SEQ ID NO: 4087733 - DNA, 17 bp, Homo sapiens
acgagtgggaaggactt

SEQ ID NO: 4087734 - DNA, 16 bp, Homo sapiens
acgatgaatttcttct

SEQ ID NO: 4087735 - DNA, 17 bp, Homo sapiens
acgatgtttatgttctt

SEQ ID NO: 4087736 - DNA, 11 bp, Homo sapiens
acgattctccc

SEQ ID NO: 4087737 - DNA, 17 bp, Homo sapiens
acgcaaagggctgaaag

SEQ ID NO: 4087738 - DNA, 21 bp, Homo sapiens
acgcaaagggctgaaagccat

SEQ ID NO: 4087739 - DNA, 16 bp, Homo sapiens
acgcacaaacacacac

SEQ ID NO: 4087740 - DNA, 22 bp, Homo sapiens
acgcacacgtacttaaatgaaa

SEQ ID NO: 4087741 - DNA, 14 bp, Homo sapiens
acgcaccggcctgg

SEQ ID NO: 4087742 - DNA, 20 bp, Homo sapiens
acgcaccggcctggctgcag

SEQ ID NO: 4087743 - DNA, 16 bp, Homo sapiens
acgcacgcacacacac

SEQ ID NO: 4087744 - DNA, 21 bp, Homo sapiens
acgcactgggccacggaggag

SEQ ID NO: 4087745 - DNA, 19 bp, Homo sapiens
acgcagccctagagcctgc

SEQ ID NO: 4087746 - DNA, 20 bp, Homo sapiens
acgcagccctagagcctgcc

SEQ ID NO: 4087747 - DNA, 24 bp, Homo sapiens
acgcagccctagagcctgcctgga

SEQ ID NO: 4087748 - DNA, 18 bp, Homo sapiens
acgcaggctgagtccaga

SEQ ID NO: 4087749 - DNA, 17 bp, Homo sapiens
acgcaggggttgcagtg

SEQ ID NO: 4087750 - DNA, 21 bp, Homo sapiens
acgcagtccgcccaggtcccc

SEQ ID NO: 4087751 - DNA, 15 bp, Homo sapiens
acgcatccagcaaga

SEQ ID NO: 4087752 - DNA, 17 bp, Homo sapiens
acgccactccacaaatg

SEQ ID NO: 4087753 - DNA, 22 bp, Homo sapiens
acgccagtctcccaggccccct

SEQ ID NO: 4087754 - DNA, 12 bp, Homo sapiens
acgcccctccaa

SEQ ID NO: 4087755 - DNA, 19 bp, Homo sapiens
acgcccctccaaacctcca

SEQ ID NO: 4087756 - DNA, 20 bp, Homo sapiens
acgcccctccaaacctccag

SEQ ID NO: 4087757 - DNA, 22 bp, Homo sapiens
acgccctgttcacgctcaccca

SEQ ID NO: 4087758 - DNA, 12 bp, Homo sapiens
acgcctcctggc

SEQ ID NO: 4087759 - DNA, 13 bp, Homo sapiens
acgcctgctggcc

SEQ ID NO: 4087760 - DNA, 18 bp, Homo sapiens
acgcctgtaatcccagca

SEQ ID NO: 4087761 - DNA, 21 bp, Homo sapiens
acgctcacccagtcacctccc

SEQ ID NO: 4087762 - DNA, 16 bp, Homo sapiens
acgctccagctgcccc

SEQ ID NO: 4087763 - DNA, 19 bp, Homo sapiens
acgctccagctgccccggc

SEQ ID NO: 4087764 - DNA, 21 bp, Homo sapiens
acgctcctttgtgtgtgtgtc

SEQ ID NO: 4087765 - DNA, 23 bp, Homo sapiens
acgctgccgctgccgctgcacca

SEQ ID NO: 4087766 - DNA, 18 bp, Homo sapiens
acgctggcaacacagagg

SEQ ID NO: 4087767 - DNA, 20 bp, Homo sapiens
acgctgtcctctcgagccca

SEQ ID NO: 4087768 - DNA, 12 bp, Homo sapiens
acgcttctgaat

SEQ ID NO: 4087769 - DNA, 18 bp, Homo sapiens
acgcttctgaatgctgct

SEQ ID NO: 4087770 - DNA, 20 bp, Homo sapiens
acgcttgcgtatgtctgtta

SEQ ID NO: 4087771 - DNA, 13 bp, Homo sapiens
acccttgttccag

SEQ ID NO: 4087772 - DNA, 20 bp, Homo sapiens
accctttaagatatccatct

SEQ ID NO: 4087773 - DNA, 21 bp, Homo sapiens
accctttaagatatccatctt

SEQ ID NO: 4087774 - DNA, 20 bp, Homo sapiens
accctttagccaaacccttg

SEQ ID NO: 4087775 - DNA, 20 bp, Homo sapiens
accctttcccccttctctta

SEQ ID NO: 4087776 - DNA, 23 bp, Homo sapiens
accctttggtttttttcttctgt

SEQ ID NO: 4087777 - DNA, 22 bp, Homo sapiens
acccttttcccccttcccattt

SEQ ID NO: 4087778 - DNA, 16 bp, Homo sapiens
acccttttctcaggac

SEQ ID NO: 4087779 - DNA, 11 bp, Homo sapiens
accgacaagca

SEQ ID NO: 4087780 - DNA, 15 bp, Homo sapiens
accgacaggccctgg

SEQ ID NO: 4087781 - DNA, 16 bp, Homo sapiens
accgaccaactgccct

SEQ ID NO: 4087782 - DNA, 18 bp, Homo sapiens
accgacgcgtctcctgtt

SEQ ID NO: 4087783 - DNA, 22 bp, Homo sapiens
accgactagacacacaaagcag

SEQ ID NO: 4087784 - DNA, 17 bp, Homo sapiens
accgactagccaggaag

SEQ ID NO: 4087785 - DNA, 19 bp, Homo sapiens
accgagcaaagatcaaaat

SEQ ID NO: 4087786 - DNA, 15 bp, Homo sapiens
accgagcagggctgt

SEQ ID NO: 4087787 - DNA, 23 bp, Homo sapiens
accgagctggagcggagaggaag

SEQ ID NO: 4087788 - DNA, 21 bp, Homo sapiens
accgagtgaacctaccttcat

SEQ ID NO: 4087789 - DNA, 14 bp, Homo sapiens
accgataatgcatg

SEQ ID NO: 4087790 - DNA, 24 bp, Homo sapiens
accgattctttggagttgtcacat

SEQ ID NO: 4087791 - DNA, 15 bp, Homo sapiens
accgcaactcacaca

SEQ ID NO: 4087792 - DNA, 11 bp, Homo sapiens
accgcccatca

SEQ ID NO: 4087793 - DNA, 11 bp, Homo sapiens
accgccccctc

SEQ ID NO: 4087794 - DNA, 19 bp, Homo sapiens
accgccccctcctctagct

SEQ ID NO: 4087795 - DNA, 12 bp, Homo sapiens
accgccctgggc

SEQ ID NO: 4087796 - DNA, 14 bp, Homo sapiens
accgccctgggctg

SEQ ID NO: 4087797 - DNA, 16 bp, Homo sapiens
accgccctgggctgga

SEQ ID NO: 4087798 - DNA, 23 bp, Homo sapiens
accgcctcagggttttggggtcc

SEQ ID NO: 4087799 - DNA, 23 bp, Homo sapiens
accggcctggctgcagctgggca

SEQ ID NO: 4087800 - DNA, 22 bp, Homo sapiens
accggctggcagggctggcccc

SEQ ID NO: 4087801 - DNA, 14 bp, Homo sapiens
accgggacagacct

SEQ ID NO: 4087802 - DNA, 21 bp, Homo sapiens
accgtcccctccttccctcac

SEQ ID NO: 4087803 - DNA, 16 bp, Homo sapiens
accgtcgggggctgag

SEQ ID NO: 4087804 - DNA, 16 bp, Homo sapiens
accgtgaaccagaggg

SEQ ID NO: 4087805 - DNA, 22 bp, Homo sapiens
accgtggaggaggaaggcaaga

SEQ ID NO: 4087806 - DNA, 18 bp, Homo sapiens
accgtgggcagggagcgg

SEQ ID NO: 4087807 - DNA, 13 bp, Homo sapiens
accgtgtcaagct

SEQ ID NO: 4087808 - DNA, 13 bp, Homo sapiens
accgttaggaaaa

SEQ ID NO: 4087809 - DNA, 17 bp, Homo sapiens
acctaaaaaaagagaat

SEQ ID NO: 4087810 - DNA, 21 bp, Homo sapiens
acctaaaaggaaatctcaccc

SEQ ID NO: 4087811 - DNA, 16 bp, Homo sapiens
acctaaaggtgtattt

SEQ ID NO: 4087812 - DNA, 17 bp, Homo sapiens
acctaatcaggctgagg

SEQ ID NO: 4087813 - DNA, 22 bp, Homo sapiens
acctaatgtctcactgttctgc

SEQ ID NO: 4087814 - DNA, 23 bp, Homo sapiens
acctaatgtctcactgttctgca

SEQ ID NO: 4087815 - DNA, 12 bp, Homo sapiens
acctaatgttta

SEQ ID NO: 4087816 - DNA, 16 bp, Homo sapiens
acctacacactgtcat

SEQ ID NO: 4087817 - DNA, 23 bp, Homo sapiens
acctacacactgtcatgcttcat

SEQ ID NO: 4087818 - DNA, 16 bp, Homo sapiens
acctacattccctctc

SEQ ID NO: 4087819 - DNA, 14 bp, Homo sapiens
acctaccatcaggg

SEQ ID NO: 4087820 - DNA, 22 bp, Homo sapiens
acctagaaattgacacaagtgg

SEQ ID NO: 4087821 - DNA, 22 bp, Homo sapiens
acctagagaacaggtggttttt

SEQ ID NO: 4087822 - DNA, 21 bp, Homo sapiens
acctagcaggctgttccatgt

SEQ ID NO: 4087823 - DNA, 18 bp, Homo sapiens
acctataaagtaaagcta

SEQ ID NO: 4087824 - DNA, 19 bp, Homo sapiens
acctataaagtaaagctaa

SEQ ID NO: 4087825 - DNA, 22 bp, Homo sapiens
acctatataataaagctactga

SEQ ID NO: 4087826 - DNA, 19 bp, Homo sapiens
acctatttccagaaataca

SEQ ID NO: 4087827 - DNA, 19 bp, Homo sapiens
acctcaaaatgtctaagat

SEQ ID NO: 4087828 - DNA, 20 bp, Homo sapiens
acctcaaactatctggccat

SEQ ID NO: 4087829 - DNA, 17 bp, Homo sapiens
acctcaaccatcctggc

SEQ ID NO: 4087830 - DNA, 14 bp, Homo sapiens
acctcaagccccat

SEQ ID NO: 4087831 - DNA, 19 bp, Homo sapiens
acctcaagccccatttcct

SEQ ID NO: 4087832 - DNA, 10 bp, Homo sapiens
acctcaaggg

SEQ ID NO: 4087833 - DNA, 13 bp, Homo sapiens
acctcaatgtccc

SEQ ID NO: 4087834 - DNA, 18 bp, Homo sapiens
acctcacccggcctcttc

SEQ ID NO: 4087835 - DNA, 14 bp, Homo sapiens
acctcaccctgcta

SEQ ID NO: 4087836 - DNA, 24 bp, Homo sapiens
acctcactatggtatgctggccag

SEQ ID NO: 4087837 - DNA, 14 bp, Homo sapiens
acctcactcctgtt

SEQ ID NO: 4087838 - DNA, 19 bp, Homo sapiens
acctcagaaagtcaccagg

SEQ ID NO: 4087839 - DNA, 12 bp, Homo sapiens
acctcagaggca

SEQ ID NO: 4087840 - DNA, 17 bp, Homo sapiens
acctcagattcttcatt

SEQ ID NO: 4087841 - DNA, 19 bp, Homo sapiens
acctcagcctggccagaca

SEQ ID NO: 4087842 - DNA, 20 bp, Homo sapiens
acctcagcctggccagacac

SEQ ID NO: 4087843 - DNA, 22 bp, Homo sapiens
acctcagctctgggagaggatt

SEQ ID NO: 4087844 - DNA, 23 bp, Homo sapiens
acctcagctctgggagaggattt

SEQ ID NO: 4087845 - DNA, 17 bp, Homo sapiens
acctcaggcagctcaag

SEQ ID NO: 4087846 - DNA, 21 bp, Homo sapiens
acctcagggcacgcaggacca

SEQ ID NO: 4087847 - DNA, 13 bp, Homo sapiens
acctcagggctcc

SEQ ID NO: 4087848 - DNA, 20 bp, Homo sapiens
acctcagggctcccaggggt

SEQ ID NO: 4087849 - DNA, 16 bp, Homo sapiens
acctcagttcccttgg

SEQ ID NO: 4087850 - DNA, 17 bp, Homo sapiens
acctcagttcccttggc

SEQ ID NO: 4087851 - DNA, 22 bp, Homo sapiens
acctcagttcccttggcctcag

SEQ ID NO: 4087852 - DNA, 13 bp, Homo sapiens
acctcagttttat

SEQ ID NO: 4087853 - DNA, 18 bp, Homo sapiens
acctcagttttatgcccc

SEQ ID NO: 4087854 - DNA, 22 bp, Homo sapiens
acctcatgcccaccccctgccc

SEQ ID NO: 4087855 - DNA, 23 bp, Homo sapiens
acctcatgcccaccccctgccct

SEQ ID NO: 4087856 - DNA, 21 bp, Homo sapiens
acctccaagcaagtagctttc

SEQ ID NO: 4087857 - DNA, 20 bp, Homo sapiens
acctccaccacatctgccag

SEQ ID NO: 4087858 - DNA, 23 bp, Homo sapiens
acctccaccacatctgccagacc

SEQ ID NO: 4087859 - DNA, 13 bp, Homo sapiens
acctccacccagc

SEQ ID NO: 4087860 - DNA, 15 bp, Homo sapiens
acctccacccagccc

SEQ ID NO: 4087861 - DNA, 15 bp, Homo sapiens
acctccagcctccct

SEQ ID NO: 4087862 - DNA, 18 bp, Homo sapiens
acctccattaaagtctga

SEQ ID NO: 4087863 - DNA, 19 bp, Homo sapiens
acctccattaaagtctgaa

SEQ ID NO: 4087864 - DNA, 21 bp, Homo sapiens
acctccattctattttagaat

SEQ ID NO: 4087865 - DNA, 14 bp, Homo sapiens
acctcccaccctga

SEQ ID NO: 4087866 - DNA, 17 bp, Homo sapiens
acctcccaccctgaccc

SEQ ID NO: 4087867 - DNA, 11 bp, Homo sapiens
acctccctccc

SEQ ID NO: 4087868 - DNA, 15 bp, Homo sapiens
acctccctcccggca

SEQ ID NO: 4087869 - DNA, 21 bp, Homo sapiens
acctccgaactgttcaagtgt

SEQ ID NO: 4087870 - DNA, 22 bp, Homo sapiens
acctccgaactgttcaagtgtc

SEQ ID NO: 4087871 - DNA, 23 bp, Homo sapiens
acctccgaactgttcaagtgtcc

SEQ ID NO: 4087872 - DNA, 14 bp, Homo sapiens
acctccgagacagt

SEQ ID NO: 4087873 - DNA, 14 bp, Homo sapiens
acctccgcccctgc

SEQ ID NO: 4087874 - DNA, 23 bp, Homo sapiens
acctccgcccctgcccccgctcc

SEQ ID NO: 4087875 - DNA, 17 bp, Homo sapiens
acctccttagccctgtc

SEQ ID NO: 4087876 - DNA, 22 bp, Homo sapiens
acctcctttcatcacactgggt

SEQ ID NO: 4087877 - DNA, 18 bp, Homo sapiens
acctcggcttgtgggctg

SEQ ID NO: 4087878 - DNA, 19 bp, Homo sapiens
acctcggcttgtgggctgg

SEQ ID NO: 4087879 - DNA, 15 bp, Homo sapiens
acctctagccctgcc

SEQ ID NO: 4087880 - DNA, 18 bp, Homo sapiens
acctctccaagtctctct

SEQ ID NO: 4087881 - DNA, 22 bp, Homo sapiens
acctctccaagtctctctgtga

SEQ ID NO: 4087882 - DNA, 15 bp, Homo sapiens
acctctcctgccctg

SEQ ID NO: 4087883 - DNA, 15 bp, Homo sapiens
acctctctcagagca

SEQ ID NO: 4087884 - DNA, 17 bp, Homo sapiens
acctctctcagagcatc

SEQ ID NO: 4087885 - DNA, 21 bp, Homo sapiens
acctctctcagagcatctggc

SEQ ID NO: 4087886 - DNA, 23 bp, Homo sapiens
acctctctcctttgctgaggcct

SEQ ID NO: 4087887 - DNA, 20 bp, Homo sapiens
acctctctgtagtttatggc

SEQ ID NO: 4087888 - DNA, 16 bp, Homo sapiens
acctctctgtcccttg

SEQ ID NO: 4087889 - DNA, 23 bp, Homo sapiens
acctctcttatagaatatttatt

SEQ ID NO: 4087890 - DNA, 12 bp, Homo sapiens
acctctgccaga

SEQ ID NO: 4087891 - DNA, 18 bp, Homo sapiens
acctctggattcattgtc

SEQ ID NO: 4087892 - DNA, 16 bp, Homo sapiens
acctctggggacccca

SEQ ID NO: 4087893 - DNA, 23 bp, Homo sapiens
acctctggggaccccaacctcag

SEQ ID NO: 4087894 - DNA, 21 bp, Homo sapiens
acctctgtaggcagcagagag

SEQ ID NO: 4087895 - DNA, 17 bp, Homo sapiens
acctctgtatagaaatc

SEQ ID NO: 4087896 - DNA, 19 bp, Homo sapiens
acctctgtatagaaatcta

SEQ ID NO: 4087897 - DNA, 22 bp, Homo sapiens
acctctgtatagaaatctaaaa

SEQ ID NO: 4087898 - DNA, 13 bp, Homo sapiens
acctctgtctcat

SEQ ID NO: 4087899 - DNA, 16 bp, Homo sapiens
acctcttactttgctt

SEQ ID NO: 4087900 - DNA, 14 bp, Homo sapiens
acctcttccccaga

SEQ ID NO: 4087901 - DNA, 13 bp, Homo sapiens
acctcttgctgtc

SEQ ID NO: 4087902 - DNA, 15 bp, Homo sapiens
acctcttgctgtctc

SEQ ID NO: 4087903 - DNA, 21 bp, Homo sapiens
acctctttgctcaacagaaca

SEQ ID NO: 4087904 - DNA, 16 bp, Homo sapiens
acctctttttcctcct

SEQ ID NO: 4087905 - DNA, 14 bp, Homo sapiens
acctgaacttgcct

SEQ ID NO: 4087906 - DNA, 19 bp, Homo sapiens
acctgaagactgaggacaa

SEQ ID NO: 4087907 - DNA, 12 bp, Homo sapiens
acctgacagatg

SEQ ID NO: 4087908 - DNA, 17 bp, Homo sapiens
acctgaccccattcctg

SEQ ID NO: 4087909 - DNA, 18 bp, Homo sapiens
acctgaccccattcctga

SEQ ID NO: 4087910 - DNA, 17 bp, Homo sapiens
acctgacctcttgctgt

SEQ ID NO: 4087911 - DNA, 19 bp, Homo sapiens
acctgacctcttgctgtct

SEQ ID NO: 4087912 - DNA, 22 bp, Homo sapiens
acctgacctcttgctgtctctg

SEQ ID NO: 4087913 - DNA, 22 bp, Homo sapiens
acctgactcaattatttgcata

SEQ ID NO: 4087914 - DNA, 22 bp, Homo sapiens
acctgagacgggcatcgcagga

SEQ ID NO: 4087915 - DNA, 17 bp, Homo sapiens
acctgagctattttcct

SEQ ID NO: 4087916 - DNA, 15 bp, Homo sapiens
acctgagctggccag

SEQ ID NO: 4087917 - DNA, 13 bp, Homo sapiens
acctgcaaaaaat

SEQ ID NO: 4087918 - DNA, 16 bp, Homo sapiens
acctgcaaagatctgt

SEQ ID NO: 4087919 - DNA, 22 bp, Homo sapiens
acctgcaaagatctgtcctcag

SEQ ID NO: 4087920 - DNA, 13 bp, Homo sapiens
acctgcacactcc

SEQ ID NO: 4087921 - DNA, 15 bp, Homo sapiens
acctgcacgttcata

SEQ ID NO: 4087922 - DNA, 17 bp, Homo sapiens
acctgccccaactctcc

SEQ ID NO: 4087923 - DNA, 14 bp, Homo sapiens
acctgccctcaagg

SEQ ID NO: 4087924 - DNA, 15 bp, Homo sapiens
acctgccctcaaggg

SEQ ID NO: 4087925 - DNA, 18 bp, Homo sapiens
acctgcctcctcgttcct

SEQ ID NO: 4087926 - DNA, 14 bp, Homo sapiens
acctgcctcctgcc

SEQ ID NO: 4087927 - DNA, 15 bp, Homo sapiens
acctgcctctaatct

SEQ ID NO: 4087928 - DNA, 22 bp, Homo sapiens
acctgccttggcctcccaaagt

SEQ ID NO: 4087929 - DNA, 12 bp, Homo sapiens
acctgctctgct

SEQ ID NO: 4087930 - DNA, 17 bp, Homo sapiens
acctgctgccccagctg

SEQ ID NO: 4087931 - DNA, 18 bp, Homo sapiens
acctgctgccccagctga

SEQ ID NO: 4087932 - DNA, 20 bp, Homo sapiens
acctgctgtgatacgatgct

SEQ ID NO: 4087933 - DNA, 19 bp, Homo sapiens
acctgcttcatgctcagcc

SEQ ID NO: 4087934 - DNA, 14 bp, Homo sapiens
acctgcttctctgc

SEQ ID NO: 4087935 - DNA, 15 bp, Homo sapiens
acctgcttctgaact

SEQ ID NO: 4087936 - DNA, 16 bp, Homo sapiens
acctgcttctgaactc

SEQ ID NO: 4087937 - DNA, 18 bp, Homo sapiens
acctgcttctgaactcaa

SEQ ID NO: 4087938 - DNA, 19 bp, Homo sapiens
acctggaaaaattccagaa

SEQ ID NO: 4087939 - DNA, 20 bp, Homo sapiens
acctggaatctacaagccaa

SEQ ID NO: 4087940 - DNA, 18 bp, Homo sapiens
acctggagcagaggaggg

SEQ ID NO: 4087941 - DNA, 14 bp, Homo sapiens
acctggcactggga

SEQ ID NO: 4087942 - DNA, 15 bp, Homo sapiens
acctggcctgtctgt

SEQ ID NO: 4087943 - DNA, 19 bp, Homo sapiens
acctggctaattttttgta

SEQ ID NO: 4087944 - DNA, 23 bp, Homo sapiens
acctggctaattttttgtacttt

SEQ ID NO: 4087945 - DNA, 13 bp, Homo sapiens
acctggctgaggt

SEQ ID NO: 4087946 - DNA, 16 bp, Homo sapiens
acctggctgcccctca

SEQ ID NO: 4087947 - DNA, 17 bp, Homo sapiens
acctggcttttacttta

SEQ ID NO: 4087948 - DNA, 18 bp, Homo sapiens
acctggcttttactttat

SEQ ID NO: 4087949 - DNA, 16 bp, Homo sapiens
acctgggacagggagc

SEQ ID NO: 4087950 - DNA, 12 bp, Homo sapiens
acctgggacccc

SEQ ID NO: 4087951 - DNA, 15 bp, Homo sapiens
acctgggcatatcca

SEQ ID NO: 4087952 - DNA, 23 bp, Homo sapiens
acctggggagtggttaggcagca

SEQ ID NO: 4087953 - DNA, 22 bp, Homo sapiens
acctgggttccctttccttcca

SEQ ID NO: 4087954 - DNA, 19 bp, Homo sapiens
acctgggtttccagggcac

SEQ ID NO: 4087955 - DNA, 19 bp, Homo sapiens
acctggtaccctcctggct

SEQ ID NO: 4087956 - DNA, 13 bp, Homo sapiens
acctggtgctgga

SEQ ID NO: 4087957 - DNA, 22 bp, Homo sapiens
acctggtgctggatattttcaa

SEQ ID NO: 4087958 - DNA, 12 bp, Homo sapiens
acctggtggcac

SEQ ID NO: 4087959 - DNA, 16 bp, Homo sapiens
acctggttggccgtgg

SEQ ID NO: 4087960 - DNA, 17 bp, Homo sapiens
acctgtaacttttgtaa

SEQ ID NO: 4087961 - DNA, 17 bp, Homo sapiens
acctgtagatgcagaaa

SEQ ID NO: 4087962 - DNA, 14 bp, Homo sapiens
acctgtagccatct

SEQ ID NO: 4087963 - DNA, 15 bp, Homo sapiens
acctgtagccatctg

SEQ ID NO: 4087964 - DNA, 21 bp, Homo sapiens
acctgtataagtggaggcact

SEQ ID NO: 4087965 - DNA, 23 bp, Homo sapiens
acctgtataagtggaggcacttt

SEQ ID NO: 4087966 - DNA, 16 bp, Homo sapiens
acctgtatacagtgca

SEQ ID NO: 4087967 - DNA, 23 bp, Homo sapiens
acctgtatgtcaataaacaacag

SEQ ID NO: 4087968 - DNA, 23 bp, Homo sapiens
acctgtatttttgttagtttaca

SEQ ID NO: 4087969 - DNA, 14 bp, Homo sapiens
acctgtccccaccc

SEQ ID NO: 4087970 - DNA, 22 bp, Homo sapiens
acctgtccccaccctccactca

SEQ ID NO: 4087971 - DNA, 13 bp, Homo sapiens
acctgtctgctcc

SEQ ID NO: 4087972 - DNA, 14 bp, Homo sapiens
acctgtctgctcca

SEQ ID NO: 4087973 - DNA, 19 bp, Homo sapiens
acctgtctgctccagctct

SEQ ID NO: 4087974 - DNA, 20 bp, Homo sapiens
acctgtctgctccagctctg

SEQ ID NO: 4087975 - DNA, 15 bp, Homo sapiens
acctgtcttttggga

SEQ ID NO: 4087976 - DNA, 16 bp, Homo sapiens
accccttatccaggac

SEQ ID NO: 4087977 - DNA, 18 bp, Homo sapiens
accccttatccaggactc

SEQ ID NO: 4087978 - DNA, 17 bp, Homo sapiens
accccttcccattccat

SEQ ID NO: 4087979 - DNA, 15 bp, Homo sapiens
accccttctctcctc

SEQ ID NO: 4087980 - DNA, 23 bp, Homo sapiens
accccttctctcctccccaaatc

SEQ ID NO: 4087981 - DNA, 19 bp, Homo sapiens
accccttctttgcagggct

SEQ ID NO: 4087982 - DNA, 14 bp, Homo sapiens
acccgaaatgccac

SEQ ID NO: 4087983 - DNA, 18 bp, Homo sapiens
acccgccccgcgcacccc

SEQ ID NO: 4087984 - DNA, 20 bp, Homo sapiens
acccgccccgcgcaccccac

SEQ ID NO: 4087985 - DNA, 21 bp, Homo sapiens
acccggaggggcctggcagcc

SEQ ID NO: 4087986 - DNA, 17 bp, Homo sapiens
acccggcctctctgccc

SEQ ID NO: 4087987 - DNA, 21 bp, Homo sapiens
acccggcctctctgccccacc

SEQ ID NO: 4087988 - DNA, 23 bp, Homo sapiens
acccggctgggtcggccctgccc

SEQ ID NO: 4087989 - DNA, 14 bp, Homo sapiens
acccggttcagtgt

SEQ ID NO: 4087990 - DNA, 18 bp, Homo sapiens
acccgttctgctggcctg

SEQ ID NO: 4087991 - DNA, 23 bp, Homo sapiens
acccgttctgctggcctggatct

SEQ ID NO: 4087992 - DNA, 16 bp, Homo sapiens
accctaagcctccttt

SEQ ID NO: 4087993 - DNA, 13 bp, Homo sapiens
accctaatgtctt

SEQ ID NO: 4087994 - DNA, 12 bp, Homo sapiens
accctagccttg

SEQ ID NO: 4087995 - DNA, 19 bp, Homo sapiens
accctaggttccctgttct

SEQ ID NO: 4087996 - DNA, 22 bp, Homo sapiens
accctagtcccttcccctccct

SEQ ID NO: 4087997 - DNA, 21 bp, Homo sapiens
accctagttagtgttttgcct

SEQ ID NO: 4087998 - DNA, 15 bp, Homo sapiens
accctagttctacct

SEQ ID NO: 4087999 - DNA, 21 bp, Homo sapiens
accctcaacctcttctggctc

SEQ ID NO: 4088000 - DNA, 14 bp, Homo sapiens
accctcacacacac

SEQ ID NO: 4088001 - DNA, 18 bp, Homo sapiens
accctcacacacacagct

SEQ ID NO: 4088002 - DNA, 21 bp, Homo sapiens
accctcacacacacagctggg

SEQ ID NO: 4088003 - DNA, 11 bp, Homo sapiens
accctcagagc

SEQ ID NO: 4088004 - DNA, 17 bp, Homo sapiens
accctccccttcccagg

SEQ ID NO: 4088005 - DNA, 17 bp, Homo sapiens
accctccctgactggcc

SEQ ID NO: 4088006 - DNA, 14 bp, Homo sapiens
accctccctggagt

SEQ ID NO: 4088007 - DNA, 12 bp, Homo sapiens
accctcctcctc

SEQ ID NO: 4088008 - DNA, 14 bp, Homo sapiens
accctcctcctctt

SEQ ID NO: 4088009 - DNA, 14 bp, Homo sapiens
accctcctgcccca

SEQ ID NO: 4088010 - DNA, 21 bp, Homo sapiens
accctcctgccccacactccc

SEQ ID NO: 4088011 - DNA, 11 bp, Homo sapiens
accctcctggc

SEQ ID NO: 4088012 - DNA, 13 bp, Homo sapiens
accctcctggctc

SEQ ID NO: 4088013 - DNA, 21 bp, Homo sapiens
accctcctgtaaatggtgtac

SEQ ID NO: 4088014 - DNA, 11 bp, Homo sapiens
accctccttcc

SEQ ID NO: 4088015 - DNA, 19 bp, Homo sapiens
accctcgggccccatcctc

SEQ ID NO: 4088016 - DNA, 15 bp, Homo sapiens
accctctcactagtg

SEQ ID NO: 4088017 - DNA, 16 bp, Homo sapiens
accctctcagctccag

SEQ ID NO: 4088018 - DNA, 21 bp, Homo sapiens
accctctcctgggggtggcag

SEQ ID NO: 4088019 - DNA, 22 bp, Homo sapiens
accctctcctgggggtggcagg

SEQ ID NO: 4088020 - DNA, 15 bp, Homo sapiens
accctctgaccctag

SEQ ID NO: 4088021 - DNA, 17 bp, Homo sapiens
accctctggaaatatgt

SEQ ID NO: 4088022 - DNA, 14 bp, Homo sapiens
accctctgtcccac

SEQ ID NO: 4088023 - DNA, 19 bp, Homo sapiens
accctctgtcccaccccta

SEQ ID NO: 4088024 - DNA, 21 bp, Homo sapiens
accctctgtcccacccctagc

SEQ ID NO: 4088025 - DNA, 18 bp, Homo sapiens
accctcttgcccatcctg

SEQ ID NO: 4088026 - DNA, 15 bp, Homo sapiens
accctctttgctgca

SEQ ID NO: 4088027 - DNA, 23 bp, Homo sapiens
accctgaacaacgagccttttca

SEQ ID NO: 4088028 - DNA, 18 bp, Homo sapiens
accctgaaggggccatga

SEQ ID NO: 4088029 - DNA, 22 bp, Homo sapiens
accctgaatggttccatgcctg

SEQ ID NO: 4088030 - DNA, 15 bp, Homo sapiens
accctgaggccctgg

SEQ ID NO: 4088031 - DNA, 20 bp, Homo sapiens
accctgaggtcagggagtgc

SEQ ID NO: 4088032 - DNA, 23 bp, Homo sapiens
accctgaggtcagggagtgctgg

SEQ ID NO: 4088033 - DNA, 14 bp, Homo sapiens
accctgatgaaaac

SEQ ID NO: 4088034 - DNA, 20 bp, Homo sapiens
accctgatttaggagaagcc

SEQ ID NO: 4088035 - DNA, 23 bp, Homo sapiens
accctgatttaggagaagccagg

SEQ ID NO: 4088036 - DNA, 23 bp, Homo sapiens
accctgcaaacagaacagggtca

SEQ ID NO: 4088037 - DNA, 13 bp, Homo sapiens
accctgccacagc

SEQ ID NO: 4088038 - DNA, 17 bp, Homo sapiens
accctgccacagccaga

SEQ ID NO: 4088039 - DNA, 18 bp, Homo sapiens
accctgccacagccagag

SEQ ID NO: 4088040 - DNA, 21 bp, Homo sapiens
accctgccccaccccacctcc

SEQ ID NO: 4088041 - DNA, 22 bp, Homo sapiens
accctgccccaccccacctcca

SEQ ID NO: 4088042 - DNA, 14 bp, Homo sapiens
accctgccttatct

SEQ ID NO: 4088043 - DNA, 14 bp, Homo sapiens
accctgcgcctcca

SEQ ID NO: 4088044 - DNA, 15 bp, Homo sapiens
accctgcgcctccag

SEQ ID NO: 4088045 - DNA, 16 bp, Homo sapiens
accctgcgcctccaga

SEQ ID NO: 4088046 - DNA, 22 bp, Homo sapiens
accctgcgcctccagaggtcct

SEQ ID NO: 4088047 - DNA, 14 bp, Homo sapiens
accctgctccctgc

SEQ ID NO: 4088048 - DNA, 15 bp, Homo sapiens
accctgctccctgct

SEQ ID NO: 4088049 - DNA, 16 bp, Homo sapiens
accctggatcagtcct

SEQ ID NO: 4088050 - DNA, 23 bp, Homo sapiens
accctggcactataatgtaagct

SEQ ID NO: 4088051 - DNA, 16 bp, Homo sapiens
accctggccgccccct

SEQ ID NO: 4088052 - DNA, 17 bp, Homo sapiens
accctggccgccccctg

SEQ ID NO: 4088053 - DNA, 20 bp, Homo sapiens
accctggcctgaactgagga

SEQ ID NO: 4088054 - DNA, 16 bp, Homo sapiens
accctgggagacagac

SEQ ID NO: 4088055 - DNA, 18 bp, Homo sapiens
accctggggcctgactgc

SEQ ID NO: 4088056 - DNA, 18 bp, Homo sapiens
accctggggcctggacct

SEQ ID NO: 4088057 - DNA, 19 bp, Homo sapiens
accctggggcctggacctg

SEQ ID NO: 4088058 - DNA, 22 bp, Homo sapiens
accctggggcctggacctgcct

SEQ ID NO: 4088059 - DNA, 19 bp, Homo sapiens
accctgggtgggctctgtg

SEQ ID NO: 4088060 - DNA, 20 bp, Homo sapiens
accctgggtgggctctgtgc

SEQ ID NO: 4088061 - DNA, 19 bp, Homo sapiens
accctgtacatatgtaaac

SEQ ID NO: 4088062 - DNA, 22 bp, Homo sapiens
accctgtactgttctgtgtctt

SEQ ID NO: 4088063 - DNA, 14 bp, Homo sapiens
accctgtctctact

SEQ ID NO: 4088064 - DNA, 23 bp, Homo sapiens
accctgtcttctgggcacagtgg

SEQ ID NO: 4088065 - DNA, 20 bp, Homo sapiens
accctgtgcagaagggagct

SEQ ID NO: 4088066 - DNA, 14 bp, Homo sapiens
accctgtggccctg

SEQ ID NO: 4088067 - DNA, 17 bp, Homo sapiens
accctgtggccctggct

SEQ ID NO: 4088068 - DNA, 18 bp, Homo sapiens
acccttaccccttagcct

SEQ ID NO: 4088069 - DNA, 22 bp, Homo sapiens
acccttaccccttagcctccct

SEQ ID NO: 4088070 - DNA, 13 bp, Homo sapiens
acccttagaaaat

SEQ ID NO: 4088071 - DNA, 17 bp, Homo sapiens
acccttcagaccccagt

SEQ ID NO: 4088072 - DNA, 21 bp, Homo sapiens
acccttcatcttcctgtgtcc

SEQ ID NO: 4088073 - DNA, 16 bp, Homo sapiens
acccttccctgcacta

SEQ ID NO: 4088074 - DNA, 17 bp, Homo sapiens
acccttcttgcctgctg

SEQ ID NO: 4088075 - DNA, 11 bp, Homo sapiens
acccttgacac

SEQ ID NO: 4088076 - DNA, 15 bp, Homo sapiens
acccttgctttcctg

SEQ ID NO: 4088077 - DNA, 17 bp, Homo sapiens
acccttggcctgtctca

SEQ ID NO: 4088078 - DNA, 17 bp, Homo sapiens
acccttggctcaatcct

SEQ ID NO: 4088079 - DNA, 14 bp, Homo sapiens
accagatgtgacag

SEQ ID NO: 4088080 - DNA, 16 bp, Homo sapiens
accagcatccaccttg

SEQ ID NO: 4088081 - DNA, 20 bp, Homo sapiens
accagcccccgccccagagt

SEQ ID NO: 4088082 - DNA, 14 bp, Homo sapiens
accagccctgcagc

SEQ ID NO: 4088083 - DNA, 15 bp, Homo sapiens
accagccgccccagc

SEQ ID NO: 4088084 - DNA, 16 bp, Homo sapiens
accagccgccccagcc

SEQ ID NO: 4088085 - DNA, 20 bp, Homo sapiens
accagcctggtcaacatggt

SEQ ID NO: 4088086 - DNA, 23 bp, Homo sapiens
accagctaagaaaagattttaat

SEQ ID NO: 4088087 - DNA, 19 bp, Homo sapiens
accagctatctgtcatctc

SEQ ID NO: 4088088 - DNA, 13 bp, Homo sapiens
accagctcagagg

SEQ ID NO: 4088089 - DNA, 13 bp, Homo sapiens
accagctcaggac

SEQ ID NO: 4088090 - DNA, 14 bp, Homo sapiens
accagctcaggaca

SEQ ID NO: 4088091 - DNA, 15 bp, Homo sapiens
accagctcaggacag

SEQ ID NO: 4088092 - DNA, 23 bp, Homo sapiens
accagctcaggacagatgccaca

SEQ ID NO: 4088093 - DNA, 19 bp, Homo sapiens
accagctgcgcttgctttt

SEQ ID NO: 4088094 - DNA, 20 bp, Homo sapiens
accagctgcgcttgcttttc

SEQ ID NO: 4088095 - DNA, 15 bp, Homo sapiens
accagcttctccagg

SEQ ID NO: 4088096 - DNA, 18 bp, Homo sapiens
accagcttgttctgggct

SEQ ID NO: 4088097 - DNA, 17 bp, Homo sapiens
accaggactccctcctc

SEQ ID NO: 4088098 - DNA, 18 bp, Homo sapiens
accaggactccctcctca

SEQ ID NO: 4088099 - DNA, 18 bp, Homo sapiens
accaggatttattttgag

SEQ ID NO: 4088100 - DNA, 14 bp, Homo sapiens
accaggatttctaa

SEQ ID NO: 4088101 - DNA, 15 bp, Homo sapiens
accaggatttctaat

SEQ ID NO: 4088102 - DNA, 15 bp, Homo sapiens
accaggcaaattcac

SEQ ID NO: 4088103 - DNA, 16 bp, Homo sapiens
accaggcacctcttcc

SEQ ID NO: 4088104 - DNA, 15 bp, Homo sapiens
accaggcccccctgt

SEQ ID NO: 4088105 - DNA, 11 bp, Homo sapiens
accaggcctct

SEQ ID NO: 4088106 - DNA, 15 bp, Homo sapiens
accaggcctctgctg

SEQ ID NO: 4088107 - DNA, 18 bp, Homo sapiens
accaggcctctgctgccg

SEQ ID NO: 4088108 - DNA, 20 bp, Homo sapiens
accaggcctctgctgccgcc

SEQ ID NO: 4088109 - DNA, 12 bp, Homo sapiens
accaggctgtgg

SEQ ID NO: 4088110 - DNA, 14 bp, Homo sapiens
accagggatgctgg

SEQ ID NO: 4088111 - DNA, 21 bp, Homo sapiens
accagggcattcgggccacag

SEQ ID NO: 4088112 - DNA, 15 bp, Homo sapiens
accagggccagaagt

SEQ ID NO: 4088113 - DNA, 19 bp, Homo sapiens
accaggggctgggctccct

SEQ ID NO: 4088114 - DNA, 21 bp, Homo sapiens
accaggggctgggctccctga

SEQ ID NO: 4088115 - DNA, 14 bp, Homo sapiens
accaggttgaaaga

SEQ ID NO: 4088116 - DNA, 23 bp, Homo sapiens
accagtacctctgtatagaaatc

SEQ ID NO: 4088117 - DNA, 20 bp, Homo sapiens
accagtatcgctcatagatc

SEQ ID NO: 4088118 - DNA, 14 bp, Homo sapiens
accagtcacatgac

SEQ ID NO: 4088119 - DNA, 15 bp, Homo sapiens
accagtccccccacc

SEQ ID NO: 4088120 - DNA, 17 bp, Homo sapiens
accagtccccccaccct

SEQ ID NO: 4088121 - DNA, 22 bp, Homo sapiens
accagtggcgttgttgcatgtt

SEQ ID NO: 4088122 - DNA, 21 bp, Homo sapiens
accagtgtggtttgtgtttga

SEQ ID NO: 4088123 - DNA, 17 bp, Homo sapiens
accagttcagacactac

SEQ ID NO: 4088124 - DNA, 12 bp, Homo sapiens
accagttgcctt

SEQ ID NO: 4088125 - DNA, 14 bp, Homo sapiens
accagttgcctttt

SEQ ID NO: 4088126 - DNA, 16 bp, Homo sapiens
accagttgccttttat

SEQ ID NO: 4088127 - DNA, 15 bp, Homo sapiens
accagttgggagcac

SEQ ID NO: 4088128 - DNA, 23 bp, Homo sapiens
accatagtaccatttatacaaat

SEQ ID NO: 4088129 - DNA, 23 bp, Homo sapiens
accatagtcgggatgtcagcaga

SEQ ID NO: 4088130 - DNA, 13 bp, Homo sapiens
accatatgatact

SEQ ID NO: 4088131 - DNA, 14 bp, Homo sapiens
accatattacctgg

SEQ ID NO: 4088132 - DNA, 15 bp, Homo sapiens
accatcaagaaccta

SEQ ID NO: 4088133 - DNA, 14 bp, Homo sapiens
accatcagggacag

SEQ ID NO: 4088134 - DNA, 16 bp, Homo sapiens
accatccctgatggca

SEQ ID NO: 4088135 - DNA, 12 bp, Homo sapiens
accatcctggct

SEQ ID NO: 4088136 - DNA, 13 bp, Homo sapiens
accatcctggctg

SEQ ID NO: 4088137 - DNA, 18 bp, Homo sapiens
accatctgcttttattaa

SEQ ID NO: 4088138 - DNA, 14 bp, Homo sapiens
accatgaagacagg

SEQ ID NO: 4088139 - DNA, 22 bp, Homo sapiens
accatgagaattttacttccat

SEQ ID NO: 4088140 - DNA, 19 bp, Homo sapiens
accatgccagattctgcct

SEQ ID NO: 4088141 - DNA, 20 bp, Homo sapiens
accatgccagattctgcctc

SEQ ID NO: 4088142 - DNA, 21 bp, Homo sapiens
accatgtaagcactctggatg

SEQ ID NO: 4088143 - DNA, 17 bp, Homo sapiens
accatgtattcatccag

SEQ ID NO: 4088144 - DNA, 19 bp, Homo sapiens
accatgtattcatccagag

SEQ ID NO: 4088145 - DNA, 15 bp, Homo sapiens
accatgtgtcacttg

SEQ ID NO: 4088146 - DNA, 16 bp, Homo sapiens
accatgtgtcacttgt

SEQ ID NO: 4088147 - DNA, 19 bp, Homo sapiens
accatgtgtcacttgtgct

SEQ ID NO: 4088148 - DNA, 15 bp, Homo sapiens
accattccccatggg

SEQ ID NO: 4088149 - DNA, 21 bp, Homo sapiens
accatttatacaaattagaaa

SEQ ID NO: 4088150 - DNA, 23 bp, Homo sapiens
accatttcagtaaacctgtctga

SEQ ID NO: 4088151 - DNA, 18 bp, Homo sapiens
accatttctcactagtgt

SEQ ID NO: 4088152 - DNA, 19 bp, Homo sapiens
accatttgtaataaagtat

SEQ ID NO: 4088153 - DNA, 23 bp, Homo sapiens
accattttcccatcatcctttgt

SEQ ID NO: 4088154 - DNA, 11 bp, Homo sapiens
accattttcta

SEQ ID NO: 4088155 - DNA, 22 bp, Homo sapiens
accatttttaaagtagaagagg

SEQ ID NO: 4088156 - DNA, 13 bp, Homo sapiens
acccaaagcagtg

SEQ ID NO: 4088157 - DNA, 17 bp, Homo sapiens
acccaaatcacatctca

SEQ ID NO: 4088158 - DNA, 20 bp, Homo sapiens
acccaaatcacatctcacct

SEQ ID NO: 4088159 - DNA, 15 bp, Homo sapiens
acccaagcaaggcca

SEQ ID NO: 4088160 - DNA, 15 bp, Homo sapiens
acccaagcaggaggc

SEQ ID NO: 4088161 - DNA, 14 bp, Homo sapiens
acccaagcccaaac

SEQ ID NO: 4088162 - DNA, 13 bp, Homo sapiens
acccaaggactga

SEQ ID NO: 4088163 - DNA, 17 bp, Homo sapiens
acccaaggactgaggga

SEQ ID NO: 4088164 - DNA, 22 bp, Homo sapiens
acccaatctgcacactccaggc

SEQ ID NO: 4088165 - DNA, 15 bp, Homo sapiens
acccacacagctgcc

SEQ ID NO: 4088166 - DNA, 15 bp, Homo sapiens
acccaccctgtgcca

SEQ ID NO: 4088167 - DNA, 22 bp, Homo sapiens
acccaccctgtgccatcaccat

SEQ ID NO: 4088168 - DNA, 22 bp, Homo sapiens
acccaccgatggagcccccaga

SEQ ID NO: 4088169 - DNA, 13 bp, Homo sapiens
acccacctccacc

SEQ ID NO: 4088170 - DNA, 19 bp, Homo sapiens
acccacctccacccagccc

SEQ ID NO: 4088171 - DNA, 18 bp, Homo sapiens
acccactatccttcgtga

SEQ ID NO: 4088172 - DNA, 23 bp, Homo sapiens
acccactcggatggaccaacctg

SEQ ID NO: 4088173 - DNA, 21 bp, Homo sapiens
acccagaatggagcctgctct

SEQ ID NO: 4088174 - DNA, 23 bp, Homo sapiens
acccagaatggagcctgctctcc

SEQ ID NO: 4088175 - DNA, 24 bp, Homo sapiens
acccagagcattacgtgagccagg

SEQ ID NO: 4088176 - DNA, 14 bp, Homo sapiens
acccagatcctcac

SEQ ID NO: 4088177 - DNA, 19 bp, Homo sapiens
acccagattttgctgtata

SEQ ID NO: 4088178 - DNA, 21 bp, Homo sapiens
acccagcaggaagccaggctg

SEQ ID NO: 4088179 - DNA, 23 bp, Homo sapiens
acccagccgtcgtctccctcgac

SEQ ID NO: 4088180 - DNA, 18 bp, Homo sapiens
acccaggatgacccctgg

SEQ ID NO: 4088181 - DNA, 11 bp, Homo sapiens
acccaggcctg

SEQ ID NO: 4088182 - DNA, 21 bp, Homo sapiens
acccaggcctgtggccccacc

SEQ ID NO: 4088183 - DNA, 14 bp, Homo sapiens
acccagggaggaag

SEQ ID NO: 4088184 - DNA, 22 bp, Homo sapiens
acccaggggaaggccctgaggc

SEQ ID NO: 4088185 - DNA, 13 bp, Homo sapiens
acccaggggtggg

SEQ ID NO: 4088186 - DNA, 18 bp, Homo sapiens
acccaggtggagggcaca

SEQ ID NO: 4088187 - DNA, 19 bp, Homo sapiens
acccaggtggagggcacag

SEQ ID NO: 4088188 - DNA, 21 bp, Homo sapiens
acccaggtggagggcacagcc

SEQ ID NO: 4088189 - DNA, 23 bp, Homo sapiens
acccaggtggagggcacagccct

SEQ ID NO: 4088190 - DNA, 16 bp, Homo sapiens
acccagtcacctcccc

SEQ ID NO: 4088191 - DNA, 18 bp, Homo sapiens
acccagtgcccccactga

SEQ ID NO: 4088192 - DNA, 14 bp, Homo sapiens
acccagtgggaaga

SEQ ID NO: 4088193 - DNA, 24 bp, Homo sapiens
acccataataagagaatgttccta

SEQ ID NO: 4088194 - DNA, 14 bp, Homo sapiens
acccatagaaaact

SEQ ID NO: 4088195 - DNA, 22 bp, Homo sapiens
acccatagaaaacttgacatgt

SEQ ID NO: 4088196 - DNA, 16 bp, Homo sapiens
acccatagcttccatg

SEQ ID NO: 4088197 - DNA, 19 bp, Homo sapiens
acccatctagtacttgaaa

SEQ ID NO: 4088198 - DNA, 14 bp, Homo sapiens
acccatgagcctgc

SEQ ID NO: 4088199 - DNA, 16 bp, Homo sapiens
acccatgagcctgccc

SEQ ID NO: 4088200 - DNA, 19 bp, Homo sapiens
acccatgagcctgcccgct

SEQ ID NO: 4088201 - DNA, 13 bp, Homo sapiens
acccatgaggcaa

SEQ ID NO: 4088202 - DNA, 17 bp, Homo sapiens
acccatgggctctgaca

SEQ ID NO: 4088203 - DNA, 16 bp, Homo sapiens
acccattcactacagg

SEQ ID NO: 4088204 - DNA, 13 bp, Homo sapiens
acccattcagaga

SEQ ID NO: 4088205 - DNA, 15 bp, Homo sapiens
acccattctgttttc

SEQ ID NO: 4088206 - DNA, 20 bp, Homo sapiens
acccattttgagtgactcga

SEQ ID NO: 4088207 - DNA, 16 bp, Homo sapiens
accccaaacaccttcc

SEQ ID NO: 4088208 - DNA, 14 bp, Homo sapiens
accccaaagagcct

SEQ ID NO: 4088209 - DNA, 21 bp, Homo sapiens
accccaaagagcctggagaag

SEQ ID NO: 4088210 - DNA, 21 bp, Homo sapiens
accccaagctgcctctgggcc

SEQ ID NO: 4088211 - DNA, 20 bp, Homo sapiens
accccaatttcggatttttt

SEQ ID NO: 4088212 - DNA, 21 bp, Homo sapiens
accccaatttcggattttttc

SEQ ID NO: 4088213 - DNA, 16 bp, Homo sapiens
accccacaccccagcc

SEQ ID NO: 4088214 - DNA, 20 bp, Homo sapiens
accccacaccccagcccacc

SEQ ID NO: 4088215 - DNA, 11 bp, Homo sapiens
accccacactt

SEQ ID NO: 4088216 - DNA, 19 bp, Homo sapiens
accccaccatatgaattgt

SEQ ID NO: 4088217 - DNA, 18 bp, Homo sapiens
accccacctccactccca

SEQ ID NO: 4088218 - DNA, 23 bp, Homo sapiens
accccacctccactcccacctca

SEQ ID NO: 4088219 - DNA, 22 bp, Homo sapiens
accccaccttgccaagctttct

SEQ ID NO: 4088220 - DNA, 15 bp, Homo sapiens
accccacgccctgtt

SEQ ID NO: 4088221 - DNA, 19 bp, Homo sapiens
accccactgggcacacgca

SEQ ID NO: 4088222 - DNA, 16 bp, Homo sapiens
accccagcccaccctg

SEQ ID NO: 4088223 - DNA, 20 bp, Homo sapiens
accccagcccaccctgctcc

SEQ ID NO: 4088224 - DNA, 12 bp, Homo sapiens
accccagcctga

SEQ ID NO: 4088225 - DNA, 14 bp, Homo sapiens
accccagcctgacc

SEQ ID NO: 4088226 - DNA, 16 bp, Homo sapiens
accccaggcccttcag

SEQ ID NO: 4088227 - DNA, 18 bp, Homo sapiens
accccagggccctggcca

SEQ ID NO: 4088228 - DNA, 20 bp, Homo sapiens
accccagggccctggccagc

SEQ ID NO: 4088229 - DNA, 17 bp, Homo sapiens
accccagtggccactca

SEQ ID NO: 4088230 - DNA, 16 bp, Homo sapiens
accccatatacacctg

SEQ ID NO: 4088231 - DNA, 18 bp, Homo sapiens
accccatcctccagggct

SEQ ID NO: 4088232 - DNA, 13 bp, Homo sapiens
accccattcctga

SEQ ID NO: 4088233 - DNA, 10 bp, Homo sapiens
acccccaccc

SEQ ID NO: 4088234 - DNA, 15 bp, Homo sapiens
acccccacccacctc

SEQ ID NO: 4088235 - DNA, 22 bp, Homo sapiens
acccccacccacctccacccag

SEQ ID NO: 4088236 - DNA, 12 bp, Homo sapiens
acccccacccca

SEQ ID NO: 4088237 - DNA, 15 bp, Homo sapiens
acccccaccccacac

SEQ ID NO: 4088238 - DNA, 14 bp, Homo sapiens
acccccacccccag

SEQ ID NO: 4088239 - DNA, 23 bp, Homo sapiens
acccccacgattggccacctgta

SEQ ID NO: 4088240 - DNA, 13 bp, Homo sapiens
acccccagcacag

SEQ ID NO: 4088241 - DNA, 12 bp, Homo sapiens
acccccagcact

SEQ ID NO: 4088242 - DNA, 13 bp, Homo sapiens
acccccagctcaa

SEQ ID NO: 4088243 - DNA, 13 bp, Homo sapiens
acccccagctccc

SEQ ID NO: 4088244 - DNA, 14 bp, Homo sapiens
accccccacacaca

SEQ ID NO: 4088245 - DNA, 12 bp, Homo sapiens
acccccccagct

SEQ ID NO: 4088246 - DNA, 14 bp, Homo sapiens
acccccctgttcta

SEQ ID NO: 4088247 - DNA, 15 bp, Homo sapiens
acccccctgttctaa

SEQ ID NO: 4088248 - DNA, 19 bp, Homo sapiens
acccccgccacctcagggc

SEQ ID NO: 4088249 - DNA, 21 bp, Homo sapiens
accccctcaagccccagcagc

SEQ ID NO: 4088250 - DNA, 12 bp, Homo sapiens
accccctccttc

SEQ ID NO: 4088251 - DNA, 19 bp, Homo sapiens
accccctccttcagacacc

SEQ ID NO: 4088252 - DNA, 14 bp, Homo sapiens
accccctgccctgc

SEQ ID NO: 4088253 - DNA, 18 bp, Homo sapiens
accccctgctccaccagc

SEQ ID NO: 4088254 - DNA, 17 bp, Homo sapiens
acccccttcctgtcccc

SEQ ID NO: 4088255 - DNA, 17 bp, Homo sapiens
acccccttctctgctcc

SEQ ID NO: 4088256 - DNA, 20 bp, Homo sapiens
acccccttctctgctccacc

SEQ ID NO: 4088257 - DNA, 18 bp, Homo sapiens
accccctttgctgtgagg

SEQ ID NO: 4088258 - DNA, 22 bp, Homo sapiens
accccgagaagtgctcttggct

SEQ ID NO: 4088259 - DNA, 22 bp, Homo sapiens
accccgaggtaggggtggggag

SEQ ID NO: 4088260 - DNA, 13 bp, Homo sapiens
accccggcctcag

SEQ ID NO: 4088261 - DNA, 14 bp, Homo sapiens
accccggcctcagg

SEQ ID NO: 4088262 - DNA, 15 bp, Homo sapiens
accccgggctctctg

SEQ ID NO: 4088263 - DNA, 18 bp, Homo sapiens
accccggggaccctgtga

SEQ ID NO: 4088264 - DNA, 21 bp, Homo sapiens
accccggggtgcccacaggcc

SEQ ID NO: 4088265 - DNA, 21 bp, Homo sapiens
acccctacacacacactccct

SEQ ID NO: 4088266 - DNA, 23 bp, Homo sapiens
acccctacacacacactccctgc

SEQ ID NO: 4088267 - DNA, 17 bp, Homo sapiens
acccctacacacaccca

SEQ ID NO: 4088268 - DNA, 15 bp, Homo sapiens
acccctagttccctc

SEQ ID NO: 4088269 - DNA, 19 bp, Homo sapiens
acccctagttccctctgct

SEQ ID NO: 4088270 - DNA, 21 bp, Homo sapiens
acccctagttccctctgctca

SEQ ID NO: 4088271 - DNA, 20 bp, Homo sapiens
acccctcacaggagcttact

SEQ ID NO: 4088272 - DNA, 22 bp, Homo sapiens
acccctcgtccaccccccacac

SEQ ID NO: 4088273 - DNA, 23 bp, Homo sapiens
acccctcgtccaccccccacaca

SEQ ID NO: 4088274 - DNA, 18 bp, Homo sapiens
acccctctggccaggatg

SEQ ID NO: 4088275 - DNA, 17 bp, Homo sapiens
acccctgagccagcagg

SEQ ID NO: 4088276 - DNA, 14 bp, Homo sapiens
acccctgcttctga

SEQ ID NO: 4088277 - DNA, 19 bp, Homo sapiens
acccctggaagagcccagt

SEQ ID NO: 4088278 - DNA, 19 bp, Homo sapiens
acccctggcttttcactgc

SEQ ID NO: 4088279 - DNA, 11 bp, Homo sapiens
acccctgtccc

SEQ ID NO: 4088280 - DNA, 16 bp, Homo sapiens
acccctgtcccaccca

SEQ ID NO: 4088281 - DNA, 21 bp, Homo sapiens
acccctgtcccacccacacag

SEQ ID NO: 4088282 - DNA, 21 bp, Homo sapiens
acccctgtcccatgcaggccc

SEQ ID NO: 4088283 - DNA, 15 bp, Homo sapiens
accccttagcctccc

SEQ ID NO: 4088284 - DNA, 16 bp, Homo sapiens
accccttagcctccct

SEQ ID NO: 4088285 - DNA, 18 bp, Homo sapiens
acatttcttttcttttta

SEQ ID NO: 4088286 - DNA, 21 bp, Homo sapiens
acatttcttttctttttacat

SEQ ID NO: 4088287 - DNA, 14 bp, Homo sapiens
acatttggagaggg

SEQ ID NO: 4088288 - DNA, 17 bp, Homo sapiens
acatttgggagacatgt

SEQ ID NO: 4088289 - DNA, 12 bp, Homo sapiens
acatttgtgaga

SEQ ID NO: 4088290 - DNA, 15 bp, Homo sapiens
acattttacattaaa

SEQ ID NO: 4088291 - DNA, 17 bp, Homo sapiens
acattttatcattaatt

SEQ ID NO: 4088292 - DNA, 12 bp, Homo sapiens
acattttcagtg

SEQ ID NO: 4088293 - DNA, 16 bp, Homo sapiens
acattttctggattct

SEQ ID NO: 4088294 - DNA, 15 bp, Homo sapiens
acatttttatttatg

SEQ ID NO: 4088295 - DNA, 21 bp, Homo sapiens
acatttttccgtttgcttttg

SEQ ID NO: 4088296 - DNA, 14 bp, Homo sapiens
acattttttcttct

SEQ ID NO: 4088297 - DNA, 20 bp, Homo sapiens
acattttttgctataatcat

SEQ ID NO: 4088298 - DNA, 18 bp, Homo sapiens
acattttttttttaaatc

SEQ ID NO: 4088299 - DNA, 18 bp, Homo sapiens
accaaaaaaatccagaaa

SEQ ID NO: 4088300 - DNA, 18 bp, Homo sapiens
accaaactgttaaatgtg

SEQ ID NO: 4088301 - DNA, 18 bp, Homo sapiens
accaaagagggcttcctc

SEQ ID NO: 4088302 - DNA, 21 bp, Homo sapiens
accaaagtcctttttttccat

SEQ ID NO: 4088303 - DNA, 12 bp, Homo sapiens
accaaagtttta

SEQ ID NO: 4088304 - DNA, 19 bp, Homo sapiens
accaaataatttcatattc

SEQ ID NO: 4088305 - DNA, 15 bp, Homo sapiens
accaacaatataaac

SEQ ID NO: 4088306 - DNA, 15 bp, Homo sapiens
accaaccctcagagc

SEQ ID NO: 4088307 - DNA, 19 bp, Homo sapiens
accaaccctggggaaggag

SEQ ID NO: 4088308 - DNA, 14 bp, Homo sapiens
accaacctgctctg

SEQ ID NO: 4088309 - DNA, 14 bp, Homo sapiens
accaacctttaaaa

SEQ ID NO: 4088310 - DNA, 14 bp, Homo sapiens
accaactgggccca

SEQ ID NO: 4088311 - DNA, 17 bp, Homo sapiens
accaagcacagcagcct

SEQ ID NO: 4088312 - DNA, 16 bp, Homo sapiens
accaagccgtggcttc

SEQ ID NO: 4088313 - DNA, 17 bp, Homo sapiens
accaagctgagtttcct

SEQ ID NO: 4088314 - DNA, 15 bp, Homo sapiens
accaaggactgagca

SEQ ID NO: 4088315 - DNA, 21 bp, Homo sapiens
accaaggatcggactctgccc

SEQ ID NO: 4088316 - DNA, 19 bp, Homo sapiens
accaaggtcttcagccatc

SEQ ID NO: 4088317 - DNA, 15 bp, Homo sapiens
accaagtttattcag

SEQ ID NO: 4088318 - DNA, 24 bp, Homo sapiens
accaagtttattcagtaaacaact

SEQ ID NO: 4088319 - DNA, 17 bp, Homo sapiens
accaataaaataatttt

SEQ ID NO: 4088320 - DNA, 15 bp, Homo sapiens
accaataaaatttct

SEQ ID NO: 4088321 - DNA, 21 bp, Homo sapiens
accaatcccagggctggctct

SEQ ID NO: 4088322 - DNA, 22 bp, Homo sapiens
accaatcccgtgaaagaattat

SEQ ID NO: 4088323 - DNA, 13 bp, Homo sapiens
accaatgcccagc

SEQ ID NO: 4088324 - DNA, 14 bp, Homo sapiens
accaatgcccagca

SEQ ID NO: 4088325 - DNA, 20 bp, Homo sapiens
accaattacatggaactttt

SEQ ID NO: 4088326 - DNA, 14 bp, Homo sapiens
accaattgtgctgc

SEQ ID NO: 4088327 - DNA, 16 bp, Homo sapiens
accaattgtgctgcca

SEQ ID NO: 4088328 - DNA, 17 bp, Homo sapiens
accaattgtgctgccat

SEQ ID NO: 4088329 - DNA, 18 bp, Homo sapiens
accaattgtgctgccatt

SEQ ID NO: 4088330 - DNA, 12 bp, Homo sapiens
accacaagggct

SEQ ID NO: 4088331 - DNA, 14 bp, Homo sapiens
accacacatttcac

SEQ ID NO: 4088332 - DNA, 21 bp, Homo sapiens
accacacatttcactgtctgt

SEQ ID NO: 4088333 - DNA, 22 bp, Homo sapiens
accacagacacaatatgtatgc

SEQ ID NO: 4088334 - DNA, 16 bp, Homo sapiens
accacagcagctgaac

SEQ ID NO: 4088335 - DNA, 21 bp, Homo sapiens
accacaggcatctacacagcc

SEQ ID NO: 4088336 - DNA, 16 bp, Homo sapiens
accacagggccagagg

SEQ ID NO: 4088337 - DNA, 17 bp, Homo sapiens
accacagggccagaggg

SEQ ID NO: 4088338 - DNA, 11 bp, Homo sapiens
accacagtgtc

SEQ ID NO: 4088339 - DNA, 20 bp, Homo sapiens
accacatcctccgtccagcc

SEQ ID NO: 4088340 - DNA, 14 bp, Homo sapiens
accacatgccactg

SEQ ID NO: 4088341 - DNA, 18 bp, Homo sapiens
accacatgccactgcctg

SEQ ID NO: 4088342 - DNA, 22 bp, Homo sapiens
accacatgccactgcctgcacc

SEQ ID NO: 4088343 - DNA, 13 bp, Homo sapiens
accacattgcttt

SEQ ID NO: 4088344 - DNA, 19 bp, Homo sapiens
accacattttatatttatt

SEQ ID NO: 4088345 - DNA, 22 bp, Homo sapiens
accacccccccccatccccgct

SEQ ID NO: 4088346 - DNA, 16 bp, Homo sapiens
accacccgaaatgcca

SEQ ID NO: 4088347 - DNA, 21 bp, Homo sapiens
accacccgaaatgccacgtgg

SEQ ID NO: 4088348 - DNA, 14 bp, Homo sapiens
accaccctccttcc

SEQ ID NO: 4088349 - DNA, 15 bp, Homo sapiens
accacctcactcctg

SEQ ID NO: 4088350 - DNA, 14 bp, Homo sapiens
accacctccctcac

SEQ ID NO: 4088351 - DNA, 12 bp, Homo sapiens
accacctctgtg

SEQ ID NO: 4088352 - DNA, 13 bp, Homo sapiens
accacctctgtgg

SEQ ID NO: 4088353 - DNA, 15 bp, Homo sapiens
accacctctgtggca

SEQ ID NO: 4088354 - DNA, 12 bp, Homo sapiens
accacctgcctc

SEQ ID NO: 4088355 - DNA, 21 bp, Homo sapiens
accaccttctgtccccagccc

SEQ ID NO: 4088356 - DNA, 23 bp, Homo sapiens
accaccttctgtccccagccctg

SEQ ID NO: 4088357 - DNA, 17 bp, Homo sapiens
accacctttgtctctgc

SEQ ID NO: 4088358 - DNA, 13 bp, Homo sapiens
accacgactggcc

SEQ ID NO: 4088359 - DNA, 18 bp, Homo sapiens
accacggaaaagagcgca

SEQ ID NO: 4088360 - DNA, 17 bp, Homo sapiens
accactacatgcagccc

SEQ ID NO: 4088361 - DNA, 20 bp, Homo sapiens
accactagaactctccatct

SEQ ID NO: 4088362 - DNA, 15 bp, Homo sapiens
accactatgaagcta

SEQ ID NO: 4088363 - DNA, 17 bp, Homo sapiens
accactcgtgcatccct

SEQ ID NO: 4088364 - DNA, 20 bp, Homo sapiens
accactgagtaccaggggct

SEQ ID NO: 4088365 - DNA, 23 bp, Homo sapiens
accactgggccataatgttgctt

SEQ ID NO: 4088366 - DNA, 16 bp, Homo sapiens
accactggtaacatgt

SEQ ID NO: 4088367 - DNA, 22 bp, Homo sapiens
accactgtggcgttctgctgcc

SEQ ID NO: 4088368 - DNA, 13 bp, Homo sapiens
accacttcgaaac

SEQ ID NO: 4088369 - DNA, 13 bp, Homo sapiens
accagaagggaaa

SEQ ID NO: 4088370 - DNA, 19 bp, Homo sapiens
accagacaaaaaaatttaa

SEQ ID NO: 4088371 - DNA, 21 bp, Homo sapiens
accagacaaaaaaatttaaaa

SEQ ID NO: 4088372 - DNA, 13 bp, Homo sapiens
accagacacaaac

SEQ ID NO: 4088373 - DNA, 19 bp, Homo sapiens
accagacatcaccctttgc

SEQ ID NO: 4088374 - DNA, 23 bp, Homo sapiens
accagacgtcaggccctgactcc

SEQ ID NO: 4088375 - DNA, 20 bp, Homo sapiens
accagagacgcccagcccca

SEQ ID NO: 4088376 - DNA, 23 bp, Homo sapiens
accagagacgcccagccccatcc

SEQ ID NO: 4088377 - DNA, 20 bp, Homo sapiens
accagagcaacctctcactc

SEQ ID NO: 4088378 - DNA, 15 bp, Homo sapiens
accagagcagatgca

SEQ ID NO: 4088379 - DNA, 12 bp, Homo sapiens
accagagccaga

SEQ ID NO: 4088380 - DNA, 14 bp, Homo sapiens
accagagcccatgc

SEQ ID NO: 4088381 - DNA, 16 bp, Homo sapiens
accagagcccatgctc

SEQ ID NO: 4088382 - DNA, 11 bp, Homo sapiens
accagagcccc

SEQ ID NO: 4088383 - DNA, 21 bp, Homo sapiens
accagagccccccacaatgat

SEQ ID NO: 4088384 - DNA, 19 bp, Homo sapiens
accagagctctatccccat

SEQ ID NO: 4088385 - DNA, 15 bp, Homo sapiens
accagagctgtctga

SEQ ID NO: 4088386 - DNA, 22 bp, Homo sapiens
accagagggtgtggctttccag

SEQ ID NO: 4088387 - DNA, 16 bp, Homo sapiens
accagaggtgcttctg

SEQ ID NO: 4088388 - DNA, 21 bp, Homo sapiens
accagataagaatgctggttt

SEQ ID NO: 4088389 - DNA, 19 bp, Homo sapiens
acagtgtaatccaggggtg

SEQ ID NO: 4088390 - DNA, 24 bp, Homo sapiens
acagtgtctgtatcggagacagtg

SEQ ID NO: 4088391 - DNA, 23 bp, Homo sapiens
acagtgtctgtgccatggatttc

SEQ ID NO: 4088392 - DNA, 14 bp, Homo sapiens
acagtgtgtgaact

SEQ ID NO: 4088393 - DNA, 22 bp, Homo sapiens
acagtgtgtgaactgctttcaa

SEQ ID NO: 4088394 - DNA, 16 bp, Homo sapiens
acagtgttattttctt

SEQ ID NO: 4088395 - DNA, 15 bp, Homo sapiens
acagtgtttcccata

SEQ ID NO: 4088396 - DNA, 19 bp, Homo sapiens
acagtgtttcgacagctga

SEQ ID NO: 4088397 - DNA, 17 bp, Homo sapiens
acagtgtttgcaatggt

SEQ ID NO: 4088398 - DNA, 14 bp, Homo sapiens
acagttaactttca

SEQ ID NO: 4088399 - DNA, 23 bp, Homo sapiens
acagttagggttttgcaataact

SEQ ID NO: 4088400 - DNA, 18 bp, Homo sapiens
acagttattttggatata

SEQ ID NO: 4088401 - DNA, 22 bp, Homo sapiens
acagttattttggatatattat

SEQ ID NO: 4088402 - DNA, 21 bp, Homo sapiens
acagttctgctctggttgttt

SEQ ID NO: 4088403 - DNA, 13 bp, Homo sapiens
acagttctgtcat

SEQ ID NO: 4088404 - DNA, 19 bp, Homo sapiens
acagttcttggtgactgtc

SEQ ID NO: 4088405 - DNA, 21 bp, Homo sapiens
acagttctttgggccagacat

SEQ ID NO: 4088406 - DNA, 19 bp, Homo sapiens
acagttgccaccacctctg

SEQ ID NO: 4088407 - DNA, 22 bp, Homo sapiens
acagttgccaccacctctgtgg

SEQ ID NO: 4088408 - DNA, 23 bp, Homo sapiens
acagttgccaccacctctgtggc

SEQ ID NO: 4088409 - DNA, 22 bp, Homo sapiens
acagttgctgtcataagaatga

SEQ ID NO: 4088410 - DNA, 16 bp, Homo sapiens
acagtttaaagctttt

SEQ ID NO: 4088411 - DNA, 12 bp, Homo sapiens
acagtttcttag

SEQ ID NO: 4088412 - DNA, 14 bp, Homo sapiens
acagtttcttagct

SEQ ID NO: 4088413 - DNA, 20 bp, Homo sapiens
acagtttcttagctttttaa

SEQ ID NO: 4088414 - DNA, 15 bp, Homo sapiens
acagttttccatgaa

SEQ ID NO: 4088415 - DNA, 21 bp, Homo sapiens
acataaaaaggacatcagcaa

SEQ ID NO: 4088416 - DNA, 11 bp, Homo sapiens
acataaaacaa

SEQ ID NO: 4088417 - DNA, 14 bp, Homo sapiens
acataaaagaattt

SEQ ID NO: 4088418 - DNA, 15 bp, Homo sapiens
acataacggaaagtt

SEQ ID NO: 4088419 - DNA, 15 bp, Homo sapiens
acataacgtttttcc

SEQ ID NO: 4088420 - DNA, 23 bp, Homo sapiens
acataacgtttttcctttaaaaa

SEQ ID NO: 4088421 - DNA, 23 bp, Homo sapiens
acataagctaaatcatattagta

SEQ ID NO: 4088422 - DNA, 23 bp, Homo sapiens
acataaggcttttcctgttctgg

SEQ ID NO: 4088423 - DNA, 15 bp, Homo sapiens
acataagtaattcaa

SEQ ID NO: 4088424 - DNA, 15 bp, Homo sapiens
acataataaatcaca

SEQ ID NO: 4088425 - DNA, 19 bp, Homo sapiens
acataatgaaaatattttt

SEQ ID NO: 4088426 - DNA, 16 bp, Homo sapiens
acatacaattccaaac

SEQ ID NO: 4088427 - DNA, 20 bp, Homo sapiens
acatacaggaaggtagaaat

SEQ ID NO: 4088428 - DNA, 13 bp, Homo sapiens
acatacaggtgct

SEQ ID NO: 4088429 - DNA, 17 bp, Homo sapiens
acataccccactgggca

SEQ ID NO: 4088430 - DNA, 19 bp, Homo sapiens
acataccccactgggcaca

SEQ ID NO: 4088431 - DNA, 20 bp, Homo sapiens
acatactgcttgattttaat

SEQ ID NO: 4088432 - DNA, 19 bp, Homo sapiens
acatactggcctggactgt

SEQ ID NO: 4088433 - DNA, 17 bp, Homo sapiens
acatactgtgttccaat

SEQ ID NO: 4088434 - DNA, 17 bp, Homo sapiens
acatacttgaagggcca

SEQ ID NO: 4088435 - DNA, 22 bp, Homo sapiens
acatactttcatcctgactctg

SEQ ID NO: 4088436 - DNA, 18 bp, Homo sapiens
acatagatattttcacaa

SEQ ID NO: 4088437 - DNA, 16 bp, Homo sapiens
acatagggttcccacg

SEQ ID NO: 4088438 - DNA, 21 bp, Homo sapiens
acatagtgatggttcccctgt

SEQ ID NO: 4088439 - DNA, 19 bp, Homo sapiens
acatagttatttttctctt

SEQ ID NO: 4088440 - DNA, 21 bp, Homo sapiens
acatagttttaaactcatttt

SEQ ID NO: 4088441 - DNA, 17 bp, Homo sapiens
acatatactgattctgt

SEQ ID NO: 4088442 - DNA, 20 bp, Homo sapiens
acatatatatattttttaat

SEQ ID NO: 4088443 - DNA, 15 bp, Homo sapiens
acatatctttattaa

SEQ ID NO: 4088444 - DNA, 16 bp, Homo sapiens
acatatctttattaat

SEQ ID NO: 4088445 - DNA, 14 bp, Homo sapiens
acatatgacttgat

SEQ ID NO: 4088446 - DNA, 19 bp, Homo sapiens
acatatgagtgtggaagcc

SEQ ID NO: 4088447 - DNA, 22 bp, Homo sapiens
acatatgatttcactagaaaag

SEQ ID NO: 4088448 - DNA, 21 bp, Homo sapiens
acatatgtgctggaattctaa

SEQ ID NO: 4088449 - DNA, 16 bp, Homo sapiens
acatcaacatcttggt

SEQ ID NO: 4088450 - DNA, 17 bp, Homo sapiens
acatcaacctggcaaaa

SEQ ID NO: 4088451 - DNA, 15 bp, Homo sapiens
acatcaatgttcatt

SEQ ID NO: 4088452 - DNA, 18 bp, Homo sapiens
acatcaatgttcattgta

SEQ ID NO: 4088453 - DNA, 20 bp, Homo sapiens
acatcaatgttcattgtaat

SEQ ID NO: 4088454 - DNA, 20 bp, Homo sapiens
acatcaccctttgccttagc

SEQ ID NO: 4088455 - DNA, 12 bp, Homo sapiens
acatcagcaaac

SEQ ID NO: 4088456 - DNA, 16 bp, Homo sapiens
acatccaaagcagaca

SEQ ID NO: 4088457 - DNA, 19 bp, Homo sapiens
acatccaaagcagacagct

SEQ ID NO: 4088458 - DNA, 19 bp, Homo sapiens
acatccacagtctccccca

SEQ ID NO: 4088459 - DNA, 20 bp, Homo sapiens
acatcccaccccatcctcca

SEQ ID NO: 4088460 - DNA, 13 bp, Homo sapiens
acatcccagcagc

SEQ ID NO: 4088461 - DNA, 18 bp, Homo sapiens
acatcccagcctgtggtt

SEQ ID NO: 4088462 - DNA, 17 bp, Homo sapiens
acatccctgagcaggaa

SEQ ID NO: 4088463 - DNA, 19 bp, Homo sapiens
acatcctgtataagcactg

SEQ ID NO: 4088464 - DNA, 18 bp, Homo sapiens
acatcctttgcagggcag

SEQ ID NO: 4088465 - DNA, 20 bp, Homo sapiens
acatcctttgcagggcagcc

SEQ ID NO: 4088466 - DNA, 14 bp, Homo sapiens
acatcgcacactgg

SEQ ID NO: 4088467 - DNA, 20 bp, Homo sapiens
acatcgtgaaaccctgtctc

SEQ ID NO: 4088468 - DNA, 18 bp, Homo sapiens
acatctaataagtatata

SEQ ID NO: 4088469 - DNA, 14 bp, Homo sapiens
acatctcacctccg

SEQ ID NO: 4088470 - DNA, 12 bp, Homo sapiens
acatctcgggag

SEQ ID NO: 4088471 - DNA, 12 bp, Homo sapiens
acatctctcccc

SEQ ID NO: 4088472 - DNA, 12 bp, Homo sapiens
acatctgcctta

SEQ ID NO: 4088473 - DNA, 12 bp, Homo sapiens
acatctgtgcag

SEQ ID NO: 4088474 - DNA, 11 bp, Homo sapiens
acatctttaag

SEQ ID NO: 4088475 - DNA, 18 bp, Homo sapiens
acatgaaacctacacact

SEQ ID NO: 4088476 - DNA, 23 bp, Homo sapiens
acatgaagcaattagtctgaaac

SEQ ID NO: 4088477 - DNA, 15 bp, Homo sapiens
acatgaatgcacact

SEQ ID NO: 4088478 - DNA, 13 bp, Homo sapiens
acatgaatgcagt

SEQ ID NO: 4088479 - DNA, 17 bp, Homo sapiens
acatgaatgcagtcatg

SEQ ID NO: 4088480 - DNA, 15 bp, Homo sapiens
acatgacaactttgc

SEQ ID NO: 4088481 - DNA, 15 bp, Homo sapiens
acatgactgggcctc

SEQ ID NO: 4088482 - DNA, 15 bp, Homo sapiens
acatgagaacaaaca

SEQ ID NO: 4088483 - DNA, 17 bp, Homo sapiens
acatgaggggacatttt

SEQ ID NO: 4088484 - DNA, 19 bp, Homo sapiens
acatgattgtataagcatg

SEQ ID NO: 4088485 - DNA, 21 bp, Homo sapiens
acatgatttccttgaatgtgg

SEQ ID NO: 4088486 - DNA, 21 bp, Homo sapiens
acatgcaaaaagaaatgacta

SEQ ID NO: 4088487 - DNA, 18 bp, Homo sapiens
acatgcagcccatgccca

SEQ ID NO: 4088488 - DNA, 15 bp, Homo sapiens
acatgcagttcatta

SEQ ID NO: 4088489 - DNA, 14 bp, Homo sapiens
acatgcataaaagg

SEQ ID NO: 4088490 - DNA, 13 bp, Homo sapiens
acatgcattgttg

SEQ ID NO: 4088491 - DNA, 15 bp, Homo sapiens
acatgcattgttggc

SEQ ID NO: 4088492 - DNA, 21 bp, Homo sapiens
acatgcatttgaggtcaagta

SEQ ID NO: 4088493 - DNA, 19 bp, Homo sapiens
acatgcctatattatcata

SEQ ID NO: 4088494 - DNA, 21 bp, Homo sapiens
acatgcctgccccaaacaaat

SEQ ID NO: 4088495 - DNA, 23 bp, Homo sapiens
acatgcggtagccagcacacagg

SEQ ID NO: 4088496 - DNA, 18 bp, Homo sapiens
acatggaataacatgtaa

SEQ ID NO: 4088497 - DNA, 15 bp, Homo sapiens
acatggagactcctg

SEQ ID NO: 4088498 - DNA, 16 bp, Homo sapiens
acatggagactcctgc

SEQ ID NO: 4088499 - DNA, 22 bp, Homo sapiens
acatggagactcctgccctgtt

SEQ ID NO: 4088500 - DNA, 15 bp, Homo sapiens
acatggagctgtcat

SEQ ID NO: 4088501 - DNA, 15 bp, Homo sapiens
acatggagtatatgt

SEQ ID NO: 4088502 - DNA, 19 bp, Homo sapiens
acatggagtatatgtcaag

SEQ ID NO: 4088503 - DNA, 14 bp, Homo sapiens
acatggctagcctt

SEQ ID NO: 4088504 - DNA, 20 bp, Homo sapiens
acatggtactcttgttgagt

SEQ ID NO: 4088505 - DNA, 23 bp, Homo sapiens
acatggtactcttgttgagttct

SEQ ID NO: 4088506 - DNA, 18 bp, Homo sapiens
acatggtgcctgagaggc

SEQ ID NO: 4088507 - DNA, 23 bp, Homo sapiens
acatggtgcctgagaggcaggca

SEQ ID NO: 4088508 - DNA, 14 bp, Homo sapiens
acatggtgtggggg

SEQ ID NO: 4088509 - DNA, 19 bp, Homo sapiens
acatggtgtggggggctgg

SEQ ID NO: 4088510 - DNA, 18 bp, Homo sapiens
acatggttgtaatatgcg

SEQ ID NO: 4088511 - DNA, 17 bp, Homo sapiens
acatggtttgactcccg

SEQ ID NO: 4088512 - DNA, 19 bp, Homo sapiens
acatgtaataaaaagtata

SEQ ID NO: 4088513 - DNA, 15 bp, Homo sapiens
acatgtaattaagta

SEQ ID NO: 4088514 - DNA, 22 bp, Homo sapiens
acatgtaattaagtactatgta

SEQ ID NO: 4088515 - DNA, 21 bp, Homo sapiens
acatgtaggtaggaagcactg

SEQ ID NO: 4088516 - DNA, 18 bp, Homo sapiens
acatgtattgcacattgt

SEQ ID NO: 4088517 - DNA, 20 bp, Homo sapiens
acatgtcctaattcttctgt

SEQ ID NO: 4088518 - DNA, 22 bp, Homo sapiens
acatgtcctaattcttctgtcc

SEQ ID NO: 4088519 - DNA, 20 bp, Homo sapiens
acatgtcttccatgtatctt

SEQ ID NO: 4088520 - DNA, 15 bp, Homo sapiens
acatgtgaaaccttt

SEQ ID NO: 4088521 - DNA, 23 bp, Homo sapiens
acatgtgaaaccttttttaagat

SEQ ID NO: 4088522 - DNA, 13 bp, Homo sapiens
acatgtgacattt

SEQ ID NO: 4088523 - DNA, 14 bp, Homo sapiens
acatgtgacattta

SEQ ID NO: 4088524 - DNA, 17 bp, Homo sapiens
acatgtgaggaggaaaa

SEQ ID NO: 4088525 - DNA, 21 bp, Homo sapiens
acatgtggcaaaatatggttt

SEQ ID NO: 4088526 - DNA, 16 bp, Homo sapiens
acatgtggggccaggt

SEQ ID NO: 4088527 - DNA, 14 bp, Homo sapiens
acatgtgtaaaggt

SEQ ID NO: 4088528 - DNA, 23 bp, Homo sapiens
acatgtgtcaacacccctgtgtg

SEQ ID NO: 4088529 - DNA, 20 bp, Homo sapiens
acatgtgtttattcatccag

SEQ ID NO: 4088530 - DNA, 16 bp, Homo sapiens
acatgtttaactttaa

SEQ ID NO: 4088531 - DNA, 21 bp, Homo sapiens
acatgtttacttttcagggca

SEQ ID NO: 4088532 - DNA, 15 bp, Homo sapiens
acattaaaaaatgaa

SEQ ID NO: 4088533 - DNA, 14 bp, Homo sapiens
acattaacaaataa

SEQ ID NO: 4088534 - DNA, 15 bp, Homo sapiens
acattaacaaataaa

SEQ ID NO: 4088535 - DNA, 12 bp, Homo sapiens
acattaacagtt

SEQ ID NO: 4088536 - DNA, 16 bp, Homo sapiens
acattaacagttttcc

SEQ ID NO: 4088537 - DNA, 20 bp, Homo sapiens
acattaacagttttccatga

SEQ ID NO: 4088538 - DNA, 21 bp, Homo sapiens
acattaatgttaattcagcac

SEQ ID NO: 4088539 - DNA, 12 bp, Homo sapiens
acattacagttc

SEQ ID NO: 4088540 - DNA, 13 bp, Homo sapiens
acattacagttca

SEQ ID NO: 4088541 - DNA, 17 bp, Homo sapiens
acattacagttcataat

SEQ ID NO: 4088542 - DNA, 19 bp, Homo sapiens
acattaccttactgtggag

SEQ ID NO: 4088543 - DNA, 14 bp, Homo sapiens
acattataaacgct

SEQ ID NO: 4088544 - DNA, 15 bp, Homo sapiens
acattatagattttc

SEQ ID NO: 4088545 - DNA, 15 bp, Homo sapiens
acattatgtatctta

SEQ ID NO: 4088546 - DNA, 22 bp, Homo sapiens
acattatgtatcttagttacat

SEQ ID NO: 4088547 - DNA, 18 bp, Homo sapiens
acattatttatatgggga

SEQ ID NO: 4088548 - DNA, 13 bp, Homo sapiens
acattatttctag

SEQ ID NO: 4088549 - DNA, 13 bp, Homo sapiens
acattatttgcat

SEQ ID NO: 4088550 - DNA, 13 bp, Homo sapiens
acattcaaggcat

SEQ ID NO: 4088551 - DNA, 20 bp, Homo sapiens
acattcatcaatatccctct

SEQ ID NO: 4088552 - DNA, 21 bp, Homo sapiens
acattcccctcccacctctcc

SEQ ID NO: 4088553 - DNA, 18 bp, Homo sapiens
acattccctctaatttga

SEQ ID NO: 4088554 - DNA, 19 bp, Homo sapiens
acattccctctaatttgaa

SEQ ID NO: 4088555 - DNA, 13 bp, Homo sapiens
acattccctctcc

SEQ ID NO: 4088556 - DNA, 17 bp, Homo sapiens
acattccctctcctgcc

SEQ ID NO: 4088557 - DNA, 14 bp, Homo sapiens
acattcgatctcat

SEQ ID NO: 4088558 - DNA, 16 bp, Homo sapiens
acattcgatctcattc

SEQ ID NO: 4088559 - DNA, 21 bp, Homo sapiens
acattcgatctcattcagtat

SEQ ID NO: 4088560 - DNA, 18 bp, Homo sapiens
acattcgtgagctgggga

SEQ ID NO: 4088561 - DNA, 19 bp, Homo sapiens
acattcttattaattcttc

SEQ ID NO: 4088562 - DNA, 18 bp, Homo sapiens
acattgaagtaatgaatt

SEQ ID NO: 4088563 - DNA, 19 bp, Homo sapiens
acattgaagtaatgaattt

SEQ ID NO: 4088564 - DNA, 20 bp, Homo sapiens
acattgaagtaatgaatttt

SEQ ID NO: 4088565 - DNA, 21 bp, Homo sapiens
acattgaccgcaactcacaca

SEQ ID NO: 4088566 - DNA, 17 bp, Homo sapiens
acattgacgattccttc

SEQ ID NO: 4088567 - DNA, 23 bp, Homo sapiens
acattgagctgatataaattctg

SEQ ID NO: 4088568 - DNA, 16 bp, Homo sapiens
acattgattcagcctg

SEQ ID NO: 4088569 - DNA, 11 bp, Homo sapiens
acattgcattc

SEQ ID NO: 4088570 - DNA, 14 bp, Homo sapiens
acattgcattctat

SEQ ID NO: 4088571 - DNA, 16 bp, Homo sapiens
acattgcattctattg

SEQ ID NO: 4088572 - DNA, 13 bp, Homo sapiens
acattgccccaag

SEQ ID NO: 4088573 - DNA, 15 bp, Homo sapiens
acattgccccaagat

SEQ ID NO: 4088574 - DNA, 19 bp, Homo sapiens
acattgcctgactaaaatg

SEQ ID NO: 4088575 - DNA, 15 bp, Homo sapiens
acattggaatgttct

SEQ ID NO: 4088576 - DNA, 17 bp, Homo sapiens
acattgtaaatagtatt

SEQ ID NO: 4088577 - DNA, 19 bp, Homo sapiens
acattgtaaatagtatttg

SEQ ID NO: 4088578 - DNA, 12 bp, Homo sapiens
acattgtcaata

SEQ ID NO: 4088579 - DNA, 17 bp, Homo sapiens
acattgttgagctattg

SEQ ID NO: 4088580 - DNA, 14 bp, Homo sapiens
acatttaaagcatt

SEQ ID NO: 4088581 - DNA, 17 bp, Homo sapiens
acatttaatacagcagt

SEQ ID NO: 4088582 - DNA, 19 bp, Homo sapiens
acatttaatttagtgatct

SEQ ID NO: 4088583 - DNA, 13 bp, Homo sapiens
acatttagaactt

SEQ ID NO: 4088584 - DNA, 13 bp, Homo sapiens
acatttagatcct

SEQ ID NO: 4088585 - DNA, 23 bp, Homo sapiens
acatttagatcctggtttcataa

SEQ ID NO: 4088586 - DNA, 14 bp, Homo sapiens
acatttagtcctgt

SEQ ID NO: 4088587 - DNA, 18 bp, Homo sapiens
acatttataatgtttgct

SEQ ID NO: 4088588 - DNA, 18 bp, Homo sapiens
acatttatgagtaactat

SEQ ID NO: 4088589 - DNA, 18 bp, Homo sapiens
acatttatttattactgt

SEQ ID NO: 4088590 - DNA, 15 bp, Homo sapiens
acatttcactgtctg

SEQ ID NO: 4088591 - DNA, 13 bp, Homo sapiens
acatttcccaggg

SEQ ID NO: 4088592 - DNA, 18 bp, Homo sapiens
acatttccttacagaact

SEQ ID NO: 4088593 - DNA, 21 bp, Homo sapiens
acatttctcttccccttagaa

SEQ ID NO: 4088594 - DNA, 22 bp, Homo sapiens
acatttctcttccccttagaaa

SEQ ID NO: 4088595 - DNA, 14 bp, Homo sapiens
aagagggctgagct

SEQ ID NO: 4088596 - DNA, 15 bp, Homo sapiens
aagagggctgagctg

SEQ ID NO: 4088597 - DNA, 23 bp, Homo sapiens
aagagggttttaggtagaaaaac

SEQ ID NO: 4088598 - DNA, 21 bp, Homo sapiens
aagaggtttggctcctgccca

SEQ ID NO: 4088599 - DNA, 21 bp, Homo sapiens
aagagtagcaagttctagaga

SEQ ID NO: 4088600 - DNA, 19 bp, Homo sapiens
aagagtagttgatgttgca

SEQ ID NO: 4088601 - DNA, 22 bp, Homo sapiens
aagagtagttgatgttgcattt

SEQ ID NO: 4088602 - DNA, 18 bp, Homo sapiens
aagagtatccttccttca

SEQ ID NO: 4088603 - DNA, 22 bp, Homo sapiens
aagagtattttaagaagacata

SEQ ID NO: 4088604 - DNA, 13 bp, Homo sapiens
aagagtgccctgc

SEQ ID NO: 4088605 - DNA, 19 bp, Homo sapiens
aagagtgccctgctttgca

SEQ ID NO: 4088606 - DNA, 20 bp, Homo sapiens
aagagtgccctgctttgcaa

SEQ ID NO: 4088607 - DNA, 21 bp, Homo sapiens
aagagtgccctgctttgcaaa

SEQ ID NO: 4088608 - DNA, 20 bp, Homo sapiens
aagagtggagagaagctctt

SEQ ID NO: 4088609 - DNA, 16 bp, Homo sapiens
aagagtgggctgcatc

SEQ ID NO: 4088610 - DNA, 22 bp, Homo sapiens
aagagtgtagaagcattccttc

SEQ ID NO: 4088611 - DNA, 12 bp, Homo sapiens
aagagtgtgtgt

SEQ ID NO: 4088612 - DNA, 13 bp, Homo sapiens
aagagtgtgtgtg

SEQ ID NO: 4088613 - DNA, 23 bp, Homo sapiens
aagagttcttaaggattgtgata

SEQ ID NO: 4088614 - DNA, 18 bp, Homo sapiens
aagagtttgttctgttct

SEQ ID NO: 4088615 - DNA, 12 bp, Homo sapiens
aagataaagatg

SEQ ID NO: 4088616 - DNA, 12 bp, Homo sapiens
aagataaatgtg

SEQ ID NO: 4088617 - DNA, 20 bp, Homo sapiens
aagataacaagatctttcag

SEQ ID NO: 4088618 - DNA, 21 bp, Homo sapiens
tccttcatttccaccaggccg

SEQ ID NO: 4088619 - DNA, 18 bp, Homo sapiens
tccttccaaaaaattaaa

SEQ ID NO: 4088620 - DNA, 19 bp, Homo sapiens
tccttccaaagaattctta

SEQ ID NO: 4088621 - DNA, 15 bp, Homo sapiens
tccttccaccaagtt

SEQ ID NO: 4088622 - DNA, 12 bp, Homo sapiens
tccttccagccc

SEQ ID NO: 4088623 - DNA, 14 bp, Homo sapiens
tccttccagcccat

SEQ ID NO: 4088624 - DNA, 22 bp, Homo sapiens
tccttcccacccctacacacac

SEQ ID NO: 4088625 - DNA, 14 bp, Homo sapiens
tccttcccactctt

SEQ ID NO: 4088626 - DNA, 17 bp, Homo sapiens
tccttcccactcttctc

SEQ ID NO: 4088627 - DNA, 13 bp, Homo sapiens
tccttccccagga

SEQ ID NO: 4088628 - DNA, 14 bp, Homo sapiens
tccttccctcaccc

SEQ ID NO: 4088629 - DNA, 15 bp, Homo sapiens
tccttccctcacccc

SEQ ID NO: 4088630 - DNA, 14 bp, Homo sapiens
tccttccctctctg

SEQ ID NO: 4088631 - DNA, 23 bp, Homo sapiens
tccttccctctctgatgtcccag

SEQ ID NO: 4088632 - DNA, 18 bp, Homo sapiens
tccttcctatgcccaggt

SEQ ID NO: 4088633 - DNA, 18 bp, Homo sapiens
tccttcctcagatgatgt

SEQ ID NO: 4088634 - DNA, 15 bp, Homo sapiens
tccttcctggcctga

SEQ ID NO: 4088635 - DNA, 20 bp, Homo sapiens
tccttcggggcgatgctccc

SEQ ID NO: 4088636 - DNA, 21 bp, Homo sapiens
tccttcggggcgatgctccct

SEQ ID NO: 4088637 - DNA, 23 bp, Homo sapiens
tccttcgtgaacatcccctccca

SEQ ID NO: 4088638 - DNA, 19 bp, Homo sapiens
tccttctaatgaagacaat

SEQ ID NO: 4088639 - DNA, 16 bp, Homo sapiens
ttttgaggcttctgtt

SEQ ID NO: 4088640 - DNA, 14 bp, Homo sapiens
ttttgagtgtgtgt

SEQ ID NO: 4088641 - DNA, 18 bp, Homo sapiens
ttttgagtgtgtgtgtgc

SEQ ID NO: 4088642 - DNA, 13 bp, Homo sapiens
ttttgcaaaattt

SEQ ID NO: 4088643 - DNA, 11 bp, Homo sapiens
tttttcttaaa

SEQ ID NO: 4088644 - DNA, 16 bp, Homo sapiens
tttttcttctgtattt

SEQ ID NO: 4088645 - DNA, 17 bp, Homo sapiens
tttttcttcttttactt

SEQ ID NO: 4088646 - DNA, 13 bp, Homo sapiens
tttttctttataa

SEQ ID NO: 4088647 - DNA, 16 bp, Homo sapiens
tttttctttataaact

SEQ ID NO: 4088648 - DNA, 17 bp, Homo sapiens
tttttctttataaactt

SEQ ID NO: 4088649 - DNA, 13 bp, Homo sapiens
tttttgaaaacat

SEQ ID NO: 4088650 - DNA, 12 bp, Homo sapiens
tttttgaaacag

SEQ ID NO: 4088651 - DNA, 15 bp, Homo sapiens
tttttgaaacagcag

SEQ ID NO: 4088652 - DNA, 21 bp, Homo sapiens
tttttgaaccatccacttaca

SEQ ID NO: 4088653 - DNA, 19 bp, Homo sapiens
tttttgaatttaaataaag

SEQ ID NO: 4088654 - DNA, 12 bp, Homo sapiens
tttttgacactg

SEQ ID NO: 4088655 - DNA, 15 bp, Homo sapiens
tttttgacactgaaa

SEQ ID NO: 4088656 - DNA, 18 bp, Homo sapiens
tttttgacactgaaagtt

SEQ ID NO: 4088657 - DNA, 19 bp, Homo sapiens
tttttgacactgaaagttt

SEQ ID NO: 4088658 - DNA, 16 bp, Homo sapiens
tttttgactcccagat

SEQ ID NO: 4088659 - DNA, 12 bp, Homo sapiens
tttttgactttt

SEQ ID NO: 4088660 - DNA, 16 bp, Homo sapiens
tttttgatcaaaaact

SEQ ID NO: 4088661 - DNA, 9 bp, Homo sapiens
tttttgcag

SEQ ID NO: 4088662 - DNA, 16 bp, Homo sapiens
tttttgcagtaactgt

SEQ ID NO: 4088663 - DNA, 21 bp, Homo sapiens
tttttgccagttttccctgga

SEQ ID NO: 4088664 - DNA, 17 bp, Homo sapiens
tttttgctttctgaaat

SEQ ID NO: 4088665 - DNA, 18 bp, Homo sapiens
tttttgctttctgaaatt

SEQ ID NO: 4088666 - DNA, 24 bp, Homo sapiens
tttttggtaataacaaacgtgttt

SEQ ID NO: 4088667 - DNA, 19 bp, Homo sapiens
tttttggtataatgtttaa

SEQ ID NO: 4088668 - DNA, 11 bp, Homo sapiens
tttttgtacat

SEQ ID NO: 4088669 - DNA, 12 bp, Homo sapiens
tttttgtatctt

SEQ ID NO: 4088670 - DNA, 18 bp, Homo sapiens
tttttgtttgtttttgct

SEQ ID NO: 4088671 - DNA, 12 bp, Homo sapiens
ttttttaagatt

SEQ ID NO: 4088672 - DNA, 17 bp, Homo sapiens
ttttttaagtatttata

SEQ ID NO: 4088673 - DNA, 11 bp, Homo sapiens
ttttttacatt

SEQ ID NO: 4088674 - DNA, 17 bp, Homo sapiens
ttttttactctttgaaa

SEQ ID NO: 4088675 - DNA, 14 bp, Homo sapiens
ttttttacttttgt

SEQ ID NO: 4088676 - DNA, 15 bp, Homo sapiens
ttttttagatcaaat

SEQ ID NO: 4088677 - DNA, 16 bp, Homo sapiens
ttttttagatcaaata

SEQ ID NO: 4088678 - DNA, 15 bp, Homo sapiens
ttttttatgttttgt

SEQ ID NO: 4088679 - DNA, 19 bp, Homo sapiens
ttttttattgctagtattt

SEQ ID NO: 4088680 - DNA, 12 bp, Homo sapiens
ttttttcacttc

SEQ ID NO: 4088681 - DNA, 13 bp, Homo sapiens
ttttttcatttat

SEQ ID NO: 4088682 - DNA, 12 bp, Homo sapiens
ttttttccaaaa

SEQ ID NO: 4088683 - DNA, 14 bp, Homo sapiens
ttttttccaaaatc

SEQ ID NO: 4088684 - DNA, 13 bp, Homo sapiens
ttttttcgtttgt

SEQ ID NO: 4088685 - DNA, 12 bp, Homo sapiens
ttttttctaaga

SEQ ID NO: 4088686 - DNA, 14 bp, Homo sapiens
ttttttcttttgta

SEQ ID NO: 4088687 - DNA, 13 bp, Homo sapiens
ttttttgactaaa

SEQ ID NO: 4088688 - DNA, 10 bp, Homo sapiens
ttttttgcag

SEQ ID NO: 4088689 - DNA, 13 bp, Homo sapiens
ttttttgtatgtg

SEQ ID NO: 4088690 - DNA, 16 bp, Homo sapiens
ttttttgtttgtttct

SEQ ID NO: 4088691 - DNA, 18 bp, Homo sapiens
ttttttgttttacaatgt

SEQ ID NO: 4088692 - DNA, 12 bp, Homo sapiens
tttttttacatt

SEQ ID NO: 4088693 - DNA, 12 bp, Homo sapiens
tttttttccatt

SEQ ID NO: 4088694 - DNA, 11 bp, Homo sapiens
tttttttgcag

SEQ ID NO: 4088695 - DNA, 11 bp, Homo sapiens
tttttttgcca

SEQ ID NO: 4088696 - DNA, 11 bp, Homo sapiens
ttttttttgca

SEQ ID NO: 4088697 - DNA, 13 bp, Homo sapiens
ttttttttttcct

SEQ ID NO: 4088698 - DNA, 13 bp, Homo sapiens
ttttttttttggt

SEQ ID NO: 4088699 - DNA, 12 bp, Homo sapiens
tttctttctagt

SEQ ID NO: 4088700 - DNA, 20 bp, Homo sapiens
tttctttgagttttaaatta

SEQ ID NO: 4088701 - DNA, 15 bp, Homo sapiens
tttctttgcattcca

SEQ ID NO: 4088702 - DNA, 14 bp, Homo sapiens
tttctttgcctctg

SEQ ID NO: 4088703 - DNA, 22 bp, Homo sapiens
tttctttgcctctgcagtctca

SEQ ID NO: 4088704 - DNA, 17 bp, Homo sapiens
tttctttgtgtttgctt

SEQ ID NO: 4088705 - DNA, 16 bp, Homo sapiens
tttcttttctctggta

SEQ ID NO: 4088706 - DNA, 22 bp, Homo sapiens
tttcttttctggaatgtaatca

SEQ ID NO: 4088707 - DNA, 15 bp, Homo sapiens
tttcttttcttttta

SEQ ID NO: 4088708 - DNA, 22 bp, Homo sapiens
tttctttttaaccctaatcttt

SEQ ID NO: 4088709 - DNA, 20 bp, Homo sapiens
ttttattaaagcatttccta

SEQ ID NO: 4088710 - DNA, 22 bp, Homo sapiens
ttttattactctcacccataaa

SEQ ID NO: 4088711 - DNA, 15 bp, Homo sapiens
ttttattatttctat

SEQ ID NO: 4088712 - DNA, 21 bp, Homo sapiens
ttttattcgtcctttgacaaa

SEQ ID NO: 4088713 - DNA, 16 bp, Homo sapiens
ttttattgacacagaa

SEQ ID NO: 4088714 - DNA, 19 bp, Homo sapiens
ttttattgagaattttaaa

SEQ ID NO: 4088715 - DNA, 19 bp, Homo sapiens
ttttattgctagtatttga

SEQ ID NO: 4088716 - DNA, 11 bp, Homo sapiens
ttttattgtgt

SEQ ID NO: 4088717 - DNA, 13 bp, Homo sapiens
ttttatttatcaa

SEQ ID NO: 4088718 - DNA, 15 bp, Homo sapiens
ttttatttatgaagt

SEQ ID NO: 4088719 - DNA, 11 bp, Homo sapiens
ttttattttac

SEQ ID NO: 4088720 - DNA, 12 bp, Homo sapiens
ttttattttgaa

SEQ ID NO: 4088721 - DNA, 14 bp, Homo sapiens
ttttcaaaatggag

SEQ ID NO: 4088722 - DNA, 22 bp, Homo sapiens
ttttcaacgcagccctgctttg

SEQ ID NO: 4088723 - DNA, 15 bp, Homo sapiens
ttttcaactgctttg

SEQ ID NO: 4088724 - DNA, 14 bp, Homo sapiens
ttttcaatatattg

SEQ ID NO: 4088725 - DNA, 22 bp, Homo sapiens
ttttcaatatattgaacttttg

SEQ ID NO: 4088726 - DNA, 14 bp, Homo sapiens
ttttcaatatttat

SEQ ID NO: 4088727 - DNA, 12 bp, Homo sapiens
ttttcacaaaat

SEQ ID NO: 4088728 - DNA, 13 bp, Homo sapiens
ttttcaccccacc

SEQ ID NO: 4088729 - DNA, 23 bp, Homo sapiens
ttttcacctgtttttaagctgtt

SEQ ID NO: 4088730 - DNA, 20 bp, Homo sapiens
ttttcactgctggctgcctt

SEQ ID NO: 4088731 - DNA, 23 bp, Homo sapiens
ttttcacttagaacctttctgtg

SEQ ID NO: 4088732 - DNA, 12 bp, Homo sapiens
ttttcagaagca

SEQ ID NO: 4088733 - DNA, 22 bp, Homo sapiens
ttttcagagtcatttatgagca

SEQ ID NO: 4088734 - DNA, 21 bp, Homo sapiens
ttttcagcacccccacccacc

SEQ ID NO: 4088735 - DNA, 13 bp, Homo sapiens
ttttcagctgagc

SEQ ID NO: 4088736 - DNA, 23 bp, Homo sapiens
ttttcagtagggctacaaaacct

SEQ ID NO: 4088737 - DNA, 12 bp, Homo sapiens
ttttcagttgtt

SEQ ID NO: 4088738 - DNA, 16 bp, Homo sapiens
ttttcagttgtttgtt

SEQ ID NO: 4088739 - DNA, 22 bp, Homo sapiens
ttttcagttgtttgtttttgct

SEQ ID NO: 4088740 - DNA, 17 bp, Homo sapiens
ttttcattaaacttgaa

SEQ ID NO: 4088741 - DNA, 14 bp, Homo sapiens
ttttcattgctgtg

SEQ ID NO: 4088742 - DNA, 20 bp, Homo sapiens
ttttccagggcaatcaatgt

SEQ ID NO: 4088743 - DNA, 12 bp, Homo sapiens
ttttccatcatt

SEQ ID NO: 4088744 - DNA, 19 bp, Homo sapiens
ttttccatcattttacagt

SEQ ID NO: 4088745 - DNA, 20 bp, Homo sapiens
ttttccatcattttacagtg

SEQ ID NO: 4088746 - DNA, 11 bp, Homo sapiens
ttttccatgaa

SEQ ID NO: 4088747 - DNA, 14 bp, Homo sapiens
ttttccatgaaaac

SEQ ID NO: 4088748 - DNA, 12 bp, Homo sapiens
ttttcccacgag

SEQ ID NO: 4088749 - DNA, 23 bp, Homo sapiens
ttttcccagactactattttctt

SEQ ID NO: 4088750 - DNA, 20 bp, Homo sapiens
ttttcccagatacttcccat

SEQ ID NO: 4088751 - DNA, 22 bp, Homo sapiens
ttttcccccagcaacgcccctc

SEQ ID NO: 4088752 - DNA, 19 bp, Homo sapiens
ttttccccccactctcccc

SEQ ID NO: 4088753 - DNA, 16 bp, Homo sapiens
ttttccccctttgtgc

SEQ ID NO: 4088754 - DNA, 15 bp, Homo sapiens
ttttcccctttcctg

SEQ ID NO: 4088755 - DNA, 17 bp, Homo sapiens
ttttcccctttcctgtc

SEQ ID NO: 4088756 - DNA, 14 bp, Homo sapiens
ttttccctggaact

SEQ ID NO: 4088757 - DNA, 14 bp, Homo sapiens
ttttcctaaatgca

SEQ ID NO: 4088758 - DNA, 18 bp, Homo sapiens
ttttcctaagtgtttact

SEQ ID NO: 4088759 - DNA, 21 bp, Homo sapiens
ttttcctcccttgggttctga

SEQ ID NO: 4088760 - DNA, 13 bp, Homo sapiens
ttttcctcctctg

SEQ ID NO: 4088761 - DNA, 15 bp, Homo sapiens
ttttcctcctctgcc

SEQ ID NO: 4088762 - DNA, 18 bp, Homo sapiens
ttttcctcgcttctttca

SEQ ID NO: 4088763 - DNA, 21 bp, Homo sapiens
ttttcctcgcttctttcaagg

SEQ ID NO: 4088764 - DNA, 11 bp, Homo sapiens
ttttcctctgg

SEQ ID NO: 4088765 - DNA, 14 bp, Homo sapiens
ttttcctgttcata

SEQ ID NO: 4088766 - DNA, 16 bp, Homo sapiens
ttttccttatttgcct

SEQ ID NO: 4088767 - DNA, 12 bp, Homo sapiens
ttttcctttaaa

SEQ ID NO: 4088768 - DNA, 21 bp, Homo sapiens
ttttcctttaaaaaaatttaa

SEQ ID NO: 4088769 - DNA, 13 bp, Homo sapiens
ttttcctttgtgc

SEQ ID NO: 4088770 - DNA, 21 bp, Homo sapiens
ttttcggaggccccactgatg

SEQ ID NO: 4088771 - DNA, 16 bp, Homo sapiens
ttttcgttaacattga

SEQ ID NO: 4088772 - DNA, 19 bp, Homo sapiens
ttttctaagcaatttcttg

SEQ ID NO: 4088773 - DNA, 18 bp, Homo sapiens
ttttctacagtggtttta

SEQ ID NO: 4088774 - DNA, 23 bp, Homo sapiens
ttttctattatggaaaactgtgt

SEQ ID NO: 4088775 - DNA, 15 bp, Homo sapiens
ttttctcaaagtttt

SEQ ID NO: 4088776 - DNA, 20 bp, Homo sapiens
ttttctcaaagttttgaaaa

SEQ ID NO: 4088777 - DNA, 20 bp, Homo sapiens
ttttctcccaagaaacctga

SEQ ID NO: 4088778 - DNA, 14 bp, Homo sapiens
ttttctcggtgggg

SEQ ID NO: 4088779 - DNA, 12 bp, Homo sapiens
ttttctctcttt

SEQ ID NO: 4088780 - DNA, 14 bp, Homo sapiens
ttttctctttgtgg

SEQ ID NO: 4088781 - DNA, 20 bp, Homo sapiens
ttttctgacatgcattgttg

SEQ ID NO: 4088782 - DNA, 17 bp, Homo sapiens
ttttctgattagctttg

SEQ ID NO: 4088783 - DNA, 16 bp, Homo sapiens
ttttctgccctggctg

SEQ ID NO: 4088784 - DNA, 16 bp, Homo sapiens
ttttctgtagtcattt

SEQ ID NO: 4088785 - DNA, 12 bp, Homo sapiens
ttttctgtattt

SEQ ID NO: 4088786 - DNA, 14 bp, Homo sapiens
ttttctgtcctggg

SEQ ID NO: 4088787 - DNA, 23 bp, Homo sapiens
ttttctgttgaagtttacaatca

SEQ ID NO: 4088788 - DNA, 15 bp, Homo sapiens
ttttctgtttgtaaa

SEQ ID NO: 4088789 - DNA, 21 bp, Homo sapiens
ttttcttcaacatcaatgttc

SEQ ID NO: 4088790 - DNA, 15 bp, Homo sapiens
ttttcttcttttact

SEQ ID NO: 4088791 - DNA, 19 bp, Homo sapiens
ttttcttggcaaaagcctt

SEQ ID NO: 4088792 - DNA, 24 bp, Homo sapiens
ttttcttggcaaaagccttgtgta

SEQ ID NO: 4088793 - DNA, 18 bp, Homo sapiens
ttttctttaaagaagttg

SEQ ID NO: 4088794 - DNA, 16 bp, Homo sapiens
ttttctttaatgcttt

SEQ ID NO: 4088795 - DNA, 13 bp, Homo sapiens
ttttcttttgtaa

SEQ ID NO: 4088796 - DNA, 22 bp, Homo sapiens
ttttgaaatattaaaccctgga

SEQ ID NO: 4088797 - DNA, 18 bp, Homo sapiens
ttttgaagaatatttaag

SEQ ID NO: 4088798 - DNA, 11 bp, Homo sapiens
ttttgaagttt

SEQ ID NO: 4088799 - DNA, 16 bp, Homo sapiens
ttttgaagtttacatt

SEQ ID NO: 4088800 - DNA, 15 bp, Homo sapiens
ttttgaatttaaata

SEQ ID NO: 4088801 - DNA, 19 bp, Homo sapiens
ttttgaatttaaataaagt

SEQ ID NO: 4088802 - DNA, 12 bp, Homo sapiens
ttttgacactga

SEQ ID NO: 4088803 - DNA, 14 bp, Homo sapiens
ttttgacactgaaa

SEQ ID NO: 4088804 - DNA, 15 bp, Homo sapiens
ttttgacggatgatt

SEQ ID NO: 4088805 - DNA, 19 bp, Homo sapiens
ttttgactaaagctatgtt

SEQ ID NO: 4088806 - DNA, 13 bp, Homo sapiens
ttttgagaaactg

SEQ ID NO: 4088807 - DNA, 17 bp, Homo sapiens
ttttgagacagaatctc

SEQ ID NO: 4088808 - DNA, 18 bp, Homo sapiens
tgtttaatttttatttct

SEQ ID NO: 4088809 - DNA, 19 bp, Homo sapiens
tgtttacactctttgtaag

SEQ ID NO: 4088810 - DNA, 12 bp, Homo sapiens
tgtttacatatc

SEQ ID NO: 4088811 - DNA, 22 bp, Homo sapiens
tgtttacatgtgtagcctatgt

SEQ ID NO: 4088812 - DNA, 12 bp, Homo sapiens
tgtttactgaaa

SEQ ID NO: 4088813 - DNA, 17 bp, Homo sapiens
tgtttagcagcagcctt

SEQ ID NO: 4088814 - DNA, 22 bp, Homo sapiens
tgtttagcagcagcctttaatg

SEQ ID NO: 4088815 - DNA, 14 bp, Homo sapiens
tgtttagttgcaga

SEQ ID NO: 4088816 - DNA, 14 bp, Homo sapiens
tgtttataatctga

SEQ ID NO: 4088817 - DNA, 16 bp, Homo sapiens
tgtttatcagatacat

SEQ ID NO: 4088818 - DNA, 17 bp, Homo sapiens
tgtttatcagatacatc

SEQ ID NO: 4088819 - DNA, 14 bp, Homo sapiens
tgtttatgagccag

SEQ ID NO: 4088820 - DNA, 23 bp, Homo sapiens
tgtttatgatatttcttgctttc

SEQ ID NO: 4088821 - DNA, 22 bp, Homo sapiens
tgtttatggcaatttaacatgt

SEQ ID NO: 4088822 - DNA, 15 bp, Homo sapiens
tgtttatggcctcag

SEQ ID NO: 4088823 - DNA, 24 bp, Homo sapiens
tgtttatggcctcagctgcctcac

SEQ ID NO: 4088824 - DNA, 22 bp, Homo sapiens
tgtttatgttcttatagaataa

SEQ ID NO: 4088825 - DNA, 13 bp, Homo sapiens
tgtttattaacaa

SEQ ID NO: 4088826 - DNA, 16 bp, Homo sapiens
tgtttattaacaaatt

SEQ ID NO: 4088827 - DNA, 12 bp, Homo sapiens
tgtttattgcaa

SEQ ID NO: 4088828 - DNA, 23 bp, Homo sapiens
tgtttatttataagcagatttaa

SEQ ID NO: 4088829 - DNA, 14 bp, Homo sapiens
tgtttatttctgtt

SEQ ID NO: 4088830 - DNA, 19 bp, Homo sapiens
tgtttcaagaacctggaaa

SEQ ID NO: 4088831 - DNA, 22 bp, Homo sapiens
tgtttcaagttcacacctgcag

SEQ ID NO: 4088832 - DNA, 23 bp, Homo sapiens
tgtttcacaccggaaggttttta

SEQ ID NO: 4088833 - DNA, 17 bp, Homo sapiens
tgtttcagctaagggaa

SEQ ID NO: 4088834 - DNA, 21 bp, Homo sapiens
tgtttcagctaagggaagaca

SEQ ID NO: 4088835 - DNA, 20 bp, Homo sapiens
tgtttccagacttccttgag

SEQ ID NO: 4088836 - DNA, 23 bp, Homo sapiens
tgtttccagacttccttgagaca

SEQ ID NO: 4088837 - DNA, 18 bp, Homo sapiens
tgtttccagcagaagaca

SEQ ID NO: 4088838 - DNA, 15 bp, Homo sapiens
tgtttcctcttccaa

SEQ ID NO: 4088839 - DNA, 23 bp, Homo sapiens
tgtttccttgaggggagccagga

SEQ ID NO: 4088840 - DNA, 22 bp, Homo sapiens
tgtttccttgttggtcagagga

SEQ ID NO: 4088841 - DNA, 19 bp, Homo sapiens
tgtttctagctaaataaat

SEQ ID NO: 4088842 - DNA, 21 bp, Homo sapiens
tgtttctagctaaataaatgg

SEQ ID NO: 4088843 - DNA, 15 bp, Homo sapiens
tgtttctcaaatctt

SEQ ID NO: 4088844 - DNA, 15 bp, Homo sapiens
tgtttctcccgtgct

SEQ ID NO: 4088845 - DNA, 12 bp, Homo sapiens
tgtttctcctta

SEQ ID NO: 4088846 - DNA, 13 bp, Homo sapiens
tgtttctctgctg

SEQ ID NO: 4088847 - DNA, 16 bp, Homo sapiens
tgtttctgacccactg

SEQ ID NO: 4088848 - DNA, 17 bp, Homo sapiens
tgtttctgacccactga

SEQ ID NO: 4088849 - DNA, 14 bp, Homo sapiens
tgtttctgcatagc

SEQ ID NO: 4088850 - DNA, 13 bp, Homo sapiens
tgtttctttctag

SEQ ID NO: 4088851 - DNA, 14 bp, Homo sapiens
tgtttctttgtgtt

SEQ ID NO: 4088852 - DNA, 19 bp, Homo sapiens
tgtttgaaaacttcagaag

SEQ ID NO: 4088853 - DNA, 13 bp, Homo sapiens
tgtttgaaagtag

SEQ ID NO: 4088854 - DNA, 16 bp, Homo sapiens
tgtttgaaatcatcgg

SEQ ID NO: 4088855 - DNA, 19 bp, Homo sapiens
tgtttgaatatggacaaga

SEQ ID NO: 4088856 - DNA, 13 bp, Homo sapiens
tgtttgctgctat

SEQ ID NO: 4088857 - DNA, 17 bp, Homo sapiens
tgtttgcttaaacaaag

SEQ ID NO: 4088858 - DNA, 16 bp, Homo sapiens
tgtttgcttattgttc

SEQ ID NO: 4088859 - DNA, 21 bp, Homo sapiens
tgtttgcttggtgctggttta

SEQ ID NO: 4088860 - DNA, 15 bp, Homo sapiens
tgtttggacagctga

SEQ ID NO: 4088861 - DNA, 17 bp, Homo sapiens
tgtttggatgtaattta

SEQ ID NO: 4088862 - DNA, 15 bp, Homo sapiens
tgtttggcaaggaaa

SEQ ID NO: 4088863 - DNA, 20 bp, Homo sapiens
tgtttggcttataaacacat

SEQ ID NO: 4088864 - DNA, 16 bp, Homo sapiens
tgtttgggcagaaggg

SEQ ID NO: 4088865 - DNA, 15 bp, Homo sapiens
tgtttgggtatcctg

SEQ ID NO: 4088866 - DNA, 16 bp, Homo sapiens
tgtttggtttacattt

SEQ ID NO: 4088867 - DNA, 15 bp, Homo sapiens
tgtttgtaaataaga

SEQ ID NO: 4088868 - DNA, 21 bp, Homo sapiens
tgtttgtaaataagagatttg

SEQ ID NO: 4088869 - DNA, 16 bp, Homo sapiens
tgtttgtcagatatga

SEQ ID NO: 4088870 - DNA, 19 bp, Homo sapiens
ttaagctgcaaatctgatg

SEQ ID NO: 4088871 - DNA, 17 bp, Homo sapiens
ttaaggacttctgcagc

SEQ ID NO: 4088872 - DNA, 15 bp, Homo sapiens
ttaaggcctgaatca

SEQ ID NO: 4088873 - DNA, 22 bp, Homo sapiens
ttaaggggggcagggagtgatg

SEQ ID NO: 4088874 - DNA, 23 bp, Homo sapiens
ttaaggtcaaactaattctcaca

SEQ ID NO: 4088875 - DNA, 16 bp, Homo sapiens
ttaagtaacttaagga

SEQ ID NO: 4088876 - DNA, 16 bp, Homo sapiens
ttaagtagaacaaaaa

SEQ ID NO: 4088877 - DNA, 19 bp, Homo sapiens
ttaagtagaacaaaaaacc

SEQ ID NO: 4088878 - DNA, 17 bp, Homo sapiens
ttaagtagtttctccaa

SEQ ID NO: 4088879 - DNA, 19 bp, Homo sapiens
ttaagtgcgtgtgtagagt

SEQ ID NO: 4088880 - DNA, 19 bp, Homo sapiens
ttaagtttgcagatttatt

SEQ ID NO: 4088881 - DNA, 19 bp, Homo sapiens
ttaataaactactctttga

SEQ ID NO: 4088882 - DNA, 16 bp, Homo sapiens
ttaataaagaaatatt

SEQ ID NO: 4088883 - DNA, 22 bp, Homo sapiens
ttaataaagaaatatttaccta

SEQ ID NO: 4088884 - DNA, 21 bp, Homo sapiens
ttaataaagaattaacagaga

SEQ ID NO: 4088885 - DNA, 21 bp, Homo sapiens
ttaataaaggtcttaaataat

SEQ ID NO: 4088886 - DNA, 17 bp, Homo sapiens
ttaataacattacctta

SEQ ID NO: 4088887 - DNA, 24 bp, Homo sapiens
ttaataatcagcaagaatttgatc

SEQ ID NO: 4088888 - DNA, 13 bp, Homo sapiens
ttaataatgtatt

SEQ ID NO: 4088889 - DNA, 22 bp, Homo sapiens
ttaatacagtttatttttaaag

SEQ ID NO: 4088890 - DNA, 15 bp, Homo sapiens
ttaatactaccttga

SEQ ID NO: 4088891 - DNA, 14 bp, Homo sapiens
ttaatagcagcctt

SEQ ID NO: 4088892 - DNA, 22 bp, Homo sapiens
ttaatagcagcctttctctctt

SEQ ID NO: 4088893 - DNA, 23 bp, Homo sapiens
ttaatagtcatcacatttctatg

SEQ ID NO: 4088894 - DNA, 14 bp, Homo sapiens
ttaatagtgctttt

SEQ ID NO: 4088895 - DNA, 16 bp, Homo sapiens
ttaatagtttgtctat

SEQ ID NO: 4088896 - DNA, 12 bp, Homo sapiens
ttaatatgaaaa

SEQ ID NO: 4088897 - DNA, 15 bp, Homo sapiens
ttaatatgaaaactt

SEQ ID NO: 4088898 - DNA, 12 bp, Homo sapiens
ttaatatgagtt

SEQ ID NO: 4088899 - DNA, 20 bp, Homo sapiens
ttaatatgcttaaaataagc

SEQ ID NO: 4088900 - DNA, 21 bp, Homo sapiens
ttaatattcttttgtttccat

SEQ ID NO: 4088901 - DNA, 12 bp, Homo sapiens
ttaatatttaaa

SEQ ID NO: 4088902 - DNA, 15 bp, Homo sapiens
ttaatatttaaacag

SEQ ID NO: 4088903 - DNA, 17 bp, Homo sapiens
ttaatatttaaacagca

SEQ ID NO: 4088904 - DNA, 12 bp, Homo sapiens
ttaatatttcct

SEQ ID NO: 4088905 - DNA, 14 bp, Homo sapiens
ttaatcaaaggcat

SEQ ID NO: 4088906 - DNA, 18 bp, Homo sapiens
ttaatcaaaggcatatct

SEQ ID NO: 4088907 - DNA, 14 bp, Homo sapiens
ttaatcaagttgaa

SEQ ID NO: 4088908 - DNA, 20 bp, Homo sapiens
ttaatcacaaatttcactta

SEQ ID NO: 4088909 - DNA, 13 bp, Homo sapiens
ttaatcagtgaag

SEQ ID NO: 4088910 - DNA, 18 bp, Homo sapiens
ttaatcctgtaccaaatc

SEQ ID NO: 4088911 - DNA, 15 bp, Homo sapiens
ttaatctgaaattct

SEQ ID NO: 4088912 - DNA, 22 bp, Homo sapiens
ttaatctggtttatttttgttc

SEQ ID NO: 4088913 - DNA, 20 bp, Homo sapiens
ttaatctgtgtgtatattga

SEQ ID NO: 4088914 - DNA, 17 bp, Homo sapiens
ttaatcttcagttttat

SEQ ID NO: 4088915 - DNA, 18 bp, Homo sapiens
ttaatgaaagactgtaca

SEQ ID NO: 4088916 - DNA, 15 bp, Homo sapiens
ttaatgacattcccc

SEQ ID NO: 4088917 - DNA, 16 bp, Homo sapiens
ttaatgataagtaaat

SEQ ID NO: 4088918 - DNA, 18 bp, Homo sapiens
ttaatgcttttatatttt

SEQ ID NO: 4088919 - DNA, 16 bp, Homo sapiens
ttaatggcctggaggg

SEQ ID NO: 4088920 - DNA, 18 bp, Homo sapiens
ttaatgtgaagacatttt

SEQ ID NO: 4088921 - DNA, 17 bp, Homo sapiens
ttaattaaatgtattta

SEQ ID NO: 4088922 - DNA, 13 bp, Homo sapiens
ttaattaatttga

SEQ ID NO: 4088923 - DNA, 20 bp, Homo sapiens
ttaattaatttgattaacaa

SEQ ID NO: 4088924 - DNA, 22 bp, Homo sapiens
ttaattactggaattcttctgc

SEQ ID NO: 4088925 - DNA, 23 bp, Homo sapiens
ttaattataggagccttaatttt

SEQ ID NO: 4088926 - DNA, 14 bp, Homo sapiens
ttaattattattct

SEQ ID NO: 4088927 - DNA, 14 bp, Homo sapiens
ttaattattatttg

SEQ ID NO: 4088928 - DNA, 21 bp, Homo sapiens
ttaattattatttgtgtttta

SEQ ID NO: 4088929 - DNA, 21 bp, Homo sapiens
ttaattcacagaatagcacaa

SEQ ID NO: 4088930 - DNA, 15 bp, Homo sapiens
ttaattcatgaggag

SEQ ID NO: 4088931 - DNA, 16 bp, Homo sapiens
ttaattcctttctcat

SEQ ID NO: 4088932 - DNA, 13 bp, Homo sapiens
ttaattctcattt

SEQ ID NO: 4088933 - DNA, 21 bp, Homo sapiens
ttaattcttcacctgttatgt

SEQ ID NO: 4088934 - DNA, 16 bp, Homo sapiens
ttaattgatcagtttt

SEQ ID NO: 4088935 - DNA, 14 bp, Homo sapiens
ttaattgtaatctg

SEQ ID NO: 4088936 - DNA, 20 bp, Homo sapiens
ttaattgttgtttctttcta

SEQ ID NO: 4088937 - DNA, 18 bp, Homo sapiens
ttaatttaaacacctcct

SEQ ID NO: 4088938 - DNA, 12 bp, Homo sapiens
ttaatttaacaa

SEQ ID NO: 4088939 - DNA, 19 bp, Homo sapiens
ttaatttaacaaactaaaa

SEQ ID NO: 4088940 - DNA, 17 bp, Homo sapiens
ttaatttatctaaatta

SEQ ID NO: 4088941 - DNA, 20 bp, Homo sapiens
ttaatttatgagtttttgat

SEQ ID NO: 4088942 - DNA, 11 bp, Homo sapiens
ttaatttccag

SEQ ID NO: 4088943 - DNA, 12 bp, Homo sapiens
ttaatttccttt

SEQ ID NO: 4088944 - DNA, 14 bp, Homo sapiens
ttaatttgattaac

SEQ ID NO: 4088945 - DNA, 19 bp, Homo sapiens
ttaatttgattaacaaata

SEQ ID NO: 4088946 - DNA, 13 bp, Homo sapiens
ttaattttaccaa

SEQ ID NO: 4088947 - DNA, 14 bp, Homo sapiens
ttaattttcacaaa

SEQ ID NO: 4088948 - DNA, 15 bp, Homo sapiens
ttaattttcacaaaa

SEQ ID NO: 4088949 - DNA, 18 bp, Homo sapiens
ttaattttcacaaaatgt

SEQ ID NO: 4088950 - DNA, 21 bp, Homo sapiens
ttaattttcacaaaatgtctc

SEQ ID NO: 4088951 - DNA, 14 bp, Homo sapiens
ttaatttttaattg

SEQ ID NO: 4088952 - DNA, 13 bp, Homo sapiens
ttaatttttccta

SEQ ID NO: 4088953 - DNA, 22 bp, Homo sapiens
ttacaaaaacaaaataaaataa

SEQ ID NO: 4088954 - DNA, 17 bp, Homo sapiens
ttacaaaactacatgag

SEQ ID NO: 4088955 - DNA, 14 bp, Homo sapiens
ttacaaaagatgta

SEQ ID NO: 4088956 - DNA, 21 bp, Homo sapiens
ttacaaactgcaatagagact

SEQ ID NO: 4088957 - DNA, 22 bp, Homo sapiens
ttacaaactgcaatagagactg

SEQ ID NO: 4088958 - DNA, 18 bp, Homo sapiens
ttacaagaagtttattct

SEQ ID NO: 4088959 - DNA, 20 bp, Homo sapiens
ttacaagaagtttattctca

SEQ ID NO: 4088960 - DNA, 21 bp, Homo sapiens
ttacaagaagtttattctcat

SEQ ID NO: 4088961 - DNA, 21 bp, Homo sapiens
ttacaagatccatttgccttt

SEQ ID NO: 4088962 - DNA, 13 bp, Homo sapiens
ttacaagcaggca

SEQ ID NO: 4088963 - DNA, 17 bp, Homo sapiens
ttacaagtatacttata

SEQ ID NO: 4088964 - DNA, 23 bp, Homo sapiens
ttacaatcattgctgaaaatggt

SEQ ID NO: 4088965 - DNA, 19 bp, Homo sapiens
ttacaatttgttcatccta

SEQ ID NO: 4088966 - DNA, 18 bp, Homo sapiens
ttacacagaaatgctgct

SEQ ID NO: 4088967 - DNA, 16 bp, Homo sapiens
ttacacattagatttt

SEQ ID NO: 4088968 - DNA, 18 bp, Homo sapiens
ttacacgatcacctgcat

SEQ ID NO: 4088969 - DNA, 15 bp, Homo sapiens
ttacactctttgtaa

SEQ ID NO: 4088970 - DNA, 14 bp, Homo sapiens
ttacactgccatct

SEQ ID NO: 4088971 - DNA, 16 bp, Homo sapiens
ttacagaaatactata

SEQ ID NO: 4088972 - DNA, 15 bp, Homo sapiens
ttacagaaatggact

SEQ ID NO: 4088973 - DNA, 19 bp, Homo sapiens
ttacagattgcctccttat

SEQ ID NO: 4088974 - DNA, 15 bp, Homo sapiens
ttacagcgagaggca

SEQ ID NO: 4088975 - DNA, 24 bp, Homo sapiens
ttacaggcaccgagaatgttgtat

SEQ ID NO: 4088976 - DNA, 17 bp, Homo sapiens
ttacaggccctgctcct

SEQ ID NO: 4088977 - DNA, 15 bp, Homo sapiens
ttacagggaagtggt

SEQ ID NO: 4088978 - DNA, 22 bp, Homo sapiens
ttacagggtaactgtgctgaat

SEQ ID NO: 4088979 - DNA, 21 bp, Homo sapiens
ttacagtgaccttttcttcat

SEQ ID NO: 4088980 - DNA, 18 bp, Homo sapiens
ttacagtgcagacaggcc

SEQ ID NO: 4088981 - DNA, 21 bp, Homo sapiens
ttacagttagggttttgcaat

SEQ ID NO: 4088982 - DNA, 16 bp, Homo sapiens
ttacataggtatatat

SEQ ID NO: 4088983 - DNA, 22 bp, Homo sapiens
ttacatagttttaaactcattt

SEQ ID NO: 4088984 - DNA, 22 bp, Homo sapiens
ttacatatcacctcatggccta

SEQ ID NO: 4088985 - DNA, 15 bp, Homo sapiens
ttacatcttctgtga

SEQ ID NO: 4088986 - DNA, 20 bp, Homo sapiens
ttacatgcataaaagggtca

SEQ ID NO: 4088987 - DNA, 16 bp, Homo sapiens
ttacatgctgtatatg

SEQ ID NO: 4088988 - DNA, 13 bp, Homo sapiens
ttacattgttcaa

SEQ ID NO: 4088989 - DNA, 20 bp, Homo sapiens
ttacatttctatcagtactt

SEQ ID NO: 4088990 - DNA, 21 bp, Homo sapiens
ttacatttctatcagtacttt

SEQ ID NO: 4088991 - DNA, 12 bp, Homo sapiens
ttacattttcag

SEQ ID NO: 4088992 - DNA, 16 bp, Homo sapiens
ttacatttttacaata

SEQ ID NO: 4088993 - DNA, 13 bp, Homo sapiens
ttacatttttatt

SEQ ID NO: 4088994 - DNA, 17 bp, Homo sapiens
ttacatttttatttatg

SEQ ID NO: 4088995 - DNA, 21 bp, Homo sapiens
ttacatttttatttatgaagt

SEQ ID NO: 4088996 - DNA, 17 bp, Homo sapiens
ttaccaagagtaacttt

SEQ ID NO: 4088997 - DNA, 13 bp, Homo sapiens
ttaccactggtaa

SEQ ID NO: 4088998 - DNA, 21 bp, Homo sapiens
ttaccactggtaacatgtgac

SEQ ID NO: 4088999 - DNA, 19 bp, Homo sapiens
ttaccagggactatctttg

SEQ ID NO: 4089000 - DNA, 20 bp, Homo sapiens
ttaccagggactatctttgc

SEQ ID NO: 4089001 - DNA, 18 bp, Homo sapiens
ttaccagttaattactca

SEQ ID NO: 4089002 - DNA, 13 bp, Homo sapiens
ttaccatttgtaa

SEQ ID NO: 4089003 - DNA, 16 bp, Homo sapiens
ttaccatttttctgga

SEQ ID NO: 4089004 - DNA, 17 bp, Homo sapiens
ttacccacccgacctgg

SEQ ID NO: 4089005 - DNA, 20 bp, Homo sapiens
ttacccacccgacctggctg

SEQ ID NO: 4089006 - DNA, 21 bp, Homo sapiens
ttacccacccgacctggctgc

SEQ ID NO: 4089007 - DNA, 12 bp, Homo sapiens
ttaccctaatgt

SEQ ID NO: 4089008 - DNA, 22 bp, Homo sapiens
ttaccctcaggcataggcctgg

SEQ ID NO: 4089009 - DNA, 23 bp, Homo sapiens
ttaccctgtacatatgtaaacat

SEQ ID NO: 4089010 - DNA, 16 bp, Homo sapiens
ttacccttttccccct

SEQ ID NO: 4089011 - DNA, 18 bp, Homo sapiens
ttacctaagtgacatttg

SEQ ID NO: 4089012 - DNA, 16 bp, Homo sapiens
ttacctaccacagtgt

SEQ ID NO: 4089013 - DNA, 15 bp, Homo sapiens
ttacctccaacagaa

SEQ ID NO: 4089014 - DNA, 19 bp, Homo sapiens
ttacctccaacagaactaa

SEQ ID NO: 4089015 - DNA, 22 bp, Homo sapiens
ttacctccaacagaactaaatg

SEQ ID NO: 4089016 - DNA, 14 bp, Homo sapiens
ttacctccatccat

SEQ ID NO: 4089017 - DNA, 18 bp, Homo sapiens
tgttatgactatgtaaac

SEQ ID NO: 4089018 - DNA, 18 bp, Homo sapiens
tgttatgatattgtttaa

SEQ ID NO: 4089019 - DNA, 17 bp, Homo sapiens
tgttatgtatgaaggaa

SEQ ID NO: 4089020 - DNA, 21 bp, Homo sapiens
tgttatgtctgtttaagaaaa

SEQ ID NO: 4089021 - DNA, 15 bp, Homo sapiens
tgttattccatcaat

SEQ ID NO: 4089022 - DNA, 19 bp, Homo sapiens
tgttattccatcaataaat

SEQ ID NO: 4089023 - DNA, 22 bp, Homo sapiens
tgttattccatcaataaatgct

SEQ ID NO: 4089024 - DNA, 23 bp, Homo sapiens
tgttattcctagtggatgactgt

SEQ ID NO: 4089025 - DNA, 16 bp, Homo sapiens
tgttattgttgaacat

SEQ ID NO: 4089026 - DNA, 16 bp, Homo sapiens
tgttattgttttgtta

SEQ ID NO: 4089027 - DNA, 15 bp, Homo sapiens
tgttatttcttccct

SEQ ID NO: 4089028 - DNA, 17 bp, Homo sapiens
tgttattttgtgtacaa

SEQ ID NO: 4089029 - DNA, 18 bp, Homo sapiens
tgttatttttcaaggaag

SEQ ID NO: 4089030 - DNA, 19 bp, Homo sapiens
tgttatttttcaaggaagg

SEQ ID NO: 4089031 - DNA, 16 bp, Homo sapiens
tgttatttttgtttct

SEQ ID NO: 4089032 - DNA, 18 bp, Homo sapiens
tgttattttttaattatt

SEQ ID NO: 4089033 - DNA, 15 bp, Homo sapiens
tgttcaaatgcattt

SEQ ID NO: 4089034 - DNA, 17 bp, Homo sapiens
tgttcacagaaaaagca

SEQ ID NO: 4089035 - DNA, 16 bp, Homo sapiens
tgttcacgctcaccca

SEQ ID NO: 4089036 - DNA, 13 bp, Homo sapiens
tgttcagcactgt

SEQ ID NO: 4089037 - DNA, 17 bp, Homo sapiens
tgttcagcactgtccct

SEQ ID NO: 4089038 - DNA, 12 bp, Homo sapiens
tgttcagtgtta

SEQ ID NO: 4089039 - DNA, 15 bp, Homo sapiens
tgttcatgtgcctct

SEQ ID NO: 4089040 - DNA, 12 bp, Homo sapiens
tgttcattgtaa

SEQ ID NO: 4089041 - DNA, 13 bp, Homo sapiens
tgttcattgtaat

SEQ ID NO: 4089042 - DNA, 16 bp, Homo sapiens
tgttcattgtaatgtt

SEQ ID NO: 4089043 - DNA, 23 bp, Homo sapiens
tgttcattgtaatgttactgatc

SEQ ID NO: 4089044 - DNA, 16 bp, Homo sapiens
tgttccaaagccagtg

SEQ ID NO: 4089045 - DNA, 17 bp, Homo sapiens
tgttccaaattcagttt

SEQ ID NO: 4089046 - DNA, 17 bp, Homo sapiens
tgttcccagaggcaggc

SEQ ID NO: 4089047 - DNA, 13 bp, Homo sapiens
tgttccccatctg

SEQ ID NO: 4089048 - DNA, 14 bp, Homo sapiens
tgttcccctcactg

SEQ ID NO: 4089049 - DNA, 19 bp, Homo sapiens
tgttccctctgctcctgga

SEQ ID NO: 4089050 - DNA, 18 bp, Homo sapiens
tgttcctccctcccacac

SEQ ID NO: 4089051 - DNA, 13 bp, Homo sapiens
tgttcctggctga

SEQ ID NO: 4089052 - DNA, 20 bp, Homo sapiens
tgttcctttttaaatgtgaa

SEQ ID NO: 4089053 - DNA, 21 bp, Homo sapiens
tgttcctttttaaatgtgaat

SEQ ID NO: 4089054 - DNA, 21 bp, Homo sapiens
tgttctagttttttacttttg

SEQ ID NO: 4089055 - DNA, 22 bp, Homo sapiens
tgttctattaatcacctctctg

SEQ ID NO: 4089056 - DNA, 13 bp, Homo sapiens
tgttctcacacca

SEQ ID NO: 4089057 - DNA, 22 bp, Homo sapiens
tgttctcacaccaacagtgtga

SEQ ID NO: 4089058 - DNA, 16 bp, Homo sapiens
tgttctcaggacagca

SEQ ID NO: 4089059 - DNA, 18 bp, Homo sapiens
tgttctccaggcttcaca

SEQ ID NO: 4089060 - DNA, 16 bp, Homo sapiens
tgttctccattttcaa

SEQ ID NO: 4089061 - DNA, 18 bp, Homo sapiens
tgttctcctcgtccatca

SEQ ID NO: 4089062 - DNA, 15 bp, Homo sapiens
tgttctcttcttcat

SEQ ID NO: 4089063 - DNA, 23 bp, Homo sapiens
tgttctcttgggaactgaactca

SEQ ID NO: 4089064 - DNA, 17 bp, Homo sapiens
tgttctgacattaacag

SEQ ID NO: 4089065 - DNA, 22 bp, Homo sapiens
tgttctgacattaacagttttc

SEQ ID NO: 4089066 - DNA, 15 bp, Homo sapiens
tgttctgaccctgct

SEQ ID NO: 4089067 - DNA, 19 bp, Homo sapiens
tgttctgactttttgtttc

SEQ ID NO: 4089068 - DNA, 19 bp, Homo sapiens
tgttctgattagaaatgac

SEQ ID NO: 4089069 - DNA, 22 bp, Homo sapiens
tgttctgattagaaatgaccaa

SEQ ID NO: 4089070 - DNA, 13 bp, Homo sapiens
tgttctgctcctg

SEQ ID NO: 4089071 - DNA, 14 bp, Homo sapiens
tgttctgctcctgc

SEQ ID NO: 4089072 - DNA, 23 bp, Homo sapiens
tgttctgctcctgcttttctgtc

SEQ ID NO: 4089073 - DNA, 13 bp, Homo sapiens
tgttctggaggaa

SEQ ID NO: 4089074 - DNA, 15 bp, Homo sapiens
tgttctgggctcttt

SEQ ID NO: 4089075 - DNA, 18 bp, Homo sapiens
tgttcttagtttgcagtt

SEQ ID NO: 4089076 - DNA, 16 bp, Homo sapiens
tgttcttatagaataa

SEQ ID NO: 4089077 - DNA, 17 bp, Homo sapiens
tgttcttatagaataaa

SEQ ID NO: 4089078 - DNA, 10 bp, Homo sapiens
tgttcttcca

SEQ ID NO: 4089079 - DNA, 16 bp, Homo sapiens
tgttcttccaaagcag

SEQ ID NO: 4089080 - DNA, 17 bp, Homo sapiens
tgttcttccaaagcaga

SEQ ID NO: 4089081 - DNA, 20 bp, Homo sapiens
tgttcttccaaagcagagag

SEQ ID NO: 4089082 - DNA, 11 bp, Homo sapiens
tgttcttccag

SEQ ID NO: 4089083 - DNA, 13 bp, Homo sapiens
tgttcttccagtt

SEQ ID NO: 4089084 - DNA, 21 bp, Homo sapiens
tgttcttccagttactttcca

SEQ ID NO: 4089085 - DNA, 22 bp, Homo sapiens
tgttcttccagttactttccaa

SEQ ID NO: 4089086 - DNA, 12 bp, Homo sapiens
tgttcttcctgg

SEQ ID NO: 4089087 - DNA, 13 bp, Homo sapiens
tgttcttcttggg

SEQ ID NO: 4089088 - DNA, 14 bp, Homo sapiens
tgttctttcctgcc

SEQ ID NO: 4089089 - DNA, 23 bp, Homo sapiens
tgttgaaaaaaaagtttcagaga

SEQ ID NO: 4089090 - DNA, 11 bp, Homo sapiens
tgttgaaagat

SEQ ID NO: 4089091 - DNA, 23 bp, Homo sapiens
tgttgaaaggttttttttcagtt

SEQ ID NO: 4089092 - DNA, 14 bp, Homo sapiens
tgttgaaattatgt

SEQ ID NO: 4089093 - DNA, 21 bp, Homo sapiens
tgttgaaattatgtatgttta

SEQ ID NO: 4089094 - DNA, 16 bp, Homo sapiens
tgttgaaattttgcaa

SEQ ID NO: 4089095 - DNA, 23 bp, Homo sapiens
tgttgaaattttgcaaatataaa

SEQ ID NO: 4089096 - DNA, 18 bp, Homo sapiens
tgttgaagaatacagtta

SEQ ID NO: 4089097 - DNA, 18 bp, Homo sapiens
tgttgaatactttttaca

SEQ ID NO: 4089098 - DNA, 15 bp, Homo sapiens
tgttgacaactgtga

SEQ ID NO: 4089099 - DNA, 22 bp, Homo sapiens
tgttgaccaggcacctcccctc

SEQ ID NO: 4089100 - DNA, 17 bp, Homo sapiens
tgttgagccaggcctgg

SEQ ID NO: 4089101 - DNA, 22 bp, Homo sapiens
tgttgaggcttatatttgtgta

SEQ ID NO: 4089102 - DNA, 16 bp, Homo sapiens
tgttgcaagatgtgaa

SEQ ID NO: 4089103 - DNA, 23 bp, Homo sapiens
tgttgcaagatgtgaattattga

SEQ ID NO: 4089104 - DNA, 17 bp, Homo sapiens
tgttgcaagtgcaataa

SEQ ID NO: 4089105 - DNA, 15 bp, Homo sapiens
tgttgcaattaggat

SEQ ID NO: 4089106 - DNA, 18 bp, Homo sapiens
tgttgcattattcattta

SEQ ID NO: 4089107 - DNA, 18 bp, Homo sapiens
tgttgcatttccagctgt

SEQ ID NO: 4089108 - DNA, 22 bp, Homo sapiens
tgttgcatttccagctgtgcag

SEQ ID NO: 4089109 - DNA, 18 bp, Homo sapiens
tgttgccaaagctggtct

SEQ ID NO: 4089110 - DNA, 19 bp, Homo sapiens
tgttgccaaatatgtcctg

SEQ ID NO: 4089111 - DNA, 20 bp, Homo sapiens
tgttgccaaatatgtcctgg

SEQ ID NO: 4089112 - DNA, 22 bp, Homo sapiens
tgttgccaaatatgtcctgggg

SEQ ID NO: 4089113 - DNA, 23 bp, Homo sapiens
tgttgccaaatatgtcctggggt

SEQ ID NO: 4089114 - DNA, 16 bp, Homo sapiens
tgttgccactttccaa

SEQ ID NO: 4089115 - DNA, 18 bp, Homo sapiens
tgttgccactttccaagt

SEQ ID NO: 4089116 - DNA, 20 bp, Homo sapiens
tgttgcccctttctcttttc

SEQ ID NO: 4089117 - DNA, 14 bp, Homo sapiens
tgttgcgttccttt

SEQ ID NO: 4089118 - DNA, 19 bp, Homo sapiens
tgttgctcaaaaaatgagc

SEQ ID NO: 4089119 - DNA, 16 bp, Homo sapiens
tttcctttttgacact

SEQ ID NO: 4089120 - DNA, 17 bp, Homo sapiens
tttcctttttgacactg

SEQ ID NO: 4089121 - DNA, 13 bp, Homo sapiens
tttcgaaactgcc

SEQ ID NO: 4089122 - DNA, 13 bp, Homo sapiens
tttcgataaacaa

SEQ ID NO: 4089123 - DNA, 19 bp, Homo sapiens
tttcgccgttgaagaggaa

SEQ ID NO: 4089124 - DNA, 20 bp, Homo sapiens
tttctaaaaagattagcaag

SEQ ID NO: 4089125 - DNA, 21 bp, Homo sapiens
tttctaacaaaaaaatatatt

SEQ ID NO: 4089126 - DNA, 19 bp, Homo sapiens
tttctaaccttgaatgctg

SEQ ID NO: 4089127 - DNA, 14 bp, Homo sapiens
tttctaactatata

SEQ ID NO: 4089128 - DNA, 11 bp, Homo sapiens
tttctaagaga

SEQ ID NO: 4089129 - DNA, 14 bp, Homo sapiens
tttctaagagagct

SEQ ID NO: 4089130 - DNA, 17 bp, Homo sapiens
tttctaatccttttcct

SEQ ID NO: 4089131 - DNA, 21 bp, Homo sapiens
tttctacaatgtgaactttat

SEQ ID NO: 4089132 - DNA, 21 bp, Homo sapiens
tttctacaattaatagtttgt

SEQ ID NO: 4089133 - DNA, 15 bp, Homo sapiens
tttctacatgactgg

SEQ ID NO: 4089134 - DNA, 23 bp, Homo sapiens
tttctacatgactgggcctccct

SEQ ID NO: 4089135 - DNA, 19 bp, Homo sapiens
tttctactgtaagaagagc

SEQ ID NO: 4089136 - DNA, 20 bp, Homo sapiens
tttctagaagtttcccttcc

SEQ ID NO: 4089137 - DNA, 23 bp, Homo sapiens
tttctagaagtttcccttcctcc

SEQ ID NO: 4089138 - DNA, 21 bp, Homo sapiens
tttctagaatttatcacactt

SEQ ID NO: 4089139 - DNA, 16 bp, Homo sapiens
tttctagacttgtgct

SEQ ID NO: 4089140 - DNA, 17 bp, Homo sapiens
tttctagagttcctacc

SEQ ID NO: 4089141 - DNA, 19 bp, Homo sapiens
tttctagtggtctttgtaa

SEQ ID NO: 4089142 - DNA, 22 bp, Homo sapiens
tttctatcatggaatatttata

SEQ ID NO: 4089143 - DNA, 20 bp, Homo sapiens
tttctattatggaaaactgt

SEQ ID NO: 4089144 - DNA, 14 bp, Homo sapiens
tttctattgttact

SEQ ID NO: 4089145 - DNA, 17 bp, Homo sapiens
tttctatttatgccttg

SEQ ID NO: 4089146 - DNA, 16 bp, Homo sapiens
tttctcaaagttttga

SEQ ID NO: 4089147 - DNA, 21 bp, Homo sapiens
tttctcactagtgtcaggccc

SEQ ID NO: 4089148 - DNA, 12 bp, Homo sapiens
tttctcagtgtg

SEQ ID NO: 4089149 - DNA, 16 bp, Homo sapiens
tttctcattcttgttt

SEQ ID NO: 4089150 - DNA, 18 bp, Homo sapiens
tttctccagccagcaatg

SEQ ID NO: 4089151 - DNA, 16 bp, Homo sapiens
tttctcccaagaaacc

SEQ ID NO: 4089152 - DNA, 15 bp, Homo sapiens
tttctccttttccta

SEQ ID NO: 4089153 - DNA, 16 bp, Homo sapiens
tttctccttttcctat

SEQ ID NO: 4089154 - DNA, 19 bp, Homo sapiens
tttctccttttgtgttcca

SEQ ID NO: 4089155 - DNA, 15 bp, Homo sapiens
tttctctacactaag

SEQ ID NO: 4089156 - DNA, 16 bp, Homo sapiens
tttctctattaaaatg

SEQ ID NO: 4089157 - DNA, 16 bp, Homo sapiens
tttctctcttccctca

SEQ ID NO: 4089158 - DNA, 21 bp, Homo sapiens
tttctctctttatacagctgt

SEQ ID NO: 4089159 - DNA, 17 bp, Homo sapiens
tttctctgtgtttgttc

SEQ ID NO: 4089160 - DNA, 14 bp, Homo sapiens
tttctctgttgtaa

SEQ ID NO: 4089161 - DNA, 21 bp, Homo sapiens
tttctcttagaacattgtatt

SEQ ID NO: 4089162 - DNA, 15 bp, Homo sapiens
tttctcttccccttc

SEQ ID NO: 4089163 - DNA, 18 bp, Homo sapiens
tttctcttccccttcctg

SEQ ID NO: 4089164 - DNA, 13 bp, Homo sapiens
tttctcttctccc

SEQ ID NO: 4089165 - DNA, 19 bp, Homo sapiens
tttctcttctccccttcca

SEQ ID NO: 4089166 - DNA, 13 bp, Homo sapiens
tttctctttctct

SEQ ID NO: 4089167 - DNA, 18 bp, Homo sapiens
tttctgaaaattccagaa

SEQ ID NO: 4089168 - DNA, 22 bp, Homo sapiens
tttctgaaaattccagaaagga

SEQ ID NO: 4089169 - DNA, 13 bp, Homo sapiens
tttctgacagttt

SEQ ID NO: 4089170 - DNA, 17 bp, Homo sapiens
tttctgagatgctcact

SEQ ID NO: 4089171 - DNA, 20 bp, Homo sapiens
tttctgagatgctcacttta

SEQ ID NO: 4089172 - DNA, 14 bp, Homo sapiens
tttctgagcgatta

SEQ ID NO: 4089173 - DNA, 21 bp, Homo sapiens
tttctgatcagaggtgtacac

SEQ ID NO: 4089174 - DNA, 14 bp, Homo sapiens
tttctgattagctt

SEQ ID NO: 4089175 - DNA, 20 bp, Homo sapiens
tttctgattagctttgtgtt

SEQ ID NO: 4089176 - DNA, 16 bp, Homo sapiens
tttctgattttaagtt

SEQ ID NO: 4089177 - DNA, 13 bp, Homo sapiens
tttctgcatatgt

SEQ ID NO: 4089178 - DNA, 18 bp, Homo sapiens
tttctgcattttgctatt

SEQ ID NO: 4089179 - DNA, 16 bp, Homo sapiens
tttctgccagggagct

SEQ ID NO: 4089180 - DNA, 12 bp, Homo sapiens
tttctgccctgg

SEQ ID NO: 4089181 - DNA, 20 bp, Homo sapiens
tttctgccctggctgctgcc

SEQ ID NO: 4089182 - DNA, 11 bp, Homo sapiens
tttctgcctcg

SEQ ID NO: 4089183 - DNA, 16 bp, Homo sapiens
tttctgctctcagctc

SEQ ID NO: 4089184 - DNA, 18 bp, Homo sapiens
tttctggaatgtaatcaa

SEQ ID NO: 4089185 - DNA, 23 bp, Homo sapiens
tttctggactgaagcctgcagga

SEQ ID NO: 4089186 - DNA, 16 bp, Homo sapiens
tttctgggagcagaaa

SEQ ID NO: 4089187 - DNA, 19 bp, Homo sapiens
tttctggggtttttctgtt

SEQ ID NO: 4089188 - DNA, 15 bp, Homo sapiens
tttctgggtcttttg

SEQ ID NO: 4089189 - DNA, 17 bp, Homo sapiens
tttctggtagatagaaa

SEQ ID NO: 4089190 - DNA, 19 bp, Homo sapiens
tttctggtagatagaaata

SEQ ID NO: 4089191 - DNA, 12 bp, Homo sapiens
tttctgtcccac

SEQ ID NO: 4089192 - DNA, 12 bp, Homo sapiens
tttctgttccaa

SEQ ID NO: 4089193 - DNA, 14 bp, Homo sapiens
tttctgttccaaat

SEQ ID NO: 4089194 - DNA, 14 bp, Homo sapiens
tttctgttgccaca

SEQ ID NO: 4089195 - DNA, 23 bp, Homo sapiens
tttctgttgtcattgctgttgtc

SEQ ID NO: 4089196 - DNA, 16 bp, Homo sapiens
tttctgtttgtaaatt

SEQ ID NO: 4089197 - DNA, 24 bp, Homo sapiens
tttcttaaatatgtatatgacatt

SEQ ID NO: 4089198 - DNA, 16 bp, Homo sapiens
tttcttagctttttaa

SEQ ID NO: 4089199 - DNA, 14 bp, Homo sapiens
tttcttattgcgct

SEQ ID NO: 4089200 - DNA, 18 bp, Homo sapiens
tttcttatttaacttaac

SEQ ID NO: 4089201 - DNA, 18 bp, Homo sapiens
tttcttcaacatcaatgt

SEQ ID NO: 4089202 - DNA, 16 bp, Homo sapiens
tttcttcatgcaatga

SEQ ID NO: 4089203 - DNA, 19 bp, Homo sapiens
tttcttcatgcaatgacat

SEQ ID NO: 4089204 - DNA, 22 bp, Homo sapiens
tttcttcatgcaatgacatctt

SEQ ID NO: 4089205 - DNA, 17 bp, Homo sapiens
tttcttcctaccaagtc

SEQ ID NO: 4089206 - DNA, 15 bp, Homo sapiens
tttcttcctcagctg

SEQ ID NO: 4089207 - DNA, 18 bp, Homo sapiens
tttcttctacaaccagag

SEQ ID NO: 4089208 - DNA, 11 bp, Homo sapiens
tttcttctgcc

SEQ ID NO: 4089209 - DNA, 13 bp, Homo sapiens
tttcttctgccct

SEQ ID NO: 4089210 - DNA, 23 bp, Homo sapiens
tttcttctgtatttttttttcta

SEQ ID NO: 4089211 - DNA, 18 bp, Homo sapiens
tttcttgatcttaaagat

SEQ ID NO: 4089212 - DNA, 15 bp, Homo sapiens
tttcttgcagattct

SEQ ID NO: 4089213 - DNA, 16 bp, Homo sapiens
tttcttgctcccttca

SEQ ID NO: 4089214 - DNA, 11 bp, Homo sapiens
tttcttgctgg

SEQ ID NO: 4089215 - DNA, 17 bp, Homo sapiens
tttcttggttcataaat

SEQ ID NO: 4089216 - DNA, 18 bp, Homo sapiens
tttcttggttcataaatg

SEQ ID NO: 4089217 - DNA, 19 bp, Homo sapiens
tttcttggttcataaatga

SEQ ID NO: 4089218 - DNA, 23 bp, Homo sapiens
tttcttggttcataaatgaattt

SEQ ID NO: 4089219 - DNA, 15 bp, Homo sapiens
tttctttaaaaaaca

SEQ ID NO: 4089220 - DNA, 18 bp, Homo sapiens
tttctttaatgcttttat

SEQ ID NO: 4089221 - DNA, 18 bp, Homo sapiens
tttctttatcattgctaa

SEQ ID NO: 4089222 - DNA, 15 bp, Homo sapiens
tttctttcagatttt

SEQ ID NO: 4089223 - DNA, 20 bp, Homo sapiens
ttaggcaaggctatgtgatt

SEQ ID NO: 4089224 - DNA, 13 bp, Homo sapiens
ttaggcagcagct

SEQ ID NO: 4089225 - DNA, 23 bp, Homo sapiens
ttaggctatttgtaaatctgcca

SEQ ID NO: 4089226 - DNA, 13 bp, Homo sapiens
ttagggagaaaat

SEQ ID NO: 4089227 - DNA, 15 bp, Homo sapiens
ttagggcactgggct

SEQ ID NO: 4089228 - DNA, 15 bp, Homo sapiens
ttagggtactaaatt

SEQ ID NO: 4089229 - DNA, 17 bp, Homo sapiens
ttaggtagactttgctt

SEQ ID NO: 4089230 - DNA, 18 bp, Homo sapiens
ttaggtggcaagctgtga

SEQ ID NO: 4089231 - DNA, 22 bp, Homo sapiens
ttaggttccatcctttacgtgt

SEQ ID NO: 4089232 - DNA, 18 bp, Homo sapiens
ttagtaaatgtctttgta

SEQ ID NO: 4089233 - DNA, 19 bp, Homo sapiens
ttagtaaatgtctttgtaa

SEQ ID NO: 4089234 - DNA, 20 bp, Homo sapiens
ttagtaaatgtctttgtaag

SEQ ID NO: 4089235 - DNA, 18 bp, Homo sapiens
ttagtaagaaatttgcag

SEQ ID NO: 4089236 - DNA, 12 bp, Homo sapiens
ttagtagcatgt

SEQ ID NO: 4089237 - DNA, 18 bp, Homo sapiens
ttagtatctaacatgtat

SEQ ID NO: 4089238 - DNA, 15 bp, Homo sapiens
ttagtattcattctg

SEQ ID NO: 4089239 - DNA, 15 bp, Homo sapiens
ttagtatttctcagg

SEQ ID NO: 4089240 - DNA, 15 bp, Homo sapiens
ttagtattttaatcc

SEQ ID NO: 4089241 - DNA, 17 bp, Homo sapiens
ttagtattttaatcctg

SEQ ID NO: 4089242 - DNA, 18 bp, Homo sapiens
ttagtattttaatcctgt

SEQ ID NO: 4089243 - DNA, 13 bp, Homo sapiens
ttagtcatgtgac

SEQ ID NO: 4089244 - DNA, 14 bp, Homo sapiens
ttagtcatgtgacc

SEQ ID NO: 4089245 - DNA, 18 bp, Homo sapiens
ttagtctaagatgattca

SEQ ID NO: 4089246 - DNA, 21 bp, Homo sapiens
ttagtctcagtttgtgtgtct

SEQ ID NO: 4089247 - DNA, 19 bp, Homo sapiens
ttagtctgaaactggcttc

SEQ ID NO: 4089248 - DNA, 14 bp, Homo sapiens
ttagtcttctcata

SEQ ID NO: 4089249 - DNA, 17 bp, Homo sapiens
ttagtgatcttagcata

SEQ ID NO: 4089250 - DNA, 20 bp, Homo sapiens
ttagtgccggctgtggagca

SEQ ID NO: 4089251 - DNA, 15 bp, Homo sapiens
ttagtgggccagggc

SEQ ID NO: 4089252 - DNA, 15 bp, Homo sapiens
ttagtgtaataagac

SEQ ID NO: 4089253 - DNA, 13 bp, Homo sapiens
ttagtgtatccat

SEQ ID NO: 4089254 - DNA, 23 bp, Homo sapiens
ttagtgtcacttacctagattta

SEQ ID NO: 4089255 - DNA, 17 bp, Homo sapiens
ttagtgtgtgtgcagag

SEQ ID NO: 4089256 - DNA, 18 bp, Homo sapiens
ttagttaatgagccatca

SEQ ID NO: 4089257 - DNA, 22 bp, Homo sapiens
ttagttactacctcctctcctg

SEQ ID NO: 4089258 - DNA, 13 bp, Homo sapiens
ttagttggctgga

SEQ ID NO: 4089259 - DNA, 13 bp, Homo sapiens
ttagtttacaata

SEQ ID NO: 4089260 - DNA, 22 bp, Homo sapiens
ttagtttcagtagattgcagaa

SEQ ID NO: 4089261 - DNA, 11 bp, Homo sapiens
ttagtttcctt

SEQ ID NO: 4089262 - DNA, 14 bp, Homo sapiens
ttagtttctttggg

SEQ ID NO: 4089263 - DNA, 18 bp, Homo sapiens
ttataaaaaatggttcag

SEQ ID NO: 4089264 - DNA, 13 bp, Homo sapiens
ttataaaacttct

SEQ ID NO: 4089265 - DNA, 18 bp, Homo sapiens
ttataaaattttgctttt

SEQ ID NO: 4089266 - DNA, 18 bp, Homo sapiens
ttataaaccaatcttaaa

SEQ ID NO: 4089267 - DNA, 19 bp, Homo sapiens
ttataaatcatattgatga

SEQ ID NO: 4089268 - DNA, 14 bp, Homo sapiens
ttataaatgaaatt

SEQ ID NO: 4089269 - DNA, 16 bp, Homo sapiens
ttataaccatgagaat

SEQ ID NO: 4089270 - DNA, 19 bp, Homo sapiens
ttataactcatcataaaat

SEQ ID NO: 4089271 - DNA, 21 bp, Homo sapiens
ttataactcatcataaaataa

SEQ ID NO: 4089272 - DNA, 22 bp, Homo sapiens
ttataactcatcataaaataaa

SEQ ID NO: 4089273 - DNA, 15 bp, Homo sapiens
ttataacttaaaaaa

SEQ ID NO: 4089274 - DNA, 13 bp, Homo sapiens
ttataagcattga

SEQ ID NO: 4089275 - DNA, 16 bp, Homo sapiens
ttataagtcacaaaga

SEQ ID NO: 4089276 - DNA, 22 bp, Homo sapiens
ttataataaaaggaaaagcaaa

SEQ ID NO: 4089277 - DNA, 13 bp, Homo sapiens
ttataatatacta

SEQ ID NO: 4089278 - DNA, 17 bp, Homo sapiens
ttataatcaatgaattt

SEQ ID NO: 4089279 - DNA, 15 bp, Homo sapiens
ttataatgaatgaaa

SEQ ID NO: 4089280 - DNA, 20 bp, Homo sapiens
ttataattttttttaaaata

SEQ ID NO: 4089281 - DNA, 19 bp, Homo sapiens
ttatacaaattagaaaatg

SEQ ID NO: 4089282 - DNA, 22 bp, Homo sapiens
ttatacagatagagttccatat

SEQ ID NO: 4089283 - DNA, 21 bp, Homo sapiens
ttatacattagtaaatgtctt

SEQ ID NO: 4089284 - DNA, 18 bp, Homo sapiens
ttataccccaataatcaa

SEQ ID NO: 4089285 - DNA, 17 bp, Homo sapiens
ttatacccccaggaaac

SEQ ID NO: 4089286 - DNA, 15 bp, Homo sapiens
ttatacctacctgtg

SEQ ID NO: 4089287 - DNA, 14 bp, Homo sapiens
ttatacctgttgct

SEQ ID NO: 4089288 - DNA, 14 bp, Homo sapiens
ttatacgcttttct

SEQ ID NO: 4089289 - DNA, 18 bp, Homo sapiens
ttatactccagtgtacat

SEQ ID NO: 4089290 - DNA, 16 bp, Homo sapiens
ttatactctttctgta

SEQ ID NO: 4089291 - DNA, 19 bp, Homo sapiens
ttatactgtgaagttacat

SEQ ID NO: 4089292 - DNA, 21 bp, Homo sapiens
ttatactgtgaagttacatgc

SEQ ID NO: 4089293 - DNA, 14 bp, Homo sapiens
ttatagaaaaggaa

SEQ ID NO: 4089294 - DNA, 12 bp, Homo sapiens
ttatagaataaa

SEQ ID NO: 4089295 - DNA, 19 bp, Homo sapiens
ttatagaataaaagctgtg

SEQ ID NO: 4089296 - DNA, 15 bp, Homo sapiens
ttatagaatatttat

SEQ ID NO: 4089297 - DNA, 22 bp, Homo sapiens
ttatagccacatccctttgaaa

SEQ ID NO: 4089298 - DNA, 18 bp, Homo sapiens
ttataggtcactcctggg

SEQ ID NO: 4089299 - DNA, 18 bp, Homo sapiens
ttataggtgagaaaaaaa

SEQ ID NO: 4089300 - DNA, 16 bp, Homo sapiens
ttatagtacatgataa

SEQ ID NO: 4089301 - DNA, 17 bp, Homo sapiens
ttatagtgtttggacag

SEQ ID NO: 4089302 - DNA, 14 bp, Homo sapiens
ttatagtttcaagc

SEQ ID NO: 4089303 - DNA, 21 bp, Homo sapiens
ttatatacagaggaaatctgt

SEQ ID NO: 4089304 - DNA, 23 bp, Homo sapiens
ttatatacagaggaaatctgtaa

SEQ ID NO: 4089305 - DNA, 23 bp, Homo sapiens
ttatatactgggttcttgtttta

SEQ ID NO: 4089306 - DNA, 14 bp, Homo sapiens
ttatatatttataa

SEQ ID NO: 4089307 - DNA, 23 bp, Homo sapiens
ttatatatttataactcatcata

SEQ ID NO: 4089308 - DNA, 19 bp, Homo sapiens
ttatatatttctaactata

SEQ ID NO: 4089309 - DNA, 15 bp, Homo sapiens
ttatatcagcctgag

SEQ ID NO: 4089310 - DNA, 16 bp, Homo sapiens
ttatatcatatgtata

SEQ ID NO: 4089311 - DNA, 14 bp, Homo sapiens
ttatatcatgcaaa

SEQ ID NO: 4089312 - DNA, 16 bp, Homo sapiens
ttatatgaagataagt

SEQ ID NO: 4089313 - DNA, 22 bp, Homo sapiens
ttatatggatgattcagaaatt

SEQ ID NO: 4089314 - DNA, 14 bp, Homo sapiens
ttatatgtaccgta

SEQ ID NO: 4089315 - DNA, 16 bp, Homo sapiens
ttatatgtaccgtagg

SEQ ID NO: 4089316 - DNA, 22 bp, Homo sapiens
ttatattgaagacaatttgata

SEQ ID NO: 4089317 - DNA, 19 bp, Homo sapiens
ttatattggtgcgttttta

SEQ ID NO: 4089318 - DNA, 11 bp, Homo sapiens
ttatatttcca

SEQ ID NO: 4089319 - DNA, 21 bp, Homo sapiens
ttatatttcctttatgtgaat

SEQ ID NO: 4089320 - DNA, 22 bp, Homo sapiens
ttatatttcctttatgtgaatt

SEQ ID NO: 4089321 - DNA, 15 bp, Homo sapiens
ttatatttgtaggag

SEQ ID NO: 4089322 - DNA, 13 bp, Homo sapiens
ttatatttgtatc

SEQ ID NO: 4089323 - DNA, 16 bp, Homo sapiens
ttatattttttcagtt

SEQ ID NO: 4089324 - DNA, 21 bp, Homo sapiens
ttatcaaaaaaagactcagcc

SEQ ID NO: 4089325 - DNA, 16 bp, Homo sapiens
ttatcaaaaatttcat

SEQ ID NO: 4089326 - DNA, 14 bp, Homo sapiens
ttacctctaaattt

SEQ ID NO: 4089327 - DNA, 15 bp, Homo sapiens
ttacctcttaacaat

SEQ ID NO: 4089328 - DNA, 21 bp, Homo sapiens
ttacctgacctcttgctgtct

SEQ ID NO: 4089329 - DNA, 19 bp, Homo sapiens
ttacctgtcacattgcatt

SEQ ID NO: 4089330 - DNA, 22 bp, Homo sapiens
ttacctgtcacattgcattcta

SEQ ID NO: 4089331 - DNA, 16 bp, Homo sapiens
ttaccttgtatactgt

SEQ ID NO: 4089332 - DNA, 13 bp, Homo sapiens
ttacctttcatac

SEQ ID NO: 4089333 - DNA, 15 bp, Homo sapiens
ttacgttctttcact

SEQ ID NO: 4089334 - DNA, 22 bp, Homo sapiens
ttactaaacatatgatttcact

SEQ ID NO: 4089335 - DNA, 20 bp, Homo sapiens
ttactacaaaatttgaaatt

SEQ ID NO: 4089336 - DNA, 15 bp, Homo sapiens
ttactacagttgttt

SEQ ID NO: 4089337 - DNA, 13 bp, Homo sapiens
ttactaccttatc

SEQ ID NO: 4089338 - DNA, 20 bp, Homo sapiens
ttactataatttgacttgaa

SEQ ID NO: 4089339 - DNA, 17 bp, Homo sapiens
ttactattttctacaat

SEQ ID NO: 4089340 - DNA, 15 bp, Homo sapiens
ttactcaatgtgtgc

SEQ ID NO: 4089341 - DNA, 19 bp, Homo sapiens
ttactcagtgttagagaaa

SEQ ID NO: 4089342 - DNA, 22 bp, Homo sapiens
ttactctcacccataaacagta

SEQ ID NO: 4089343 - DNA, 16 bp, Homo sapiens
ttactctgtgtttaaa

SEQ ID NO: 4089344 - DNA, 13 bp, Homo sapiens
ttactctttgaaa

SEQ ID NO: 4089345 - DNA, 14 bp, Homo sapiens
ttactgagcttctc

SEQ ID NO: 4089346 - DNA, 19 bp, Homo sapiens
ttactgagcttctctgtga

SEQ ID NO: 4089347 - DNA, 21 bp, Homo sapiens
ttactgatcatgcattgttga

SEQ ID NO: 4089348 - DNA, 21 bp, Homo sapiens
ttactgccaaagggaaatatc

SEQ ID NO: 4089349 - DNA, 19 bp, Homo sapiens
ttactgccggtttgaaaat

SEQ ID NO: 4089350 - DNA, 17 bp, Homo sapiens
ttactgtcaataaacag

SEQ ID NO: 4089351 - DNA, 14 bp, Homo sapiens
ttactgtgaaactg

SEQ ID NO: 4089352 - DNA, 17 bp, Homo sapiens
ttactgtggaggaagga

SEQ ID NO: 4089353 - DNA, 23 bp, Homo sapiens
ttactgtggaggaaggattgtaa

SEQ ID NO: 4089354 - DNA, 15 bp, Homo sapiens
ttactgttaaccatt

SEQ ID NO: 4089355 - DNA, 18 bp, Homo sapiens
ttactgttagtcatttgc

SEQ ID NO: 4089356 - DNA, 11 bp, Homo sapiens
ttacttcatat

SEQ ID NO: 4089357 - DNA, 17 bp, Homo sapiens
ttacttctaatcttaaa

SEQ ID NO: 4089358 - DNA, 20 bp, Homo sapiens
ttacttctaatcttaaatca

SEQ ID NO: 4089359 - DNA, 16 bp, Homo sapiens
ttacttgaatttcaaa

SEQ ID NO: 4089360 - DNA, 19 bp, Homo sapiens
ttactttaattactggaat

SEQ ID NO: 4089361 - DNA, 20 bp, Homo sapiens
ttactttgctgccttaatga

SEQ ID NO: 4089362 - DNA, 20 bp, Homo sapiens
ttactttgcttgagaatcct

SEQ ID NO: 4089363 - DNA, 11 bp, Homo sapiens
ttactttgtaa

SEQ ID NO: 4089364 - DNA, 13 bp, Homo sapiens
ttactttgtaatt

SEQ ID NO: 4089365 - DNA, 15 bp, Homo sapiens
ttactttgtaatttt

SEQ ID NO: 4089366 - DNA, 22 bp, Homo sapiens
ttacttttataataaaaggaaa

SEQ ID NO: 4089367 - DNA, 15 bp, Homo sapiens
ttacttttttatagc

SEQ ID NO: 4089368 - DNA, 16 bp, Homo sapiens
ttacttttttatagct

SEQ ID NO: 4089369 - DNA, 18 bp, Homo sapiens
ttacttttttatagctta

SEQ ID NO: 4089370 - DNA, 16 bp, Homo sapiens
ttagaaaaaaattact

SEQ ID NO: 4089371 - DNA, 12 bp, Homo sapiens
ttagaaaaggca

SEQ ID NO: 4089372 - DNA, 21 bp, Homo sapiens
ttagaaaatgacttatttctg

SEQ ID NO: 4089373 - DNA, 22 bp, Homo sapiens
ttagaaagaagcccaatattat

SEQ ID NO: 4089374 - DNA, 12 bp, Homo sapiens
ttagaaatactt

SEQ ID NO: 4089375 - DNA, 15 bp, Homo sapiens
ttagaaatagacagt

SEQ ID NO: 4089376 - DNA, 14 bp, Homo sapiens
ttagaaatataatt

SEQ ID NO: 4089377 - DNA, 17 bp, Homo sapiens
ttagaaatcaagcataa

SEQ ID NO: 4089378 - DNA, 12 bp, Homo sapiens
ttagaacatttt

SEQ ID NO: 4089379 - DNA, 18 bp, Homo sapiens
ttagaacattttaattca

SEQ ID NO: 4089380 - DNA, 13 bp, Homo sapiens
ttagaacctttct

SEQ ID NO: 4089381 - DNA, 18 bp, Homo sapiens
ttagaagatagatgcact

SEQ ID NO: 4089382 - DNA, 23 bp, Homo sapiens
ttagaagcactacaccttgcctt

SEQ ID NO: 4089383 - DNA, 16 bp, Homo sapiens
ttagaataaattccca

SEQ ID NO: 4089384 - DNA, 18 bp, Homo sapiens
ttagaatccaaacttgga

SEQ ID NO: 4089385 - DNA, 16 bp, Homo sapiens
ttagaattatttaaac

SEQ ID NO: 4089386 - DNA, 16 bp, Homo sapiens
ttagacaagagatggg

SEQ ID NO: 4089387 - DNA, 13 bp, Homo sapiens
ttagaccctgggt

SEQ ID NO: 4089388 - DNA, 21 bp, Homo sapiens
ttagacttcgactcaggatcc

SEQ ID NO: 4089389 - DNA, 24 bp, Homo sapiens
ttagagacagagcgacagagcagt

SEQ ID NO: 4089390 - DNA, 12 bp, Homo sapiens
ttagagagagga

SEQ ID NO: 4089391 - DNA, 19 bp, Homo sapiens
ttagagcctcgtccctccc

SEQ ID NO: 4089392 - DNA, 16 bp, Homo sapiens
ttagaggaaaatgagt

SEQ ID NO: 4089393 - DNA, 16 bp, Homo sapiens
ttagagtttctgtttg

SEQ ID NO: 4089394 - DNA, 17 bp, Homo sapiens
ttagagtttctgtttga

SEQ ID NO: 4089395 - DNA, 13 bp, Homo sapiens
ttagatcaaatac

SEQ ID NO: 4089396 - DNA, 19 bp, Homo sapiens
ttagatgtgccaataacca

SEQ ID NO: 4089397 - DNA, 22 bp, Homo sapiens
ttagatgtgccaataaccaagt

SEQ ID NO: 4089398 - DNA, 10 bp, Homo sapiens
ttagatttca

SEQ ID NO: 4089399 - DNA, 20 bp, Homo sapiens
ttagatttcatagttcagaa

SEQ ID NO: 4089400 - DNA, 22 bp, Homo sapiens
ttagatttcatagttcagaatt

SEQ ID NO: 4089401 - DNA, 21 bp, Homo sapiens
ttagcacttgggtgacggcag

SEQ ID NO: 4089402 - DNA, 15 bp, Homo sapiens
ttagcagaactcatt

SEQ ID NO: 4089403 - DNA, 13 bp, Homo sapiens
ttagcatattaat

SEQ ID NO: 4089404 - DNA, 18 bp, Homo sapiens
ttagcatcctaagaaata

SEQ ID NO: 4089405 - DNA, 19 bp, Homo sapiens
ttagcatcctaagaaatat

SEQ ID NO: 4089406 - DNA, 23 bp, Homo sapiens
ttagccaggatcatggtgtaata

SEQ ID NO: 4089407 - DNA, 21 bp, Homo sapiens
ttagctaaacggattccaaag

SEQ ID NO: 4089408 - DNA, 15 bp, Homo sapiens
ttagctactgtatgc

SEQ ID NO: 4089409 - DNA, 15 bp, Homo sapiens
ttagctggcgcatat

SEQ ID NO: 4089410 - DNA, 14 bp, Homo sapiens
ttagctgtaaactg

SEQ ID NO: 4089411 - DNA, 15 bp, Homo sapiens
ttagctgtgtgaaat

SEQ ID NO: 4089412 - DNA, 16 bp, Homo sapiens
ttagctgtgtgaaata

SEQ ID NO: 4089413 - DNA, 13 bp, Homo sapiens
ttagctttgtgtt

SEQ ID NO: 4089414 - DNA, 20 bp, Homo sapiens
ttagctttttaaaacattag

SEQ ID NO: 4089415 - DNA, 17 bp, Homo sapiens
ttagctttttaattgtt

SEQ ID NO: 4089416 - DNA, 18 bp, Homo sapiens
ttagctttttaattgttg

SEQ ID NO: 4089417 - DNA, 21 bp, Homo sapiens
ttaggaaaatcactttgtcta

SEQ ID NO: 4089418 - DNA, 16 bp, Homo sapiens
ttaggaaaggagatca

SEQ ID NO: 4089419 - DNA, 16 bp, Homo sapiens
ttaggaacagcagtgt

SEQ ID NO: 4089420 - DNA, 21 bp, Homo sapiens
ttaggaacagcagtgttctca

SEQ ID NO: 4089421 - DNA, 20 bp, Homo sapiens
ttaggaagtgtaacagctga

SEQ ID NO: 4089422 - DNA, 21 bp, Homo sapiens
ttaggaagtgtaacagctgag

SEQ ID NO: 4089423 - DNA, 23 bp, Homo sapiens
ttaggaagttgacttatagtaca

SEQ ID NO: 4089424 - DNA, 14 bp, Homo sapiens
ttaggactgtataa

SEQ ID NO: 4089425 - DNA, 16 bp, Homo sapiens
ttaggagaagccagga

SEQ ID NO: 4089426 - DNA, 17 bp, Homo sapiens
ttaggagaagccaggaa

SEQ ID NO: 4089427 - DNA, 23 bp, Homo sapiens
ttaggagattttaggtgttgatt

SEQ ID NO: 4089428 - DNA, 22 bp, Homo sapiens
ttaggatttaacagtcatttaa

SEQ ID NO: 4089429 - DNA, 21 bp, Homo sapiens
tgtctcctctatcctgggctt

SEQ ID NO: 4089430 - DNA, 19 bp, Homo sapiens
tgtctcggaacctgtgagc

SEQ ID NO: 4089431 - DNA, 15 bp, Homo sapiens
tgtctctaacttatt

SEQ ID NO: 4089432 - DNA, 16 bp, Homo sapiens
tgtctctaacttattt

SEQ ID NO: 4089433 - DNA, 15 bp, Homo sapiens
tgtctctgataaaag

SEQ ID NO: 4089434 - DNA, 23 bp, Homo sapiens
tgtctctgggcttggggcttcct

SEQ ID NO: 4089435 - DNA, 12 bp, Homo sapiens
tgtctctggggc

SEQ ID NO: 4089436 - DNA, 17 bp, Homo sapiens
tgtctcttagaaatact

SEQ ID NO: 4089437 - DNA, 13 bp, Homo sapiens
tgtctcttctcct

SEQ ID NO: 4089438 - DNA, 14 bp, Homo sapiens
tgtctcttctcctt

SEQ ID NO: 4089439 - DNA, 15 bp, Homo sapiens
tgtctcttgaaaaat

SEQ ID NO: 4089440 - DNA, 17 bp, Homo sapiens
tgtctctttaagggcat

SEQ ID NO: 4089441 - DNA, 13 bp, Homo sapiens
tgtctgaacttgc

SEQ ID NO: 4089442 - DNA, 22 bp, Homo sapiens
tgtctgaatcgagtgagacaaa

SEQ ID NO: 4089443 - DNA, 14 bp, Homo sapiens
tgtctgagggacat

SEQ ID NO: 4089444 - DNA, 14 bp, Homo sapiens
tgtctgagtgaacc

SEQ ID NO: 4089445 - DNA, 21 bp, Homo sapiens
tgtctgagtgaacctgtataa

SEQ ID NO: 4089446 - DNA, 22 bp, Homo sapiens
tgtctgcctggagtgctgtgct

SEQ ID NO: 4089447 - DNA, 21 bp, Homo sapiens
tgtctgctaggcgctggggag

SEQ ID NO: 4089448 - DNA, 23 bp, Homo sapiens
tgtctgctaggcgctggggagac

SEQ ID NO: 4089449 - DNA, 18 bp, Homo sapiens
tgtctgctggtcacttct

SEQ ID NO: 4089450 - DNA, 21 bp, Homo sapiens
tgtctgctggtcacttcttct

SEQ ID NO: 4089451 - DNA, 23 bp, Homo sapiens
tgtctgcttagtatctcatcaac

SEQ ID NO: 4089452 - DNA, 22 bp, Homo sapiens
tgtctgctttaaagggcctgcc

SEQ ID NO: 4089453 - DNA, 13 bp, Homo sapiens
tgtctgctttggt

SEQ ID NO: 4089454 - DNA, 14 bp, Homo sapiens
tgtctggcctgagg

SEQ ID NO: 4089455 - DNA, 17 bp, Homo sapiens
tgtctgggtttttcttg

SEQ ID NO: 4089456 - DNA, 17 bp, Homo sapiens
tgtctgtagctcctcaa

SEQ ID NO: 4089457 - DNA, 11 bp, Homo sapiens
tgtctgtcacc

SEQ ID NO: 4089458 - DNA, 21 bp, Homo sapiens
tgtctgtcaccagctatctgt

SEQ ID NO: 4089459 - DNA, 24 bp, Homo sapiens
tgtctgtcaccagctatctgtcat

SEQ ID NO: 4089460 - DNA, 19 bp, Homo sapiens
tgtctgtgaacagagagac

SEQ ID NO: 4089461 - DNA, 22 bp, Homo sapiens
tgtctgttaccatgtcactgtg

SEQ ID NO: 4089462 - DNA, 21 bp, Homo sapiens
tgtctgtttaagaaaagtatt

SEQ ID NO: 4089463 - DNA, 13 bp, Homo sapiens
tgtctgtttgttt

SEQ ID NO: 4089464 - DNA, 16 bp, Homo sapiens
tgtctgtttgtttcaa

SEQ ID NO: 4089465 - DNA, 23 bp, Homo sapiens
tgtctgtttgtttcaagaacctg

SEQ ID NO: 4089466 - DNA, 13 bp, Homo sapiens
tgtcttatatata

SEQ ID NO: 4089467 - DNA, 22 bp, Homo sapiens
tgtcttatatatatttctttgt

SEQ ID NO: 4089468 - DNA, 12 bp, Homo sapiens
tgtcttattgca

SEQ ID NO: 4089469 - DNA, 16 bp, Homo sapiens
tgtcttcaaactgtga

SEQ ID NO: 4089470 - DNA, 23 bp, Homo sapiens
tgtcttcagcagtcaatacaaat

SEQ ID NO: 4089471 - DNA, 20 bp, Homo sapiens
tgtcttcaggctctgcccag

SEQ ID NO: 4089472 - DNA, 15 bp, Homo sapiens
tgtcttcatagcaga

SEQ ID NO: 4089473 - DNA, 16 bp, Homo sapiens
tgtcttccaaggagac

SEQ ID NO: 4089474 - DNA, 13 bp, Homo sapiens
tgtcttccataat

SEQ ID NO: 4089475 - DNA, 14 bp, Homo sapiens
tgtcttccataatg

SEQ ID NO: 4089476 - DNA, 15 bp, Homo sapiens
tgtcttccccaccgc

SEQ ID NO: 4089477 - DNA, 23 bp, Homo sapiens
tgtcttccctgggctgccaccag

SEQ ID NO: 4089478 - DNA, 23 bp, Homo sapiens
tgtcttctggacaggctctgctt

SEQ ID NO: 4089479 - DNA, 15 bp, Homo sapiens
tgtcttgaaagtggc

SEQ ID NO: 4089480 - DNA, 19 bp, Homo sapiens
tgtcttgcaacttcagttt

SEQ ID NO: 4089481 - DNA, 18 bp, Homo sapiens
tgtcttggggtcccactg

SEQ ID NO: 4089482 - DNA, 16 bp, Homo sapiens
tgtctttaaaagagag

SEQ ID NO: 4089483 - DNA, 19 bp, Homo sapiens
tgtctttaaatagatacaa

SEQ ID NO: 4089484 - DNA, 16 bp, Homo sapiens
tgtctttcagatacat

SEQ ID NO: 4089485 - DNA, 22 bp, Homo sapiens
tgtctttcctgaaccatgtgga

SEQ ID NO: 4089486 - DNA, 12 bp, Homo sapiens
tgtctttgtaag

SEQ ID NO: 4089487 - DNA, 14 bp, Homo sapiens
tgtcttttaatgct

SEQ ID NO: 4089488 - DNA, 18 bp, Homo sapiens
tgtcttttaatgcttcat

SEQ ID NO: 4089489 - DNA, 20 bp, Homo sapiens
tgtcttttaatgcttcattc

SEQ ID NO: 4089490 - DNA, 23 bp, Homo sapiens
tgtcttttcagaagcaagccaga

SEQ ID NO: 4089491 - DNA, 14 bp, Homo sapiens
tgtcttttcttggc

SEQ ID NO: 4089492 - DNA, 15 bp, Homo sapiens
tgtcttttcttggca

SEQ ID NO: 4089493 - DNA, 22 bp, Homo sapiens
tgtcttttcttggcaaaagcct

SEQ ID NO: 4089494 - DNA, 23 bp, Homo sapiens
tgtcttttcttggcaaaagcctt

SEQ ID NO: 4089495 - DNA, 21 bp, Homo sapiens
tgtgaaaaaggaataaattgt

SEQ ID NO: 4089496 - DNA, 22 bp, Homo sapiens
tgtgaaaagtatcactctaaaa

SEQ ID NO: 4089497 - DNA, 17 bp, Homo sapiens
tgtgaaacacagctgtt

SEQ ID NO: 4089498 - DNA, 23 bp, Homo sapiens
tgtgaaagaagacagcttaatag

SEQ ID NO: 4089499 - DNA, 14 bp, Homo sapiens
tgtgaaatgctggc

SEQ ID NO: 4089500 - DNA, 15 bp, Homo sapiens
tgtgaacagagagac

SEQ ID NO: 4089501 - DNA, 16 bp, Homo sapiens
tgtgaaccaagatcta

SEQ ID NO: 4089502 - DNA, 22 bp, Homo sapiens
tgtgaaccctggggcctgactg

SEQ ID NO: 4089503 - DNA, 22 bp, Homo sapiens
tgtgaacctacctgccttggag

SEQ ID NO: 4089504 - DNA, 12 bp, Homo sapiens
tgtgaactcatt

SEQ ID NO: 4089505 - DNA, 19 bp, Homo sapiens
tgtgaagacattttttgct

SEQ ID NO: 4089506 - DNA, 18 bp, Homo sapiens
tgtgaagagggagaagca

SEQ ID NO: 4089507 - DNA, 18 bp, Homo sapiens
tgtgaagataatttgcat

SEQ ID NO: 4089508 - DNA, 19 bp, Homo sapiens
tgtgaagataatttgcata

SEQ ID NO: 4089509 - DNA, 14 bp, Homo sapiens
tgtgaagtttacat

SEQ ID NO: 4089510 - DNA, 16 bp, Homo sapiens
tgggagctcctctcct

SEQ ID NO: 4089511 - DNA, 20 bp, Homo sapiens
tgggagctgaggccacactc

SEQ ID NO: 4089512 - DNA, 15 bp, Homo sapiens
tgggaggcaagaaaa

SEQ ID NO: 4089513 - DNA, 20 bp, Homo sapiens
tgggaggccccttctctccc

SEQ ID NO: 4089514 - DNA, 14 bp, Homo sapiens
tgggaggctgaggc

SEQ ID NO: 4089515 - DNA, 15 bp, Homo sapiens
tgggaggctgaggca

SEQ ID NO: 4089516 - DNA, 14 bp, Homo sapiens
tgggaggcttcccc

SEQ ID NO: 4089517 - DNA, 14 bp, Homo sapiens
tgggagggaaaagg

SEQ ID NO: 4089518 - DNA, 18 bp, Homo sapiens
tgggagggaaaagggaag

SEQ ID NO: 4089519 - DNA, 16 bp, Homo sapiens
tgggagggaggctcag

SEQ ID NO: 4089520 - DNA, 19 bp, Homo sapiens
tgggagggttggcacctgc

SEQ ID NO: 4089521 - DNA, 14 bp, Homo sapiens
tgggaggtcttgct

SEQ ID NO: 4089522 - DNA, 20 bp, Homo sapiens
tgggagtagttggagcattg

SEQ ID NO: 4089523 - DNA, 23 bp, Homo sapiens
tgggagtcacacagtgttggagg

SEQ ID NO: 4089524 - DNA, 16 bp, Homo sapiens
tgggagtcagagccct

SEQ ID NO: 4089525 - DNA, 18 bp, Homo sapiens
tgggagtcagagccctgg

SEQ ID NO: 4089526 - DNA, 22 bp, Homo sapiens
tgggagtcagagccctggctgg

SEQ ID NO: 4089527 - DNA, 18 bp, Homo sapiens
tgggagtgggcacctcag

SEQ ID NO: 4089528 - DNA, 22 bp, Homo sapiens
tgggagtgggcacctcagaaag

SEQ ID NO: 4089529 - DNA, 19 bp, Homo sapiens
tgggatagtgttctgctcc

SEQ ID NO: 4089530 - DNA, 23 bp, Homo sapiens
tgggatatctttacaagcaggca

SEQ ID NO: 4089531 - DNA, 18 bp, Homo sapiens
tgggatatggctgcccag

SEQ ID NO: 4089532 - DNA, 16 bp, Homo sapiens
tgggatatgtggtgta

SEQ ID NO: 4089533 - DNA, 14 bp, Homo sapiens
tgggatcctccctc

SEQ ID NO: 4089534 - DNA, 18 bp, Homo sapiens
tgggatgggacagggagg

SEQ ID NO: 4089535 - DNA, 20 bp, Homo sapiens
tgggatgttcagcactgtcc

SEQ ID NO: 4089536 - DNA, 17 bp, Homo sapiens
tgggattaagaaacctt

SEQ ID NO: 4089537 - DNA, 23 bp, Homo sapiens
tgggattcccaccaaggtcttca

SEQ ID NO: 4089538 - DNA, 17 bp, Homo sapiens
tgggatttaatttccag

SEQ ID NO: 4089539 - DNA, 15 bp, Homo sapiens
tgggattttgcaaaa

SEQ ID NO: 4089540 - DNA, 22 bp, Homo sapiens
tgggcacaactgcaataacttc

SEQ ID NO: 4089541 - DNA, 23 bp, Homo sapiens
tgggcacacgcacaaacacacac

SEQ ID NO: 4089542 - DNA, 22 bp, Homo sapiens
tgggcactgggatgagccgctg

SEQ ID NO: 4089543 - DNA, 18 bp, Homo sapiens
tgggcagcaatttaaatg

SEQ ID NO: 4089544 - DNA, 19 bp, Homo sapiens
tgggcagcaatttaaatgt

SEQ ID NO: 4089545 - DNA, 14 bp, Homo sapiens
tgggcagcaccctc

SEQ ID NO: 4089546 - DNA, 22 bp, Homo sapiens
tgggcagcaccctcccccgcag

SEQ ID NO: 4089547 - DNA, 16 bp, Homo sapiens
tgggcagcatagcaag

SEQ ID NO: 4089548 - DNA, 20 bp, Homo sapiens
tgggcagcccaaagctgcag

SEQ ID NO: 4089549 - DNA, 12 bp, Homo sapiens
tgggcaggaagg

SEQ ID NO: 4089550 - DNA, 22 bp, Homo sapiens
tgggcaggcggtccccatcccc

SEQ ID NO: 4089551 - DNA, 15 bp, Homo sapiens
tgggcagtgccccag

SEQ ID NO: 4089552 - DNA, 20 bp, Homo sapiens
tgggcagtgccccagggagt

SEQ ID NO: 4089553 - DNA, 15 bp, Homo sapiens
tgggcatcagcagca

SEQ ID NO: 4089554 - DNA, 15 bp, Homo sapiens
tgggcatgccaccct

SEQ ID NO: 4089555 - DNA, 22 bp, Homo sapiens
tgggcatgccaccctcacacac

SEQ ID NO: 4089556 - DNA, 14 bp, Homo sapiens
tgggcattctctct

SEQ ID NO: 4089557 - DNA, 12 bp, Homo sapiens
tgggcattgctt

SEQ ID NO: 4089558 - DNA, 13 bp, Homo sapiens
tgggcattgcttt

SEQ ID NO: 4089559 - DNA, 20 bp, Homo sapiens
tgggcattgctttccactga

SEQ ID NO: 4089560 - DNA, 22 bp, Homo sapiens
tgggcattttcctcctctgcct

SEQ ID NO: 4089561 - DNA, 16 bp, Homo sapiens
tgggccacggaggagg

SEQ ID NO: 4089562 - DNA, 18 bp, Homo sapiens
tgggccacggctgagcct

SEQ ID NO: 4089563 - DNA, 15 bp, Homo sapiens
tgggccactggggac

SEQ ID NO: 4089564 - DNA, 22 bp, Homo sapiens
tgggccactggggactttattt

SEQ ID NO: 4089565 - DNA, 19 bp, Homo sapiens
tgggccagacatgccacaa

SEQ ID NO: 4089566 - DNA, 13 bp, Homo sapiens
tgggccagccctg

SEQ ID NO: 4089567 - DNA, 20 bp, Homo sapiens
tgggccagccctgcagccca

SEQ ID NO: 4089568 - DNA, 21 bp, Homo sapiens
tgggccagccctgcagcccaa

SEQ ID NO: 4089569 - DNA, 17 bp, Homo sapiens
tgggccagcggggctgc

SEQ ID NO: 4089570 - DNA, 22 bp, Homo sapiens
tgggccagggtctgtgtgaatg

SEQ ID NO: 4089571 - DNA, 23 bp, Homo sapiens
tgggccataatgttgcttctcag

SEQ ID NO: 4089572 - DNA, 19 bp, Homo sapiens
tgggcccacccaagcagga

SEQ ID NO: 4089573 - DNA, 14 bp, Homo sapiens
tgggcccagaactg

SEQ ID NO: 4089574 - DNA, 19 bp, Homo sapiens
tgggcccagaactgccccc

SEQ ID NO: 4089575 - DNA, 21 bp, Homo sapiens
tgggcccagaactgcccccac

SEQ ID NO: 4089576 - DNA, 13 bp, Homo sapiens
tgggcccagatct

SEQ ID NO: 4089577 - DNA, 14 bp, Homo sapiens
tgggcccagatctg

SEQ ID NO: 4089578 - DNA, 18 bp, Homo sapiens
tgggccccagaccccagg

SEQ ID NO: 4089579 - DNA, 15 bp, Homo sapiens
tgggcccctcaacag

SEQ ID NO: 4089580 - DNA, 20 bp, Homo sapiens
tgggcccctcaacagccaag

SEQ ID NO: 4089581 - DNA, 22 bp, Homo sapiens
tgggcccctcaacagccaagtg

SEQ ID NO: 4089582 - DNA, 16 bp, Homo sapiens
tgggcccctcagagcc

SEQ ID NO: 4089583 - DNA, 23 bp, Homo sapiens
tgggcccctcttattcctctagg

SEQ ID NO: 4089584 - DNA, 13 bp, Homo sapiens
tgggccctctctc

SEQ ID NO: 4089585 - DNA, 19 bp, Homo sapiens
tgggccctctttccctgcg

SEQ ID NO: 4089586 - DNA, 14 bp, Homo sapiens
tgggccctgcacag

SEQ ID NO: 4089587 - DNA, 15 bp, Homo sapiens
tgggccctgcacaga

SEQ ID NO: 4089588 - DNA, 21 bp, Homo sapiens
tgggccggcttcatgccagct

SEQ ID NO: 4089589 - DNA, 15 bp, Homo sapiens
tgggcctctgcccct

SEQ ID NO: 4089590 - DNA, 20 bp, Homo sapiens
tgggcctctgcttctctcac

SEQ ID NO: 4089591 - DNA, 16 bp, Homo sapiens
tgggcctgctccagac

SEQ ID NO: 4089592 - DNA, 20 bp, Homo sapiens
tgggcctgctccagacctga

SEQ ID NO: 4089593 - DNA, 16 bp, Homo sapiens
tgggcctgggcctctg

SEQ ID NO: 4089594 - DNA, 17 bp, Homo sapiens
tgggcctgggcctctgc

SEQ ID NO: 4089595 - DNA, 17 bp, Homo sapiens
tgggcctgtcgtgccag

SEQ ID NO: 4089596 - DNA, 19 bp, Homo sapiens
tgggccttagtgggccagg

SEQ ID NO: 4089597 - DNA, 15 bp, Homo sapiens
tgggccttgctgctg

SEQ ID NO: 4089598 - DNA, 16 bp, Homo sapiens
tgggccttgctgctgc

SEQ ID NO: 4089599 - DNA, 17 bp, Homo sapiens
tgggccttgctgctgct

SEQ ID NO: 4089600 - DNA, 14 bp, Homo sapiens
tgggcgctgcttcc

SEQ ID NO: 4089601 - DNA, 17 bp, Homo sapiens
tgggcgctgcttccagg

SEQ ID NO: 4089602 - DNA, 20 bp, Homo sapiens
tgggcggacggctgtggacc

SEQ ID NO: 4089603 - DNA, 16 bp, Homo sapiens
tgggcggcggccacgc

SEQ ID NO: 4089604 - DNA, 19 bp, Homo sapiens
tgggcgttgggagcctagc

SEQ ID NO: 4089605 - DNA, 17 bp, Homo sapiens
tgggctatagcacacag

SEQ ID NO: 4089606 - DNA, 17 bp, Homo sapiens
tgggctattgctgctgc

SEQ ID NO: 4089607 - DNA, 20 bp, Homo sapiens
tgggctcaagcaatcctcct

SEQ ID NO: 4089608 - DNA, 10 bp, Homo sapiens
tgggctcagc

SEQ ID NO: 4089609 - DNA, 15 bp, Homo sapiens
tgggctccctgatga

SEQ ID NO: 4089610 - DNA, 15 bp, Homo sapiens
tgggctcctgcccct

SEQ ID NO: 4089611 - DNA, 17 bp, Homo sapiens
tgggctcctggaaccaa

SEQ ID NO: 4089612 - DNA, 17 bp, Homo sapiens
tgggctgccctggtgct

SEQ ID NO: 4089613 - DNA, 20 bp, Homo sapiens
tgggctgccctggtgctgcc

SEQ ID NO: 4089614 - DNA, 17 bp, Homo sapiens
tgggctgctacccagaa

SEQ ID NO: 4089615 - DNA, 16 bp, Homo sapiens
tgggctgctcctcatg

SEQ ID NO: 4089616 - DNA, 22 bp, Homo sapiens
tgggctgggccctctcttctca

SEQ ID NO: 4089617 - DNA, 12 bp, Homo sapiens
tgggctggggga

SEQ ID NO: 4089618 - DNA, 15 bp, Homo sapiens
tgggctgggggactg

SEQ ID NO: 4089619 - DNA, 17 bp, Homo sapiens
tgggctgggtttgctgt

SEQ ID NO: 4089620 - DNA, 14 bp, Homo sapiens
tgggctggtatctc

SEQ ID NO: 4089621 - DNA, 14 bp, Homo sapiens
tgggctggtgcccc

SEQ ID NO: 4089622 - DNA, 14 bp, Homo sapiens
tgggctgtctgtca

SEQ ID NO: 4089623 - DNA, 18 bp, Homo sapiens
tgggcttagtatttctca

SEQ ID NO: 4089624 - DNA, 16 bp, Homo sapiens
tgggcttcactgtata

SEQ ID NO: 4089625 - DNA, 18 bp, Homo sapiens
tgggcttcactgtataaa

SEQ ID NO: 4089626 - DNA, 23 bp, Homo sapiens
tgggcttcactgtataaatagga

SEQ ID NO: 4089627 - DNA, 15 bp, Homo sapiens
tgggcttcctgccct

SEQ ID NO: 4089628 - DNA, 18 bp, Homo sapiens
tgggcttcctgcccttcc

SEQ ID NO: 4089629 - DNA, 19 bp, Homo sapiens
tgggcttggcctgctgtga

SEQ ID NO: 4089630 - DNA, 13 bp, Homo sapiens
tggggaaaaaagc

SEQ ID NO: 4089631 - DNA, 15 bp, Homo sapiens
tggggaaaaaagcac

SEQ ID NO: 4089632 - DNA, 19 bp, Homo sapiens
tggggaaccccgagctggg

SEQ ID NO: 4089633 - DNA, 15 bp, Homo sapiens
tggggaactgagggc

SEQ ID NO: 4089634 - DNA, 20 bp, Homo sapiens
tggggaactgagggcaaggg

SEQ ID NO: 4089635 - DNA, 20 bp, Homo sapiens
tggggaagccaggtgagctc

SEQ ID NO: 4089636 - DNA, 15 bp, Homo sapiens
tggggaaggagccag

SEQ ID NO: 4089637 - DNA, 22 bp, Homo sapiens
tggggacagcttcctcacaccc

SEQ ID NO: 4089638 - DNA, 18 bp, Homo sapiens
tggggacctggcactggg

SEQ ID NO: 4089639 - DNA, 12 bp, Homo sapiens
tggggactgggc

SEQ ID NO: 4089640 - DNA, 14 bp, Homo sapiens
tggggactgggcac

SEQ ID NO: 4089641 - DNA, 20 bp, Homo sapiens
tggggactgttccaaagcca

SEQ ID NO: 4089642 - DNA, 23 bp, Homo sapiens
tggggactgttccaaagccagtg

SEQ ID NO: 4089643 - DNA, 20 bp, Homo sapiens
tggggagagggatttccctg

SEQ ID NO: 4089644 - DNA, 21 bp, Homo sapiens
tggggagagggatttccctgc

SEQ ID NO: 4089645 - DNA, 20 bp, Homo sapiens
tggggagatgcttctctcct

SEQ ID NO: 4089646 - DNA, 15 bp, Homo sapiens
tggggagcagagaca

SEQ ID NO: 4089647 - DNA, 21 bp, Homo sapiens
tggggagcaggaggccaataa

SEQ ID NO: 4089648 - DNA, 22 bp, Homo sapiens
tggggagcaggaggccaataaa

SEQ ID NO: 4089649 - DNA, 22 bp, Homo sapiens
tggggagccaacagaagcttcc

SEQ ID NO: 4089650 - DNA, 21 bp, Homo sapiens
tggggagcccgtctcagtgtt

SEQ ID NO: 4089651 - DNA, 19 bp, Homo sapiens
tggggaggaatcctggacc

SEQ ID NO: 4089652 - DNA, 18 bp, Homo sapiens
tggggagggaggggaaat

SEQ ID NO: 4089653 - DNA, 17 bp, Homo sapiens
tggggagttaagacctg

SEQ ID NO: 4089654 - DNA, 18 bp, Homo sapiens
tggggagttaagacctgg

SEQ ID NO: 4089655 - DNA, 19 bp, Homo sapiens
tggggagttaagacctggc

SEQ ID NO: 4089656 - DNA, 20 bp, Homo sapiens
tggggatccctcccccccat

SEQ ID NO: 4089657 - DNA, 15 bp, Homo sapiens
tggggatgtgggagg

SEQ ID NO: 4089658 - DNA, 16 bp, Homo sapiens
tggggattggtgggtc

SEQ ID NO: 4089659 - DNA, 19 bp, Homo sapiens
tggggcaaacctagccgga

SEQ ID NO: 4089660 - DNA, 17 bp, Homo sapiens
tggggcaggctggctgg

SEQ ID NO: 4089661 - DNA, 14 bp, Homo sapiens
tggggcaggctggg

SEQ ID NO: 4089662 - DNA, 18 bp, Homo sapiens
tggggccagaggctggga

SEQ ID NO: 4089663 - DNA, 18 bp, Homo sapiens
tggggccagatccagcct

SEQ ID NO: 4089664 - DNA, 19 bp, Homo sapiens
tggggccagatccagcctg

SEQ ID NO: 4089665 - DNA, 21 bp, Homo sapiens
tggggccccgggttcagcctg

SEQ ID NO: 4089666 - DNA, 16 bp, Homo sapiens
tggggccctgggcctc

SEQ ID NO: 4089667 - DNA, 18 bp, Homo sapiens
tggggccctgggcctcag

SEQ ID NO: 4089668 - DNA, 19 bp, Homo sapiens
tggggccctgggcctcagt

SEQ ID NO: 4089669 - DNA, 18 bp, Homo sapiens
tggggcctacagctttga

SEQ ID NO: 4089670 - DNA, 22 bp, Homo sapiens
tggggcctagcgatctctcctg

SEQ ID NO: 4089671 - DNA, 11 bp, Homo sapiens
tggggcctccc

SEQ ID NO: 4089672 - DNA, 14 bp, Homo sapiens
tggggcctccctcc

SEQ ID NO: 4089673 - DNA, 13 bp, Homo sapiens
tggggcctgactg

SEQ ID NO: 4089674 - DNA, 11 bp, Homo sapiens
tggggcctgag

SEQ ID NO: 4089675 - DNA, 12 bp, Homo sapiens
tggggcctgaga

SEQ ID NO: 4089676 - DNA, 14 bp, Homo sapiens
tggggcctgagaga

SEQ ID NO: 4089677 - DNA, 17 bp, Homo sapiens
tggggcctggacctgcc

SEQ ID NO: 4089678 - DNA, 20 bp, Homo sapiens
tggggcctggacctgcctcc

SEQ ID NO: 4089679 - DNA, 13 bp, Homo sapiens
tggggcctgtgga

SEQ ID NO: 4089680 - DNA, 14 bp, Homo sapiens
tggggcctgtggaa

SEQ ID NO: 4089681 - DNA, 16 bp, Homo sapiens
tggggcctgtggaatg

SEQ ID NO: 4089682 - DNA, 21 bp, Homo sapiens
tggggcctgtggaatgagtgt

SEQ ID NO: 4089683 - DNA, 13 bp, Homo sapiens
tggggcggggccc

SEQ ID NO: 4089684 - DNA, 14 bp, Homo sapiens
tggggcggggccca

SEQ ID NO: 4089685 - DNA, 16 bp, Homo sapiens
tggggcggggcccagg

SEQ ID NO: 4089686 - DNA, 20 bp, Homo sapiens
tggggctagggggagcccct

SEQ ID NO: 4089687 - DNA, 23 bp, Homo sapiens
tggggctcctttctccagccagc

SEQ ID NO: 4089688 - DNA, 18 bp, Homo sapiens
tggggctgggcccaccca

SEQ ID NO: 4089689 - DNA, 16 bp, Homo sapiens
tggggctttgccttgc

SEQ ID NO: 4089690 - DNA, 21 bp, Homo sapiens
tggggctttgccttgcagcca

SEQ ID NO: 4089691 - DNA, 17 bp, Homo sapiens
tgggggaacagatgcta

SEQ ID NO: 4089692 - DNA, 20 bp, Homo sapiens
tgggggaactcagatccagg

SEQ ID NO: 4089693 - DNA, 19 bp, Homo sapiens
tgggggacgatcaggagga

SEQ ID NO: 4089694 - DNA, 19 bp, Homo sapiens
tgggggactggggggccat

SEQ ID NO: 4089695 - DNA, 11 bp, Homo sapiens
tgggggagaga

SEQ ID NO: 4089696 - DNA, 15 bp, Homo sapiens
tgggggagagaggca

SEQ ID NO: 4089697 - DNA, 18 bp, Homo sapiens
tgggggatgggccagggt

SEQ ID NO: 4089698 - DNA, 14 bp, Homo sapiens
tgggggcagggctg

SEQ ID NO: 4089699 - DNA, 13 bp, Homo sapiens
tgggggggcagag

SEQ ID NO: 4089700 - DNA, 12 bp, Homo sapiens
tggggggtgcag

SEQ ID NO: 4089701 - DNA, 19 bp, Homo sapiens
tgggggtgctggatggaca

SEQ ID NO: 4089702 - DNA, 18 bp, Homo sapiens
tgggggtggaggcttcct

SEQ ID NO: 4089703 - DNA, 14 bp, Homo sapiens
tgggggtggccatc

SEQ ID NO: 4089704 - DNA, 23 bp, Homo sapiens
tgggggtggccatccctgggccc

SEQ ID NO: 4089705 - DNA, 16 bp, Homo sapiens
tgggggttcaggcccg

SEQ ID NO: 4089706 - DNA, 17 bp, Homo sapiens
tggggtactcttgatgt

SEQ ID NO: 4089707 - DNA, 12 bp, Homo sapiens
tggggtgacagt

SEQ ID NO: 4089708 - DNA, 15 bp, Homo sapiens
tggggtgacagtcat

SEQ ID NO: 4089709 - DNA, 23 bp, Homo sapiens
tggggtgacagtcatcatcaggg

SEQ ID NO: 4089710 - DNA, 13 bp, Homo sapiens
tggggtgagagag

SEQ ID NO: 4089711 - DNA, 14 bp, Homo sapiens
tggggtgaggacca

SEQ ID NO: 4089712 - DNA, 16 bp, Homo sapiens
tggggtgcatctcctc

SEQ ID NO: 4089713 - DNA, 12 bp, Homo sapiens
tggggttttgta

SEQ ID NO: 4089714 - DNA, 21 bp, Homo sapiens
tgggtagaaagagatacagag

SEQ ID NO: 4089715 - DNA, 21 bp, Homo sapiens
tgggtagtgagcagtgagcag

SEQ ID NO: 4089716 - DNA, 19 bp, Homo sapiens
tgggtatcctgcccagtgt

SEQ ID NO: 4089717 - DNA, 20 bp, Homo sapiens
tgggtatcctgcccagtgtt

SEQ ID NO: 4089718 - DNA, 13 bp, Homo sapiens
tgggtcaggcagg

SEQ ID NO: 4089719 - DNA, 12 bp, Homo sapiens
tgggtcagtctg

SEQ ID NO: 4089720 - DNA, 22 bp, Homo sapiens
tgggtcatgatgctctttccca

SEQ ID NO: 4089721 - DNA, 19 bp, Homo sapiens
tgggtcattgacctctcag

SEQ ID NO: 4089722 - DNA, 21 bp, Homo sapiens
tgggtccagggcctgacaccc

SEQ ID NO: 4089723 - DNA, 19 bp, Homo sapiens
tgggtccccagcccttcct

SEQ ID NO: 4089724 - DNA, 17 bp, Homo sapiens
tgggtcccccacgtgac

SEQ ID NO: 4089725 - DNA, 22 bp, Homo sapiens
tgggtccccctcagcaagccct

SEQ ID NO: 4089726 - DNA, 16 bp, Homo sapiens
tgggtccgataatatc

SEQ ID NO: 4089727 - DNA, 18 bp, Homo sapiens
tgggtccgataatatctt

SEQ ID NO: 4089728 - DNA, 14 bp, Homo sapiens
tgggtcctgaagaa

SEQ ID NO: 4089729 - DNA, 20 bp, Homo sapiens
tgggtcctgcaattctacag

SEQ ID NO: 4089730 - DNA, 16 bp, Homo sapiens
tgggtcggccctgccc

SEQ ID NO: 4089731 - DNA, 20 bp, Homo sapiens
tgggtctcgctttgttgccc

SEQ ID NO: 4089732 - DNA, 21 bp, Homo sapiens
tgggtctgatattaatcaaaa

SEQ ID NO: 4089733 - DNA, 14 bp, Homo sapiens
tgggtctgtgcatt

SEQ ID NO: 4089734 - DNA, 19 bp, Homo sapiens
tgggtctgtgtctcttttc

SEQ ID NO: 4089735 - DNA, 20 bp, Homo sapiens
tgggtgaaggcctggctgga

SEQ ID NO: 4089736 - DNA, 22 bp, Homo sapiens
tgggtgaaggcctggctggaag

SEQ ID NO: 4089737 - DNA, 15 bp, Homo sapiens
tgggtgaagggagag

SEQ ID NO: 4089738 - DNA, 17 bp, Homo sapiens
tgggtgacagagcaaga

SEQ ID NO: 4089739 - DNA, 12 bp, Homo sapiens
tgggtgacattt

SEQ ID NO: 4089740 - DNA, 20 bp, Homo sapiens
tgggtgcaggagcgctccct

SEQ ID NO: 4089741 - DNA, 22 bp, Homo sapiens
tgggtgctcagaataaggcagg

SEQ ID NO: 4089742 - DNA, 13 bp, Homo sapiens
tgggtgctgccct

SEQ ID NO: 4089743 - DNA, 14 bp, Homo sapiens
tgggtgctgccctg

SEQ ID NO: 4089744 - DNA, 17 bp, Homo sapiens
tgggtggaagggctggg

SEQ ID NO: 4089745 - DNA, 16 bp, Homo sapiens
tgggtgggctctgtgc

SEQ ID NO: 4089746 - DNA, 14 bp, Homo sapiens
tgggtggggacagt

SEQ ID NO: 4089747 - DNA, 15 bp, Homo sapiens
tgggtggggtgagga

SEQ ID NO: 4089748 - DNA, 14 bp, Homo sapiens
tgggtgtagccagg

SEQ ID NO: 4089749 - DNA, 20 bp, Homo sapiens
tgggtgtcatttcattccat

SEQ ID NO: 4089750 - DNA, 14 bp, Homo sapiens
tgggtgtccatgtg

SEQ ID NO: 4089751 - DNA, 20 bp, Homo sapiens
tgggtgtccatgtgcacccg

SEQ ID NO: 4089752 - DNA, 12 bp, Homo sapiens
tgggtgtcctgc

SEQ ID NO: 4089753 - DNA, 22 bp, Homo sapiens
tgggtgtgagaatgatcaagga

SEQ ID NO: 4089754 - DNA, 20 bp, Homo sapiens
tgggtgttcctggcagttta

SEQ ID NO: 4089755 - DNA, 17 bp, Homo sapiens
tgggtgttctttcctgc

SEQ ID NO: 4089756 - DNA, 15 bp, Homo sapiens
tgggtgtttcagttt

SEQ ID NO: 4089757 - DNA, 15 bp, Homo sapiens
tgggttattctggag

SEQ ID NO: 4089758 - DNA, 24 bp, Homo sapiens
tgggttcaggggactcagccctga

SEQ ID NO: 4089759 - DNA, 13 bp, Homo sapiens
tgggttcattatt

SEQ ID NO: 4089760 - DNA, 14 bp, Homo sapiens
tgggttctgcctgc

SEQ ID NO: 4089761 - DNA, 15 bp, Homo sapiens
tgggtttttgttacc

SEQ ID NO: 4089762 - DNA, 22 bp, Homo sapiens
tgggtttttgttacctttatgg

SEQ ID NO: 4089763 - DNA, 17 bp, Homo sapiens
tggtaacagttcatgtt

SEQ ID NO: 4089764 - DNA, 12 bp, Homo sapiens
tggtaagaaaaa

SEQ ID NO: 4089765 - DNA, 16 bp, Homo sapiens
tggtaatcatatgtgt

SEQ ID NO: 4089766 - DNA, 22 bp, Homo sapiens
tggtaatttaagattccagaga

SEQ ID NO: 4089767 - DNA, 21 bp, Homo sapiens
tggtacttttatgatgtatat

SEQ ID NO: 4089768 - DNA, 17 bp, Homo sapiens
tggtacttttgagtgtg

SEQ ID NO: 4089769 - DNA, 18 bp, Homo sapiens
tggtacttttgagtgtgt

SEQ ID NO: 4089770 - DNA, 12 bp, Homo sapiens
tggtagagagag

SEQ ID NO: 4089771 - DNA, 18 bp, Homo sapiens
tggtagattaaatataga

SEQ ID NO: 4089772 - DNA, 22 bp, Homo sapiens
tggtagcataaataaaactgaa

SEQ ID NO: 4089773 - DNA, 22 bp, Homo sapiens
tggtagtggaatagtgaatact

SEQ ID NO: 4089774 - DNA, 17 bp, Homo sapiens
tggtagttgaggaaagc

SEQ ID NO: 4089775 - DNA, 16 bp, Homo sapiens
tggtataatgtttaaa

SEQ ID NO: 4089776 - DNA, 19 bp, Homo sapiens
tggtataatgtttaaatca

SEQ ID NO: 4089777 - DNA, 20 bp, Homo sapiens
tggtataatgtttaaatcat

SEQ ID NO: 4089778 - DNA, 22 bp, Homo sapiens
tggtatatggcttcaagttgta

SEQ ID NO: 4089779 - DNA, 15 bp, Homo sapiens
tggtatcaagaaagt

SEQ ID NO: 4089780 - DNA, 22 bp, Homo sapiens
tggtatcctgtgacatgtaaca

SEQ ID NO: 4089781 - DNA, 14 bp, Homo sapiens
tggtatgagctgag

SEQ ID NO: 4089782 - DNA, 18 bp, Homo sapiens
tggtatgctggccagcac

SEQ ID NO: 4089783 - DNA, 22 bp, Homo sapiens
tggtatgctggccagcaccctc

SEQ ID NO: 4089784 - DNA, 13 bp, Homo sapiens
tggtatgtctgcc

SEQ ID NO: 4089785 - DNA, 19 bp, Homo sapiens
tggtatgtgacaccaaagc

SEQ ID NO: 4089786 - DNA, 19 bp, Homo sapiens
tggtattattctgttttgc

SEQ ID NO: 4089787 - DNA, 15 bp, Homo sapiens
tggtcaagttgagat

SEQ ID NO: 4089788 - DNA, 14 bp, Homo sapiens
tggtcacagccagg

SEQ ID NO: 4089789 - DNA, 15 bp, Homo sapiens
tggtcacagcctcct

SEQ ID NO: 4089790 - DNA, 18 bp, Homo sapiens
tggtcacagcctcctctg

SEQ ID NO: 4089791 - DNA, 21 bp, Homo sapiens
tggtcactaaccaacaaggtt

SEQ ID NO: 4089792 - DNA, 14 bp, Homo sapiens
tggtcactgtgcac

SEQ ID NO: 4089793 - DNA, 18 bp, Homo sapiens
tggtcactgtgcactgcc

SEQ ID NO: 4089794 - DNA, 16 bp, Homo sapiens
tggtcacttcttctgt

SEQ ID NO: 4089795 - DNA, 12 bp, Homo sapiens
tggtcagaggag

SEQ ID NO: 4089796 - DNA, 15 bp, Homo sapiens
tggtcagcttttgtt

SEQ ID NO: 4089797 - DNA, 16 bp, Homo sapiens
tggtcatttcccccaa

SEQ ID NO: 4089798 - DNA, 23 bp, Homo sapiens
tggtccaattagtttccttttta

SEQ ID NO: 4089799 - DNA, 13 bp, Homo sapiens
tggtccagaaact

SEQ ID NO: 4089800 - DNA, 21 bp, Homo sapiens
tgtacatgttcgggtgtgggt

SEQ ID NO: 4089801 - DNA, 15 bp, Homo sapiens
tgtacatttaaaatt

SEQ ID NO: 4089802 - DNA, 21 bp, Homo sapiens
tgtacatttatgatttaataa

SEQ ID NO: 4089803 - DNA, 16 bp, Homo sapiens
tgtaccaaatctgaca

SEQ ID NO: 4089804 - DNA, 17 bp, Homo sapiens
tgtaccaaatctgacat

SEQ ID NO: 4089805 - DNA, 15 bp, Homo sapiens
tgtaccacagacaca

SEQ ID NO: 4089806 - DNA, 18 bp, Homo sapiens
tgtaccatatgatctgtt

SEQ ID NO: 4089807 - DNA, 12 bp, Homo sapiens
tgtaccatgtac

SEQ ID NO: 4089808 - DNA, 15 bp, Homo sapiens
tgtacccagatgcct

SEQ ID NO: 4089809 - DNA, 15 bp, Homo sapiens
tgtacctcctctcag

SEQ ID NO: 4089810 - DNA, 20 bp, Homo sapiens
tgtacctcctctcagtgttt

SEQ ID NO: 4089811 - DNA, 22 bp, Homo sapiens
tgtaccttttgaggagccccag

SEQ ID NO: 4089812 - DNA, 13 bp, Homo sapiens
tgtactagtttta

SEQ ID NO: 4089813 - DNA, 23 bp, Homo sapiens
tgtactgaatttttttgtaataa

SEQ ID NO: 4089814 - DNA, 19 bp, Homo sapiens
tgtactgagccttgtaatt

SEQ ID NO: 4089815 - DNA, 19 bp, Homo sapiens
tgtactgtatggaaacact

SEQ ID NO: 4089816 - DNA, 21 bp, Homo sapiens
tgtacttaataaattcagata

SEQ ID NO: 4089817 - DNA, 22 bp, Homo sapiens
tgtacttaataaattcagatat

SEQ ID NO: 4089818 - DNA, 14 bp, Homo sapiens
tgtacttcaagtta

SEQ ID NO: 4089819 - DNA, 18 bp, Homo sapiens
tgtacttcccgggccagg

SEQ ID NO: 4089820 - DNA, 21 bp, Homo sapiens
tgtacttcccgggccagggct

SEQ ID NO: 4089821 - DNA, 15 bp, Homo sapiens
tgtacttgatttgat

SEQ ID NO: 4089822 - DNA, 14 bp, Homo sapiens
tgtacttgtttcat

SEQ ID NO: 4089823 - DNA, 20 bp, Homo sapiens
tgtacttgtttcatctggtt

SEQ ID NO: 4089824 - DNA, 14 bp, Homo sapiens
tgtacttgtttgca

SEQ ID NO: 4089825 - DNA, 19 bp, Homo sapiens
tgtactttctaagagaaag

SEQ ID NO: 4089826 - DNA, 18 bp, Homo sapiens
tgtactttttagttgttc

SEQ ID NO: 4089827 - DNA, 15 bp, Homo sapiens
tgtagaaaggaagcc

SEQ ID NO: 4089828 - DNA, 23 bp, Homo sapiens
tgtagaaaggaagccttgctcat

SEQ ID NO: 4089829 - DNA, 14 bp, Homo sapiens
tgtagaacactaat

SEQ ID NO: 4089830 - DNA, 15 bp, Homo sapiens
tgtagaacactaatt

SEQ ID NO: 4089831 - DNA, 20 bp, Homo sapiens
tgtagaacactaattcataa

SEQ ID NO: 4089832 - DNA, 17 bp, Homo sapiens
tgtagaactcactctgg

SEQ ID NO: 4089833 - DNA, 13 bp, Homo sapiens
tgtagaagcattc

SEQ ID NO: 4089834 - DNA, 17 bp, Homo sapiens
tgtagaagcattccttc

SEQ ID NO: 4089835 - DNA, 22 bp, Homo sapiens
tgtagaagcattccttctttga

SEQ ID NO: 4089836 - DNA, 21 bp, Homo sapiens
tgtagacctagggaggacctt

SEQ ID NO: 4089837 - DNA, 15 bp, Homo sapiens
tgtagagagaacagg

SEQ ID NO: 4089838 - DNA, 19 bp, Homo sapiens
tgtagagttaagaagctgt

SEQ ID NO: 4089839 - DNA, 21 bp, Homo sapiens
tgtagagttaagaagctgttg

SEQ ID NO: 4089840 - DNA, 13 bp, Homo sapiens
tgtagagttgctg

SEQ ID NO: 4089841 - DNA, 14 bp, Homo sapiens
tgtagagttgctga

SEQ ID NO: 4089842 - DNA, 15 bp, Homo sapiens
tgtagagttgctgag

SEQ ID NO: 4089843 - DNA, 21 bp, Homo sapiens
tgtagatattgtgaagtacat

SEQ ID NO: 4089844 - DNA, 22 bp, Homo sapiens
tgtagatattgtgaagtacata

SEQ ID NO: 4089845 - DNA, 13 bp, Homo sapiens
tgtagatgcagaa

SEQ ID NO: 4089846 - DNA, 18 bp, Homo sapiens
tgtagatgcagaaaaaga

SEQ ID NO: 4089847 - DNA, 21 bp, Homo sapiens
tgtagatgggggaactgtgaa

SEQ ID NO: 4089848 - DNA, 15 bp, Homo sapiens
tgtagcatataggtg

SEQ ID NO: 4089849 - DNA, 18 bp, Homo sapiens
tgtagccacagctgctgt

SEQ ID NO: 4089850 - DNA, 23 bp, Homo sapiens
tgtagccacagctgctgttctca

SEQ ID NO: 4089851 - DNA, 22 bp, Homo sapiens
tgtagccaggtatggctctgca

SEQ ID NO: 4089852 - DNA, 20 bp, Homo sapiens
tgtagccatggctgggcgtg

SEQ ID NO: 4089853 - DNA, 17 bp, Homo sapiens
tgtagccccctggcctc

SEQ ID NO: 4089854 - DNA, 19 bp, Homo sapiens
tgtagccccctggcctctg

SEQ ID NO: 4089855 - DNA, 13 bp, Homo sapiens
tgtagcctttttg

SEQ ID NO: 4089856 - DNA, 21 bp, Homo sapiens
tgtagcgtgtttacatgtgta

SEQ ID NO: 4089857 - DNA, 20 bp, Homo sapiens
tgtagctctgcatctcctgt

SEQ ID NO: 4089858 - DNA, 22 bp, Homo sapiens
tgtagcttttggggagggaggg

SEQ ID NO: 4089859 - DNA, 20 bp, Homo sapiens
tgtaggaaggttaatgttca

SEQ ID NO: 4089860 - DNA, 12 bp, Homo sapiens
tgtaggctgggg

SEQ ID NO: 4089861 - DNA, 23 bp, Homo sapiens
tgtaggggcttacaaagccttac

SEQ ID NO: 4089862 - DNA, 20 bp, Homo sapiens
tgtaggtgcaagatggaaag

SEQ ID NO: 4089863 - DNA, 16 bp, Homo sapiens
tgtaggtggtatgtga

SEQ ID NO: 4089864 - DNA, 19 bp, Homo sapiens
tgtaggtgtctgcacccag

SEQ ID NO: 4089865 - DNA, 20 bp, Homo sapiens
tgtaggtgtctgcacccagg

SEQ ID NO: 4089866 - DNA, 14 bp, Homo sapiens
tgtagtaattgaca

SEQ ID NO: 4089867 - DNA, 15 bp, Homo sapiens
tgtagtaattgacat

SEQ ID NO: 4089868 - DNA, 18 bp, Homo sapiens
tgtagtaattgacatgtg

SEQ ID NO: 4089869 - DNA, 14 bp, Homo sapiens
tgtagtcaggtgct

SEQ ID NO: 4089870 - DNA, 23 bp, Homo sapiens
tgtagtcccagctacttgggagg

SEQ ID NO: 4089871 - DNA, 21 bp, Homo sapiens
tgtagtcctcataaaaagcaa

SEQ ID NO: 4089872 - DNA, 17 bp, Homo sapiens
tgtagtgtagtcaggtg

SEQ ID NO: 4089873 - DNA, 18 bp, Homo sapiens
tgtagtgttcagaaaaaa

SEQ ID NO: 4089874 - DNA, 13 bp, Homo sapiens
tgtagttaatgat

SEQ ID NO: 4089875 - DNA, 17 bp, Homo sapiens
tgtagttaatttatcta

SEQ ID NO: 4089876 - DNA, 15 bp, Homo sapiens
tgtagttctgccagg

SEQ ID NO: 4089877 - DNA, 18 bp, Homo sapiens
tgtagttctgccaggcaa

SEQ ID NO: 4089878 - DNA, 19 bp, Homo sapiens
tgtagtttttcttcaacat

SEQ ID NO: 4089879 - DNA, 13 bp, Homo sapiens
tgtataaaataga

SEQ ID NO: 4089880 - DNA, 15 bp, Homo sapiens
tgtataaaatagaca

SEQ ID NO: 4089881 - DNA, 19 bp, Homo sapiens
tgtataaacataagttgca

SEQ ID NO: 4089882 - DNA, 13 bp, Homo sapiens
tgtataaagaaca

SEQ ID NO: 4089883 - DNA, 14 bp, Homo sapiens
tgtataaataggag

SEQ ID NO: 4089884 - DNA, 18 bp, Homo sapiens
tgtataaataggagagga

SEQ ID NO: 4089885 - DNA, 16 bp, Homo sapiens
tgtataagcactgaaa

SEQ ID NO: 4089886 - DNA, 19 bp, Homo sapiens
tgtataagtggaggcactt

SEQ ID NO: 4089887 - DNA, 21 bp, Homo sapiens
tgtataagtggaggcacttta

SEQ ID NO: 4089888 - DNA, 20 bp, Homo sapiens
tgtatagatgcaagatattt

SEQ ID NO: 4089889 - DNA, 14 bp, Homo sapiens
tgtatagttcacgt

SEQ ID NO: 4089890 - DNA, 13 bp, Homo sapiens
tgtatatacagtt

SEQ ID NO: 4089891 - DNA, 16 bp, Homo sapiens
tgtatatacagttatt

SEQ ID NO: 4089892 - DNA, 13 bp, Homo sapiens
tgtatatactttt

SEQ ID NO: 4089893 - DNA, 22 bp, Homo sapiens
tgtatatatttcctatattgtt

SEQ ID NO: 4089894 - DNA, 17 bp, Homo sapiens
tgtatatcattctacag

SEQ ID NO: 4089895 - DNA, 23 bp, Homo sapiens
tgtatattacacatttgtacaga

SEQ ID NO: 4089896 - DNA, 21 bp, Homo sapiens
tgtatattatggaagatttta

SEQ ID NO: 4089897 - DNA, 23 bp, Homo sapiens
tgtatattgagaatcccttaaaa

SEQ ID NO: 4089898 - DNA, 16 bp, Homo sapiens
tgtatatttgtacaaa

SEQ ID NO: 4089899 - DNA, 15 bp, Homo sapiens
tgtatatttgtatat

SEQ ID NO: 4089900 - DNA, 21 bp, Homo sapiens
tgtatatttgtgatagcactt

SEQ ID NO: 4089901 - DNA, 22 bp, Homo sapiens
tgtatatttttatattgttttt

SEQ ID NO: 4089902 - DNA, 23 bp, Homo sapiens
tgtcagcgttctaccaggcaaat

SEQ ID NO: 4089903 - DNA, 21 bp, Homo sapiens
tgtcagctactaatgatgttt

SEQ ID NO: 4089904 - DNA, 13 bp, Homo sapiens
tgtcagctgaggc

SEQ ID NO: 4089905 - DNA, 14 bp, Homo sapiens
tgtcagctgaggct

SEQ ID NO: 4089906 - DNA, 19 bp, Homo sapiens
tgtcagctgaggctggggg

SEQ ID NO: 4089907 - DNA, 14 bp, Homo sapiens
tgtcagctttgact

SEQ ID NO: 4089908 - DNA, 16 bp, Homo sapiens
tgtcaggaacagaagg

SEQ ID NO: 4089909 - DNA, 18 bp, Homo sapiens
tgtcaggaacagaaggat

SEQ ID NO: 4089910 - DNA, 22 bp, Homo sapiens
tgtcaggcccccagtgggacca

SEQ ID NO: 4089911 - DNA, 15 bp, Homo sapiens
tgtcagtcacagcca

SEQ ID NO: 4089912 - DNA, 21 bp, Homo sapiens
tgtcagttcttggtgctctgt

SEQ ID NO: 4089913 - DNA, 14 bp, Homo sapiens
tgtcataagaatga

SEQ ID NO: 4089914 - DNA, 16 bp, Homo sapiens
tgtcataagaatgaat

SEQ ID NO: 4089915 - DNA, 13 bp, Homo sapiens
tgtcatagccagt

SEQ ID NO: 4089916 - DNA, 16 bp, Homo sapiens
tgtcatatactgccat

SEQ ID NO: 4089917 - DNA, 21 bp, Homo sapiens
tgtcatatgtaggtgtctgca

SEQ ID NO: 4089918 - DNA, 15 bp, Homo sapiens
tgtcatcagaagata

SEQ ID NO: 4089919 - DNA, 16 bp, Homo sapiens
tgtcatcagaagataa

SEQ ID NO: 4089920 - DNA, 14 bp, Homo sapiens
tgctggcctttgct

SEQ ID NO: 4089921 - DNA, 13 bp, Homo sapiens
tgctggctgccca

SEQ ID NO: 4089922 - DNA, 14 bp, Homo sapiens
tgctggctgcccag

SEQ ID NO: 4089923 - DNA, 14 bp, Homo sapiens
tgctggctgcctta

SEQ ID NO: 4089924 - DNA, 15 bp, Homo sapiens
tgctggctgccttag

SEQ ID NO: 4089925 - DNA, 21 bp, Homo sapiens
tgctggctgccttagaacctt

SEQ ID NO: 4089926 - DNA, 17 bp, Homo sapiens
tgctggcttccagcttc

SEQ ID NO: 4089927 - DNA, 15 bp, Homo sapiens
tgctgggaccagagc

SEQ ID NO: 4089928 - DNA, 19 bp, Homo sapiens
tgcttgaaggccctgctga

SEQ ID NO: 4089929 - DNA, 19 bp, Homo sapiens
tgcttgaccgtactctcac

SEQ ID NO: 4089930 - DNA, 14 bp, Homo sapiens
tgcttgagcccagg

SEQ ID NO: 4089931 - DNA, 14 bp, Homo sapiens
tgcttgatgaagca

SEQ ID NO: 4089932 - DNA, 19 bp, Homo sapiens
tgcttgatgaagcaaggaa

SEQ ID NO: 4089933 - DNA, 17 bp, Homo sapiens
tgcttgcccaagtcaca

SEQ ID NO: 4089934 - DNA, 18 bp, Homo sapiens
tgcttgctcatatgcatg

SEQ ID NO: 4089935 - DNA, 14 bp, Homo sapiens
tgcttggcccggcc

SEQ ID NO: 4089936 - DNA, 13 bp, Homo sapiens
tgcttggtctgtt

SEQ ID NO: 4089937 - DNA, 13 bp, Homo sapiens
tgcttggtgctgg

SEQ ID NO: 4089938 - DNA, 15 bp, Homo sapiens
tgcttggtgctggtt

SEQ ID NO: 4089939 - DNA, 21 bp, Homo sapiens
tgcttgtaatcaagcctttat

SEQ ID NO: 4089940 - DNA, 17 bp, Homo sapiens
tgcttgtcattccagag

SEQ ID NO: 4089941 - DNA, 20 bp, Homo sapiens
tgcttgtcattccagagtgc

SEQ ID NO: 4089942 - DNA, 15 bp, Homo sapiens
tgcttgtcattgact

SEQ ID NO: 4089943 - DNA, 22 bp, Homo sapiens
tgcttgtcattgactcttgcgt

SEQ ID NO: 4089944 - DNA, 17 bp, Homo sapiens
tgcttgtcgctttctca

SEQ ID NO: 4089945 - DNA, 22 bp, Homo sapiens
tgcttgtcgctttctcagtgtg

SEQ ID NO: 4089946 - DNA, 15 bp, Homo sapiens
tgcttgtgttaagta

SEQ ID NO: 4089947 - DNA, 13 bp, Homo sapiens
tgcttgtttatga

SEQ ID NO: 4089948 - DNA, 20 bp, Homo sapiens
tgcttgtttatgatatttct

SEQ ID NO: 4089949 - DNA, 17 bp, Homo sapiens
tgctttaggctcacggc

SEQ ID NO: 4089950 - DNA, 14 bp, Homo sapiens
tgctttattccaga

SEQ ID NO: 4089951 - DNA, 12 bp, Homo sapiens
tgctttccaagc

SEQ ID NO: 4089952 - DNA, 13 bp, Homo sapiens
tgctttctgaaat

SEQ ID NO: 4089953 - DNA, 14 bp, Homo sapiens
tgctttctgttcca

SEQ ID NO: 4089954 - DNA, 15 bp, Homo sapiens
tgctttctgttccaa

SEQ ID NO: 4089955 - DNA, 11 bp, Homo sapiens
tgctttcttac

SEQ ID NO: 4089956 - DNA, 13 bp, Homo sapiens
tgctttcttgtct

SEQ ID NO: 4089957 - DNA, 17 bp, Homo sapiens
tgctttgatttacagca

SEQ ID NO: 4089958 - DNA, 17 bp, Homo sapiens
tgctttgcacaggaaag

SEQ ID NO: 4089959 - DNA, 16 bp, Homo sapiens
tgctttgcatctttgt

SEQ ID NO: 4089960 - DNA, 21 bp, Homo sapiens
tgctttgcctctaccagttgg

SEQ ID NO: 4089961 - DNA, 14 bp, Homo sapiens
tgctttgctcttgt

SEQ ID NO: 4089962 - DNA, 15 bp, Homo sapiens
tgctttgggctgccc

SEQ ID NO: 4089963 - DNA, 16 bp, Homo sapiens
tgctttgggctgccct

SEQ ID NO: 4089964 - DNA, 22 bp, Homo sapiens
tgctttgtaaattgtgttgtct

SEQ ID NO: 4089965 - DNA, 12 bp, Homo sapiens
tgctttgtctcc

SEQ ID NO: 4089966 - DNA, 13 bp, Homo sapiens
tgcttttaattaa

SEQ ID NO: 4089967 - DNA, 14 bp, Homo sapiens
tgcttttattttga

SEQ ID NO: 4089968 - DNA, 18 bp, Homo sapiens
tgcttttctgccctggct

SEQ ID NO: 4089969 - DNA, 15 bp, Homo sapiens
tgcttttctgtcctg

SEQ ID NO: 4089970 - DNA, 17 bp, Homo sapiens
tgcttttctgtcctggg

SEQ ID NO: 4089971 - DNA, 19 bp, Homo sapiens
tgcttttctgtcctgggca

SEQ ID NO: 4089972 - DNA, 21 bp, Homo sapiens
tgcttttgtttgctcttttaa

SEQ ID NO: 4089973 - DNA, 15 bp, Homo sapiens
tgctttttatttctg

SEQ ID NO: 4089974 - DNA, 18 bp, Homo sapiens
tgctttttatttctgcat

SEQ ID NO: 4089975 - DNA, 14 bp, Homo sapiens
tgctttttcttgtt

SEQ ID NO: 4089976 - DNA, 14 bp, Homo sapiens
tgcttttttttcct

SEQ ID NO: 4089977 - DNA, 11 bp, Homo sapiens
tggaaaaatgg

SEQ ID NO: 4089978 - DNA, 14 bp, Homo sapiens
tggaaaaatggttg

SEQ ID NO: 4089979 - DNA, 22 bp, Homo sapiens
tggaaaaatggttgatggaaaa

SEQ ID NO: 4089980 - DNA, 18 bp, Homo sapiens
tggaaaagaagaaacttt

SEQ ID NO: 4089981 - DNA, 21 bp, Homo sapiens
tggaaaagaagaaactttgcc

SEQ ID NO: 4089982 - DNA, 22 bp, Homo sapiens
tggaaaagaagaaactttgcct

SEQ ID NO: 4089983 - DNA, 15 bp, Homo sapiens
tggaaaaggaagact

SEQ ID NO: 4089984 - DNA, 13 bp, Homo sapiens
tggaaaataaaca

SEQ ID NO: 4089985 - DNA, 15 bp, Homo sapiens
tggaaaataaattat

SEQ ID NO: 4089986 - DNA, 22 bp, Homo sapiens
tggaaaatttcagtccagaaga

SEQ ID NO: 4089987 - DNA, 12 bp, Homo sapiens
tggaaacaatgt

SEQ ID NO: 4089988 - DNA, 14 bp, Homo sapiens
tggaaacaggacca

SEQ ID NO: 4089989 - DNA, 20 bp, Homo sapiens
tggaaacatttatattttta

SEQ ID NO: 4089990 - DNA, 18 bp, Homo sapiens
tggaaactctttaacttc

SEQ ID NO: 4089991 - DNA, 19 bp, Homo sapiens
tggaaactctttaacttct

SEQ ID NO: 4089992 - DNA, 21 bp, Homo sapiens
tggaaactgctaaattctatg

SEQ ID NO: 4089993 - DNA, 20 bp, Homo sapiens
tggaaagagtgttggtgttg

SEQ ID NO: 4089994 - DNA, 21 bp, Homo sapiens
tggaaagatagagattgtttt

SEQ ID NO: 4089995 - DNA, 16 bp, Homo sapiens
tggaaagcaggatgta

SEQ ID NO: 4089996 - DNA, 19 bp, Homo sapiens
tggaaaggggagagcctgc

SEQ ID NO: 4089997 - DNA, 21 bp, Homo sapiens
tggaaaggggagagcctgctg

SEQ ID NO: 4089998 - DNA, 19 bp, Homo sapiens
tggaaaggtgtgagactgg

SEQ ID NO: 4089999 - DNA, 19 bp, Homo sapiens
tggaaagtaactcatttgt

SEQ ID NO: 4090000 - DNA, 14 bp, Homo sapiens
tggaaagtgaattt

SEQ ID NO: 4090001 - DNA, 17 bp, Homo sapiens
tggaaagtgaatttgaa

SEQ ID NO: 4090002 - DNA, 23 bp, Homo sapiens
tggaaagtgaatttgaatgaaaa

SEQ ID NO: 4090003 - DNA, 15 bp, Homo sapiens
tggaaatacacagtg

SEQ ID NO: 4090004 - DNA, 19 bp, Homo sapiens
tggaaatagaaagaagcca

SEQ ID NO: 4090005 - DNA, 15 bp, Homo sapiens
tggaaatattaagaa

SEQ ID NO: 4090006 - DNA, 14 bp, Homo sapiens
tggaaatattttga

SEQ ID NO: 4090007 - DNA, 21 bp, Homo sapiens
tggaaatattttgataataaa

SEQ ID NO: 4090008 - DNA, 17 bp, Homo sapiens
tggaaattggaagagca

SEQ ID NO: 4090009 - DNA, 14 bp, Homo sapiens
tggaacaccttggg

SEQ ID NO: 4090010 - DNA, 15 bp, Homo sapiens
tggaacacggccaca

SEQ ID NO: 4090011 - DNA, 16 bp, Homo sapiens
tggaacagaatgtttt

SEQ ID NO: 4090012 - DNA, 13 bp, Homo sapiens
tggaacagcggga

SEQ ID NO: 4090013 - DNA, 16 bp, Homo sapiens
tggaacagcgggagac

SEQ ID NO: 4090014 - DNA, 23 bp, Homo sapiens
tggaacatcctttgcagggcagc

SEQ ID NO: 4090015 - DNA, 13 bp, Homo sapiens
tggaaccagcccc

SEQ ID NO: 4090016 - DNA, 16 bp, Homo sapiens
tggaacccagactcag

SEQ ID NO: 4090017 - DNA, 17 bp, Homo sapiens
tggaacccagactcaga

SEQ ID NO: 4090018 - DNA, 14 bp, Homo sapiens
tggaaccttccctc

SEQ ID NO: 4090019 - DNA, 17 bp, Homo sapiens
tggaaccttccctccaa

SEQ ID NO: 4090020 - DNA, 16 bp, Homo sapiens
tggaacttacattgtt

SEQ ID NO: 4090021 - DNA, 21 bp, Homo sapiens
tggaagaaaaaaaccacacaa

SEQ ID NO: 4090022 - DNA, 22 bp, Homo sapiens
tggaagaaaaaaatcttctcca

SEQ ID NO: 4090023 - DNA, 13 bp, Homo sapiens
tggaagaagggag

SEQ ID NO: 4090024 - DNA, 21 bp, Homo sapiens
tggaagaagggagaagaaagg

SEQ ID NO: 4090025 - DNA, 23 bp, Homo sapiens
tggaagaggaacagcactgggga

SEQ ID NO: 4090026 - DNA, 23 bp, Homo sapiens
tgccccacactccccgccttaga

SEQ ID NO: 4090027 - DNA, 11 bp, Homo sapiens
tgccccaccca

SEQ ID NO: 4090028 - DNA, 16 bp, Homo sapiens
tgccccacccaagccc

SEQ ID NO: 4090029 - DNA, 23 bp, Homo sapiens
tgccccacgctgtggccctggag

SEQ ID NO: 4090030 - DNA, 13 bp, Homo sapiens
tgccccagagctg

SEQ ID NO: 4090031 - DNA, 14 bp, Homo sapiens
tgccccagagctgt

SEQ ID NO: 4090032 - DNA, 19 bp, Homo sapiens
tgccccagctgactgtggc

SEQ ID NO: 4090033 - DNA, 18 bp, Homo sapiens
tgccccaggaccagctca

SEQ ID NO: 4090034 - DNA, 19 bp, Homo sapiens
tgccccaggaccagctcag

SEQ ID NO: 4090035 - DNA, 19 bp, Homo sapiens
tgccccagggagtccaggg

SEQ ID NO: 4090036 - DNA, 24 bp, Homo sapiens
tgccccagtcggccccatctctca

SEQ ID NO: 4090037 - DNA, 12 bp, Homo sapiens
tgccccatgcct

SEQ ID NO: 4090038 - DNA, 15 bp, Homo sapiens
tgccccatgcctgtc

SEQ ID NO: 4090039 - DNA, 13 bp, Homo sapiens
tgcctctgggact

SEQ ID NO: 4090040 - DNA, 14 bp, Homo sapiens
tgcctctgggccat

SEQ ID NO: 4090041 - DNA, 11 bp, Homo sapiens
tgcctcttctt

SEQ ID NO: 4090042 - DNA, 11 bp, Homo sapiens
tgcctctttcc

SEQ ID NO: 4090043 - DNA, 19 bp, Homo sapiens
tgcctcttttccccatgaa

SEQ ID NO: 4090044 - DNA, 14 bp, Homo sapiens
tgcctgaaacagcc

SEQ ID NO: 4090045 - DNA, 13 bp, Homo sapiens
tgcctgacacact

SEQ ID NO: 4090046 - DNA, 19 bp, Homo sapiens
tgcctgacactgagcccca

SEQ ID NO: 4090047 - DNA, 20 bp, Homo sapiens
tgcctgactaatttttgtat

SEQ ID NO: 4090048 - DNA, 19 bp, Homo sapiens
tgcctgagaggcaggcata

SEQ ID NO: 4090049 - DNA, 15 bp, Homo sapiens
tgcctgagctgggga

SEQ ID NO: 4090050 - DNA, 18 bp, Homo sapiens
tgcctgaggggcagcctg

SEQ ID NO: 4090051 - DNA, 22 bp, Homo sapiens
tgcctgaggggcagcctgcctt

SEQ ID NO: 4090052 - DNA, 11 bp, Homo sapiens
tgcctgagggt

SEQ ID NO: 4090053 - DNA, 18 bp, Homo sapiens
tgcctgagggtggagact

SEQ ID NO: 4090054 - DNA, 15 bp, Homo sapiens
tgcctgccaccttca

SEQ ID NO: 4090055 - DNA, 16 bp, Homo sapiens
tgcctgccagctgcac

SEQ ID NO: 4090056 - DNA, 15 bp, Homo sapiens
tgcctgccccacacg

SEQ ID NO: 4090057 - DNA, 20 bp, Homo sapiens
tgcctgccctgtcaggaggc

SEQ ID NO: 4090058 - DNA, 15 bp, Homo sapiens
tgcctgccctttgtc

SEQ ID NO: 4090059 - DNA, 18 bp, Homo sapiens
tgcctgcgcctgctgcct

SEQ ID NO: 4090060 - DNA, 20 bp, Homo sapiens
tgcctgcgcctgctgcctgc

SEQ ID NO: 4090061 - DNA, 14 bp, Homo sapiens
tgcctgctgggctc

SEQ ID NO: 4090062 - DNA, 15 bp, Homo sapiens
tgcctggagacagat

SEQ ID NO: 4090063 - DNA, 16 bp, Homo sapiens
tgcctggagagggtct

SEQ ID NO: 4090064 - DNA, 17 bp, Homo sapiens
tgcctggagtgctgtgc

SEQ ID NO: 4090065 - DNA, 13 bp, Homo sapiens
tgcctggcactta

SEQ ID NO: 4090066 - DNA, 22 bp, Homo sapiens
tgcctggcacttactggtcctt

SEQ ID NO: 4090067 - DNA, 17 bp, Homo sapiens
tgcctggccagattttt

SEQ ID NO: 4090068 - DNA, 11 bp, Homo sapiens
tgcctggcccc

SEQ ID NO: 4090069 - DNA, 11 bp, Homo sapiens
tgcctggcctc

SEQ ID NO: 4090070 - DNA, 21 bp, Homo sapiens
tgcctgggaaggcgagtctgg

SEQ ID NO: 4090071 - DNA, 14 bp, Homo sapiens
tgcctgggaatgta

SEQ ID NO: 4090072 - DNA, 19 bp, Homo sapiens
tgcctgggggagttttcct

SEQ ID NO: 4090073 - DNA, 17 bp, Homo sapiens
tgcctggggtctgagca

SEQ ID NO: 4090074 - DNA, 17 bp, Homo sapiens
tgcctggtgaatggcct

SEQ ID NO: 4090075 - DNA, 15 bp, Homo sapiens
tgcctgtaacttgag

SEQ ID NO: 4090076 - DNA, 13 bp, Homo sapiens
tgcctgtctgccc

SEQ ID NO: 4090077 - DNA, 15 bp, Homo sapiens
tgcctgtctgcccca

SEQ ID NO: 4090078 - DNA, 16 bp, Homo sapiens
tgcctgtgccaataaa

SEQ ID NO: 4090079 - DNA, 19 bp, Homo sapiens
tgcctgtgccacccaccag

SEQ ID NO: 4090080 - DNA, 16 bp, Homo sapiens
tgccttaaaaccaaag

SEQ ID NO: 4090081 - DNA, 22 bp, Homo sapiens
tgccttaaaaccaaagagggct

SEQ ID NO: 4090082 - DNA, 15 bp, Homo sapiens
tgccttagcaggggt

SEQ ID NO: 4090083 - DNA, 20 bp, Homo sapiens
tgccttagtctcagtttgtg

SEQ ID NO: 4090084 - DNA, 14 bp, Homo sapiens
tgccttccataatt

SEQ ID NO: 4090085 - DNA, 17 bp, Homo sapiens
tgccttccataattatg

SEQ ID NO: 4090086 - DNA, 21 bp, Homo sapiens
tgccttccataattatgacag

SEQ ID NO: 4090087 - DNA, 14 bp, Homo sapiens
tgccttccctagct

SEQ ID NO: 4090088 - DNA, 16 bp, Homo sapiens
tgccttcctttctcca

SEQ ID NO: 4090089 - DNA, 22 bp, Homo sapiens
tgccttcctttctccaggacca

SEQ ID NO: 4090090 - DNA, 16 bp, Homo sapiens
tgccttctactcccct

SEQ ID NO: 4090091 - DNA, 17 bp, Homo sapiens
tgccttctactcccctt

SEQ ID NO: 4090092 - DNA, 22 bp, Homo sapiens
tgccttctcctctctgggcctt

SEQ ID NO: 4090093 - DNA, 16 bp, Homo sapiens
tgccttctttgaagaa

SEQ ID NO: 4090094 - DNA, 13 bp, Homo sapiens
tgccttcttttgt

SEQ ID NO: 4090095 - DNA, 14 bp, Homo sapiens
tgccttgcagccac

SEQ ID NO: 4090096 - DNA, 23 bp, Homo sapiens
tgccttgcccactcctgctctgc

SEQ ID NO: 4090097 - DNA, 21 bp, Homo sapiens
tgccttgctcggcgcccacca

SEQ ID NO: 4090098 - DNA, 19 bp, Homo sapiens
tgccttggagagggcccag

SEQ ID NO: 4090099 - DNA, 12 bp, Homo sapiens
tgccttggcctc

SEQ ID NO: 4090100 - DNA, 17 bp, Homo sapiens
tgccttggcctcccaaa

SEQ ID NO: 4090101 - DNA, 20 bp, Homo sapiens
tgccttgggccttgctgctg

SEQ ID NO: 4090102 - DNA, 21 bp, Homo sapiens
tgccttgggccttgctgctgc

SEQ ID NO: 4090103 - DNA, 11 bp, Homo sapiens
tgccttgggct

SEQ ID NO: 4090104 - DNA, 16 bp, Homo sapiens
tgccttgggctgctcc

SEQ ID NO: 4090105 - DNA, 20 bp, Homo sapiens
tgccttgtttgagtttttcc

SEQ ID NO: 4090106 - DNA, 16 bp, Homo sapiens
tgccttgttttttgtt

SEQ ID NO: 4090107 - DNA, 19 bp, Homo sapiens
tgcctttatctctgaggct

SEQ ID NO: 4090108 - DNA, 18 bp, Homo sapiens
tgcctttatttgctgtta

SEQ ID NO: 4090109 - DNA, 21 bp, Homo sapiens
tgcctttatttgctgttaact

SEQ ID NO: 4090110 - DNA, 18 bp, Homo sapiens
tgcctttcatagtttatt

SEQ ID NO: 4090111 - DNA, 16 bp, Homo sapiens
tgcctttcgaggcctg

SEQ ID NO: 4090112 - DNA, 17 bp, Homo sapiens
tgcctttcgaggcctga

SEQ ID NO: 4090113 - DNA, 17 bp, Homo sapiens
tgcctttcttctgccct

SEQ ID NO: 4090114 - DNA, 16 bp, Homo sapiens
tgcctttctttgcctc

SEQ ID NO: 4090115 - DNA, 18 bp, Homo sapiens
tgcctttctttgcctctg

SEQ ID NO: 4090116 - DNA, 21 bp, Homo sapiens
tgcctttgcagttggactctc

SEQ ID NO: 4090117 - DNA, 15 bp, Homo sapiens
tgcctttgtaagtta

SEQ ID NO: 4090118 - DNA, 22 bp, Homo sapiens
tgccttttgcagaagagggtgt

SEQ ID NO: 4090119 - DNA, 16 bp, Homo sapiens
tgccttttgctgcgca

SEQ ID NO: 4090120 - DNA, 20 bp, Homo sapiens
tgccttttgctgcgcaccaa

SEQ ID NO: 4090121 - DNA, 18 bp, Homo sapiens
tgcgaccttgcaacctca

SEQ ID NO: 4090122 - DNA, 19 bp, Homo sapiens
tgcgacggagagaaaaaag

SEQ ID NO: 4090123 - DNA, 16 bp, Homo sapiens
tgcgagtccaaggcca

SEQ ID NO: 4090124 - DNA, 13 bp, Homo sapiens
tgcgcaatgtggc

SEQ ID NO: 4090125 - DNA, 19 bp, Homo sapiens
tgcgcaccaatgcccagca

SEQ ID NO: 4090126 - DNA, 16 bp, Homo sapiens
tgcgccagtcctgcta

SEQ ID NO: 4090127 - DNA, 16 bp, Homo sapiens
tgcgcctcagccctca

SEQ ID NO: 4090128 - DNA, 13 bp, Homo sapiens
tgcgcctccagag

SEQ ID NO: 4090129 - DNA, 12 bp, Homo sapiens
tgcgcctgcagg

SEQ ID NO: 4090130 - DNA, 17 bp, Homo sapiens
tgcagaataatggaaac

SEQ ID NO: 4090131 - DNA, 20 bp, Homo sapiens
tgcagaataatggaaacatt

SEQ ID NO: 4090132 - DNA, 21 bp, Homo sapiens
tgcagacacgccttcccctca

SEQ ID NO: 4090133 - DNA, 23 bp, Homo sapiens
tgcagacaggccatgtgagccac

SEQ ID NO: 4090134 - DNA, 23 bp, Homo sapiens
tgcagaccatgaagtaaattatg

SEQ ID NO: 4090135 - DNA, 17 bp, Homo sapiens
tgcagacctcaagccat

SEQ ID NO: 4090136 - DNA, 15 bp, Homo sapiens
tgcagacttcccagc

SEQ ID NO: 4090137 - DNA, 21 bp, Homo sapiens
tgcagagaaacttaagcaaag

SEQ ID NO: 4090138 - DNA, 14 bp, Homo sapiens
tgcagagaagctgg

SEQ ID NO: 4090139 - DNA, 14 bp, Homo sapiens
tgcagagagaagcc

SEQ ID NO: 4090140 - DNA, 22 bp, Homo sapiens
tgcagagagccattttgtgaat

SEQ ID NO: 4090141 - DNA, 23 bp, Homo sapiens
tgcagagagccattttgtgaatg

SEQ ID NO: 4090142 - DNA, 13 bp, Homo sapiens
tgcagagctgaag

SEQ ID NO: 4090143 - DNA, 14 bp, Homo sapiens
tgcagaggaggtga

SEQ ID NO: 4090144 - DNA, 16 bp, Homo sapiens
tgcagaggaggtgaga

SEQ ID NO: 4090145 - DNA, 21 bp, Homo sapiens
tgcagaggaggtgagagtggg

SEQ ID NO: 4090146 - DNA, 23 bp, Homo sapiens
tgcagaggctcttgatggtggac

SEQ ID NO: 4090147 - DNA, 18 bp, Homo sapiens
tgcagagtaaattgctct

SEQ ID NO: 4090148 - DNA, 20 bp, Homo sapiens
tgcagagtaaattgctctgt

SEQ ID NO: 4090149 - DNA, 16 bp, Homo sapiens
tgcagattctatttcc

SEQ ID NO: 4090150 - DNA, 19 bp, Homo sapiens
tgcagcaaacactccaccc

SEQ ID NO: 4090151 - DNA, 22 bp, Homo sapiens
tgcagcaaacactccaccctcc

SEQ ID NO: 4090152 - DNA, 18 bp, Homo sapiens
tgcagcaaggccctgctg

SEQ ID NO: 4090153 - DNA, 12 bp, Homo sapiens
tgcagcacctcc

SEQ ID NO: 4090154 - DNA, 13 bp, Homo sapiens
tgcagcacgtctc

SEQ ID NO: 4090155 - DNA, 19 bp, Homo sapiens
tgcatggtgccccaggacc

SEQ ID NO: 4090156 - DNA, 22 bp, Homo sapiens
tgcatggtgccccaggaccagc

SEQ ID NO: 4090157 - DNA, 15 bp, Homo sapiens
tgcatgtggcttttt

SEQ ID NO: 4090158 - DNA, 11 bp, Homo sapiens
tgcatgtgtgt

SEQ ID NO: 4090159 - DNA, 19 bp, Homo sapiens
tgcatgttacataagataa

SEQ ID NO: 4090160 - DNA, 15 bp, Homo sapiens
tgcattacagagagg

SEQ ID NO: 4090161 - DNA, 19 bp, Homo sapiens
tgcattagaaatagacagt

SEQ ID NO: 4090162 - DNA, 14 bp, Homo sapiens
tgcattagaaatta

SEQ ID NO: 4090163 - DNA, 12 bp, Homo sapiens
tgcattcatttt

SEQ ID NO: 4090164 - DNA, 15 bp, Homo sapiens
tgcattcattttctg

SEQ ID NO: 4090165 - DNA, 18 bp, Homo sapiens
tgcattccagaatcttga

SEQ ID NO: 4090166 - DNA, 16 bp, Homo sapiens
tgcattccctgaatct

SEQ ID NO: 4090167 - DNA, 20 bp, Homo sapiens
tgcattccctgaatctgtgc

SEQ ID NO: 4090168 - DNA, 23 bp, Homo sapiens
tgcattccctgaatctgtgcctg

SEQ ID NO: 4090169 - DNA, 16 bp, Homo sapiens
tgcattcctttgtctt

SEQ ID NO: 4090170 - DNA, 18 bp, Homo sapiens
tgcattcgttgtgttttt

SEQ ID NO: 4090171 - DNA, 13 bp, Homo sapiens
tgcattctattgc

SEQ ID NO: 4090172 - DNA, 17 bp, Homo sapiens
tgcattctattgccttc

SEQ ID NO: 4090173 - DNA, 20 bp, Homo sapiens
tgcattctattgccttcttt

SEQ ID NO: 4090174 - DNA, 15 bp, Homo sapiens
tgcattcttctctgt

SEQ ID NO: 4090175 - DNA, 14 bp, Homo sapiens
tgcattgaacacaa

SEQ ID NO: 4090176 - DNA, 19 bp, Homo sapiens
tgcattgaacacaaactgt

SEQ ID NO: 4090177 - DNA, 14 bp, Homo sapiens
tgcattgaatatat

SEQ ID NO: 4090178 - DNA, 20 bp, Homo sapiens
tgcattgaccgcgactaatt

SEQ ID NO: 4090179 - DNA, 21 bp, Homo sapiens
tgcattgactttcagtaaaca

SEQ ID NO: 4090180 - DNA, 16 bp, Homo sapiens
tgcattgaggaaatat

SEQ ID NO: 4090181 - DNA, 17 bp, Homo sapiens
tgcattgaggaaatatt

SEQ ID NO: 4090182 - DNA, 16 bp, Homo sapiens
tgcattgctagataaa

SEQ ID NO: 4090183 - DNA, 17 bp, Homo sapiens
tgcattgctagataaaa

SEQ ID NO: 4090184 - DNA, 18 bp, Homo sapiens
tgcattgctagataaaag

SEQ ID NO: 4090185 - DNA, 19 bp, Homo sapiens
tgcattgcttttttttcct

SEQ ID NO: 4090186 - DNA, 15 bp, Homo sapiens
tgcattgttggctat

SEQ ID NO: 4090187 - DNA, 16 bp, Homo sapiens
tgcatttagcttcttt

SEQ ID NO: 4090188 - DNA, 19 bp, Homo sapiens
tgcatttagcttctttccc

SEQ ID NO: 4090189 - DNA, 22 bp, Homo sapiens
tgcatttatttatacagtgcct

SEQ ID NO: 4090190 - DNA, 12 bp, Homo sapiens
tgcatttcaagc

SEQ ID NO: 4090191 - DNA, 17 bp, Homo sapiens
tgcatttgagagaagcc

SEQ ID NO: 4090192 - DNA, 22 bp, Homo sapiens
tgcatttgagagaagccacgct

SEQ ID NO: 4090193 - DNA, 13 bp, Homo sapiens
tgcatttgaggtc

SEQ ID NO: 4090194 - DNA, 14 bp, Homo sapiens
tgcatttgcttttg

SEQ ID NO: 4090195 - DNA, 17 bp, Homo sapiens
tgcattttcaccccacc

SEQ ID NO: 4090196 - DNA, 15 bp, Homo sapiens
tgcattttgctattg

SEQ ID NO: 4090197 - DNA, 22 bp, Homo sapiens
tgcattttgctattgtaaatat

SEQ ID NO: 4090198 - DNA, 20 bp, Homo sapiens
tgcatttttggatcattttt

SEQ ID NO: 4090199 - DNA, 14 bp, Homo sapiens
tgcatttttgtgaa

SEQ ID NO: 4090200 - DNA, 16 bp, Homo sapiens
tgccaaaaaaaaaaga

SEQ ID NO: 4090201 - DNA, 17 bp, Homo sapiens
tgccaaaaaaaaaagaa

SEQ ID NO: 4090202 - DNA, 16 bp, Homo sapiens
tgccaaaaccaggcct

SEQ ID NO: 4090203 - DNA, 17 bp, Homo sapiens
tgccaaaaccaggcctc

SEQ ID NO: 4090204 - DNA, 19 bp, Homo sapiens
tgccaaaatcattttaatg

SEQ ID NO: 4090205 - DNA, 23 bp, Homo sapiens
tgccaaacaaaaaggttctcagg

SEQ ID NO: 4090206 - DNA, 18 bp, Homo sapiens
tgccaaatatgtcctggg

SEQ ID NO: 4090207 - DNA, 12 bp, Homo sapiens
tgccaaatgctc

SEQ ID NO: 4090208 - DNA, 14 bp, Homo sapiens
tgccaaatgctggg

SEQ ID NO: 4090209 - DNA, 18 bp, Homo sapiens
tgccaaattgtagttctt

SEQ ID NO: 4090210 - DNA, 15 bp, Homo sapiens
tgccaaccctgggct

SEQ ID NO: 4090211 - DNA, 16 bp, Homo sapiens
tgccaaccctgggcta

SEQ ID NO: 4090212 - DNA, 18 bp, Homo sapiens
tgccaactgccaggctgc

SEQ ID NO: 4090213 - DNA, 23 bp, Homo sapiens
tgccaactgttgtaactaggctc

SEQ ID NO: 4090214 - DNA, 21 bp, Homo sapiens
tgccaagaaaagggctgacat

SEQ ID NO: 4090215 - DNA, 16 bp, Homo sapiens
tgccaagaaaatgaag

SEQ ID NO: 4090216 - DNA, 16 bp, Homo sapiens
tgccaaggccagagtg

SEQ ID NO: 4090217 - DNA, 20 bp, Homo sapiens
tgccaaggccagagtggcct

SEQ ID NO: 4090218 - DNA, 21 bp, Homo sapiens
tgccaaggccagagtggcctg

SEQ ID NO: 4090219 - DNA, 20 bp, Homo sapiens
tgccaataaccaagtttatt

SEQ ID NO: 4090220 - DNA, 21 bp, Homo sapiens
tgccaatattaaatctgctgg

SEQ ID NO: 4090221 - DNA, 21 bp, Homo sapiens
tgccaatgaggtctgaaatgg

SEQ ID NO: 4090222 - DNA, 16 bp, Homo sapiens
tgccaatgatgtgacc

SEQ ID NO: 4090223 - DNA, 16 bp, Homo sapiens
tgccacaaggacttcc

SEQ ID NO: 4090224 - DNA, 19 bp, Homo sapiens
tgccacaaggacttcctgt

SEQ ID NO: 4090225 - DNA, 22 bp, Homo sapiens
tgccacacaaggatagatgctg

SEQ ID NO: 4090226 - DNA, 23 bp, Homo sapiens
tgccacacagagtggtctttctg

SEQ ID NO: 4090227 - DNA, 22 bp, Homo sapiens
tgccacaccctcccccgccact

SEQ ID NO: 4090228 - DNA, 16 bp, Homo sapiens
tgccacagcttttgca

SEQ ID NO: 4090229 - DNA, 17 bp, Homo sapiens
tgccacagtagaactgt

SEQ ID NO: 4090230 - DNA, 22 bp, Homo sapiens
tgccacagtagaactgtctgtg

SEQ ID NO: 4090231 - DNA, 16 bp, Homo sapiens
tgccacatacaggtgc

SEQ ID NO: 4090232 - DNA, 17 bp, Homo sapiens
tgccacatacaggtgct

SEQ ID NO: 4090233 - DNA, 15 bp, Homo sapiens
tgccacatggagccc

SEQ ID NO: 4090234 - DNA, 11 bp, Homo sapiens
tgccacatttc

SEQ ID NO: 4090235 - DNA, 13 bp, Homo sapiens
tgccacatttctg

SEQ ID NO: 4090236 - DNA, 12 bp, Homo sapiens
tgccaccaggag

SEQ ID NO: 4090237 - DNA, 23 bp, Homo sapiens
tctctatttccccctttcttcct

SEQ ID NO: 4090238 - DNA, 13 bp, Homo sapiens
tctctcaaatctg

SEQ ID NO: 4090239 - DNA, 14 bp, Homo sapiens
tctctcaggagcac

SEQ ID NO: 4090240 - DNA, 18 bp, Homo sapiens
tctctccactaccccaca

SEQ ID NO: 4090241 - DNA, 21 bp, Homo sapiens
tctctccactaccccacacca

SEQ ID NO: 4090242 - DNA, 22 bp, Homo sapiens
tctctccactaccccacaccag

SEQ ID NO: 4090243 - DNA, 21 bp, Homo sapiens
tctctccaggaaggtagccca

SEQ ID NO: 4090244 - DNA, 24 bp, Homo sapiens
tctctccaggaaggtagcccagca

SEQ ID NO: 4090245 - DNA, 12 bp, Homo sapiens
tctctccagggt

SEQ ID NO: 4090246 - DNA, 20 bp, Homo sapiens
tctctcccatttcaggaatt

SEQ ID NO: 4090247 - DNA, 14 bp, Homo sapiens
tctctccctcccct

SEQ ID NO: 4090248 - DNA, 13 bp, Homo sapiens
tctctcctcccca

SEQ ID NO: 4090249 - DNA, 16 bp, Homo sapiens
tctctcctggcctatc

SEQ ID NO: 4090250 - DNA, 23 bp, Homo sapiens
tctctcggctccccatgtgtcct

SEQ ID NO: 4090251 - DNA, 21 bp, Homo sapiens
tctctctatttccccctttct

SEQ ID NO: 4090252 - DNA, 12 bp, Homo sapiens
tctctctccagg

SEQ ID NO: 4090253 - DNA, 13 bp, Homo sapiens
tctctctccaggg

SEQ ID NO: 4090254 - DNA, 15 bp, Homo sapiens
tctctctgcagctgc

SEQ ID NO: 4090255 - DNA, 12 bp, Homo sapiens
tctctctgccca

SEQ ID NO: 4090256 - DNA, 16 bp, Homo sapiens
tctctctgcccaaccc

SEQ ID NO: 4090257 - DNA, 17 bp, Homo sapiens
tctctctgggcccaggg

SEQ ID NO: 4090258 - DNA, 21 bp, Homo sapiens
tctctctggggccctgggcct

SEQ ID NO: 4090259 - DNA, 17 bp, Homo sapiens
tctctctgtgctgtgga

SEQ ID NO: 4090260 - DNA, 11 bp, Homo sapiens
tctctcttctg

SEQ ID NO: 4090261 - DNA, 16 bp, Homo sapiens
tctctcttctgctcca

SEQ ID NO: 4090262 - DNA, 16 bp, Homo sapiens
tctctcttgtcctctt

SEQ ID NO: 4090263 - DNA, 19 bp, Homo sapiens
tctctcttgtcctcttctg

SEQ ID NO: 4090264 - DNA, 21 bp, Homo sapiens
tctctcttgtcctcttctgct

SEQ ID NO: 4090265 - DNA, 18 bp, Homo sapiens
tctctctttcctccaccc

SEQ ID NO: 4090266 - DNA, 16 bp, Homo sapiens
tctctgaacacaggca

SEQ ID NO: 4090267 - DNA, 18 bp, Homo sapiens
tctctgaacacaggcagc

SEQ ID NO: 4090268 - DNA, 13 bp, Homo sapiens
tctctgaagatga

SEQ ID NO: 4090269 - DNA, 15 bp, Homo sapiens
tctctgaatgcccca

SEQ ID NO: 4090270 - DNA, 23 bp, Homo sapiens
tctctgaccctctggaaatatgt

SEQ ID NO: 4090271 - DNA, 12 bp, Homo sapiens
tctctgagactc

SEQ ID NO: 4090272 - DNA, 17 bp, Homo sapiens
tctctgatgtcccagtg

SEQ ID NO: 4090273 - DNA, 16 bp, Homo sapiens
tctctgcagctgccgg

SEQ ID NO: 4090274 - DNA, 13 bp, Homo sapiens
tctctgccaccca

SEQ ID NO: 4090275 - DNA, 16 bp, Homo sapiens
tctctgccacccactc

SEQ ID NO: 4090276 - DNA, 12 bp, Homo sapiens
tctctgcccaac

SEQ ID NO: 4090277 - DNA, 14 bp, Homo sapiens
tgaatcaatgaaaa

SEQ ID NO: 4090278 - DNA, 13 bp, Homo sapiens
tgaatcacctggc

SEQ ID NO: 4090279 - DNA, 19 bp, Homo sapiens
tgaatcacctggctgagca

SEQ ID NO: 4090280 - DNA, 17 bp, Homo sapiens
tgaatcagtttttaaaa

SEQ ID NO: 4090281 - DNA, 19 bp, Homo sapiens
tgaatcagtttttaaaata

SEQ ID NO: 4090282 - DNA, 13 bp, Homo sapiens
tgaatcatgagcc

SEQ ID NO: 4090283 - DNA, 18 bp, Homo sapiens
tgaatccaaaagaaaaac

SEQ ID NO: 4090284 - DNA, 11 bp, Homo sapiens
tgaatgaaaaa

SEQ ID NO: 4090285 - DNA, 19 bp, Homo sapiens
tgaatgaaaaatttaagca

SEQ ID NO: 4090286 - DNA, 20 bp, Homo sapiens
tgaatgaaaaatttaagcat

SEQ ID NO: 4090287 - DNA, 22 bp, Homo sapiens
tgaatgaaaaatttaagcattg

SEQ ID NO: 4090288 - DNA, 16 bp, Homo sapiens
tgaatgaaaacatttt

SEQ ID NO: 4090289 - DNA, 19 bp, Homo sapiens
tgaatgaaagattaaacag

SEQ ID NO: 4090290 - DNA, 22 bp, Homo sapiens
tgaatgaaagattaaacagatg

SEQ ID NO: 4090291 - DNA, 17 bp, Homo sapiens
tgaatgaggtcccaggc

SEQ ID NO: 4090292 - DNA, 22 bp, Homo sapiens
tgaatgaggtcccaggcagaga

SEQ ID NO: 4090293 - DNA, 16 bp, Homo sapiens
tgaatgcagtcatgca

SEQ ID NO: 4090294 - DNA, 23 bp, Homo sapiens
tgaatgcccacaggcaaatgcat

SEQ ID NO: 4090295 - DNA, 17 bp, Homo sapiens
tgaatgcctcctgtggg

SEQ ID NO: 4090296 - DNA, 14 bp, Homo sapiens
tgaatggattggat

SEQ ID NO: 4090297 - DNA, 15 bp, Homo sapiens
tgaatggattggatt

SEQ ID NO: 4090298 - DNA, 17 bp, Homo sapiens
tgaatggattggattat

SEQ ID NO: 4090299 - DNA, 17 bp, Homo sapiens
tgaatgggtccattttg

SEQ ID NO: 4090300 - DNA, 13 bp, Homo sapiens
tgaatggtatgga

SEQ ID NO: 4090301 - DNA, 15 bp, Homo sapiens
tgaatgtatgtgcac

SEQ ID NO: 4090302 - DNA, 16 bp, Homo sapiens
tgaatgtctaaaattg

SEQ ID NO: 4090303 - DNA, 16 bp, Homo sapiens
tgaatgtgggcactgg

SEQ ID NO: 4090304 - DNA, 16 bp, Homo sapiens
tgaatgtgtgatgtga

SEQ ID NO: 4090305 - DNA, 17 bp, Homo sapiens
tgaatgttaagaattga

SEQ ID NO: 4090306 - DNA, 14 bp, Homo sapiens
tgaatgttctgaca

SEQ ID NO: 4090307 - DNA, 20 bp, Homo sapiens
tgaatgttttatttatcaaa

SEQ ID NO: 4090308 - DNA, 14 bp, Homo sapiens
tgaattaaaacttc

SEQ ID NO: 4090309 - DNA, 22 bp, Homo sapiens
tgaattaaaacttcttaaatat

SEQ ID NO: 4090310 - DNA, 11 bp, Homo sapiens
tgaattaaatt

SEQ ID NO: 4090311 - DNA, 16 bp, Homo sapiens
tgaattaatatcccta

SEQ ID NO: 4090312 - DNA, 23 bp, Homo sapiens
tgaattaatatccctacatgtat

SEQ ID NO: 4090313 - DNA, 15 bp, Homo sapiens
tgaattaatttctaa

SEQ ID NO: 4090314 - DNA, 14 bp, Homo sapiens
tgaattattgacac

SEQ ID NO: 4090315 - DNA, 15 bp, Homo sapiens
tgaattattgacact

SEQ ID NO: 4090316 - DNA, 17 bp, Homo sapiens
tgaattattgacactga

SEQ ID NO: 4090317 - DNA, 23 bp, Homo sapiens
tgaattcggaactgtcctttcct

SEQ ID NO: 4090318 - DNA, 20 bp, Homo sapiens
tgaattgaggggattaatat

SEQ ID NO: 4090319 - DNA, 12 bp, Homo sapiens
tgaattgtacag

SEQ ID NO: 4090320 - DNA, 17 bp, Homo sapiens
tgaattgtgaccaagtt

SEQ ID NO: 4090321 - DNA, 17 bp, Homo sapiens
tgaattgttttctttaa

SEQ ID NO: 4090322 - DNA, 12 bp, Homo sapiens
tgaatttaaata

SEQ ID NO: 4090323 - DNA, 14 bp, Homo sapiens
tgaatttaaataaa

SEQ ID NO: 4090324 - DNA, 20 bp, Homo sapiens
tgaatttaaatataattctg

SEQ ID NO: 4090325 - DNA, 20 bp, Homo sapiens
tgaatttcttctaattattt

SEQ ID NO: 4090326 - DNA, 23 bp, Homo sapiens
tgaatttgttctttctgatttta

SEQ ID NO: 4090327 - DNA, 23 bp, Homo sapiens
tgaattttaaatctaaatctatt

SEQ ID NO: 4090328 - DNA, 21 bp, Homo sapiens
tgaatttttatttctttttaa

SEQ ID NO: 4090329 - DNA, 19 bp, Homo sapiens
tgacaaaaagtttccatat

SEQ ID NO: 4090330 - DNA, 20 bp, Homo sapiens
tgacaaataaattaggacca

SEQ ID NO: 4090331 - DNA, 12 bp, Homo sapiens
tgacaacacagc

SEQ ID NO: 4090332 - DNA, 17 bp, Homo sapiens
tgacaaccactggtctg

SEQ ID NO: 4090333 - DNA, 19 bp, Homo sapiens
tgacaaccatgagaccact

SEQ ID NO: 4090334 - DNA, 16 bp, Homo sapiens
tgacaacctagaatgt

SEQ ID NO: 4090335 - DNA, 13 bp, Homo sapiens
tgacaacctccat

SEQ ID NO: 4090336 - DNA, 20 bp, Homo sapiens
tgacaacctccattctattt

SEQ ID NO: 4090337 - DNA, 21 bp, Homo sapiens
tgacaactgcacatgaaagtt

SEQ ID NO: 4090338 - DNA, 13 bp, Homo sapiens
tgacaactgtcta

SEQ ID NO: 4090339 - DNA, 21 bp, Homo sapiens
tgacaactgtctaactttaga

SEQ ID NO: 4090340 - DNA, 13 bp, Homo sapiens
tgacaactgtgac

SEQ ID NO: 4090341 - DNA, 22 bp, Homo sapiens
tgacaacttcccagtgaattct

SEQ ID NO: 4090342 - DNA, 19 bp, Homo sapiens
tgacaactttgccagcttt

SEQ ID NO: 4090343 - DNA, 14 bp, Homo sapiens
tgacaagtcatttt

SEQ ID NO: 4090344 - DNA, 17 bp, Homo sapiens
tgacaataaaacattaa

SEQ ID NO: 4090345 - DNA, 19 bp, Homo sapiens
tgacaataatattgttgta

SEQ ID NO: 4090346 - DNA, 15 bp, Homo sapiens
tgacaatcaactcta

SEQ ID NO: 4090347 - DNA, 15 bp, Homo sapiens
tgacacaagcacttt

SEQ ID NO: 4090348 - DNA, 14 bp, Homo sapiens
tgacacacagcact

SEQ ID NO: 4090349 - DNA, 22 bp, Homo sapiens
tgacacagcagcttcaccagag

SEQ ID NO: 4090350 - DNA, 14 bp, Homo sapiens
tgacaccaaagcca

SEQ ID NO: 4090351 - DNA, 14 bp, Homo sapiens
tgacacccaccctg

SEQ ID NO: 4090352 - DNA, 18 bp, Homo sapiens
tgacacccaccctgtgcc

SEQ ID NO: 4090353 - DNA, 22 bp, Homo sapiens
tgacacccaccctgtgccatca

SEQ ID NO: 4090354 - DNA, 14 bp, Homo sapiens
tgacaccccctccc

SEQ ID NO: 4090355 - DNA, 21 bp, Homo sapiens
tgacaccggggtggtgggaac

SEQ ID NO: 4090356 - DNA, 15 bp, Homo sapiens
tgacactagaaaact

SEQ ID NO: 4090357 - DNA, 12 bp, Homo sapiens
tgacactgaaag

SEQ ID NO: 4090358 - DNA, 20 bp, Homo sapiens
tgacactgaaagttttgtaa

SEQ ID NO: 4090359 - DNA, 16 bp, Homo sapiens
tgacacttcagagagc

SEQ ID NO: 4090360 - DNA, 18 bp, Homo sapiens
tgacacttcagagagctg

SEQ ID NO: 4090361 - DNA, 19 bp, Homo sapiens
tgacacttcagagagctgg

SEQ ID NO: 4090362 - DNA, 15 bp, Homo sapiens
tgacagacaggctct

SEQ ID NO: 4090363 - DNA, 19 bp, Homo sapiens
tgacagacaggctcttagc

SEQ ID NO: 4090364 - DNA, 22 bp, Homo sapiens
tgacagagcctgccccagcgct

SEQ ID NO: 4090365 - DNA, 20 bp, Homo sapiens
tgacagaggctgcacccctg

SEQ ID NO: 4090366 - DNA, 19 bp, Homo sapiens
tgacagatatatttaagcc

SEQ ID NO: 4090367 - DNA, 19 bp, Homo sapiens
tgacagatgttgaatgccc

SEQ ID NO: 4090368 - DNA, 14 bp, Homo sapiens
tgacagcaggtggg

SEQ ID NO: 4090369 - DNA, 12 bp, Homo sapiens
tgacagcctccc

SEQ ID NO: 4090370 - DNA, 17 bp, Homo sapiens
tgacagcctcccacccc

SEQ ID NO: 4090371 - DNA, 19 bp, Homo sapiens
tgacagcctcccaccccca

SEQ ID NO: 4090372 - DNA, 16 bp, Homo sapiens
tgacagctgcaagcca

SEQ ID NO: 4090373 - DNA, 17 bp, Homo sapiens
tgacaggaaagccctcc

SEQ ID NO: 4090374 - DNA, 21 bp, Homo sapiens
tgacaggaaagccctccccct

SEQ ID NO: 4090375 - DNA, 13 bp, Homo sapiens
tgacagggccagt

SEQ ID NO: 4090376 - DNA, 17 bp, Homo sapiens
tgacagggccagtgggg

SEQ ID NO: 4090377 - DNA, 20 bp, Homo sapiens
tgacagggccagtggggcct

SEQ ID NO: 4090378 - DNA, 21 bp, Homo sapiens
tgacagggccagtggggcctg

SEQ ID NO: 4090379 - DNA, 23 bp, Homo sapiens
tgacagggccagtggggcctgtg

SEQ ID NO: 4090380 - DNA, 19 bp, Homo sapiens
tgacagtcatcatcagggc

SEQ ID NO: 4090381 - DNA, 17 bp, Homo sapiens
tgacagtgcctgggaat

SEQ ID NO: 4090382 - DNA, 21 bp, Homo sapiens
tgacataacactataaaggtt

SEQ ID NO: 4090383 - DNA, 16 bp, Homo sapiens
tgacataatatattct

SEQ ID NO: 4090384 - DNA, 13 bp, Homo sapiens
tgacatacatatt

SEQ ID NO: 4090385 - DNA, 20 bp, Homo sapiens
tgacatattatgcctgaatg

SEQ ID NO: 4090386 - DNA, 14 bp, Homo sapiens
tgacatcacagcag

SEQ ID NO: 4090387 - DNA, 19 bp, Homo sapiens
tgacatctcaggggccaga

SEQ ID NO: 4090388 - DNA, 13 bp, Homo sapiens
tgacatgtagctt

SEQ ID NO: 4090389 - DNA, 19 bp, Homo sapiens
tgacatgtgaaaccttttt

SEQ ID NO: 4090390 - DNA, 17 bp, Homo sapiens
tgacatgtggaaagtga

SEQ ID NO: 4090391 - DNA, 20 bp, Homo sapiens
tgacattaaatgcaataatt

SEQ ID NO: 4090392 - DNA, 12 bp, Homo sapiens
tgacattcacct

SEQ ID NO: 4090393 - DNA, 13 bp, Homo sapiens
tgacattcccctc

SEQ ID NO: 4090394 - DNA, 14 bp, Homo sapiens
tgacattgcacctg

SEQ ID NO: 4090395 - DNA, 17 bp, Homo sapiens
tgacattgcacctggat

SEQ ID NO: 4090396 - DNA, 15 bp, Homo sapiens
tgacattgcgtttga

SEQ ID NO: 4090397 - DNA, 19 bp, Homo sapiens
tgacattgcgtttgacctt

SEQ ID NO: 4090398 - DNA, 23 bp, Homo sapiens
tgacatttaatttagtgatctta

SEQ ID NO: 4090399 - DNA, 15 bp, Homo sapiens
tgacatttatatatt

SEQ ID NO: 4090400 - DNA, 19 bp, Homo sapiens
tgacatttatatattgaat

SEQ ID NO: 4090401 - DNA, 15 bp, Homo sapiens
tgacatttggagagg

SEQ ID NO: 4090402 - DNA, 21 bp, Homo sapiens
tgacatttgggagacatgtga

SEQ ID NO: 4090403 - DNA, 16 bp, Homo sapiens
tgacattttacattaa

SEQ ID NO: 4090404 - DNA, 14 bp, Homo sapiens
tgaccaaagtcctt

SEQ ID NO: 4090405 - DNA, 21 bp, Homo sapiens
tgaccaaatatcaccaggact

SEQ ID NO: 4090406 - DNA, 14 bp, Homo sapiens
tgaccaagaactgc

SEQ ID NO: 4090407 - DNA, 13 bp, Homo sapiens
tgaccaagttata

SEQ ID NO: 4090408 - DNA, 18 bp, Homo sapiens
tgaccaatgatggtcacc

SEQ ID NO: 4090409 - DNA, 16 bp, Homo sapiens
tgaccaattgtgctgc

SEQ ID NO: 4090410 - DNA, 16 bp, Homo sapiens
tgaccacagcacagcc

SEQ ID NO: 4090411 - DNA, 22 bp, Homo sapiens
tgaccaccttctgtccccagcc

SEQ ID NO: 4090412 - DNA, 21 bp, Homo sapiens
tgaccacgctttctagctgtt

SEQ ID NO: 4090413 - DNA, 22 bp, Homo sapiens
tgaccacgctttctagctgttg

SEQ ID NO: 4090414 - DNA, 23 bp, Homo sapiens
tgaccactcttctttaagccata

SEQ ID NO: 4090415 - DNA, 18 bp, Homo sapiens
tgaccagcactgtctcag

SEQ ID NO: 4090416 - DNA, 21 bp, Homo sapiens
tgaccagggatgctgggctgg

SEQ ID NO: 4090417 - DNA, 22 bp, Homo sapiens
tgaccagggatgctgggctggg

SEQ ID NO: 4090418 - DNA, 22 bp, Homo sapiens
tgaccaggggtgatttcagaga

SEQ ID NO: 4090419 - DNA, 16 bp, Homo sapiens
tgaccatactgaggga

SEQ ID NO: 4090420 - DNA, 19 bp, Homo sapiens
tgaccatccactctaccct

SEQ ID NO: 4090421 - DNA, 14 bp, Homo sapiens
tgaccattaataaa

SEQ ID NO: 4090422 - DNA, 16 bp, Homo sapiens
tgaccattaataaaga

SEQ ID NO: 4090423 - DNA, 23 bp, Homo sapiens
tgaccatttataatgttagtaga

SEQ ID NO: 4090424 - DNA, 20 bp, Homo sapiens
tgacccactgatctctacta

SEQ ID NO: 4090425 - DNA, 19 bp, Homo sapiens
tgacccagccccttgagaa

SEQ ID NO: 4090426 - DNA, 23 bp, Homo sapiens
tgacccagccccttgagaaacct

SEQ ID NO: 4090427 - DNA, 17 bp, Homo sapiens
tgacccagtgcccccac

SEQ ID NO: 4090428 - DNA, 18 bp, Homo sapiens
tgacccagtgcccccact

SEQ ID NO: 4090429 - DNA, 22 bp, Homo sapiens
tgaccccaaacaccttccagct

SEQ ID NO: 4090430 - DNA, 19 bp, Homo sapiens
tgaccccaaagagcctgga

SEQ ID NO: 4090431 - DNA, 22 bp, Homo sapiens
tgaccccaaagagcctggagaa

SEQ ID NO: 4090432 - DNA, 19 bp, Homo sapiens
tgacccccccagcttcact

SEQ ID NO: 4090433 - DNA, 20 bp, Homo sapiens
tgaccccgagaagtgctctt

SEQ ID NO: 4090434 - DNA, 12 bp, Homo sapiens
tgacccctctgg

SEQ ID NO: 4090435 - DNA, 13 bp, Homo sapiens
tgacccctgccca

SEQ ID NO: 4090436 - DNA, 20 bp, Homo sapiens
tgacccctgcccagatcagc

SEQ ID NO: 4090437 - DNA, 16 bp, Homo sapiens
tgaccctactcccttg

SEQ ID NO: 4090438 - DNA, 15 bp, Homo sapiens
tgacccttgaaccaa

SEQ ID NO: 4090439 - DNA, 16 bp, Homo sapiens
tgaccgagagaacctc

SEQ ID NO: 4090440 - DNA, 21 bp, Homo sapiens
tgaccgtactctcacatgtgg

SEQ ID NO: 4090441 - DNA, 22 bp, Homo sapiens
tgacctccctctaatttatctt

SEQ ID NO: 4090442 - DNA, 19 bp, Homo sapiens
tgacctccgcccctgcccc

SEQ ID NO: 4090443 - DNA, 19 bp, Homo sapiens
tgacctctagccctgcccg

SEQ ID NO: 4090444 - DNA, 18 bp, Homo sapiens
tgacctctcagggcctgg

SEQ ID NO: 4090445 - DNA, 17 bp, Homo sapiens
tgacctctgtcctccct

SEQ ID NO: 4090446 - DNA, 14 bp, Homo sapiens
tgacctcttgctgt

SEQ ID NO: 4090447 - DNA, 15 bp, Homo sapiens
tgacctcttgctgtc

SEQ ID NO: 4090448 - DNA, 16 bp, Homo sapiens
tgacctcttgctgtct

SEQ ID NO: 4090449 - DNA, 18 bp, Homo sapiens
tgacctgctccgctgctc

SEQ ID NO: 4090450 - DNA, 22 bp, Homo sapiens
tgacctggataacttaggtggc

SEQ ID NO: 4090451 - DNA, 16 bp, Homo sapiens
tgaccttgcaacttca

SEQ ID NO: 4090452 - DNA, 18 bp, Homo sapiens
tgaccttggctgactggg

SEQ ID NO: 4090453 - DNA, 20 bp, Homo sapiens
tgaccttggctgactggggc

SEQ ID NO: 4090454 - DNA, 14 bp, Homo sapiens
tgacctttgacctc

SEQ ID NO: 4090455 - DNA, 16 bp, Homo sapiens
tgaccttttcttcatt

SEQ ID NO: 4090456 - DNA, 20 bp, Homo sapiens
tgaccttttgacttaaagca

SEQ ID NO: 4090457 - DNA, 19 bp, Homo sapiens
tgacgatcccatgttagct

SEQ ID NO: 4090458 - DNA, 14 bp, Homo sapiens
tgacggaagaacat

SEQ ID NO: 4090459 - DNA, 14 bp, Homo sapiens
tgacggccctcatc

SEQ ID NO: 4090460 - DNA, 15 bp, Homo sapiens
tgacggcgcccccag

SEQ ID NO: 4090461 - DNA, 21 bp, Homo sapiens
tgacggtcccacactggtgac

SEQ ID NO: 4090462 - DNA, 18 bp, Homo sapiens
tgacgtagaaagatcctt

SEQ ID NO: 4090463 - DNA, 19 bp, Homo sapiens
tgacgtcaagtctccttcc

SEQ ID NO: 4090464 - DNA, 14 bp, Homo sapiens
tgacgtctgaagct

SEQ ID NO: 4090465 - DNA, 17 bp, Homo sapiens
tgacgtgtcaggaaaac

SEQ ID NO: 4090466 - DNA, 15 bp, Homo sapiens
tgactaagaaattct

SEQ ID NO: 4090467 - DNA, 23 bp, Homo sapiens
tgactaattagggtacatttata

SEQ ID NO: 4090468 - DNA, 19 bp, Homo sapiens
tgactagggattcaggctg

SEQ ID NO: 4090469 - DNA, 13 bp, Homo sapiens
tgactagtacaaa

SEQ ID NO: 4090470 - DNA, 17 bp, Homo sapiens
tgactagtacaaattat

SEQ ID NO: 4090471 - DNA, 18 bp, Homo sapiens
tgactatataatttattt

SEQ ID NO: 4090472 - DNA, 23 bp, Homo sapiens
tgactatataatttatttccact

SEQ ID NO: 4090473 - DNA, 14 bp, Homo sapiens
tgactatcataaaa

SEQ ID NO: 4090474 - DNA, 17 bp, Homo sapiens
tgactattttcgttcat

SEQ ID NO: 4090475 - DNA, 12 bp, Homo sapiens
tgactcaagaag

SEQ ID NO: 4090476 - DNA, 14 bp, Homo sapiens
tgactcaagaagtg

SEQ ID NO: 4090477 - DNA, 15 bp, Homo sapiens
tgactcaagaagtga

SEQ ID NO: 4090478 - DNA, 15 bp, Homo sapiens
tgactcatcatttgt

SEQ ID NO: 4090479 - DNA, 15 bp, Homo sapiens
tgactcatggcagct

SEQ ID NO: 4090480 - DNA, 20 bp, Homo sapiens
tgactcatggcagctgtttc

SEQ ID NO: 4090481 - DNA, 13 bp, Homo sapiens
tgactccctgtgg

SEQ ID NO: 4090482 - DNA, 23 bp, Homo sapiens
tgactccctgtgggggtggccat

SEQ ID NO: 4090483 - DNA, 17 bp, Homo sapiens
tgactcctctaagccac

SEQ ID NO: 4090484 - DNA, 14 bp, Homo sapiens
tgactcctctggct

SEQ ID NO: 4090485 - DNA, 17 bp, Homo sapiens
tgactctaagctcagtg

SEQ ID NO: 4090486 - DNA, 19 bp, Homo sapiens
tgactctccactcctcctc

SEQ ID NO: 4090487 - DNA, 22 bp, Homo sapiens
tgactctctgaccctctggaaa

SEQ ID NO: 4090488 - DNA, 18 bp, Homo sapiens
tgactctgagtccactgc

SEQ ID NO: 4090489 - DNA, 20 bp, Homo sapiens
tgactctgagtccactgctc

SEQ ID NO: 4090490 - DNA, 17 bp, Homo sapiens
tgactctggcaaagctt

SEQ ID NO: 4090491 - DNA, 18 bp, Homo sapiens
tgactcttccccaggaag

SEQ ID NO: 4090492 - DNA, 21 bp, Homo sapiens
tgactcttgaagtacttaaca

SEQ ID NO: 4090493 - DNA, 18 bp, Homo sapiens
tgactgatgattttcctt

SEQ ID NO: 4090494 - DNA, 20 bp, Homo sapiens
tgactgatgctgagattctt

SEQ ID NO: 4090495 - DNA, 19 bp, Homo sapiens
tgactgcattgccgctgta

SEQ ID NO: 4090496 - DNA, 19 bp, Homo sapiens
tgactgccctgtttctgtt

SEQ ID NO: 4090497 - DNA, 20 bp, Homo sapiens
tgactgctcagaacttgctg

SEQ ID NO: 4090498 - DNA, 14 bp, Homo sapiens
tgactgggcctccc

SEQ ID NO: 4090499 - DNA, 17 bp, Homo sapiens
tgactgggcctcccttg

SEQ ID NO: 4090500 - DNA, 15 bp, Homo sapiens
tgactgggctgggtt

SEQ ID NO: 4090501 - DNA, 20 bp, Homo sapiens
tgactggggtgggaggtctt

SEQ ID NO: 4090502 - DNA, 20 bp, Homo sapiens
tgactggtttacaggccctg

SEQ ID NO: 4090503 - DNA, 21 bp, Homo sapiens
tgactggtttacaggccctgc

SEQ ID NO: 4090504 - DNA, 23 bp, Homo sapiens
tgactggtttacaggccctgctc

SEQ ID NO: 4090505 - DNA, 16 bp, Homo sapiens
tgactgtactcctccc

SEQ ID NO: 4090506 - DNA, 17 bp, Homo sapiens
tgactgtactcctccca

SEQ ID NO: 4090507 - DNA, 22 bp, Homo sapiens
tgactgtactcctcccaggcgc

SEQ ID NO: 4090508 - DNA, 20 bp, Homo sapiens
tgactgtagccacagctgct

SEQ ID NO: 4090509 - DNA, 16 bp, Homo sapiens
tgactgtcccaccggg

SEQ ID NO: 4090510 - DNA, 16 bp, Homo sapiens
tgactgtgaccacctt

SEQ ID NO: 4090511 - DNA, 17 bp, Homo sapiens
tgactgtgaccaccttc

SEQ ID NO: 4090512 - DNA, 23 bp, Homo sapiens
tgactgtgaccaccttctgtccc

SEQ ID NO: 4090513 - DNA, 14 bp, Homo sapiens
tgactgttgatgaa

SEQ ID NO: 4090514 - DNA, 22 bp, Homo sapiens
tgactgttgatgaagtatactt

SEQ ID NO: 4090515 - DNA, 19 bp, Homo sapiens
tgacttaagcaaaagaaaa

SEQ ID NO: 4090516 - DNA, 23 bp, Homo sapiens
tgacttactttaattactggaat

SEQ ID NO: 4090517 - DNA, 15 bp, Homo sapiens
tgacttatagtacat

SEQ ID NO: 4090518 - DNA, 18 bp, Homo sapiens
tgagcaaactaacttgac

SEQ ID NO: 4090519 - DNA, 16 bp, Homo sapiens
tgagcaactcttgatt

SEQ ID NO: 4090520 - DNA, 18 bp, Homo sapiens
tgagcaactcttgattat

SEQ ID NO: 4090521 - DNA, 17 bp, Homo sapiens
tgagcaagatcttgtct

SEQ ID NO: 4090522 - DNA, 19 bp, Homo sapiens
tgagcaagatcttgtctcc

SEQ ID NO: 4090523 - DNA, 22 bp, Homo sapiens
tgagcaaggacattgccccaag

SEQ ID NO: 4090524 - DNA, 23 bp, Homo sapiens
tgagcaaggacattgccccaaga

SEQ ID NO: 4090525 - DNA, 17 bp, Homo sapiens
tgagcacagcctagggc

SEQ ID NO: 4090526 - DNA, 15 bp, Homo sapiens
tgagcaccctctgga

SEQ ID NO: 4090527 - DNA, 16 bp, Homo sapiens
tgagcaccctctggat

SEQ ID NO: 4090528 - DNA, 14 bp, Homo sapiens
tgagcacctgggga

SEQ ID NO: 4090529 - DNA, 16 bp, Homo sapiens
tgagcagccgccagct

SEQ ID NO: 4090530 - DNA, 19 bp, Homo sapiens
tgagcagccgccagctggg

SEQ ID NO: 4090531 - DNA, 14 bp, Homo sapiens
tgagcagcctctgg

SEQ ID NO: 4090532 - DNA, 23 bp, Homo sapiens
tgagcagcctctggacagccagt

SEQ ID NO: 4090533 - DNA, 15 bp, Homo sapiens
tgagcagtcgcctgc

SEQ ID NO: 4090534 - DNA, 16 bp, Homo sapiens
tgagcagtcgcctgcc

SEQ ID NO: 4090535 - DNA, 14 bp, Homo sapiens
tgagcagtggctgg

SEQ ID NO: 4090536 - DNA, 18 bp, Homo sapiens
tgagcagtggctggtcca

SEQ ID NO: 4090537 - DNA, 16 bp, Homo sapiens
tgagcagttcccctgg

SEQ ID NO: 4090538 - DNA, 21 bp, Homo sapiens
tgagcagttcccctggagccc

SEQ ID NO: 4090539 - DNA, 21 bp, Homo sapiens
tgagcatgacagcctgcagca

SEQ ID NO: 4090540 - DNA, 18 bp, Homo sapiens
tgagccacagaccacctg

SEQ ID NO: 4090541 - DNA, 24 bp, Homo sapiens
tgagccacagaccacctgcttctg

SEQ ID NO: 4090542 - DNA, 16 bp, Homo sapiens
tgagccaccgtgcctg

SEQ ID NO: 4090543 - DNA, 16 bp, Homo sapiens
tgagccactctcttcc

SEQ ID NO: 4090544 - DNA, 21 bp, Homo sapiens
tgagccaggtaatgagggact

SEQ ID NO: 4090545 - DNA, 21 bp, Homo sapiens
tgagccagtgctttaatggca

SEQ ID NO: 4090546 - DNA, 22 bp, Homo sapiens
tgagccatcactagaagaaaag

SEQ ID NO: 4090547 - DNA, 14 bp, Homo sapiens
tgagcccagctgcc

SEQ ID NO: 4090548 - DNA, 12 bp, Homo sapiens
tgagcccaggag

SEQ ID NO: 4090549 - DNA, 22 bp, Homo sapiens
tgagcccatgtggagtcagcct

SEQ ID NO: 4090550 - DNA, 19 bp, Homo sapiens
tgagccccacctctccaag

SEQ ID NO: 4090551 - DNA, 18 bp, Homo sapiens
tgagccccagggtgccca

SEQ ID NO: 4090552 - DNA, 23 bp, Homo sapiens
tgagccccagggtgcccagaact

SEQ ID NO: 4090553 - DNA, 17 bp, Homo sapiens
tgagcccggatgcttct

SEQ ID NO: 4090554 - DNA, 15 bp, Homo sapiens
tgagccgcggggaag

SEQ ID NO: 4090555 - DNA, 19 bp, Homo sapiens
tgagccgggcccctgggct

SEQ ID NO: 4090556 - DNA, 12 bp, Homo sapiens
tgagcctcctgt

SEQ ID NO: 4090557 - DNA, 17 bp, Homo sapiens
tgagcctcctgtgcctg

SEQ ID NO: 4090558 - DNA, 18 bp, Homo sapiens
tgagcctcctgtgcctgg

SEQ ID NO: 4090559 - DNA, 19 bp, Homo sapiens
tgagcctcctgtgcctggc

SEQ ID NO: 4090560 - DNA, 24 bp, Homo sapiens
tgagcctcctgtgcctggccccag

SEQ ID NO: 4090561 - DNA, 15 bp, Homo sapiens
tgagcctgcccgctg

SEQ ID NO: 4090562 - DNA, 20 bp, Homo sapiens
tgagcctgtgggtccccact

SEQ ID NO: 4090563 - DNA, 13 bp, Homo sapiens
tgagcgccttggt

SEQ ID NO: 4090564 - DNA, 14 bp, Homo sapiens
tgagcgggaggcag

SEQ ID NO: 4090565 - DNA, 16 bp, Homo sapiens
tgagctattgctgttc

SEQ ID NO: 4090566 - DNA, 21 bp, Homo sapiens
tgagctatttccattccagaa

SEQ ID NO: 4090567 - DNA, 23 bp, Homo sapiens
tgagctattttcctctggccgca

SEQ ID NO: 4090568 - DNA, 18 bp, Homo sapiens
tgagctcacatgggactg

SEQ ID NO: 4090569 - DNA, 21 bp, Homo sapiens
tgagctcacatgggactggga

SEQ ID NO: 4090570 - DNA, 12 bp, Homo sapiens
tgagctcctgcg

SEQ ID NO: 4090571 - DNA, 12 bp, Homo sapiens
tgagctcttccc

SEQ ID NO: 4090572 - DNA, 20 bp, Homo sapiens
tgagctcttcccttattcct

SEQ ID NO: 4090573 - DNA, 23 bp, Homo sapiens
tgagctcttcccttattcctaat

SEQ ID NO: 4090574 - DNA, 15 bp, Homo sapiens
tgagctgatataaat

SEQ ID NO: 4090575 - DNA, 15 bp, Homo sapiens
tgagctgcaccaggt

SEQ ID NO: 4090576 - DNA, 18 bp, Homo sapiens
tgagctgcagcctggctg

SEQ ID NO: 4090577 - DNA, 16 bp, Homo sapiens
tgagctgccttcccta

SEQ ID NO: 4090578 - DNA, 17 bp, Homo sapiens
tgagctgccttccctag

SEQ ID NO: 4090579 - DNA, 16 bp, Homo sapiens
tgagctggccaggccc

SEQ ID NO: 4090580 - DNA, 18 bp, Homo sapiens
tgagctggggactcaggg

SEQ ID NO: 4090581 - DNA, 12 bp, Homo sapiens
tgaggaaatatt

SEQ ID NO: 4090582 - DNA, 16 bp, Homo sapiens
tgaggaaatattaatt

SEQ ID NO: 4090583 - DNA, 14 bp, Homo sapiens
tgaggaagagtctt

SEQ ID NO: 4090584 - DNA, 17 bp, Homo sapiens
tgaggaatgctctgtgc

SEQ ID NO: 4090585 - DNA, 18 bp, Homo sapiens
tgaggaatgctctgtgcc

SEQ ID NO: 4090586 - DNA, 20 bp, Homo sapiens
tgaggacacaccccacaccc

SEQ ID NO: 4090587 - DNA, 20 bp, Homo sapiens
tgataatgccccaaggacaa

SEQ ID NO: 4090588 - DNA, 16 bp, Homo sapiens
tgataatgttaaattt

SEQ ID NO: 4090589 - DNA, 21 bp, Homo sapiens
tgataatgttaaatttgtaag

SEQ ID NO: 4090590 - DNA, 13 bp, Homo sapiens
tgataatttaaga

SEQ ID NO: 4090591 - DNA, 23 bp, Homo sapiens
tgatacactatgaagatgtttca

SEQ ID NO: 4090592 - DNA, 18 bp, Homo sapiens
tgataccagaagggaaag

SEQ ID NO: 4090593 - DNA, 18 bp, Homo sapiens
tgatacccatagcttcca

SEQ ID NO: 4090594 - DNA, 21 bp, Homo sapiens
tgatacccatagcttccatga

SEQ ID NO: 4090595 - DNA, 16 bp, Homo sapiens
tgatacgatgcttcaa

SEQ ID NO: 4090596 - DNA, 14 bp, Homo sapiens
tgatacttcactac

SEQ ID NO: 4090597 - DNA, 13 bp, Homo sapiens
tgatacttcattt

SEQ ID NO: 4090598 - DNA, 17 bp, Homo sapiens
tgatagacaattgaggt

SEQ ID NO: 4090599 - DNA, 18 bp, Homo sapiens
tgatagacaattgaggta

SEQ ID NO: 4090600 - DNA, 13 bp, Homo sapiens
tgatagcactttc

SEQ ID NO: 4090601 - DNA, 15 bp, Homo sapiens
tgatagcactttcta

SEQ ID NO: 4090602 - DNA, 21 bp, Homo sapiens
tgatagcccctctccccgcag

SEQ ID NO: 4090603 - DNA, 13 bp, Homo sapiens
tgatagctttatt

SEQ ID NO: 4090604 - DNA, 21 bp, Homo sapiens
tgataggaagcgtctggcaga

SEQ ID NO: 4090605 - DNA, 13 bp, Homo sapiens
tgatataaattct

SEQ ID NO: 4090606 - DNA, 22 bp, Homo sapiens
tgatatacttttttcttattta

SEQ ID NO: 4090607 - DNA, 20 bp, Homo sapiens
tgatatatgagactttatgt

SEQ ID NO: 4090608 - DNA, 16 bp, Homo sapiens
tgatatggcagaagac

SEQ ID NO: 4090609 - DNA, 15 bp, Homo sapiens
tgatatgtaaacata

SEQ ID NO: 4090610 - DNA, 16 bp, Homo sapiens
tgatattaaaggagtt

SEQ ID NO: 4090611 - DNA, 18 bp, Homo sapiens
tgatattccatgaatgta

SEQ ID NO: 4090612 - DNA, 19 bp, Homo sapiens
tgatattccatgaatgtat

SEQ ID NO: 4090613 - DNA, 20 bp, Homo sapiens
tgatattccatgaatgtatc

SEQ ID NO: 4090614 - DNA, 22 bp, Homo sapiens
tgatattgacactgtccctctt

SEQ ID NO: 4090615 - DNA, 19 bp, Homo sapiens
tgatattttcaacgcagcc

SEQ ID NO: 4090616 - DNA, 22 bp, Homo sapiens
tgatcaaattcatttttttcac

SEQ ID NO: 4090617 - DNA, 16 bp, Homo sapiens
tgattactgtcaataa

SEQ ID NO: 4090618 - DNA, 17 bp, Homo sapiens
tgattactgtcaataaa

SEQ ID NO: 4090619 - DNA, 18 bp, Homo sapiens
tgattactgtcaataaac

SEQ ID NO: 4090620 - DNA, 15 bp, Homo sapiens
tgattagctttgtgt

SEQ ID NO: 4090621 - DNA, 19 bp, Homo sapiens
tgattagctttgtgtttgg

SEQ ID NO: 4090622 - DNA, 13 bp, Homo sapiens
tgattagttgaaa

SEQ ID NO: 4090623 - DNA, 14 bp, Homo sapiens
tgattagttgaaag

SEQ ID NO: 4090624 - DNA, 15 bp, Homo sapiens
tgattagttgaaagg

SEQ ID NO: 4090625 - DNA, 22 bp, Homo sapiens
tgattatgtcttttatatttgt

SEQ ID NO: 4090626 - DNA, 19 bp, Homo sapiens
tgattattttcttcatcca

SEQ ID NO: 4090627 - DNA, 24 bp, Homo sapiens
tgattcaccaaaatagtcttctca

SEQ ID NO: 4090628 - DNA, 15 bp, Homo sapiens
tgattcagcatcact

SEQ ID NO: 4090629 - DNA, 20 bp, Homo sapiens
tgattccactacacctggct

SEQ ID NO: 4090630 - DNA, 22 bp, Homo sapiens
tgattccttgatggagatattt

SEQ ID NO: 4090631 - DNA, 21 bp, Homo sapiens
tgattctatttatatgtacat

SEQ ID NO: 4090632 - DNA, 11 bp, Homo sapiens
tgattctctcc

SEQ ID NO: 4090633 - DNA, 16 bp, Homo sapiens
tgattctgcagtaaat

SEQ ID NO: 4090634 - DNA, 15 bp, Homo sapiens
tgattctgtgtgttt

SEQ ID NO: 4090635 - DNA, 14 bp, Homo sapiens
tgattctttgttac

SEQ ID NO: 4090636 - DNA, 15 bp, Homo sapiens
tgattgacacacagc

SEQ ID NO: 4090637 - DNA, 16 bp, Homo sapiens
tgattgacacacagca

SEQ ID NO: 4090638 - DNA, 16 bp, Homo sapiens
tgattgacctgctccg

SEQ ID NO: 4090639 - DNA, 17 bp, Homo sapiens
tgattgcacagaatttg

SEQ ID NO: 4090640 - DNA, 18 bp, Homo sapiens
tgattgcacagaatttgt

SEQ ID NO: 4090641 - DNA, 19 bp, Homo sapiens
tgattggaatagcttctgg

SEQ ID NO: 4090642 - DNA, 18 bp, Homo sapiens
tgattggattattcattt

SEQ ID NO: 4090643 - DNA, 19 bp, Homo sapiens
tgattggattattcattta

SEQ ID NO: 4090644 - DNA, 21 bp, Homo sapiens
tgattggcctgtagagttgct

SEQ ID NO: 4090645 - DNA, 18 bp, Homo sapiens
tgattggtgattcaaagt

SEQ ID NO: 4090646 - DNA, 23 bp, Homo sapiens
tgattggttttggggaaatgtgg

SEQ ID NO: 4090647 - DNA, 18 bp, Homo sapiens
tgattgttcgggtgtgca

SEQ ID NO: 4090648 - DNA, 15 bp, Homo sapiens
tgatttaaacacaca

SEQ ID NO: 4090649 - DNA, 20 bp, Homo sapiens
tgatttaggagaagccagga

SEQ ID NO: 4090650 - DNA, 21 bp, Homo sapiens
tgatttaggagaagccaggaa

SEQ ID NO: 4090651 - DNA, 23 bp, Homo sapiens
tgatttataaacagacaatatgt

SEQ ID NO: 4090652 - DNA, 19 bp, Homo sapiens
tgatttcacaacagatcaa

SEQ ID NO: 4090653 - DNA, 14 bp, Homo sapiens
tgatttcactagaa

SEQ ID NO: 4090654 - DNA, 21 bp, Homo sapiens
tgatttcagtcatagcaagct

SEQ ID NO: 4090655 - DNA, 13 bp, Homo sapiens
tgatttcccctct

SEQ ID NO: 4090656 - DNA, 15 bp, Homo sapiens
tgatttccttcaatg

SEQ ID NO: 4090657 - DNA, 13 bp, Homo sapiens
tgatttccttgaa

SEQ ID NO: 4090658 - DNA, 23 bp, Homo sapiens
tgatttccttgaatgtggcttga

SEQ ID NO: 4090659 - DNA, 16 bp, Homo sapiens
tgatttcttcagaatt

SEQ ID NO: 4090660 - DNA, 20 bp, Homo sapiens
tgatttctttaaaagaatga

SEQ ID NO: 4090661 - DNA, 17 bp, Homo sapiens
tgatttgaagaacatgt

SEQ ID NO: 4090662 - DNA, 13 bp, Homo sapiens
tgatttgatgtga

SEQ ID NO: 4090663 - DNA, 16 bp, Homo sapiens
tgatttgcatggattt

SEQ ID NO: 4090664 - DNA, 17 bp, Homo sapiens
tgatttgcatggatttt

SEQ ID NO: 4090665 - DNA, 12 bp, Homo sapiens
tgatttgcattg

SEQ ID NO: 4090666 - DNA, 17 bp, Homo sapiens
tgatttgctctttgaca

SEQ ID NO: 4090667 - DNA, 20 bp, Homo sapiens
tgatttgctctttgacaact

SEQ ID NO: 4090668 - DNA, 13 bp, Homo sapiens
tgatttgggggag

SEQ ID NO: 4090669 - DNA, 18 bp, Homo sapiens
tgatttgggggaggcttt

SEQ ID NO: 4090670 - DNA, 13 bp, Homo sapiens
tgatttggtgacc

SEQ ID NO: 4090671 - DNA, 20 bp, Homo sapiens
tgatttggtgaccaactgtc

SEQ ID NO: 4090672 - DNA, 14 bp, Homo sapiens
tgatttgttttgaa

SEQ ID NO: 4090673 - DNA, 15 bp, Homo sapiens
tgatttgttttgaat

SEQ ID NO: 4090674 - DNA, 20 bp, Homo sapiens
tgatttgttttgaattttgt

SEQ ID NO: 4090675 - DNA, 14 bp, Homo sapiens
tgattttaacaata

SEQ ID NO: 4090676 - DNA, 18 bp, Homo sapiens
tgattttaacaataacta

SEQ ID NO: 4090677 - DNA, 22 bp, Homo sapiens
tgattttaacaataactactgt

SEQ ID NO: 4090678 - DNA, 12 bp, Homo sapiens
tgattttatgat

SEQ ID NO: 4090679 - DNA, 18 bp, Homo sapiens
tgattttatgatcagtgt

SEQ ID NO: 4090680 - DNA, 20 bp, Homo sapiens
tgatttttcttcttttactt

SEQ ID NO: 4090681 - DNA, 18 bp, Homo sapiens
tgatttttttaatagtgc

SEQ ID NO: 4090682 - DNA, 15 bp, Homo sapiens
tgcaaaaagaaatga

SEQ ID NO: 4090683 - DNA, 22 bp, Homo sapiens
tgcaaaaagaaatgactaatta

SEQ ID NO: 4090684 - DNA, 18 bp, Homo sapiens
tgcaaaaatatttataaa

SEQ ID NO: 4090685 - DNA, 20 bp, Homo sapiens
tgcaaaaattcagagtcctt

SEQ ID NO: 4090686 - DNA, 22 bp, Homo sapiens
tgcaaaattgtctaaaatgtca

SEQ ID NO: 4090687 - DNA, 15 bp, Homo sapiens
tgcaaaatttccagt

SEQ ID NO: 4090688 - DNA, 16 bp, Homo sapiens
tgcaaaatttccagta

SEQ ID NO: 4090689 - DNA, 21 bp, Homo sapiens
tgcaaaatttgatgccaggac

SEQ ID NO: 4090690 - DNA, 22 bp, Homo sapiens
tgcaaaatttgatgccaggaca

SEQ ID NO: 4090691 - DNA, 14 bp, Homo sapiens
tcggagacagtgat

SEQ ID NO: 4090692 - DNA, 16 bp, Homo sapiens
tcggagagcagcagca

SEQ ID NO: 4090693 - DNA, 12 bp, Homo sapiens
tcggaggaagcc

SEQ ID NO: 4090694 - DNA, 18 bp, Homo sapiens
tcggaggccccactgatg

SEQ ID NO: 4090695 - DNA, 18 bp, Homo sapiens
tcggaggctgggcccctg

SEQ ID NO: 4090696 - DNA, 19 bp, Homo sapiens
tcggaggctgggcccctgg

SEQ ID NO: 4090697 - DNA, 13 bp, Homo sapiens
tcggagtttctta

SEQ ID NO: 4090698 - DNA, 19 bp, Homo sapiens
tcggatatgattgtttctc

SEQ ID NO: 4090699 - DNA, 19 bp, Homo sapiens
tcggatgacaccctggcct

SEQ ID NO: 4090700 - DNA, 16 bp, Homo sapiens
tcggatggaccaacct

SEQ ID NO: 4090701 - DNA, 23 bp, Homo sapiens
tcggatggaccaacctgctctgt

SEQ ID NO: 4090702 - DNA, 13 bp, Homo sapiens
tcggcacagcctg

SEQ ID NO: 4090703 - DNA, 19 bp, Homo sapiens
tcggcagaggaacccccac

SEQ ID NO: 4090704 - DNA, 15 bp, Homo sapiens
tcggccgagctggtt

SEQ ID NO: 4090705 - DNA, 18 bp, Homo sapiens
tcggccgagctggtttcc

SEQ ID NO: 4090706 - DNA, 13 bp, Homo sapiens
tcggctcaggctc

SEQ ID NO: 4090707 - DNA, 14 bp, Homo sapiens
tcggctcaggctct

SEQ ID NO: 4090708 - DNA, 17 bp, Homo sapiens
tcggcttgtgggctggt

SEQ ID NO: 4090709 - DNA, 14 bp, Homo sapiens
tcgggaacagtgtt

SEQ ID NO: 4090710 - DNA, 14 bp, Homo sapiens
tcgggagcacccag

SEQ ID NO: 4090711 - DNA, 13 bp, Homo sapiens
tcgggagcagtgt

SEQ ID NO: 4090712 - DNA, 19 bp, Homo sapiens
tcgggagcagtgtcttcca

SEQ ID NO: 4090713 - DNA, 17 bp, Homo sapiens
tcgggcaccagccagcg

SEQ ID NO: 4090714 - DNA, 17 bp, Homo sapiens
tcgggcagccagcagag

SEQ ID NO: 4090715 - DNA, 14 bp, Homo sapiens
tcgggctccagcca

SEQ ID NO: 4090716 - DNA, 18 bp, Homo sapiens
tcggggcgatgctccctc

SEQ ID NO: 4090717 - DNA, 20 bp, Homo sapiens
tcggggcgatgctccctcag

SEQ ID NO: 4090718 - DNA, 17 bp, Homo sapiens
tcggtgccatcagtgcc

SEQ ID NO: 4090719 - DNA, 15 bp, Homo sapiens
tcgtattcaccttca

SEQ ID NO: 4090720 - DNA, 18 bp, Homo sapiens
tcgtccaccccccacaca

SEQ ID NO: 4090721 - DNA, 13 bp, Homo sapiens
tcgtccttttggt

SEQ ID NO: 4090722 - DNA, 19 bp, Homo sapiens
tcgtgaacatcccctccca

SEQ ID NO: 4090723 - DNA, 13 bp, Homo sapiens
tcgtgagctgggg

SEQ ID NO: 4090724 - DNA, 13 bp, Homo sapiens
tcgtgatggggca

SEQ ID NO: 4090725 - DNA, 20 bp, Homo sapiens
tcgtgcctccttccacctcc

SEQ ID NO: 4090726 - DNA, 22 bp, Homo sapiens
tcgtggtgatcaattaaatgta

SEQ ID NO: 4090727 - DNA, 19 bp, Homo sapiens
tcgtggttattagcaaggc

SEQ ID NO: 4090728 - DNA, 13 bp, Homo sapiens
tcgtgtggatctt

SEQ ID NO: 4090729 - DNA, 17 bp, Homo sapiens
tcgtgtggatcttgcca

SEQ ID NO: 4090730 - DNA, 14 bp, Homo sapiens
tcgttaactgtgta

SEQ ID NO: 4090731 - DNA, 22 bp, Homo sapiens
tcgttaactgtgtatgtacata

SEQ ID NO: 4090732 - DNA, 19 bp, Homo sapiens
tcgttaattaatgtcatgt

SEQ ID NO: 4090733 - DNA, 18 bp, Homo sapiens
tcgttaggatactgcctc

SEQ ID NO: 4090734 - DNA, 13 bp, Homo sapiens
tcgttattataaa

SEQ ID NO: 4090735 - DNA, 16 bp, Homo sapiens
tcgttattataaatgt

SEQ ID NO: 4090736 - DNA, 12 bp, Homo sapiens
tcgttcctttct

SEQ ID NO: 4090737 - DNA, 15 bp, Homo sapiens
tctaaaaaacatttt

SEQ ID NO: 4090738 - DNA, 14 bp, Homo sapiens
tctaaaaacaccaa

SEQ ID NO: 4090739 - DNA, 18 bp, Homo sapiens
tctaaaaagattagcaag

SEQ ID NO: 4090740 - DNA, 13 bp, Homo sapiens
tctaaaactatgg

SEQ ID NO: 4090741 - DNA, 19 bp, Homo sapiens
tctaaaactatggttccca

SEQ ID NO: 4090742 - DNA, 20 bp, Homo sapiens
tctaaacaatgctgatttgg

SEQ ID NO: 4090743 - DNA, 20 bp, Homo sapiens
tctaaaccttacatgtgtaa

SEQ ID NO: 4090744 - DNA, 17 bp, Homo sapiens
tctaaagcagaggcaac

SEQ ID NO: 4090745 - DNA, 18 bp, Homo sapiens
tctaaaggtggtgaggca

SEQ ID NO: 4090746 - DNA, 14 bp, Homo sapiens
tctaaatctattta

SEQ ID NO: 4090747 - DNA, 17 bp, Homo sapiens
tctaaatctatttatta

SEQ ID NO: 4090748 - DNA, 20 bp, Homo sapiens
tctaaatctatttattaata

SEQ ID NO: 4090749 - DNA, 16 bp, Homo sapiens
tctaaatcttccttgt

SEQ ID NO: 4090750 - DNA, 17 bp, Homo sapiens
tctaaatcttccttgtg

SEQ ID NO: 4090751 - DNA, 19 bp, Homo sapiens
tctaaatgcagttttaaga

SEQ ID NO: 4090752 - DNA, 14 bp, Homo sapiens
tctaaatgcatatc

SEQ ID NO: 4090753 - DNA, 21 bp, Homo sapiens
tctaaatggtgctgcagattt

SEQ ID NO: 4090754 - DNA, 20 bp, Homo sapiens
tctaaattaaagcctttagt

SEQ ID NO: 4090755 - DNA, 23 bp, Homo sapiens
tctaaccattaagtcatgtgtga

SEQ ID NO: 4090756 - DNA, 15 bp, Homo sapiens
tctaacccccagctg

SEQ ID NO: 4090757 - DNA, 16 bp, Homo sapiens
tctaacccccagctgg

SEQ ID NO: 4090758 - DNA, 21 bp, Homo sapiens
tctaaccccctctgctctgtc

SEQ ID NO: 4090759 - DNA, 19 bp, Homo sapiens
tctaaccttgaatgctgcc

SEQ ID NO: 4090760 - DNA, 14 bp, Homo sapiens
tctatcttccaaat

SEQ ID NO: 4090761 - DNA, 14 bp, Homo sapiens
tctatgccagctca

SEQ ID NO: 4090762 - DNA, 15 bp, Homo sapiens
tctatgttaaatact

SEQ ID NO: 4090763 - DNA, 17 bp, Homo sapiens
tctatgttaaatactgt

SEQ ID NO: 4090764 - DNA, 21 bp, Homo sapiens
tctattaaagtgactttctat

SEQ ID NO: 4090765 - DNA, 19 bp, Homo sapiens
tctattaatcacctctctg

SEQ ID NO: 4090766 - DNA, 18 bp, Homo sapiens
tctattagactttagaaa

SEQ ID NO: 4090767 - DNA, 12 bp, Homo sapiens
tctattctgtgt

SEQ ID NO: 4090768 - DNA, 16 bp, Homo sapiens
tctattgccttctttg

SEQ ID NO: 4090769 - DNA, 17 bp, Homo sapiens
tctattgccttctttga

SEQ ID NO: 4090770 - DNA, 20 bp, Homo sapiens
tctattgccttctttgaaga

SEQ ID NO: 4090771 - DNA, 16 bp, Homo sapiens
tctattgggttcatta

SEQ ID NO: 4090772 - DNA, 16 bp, Homo sapiens
tctattgtattatttg

SEQ ID NO: 4090773 - DNA, 18 bp, Homo sapiens
tctattgtgggacttatt

SEQ ID NO: 4090774 - DNA, 12 bp, Homo sapiens
tctatttaatat

SEQ ID NO: 4090775 - DNA, 13 bp, Homo sapiens
tctatttaatatt

SEQ ID NO: 4090776 - DNA, 23 bp, Homo sapiens
tctatttacttctaatcttaaat

SEQ ID NO: 4090777 - DNA, 18 bp, Homo sapiens
tctatttatatgtacatg

SEQ ID NO: 4090778 - DNA, 19 bp, Homo sapiens
tctatttccccctttcttc

SEQ ID NO: 4090779 - DNA, 21 bp, Homo sapiens
tctatttctggatgaatgccc

SEQ ID NO: 4090780 - DNA, 12 bp, Homo sapiens
tctattttgtga

SEQ ID NO: 4090781 - DNA, 18 bp, Homo sapiens
tctatttttttaactgaa

SEQ ID NO: 4090782 - DNA, 20 bp, Homo sapiens
tctatttttttaactgaaaa

SEQ ID NO: 4090783 - DNA, 20 bp, Homo sapiens
tctcaaaaaataattagtta

SEQ ID NO: 4090784 - DNA, 14 bp, Homo sapiens
tctcaaaaatacaa

SEQ ID NO: 4090785 - DNA, 14 bp, Homo sapiens
tctcaaactggggc

SEQ ID NO: 4090786 - DNA, 15 bp, Homo sapiens
tctcaaacttgtggc

SEQ ID NO: 4090787 - DNA, 19 bp, Homo sapiens
tctcaaacttgtggcctca

SEQ ID NO: 4090788 - DNA, 11 bp, Homo sapiens
tctcaaagtta

SEQ ID NO: 4090789 - DNA, 17 bp, Homo sapiens
tctcaaagttttgaaaa

SEQ ID NO: 4090790 - DNA, 18 bp, Homo sapiens
tctcaaagttttgaaaag

SEQ ID NO: 4090791 - DNA, 15 bp, Homo sapiens
tctcaagctagtgtt

SEQ ID NO: 4090792 - DNA, 18 bp, Homo sapiens
tctcaagctagtgtttct

SEQ ID NO: 4090793 - DNA, 22 bp, Homo sapiens
tctcaatcctaatttctcctcc

SEQ ID NO: 4090794 - DNA, 22 bp, Homo sapiens
tctcaattaaagtctattcaaa

SEQ ID NO: 4090795 - DNA, 19 bp, Homo sapiens
tctcacactggtctgctgt

SEQ ID NO: 4090796 - DNA, 12 bp, Homo sapiens
tccttctccctt

SEQ ID NO: 4090797 - DNA, 19 bp, Homo sapiens
tccttctccttctcacaca

SEQ ID NO: 4090798 - DNA, 18 bp, Homo sapiens
tccttctctgaacacagg

SEQ ID NO: 4090799 - DNA, 21 bp, Homo sapiens
tccttctctgaacacaggcag

SEQ ID NO: 4090800 - DNA, 23 bp, Homo sapiens
tccttctctgaacacaggcagct

SEQ ID NO: 4090801 - DNA, 21 bp, Homo sapiens
tccttctctgggtctgatttt

SEQ ID NO: 4090802 - DNA, 23 bp, Homo sapiens
tccttctctgggtctgattttct

SEQ ID NO: 4090803 - DNA, 13 bp, Homo sapiens
tccttctttgccc

SEQ ID NO: 4090804 - DNA, 19 bp, Homo sapiens
tccttgaatatctttcgat

SEQ ID NO: 4090805 - DNA, 21 bp, Homo sapiens
tccttgagacacggagcccag

SEQ ID NO: 4090806 - DNA, 23 bp, Homo sapiens
tccttgagacacggagcccagcc

SEQ ID NO: 4090807 - DNA, 14 bp, Homo sapiens
tccttgatcatttt

SEQ ID NO: 4090808 - DNA, 14 bp, Homo sapiens
tccttgcacccctc

SEQ ID NO: 4090809 - DNA, 16 bp, Homo sapiens
tccttgcgcctcagcc

SEQ ID NO: 4090810 - DNA, 22 bp, Homo sapiens
tccttggactgttttgaaaagt

SEQ ID NO: 4090811 - DNA, 18 bp, Homo sapiens
tccttggccaagagaagg

SEQ ID NO: 4090812 - DNA, 20 bp, Homo sapiens
tccttggcttacctgacctc

SEQ ID NO: 4090813 - DNA, 23 bp, Homo sapiens
tccttggggttaagtctcctgtc

SEQ ID NO: 4090814 - DNA, 23 bp, Homo sapiens
tccttggtctttgtatcttccat

SEQ ID NO: 4090815 - DNA, 23 bp, Homo sapiens
tccttgtttatcagatacatcac

SEQ ID NO: 4090816 - DNA, 16 bp, Homo sapiens
tcctttaaaaaaattt

SEQ ID NO: 4090817 - DNA, 22 bp, Homo sapiens
tcctttaaaaaaatttaagtgc

SEQ ID NO: 4090818 - DNA, 12 bp, Homo sapiens
tcctttacaaaa

SEQ ID NO: 4090819 - DNA, 15 bp, Homo sapiens
tcctttacaaaagaa

SEQ ID NO: 4090820 - DNA, 22 bp, Homo sapiens
tcctttctaacaaaaaaatata

SEQ ID NO: 4090821 - DNA, 23 bp, Homo sapiens
tcctttctcagccgcttctgact

SEQ ID NO: 4090822 - DNA, 17 bp, Homo sapiens
tcctttctccagccagc

SEQ ID NO: 4090823 - DNA, 18 bp, Homo sapiens
tcctttctccagccagca

SEQ ID NO: 4090824 - DNA, 17 bp, Homo sapiens
tcctttctccaggacca

SEQ ID NO: 4090825 - DNA, 18 bp, Homo sapiens
tcctttcttccttggcca

SEQ ID NO: 4090826 - DNA, 14 bp, Homo sapiens
tcctttgcactgag

SEQ ID NO: 4090827 - DNA, 16 bp, Homo sapiens
tcctttgcagggcagc

SEQ ID NO: 4090828 - DNA, 22 bp, Homo sapiens
tcctttggagcttttttcttta

SEQ ID NO: 4090829 - DNA, 15 bp, Homo sapiens
tcctttgtagctact

SEQ ID NO: 4090830 - DNA, 18 bp, Homo sapiens
tcctttgttttctgacta

SEQ ID NO: 4090831 - DNA, 13 bp, Homo sapiens
tccttttccagag

SEQ ID NO: 4090832 - DNA, 15 bp, Homo sapiens
tccttttccagagca

SEQ ID NO: 4090833 - DNA, 23 bp, Homo sapiens
tccttttccagagcattccagtc

SEQ ID NO: 4090834 - DNA, 13 bp, Homo sapiens
tccttttccctgc

SEQ ID NO: 4090835 - DNA, 14 bp, Homo sapiens
tccttttccctgct

SEQ ID NO: 4090836 - DNA, 11 bp, Homo sapiens
tccttttcctt

SEQ ID NO: 4090837 - DNA, 23 bp, Homo sapiens
tccttttccttatttgccttcta

SEQ ID NO: 4090838 - DNA, 15 bp, Homo sapiens
tccttttctctgccc

SEQ ID NO: 4090839 - DNA, 16 bp, Homo sapiens
tccttttctctgccct

SEQ ID NO: 4090840 - DNA, 14 bp, Homo sapiens
tccttttgaggctt

SEQ ID NO: 4090841 - DNA, 12 bp, Homo sapiens
tccttttgtgtt

SEQ ID NO: 4090842 - DNA, 16 bp, Homo sapiens
tcctttttccatcatt

SEQ ID NO: 4090843 - DNA, 17 bp, Homo sapiens
tcctttttgacactgaa

SEQ ID NO: 4090844 - DNA, 23 bp, Homo sapiens
tcctttttggtcgaggagtaaca

SEQ ID NO: 4090845 - DNA, 17 bp, Homo sapiens
tcgaaactgccaagggt

SEQ ID NO: 4090846 - DNA, 16 bp, Homo sapiens
tcgaaataacaatgtt

SEQ ID NO: 4090847 - DNA, 20 bp, Homo sapiens
tcgaatctactaattccaca

SEQ ID NO: 4090848 - DNA, 15 bp, Homo sapiens
tcgaattaagaatat

SEQ ID NO: 4090849 - DNA, 19 bp, Homo sapiens
tcgacactcaccatgaagc

SEQ ID NO: 4090850 - DNA, 18 bp, Homo sapiens
tcgacagcgcccctgctg

SEQ ID NO: 4090851 - DNA, 19 bp, Homo sapiens
tcgacagcgcccctgctgt

SEQ ID NO: 4090852 - DNA, 20 bp, Homo sapiens
tcgacagcgcccctgctgtc

SEQ ID NO: 4090853 - DNA, 14 bp, Homo sapiens
tcgagaagggtgga

SEQ ID NO: 4090854 - DNA, 18 bp, Homo sapiens
tcgagacccaaaccccca

SEQ ID NO: 4090855 - DNA, 17 bp, Homo sapiens
tcgagcagcattttatt

SEQ ID NO: 4090856 - DNA, 11 bp, Homo sapiens
tcgaggcctga

SEQ ID NO: 4090857 - DNA, 12 bp, Homo sapiens
tcgaggcctgaa

SEQ ID NO: 4090858 - DNA, 18 bp, Homo sapiens
tcgaggggctctcagctc

SEQ ID NO: 4090859 - DNA, 21 bp, Homo sapiens
tcgaggtagagtttgaaggag

SEQ ID NO: 4090860 - DNA, 16 bp, Homo sapiens
tcgagtggcccaacag

SEQ ID NO: 4090861 - DNA, 21 bp, Homo sapiens
tcgatacccaggaccaagcca

SEQ ID NO: 4090862 - DNA, 12 bp, Homo sapiens
tcgatgcacagt

SEQ ID NO: 4090863 - DNA, 22 bp, Homo sapiens
tcgatgttttattatttctatt

SEQ ID NO: 4090864 - DNA, 15 bp, Homo sapiens
tcgcacactggggcc

SEQ ID NO: 4090865 - DNA, 15 bp, Homo sapiens
tcgcacccccctgtt

SEQ ID NO: 4090866 - DNA, 22 bp, Homo sapiens
tcgcacccccctgttctaaggg

SEQ ID NO: 4090867 - DNA, 12 bp, Homo sapiens
tcgcacctacca

SEQ ID NO: 4090868 - DNA, 16 bp, Homo sapiens
tcgcacctgtgctgga

SEQ ID NO: 4090869 - DNA, 21 bp, Homo sapiens
tcgcaggagtctctgccaccc

SEQ ID NO: 4090870 - DNA, 22 bp, Homo sapiens
tcgcaggagtctctgccaccca

SEQ ID NO: 4090871 - DNA, 23 bp, Homo sapiens
tcgcaggagtctctgccacccac

SEQ ID NO: 4090872 - DNA, 11 bp, Homo sapiens
tcgcccagcag

SEQ ID NO: 4090873 - DNA, 13 bp, Homo sapiens
tcgccccaggccc

SEQ ID NO: 4090874 - DNA, 14 bp, Homo sapiens
tcgccctcctttct

SEQ ID NO: 4090875 - DNA, 13 bp, Homo sapiens
tctcattcagtat

SEQ ID NO: 4090876 - DNA, 17 bp, Homo sapiens
tctcattcagtattaaa

SEQ ID NO: 4090877 - DNA, 20 bp, Homo sapiens
tctcattccgttgtctgtgg

SEQ ID NO: 4090878 - DNA, 21 bp, Homo sapiens
tctcattccgttgtctgtgga

SEQ ID NO: 4090879 - DNA, 17 bp, Homo sapiens
tctcatttaatttgtta

SEQ ID NO: 4090880 - DNA, 21 bp, Homo sapiens
tctcatttggtctgccagaat

SEQ ID NO: 4090881 - DNA, 16 bp, Homo sapiens
tctccaaggaccaggt

SEQ ID NO: 4090882 - DNA, 22 bp, Homo sapiens
tctccaaggatcctctccactc

SEQ ID NO: 4090883 - DNA, 19 bp, Homo sapiens
tctccacagcaaccccagg

SEQ ID NO: 4090884 - DNA, 14 bp, Homo sapiens
tctccactgccttc

SEQ ID NO: 4090885 - DNA, 21 bp, Homo sapiens
tctccagcgtcagctgctccc

SEQ ID NO: 4090886 - DNA, 15 bp, Homo sapiens
tctccagctgcctgg

SEQ ID NO: 4090887 - DNA, 16 bp, Homo sapiens
tctccagctgcctggg

SEQ ID NO: 4090888 - DNA, 17 bp, Homo sapiens
tctccagctgcctgggc

SEQ ID NO: 4090889 - DNA, 19 bp, Homo sapiens
tctccagctgggctctgca

SEQ ID NO: 4090890 - DNA, 21 bp, Homo sapiens
tctccaggaaggtagcccagc

SEQ ID NO: 4090891 - DNA, 14 bp, Homo sapiens
tctccaggaccaat

SEQ ID NO: 4090892 - DNA, 11 bp, Homo sapiens
tctccaggcca

SEQ ID NO: 4090893 - DNA, 21 bp, Homo sapiens
tctccaggcgacgcggttttt

SEQ ID NO: 4090894 - DNA, 13 bp, Homo sapiens
tctccaggcttca

SEQ ID NO: 4090895 - DNA, 18 bp, Homo sapiens
tctccaggcttcacagtc

SEQ ID NO: 4090896 - DNA, 20 bp, Homo sapiens
tctccagggagcaagacaga

SEQ ID NO: 4090897 - DNA, 19 bp, Homo sapiens
tctccatatctccatggcc

SEQ ID NO: 4090898 - DNA, 13 bp, Homo sapiens
tctccatcagctg

SEQ ID NO: 4090899 - DNA, 17 bp, Homo sapiens
tctccatcagctgtaag

SEQ ID NO: 4090900 - DNA, 14 bp, Homo sapiens
tctccatcatatgc

SEQ ID NO: 4090901 - DNA, 12 bp, Homo sapiens
tctccatctcta

SEQ ID NO: 4090902 - DNA, 22 bp, Homo sapiens
tctccattttggtgtctttctc

SEQ ID NO: 4090903 - DNA, 15 bp, Homo sapiens
tctcccacgtgggag

SEQ ID NO: 4090904 - DNA, 16 bp, Homo sapiens
tctcccaggccccctg

SEQ ID NO: 4090905 - DNA, 18 bp, Homo sapiens
tctcccaggtaccagctg

SEQ ID NO: 4090906 - DNA, 19 bp, Homo sapiens
tctcccaggtaccagctgc

SEQ ID NO: 4090907 - DNA, 20 bp, Homo sapiens
tctcccagtgaactcctgcc

SEQ ID NO: 4090908 - DNA, 21 bp, Homo sapiens
tctcccagtgaactcctgcca

SEQ ID NO: 4090909 - DNA, 20 bp, Homo sapiens
tctcccatttcaggaattta

SEQ ID NO: 4090910 - DNA, 23 bp, Homo sapiens
tctcccattttggaatttgcctg

SEQ ID NO: 4090911 - DNA, 10 bp, Homo sapiens
tctccccaca

SEQ ID NO: 4090912 - DNA, 21 bp, Homo sapiens
tccctggagtgtggctgagga

SEQ ID NO: 4090913 - DNA, 17 bp, Homo sapiens
tccctggctccctcctc

SEQ ID NO: 4090914 - DNA, 16 bp, Homo sapiens
tccctggcttccttac

SEQ ID NO: 4090915 - DNA, 18 bp, Homo sapiens
tccctgggcattgctttc

SEQ ID NO: 4090916 - DNA, 18 bp, Homo sapiens
tccctgggccagggtctg

SEQ ID NO: 4090917 - DNA, 24 bp, Homo sapiens
tccctgggccagggtctgtgtgaa

SEQ ID NO: 4090918 - DNA, 19 bp, Homo sapiens
tccctgggcccctccacgc

SEQ ID NO: 4090919 - DNA, 14 bp, Homo sapiens
tccctggggctgtg

SEQ ID NO: 4090920 - DNA, 16 bp, Homo sapiens
tccctggggctgtgca

SEQ ID NO: 4090921 - DNA, 19 bp, Homo sapiens
tccctggtcccttggagac

SEQ ID NO: 4090922 - DNA, 17 bp, Homo sapiens
tccctgtctccagctgc

SEQ ID NO: 4090923 - DNA, 18 bp, Homo sapiens
tccctgtgtgtaggctgg

SEQ ID NO: 4090924 - DNA, 14 bp, Homo sapiens
tccctgttcttcct

SEQ ID NO: 4090925 - DNA, 18 bp, Homo sapiens
tccctgttcttcctccag

SEQ ID NO: 4090926 - DNA, 11 bp, Homo sapiens
tccctgtttaa

SEQ ID NO: 4090927 - DNA, 14 bp, Homo sapiens
tccctgtttaatat

SEQ ID NO: 4090928 - DNA, 15 bp, Homo sapiens
tccctgtttaatatt

SEQ ID NO: 4090929 - DNA, 16 bp, Homo sapiens
tccctgtttaatattt

SEQ ID NO: 4090930 - DNA, 18 bp, Homo sapiens
tccctgtttaatatttaa

SEQ ID NO: 4090931 - DNA, 22 bp, Homo sapiens
tccctgtttaatatttaaacag

SEQ ID NO: 4090932 - DNA, 12 bp, Homo sapiens
tcccttaaaatt

SEQ ID NO: 4090933 - DNA, 14 bp, Homo sapiens
tcccttacaaggtg

SEQ ID NO: 4090934 - DNA, 12 bp, Homo sapiens
tcccttcagccc

SEQ ID NO: 4090935 - DNA, 21 bp, Homo sapiens
tcccttcagcccccagcccct

SEQ ID NO: 4090936 - DNA, 18 bp, Homo sapiens
tcccttcagtaccctctc

SEQ ID NO: 4090937 - DNA, 20 bp, Homo sapiens
tcccttcagtaccctctcag

SEQ ID NO: 4090938 - DNA, 21 bp, Homo sapiens
tcccttcagtaccctctcagc

SEQ ID NO: 4090939 - DNA, 23 bp, Homo sapiens
tcccttcagtaccctctcagctc

SEQ ID NO: 4090940 - DNA, 17 bp, Homo sapiens
tcccttccacctgctct

SEQ ID NO: 4090941 - DNA, 22 bp, Homo sapiens
tcccttccagtttattccagag

SEQ ID NO: 4090942 - DNA, 13 bp, Homo sapiens
tcccttcccacat

SEQ ID NO: 4090943 - DNA, 17 bp, Homo sapiens
tcccttcccccataagc

SEQ ID NO: 4090944 - DNA, 21 bp, Homo sapiens
tcccttcccctccctggctcc

SEQ ID NO: 4090945 - DNA, 16 bp, Homo sapiens
tcccttcctctctcct

SEQ ID NO: 4090946 - DNA, 23 bp, Homo sapiens
tcccttgaactgttctggcctca

SEQ ID NO: 4090947 - DNA, 19 bp, Homo sapiens
tcccttgcctctgccctgg

SEQ ID NO: 4090948 - DNA, 18 bp, Homo sapiens
tcccttgccttcctcagc

SEQ ID NO: 4090949 - DNA, 20 bp, Homo sapiens
tcccttgcctttcgaggcct

SEQ ID NO: 4090950 - DNA, 13 bp, Homo sapiens
tcccttgctttgt

SEQ ID NO: 4090951 - DNA, 21 bp, Homo sapiens
tcccttgctttgttttaataa

SEQ ID NO: 4090952 - DNA, 17 bp, Homo sapiens
tcccttgggttctgata

SEQ ID NO: 4090953 - DNA, 16 bp, Homo sapiens
tccctttccccagcat

SEQ ID NO: 4090954 - DNA, 14 bp, Homo sapiens
tccctttccctacc

SEQ ID NO: 4090955 - DNA, 15 bp, Homo sapiens
tccctttgacttcag

SEQ ID NO: 4090956 - DNA, 13 bp, Homo sapiens
tcccttttctgtt

SEQ ID NO: 4090957 - DNA, 20 bp, Homo sapiens
tcccttttctgttctagttt

SEQ ID NO: 4090958 - DNA, 20 bp, Homo sapiens
tccgaactgttcaagtgtcc

SEQ ID NO: 4090959 - DNA, 21 bp, Homo sapiens
tccgacttgtgcacaggcaga

SEQ ID NO: 4090960 - DNA, 12 bp, Homo sapiens
tccgagaactaa

SEQ ID NO: 4090961 - DNA, 14 bp, Homo sapiens
tccgagatccccag

SEQ ID NO: 4090962 - DNA, 20 bp, Homo sapiens
tccgagatccccagggcagc

SEQ ID NO: 4090963 - DNA, 15 bp, Homo sapiens
tccgatgaattctta

SEQ ID NO: 4090964 - DNA, 15 bp, Homo sapiens
tccgcactttccact

SEQ ID NO: 4090965 - DNA, 22 bp, Homo sapiens
tccgcactttccacttcttcct

SEQ ID NO: 4090966 - DNA, 23 bp, Homo sapiens
tccgcactttccacttcttcctt

SEQ ID NO: 4090967 - DNA, 16 bp, Homo sapiens
tccgcaggtgctggtc

SEQ ID NO: 4090968 - DNA, 17 bp, Homo sapiens
tccgccaatctggccct

SEQ ID NO: 4090969 - DNA, 12 bp, Homo sapiens
tccgccagcctc

SEQ ID NO: 4090970 - DNA, 15 bp, Homo sapiens
tccgccagcctcctc

SEQ ID NO: 4090971 - DNA, 18 bp, Homo sapiens
tccgccagcctcctctgg

SEQ ID NO: 4090972 - DNA, 20 bp, Homo sapiens
tccgccatggtgtcccggta

SEQ ID NO: 4090973 - DNA, 14 bp, Homo sapiens
tccgctgccagcct

SEQ ID NO: 4090974 - DNA, 19 bp, Homo sapiens
tccgctgccagccttgagc

SEQ ID NO: 4090975 - DNA, 12 bp, Homo sapiens
tccgctgctcct

SEQ ID NO: 4090976 - DNA, 15 bp, Homo sapiens
tccggagatgtagca

SEQ ID NO: 4090977 - DNA, 15 bp, Homo sapiens
tccggagtagctggg

SEQ ID NO: 4090978 - DNA, 15 bp, Homo sapiens
tccgggtgtggcctc

SEQ ID NO: 4090979 - DNA, 16 bp, Homo sapiens
tccgggtgtggcctca

SEQ ID NO: 4090980 - DNA, 18 bp, Homo sapiens
tccggtgtgtcagatttt

SEQ ID NO: 4090981 - DNA, 20 bp, Homo sapiens
tccgtagggtctttcttggg

SEQ ID NO: 4090982 - DNA, 23 bp, Homo sapiens
tccgtgatccatccatctccagg

SEQ ID NO: 4090983 - DNA, 17 bp, Homo sapiens
tccgtgccgtgtatttt

SEQ ID NO: 4090984 - DNA, 18 bp, Homo sapiens
tccgtgccgtgtattttt

SEQ ID NO: 4090985 - DNA, 22 bp, Homo sapiens
tccgttaacctttttgtaaata

SEQ ID NO: 4090986 - DNA, 14 bp, Homo sapiens
tccgttctgttctg

SEQ ID NO: 4090987 - DNA, 18 bp, Homo sapiens
tccgttctgttctgctgg

SEQ ID NO: 4090988 - DNA, 19 bp, Homo sapiens
tccgttctgttctgctggg

SEQ ID NO: 4090989 - DNA, 20 bp, Homo sapiens
tccgtttgatttgtcactgc

SEQ ID NO: 4090990 - DNA, 15 bp, Homo sapiens
tcctaaaacaaatag

SEQ ID NO: 4090991 - DNA, 23 bp, Homo sapiens
tcctaaaactgggattaagaaac

SEQ ID NO: 4090992 - DNA, 18 bp, Homo sapiens
tcctaagaaatatgtgag

SEQ ID NO: 4090993 - DNA, 17 bp, Homo sapiens
tcctaagagtgctgggc

SEQ ID NO: 4090994 - DNA, 13 bp, Homo sapiens
tcctaaggaacct

SEQ ID NO: 4090995 - DNA, 12 bp, Homo sapiens
tcctaaggacac

SEQ ID NO: 4090996 - DNA, 16 bp, Homo sapiens
tcctaaggacacacta

SEQ ID NO: 4090997 - DNA, 17 bp, Homo sapiens
tcctaaggacacactaa

SEQ ID NO: 4090998 - DNA, 18 bp, Homo sapiens
tcctaaggacacactaat

SEQ ID NO: 4090999 - DNA, 23 bp, Homo sapiens
tcctaaggtccaacaagaatgca

SEQ ID NO: 4091000 - DNA, 15 bp, Homo sapiens
tcctaatcactcaga

SEQ ID NO: 4091001 - DNA, 18 bp, Homo sapiens
tcctaatcactcagagca

SEQ ID NO: 4091002 - DNA, 18 bp, Homo sapiens
tcctaattcttctgtcct

SEQ ID NO: 4091003 - DNA, 15 bp, Homo sapiens
tcctaatttctcctc

SEQ ID NO: 4091004 - DNA, 14 bp, Homo sapiens
tcctacaacttaat

SEQ ID NO: 4091005 - DNA, 15 bp, Homo sapiens
tcctacagcactact

SEQ ID NO: 4091006 - DNA, 24 bp, Homo sapiens
tcctaccagttgccctagcccaga

SEQ ID NO: 4091007 - DNA, 16 bp, Homo sapiens
tcctacccaaccactc

SEQ ID NO: 4091008 - DNA, 20 bp, Homo sapiens
tcctacccacacctctgcca

SEQ ID NO: 4091009 - DNA, 14 bp, Homo sapiens
tcctacctgccctg

SEQ ID NO: 4091010 - DNA, 13 bp, Homo sapiens
tcctactcctgac

SEQ ID NO: 4091011 - DNA, 13 bp, Homo sapiens
tcctactcttctc

SEQ ID NO: 4091012 - DNA, 16 bp, Homo sapiens
tcctactcttctctct

SEQ ID NO: 4091013 - DNA, 18 bp, Homo sapiens
tcctactcttctctctgc

SEQ ID NO: 4091014 - DNA, 12 bp, Homo sapiens
tcctacttacaa

SEQ ID NO: 4091015 - DNA, 19 bp, Homo sapiens
tcctagagaacgcagccct

SEQ ID NO: 4091016 - DNA, 14 bp, Homo sapiens
tcctagataaaaag

SEQ ID NO: 4091017 - DNA, 22 bp, Homo sapiens
tcctagcagacagaaactggat

SEQ ID NO: 4091018 - DNA, 21 bp, Homo sapiens
tcctagcaggagagaggctct

SEQ ID NO: 4091019 - DNA, 16 bp, Homo sapiens
tcctagcccttccctg

SEQ ID NO: 4091020 - DNA, 20 bp, Homo sapiens
tcctagcccttccctgagtg

SEQ ID NO: 4091021 - DNA, 14 bp, Homo sapiens
tcctaggagagcca

SEQ ID NO: 4091022 - DNA, 21 bp, Homo sapiens
tcctaggcccaggcctgggtt

SEQ ID NO: 4091023 - DNA, 20 bp, Homo sapiens
tcctagggaaaagttcatag

SEQ ID NO: 4091024 - DNA, 18 bp, Homo sapiens
tcctaggggaacagacca

SEQ ID NO: 4091025 - DNA, 20 bp, Homo sapiens
tcctaggggaacagaccagt

SEQ ID NO: 4091026 - DNA, 15 bp, Homo sapiens
tcctaggtccaagcc

SEQ ID NO: 4091027 - DNA, 16 bp, Homo sapiens
tcctaggtccaagccc

SEQ ID NO: 4091028 - DNA, 18 bp, Homo sapiens
tcctagtggatgactgtt

SEQ ID NO: 4091029 - DNA, 18 bp, Homo sapiens
tcctatattgttttcagt

SEQ ID NO: 4091030 - DNA, 21 bp, Homo sapiens
tcctatgcccaggtaccaccc

SEQ ID NO: 4091031 - DNA, 16 bp, Homo sapiens
tcctatggacaactta

SEQ ID NO: 4091032 - DNA, 18 bp, Homo sapiens
tcctatggacaacttatt

SEQ ID NO: 4091033 - DNA, 17 bp, Homo sapiens
tcctattaaaacacagc

SEQ ID NO: 4091034 - DNA, 19 bp, Homo sapiens
tcctcaaattttttgactt

SEQ ID NO: 4091035 - DNA, 17 bp, Homo sapiens
tcctcaagaaataaaag

SEQ ID NO: 4091036 - DNA, 17 bp, Homo sapiens
tcctcacacccctgtcc

SEQ ID NO: 4091037 - DNA, 13 bp, Homo sapiens
tcctcacctctgg

SEQ ID NO: 4091038 - DNA, 13 bp, Homo sapiens
tcctcactaaaaa

SEQ ID NO: 4091039 - DNA, 21 bp, Homo sapiens
tcctcactatgacactgagca

SEQ ID NO: 4091040 - DNA, 17 bp, Homo sapiens
tcctcactcccagtcca

SEQ ID NO: 4091041 - DNA, 14 bp, Homo sapiens
tcctcactgggtgg

SEQ ID NO: 4091042 - DNA, 22 bp, Homo sapiens
tcctcactgggtggggtgagga

SEQ ID NO: 4091043 - DNA, 21 bp, Homo sapiens
tcctcacttccatacagctct

SEQ ID NO: 4091044 - DNA, 15 bp, Homo sapiens
tcctcacttggggga

SEQ ID NO: 4091045 - DNA, 15 bp, Homo sapiens
tcctcagagcgccag

SEQ ID NO: 4091046 - DNA, 17 bp, Homo sapiens
tcctcagagcgccagga

SEQ ID NO: 4091047 - DNA, 19 bp, Homo sapiens
tcctcagcatttcttttct

SEQ ID NO: 4091048 - DNA, 11 bp, Homo sapiens
tcctcagcctt

SEQ ID NO: 4091049 - DNA, 21 bp, Homo sapiens
tcctcagccttgccagagatc

SEQ ID NO: 4091050 - DNA, 21 bp, Homo sapiens
tcctcagctgcctcctgcgcc

SEQ ID NO: 4091051 - DNA, 21 bp, Homo sapiens
tcctcagctggttactcaggg

SEQ ID NO: 4091052 - DNA, 22 bp, Homo sapiens
tcctcagctggttactcagggt

SEQ ID NO: 4091053 - DNA, 23 bp, Homo sapiens
tcctcagctggttactcagggtt

SEQ ID NO: 4091054 - DNA, 22 bp, Homo sapiens
tcctcagcttcttcacaggcac

SEQ ID NO: 4091055 - DNA, 22 bp, Homo sapiens
tcctcaggcacacagctactct

SEQ ID NO: 4091056 - DNA, 13 bp, Homo sapiens
tcctcagggtggg

SEQ ID NO: 4091057 - DNA, 19 bp, Homo sapiens
tcctcagtccatttatata

SEQ ID NO: 4091058 - DNA, 21 bp, Homo sapiens
tcctcagtccatttatatatg

SEQ ID NO: 4091059 - DNA, 15 bp, Homo sapiens
tcctcatccacccca

SEQ ID NO: 4091060 - DNA, 22 bp, Homo sapiens
tcctcatcccgtgttctccttt

SEQ ID NO: 4091061 - DNA, 13 bp, Homo sapiens
tcctcatccctga

SEQ ID NO: 4091062 - DNA, 18 bp, Homo sapiens
tcctccaaatctcttgct

SEQ ID NO: 4091063 - DNA, 22 bp, Homo sapiens
tcctccaacaccaagcacagca

SEQ ID NO: 4091064 - DNA, 17 bp, Homo sapiens
tcctccacccataataa

SEQ ID NO: 4091065 - DNA, 15 bp, Homo sapiens
tcctccacctcccac

SEQ ID NO: 4091066 - DNA, 16 bp, Homo sapiens
tcctccagaactcttc

SEQ ID NO: 4091067 - DNA, 21 bp, Homo sapiens
tcctccagaactcttcctcca

SEQ ID NO: 4091068 - DNA, 16 bp, Homo sapiens
tcctccagaagcctct

SEQ ID NO: 4091069 - DNA, 12 bp, Homo sapiens
tcctccagacca

SEQ ID NO: 4091070 - DNA, 16 bp, Homo sapiens
tcctccagaccaccag

SEQ ID NO: 4091071 - DNA, 12 bp, Homo sapiens
tcctccagcccc

SEQ ID NO: 4091072 - DNA, 14 bp, Homo sapiens
tcctccagcccctg

SEQ ID NO: 4091073 - DNA, 18 bp, Homo sapiens
tcctccagcccctgtccc

SEQ ID NO: 4091074 - DNA, 14 bp, Homo sapiens
tcctccagctgcac

SEQ ID NO: 4091075 - DNA, 13 bp, Homo sapiens
tcctccaggcctg

SEQ ID NO: 4091076 - DNA, 13 bp, Homo sapiens
tcctccagggaag

SEQ ID NO: 4091077 - DNA, 21 bp, Homo sapiens
tcctccagggaaggtggccac

SEQ ID NO: 4091078 - DNA, 21 bp, Homo sapiens
tcctccagggatgatcaacag

SEQ ID NO: 4091079 - DNA, 22 bp, Homo sapiens
tcctccagggtgattttatgat

SEQ ID NO: 4091080 - DNA, 17 bp, Homo sapiens
tcctccagtaccttgct

SEQ ID NO: 4091081 - DNA, 21 bp, Homo sapiens
tcctccatctttctacagaga

SEQ ID NO: 4091082 - DNA, 20 bp, Homo sapiens
tcctcccaatttcagactcc

SEQ ID NO: 4091083 - DNA, 19 bp, Homo sapiens
tcctcccaggcgccccttc

SEQ ID NO: 4091084 - DNA, 21 bp, Homo sapiens
tcctcccaggcgccccttccc

SEQ ID NO: 4091085 - DNA, 12 bp, Homo sapiens
tcctcccagtga

SEQ ID NO: 4091086 - DNA, 13 bp, Homo sapiens
tcctcccagtgag

SEQ ID NO: 4091087 - DNA, 19 bp, Homo sapiens
tcctcccatcccctggact

SEQ ID NO: 4091088 - DNA, 16 bp, Homo sapiens
tcctccccaaatcaat

SEQ ID NO: 4091089 - DNA, 21 bp, Homo sapiens
tcctccccaaatcaatacact

SEQ ID NO: 4091090 - DNA, 22 bp, Homo sapiens
tcctccccaccttcaatgactt

SEQ ID NO: 4091091 - DNA, 13 bp, Homo sapiens
tcctcccgccctt

SEQ ID NO: 4091092 - DNA, 19 bp, Homo sapiens
tcctccctgggcagaaagt

SEQ ID NO: 4091093 - DNA, 18 bp, Homo sapiens
tcctcccttacagagcat

SEQ ID NO: 4091094 - DNA, 23 bp, Homo sapiens
tcctccgtagggtctttcttggg

SEQ ID NO: 4091095 - DNA, 18 bp, Homo sapiens
tcctccgtccagccgcca

SEQ ID NO: 4091096 - DNA, 12 bp, Homo sapiens
tcctcctccagg

SEQ ID NO: 4091097 - DNA, 13 bp, Homo sapiens
tcctcctccaggg

SEQ ID NO: 4091098 - DNA, 15 bp, Homo sapiens
tcctcctccagggtg

SEQ ID NO: 4091099 - DNA, 16 bp, Homo sapiens
tcctcctccttcctag

SEQ ID NO: 4091100 - DNA, 18 bp, Homo sapiens
tcctcctccttcctagtt

SEQ ID NO: 4091101 - DNA, 11 bp, Homo sapiens
tcctcctctgc

SEQ ID NO: 4091102 - DNA, 12 bp, Homo sapiens
tcctcctctgcc

SEQ ID NO: 4091103 - DNA, 13 bp, Homo sapiens
tcctcctctgcct

SEQ ID NO: 4091104 - DNA, 15 bp, Homo sapiens
tcctcctctgcctac

SEQ ID NO: 4091105 - DNA, 22 bp, Homo sapiens
tcctcctctgcctacagccagg

SEQ ID NO: 4091106 - DNA, 21 bp, Homo sapiens
tcctcctcttcaccaggtgca

SEQ ID NO: 4091107 - DNA, 13 bp, Homo sapiens
tcctcctgccctg

SEQ ID NO: 4091108 - DNA, 16 bp, Homo sapiens
tcctcctgccctgtcc

SEQ ID NO: 4091109 - DNA, 13 bp, Homo sapiens
tcctcctgcctca

SEQ ID NO: 4091110 - DNA, 14 bp, Homo sapiens
tcctcctgcctcag

SEQ ID NO: 4091111 - DNA, 21 bp, Homo sapiens
tcctcctgcctcagccttcca

SEQ ID NO: 4091112 - DNA, 18 bp, Homo sapiens
tcctcctggaaccttgct

SEQ ID NO: 4091113 - DNA, 19 bp, Homo sapiens
tcctcctggaaccttgctg

SEQ ID NO: 4091114 - DNA, 20 bp, Homo sapiens
tcctcctggaaccttgctgt

SEQ ID NO: 4091115 - DNA, 22 bp, Homo sapiens
tcctcctggaaccttgctgtcc

SEQ ID NO: 4091116 - DNA, 23 bp, Homo sapiens
tcctccttgcccagactacaggg

SEQ ID NO: 4091117 - DNA, 24 bp, Homo sapiens
tcctccttgcccagactacagggc

SEQ ID NO: 4091118 - DNA, 21 bp, Homo sapiens
tccatttatatatgaaaacta

SEQ ID NO: 4091119 - DNA, 15 bp, Homo sapiens
tccctgcgggccagg

SEQ ID NO: 4091120 - DNA, 15 bp, Homo sapiens
tccctgctttgcatc

SEQ ID NO: 4091121 - DNA, 16 bp, Homo sapiens
tccctgctttgcatct

SEQ ID NO: 4091122 - DNA, 14 bp, Homo sapiens
tccctgctttggct

SEQ ID NO: 4091123 - DNA, 19 bp, Homo sapiens
tccctgctttggctgaggg

SEQ ID NO: 4091124 - DNA, 23 bp, Homo sapiens
tccctgctttggctgaggggctt

SEQ ID NO: 4091125 - DNA, 23 bp, Homo sapiens
tccctggagcaggagccccgcca

SEQ ID NO: 4091126 - DNA, 16 bp, Homo sapiens
tcctcggagagcagca

SEQ ID NO: 4091127 - DNA, 17 bp, Homo sapiens
tcctcggagagcagcag

SEQ ID NO: 4091128 - DNA, 16 bp, Homo sapiens
tcctcgggccgaggcc

SEQ ID NO: 4091129 - DNA, 18 bp, Homo sapiens
tcctcgggccgaggccca

SEQ ID NO: 4091130 - DNA, 19 bp, Homo sapiens
tcctcgggccgaggcccag

SEQ ID NO: 4091131 - DNA, 19 bp, Homo sapiens
tcctcgtccatcagggatc

SEQ ID NO: 4091132 - DNA, 20 bp, Homo sapiens
tcctctaagccactcttcca

SEQ ID NO: 4091133 - DNA, 14 bp, Homo sapiens
tcctctagaagcca

SEQ ID NO: 4091134 - DNA, 15 bp, Homo sapiens
tcctctagctgtggg

SEQ ID NO: 4091135 - DNA, 23 bp, Homo sapiens
tcctctaggcaagcaggacctgg

SEQ ID NO: 4091136 - DNA, 17 bp, Homo sapiens
tcctctatacatctctc

SEQ ID NO: 4091137 - DNA, 15 bp, Homo sapiens
tcctctcaggctctt

SEQ ID NO: 4091138 - DNA, 16 bp, Homo sapiens
tcctctccccagccca

SEQ ID NO: 4091139 - DNA, 20 bp, Homo sapiens
tcctctccccctcctccagg

SEQ ID NO: 4091140 - DNA, 13 bp, Homo sapiens
tcctctcccctcc

SEQ ID NO: 4091141 - DNA, 14 bp, Homo sapiens
tcctctcccctcca

SEQ ID NO: 4091142 - DNA, 12 bp, Homo sapiens
tcctctcctgga

SEQ ID NO: 4091143 - DNA, 14 bp, Homo sapiens
tcctctcctggagg

SEQ ID NO: 4091144 - DNA, 16 bp, Homo sapiens
tcctctcctggaggat

SEQ ID NO: 4091145 - DNA, 13 bp, Homo sapiens
tcctctcgagccc

SEQ ID NO: 4091146 - DNA, 15 bp, Homo sapiens
tcctctcgagcccag

SEQ ID NO: 4091147 - DNA, 18 bp, Homo sapiens
tcctctcgagcccagatg

SEQ ID NO: 4091148 - DNA, 19 bp, Homo sapiens
tcctctctccagatgtttc

SEQ ID NO: 4091149 - DNA, 19 bp, Homo sapiens
tcctctctctttcctccac

SEQ ID NO: 4091150 - DNA, 20 bp, Homo sapiens
tcctctcttaaatgcaagtg

SEQ ID NO: 4091151 - DNA, 15 bp, Homo sapiens
tcctctgagcccagc

SEQ ID NO: 4091152 - DNA, 22 bp, Homo sapiens
tcctctgagcccagctgcctgg

SEQ ID NO: 4091153 - DNA, 14 bp, Homo sapiens
tcctctgcctgccc

SEQ ID NO: 4091154 - DNA, 20 bp, Homo sapiens
tcctctgctcaccgcccatc

SEQ ID NO: 4091155 - DNA, 20 bp, Homo sapiens
tcctctgctcccccttttcc

SEQ ID NO: 4091156 - DNA, 20 bp, Homo sapiens
tcctctggacggcaggctca

SEQ ID NO: 4091157 - DNA, 22 bp, Homo sapiens
tcctctggacggcaggctcact

SEQ ID NO: 4091158 - DNA, 18 bp, Homo sapiens
tcctctggctttcccagg

SEQ ID NO: 4091159 - DNA, 20 bp, Homo sapiens
tcctctggctttcccaggag

SEQ ID NO: 4091160 - DNA, 21 bp, Homo sapiens
tcctctgtcagtcacagccac

SEQ ID NO: 4091161 - DNA, 12 bp, Homo sapiens
tcctctgtccta

SEQ ID NO: 4091162 - DNA, 15 bp, Homo sapiens
tcctcttcaccaggt

SEQ ID NO: 4091163 - DNA, 17 bp, Homo sapiens
tcctcttcaccaggtgc

SEQ ID NO: 4091164 - DNA, 19 bp, Homo sapiens
tcctcttcagaacttgtca

SEQ ID NO: 4091165 - DNA, 17 bp, Homo sapiens
tcctcttctgggcctga

SEQ ID NO: 4091166 - DNA, 16 bp, Homo sapiens
tcctgaaacgctcctt

SEQ ID NO: 4091167 - DNA, 19 bp, Homo sapiens
tcctgaactcttctgcaaa

SEQ ID NO: 4091168 - DNA, 14 bp, Homo sapiens
tcctgaatgaaata

SEQ ID NO: 4091169 - DNA, 21 bp, Homo sapiens
tcctgacggcgcccccagtgt

SEQ ID NO: 4091170 - DNA, 18 bp, Homo sapiens
tcctgacgtctgaagctt

SEQ ID NO: 4091171 - DNA, 19 bp, Homo sapiens
tcctgactcaacatgttac

SEQ ID NO: 4091172 - DNA, 14 bp, Homo sapiens
tcctgactctgccc

SEQ ID NO: 4091173 - DNA, 15 bp, Homo sapiens
tcctgactctgcccc

SEQ ID NO: 4091174 - DNA, 22 bp, Homo sapiens
tcctgactctgccccctgctgg

SEQ ID NO: 4091175 - DNA, 23 bp, Homo sapiens
tcctgactctgccccctgctggc

SEQ ID NO: 4091176 - DNA, 16 bp, Homo sapiens
tcctgactgggctggg

SEQ ID NO: 4091177 - DNA, 19 bp, Homo sapiens
tcctgactgggctgggttt

SEQ ID NO: 4091178 - DNA, 22 bp, Homo sapiens
tcctgactgggctgggtttgct

SEQ ID NO: 4091179 - DNA, 12 bp, Homo sapiens
tcctgacttgag

SEQ ID NO: 4091180 - DNA, 20 bp, Homo sapiens
tcctgagatttcctcctggc

SEQ ID NO: 4091181 - DNA, 16 bp, Homo sapiens
tcctgaggctttggat

SEQ ID NO: 4091182 - DNA, 20 bp, Homo sapiens
tcctgataaagcacagctgt

SEQ ID NO: 4091183 - DNA, 14 bp, Homo sapiens
tcctgatctgtgat

SEQ ID NO: 4091184 - DNA, 20 bp, Homo sapiens
tcctgcaaccaaactcccat

SEQ ID NO: 4091185 - DNA, 19 bp, Homo sapiens
tcctgcagcaaacactcca

SEQ ID NO: 4091186 - DNA, 12 bp, Homo sapiens
tcctgcagcatg

SEQ ID NO: 4091187 - DNA, 11 bp, Homo sapiens
tcctgccaaaa

SEQ ID NO: 4091188 - DNA, 18 bp, Homo sapiens
tcctgccacatggagccc

SEQ ID NO: 4091189 - DNA, 22 bp, Homo sapiens
tcctgccagccccacacagcta

SEQ ID NO: 4091190 - DNA, 21 bp, Homo sapiens
tcctgccaggcacacacagcc

SEQ ID NO: 4091191 - DNA, 12 bp, Homo sapiens
tcctgcccagat

SEQ ID NO: 4091192 - DNA, 13 bp, Homo sapiens
tcctgcccagtgt

SEQ ID NO: 4091193 - DNA, 17 bp, Homo sapiens
tcctgcccagtgttgtt

SEQ ID NO: 4091194 - DNA, 22 bp, Homo sapiens
tcctgcccagtgttgtttgtaa

SEQ ID NO: 4091195 - DNA, 18 bp, Homo sapiens
tcctgcccatgtgtcccc

SEQ ID NO: 4091196 - DNA, 19 bp, Homo sapiens
tcctgcccatgtgtcccct

SEQ ID NO: 4091197 - DNA, 12 bp, Homo sapiens
tcctgccccaca

SEQ ID NO: 4091198 - DNA, 12 bp, Homo sapiens
tcctgccctccc

SEQ ID NO: 4091199 - DNA, 15 bp, Homo sapiens
tcctgccctgtccaa

SEQ ID NO: 4091200 - DNA, 18 bp, Homo sapiens
tcctgccctgtccctgtc

SEQ ID NO: 4091201 - DNA, 16 bp, Homo sapiens
tcctgcccttccctct

SEQ ID NO: 4091202 - DNA, 13 bp, Homo sapiens
tcctgccgcagac

SEQ ID NO: 4091203 - DNA, 20 bp, Homo sapiens
tcctgccgcagacgggcaca

SEQ ID NO: 4091204 - DNA, 13 bp, Homo sapiens
tcctgcctcagcc

SEQ ID NO: 4091205 - DNA, 16 bp, Homo sapiens
tcctgcctcagcctcc

SEQ ID NO: 4091206 - DNA, 19 bp, Homo sapiens
tcctgcctcagcctcccaa

SEQ ID NO: 4091207 - DNA, 14 bp, Homo sapiens
tcctgcctggcact

SEQ ID NO: 4091208 - DNA, 15 bp, Homo sapiens
tcctgcctggcactt

SEQ ID NO: 4091209 - DNA, 13 bp, Homo sapiens
tcctgcctggcca

SEQ ID NO: 4091210 - DNA, 14 bp, Homo sapiens
tcctgcctggccag

SEQ ID NO: 4091211 - DNA, 16 bp, Homo sapiens
tcctgcctgtctgccc

SEQ ID NO: 4091212 - DNA, 18 bp, Homo sapiens
tcctgcgccctgtgcccg

SEQ ID NO: 4091213 - DNA, 18 bp, Homo sapiens
tcctgctaagttaatgtt

SEQ ID NO: 4091214 - DNA, 17 bp, Homo sapiens
tcctgctacaggagggg

SEQ ID NO: 4091215 - DNA, 21 bp, Homo sapiens
tcctgctacctcccttgcctt

SEQ ID NO: 4091216 - DNA, 19 bp, Homo sapiens
tcctgctcaccacctgcct

SEQ ID NO: 4091217 - DNA, 13 bp, Homo sapiens
tcctgctcagcag

SEQ ID NO: 4091218 - DNA, 20 bp, Homo sapiens
tcctgctccctgtggcactc

SEQ ID NO: 4091219 - DNA, 12 bp, Homo sapiens
tcctgctgcacc

SEQ ID NO: 4091220 - DNA, 14 bp, Homo sapiens
tcctgctgctgtgt

SEQ ID NO: 4091221 - DNA, 14 bp, Homo sapiens
tcctgctggcttcc

SEQ ID NO: 4091222 - DNA, 13 bp, Homo sapiens
tcctgcttttctg

SEQ ID NO: 4091223 - DNA, 21 bp, Homo sapiens
tcctggaaaagaagaaacttt

SEQ ID NO: 4091224 - DNA, 18 bp, Homo sapiens
tcctggaaccttgctgtc

SEQ ID NO: 4091225 - DNA, 17 bp, Homo sapiens
tcctggacactcagacc

SEQ ID NO: 4091226 - DNA, 19 bp, Homo sapiens
tcctggacactcagacctg

SEQ ID NO: 4091227 - DNA, 17 bp, Homo sapiens
tcctggacaggccaggt

SEQ ID NO: 4091228 - DNA, 21 bp, Homo sapiens
tcctggacatcctcttctgct

SEQ ID NO: 4091229 - DNA, 22 bp, Homo sapiens
tcctggacatcctcttctgctt

SEQ ID NO: 4091230 - DNA, 22 bp, Homo sapiens
tccacctccaccacatctgcca

SEQ ID NO: 4091231 - DNA, 16 bp, Homo sapiens
tccacctcccaccctg

SEQ ID NO: 4091232 - DNA, 14 bp, Homo sapiens
tccacctgctctgc

SEQ ID NO: 4091233 - DNA, 23 bp, Homo sapiens
tccacctgggcatatccaccacc

SEQ ID NO: 4091234 - DNA, 12 bp, Homo sapiens
tccacctgtggg

SEQ ID NO: 4091235 - DNA, 13 bp, Homo sapiens
tccacctgtgggt

SEQ ID NO: 4091236 - DNA, 13 bp, Homo sapiens
tccaccttggctc

SEQ ID NO: 4091237 - DNA, 18 bp, Homo sapiens
tccaggcagcacccaggt

SEQ ID NO: 4091238 - DNA, 11 bp, Homo sapiens
tccaggcagcc

SEQ ID NO: 4091239 - DNA, 13 bp, Homo sapiens
tccaggcagccgc

SEQ ID NO: 4091240 - DNA, 19 bp, Homo sapiens
tcagctgctccctggcatt

SEQ ID NO: 4091241 - DNA, 21 bp, Homo sapiens
tcagctggttactcagggttc

SEQ ID NO: 4091242 - DNA, 12 bp, Homo sapiens
tcagctgtactt

SEQ ID NO: 4091243 - DNA, 17 bp, Homo sapiens
tcagctgtacttcgtct

SEQ ID NO: 4091244 - DNA, 14 bp, Homo sapiens
tcagctgttgcaga

SEQ ID NO: 4091245 - DNA, 17 bp, Homo sapiens
tcagcttaaaataaaca

SEQ ID NO: 4091246 - DNA, 18 bp, Homo sapiens
tcagcttaaaataaacag

SEQ ID NO: 4091247 - DNA, 13 bp, Homo sapiens
tcagcttatctct

SEQ ID NO: 4091248 - DNA, 20 bp, Homo sapiens
tcagcttatctcttttatat

SEQ ID NO: 4091249 - DNA, 19 bp, Homo sapiens
tcagcttcctacccacacc

SEQ ID NO: 4091250 - DNA, 21 bp, Homo sapiens
tcagcttcttcacaggcactc

SEQ ID NO: 4091251 - DNA, 17 bp, Homo sapiens
tcagcttcttcctaggt

SEQ ID NO: 4091252 - DNA, 23 bp, Homo sapiens
tcagctttgactttatctcctgc

SEQ ID NO: 4091253 - DNA, 18 bp, Homo sapiens
tcaggaaatatatatgtg

SEQ ID NO: 4091254 - DNA, 21 bp, Homo sapiens
tcaggaaatatatatgtgtgt

SEQ ID NO: 4091255 - DNA, 13 bp, Homo sapiens
tcaggaatttaaa

SEQ ID NO: 4091256 - DNA, 15 bp, Homo sapiens
tcaggacagatgcca

SEQ ID NO: 4091257 - DNA, 22 bp, Homo sapiens
tcaggacggctcctcagagcgc

SEQ ID NO: 4091258 - DNA, 11 bp, Homo sapiens
tcaggagcaca

SEQ ID NO: 4091259 - DNA, 21 bp, Homo sapiens
tcaggagcttgggcagtgccc

SEQ ID NO: 4091260 - DNA, 13 bp, Homo sapiens
tcaggaggctgga

SEQ ID NO: 4091261 - DNA, 14 bp, Homo sapiens
tcaggaggctggag

SEQ ID NO: 4091262 - DNA, 16 bp, Homo sapiens
tcaggatacatgtgcc

SEQ ID NO: 4091263 - DNA, 16 bp, Homo sapiens
tcaggatcaagaaagt

SEQ ID NO: 4091264 - DNA, 15 bp, Homo sapiens
tcaggatgaacccag

SEQ ID NO: 4091265 - DNA, 12 bp, Homo sapiens
tcaggcaccagc

SEQ ID NO: 4091266 - DNA, 20 bp, Homo sapiens
tcaggcaccagcatccacct

SEQ ID NO: 4091267 - DNA, 13 bp, Homo sapiens
tcaggcaggaagg

SEQ ID NO: 4091268 - DNA, 18 bp, Homo sapiens
tcaggcataggcctgggt

SEQ ID NO: 4091269 - DNA, 22 bp, Homo sapiens
tcaggcataggcctgggtgctg

SEQ ID NO: 4091270 - DNA, 19 bp, Homo sapiens
tcaggccctgactcctctg

SEQ ID NO: 4091271 - DNA, 20 bp, Homo sapiens
tcaggccctgactcctctgg

SEQ ID NO: 4091272 - DNA, 18 bp, Homo sapiens
tcaggcctccctctctct

SEQ ID NO: 4091273 - DNA, 21 bp, Homo sapiens
tcaggcgatccacctgtctca

SEQ ID NO: 4091274 - DNA, 18 bp, Homo sapiens
tcaggcggggtgctgtgg

SEQ ID NO: 4091275 - DNA, 19 bp, Homo sapiens
tcaggcggggtgctgtggt

SEQ ID NO: 4091276 - DNA, 15 bp, Homo sapiens
tcaggctactagaat

SEQ ID NO: 4091277 - DNA, 20 bp, Homo sapiens
tcaggctccattaggatttg

SEQ ID NO: 4091278 - DNA, 19 bp, Homo sapiens
tcaggctctgtggagggca

SEQ ID NO: 4091279 - DNA, 22 bp, Homo sapiens
tcaggctgggcagccccagaga

SEQ ID NO: 4091280 - DNA, 16 bp, Homo sapiens
tcaggcttgaaatgca

SEQ ID NO: 4091281 - DNA, 14 bp, Homo sapiens
tcagggacagagcc

SEQ ID NO: 4091282 - DNA, 20 bp, Homo sapiens
tcagggaccggtgctgcagg

SEQ ID NO: 4091283 - DNA, 18 bp, Homo sapiens
tcagggaccgtccagggg

SEQ ID NO: 4091284 - DNA, 13 bp, Homo sapiens
tcagggagtgctg

SEQ ID NO: 4091285 - DNA, 17 bp, Homo sapiens
tcagggagtgctggctc

SEQ ID NO: 4091286 - DNA, 22 bp, Homo sapiens
tcagggagtgctggctcacagt

SEQ ID NO: 4091287 - DNA, 20 bp, Homo sapiens
tcagggattttttttttaaa

SEQ ID NO: 4091288 - DNA, 18 bp, Homo sapiens
tcagggcacgcaggacca

SEQ ID NO: 4091289 - DNA, 19 bp, Homo sapiens
tcagggcacgcaggaccag

SEQ ID NO: 4091290 - DNA, 16 bp, Homo sapiens
tcagggcagggctctg

SEQ ID NO: 4091291 - DNA, 13 bp, Homo sapiens
tcagggccaggcc

SEQ ID NO: 4091292 - DNA, 16 bp, Homo sapiens
tcagggccaggcccag

SEQ ID NO: 4091293 - DNA, 20 bp, Homo sapiens
tcagggccaggcccaggcct

SEQ ID NO: 4091294 - DNA, 21 bp, Homo sapiens
tcagggccaggcccaggcctc

SEQ ID NO: 4091295 - DNA, 20 bp, Homo sapiens
tcagggccagtcctcctggg

SEQ ID NO: 4091296 - DNA, 17 bp, Homo sapiens
tcagggcctggcaggcc

SEQ ID NO: 4091297 - DNA, 19 bp, Homo sapiens
tcagggcctggcaggccag

SEQ ID NO: 4091298 - DNA, 21 bp, Homo sapiens
tcagggcctggcaggccagtg

SEQ ID NO: 4091299 - DNA, 21 bp, Homo sapiens
tcagggcctggggcctgagag

SEQ ID NO: 4091300 - DNA, 22 bp, Homo sapiens
tcagggcctggggcctgagaga

SEQ ID NO: 4091301 - DNA, 18 bp, Homo sapiens
tcagggcgctcagacggc

SEQ ID NO: 4091302 - DNA, 17 bp, Homo sapiens
tcagggctgtcccagcc

SEQ ID NO: 4091303 - DNA, 19 bp, Homo sapiens
tcagggctgtcccagcccc

SEQ ID NO: 4091304 - DNA, 16 bp, Homo sapiens
tcaggggactcagccc

SEQ ID NO: 4091305 - DNA, 14 bp, Homo sapiens
tcaggggccagagg

SEQ ID NO: 4091306 - DNA, 20 bp, Homo sapiens
tcaggggggttgtgaggcct

SEQ ID NO: 4091307 - DNA, 18 bp, Homo sapiens
tcaggggtgcattctggc

SEQ ID NO: 4091308 - DNA, 22 bp, Homo sapiens
tcaggggttcgagaccagtctg

SEQ ID NO: 4091309 - DNA, 18 bp, Homo sapiens
tcagggttggtgtgctga

SEQ ID NO: 4091310 - DNA, 16 bp, Homo sapiens
tcagggttttggggtc

SEQ ID NO: 4091311 - DNA, 15 bp, Homo sapiens
tcaggtcagggactt

SEQ ID NO: 4091312 - DNA, 17 bp, Homo sapiens
tcaggtcagggacttgg

SEQ ID NO: 4091313 - DNA, 16 bp, Homo sapiens
tcaggtgacatgtgaa

SEQ ID NO: 4091314 - DNA, 23 bp, Homo sapiens
tcaggtgtcatggactgttgcca

SEQ ID NO: 4091315 - DNA, 19 bp, Homo sapiens
tcaggttatcgaaataaca

SEQ ID NO: 4091316 - DNA, 21 bp, Homo sapiens
tcaggttatcgaaataacaat

SEQ ID NO: 4091317 - DNA, 17 bp, Homo sapiens
tcagtaaacctgtctga

SEQ ID NO: 4091318 - DNA, 14 bp, Homo sapiens
tcagtaatatttat

SEQ ID NO: 4091319 - DNA, 23 bp, Homo sapiens
tcagtacttgtgaaacacagctg

SEQ ID NO: 4091320 - DNA, 13 bp, Homo sapiens
tcagtacttttat

SEQ ID NO: 4091321 - DNA, 17 bp, Homo sapiens
tcagtagattgcagaaa

SEQ ID NO: 4091322 - DNA, 17 bp, Homo sapiens
tcagtagcttaagaaaa

SEQ ID NO: 4091323 - DNA, 15 bp, Homo sapiens
tcagtataaacaaag

SEQ ID NO: 4091324 - DNA, 14 bp, Homo sapiens
tcagtatcatctcc

SEQ ID NO: 4091325 - DNA, 21 bp, Homo sapiens
tcagtattaaaggggggaggg

SEQ ID NO: 4091326 - DNA, 15 bp, Homo sapiens
tcagtatttcagtgt

SEQ ID NO: 4091327 - DNA, 14 bp, Homo sapiens
tcagtcacagccac

SEQ ID NO: 4091328 - DNA, 17 bp, Homo sapiens
tcagtcatgcataaata

SEQ ID NO: 4091329 - DNA, 15 bp, Homo sapiens
tcagtccatttatat

SEQ ID NO: 4091330 - DNA, 17 bp, Homo sapiens
tcagtcccatcagagag

SEQ ID NO: 4091331 - DNA, 23 bp, Homo sapiens
tcagtcgcctttcagcaggcagc

SEQ ID NO: 4091332 - DNA, 20 bp, Homo sapiens
tcagtctccctttcccttct

SEQ ID NO: 4091333 - DNA, 17 bp, Homo sapiens
tcagtctggtgggagga

SEQ ID NO: 4091334 - DNA, 12 bp, Homo sapiens
tcagtgactgaa

SEQ ID NO: 4091335 - DNA, 13 bp, Homo sapiens
tcagtgagcctcc

SEQ ID NO: 4091336 - DNA, 20 bp, Homo sapiens
tcagtgagcctcctgtgcct

SEQ ID NO: 4091337 - DNA, 14 bp, Homo sapiens
tcagtgctctctcc

SEQ ID NO: 4091338 - DNA, 15 bp, Homo sapiens
tcagtgctctctcca

SEQ ID NO: 4091339 - DNA, 12 bp, Homo sapiens
tcagtgcttctt

SEQ ID NO: 4091340 - DNA, 17 bp, Homo sapiens
tcagtgggcaggataaa

SEQ ID NO: 4091341 - DNA, 20 bp, Homo sapiens
tcagtgtacatggaataaca

SEQ ID NO: 4091342 - DNA, 18 bp, Homo sapiens
tcagtgtaccatttgcct

SEQ ID NO: 4091343 - DNA, 14 bp, Homo sapiens
tcatttcttcactt

SEQ ID NO: 4091344 - DNA, 16 bp, Homo sapiens
tcatttgaacaactag

SEQ ID NO: 4091345 - DNA, 22 bp, Homo sapiens
tcatttgttaaaattatcaata

SEQ ID NO: 4091346 - DNA, 20 bp, Homo sapiens
tcatttgttgtgatgtcttt

SEQ ID NO: 4091347 - DNA, 13 bp, Homo sapiens
tcattttaattat

SEQ ID NO: 4091348 - DNA, 14 bp, Homo sapiens
tcattttaattatt

SEQ ID NO: 4091349 - DNA, 13 bp, Homo sapiens
tcattttacagtg

SEQ ID NO: 4091350 - DNA, 16 bp, Homo sapiens
tcattttcatcactgg

SEQ ID NO: 4091351 - DNA, 18 bp, Homo sapiens
tcattttcatcactggga

SEQ ID NO: 4091352 - DNA, 15 bp, Homo sapiens
tcattttccccccac

SEQ ID NO: 4091353 - DNA, 12 bp, Homo sapiens
tcattttcctgt

SEQ ID NO: 4091354 - DNA, 15 bp, Homo sapiens
tcattttcctgttca

SEQ ID NO: 4091355 - DNA, 20 bp, Homo sapiens
tcattttctataacagatat

SEQ ID NO: 4091356 - DNA, 18 bp, Homo sapiens
tcattttctgacatgcat

SEQ ID NO: 4091357 - DNA, 22 bp, Homo sapiens
tcattttctgacatgcattgtt

SEQ ID NO: 4091358 - DNA, 13 bp, Homo sapiens
tcattttctggtt

SEQ ID NO: 4091359 - DNA, 23 bp, Homo sapiens
tcattttgggacaattgttttaa

SEQ ID NO: 4091360 - DNA, 19 bp, Homo sapiens
tcagtgtaccatttgcctc

SEQ ID NO: 4091361 - DNA, 15 bp, Homo sapiens
tcagtgtagttaatt

SEQ ID NO: 4091362 - DNA, 17 bp, Homo sapiens
tcagtgtagttaattta

SEQ ID NO: 4091363 - DNA, 14 bp, Homo sapiens
tcagtgtcccaggc

SEQ ID NO: 4091364 - DNA, 23 bp, Homo sapiens
tcagtgtgtgtgtgtggtccatg

SEQ ID NO: 4091365 - DNA, 16 bp, Homo sapiens
tcagtgttacctgtgt

SEQ ID NO: 4091366 - DNA, 18 bp, Homo sapiens
tcagtgttacctgtgtgc

SEQ ID NO: 4091367 - DNA, 15 bp, Homo sapiens
tcagtgttgagatgg

SEQ ID NO: 4091368 - DNA, 15 bp, Homo sapiens
tcagtgttttaaatt

SEQ ID NO: 4091369 - DNA, 18 bp, Homo sapiens
tcagtgttttaaattctg

SEQ ID NO: 4091370 - DNA, 23 bp, Homo sapiens
tcagttaattcaatgtgaacact

SEQ ID NO: 4091371 - DNA, 13 bp, Homo sapiens
tcagttattcatt

SEQ ID NO: 4091372 - DNA, 17 bp, Homo sapiens
tcagttcaacctggtgg

SEQ ID NO: 4091373 - DNA, 22 bp, Homo sapiens
tcagttcaacctggtggcacca

SEQ ID NO: 4091374 - DNA, 20 bp, Homo sapiens
tcagttcccccagtacctcc

SEQ ID NO: 4091375 - DNA, 18 bp, Homo sapiens
tcagttcccttggcctca

SEQ ID NO: 4091376 - DNA, 19 bp, Homo sapiens
tcagttctctcccttcctc

SEQ ID NO: 4091377 - DNA, 17 bp, Homo sapiens
tcagttggttgtgtctt

SEQ ID NO: 4091378 - DNA, 16 bp, Homo sapiens
tcagtttcatgaaatg

SEQ ID NO: 4091379 - DNA, 21 bp, Homo sapiens
tcagtttgaaaatattttgtt

SEQ ID NO: 4091380 - DNA, 19 bp, Homo sapiens
tcagtttgctagcagaaat

SEQ ID NO: 4091381 - DNA, 17 bp, Homo sapiens
tcagtttgtgtgtctta

SEQ ID NO: 4091382 - DNA, 19 bp, Homo sapiens
tcagttttatcattttcaa

SEQ ID NO: 4091383 - DNA, 12 bp, Homo sapiens
tcagtttttgta

SEQ ID NO: 4091384 - DNA, 13 bp, Homo sapiens
tcagtttttgtat

SEQ ID NO: 4091385 - DNA, 14 bp, Homo sapiens
tcagtttttgtatc

SEQ ID NO: 4091386 - DNA, 16 bp, Homo sapiens
tcagtttttgtatctt

SEQ ID NO: 4091387 - DNA, 17 bp, Homo sapiens
tcagttttttgttttac

SEQ ID NO: 4091388 - DNA, 15 bp, Homo sapiens
tcataaaaactgctt

SEQ ID NO: 4091389 - DNA, 22 bp, Homo sapiens
tcataaaaagcctgcaatttca

SEQ ID NO: 4091390 - DNA, 13 bp, Homo sapiens
tcataaaagagac

SEQ ID NO: 4091391 - DNA, 12 bp, Homo sapiens
tcataaaataaa

SEQ ID NO: 4091392 - DNA, 16 bp, Homo sapiens
tcataaaataaagtat

SEQ ID NO: 4091393 - DNA, 21 bp, Homo sapiens
tcataaagggttgaaaatgtg

SEQ ID NO: 4091394 - DNA, 13 bp, Homo sapiens
tcataattttgca

SEQ ID NO: 4091395 - DNA, 19 bp, Homo sapiens
tcatacactaaccaaatct

SEQ ID NO: 4091396 - DNA, 14 bp, Homo sapiens
tcatagagatttgt

SEQ ID NO: 4091397 - DNA, 23 bp, Homo sapiens
tcatagagttgattgtctagtga

SEQ ID NO: 4091398 - DNA, 19 bp, Homo sapiens
tcatagctcactgcagcct

SEQ ID NO: 4091399 - DNA, 21 bp, Homo sapiens
tcatagctcactgcagcctca

SEQ ID NO: 4091400 - DNA, 17 bp, Homo sapiens
tcatagctccttggagc

SEQ ID NO: 4091401 - DNA, 12 bp, Homo sapiens
tcatagctgaga

SEQ ID NO: 4091402 - DNA, 20 bp, Homo sapiens
tcatagggtctcttcaggtt

SEQ ID NO: 4091403 - DNA, 15 bp, Homo sapiens
tcatagtaacttctt

SEQ ID NO: 4091404 - DNA, 16 bp, Homo sapiens
tcatagtaacttctta

SEQ ID NO: 4091405 - DNA, 22 bp, Homo sapiens
tcatagttatgtgattttcctt

SEQ ID NO: 4091406 - DNA, 13 bp, Homo sapiens
tcatagttcagaa

SEQ ID NO: 4091407 - DNA, 16 bp, Homo sapiens
tcatagttcagaattt

SEQ ID NO: 4091408 - DNA, 18 bp, Homo sapiens
tcatagttcagaatttag

SEQ ID NO: 4091409 - DNA, 16 bp, Homo sapiens
tcatataataaatgta

SEQ ID NO: 4091410 - DNA, 23 bp, Homo sapiens
tcatataattaaagactcaagag

SEQ ID NO: 4091411 - DNA, 12 bp, Homo sapiens
tcatatctggtc

SEQ ID NO: 4091412 - DNA, 22 bp, Homo sapiens
tcatatgtaccatgtacatgaa

SEQ ID NO: 4091413 - DNA, 18 bp, Homo sapiens
tcatatgtgtctttatag

SEQ ID NO: 4091414 - DNA, 14 bp, Homo sapiens
tcatatgttgctca

SEQ ID NO: 4091415 - DNA, 18 bp, Homo sapiens
tcatattctaaaaccatt

SEQ ID NO: 4091416 - DNA, 19 bp, Homo sapiens
tcatatttaaagacaggga

SEQ ID NO: 4091417 - DNA, 22 bp, Homo sapiens
tcatatttacttcttatacatt

SEQ ID NO: 4091418 - DNA, 18 bp, Homo sapiens
tcatcaacaaagaaatat

SEQ ID NO: 4091419 - DNA, 21 bp, Homo sapiens
tcatcaatatccctcttgtaa

SEQ ID NO: 4091420 - DNA, 21 bp, Homo sapiens
tcatcaatcaaataagtattt

SEQ ID NO: 4091421 - DNA, 13 bp, Homo sapiens
tcatcagaagtgg

SEQ ID NO: 4091422 - DNA, 22 bp, Homo sapiens
tcatcagaagtggtaggaaagc

SEQ ID NO: 4091423 - DNA, 18 bp, Homo sapiens
tcatcagatggaaatatt

SEQ ID NO: 4091424 - DNA, 20 bp, Homo sapiens
tcatcagatggaaatatttt

SEQ ID NO: 4091425 - DNA, 12 bp, Homo sapiens
tcatcagggcct

SEQ ID NO: 4091426 - DNA, 13 bp, Homo sapiens
tcatcataaaata

SEQ ID NO: 4091427 - DNA, 15 bp, Homo sapiens
tcatcataaaataaa

SEQ ID NO: 4091428 - DNA, 19 bp, Homo sapiens
tcatcataaaataaagtat

SEQ ID NO: 4091429 - DNA, 15 bp, Homo sapiens
tcatcattccctctc

SEQ ID NO: 4091430 - DNA, 14 bp, Homo sapiens
tcatccaacaagaa

SEQ ID NO: 4091431 - DNA, 15 bp, Homo sapiens
tcatccaatcctcac

SEQ ID NO: 4091432 - DNA, 20 bp, Homo sapiens
tcatccaatcctcactgggt

SEQ ID NO: 4091433 - DNA, 22 bp, Homo sapiens
tcatccaatcctcactgggtgg

SEQ ID NO: 4091434 - DNA, 17 bp, Homo sapiens
tcatccagcagtgttgc

SEQ ID NO: 4091435 - DNA, 21 bp, Homo sapiens
tcatccagtttgttctccggg

SEQ ID NO: 4091436 - DNA, 12 bp, Homo sapiens
tcatcccaacct

SEQ ID NO: 4091437 - DNA, 18 bp, Homo sapiens
tcatcccacgcactccat

SEQ ID NO: 4091438 - DNA, 17 bp, Homo sapiens
tcatcccatgagaccct

SEQ ID NO: 4091439 - DNA, 21 bp, Homo sapiens
tcatccccaggggtcccagcc

SEQ ID NO: 4091440 - DNA, 15 bp, Homo sapiens
tcatccccatcctcc

SEQ ID NO: 4091441 - DNA, 15 bp, Homo sapiens
tcatcctaagctatt

SEQ ID NO: 4091442 - DNA, 15 bp, Homo sapiens
tcatcctattgttga

SEQ ID NO: 4091443 - DNA, 21 bp, Homo sapiens
tcatcctccagtaccttgctt

SEQ ID NO: 4091444 - DNA, 23 bp, Homo sapiens
tcatcctcctggaaccttgctgt

SEQ ID NO: 4091445 - DNA, 20 bp, Homo sapiens
tcatcctgactctgccccct

SEQ ID NO: 4091446 - DNA, 15 bp, Homo sapiens
tcatcctgccttcat

SEQ ID NO: 4091447 - DNA, 23 bp, Homo sapiens
tcatcctgccttcatggaactca

SEQ ID NO: 4091448 - DNA, 15 bp, Homo sapiens
tcatcctgtgctcgg

SEQ ID NO: 4091449 - DNA, 18 bp, Homo sapiens
tcatccttcccactctgt

SEQ ID NO: 4091450 - DNA, 14 bp, Homo sapiens
tcatcgaatctact

SEQ ID NO: 4091451 - DNA, 21 bp, Homo sapiens
tcatcgccagaggtgcttcac

SEQ ID NO: 4091452 - DNA, 16 bp, Homo sapiens
tcatcggaggctgggc

SEQ ID NO: 4091453 - DNA, 22 bp, Homo sapiens
tcatctaaccattaagtcatgt

SEQ ID NO: 4091454 - DNA, 18 bp, Homo sapiens
tcatctaccttttctggc

SEQ ID NO: 4091455 - DNA, 22 bp, Homo sapiens
tcatctccaaggatcctctcca

SEQ ID NO: 4091456 - DNA, 17 bp, Homo sapiens
tcatctccatcagctgt

SEQ ID NO: 4091457 - DNA, 20 bp, Homo sapiens
tcatctctctggggccctgg

SEQ ID NO: 4091458 - DNA, 19 bp, Homo sapiens
tcatctgagaggctctccg

SEQ ID NO: 4091459 - DNA, 21 bp, Homo sapiens
tcatctgattggacaggcatg

SEQ ID NO: 4091460 - DNA, 12 bp, Homo sapiens
tcatctgcaaaa

SEQ ID NO: 4091461 - DNA, 20 bp, Homo sapiens
tcatctggttgaactctggt

SEQ ID NO: 4091462 - DNA, 18 bp, Homo sapiens
tcatctggttttattact

SEQ ID NO: 4091463 - DNA, 13 bp, Homo sapiens
tcatctgtagata

SEQ ID NO: 4091464 - DNA, 12 bp, Homo sapiens
tcatcttcctgt

SEQ ID NO: 4091465 - DNA, 19 bp, Homo sapiens
tcatcttcctgtgtcctga

SEQ ID NO: 4091466 - DNA, 21 bp, Homo sapiens
tcatcttgacagagcctgccc

SEQ ID NO: 4091467 - DNA, 15 bp, Homo sapiens
tcatgaaatatgcat

SEQ ID NO: 4091468 - DNA, 13 bp, Homo sapiens
tcatgaagcccaa

SEQ ID NO: 4091469 - DNA, 19 bp, Homo sapiens
tcatgaattcccttttaat

SEQ ID NO: 4091470 - DNA, 13 bp, Homo sapiens
tcatgaattttac

SEQ ID NO: 4091471 - DNA, 14 bp, Homo sapiens
tcatgaccagtaaa

SEQ ID NO: 4091472 - DNA, 19 bp, Homo sapiens
tcatgagcctgctggaagc

SEQ ID NO: 4091473 - DNA, 18 bp, Homo sapiens
tcatgagtgaataaatgt

SEQ ID NO: 4091474 - DNA, 13 bp, Homo sapiens
tcatgcaaaatat

SEQ ID NO: 4091475 - DNA, 16 bp, Homo sapiens
tcatgcacccctgagc

SEQ ID NO: 4091476 - DNA, 20 bp, Homo sapiens
tcatgcacccctgagccagc

SEQ ID NO: 4091477 - DNA, 20 bp, Homo sapiens
tcatgcataaatatgcagtg

SEQ ID NO: 4091478 - DNA, 12 bp, Homo sapiens
tcatgcattgtt

SEQ ID NO: 4091479 - DNA, 21 bp, Homo sapiens
tcatgccagctacttcctcct

SEQ ID NO: 4091480 - DNA, 20 bp, Homo sapiens
tcatgcccaccccctgccct

SEQ ID NO: 4091481 - DNA, 21 bp, Homo sapiens
tcatgcccaccccctgccctg

SEQ ID NO: 4091482 - DNA, 15 bp, Homo sapiens
tcatgccctgtgcaa

SEQ ID NO: 4091483 - DNA, 18 bp, Homo sapiens
tcatgcctttcatagttt

SEQ ID NO: 4091484 - DNA, 22 bp, Homo sapiens
tcatgcctttcatagtttatta

SEQ ID NO: 4091485 - DNA, 17 bp, Homo sapiens
tcatgcctttgtaagtt

SEQ ID NO: 4091486 - DNA, 15 bp, Homo sapiens
tcatgctaaaattct

SEQ ID NO: 4091487 - DNA, 14 bp, Homo sapiens
tcatgctgggattt

SEQ ID NO: 4091488 - DNA, 18 bp, Homo sapiens
tcatggaatggacatcct

SEQ ID NO: 4091489 - DNA, 19 bp, Homo sapiens
tcatggactgttgccacca

SEQ ID NO: 4091490 - DNA, 23 bp, Homo sapiens
tcatggcagctgtttctcatgaa

SEQ ID NO: 4091491 - DNA, 15 bp, Homo sapiens
tcatggcccccaggg

SEQ ID NO: 4091492 - DNA, 18 bp, Homo sapiens
tcatggcccctctgacct

SEQ ID NO: 4091493 - DNA, 20 bp, Homo sapiens
tcatggcctattatattaaa

SEQ ID NO: 4091494 - DNA, 19 bp, Homo sapiens
tcatggctaatttaacacc

SEQ ID NO: 4091495 - DNA, 21 bp, Homo sapiens
tcatggggatcaattttcatt

SEQ ID NO: 4091496 - DNA, 15 bp, Homo sapiens
tcatgggtcctagcc

SEQ ID NO: 4091497 - DNA, 23 bp, Homo sapiens
tcatggtgggttcaggggactca

SEQ ID NO: 4091498 - DNA, 14 bp, Homo sapiens
tcatggtgtaataa

SEQ ID NO: 4091499 - DNA, 18 bp, Homo sapiens
tcatggtgtaataagaca

SEQ ID NO: 4091500 - DNA, 22 bp, Homo sapiens
tcatggtgtaataagacataac

SEQ ID NO: 4091501 - DNA, 13 bp, Homo sapiens
tcatgtaaaacag

SEQ ID NO: 4091502 - DNA, 18 bp, Homo sapiens
tcatgtaacacataaaca

SEQ ID NO: 4091503 - DNA, 15 bp, Homo sapiens
tcatgtaatcctcaa

SEQ ID NO: 4091504 - DNA, 15 bp, Homo sapiens
tcatgtatcatctgg

SEQ ID NO: 4091505 - DNA, 19 bp, Homo sapiens
tcatgtatcatctggatag

SEQ ID NO: 4091506 - DNA, 16 bp, Homo sapiens
tcatgtcaacttctgg

SEQ ID NO: 4091507 - DNA, 16 bp, Homo sapiens
tcatgtcaggcctgtg

SEQ ID NO: 4091508 - DNA, 15 bp, Homo sapiens
tcatgtgaaatgttt

SEQ ID NO: 4091509 - DNA, 16 bp, Homo sapiens
tcatgtgggtgagcca

SEQ ID NO: 4091510 - DNA, 13 bp, Homo sapiens
tcatgtgtgaaca

SEQ ID NO: 4091511 - DNA, 14 bp, Homo sapiens
tcatgtgtgaacac

SEQ ID NO: 4091512 - DNA, 14 bp, Homo sapiens
tcatgtttgcttca

SEQ ID NO: 4091513 - DNA, 15 bp, Homo sapiens
tcatgtttgcttcat

SEQ ID NO: 4091514 - DNA, 17 bp, Homo sapiens
tcatgtttgcttcataa

SEQ ID NO: 4091515 - DNA, 21 bp, Homo sapiens
tcatgtttgcttcataaatga

SEQ ID NO: 4091516 - DNA, 16 bp, Homo sapiens
tcattaaacttgaagc

SEQ ID NO: 4091517 - DNA, 15 bp, Homo sapiens
tcattacccttccct

SEQ ID NO: 4091518 - DNA, 14 bp, Homo sapiens
tcattactgggcct

SEQ ID NO: 4091519 - DNA, 15 bp, Homo sapiens
tcattactgggcctt

SEQ ID NO: 4091520 - DNA, 13 bp, Homo sapiens
tcattacttgatt

SEQ ID NO: 4091521 - DNA, 16 bp, Homo sapiens
tcattacttttgaagt

SEQ ID NO: 4091522 - DNA, 13 bp, Homo sapiens
tcattagactcct

SEQ ID NO: 4091523 - DNA, 13 bp, Homo sapiens
tcattagctgtga

SEQ ID NO: 4091524 - DNA, 13 bp, Homo sapiens
tcattataaacgt

SEQ ID NO: 4091525 - DNA, 19 bp, Homo sapiens
tcattattggaattaacct

SEQ ID NO: 4091526 - DNA, 20 bp, Homo sapiens
tcattattttgggaagaaaa

SEQ ID NO: 4091527 - DNA, 15 bp, Homo sapiens
tcattcaatattgac

SEQ ID NO: 4091528 - DNA, 21 bp, Homo sapiens
tcattcaatattgacatttgt

SEQ ID NO: 4091529 - DNA, 19 bp, Homo sapiens
tcattccagagtgctgagg

SEQ ID NO: 4091530 - DNA, 20 bp, Homo sapiens
tcattccattgcctagctct

SEQ ID NO: 4091531 - DNA, 19 bp, Homo sapiens
tcattccctcgtctttccc

SEQ ID NO: 4091532 - DNA, 17 bp, Homo sapiens
tcattcctaacacagca

SEQ ID NO: 4091533 - DNA, 15 bp, Homo sapiens
tcattccttctggcc

SEQ ID NO: 4091534 - DNA, 17 bp, Homo sapiens
tcattcgtggcatgttt

SEQ ID NO: 4091535 - DNA, 16 bp, Homo sapiens
tcattctacagaataa

SEQ ID NO: 4091536 - DNA, 17 bp, Homo sapiens
tcattctacagaataat

SEQ ID NO: 4091537 - DNA, 23 bp, Homo sapiens
tcattctcataattcctacagca

SEQ ID NO: 4091538 - DNA, 13 bp, Homo sapiens
tcattctcctgcc

SEQ ID NO: 4091539 - DNA, 16 bp, Homo sapiens
tcattctcgtgagtca

SEQ ID NO: 4091540 - DNA, 16 bp, Homo sapiens
tcattctgtgatcatt

SEQ ID NO: 4091541 - DNA, 21 bp, Homo sapiens
tcattcttccaagctgagagt

SEQ ID NO: 4091542 - DNA, 18 bp, Homo sapiens
tcattcttgaaagctgtg

SEQ ID NO: 4091543 - DNA, 19 bp, Homo sapiens
tcattgaactttaagaagc

SEQ ID NO: 4091544 - DNA, 20 bp, Homo sapiens
tcattgacctctcagggcct

SEQ ID NO: 4091545 - DNA, 23 bp, Homo sapiens
tcattgacctctcagggcctggc

SEQ ID NO: 4091546 - DNA, 18 bp, Homo sapiens
tcattgactcttgcgtgt

SEQ ID NO: 4091547 - DNA, 18 bp, Homo sapiens
tcattgattgtcagctac

SEQ ID NO: 4091548 - DNA, 18 bp, Homo sapiens
tcattgctgaaaatggta

SEQ ID NO: 4091549 - DNA, 23 bp, Homo sapiens
tcattgctgaaaatggtattttc

SEQ ID NO: 4091550 - DNA, 16 bp, Homo sapiens
tcattgctgagcctct

SEQ ID NO: 4091551 - DNA, 23 bp, Homo sapiens
tcattgctgagcctctgctcccc

SEQ ID NO: 4091552 - DNA, 14 bp, Homo sapiens
tcattgcttcttct

SEQ ID NO: 4091553 - DNA, 16 bp, Homo sapiens
tcattgcttcttctga

SEQ ID NO: 4091554 - DNA, 19 bp, Homo sapiens
tcattgtaaccatttctca

SEQ ID NO: 4091555 - DNA, 22 bp, Homo sapiens
tcattgtaaccatttctcacta

SEQ ID NO: 4091556 - DNA, 15 bp, Homo sapiens
tcattgtatgttatt

SEQ ID NO: 4091557 - DNA, 22 bp, Homo sapiens
tcattgtctctcacagatgtga

SEQ ID NO: 4091558 - DNA, 13 bp, Homo sapiens
tcatttaaaatga

SEQ ID NO: 4091559 - DNA, 17 bp, Homo sapiens
tcatttaatttgttata

SEQ ID NO: 4091560 - DNA, 22 bp, Homo sapiens
tcatttactaaacatatgattt

SEQ ID NO: 4091561 - DNA, 23 bp, Homo sapiens
tcatttagtgagttattccttga

SEQ ID NO: 4091562 - DNA, 14 bp, Homo sapiens
tcatttatgaaaag

SEQ ID NO: 4091563 - DNA, 18 bp, Homo sapiens
tcatttccccataactca

SEQ ID NO: 4091564 - DNA, 19 bp, Homo sapiens
tcatttctactgtgactga

SEQ ID NO: 4091565 - DNA, 23 bp, Homo sapiens
tcatttctcactgtgtacataat

SEQ ID NO: 4091566 - DNA, 10 bp, Homo sapiens
ggagactaga

SEQ ID NO: 4091567 - DNA, 17 bp, Homo sapiens
ggagactcctgccctgt

SEQ ID NO: 4091568 - DNA, 23 bp, Homo sapiens
ggagactgataacttggggaggc

SEQ ID NO: 4091569 - DNA, 15 bp, Homo sapiens
ggagagaaaaaagaa

SEQ ID NO: 4091570 - DNA, 13 bp, Homo sapiens
ggagagaagctct

SEQ ID NO: 4091571 - DNA, 14 bp, Homo sapiens
ggagagacaggcag

SEQ ID NO: 4091572 - DNA, 17 bp, Homo sapiens
ggagagactgagcagcc

SEQ ID NO: 4091573 - DNA, 12 bp, Homo sapiens
ggagagcagcag

SEQ ID NO: 4091574 - DNA, 23 bp, Homo sapiens
ggagagcagcagcaccaaccaca

SEQ ID NO: 4091575 - DNA, 13 bp, Homo sapiens
ggagagccaacct

SEQ ID NO: 4091576 - DNA, 19 bp, Homo sapiens
ggagagccaacctcggctt

SEQ ID NO: 4091577 - DNA, 14 bp, Homo sapiens
ggagagctgagcca

SEQ ID NO: 4091578 - DNA, 17 bp, Homo sapiens
ggagagctggtgcccgg

SEQ ID NO: 4091579 - DNA, 21 bp, Homo sapiens
ggagaggcggcctcgtgccat

SEQ ID NO: 4091580 - DNA, 19 bp, Homo sapiens
ggagaggctgtctggggcc

SEQ ID NO: 4091581 - DNA, 20 bp, Homo sapiens
ggagagtacagtgagccaag

SEQ ID NO: 4091582 - DNA, 21 bp, Homo sapiens
ggagagtcccctgaaggtctg

SEQ ID NO: 4091583 - DNA, 13 bp, Homo sapiens
ggagatgaccagg

SEQ ID NO: 4091584 - DNA, 15 bp, Homo sapiens
ggagatggagggctt

SEQ ID NO: 4091585 - DNA, 18 bp, Homo sapiens
ggagatgggccttttgga

SEQ ID NO: 4091586 - DNA, 17 bp, Homo sapiens
ggagattggacggcctg

SEQ ID NO: 4091587 - DNA, 16 bp, Homo sapiens
ggagattttaggtgtt

SEQ ID NO: 4091588 - DNA, 13 bp, Homo sapiens
ggagcaaggttta

SEQ ID NO: 4091589 - DNA, 16 bp, Homo sapiens
ggagcaatgggactgg

SEQ ID NO: 4091590 - DNA, 22 bp, Homo sapiens
ggagcaatgggactggagtcag

SEQ ID NO: 4091591 - DNA, 13 bp, Homo sapiens
ggagcacaggcag

SEQ ID NO: 4091592 - DNA, 13 bp, Homo sapiens
ggagcactggagt

SEQ ID NO: 4091593 - DNA, 15 bp, Homo sapiens
ggagcactggagtgc

SEQ ID NO: 4091594 - DNA, 18 bp, Homo sapiens
ggagcactggagtgcagg

SEQ ID NO: 4091595 - DNA, 17 bp, Homo sapiens
ggagcagaaacagccat

SEQ ID NO: 4091596 - DNA, 20 bp, Homo sapiens
ggagcagacaggaggaatca

SEQ ID NO: 4091597 - DNA, 20 bp, Homo sapiens
ggagcaggccggaaccacag

SEQ ID NO: 4091598 - DNA, 13 bp, Homo sapiens
ggagcagggaagg

SEQ ID NO: 4091599 - DNA, 21 bp, Homo sapiens
ggagcagggaaggcctgactt

SEQ ID NO: 4091600 - DNA, 18 bp, Homo sapiens
ggagcagtgtcttccata

SEQ ID NO: 4091601 - DNA, 14 bp, Homo sapiens
ggagcatgggcctg

SEQ ID NO: 4091602 - DNA, 20 bp, Homo sapiens
ggagcatttaatggcagcta

SEQ ID NO: 4091603 - DNA, 13 bp, Homo sapiens
ggagccagacaga

SEQ ID NO: 4091604 - DNA, 14 bp, Homo sapiens
ggagccagctgctt

SEQ ID NO: 4091605 - DNA, 15 bp, Homo sapiens
ggagccagtcctcca

SEQ ID NO: 4091606 - DNA, 12 bp, Homo sapiens
ggagcccactgt

SEQ ID NO: 4091607 - DNA, 18 bp, Homo sapiens
ggagcccactgtcctggg

SEQ ID NO: 4091608 - DNA, 20 bp, Homo sapiens
ggagcccactgtcctgggcc

SEQ ID NO: 4091609 - DNA, 23 bp, Homo sapiens
ggagcccactgtcctgggcctgc

SEQ ID NO: 4091610 - DNA, 16 bp, Homo sapiens
ggagcccagccctccc

SEQ ID NO: 4091611 - DNA, 13 bp, Homo sapiens
ggagcccagcctg

SEQ ID NO: 4091612 - DNA, 20 bp, Homo sapiens
ggagcccagcctgggagccc

SEQ ID NO: 4091613 - DNA, 12 bp, Homo sapiens
ggagcccaggag

SEQ ID NO: 4091614 - DNA, 13 bp, Homo sapiens
ggagcccaggagt

SEQ ID NO: 4091615 - DNA, 12 bp, Homo sapiens
ggagcccagggc

SEQ ID NO: 4091616 - DNA, 13 bp, Homo sapiens
ggagccccaggcc

SEQ ID NO: 4091617 - DNA, 14 bp, Homo sapiens
ggagccccaggcct

SEQ ID NO: 4091618 - DNA, 21 bp, Homo sapiens
ggagcccccagatagagctgg

SEQ ID NO: 4091619 - DNA, 22 bp, Homo sapiens
ggagcccccagatagagctggg

SEQ ID NO: 4091620 - DNA, 15 bp, Homo sapiens
ggagcccccagcaga

SEQ ID NO: 4091621 - DNA, 19 bp, Homo sapiens
ggagcccccagcagaggca

SEQ ID NO: 4091622 - DNA, 22 bp, Homo sapiens
ggagcccccagcagaggcaggc

SEQ ID NO: 4091623 - DNA, 20 bp, Homo sapiens
ggagccccttcgggagcagg

SEQ ID NO: 4091624 - DNA, 21 bp, Homo sapiens
ggagccccttctgctcagctc

SEQ ID NO: 4091625 - DNA, 19 bp, Homo sapiens
ggagccctgaccttggctg

SEQ ID NO: 4091626 - DNA, 17 bp, Homo sapiens
ggagcccttggcccctc

SEQ ID NO: 4091627 - DNA, 15 bp, Homo sapiens
ggagcctagctcctg

SEQ ID NO: 4091628 - DNA, 18 bp, Homo sapiens
ggagcctagctcctgcca

SEQ ID NO: 4091629 - DNA, 19 bp, Homo sapiens
ggagcctccccatctgtcc

SEQ ID NO: 4091630 - DNA, 20 bp, Homo sapiens
ggagcctccccatctgtcca

SEQ ID NO: 4091631 - DNA, 21 bp, Homo sapiens
ggagcctccccatctgtccag

SEQ ID NO: 4091632 - DNA, 19 bp, Homo sapiens
ggagcctccccctcagatg

SEQ ID NO: 4091633 - DNA, 17 bp, Homo sapiens
ggagcctgacagccaga

SEQ ID NO: 4091634 - DNA, 20 bp, Homo sapiens
ggagcctttggttctggcca

SEQ ID NO: 4091635 - DNA, 16 bp, Homo sapiens
ggagcgggaggcggtg

SEQ ID NO: 4091636 - DNA, 15 bp, Homo sapiens
ggagctatcaggaac

SEQ ID NO: 4091637 - DNA, 12 bp, Homo sapiens
ggagctcagccc

SEQ ID NO: 4091638 - DNA, 13 bp, Homo sapiens
ggagctcctctcc

SEQ ID NO: 4091639 - DNA, 21 bp, Homo sapiens
tttttgaatttaaataaagtt

SEQ ID NO: 4091640 - DNA, 13 bp, Homo sapiens
tttttgacactga

SEQ ID NO: 4091641 - DNA, 20 bp, Homo sapiens
tttttgactttttttgtatg

SEQ ID NO: 4091642 - DNA, 16 bp, Homo sapiens
tttttgctataatcat

SEQ ID NO: 4091643 - DNA, 18 bp, Homo sapiens
tttttgctataatcatta

SEQ ID NO: 4091644 - DNA, 23 bp, Homo sapiens
tttttgctgctgcctctttccct

SEQ ID NO: 4091645 - DNA, 19 bp, Homo sapiens
tttttggggaaaaaagcac

SEQ ID NO: 4091646 - DNA, 22 bp, Homo sapiens
tttttggggaaaaaagcacata

SEQ ID NO: 4091647 - DNA, 12 bp, Homo sapiens
tttttgtaataa

SEQ ID NO: 4091648 - DNA, 11 bp, Homo sapiens
tttttgtagta

SEQ ID NO: 4091649 - DNA, 12 bp, Homo sapiens
tttttgtgtatg

SEQ ID NO: 4091650 - DNA, 14 bp, Homo sapiens
tttttgttggagtg

SEQ ID NO: 4091651 - DNA, 11 bp, Homo sapiens
ttttttaagat

SEQ ID NO: 4091652 - DNA, 12 bp, Homo sapiens
ttttttaatcta

SEQ ID NO: 4091653 - DNA, 13 bp, Homo sapiens
ttttttacagatt

SEQ ID NO: 4091654 - DNA, 22 bp, Homo sapiens
ttttttataaccatgagaattt

SEQ ID NO: 4091655 - DNA, 16 bp, Homo sapiens
ttttttataagtatgt

SEQ ID NO: 4091656 - DNA, 12 bp, Homo sapiens
ttttttcagttg

SEQ ID NO: 4091657 - DNA, 19 bp, Homo sapiens
ttttttcattttgttctgt

SEQ ID NO: 4091658 - DNA, 13 bp, Homo sapiens
ttttttccatctt

SEQ ID NO: 4091659 - DNA, 13 bp, Homo sapiens
ttttttgaaacag

SEQ ID NO: 4091660 - DNA, 13 bp, Homo sapiens
ttttttgcaagtt

SEQ ID NO: 4091661 - DNA, 17 bp, Homo sapiens
ttttttgcagtaactgt

SEQ ID NO: 4091662 - DNA, 20 bp, Homo sapiens
ttttttggtggtgaaattga

SEQ ID NO: 4091663 - DNA, 13 bp, Homo sapiens
tttttttcctttt

SEQ ID NO: 4091664 - DNA, 12 bp, Homo sapiens
ttttttttgcag

SEQ ID NO: 4091665 - DNA, 17 bp, Homo sapiens
ttttgacttaaagcaga

SEQ ID NO: 4091666 - DNA, 18 bp, Homo sapiens
ttttgaggcttctccttc

SEQ ID NO: 4091667 - DNA, 16 bp, Homo sapiens
ttttgatgagttgtga

SEQ ID NO: 4091668 - DNA, 22 bp, Homo sapiens
ttttgatgtttgtggcctcaga

SEQ ID NO: 4091669 - DNA, 13 bp, Homo sapiens
ttttgatttggtg

SEQ ID NO: 4091670 - DNA, 12 bp, Homo sapiens
ttttgcaaaggg

SEQ ID NO: 4091671 - DNA, 19 bp, Homo sapiens
ttttgcaaattatattttg

SEQ ID NO: 4091672 - DNA, 17 bp, Homo sapiens
ttttgcaataacttcta

SEQ ID NO: 4091673 - DNA, 21 bp, Homo sapiens
ttttgcagcccagacaaatgt

SEQ ID NO: 4091674 - DNA, 14 bp, Homo sapiens
ttttgcagtaactg

SEQ ID NO: 4091675 - DNA, 15 bp, Homo sapiens
ttttgcagtaactgt

SEQ ID NO: 4091676 - DNA, 13 bp, Homo sapiens
ttttgcattcaaa

SEQ ID NO: 4091677 - DNA, 16 bp, Homo sapiens
ttttgcattccagaat

SEQ ID NO: 4091678 - DNA, 14 bp, Homo sapiens
ttttgccacagctt

SEQ ID NO: 4091679 - DNA, 19 bp, Homo sapiens
ttttgccagtattatgcat

SEQ ID NO: 4091680 - DNA, 17 bp, Homo sapiens
ttttgccagttttccct

SEQ ID NO: 4091681 - DNA, 21 bp, Homo sapiens
ttttgcccgttgaccagataa

SEQ ID NO: 4091682 - DNA, 15 bp, Homo sapiens
ttttgcctaaaatat

SEQ ID NO: 4091683 - DNA, 16 bp, Homo sapiens
ttttgcctaaaatata

SEQ ID NO: 4091684 - DNA, 13 bp, Homo sapiens
ttttgcttcccct

SEQ ID NO: 4091685 - DNA, 17 bp, Homo sapiens
ttttgctttctgaaatt

SEQ ID NO: 4091686 - DNA, 19 bp, Homo sapiens
ttttgctttctgaaattca

SEQ ID NO: 4091687 - DNA, 20 bp, Homo sapiens
ttttggaagattttcagtct

SEQ ID NO: 4091688 - DNA, 17 bp, Homo sapiens
ttttggactccatctct

SEQ ID NO: 4091689 - DNA, 18 bp, Homo sapiens
ttttggatatattattgt

SEQ ID NO: 4091690 - DNA, 19 bp, Homo sapiens
ttttggcaaacgctaaaga

SEQ ID NO: 4091691 - DNA, 20 bp, Homo sapiens
ttttggggaaaaaagcacat

SEQ ID NO: 4091692 - DNA, 19 bp, Homo sapiens
ttttgggggtttttaatct

SEQ ID NO: 4091693 - DNA, 18 bp, Homo sapiens
ttttggggtgtgacctca

SEQ ID NO: 4091694 - DNA, 17 bp, Homo sapiens
ttttggtaataacaaac

SEQ ID NO: 4091695 - DNA, 14 bp, Homo sapiens
ttttggtataatgt

SEQ ID NO: 4091696 - DNA, 21 bp, Homo sapiens
ttttggtccaagttgtgctta

SEQ ID NO: 4091697 - DNA, 14 bp, Homo sapiens
ttttggtttacctg

SEQ ID NO: 4091698 - DNA, 21 bp, Homo sapiens
ttttgtaaacgacaagaataa

SEQ ID NO: 4091699 - DNA, 16 bp, Homo sapiens
ttttgtacactgctgt

SEQ ID NO: 4091700 - DNA, 15 bp, Homo sapiens
ttttgtactgaattt

SEQ ID NO: 4091701 - DNA, 15 bp, Homo sapiens
ttttgtatatacagt

SEQ ID NO: 4091702 - DNA, 18 bp, Homo sapiens
ttttgtatgttatgaaca

SEQ ID NO: 4091703 - DNA, 19 bp, Homo sapiens
ttttgtgaatggattggat

SEQ ID NO: 4091704 - DNA, 23 bp, Homo sapiens
ttttgtgaatggattggattatt

SEQ ID NO: 4091705 - DNA, 15 bp, Homo sapiens
ttttgtggaggggag

SEQ ID NO: 4091706 - DNA, 22 bp, Homo sapiens
ttttgtggttctattttacttt

SEQ ID NO: 4091707 - DNA, 13 bp, Homo sapiens
ttttgtgtcctcc

SEQ ID NO: 4091708 - DNA, 13 bp, Homo sapiens
ttttgtgtttcta

SEQ ID NO: 4091709 - DNA, 18 bp, Homo sapiens
ttttgttatcagtcaata

SEQ ID NO: 4091710 - DNA, 15 bp, Homo sapiens
ttttgttccacaagt

SEQ ID NO: 4091711 - DNA, 23 bp, Homo sapiens
ttttgttcgcatggtcacacact

SEQ ID NO: 4091712 - DNA, 14 bp, Homo sapiens
ttttgttgctttct

SEQ ID NO: 4091713 - DNA, 13 bp, Homo sapiens
ttttgttgtgtgt

SEQ ID NO: 4091714 - DNA, 21 bp, Homo sapiens
ttttgtttgtttctttgtgtt

SEQ ID NO: 4091715 - DNA, 16 bp, Homo sapiens
tttttaaaacactaaa

SEQ ID NO: 4091716 - DNA, 17 bp, Homo sapiens
tttttaaaatatttatt

SEQ ID NO: 4091717 - DNA, 16 bp, Homo sapiens
tttttaaataaaagca

SEQ ID NO: 4091718 - DNA, 17 bp, Homo sapiens
tttttaagaatatctgt

SEQ ID NO: 4091719 - DNA, 18 bp, Homo sapiens
tttttaagaatatctgta

SEQ ID NO: 4091720 - DNA, 13 bp, Homo sapiens
tttttaagaattg

SEQ ID NO: 4091721 - DNA, 11 bp, Homo sapiens
tttttaagata

SEQ ID NO: 4091722 - DNA, 20 bp, Homo sapiens
tttttaagctgcaaatctga

SEQ ID NO: 4091723 - DNA, 18 bp, Homo sapiens
tttttaagctgtttccat

SEQ ID NO: 4091724 - DNA, 12 bp, Homo sapiens
tttttaattatt

SEQ ID NO: 4091725 - DNA, 18 bp, Homo sapiens
tttttaattgttgtttct

SEQ ID NO: 4091726 - DNA, 20 bp, Homo sapiens
tttttaattgttgtttcttt

SEQ ID NO: 4091727 - DNA, 19 bp, Homo sapiens
tttttaatttaacaaacta

SEQ ID NO: 4091728 - DNA, 21 bp, Homo sapiens
tttttaatttaacaaactaaa

SEQ ID NO: 4091729 - DNA, 13 bp, Homo sapiens
tttttacaataaa

SEQ ID NO: 4091730 - DNA, 13 bp, Homo sapiens
tttttacagctgt

SEQ ID NO: 4091731 - DNA, 19 bp, Homo sapiens
tttttacagctgtgttatt

SEQ ID NO: 4091732 - DNA, 11 bp, Homo sapiens
tttttacattt

SEQ ID NO: 4091733 - DNA, 14 bp, Homo sapiens
tttttaggcaaaga

SEQ ID NO: 4091734 - DNA, 12 bp, Homo sapiens
tttttatataca

SEQ ID NO: 4091735 - DNA, 15 bp, Homo sapiens
tttttatattaatgt

SEQ ID NO: 4091736 - DNA, 14 bp, Homo sapiens
tttttatcttttta

SEQ ID NO: 4091737 - DNA, 21 bp, Homo sapiens
tttttattaaagcatttccta

SEQ ID NO: 4091738 - DNA, 14 bp, Homo sapiens
tttttattaattta

SEQ ID NO: 4091739 - DNA, 11 bp, Homo sapiens
tttttattatt

SEQ ID NO: 4091740 - DNA, 23 bp, Homo sapiens
tttttattatttttacctaaaga

SEQ ID NO: 4091741 - DNA, 18 bp, Homo sapiens
tttttattgctagtattt

SEQ ID NO: 4091742 - DNA, 21 bp, Homo sapiens
tttttatttaattaaatgtat

SEQ ID NO: 4091743 - DNA, 14 bp, Homo sapiens
tttttatttatgaa

SEQ ID NO: 4091744 - DNA, 15 bp, Homo sapiens
tttttatttctcctt

SEQ ID NO: 4091745 - DNA, 12 bp, Homo sapiens
tttttatttctg

SEQ ID NO: 4091746 - DNA, 15 bp, Homo sapiens
tttttatttcttcct

SEQ ID NO: 4091747 - DNA, 19 bp, Homo sapiens
tttttcaagttgtaaataa

SEQ ID NO: 4091748 - DNA, 21 bp, Homo sapiens
tttttcaagttgtaaataatt

SEQ ID NO: 4091749 - DNA, 12 bp, Homo sapiens
tttttcaatata

SEQ ID NO: 4091750 - DNA, 19 bp, Homo sapiens
tttttcaatatattgaact

SEQ ID NO: 4091751 - DNA, 14 bp, Homo sapiens
tttttcagaaatat

SEQ ID NO: 4091752 - DNA, 20 bp, Homo sapiens
tttttcatttcttcctcagc

SEQ ID NO: 4091753 - DNA, 13 bp, Homo sapiens
tttttccatcttt

SEQ ID NO: 4091754 - DNA, 23 bp, Homo sapiens
tttttcctaacaaaagatgaaag

SEQ ID NO: 4091755 - DNA, 16 bp, Homo sapiens
tttttcctcttcagaa

SEQ ID NO: 4091756 - DNA, 15 bp, Homo sapiens
tttttccttaatcca

SEQ ID NO: 4091757 - DNA, 17 bp, Homo sapiens
tttttcctttttctgat

SEQ ID NO: 4091758 - DNA, 22 bp, Homo sapiens
tttttcgtgtggatcttgccac

SEQ ID NO: 4091759 - DNA, 16 bp, Homo sapiens
tttttcgtttgtttgt

SEQ ID NO: 4091760 - DNA, 16 bp, Homo sapiens
tttttctcaaagtttt

SEQ ID NO: 4091761 - DNA, 17 bp, Homo sapiens
tttttctcatgtatctt

SEQ ID NO: 4091762 - DNA, 16 bp, Homo sapiens
tttttctctaatgctt

SEQ ID NO: 4091763 - DNA, 14 bp, Homo sapiens
tttttcttcgctgg

SEQ ID NO: 4091764 - DNA, 10 bp, Homo sapiens
tttttcttct

SEQ ID NO: 4091765 - DNA, 11 bp, Homo sapiens
tttttcttctg

SEQ ID NO: 4091766 - DNA, 14 bp, Homo sapiens
tttttcttgatctt

SEQ ID NO: 4091767 - DNA, 13 bp, Homo sapiens
tttttcttttgta

SEQ ID NO: 4091768 - DNA, 15 bp, Homo sapiens
tttttgaatttaaat

SEQ ID NO: 4091769 - DNA, 16 bp, Homo sapiens
ttttatgtttgaatat

SEQ ID NO: 4091770 - DNA, 14 bp, Homo sapiens
ttttattaaaacat

SEQ ID NO: 4091771 - DNA, 12 bp, Homo sapiens
ttttattaaatt

SEQ ID NO: 4091772 - DNA, 13 bp, Homo sapiens
ttttattaattta

SEQ ID NO: 4091773 - DNA, 19 bp, Homo sapiens
ttttattatttttacctaa

SEQ ID NO: 4091774 - DNA, 11 bp, Homo sapiens
ttttattcagc

SEQ ID NO: 4091775 - DNA, 13 bp, Homo sapiens
ttttattcagcag

SEQ ID NO: 4091776 - DNA, 18 bp, Homo sapiens
ttttattgacacagaaaa

SEQ ID NO: 4091777 - DNA, 17 bp, Homo sapiens
ttttattgctagtattt

SEQ ID NO: 4091778 - DNA, 15 bp, Homo sapiens
ttttattgttttcta

SEQ ID NO: 4091779 - DNA, 14 bp, Homo sapiens
ttttatttatcaaa

SEQ ID NO: 4091780 - DNA, 15 bp, Homo sapiens
ttttatttattttat

SEQ ID NO: 4091781 - DNA, 14 bp, Homo sapiens
ttttatttccatca

SEQ ID NO: 4091782 - DNA, 16 bp, Homo sapiens
ttttatttctcctttt

SEQ ID NO: 4091783 - DNA, 21 bp, Homo sapiens
ttttatttctcgggtgcattt

SEQ ID NO: 4091784 - DNA, 15 bp, Homo sapiens
ttttatttgacaaaa

SEQ ID NO: 4091785 - DNA, 13 bp, Homo sapiens
ttttatttgtcag

SEQ ID NO: 4091786 - DNA, 13 bp, Homo sapiens
ttttattttcaaa

SEQ ID NO: 4091787 - DNA, 14 bp, Homo sapiens
ttttattttcaaat

SEQ ID NO: 4091788 - DNA, 14 bp, Homo sapiens
ttttattttcaaga

SEQ ID NO: 4091789 - DNA, 20 bp, Homo sapiens
ttttattttgaaaagcttct

SEQ ID NO: 4091790 - DNA, 13 bp, Homo sapiens
ttttatttttcta

SEQ ID NO: 4091791 - DNA, 18 bp, Homo sapiens
ttttatttttctaaaaaa

SEQ ID NO: 4091792 - DNA, 17 bp, Homo sapiens
ttttatttttttctacc

SEQ ID NO: 4091793 - DNA, 17 bp, Homo sapiens
ttttcaaaataaaaatg

SEQ ID NO: 4091794 - DNA, 19 bp, Homo sapiens
ttttcaaattgtatctagt

SEQ ID NO: 4091795 - DNA, 21 bp, Homo sapiens
ttttcaacgcagccctgcttt

SEQ ID NO: 4091796 - DNA, 13 bp, Homo sapiens
ttttcaagttgta

SEQ ID NO: 4091797 - DNA, 23 bp, Homo sapiens
ttttcaatatattgaacttttgt

SEQ ID NO: 4091798 - DNA, 13 bp, Homo sapiens
ttttcacaaaatg

SEQ ID NO: 4091799 - DNA, 19 bp, Homo sapiens
ttttcactgctggctgcct

SEQ ID NO: 4091800 - DNA, 21 bp, Homo sapiens
ttttcactggagttacattaa

SEQ ID NO: 4091801 - DNA, 17 bp, Homo sapiens
ttttcagaaaaagaaat

SEQ ID NO: 4091802 - DNA, 22 bp, Homo sapiens
ttttcagaaaatattatgtgtt

SEQ ID NO: 4091803 - DNA, 15 bp, Homo sapiens
ttttcagaaatatgt

SEQ ID NO: 4091804 - DNA, 20 bp, Homo sapiens
ttttcagaagcaagccagac

SEQ ID NO: 4091805 - DNA, 20 bp, Homo sapiens
ttttcagcacccccacccac

SEQ ID NO: 4091806 - DNA, 14 bp, Homo sapiens
ttttcagctgagcc

SEQ ID NO: 4091807 - DNA, 12 bp, Homo sapiens
ttttcataataa

SEQ ID NO: 4091808 - DNA, 13 bp, Homo sapiens
ttttcatcactgg

SEQ ID NO: 4091809 - DNA, 15 bp, Homo sapiens
ttttcatcactggga

SEQ ID NO: 4091810 - DNA, 13 bp, Homo sapiens
ttttcattaaact

SEQ ID NO: 4091811 - DNA, 16 bp, Homo sapiens
ttttcattaaacttga

SEQ ID NO: 4091812 - DNA, 15 bp, Homo sapiens
ttttcatttcttcct

SEQ ID NO: 4091813 - DNA, 13 bp, Homo sapiens
ttttccactttgt

SEQ ID NO: 4091814 - DNA, 20 bp, Homo sapiens
ttttccagagcattccagtc

SEQ ID NO: 4091815 - DNA, 16 bp, Homo sapiens
ttttccatatcctggt

SEQ ID NO: 4091816 - DNA, 16 bp, Homo sapiens
ttttccatgaaaacgt

SEQ ID NO: 4091817 - DNA, 23 bp, Homo sapiens
ttttcccatcatcctttgttctg

SEQ ID NO: 4091818 - DNA, 16 bp, Homo sapiens
ttttcccccttcccat

SEQ ID NO: 4091819 - DNA, 19 bp, Homo sapiens
ttttcccctcttttgttaa

SEQ ID NO: 4091820 - DNA, 16 bp, Homo sapiens
ttttcccctttcctgt

SEQ ID NO: 4091821 - DNA, 14 bp, Homo sapiens
ttttccctccccag

SEQ ID NO: 4091822 - DNA, 22 bp, Homo sapiens
ttttccctctttggctcccctg

SEQ ID NO: 4091823 - DNA, 18 bp, Homo sapiens
ttttccctggaactcctg

SEQ ID NO: 4091824 - DNA, 22 bp, Homo sapiens
ttttccctggaactcctggcct

SEQ ID NO: 4091825 - DNA, 16 bp, Homo sapiens
ttttccgttctgttct

SEQ ID NO: 4091826 - DNA, 16 bp, Homo sapiens
ttttcctcctctgcct

SEQ ID NO: 4091827 - DNA, 17 bp, Homo sapiens
ttttcctcctctgccta

SEQ ID NO: 4091828 - DNA, 13 bp, Homo sapiens
ttttcctctgagc

SEQ ID NO: 4091829 - DNA, 13 bp, Homo sapiens
ttttcctctggcc

SEQ ID NO: 4091830 - DNA, 18 bp, Homo sapiens
ttttccttcctctgtaag

SEQ ID NO: 4091831 - DNA, 23 bp, Homo sapiens
ttttctaacagaaagcatgattt

SEQ ID NO: 4091832 - DNA, 13 bp, Homo sapiens
ttttctaaccttg

SEQ ID NO: 4091833 - DNA, 13 bp, Homo sapiens
ttttctaagagaa

SEQ ID NO: 4091834 - DNA, 21 bp, Homo sapiens
ttttctaatgtggttatttct

SEQ ID NO: 4091835 - DNA, 22 bp, Homo sapiens
ttttctatcatggaatatttat

SEQ ID NO: 4091836 - DNA, 23 bp, Homo sapiens
ttttctattgttactctggttct

SEQ ID NO: 4091837 - DNA, 17 bp, Homo sapiens
ttttctatttatgcctt

SEQ ID NO: 4091838 - DNA, 15 bp, Homo sapiens
ttttctcatgtatct

SEQ ID NO: 4091839 - DNA, 12 bp, Homo sapiens
ttttctcccaag

SEQ ID NO: 4091840 - DNA, 19 bp, Homo sapiens
ttttctcccaagaaacctg

SEQ ID NO: 4091841 - DNA, 20 bp, Homo sapiens
ttttctccctttatgtatct

SEQ ID NO: 4091842 - DNA, 14 bp, Homo sapiens
ttttctctttctcc

SEQ ID NO: 4091843 - DNA, 16 bp, Homo sapiens
ttttctgacatgcatt

SEQ ID NO: 4091844 - DNA, 22 bp, Homo sapiens
ttttctgagatgctcactttat

SEQ ID NO: 4091845 - DNA, 10 bp, Homo sapiens
ttttctgagc

SEQ ID NO: 4091846 - DNA, 11 bp, Homo sapiens
ttttctgatta

SEQ ID NO: 4091847 - DNA, 13 bp, Homo sapiens
ttttctgccctgg

SEQ ID NO: 4091848 - DNA, 15 bp, Homo sapiens
ttttctgccctggct

SEQ ID NO: 4091849 - DNA, 18 bp, Homo sapiens
ttttctggaatgtaatca

SEQ ID NO: 4091850 - DNA, 13 bp, Homo sapiens
ttttctggattct

SEQ ID NO: 4091851 - DNA, 21 bp, Homo sapiens
ttttctgggggaaaaagccat

SEQ ID NO: 4091852 - DNA, 16 bp, Homo sapiens
ttttctggtagataga

SEQ ID NO: 4091853 - DNA, 19 bp, Homo sapiens
ttttctggtagatagaaat

SEQ ID NO: 4091854 - DNA, 18 bp, Homo sapiens
ttttctgtagtcatttac

SEQ ID NO: 4091855 - DNA, 14 bp, Homo sapiens
ttttctgtttctgt

SEQ ID NO: 4091856 - DNA, 22 bp, Homo sapiens
ttttctgtttgtaaattatttg

SEQ ID NO: 4091857 - DNA, 14 bp, Homo sapiens
ttttcttagttact

SEQ ID NO: 4091858 - DNA, 22 bp, Homo sapiens
ttttcttcaacatcaatgttca

SEQ ID NO: 4091859 - DNA, 13 bp, Homo sapiens
ttttcttcaggaa

SEQ ID NO: 4091860 - DNA, 16 bp, Homo sapiens
ttttcttcatgcaatg

SEQ ID NO: 4091861 - DNA, 11 bp, Homo sapiens
ttttcttctga

SEQ ID NO: 4091862 - DNA, 13 bp, Homo sapiens
ttttcttctttta

SEQ ID NO: 4091863 - DNA, 16 bp, Homo sapiens
ttttcttgatcttaaa

SEQ ID NO: 4091864 - DNA, 21 bp, Homo sapiens
ttttcttgccaatgaggtctg

SEQ ID NO: 4091865 - DNA, 14 bp, Homo sapiens
ttttctttcaaaag

SEQ ID NO: 4091866 - DNA, 20 bp, Homo sapiens
ttttgaaattatgtgacatt

SEQ ID NO: 4091867 - DNA, 13 bp, Homo sapiens
ttttgaaggcaaa

SEQ ID NO: 4091868 - DNA, 18 bp, Homo sapiens
ttttgaagtttacatttt

SEQ ID NO: 4091869 - DNA, 18 bp, Homo sapiens
ttttgaatgcttcctgac

SEQ ID NO: 4091870 - DNA, 11 bp, Homo sapiens
ttttgaatttt

SEQ ID NO: 4091871 - DNA, 18 bp, Homo sapiens
ttttgacactgaaagttt

SEQ ID NO: 4091872 - DNA, 22 bp, Homo sapiens
ttttgactagggattcaggctg

SEQ ID NO: 4091873 - DNA, 21 bp, Homo sapiens
ttttgactctggcaaagcttt

SEQ ID NO: 4091874 - DNA, 19 bp, Homo sapiens
tttgtgtcctccaggagct

SEQ ID NO: 4091875 - DNA, 13 bp, Homo sapiens
tttgtgtgtctta

SEQ ID NO: 4091876 - DNA, 13 bp, Homo sapiens
tttgtgttccaaa

SEQ ID NO: 4091877 - DNA, 14 bp, Homo sapiens
tttgtgttgtaatt

SEQ ID NO: 4091878 - DNA, 17 bp, Homo sapiens
tttgtgttgtaattctt

SEQ ID NO: 4091879 - DNA, 23 bp, Homo sapiens
tttgtgttgtaattcttcagttg

SEQ ID NO: 4091880 - DNA, 18 bp, Homo sapiens
tttgtgtttggtttacat

SEQ ID NO: 4091881 - DNA, 21 bp, Homo sapiens
tttgtgtttggtttacattta

SEQ ID NO: 4091882 - DNA, 15 bp, Homo sapiens
tttgttagatagctg

SEQ ID NO: 4091883 - DNA, 20 bp, Homo sapiens
tttgttagtttacaatatta

SEQ ID NO: 4091884 - DNA, 17 bp, Homo sapiens
tttgttcactgaaggtg

SEQ ID NO: 4091885 - DNA, 16 bp, Homo sapiens
tttgttcagctccccc

SEQ ID NO: 4091886 - DNA, 19 bp, Homo sapiens
tttgttcatcctattgttg

SEQ ID NO: 4091887 - DNA, 11 bp, Homo sapiens
tttgttcctgg

SEQ ID NO: 4091888 - DNA, 12 bp, Homo sapiens
tttgttcctgga

SEQ ID NO: 4091889 - DNA, 21 bp, Homo sapiens
tttgttctccgggtgtggcct

SEQ ID NO: 4091890 - DNA, 16 bp, Homo sapiens
tttgttgattctctcc

SEQ ID NO: 4091891 - DNA, 18 bp, Homo sapiens
tttgtttaaagaataaag

SEQ ID NO: 4091892 - DNA, 21 bp, Homo sapiens
tttgtttcaagaacctggaaa

SEQ ID NO: 4091893 - DNA, 22 bp, Homo sapiens
tttgtttcaatgaggtgtccaa

SEQ ID NO: 4091894 - DNA, 16 bp, Homo sapiens
tttgtttctgaaaatt

SEQ ID NO: 4091895 - DNA, 16 bp, Homo sapiens
tttgtttcttccaaag

SEQ ID NO: 4091896 - DNA, 12 bp, Homo sapiens
tttgtttgtctg

SEQ ID NO: 4091897 - DNA, 18 bp, Homo sapiens
tttgttttacaatgtcat

SEQ ID NO: 4091898 - DNA, 14 bp, Homo sapiens
tttgttttgttgga

SEQ ID NO: 4091899 - DNA, 16 bp, Homo sapiens
tttgtttttattttca

SEQ ID NO: 4091900 - DNA, 21 bp, Homo sapiens
tttgtttttttttttttggta

SEQ ID NO: 4091901 - DNA, 14 bp, Homo sapiens
ttttaaaacactaa

SEQ ID NO: 4091902 - DNA, 14 bp, Homo sapiens
ttttaaaatagaaa

SEQ ID NO: 4091903 - DNA, 18 bp, Homo sapiens
ttttaaaatagaaatttt

SEQ ID NO: 4091904 - DNA, 21 bp, Homo sapiens
ttttaaaatagaaattttgta

SEQ ID NO: 4091905 - DNA, 15 bp, Homo sapiens
ttttaaaatatttag

SEQ ID NO: 4091906 - DNA, 17 bp, Homo sapiens
ttttaaagaatgctctt

SEQ ID NO: 4091907 - DNA, 16 bp, Homo sapiens
ttttaaagtatatatt

SEQ ID NO: 4091908 - DNA, 15 bp, Homo sapiens
ttttaaataaaagca

SEQ ID NO: 4091909 - DNA, 14 bp, Homo sapiens
ttttaaatctaaat

SEQ ID NO: 4091910 - DNA, 12 bp, Homo sapiens
ttttaaatgtat

SEQ ID NO: 4091911 - DNA, 20 bp, Homo sapiens
ttttaaattctgagacatgt

SEQ ID NO: 4091912 - DNA, 20 bp, Homo sapiens
ttttaacaaaagcaagactg

SEQ ID NO: 4091913 - DNA, 17 bp, Homo sapiens
ttttaaccctaatcttt

SEQ ID NO: 4091914 - DNA, 12 bp, Homo sapiens
ttttaactagaa

SEQ ID NO: 4091915 - DNA, 21 bp, Homo sapiens
ttttaactgaaaatgtaaatt

SEQ ID NO: 4091916 - DNA, 19 bp, Homo sapiens
ttttaactttaagtttcag

SEQ ID NO: 4091917 - DNA, 11 bp, Homo sapiens
ttttaagaaat

SEQ ID NO: 4091918 - DNA, 18 bp, Homo sapiens
ttttaagaacttcatttt

SEQ ID NO: 4091919 - DNA, 12 bp, Homo sapiens
ttttaagaagac

SEQ ID NO: 4091920 - DNA, 13 bp, Homo sapiens
ttttaagaatatc

SEQ ID NO: 4091921 - DNA, 17 bp, Homo sapiens
ttttaagactgaatgtt

SEQ ID NO: 4091922 - DNA, 16 bp, Homo sapiens
ttttaagatagtgtaa

SEQ ID NO: 4091923 - DNA, 19 bp, Homo sapiens
ttttaagatttttctcaaa

SEQ ID NO: 4091924 - DNA, 15 bp, Homo sapiens
ttttaagcaaatgca

SEQ ID NO: 4091925 - DNA, 17 bp, Homo sapiens
ttttaagtatttatata

SEQ ID NO: 4091926 - DNA, 18 bp, Homo sapiens
ttttaagtatttatatat

SEQ ID NO: 4091927 - DNA, 19 bp, Homo sapiens
ttttaagtatttatatatt

SEQ ID NO: 4091928 - DNA, 19 bp, Homo sapiens
ttttaagtgctttgtaatg

SEQ ID NO: 4091929 - DNA, 15 bp, Homo sapiens
ttttaagttcttatg

SEQ ID NO: 4091930 - DNA, 15 bp, Homo sapiens
ttttaatacattgat

SEQ ID NO: 4091931 - DNA, 21 bp, Homo sapiens
ttttaatagaatataattatc

SEQ ID NO: 4091932 - DNA, 23 bp, Homo sapiens
ttttaatcctgtaccaaatctga

SEQ ID NO: 4091933 - DNA, 16 bp, Homo sapiens
ttttaatgcagttgct

SEQ ID NO: 4091934 - DNA, 20 bp, Homo sapiens
ttttaatgtcatttgttaaa

SEQ ID NO: 4091935 - DNA, 23 bp, Homo sapiens
ttttaattattatttatatatgt

SEQ ID NO: 4091936 - DNA, 18 bp, Homo sapiens
ttttaattattttaaaat

SEQ ID NO: 4091937 - DNA, 24 bp, Homo sapiens
ttttaattgatcagttttcatgtg

SEQ ID NO: 4091938 - DNA, 16 bp, Homo sapiens
ttttaattttcacaaa

SEQ ID NO: 4091939 - DNA, 18 bp, Homo sapiens
ttttacagtatccaaaaa

SEQ ID NO: 4091940 - DNA, 19 bp, Homo sapiens
ttttacagtgaccttttct

SEQ ID NO: 4091941 - DNA, 22 bp, Homo sapiens
ttttacagtgaccttttcttca

SEQ ID NO: 4091942 - DNA, 13 bp, Homo sapiens
ttttacataactg

SEQ ID NO: 4091943 - DNA, 13 bp, Homo sapiens
ttttacattaaat

SEQ ID NO: 4091944 - DNA, 19 bp, Homo sapiens
ttttacctaccacagtgtc

SEQ ID NO: 4091945 - DNA, 20 bp, Homo sapiens
ttttacctaccacagtgtct

SEQ ID NO: 4091946 - DNA, 23 bp, Homo sapiens
ttttacctagctggtagcataaa

SEQ ID NO: 4091947 - DNA, 21 bp, Homo sapiens
ttttacctgtcacattgcatt

SEQ ID NO: 4091948 - DNA, 14 bp, Homo sapiens
ttttacctttcata

SEQ ID NO: 4091949 - DNA, 13 bp, Homo sapiens
ttttactctgcct

SEQ ID NO: 4091950 - DNA, 16 bp, Homo sapiens
ttttactctgcctaca

SEQ ID NO: 4091951 - DNA, 19 bp, Homo sapiens
ttttactttgtacttgtgt

SEQ ID NO: 4091952 - DNA, 21 bp, Homo sapiens
ttttagcaatttatacaatat

SEQ ID NO: 4091953 - DNA, 19 bp, Homo sapiens
ttttagcctagttcatcca

SEQ ID NO: 4091954 - DNA, 22 bp, Homo sapiens
ttttagctggtggcaataaata

SEQ ID NO: 4091955 - DNA, 13 bp, Homo sapiens
ttttaggcaaaga

SEQ ID NO: 4091956 - DNA, 17 bp, Homo sapiens
ttttaggcactcttaaa

SEQ ID NO: 4091957 - DNA, 23 bp, Homo sapiens
ttttaggtcaagggcttactatt

SEQ ID NO: 4091958 - DNA, 22 bp, Homo sapiens
ttttaggtgttgattttctgtt

SEQ ID NO: 4091959 - DNA, 13 bp, Homo sapiens
ttttagttttagt

SEQ ID NO: 4091960 - DNA, 16 bp, Homo sapiens
ttttagtttttctgtc

SEQ ID NO: 4091961 - DNA, 20 bp, Homo sapiens
ttttataaatataagccttt

SEQ ID NO: 4091962 - DNA, 18 bp, Homo sapiens
ttttatactctttctgta

SEQ ID NO: 4091963 - DNA, 19 bp, Homo sapiens
ttttatactctttctgtat

SEQ ID NO: 4091964 - DNA, 13 bp, Homo sapiens
ttttatagaaaag

SEQ ID NO: 4091965 - DNA, 22 bp, Homo sapiens
ttttatagcttaactaatttga

SEQ ID NO: 4091966 - DNA, 22 bp, Homo sapiens
ttttatatgaagataagtgtat

SEQ ID NO: 4091967 - DNA, 21 bp, Homo sapiens
ttttatattgtttttgtattt

SEQ ID NO: 4091968 - DNA, 11 bp, Homo sapiens
ttttatattta

SEQ ID NO: 4091969 - DNA, 16 bp, Homo sapiens
ttttatatttgtatcg

SEQ ID NO: 4091970 - DNA, 13 bp, Homo sapiens
ttttatcatgaat

SEQ ID NO: 4091971 - DNA, 14 bp, Homo sapiens
ttttatcatgaatt

SEQ ID NO: 4091972 - DNA, 19 bp, Homo sapiens
ttttatcattttcaaaatg

SEQ ID NO: 4091973 - DNA, 17 bp, Homo sapiens
ttttatccctcacctgt

SEQ ID NO: 4091974 - DNA, 22 bp, Homo sapiens
ttttatggtggaaaagaactgt

SEQ ID NO: 4091975 - DNA, 19 bp, Homo sapiens
ttttatgtagtaattgaca

SEQ ID NO: 4091976 - DNA, 18 bp, Homo sapiens
ttttatgtgagagaaagt

SEQ ID NO: 4091977 - DNA, 23 bp, Homo sapiens
tttgctggagaagtgtgtttctt

SEQ ID NO: 4091978 - DNA, 20 bp, Homo sapiens
tttgcttaaatcagttggag

SEQ ID NO: 4091979 - DNA, 15 bp, Homo sapiens
tttgcttattgttcc

SEQ ID NO: 4091980 - DNA, 19 bp, Homo sapiens
tttgcttattgttccaaga

SEQ ID NO: 4091981 - DNA, 15 bp, Homo sapiens
tttgcttgatccaga

SEQ ID NO: 4091982 - DNA, 16 bp, Homo sapiens
tttgcttgatccagaa

SEQ ID NO: 4091983 - DNA, 21 bp, Homo sapiens
tttgcttgctcatatgcatgt

SEQ ID NO: 4091984 - DNA, 13 bp, Homo sapiens
tttgcttggtgct

SEQ ID NO: 4091985 - DNA, 23 bp, Homo sapiens
tttgcttgtggctccacacacac

SEQ ID NO: 4091986 - DNA, 17 bp, Homo sapiens
tttgctttctgaaattc

SEQ ID NO: 4091987 - DNA, 15 bp, Homo sapiens
tttgctttcttgtct

SEQ ID NO: 4091988 - DNA, 13 bp, Homo sapiens
tttggaaagtaca

SEQ ID NO: 4091989 - DNA, 15 bp, Homo sapiens
tttggaaagtacact

SEQ ID NO: 4091990 - DNA, 22 bp, Homo sapiens
tttggaaagtacactctgctgt

SEQ ID NO: 4091991 - DNA, 13 bp, Homo sapiens
tttggacagctga

SEQ ID NO: 4091992 - DNA, 20 bp, Homo sapiens
tttggagagggggcctggga

SEQ ID NO: 4091993 - DNA, 21 bp, Homo sapiens
tttggagcctcccttctgcct

SEQ ID NO: 4091994 - DNA, 20 bp, Homo sapiens
tttggagtcccctcacctcc

SEQ ID NO: 4091995 - DNA, 20 bp, Homo sapiens
tttggagttaggtcctcact

SEQ ID NO: 4091996 - DNA, 19 bp, Homo sapiens
tttggatatttttgtactt

SEQ ID NO: 4091997 - DNA, 21 bp, Homo sapiens
tttggatatttttgtacttga

SEQ ID NO: 4091998 - DNA, 19 bp, Homo sapiens
tttggatgggagtgagaca

SEQ ID NO: 4091999 - DNA, 23 bp, Homo sapiens
tttggattctcttagctactgta

SEQ ID NO: 4092000 - DNA, 22 bp, Homo sapiens
tttggatttcctttatactgtg

SEQ ID NO: 4092001 - DNA, 14 bp, Homo sapiens
tttggatttgacat

SEQ ID NO: 4092002 - DNA, 19 bp, Homo sapiens
tttggcaaacgctaaagag

SEQ ID NO: 4092003 - DNA, 14 bp, Homo sapiens
tttggcaaggaaag

SEQ ID NO: 4092004 - DNA, 23 bp, Homo sapiens
tttggcaaggaaaggggagaagg

SEQ ID NO: 4092005 - DNA, 22 bp, Homo sapiens
tttggcaggggcagaaaactct

SEQ ID NO: 4092006 - DNA, 19 bp, Homo sapiens
tttggcgctattacaaata

SEQ ID NO: 4092007 - DNA, 13 bp, Homo sapiens
tttggctcctgcc

SEQ ID NO: 4092008 - DNA, 15 bp, Homo sapiens
tttggcttataaaca

SEQ ID NO: 4092009 - DNA, 23 bp, Homo sapiens
tttggcttttcttatttaaaatt

SEQ ID NO: 4092010 - DNA, 24 bp, Homo sapiens
tttgggaaagatggataaactgag

SEQ ID NO: 4092011 - DNA, 17 bp, Homo sapiens
tttgggcccctcagagc

SEQ ID NO: 4092012 - DNA, 14 bp, Homo sapiens
tttgggcctctgct

SEQ ID NO: 4092013 - DNA, 14 bp, Homo sapiens
tttgggctgccctg

SEQ ID NO: 4092014 - DNA, 23 bp, Homo sapiens
tttggggaagggtttgaattgtt

SEQ ID NO: 4092015 - DNA, 21 bp, Homo sapiens
tttgggggctcatttttgctg

SEQ ID NO: 4092016 - DNA, 10 bp, Homo sapiens
tttggggtct

SEQ ID NO: 4092017 - DNA, 22 bp, Homo sapiens
tttgggtctacaagtatatgtg

SEQ ID NO: 4092018 - DNA, 12 bp, Homo sapiens
tttgggttgacc

SEQ ID NO: 4092019 - DNA, 21 bp, Homo sapiens
tttggtccttcaaaggcttgt

SEQ ID NO: 4092020 - DNA, 22 bp, Homo sapiens
tttggtcgaggagtaacaatac

SEQ ID NO: 4092021 - DNA, 16 bp, Homo sapiens
tttggtctgccagaat

SEQ ID NO: 4092022 - DNA, 16 bp, Homo sapiens
tttggtgaacagtttt

SEQ ID NO: 4092023 - DNA, 16 bp, Homo sapiens
tttggtgagatctcta

SEQ ID NO: 4092024 - DNA, 18 bp, Homo sapiens
tttggtgccaatgtgaaa

SEQ ID NO: 4092025 - DNA, 13 bp, Homo sapiens
tttggttctaata

SEQ ID NO: 4092026 - DNA, 12 bp, Homo sapiens
tttggtttacat

SEQ ID NO: 4092027 - DNA, 14 bp, Homo sapiens
tttggtttacattt

SEQ ID NO: 4092028 - DNA, 20 bp, Homo sapiens
tttggtttgctttggtttat

SEQ ID NO: 4092029 - DNA, 21 bp, Homo sapiens
tttgtaaaaacagcattgctt

SEQ ID NO: 4092030 - DNA, 22 bp, Homo sapiens
tttgtaaaaacagcattgcttt

SEQ ID NO: 4092031 - DNA, 23 bp, Homo sapiens
tttgtaaaagaacagtaaacatt

SEQ ID NO: 4092032 - DNA, 17 bp, Homo sapiens
tttgtaaatactgcttg

SEQ ID NO: 4092033 - DNA, 18 bp, Homo sapiens
tttgtaaatactgcttga

SEQ ID NO: 4092034 - DNA, 21 bp, Homo sapiens
tttgtaaatgattttaatttt

SEQ ID NO: 4092035 - DNA, 15 bp, Homo sapiens
tttgtaaattgtgtt

SEQ ID NO: 4092036 - DNA, 16 bp, Homo sapiens
tttgtaacctcagctc

SEQ ID NO: 4092037 - DNA, 20 bp, Homo sapiens
tttgtaagaaggcaatatta

SEQ ID NO: 4092038 - DNA, 17 bp, Homo sapiens
tttgtaagagtgtagaa

SEQ ID NO: 4092039 - DNA, 21 bp, Homo sapiens
tttgtaagtcagtgttgagat

SEQ ID NO: 4092040 - DNA, 15 bp, Homo sapiens
tttgtaatgtgaaaa

SEQ ID NO: 4092041 - DNA, 21 bp, Homo sapiens
tttgtaatgtgaaaagtatca

SEQ ID NO: 4092042 - DNA, 15 bp, Homo sapiens
tttgtaatgtgtgaa

SEQ ID NO: 4092043 - DNA, 13 bp, Homo sapiens
tttgtaattatga

SEQ ID NO: 4092044 - DNA, 20 bp, Homo sapiens
tttgtaattgcttacatttt

SEQ ID NO: 4092045 - DNA, 14 bp, Homo sapiens
tttgtacagagtgc

SEQ ID NO: 4092046 - DNA, 11 bp, Homo sapiens
tttgtacatgt

SEQ ID NO: 4092047 - DNA, 14 bp, Homo sapiens
tttgtaccatttca

SEQ ID NO: 4092048 - DNA, 14 bp, Homo sapiens
tttgtacctctaag

SEQ ID NO: 4092049 - DNA, 16 bp, Homo sapiens
tttgtactgaattttt

SEQ ID NO: 4092050 - DNA, 22 bp, Homo sapiens
tttgtactgaatttttttgtaa

SEQ ID NO: 4092051 - DNA, 20 bp, Homo sapiens
tttgtacttgatttgatgtg

SEQ ID NO: 4092052 - DNA, 14 bp, Homo sapiens
tttgtacttttagt

SEQ ID NO: 4092053 - DNA, 22 bp, Homo sapiens
tttgtaggaaggtctcattctt

SEQ ID NO: 4092054 - DNA, 15 bp, Homo sapiens
tttgtagtagcgttt

SEQ ID NO: 4092055 - DNA, 17 bp, Homo sapiens
tttgtagtagcgttttt

SEQ ID NO: 4092056 - DNA, 19 bp, Homo sapiens
tttgtagtagcgtttttta

SEQ ID NO: 4092057 - DNA, 23 bp, Homo sapiens
tttgtagtggaaacatttatatt

SEQ ID NO: 4092058 - DNA, 18 bp, Homo sapiens
tttgtatagaccaaagca

SEQ ID NO: 4092059 - DNA, 12 bp, Homo sapiens
tttgtatattgt

SEQ ID NO: 4092060 - DNA, 14 bp, Homo sapiens
tttgtatcttttat

SEQ ID NO: 4092061 - DNA, 22 bp, Homo sapiens
tttgtatcttttatcctgggag

SEQ ID NO: 4092062 - DNA, 13 bp, Homo sapiens
tttgtattcaaaa

SEQ ID NO: 4092063 - DNA, 23 bp, Homo sapiens
tttgtcaaaagttggtgttgaca

SEQ ID NO: 4092064 - DNA, 14 bp, Homo sapiens
tttgtcaaactgta

SEQ ID NO: 4092065 - DNA, 19 bp, Homo sapiens
tttgtcatcagatggaaat

SEQ ID NO: 4092066 - DNA, 22 bp, Homo sapiens
tttgtcatgctgggatttccaa

SEQ ID NO: 4092067 - DNA, 20 bp, Homo sapiens
tttgtcccatttccttggag

SEQ ID NO: 4092068 - DNA, 19 bp, Homo sapiens
tttgtcctgatgcttttgt

SEQ ID NO: 4092069 - DNA, 14 bp, Homo sapiens
tttgtctcttctgg

SEQ ID NO: 4092070 - DNA, 17 bp, Homo sapiens
tttgtctgtcttcatag

SEQ ID NO: 4092071 - DNA, 21 bp, Homo sapiens
tttgtctgtttgtttcaagaa

SEQ ID NO: 4092072 - DNA, 17 bp, Homo sapiens
tttgtcttttaatgctt

SEQ ID NO: 4092073 - DNA, 17 bp, Homo sapiens
tttgtgaatggattgga

SEQ ID NO: 4092074 - DNA, 18 bp, Homo sapiens
tttgtgatgatgctgtga

SEQ ID NO: 4092075 - DNA, 21 bp, Homo sapiens
tttgtgcaaaagcttcaaatt

SEQ ID NO: 4092076 - DNA, 15 bp, Homo sapiens
tttgtgcaaagccaa

SEQ ID NO: 4092077 - DNA, 14 bp, Homo sapiens
tttgtgctgtgggc

SEQ ID NO: 4092078 - DNA, 12 bp, Homo sapiens
tttgtggcctca

SEQ ID NO: 4092079 - DNA, 16 bp, Homo sapiens
tttgtgtaatgaaaat

SEQ ID NO: 4092080 - DNA, 19 bp, Homo sapiens
tttgaaaacatgtttattt

SEQ ID NO: 4092081 - DNA, 15 bp, Homo sapiens
tttgaaatactaaaa

SEQ ID NO: 4092082 - DNA, 18 bp, Homo sapiens
tttgaaatactaaaagca

SEQ ID NO: 4092083 - DNA, 19 bp, Homo sapiens
tttgaaatactaaaagcaa

SEQ ID NO: 4092084 - DNA, 20 bp, Homo sapiens
tttgaaatagtctgtgtgaa

SEQ ID NO: 4092085 - DNA, 21 bp, Homo sapiens
tttgaaatgaggtctgtttaa

SEQ ID NO: 4092086 - DNA, 17 bp, Homo sapiens
tttgaaattatgtgaca

SEQ ID NO: 4092087 - DNA, 15 bp, Homo sapiens
tttgaactaataaaa

SEQ ID NO: 4092088 - DNA, 15 bp, Homo sapiens
tttgaactcagatct

SEQ ID NO: 4092089 - DNA, 14 bp, Homo sapiens
tttgaactcttcaa

SEQ ID NO: 4092090 - DNA, 19 bp, Homo sapiens
tttgaactggcaattgtct

SEQ ID NO: 4092091 - DNA, 22 bp, Homo sapiens
tttgaagtaatcccgccaccta

SEQ ID NO: 4092092 - DNA, 14 bp, Homo sapiens
tttgaatatggaca

SEQ ID NO: 4092093 - DNA, 15 bp, Homo sapiens
tttgaatgaaaaatt

SEQ ID NO: 4092094 - DNA, 21 bp, Homo sapiens
tttgaatgaaaaatttaagca

SEQ ID NO: 4092095 - DNA, 22 bp, Homo sapiens
tttgaatgaaaaatttaagcat

SEQ ID NO: 4092096 - DNA, 23 bp, Homo sapiens
tttgaatgaaaaatttaagcatt

SEQ ID NO: 4092097 - DNA, 13 bp, Homo sapiens
tttgaattaaaac

SEQ ID NO: 4092098 - DNA, 15 bp, Homo sapiens
tttgaattaaaactt

SEQ ID NO: 4092099 - DNA, 15 bp, Homo sapiens
tttgaatttaaataa

SEQ ID NO: 4092100 - DNA, 19 bp, Homo sapiens
tttgaatttaaataaagtt

SEQ ID NO: 4092101 - DNA, 17 bp, Homo sapiens
tttgacaaaagtaaatg

SEQ ID NO: 4092102 - DNA, 18 bp, Homo sapiens
tttgacaaaagtaaatgg

SEQ ID NO: 4092103 - DNA, 20 bp, Homo sapiens
tttgacacctcttttttcgt

SEQ ID NO: 4092104 - DNA, 17 bp, Homo sapiens
tttgacactgaaagttt

SEQ ID NO: 4092105 - DNA, 18 bp, Homo sapiens
tttgacactgaaagtttt

SEQ ID NO: 4092106 - DNA, 18 bp, Homo sapiens
tttgacagttattttgat

SEQ ID NO: 4092107 - DNA, 20 bp, Homo sapiens
tttgacattgcgtttgacct

SEQ ID NO: 4092108 - DNA, 17 bp, Homo sapiens
tttgactaaagctatgt

SEQ ID NO: 4092109 - DNA, 21 bp, Homo sapiens
tttgactcagttccaggcctg

SEQ ID NO: 4092110 - DNA, 20 bp, Homo sapiens
tttgactctggcaaagcttt

SEQ ID NO: 4092111 - DNA, 21 bp, Homo sapiens
tttgactctggcaaagctttt

SEQ ID NO: 4092112 - DNA, 19 bp, Homo sapiens
tttgacttcagctgcctga

SEQ ID NO: 4092113 - DNA, 18 bp, Homo sapiens
tttgactttcttctgaat

SEQ ID NO: 4092114 - DNA, 20 bp, Homo sapiens
tttgagaaatgaaatattgt

SEQ ID NO: 4092115 - DNA, 15 bp, Homo sapiens
tttgagacagtttct

SEQ ID NO: 4092116 - DNA, 17 bp, Homo sapiens
tttgagacagtttctta

SEQ ID NO: 4092117 - DNA, 18 bp, Homo sapiens
tttgagacagtttcttag

SEQ ID NO: 4092118 - DNA, 22 bp, Homo sapiens
tttgagagacgccactccctgg

SEQ ID NO: 4092119 - DNA, 16 bp, Homo sapiens
tttgagagttctaaat

SEQ ID NO: 4092120 - DNA, 22 bp, Homo sapiens
tttgagctcagccccaactctt

SEQ ID NO: 4092121 - DNA, 12 bp, Homo sapiens
tttgagctgcct

SEQ ID NO: 4092122 - DNA, 23 bp, Homo sapiens
tttgagggcccagccaggagcag

SEQ ID NO: 4092123 - DNA, 21 bp, Homo sapiens
tttgagttttaaattatgtat

SEQ ID NO: 4092124 - DNA, 21 bp, Homo sapiens
tttgagtttttcctcccagtg

SEQ ID NO: 4092125 - DNA, 12 bp, Homo sapiens
tttgataatgtt

SEQ ID NO: 4092126 - DNA, 17 bp, Homo sapiens
tttgataatgttaaatt

SEQ ID NO: 4092127 - DNA, 14 bp, Homo sapiens
tttgatattatcta

SEQ ID NO: 4092128 - DNA, 15 bp, Homo sapiens
tttgatgagttgtga

SEQ ID NO: 4092129 - DNA, 22 bp, Homo sapiens
tttgatgattttcatttcatga

SEQ ID NO: 4092130 - DNA, 18 bp, Homo sapiens
tttgatgctatttatgca

SEQ ID NO: 4092131 - DNA, 14 bp, Homo sapiens
tttgatgtgacaat

SEQ ID NO: 4092132 - DNA, 13 bp, Homo sapiens
tttgatgtgactt

SEQ ID NO: 4092133 - DNA, 14 bp, Homo sapiens
tttgatgtgacttt

SEQ ID NO: 4092134 - DNA, 19 bp, Homo sapiens
tttgatgtttgtggcctca

SEQ ID NO: 4092135 - DNA, 20 bp, Homo sapiens
tttgattcatagtaacttct

SEQ ID NO: 4092136 - DNA, 13 bp, Homo sapiens
tttgattcatttt

SEQ ID NO: 4092137 - DNA, 19 bp, Homo sapiens
tttgattcattttcctgtt

SEQ ID NO: 4092138 - DNA, 18 bp, Homo sapiens
tttgattcgccctcctcc

SEQ ID NO: 4092139 - DNA, 15 bp, Homo sapiens
tttgattgatttgaa

SEQ ID NO: 4092140 - DNA, 15 bp, Homo sapiens
tttgatttacagcaa

SEQ ID NO: 4092141 - DNA, 13 bp, Homo sapiens
tttgatttacata

SEQ ID NO: 4092142 - DNA, 12 bp, Homo sapiens
tttgcaaaattt

SEQ ID NO: 4092143 - DNA, 19 bp, Homo sapiens
tttgcaacctctttgctca

SEQ ID NO: 4092144 - DNA, 24 bp, Homo sapiens
tttgcaaggtgcatttttactatt

SEQ ID NO: 4092145 - DNA, 19 bp, Homo sapiens
tttgcaataacttctatat

SEQ ID NO: 4092146 - DNA, 14 bp, Homo sapiens
tttgcaatgtcaca

SEQ ID NO: 4092147 - DNA, 15 bp, Homo sapiens
tttgcactcttgttt

SEQ ID NO: 4092148 - DNA, 23 bp, Homo sapiens
tttgcactcttgtttctcccgtg

SEQ ID NO: 4092149 - DNA, 17 bp, Homo sapiens
tttgcagaagagggtgt

SEQ ID NO: 4092150 - DNA, 21 bp, Homo sapiens
tttgcagcagtgagtctcttc

SEQ ID NO: 4092151 - DNA, 22 bp, Homo sapiens
tttgcagttggactctcaggga

SEQ ID NO: 4092152 - DNA, 13 bp, Homo sapiens
tttgcatattttg

SEQ ID NO: 4092153 - DNA, 21 bp, Homo sapiens
tttgcatattttgagaaactg

SEQ ID NO: 4092154 - DNA, 13 bp, Homo sapiens
tttgcattcaaat

SEQ ID NO: 4092155 - DNA, 14 bp, Homo sapiens
tttgcattcaaatt

SEQ ID NO: 4092156 - DNA, 15 bp, Homo sapiens
tttgcattcaaatta

SEQ ID NO: 4092157 - DNA, 19 bp, Homo sapiens
tttgcattgaggaaatatt

SEQ ID NO: 4092158 - DNA, 15 bp, Homo sapiens
tttgccacagctttt

SEQ ID NO: 4092159 - DNA, 14 bp, Homo sapiens
tttgccagctgctg

SEQ ID NO: 4092160 - DNA, 14 bp, Homo sapiens
tttgcccacccctc

SEQ ID NO: 4092161 - DNA, 13 bp, Homo sapiens
tttgccctttact

SEQ ID NO: 4092162 - DNA, 23 bp, Homo sapiens
tttgccctttacttgtctttctg

SEQ ID NO: 4092163 - DNA, 10 bp, Homo sapiens
tttgcctcaa

SEQ ID NO: 4092164 - DNA, 15 bp, Homo sapiens
tttgcctcttctttg

SEQ ID NO: 4092165 - DNA, 12 bp, Homo sapiens
tttgcctgtgcc

SEQ ID NO: 4092166 - DNA, 15 bp, Homo sapiens
tttgccttctactcc

SEQ ID NO: 4092167 - DNA, 11 bp, Homo sapiens
tttgcctttct

SEQ ID NO: 4092168 - DNA, 14 bp, Homo sapiens
tttgcggacgggct

SEQ ID NO: 4092169 - DNA, 21 bp, Homo sapiens
tttgctaagtaaatctcttct

SEQ ID NO: 4092170 - DNA, 23 bp, Homo sapiens
tttgctaagtaaatctcttctgt

SEQ ID NO: 4092171 - DNA, 21 bp, Homo sapiens
tttgctagactctagacaaga

SEQ ID NO: 4092172 - DNA, 24 bp, Homo sapiens
tttgctagcagtaaaagatgaagt

SEQ ID NO: 4092173 - DNA, 15 bp, Homo sapiens
tttgctataatcatt

SEQ ID NO: 4092174 - DNA, 13 bp, Homo sapiens
tttgctattgaca

SEQ ID NO: 4092175 - DNA, 22 bp, Homo sapiens
tttgctccccttccccttcctt

SEQ ID NO: 4092176 - DNA, 23 bp, Homo sapiens
tttgctccccttccccttccttc

SEQ ID NO: 4092177 - DNA, 17 bp, Homo sapiens
tttgctcttgtttttat

SEQ ID NO: 4092178 - DNA, 22 bp, Homo sapiens
tttgctctttgacaactaaaat

SEQ ID NO: 4092179 - DNA, 19 bp, Homo sapiens
tttgctgagcatgtactga

SEQ ID NO: 4092180 - DNA, 19 bp, Homo sapiens
tttgctgcactttttactt

SEQ ID NO: 4092181 - DNA, 10 bp, Homo sapiens
tttgctgcca

SEQ ID NO: 4092182 - DNA, 22 bp, Homo sapiens
tttgctgctaccgccctgggct

SEQ ID NO: 4092183 - DNA, 13 bp, Homo sapiens
tttctaaccttga

SEQ ID NO: 4092184 - DNA, 14 bp, Homo sapiens
tttctaaccttgaa

SEQ ID NO: 4092185 - DNA, 17 bp, Homo sapiens
tttctaaccttgaatgc

SEQ ID NO: 4092186 - DNA, 20 bp, Homo sapiens
tttctaaccttgaatgctgc

SEQ ID NO: 4092187 - DNA, 23 bp, Homo sapiens
tttctaaccttgaatgctgccag

SEQ ID NO: 4092188 - DNA, 13 bp, Homo sapiens
tttctaagagaag

SEQ ID NO: 4092189 - DNA, 16 bp, Homo sapiens
tttctaagagaagcaa

SEQ ID NO: 4092190 - DNA, 16 bp, Homo sapiens
tttctaagagaagtta

SEQ ID NO: 4092191 - DNA, 21 bp, Homo sapiens
tttctaataaacttggattct

SEQ ID NO: 4092192 - DNA, 13 bp, Homo sapiens
tttctaatcaaaa

SEQ ID NO: 4092193 - DNA, 18 bp, Homo sapiens
tttctaatccttttcctt

SEQ ID NO: 4092194 - DNA, 19 bp, Homo sapiens
tttctaatccttttcctta

SEQ ID NO: 4092195 - DNA, 20 bp, Homo sapiens
tttctaatggaatggtttgg

SEQ ID NO: 4092196 - DNA, 13 bp, Homo sapiens
tttctaatgtggt

SEQ ID NO: 4092197 - DNA, 18 bp, Homo sapiens
tttctacaactgattgca

SEQ ID NO: 4092198 - DNA, 12 bp, Homo sapiens
tttctacagaga

SEQ ID NO: 4092199 - DNA, 19 bp, Homo sapiens
tttctacagtggttttata

SEQ ID NO: 4092200 - DNA, 21 bp, Homo sapiens
tttctacccaacggccctgca

SEQ ID NO: 4092201 - DNA, 19 bp, Homo sapiens
tttctagaagcacatgtgt

SEQ ID NO: 4092202 - DNA, 19 bp, Homo sapiens
tttctagctagaaatatga

SEQ ID NO: 4092203 - DNA, 20 bp, Homo sapiens
tttctagctagaaatatgat

SEQ ID NO: 4092204 - DNA, 14 bp, Homo sapiens
tttctagtggtctt

SEQ ID NO: 4092205 - DNA, 17 bp, Homo sapiens
tttctagtggtctttgt

SEQ ID NO: 4092206 - DNA, 21 bp, Homo sapiens
tttctagtggtctttgtaaga

SEQ ID NO: 4092207 - DNA, 23 bp, Homo sapiens
tttctagtggtctttgtaagagt

SEQ ID NO: 4092208 - DNA, 13 bp, Homo sapiens
tttctcaaaagca

SEQ ID NO: 4092209 - DNA, 19 bp, Homo sapiens
tttctcaaaagcatttatc

SEQ ID NO: 4092210 - DNA, 14 bp, Homo sapiens
tttctcaaagtttt

SEQ ID NO: 4092211 - DNA, 15 bp, Homo sapiens
tttctcaaagttttg

SEQ ID NO: 4092212 - DNA, 22 bp, Homo sapiens
tttctcaaagttttgaaaagct

SEQ ID NO: 4092213 - DNA, 13 bp, Homo sapiens
tttctcaaatctt

SEQ ID NO: 4092214 - DNA, 17 bp, Homo sapiens
tttctcataattttgca

SEQ ID NO: 4092215 - DNA, 14 bp, Homo sapiens
tttctcatgaagct

SEQ ID NO: 4092216 - DNA, 12 bp, Homo sapiens
tttctccagctg

SEQ ID NO: 4092217 - DNA, 13 bp, Homo sapiens
tttctccatatca

SEQ ID NO: 4092218 - DNA, 13 bp, Homo sapiens
tttctcccaagaa

SEQ ID NO: 4092219 - DNA, 19 bp, Homo sapiens
tttctcccaagaaacctga

SEQ ID NO: 4092220 - DNA, 19 bp, Homo sapiens
tttctccttagtcttctca

SEQ ID NO: 4092221 - DNA, 14 bp, Homo sapiens
tttctccttttcct

SEQ ID NO: 4092222 - DNA, 23 bp, Homo sapiens
tttctcgggtgcatttgagagaa

SEQ ID NO: 4092223 - DNA, 17 bp, Homo sapiens
tttctctcttccctcag

SEQ ID NO: 4092224 - DNA, 20 bp, Homo sapiens
tttctctctttatacagctg

SEQ ID NO: 4092225 - DNA, 18 bp, Homo sapiens
tttctctgtgtttgttcc

SEQ ID NO: 4092226 - DNA, 20 bp, Homo sapiens
tttctcttctccccttccat

SEQ ID NO: 4092227 - DNA, 12 bp, Homo sapiens
tttctctttctc

SEQ ID NO: 4092228 - DNA, 16 bp, Homo sapiens
tttctgaaaatataac

SEQ ID NO: 4092229 - DNA, 16 bp, Homo sapiens
tttctgattagctttg

SEQ ID NO: 4092230 - DNA, 19 bp, Homo sapiens
tttctgattagctttgtgt

SEQ ID NO: 4092231 - DNA, 21 bp, Homo sapiens
tttctgcagcccttgggcagt

SEQ ID NO: 4092232 - DNA, 17 bp, Homo sapiens
tttctgcatatgttgaa

SEQ ID NO: 4092233 - DNA, 13 bp, Homo sapiens
tttctgcattttg

SEQ ID NO: 4092234 - DNA, 14 bp, Homo sapiens
tttctgccctggct

SEQ ID NO: 4092235 - DNA, 15 bp, Homo sapiens
tttctgctctggaat

SEQ ID NO: 4092236 - DNA, 21 bp, Homo sapiens
tttctggactgaagcctgcag

SEQ ID NO: 4092237 - DNA, 14 bp, Homo sapiens
tttctggggcctag

SEQ ID NO: 4092238 - DNA, 16 bp, Homo sapiens
tttctggggtttttct

SEQ ID NO: 4092239 - DNA, 15 bp, Homo sapiens
tttctgggtcctgaa

SEQ ID NO: 4092240 - DNA, 15 bp, Homo sapiens
tttctggttgatttg

SEQ ID NO: 4092241 - DNA, 14 bp, Homo sapiens
tttctgtaaataac

SEQ ID NO: 4092242 - DNA, 16 bp, Homo sapiens
tttctgtaaataacct

SEQ ID NO: 4092243 - DNA, 14 bp, Homo sapiens
tttctgtaaggtct

SEQ ID NO: 4092244 - DNA, 13 bp, Homo sapiens
tttctgtcctggg

SEQ ID NO: 4092245 - DNA, 18 bp, Homo sapiens
tttctgtgccctactcat

SEQ ID NO: 4092246 - DNA, 20 bp, Homo sapiens
tttctgttccaaattcagtt

SEQ ID NO: 4092247 - DNA, 14 bp, Homo sapiens
tttctgttctagtt

SEQ ID NO: 4092248 - DNA, 13 bp, Homo sapiens
tttctgtttctca

SEQ ID NO: 4092249 - DNA, 20 bp, Homo sapiens
tttctgtttcttcttgtgat

SEQ ID NO: 4092250 - DNA, 16 bp, Homo sapiens
tttctgtttgattctt

SEQ ID NO: 4092251 - DNA, 14 bp, Homo sapiens
tttctgtttgtaaa

SEQ ID NO: 4092252 - DNA, 22 bp, Homo sapiens
tttcttaaaccaacctttaaaa

SEQ ID NO: 4092253 - DNA, 12 bp, Homo sapiens
tttcttaaataa

SEQ ID NO: 4092254 - DNA, 23 bp, Homo sapiens
tttcttaaataatgcttcagata

SEQ ID NO: 4092255 - DNA, 13 bp, Homo sapiens
tttcttaaatatg

SEQ ID NO: 4092256 - DNA, 21 bp, Homo sapiens
tttcttagtgttgtggacact

SEQ ID NO: 4092257 - DNA, 16 bp, Homo sapiens
tttcttagttactttt

SEQ ID NO: 4092258 - DNA, 17 bp, Homo sapiens
tttcttatcttctgcaa

SEQ ID NO: 4092259 - DNA, 14 bp, Homo sapiens
tttcttatgtgaca

SEQ ID NO: 4092260 - DNA, 15 bp, Homo sapiens
tttcttatgtgacat

SEQ ID NO: 4092261 - DNA, 15 bp, Homo sapiens
tttcttattctgtat

SEQ ID NO: 4092262 - DNA, 15 bp, Homo sapiens
tttcttatttttgtc

SEQ ID NO: 4092263 - DNA, 18 bp, Homo sapiens
tttcttcaacatgctcca

SEQ ID NO: 4092264 - DNA, 23 bp, Homo sapiens
tttcttcacttcaagctgttatt

SEQ ID NO: 4092265 - DNA, 12 bp, Homo sapiens
tttcttcagaat

SEQ ID NO: 4092266 - DNA, 19 bp, Homo sapiens
tttcttcaggaaaataaat

SEQ ID NO: 4092267 - DNA, 15 bp, Homo sapiens
tttcttcatccaact

SEQ ID NO: 4092268 - DNA, 18 bp, Homo sapiens
tttcttcatgcaatgaca

SEQ ID NO: 4092269 - DNA, 21 bp, Homo sapiens
tttcttccctgctttgcatct

SEQ ID NO: 4092270 - DNA, 22 bp, Homo sapiens
tttcttcctaccaagtcaaact

SEQ ID NO: 4092271 - DNA, 23 bp, Homo sapiens
tttcttcctaccaagtcaaactt

SEQ ID NO: 4092272 - DNA, 17 bp, Homo sapiens
tttcttctgaagattct

SEQ ID NO: 4092273 - DNA, 15 bp, Homo sapiens
tttcttcttttactt

SEQ ID NO: 4092274 - DNA, 19 bp, Homo sapiens
tttcttggcaaaagccttg

SEQ ID NO: 4092275 - DNA, 15 bp, Homo sapiens
tttcttgtggtgtaa

SEQ ID NO: 4092276 - DNA, 20 bp, Homo sapiens
tttcttgtggtgtaaagctg

SEQ ID NO: 4092277 - DNA, 14 bp, Homo sapiens
tttctttaaagatg

SEQ ID NO: 4092278 - DNA, 16 bp, Homo sapiens
tttctttaagaaagta

SEQ ID NO: 4092279 - DNA, 11 bp, Homo sapiens
tttctttcagt

SEQ ID NO: 4092280 - DNA, 14 bp, Homo sapiens
tttctttctgtctt

SEQ ID NO: 4092281 - DNA, 22 bp, Homo sapiens
tttcttttgcccttcacagtgt

SEQ ID NO: 4092282 - DNA, 19 bp, Homo sapiens
tttcttttttgctttcttg

SEQ ID NO: 4092283 - DNA, 18 bp, Homo sapiens
tttctttttttttaagtt

SEQ ID NO: 4092284 - DNA, 16 bp, Homo sapiens
tttgaaaaaaacttca

SEQ ID NO: 4092285 - DNA, 19 bp, Homo sapiens
tttgaaaaattacagcttc

SEQ ID NO: 4092286 - DNA, 17 bp, Homo sapiens
tttgaaaacatgtttat

SEQ ID NO: 4092287 - DNA, 17 bp, Homo sapiens
tttcactggagttacat

SEQ ID NO: 4092288 - DNA, 18 bp, Homo sapiens
tttcactggagttacatt

SEQ ID NO: 4092289 - DNA, 19 bp, Homo sapiens
tttcactggagttacatta

SEQ ID NO: 4092290 - DNA, 15 bp, Homo sapiens
tttcactgtctgtct

SEQ ID NO: 4092291 - DNA, 23 bp, Homo sapiens
tttcacttctttcccttcctcca

SEQ ID NO: 4092292 - DNA, 21 bp, Homo sapiens
tttcactttcacatagatgtc

SEQ ID NO: 4092293 - DNA, 13 bp, Homo sapiens
tttcactttgaaa

SEQ ID NO: 4092294 - DNA, 16 bp, Homo sapiens
tttcagaaatatgtgg

SEQ ID NO: 4092295 - DNA, 19 bp, Homo sapiens
tttcagaacctcttcccca

SEQ ID NO: 4092296 - DNA, 23 bp, Homo sapiens
tttcagaacctcttccccagaaa

SEQ ID NO: 4092297 - DNA, 22 bp, Homo sapiens
tttcagaagcaagccagaccta

SEQ ID NO: 4092298 - DNA, 11 bp, Homo sapiens
tttcagactcc

SEQ ID NO: 4092299 - DNA, 16 bp, Homo sapiens
tttcagatgcttctgg

SEQ ID NO: 4092300 - DNA, 20 bp, Homo sapiens
tttcagcacccccacccacc

SEQ ID NO: 4092301 - DNA, 22 bp, Homo sapiens
tttcagcacccccacccacctc

SEQ ID NO: 4092302 - DNA, 14 bp, Homo sapiens
tttcagcaggcagc

SEQ ID NO: 4092303 - DNA, 21 bp, Homo sapiens
tttcagctaagggaagacatt

SEQ ID NO: 4092304 - DNA, 13 bp, Homo sapiens
tttcagctgagcc

SEQ ID NO: 4092305 - DNA, 15 bp, Homo sapiens
tttcaggaatttaaa

SEQ ID NO: 4092306 - DNA, 19 bp, Homo sapiens
tttcaggatactctgtcag

SEQ ID NO: 4092307 - DNA, 16 bp, Homo sapiens
tttcagggttttctga

SEQ ID NO: 4092308 - DNA, 13 bp, Homo sapiens
tttcaggtgacat

SEQ ID NO: 4092309 - DNA, 15 bp, Homo sapiens
tttcaggtgacatgt

SEQ ID NO: 4092310 - DNA, 17 bp, Homo sapiens
tttcaggtgtcatggac

SEQ ID NO: 4092311 - DNA, 19 bp, Homo sapiens
tttcagtaaacctgtctga

SEQ ID NO: 4092312 - DNA, 19 bp, Homo sapiens
tttcagtgtagttaattta

SEQ ID NO: 4092313 - DNA, 16 bp, Homo sapiens
tttcagtgttacctgt

SEQ ID NO: 4092314 - DNA, 20 bp, Homo sapiens
tttcagttattgtccctggc

SEQ ID NO: 4092315 - DNA, 14 bp, Homo sapiens
tttcatagttcaga

SEQ ID NO: 4092316 - DNA, 15 bp, Homo sapiens
tttcatagttcagaa

SEQ ID NO: 4092317 - DNA, 13 bp, Homo sapiens
tttcatatccaag

SEQ ID NO: 4092318 - DNA, 15 bp, Homo sapiens
tttcatatgctgtat

SEQ ID NO: 4092319 - DNA, 16 bp, Homo sapiens
tttcatcattgtttct

SEQ ID NO: 4092320 - DNA, 22 bp, Homo sapiens
tttcatccagtttgttctccgg

SEQ ID NO: 4092321 - DNA, 14 bp, Homo sapiens
tttcatctaccttt

SEQ ID NO: 4092322 - DNA, 19 bp, Homo sapiens
tttcatctaccttttctgg

SEQ ID NO: 4092323 - DNA, 17 bp, Homo sapiens
tttcatgaccagtaaag

SEQ ID NO: 4092324 - DNA, 12 bp, Homo sapiens
tttcatgtacaa

SEQ ID NO: 4092325 - DNA, 17 bp, Homo sapiens
tttcatgtggctgtaga

SEQ ID NO: 4092326 - DNA, 11 bp, Homo sapiens
tttcattccat

SEQ ID NO: 4092327 - DNA, 17 bp, Homo sapiens
tttcattccattgccta

SEQ ID NO: 4092328 - DNA, 13 bp, Homo sapiens
tttcattccttca

SEQ ID NO: 4092329 - DNA, 21 bp, Homo sapiens
tttcattccttcagatttggc

SEQ ID NO: 4092330 - DNA, 15 bp, Homo sapiens
tttcattctcctgcc

SEQ ID NO: 4092331 - DNA, 17 bp, Homo sapiens
tttcattgcctgtgtat

SEQ ID NO: 4092332 - DNA, 19 bp, Homo sapiens
tttcatttaagggaaagaa

SEQ ID NO: 4092333 - DNA, 20 bp, Homo sapiens
tttcatttcttgtcaattat

SEQ ID NO: 4092334 - DNA, 21 bp, Homo sapiens
tttccaacaccacagacacac

SEQ ID NO: 4092335 - DNA, 22 bp, Homo sapiens
tttccaacaccacagacacaca

SEQ ID NO: 4092336 - DNA, 16 bp, Homo sapiens
tttccaagaggctgta

SEQ ID NO: 4092337 - DNA, 19 bp, Homo sapiens
tttccacgatgaaaaactt

SEQ ID NO: 4092338 - DNA, 12 bp, Homo sapiens
tttccactgtaa

SEQ ID NO: 4092339 - DNA, 19 bp, Homo sapiens
tttccagacttccttgaga

SEQ ID NO: 4092340 - DNA, 12 bp, Homo sapiens
tttccagagcat

SEQ ID NO: 4092341 - DNA, 13 bp, Homo sapiens
tttccagagcatt

SEQ ID NO: 4092342 - DNA, 17 bp, Homo sapiens
tttccagagcattccag

SEQ ID NO: 4092343 - DNA, 19 bp, Homo sapiens
tttccagctgtgcagcacg

SEQ ID NO: 4092344 - DNA, 18 bp, Homo sapiens
tttccaggcaccctcagg

SEQ ID NO: 4092345 - DNA, 15 bp, Homo sapiens
tttccagtacctttg

SEQ ID NO: 4092346 - DNA, 12 bp, Homo sapiens
tttccagtgcaa

SEQ ID NO: 4092347 - DNA, 21 bp, Homo sapiens
tttccattatttatattagtt

SEQ ID NO: 4092348 - DNA, 14 bp, Homo sapiens
tttccattccagaa

SEQ ID NO: 4092349 - DNA, 12 bp, Homo sapiens
tttcccataatt

SEQ ID NO: 4092350 - DNA, 13 bp, Homo sapiens
tttcccatctgca

SEQ ID NO: 4092351 - DNA, 19 bp, Homo sapiens
tttccccagcatcactccc

SEQ ID NO: 4092352 - DNA, 13 bp, Homo sapiens
tttccccccactc

SEQ ID NO: 4092353 - DNA, 19 bp, Homo sapiens
tttcccccctttttttcct

SEQ ID NO: 4092354 - DNA, 13 bp, Homo sapiens
tttccccctttct

SEQ ID NO: 4092355 - DNA, 12 bp, Homo sapiens
tttcccctctgg

SEQ ID NO: 4092356 - DNA, 15 bp, Homo sapiens
tttcccctctggctt

SEQ ID NO: 4092357 - DNA, 13 bp, Homo sapiens
tttcccctgttaa

SEQ ID NO: 4092358 - DNA, 13 bp, Homo sapiens
tttccctaaaata

SEQ ID NO: 4092359 - DNA, 18 bp, Homo sapiens
tttccctccccagaatca

SEQ ID NO: 4092360 - DNA, 21 bp, Homo sapiens
tttccctggaactcctggcct

SEQ ID NO: 4092361 - DNA, 19 bp, Homo sapiens
tttcccttacaaggtgggg

SEQ ID NO: 4092362 - DNA, 13 bp, Homo sapiens
tttcccttccagt

SEQ ID NO: 4092363 - DNA, 23 bp, Homo sapiens
tttccgtgccgtgtattttttaa

SEQ ID NO: 4092364 - DNA, 16 bp, Homo sapiens
tttccgtttgcttttg

SEQ ID NO: 4092365 - DNA, 23 bp, Homo sapiens
tttcctaacaaaagatgaaagca

SEQ ID NO: 4092366 - DNA, 15 bp, Homo sapiens
tttcctatgggaaca

SEQ ID NO: 4092367 - DNA, 15 bp, Homo sapiens
tttcctcccttgggt

SEQ ID NO: 4092368 - DNA, 22 bp, Homo sapiens
tttcctcctgaggctttggatt

SEQ ID NO: 4092369 - DNA, 19 bp, Homo sapiens
tttcctctgagcccagctg

SEQ ID NO: 4092370 - DNA, 22 bp, Homo sapiens
tttcctctgagcccagctgcct

SEQ ID NO: 4092371 - DNA, 13 bp, Homo sapiens
tttcctcttcaga

SEQ ID NO: 4092372 - DNA, 15 bp, Homo sapiens
tttcctgccctgtcc

SEQ ID NO: 4092373 - DNA, 11 bp, Homo sapiens
tttcctggaaa

SEQ ID NO: 4092374 - DNA, 20 bp, Homo sapiens
tttcctggacactcagacct

SEQ ID NO: 4092375 - DNA, 13 bp, Homo sapiens
tttccttaatcca

SEQ ID NO: 4092376 - DNA, 14 bp, Homo sapiens
tttccttatttgct

SEQ ID NO: 4092377 - DNA, 16 bp, Homo sapiens
tttccttcattcatag

SEQ ID NO: 4092378 - DNA, 11 bp, Homo sapiens
tttccttccag

SEQ ID NO: 4092379 - DNA, 18 bp, Homo sapiens
tttccttcccttttctgt

SEQ ID NO: 4092380 - DNA, 20 bp, Homo sapiens
tttccttcccttttctgttc

SEQ ID NO: 4092381 - DNA, 13 bp, Homo sapiens
tttccttgtcccg

SEQ ID NO: 4092382 - DNA, 16 bp, Homo sapiens
tttccttgtttatcag

SEQ ID NO: 4092383 - DNA, 19 bp, Homo sapiens
tttcctttatgtgaatttt

SEQ ID NO: 4092384 - DNA, 16 bp, Homo sapiens
tttcctttttctgatt

SEQ ID NO: 4092385 - DNA, 15 bp, Homo sapiens
tttcctttttcttcg

SEQ ID NO: 4092386 - DNA, 19 bp, Homo sapiens
tttcctttttgacactgaa

SEQ ID NO: 4092387 - DNA, 15 bp, Homo sapiens
tttcgaaactgccaa

SEQ ID NO: 4092388 - DNA, 13 bp, Homo sapiens
tttcgtggcttca

SEQ ID NO: 4092389 - DNA, 18 bp, Homo sapiens
tttcgttaacattgacca

SEQ ID NO: 4092390 - DNA, 19 bp, Homo sapiens
tttcgttaacattgaccaa

SEQ ID NO: 4092391 - DNA, 19 bp, Homo sapiens
tttatatgaagataagtgt

SEQ ID NO: 4092392 - DNA, 23 bp, Homo sapiens
tttatatggatgattcagaaatt

SEQ ID NO: 4092393 - DNA, 15 bp, Homo sapiens
tttatatttattgtt

SEQ ID NO: 4092394 - DNA, 19 bp, Homo sapiens
tttatatttattgttagaa

SEQ ID NO: 4092395 - DNA, 13 bp, Homo sapiens
tttatatttcctt

SEQ ID NO: 4092396 - DNA, 19 bp, Homo sapiens
tttatatttcctttatgtg

SEQ ID NO: 4092397 - DNA, 22 bp, Homo sapiens
tttatatttcctttatgtgaat

SEQ ID NO: 4092398 - DNA, 19 bp, Homo sapiens
tttatatttggggtccttt

SEQ ID NO: 4092399 - DNA, 14 bp, Homo sapiens
tttatcagaattct

SEQ ID NO: 4092400 - DNA, 14 bp, Homo sapiens
tttatcagatacat

SEQ ID NO: 4092401 - DNA, 20 bp, Homo sapiens
tttatcagatacatcactgc

SEQ ID NO: 4092402 - DNA, 22 bp, Homo sapiens
tttatcagtttccagtctcaaa

SEQ ID NO: 4092403 - DNA, 22 bp, Homo sapiens
tttatcatgaattcccttttaa

SEQ ID NO: 4092404 - DNA, 17 bp, Homo sapiens
tttatcattaattttta

SEQ ID NO: 4092405 - DNA, 21 bp, Homo sapiens
tttatcattaatttttaattg

SEQ ID NO: 4092406 - DNA, 21 bp, Homo sapiens
tttatccattcaactgaaaat

SEQ ID NO: 4092407 - DNA, 21 bp, Homo sapiens
tttatcccaaagttgttgtaa

SEQ ID NO: 4092408 - DNA, 13 bp, Homo sapiens
tttatctgattaa

SEQ ID NO: 4092409 - DNA, 19 bp, Homo sapiens
tttatctgtagtaaactat

SEQ ID NO: 4092410 - DNA, 13 bp, Homo sapiens
tttatctgttctt

SEQ ID NO: 4092411 - DNA, 15 bp, Homo sapiens
tttatgaagtttaaa

SEQ ID NO: 4092412 - DNA, 23 bp, Homo sapiens
tttatgaagtttaaaacagtatt

SEQ ID NO: 4092413 - DNA, 19 bp, Homo sapiens
tttatgagccagacaaatg

SEQ ID NO: 4092414 - DNA, 20 bp, Homo sapiens
tttatgagtaactattatta

SEQ ID NO: 4092415 - DNA, 21 bp, Homo sapiens
tttatgagtaactattattat

SEQ ID NO: 4092416 - DNA, 14 bp, Homo sapiens
tttatgatcagtgt

SEQ ID NO: 4092417 - DNA, 18 bp, Homo sapiens
tttatgatttaataaaat

SEQ ID NO: 4092418 - DNA, 15 bp, Homo sapiens
tttatgcaaggaagg

SEQ ID NO: 4092419 - DNA, 18 bp, Homo sapiens
tttatgcaaggaaggaaa

SEQ ID NO: 4092420 - DNA, 14 bp, Homo sapiens
tttatgcagataga

SEQ ID NO: 4092421 - DNA, 21 bp, Homo sapiens
tttatggtaactgctttctgt

SEQ ID NO: 4092422 - DNA, 15 bp, Homo sapiens
tttatggttttcatt

SEQ ID NO: 4092423 - DNA, 18 bp, Homo sapiens
tttatgtctatttaagcc

SEQ ID NO: 4092424 - DNA, 13 bp, Homo sapiens
tttatgtgaaatg

SEQ ID NO: 4092425 - DNA, 20 bp, Homo sapiens
tttatgtgaaatgctttctg

SEQ ID NO: 4092426 - DNA, 21 bp, Homo sapiens
tttatgtgaaatgctttctgt

SEQ ID NO: 4092427 - DNA, 22 bp, Homo sapiens
tttatgtgaaatgctttctgta

SEQ ID NO: 4092428 - DNA, 13 bp, Homo sapiens
tttatgtgaattt

SEQ ID NO: 4092429 - DNA, 16 bp, Homo sapiens
tttatgtgaattttta

SEQ ID NO: 4092430 - DNA, 11 bp, Homo sapiens
tttatgttctt

SEQ ID NO: 4092431 - DNA, 14 bp, Homo sapiens
tttatgttcttata

SEQ ID NO: 4092432 - DNA, 13 bp, Homo sapiens
tttatgtttgaat

SEQ ID NO: 4092433 - DNA, 14 bp, Homo sapiens
tttatgtttgaata

SEQ ID NO: 4092434 - DNA, 23 bp, Homo sapiens
tttatgtttgcacttgtgattat

SEQ ID NO: 4092435 - DNA, 14 bp, Homo sapiens
tttatgtttgtctt

SEQ ID NO: 4092436 - DNA, 22 bp, Homo sapiens
tttattaaacagatttttacaa

SEQ ID NO: 4092437 - DNA, 23 bp, Homo sapiens
tttattaaacagatttttacaaa

SEQ ID NO: 4092438 - DNA, 19 bp, Homo sapiens
tttattaaagcatttccta

SEQ ID NO: 4092439 - DNA, 20 bp, Homo sapiens
tttattaaatttgttgacaa

SEQ ID NO: 4092440 - DNA, 21 bp, Homo sapiens
tttattaaatttgttgacaaa

SEQ ID NO: 4092441 - DNA, 15 bp, Homo sapiens
tttattaatttgaaa

SEQ ID NO: 4092442 - DNA, 12 bp, Homo sapiens
tttattaccagt

SEQ ID NO: 4092443 - DNA, 14 bp, Homo sapiens
tttattaccagtgg

SEQ ID NO: 4092444 - DNA, 23 bp, Homo sapiens
tttattaccccctccttcagaca

SEQ ID NO: 4092445 - DNA, 16 bp, Homo sapiens
tttattatttatttat

SEQ ID NO: 4092446 - DNA, 13 bp, Homo sapiens
tttattattttta

SEQ ID NO: 4092447 - DNA, 13 bp, Homo sapiens
tttattcagtaaa

SEQ ID NO: 4092448 - DNA, 16 bp, Homo sapiens
tttattcagtaaacaa

SEQ ID NO: 4092449 - DNA, 22 bp, Homo sapiens
tttattcatccagcagtgttgc

SEQ ID NO: 4092450 - DNA, 16 bp, Homo sapiens
tttattcattagctgt

SEQ ID NO: 4092451 - DNA, 23 bp, Homo sapiens
tttattccagaatgctgtacatc

SEQ ID NO: 4092452 - DNA, 12 bp, Homo sapiens
tttattcttcca

SEQ ID NO: 4092453 - DNA, 12 bp, Homo sapiens
tttattgacaca

SEQ ID NO: 4092454 - DNA, 13 bp, Homo sapiens
tttattgacacag

SEQ ID NO: 4092455 - DNA, 14 bp, Homo sapiens
tttattgacacaga

SEQ ID NO: 4092456 - DNA, 17 bp, Homo sapiens
tttattgctagtatttg

SEQ ID NO: 4092457 - DNA, 20 bp, Homo sapiens
tttattgttaactcttgtct

SEQ ID NO: 4092458 - DNA, 13 bp, Homo sapiens
tttatttatgaag

SEQ ID NO: 4092459 - DNA, 14 bp, Homo sapiens
tttatttatttaca

SEQ ID NO: 4092460 - DNA, 12 bp, Homo sapiens
tttatttccact

SEQ ID NO: 4092461 - DNA, 13 bp, Homo sapiens
tttatttcctccc

SEQ ID NO: 4092462 - DNA, 16 bp, Homo sapiens
tttatttctgcatatg

SEQ ID NO: 4092463 - DNA, 13 bp, Homo sapiens
tttattttaatac

SEQ ID NO: 4092464 - DNA, 17 bp, Homo sapiens
tttattttactattgga

SEQ ID NO: 4092465 - DNA, 17 bp, Homo sapiens
tttattttcaaatctgg

SEQ ID NO: 4092466 - DNA, 16 bp, Homo sapiens
tttattttcttttgaa

SEQ ID NO: 4092467 - DNA, 19 bp, Homo sapiens
tttattttgaaaagcttct

SEQ ID NO: 4092468 - DNA, 17 bp, Homo sapiens
tttatttttcttgtctt

SEQ ID NO: 4092469 - DNA, 23 bp, Homo sapiens
tttcaaaaacaccccccccccac

SEQ ID NO: 4092470 - DNA, 13 bp, Homo sapiens
tttcaaaaacatt

SEQ ID NO: 4092471 - DNA, 18 bp, Homo sapiens
tttcaaaaatataactta

SEQ ID NO: 4092472 - DNA, 21 bp, Homo sapiens
tttcaaaataagtatttctga

SEQ ID NO: 4092473 - DNA, 19 bp, Homo sapiens
tttcaaattggactttcaa

SEQ ID NO: 4092474 - DNA, 20 bp, Homo sapiens
tttcaaattggactttcaaa

SEQ ID NO: 4092475 - DNA, 14 bp, Homo sapiens
tttcaaattgtatc

SEQ ID NO: 4092476 - DNA, 21 bp, Homo sapiens
tttcaacgcagccctgctttg

SEQ ID NO: 4092477 - DNA, 15 bp, Homo sapiens
tttcaactatgtagg

SEQ ID NO: 4092478 - DNA, 20 bp, Homo sapiens
tttcaaggaaggttcatgta

SEQ ID NO: 4092479 - DNA, 20 bp, Homo sapiens
tttcaagtcaaattaataat

SEQ ID NO: 4092480 - DNA, 19 bp, Homo sapiens
tttcaagtctgactctcca

SEQ ID NO: 4092481 - DNA, 14 bp, Homo sapiens
tttcaatatattga

SEQ ID NO: 4092482 - DNA, 18 bp, Homo sapiens
tttcaatatattgaactt

SEQ ID NO: 4092483 - DNA, 23 bp, Homo sapiens
tttcaattcagattgtcttgcaa

SEQ ID NO: 4092484 - DNA, 15 bp, Homo sapiens
tttcacaaaatgtct

SEQ ID NO: 4092485 - DNA, 13 bp, Homo sapiens
tttcacaacattt

SEQ ID NO: 4092486 - DNA, 20 bp, Homo sapiens
tttcacaccggaaggttttt

SEQ ID NO: 4092487 - DNA, 22 bp, Homo sapiens
tttcaccccacccttcccctcc

SEQ ID NO: 4092488 - DNA, 15 bp, Homo sapiens
tttcacccttctact

SEQ ID NO: 4092489 - DNA, 15 bp, Homo sapiens
tttcacgggagattt

SEQ ID NO: 4092490 - DNA, 20 bp, Homo sapiens
tttcacgtcttggtgccttt

SEQ ID NO: 4092491 - DNA, 23 bp, Homo sapiens
tttcacgtcttggtgccttttgt

SEQ ID NO: 4092492 - DNA, 18 bp, Homo sapiens
tttcactgctggctgcct

SEQ ID NO: 4092493 - DNA, 20 bp, Homo sapiens
tttcactgctggctgcctta

SEQ ID NO: 4092494 - DNA, 14 bp, Homo sapiens
tttaatcagtgaag

SEQ ID NO: 4092495 - DNA, 20 bp, Homo sapiens
tttaatcctgtaccaaatct

SEQ ID NO: 4092496 - DNA, 19 bp, Homo sapiens
tttaatgcttcattcaata

SEQ ID NO: 4092497 - DNA, 14 bp, Homo sapiens
tttaatggcagcta

SEQ ID NO: 4092498 - DNA, 13 bp, Homo sapiens
tttaattaaataa

SEQ ID NO: 4092499 - DNA, 23 bp, Homo sapiens
tttaattattattcttcataaca

SEQ ID NO: 4092500 - DNA, 23 bp, Homo sapiens
tttaattattatttatatatgta

SEQ ID NO: 4092501 - DNA, 12 bp, Homo sapiens
tttaattatttt

SEQ ID NO: 4092502 - DNA, 23 bp, Homo sapiens
tttaattgttgtttctttctagt

SEQ ID NO: 4092503 - DNA, 24 bp, Homo sapiens
tttaattgttgtttctttctagtg

SEQ ID NO: 4092504 - DNA, 13 bp, Homo sapiens
tttaatttaacaa

SEQ ID NO: 4092505 - DNA, 19 bp, Homo sapiens
tttaatttggcttttctta

SEQ ID NO: 4092506 - DNA, 15 bp, Homo sapiens
tttacaaaaatataa

SEQ ID NO: 4092507 - DNA, 16 bp, Homo sapiens
tttacaaaaatataaa

SEQ ID NO: 4092508 - DNA, 21 bp, Homo sapiens
tttacaaaagaaataccttga

SEQ ID NO: 4092509 - DNA, 13 bp, Homo sapiens
tttacaaaagatg

SEQ ID NO: 4092510 - DNA, 21 bp, Homo sapiens
tttacaagaagtttattctca

SEQ ID NO: 4092511 - DNA, 16 bp, Homo sapiens
tttacaataaataatc

SEQ ID NO: 4092512 - DNA, 21 bp, Homo sapiens
tttacaatcagccacattcta

SEQ ID NO: 4092513 - DNA, 14 bp, Homo sapiens
tttacacaattctt

SEQ ID NO: 4092514 - DNA, 13 bp, Homo sapiens
tttacagaaatgg

SEQ ID NO: 4092515 - DNA, 18 bp, Homo sapiens
tttacaggaacttcatca

SEQ ID NO: 4092516 - DNA, 22 bp, Homo sapiens
tttacaggccctgctcctgcag

SEQ ID NO: 4092517 - DNA, 22 bp, Homo sapiens
tttacagtatctacttgcatgt

SEQ ID NO: 4092518 - DNA, 15 bp, Homo sapiens
tttacagtccttcaa

SEQ ID NO: 4092519 - DNA, 21 bp, Homo sapiens
tttacagttagggttttgcaa

SEQ ID NO: 4092520 - DNA, 16 bp, Homo sapiens
tttacataactgcctt

SEQ ID NO: 4092521 - DNA, 19 bp, Homo sapiens
tttacatataaaatgtaat

SEQ ID NO: 4092522 - DNA, 18 bp, Homo sapiens
tttacatgaattgcattt

SEQ ID NO: 4092523 - DNA, 19 bp, Homo sapiens
tttacatgtgtagcctatg

SEQ ID NO: 4092524 - DNA, 20 bp, Homo sapiens
tttacatgtgtagcctatgt

SEQ ID NO: 4092525 - DNA, 14 bp, Homo sapiens
tttacattctagtt

SEQ ID NO: 4092526 - DNA, 15 bp, Homo sapiens
tttacattctagttc

SEQ ID NO: 4092527 - DNA, 13 bp, Homo sapiens
tttacattgtaaa

SEQ ID NO: 4092528 - DNA, 20 bp, Homo sapiens
tttacatttaaagcattgct

SEQ ID NO: 4092529 - DNA, 16 bp, Homo sapiens
tttaccatcatctctg

SEQ ID NO: 4092530 - DNA, 16 bp, Homo sapiens
tttaccatttgtaata

SEQ ID NO: 4092531 - DNA, 16 bp, Homo sapiens
tttaccctaatgtctt

SEQ ID NO: 4092532 - DNA, 18 bp, Homo sapiens
tttacccttttccccctt

SEQ ID NO: 4092533 - DNA, 22 bp, Homo sapiens
tttacccttttcccccttccca

SEQ ID NO: 4092534 - DNA, 20 bp, Homo sapiens
tttacctgtcacattgcatt

SEQ ID NO: 4092535 - DNA, 21 bp, Homo sapiens
tttacctgtcacattgcattc

SEQ ID NO: 4092536 - DNA, 18 bp, Homo sapiens
tttacgctttgattcata

SEQ ID NO: 4092537 - DNA, 12 bp, Homo sapiens
tttactctgcct

SEQ ID NO: 4092538 - DNA, 12 bp, Homo sapiens
tttactctgtgt

SEQ ID NO: 4092539 - DNA, 22 bp, Homo sapiens
tttactgccaaagggaaatatc

SEQ ID NO: 4092540 - DNA, 15 bp, Homo sapiens
tttacttcttataca

SEQ ID NO: 4092541 - DNA, 19 bp, Homo sapiens
tttacttcttatacatttg

SEQ ID NO: 4092542 - DNA, 18 bp, Homo sapiens
tttactttaaacttgtct

SEQ ID NO: 4092543 - DNA, 23 bp, Homo sapiens
tttagaaaaaatggatgcccaga

SEQ ID NO: 4092544 - DNA, 20 bp, Homo sapiens
tttagaaatactgcaagaaa

SEQ ID NO: 4092545 - DNA, 22 bp, Homo sapiens
tttagacaagagatgggaatga

SEQ ID NO: 4092546 - DNA, 11 bp, Homo sapiens
tttagacagta

SEQ ID NO: 4092547 - DNA, 20 bp, Homo sapiens
tttagacagtctcactttgt

SEQ ID NO: 4092548 - DNA, 15 bp, Homo sapiens
tttagaccatttatc

SEQ ID NO: 4092549 - DNA, 22 bp, Homo sapiens
tttagactcatcaatcaaataa

SEQ ID NO: 4092550 - DNA, 15 bp, Homo sapiens
tttagaggcattgtt

SEQ ID NO: 4092551 - DNA, 18 bp, Homo sapiens
tttagaggcattgttagt

SEQ ID NO: 4092552 - DNA, 16 bp, Homo sapiens
tttagccctttaaaac

SEQ ID NO: 4092553 - DNA, 22 bp, Homo sapiens
tttagcctgtgtcattgcccca

SEQ ID NO: 4092554 - DNA, 18 bp, Homo sapiens
tttagcttctttccctta

SEQ ID NO: 4092555 - DNA, 13 bp, Homo sapiens
tttaggaaaatca

SEQ ID NO: 4092556 - DNA, 22 bp, Homo sapiens
tttaggaagttgacttatagta

SEQ ID NO: 4092557 - DNA, 18 bp, Homo sapiens
tttaggaatcctttggtg

SEQ ID NO: 4092558 - DNA, 13 bp, Homo sapiens
tttaggagatttt

SEQ ID NO: 4092559 - DNA, 20 bp, Homo sapiens
tttaggagggagttatctaa

SEQ ID NO: 4092560 - DNA, 20 bp, Homo sapiens
tttaggcactcttaaatgat

SEQ ID NO: 4092561 - DNA, 18 bp, Homo sapiens
tttaggctatttgtaaat

SEQ ID NO: 4092562 - DNA, 20 bp, Homo sapiens
tttagggtactaaatttaaa

SEQ ID NO: 4092563 - DNA, 15 bp, Homo sapiens
tttaggtaagaagtt

SEQ ID NO: 4092564 - DNA, 14 bp, Homo sapiens
tttagtatgtaaat

SEQ ID NO: 4092565 - DNA, 13 bp, Homo sapiens
tttagtattcatt

SEQ ID NO: 4092566 - DNA, 15 bp, Homo sapiens
tttagtcatgtgacc

SEQ ID NO: 4092567 - DNA, 15 bp, Homo sapiens
tttagtcctgtactg

SEQ ID NO: 4092568 - DNA, 19 bp, Homo sapiens
tttagtggaagcttctaaa

SEQ ID NO: 4092569 - DNA, 16 bp, Homo sapiens
tttagtgtaataagac

SEQ ID NO: 4092570 - DNA, 19 bp, Homo sapiens
tttagtgtgtgtgcagagt

SEQ ID NO: 4092571 - DNA, 11 bp, Homo sapiens
tttagttcttt

SEQ ID NO: 4092572 - DNA, 19 bp, Homo sapiens
tttagttgcagactcagtt

SEQ ID NO: 4092573 - DNA, 14 bp, Homo sapiens
tttataaaacttct

SEQ ID NO: 4092574 - DNA, 17 bp, Homo sapiens
tttataaaattttgctt

SEQ ID NO: 4092575 - DNA, 22 bp, Homo sapiens
tttataaacagacaatatgtga

SEQ ID NO: 4092576 - DNA, 21 bp, Homo sapiens
tttataaatatattcaggagt

SEQ ID NO: 4092577 - DNA, 14 bp, Homo sapiens
tttataaatgctat

SEQ ID NO: 4092578 - DNA, 15 bp, Homo sapiens
tttataaatgctatt

SEQ ID NO: 4092579 - DNA, 17 bp, Homo sapiens
tttataaggacttcctg

SEQ ID NO: 4092580 - DNA, 17 bp, Homo sapiens
tttataagtcattgtat

SEQ ID NO: 4092581 - DNA, 16 bp, Homo sapiens
tttataagttcacaaa

SEQ ID NO: 4092582 - DNA, 18 bp, Homo sapiens
tttataagttcacaaaat

SEQ ID NO: 4092583 - DNA, 13 bp, Homo sapiens
tttatacaaatta

SEQ ID NO: 4092584 - DNA, 17 bp, Homo sapiens
tttatacaaattagaaa

SEQ ID NO: 4092585 - DNA, 21 bp, Homo sapiens
tttatacagctgtattgtctg

SEQ ID NO: 4092586 - DNA, 16 bp, Homo sapiens
tttataccattcagat

SEQ ID NO: 4092587 - DNA, 21 bp, Homo sapiens
tttatacctcaaactatctgg

SEQ ID NO: 4092588 - DNA, 19 bp, Homo sapiens
tttatactccagtgtacat

SEQ ID NO: 4092589 - DNA, 16 bp, Homo sapiens
tttatactctttctgt

SEQ ID NO: 4092590 - DNA, 14 bp, Homo sapiens
tttatactgaatat

SEQ ID NO: 4092591 - DNA, 16 bp, Homo sapiens
tttatactgtttactg

SEQ ID NO: 4092592 - DNA, 16 bp, Homo sapiens
tttataggtgagaaaa

SEQ ID NO: 4092593 - DNA, 14 bp, Homo sapiens
tttatataaatgta

SEQ ID NO: 4092594 - DNA, 14 bp, Homo sapiens
tttatatatgaaaa

SEQ ID NO: 4092595 - DNA, 15 bp, Homo sapiens
tttatatatttataa

SEQ ID NO: 4092596 - DNA, 16 bp, Homo sapiens
tttatatatttataac

SEQ ID NO: 4092597 - DNA, 14 bp, Homo sapiens
ttgttttgcttccc

SEQ ID NO: 4092598 - DNA, 12 bp, Homo sapiens
ttgtttttcatt

SEQ ID NO: 4092599 - DNA, 23 bp, Homo sapiens
ttgtttttgaatttaaataaagt

SEQ ID NO: 4092600 - DNA, 19 bp, Homo sapiens
ttgtttttgctttctgaaa

SEQ ID NO: 4092601 - DNA, 14 bp, Homo sapiens
ttgtttttttgcca

SEQ ID NO: 4092602 - DNA, 18 bp, Homo sapiens
ttgttttttttttccact

SEQ ID NO: 4092603 - DNA, 19 bp, Homo sapiens
ttgttttttttttccactt

SEQ ID NO: 4092604 - DNA, 17 bp, Homo sapiens
tttaaaaaaatcacaaa

SEQ ID NO: 4092605 - DNA, 16 bp, Homo sapiens
tttaaaaaaatttaag

SEQ ID NO: 4092606 - DNA, 19 bp, Homo sapiens
tttaaaaaagcaacagaaa

SEQ ID NO: 4092607 - DNA, 20 bp, Homo sapiens
tttaaaaaatgaaatccttt

SEQ ID NO: 4092608 - DNA, 11 bp, Homo sapiens
tttaaaaagaa

SEQ ID NO: 4092609 - DNA, 18 bp, Homo sapiens
tttaaaaagtaagttaat

SEQ ID NO: 4092610 - DNA, 23 bp, Homo sapiens
tttaaaaagtaagttaataatgt

SEQ ID NO: 4092611 - DNA, 23 bp, Homo sapiens
tttaaaaagttgtagcagattgt

SEQ ID NO: 4092612 - DNA, 23 bp, Homo sapiens
tttaaaaatacagatagatatat

SEQ ID NO: 4092613 - DNA, 12 bp, Homo sapiens
tttaaaaatatt

SEQ ID NO: 4092614 - DNA, 18 bp, Homo sapiens
tttaaaataaaatgaaaa

SEQ ID NO: 4092615 - DNA, 17 bp, Homo sapiens
tttaaaataaattccta

SEQ ID NO: 4092616 - DNA, 24 bp, Homo sapiens
tttaaaataaattcctacaactta

SEQ ID NO: 4092617 - DNA, 21 bp, Homo sapiens
tttaaaatagaaattttgtaa

SEQ ID NO: 4092618 - DNA, 22 bp, Homo sapiens
tttaaaatagaaattttgtaag

SEQ ID NO: 4092619 - DNA, 23 bp, Homo sapiens
tttaaaatagaaattttgtaaga

SEQ ID NO: 4092620 - DNA, 16 bp, Homo sapiens
tttaaaatatttatct

SEQ ID NO: 4092621 - DNA, 22 bp, Homo sapiens
tttaaaatatttgaatgaaaac

SEQ ID NO: 4092622 - DNA, 12 bp, Homo sapiens
tttaaaatgatt

SEQ ID NO: 4092623 - DNA, 13 bp, Homo sapiens
tttaaaattcagt

SEQ ID NO: 4092624 - DNA, 20 bp, Homo sapiens
tttaaaattgtcacctctgt

SEQ ID NO: 4092625 - DNA, 23 bp, Homo sapiens
tttaaaattgtcacctctgttaa

SEQ ID NO: 4092626 - DNA, 19 bp, Homo sapiens
tttaaaatttaagtatctt

SEQ ID NO: 4092627 - DNA, 13 bp, Homo sapiens
tttaaacacacag

SEQ ID NO: 4092628 - DNA, 16 bp, Homo sapiens
tttaaacataagctaa

SEQ ID NO: 4092629 - DNA, 20 bp, Homo sapiens
tttaaacatttgttcctgga

SEQ ID NO: 4092630 - DNA, 22 bp, Homo sapiens
tttaaacctcacctttgtgggg

SEQ ID NO: 4092631 - DNA, 15 bp, Homo sapiens
tttaaagaataaagt

SEQ ID NO: 4092632 - DNA, 15 bp, Homo sapiens
tttaaagagaggtta

SEQ ID NO: 4092633 - DNA, 16 bp, Homo sapiens
tttaaagcattgcttt

SEQ ID NO: 4092634 - DNA, 18 bp, Homo sapiens
tttaaagcttactctgtc

SEQ ID NO: 4092635 - DNA, 17 bp, Homo sapiens
tttaaaggaaaaaatgt

SEQ ID NO: 4092636 - DNA, 14 bp, Homo sapiens
tttaaaggttttta

SEQ ID NO: 4092637 - DNA, 21 bp, Homo sapiens
tttaaatataattctgtaaat

SEQ ID NO: 4092638 - DNA, 16 bp, Homo sapiens
tttaaatatatatttt

SEQ ID NO: 4092639 - DNA, 17 bp, Homo sapiens
tttaaatcatgtatgtt

SEQ ID NO: 4092640 - DNA, 20 bp, Homo sapiens
tttaaatcatgtatgttatg

SEQ ID NO: 4092641 - DNA, 21 bp, Homo sapiens
tttaaatggcagtatttcatt

SEQ ID NO: 4092642 - DNA, 13 bp, Homo sapiens
tttaaatgtgaat

SEQ ID NO: 4092643 - DNA, 16 bp, Homo sapiens
tttaaatgtgaatttt

SEQ ID NO: 4092644 - DNA, 14 bp, Homo sapiens
tttaaatgtgtaca

SEQ ID NO: 4092645 - DNA, 19 bp, Homo sapiens
tttaaatgtgtacaatgta

SEQ ID NO: 4092646 - DNA, 20 bp, Homo sapiens
tttaaattataacttaaaat

SEQ ID NO: 4092647 - DNA, 19 bp, Homo sapiens
tttaaattcacaatagaaa

SEQ ID NO: 4092648 - DNA, 17 bp, Homo sapiens
tttaaattctgagacat

SEQ ID NO: 4092649 - DNA, 17 bp, Homo sapiens
tttaaattgtttcatat

SEQ ID NO: 4092650 - DNA, 14 bp, Homo sapiens
tttaaatttgttat

SEQ ID NO: 4092651 - DNA, 14 bp, Homo sapiens
tttaacaaactaaa

SEQ ID NO: 4092652 - DNA, 22 bp, Homo sapiens
tttaacaataactactgtgttc

SEQ ID NO: 4092653 - DNA, 17 bp, Homo sapiens
tttaacagctgaattat

SEQ ID NO: 4092654 - DNA, 12 bp, Homo sapiens
tttaacattatt

SEQ ID NO: 4092655 - DNA, 16 bp, Homo sapiens
tttaacctttgataga

SEQ ID NO: 4092656 - DNA, 22 bp, Homo sapiens
tttaactcatacctttaaagga

SEQ ID NO: 4092657 - DNA, 23 bp, Homo sapiens
tttaactcgagaccttttcaact

SEQ ID NO: 4092658 - DNA, 16 bp, Homo sapiens
tttaactgaaaatgta

SEQ ID NO: 4092659 - DNA, 19 bp, Homo sapiens
tttaactgaaaatgtaaat

SEQ ID NO: 4092660 - DNA, 14 bp, Homo sapiens
tttaactgccttgt

SEQ ID NO: 4092661 - DNA, 14 bp, Homo sapiens
tttaactttaagtt

SEQ ID NO: 4092662 - DNA, 18 bp, Homo sapiens
tttaactttaagtttcag

SEQ ID NO: 4092663 - DNA, 18 bp, Homo sapiens
tttaagaaaaaataacac

SEQ ID NO: 4092664 - DNA, 11 bp, Homo sapiens
tttaagaaaag

SEQ ID NO: 4092665 - DNA, 15 bp, Homo sapiens
tttaagaaaagcact

SEQ ID NO: 4092666 - DNA, 18 bp, Homo sapiens
tttaagaaaagcactttt

SEQ ID NO: 4092667 - DNA, 16 bp, Homo sapiens
tttaagaaaagtattt

SEQ ID NO: 4092668 - DNA, 20 bp, Homo sapiens
tttaagaaaagtattttgaa

SEQ ID NO: 4092669 - DNA, 21 bp, Homo sapiens
tttaagaaaagtattttgaag

SEQ ID NO: 4092670 - DNA, 22 bp, Homo sapiens
tttaagaaaagtattttgaagt

SEQ ID NO: 4092671 - DNA, 16 bp, Homo sapiens
tttaagaaaatacaat

SEQ ID NO: 4092672 - DNA, 15 bp, Homo sapiens
tttaagaatatctgt

SEQ ID NO: 4092673 - DNA, 15 bp, Homo sapiens
tttaagataatagtt

SEQ ID NO: 4092674 - DNA, 20 bp, Homo sapiens
tttaagataatagtttacat

SEQ ID NO: 4092675 - DNA, 18 bp, Homo sapiens
tttaagatatccatcttt

SEQ ID NO: 4092676 - DNA, 14 bp, Homo sapiens
tttaagatttttct

SEQ ID NO: 4092677 - DNA, 16 bp, Homo sapiens
tttaagatttttctca

SEQ ID NO: 4092678 - DNA, 16 bp, Homo sapiens
tttaagcaaatgcatt

SEQ ID NO: 4092679 - DNA, 15 bp, Homo sapiens
tttaagcaacatctt

SEQ ID NO: 4092680 - DNA, 17 bp, Homo sapiens
tttaagcaacatctttt

SEQ ID NO: 4092681 - DNA, 14 bp, Homo sapiens
tttaagcattgttt

SEQ ID NO: 4092682 - DNA, 19 bp, Homo sapiens
tttaagcctcatatttaaa

SEQ ID NO: 4092683 - DNA, 11 bp, Homo sapiens
tttaagctgtt

SEQ ID NO: 4092684 - DNA, 12 bp, Homo sapiens
tttaagctgttt

SEQ ID NO: 4092685 - DNA, 16 bp, Homo sapiens
tttaaggtttttactg

SEQ ID NO: 4092686 - DNA, 20 bp, Homo sapiens
tttaagtactacacattttt

SEQ ID NO: 4092687 - DNA, 21 bp, Homo sapiens
tttaagtactacacattttta

SEQ ID NO: 4092688 - DNA, 15 bp, Homo sapiens
tttaagtattaactt

SEQ ID NO: 4092689 - DNA, 13 bp, Homo sapiens
tttaagtatttat

SEQ ID NO: 4092690 - DNA, 21 bp, Homo sapiens
tttaagtgcgtgtgtagagtt

SEQ ID NO: 4092691 - DNA, 22 bp, Homo sapiens
tttaagtttcaaacttactatt

SEQ ID NO: 4092692 - DNA, 18 bp, Homo sapiens
tttaagtttgcagattta

SEQ ID NO: 4092693 - DNA, 20 bp, Homo sapiens
tttaataaactactctttga

SEQ ID NO: 4092694 - DNA, 15 bp, Homo sapiens
tttaataattagaaa

SEQ ID NO: 4092695 - DNA, 15 bp, Homo sapiens
tttaatagaaataaa

SEQ ID NO: 4092696 - DNA, 15 bp, Homo sapiens
tttaatagactgagt

SEQ ID NO: 4092697 - DNA, 15 bp, Homo sapiens
tttaatatcttcagc

SEQ ID NO: 4092698 - DNA, 15 bp, Homo sapiens
tttaatattgagaaa

SEQ ID NO: 4092699 - DNA, 15 bp, Homo sapiens
tttaatatttaaaca

SEQ ID NO: 4092700 - DNA, 11 bp, Homo sapiens
ttgtctcagaa

SEQ ID NO: 4092701 - DNA, 17 bp, Homo sapiens
ttgtctcctactcctga

SEQ ID NO: 4092702 - DNA, 12 bp, Homo sapiens
ttgtctctgggc

SEQ ID NO: 4092703 - DNA, 13 bp, Homo sapiens
ttgtcttatatat

SEQ ID NO: 4092704 - DNA, 15 bp, Homo sapiens
ttgtcttatatatat

SEQ ID NO: 4092705 - DNA, 17 bp, Homo sapiens
ttgtcttcaaactgtga

SEQ ID NO: 4092706 - DNA, 23 bp, Homo sapiens
ttgtcttcagcagtcaatacaaa

SEQ ID NO: 4092707 - DNA, 14 bp, Homo sapiens
ttgtctttctgggg

SEQ ID NO: 4092708 - DNA, 14 bp, Homo sapiens
ttgtctttttataa

SEQ ID NO: 4092709 - DNA, 17 bp, Homo sapiens
ttgtctttttataaaaa

SEQ ID NO: 4092710 - DNA, 22 bp, Homo sapiens
ttgtgaaagaaagctgagaaga

SEQ ID NO: 4092711 - DNA, 19 bp, Homo sapiens
ttgtgaaagaggtcccaag

SEQ ID NO: 4092712 - DNA, 11 bp, Homo sapiens
ttgtgaacaga

SEQ ID NO: 4092713 - DNA, 15 bp, Homo sapiens
ttgtgaatggattgg

SEQ ID NO: 4092714 - DNA, 21 bp, Homo sapiens
ttgtgatagcactttctacaa

SEQ ID NO: 4092715 - DNA, 19 bp, Homo sapiens
ttgtgatgatgctgtgaca

SEQ ID NO: 4092716 - DNA, 15 bp, Homo sapiens
ttgtgattggcctgt

SEQ ID NO: 4092717 - DNA, 18 bp, Homo sapiens
ttgtgcacatttatttcc

SEQ ID NO: 4092718 - DNA, 15 bp, Homo sapiens
ttgtgcatttgtaaa

SEQ ID NO: 4092719 - DNA, 16 bp, Homo sapiens
ttgtgccaactgccag

SEQ ID NO: 4092720 - DNA, 14 bp, Homo sapiens
ttgtgcctttggcc

SEQ ID NO: 4092721 - DNA, 21 bp, Homo sapiens
ttgtgctcctcttgattcctg

SEQ ID NO: 4092722 - DNA, 12 bp, Homo sapiens
ttgtgctgccat

SEQ ID NO: 4092723 - DNA, 19 bp, Homo sapiens
ttgtgctgtgggcagcacc

SEQ ID NO: 4092724 - DNA, 15 bp, Homo sapiens
ttgtgctttgctctt

SEQ ID NO: 4092725 - DNA, 12 bp, Homo sapiens
ttgtggcctcag

SEQ ID NO: 4092726 - DNA, 15 bp, Homo sapiens
ttgtggcgtctccct

SEQ ID NO: 4092727 - DNA, 11 bp, Homo sapiens
ttgtgggctgg

SEQ ID NO: 4092728 - DNA, 17 bp, Homo sapiens
ttgtggttttcaaattg

SEQ ID NO: 4092729 - DNA, 16 bp, Homo sapiens
ttgtgtaaaaaatgga

SEQ ID NO: 4092730 - DNA, 19 bp, Homo sapiens
ttgtgtaaaaaatggaaaa

SEQ ID NO: 4092731 - DNA, 24 bp, Homo sapiens
ttgtgtaatgaaaatgaatatcta

SEQ ID NO: 4092732 - DNA, 15 bp, Homo sapiens
ttgtgtacaagttgt

SEQ ID NO: 4092733 - DNA, 14 bp, Homo sapiens
ttgtgtagcctttt

SEQ ID NO: 4092734 - DNA, 14 bp, Homo sapiens
ttgtgtatatttgt

SEQ ID NO: 4092735 - DNA, 11 bp, Homo sapiens
ttgtgtatgtt

SEQ ID NO: 4092736 - DNA, 18 bp, Homo sapiens
ttgtgtcccatgatccct

SEQ ID NO: 4092737 - DNA, 13 bp, Homo sapiens
ttgtgtgtactca

SEQ ID NO: 4092738 - DNA, 13 bp, Homo sapiens
ttgtgtgtcttaa

SEQ ID NO: 4092739 - DNA, 13 bp, Homo sapiens
ttgtgttctgctc

SEQ ID NO: 4092740 - DNA, 12 bp, Homo sapiens
ttgtgttgtaat

SEQ ID NO: 4092741 - DNA, 17 bp, Homo sapiens
ttgtgtttgcttaaaca

SEQ ID NO: 4092742 - DNA, 20 bp, Homo sapiens
ttgtgtttgcttaaacaaag

SEQ ID NO: 4092743 - DNA, 16 bp, Homo sapiens
ttgtgtttgcttggtg

SEQ ID NO: 4092744 - DNA, 17 bp, Homo sapiens
ttgtgtttggtttacat

SEQ ID NO: 4092745 - DNA, 19 bp, Homo sapiens
ttgtgtttggtttacattt

SEQ ID NO: 4092746 - DNA, 17 bp, Homo sapiens
ttgtgtttttaatttat

SEQ ID NO: 4092747 - DNA, 18 bp, Homo sapiens
ttgtgtttttaatttatt

SEQ ID NO: 4092748 - DNA, 17 bp, Homo sapiens
ttgtgttttttaagata

SEQ ID NO: 4092749 - DNA, 18 bp, Homo sapiens
ttgttaactcttgtctat

SEQ ID NO: 4092750 - DNA, 22 bp, Homo sapiens
ttgttaactcttgtctattttt

SEQ ID NO: 4092751 - DNA, 22 bp, Homo sapiens
ttgttaagtctaaatatttcct

SEQ ID NO: 4092752 - DNA, 18 bp, Homo sapiens
ttgttaatgaaaatgtca

SEQ ID NO: 4092753 - DNA, 13 bp, Homo sapiens
ttgttaatgcttt

SEQ ID NO: 4092754 - DNA, 21 bp, Homo sapiens
ttgttacctccaacagaacta

SEQ ID NO: 4092755 - DNA, 12 bp, Homo sapiens
ttgttaccttta

SEQ ID NO: 4092756 - DNA, 17 bp, Homo sapiens
ttgttagcccttcagat

SEQ ID NO: 4092757 - DNA, 21 bp, Homo sapiens
ttgttagcccttcagattgtt

SEQ ID NO: 4092758 - DNA, 17 bp, Homo sapiens
ttgttagtttacaatat

SEQ ID NO: 4092759 - DNA, 14 bp, Homo sapiens
ttgttattccatca

SEQ ID NO: 4092760 - DNA, 13 bp, Homo sapiens
ttgttattcctag

SEQ ID NO: 4092761 - DNA, 13 bp, Homo sapiens
ttgttcaagtttt

SEQ ID NO: 4092762 - DNA, 20 bp, Homo sapiens
ttgttcaataataaatattt

SEQ ID NO: 4092763 - DNA, 22 bp, Homo sapiens
ttgttcagctcccccaggctgt

SEQ ID NO: 4092764 - DNA, 21 bp, Homo sapiens
ttgttccacaagttaaataaa

SEQ ID NO: 4092765 - DNA, 12 bp, Homo sapiens
ttgttccagaga

SEQ ID NO: 4092766 - DNA, 11 bp, Homo sapiens
ttgttccagtt

SEQ ID NO: 4092767 - DNA, 11 bp, Homo sapiens
ttgttcctgga

SEQ ID NO: 4092768 - DNA, 13 bp, Homo sapiens
ttgttcctggagt

SEQ ID NO: 4092769 - DNA, 16 bp, Homo sapiens
ttgttcgggtgtgcaa

SEQ ID NO: 4092770 - DNA, 17 bp, Homo sapiens
ttgttcgggtgtgcaat

SEQ ID NO: 4092771 - DNA, 22 bp, Homo sapiens
ttgttctacatggctttgataa

SEQ ID NO: 4092772 - DNA, 16 bp, Homo sapiens
ttgttctgactttttg

SEQ ID NO: 4092773 - DNA, 22 bp, Homo sapiens
ttgttctgactttttgtttctt

SEQ ID NO: 4092774 - DNA, 18 bp, Homo sapiens
ttgttcttattctggcat

SEQ ID NO: 4092775 - DNA, 16 bp, Homo sapiens
ttgttgaacatacttc

SEQ ID NO: 4092776 - DNA, 22 bp, Homo sapiens
ttgttgagcatgacagcctgca

SEQ ID NO: 4092777 - DNA, 23 bp, Homo sapiens
ttgttgatgggcacttgagaact

SEQ ID NO: 4092778 - DNA, 17 bp, Homo sapiens
ttgttgattctctccat

SEQ ID NO: 4092779 - DNA, 14 bp, Homo sapiens
ttgttgcggatgga

SEQ ID NO: 4092780 - DNA, 19 bp, Homo sapiens
ttgttggctatttgaaata

SEQ ID NO: 4092781 - DNA, 14 bp, Homo sapiens
ttgttggtcagagg

SEQ ID NO: 4092782 - DNA, 15 bp, Homo sapiens
ttgttgtaacctgct

SEQ ID NO: 4092783 - DNA, 9 bp, Homo sapiens
ttgtttata

SEQ ID NO: 4092784 - DNA, 19 bp, Homo sapiens
ttgtttatcagatacatca

SEQ ID NO: 4092785 - DNA, 20 bp, Homo sapiens
ttgtttatttatcagtgaca

SEQ ID NO: 4092786 - DNA, 14 bp, Homo sapiens
ttgtttcaagaacc

SEQ ID NO: 4092787 - DNA, 20 bp, Homo sapiens
ttgtttcaagaacctggaaa

SEQ ID NO: 4092788 - DNA, 19 bp, Homo sapiens
ttgtttcctcttccaaagt

SEQ ID NO: 4092789 - DNA, 14 bp, Homo sapiens
ttgtttctgaccca

SEQ ID NO: 4092790 - DNA, 13 bp, Homo sapiens
ttgtttcttccaa

SEQ ID NO: 4092791 - DNA, 22 bp, Homo sapiens
ttgtttgagtttttcctcccag

SEQ ID NO: 4092792 - DNA, 22 bp, Homo sapiens
ttgtttgatctacttcatagct

SEQ ID NO: 4092793 - DNA, 16 bp, Homo sapiens
ttgtttgggtatcctg

SEQ ID NO: 4092794 - DNA, 15 bp, Homo sapiens
ttgtttgtcacaagt

SEQ ID NO: 4092795 - DNA, 12 bp, Homo sapiens
ttgtttgtctgt

SEQ ID NO: 4092796 - DNA, 10 bp, Homo sapiens
ttgtttgttt

SEQ ID NO: 4092797 - DNA, 13 bp, Homo sapiens
ttgtttgtttctt

SEQ ID NO: 4092798 - DNA, 14 bp, Homo sapiens
ttgtttgtttcttt

SEQ ID NO: 4092799 - DNA, 15 bp, Homo sapiens
ttgtttgtttttgct

SEQ ID NO: 4092800 - DNA, 14 bp, Homo sapiens
ttgttttaatctga

SEQ ID NO: 4092801 - DNA, 16 bp, Homo sapiens
ttgttttatatacctg

SEQ ID NO: 4092802 - DNA, 18 bp, Homo sapiens
ttgttttcttctgtatgt

SEQ ID NO: 4092803 - DNA, 20 bp, Homo sapiens
ttgttttcttctgtatgtta

SEQ ID NO: 4092804 - DNA, 14 bp, Homo sapiens
ttgttttgcacttt

SEQ ID NO: 4092805 - DNA, 19 bp, Homo sapiens
ttggttattctaagccctt

SEQ ID NO: 4092806 - DNA, 14 bp, Homo sapiens
ttggttcattaatt

SEQ ID NO: 4092807 - DNA, 19 bp, Homo sapiens
ttggttctctccaggaagg

SEQ ID NO: 4092808 - DNA, 13 bp, Homo sapiens
ttggttggaagct

SEQ ID NO: 4092809 - DNA, 18 bp, Homo sapiens
ttggttggtagggtggga

SEQ ID NO: 4092810 - DNA, 18 bp, Homo sapiens
ttggttgttttttccttt

SEQ ID NO: 4092811 - DNA, 20 bp, Homo sapiens
ttggtttacatttaaagcat

SEQ ID NO: 4092812 - DNA, 21 bp, Homo sapiens
ttggtttacatttaaagcatt

SEQ ID NO: 4092813 - DNA, 16 bp, Homo sapiens
ttggtttctcttctcc

SEQ ID NO: 4092814 - DNA, 22 bp, Homo sapiens
ttggtttgtggcgtctccctcg

SEQ ID NO: 4092815 - DNA, 23 bp, Homo sapiens
ttggttttatggttacttcttct

SEQ ID NO: 4092816 - DNA, 19 bp, Homo sapiens
ttggtttttatttctcctt

SEQ ID NO: 4092817 - DNA, 15 bp, Homo sapiens
ttgtaaaaaaaaatg

SEQ ID NO: 4092818 - DNA, 16 bp, Homo sapiens
ttgtaaaaaaaaatgc

SEQ ID NO: 4092819 - DNA, 17 bp, Homo sapiens
ttgtaaaaaaaaatgcc

SEQ ID NO: 4092820 - DNA, 19 bp, Homo sapiens
ttgtaaaaaaaaatgcctt

SEQ ID NO: 4092821 - DNA, 22 bp, Homo sapiens
ttgtaaaaaaaaatgcctttga

SEQ ID NO: 4092822 - DNA, 15 bp, Homo sapiens
ttgtaaaagaaatca

SEQ ID NO: 4092823 - DNA, 18 bp, Homo sapiens
ttgtaaaagaaatcatgt

SEQ ID NO: 4092824 - DNA, 23 bp, Homo sapiens
ttgtaaaagaacagtaaacattg

SEQ ID NO: 4092825 - DNA, 21 bp, Homo sapiens
ttgtaaataagagatttggag

SEQ ID NO: 4092826 - DNA, 19 bp, Homo sapiens
ttgtaaatatttatgtaaa

SEQ ID NO: 4092827 - DNA, 14 bp, Homo sapiens
ttgtaaatgatttt

SEQ ID NO: 4092828 - DNA, 17 bp, Homo sapiens
ttgtaaatgattttaat

SEQ ID NO: 4092829 - DNA, 22 bp, Homo sapiens
ttgtaaattatttgctaagcat

SEQ ID NO: 4092830 - DNA, 19 bp, Homo sapiens
ttgtaacacagtcattcta

SEQ ID NO: 4092831 - DNA, 15 bp, Homo sapiens
ttgtaaccatttctc

SEQ ID NO: 4092832 - DNA, 23 bp, Homo sapiens
ttgtaaccatttctcactagtgt

SEQ ID NO: 4092833 - DNA, 20 bp, Homo sapiens
ttgtaacctcagctctggga

SEQ ID NO: 4092834 - DNA, 12 bp, Homo sapiens
ttgtaacctgct

SEQ ID NO: 4092835 - DNA, 22 bp, Homo sapiens
ttgtaactatgtttaaagtaat

SEQ ID NO: 4092836 - DNA, 13 bp, Homo sapiens
ttgtaagaaggca

SEQ ID NO: 4092837 - DNA, 15 bp, Homo sapiens
ttgtaagaaggcaat

SEQ ID NO: 4092838 - DNA, 20 bp, Homo sapiens
ttgtaagaaggcaatattaa

SEQ ID NO: 4092839 - DNA, 20 bp, Homo sapiens
ttgtaagtcagtgttgagat

SEQ ID NO: 4092840 - DNA, 18 bp, Homo sapiens
ttgtaagtttcaggtgac

SEQ ID NO: 4092841 - DNA, 13 bp, Homo sapiens
ttgtaatatctaa

SEQ ID NO: 4092842 - DNA, 14 bp, Homo sapiens
ttgtaatattttta

SEQ ID NO: 4092843 - DNA, 17 bp, Homo sapiens
ttgtaatctgaataaag

SEQ ID NO: 4092844 - DNA, 15 bp, Homo sapiens
ttgtaatgttactga

SEQ ID NO: 4092845 - DNA, 15 bp, Homo sapiens
ttgtaattatgattt

SEQ ID NO: 4092846 - DNA, 14 bp, Homo sapiens
ttgtaattctaaat

SEQ ID NO: 4092847 - DNA, 16 bp, Homo sapiens
ttgtaattcttcagtt

SEQ ID NO: 4092848 - DNA, 17 bp, Homo sapiens
ttgtaattcttcagttg

SEQ ID NO: 4092849 - DNA, 22 bp, Homo sapiens
ttgtaattgcttttttaaatat

SEQ ID NO: 4092850 - DNA, 14 bp, Homo sapiens
ttgtaattgtgtaa

SEQ ID NO: 4092851 - DNA, 23 bp, Homo sapiens
ttgtaatttaaacatttgttcct

SEQ ID NO: 4092852 - DNA, 15 bp, Homo sapiens
ttgtacaaatgtatt

SEQ ID NO: 4092853 - DNA, 17 bp, Homo sapiens
ttgtacaaatgtatttt

SEQ ID NO: 4092854 - DNA, 22 bp, Homo sapiens
ttgtacagaatatttctattga

SEQ ID NO: 4092855 - DNA, 18 bp, Homo sapiens
ttgtacagaattttggaa

SEQ ID NO: 4092856 - DNA, 18 bp, Homo sapiens
ttgtaccatcattttatt

SEQ ID NO: 4092857 - DNA, 15 bp, Homo sapiens
ttgtaccattttcta

SEQ ID NO: 4092858 - DNA, 21 bp, Homo sapiens
ttgtactgaatttttttgtaa

SEQ ID NO: 4092859 - DNA, 22 bp, Homo sapiens
ttgtactgaatttttttgtaat

SEQ ID NO: 4092860 - DNA, 19 bp, Homo sapiens
ttgtagcagattgtttcct

SEQ ID NO: 4092861 - DNA, 22 bp, Homo sapiens
ttgtaggatttttttcctcccc

SEQ ID NO: 4092862 - DNA, 19 bp, Homo sapiens
ttgtaggtgcaagatggaa

SEQ ID NO: 4092863 - DNA, 21 bp, Homo sapiens
ttgtagtagcgttttttaaat

SEQ ID NO: 4092864 - DNA, 20 bp, Homo sapiens
ttgtagtagtctcattactt

SEQ ID NO: 4092865 - DNA, 19 bp, Homo sapiens
ttgtagttacctactgagt

SEQ ID NO: 4092866 - DNA, 14 bp, Homo sapiens
ttgtagttgtttta

SEQ ID NO: 4092867 - DNA, 12 bp, Homo sapiens
ttgtataaaata

SEQ ID NO: 4092868 - DNA, 12 bp, Homo sapiens
ttgtataatttc

SEQ ID NO: 4092869 - DNA, 16 bp, Homo sapiens
ttgtatagaccaaagc

SEQ ID NO: 4092870 - DNA, 17 bp, Homo sapiens
ttgtatagaccaaagca

SEQ ID NO: 4092871 - DNA, 16 bp, Homo sapiens
ttgtatatacagttat

SEQ ID NO: 4092872 - DNA, 20 bp, Homo sapiens
ttgtatatacagttattttg

SEQ ID NO: 4092873 - DNA, 16 bp, Homo sapiens
ttgtatattgtcagat

SEQ ID NO: 4092874 - DNA, 17 bp, Homo sapiens
ttgtatatttgtacaaa

SEQ ID NO: 4092875 - DNA, 13 bp, Homo sapiens
ttgtatctagtgc

SEQ ID NO: 4092876 - DNA, 18 bp, Homo sapiens
ttgtatctagtgcagctg

SEQ ID NO: 4092877 - DNA, 20 bp, Homo sapiens
ttgtatctagtgcagctgat

SEQ ID NO: 4092878 - DNA, 14 bp, Homo sapiens
ttgtatcttaaatt

SEQ ID NO: 4092879 - DNA, 15 bp, Homo sapiens
ttgtatgcaatggat

SEQ ID NO: 4092880 - DNA, 15 bp, Homo sapiens
ttgtattaaactctt

SEQ ID NO: 4092881 - DNA, 13 bp, Homo sapiens
ttgtattacagat

SEQ ID NO: 4092882 - DNA, 15 bp, Homo sapiens
ttgtattgctgctgt

SEQ ID NO: 4092883 - DNA, 16 bp, Homo sapiens
ttgtattgctgctgtg

SEQ ID NO: 4092884 - DNA, 17 bp, Homo sapiens
ttgtattttttaaaaca

SEQ ID NO: 4092885 - DNA, 20 bp, Homo sapiens
ttgtattttttaaaacacta

SEQ ID NO: 4092886 - DNA, 19 bp, Homo sapiens
ttgtcaatatttaaacatg

SEQ ID NO: 4092887 - DNA, 14 bp, Homo sapiens
ttgtcacaataaat

SEQ ID NO: 4092888 - DNA, 23 bp, Homo sapiens
ttgtcacaatcctaacacattat

SEQ ID NO: 4092889 - DNA, 21 bp, Homo sapiens
ttgtcactttttatgctattt

SEQ ID NO: 4092890 - DNA, 18 bp, Homo sapiens
ttgtcagatatgatatgt

SEQ ID NO: 4092891 - DNA, 21 bp, Homo sapiens
ttgtcatataagattcatatt

SEQ ID NO: 4092892 - DNA, 18 bp, Homo sapiens
ttgtcattccagagtgct

SEQ ID NO: 4092893 - DNA, 14 bp, Homo sapiens
ttgtccacccacct

SEQ ID NO: 4092894 - DNA, 14 bp, Homo sapiens
ttgtcccatttcct

SEQ ID NO: 4092895 - DNA, 19 bp, Homo sapiens
ttgtcccatttccttggag

SEQ ID NO: 4092896 - DNA, 14 bp, Homo sapiens
ttgtcccctcttga

SEQ ID NO: 4092897 - DNA, 16 bp, Homo sapiens
ttgtccctctgctacg

SEQ ID NO: 4092898 - DNA, 15 bp, Homo sapiens
ttgtcctaagtgtca

SEQ ID NO: 4092899 - DNA, 16 bp, Homo sapiens
ttgtcctcctgctgcc

SEQ ID NO: 4092900 - DNA, 17 bp, Homo sapiens
ttgtcctcctgctgcca

SEQ ID NO: 4092901 - DNA, 23 bp, Homo sapiens
ttgtcctgatgcttttgtctaat

SEQ ID NO: 4092902 - DNA, 15 bp, Homo sapiens
ttgtcctttcccttc

SEQ ID NO: 4092903 - DNA, 17 bp, Homo sapiens
ttgtcctttcccttcag

SEQ ID NO: 4092904 - DNA, 17 bp, Homo sapiens
ttgtcgtaaagatttgg

SEQ ID NO: 4092905 - DNA, 15 bp, Homo sapiens
ttgtctaactcagaa

SEQ ID NO: 4092906 - DNA, 13 bp, Homo sapiens
ttgtctattttaa

SEQ ID NO: 4092907 - DNA, 16 bp, Homo sapiens
ttgtctatttttgtct

SEQ ID NO: 4092908 - DNA, 15 bp, Homo sapiens
ttggagtcactgcca

SEQ ID NO: 4092909 - DNA, 23 bp, Homo sapiens
ttggagtcccctcacctcctcta

SEQ ID NO: 4092910 - DNA, 19 bp, Homo sapiens
ttggatatttttgtacttg

SEQ ID NO: 4092911 - DNA, 14 bp, Homo sapiens
ttggatgggagtgg

SEQ ID NO: 4092912 - DNA, 24 bp, Homo sapiens
ttggatgggagtgggcacctcaga

SEQ ID NO: 4092913 - DNA, 13 bp, Homo sapiens
ttggattattcat

SEQ ID NO: 4092914 - DNA, 20 bp, Homo sapiens
ttggattattcatttaaaat

SEQ ID NO: 4092915 - DNA, 23 bp, Homo sapiens
ttggattattcatttaaaatgat

SEQ ID NO: 4092916 - DNA, 15 bp, Homo sapiens
ttggattatttaata

SEQ ID NO: 4092917 - DNA, 17 bp, Homo sapiens
ttggattatttaataac

SEQ ID NO: 4092918 - DNA, 20 bp, Homo sapiens
ttggatttcctttatactgt

SEQ ID NO: 4092919 - DNA, 14 bp, Homo sapiens
ttggatttgacatt

SEQ ID NO: 4092920 - DNA, 22 bp, Homo sapiens
ttggatttgacattgcgtttga

SEQ ID NO: 4092921 - DNA, 20 bp, Homo sapiens
ttggattttgcaaggtgcat

SEQ ID NO: 4092922 - DNA, 19 bp, Homo sapiens
ttggcaacaggacagagtt

SEQ ID NO: 4092923 - DNA, 20 bp, Homo sapiens
ttggcaacaggacagagttc

SEQ ID NO: 4092924 - DNA, 17 bp, Homo sapiens
ttggcaagatgaaataa

SEQ ID NO: 4092925 - DNA, 13 bp, Homo sapiens
ttggcaaggaaag

SEQ ID NO: 4092926 - DNA, 16 bp, Homo sapiens
ttggcaatattcctta

SEQ ID NO: 4092927 - DNA, 16 bp, Homo sapiens
ttggcacatgccacct

SEQ ID NO: 4092928 - DNA, 13 bp, Homo sapiens
ttggcaccagaca

SEQ ID NO: 4092929 - DNA, 13 bp, Homo sapiens
ttggcagatgcag

SEQ ID NO: 4092930 - DNA, 20 bp, Homo sapiens
ttggcataatagtcaatttc

SEQ ID NO: 4092931 - DNA, 20 bp, Homo sapiens
ttggccaaacatcagacctg

SEQ ID NO: 4092932 - DNA, 19 bp, Homo sapiens
ttggccacctgtagccatc

SEQ ID NO: 4092933 - DNA, 21 bp, Homo sapiens
ttggccacctgtagccatctg

SEQ ID NO: 4092934 - DNA, 22 bp, Homo sapiens
ttggccacctgtagccatctgc

SEQ ID NO: 4092935 - DNA, 14 bp, Homo sapiens
ttggcccctgtgtg

SEQ ID NO: 4092936 - DNA, 22 bp, Homo sapiens
ttggcccctgtgtgagttgagt

SEQ ID NO: 4092937 - DNA, 14 bp, Homo sapiens
ttggccctttcctt

SEQ ID NO: 4092938 - DNA, 22 bp, Homo sapiens
ttggccgggtgcggtggctcac

SEQ ID NO: 4092939 - DNA, 16 bp, Homo sapiens
ttggcctgtctcatcc

SEQ ID NO: 4092940 - DNA, 22 bp, Homo sapiens
ttggcctgtctcatccccaggg

SEQ ID NO: 4092941 - DNA, 20 bp, Homo sapiens
ttggctaactatatttgctt

SEQ ID NO: 4092942 - DNA, 17 bp, Homo sapiens
ttggctatttaaaactt

SEQ ID NO: 4092943 - DNA, 16 bp, Homo sapiens
ttggctatttgaaata

SEQ ID NO: 4092944 - DNA, 14 bp, Homo sapiens
ttggctgacccctc

SEQ ID NO: 4092945 - DNA, 12 bp, Homo sapiens
ttggctgagggg

SEQ ID NO: 4092946 - DNA, 18 bp, Homo sapiens
ttggctgaggggcttggg

SEQ ID NO: 4092947 - DNA, 17 bp, Homo sapiens
ttggctgtgaggcccct

SEQ ID NO: 4092948 - DNA, 17 bp, Homo sapiens
ttggcttactgcagcct

SEQ ID NO: 4092949 - DNA, 15 bp, Homo sapiens
ttggcttataaacac

SEQ ID NO: 4092950 - DNA, 21 bp, Homo sapiens
ttggctttgcccacccctcac

SEQ ID NO: 4092951 - DNA, 16 bp, Homo sapiens
ttggctttttcagagt

SEQ ID NO: 4092952 - DNA, 22 bp, Homo sapiens
ttgggaaattaaatccaataaa

SEQ ID NO: 4092953 - DNA, 10 bp, Homo sapiens
ttgggaagaa

SEQ ID NO: 4092954 - DNA, 19 bp, Homo sapiens
ttgggaatatccatgtact

SEQ ID NO: 4092955 - DNA, 20 bp, Homo sapiens
ttgggaatgaaattaacaca

SEQ ID NO: 4092956 - DNA, 13 bp, Homo sapiens
ttgggacagccag

SEQ ID NO: 4092957 - DNA, 16 bp, Homo sapiens
ttgggacagccagagc

SEQ ID NO: 4092958 - DNA, 17 bp, Homo sapiens
ttgggagacatgtgaca

SEQ ID NO: 4092959 - DNA, 21 bp, Homo sapiens
ttgggagcaaaataaggaaga

SEQ ID NO: 4092960 - DNA, 11 bp, Homo sapiens
ttgggagcact

SEQ ID NO: 4092961 - DNA, 20 bp, Homo sapiens
ttgggatagtgttctgctcc

SEQ ID NO: 4092962 - DNA, 13 bp, Homo sapiens
ttgggatttgctg

SEQ ID NO: 4092963 - DNA, 14 bp, Homo sapiens
ttgggatttgctgt

SEQ ID NO: 4092964 - DNA, 17 bp, Homo sapiens
ttgggccagacatgcca

SEQ ID NO: 4092965 - DNA, 16 bp, Homo sapiens
ttgggcctgctccaga

SEQ ID NO: 4092966 - DNA, 17 bp, Homo sapiens
ttgggcctgctccagac

SEQ ID NO: 4092967 - DNA, 20 bp, Homo sapiens
ttgggcctgggcctctgccc

SEQ ID NO: 4092968 - DNA, 12 bp, Homo sapiens
ttgggctcccaa

SEQ ID NO: 4092969 - DNA, 13 bp, Homo sapiens
ttgggctctgctg

SEQ ID NO: 4092970 - DNA, 21 bp, Homo sapiens
ttgggcttagtatttctcagg

SEQ ID NO: 4092971 - DNA, 17 bp, Homo sapiens
ttggggaaaaaagcaca

SEQ ID NO: 4092972 - DNA, 22 bp, Homo sapiens
ttggggaaaaaagcacatacat

SEQ ID NO: 4092973 - DNA, 20 bp, Homo sapiens
ttggggaaacctagagaaga

SEQ ID NO: 4092974 - DNA, 14 bp, Homo sapiens
ttggggagggaggg

SEQ ID NO: 4092975 - DNA, 19 bp, Homo sapiens
ttggggagttaagacctgg

SEQ ID NO: 4092976 - DNA, 15 bp, Homo sapiens
ttggggcaaaaatcc

SEQ ID NO: 4092977 - DNA, 19 bp, Homo sapiens
ttggggcaagactgcaaac

SEQ ID NO: 4092978 - DNA, 21 bp, Homo sapiens
ttggggtactcttgatgtgaa

SEQ ID NO: 4092979 - DNA, 13 bp, Homo sapiens
ttggggtcagcca

SEQ ID NO: 4092980 - DNA, 17 bp, Homo sapiens
ttggggtcctgggctgg

SEQ ID NO: 4092981 - DNA, 14 bp, Homo sapiens
ttggggtctgaccc

SEQ ID NO: 4092982 - DNA, 15 bp, Homo sapiens
ttggggtctgacccc

SEQ ID NO: 4092983 - DNA, 16 bp, Homo sapiens
ttggggtctgccacca

SEQ ID NO: 4092984 - DNA, 13 bp, Homo sapiens
ttggggtgacagt

SEQ ID NO: 4092985 - DNA, 18 bp, Homo sapiens
ttggggtgtggggtgggg

SEQ ID NO: 4092986 - DNA, 19 bp, Homo sapiens
ttggggtgtggggtggggt

SEQ ID NO: 4092987 - DNA, 16 bp, Homo sapiens
ttggggttaagtctcc

SEQ ID NO: 4092988 - DNA, 23 bp, Homo sapiens
ttgggtagaaagagatacagagg

SEQ ID NO: 4092989 - DNA, 20 bp, Homo sapiens
ttgggtcattgacctctcag

SEQ ID NO: 4092990 - DNA, 18 bp, Homo sapiens
ttggtaaaactcactgtg

SEQ ID NO: 4092991 - DNA, 13 bp, Homo sapiens
ttggtaataacaa

SEQ ID NO: 4092992 - DNA, 14 bp, Homo sapiens
ttggtaataacaaa

SEQ ID NO: 4092993 - DNA, 20 bp, Homo sapiens
ttggtataatgtttaaatca

SEQ ID NO: 4092994 - DNA, 17 bp, Homo sapiens
ttggtatatccttttct

SEQ ID NO: 4092995 - DNA, 13 bp, Homo sapiens
ttggtcagaggag

SEQ ID NO: 4092996 - DNA, 15 bp, Homo sapiens
ttggtcagaggagtg

SEQ ID NO: 4092997 - DNA, 13 bp, Homo sapiens
ttggtccaaaaaa

SEQ ID NO: 4092998 - DNA, 19 bp, Homo sapiens
ttggtccaaaaaaaggaaa

SEQ ID NO: 4092999 - DNA, 12 bp, Homo sapiens
ttggtccagagc

SEQ ID NO: 4093000 - DNA, 22 bp, Homo sapiens
ttggtccagagcggaggctgtg

SEQ ID NO: 4093001 - DNA, 17 bp, Homo sapiens
ttggtgaatttcacaag

SEQ ID NO: 4093002 - DNA, 14 bp, Homo sapiens
ttggtgactgtccc

SEQ ID NO: 4093003 - DNA, 21 bp, Homo sapiens
ttggtgcaacccttacccctt

SEQ ID NO: 4093004 - DNA, 18 bp, Homo sapiens
ttggtgccttttgtgtga

SEQ ID NO: 4093005 - DNA, 13 bp, Homo sapiens
ttggtggatgtga

SEQ ID NO: 4093006 - DNA, 16 bp, Homo sapiens
ttggtggtgaaattga

SEQ ID NO: 4093007 - DNA, 12 bp, Homo sapiens
ttggtggttttt

SEQ ID NO: 4093008 - DNA, 20 bp, Homo sapiens
ttggtgtaatttgaagattg

SEQ ID NO: 4093009 - DNA, 15 bp, Homo sapiens
ttggttaaaactgta

SEQ ID NO: 4093010 - DNA, 22 bp, Homo sapiens
ttggttaaaactgtacatttaa

SEQ ID NO: 4093011 - DNA, 18 bp, Homo sapiens
ttgccttctactcccctt

SEQ ID NO: 4093012 - DNA, 19 bp, Homo sapiens
ttgccttcttcacccagct

SEQ ID NO: 4093013 - DNA, 14 bp, Homo sapiens
ttgccttctttgaa

SEQ ID NO: 4093014 - DNA, 16 bp, Homo sapiens
ttgccttctttgaaga

SEQ ID NO: 4093015 - DNA, 14 bp, Homo sapiens
ttgccttgcagcca

SEQ ID NO: 4093016 - DNA, 20 bp, Homo sapiens
ttgccttgcagccacatggc

SEQ ID NO: 4093017 - DNA, 20 bp, Homo sapiens
ttgcctttatctctgaggct

SEQ ID NO: 4093018 - DNA, 21 bp, Homo sapiens
ttgcctttcctgctacatttg

SEQ ID NO: 4093019 - DNA, 18 bp, Homo sapiens
ttgcctttcgaggcctga

SEQ ID NO: 4093020 - DNA, 14 bp, Homo sapiens
ttgcctttctggga

SEQ ID NO: 4093021 - DNA, 20 bp, Homo sapiens
ttgcctttctgggagcagaa

SEQ ID NO: 4093022 - DNA, 18 bp, Homo sapiens
ttgcctttcttctgccct

SEQ ID NO: 4093023 - DNA, 20 bp, Homo sapiens
ttgcgacggagagaaaaaag

SEQ ID NO: 4093024 - DNA, 20 bp, Homo sapiens
ttgcgctctcaagaccagag

SEQ ID NO: 4093025 - DNA, 17 bp, Homo sapiens
ttgctaagtaaatctct

SEQ ID NO: 4093026 - DNA, 19 bp, Homo sapiens
ttgctaagtaaatctcttc

SEQ ID NO: 4093027 - DNA, 16 bp, Homo sapiens
ttgctaatcaaagcca

SEQ ID NO: 4093028 - DNA, 21 bp, Homo sapiens
ttgctaatcaaagccagggtc

SEQ ID NO: 4093029 - DNA, 20 bp, Homo sapiens
ttgctaattaactgaaacat

SEQ ID NO: 4093030 - DNA, 15 bp, Homo sapiens
ttgctaattttctca

SEQ ID NO: 4093031 - DNA, 17 bp, Homo sapiens
ttgctaattttctcaaa

SEQ ID NO: 4093032 - DNA, 23 bp, Homo sapiens
ttgctaattttctcaaaagcatt

SEQ ID NO: 4093033 - DNA, 23 bp, Homo sapiens
ttgctaccacggcctcctttccg

SEQ ID NO: 4093034 - DNA, 18 bp, Homo sapiens
ttgctagcagtaaaagat

SEQ ID NO: 4093035 - DNA, 16 bp, Homo sapiens
ttgctagtatttgaat

SEQ ID NO: 4093036 - DNA, 18 bp, Homo sapiens
ttgctagtatttgaatta

SEQ ID NO: 4093037 - DNA, 15 bp, Homo sapiens
ttgctataatcatta

SEQ ID NO: 4093038 - DNA, 16 bp, Homo sapiens
ttgctatgttactatt

SEQ ID NO: 4093039 - DNA, 19 bp, Homo sapiens
ttgctatgttactattttc

SEQ ID NO: 4093040 - DNA, 15 bp, Homo sapiens
ttgctattgtaaata

SEQ ID NO: 4093041 - DNA, 17 bp, Homo sapiens
ttgctcaaaaaatgagc

SEQ ID NO: 4093042 - DNA, 16 bp, Homo sapiens
ttgctcaaaaatctgt

SEQ ID NO: 4093043 - DNA, 22 bp, Homo sapiens
ttgctcaagttcattgatgacc

SEQ ID NO: 4093044 - DNA, 17 bp, Homo sapiens
ttgctcagagaaggaaa

SEQ ID NO: 4093045 - DNA, 14 bp, Homo sapiens
ttgctccccttccc

SEQ ID NO: 4093046 - DNA, 16 bp, Homo sapiens
ttgctccccttcccct

SEQ ID NO: 4093047 - DNA, 17 bp, Homo sapiens
ttgctccccttcccctt

SEQ ID NO: 4093048 - DNA, 21 bp, Homo sapiens
ttgctccccttccccttcctt

SEQ ID NO: 4093049 - DNA, 22 bp, Homo sapiens
ttgctccccttccccttccttc

SEQ ID NO: 4093050 - DNA, 15 bp, Homo sapiens
ttgctcccttcagcc

SEQ ID NO: 4093051 - DNA, 17 bp, Homo sapiens
ttgctcccttcagcccc

SEQ ID NO: 4093052 - DNA, 14 bp, Homo sapiens
ttgctcctagcaga

SEQ ID NO: 4093053 - DNA, 16 bp, Homo sapiens
ttgctctatctctcaa

SEQ ID NO: 4093054 - DNA, 13 bp, Homo sapiens
ttgctctctgtga

SEQ ID NO: 4093055 - DNA, 16 bp, Homo sapiens
ttgctctgtcccccag

SEQ ID NO: 4093056 - DNA, 18 bp, Homo sapiens
ttgctcttttaagcagtc

SEQ ID NO: 4093057 - DNA, 15 bp, Homo sapiens
ttgctgatggcttga

SEQ ID NO: 4093058 - DNA, 17 bp, Homo sapiens
ttgctgatttcccctct

SEQ ID NO: 4093059 - DNA, 12 bp, Homo sapiens
ttgctgcagaga

SEQ ID NO: 4093060 - DNA, 21 bp, Homo sapiens
ttgctgcagagaaacttaagc

SEQ ID NO: 4093061 - DNA, 23 bp, Homo sapiens
ttgctgccataattctaagttat

SEQ ID NO: 4093062 - DNA, 21 bp, Homo sapiens
ttgctgctaccgccctgggct

SEQ ID NO: 4093063 - DNA, 18 bp, Homo sapiens
ttgctgctgtgcgtggaa

SEQ ID NO: 4093064 - DNA, 21 bp, Homo sapiens
ttgctggggctcacggggcct

SEQ ID NO: 4093065 - DNA, 19 bp, Homo sapiens
ttgctggtgcctgccacct

SEQ ID NO: 4093066 - DNA, 11 bp, Homo sapiens
ttgctgtatat

SEQ ID NO: 4093067 - DNA, 18 bp, Homo sapiens
ttgctgtatgctgatcat

SEQ ID NO: 4093068 - DNA, 21 bp, Homo sapiens
ttgctgtatgctgatcatcgc

SEQ ID NO: 4093069 - DNA, 14 bp, Homo sapiens
ttgctgtctctgct

SEQ ID NO: 4093070 - DNA, 15 bp, Homo sapiens
ttgctgtctctgctc

SEQ ID NO: 4093071 - DNA, 18 bp, Homo sapiens
ttgctgtgaggctgtcct

SEQ ID NO: 4093072 - DNA, 19 bp, Homo sapiens
ttgctgtgaggctgtcctg

SEQ ID NO: 4093073 - DNA, 21 bp, Homo sapiens
ttgctgtgtttaatttgactt

SEQ ID NO: 4093074 - DNA, 21 bp, Homo sapiens
ttgcttaattacaatatttct

SEQ ID NO: 4093075 - DNA, 18 bp, Homo sapiens
ttgcttacatttttacaa

SEQ ID NO: 4093076 - DNA, 17 bp, Homo sapiens
ttgcttcaccatggcct

SEQ ID NO: 4093077 - DNA, 20 bp, Homo sapiens
ttgcttgaaattactgtgta

SEQ ID NO: 4093078 - DNA, 21 bp, Homo sapiens
ttgcttgaaattactgtgtaa

SEQ ID NO: 4093079 - DNA, 14 bp, Homo sapiens
ttgcttgagcccag

SEQ ID NO: 4093080 - DNA, 17 bp, Homo sapiens
ttgcttgagcccaggag

SEQ ID NO: 4093081 - DNA, 17 bp, Homo sapiens
ttgcttgatccagaaga

SEQ ID NO: 4093082 - DNA, 16 bp, Homo sapiens
ttgctttcctgggcct

SEQ ID NO: 4093083 - DNA, 13 bp, Homo sapiens
ttgctttctgaaa

SEQ ID NO: 4093084 - DNA, 13 bp, Homo sapiens
ttgctttgtatgc

SEQ ID NO: 4093085 - DNA, 17 bp, Homo sapiens
ttgcttttattttgaaa

SEQ ID NO: 4093086 - DNA, 13 bp, Homo sapiens
ttgcttttgtgaa

SEQ ID NO: 4093087 - DNA, 22 bp, Homo sapiens
ttgctttttctaatgtggttat

SEQ ID NO: 4093088 - DNA, 17 bp, Homo sapiens
ttgcttttttttccttc

SEQ ID NO: 4093089 - DNA, 22 bp, Homo sapiens
ttggaaaaacaacagcgacaaa

SEQ ID NO: 4093090 - DNA, 17 bp, Homo sapiens
ttggaaaataaattatt

SEQ ID NO: 4093091 - DNA, 11 bp, Homo sapiens
ttggaaagagt

SEQ ID NO: 4093092 - DNA, 17 bp, Homo sapiens
ttggaaagtacactctg

SEQ ID NO: 4093093 - DNA, 22 bp, Homo sapiens
ttggaaatagaaagaagccata

SEQ ID NO: 4093094 - DNA, 13 bp, Homo sapiens
ttggaacagaatg

SEQ ID NO: 4093095 - DNA, 22 bp, Homo sapiens
ttggaacattggaatgttctca

SEQ ID NO: 4093096 - DNA, 17 bp, Homo sapiens
ttggaagctaccagagc

SEQ ID NO: 4093097 - DNA, 16 bp, Homo sapiens
ttggaaggggccttgc

SEQ ID NO: 4093098 - DNA, 17 bp, Homo sapiens
ttggaatgttctcagat

SEQ ID NO: 4093099 - DNA, 17 bp, Homo sapiens
ttggaattaacctggtg

SEQ ID NO: 4093100 - DNA, 22 bp, Homo sapiens
ttggaatttgtaacctcagctc

SEQ ID NO: 4093101 - DNA, 20 bp, Homo sapiens
ttggacaaacctagaatttt

SEQ ID NO: 4093102 - DNA, 19 bp, Homo sapiens
ttggacaggagtcagtgtc

SEQ ID NO: 4093103 - DNA, 15 bp, Homo sapiens
ttggacagtttacca

SEQ ID NO: 4093104 - DNA, 17 bp, Homo sapiens
ttggacatagatatttt

SEQ ID NO: 4093105 - DNA, 13 bp, Homo sapiens
ttggacggcctga

SEQ ID NO: 4093106 - DNA, 19 bp, Homo sapiens
ttggagaacgccagtctcc

SEQ ID NO: 4093107 - DNA, 16 bp, Homo sapiens
ttggagaatactttgc

SEQ ID NO: 4093108 - DNA, 22 bp, Homo sapiens
ttggagagggcccaggtcccaa

SEQ ID NO: 4093109 - DNA, 18 bp, Homo sapiens
ttggagagtttcctgaaa

SEQ ID NO: 4093110 - DNA, 23 bp, Homo sapiens
ttggagcacatgttactgcttca

SEQ ID NO: 4093111 - DNA, 23 bp, Homo sapiens
ttggagcaggcaaaaaagggaca

SEQ ID NO: 4093112 - DNA, 21 bp, Homo sapiens
ttggagcctcccttctgcctt

SEQ ID NO: 4093113 - DNA, 16 bp, Homo sapiens
ttggagctgaagacct

SEQ ID NO: 4093114 - DNA, 15 bp, Homo sapiens
ttgattttaatacat

SEQ ID NO: 4093115 - DNA, 14 bp, Homo sapiens
ttgattttctgttg

SEQ ID NO: 4093116 - DNA, 15 bp, Homo sapiens
ttgatttttgtctca

SEQ ID NO: 4093117 - DNA, 21 bp, Homo sapiens
ttgcaaaatcacttagcagca

SEQ ID NO: 4093118 - DNA, 23 bp, Homo sapiens
ttgcaaaatttccagtacctttg

SEQ ID NO: 4093119 - DNA, 15 bp, Homo sapiens
ttgcaaatcttgaaa

SEQ ID NO: 4093120 - DNA, 13 bp, Homo sapiens
ttgcaacatatta

SEQ ID NO: 4093121 - DNA, 20 bp, Homo sapiens
ttgcaactaggtatttctaa

SEQ ID NO: 4093122 - DNA, 23 bp, Homo sapiens
ttgcaacttcagttttatttttg

SEQ ID NO: 4093123 - DNA, 15 bp, Homo sapiens
ttgcaagatgtgaat

SEQ ID NO: 4093124 - DNA, 18 bp, Homo sapiens
ttgcaagttatattagtg

SEQ ID NO: 4093125 - DNA, 14 bp, Homo sapiens
ttgcaataacttct

SEQ ID NO: 4093126 - DNA, 23 bp, Homo sapiens
ttgcaataacttctatattttaa

SEQ ID NO: 4093127 - DNA, 15 bp, Homo sapiens
ttgcaatttcttagg

SEQ ID NO: 4093128 - DNA, 18 bp, Homo sapiens
ttgcacatgattgtataa

SEQ ID NO: 4093129 - DNA, 23 bp, Homo sapiens
ttgcaccatactccttgcttcct

SEQ ID NO: 4093130 - DNA, 22 bp, Homo sapiens
ttgcaccccaaagctttcctgc

SEQ ID NO: 4093131 - DNA, 17 bp, Homo sapiens
ttgcacctacctcacag

SEQ ID NO: 4093132 - DNA, 18 bp, Homo sapiens
ttgcacctgtccccaccc

SEQ ID NO: 4093133 - DNA, 21 bp, Homo sapiens
ttgcactattgagtcttcatg

SEQ ID NO: 4093134 - DNA, 13 bp, Homo sapiens
ttgcactgagggc

SEQ ID NO: 4093135 - DNA, 23 bp, Homo sapiens
ttgcactgggggaacagatgcta

SEQ ID NO: 4093136 - DNA, 20 bp, Homo sapiens
ttgcacttgtgattatttat

SEQ ID NO: 4093137 - DNA, 19 bp, Homo sapiens
ttgcagaaaattctgtgcc

SEQ ID NO: 4093138 - DNA, 11 bp, Homo sapiens
ttgcagaactt

SEQ ID NO: 4093139 - DNA, 21 bp, Homo sapiens
ttgcagaacttgaagcctgct

SEQ ID NO: 4093140 - DNA, 13 bp, Homo sapiens
ttgcagaagaggg

SEQ ID NO: 4093141 - DNA, 15 bp, Homo sapiens
ttgcagaagagggtg

SEQ ID NO: 4093142 - DNA, 12 bp, Homo sapiens
ttgcagattcta

SEQ ID NO: 4093143 - DNA, 12 bp, Homo sapiens
ttgcagcagtga

SEQ ID NO: 4093144 - DNA, 20 bp, Homo sapiens
ttgcagcatgagactttctg

SEQ ID NO: 4093145 - DNA, 18 bp, Homo sapiens
ttgcagccggcacagggt

SEQ ID NO: 4093146 - DNA, 20 bp, Homo sapiens
ttgcagccggcacagggtct

SEQ ID NO: 4093147 - DNA, 18 bp, Homo sapiens
ttgcagctttatgttcat

SEQ ID NO: 4093148 - DNA, 16 bp, Homo sapiens
ttgcagtgagctgaga

SEQ ID NO: 4093149 - DNA, 20 bp, Homo sapiens
ttgcagtgtggtgagatcat

SEQ ID NO: 4093150 - DNA, 21 bp, Homo sapiens
ttgcagttggactctcaggga

SEQ ID NO: 4093151 - DNA, 15 bp, Homo sapiens
ttgcataataagcta

SEQ ID NO: 4093152 - DNA, 20 bp, Homo sapiens
ttgcataggctcttaagcag

SEQ ID NO: 4093153 - DNA, 22 bp, Homo sapiens
ttgcatagtaccaatcatttta

SEQ ID NO: 4093154 - DNA, 16 bp, Homo sapiens
ttgcatattttgagaa

SEQ ID NO: 4093155 - DNA, 18 bp, Homo sapiens
ttgcatattttgagaaac

SEQ ID NO: 4093156 - DNA, 22 bp, Homo sapiens
ttgcatattttgagaaactgct

SEQ ID NO: 4093157 - DNA, 18 bp, Homo sapiens
ttgcatgaagagaagcaa

SEQ ID NO: 4093158 - DNA, 20 bp, Homo sapiens
ttgcatggctccagaaatgt

SEQ ID NO: 4093159 - DNA, 16 bp, Homo sapiens
ttgcattattcattta

SEQ ID NO: 4093160 - DNA, 17 bp, Homo sapiens
ttgcattattcatttag

SEQ ID NO: 4093161 - DNA, 22 bp, Homo sapiens
ttgcattcattttctgacatgc

SEQ ID NO: 4093162 - DNA, 17 bp, Homo sapiens
ttgcattccagaatctt

SEQ ID NO: 4093163 - DNA, 21 bp, Homo sapiens
ttgcattccagaatcttgact

SEQ ID NO: 4093164 - DNA, 17 bp, Homo sapiens
ttgcattctattgcctt

SEQ ID NO: 4093165 - DNA, 17 bp, Homo sapiens
ttgcattgaatatatta

SEQ ID NO: 4093166 - DNA, 16 bp, Homo sapiens
ttgcatttacttttaa

SEQ ID NO: 4093167 - DNA, 16 bp, Homo sapiens
ttgcatttagaaatca

SEQ ID NO: 4093168 - DNA, 17 bp, Homo sapiens
ttgcatttccagctgtg

SEQ ID NO: 4093169 - DNA, 15 bp, Homo sapiens
ttgcatttgctcttt

SEQ ID NO: 4093170 - DNA, 21 bp, Homo sapiens
ttgcatttttattaaagcatt

SEQ ID NO: 4093171 - DNA, 12 bp, Homo sapiens
ttgccaaaaaaa

SEQ ID NO: 4093172 - DNA, 17 bp, Homo sapiens
ttgccaaatatgtcctg

SEQ ID NO: 4093173 - DNA, 18 bp, Homo sapiens
ttgccaaatatgtcctgg

SEQ ID NO: 4093174 - DNA, 15 bp, Homo sapiens
ttgccaaatctggct

SEQ ID NO: 4093175 - DNA, 22 bp, Homo sapiens
ttgccaagaaaatgaagggatt

SEQ ID NO: 4093176 - DNA, 17 bp, Homo sapiens
ttgccaaggcaaaaaac

SEQ ID NO: 4093177 - DNA, 14 bp, Homo sapiens
ttgccacagctttt

SEQ ID NO: 4093178 - DNA, 12 bp, Homo sapiens
ttgccacattta

SEQ ID NO: 4093179 - DNA, 18 bp, Homo sapiens
ttgccaccacctctgtgg

SEQ ID NO: 4093180 - DNA, 13 bp, Homo sapiens
ttgccaccaggag

SEQ ID NO: 4093181 - DNA, 14 bp, Homo sapiens
ttgccaccaggaga

SEQ ID NO: 4093182 - DNA, 15 bp, Homo sapiens
ttgccaccaggagaa

SEQ ID NO: 4093183 - DNA, 14 bp, Homo sapiens
ttgccaccatgtat

SEQ ID NO: 4093184 - DNA, 22 bp, Homo sapiens
ttgccaccatgtattcatccag

SEQ ID NO: 4093185 - DNA, 12 bp, Homo sapiens
ttgccaccccac

SEQ ID NO: 4093186 - DNA, 17 bp, Homo sapiens
ttgccacccctgtccag

SEQ ID NO: 4093187 - DNA, 17 bp, Homo sapiens
ttgccagaaagcataaa

SEQ ID NO: 4093188 - DNA, 19 bp, Homo sapiens
ttgccagagatccaaaaga

SEQ ID NO: 4093189 - DNA, 15 bp, Homo sapiens
ttgccagctgctgct

SEQ ID NO: 4093190 - DNA, 18 bp, Homo sapiens
ttgccagcttttcctccc

SEQ ID NO: 4093191 - DNA, 19 bp, Homo sapiens
ttgccagtattatgcatat

SEQ ID NO: 4093192 - DNA, 18 bp, Homo sapiens
ttgccagttttccctgga

SEQ ID NO: 4093193 - DNA, 14 bp, Homo sapiens
ttgccatctgtgat

SEQ ID NO: 4093194 - DNA, 17 bp, Homo sapiens
ttgccattggacagttg

SEQ ID NO: 4093195 - DNA, 18 bp, Homo sapiens
ttgccattggacagttgt

SEQ ID NO: 4093196 - DNA, 12 bp, Homo sapiens
ttgcccacccct

SEQ ID NO: 4093197 - DNA, 14 bp, Homo sapiens
ttgcccacccctca

SEQ ID NO: 4093198 - DNA, 15 bp, Homo sapiens
ttgcccactcctgct

SEQ ID NO: 4093199 - DNA, 16 bp, Homo sapiens
ttgcccagcctctttc

SEQ ID NO: 4093200 - DNA, 17 bp, Homo sapiens
ttgcccatcctgactga

SEQ ID NO: 4093201 - DNA, 20 bp, Homo sapiens
ttgcccatgctgggctcccg

SEQ ID NO: 4093202 - DNA, 14 bp, Homo sapiens
ttgcccatgggata

SEQ ID NO: 4093203 - DNA, 11 bp, Homo sapiens
ttgccccaaga

SEQ ID NO: 4093204 - DNA, 17 bp, Homo sapiens
ttgccccagacctggaa

SEQ ID NO: 4093205 - DNA, 19 bp, Homo sapiens
ttgccccagacctggaaga

SEQ ID NO: 4093206 - DNA, 21 bp, Homo sapiens
ttgccccatccagacctggct

SEQ ID NO: 4093207 - DNA, 14 bp, Homo sapiens
ttgccccctctcac

SEQ ID NO: 4093208 - DNA, 15 bp, Homo sapiens
ttgccccctctcact

SEQ ID NO: 4093209 - DNA, 12 bp, Homo sapiens
ttgcccctggct

SEQ ID NO: 4093210 - DNA, 14 bp, Homo sapiens
ttgcccctggcttt

SEQ ID NO: 4093211 - DNA, 19 bp, Homo sapiens
ttgcccgaaactaagccag

SEQ ID NO: 4093212 - DNA, 21 bp, Homo sapiens
ttgcccgaaactaagccaggc

SEQ ID NO: 4093213 - DNA, 16 bp, Homo sapiens
ttgcccttcacagtgt

SEQ ID NO: 4093214 - DNA, 23 bp, Homo sapiens
ttgcctgactaaaatgtttcatt

SEQ ID NO: 4093215 - DNA, 13 bp, Homo sapiens
ttgccttaaaata

SEQ ID NO: 4093216 - DNA, 23 bp, Homo sapiens
ttgccttcctttctccaggacca

SEQ ID NO: 4093217 - DNA, 14 bp, Homo sapiens
ttgaccaagaactg

SEQ ID NO: 4093218 - DNA, 21 bp, Homo sapiens
ttgaccaagaactgcatggac

SEQ ID NO: 4093219 - DNA, 17 bp, Homo sapiens
ttgaccatctgctttta

SEQ ID NO: 4093220 - DNA, 18 bp, Homo sapiens
ttgaccgcaactcacaca

SEQ ID NO: 4093221 - DNA, 24 bp, Homo sapiens
ttgacctcatctcccgagcaatgg

SEQ ID NO: 4093222 - DNA, 21 bp, Homo sapiens
ttgaccttttatgtagtaatt

SEQ ID NO: 4093223 - DNA, 20 bp, Homo sapiens
ttgacggatgattggattat

SEQ ID NO: 4093224 - DNA, 23 bp, Homo sapiens
ttgacgtcactttttggccatgt

SEQ ID NO: 4093225 - DNA, 19 bp, Homo sapiens
ttgactctggcaaagcttt

SEQ ID NO: 4093226 - DNA, 21 bp, Homo sapiens
ttgactcttgcgtgtcaattt

SEQ ID NO: 4093227 - DNA, 17 bp, Homo sapiens
ttgactgatgattttcc

SEQ ID NO: 4093228 - DNA, 19 bp, Homo sapiens
ttgactgatgattttcctt

SEQ ID NO: 4093229 - DNA, 17 bp, Homo sapiens
ttgactgtagccacagc

SEQ ID NO: 4093230 - DNA, 18 bp, Homo sapiens
ttgacttatagtacatga

SEQ ID NO: 4093231 - DNA, 16 bp, Homo sapiens
ttgacttgcatgaaga

SEQ ID NO: 4093232 - DNA, 15 bp, Homo sapiens
ttgactttctgattg

SEQ ID NO: 4093233 - DNA, 10 bp, Homo sapiens
ttgagaaacc

SEQ ID NO: 4093234 - DNA, 22 bp, Homo sapiens
ttgagacacggagcccagccct

SEQ ID NO: 4093235 - DNA, 12 bp, Homo sapiens
ttgagacagttt

SEQ ID NO: 4093236 - DNA, 19 bp, Homo sapiens
ttgagacagtttcttagct

SEQ ID NO: 4093237 - DNA, 22 bp, Homo sapiens
ttgagacagtttcttagctttt

SEQ ID NO: 4093238 - DNA, 21 bp, Homo sapiens
ttgagacgcaccatgtgggca

SEQ ID NO: 4093239 - DNA, 23 bp, Homo sapiens
ttgagagaagccacgctgtcctc

SEQ ID NO: 4093240 - DNA, 18 bp, Homo sapiens
ttgagataatatctgtga

SEQ ID NO: 4093241 - DNA, 19 bp, Homo sapiens
ttgagataatatctgtgag

SEQ ID NO: 4093242 - DNA, 13 bp, Homo sapiens
ttgagatggggat

SEQ ID NO: 4093243 - DNA, 18 bp, Homo sapiens
ttgagatggggataaaat

SEQ ID NO: 4093244 - DNA, 23 bp, Homo sapiens
ttgagatggggataaaatgacta

SEQ ID NO: 4093245 - DNA, 20 bp, Homo sapiens
ttgagatttttaagaacttc

SEQ ID NO: 4093246 - DNA, 19 bp, Homo sapiens
ttgagcatgacagcctgca

SEQ ID NO: 4093247 - DNA, 20 bp, Homo sapiens
ttgagcatgacagcctgcag

SEQ ID NO: 4093248 - DNA, 13 bp, Homo sapiens
ttgagccaggcct

SEQ ID NO: 4093249 - DNA, 13 bp, Homo sapiens
ttgagccctggct

SEQ ID NO: 4093250 - DNA, 15 bp, Homo sapiens
ttgagccctggctgt

SEQ ID NO: 4093251 - DNA, 19 bp, Homo sapiens
ttgagccgggcccctgggc

SEQ ID NO: 4093252 - DNA, 20 bp, Homo sapiens
ttgagccgggcccctgggct

SEQ ID NO: 4093253 - DNA, 16 bp, Homo sapiens
ttgagctgatataaat

SEQ ID NO: 4093254 - DNA, 14 bp, Homo sapiens
ttgagctgccttcc

SEQ ID NO: 4093255 - DNA, 18 bp, Homo sapiens
ttgagctgttttccctga

SEQ ID NO: 4093256 - DNA, 16 bp, Homo sapiens
ttgaggaaatattaat

SEQ ID NO: 4093257 - DNA, 12 bp, Homo sapiens
ttgaggagcccc

SEQ ID NO: 4093258 - DNA, 13 bp, Homo sapiens
ttgaggagtgtga

SEQ ID NO: 4093259 - DNA, 13 bp, Homo sapiens
ttgaggcaagtgt

SEQ ID NO: 4093260 - DNA, 14 bp, Homo sapiens
ttgaggcatgcaca

SEQ ID NO: 4093261 - DNA, 19 bp, Homo sapiens
ttgaggcctgccctcaggg

SEQ ID NO: 4093262 - DNA, 14 bp, Homo sapiens
ttgagggaaggttc

SEQ ID NO: 4093263 - DNA, 20 bp, Homo sapiens
ttgagggacgctttgtctgt

SEQ ID NO: 4093264 - DNA, 14 bp, Homo sapiens
ttgagggcccagag

SEQ ID NO: 4093265 - DNA, 21 bp, Homo sapiens
ttgagggcccagagcaggaag

SEQ ID NO: 4093266 - DNA, 15 bp, Homo sapiens
ttgaggggattaata

SEQ ID NO: 4093267 - DNA, 16 bp, Homo sapiens
ttgaggggattaatat

SEQ ID NO: 4093268 - DNA, 22 bp, Homo sapiens
ttgaggggattaatatgaaaac

SEQ ID NO: 4093269 - DNA, 23 bp, Homo sapiens
ttgaggtagaccaggatttctaa

SEQ ID NO: 4093270 - DNA, 17 bp, Homo sapiens
ttgaggtcttttgacat

SEQ ID NO: 4093271 - DNA, 18 bp, Homo sapiens
ttgaggtcttttgacatg

SEQ ID NO: 4093272 - DNA, 19 bp, Homo sapiens
ttgaggtcttttgacatgt

SEQ ID NO: 4093273 - DNA, 23 bp, Homo sapiens
ttgaggtcttttgacatgtggaa

SEQ ID NO: 4093274 - DNA, 21 bp, Homo sapiens
ttgaggtggtctgaatgttct

SEQ ID NO: 4093275 - DNA, 13 bp, Homo sapiens
ttgagtaaaaagg

SEQ ID NO: 4093276 - DNA, 15 bp, Homo sapiens
ttgagtgtgtgtgtg

SEQ ID NO: 4093277 - DNA, 23 bp, Homo sapiens
ttgagtgttcctttttaaatgtg

SEQ ID NO: 4093278 - DNA, 20 bp, Homo sapiens
ttgagttggttacttcatat

SEQ ID NO: 4093279 - DNA, 19 bp, Homo sapiens
ttgataatgttaaatttgt

SEQ ID NO: 4093280 - DNA, 22 bp, Homo sapiens
ttgataatgttaaatttgtaag

SEQ ID NO: 4093281 - DNA, 13 bp, Homo sapiens
ttgatagaaccat

SEQ ID NO: 4093282 - DNA, 22 bp, Homo sapiens
ttgatcattttccccccactct

SEQ ID NO: 4093283 - DNA, 21 bp, Homo sapiens
ttgatccctgttacccagaga

SEQ ID NO: 4093284 - DNA, 12 bp, Homo sapiens
ttgatctctctt

SEQ ID NO: 4093285 - DNA, 13 bp, Homo sapiens
ttgatctctcttg

SEQ ID NO: 4093286 - DNA, 14 bp, Homo sapiens
ttgatctctcttgt

SEQ ID NO: 4093287 - DNA, 14 bp, Homo sapiens
ttgatcttaaagat

SEQ ID NO: 4093288 - DNA, 11 bp, Homo sapiens
ttgatgaaaag

SEQ ID NO: 4093289 - DNA, 18 bp, Homo sapiens
ttgatgataacacttaaa

SEQ ID NO: 4093290 - DNA, 21 bp, Homo sapiens
ttgatgatacaatgaacactt

SEQ ID NO: 4093291 - DNA, 15 bp, Homo sapiens
ttgatgccaggacac

SEQ ID NO: 4093292 - DNA, 16 bp, Homo sapiens
ttgatgctatttatgc

SEQ ID NO: 4093293 - DNA, 17 bp, Homo sapiens
ttgatgctatttatgca

SEQ ID NO: 4093294 - DNA, 15 bp, Homo sapiens
ttgatgctggagagg

SEQ ID NO: 4093295 - DNA, 20 bp, Homo sapiens
ttgatgggggccaggacacc

SEQ ID NO: 4093296 - DNA, 23 bp, Homo sapiens
ttgatgtacataactcctgtccc

SEQ ID NO: 4093297 - DNA, 17 bp, Homo sapiens
ttgatgtgaagataatt

SEQ ID NO: 4093298 - DNA, 22 bp, Homo sapiens
ttgatgtgaagataatttgcat

SEQ ID NO: 4093299 - DNA, 15 bp, Homo sapiens
ttgatgtgacaataa

SEQ ID NO: 4093300 - DNA, 19 bp, Homo sapiens
ttgatgtgacaataatatt

SEQ ID NO: 4093301 - DNA, 13 bp, Homo sapiens
ttgatgtttcctt

SEQ ID NO: 4093302 - DNA, 19 bp, Homo sapiens
ttgatgtttgtggcctcag

SEQ ID NO: 4093303 - DNA, 22 bp, Homo sapiens
ttgatgtttgtggcctcagaat

SEQ ID NO: 4093304 - DNA, 14 bp, Homo sapiens
ttgattaacaaata

SEQ ID NO: 4093305 - DNA, 16 bp, Homo sapiens
ttgattaacaaatatg

SEQ ID NO: 4093306 - DNA, 16 bp, Homo sapiens
ttgattaagattttac

SEQ ID NO: 4093307 - DNA, 14 bp, Homo sapiens
ttgattcagcctgt

SEQ ID NO: 4093308 - DNA, 16 bp, Homo sapiens
ttgattcattttcctg

SEQ ID NO: 4093309 - DNA, 12 bp, Homo sapiens
ttgattcctggt

SEQ ID NO: 4093310 - DNA, 13 bp, Homo sapiens
ttgattctctcca

SEQ ID NO: 4093311 - DNA, 13 bp, Homo sapiens
ttgattgcttttt

SEQ ID NO: 4093312 - DNA, 15 bp, Homo sapiens
ttgattgtcagctac

SEQ ID NO: 4093313 - DNA, 21 bp, Homo sapiens
ttgattgtcagctactaatga

SEQ ID NO: 4093314 - DNA, 18 bp, Homo sapiens
ttgatttaaacacacaga

SEQ ID NO: 4093315 - DNA, 11 bp, Homo sapiens
ttgatttacag

SEQ ID NO: 4093316 - DNA, 13 bp, Homo sapiens
ttgatttgaagaa

SEQ ID NO: 4093317 - DNA, 14 bp, Homo sapiens
ttgatttgaagaac

SEQ ID NO: 4093318 - DNA, 18 bp, Homo sapiens
ttgatttgaagaacatgt

SEQ ID NO: 4093319 - DNA, 19 bp, Homo sapiens
ttgatttggtggatgtgat

SEQ ID NO: 4093320 - DNA, 16 bp, Homo sapiens
ttcttgtcacaataaa

SEQ ID NO: 4093321 - DNA, 19 bp, Homo sapiens
ttcttgtctgattggctca

SEQ ID NO: 4093322 - DNA, 15 bp, Homo sapiens
ttcttgtttccttgt

SEQ ID NO: 4093323 - DNA, 16 bp, Homo sapiens
ttcttgtttccttgtt

SEQ ID NO: 4093324 - DNA, 13 bp, Homo sapiens
ttcttgttttgct

SEQ ID NO: 4093325 - DNA, 23 bp, Homo sapiens
ttctttaaaaaacaactatggat

SEQ ID NO: 4093326 - DNA, 16 bp, Homo sapiens
ttctttaaaagaatga

SEQ ID NO: 4093327 - DNA, 17 bp, Homo sapiens
ttctttaaaagaatgac

SEQ ID NO: 4093328 - DNA, 22 bp, Homo sapiens
ttctttaaagaagttgaagttt

SEQ ID NO: 4093329 - DNA, 13 bp, Homo sapiens
ttctttaaagatg

SEQ ID NO: 4093330 - DNA, 11 bp, Homo sapiens
ttctttacaaa

SEQ ID NO: 4093331 - DNA, 19 bp, Homo sapiens
ttctttacttctcacttca

SEQ ID NO: 4093332 - DNA, 13 bp, Homo sapiens
ttctttataaact

SEQ ID NO: 4093333 - DNA, 18 bp, Homo sapiens
ttctttataattctactt

SEQ ID NO: 4093334 - DNA, 19 bp, Homo sapiens
ttctttcccttagtgactc

SEQ ID NO: 4093335 - DNA, 14 bp, Homo sapiens
ttctttcccttcct

SEQ ID NO: 4093336 - DNA, 21 bp, Homo sapiens
ttctttcctccccctgcaact

SEQ ID NO: 4093337 - DNA, 15 bp, Homo sapiens
ttctttcctgccctg

SEQ ID NO: 4093338 - DNA, 21 bp, Homo sapiens
ttctttctagtggtctttgta

SEQ ID NO: 4093339 - DNA, 12 bp, Homo sapiens
ttctttgaagaa

SEQ ID NO: 4093340 - DNA, 17 bp, Homo sapiens
ttctttgataatgttaa

SEQ ID NO: 4093341 - DNA, 18 bp, Homo sapiens
ttctttgatctggacaga

SEQ ID NO: 4093342 - DNA, 14 bp, Homo sapiens
ttctttgcccttta

SEQ ID NO: 4093343 - DNA, 16 bp, Homo sapiens
ttctttggaaagtaca

SEQ ID NO: 4093344 - DNA, 20 bp, Homo sapiens
ttctttggaaagtacactct

SEQ ID NO: 4093345 - DNA, 12 bp, Homo sapiens
ttctttgtgcct

SEQ ID NO: 4093346 - DNA, 13 bp, Homo sapiens
ttctttgtgcctt

SEQ ID NO: 4093347 - DNA, 16 bp, Homo sapiens
ttctttgtgcctttgg

SEQ ID NO: 4093348 - DNA, 13 bp, Homo sapiens
ttcttttagagag

SEQ ID NO: 4093349 - DNA, 22 bp, Homo sapiens
ttcttttgcccttcacagtgtt

SEQ ID NO: 4093350 - DNA, 23 bp, Homo sapiens
ttcttttgcccttcacagtgttt

SEQ ID NO: 4093351 - DNA, 18 bp, Homo sapiens
ttcttttttttcattata

SEQ ID NO: 4093352 - DNA, 21 bp, Homo sapiens
ttctttttttttaagttctta

SEQ ID NO: 4093353 - DNA, 21 bp, Homo sapiens
ttgaaaagaaagtgttttatt

SEQ ID NO: 4093354 - DNA, 23 bp, Homo sapiens
ttgaaaagatgtacctggtggat

SEQ ID NO: 4093355 - DNA, 16 bp, Homo sapiens
ttgaaaagtttcctag

SEQ ID NO: 4093356 - DNA, 21 bp, Homo sapiens
ttgaaaataagaatagaaata

SEQ ID NO: 4093357 - DNA, 17 bp, Homo sapiens
ttgaaaatgtgtttgct

SEQ ID NO: 4093358 - DNA, 14 bp, Homo sapiens
ttgaaacagcagtc

SEQ ID NO: 4093359 - DNA, 16 bp, Homo sapiens
ttgaaaccaggacatt

SEQ ID NO: 4093360 - DNA, 14 bp, Homo sapiens
ttgaaacctcaggg

SEQ ID NO: 4093361 - DNA, 20 bp, Homo sapiens
ttgaaagagaaccagtttca

SEQ ID NO: 4093362 - DNA, 22 bp, Homo sapiens
ttgaaagattttattgtataaa

SEQ ID NO: 4093363 - DNA, 12 bp, Homo sapiens
ttgaaagctgtg

SEQ ID NO: 4093364 - DNA, 22 bp, Homo sapiens
ttgaaaggttttttttcagttg

SEQ ID NO: 4093365 - DNA, 17 bp, Homo sapiens
ttgaaatactaaaagca

SEQ ID NO: 4093366 - DNA, 18 bp, Homo sapiens
ttgaaatactaaaagcaa

SEQ ID NO: 4093367 - DNA, 19 bp, Homo sapiens
ttgaaatactaaaagcaaa

SEQ ID NO: 4093368 - DNA, 19 bp, Homo sapiens
ttgaaatcaatgcaagagt

SEQ ID NO: 4093369 - DNA, 18 bp, Homo sapiens
ttgaaatgaggtctgttt

SEQ ID NO: 4093370 - DNA, 19 bp, Homo sapiens
ttgaaatgaggtctgttta

SEQ ID NO: 4093371 - DNA, 13 bp, Homo sapiens
ttgaaattactgt

SEQ ID NO: 4093372 - DNA, 15 bp, Homo sapiens
ttgaaattactgtgt

SEQ ID NO: 4093373 - DNA, 16 bp, Homo sapiens
ttgaaattactgtgta

SEQ ID NO: 4093374 - DNA, 17 bp, Homo sapiens
ttgaaattactgtgtaa

SEQ ID NO: 4093375 - DNA, 14 bp, Homo sapiens
ttgaaattatatct

SEQ ID NO: 4093376 - DNA, 20 bp, Homo sapiens
ttgaaattatgtgacatttt

SEQ ID NO: 4093377 - DNA, 19 bp, Homo sapiens
ttgaaattgtgaactcatt

SEQ ID NO: 4093378 - DNA, 19 bp, Homo sapiens
ttgaaattgtttaagtgtt

SEQ ID NO: 4093379 - DNA, 17 bp, Homo sapiens
ttgaaattttgcaaata

SEQ ID NO: 4093380 - DNA, 19 bp, Homo sapiens
ttgaaattttgcaaatata

SEQ ID NO: 4093381 - DNA, 14 bp, Homo sapiens
ttgaacacaaactg

SEQ ID NO: 4093382 - DNA, 18 bp, Homo sapiens
ttgaacacaaactgtaaa

SEQ ID NO: 4093383 - DNA, 11 bp, Homo sapiens
ttgaacactgg

SEQ ID NO: 4093384 - DNA, 15 bp, Homo sapiens
ttgaactcagatctg

SEQ ID NO: 4093385 - DNA, 15 bp, Homo sapiens
ttgaactctggtggc

SEQ ID NO: 4093386 - DNA, 15 bp, Homo sapiens
ttgaactttgccaaa

SEQ ID NO: 4093387 - DNA, 19 bp, Homo sapiens
ttgaacttttgtactgaat

SEQ ID NO: 4093388 - DNA, 16 bp, Homo sapiens
ttgaagacaatttgat

SEQ ID NO: 4093389 - DNA, 23 bp, Homo sapiens
ttgaagacaatttgatacataat

SEQ ID NO: 4093390 - DNA, 21 bp, Homo sapiens
ttgaagagagatatatctgaa

SEQ ID NO: 4093391 - DNA, 18 bp, Homo sapiens
ttgaagcagtcttgctct

SEQ ID NO: 4093392 - DNA, 20 bp, Homo sapiens
ttgaagccaagtggggtgct

SEQ ID NO: 4093393 - DNA, 13 bp, Homo sapiens
ttgaagcctgctc

SEQ ID NO: 4093394 - DNA, 19 bp, Homo sapiens
ttgaaggaagccaaattta

SEQ ID NO: 4093395 - DNA, 15 bp, Homo sapiens
ttgaaggcaaaattg

SEQ ID NO: 4093396 - DNA, 20 bp, Homo sapiens
ttgaaggccctgctgagtca

SEQ ID NO: 4093397 - DNA, 15 bp, Homo sapiens
ttgaagggccagagc

SEQ ID NO: 4093398 - DNA, 17 bp, Homo sapiens
ttgaagggccagagcca

SEQ ID NO: 4093399 - DNA, 19 bp, Homo sapiens
ttgaagggccagagccagg

SEQ ID NO: 4093400 - DNA, 23 bp, Homo sapiens
ttgaagggctttattaaagaaat

SEQ ID NO: 4093401 - DNA, 16 bp, Homo sapiens
ttgaagtaaacttttt

SEQ ID NO: 4093402 - DNA, 17 bp, Homo sapiens
ttgaagtacttaacata

SEQ ID NO: 4093403 - DNA, 13 bp, Homo sapiens
ttgaagtttacat

SEQ ID NO: 4093404 - DNA, 17 bp, Homo sapiens
ttgaatcagtataaaca

SEQ ID NO: 4093405 - DNA, 15 bp, Homo sapiens
ttgaatctttccaat

SEQ ID NO: 4093406 - DNA, 12 bp, Homo sapiens
ttgaatgaaaaa

SEQ ID NO: 4093407 - DNA, 23 bp, Homo sapiens
ttgaatgaaaaatttaagcattg

SEQ ID NO: 4093408 - DNA, 20 bp, Homo sapiens
ttgaatggcaatgttttgct

SEQ ID NO: 4093409 - DNA, 22 bp, Homo sapiens
ttgaatgtggcttgagaaatat

SEQ ID NO: 4093410 - DNA, 13 bp, Homo sapiens
ttgaatgtgtcag

SEQ ID NO: 4093411 - DNA, 22 bp, Homo sapiens
ttgaattaaattaggaataaat

SEQ ID NO: 4093412 - DNA, 15 bp, Homo sapiens
ttgacaaaagtaaat

SEQ ID NO: 4093413 - DNA, 12 bp, Homo sapiens
ttgacaaaattt

SEQ ID NO: 4093414 - DNA, 16 bp, Homo sapiens
ttgacaaccatgagac

SEQ ID NO: 4093415 - DNA, 17 bp, Homo sapiens
ttgacaactaaaattag

SEQ ID NO: 4093416 - DNA, 18 bp, Homo sapiens
ttgacaataaatgtgctt

SEQ ID NO: 4093417 - DNA, 15 bp, Homo sapiens
ttgacaattcctaga

SEQ ID NO: 4093418 - DNA, 19 bp, Homo sapiens
ttgacacagtcagcatgct

SEQ ID NO: 4093419 - DNA, 20 bp, Homo sapiens
ttgacaccagaaagccctct

SEQ ID NO: 4093420 - DNA, 12 bp, Homo sapiens
ttgacactgaaa

SEQ ID NO: 4093421 - DNA, 14 bp, Homo sapiens
ttgacactgaactt

SEQ ID NO: 4093422 - DNA, 13 bp, Homo sapiens
ttgacatgtagct

SEQ ID NO: 4093423 - DNA, 14 bp, Homo sapiens
ttgacatgtggaaa

SEQ ID NO: 4093424 - DNA, 21 bp, Homo sapiens
ttctgcattttgctattgtaa

SEQ ID NO: 4093425 - DNA, 23 bp, Homo sapiens
ttctgccaggcaacttttaaagc

SEQ ID NO: 4093426 - DNA, 21 bp, Homo sapiens
ttctgccatctagccagcccc

SEQ ID NO: 4093427 - DNA, 19 bp, Homo sapiens
ttctgccctggctgctgcc

SEQ ID NO: 4093428 - DNA, 22 bp, Homo sapiens
ttctgccgacccctagttccct

SEQ ID NO: 4093429 - DNA, 16 bp, Homo sapiens
ttctgcctgccagctg

SEQ ID NO: 4093430 - DNA, 18 bp, Homo sapiens
ttctgcctgccagctgca

SEQ ID NO: 4093431 - DNA, 16 bp, Homo sapiens
ttctgcctttgatgtt

SEQ ID NO: 4093432 - DNA, 14 bp, Homo sapiens
ttctgctcagctct

SEQ ID NO: 4093433 - DNA, 20 bp, Homo sapiens
ttctgctccacccttggcct

SEQ ID NO: 4093434 - DNA, 13 bp, Homo sapiens
ttctgctctggaa

SEQ ID NO: 4093435 - DNA, 17 bp, Homo sapiens
ttctgctctggttgttt

SEQ ID NO: 4093436 - DNA, 16 bp, Homo sapiens
ttctgcttaggagaga

SEQ ID NO: 4093437 - DNA, 13 bp, Homo sapiens
ttctgcttttctg

SEQ ID NO: 4093438 - DNA, 22 bp, Homo sapiens
ttctggaatcattgtccagagc

SEQ ID NO: 4093439 - DNA, 19 bp, Homo sapiens
ttctggaatttgttcaagt

SEQ ID NO: 4093440 - DNA, 20 bp, Homo sapiens
ttctggaatttgttcaagtt

SEQ ID NO: 4093441 - DNA, 17 bp, Homo sapiens
ttctggctcctcaaaca

SEQ ID NO: 4093442 - DNA, 20 bp, Homo sapiens
ttctggctgccccaacctgc

SEQ ID NO: 4093443 - DNA, 23 bp, Homo sapiens
ttctgggcacagtggactcagca

SEQ ID NO: 4093444 - DNA, 16 bp, Homo sapiens
ttctgggctctttcct

SEQ ID NO: 4093445 - DNA, 19 bp, Homo sapiens
ttctgggcttggggtgtgg

SEQ ID NO: 4093446 - DNA, 17 bp, Homo sapiens
ttctggggcaggctggg

SEQ ID NO: 4093447 - DNA, 19 bp, Homo sapiens
ttctggggcaggctgggcc

SEQ ID NO: 4093448 - DNA, 21 bp, Homo sapiens
ttctggggcaggctgggccat

SEQ ID NO: 4093449 - DNA, 20 bp, Homo sapiens
ttctgggggaaaaagccata

SEQ ID NO: 4093450 - DNA, 16 bp, Homo sapiens
ttctgggtcttttgct

SEQ ID NO: 4093451 - DNA, 17 bp, Homo sapiens
ttctgggtcttttgcta

SEQ ID NO: 4093452 - DNA, 14 bp, Homo sapiens
ttctgggtggcctc

SEQ ID NO: 4093453 - DNA, 14 bp, Homo sapiens
ttctggtccttttt

SEQ ID NO: 4093454 - DNA, 17 bp, Homo sapiens
ttctggtgtgttaacat

SEQ ID NO: 4093455 - DNA, 16 bp, Homo sapiens
ttctgtatatactttt

SEQ ID NO: 4093456 - DNA, 14 bp, Homo sapiens
ttctgtatttctag

SEQ ID NO: 4093457 - DNA, 20 bp, Homo sapiens
ttctgtatttttttttctaa

SEQ ID NO: 4093458 - DNA, 13 bp, Homo sapiens
ttctgtccccagc

SEQ ID NO: 4093459 - DNA, 13 bp, Homo sapiens
ttctgtcctgggc

SEQ ID NO: 4093460 - DNA, 22 bp, Homo sapiens
ttctgtccttttggcactgaga

SEQ ID NO: 4093461 - DNA, 19 bp, Homo sapiens
ttctgtgagacccccacac

SEQ ID NO: 4093462 - DNA, 12 bp, Homo sapiens
ttctgtggctca

SEQ ID NO: 4093463 - DNA, 22 bp, Homo sapiens
ttctgtgtcacagttcttggtg

SEQ ID NO: 4093464 - DNA, 17 bp, Homo sapiens
ttctgttaaaatctatt

SEQ ID NO: 4093465 - DNA, 21 bp, Homo sapiens
ttctgttaaaatctattctgt

SEQ ID NO: 4093466 - DNA, 16 bp, Homo sapiens
ttctgttctggaggaa

SEQ ID NO: 4093467 - DNA, 12 bp, Homo sapiens
ttctgtttctca

SEQ ID NO: 4093468 - DNA, 13 bp, Homo sapiens
ttctgtttgctgt

SEQ ID NO: 4093469 - DNA, 18 bp, Homo sapiens
ttcttaaaagggaaatta

SEQ ID NO: 4093470 - DNA, 21 bp, Homo sapiens
ttcttaaaatatatttcagat

SEQ ID NO: 4093471 - DNA, 21 bp, Homo sapiens
ttcttaaaccaacctttaaaa

SEQ ID NO: 4093472 - DNA, 23 bp, Homo sapiens
ttcttaaaccaacctttaaaatt

SEQ ID NO: 4093473 - DNA, 16 bp, Homo sapiens
ttcttaaataatgctt

SEQ ID NO: 4093474 - DNA, 11 bp, Homo sapiens
ttcttaaatat

SEQ ID NO: 4093475 - DNA, 12 bp, Homo sapiens
ttcttaaatatc

SEQ ID NO: 4093476 - DNA, 16 bp, Homo sapiens
ttcttaaatatgtata

SEQ ID NO: 4093477 - DNA, 22 bp, Homo sapiens
ttcttaagtatgttattttctg

SEQ ID NO: 4093478 - DNA, 14 bp, Homo sapiens
ttcttacatgcatt

SEQ ID NO: 4093479 - DNA, 22 bp, Homo sapiens
ttcttaccctgtacatatgtaa

SEQ ID NO: 4093480 - DNA, 22 bp, Homo sapiens
ttcttactattaagcagtaaaa

SEQ ID NO: 4093481 - DNA, 14 bp, Homo sapiens
ttcttactgcttaa

SEQ ID NO: 4093482 - DNA, 19 bp, Homo sapiens
ttcttactgttttgtatca

SEQ ID NO: 4093483 - DNA, 13 bp, Homo sapiens
ttcttagtgtcac

SEQ ID NO: 4093484 - DNA, 21 bp, Homo sapiens
ttcttatacatttgataaagt

SEQ ID NO: 4093485 - DNA, 20 bp, Homo sapiens
ttcttatacgcttttctttg

SEQ ID NO: 4093486 - DNA, 13 bp, Homo sapiens
ttcttatagaata

SEQ ID NO: 4093487 - DNA, 15 bp, Homo sapiens
ttcttatagaataaa

SEQ ID NO: 4093488 - DNA, 15 bp, Homo sapiens
ttcttatggaattga

SEQ ID NO: 4093489 - DNA, 22 bp, Homo sapiens
ttcttatggaattgatttgcat

SEQ ID NO: 4093490 - DNA, 20 bp, Homo sapiens
ttcttattaatttcagtctt

SEQ ID NO: 4093491 - DNA, 17 bp, Homo sapiens
ttcttatttaccctttt

SEQ ID NO: 4093492 - DNA, 18 bp, Homo sapiens
ttcttcaaatacaaagta

SEQ ID NO: 4093493 - DNA, 21 bp, Homo sapiens
ttcttcaaatacaaagtaaat

SEQ ID NO: 4093494 - DNA, 17 bp, Homo sapiens
ttcttcaacatcaatgt

SEQ ID NO: 4093495 - DNA, 15 bp, Homo sapiens
ttcttcacaggcact

SEQ ID NO: 4093496 - DNA, 14 bp, Homo sapiens
ttcttcacccagct

SEQ ID NO: 4093497 - DNA, 21 bp, Homo sapiens
ttcttcacccagctaatctgt

SEQ ID NO: 4093498 - DNA, 21 bp, Homo sapiens
ttcttcacctgttatgtatga

SEQ ID NO: 4093499 - DNA, 20 bp, Homo sapiens
ttcttcagagtgaagaatct

SEQ ID NO: 4093500 - DNA, 21 bp, Homo sapiens
ttcttcataacaattttagga

SEQ ID NO: 4093501 - DNA, 20 bp, Homo sapiens
ttcttcatattctaaaacca

SEQ ID NO: 4093502 - DNA, 14 bp, Homo sapiens
ttcttcatgcaatg

SEQ ID NO: 4093503 - DNA, 17 bp, Homo sapiens
ttcttcatgcaatgaca

SEQ ID NO: 4093504 - DNA, 15 bp, Homo sapiens
ttcttccagaatgct

SEQ ID NO: 4093505 - DNA, 16 bp, Homo sapiens
ttcttccagaatgctg

SEQ ID NO: 4093506 - DNA, 12 bp, Homo sapiens
ttcttccagtta

SEQ ID NO: 4093507 - DNA, 15 bp, Homo sapiens
ttcttcctaatgtca

SEQ ID NO: 4093508 - DNA, 18 bp, Homo sapiens
ttcttcctaccaagtcaa

SEQ ID NO: 4093509 - DNA, 14 bp, Homo sapiens
ttcttcctcagctg

SEQ ID NO: 4093510 - DNA, 16 bp, Homo sapiens
ttcttcctccagctgc

SEQ ID NO: 4093511 - DNA, 21 bp, Homo sapiens
ttcttccttgttgtttgcttt

SEQ ID NO: 4093512 - DNA, 17 bp, Homo sapiens
ttcttcgtccttttggt

SEQ ID NO: 4093513 - DNA, 19 bp, Homo sapiens
ttcttcgtccttttggttt

SEQ ID NO: 4093514 - DNA, 17 bp, Homo sapiens
ttcttctacaaccagag

SEQ ID NO: 4093515 - DNA, 18 bp, Homo sapiens
ttcttctcaaaaaataat

SEQ ID NO: 4093516 - DNA, 19 bp, Homo sapiens
ttcttctcttagattctta

SEQ ID NO: 4093517 - DNA, 19 bp, Homo sapiens
ttcttctgaagattcttaa

SEQ ID NO: 4093518 - DNA, 13 bp, Homo sapiens
ttcttctgccctt

SEQ ID NO: 4093519 - DNA, 13 bp, Homo sapiens
ttcttctgtattt

SEQ ID NO: 4093520 - DNA, 16 bp, Homo sapiens
ttcttgatcttaaaga

SEQ ID NO: 4093521 - DNA, 15 bp, Homo sapiens
ttcttgcagattcta

SEQ ID NO: 4093522 - DNA, 17 bp, Homo sapiens
ttcttgcctgctgggct

SEQ ID NO: 4093523 - DNA, 17 bp, Homo sapiens
ttcttgctcccttcagc

SEQ ID NO: 4093524 - DNA, 14 bp, Homo sapiens
ttcttgctggttgt

SEQ ID NO: 4093525 - DNA, 15 bp, Homo sapiens
ttcttggtagagatt

SEQ ID NO: 4093526 - DNA, 18 bp, Homo sapiens
ttcttggttcataaatga

SEQ ID NO: 4093527 - DNA, 21 bp, Homo sapiens
ttctattgtattatttggagt

SEQ ID NO: 4093528 - DNA, 17 bp, Homo sapiens
ttctattgttactctgg

SEQ ID NO: 4093529 - DNA, 19 bp, Homo sapiens
ttctatttatatgtacatg

SEQ ID NO: 4093530 - DNA, 14 bp, Homo sapiens
ttctatttatttgt

SEQ ID NO: 4093531 - DNA, 16 bp, Homo sapiens
ttctattttactttgt

SEQ ID NO: 4093532 - DNA, 14 bp, Homo sapiens
ttctattttcttaa

SEQ ID NO: 4093533 - DNA, 18 bp, Homo sapiens
ttctatttttatcatgaa

SEQ ID NO: 4093534 - DNA, 16 bp, Homo sapiens
ttctcaaaagcattta

SEQ ID NO: 4093535 - DNA, 19 bp, Homo sapiens
ttctcaaagatctgaatta

SEQ ID NO: 4093536 - DNA, 21 bp, Homo sapiens
ttctcaaagttttgaaaagct

SEQ ID NO: 4093537 - DNA, 14 bp, Homo sapiens
ttctcaccagctgt

SEQ ID NO: 4093538 - DNA, 15 bp, Homo sapiens
ttctcactaatttgt

SEQ ID NO: 4093539 - DNA, 14 bp, Homo sapiens
ttctcactagtgtc

SEQ ID NO: 4093540 - DNA, 16 bp, Homo sapiens
ttctcactagtgtcag

SEQ ID NO: 4093541 - DNA, 14 bp, Homo sapiens
ttctcactgaactc

SEQ ID NO: 4093542 - DNA, 18 bp, Homo sapiens
ttctcactgaactccacc

SEQ ID NO: 4093543 - DNA, 19 bp, Homo sapiens
ttctcactgaactccaccg

SEQ ID NO: 4093544 - DNA, 19 bp, Homo sapiens
ttctcagaatctcaaataa

SEQ ID NO: 4093545 - DNA, 23 bp, Homo sapiens
ttctcagaatctcaaataactaa

SEQ ID NO: 4093546 - DNA, 13 bp, Homo sapiens
ttctcagatattt

SEQ ID NO: 4093547 - DNA, 14 bp, Homo sapiens
ttctcagatttctg

SEQ ID NO: 4093548 - DNA, 18 bp, Homo sapiens
ttctcataattcctacag

SEQ ID NO: 4093549 - DNA, 19 bp, Homo sapiens
ttctcataattcctacagc

SEQ ID NO: 4093550 - DNA, 23 bp, Homo sapiens
ttctcataattcctacagcacta

SEQ ID NO: 4093551 - DNA, 17 bp, Homo sapiens
ttctcatcccacgcact

SEQ ID NO: 4093552 - DNA, 14 bp, Homo sapiens
ttctcatgtatctt

SEQ ID NO: 4093553 - DNA, 11 bp, Homo sapiens
ttctcattctt

SEQ ID NO: 4093554 - DNA, 21 bp, Homo sapiens
ttctcatttggtctgccagaa

SEQ ID NO: 4093555 - DNA, 23 bp, Homo sapiens
ttctcatttggtctgccagaata

SEQ ID NO: 4093556 - DNA, 15 bp, Homo sapiens
ttctccaaggaaacc

SEQ ID NO: 4093557 - DNA, 12 bp, Homo sapiens
ttctccactgga

SEQ ID NO: 4093558 - DNA, 18 bp, Homo sapiens
ttctccagaatgtaagaa

SEQ ID NO: 4093559 - DNA, 19 bp, Homo sapiens
ttctccagacccaccacac

SEQ ID NO: 4093560 - DNA, 23 bp, Homo sapiens
ttctccagatttttcggaggccc

SEQ ID NO: 4093561 - DNA, 15 bp, Homo sapiens
ttctccagctgggct

SEQ ID NO: 4093562 - DNA, 18 bp, Homo sapiens
ttctccaggctctttggg

SEQ ID NO: 4093563 - DNA, 15 bp, Homo sapiens
ttctcccaagaaacc

SEQ ID NO: 4093564 - DNA, 17 bp, Homo sapiens
ttctcccaagaaacctg

SEQ ID NO: 4093565 - DNA, 19 bp, Homo sapiens
ttctcccaggtaccagctg

SEQ ID NO: 4093566 - DNA, 13 bp, Homo sapiens
ttctccccttcca

SEQ ID NO: 4093567 - DNA, 22 bp, Homo sapiens
ttctccccttccatttctgcct

SEQ ID NO: 4093568 - DNA, 18 bp, Homo sapiens
ttctccctcccaccttaa

SEQ ID NO: 4093569 - DNA, 10 bp, Homo sapiens
ttctccctgt

SEQ ID NO: 4093570 - DNA, 19 bp, Homo sapiens
ttctccctttatgtatctc

SEQ ID NO: 4093571 - DNA, 18 bp, Homo sapiens
ttctccgccagcctcctc

SEQ ID NO: 4093572 - DNA, 21 bp, Homo sapiens
ttctccgccagcctcctctgg

SEQ ID NO: 4093573 - DNA, 21 bp, Homo sapiens
ttctccgggtgtggcctcagc

SEQ ID NO: 4093574 - DNA, 11 bp, Homo sapiens
ttctcctcccc

SEQ ID NO: 4093575 - DNA, 20 bp, Homo sapiens
ttctcctcccttccttttcc

SEQ ID NO: 4093576 - DNA, 15 bp, Homo sapiens
ttctcctctctgggc

SEQ ID NO: 4093577 - DNA, 15 bp, Homo sapiens
ttctccttagtcttc

SEQ ID NO: 4093578 - DNA, 17 bp, Homo sapiens
ttctccttctccttccc

SEQ ID NO: 4093579 - DNA, 21 bp, Homo sapiens
ttctccttgttgttggttgtt

SEQ ID NO: 4093580 - DNA, 14 bp, Homo sapiens
ttctccttttccta

SEQ ID NO: 4093581 - DNA, 21 bp, Homo sapiens
ttctctaacttcaaggcccat

SEQ ID NO: 4093582 - DNA, 19 bp, Homo sapiens
ttctctaatgcttgattta

SEQ ID NO: 4093583 - DNA, 20 bp, Homo sapiens
ttctctacagacttctccag

SEQ ID NO: 4093584 - DNA, 22 bp, Homo sapiens
ttctctcacccatcccacccct

SEQ ID NO: 4093585 - DNA, 12 bp, Homo sapiens
ttctctccattt

SEQ ID NO: 4093586 - DNA, 19 bp, Homo sapiens
ttctctctccagggtgctt

SEQ ID NO: 4093587 - DNA, 17 bp, Homo sapiens
ttctctctttatacagc

SEQ ID NO: 4093588 - DNA, 18 bp, Homo sapiens
ttctctctttatacagct

SEQ ID NO: 4093589 - DNA, 21 bp, Homo sapiens
ttctctgcctttgacatttaa

SEQ ID NO: 4093590 - DNA, 15 bp, Homo sapiens
ttctctgctccacca

SEQ ID NO: 4093591 - DNA, 16 bp, Homo sapiens
ttctctgggtctgatt

SEQ ID NO: 4093592 - DNA, 20 bp, Homo sapiens
ttctctgtgaacgatttaga

SEQ ID NO: 4093593 - DNA, 19 bp, Homo sapiens
ttctctgtgtttgttccta

SEQ ID NO: 4093594 - DNA, 24 bp, Homo sapiens
ttctctgtgtttgttcctacagcc

SEQ ID NO: 4093595 - DNA, 18 bp, Homo sapiens
ttctcttagcaactcaga

SEQ ID NO: 4093596 - DNA, 15 bp, Homo sapiens
ttctcttccaggcag

SEQ ID NO: 4093597 - DNA, 16 bp, Homo sapiens
ttctcttccaggcagc

SEQ ID NO: 4093598 - DNA, 21 bp, Homo sapiens
ttctcttccccttagaaacac

SEQ ID NO: 4093599 - DNA, 17 bp, Homo sapiens
ttctcttccccttcctg

SEQ ID NO: 4093600 - DNA, 19 bp, Homo sapiens
ttctcttctccccttccat

SEQ ID NO: 4093601 - DNA, 23 bp, Homo sapiens
ttctcttctccccttccatttct

SEQ ID NO: 4093602 - DNA, 11 bp, Homo sapiens
ttctctttctc

SEQ ID NO: 4093603 - DNA, 19 bp, Homo sapiens
ttctctttgtggtttcttg

SEQ ID NO: 4093604 - DNA, 16 bp, Homo sapiens
ttctgaaatgttctta

SEQ ID NO: 4093605 - DNA, 22 bp, Homo sapiens
ttctgaactcaagctgcgttta

SEQ ID NO: 4093606 - DNA, 22 bp, Homo sapiens
ttctgaatattttatctttcct

SEQ ID NO: 4093607 - DNA, 14 bp, Homo sapiens
ttctgaatgctgct

SEQ ID NO: 4093608 - DNA, 11 bp, Homo sapiens
ttctgaatgta

SEQ ID NO: 4093609 - DNA, 18 bp, Homo sapiens
ttctgacagtttttctgt

SEQ ID NO: 4093610 - DNA, 18 bp, Homo sapiens
ttctgacatgcattgttg

SEQ ID NO: 4093611 - DNA, 14 bp, Homo sapiens
ttctgactcttccc

SEQ ID NO: 4093612 - DNA, 18 bp, Homo sapiens
ttctgactttttgtttct

SEQ ID NO: 4093613 - DNA, 13 bp, Homo sapiens
ttctgagaccagt

SEQ ID NO: 4093614 - DNA, 15 bp, Homo sapiens
ttctgagcagtgcct

SEQ ID NO: 4093615 - DNA, 21 bp, Homo sapiens
ttctgaggcctgaatccaaaa

SEQ ID NO: 4093616 - DNA, 14 bp, Homo sapiens
ttctgagtgttttt

SEQ ID NO: 4093617 - DNA, 23 bp, Homo sapiens
ttctgagtttcattctcctgcct

SEQ ID NO: 4093618 - DNA, 15 bp, Homo sapiens
ttctgattagaaatg

SEQ ID NO: 4093619 - DNA, 15 bp, Homo sapiens
ttctgattagctttg

SEQ ID NO: 4093620 - DNA, 18 bp, Homo sapiens
ttctgattagctttgtgt

SEQ ID NO: 4093621 - DNA, 10 bp, Homo sapiens
ttctgattct

SEQ ID NO: 4093622 - DNA, 16 bp, Homo sapiens
ttctgattttaagttt

SEQ ID NO: 4093623 - DNA, 21 bp, Homo sapiens
ttctgcagcatgacctgtgac

SEQ ID NO: 4093624 - DNA, 23 bp, Homo sapiens
ttctgcagcatgacctgtgacca

SEQ ID NO: 4093625 - DNA, 20 bp, Homo sapiens
ttctgcagcccttgggcagt

SEQ ID NO: 4093626 - DNA, 23 bp, Homo sapiens
ttctgcatagcgaaataaaaatg

SEQ ID NO: 4093627 - DNA, 13 bp, Homo sapiens
ttctgcattgcta

SEQ ID NO: 4093628 - DNA, 23 bp, Homo sapiens
ttctgcattttattctggatgga

SEQ ID NO: 4093629 - DNA, 17 bp, Homo sapiens
ttctgcattttgctatt

SEQ ID NO: 4093630 - DNA, 22 bp, Homo sapiens
ttccttcccgccagagggcttg

SEQ ID NO: 4093631 - DNA, 11 bp, Homo sapiens
ttccttccctc

SEQ ID NO: 4093632 - DNA, 19 bp, Homo sapiens
ttccttcccttttctgttc

SEQ ID NO: 4093633 - DNA, 17 bp, Homo sapiens
ttccttcctaaaataat

SEQ ID NO: 4093634 - DNA, 15 bp, Homo sapiens
ttccttcctctgtaa

SEQ ID NO: 4093635 - DNA, 16 bp, Homo sapiens
ttccttctctgaacac

SEQ ID NO: 4093636 - DNA, 17 bp, Homo sapiens
ttccttctctgaacaca

SEQ ID NO: 4093637 - DNA, 22 bp, Homo sapiens
ttccttctctgaacacaggcag

SEQ ID NO: 4093638 - DNA, 21 bp, Homo sapiens
ttccttctggcctctgctgaa

SEQ ID NO: 4093639 - DNA, 17 bp, Homo sapiens
ttccttctgtgaaagta

SEQ ID NO: 4093640 - DNA, 23 bp, Homo sapiens
ttccttgaggggagccaggaggg

SEQ ID NO: 4093641 - DNA, 16 bp, Homo sapiens
ttccttgatcattttg

SEQ ID NO: 4093642 - DNA, 15 bp, Homo sapiens
ttccttgccagtctt

SEQ ID NO: 4093643 - DNA, 20 bp, Homo sapiens
ttccttggaggccaccggga

SEQ ID NO: 4093644 - DNA, 18 bp, Homo sapiens
ttccttgttgtttgcttt

SEQ ID NO: 4093645 - DNA, 19 bp, Homo sapiens
ttccttgttgtttgctttg

SEQ ID NO: 4093646 - DNA, 17 bp, Homo sapiens
ttcctttaaaaaaattt

SEQ ID NO: 4093647 - DNA, 18 bp, Homo sapiens
ttcctttatactgtgaag

SEQ ID NO: 4093648 - DNA, 19 bp, Homo sapiens
ttcctttatactgtgaagt

SEQ ID NO: 4093649 - DNA, 15 bp, Homo sapiens
ttcctttctctttct

SEQ ID NO: 4093650 - DNA, 17 bp, Homo sapiens
ttcctttctctttctct

SEQ ID NO: 4093651 - DNA, 22 bp, Homo sapiens
ttcctttctctttctctcttcc

SEQ ID NO: 4093652 - DNA, 20 bp, Homo sapiens
ttcctttcttggttcataaa

SEQ ID NO: 4093653 - DNA, 17 bp, Homo sapiens
ttcctttgggcctctgc

SEQ ID NO: 4093654 - DNA, 20 bp, Homo sapiens
ttccttttagcctagttcat

SEQ ID NO: 4093655 - DNA, 17 bp, Homo sapiens
ttccttttgtgtacagt

SEQ ID NO: 4093656 - DNA, 22 bp, Homo sapiens
ttcctttttaaatgtgaatttt

SEQ ID NO: 4093657 - DNA, 20 bp, Homo sapiens
ttcctttttaatatgcttaa

SEQ ID NO: 4093658 - DNA, 22 bp, Homo sapiens
ttcctttttctgattagctttg

SEQ ID NO: 4093659 - DNA, 16 bp, Homo sapiens
ttcctttttcttcgct

SEQ ID NO: 4093660 - DNA, 12 bp, Homo sapiens
ttcgaaactgcc

SEQ ID NO: 4093661 - DNA, 23 bp, Homo sapiens
ttcgaatcttaatttattatttt

SEQ ID NO: 4093662 - DNA, 15 bp, Homo sapiens
ttcgacatatttcct

SEQ ID NO: 4093663 - DNA, 20 bp, Homo sapiens
ttcgaggcctgaagccagct

SEQ ID NO: 4093664 - DNA, 19 bp, Homo sapiens
ttcgcatggtcacacactg

SEQ ID NO: 4093665 - DNA, 20 bp, Homo sapiens
ttcgcatggtcacacactga

SEQ ID NO: 4093666 - DNA, 15 bp, Homo sapiens
ttcgcctttcccacc

SEQ ID NO: 4093667 - DNA, 17 bp, Homo sapiens
ttcggggcgatgctccc

SEQ ID NO: 4093668 - DNA, 22 bp, Homo sapiens
ttcggggcgatgctccctcagc

SEQ ID NO: 4093669 - DNA, 21 bp, Homo sapiens
ttcgggtgtgcaatgtctgag

SEQ ID NO: 4093670 - DNA, 16 bp, Homo sapiens
ttcggtttcaaagtga

SEQ ID NO: 4093671 - DNA, 12 bp, Homo sapiens
ttcgtctgttgt

SEQ ID NO: 4093672 - DNA, 13 bp, Homo sapiens
ttcgtcttctaat

SEQ ID NO: 4093673 - DNA, 14 bp, Homo sapiens
ttcgtcttctaatt

SEQ ID NO: 4093674 - DNA, 16 bp, Homo sapiens
ttcgtcttctaatttc

SEQ ID NO: 4093675 - DNA, 15 bp, Homo sapiens
ttcgtgagctgggga

SEQ ID NO: 4093676 - DNA, 13 bp, Homo sapiens
ttcgtgcattttt

SEQ ID NO: 4093677 - DNA, 19 bp, Homo sapiens
ttcgttaactgtgtatgta

SEQ ID NO: 4093678 - DNA, 14 bp, Homo sapiens
ttctaaaaagatta

SEQ ID NO: 4093679 - DNA, 18 bp, Homo sapiens
ttctaaacccaatccaaa

SEQ ID NO: 4093680 - DNA, 20 bp, Homo sapiens
ttctaaagagcacttactgt

SEQ ID NO: 4093681 - DNA, 15 bp, Homo sapiens
ttctaaagctgaatg

SEQ ID NO: 4093682 - DNA, 12 bp, Homo sapiens
ttctaaatgaat

SEQ ID NO: 4093683 - DNA, 20 bp, Homo sapiens
ttctaaccttgaatgctgcc

SEQ ID NO: 4093684 - DNA, 23 bp, Homo sapiens
ttctaagatgccagcatatactg

SEQ ID NO: 4093685 - DNA, 21 bp, Homo sapiens
ttctaagccagttttcatttt

SEQ ID NO: 4093686 - DNA, 13 bp, Homo sapiens
ttctaatcaaaag

SEQ ID NO: 4093687 - DNA, 17 bp, Homo sapiens
ttctaatggaatggttt

SEQ ID NO: 4093688 - DNA, 20 bp, Homo sapiens
ttctaatttatattatccat

SEQ ID NO: 4093689 - DNA, 14 bp, Homo sapiens
ttctacaaccagag

SEQ ID NO: 4093690 - DNA, 15 bp, Homo sapiens
ttctacaaccagagc

SEQ ID NO: 4093691 - DNA, 16 bp, Homo sapiens
ttctacaatgtgaact

SEQ ID NO: 4093692 - DNA, 18 bp, Homo sapiens
ttctacaatgtgaacttt

SEQ ID NO: 4093693 - DNA, 19 bp, Homo sapiens
ttctacaatgtgaacttta

SEQ ID NO: 4093694 - DNA, 22 bp, Homo sapiens
ttctacataagtaattcaagaa

SEQ ID NO: 4093695 - DNA, 16 bp, Homo sapiens
ttctacatgactgggc

SEQ ID NO: 4093696 - DNA, 18 bp, Homo sapiens
ttctacatgactgggcct

SEQ ID NO: 4093697 - DNA, 20 bp, Homo sapiens
ttctacatttgagggcccag

SEQ ID NO: 4093698 - DNA, 19 bp, Homo sapiens
ttctaccaaggtcttctta

SEQ ID NO: 4093699 - DNA, 23 bp, Homo sapiens
ttctacctgtacacattcctgca

SEQ ID NO: 4093700 - DNA, 12 bp, Homo sapiens
ttctactcccct

SEQ ID NO: 4093701 - DNA, 17 bp, Homo sapiens
ttctactctgtcttaaa

SEQ ID NO: 4093702 - DNA, 13 bp, Homo sapiens
ttctactgtgact

SEQ ID NO: 4093703 - DNA, 18 bp, Homo sapiens
ttctactttaagcactac

SEQ ID NO: 4093704 - DNA, 23 bp, Homo sapiens
ttctagaaagcctgttcccctca

SEQ ID NO: 4093705 - DNA, 13 bp, Homo sapiens
ttctagaaccact

SEQ ID NO: 4093706 - DNA, 16 bp, Homo sapiens
ttctagaagcacatgt

SEQ ID NO: 4093707 - DNA, 20 bp, Homo sapiens
ttctagaagtttcccttcct

SEQ ID NO: 4093708 - DNA, 17 bp, Homo sapiens
ttctagctaatgtaata

SEQ ID NO: 4093709 - DNA, 14 bp, Homo sapiens
ttctagctctgact

SEQ ID NO: 4093710 - DNA, 23 bp, Homo sapiens
ttctaggcacaaggttggttgct

SEQ ID NO: 4093711 - DNA, 16 bp, Homo sapiens
ttctaggcatctctgt

SEQ ID NO: 4093712 - DNA, 19 bp, Homo sapiens
ttctaggcatctctgtact

SEQ ID NO: 4093713 - DNA, 20 bp, Homo sapiens
ttctaggcatctctgtactt

SEQ ID NO: 4093714 - DNA, 16 bp, Homo sapiens
ttctaggggagaagag

SEQ ID NO: 4093715 - DNA, 15 bp, Homo sapiens
ttctaggttctaaaa

SEQ ID NO: 4093716 - DNA, 23 bp, Homo sapiens
ttctagtctcctttgcactgagg

SEQ ID NO: 4093717 - DNA, 18 bp, Homo sapiens
ttctagtggtctttgtaa

SEQ ID NO: 4093718 - DNA, 19 bp, Homo sapiens
ttctagtggtctttgtaag

SEQ ID NO: 4093719 - DNA, 13 bp, Homo sapiens
ttctagttcagag

SEQ ID NO: 4093720 - DNA, 14 bp, Homo sapiens
ttctataacagata

SEQ ID NO: 4093721 - DNA, 13 bp, Homo sapiens
ttctataaggcca

SEQ ID NO: 4093722 - DNA, 20 bp, Homo sapiens
ttctataggaacatatgaaa

SEQ ID NO: 4093723 - DNA, 16 bp, Homo sapiens
ttctatattttaatag

SEQ ID NO: 4093724 - DNA, 17 bp, Homo sapiens
ttctatcacatatttga

SEQ ID NO: 4093725 - DNA, 17 bp, Homo sapiens
ttctatcgttattataa

SEQ ID NO: 4093726 - DNA, 21 bp, Homo sapiens
ttctatcgttattataaatgt

SEQ ID NO: 4093727 - DNA, 22 bp, Homo sapiens
ttctatcgttattataaatgtt

SEQ ID NO: 4093728 - DNA, 17 bp, Homo sapiens
ttctatgttaaatactg

SEQ ID NO: 4093729 - DNA, 20 bp, Homo sapiens
ttctatgttaaatactgtgc

SEQ ID NO: 4093730 - DNA, 15 bp, Homo sapiens
ttctattaaatagtt

SEQ ID NO: 4093731 - DNA, 12 bp, Homo sapiens
ttctattgcctt

SEQ ID NO: 4093732 - DNA, 18 bp, Homo sapiens
ttctattgccttctttga

SEQ ID NO: 4093733 - DNA, 10 bp, Homo sapiens
tgtcctgggc

SEQ ID NO: 4093734 - DNA, 21 bp, Homo sapiens
tgtcctggttccttcctatgc

SEQ ID NO: 4093735 - DNA, 16 bp, Homo sapiens
tgtcctgtacattgtg

SEQ ID NO: 4093736 - DNA, 18 bp, Homo sapiens
tgtcctgtcctttcttgc

SEQ ID NO: 4093737 - DNA, 20 bp, Homo sapiens
tgtccttagtgtataaaaac

SEQ ID NO: 4093738 - DNA, 16 bp, Homo sapiens
tgtccttccctgcatt

SEQ ID NO: 4093739 - DNA, 12 bp, Homo sapiens
tgtcctttcctt

SEQ ID NO: 4093740 - DNA, 15 bp, Homo sapiens
tgtcgatgcacagta

SEQ ID NO: 4093741 - DNA, 22 bp, Homo sapiens
tgtcgattaaaatcactctcag

SEQ ID NO: 4093742 - DNA, 18 bp, Homo sapiens
tgtcgctttctcagtgtg

SEQ ID NO: 4093743 - DNA, 20 bp, Homo sapiens
tgtcggagaggctgtctggg

SEQ ID NO: 4093744 - DNA, 22 bp, Homo sapiens
tgtcggagaggctgtctggggc

SEQ ID NO: 4093745 - DNA, 17 bp, Homo sapiens
tgtcggctccagtcccc

SEQ ID NO: 4093746 - DNA, 15 bp, Homo sapiens
tgtcgggcaccagcc

SEQ ID NO: 4093747 - DNA, 19 bp, Homo sapiens
tgtcgggcaccagccagcg

SEQ ID NO: 4093748 - DNA, 23 bp, Homo sapiens
tgtcgttaaaaagttgtttgttt

SEQ ID NO: 4093749 - DNA, 13 bp, Homo sapiens
tgtctaaaaacac

SEQ ID NO: 4093750 - DNA, 17 bp, Homo sapiens
tgtctaaacaatgctga

SEQ ID NO: 4093751 - DNA, 21 bp, Homo sapiens
tgtctaaacaatgctgatttg

SEQ ID NO: 4093752 - DNA, 22 bp, Homo sapiens
tgtctaaacaatgctgatttgg

SEQ ID NO: 4093753 - DNA, 18 bp, Homo sapiens
tgtctaactcagaattat

SEQ ID NO: 4093754 - DNA, 22 bp, Homo sapiens
tgtctaactttagaagtgcatt

SEQ ID NO: 4093755 - DNA, 15 bp, Homo sapiens
tgtctaagatagtaa

SEQ ID NO: 4093756 - DNA, 19 bp, Homo sapiens
tgtctaattgcatctcaaa

SEQ ID NO: 4093757 - DNA, 12 bp, Homo sapiens
tgtctacaaata

SEQ ID NO: 4093758 - DNA, 13 bp, Homo sapiens
tgtctacaaatat

SEQ ID NO: 4093759 - DNA, 13 bp, Homo sapiens
tgtctagaatgtg

SEQ ID NO: 4093760 - DNA, 15 bp, Homo sapiens
tgtctagaatgtgga

SEQ ID NO: 4093761 - DNA, 18 bp, Homo sapiens
tgtctagcacttccttgc

SEQ ID NO: 4093762 - DNA, 19 bp, Homo sapiens
tgtctagtgaggaagacaa

SEQ ID NO: 4093763 - DNA, 15 bp, Homo sapiens
tgtctataaaagaaa

SEQ ID NO: 4093764 - DNA, 15 bp, Homo sapiens
tgtctattttaaaat

SEQ ID NO: 4093765 - DNA, 16 bp, Homo sapiens
tgtctcaacgcctccc

SEQ ID NO: 4093766 - DNA, 17 bp, Homo sapiens
tgtctcaagagggcact

SEQ ID NO: 4093767 - DNA, 15 bp, Homo sapiens
tgtctcaataatata

SEQ ID NO: 4093768 - DNA, 15 bp, Homo sapiens
tgtctcagttttcag

SEQ ID NO: 4093769 - DNA, 18 bp, Homo sapiens
tgtctcatcctcctggaa

SEQ ID NO: 4093770 - DNA, 19 bp, Homo sapiens
tgtctcatcctcctggaac

SEQ ID NO: 4093771 - DNA, 22 bp, Homo sapiens
tgtctccactaaatgagctcct

SEQ ID NO: 4093772 - DNA, 23 bp, Homo sapiens
tgtctccactaaatgagctcctg

SEQ ID NO: 4093773 - DNA, 15 bp, Homo sapiens
tgtctccagctgcct

SEQ ID NO: 4093774 - DNA, 21 bp, Homo sapiens
tgtctccagctgcctgggccc

SEQ ID NO: 4093775 - DNA, 22 bp, Homo sapiens
tgtctctactaaaacgataaaa

SEQ ID NO: 4093776 - DNA, 12 bp, Homo sapiens
tgtctctcctgg

SEQ ID NO: 4093777 - DNA, 15 bp, Homo sapiens
tgtctctcctggctg

SEQ ID NO: 4093778 - DNA, 13 bp, Homo sapiens
tgtctcttagaaa

SEQ ID NO: 4093779 - DNA, 22 bp, Homo sapiens
tgtctctttaagggcatgcctt

SEQ ID NO: 4093780 - DNA, 23 bp, Homo sapiens
tgtctctttggcgacctcctttc

SEQ ID NO: 4093781 - DNA, 18 bp, Homo sapiens
tgtctgaacttgcattgt

SEQ ID NO: 4093782 - DNA, 19 bp, Homo sapiens
tgtctgaagtcactgcaca

SEQ ID NO: 4093783 - DNA, 15 bp, Homo sapiens
tgtctgagtgaacct

SEQ ID NO: 4093784 - DNA, 14 bp, Homo sapiens
tgtctgataatgat

SEQ ID NO: 4093785 - DNA, 15 bp, Homo sapiens
tgtctgcacccaggg

SEQ ID NO: 4093786 - DNA, 16 bp, Homo sapiens
tgtctgcacccagggg

SEQ ID NO: 4093787 - DNA, 19 bp, Homo sapiens
tgtctgccccagcccagat

SEQ ID NO: 4093788 - DNA, 16 bp, Homo sapiens
tgtctgcccttcaccc

SEQ ID NO: 4093789 - DNA, 13 bp, Homo sapiens
tgtctgcctggag

SEQ ID NO: 4093790 - DNA, 21 bp, Homo sapiens
tgtctgcctggagtgctgtgc

SEQ ID NO: 4093791 - DNA, 16 bp, Homo sapiens
tgtctgctccagctct

SEQ ID NO: 4093792 - DNA, 13 bp, Homo sapiens
tgtctgcttgtca

SEQ ID NO: 4093793 - DNA, 20 bp, Homo sapiens
tgtctgctttaaagggcctg

SEQ ID NO: 4093794 - DNA, 21 bp, Homo sapiens
tgtctgctttaaagggcctgc

SEQ ID NO: 4093795 - DNA, 13 bp, Homo sapiens
tgtctggcctgag

SEQ ID NO: 4093796 - DNA, 20 bp, Homo sapiens
tgtctggctttttcctctga

SEQ ID NO: 4093797 - DNA, 21 bp, Homo sapiens
tgtctggctttttcctctgag

SEQ ID NO: 4093798 - DNA, 19 bp, Homo sapiens
tgtctgggtttgagaaatg

SEQ ID NO: 4093799 - DNA, 23 bp, Homo sapiens
tgtctgtagctcctcaactcacc

SEQ ID NO: 4093800 - DNA, 20 bp, Homo sapiens
tgtctgtatttcatgtggct

SEQ ID NO: 4093801 - DNA, 22 bp, Homo sapiens
tgtctgtatttcatgtggctgt

SEQ ID NO: 4093802 - DNA, 14 bp, Homo sapiens
tgtctgtctggcac

SEQ ID NO: 4093803 - DNA, 21 bp, Homo sapiens
tgtctgtggatggtcattgca

SEQ ID NO: 4093804 - DNA, 15 bp, Homo sapiens
tgtctgtttaagaaa

SEQ ID NO: 4093805 - DNA, 16 bp, Homo sapiens
tgtctgtttaagaaaa

SEQ ID NO: 4093806 - DNA, 17 bp, Homo sapiens
tgtctgtttaagaaaag

SEQ ID NO: 4093807 - DNA, 14 bp, Homo sapiens
tgtcttaattatta

SEQ ID NO: 4093808 - DNA, 15 bp, Homo sapiens
tgtcttaattattat

SEQ ID NO: 4093809 - DNA, 15 bp, Homo sapiens
tgtcttcataaagta

SEQ ID NO: 4093810 - DNA, 17 bp, Homo sapiens
tgtcttccataatgtat

SEQ ID NO: 4093811 - DNA, 16 bp, Homo sapiens
tgtcttccatgtatct

SEQ ID NO: 4093812 - DNA, 15 bp, Homo sapiens
tgtcttcctagaatt

SEQ ID NO: 4093813 - DNA, 16 bp, Homo sapiens
tgtcttcctcaaaata

SEQ ID NO: 4093814 - DNA, 22 bp, Homo sapiens
tgtcttcctcaaaataaagaag

SEQ ID NO: 4093815 - DNA, 13 bp, Homo sapiens
tgtcttgcaactt

SEQ ID NO: 4093816 - DNA, 15 bp, Homo sapiens
tgtctttaaaagaga

SEQ ID NO: 4093817 - DNA, 14 bp, Homo sapiens
tgtctttaaataga

SEQ ID NO: 4093818 - DNA, 19 bp, Homo sapiens
tgtctttaggcagcagctt

SEQ ID NO: 4093819 - DNA, 16 bp, Homo sapiens
tgtctttatagatgta

SEQ ID NO: 4093820 - DNA, 19 bp, Homo sapiens
tgtctttcagatacatggt

SEQ ID NO: 4093821 - DNA, 13 bp, Homo sapiens
tgtctttcctgaa

SEQ ID NO: 4093822 - DNA, 19 bp, Homo sapiens
tgtctttctccaaagttat

SEQ ID NO: 4093823 - DNA, 11 bp, Homo sapiens
tgtctttgtaa

SEQ ID NO: 4093824 - DNA, 13 bp, Homo sapiens
tgtctttgtaagt

SEQ ID NO: 4093825 - DNA, 17 bp, Homo sapiens
tgtctttgtaagtcagt

SEQ ID NO: 4093826 - DNA, 18 bp, Homo sapiens
tgtcttttatatttgtat

SEQ ID NO: 4093827 - DNA, 17 bp, Homo sapiens
tgtcttttatgcagata

SEQ ID NO: 4093828 - DNA, 16 bp, Homo sapiens
tgtcttttcagaagca

SEQ ID NO: 4093829 - DNA, 13 bp, Homo sapiens
tgtcttttgtcat

SEQ ID NO: 4093830 - DNA, 23 bp, Homo sapiens
tgtctttttctggactgaagcct

SEQ ID NO: 4093831 - DNA, 12 bp, Homo sapiens
tgtgaaacatgg

SEQ ID NO: 4093832 - DNA, 23 bp, Homo sapiens
tgtgaaccctggggcctgactgc

SEQ ID NO: 4093833 - DNA, 19 bp, Homo sapiens
tgtgaacctacctgccttg

SEQ ID NO: 4093834 - DNA, 21 bp, Homo sapiens
tgtgaacgatttagaaagaag

SEQ ID NO: 4093835 - DNA, 20 bp, Homo sapiens
tgtgaactagggaagctcag

SEQ ID NO: 4093836 - DNA, 19 bp, Homo sapiens
tgtcactggctggctccta

SEQ ID NO: 4093837 - DNA, 12 bp, Homo sapiens
tgtcactgtggt

SEQ ID NO: 4093838 - DNA, 13 bp, Homo sapiens
tgtcactgtttct

SEQ ID NO: 4093839 - DNA, 15 bp, Homo sapiens
tgtcacttgtgcttt

SEQ ID NO: 4093840 - DNA, 17 bp, Homo sapiens
tgtcacttgtgctttgc

SEQ ID NO: 4093841 - DNA, 16 bp, Homo sapiens
tgtcagaaaccagtta

SEQ ID NO: 4093842 - DNA, 21 bp, Homo sapiens
tgtcagaaaccagttatgtga

SEQ ID NO: 4093843 - DNA, 18 bp, Homo sapiens
tgtcagaagcctccaagc

SEQ ID NO: 4093844 - DNA, 21 bp, Homo sapiens
tgtcagacagaacttgaatgt

SEQ ID NO: 4093845 - DNA, 20 bp, Homo sapiens
tgtcagacctatttgacata

SEQ ID NO: 4093846 - DNA, 20 bp, Homo sapiens
tgtcagaggcacaaaagggt

SEQ ID NO: 4093847 - DNA, 15 bp, Homo sapiens
tgtcagagtgttgtt

SEQ ID NO: 4093848 - DNA, 17 bp, Homo sapiens
tgtcagatttctggttg

SEQ ID NO: 4093849 - DNA, 11 bp, Homo sapiens
tgtcagccagc

SEQ ID NO: 4093850 - DNA, 15 bp, Homo sapiens
tgtcagccagccgcc

SEQ ID NO: 4093851 - DNA, 16 bp, Homo sapiens
tgtcagccagccgccc

SEQ ID NO: 4093852 - DNA, 22 bp, Homo sapiens
tgtcagccgagccgggcctggg

SEQ ID NO: 4093853 - DNA, 19 bp, Homo sapiens
tgtcagctactaatgatgt

SEQ ID NO: 4093854 - DNA, 19 bp, Homo sapiens
tgtcaggaaaacacccagg

SEQ ID NO: 4093855 - DNA, 17 bp, Homo sapiens
tgtcaggaacagaagga

SEQ ID NO: 4093856 - DNA, 11 bp, Homo sapiens
tgtcaggaggc

SEQ ID NO: 4093857 - DNA, 14 bp, Homo sapiens
tgtcagtatccagg

SEQ ID NO: 4093858 - DNA, 14 bp, Homo sapiens
tgtcagtcacagcc

SEQ ID NO: 4093859 - DNA, 17 bp, Homo sapiens
tgtcataagaatgaata

SEQ ID NO: 4093860 - DNA, 20 bp, Homo sapiens
tgtcatagttatgtgatttt

SEQ ID NO: 4093861 - DNA, 20 bp, Homo sapiens
tgtcatccttggtctttgta

SEQ ID NO: 4093862 - DNA, 23 bp, Homo sapiens
tgtcatccttggtctttgtatct

SEQ ID NO: 4093863 - DNA, 22 bp, Homo sapiens
tgtcatctctctggggccctgg

SEQ ID NO: 4093864 - DNA, 17 bp, Homo sapiens
tgtcatgcttcatcatt

SEQ ID NO: 4093865 - DNA, 22 bp, Homo sapiens
tgtcatgcttcatcattccctc

SEQ ID NO: 4093866 - DNA, 13 bp, Homo sapiens
tgtcattaaaggt

SEQ ID NO: 4093867 - DNA, 17 bp, Homo sapiens
tgtcattgcttcttctg

SEQ ID NO: 4093868 - DNA, 20 bp, Homo sapiens
tgtcatttcattccattgcc

SEQ ID NO: 4093869 - DNA, 13 bp, Homo sapiens
tgtcatttcttca

SEQ ID NO: 4093870 - DNA, 17 bp, Homo sapiens
tgtccaaagaggctgcc

SEQ ID NO: 4093871 - DNA, 16 bp, Homo sapiens
tgtccagcacagaagg

SEQ ID NO: 4093872 - DNA, 15 bp, Homo sapiens
tgtccagcagtctga

SEQ ID NO: 4093873 - DNA, 12 bp, Homo sapiens
tgtccagcctgg

SEQ ID NO: 4093874 - DNA, 23 bp, Homo sapiens
tgtccagcctgggcagccaggct

SEQ ID NO: 4093875 - DNA, 20 bp, Homo sapiens
tgtccagctccaacctgcaa

SEQ ID NO: 4093876 - DNA, 23 bp, Homo sapiens
tgtccagctccaacctgcaaaga

SEQ ID NO: 4093877 - DNA, 15 bp, Homo sapiens
tgtccatggcctttc

SEQ ID NO: 4093878 - DNA, 17 bp, Homo sapiens
tgtccatggcctttcta

SEQ ID NO: 4093879 - DNA, 21 bp, Homo sapiens
tgtccatttatccacaggaaa

SEQ ID NO: 4093880 - DNA, 11 bp, Homo sapiens
tgtcccaccca

SEQ ID NO: 4093881 - DNA, 12 bp, Homo sapiens
tgtcccacccac

SEQ ID NO: 4093882 - DNA, 19 bp, Homo sapiens
tgtcccacccacacagctg

SEQ ID NO: 4093883 - DNA, 23 bp, Homo sapiens
tgtcccacccacacagctgccct

SEQ ID NO: 4093884 - DNA, 23 bp, Homo sapiens
tgtcccacccccacccccagctc

SEQ ID NO: 4093885 - DNA, 20 bp, Homo sapiens
tgtcccacccccttccccca

SEQ ID NO: 4093886 - DNA, 22 bp, Homo sapiens
tgtcccactacatctgggactg

SEQ ID NO: 4093887 - DNA, 17 bp, Homo sapiens
tgtcccatgcaggccct

SEQ ID NO: 4093888 - DNA, 17 bp, Homo sapiens
tgtcccatggacactcc

SEQ ID NO: 4093889 - DNA, 20 bp, Homo sapiens
tgtcccatgtgagctgctgc

SEQ ID NO: 4093890 - DNA, 22 bp, Homo sapiens
tgtcccatgtgagctgctgcca

SEQ ID NO: 4093891 - DNA, 13 bp, Homo sapiens
tgtcccatttcct

SEQ ID NO: 4093892 - DNA, 21 bp, Homo sapiens
tgtcccatttccttggaggcc

SEQ ID NO: 4093893 - DNA, 17 bp, Homo sapiens
tgtccccaccctccact

SEQ ID NO: 4093894 - DNA, 18 bp, Homo sapiens
tgtccccaccctccactc

SEQ ID NO: 4093895 - DNA, 19 bp, Homo sapiens
tgtccccaccctccactca

SEQ ID NO: 4093896 - DNA, 14 bp, Homo sapiens
tgtcccccaggctg

SEQ ID NO: 4093897 - DNA, 17 bp, Homo sapiens
tgtccccctacccaccg

SEQ ID NO: 4093898 - DNA, 16 bp, Homo sapiens
tgtcccctcactctgt

SEQ ID NO: 4093899 - DNA, 21 bp, Homo sapiens
tgtccccttggcaggtcctgg

SEQ ID NO: 4093900 - DNA, 14 bp, Homo sapiens
tgtccctccccctt

SEQ ID NO: 4093901 - DNA, 15 bp, Homo sapiens
tgtccctcccttgct

SEQ ID NO: 4093902 - DNA, 14 bp, Homo sapiens
tgtccctcttcact

SEQ ID NO: 4093903 - DNA, 16 bp, Homo sapiens
tgtccctcttcactcc

SEQ ID NO: 4093904 - DNA, 15 bp, Homo sapiens
tgtccctgaaaccta

SEQ ID NO: 4093905 - DNA, 15 bp, Homo sapiens
tgtccctggcttcct

SEQ ID NO: 4093906 - DNA, 14 bp, Homo sapiens
tgtccctgggccag

SEQ ID NO: 4093907 - DNA, 15 bp, Homo sapiens
tgtccctgggccagg

SEQ ID NO: 4093908 - DNA, 12 bp, Homo sapiens
tgtcccttgcct

SEQ ID NO: 4093909 - DNA, 12 bp, Homo sapiens
tgtcccttgctg

SEQ ID NO: 4093910 - DNA, 15 bp, Homo sapiens
tgtccctttccctac

SEQ ID NO: 4093911 - DNA, 14 bp, Homo sapiens
tgtccctttcttct

SEQ ID NO: 4093912 - DNA, 17 bp, Homo sapiens
tgtccctttcttctccc

SEQ ID NO: 4093913 - DNA, 13 bp, Homo sapiens
tgtccgagaacta

SEQ ID NO: 4093914 - DNA, 15 bp, Homo sapiens
tgtccgctgggtggt

SEQ ID NO: 4093915 - DNA, 16 bp, Homo sapiens
tgtcctaattcttctg

SEQ ID NO: 4093916 - DNA, 20 bp, Homo sapiens
tgtcctaattcttctgtcct

SEQ ID NO: 4093917 - DNA, 16 bp, Homo sapiens
tgtcctacgtccaagg

SEQ ID NO: 4093918 - DNA, 22 bp, Homo sapiens
tgtcctcagccttgccagagat

SEQ ID NO: 4093919 - DNA, 14 bp, Homo sapiens
tgtcctcagggagc

SEQ ID NO: 4093920 - DNA, 19 bp, Homo sapiens
tgtcctcagggagcaggga

SEQ ID NO: 4093921 - DNA, 17 bp, Homo sapiens
tgtcctcatgacccctc

SEQ ID NO: 4093922 - DNA, 23 bp, Homo sapiens
tgtcctccaagtgccccctcacc

SEQ ID NO: 4093923 - DNA, 21 bp, Homo sapiens
tgtcctccagaagcctctggc

SEQ ID NO: 4093924 - DNA, 22 bp, Homo sapiens
tgtcctccagaagcctctggct

SEQ ID NO: 4093925 - DNA, 17 bp, Homo sapiens
tgtcctcccatcccctg

SEQ ID NO: 4093926 - DNA, 23 bp, Homo sapiens
tgtcctcccatcccctggactgg

SEQ ID NO: 4093927 - DNA, 14 bp, Homo sapiens
tgtcctcctgctgc

SEQ ID NO: 4093928 - DNA, 20 bp, Homo sapiens
tgtcctctcccctccagcct

SEQ ID NO: 4093929 - DNA, 13 bp, Homo sapiens
tgtcctcttccct

SEQ ID NO: 4093930 - DNA, 14 bp, Homo sapiens
tgtcctcttctgct

SEQ ID NO: 4093931 - DNA, 21 bp, Homo sapiens
tgtcctcttctgctcttttcc

SEQ ID NO: 4093932 - DNA, 15 bp, Homo sapiens
tgtcctcttgctcaa

SEQ ID NO: 4093933 - DNA, 22 bp, Homo sapiens
tgtcctgaaacgctcctttgtg

SEQ ID NO: 4093934 - DNA, 10 bp, Homo sapiens
tgtcctgcct

SEQ ID NO: 4093935 - DNA, 22 bp, Homo sapiens
tgtcctgcctgcaatatttgaa

SEQ ID NO: 4093936 - DNA, 21 bp, Homo sapiens
tgtcctgcctgtctgccccag

SEQ ID NO: 4093937 - DNA, 16 bp, Homo sapiens
tgtcctgctggcttcc

SEQ ID NO: 4093938 - DNA, 19 bp, Homo sapiens
tgtcctgctggcttccagc

SEQ ID NO: 4093939 - DNA, 17 bp, Homo sapiens
tgtagggttataataat

SEQ ID NO: 4093940 - DNA, 16 bp, Homo sapiens
tgtagtaattgacatg

SEQ ID NO: 4093941 - DNA, 22 bp, Homo sapiens
tgtagtagcgttttttaaatgt

SEQ ID NO: 4093942 - DNA, 15 bp, Homo sapiens
tgtagtataaagaaa

SEQ ID NO: 4093943 - DNA, 14 bp, Homo sapiens
tgtagtcatttact

SEQ ID NO: 4093944 - DNA, 24 bp, Homo sapiens
tgtagtcatttactaaacatatga

SEQ ID NO: 4093945 - DNA, 14 bp, Homo sapiens
tgtagttaatttat

SEQ ID NO: 4093946 - DNA, 18 bp, Homo sapiens
tgtagttacctactgagt

SEQ ID NO: 4093947 - DNA, 16 bp, Homo sapiens
tgtagttctgccaggc

SEQ ID NO: 4093948 - DNA, 23 bp, Homo sapiens
tgtataaacataagttgcattta

SEQ ID NO: 4093949 - DNA, 18 bp, Homo sapiens
tgtataaatgtctattat

SEQ ID NO: 4093950 - DNA, 13 bp, Homo sapiens
tgtataagttatt

SEQ ID NO: 4093951 - DNA, 23 bp, Homo sapiens
tgtataagttatttttgtacatg

SEQ ID NO: 4093952 - DNA, 12 bp, Homo sapiens
tgtataatttcg

SEQ ID NO: 4093953 - DNA, 22 bp, Homo sapiens
tgtatacagtgcagagccttct

SEQ ID NO: 4093954 - DNA, 15 bp, Homo sapiens
tgtatactatagtac

SEQ ID NO: 4093955 - DNA, 17 bp, Homo sapiens
tgtatactatagtacca

SEQ ID NO: 4093956 - DNA, 14 bp, Homo sapiens
tgtatataaatgtg

SEQ ID NO: 4093957 - DNA, 17 bp, Homo sapiens
tgtatatacagttattt

SEQ ID NO: 4093958 - DNA, 12 bp, Homo sapiens
tgtatatacttt

SEQ ID NO: 4093959 - DNA, 14 bp, Homo sapiens
tgtatatagttttt

SEQ ID NO: 4093960 - DNA, 16 bp, Homo sapiens
tgtatatcattctaca

SEQ ID NO: 4093961 - DNA, 17 bp, Homo sapiens
tgtatatccttccaaaa

SEQ ID NO: 4093962 - DNA, 18 bp, Homo sapiens
tgtatatgacatttaaat

SEQ ID NO: 4093963 - DNA, 13 bp, Homo sapiens
tgtatatgtttat

SEQ ID NO: 4093964 - DNA, 19 bp, Homo sapiens
tgtatatttgtatattaca

SEQ ID NO: 4093965 - DNA, 22 bp, Homo sapiens
tgtatatttgtgatagcacttt

SEQ ID NO: 4093966 - DNA, 19 bp, Homo sapiens
tgtatatttttatattgtt

SEQ ID NO: 4093967 - DNA, 14 bp, Homo sapiens
tgtatcaggtcagg

SEQ ID NO: 4093968 - DNA, 18 bp, Homo sapiens
tgtatcaggtcagggact

SEQ ID NO: 4093969 - DNA, 19 bp, Homo sapiens
tgtatcagtgtcctttcca

SEQ ID NO: 4093970 - DNA, 20 bp, Homo sapiens
tgtatcagtgtcctttccag

SEQ ID NO: 4093971 - DNA, 17 bp, Homo sapiens
tgtatcatttgaacaac

SEQ ID NO: 4093972 - DNA, 18 bp, Homo sapiens
tgtatcggagacagtgat

SEQ ID NO: 4093973 - DNA, 21 bp, Homo sapiens
tgtatctcatttaatttgtta

SEQ ID NO: 4093974 - DNA, 16 bp, Homo sapiens
tgtatcttccatattt

SEQ ID NO: 4093975 - DNA, 15 bp, Homo sapiens
tgtatgactaaagag

SEQ ID NO: 4093976 - DNA, 16 bp, Homo sapiens
tgtatgatctctctag

SEQ ID NO: 4093977 - DNA, 14 bp, Homo sapiens
tgtatgcactttgt

SEQ ID NO: 4093978 - DNA, 16 bp, Homo sapiens
tgtatgccaagtgaga

SEQ ID NO: 4093979 - DNA, 15 bp, Homo sapiens
tgtatggaaacactg

SEQ ID NO: 4093980 - DNA, 19 bp, Homo sapiens
tgtatggaaacactgattt

SEQ ID NO: 4093981 - DNA, 20 bp, Homo sapiens
tgtatggaaacactgatttt

SEQ ID NO: 4093982 - DNA, 17 bp, Homo sapiens
tgtatggaatacagtgt

SEQ ID NO: 4093983 - DNA, 13 bp, Homo sapiens
tgtatgtacatat

SEQ ID NO: 4093984 - DNA, 14 bp, Homo sapiens
tgtatgtattatta

SEQ ID NO: 4093985 - DNA, 22 bp, Homo sapiens
tgtatgtcaataaacaacagct

SEQ ID NO: 4093986 - DNA, 19 bp, Homo sapiens
tgtatgtgcactgtcactt

SEQ ID NO: 4093987 - DNA, 21 bp, Homo sapiens
tgtatgtgtctgctaatgtaa

SEQ ID NO: 4093988 - DNA, 15 bp, Homo sapiens
tgtatgttatgatat

SEQ ID NO: 4093989 - DNA, 21 bp, Homo sapiens
tgtatgttattatattccgta

SEQ ID NO: 4093990 - DNA, 18 bp, Homo sapiens
tgtatgtttctgcatagc

SEQ ID NO: 4093991 - DNA, 14 bp, Homo sapiens
tgtatgtttgcaca

SEQ ID NO: 4093992 - DNA, 22 bp, Homo sapiens
tgtatgtttgcacacttgtgtg

SEQ ID NO: 4093993 - DNA, 21 bp, Homo sapiens
tgtattaaaacacattatgta

SEQ ID NO: 4093994 - DNA, 19 bp, Homo sapiens
tgtattatacttagtcaaa

SEQ ID NO: 4093995 - DNA, 14 bp, Homo sapiens
tgtattcatccaga

SEQ ID NO: 4093996 - DNA, 17 bp, Homo sapiens
tgtattcccatatcaaa

SEQ ID NO: 4093997 - DNA, 17 bp, Homo sapiens
tgtattcgtgcattttt

SEQ ID NO: 4093998 - DNA, 22 bp, Homo sapiens
tgtattgctgctgtgcgtggaa

SEQ ID NO: 4093999 - DNA, 17 bp, Homo sapiens
tgtattgtaactatgtt

SEQ ID NO: 4094000 - DNA, 22 bp, Homo sapiens
tgtatttatacccccaggaaac

SEQ ID NO: 4094001 - DNA, 22 bp, Homo sapiens
tgtatttattaatttgaaacca

SEQ ID NO: 4094002 - DNA, 13 bp, Homo sapiens
tgtatttcttata

SEQ ID NO: 4094003 - DNA, 14 bp, Homo sapiens
tgtattttaactca

SEQ ID NO: 4094004 - DNA, 17 bp, Homo sapiens
tgtattttatcttattt

SEQ ID NO: 4094005 - DNA, 13 bp, Homo sapiens
tgtattttgaaga

SEQ ID NO: 4094006 - DNA, 22 bp, Homo sapiens
tgtatttttgttagtttacaat

SEQ ID NO: 4094007 - DNA, 19 bp, Homo sapiens
tgtattttttaattgattt

SEQ ID NO: 4094008 - DNA, 22 bp, Homo sapiens
tgtatttttttttctaagagaa

SEQ ID NO: 4094009 - DNA, 21 bp, Homo sapiens
tgtcaaacagtgccaaatgct

SEQ ID NO: 4094010 - DNA, 15 bp, Homo sapiens
tgtcaactatgatat

SEQ ID NO: 4094011 - DNA, 15 bp, Homo sapiens
tgtcaacttctggct

SEQ ID NO: 4094012 - DNA, 19 bp, Homo sapiens
tgtcaagctgaccttgctg

SEQ ID NO: 4094013 - DNA, 13 bp, Homo sapiens
tgtcaagtcctga

SEQ ID NO: 4094014 - DNA, 21 bp, Homo sapiens
tgtcaagtcctgactgggctg

SEQ ID NO: 4094015 - DNA, 18 bp, Homo sapiens
tgtcaagtctctgctggc

SEQ ID NO: 4094016 - DNA, 18 bp, Homo sapiens
tgtcaataaacaacagct

SEQ ID NO: 4094017 - DNA, 21 bp, Homo sapiens
tgtcaataaacagcttcatgc

SEQ ID NO: 4094018 - DNA, 17 bp, Homo sapiens
tgtcaataaagctgtgc

SEQ ID NO: 4094019 - DNA, 13 bp, Homo sapiens
tgtcaatattaaa

SEQ ID NO: 4094020 - DNA, 17 bp, Homo sapiens
tgtcaatattaaataca

SEQ ID NO: 4094021 - DNA, 17 bp, Homo sapiens
tgtcaatatttaaacat

SEQ ID NO: 4094022 - DNA, 19 bp, Homo sapiens
tgtcaatttccctcaggtt

SEQ ID NO: 4094023 - DNA, 17 bp, Homo sapiens
tgtcacaacctctctga

SEQ ID NO: 4094024 - DNA, 21 bp, Homo sapiens
tgtcacaagtggtgtttattg

SEQ ID NO: 4094025 - DNA, 16 bp, Homo sapiens
tgtcacaataaatgta

SEQ ID NO: 4094026 - DNA, 14 bp, Homo sapiens
tgtcacaccagcca

SEQ ID NO: 4094027 - DNA, 14 bp, Homo sapiens
tgtcacagaaatca

SEQ ID NO: 4094028 - DNA, 16 bp, Homo sapiens
tgtcacattgcattct

SEQ ID NO: 4094029 - DNA, 14 bp, Homo sapiens
tgtcaccaaggaaa

SEQ ID NO: 4094030 - DNA, 13 bp, Homo sapiens
tgtcacccccact

SEQ ID NO: 4094031 - DNA, 15 bp, Homo sapiens
tgtcacccccactcc

SEQ ID NO: 4094032 - DNA, 18 bp, Homo sapiens
tgtcaccggtcagtgcct

SEQ ID NO: 4094033 - DNA, 16 bp, Homo sapiens
tgtcaccgtgagcagc

SEQ ID NO: 4094034 - DNA, 20 bp, Homo sapiens
tgtcacctctctcagagcat

SEQ ID NO: 4094035 - DNA, 13 bp, Homo sapiens
tgtcacctctgtt

SEQ ID NO: 4094036 - DNA, 17 bp, Homo sapiens
tgtcacctgcttctctg

SEQ ID NO: 4094037 - DNA, 18 bp, Homo sapiens
tgtcacggggttccctcc

SEQ ID NO: 4094038 - DNA, 22 bp, Homo sapiens
tgtcactactcacagtctcttt

SEQ ID NO: 4094039 - DNA, 16 bp, Homo sapiens
tgtcactcattgctga

SEQ ID NO: 4094040 - DNA, 21 bp, Homo sapiens
tgtcactcattgctgagcctc

SEQ ID NO: 4094041 - DNA, 15 bp, Homo sapiens
tgtcactggctggct

SEQ ID NO: 4094042 - DNA, 21 bp, Homo sapiens
tgtaatggtactgactttgct

SEQ ID NO: 4094043 - DNA, 22 bp, Homo sapiens
tgtaatgtccctttcagagaca

SEQ ID NO: 4094044 - DNA, 22 bp, Homo sapiens
tgtaatgttactgatcatgcat

SEQ ID NO: 4094045 - DNA, 13 bp, Homo sapiens
tgtaattaaaact

SEQ ID NO: 4094046 - DNA, 17 bp, Homo sapiens
tgtaattaagtactatg

SEQ ID NO: 4094047 - DNA, 21 bp, Homo sapiens
tgtaattaagtactatgtatc

SEQ ID NO: 4094048 - DNA, 15 bp, Homo sapiens
tgtaattatgatttg

SEQ ID NO: 4094049 - DNA, 14 bp, Homo sapiens
tgtaattcaaaaga

SEQ ID NO: 4094050 - DNA, 16 bp, Homo sapiens
tgtaattctaaatgaa

SEQ ID NO: 4094051 - DNA, 14 bp, Homo sapiens
tgtaattcttcagt

SEQ ID NO: 4094052 - DNA, 15 bp, Homo sapiens
tgtaattgaataaag

SEQ ID NO: 4094053 - DNA, 15 bp, Homo sapiens
tgtaattgcttacat

SEQ ID NO: 4094054 - DNA, 16 bp, Homo sapiens
tgtaattgctttttta

SEQ ID NO: 4094055 - DNA, 10 bp, Homo sapiens
tgtaattgtg

SEQ ID NO: 4094056 - DNA, 13 bp, Homo sapiens
tgtaatttatgca

SEQ ID NO: 4094057 - DNA, 14 bp, Homo sapiens
tgtaatttatgcaa

SEQ ID NO: 4094058 - DNA, 23 bp, Homo sapiens
tgtacaaagtagaagtcttagat

SEQ ID NO: 4094059 - DNA, 14 bp, Homo sapiens
tgtacaaatgtatt

SEQ ID NO: 4094060 - DNA, 22 bp, Homo sapiens
tgtacaagttgttattgttgaa

SEQ ID NO: 4094061 - DNA, 20 bp, Homo sapiens
tgtacacattcctgcattca

SEQ ID NO: 4094062 - DNA, 17 bp, Homo sapiens
tgtacactaacatttcc

SEQ ID NO: 4094063 - DNA, 20 bp, Homo sapiens
tgtacactgaatatttatat

SEQ ID NO: 4094064 - DNA, 18 bp, Homo sapiens
tgtacactgctgtaccca

SEQ ID NO: 4094065 - DNA, 23 bp, Homo sapiens
tgtacagaatatttctattgaat

SEQ ID NO: 4094066 - DNA, 15 bp, Homo sapiens
tgtacagaatttcca

SEQ ID NO: 4094067 - DNA, 18 bp, Homo sapiens
tgtacagaatttccactg

SEQ ID NO: 4094068 - DNA, 16 bp, Homo sapiens
tgtacaggaactgcat

SEQ ID NO: 4094069 - DNA, 14 bp, Homo sapiens
tgtacagtgttacc

SEQ ID NO: 4094070 - DNA, 17 bp, Homo sapiens
tgtacagttatttatgc

SEQ ID NO: 4094071 - DNA, 11 bp, Homo sapiens
tgtacataaaa

SEQ ID NO: 4094072 - DNA, 23 bp, Homo sapiens
tgtacataaattgcataaagcat

SEQ ID NO: 4094073 - DNA, 17 bp, Homo sapiens
tgtacataactcctgtc

SEQ ID NO: 4094074 - DNA, 20 bp, Homo sapiens
tgtacataactcctgtccct

SEQ ID NO: 4094075 - DNA, 23 bp, Homo sapiens
tgtacataactctgtaaaaacac

SEQ ID NO: 4094076 - DNA, 21 bp, Homo sapiens
tgtacataccctggccgcccc

SEQ ID NO: 4094077 - DNA, 21 bp, Homo sapiens
tgtacatacctccttgcacaa

SEQ ID NO: 4094078 - DNA, 22 bp, Homo sapiens
tgtacatagttatttttctctt

SEQ ID NO: 4094079 - DNA, 20 bp, Homo sapiens
tgtacatatgtgctggaatt

SEQ ID NO: 4094080 - DNA, 15 bp, Homo sapiens
tgtacatattactgt

SEQ ID NO: 4094081 - DNA, 19 bp, Homo sapiens
tgtacatctattttggatt

SEQ ID NO: 4094082 - DNA, 20 bp, Homo sapiens
tgtacatctattttggattg

SEQ ID NO: 4094083 - DNA, 14 bp, Homo sapiens
tgtacatctggcct

SEQ ID NO: 4094084 - DNA, 20 bp, Homo sapiens
tgtacatttatgatttaata

SEQ ID NO: 4094085 - DNA, 23 bp, Homo sapiens
tgtacatttatttattactgtcc

SEQ ID NO: 4094086 - DNA, 21 bp, Homo sapiens
tgtaccaaatctgacatatta

SEQ ID NO: 4094087 - DNA, 16 bp, Homo sapiens
tgtaccatcattttat

SEQ ID NO: 4094088 - DNA, 21 bp, Homo sapiens
tgtaccatgaaacaaagctgc

SEQ ID NO: 4094089 - DNA, 14 bp, Homo sapiens
tgtaccatttgcct

SEQ ID NO: 4094090 - DNA, 14 bp, Homo sapiens
tgtacccagatgcc

SEQ ID NO: 4094091 - DNA, 15 bp, Homo sapiens
tgtaccctttaagat

SEQ ID NO: 4094092 - DNA, 23 bp, Homo sapiens
tgtaccctttaagatatccatct

SEQ ID NO: 4094093 - DNA, 19 bp, Homo sapiens
tgtacctgtgtacataact

SEQ ID NO: 4094094 - DNA, 21 bp, Homo sapiens
tgtaccttttgaggagcccca

SEQ ID NO: 4094095 - DNA, 18 bp, Homo sapiens
tgtacggattttcagtta

SEQ ID NO: 4094096 - DNA, 14 bp, Homo sapiens
tgtactacctgtgt

SEQ ID NO: 4094097 - DNA, 17 bp, Homo sapiens
tgtactacctgtgtata

SEQ ID NO: 4094098 - DNA, 12 bp, Homo sapiens
tgtactcctccc

SEQ ID NO: 4094099 - DNA, 13 bp, Homo sapiens
tgtactcctccca

SEQ ID NO: 4094100 - DNA, 17 bp, Homo sapiens
tgtactgagccttgtaa

SEQ ID NO: 4094101 - DNA, 22 bp, Homo sapiens
tgtactgagccttgtaattcta

SEQ ID NO: 4094102 - DNA, 19 bp, Homo sapiens
tgtactgcatatgaaagga

SEQ ID NO: 4094103 - DNA, 18 bp, Homo sapiens
tgtactgcatgttaccat

SEQ ID NO: 4094104 - DNA, 12 bp, Homo sapiens
tgtactgtagtt

SEQ ID NO: 4094105 - DNA, 20 bp, Homo sapiens
tgtacttaataaattcagat

SEQ ID NO: 4094106 - DNA, 23 bp, Homo sapiens
tgtacttgaagtctaaaagcaga

SEQ ID NO: 4094107 - DNA, 18 bp, Homo sapiens
tgtactttgcttgctcat

SEQ ID NO: 4094108 - DNA, 22 bp, Homo sapiens
tgtagaaaggaagccttgctca

SEQ ID NO: 4094109 - DNA, 19 bp, Homo sapiens
tgtagaacactaattcata

SEQ ID NO: 4094110 - DNA, 15 bp, Homo sapiens
tgtagaagcattcct

SEQ ID NO: 4094111 - DNA, 11 bp, Homo sapiens
tgtagactagt

SEQ ID NO: 4094112 - DNA, 14 bp, Homo sapiens
tgtagactgtggct

SEQ ID NO: 4094113 - DNA, 17 bp, Homo sapiens
tgtagagtgtagactgt

SEQ ID NO: 4094114 - DNA, 15 bp, Homo sapiens
tgtagagttaagaag

SEQ ID NO: 4094115 - DNA, 20 bp, Homo sapiens
tgtagagttgctgagagggc

SEQ ID NO: 4094116 - DNA, 21 bp, Homo sapiens
tgtagataaataatgtagttt

SEQ ID NO: 4094117 - DNA, 22 bp, Homo sapiens
tgtagatcccaagatgactggg

SEQ ID NO: 4094118 - DNA, 19 bp, Homo sapiens
tgtagccacagctgctgtt

SEQ ID NO: 4094119 - DNA, 24 bp, Homo sapiens
tgtagccacagctgctgttctcag

SEQ ID NO: 4094120 - DNA, 18 bp, Homo sapiens
tgtagccagctgtgcact

SEQ ID NO: 4094121 - DNA, 20 bp, Homo sapiens
tgtagccaggtatggctctg

SEQ ID NO: 4094122 - DNA, 21 bp, Homo sapiens
tgtagccaggtatggctctgc

SEQ ID NO: 4094123 - DNA, 16 bp, Homo sapiens
tgtagccatctgcaca

SEQ ID NO: 4094124 - DNA, 14 bp, Homo sapiens
tgtagcccacactt

SEQ ID NO: 4094125 - DNA, 23 bp, Homo sapiens
tgtagcccatccttccctttgga

SEQ ID NO: 4094126 - DNA, 16 bp, Homo sapiens
tgtagccccctggcct

SEQ ID NO: 4094127 - DNA, 20 bp, Homo sapiens
tgtagccccctggcctctgt

SEQ ID NO: 4094128 - DNA, 12 bp, Homo sapiens
tgtagccttttt

SEQ ID NO: 4094129 - DNA, 16 bp, Homo sapiens
tgtagcgtgtttacat

SEQ ID NO: 4094130 - DNA, 17 bp, Homo sapiens
tgtagcgtgtttacatg

SEQ ID NO: 4094131 - DNA, 16 bp, Homo sapiens
tgtagcttcttctgaa

SEQ ID NO: 4094132 - DNA, 17 bp, Homo sapiens
tgtagcttcttctgaaa

SEQ ID NO: 4094133 - DNA, 21 bp, Homo sapiens
tgtagcttcttctgaaagaat

SEQ ID NO: 4094134 - DNA, 21 bp, Homo sapiens
tgtaggaaccgtggtatgtct

SEQ ID NO: 4094135 - DNA, 19 bp, Homo sapiens
tgtaggaaggtctcattct

SEQ ID NO: 4094136 - DNA, 20 bp, Homo sapiens
tgtaggaaggtctcattctt

SEQ ID NO: 4094137 - DNA, 18 bp, Homo sapiens
tgtaggaaggttaatgtt

SEQ ID NO: 4094138 - DNA, 18 bp, Homo sapiens
tgtaggatttttttcctc

SEQ ID NO: 4094139 - DNA, 21 bp, Homo sapiens
tgtaggctggggcggggccca

SEQ ID NO: 4094140 - DNA, 17 bp, Homo sapiens
tgtagggagaagcttta

SEQ ID NO: 4094141 - DNA, 16 bp, Homo sapiens
tgtagggctggaccta

SEQ ID NO: 4094142 - DNA, 19 bp, Homo sapiens
tgtaggggacgagaaagat

SEQ ID NO: 4094143 - DNA, 16 bp, Homo sapiens
tgtagggttacagaga

SEQ ID NO: 4094144 - DNA, 16 bp, Homo sapiens
tggtgtggattttcta

SEQ ID NO: 4094145 - DNA, 16 bp, Homo sapiens
tggtgttgacatacat

SEQ ID NO: 4094146 - DNA, 17 bp, Homo sapiens
tggttacagtgcagaca

SEQ ID NO: 4094147 - DNA, 19 bp, Homo sapiens
tggttacagtgcagacagg

SEQ ID NO: 4094148 - DNA, 14 bp, Homo sapiens
tggttactcagggt

SEQ ID NO: 4094149 - DNA, 14 bp, Homo sapiens
tggttacttcttct

SEQ ID NO: 4094150 - DNA, 13 bp, Homo sapiens
tggttatgaaaga

SEQ ID NO: 4094151 - DNA, 15 bp, Homo sapiens
tggttatgaaagaat

SEQ ID NO: 4094152 - DNA, 13 bp, Homo sapiens
tggttattctaag

SEQ ID NO: 4094153 - DNA, 19 bp, Homo sapiens
tggttattctaagcccttt

SEQ ID NO: 4094154 - DNA, 15 bp, Homo sapiens
tggttatttctctga

SEQ ID NO: 4094155 - DNA, 15 bp, Homo sapiens
tggttcataaatgaa

SEQ ID NO: 4094156 - DNA, 17 bp, Homo sapiens
tggttccatgcctgagg

SEQ ID NO: 4094157 - DNA, 19 bp, Homo sapiens
tggttcccaataaaagtga

SEQ ID NO: 4094158 - DNA, 20 bp, Homo sapiens
tggttcccaataaaagtgac

SEQ ID NO: 4094159 - DNA, 23 bp, Homo sapiens
tggttcccctgttcactctactt

SEQ ID NO: 4094160 - DNA, 17 bp, Homo sapiens
tggttccttctctgggt

SEQ ID NO: 4094161 - DNA, 17 bp, Homo sapiens
tggttcctttctcagcc

SEQ ID NO: 4094162 - DNA, 12 bp, Homo sapiens
tggttctatttt

SEQ ID NO: 4094163 - DNA, 13 bp, Homo sapiens
tggttctatttta

SEQ ID NO: 4094164 - DNA, 17 bp, Homo sapiens
tggttgagaaatgaata

SEQ ID NO: 4094165 - DNA, 16 bp, Homo sapiens
tggttgatggaaaata

SEQ ID NO: 4094166 - DNA, 17 bp, Homo sapiens
tggttgatggaaaataa

SEQ ID NO: 4094167 - DNA, 15 bp, Homo sapiens
tggttgatgggttct

SEQ ID NO: 4094168 - DNA, 19 bp, Homo sapiens
tggttgatttgtaacacag

SEQ ID NO: 4094169 - DNA, 16 bp, Homo sapiens
tggttggagaatttag

SEQ ID NO: 4094170 - DNA, 23 bp, Homo sapiens
tggttggccgtggtccagctctt

SEQ ID NO: 4094171 - DNA, 15 bp, Homo sapiens
tggttgtcaatatta

SEQ ID NO: 4094172 - DNA, 17 bp, Homo sapiens
tggttgtcaatattaaa

SEQ ID NO: 4094173 - DNA, 15 bp, Homo sapiens
tggttgtgtctgctt

SEQ ID NO: 4094174 - DNA, 15 bp, Homo sapiens
tggttgtgttgaggt

SEQ ID NO: 4094175 - DNA, 17 bp, Homo sapiens
tggttgtttctgttcca

SEQ ID NO: 4094176 - DNA, 15 bp, Homo sapiens
tggtttacaggccct

SEQ ID NO: 4094177 - DNA, 15 bp, Homo sapiens
tggtttacatttaaa

SEQ ID NO: 4094178 - DNA, 13 bp, Homo sapiens
tggtttatatttt

SEQ ID NO: 4094179 - DNA, 16 bp, Homo sapiens
tggtttcaattcagat

SEQ ID NO: 4094180 - DNA, 18 bp, Homo sapiens
tggtttccagtcatgagc

SEQ ID NO: 4094181 - DNA, 22 bp, Homo sapiens
tggtttcctccatttgagaaaa

SEQ ID NO: 4094182 - DNA, 20 bp, Homo sapiens
tggtttcctgcccagcctgg

SEQ ID NO: 4094183 - DNA, 14 bp, Homo sapiens
tggtttctcttctc

SEQ ID NO: 4094184 - DNA, 14 bp, Homo sapiens
tggtttctgaaaat

SEQ ID NO: 4094185 - DNA, 13 bp, Homo sapiens
tggtttgactcag

SEQ ID NO: 4094186 - DNA, 20 bp, Homo sapiens
tggtttgggaatatccatgt

SEQ ID NO: 4094187 - DNA, 13 bp, Homo sapiens
tggttttctgcca

SEQ ID NO: 4094188 - DNA, 19 bp, Homo sapiens
tggttttgtacactgctgt

SEQ ID NO: 4094189 - DNA, 20 bp, Homo sapiens
tggttttgtacactgctgta

SEQ ID NO: 4094190 - DNA, 16 bp, Homo sapiens
tgtaaaaaatggaaaa

SEQ ID NO: 4094191 - DNA, 18 bp, Homo sapiens
tgtaaaaaatggaaaaaa

SEQ ID NO: 4094192 - DNA, 24 bp, Homo sapiens
tgtaaaaacagcattgctttctga

SEQ ID NO: 4094193 - DNA, 22 bp, Homo sapiens
tgtaaaaacccaagtccctgtc

SEQ ID NO: 4094194 - DNA, 13 bp, Homo sapiens
tgtaaaagaaatc

SEQ ID NO: 4094195 - DNA, 12 bp, Homo sapiens
tgtaaaagcaag

SEQ ID NO: 4094196 - DNA, 15 bp, Homo sapiens
tgtaaaatgaaatta

SEQ ID NO: 4094197 - DNA, 20 bp, Homo sapiens
tgtaaaatgtgaagtgaatg

SEQ ID NO: 4094198 - DNA, 22 bp, Homo sapiens
tgtaaactgaatataaagctta

SEQ ID NO: 4094199 - DNA, 18 bp, Homo sapiens
tgtaaactttgtcatggt

SEQ ID NO: 4094200 - DNA, 12 bp, Homo sapiens
tgtaaagactgg

SEQ ID NO: 4094201 - DNA, 18 bp, Homo sapiens
tgtaaagccaacaccctg

SEQ ID NO: 4094202 - DNA, 15 bp, Homo sapiens
tgtaaagctggccct

SEQ ID NO: 4094203 - DNA, 16 bp, Homo sapiens
tgtaaaggagtcaaaa

SEQ ID NO: 4094204 - DNA, 19 bp, Homo sapiens
tgtaaaggagtcaaaacta

SEQ ID NO: 4094205 - DNA, 21 bp, Homo sapiens
tgtaaaggagtcaaaactaca

SEQ ID NO: 4094206 - DNA, 16 bp, Homo sapiens
tgtaaagtgtaaatcc

SEQ ID NO: 4094207 - DNA, 21 bp, Homo sapiens
tgtaaataaccacaaggtcca

SEQ ID NO: 4094208 - DNA, 12 bp, Homo sapiens
tgtaaatacacc

SEQ ID NO: 4094209 - DNA, 22 bp, Homo sapiens
tgtaaatatgttttttagatca

SEQ ID NO: 4094210 - DNA, 12 bp, Homo sapiens
tgtaaatccttt

SEQ ID NO: 4094211 - DNA, 22 bp, Homo sapiens
tgtaaatcctttttctttataa

SEQ ID NO: 4094212 - DNA, 13 bp, Homo sapiens
tgtaaatctgcca

SEQ ID NO: 4094213 - DNA, 14 bp, Homo sapiens
tgtaaatctgccac

SEQ ID NO: 4094214 - DNA, 22 bp, Homo sapiens
tgtaaatgctgtcaactatgat

SEQ ID NO: 4094215 - DNA, 17 bp, Homo sapiens
tgtaaatggtgtacata

SEQ ID NO: 4094216 - DNA, 17 bp, Homo sapiens
tgtaaattatttgctaa

SEQ ID NO: 4094217 - DNA, 18 bp, Homo sapiens
tgtaacagccaggagtgt

SEQ ID NO: 4094218 - DNA, 15 bp, Homo sapiens
tgtaacagctgaggt

SEQ ID NO: 4094219 - DNA, 23 bp, Homo sapiens
tgtaacctcagctctgggagagg

SEQ ID NO: 4094220 - DNA, 19 bp, Homo sapiens
tgtaacctgttgctgtgtt

SEQ ID NO: 4094221 - DNA, 16 bp, Homo sapiens
tgtaacttatattgaa

SEQ ID NO: 4094222 - DNA, 12 bp, Homo sapiens
tgtaacttcctg

SEQ ID NO: 4094223 - DNA, 15 bp, Homo sapiens
tgtaacttcctgctg

SEQ ID NO: 4094224 - DNA, 22 bp, Homo sapiens
tgtaacttcctgctgcaccctg

SEQ ID NO: 4094225 - DNA, 23 bp, Homo sapiens
tgtaacttcctgctgcaccctgc

SEQ ID NO: 4094226 - DNA, 13 bp, Homo sapiens
tgtaagaaaacaa

SEQ ID NO: 4094227 - DNA, 18 bp, Homo sapiens
tgtaagaattcagaagac

SEQ ID NO: 4094228 - DNA, 17 bp, Homo sapiens
tgtaagcactctggatg

SEQ ID NO: 4094229 - DNA, 15 bp, Homo sapiens
tgtaagcctgcaagc

SEQ ID NO: 4094230 - DNA, 22 bp, Homo sapiens
tgtaagctctactgaggtgcta

SEQ ID NO: 4094231 - DNA, 22 bp, Homo sapiens
tgtaagtcatctacttaataaa

SEQ ID NO: 4094232 - DNA, 23 bp, Homo sapiens
tgtaagtcatctacttaataaat

SEQ ID NO: 4094233 - DNA, 16 bp, Homo sapiens
tgtaagttatttcttg

SEQ ID NO: 4094234 - DNA, 22 bp, Homo sapiens
tgtaagttatttcttgtttgtt

SEQ ID NO: 4094235 - DNA, 18 bp, Homo sapiens
tgtaagtttcaggtgaca

SEQ ID NO: 4094236 - DNA, 15 bp, Homo sapiens
tgtaataaagtatat

SEQ ID NO: 4094237 - DNA, 15 bp, Homo sapiens
tgtaataaatactgc

SEQ ID NO: 4094238 - DNA, 13 bp, Homo sapiens
tgtaatactggaa

SEQ ID NO: 4094239 - DNA, 17 bp, Homo sapiens
tgtaatcatataataaa

SEQ ID NO: 4094240 - DNA, 16 bp, Homo sapiens
tgtaatcccagcactt

SEQ ID NO: 4094241 - DNA, 18 bp, Homo sapiens
tgtaatctctctgcagct

SEQ ID NO: 4094242 - DNA, 19 bp, Homo sapiens
tgtaatctctctgcagctg

SEQ ID NO: 4094243 - DNA, 20 bp, Homo sapiens
tgtaatctctctgcagctgc

SEQ ID NO: 4094244 - DNA, 22 bp, Homo sapiens
tgtaatctctctgcagctgccg

SEQ ID NO: 4094245 - DNA, 21 bp, Homo sapiens
tgtaatctttcatccaaaata

SEQ ID NO: 4094246 - DNA, 16 bp, Homo sapiens
tgtaatgcttccaatc

SEQ ID NO: 4094247 - DNA, 22 bp, Homo sapiens
tggtagtactcctgcaaaattt

SEQ ID NO: 4094248 - DNA, 17 bp, Homo sapiens
tggtagttagtagcatg

SEQ ID NO: 4094249 - DNA, 22 bp, Homo sapiens
tggtatatccttttctgtgttt

SEQ ID NO: 4094250 - DNA, 22 bp, Homo sapiens
tggtatctcagaaagtgcctga

SEQ ID NO: 4094251 - DNA, 16 bp, Homo sapiens
tggtatgacttaaaat

SEQ ID NO: 4094252 - DNA, 14 bp, Homo sapiens
tggtatgctggcca

SEQ ID NO: 4094253 - DNA, 18 bp, Homo sapiens
tggtatgtaatttatgca

SEQ ID NO: 4094254 - DNA, 20 bp, Homo sapiens
tggtcaaaccgcactcaccc

SEQ ID NO: 4094255 - DNA, 22 bp, Homo sapiens
tggtcaagattttgaatgcttc

SEQ ID NO: 4094256 - DNA, 22 bp, Homo sapiens
tggtcaatccgaagtatgaggg

SEQ ID NO: 4094257 - DNA, 14 bp, Homo sapiens
tggtcacacactga

SEQ ID NO: 4094258 - DNA, 20 bp, Homo sapiens
tggtcaccaaatcagctgct

SEQ ID NO: 4094259 - DNA, 23 bp, Homo sapiens
tggtcaccaaatcagctgctact

SEQ ID NO: 4094260 - DNA, 18 bp, Homo sapiens
tggtcactaaccaacaag

SEQ ID NO: 4094261 - DNA, 15 bp, Homo sapiens
tggtccagctcttgg

SEQ ID NO: 4094262 - DNA, 21 bp, Homo sapiens
tggtccagctcttggcccctg

SEQ ID NO: 4094263 - DNA, 17 bp, Homo sapiens
tggtccagggaagctgg

SEQ ID NO: 4094264 - DNA, 14 bp, Homo sapiens
tggtccagggttga

SEQ ID NO: 4094265 - DNA, 17 bp, Homo sapiens
tggtccatatttacatt

SEQ ID NO: 4094266 - DNA, 12 bp, Homo sapiens
tggtccatgccc

SEQ ID NO: 4094267 - DNA, 15 bp, Homo sapiens
tggtccatgcccact

SEQ ID NO: 4094268 - DNA, 17 bp, Homo sapiens
tggtccatttgttcctg

SEQ ID NO: 4094269 - DNA, 20 bp, Homo sapiens
tggtccatttgttcctgctt

SEQ ID NO: 4094270 - DNA, 17 bp, Homo sapiens
tggtcccatcctctaaa

SEQ ID NO: 4094271 - DNA, 13 bp, Homo sapiens
tggtccccgagac

SEQ ID NO: 4094272 - DNA, 20 bp, Homo sapiens
tggtcctgagggtccccacc

SEQ ID NO: 4094273 - DNA, 16 bp, Homo sapiens
tggtccttaccagaga

SEQ ID NO: 4094274 - DNA, 18 bp, Homo sapiens
tggtcgccttccacctct

SEQ ID NO: 4094275 - DNA, 21 bp, Homo sapiens
tggtctcaaacttgtggcctc

SEQ ID NO: 4094276 - DNA, 13 bp, Homo sapiens
tggtctcaggata

SEQ ID NO: 4094277 - DNA, 23 bp, Homo sapiens
tggtctcaggatatccttatcag

SEQ ID NO: 4094278 - DNA, 17 bp, Homo sapiens
tggtctcgatctcctga

SEQ ID NO: 4094279 - DNA, 19 bp, Homo sapiens
tggtctgaatgttctgaca

SEQ ID NO: 4094280 - DNA, 21 bp, Homo sapiens
tggtctgaatgttctgacatt

SEQ ID NO: 4094281 - DNA, 14 bp, Homo sapiens
tggtcttaaatgct

SEQ ID NO: 4094282 - DNA, 22 bp, Homo sapiens
tggtctttcctatcatggagtg

SEQ ID NO: 4094283 - DNA, 13 bp, Homo sapiens
tggtctttgtaag

SEQ ID NO: 4094284 - DNA, 14 bp, Homo sapiens
tggtctttgtaaga

SEQ ID NO: 4094285 - DNA, 15 bp, Homo sapiens
tggtctttgtaagag

SEQ ID NO: 4094286 - DNA, 21 bp, Homo sapiens
tggtctttgtaagagtgtaga

SEQ ID NO: 4094287 - DNA, 23 bp, Homo sapiens
tggtctttgtaagagtgtagaag

SEQ ID NO: 4094288 - DNA, 17 bp, Homo sapiens
tggtcttttcctcgctt

SEQ ID NO: 4094289 - DNA, 11 bp, Homo sapiens
tggtgaacagt

SEQ ID NO: 4094290 - DNA, 20 bp, Homo sapiens
tggtgaagtaaattaggcag

SEQ ID NO: 4094291 - DNA, 15 bp, Homo sapiens
tggtgaatcacctgg

SEQ ID NO: 4094292 - DNA, 16 bp, Homo sapiens
tggtgacagctgcaag

SEQ ID NO: 4094293 - DNA, 18 bp, Homo sapiens
tggtgactgcgatcttca

SEQ ID NO: 4094294 - DNA, 13 bp, Homo sapiens
tggtgactgtccc

SEQ ID NO: 4094295 - DNA, 19 bp, Homo sapiens
tggtgactgtcccaccggg

SEQ ID NO: 4094296 - DNA, 12 bp, Homo sapiens
tggtgagcatta

SEQ ID NO: 4094297 - DNA, 16 bp, Homo sapiens
tggtgaggggctttct

SEQ ID NO: 4094298 - DNA, 17 bp, Homo sapiens
tggtgaggggctttctc

SEQ ID NO: 4094299 - DNA, 18 bp, Homo sapiens
tggtgaggggctttctct

SEQ ID NO: 4094300 - DNA, 15 bp, Homo sapiens
tggtgatcctctatt

SEQ ID NO: 4094301 - DNA, 13 bp, Homo sapiens
tggtgcagacaga

SEQ ID NO: 4094302 - DNA, 22 bp, Homo sapiens
tggtgcagacagaagtctcctc

SEQ ID NO: 4094303 - DNA, 19 bp, Homo sapiens
tggtgcagagaagctggac

SEQ ID NO: 4094304 - DNA, 20 bp, Homo sapiens
tggtgcagagaagctggact

SEQ ID NO: 4094305 - DNA, 21 bp, Homo sapiens
tggtgcagagaagctggactt

SEQ ID NO: 4094306 - DNA, 23 bp, Homo sapiens
tggtgcagagaagctggacttct

SEQ ID NO: 4094307 - DNA, 15 bp, Homo sapiens
tggtgcagtgtgaaa

SEQ ID NO: 4094308 - DNA, 10 bp, Homo sapiens
tggtgcatta

SEQ ID NO: 4094309 - DNA, 19 bp, Homo sapiens
tggtgccaaaaccaggcct

SEQ ID NO: 4094310 - DNA, 20 bp, Homo sapiens
tggtgccaaaaccaggcctc

SEQ ID NO: 4094311 - DNA, 21 bp, Homo sapiens
tggtgccaaaaccaggcctct

SEQ ID NO: 4094312 - DNA, 23 bp, Homo sapiens
tggtgccagggtgggtgtccatg

SEQ ID NO: 4094313 - DNA, 18 bp, Homo sapiens
tggtgccccaggaccagc

SEQ ID NO: 4094314 - DNA, 19 bp, Homo sapiens
tggtgccccaggaccagct

SEQ ID NO: 4094315 - DNA, 13 bp, Homo sapiens
tggtgcctgagag

SEQ ID NO: 4094316 - DNA, 14 bp, Homo sapiens
tggtgcctgagagg

SEQ ID NO: 4094317 - DNA, 17 bp, Homo sapiens
tggtgcctgagaggcag

SEQ ID NO: 4094318 - DNA, 18 bp, Homo sapiens
tggtgcctgagaggcagg

SEQ ID NO: 4094319 - DNA, 19 bp, Homo sapiens
tggtgcctgagaggcaggc

SEQ ID NO: 4094320 - DNA, 14 bp, Homo sapiens
tggtgcctgccacc

SEQ ID NO: 4094321 - DNA, 14 bp, Homo sapiens
tggtgccttttgtg

SEQ ID NO: 4094322 - DNA, 18 bp, Homo sapiens
tggtgctataggctggag

SEQ ID NO: 4094323 - DNA, 22 bp, Homo sapiens
tggtgctataggctggagaagc

SEQ ID NO: 4094324 - DNA, 13 bp, Homo sapiens
tggtgctgccaca

SEQ ID NO: 4094325 - DNA, 18 bp, Homo sapiens
tggtgctgccttgcttct

SEQ ID NO: 4094326 - DNA, 18 bp, Homo sapiens
tggtgctggatattttca

SEQ ID NO: 4094327 - DNA, 21 bp, Homo sapiens
tggtgctggatattttcaaat

SEQ ID NO: 4094328 - DNA, 13 bp, Homo sapiens
tggtgctgtggcc

SEQ ID NO: 4094329 - DNA, 19 bp, Homo sapiens
tggtgcttccaaatattgt

SEQ ID NO: 4094330 - DNA, 21 bp, Homo sapiens
tggtggaaagcgattcactgt

SEQ ID NO: 4094331 - DNA, 19 bp, Homo sapiens
tggtggaccacaggcatct

SEQ ID NO: 4094332 - DNA, 21 bp, Homo sapiens
tggtggatatggtgcagagaa

SEQ ID NO: 4094333 - DNA, 15 bp, Homo sapiens
tggtggcacaggccc

SEQ ID NO: 4094334 - DNA, 19 bp, Homo sapiens
tggtggcagtggaggtggg

SEQ ID NO: 4094335 - DNA, 21 bp, Homo sapiens
tggtggcccgacagcctggca

SEQ ID NO: 4094336 - DNA, 16 bp, Homo sapiens
tggtggcctggtccct

SEQ ID NO: 4094337 - DNA, 20 bp, Homo sapiens
tggtgggcagctgaggacac

SEQ ID NO: 4094338 - DNA, 23 bp, Homo sapiens
tggtgggcttgtcatagccagtg

SEQ ID NO: 4094339 - DNA, 14 bp, Homo sapiens
tggtggtcagatgc

SEQ ID NO: 4094340 - DNA, 16 bp, Homo sapiens
tggtggtttttgctct

SEQ ID NO: 4094341 - DNA, 14 bp, Homo sapiens
tggtgtaaagctgg

SEQ ID NO: 4094342 - DNA, 16 bp, Homo sapiens
tggtgtaaagctggcc

SEQ ID NO: 4094343 - DNA, 20 bp, Homo sapiens
tggtgtaaagctggccctgc

SEQ ID NO: 4094344 - DNA, 22 bp, Homo sapiens
tggtgtcccggtaccttccata

SEQ ID NO: 4094345 - DNA, 16 bp, Homo sapiens
tggtgtgaacccggga

SEQ ID NO: 4094346 - DNA, 22 bp, Homo sapiens
tggtgtgaacccgggaggcaga

SEQ ID NO: 4094347 - DNA, 16 bp, Homo sapiens
tggtgtgacctgaggg

SEQ ID NO: 4094348 - DNA, 17 bp, Homo sapiens
tggtgtgacctgagggc

SEQ ID NO: 4094349 - DNA, 17 bp, Homo sapiens
tggtgtgattgcacaga

SEQ ID NO: 4094350 - DNA, 16 bp, Homo sapiens
tggggccagatccagc

SEQ ID NO: 4094351 - DNA, 20 bp, Homo sapiens
tggggccagatccagcctgg

SEQ ID NO: 4094352 - DNA, 19 bp, Homo sapiens
tggggccccgggttcagcc

SEQ ID NO: 4094353 - DNA, 18 bp, Homo sapiens
tggggcctccctccttgg

SEQ ID NO: 4094354 - DNA, 18 bp, Homo sapiens
tggggcctgactgctcag

SEQ ID NO: 4094355 - DNA, 13 bp, Homo sapiens
tggggcctgagag

SEQ ID NO: 4094356 - DNA, 16 bp, Homo sapiens
tggggcctgagagaat

SEQ ID NO: 4094357 - DNA, 18 bp, Homo sapiens
tggggcctgagagaattg

SEQ ID NO: 4094358 - DNA, 15 bp, Homo sapiens
tggggcctggacctg

SEQ ID NO: 4094359 - DNA, 22 bp, Homo sapiens
tggggcctgtggaatgagtgtg

SEQ ID NO: 4094360 - DNA, 15 bp, Homo sapiens
tggggcggggcccag

SEQ ID NO: 4094361 - DNA, 20 bp, Homo sapiens
tggggctcagatggactggg

SEQ ID NO: 4094362 - DNA, 12 bp, Homo sapiens
tggggctccccg

SEQ ID NO: 4094363 - DNA, 11 bp, Homo sapiens
tggggctcctt

SEQ ID NO: 4094364 - DNA, 18 bp, Homo sapiens
tggggctggggggcaccc

SEQ ID NO: 4094365 - DNA, 13 bp, Homo sapiens
tggggctggggtg

SEQ ID NO: 4094366 - DNA, 12 bp, Homo sapiens
tgggggaaaaag

SEQ ID NO: 4094367 - DNA, 14 bp, Homo sapiens
tgggggactgggag

SEQ ID NO: 4094368 - DNA, 21 bp, Homo sapiens
tgggggactgggagtcagagc

SEQ ID NO: 4094369 - DNA, 21 bp, Homo sapiens
tgggggatgggccagggttta

SEQ ID NO: 4094370 - DNA, 20 bp, Homo sapiens
tggggggtgcaggtgggcac

SEQ ID NO: 4094371 - DNA, 20 bp, Homo sapiens
tggggggtgttttgtggggc

SEQ ID NO: 4094372 - DNA, 21 bp, Homo sapiens
tgggggtggccatccctgggc

SEQ ID NO: 4094373 - DNA, 12 bp, Homo sapiens
tgggggttttta

SEQ ID NO: 4094374 - DNA, 19 bp, Homo sapiens
tggggtaagcggaataaac

SEQ ID NO: 4094375 - DNA, 16 bp, Homo sapiens
tggggtagggctgact

SEQ ID NO: 4094376 - DNA, 20 bp, Homo sapiens
tggggtcaagaaacagccag

SEQ ID NO: 4094377 - DNA, 15 bp, Homo sapiens
tggggtcagccaggg

SEQ ID NO: 4094378 - DNA, 22 bp, Homo sapiens
tggggtcaggttgacaggaggt

SEQ ID NO: 4094379 - DNA, 19 bp, Homo sapiens
tggggtccctccaccccac

SEQ ID NO: 4094380 - DNA, 22 bp, Homo sapiens
tggggtccttttttatacagga

SEQ ID NO: 4094381 - DNA, 10 bp, Homo sapiens
tggggtctct

SEQ ID NO: 4094382 - DNA, 14 bp, Homo sapiens
tggggtctggcagc

SEQ ID NO: 4094383 - DNA, 12 bp, Homo sapiens
tggggtgcatct

SEQ ID NO: 4094384 - DNA, 13 bp, Homo sapiens
tggggtgctggga

SEQ ID NO: 4094385 - DNA, 22 bp, Homo sapiens
tggggtgggggtggggagacct

SEQ ID NO: 4094386 - DNA, 19 bp, Homo sapiens
tggggttatctctgtgtta

SEQ ID NO: 4094387 - DNA, 15 bp, Homo sapiens
tggggttggcaacag

SEQ ID NO: 4094388 - DNA, 19 bp, Homo sapiens
tggggtttatcagaattct

SEQ ID NO: 4094389 - DNA, 18 bp, Homo sapiens
tggggtttttattatttt

SEQ ID NO: 4094390 - DNA, 16 bp, Homo sapiens
tgggtaaaatactttt

SEQ ID NO: 4094391 - DNA, 23 bp, Homo sapiens
tgggtaaaatacttttactctgc

SEQ ID NO: 4094392 - DNA, 23 bp, Homo sapiens
tgggtaggaaagaggaagcaaat

SEQ ID NO: 4094393 - DNA, 18 bp, Homo sapiens
tgggtagggtaaatcagt

SEQ ID NO: 4094394 - DNA, 15 bp, Homo sapiens
tgggtatgctcaggt

SEQ ID NO: 4094395 - DNA, 17 bp, Homo sapiens
tgggtcaaaaaaaagaa

SEQ ID NO: 4094396 - DNA, 21 bp, Homo sapiens
tgggtcattgacctctcaggg

SEQ ID NO: 4094397 - DNA, 14 bp, Homo sapiens
tgggtccagggcct

SEQ ID NO: 4094398 - DNA, 22 bp, Homo sapiens
tgggtccagggcctgacacccc

SEQ ID NO: 4094399 - DNA, 20 bp, Homo sapiens
tgggtccaggggtctgtctg

SEQ ID NO: 4094400 - DNA, 13 bp, Homo sapiens
tgggtcctagccc

SEQ ID NO: 4094401 - DNA, 18 bp, Homo sapiens
tgggtcctagcccttccc

SEQ ID NO: 4094402 - DNA, 19 bp, Homo sapiens
tgggtcctagcccttccct

SEQ ID NO: 4094403 - DNA, 21 bp, Homo sapiens
tgggtcctagcccttccctga

SEQ ID NO: 4094404 - DNA, 19 bp, Homo sapiens
tgggtctgatattaatcaa

SEQ ID NO: 4094405 - DNA, 17 bp, Homo sapiens
tgggtctgattttctca

SEQ ID NO: 4094406 - DNA, 18 bp, Homo sapiens
tgggtctgattttctcac

SEQ ID NO: 4094407 - DNA, 21 bp, Homo sapiens
tgggtctggaggacctgcccg

SEQ ID NO: 4094408 - DNA, 23 bp, Homo sapiens
tgggtctgggatatggctgccca

SEQ ID NO: 4094409 - DNA, 24 bp, Homo sapiens
tgggtctgggatatggctgcccag

SEQ ID NO: 4094410 - DNA, 19 bp, Homo sapiens
tgggtgaaggcctggctgg

SEQ ID NO: 4094411 - DNA, 14 bp, Homo sapiens
tgggtgacagagca

SEQ ID NO: 4094412 - DNA, 15 bp, Homo sapiens
tgggtgctgccatga

SEQ ID NO: 4094413 - DNA, 17 bp, Homo sapiens
tgggtggaaactaagac

SEQ ID NO: 4094414 - DNA, 15 bp, Homo sapiens
tgggtgggctctgtg

SEQ ID NO: 4094415 - DNA, 13 bp, Homo sapiens
tgggtggggacag

SEQ ID NO: 4094416 - DNA, 16 bp, Homo sapiens
tgggtggggtattttt

SEQ ID NO: 4094417 - DNA, 13 bp, Homo sapiens
tgggtggtaccct

SEQ ID NO: 4094418 - DNA, 14 bp, Homo sapiens
tgggtggtaccctc

SEQ ID NO: 4094419 - DNA, 22 bp, Homo sapiens
tgggtggtaccctctggagggg

SEQ ID NO: 4094420 - DNA, 17 bp, Homo sapiens
tgggtgtatataatttt

SEQ ID NO: 4094421 - DNA, 14 bp, Homo sapiens
tgggtgtcatttca

SEQ ID NO: 4094422 - DNA, 13 bp, Homo sapiens
tgggtgtcctgcc

SEQ ID NO: 4094423 - DNA, 17 bp, Homo sapiens
tgggtgtcctgcctgtc

SEQ ID NO: 4094424 - DNA, 23 bp, Homo sapiens
tgggtgtcctgcctgtctgcccc

SEQ ID NO: 4094425 - DNA, 15 bp, Homo sapiens
tgggtgtgggtggaa

SEQ ID NO: 4094426 - DNA, 19 bp, Homo sapiens
tgggtgttctttcctgccc

SEQ ID NO: 4094427 - DNA, 16 bp, Homo sapiens
tgggttattctggagt

SEQ ID NO: 4094428 - DNA, 16 bp, Homo sapiens
tgggttcattattgga

SEQ ID NO: 4094429 - DNA, 18 bp, Homo sapiens
tgggttcattattggaat

SEQ ID NO: 4094430 - DNA, 12 bp, Homo sapiens
tgggttccagag

SEQ ID NO: 4094431 - DNA, 20 bp, Homo sapiens
tgggttccctttccttccat

SEQ ID NO: 4094432 - DNA, 16 bp, Homo sapiens
tgggttctgcctgcca

SEQ ID NO: 4094433 - DNA, 17 bp, Homo sapiens
tgggttctttggaagga

SEQ ID NO: 4094434 - DNA, 12 bp, Homo sapiens
tgggttgacccc

SEQ ID NO: 4094435 - DNA, 19 bp, Homo sapiens
tgggttgcgtcctgacggc

SEQ ID NO: 4094436 - DNA, 18 bp, Homo sapiens
tgggttgtgcacatttct

SEQ ID NO: 4094437 - DNA, 20 bp, Homo sapiens
tggtaaaactcactgtgatc

SEQ ID NO: 4094438 - DNA, 22 bp, Homo sapiens
tggtaagaaaaagcaaaaggca

SEQ ID NO: 4094439 - DNA, 23 bp, Homo sapiens
tggtaagaaaaagcaaaaggcat

SEQ ID NO: 4094440 - DNA, 14 bp, Homo sapiens
tggtaagagaagtg

SEQ ID NO: 4094441 - DNA, 13 bp, Homo sapiens
tggtaagctctgg

SEQ ID NO: 4094442 - DNA, 15 bp, Homo sapiens
tggtaagctctggct

SEQ ID NO: 4094443 - DNA, 14 bp, Homo sapiens
tggtaatattgact

SEQ ID NO: 4094444 - DNA, 17 bp, Homo sapiens
tggtacatgtcttccat

SEQ ID NO: 4094445 - DNA, 16 bp, Homo sapiens
tggtaccctcctggct

SEQ ID NO: 4094446 - DNA, 14 bp, Homo sapiens
tggtaccctctgga

SEQ ID NO: 4094447 - DNA, 21 bp, Homo sapiens
tggtactgactttgcttgctt

SEQ ID NO: 4094448 - DNA, 16 bp, Homo sapiens
tggtacttcctttctc

SEQ ID NO: 4094449 - DNA, 17 bp, Homo sapiens
tggtacttcctttctcc

SEQ ID NO: 4094450 - DNA, 22 bp, Homo sapiens
tggtaggatcagccctcatttt

SEQ ID NO: 4094451 - DNA, 19 bp, Homo sapiens
tggtagggtgggagtggtt

SEQ ID NO: 4094452 - DNA, 14 bp, Homo sapiens
tggtaggttgggac

SEQ ID NO: 4094453 - DNA, 22 bp, Homo sapiens
tgggatgggacagggaggccac

SEQ ID NO: 4094454 - DNA, 16 bp, Homo sapiens
tgggatgttcagcact

SEQ ID NO: 4094455 - DNA, 17 bp, Homo sapiens
tgggattctactttaag

SEQ ID NO: 4094456 - DNA, 10 bp, Homo sapiens
tgggattgct

SEQ ID NO: 4094457 - DNA, 14 bp, Homo sapiens
tgggatttaatttc

SEQ ID NO: 4094458 - DNA, 16 bp, Homo sapiens
tgggatttaatttcca

SEQ ID NO: 4094459 - DNA, 13 bp, Homo sapiens
tgggattttgcaa

SEQ ID NO: 4094460 - DNA, 14 bp, Homo sapiens
tgggattttgcaaa

SEQ ID NO: 4094461 - DNA, 15 bp, Homo sapiens
tgggcaaacaggcag

SEQ ID NO: 4094462 - DNA, 16 bp, Homo sapiens
tgggcaaacaggcagt

SEQ ID NO: 4094463 - DNA, 22 bp, Homo sapiens
tgggcaaagccacaaggctggc

SEQ ID NO: 4094464 - DNA, 12 bp, Homo sapiens
tgggcaacagag

SEQ ID NO: 4094465 - DNA, 14 bp, Homo sapiens
tgggcaacagagca

SEQ ID NO: 4094466 - DNA, 22 bp, Homo sapiens
tgggcacacgcacaaacacaca

SEQ ID NO: 4094467 - DNA, 16 bp, Homo sapiens
tgggcacgcctgctgg

SEQ ID NO: 4094468 - DNA, 18 bp, Homo sapiens
tgggcacgcctgctggcc

SEQ ID NO: 4094469 - DNA, 15 bp, Homo sapiens
tgggcagcaccctcc

SEQ ID NO: 4094470 - DNA, 15 bp, Homo sapiens
tgggcagccaggctg

SEQ ID NO: 4094471 - DNA, 14 bp, Homo sapiens
tgggcagccccaga

SEQ ID NO: 4094472 - DNA, 17 bp, Homo sapiens
tgggcagccccagagag

SEQ ID NO: 4094473 - DNA, 20 bp, Homo sapiens
tgggcagccccagagagagg

SEQ ID NO: 4094474 - DNA, 12 bp, Homo sapiens
tgggcaggcggt

SEQ ID NO: 4094475 - DNA, 23 bp, Homo sapiens
tgggcaggcggtccccatcccca

SEQ ID NO: 4094476 - DNA, 16 bp, Homo sapiens
tgggcagtgccccagg

SEQ ID NO: 4094477 - DNA, 18 bp, Homo sapiens
tgggcagtgccccaggga

SEQ ID NO: 4094478 - DNA, 23 bp, Homo sapiens
tgggcagtgccccagggagtcca

SEQ ID NO: 4094479 - DNA, 20 bp, Homo sapiens
tgggcatgacatcctttctt

SEQ ID NO: 4094480 - DNA, 14 bp, Homo sapiens
tgggcatgccaccc

SEQ ID NO: 4094481 - DNA, 20 bp, Homo sapiens
tgggcatgccaccctcacac

SEQ ID NO: 4094482 - DNA, 18 bp, Homo sapiens
tgggcatgggtccagggc

SEQ ID NO: 4094483 - DNA, 14 bp, Homo sapiens
tgggcattgctttc

SEQ ID NO: 4094484 - DNA, 15 bp, Homo sapiens
tgggcatttgtgagg

SEQ ID NO: 4094485 - DNA, 16 bp, Homo sapiens
tgggcatttgtgaggc

SEQ ID NO: 4094486 - DNA, 14 bp, Homo sapiens
tgggcattttcctc

SEQ ID NO: 4094487 - DNA, 19 bp, Homo sapiens
tgggcattttcctcctctg

SEQ ID NO: 4094488 - DNA, 22 bp, Homo sapiens
tgggccacggctgagccttcag

SEQ ID NO: 4094489 - DNA, 15 bp, Homo sapiens
tgggccactgtggtg

SEQ ID NO: 4094490 - DNA, 18 bp, Homo sapiens
tgggccagacatgccaca

SEQ ID NO: 4094491 - DNA, 18 bp, Homo sapiens
tgggccagccctgcagcc

SEQ ID NO: 4094492 - DNA, 10 bp, Homo sapiens
tgggccaggg

SEQ ID NO: 4094493 - DNA, 21 bp, Homo sapiens
tgggccagggctgccctgaga

SEQ ID NO: 4094494 - DNA, 19 bp, Homo sapiens
tgggccatccttccgccaa

SEQ ID NO: 4094495 - DNA, 18 bp, Homo sapiens
tgggccatgtccaaagag

SEQ ID NO: 4094496 - DNA, 19 bp, Homo sapiens
tgggccattctccacagca

SEQ ID NO: 4094497 - DNA, 22 bp, Homo sapiens
tgggcccacccaagcaggaggc

SEQ ID NO: 4094498 - DNA, 18 bp, Homo sapiens
tgggcccagaactgcccc

SEQ ID NO: 4094499 - DNA, 13 bp, Homo sapiens
tgggcccctccac

SEQ ID NO: 4094500 - DNA, 17 bp, Homo sapiens
tgggcccctccacgcct

SEQ ID NO: 4094501 - DNA, 16 bp, Homo sapiens
tgggccctctctctgg

SEQ ID NO: 4094502 - DNA, 16 bp, Homo sapiens
tgggcctctgcccctc

SEQ ID NO: 4094503 - DNA, 14 bp, Homo sapiens
tgggcctgctccag

SEQ ID NO: 4094504 - DNA, 15 bp, Homo sapiens
tgggcctgctccaga

SEQ ID NO: 4094505 - DNA, 19 bp, Homo sapiens
tgggcctgctccagacctg

SEQ ID NO: 4094506 - DNA, 16 bp, Homo sapiens
tgggcctgtcgtgcca

SEQ ID NO: 4094507 - DNA, 21 bp, Homo sapiens
tgggcctgtcgtgccagtcct

SEQ ID NO: 4094508 - DNA, 14 bp, Homo sapiens
tgggccttgctgct

SEQ ID NO: 4094509 - DNA, 17 bp, Homo sapiens
tgggcggcggccacgca

SEQ ID NO: 4094510 - DNA, 17 bp, Homo sapiens
tgggcgttgggagccta

SEQ ID NO: 4094511 - DNA, 18 bp, Homo sapiens
tgggctattgctgctgcc

SEQ ID NO: 4094512 - DNA, 15 bp, Homo sapiens
tgggctcctccaggg

SEQ ID NO: 4094513 - DNA, 23 bp, Homo sapiens
tgggctcctccagggtgtgtgct

SEQ ID NO: 4094514 - DNA, 19 bp, Homo sapiens
tgggctctgacagaaagca

SEQ ID NO: 4094515 - DNA, 12 bp, Homo sapiens
tgggctctgctg

SEQ ID NO: 4094516 - DNA, 18 bp, Homo sapiens
tgggctctgtgcagtcac

SEQ ID NO: 4094517 - DNA, 13 bp, Homo sapiens
tgggctcttccaa

SEQ ID NO: 4094518 - DNA, 17 bp, Homo sapiens
tgggctgagtgacacaa

SEQ ID NO: 4094519 - DNA, 18 bp, Homo sapiens
tgggctgccaccagcccc

SEQ ID NO: 4094520 - DNA, 13 bp, Homo sapiens
tgggctgccctgg

SEQ ID NO: 4094521 - DNA, 19 bp, Homo sapiens
tgggctgccctggtgctgc

SEQ ID NO: 4094522 - DNA, 12 bp, Homo sapiens
tgggctggactt

SEQ ID NO: 4094523 - DNA, 14 bp, Homo sapiens
tgggctgggccctc

SEQ ID NO: 4094524 - DNA, 20 bp, Homo sapiens
tgggctgggccctctcttct

SEQ ID NO: 4094525 - DNA, 21 bp, Homo sapiens
tgggctgggccctctcttctc

SEQ ID NO: 4094526 - DNA, 16 bp, Homo sapiens
tgggctgggccctctt

SEQ ID NO: 4094527 - DNA, 23 bp, Homo sapiens
tgggctggggccaccatccctga

SEQ ID NO: 4094528 - DNA, 16 bp, Homo sapiens
tgggctgggggactgg

SEQ ID NO: 4094529 - DNA, 18 bp, Homo sapiens
tgggctggtatctcagaa

SEQ ID NO: 4094530 - DNA, 20 bp, Homo sapiens
tgggctggtatctcagaaag

SEQ ID NO: 4094531 - DNA, 23 bp, Homo sapiens
tgggctggtatctcagaaagtgc

SEQ ID NO: 4094532 - DNA, 18 bp, Homo sapiens
tgggctgtctgtcaccag

SEQ ID NO: 4094533 - DNA, 19 bp, Homo sapiens
tgggctgtctgtcaccagc

SEQ ID NO: 4094534 - DNA, 19 bp, Homo sapiens
tgggcttcctgcccttccc

SEQ ID NO: 4094535 - DNA, 21 bp, Homo sapiens
tgggcttcctgcccttccctc

SEQ ID NO: 4094536 - DNA, 22 bp, Homo sapiens
tgggcttgaccaggcttggcct

SEQ ID NO: 4094537 - DNA, 14 bp, Homo sapiens
tgggcttgctgtgg

SEQ ID NO: 4094538 - DNA, 16 bp, Homo sapiens
tgggcttggcctgctg

SEQ ID NO: 4094539 - DNA, 17 bp, Homo sapiens
tggggaaaaaagcacat

SEQ ID NO: 4094540 - DNA, 21 bp, Homo sapiens
tggggaaaaaagcacatacat

SEQ ID NO: 4094541 - DNA, 11 bp, Homo sapiens
tggggaaaggg

SEQ ID NO: 4094542 - DNA, 12 bp, Homo sapiens
tggggaaatgtg

SEQ ID NO: 4094543 - DNA, 14 bp, Homo sapiens
tggggaactgaggg

SEQ ID NO: 4094544 - DNA, 17 bp, Homo sapiens
tggggaccccaacctca

SEQ ID NO: 4094545 - DNA, 11 bp, Homo sapiens
tggggaccccc

SEQ ID NO: 4094546 - DNA, 16 bp, Homo sapiens
tggggactgggcacag

SEQ ID NO: 4094547 - DNA, 20 bp, Homo sapiens
tggggagacctggttggccg

SEQ ID NO: 4094548 - DNA, 21 bp, Homo sapiens
tggggataaaatgactactta

SEQ ID NO: 4094549 - DNA, 17 bp, Homo sapiens
tggggatcaattttcat

SEQ ID NO: 4094550 - DNA, 21 bp, Homo sapiens
tggggatggggcctccctcct

SEQ ID NO: 4094551 - DNA, 18 bp, Homo sapiens
tggggcacagggagaggc

SEQ ID NO: 4094552 - DNA, 23 bp, Homo sapiens
tggggcagcccccatgggctcct

SEQ ID NO: 4094553 - DNA, 17 bp, Homo sapiens
tggggcaggctgggcca

SEQ ID NO: 4094554 - DNA, 18 bp, Homo sapiens
tggggcaggctgggccat

SEQ ID NO: 4094555 - DNA, 17 bp, Homo sapiens
tggggcatcctgtgcca

SEQ ID NO: 4094556 - DNA, 13 bp, Homo sapiens
tggggccagatcc

SEQ ID NO: 4094557 - DNA, 16 bp, Homo sapiens
tggctgggggcaggag

SEQ ID NO: 4094558 - DNA, 17 bp, Homo sapiens
tggctgggggcaggagg

SEQ ID NO: 4094559 - DNA, 21 bp, Homo sapiens
tggctggggtgggggtgggga

SEQ ID NO: 4094560 - DNA, 21 bp, Homo sapiens
tggctggggtgtcaataaagc

SEQ ID NO: 4094561 - DNA, 11 bp, Homo sapiens
tggctgggtgg

SEQ ID NO: 4094562 - DNA, 22 bp, Homo sapiens
tggctgggtgggcccagaactg

SEQ ID NO: 4094563 - DNA, 13 bp, Homo sapiens
tggctgggttcag

SEQ ID NO: 4094564 - DNA, 22 bp, Homo sapiens
tggctggtaacagttcatgttt

SEQ ID NO: 4094565 - DNA, 13 bp, Homo sapiens
tggctggtccagg

SEQ ID NO: 4094566 - DNA, 15 bp, Homo sapiens
tggctggtcctccca

SEQ ID NO: 4094567 - DNA, 17 bp, Homo sapiens
tggctggtcctcccatt

SEQ ID NO: 4094568 - DNA, 18 bp, Homo sapiens
tggctgtagatcccaaga

SEQ ID NO: 4094569 - DNA, 19 bp, Homo sapiens
tggctgtctagaatgtgga

SEQ ID NO: 4094570 - DNA, 15 bp, Homo sapiens
tggcttataaacaca

SEQ ID NO: 4094571 - DNA, 17 bp, Homo sapiens
tggcttcaagttgtaaa

SEQ ID NO: 4094572 - DNA, 16 bp, Homo sapiens
tggcttcatctgtcaa

SEQ ID NO: 4094573 - DNA, 20 bp, Homo sapiens
tggcttccagcttcaggcac

SEQ ID NO: 4094574 - DNA, 21 bp, Homo sapiens
tggcttccagcttcaggcacc

SEQ ID NO: 4094575 - DNA, 15 bp, Homo sapiens
tggcttccaggtatc

SEQ ID NO: 4094576 - DNA, 15 bp, Homo sapiens
tggcttcccatgtct

SEQ ID NO: 4094577 - DNA, 18 bp, Homo sapiens
tggcttcccgctcagccc

SEQ ID NO: 4094578 - DNA, 21 bp, Homo sapiens
tggcttcccgctcagccctcc

SEQ ID NO: 4094579 - DNA, 15 bp, Homo sapiens
tggcttgacagcatg

SEQ ID NO: 4094580 - DNA, 15 bp, Homo sapiens
tggcttgagaaatat

SEQ ID NO: 4094581 - DNA, 22 bp, Homo sapiens
tggcttggggtcaagaaacagc

SEQ ID NO: 4094582 - DNA, 23 bp, Homo sapiens
tggcttggggtcaagaaacagcc

SEQ ID NO: 4094583 - DNA, 12 bp, Homo sapiens
tggctttccagg

SEQ ID NO: 4094584 - DNA, 23 bp, Homo sapiens
tggctttctccgactgctaggga

SEQ ID NO: 4094585 - DNA, 20 bp, Homo sapiens
tggctttgcccacccctcac

SEQ ID NO: 4094586 - DNA, 11 bp, Homo sapiens
tggctttgcct

SEQ ID NO: 4094587 - DNA, 14 bp, Homo sapiens
tggctttgcctctt

SEQ ID NO: 4094588 - DNA, 19 bp, Homo sapiens
tggctttgttttcttagtt

SEQ ID NO: 4094589 - DNA, 20 bp, Homo sapiens
tggcttttactttattaata

SEQ ID NO: 4094590 - DNA, 14 bp, Homo sapiens
tggcttttcactgc

SEQ ID NO: 4094591 - DNA, 15 bp, Homo sapiens
tggcttttcactgct

SEQ ID NO: 4094592 - DNA, 15 bp, Homo sapiens
tggctttttcagagt

SEQ ID NO: 4094593 - DNA, 16 bp, Homo sapiens
tggctttttcctctga

SEQ ID NO: 4094594 - DNA, 17 bp, Homo sapiens
tggctttttcctctgag

SEQ ID NO: 4094595 - DNA, 18 bp, Homo sapiens
tggctttttcctctgagc

SEQ ID NO: 4094596 - DNA, 22 bp, Homo sapiens
tggctttttcctctgagcccag

SEQ ID NO: 4094597 - DNA, 19 bp, Homo sapiens
tgggaaaaaaacttggcac

SEQ ID NO: 4094598 - DNA, 21 bp, Homo sapiens
tgggaaaaaaacttggcactt

SEQ ID NO: 4094599 - DNA, 21 bp, Homo sapiens
tgggaaagccacctctccctc

SEQ ID NO: 4094600 - DNA, 21 bp, Homo sapiens
tgggaaattaaatccaataaa

SEQ ID NO: 4094601 - DNA, 22 bp, Homo sapiens
tgggaaccccttcatcctctga

SEQ ID NO: 4094602 - DNA, 17 bp, Homo sapiens
tgggaacttgcgagtcc

SEQ ID NO: 4094603 - DNA, 18 bp, Homo sapiens
tgggaagaagaagacctc

SEQ ID NO: 4094604 - DNA, 18 bp, Homo sapiens
tgggaagaattggaagtt

SEQ ID NO: 4094605 - DNA, 13 bp, Homo sapiens
tgggaagacatga

SEQ ID NO: 4094606 - DNA, 19 bp, Homo sapiens
tgggaagacgcctgagctc

SEQ ID NO: 4094607 - DNA, 21 bp, Homo sapiens
tgggaagacgcctgagctcac

SEQ ID NO: 4094608 - DNA, 17 bp, Homo sapiens
tgggaagataggctctg

SEQ ID NO: 4094609 - DNA, 22 bp, Homo sapiens
tgggaagataggctctgcacag

SEQ ID NO: 4094610 - DNA, 18 bp, Homo sapiens
tgggaaggcgagtctggg

SEQ ID NO: 4094611 - DNA, 18 bp, Homo sapiens
tgggaaggcttgggattt

SEQ ID NO: 4094612 - DNA, 15 bp, Homo sapiens
tgggaagtgaagact

SEQ ID NO: 4094613 - DNA, 19 bp, Homo sapiens
tgggaatgaaattaacaca

SEQ ID NO: 4094614 - DNA, 20 bp, Homo sapiens
tgggaatgttacattgtttg

SEQ ID NO: 4094615 - DNA, 19 bp, Homo sapiens
tgggaatttgtcagcgttc

SEQ ID NO: 4094616 - DNA, 20 bp, Homo sapiens
tgggacacagacccaggacc

SEQ ID NO: 4094617 - DNA, 11 bp, Homo sapiens
tgggacagagg

SEQ ID NO: 4094618 - DNA, 18 bp, Homo sapiens
tgggacagaggagcaagg

SEQ ID NO: 4094619 - DNA, 22 bp, Homo sapiens
tgggacagaggagcaaggttta

SEQ ID NO: 4094620 - DNA, 18 bp, Homo sapiens
tgggacagccagagctgg

SEQ ID NO: 4094621 - DNA, 18 bp, Homo sapiens
tgggacagcccagagcct

SEQ ID NO: 4094622 - DNA, 17 bp, Homo sapiens
tgggacagggaggccac

SEQ ID NO: 4094623 - DNA, 21 bp, Homo sapiens
tgggacagtggtgacatagtc

SEQ ID NO: 4094624 - DNA, 16 bp, Homo sapiens
tgggaccagagccaga

SEQ ID NO: 4094625 - DNA, 15 bp, Homo sapiens
tgggactcaggatat

SEQ ID NO: 4094626 - DNA, 20 bp, Homo sapiens
tgggactggagtcagatgag

SEQ ID NO: 4094627 - DNA, 18 bp, Homo sapiens
tgggagacctgtaatcat

SEQ ID NO: 4094628 - DNA, 13 bp, Homo sapiens
tgggagcactgga

SEQ ID NO: 4094629 - DNA, 12 bp, Homo sapiens
tgggagcagaaa

SEQ ID NO: 4094630 - DNA, 21 bp, Homo sapiens
tgggagcagcggtttggggag

SEQ ID NO: 4094631 - DNA, 17 bp, Homo sapiens
tgggagccacttctccc

SEQ ID NO: 4094632 - DNA, 17 bp, Homo sapiens
tgggagccagctgcttt

SEQ ID NO: 4094633 - DNA, 19 bp, Homo sapiens
tgggagccagtcctccact

SEQ ID NO: 4094634 - DNA, 21 bp, Homo sapiens
tgggagccctgaccttggctg

SEQ ID NO: 4094635 - DNA, 20 bp, Homo sapiens
tgggagcctgcaaactcact

SEQ ID NO: 4094636 - DNA, 15 bp, Homo sapiens
tgggagctcctctcc

SEQ ID NO: 4094637 - DNA, 21 bp, Homo sapiens
tgggagctcctctcctggagg

SEQ ID NO: 4094638 - DNA, 14 bp, Homo sapiens
tgggagctgagcag

SEQ ID NO: 4094639 - DNA, 19 bp, Homo sapiens
tgggagctgagcagcctct

SEQ ID NO: 4094640 - DNA, 18 bp, Homo sapiens
tgggagctggagtccact

SEQ ID NO: 4094641 - DNA, 19 bp, Homo sapiens
tgggaggacggtgcaaccc

SEQ ID NO: 4094642 - DNA, 13 bp, Homo sapiens
tgggaggcaagaa

SEQ ID NO: 4094643 - DNA, 14 bp, Homo sapiens
tgggaggcaagaaa

SEQ ID NO: 4094644 - DNA, 18 bp, Homo sapiens
tgggaggcatggccctgg

SEQ ID NO: 4094645 - DNA, 18 bp, Homo sapiens
tgggaggcctaggcgggc

SEQ ID NO: 4094646 - DNA, 19 bp, Homo sapiens
tgggagggagcagacagga

SEQ ID NO: 4094647 - DNA, 16 bp, Homo sapiens
tgggagggttggcacc

SEQ ID NO: 4094648 - DNA, 20 bp, Homo sapiens
tgggagggttggcacctgca

SEQ ID NO: 4094649 - DNA, 19 bp, Homo sapiens
tgggaggtggaagaaggga

SEQ ID NO: 4094650 - DNA, 15 bp, Homo sapiens
tgggagtcacacagt

SEQ ID NO: 4094651 - DNA, 15 bp, Homo sapiens
tgggagtccctacct

SEQ ID NO: 4094652 - DNA, 19 bp, Homo sapiens
tgggagtgggcacctcaga

SEQ ID NO: 4094653 - DNA, 17 bp, Homo sapiens
tgggagttctagaacca

SEQ ID NO: 4094654 - DNA, 19 bp, Homo sapiens
tgggagttctagaaccact

SEQ ID NO: 4094655 - DNA, 15 bp, Homo sapiens
tgggatatgtggtgt

SEQ ID NO: 4094656 - DNA, 14 bp, Homo sapiens
tgggatcccaccct

SEQ ID NO: 4094657 - DNA, 21 bp, Homo sapiens
tgggatccttgggcccatcac

SEQ ID NO: 4094658 - DNA, 15 bp, Homo sapiens
tgggatggaggggag

SEQ ID NO: 4094659 - DNA, 13 bp, Homo sapiens
tgggatgggacag

SEQ ID NO: 4094660 - DNA, 14 bp, Homo sapiens
tggccgcagaggtg

SEQ ID NO: 4094661 - DNA, 13 bp, Homo sapiens
tggccgccccctg

SEQ ID NO: 4094662 - DNA, 21 bp, Homo sapiens
tggccgccccctgccccccag

SEQ ID NO: 4094663 - DNA, 23 bp, Homo sapiens
tggccgccccctgccccccagcc

SEQ ID NO: 4094664 - DNA, 15 bp, Homo sapiens
tggccgtctcctccc

SEQ ID NO: 4094665 - DNA, 16 bp, Homo sapiens
tggccgtggtccagct

SEQ ID NO: 4094666 - DNA, 20 bp, Homo sapiens
tggccgtggtccagctcttg

SEQ ID NO: 4094667 - DNA, 15 bp, Homo sapiens
tggcctaaaatcttg

SEQ ID NO: 4094668 - DNA, 17 bp, Homo sapiens
tggcctaaaatcttgga

SEQ ID NO: 4094669 - DNA, 15 bp, Homo sapiens
tggcctatccgctgc

SEQ ID NO: 4094670 - DNA, 17 bp, Homo sapiens
tggcctattatattaaa

SEQ ID NO: 4094671 - DNA, 21 bp, Homo sapiens
tggcctattatattaaaatat

SEQ ID NO: 4094672 - DNA, 15 bp, Homo sapiens
tggcctcacccaccc

SEQ ID NO: 4094673 - DNA, 22 bp, Homo sapiens
tggcctcacccacccctgcaca

SEQ ID NO: 4094674 - DNA, 17 bp, Homo sapiens
tggcctcagaattcaca

SEQ ID NO: 4094675 - DNA, 14 bp, Homo sapiens
tggcctcagctgcc

SEQ ID NO: 4094676 - DNA, 16 bp, Homo sapiens
tggcctcagctgcctc

SEQ ID NO: 4094677 - DNA, 18 bp, Homo sapiens
tggcctcagctgcctcac

SEQ ID NO: 4094678 - DNA, 19 bp, Homo sapiens
tggcctcagctgcctcact

SEQ ID NO: 4094679 - DNA, 20 bp, Homo sapiens
tggcctcccaaatgagccat

SEQ ID NO: 4094680 - DNA, 15 bp, Homo sapiens
tggcctccctgctgt

SEQ ID NO: 4094681 - DNA, 20 bp, Homo sapiens
tggcctctcactgcctcccc

SEQ ID NO: 4094682 - DNA, 20 bp, Homo sapiens
tggcctctgcctccaccctc

SEQ ID NO: 4094683 - DNA, 22 bp, Homo sapiens
tggcctcttgagcagtggctgg

SEQ ID NO: 4094684 - DNA, 16 bp, Homo sapiens
tggcctgaactgagga

SEQ ID NO: 4094685 - DNA, 18 bp, Homo sapiens
tggcctgaactgaggaga

SEQ ID NO: 4094686 - DNA, 19 bp, Homo sapiens
tggcctgagagtcagctct

SEQ ID NO: 4094687 - DNA, 21 bp, Homo sapiens
tggcctgaggtcaatggtgca

SEQ ID NO: 4094688 - DNA, 14 bp, Homo sapiens
tggcctgcccgtgc

SEQ ID NO: 4094689 - DNA, 15 bp, Homo sapiens
tggcctggccaggag

SEQ ID NO: 4094690 - DNA, 18 bp, Homo sapiens
tggcctggggtgcatctc

SEQ ID NO: 4094691 - DNA, 23 bp, Homo sapiens
tggcctggggtgcatctcctccc

SEQ ID NO: 4094692 - DNA, 18 bp, Homo sapiens
tggcctgtagagttgctg

SEQ ID NO: 4094693 - DNA, 12 bp, Homo sapiens
tggcctgtctca

SEQ ID NO: 4094694 - DNA, 14 bp, Homo sapiens
tggcctgtctcatc

SEQ ID NO: 4094695 - DNA, 22 bp, Homo sapiens
tggcctgtttctgcagcccttg

SEQ ID NO: 4094696 - DNA, 15 bp, Homo sapiens
tggccttacactgaa

SEQ ID NO: 4094697 - DNA, 18 bp, Homo sapiens
tggcctttccttccctct

SEQ ID NO: 4094698 - DNA, 18 bp, Homo sapiens
tggcctttgcttatgaat

SEQ ID NO: 4094699 - DNA, 14 bp, Homo sapiens
tggcctttgtgctg

SEQ ID NO: 4094700 - DNA, 16 bp, Homo sapiens
tggcgcaaggccgagc

SEQ ID NO: 4094701 - DNA, 20 bp, Homo sapiens
tggcgcctgctccctccaga

SEQ ID NO: 4094702 - DNA, 14 bp, Homo sapiens
tggcgggcgcctgt

SEQ ID NO: 4094703 - DNA, 21 bp, Homo sapiens
tggcgtaagatgatggatttg

SEQ ID NO: 4094704 - DNA, 14 bp, Homo sapiens
tggcgtctccctcg

SEQ ID NO: 4094705 - DNA, 18 bp, Homo sapiens
tggcgtgggagccagcct

SEQ ID NO: 4094706 - DNA, 20 bp, Homo sapiens
tggctaaatgcctaataaac

SEQ ID NO: 4094707 - DNA, 19 bp, Homo sapiens
tggctaacttttcattttt

SEQ ID NO: 4094708 - DNA, 19 bp, Homo sapiens
tggctaatgtactgcatat

SEQ ID NO: 4094709 - DNA, 22 bp, Homo sapiens
tggctacatcccagcctgtggt

SEQ ID NO: 4094710 - DNA, 15 bp, Homo sapiens
tggctacgcctcttc

SEQ ID NO: 4094711 - DNA, 19 bp, Homo sapiens
tggctagaggccagcccca

SEQ ID NO: 4094712 - DNA, 18 bp, Homo sapiens
tggctagagtcctcactc

SEQ ID NO: 4094713 - DNA, 19 bp, Homo sapiens
tggctataaatatataaaa

SEQ ID NO: 4094714 - DNA, 12 bp, Homo sapiens
tggctatttgaa

SEQ ID NO: 4094715 - DNA, 15 bp, Homo sapiens
tggctatttttgaag

SEQ ID NO: 4094716 - DNA, 17 bp, Homo sapiens
tggctcaagtctggccc

SEQ ID NO: 4094717 - DNA, 15 bp, Homo sapiens
tggctcacccaagca

SEQ ID NO: 4094718 - DNA, 14 bp, Homo sapiens
tggctcacgcctgt

SEQ ID NO: 4094719 - DNA, 18 bp, Homo sapiens
tggctcagacatgttttc

SEQ ID NO: 4094720 - DNA, 19 bp, Homo sapiens
tggctcagagcttgaagat

SEQ ID NO: 4094721 - DNA, 13 bp, Homo sapiens
tggctcagccagc

SEQ ID NO: 4094722 - DNA, 18 bp, Homo sapiens
tggctccactcttgatct

SEQ ID NO: 4094723 - DNA, 19 bp, Homo sapiens
tggctccactcttgatctc

SEQ ID NO: 4094724 - DNA, 22 bp, Homo sapiens
tggctccactcttgatctctct

SEQ ID NO: 4094725 - DNA, 20 bp, Homo sapiens
tggctccagaaatgtctaaa

SEQ ID NO: 4094726 - DNA, 14 bp, Homo sapiens
tggctcccatgacc

SEQ ID NO: 4094727 - DNA, 21 bp, Homo sapiens
tggctccccctccccaggctg

SEQ ID NO: 4094728 - DNA, 19 bp, Homo sapiens
tggctcccgcggtgccatg

SEQ ID NO: 4094729 - DNA, 13 bp, Homo sapiens
tggctcctgccca

SEQ ID NO: 4094730 - DNA, 18 bp, Homo sapiens
tggctcctttacaaaaga

SEQ ID NO: 4094731 - DNA, 17 bp, Homo sapiens
tggctctaccttcctgt

SEQ ID NO: 4094732 - DNA, 23 bp, Homo sapiens
tggctctaccttcctgtccctga

SEQ ID NO: 4094733 - DNA, 16 bp, Homo sapiens
tggctctcagaaggta

SEQ ID NO: 4094734 - DNA, 14 bp, Homo sapiens
tggctctcctctgg

SEQ ID NO: 4094735 - DNA, 14 bp, Homo sapiens
tggctctgcactaa

SEQ ID NO: 4094736 - DNA, 16 bp, Homo sapiens
tggctctgccagtgga

SEQ ID NO: 4094737 - DNA, 21 bp, Homo sapiens
tggctgaccccaaagagcctg

SEQ ID NO: 4094738 - DNA, 17 bp, Homo sapiens
tggctgacccctctggt

SEQ ID NO: 4094739 - DNA, 13 bp, Homo sapiens
tggctgagggcag

SEQ ID NO: 4094740 - DNA, 14 bp, Homo sapiens
tggctgagggcagc

SEQ ID NO: 4094741 - DNA, 23 bp, Homo sapiens
tggctgagggcagctgcgcgggc

SEQ ID NO: 4094742 - DNA, 17 bp, Homo sapiens
tggctgaggggcttggg

SEQ ID NO: 4094743 - DNA, 17 bp, Homo sapiens
tggctgaggttcctctg

SEQ ID NO: 4094744 - DNA, 21 bp, Homo sapiens
tggctgaggttcctctgcctg

SEQ ID NO: 4094745 - DNA, 23 bp, Homo sapiens
tggctgaggttcctctgcctgcc

SEQ ID NO: 4094746 - DNA, 22 bp, Homo sapiens
tggctgcaccacttccagggtt

SEQ ID NO: 4094747 - DNA, 18 bp, Homo sapiens
tggctgcagctgggcagc

SEQ ID NO: 4094748 - DNA, 12 bp, Homo sapiens
tggctgccacac

SEQ ID NO: 4094749 - DNA, 13 bp, Homo sapiens
tggctgccacacc

SEQ ID NO: 4094750 - DNA, 14 bp, Homo sapiens
tggctgccacaccc

SEQ ID NO: 4094751 - DNA, 13 bp, Homo sapiens
tggctgcccagga

SEQ ID NO: 4094752 - DNA, 20 bp, Homo sapiens
tggctgccccaacctgctga

SEQ ID NO: 4094753 - DNA, 16 bp, Homo sapiens
tggctgccttctttcc

SEQ ID NO: 4094754 - DNA, 20 bp, Homo sapiens
tggctgctgcccccaccccg

SEQ ID NO: 4094755 - DNA, 13 bp, Homo sapiens
tggctgctgggct

SEQ ID NO: 4094756 - DNA, 17 bp, Homo sapiens
tggctgctttgcctcta

SEQ ID NO: 4094757 - DNA, 16 bp, Homo sapiens
tggctggaagagggtg

SEQ ID NO: 4094758 - DNA, 13 bp, Homo sapiens
tggctggaagggg

SEQ ID NO: 4094759 - DNA, 17 bp, Homo sapiens
tggctggcccgtcatgt

SEQ ID NO: 4094760 - DNA, 11 bp, Homo sapiens
tggctggctct

SEQ ID NO: 4094761 - DNA, 20 bp, Homo sapiens
tggctgggaagactatggtg

SEQ ID NO: 4094762 - DNA, 22 bp, Homo sapiens
tggctgggcgtgctagaggttg

SEQ ID NO: 4094763 - DNA, 20 bp, Homo sapiens
tggcacccaccgtggaggag

SEQ ID NO: 4094764 - DNA, 22 bp, Homo sapiens
tggcacccaccgtggaggagga

SEQ ID NO: 4094765 - DNA, 21 bp, Homo sapiens
tggcaccccagctaccccttc

SEQ ID NO: 4094766 - DNA, 20 bp, Homo sapiens
tggcacctaatccaggcaga

SEQ ID NO: 4094767 - DNA, 17 bp, Homo sapiens
tggcacctgcacactcc

SEQ ID NO: 4094768 - DNA, 21 bp, Homo sapiens
tggcacctgcacactccatct

SEQ ID NO: 4094769 - DNA, 20 bp, Homo sapiens
tggcacggtggctcaggcct

SEQ ID NO: 4094770 - DNA, 15 bp, Homo sapiens
tggcactagaatgca

SEQ ID NO: 4094771 - DNA, 15 bp, Homo sapiens
tggcactataatgta

SEQ ID NO: 4094772 - DNA, 16 bp, Homo sapiens
tggcactataatgtaa

SEQ ID NO: 4094773 - DNA, 21 bp, Homo sapiens
tggcactataatgtaagctct

SEQ ID NO: 4094774 - DNA, 23 bp, Homo sapiens
tggcactcaactctgagcccata

SEQ ID NO: 4094775 - DNA, 13 bp, Homo sapiens
tggcactggatgc

SEQ ID NO: 4094776 - DNA, 20 bp, Homo sapiens
tggcacttagtaggtcctca

SEQ ID NO: 4094777 - DNA, 11 bp, Homo sapiens
tggcactttga

SEQ ID NO: 4094778 - DNA, 23 bp, Homo sapiens
tggcagaagacaccagagcagat

SEQ ID NO: 4094779 - DNA, 15 bp, Homo sapiens
tggcagacagccgtt

SEQ ID NO: 4094780 - DNA, 12 bp, Homo sapiens
tggcagagagag

SEQ ID NO: 4094781 - DNA, 20 bp, Homo sapiens
tggcagatactccttttgcc

SEQ ID NO: 4094782 - DNA, 16 bp, Homo sapiens
tggcagatgcagctct

SEQ ID NO: 4094783 - DNA, 17 bp, Homo sapiens
tggcagatgcagctctt

SEQ ID NO: 4094784 - DNA, 21 bp, Homo sapiens
tggcagatgcagctcttcctg

SEQ ID NO: 4094785 - DNA, 16 bp, Homo sapiens
tggcagatgtcttccc

SEQ ID NO: 4094786 - DNA, 19 bp, Homo sapiens
tggcagatgtcttccctgg

SEQ ID NO: 4094787 - DNA, 22 bp, Homo sapiens
tggcagatgtcttccctgggct

SEQ ID NO: 4094788 - DNA, 15 bp, Homo sapiens
tggcagattttacaa

SEQ ID NO: 4094789 - DNA, 17 bp, Homo sapiens
tggcagccgtgccttca

SEQ ID NO: 4094790 - DNA, 19 bp, Homo sapiens
tggcagccgtgccttcagc

SEQ ID NO: 4094791 - DNA, 20 bp, Homo sapiens
tggcagccgtgccttcagct

SEQ ID NO: 4094792 - DNA, 21 bp, Homo sapiens
tggcagccgtgccttcagctc

SEQ ID NO: 4094793 - DNA, 22 bp, Homo sapiens
tggcagccgtgccttcagctct

SEQ ID NO: 4094794 - DNA, 23 bp, Homo sapiens
tggcagccgtgccttcagctcta

SEQ ID NO: 4094795 - DNA, 20 bp, Homo sapiens
tggcagcctcccatccaggg

SEQ ID NO: 4094796 - DNA, 15 bp, Homo sapiens
tggcagctagtgcct

SEQ ID NO: 4094797 - DNA, 21 bp, Homo sapiens
tggcagctctggacagcccca

SEQ ID NO: 4094798 - DNA, 16 bp, Homo sapiens
tggcagctgtttctca

SEQ ID NO: 4094799 - DNA, 19 bp, Homo sapiens
tggcagctgtttctcatga

SEQ ID NO: 4094800 - DNA, 11 bp, Homo sapiens
tggcaggacca

SEQ ID NO: 4094801 - DNA, 17 bp, Homo sapiens
tggcaggaccaggacta

SEQ ID NO: 4094802 - DNA, 12 bp, Homo sapiens
tggcaggcaggg

SEQ ID NO: 4094803 - DNA, 14 bp, Homo sapiens
tggcaggccagtgt

SEQ ID NO: 4094804 - DNA, 18 bp, Homo sapiens
tggcagggggccccgcca

SEQ ID NO: 4094805 - DNA, 18 bp, Homo sapiens
tggcagtatttcatttct

SEQ ID NO: 4094806 - DNA, 20 bp, Homo sapiens
tggcagtgactttgtataga

SEQ ID NO: 4094807 - DNA, 14 bp, Homo sapiens
tggcatagacatgg

SEQ ID NO: 4094808 - DNA, 16 bp, Homo sapiens
tggcatagccccggcc

SEQ ID NO: 4094809 - DNA, 15 bp, Homo sapiens
tggcatcatggtgga

SEQ ID NO: 4094810 - DNA, 21 bp, Homo sapiens
tggcatctttgccttgggctg

SEQ ID NO: 4094811 - DNA, 22 bp, Homo sapiens
tggcatgatcatagctcactgc

SEQ ID NO: 4094812 - DNA, 20 bp, Homo sapiens
tggcatgttttgtgcatttg

SEQ ID NO: 4094813 - DNA, 15 bp, Homo sapiens
tggccaagagaaggg

SEQ ID NO: 4094814 - DNA, 23 bp, Homo sapiens
tggccacagcaagtacagcggct

SEQ ID NO: 4094815 - DNA, 17 bp, Homo sapiens
tggccacagtagtcttg

SEQ ID NO: 4094816 - DNA, 19 bp, Homo sapiens
tggccaccagccatcctcc

SEQ ID NO: 4094817 - DNA, 15 bp, Homo sapiens
tggccacctctctcc

SEQ ID NO: 4094818 - DNA, 23 bp, Homo sapiens
tggccacctgtagccatctgcac

SEQ ID NO: 4094819 - DNA, 18 bp, Homo sapiens
tggccactaaagcttcag

SEQ ID NO: 4094820 - DNA, 12 bp, Homo sapiens
tggccactcagc

SEQ ID NO: 4094821 - DNA, 22 bp, Homo sapiens
tggccactccagacccctggct

SEQ ID NO: 4094822 - DNA, 16 bp, Homo sapiens
tggccacttatttcac

SEQ ID NO: 4094823 - DNA, 15 bp, Homo sapiens
tggccagacgctgcc

SEQ ID NO: 4094824 - DNA, 13 bp, Homo sapiens
tggccagagagcc

SEQ ID NO: 4094825 - DNA, 15 bp, Homo sapiens
tggccagagctggga

SEQ ID NO: 4094826 - DNA, 18 bp, Homo sapiens
tggccagagctgggaggc

SEQ ID NO: 4094827 - DNA, 17 bp, Homo sapiens
tggccagatggcccgga

SEQ ID NO: 4094828 - DNA, 15 bp, Homo sapiens
tggccagcaccctct

SEQ ID NO: 4094829 - DNA, 20 bp, Homo sapiens
tggccagcaccctctcctgg

SEQ ID NO: 4094830 - DNA, 15 bp, Homo sapiens
tggccagccgggagc

SEQ ID NO: 4094831 - DNA, 14 bp, Homo sapiens
tggccaggagctct

SEQ ID NO: 4094832 - DNA, 12 bp, Homo sapiens
tggccaggatgg

SEQ ID NO: 4094833 - DNA, 20 bp, Homo sapiens
tggccaggcaccccctggag

SEQ ID NO: 4094834 - DNA, 21 bp, Homo sapiens
tggccaggcactgccttctcc

SEQ ID NO: 4094835 - DNA, 12 bp, Homo sapiens
tggccaggcaga

SEQ ID NO: 4094836 - DNA, 23 bp, Homo sapiens
tggccaggcagatctgtgcccca

SEQ ID NO: 4094837 - DNA, 13 bp, Homo sapiens
tggccagggtgag

SEQ ID NO: 4094838 - DNA, 18 bp, Homo sapiens
tggccagggtgagagctg

SEQ ID NO: 4094839 - DNA, 20 bp, Homo sapiens
tggccagtctggtctcgaac

SEQ ID NO: 4094840 - DNA, 19 bp, Homo sapiens
tggccataggagaggaggg

SEQ ID NO: 4094841 - DNA, 18 bp, Homo sapiens
tggccatggggccctccc

SEQ ID NO: 4094842 - DNA, 20 bp, Homo sapiens
tggcccaacaggggctccat

SEQ ID NO: 4094843 - DNA, 19 bp, Homo sapiens
tggcccaccaggcccccct

SEQ ID NO: 4094844 - DNA, 20 bp, Homo sapiens
tggcccaccgtggcactaga

SEQ ID NO: 4094845 - DNA, 12 bp, Homo sapiens
tggcccagcctt

SEQ ID NO: 4094846 - DNA, 17 bp, Homo sapiens
tggcccagggcccagag

SEQ ID NO: 4094847 - DNA, 23 bp, Homo sapiens
tggcccagggtgaggtggcatgg

SEQ ID NO: 4094848 - DNA, 13 bp, Homo sapiens
tggccccagcctg

SEQ ID NO: 4094849 - DNA, 18 bp, Homo sapiens
tggccccagggcaccctg

SEQ ID NO: 4094850 - DNA, 13 bp, Homo sapiens
tggcccccagggg

SEQ ID NO: 4094851 - DNA, 15 bp, Homo sapiens
tggcccctactttgt

SEQ ID NO: 4094852 - DNA, 21 bp, Homo sapiens
tggcccctcaaatcgtccagc

SEQ ID NO: 4094853 - DNA, 16 bp, Homo sapiens
tggcccgacagcctgg

SEQ ID NO: 4094854 - DNA, 17 bp, Homo sapiens
tggcccgacagcctggc

SEQ ID NO: 4094855 - DNA, 18 bp, Homo sapiens
tggcccgacagcctggca

SEQ ID NO: 4094856 - DNA, 23 bp, Homo sapiens
tggccctccaccttgttcctgcc

SEQ ID NO: 4094857 - DNA, 16 bp, Homo sapiens
tggccctgcctcctgg

SEQ ID NO: 4094858 - DNA, 18 bp, Homo sapiens
tggccctgcctcctggga

SEQ ID NO: 4094859 - DNA, 14 bp, Homo sapiens
tggccctggctctg

SEQ ID NO: 4094860 - DNA, 14 bp, Homo sapiens
tggccctgtcccag

SEQ ID NO: 4094861 - DNA, 15 bp, Homo sapiens
tggcccttacacact

SEQ ID NO: 4094862 - DNA, 22 bp, Homo sapiens
tggcccttacacactcaggcct

SEQ ID NO: 4094863 - DNA, 21 bp, Homo sapiens
tggcccttacttgcttctcta

SEQ ID NO: 4094864 - DNA, 18 bp, Homo sapiens
tggccctttccttccaga

SEQ ID NO: 4094865 - DNA, 17 bp, Homo sapiens
tggccgagtccaagctg

SEQ ID NO: 4094866 - DNA, 19 bp, Homo sapiens
tggagtctggagtgggcag

SEQ ID NO: 4094867 - DNA, 18 bp, Homo sapiens
tggagtgagtcacctgct

SEQ ID NO: 4094868 - DNA, 19 bp, Homo sapiens
tggagtgagtcacctgctc

SEQ ID NO: 4094869 - DNA, 14 bp, Homo sapiens
tggagtgctgtgct

SEQ ID NO: 4094870 - DNA, 19 bp, Homo sapiens
tggagtgtgtattgttccc

SEQ ID NO: 4094871 - DNA, 20 bp, Homo sapiens
tggagtgtgtattgttccca

SEQ ID NO: 4094872 - DNA, 12 bp, Homo sapiens
tggagttccctc

SEQ ID NO: 4094873 - DNA, 23 bp, Homo sapiens
tggagttccttatccctctcttc

SEQ ID NO: 4094874 - DNA, 13 bp, Homo sapiens
tggagtttctctg

SEQ ID NO: 4094875 - DNA, 14 bp, Homo sapiens
tggagtttctctgt

SEQ ID NO: 4094876 - DNA, 17 bp, Homo sapiens
tggagtttgtgtctgtt

SEQ ID NO: 4094877 - DNA, 17 bp, Homo sapiens
tggataaaataatgctg

SEQ ID NO: 4094878 - DNA, 14 bp, Homo sapiens
tggataaatcattt

SEQ ID NO: 4094879 - DNA, 15 bp, Homo sapiens
tggatacttggattt

SEQ ID NO: 4094880 - DNA, 22 bp, Homo sapiens
tggatacttggatttagtttca

SEQ ID NO: 4094881 - DNA, 17 bp, Homo sapiens
tggatattattagaaat

SEQ ID NO: 4094882 - DNA, 13 bp, Homo sapiens
tggatattttcaa

SEQ ID NO: 4094883 - DNA, 18 bp, Homo sapiens
tggatatttttgtacttg

SEQ ID NO: 4094884 - DNA, 22 bp, Homo sapiens
tggatatttttgtacttgattt

SEQ ID NO: 4094885 - DNA, 15 bp, Homo sapiens
tggatcacagctgct

SEQ ID NO: 4094886 - DNA, 19 bp, Homo sapiens
tggatcagtcctttgatca

SEQ ID NO: 4094887 - DNA, 21 bp, Homo sapiens
tggatcccctgcggtcaggct

SEQ ID NO: 4094888 - DNA, 20 bp, Homo sapiens
tggatctatttcatgttttt

SEQ ID NO: 4094889 - DNA, 21 bp, Homo sapiens
tggatctccaaggaccaggtt

SEQ ID NO: 4094890 - DNA, 16 bp, Homo sapiens
tggatcttgaatgtgg

SEQ ID NO: 4094891 - DNA, 18 bp, Homo sapiens
tggatcttgccacatttc

SEQ ID NO: 4094892 - DNA, 19 bp, Homo sapiens
tggatcttgccacatttct

SEQ ID NO: 4094893 - DNA, 19 bp, Homo sapiens
tggatgaagattctcctgt

SEQ ID NO: 4094894 - DNA, 23 bp, Homo sapiens
tggatgacacaatccctggggct

SEQ ID NO: 4094895 - DNA, 17 bp, Homo sapiens
tggatgactgttgatga

SEQ ID NO: 4094896 - DNA, 20 bp, Homo sapiens
tggatgagacttccaaacct

SEQ ID NO: 4094897 - DNA, 16 bp, Homo sapiens
tggatgaggagacaga

SEQ ID NO: 4094898 - DNA, 17 bp, Homo sapiens
tggatgcgcagtgcctt

SEQ ID NO: 4094899 - DNA, 13 bp, Homo sapiens
tggatggcttcta

SEQ ID NO: 4094900 - DNA, 17 bp, Homo sapiens
tggatgggaatttgtca

SEQ ID NO: 4094901 - DNA, 17 bp, Homo sapiens
tggatgggagtgagaca

SEQ ID NO: 4094902 - DNA, 17 bp, Homo sapiens
tggatgggagtgggcac

SEQ ID NO: 4094903 - DNA, 21 bp, Homo sapiens
tggatgggggaactcagatcc

SEQ ID NO: 4094904 - DNA, 22 bp, Homo sapiens
tggatgggggaactcagatcca

SEQ ID NO: 4094905 - DNA, 15 bp, Homo sapiens
tggatgttgtgtgta

SEQ ID NO: 4094906 - DNA, 13 bp, Homo sapiens
tggattaaaacaa

SEQ ID NO: 4094907 - DNA, 15 bp, Homo sapiens
tggattaaaacaatt

SEQ ID NO: 4094908 - DNA, 14 bp, Homo sapiens
tggattattcattt

SEQ ID NO: 4094909 - DNA, 20 bp, Homo sapiens
tggattattcatttaaaatg

SEQ ID NO: 4094910 - DNA, 13 bp, Homo sapiens
tggattatttaat

SEQ ID NO: 4094911 - DNA, 15 bp, Homo sapiens
tggattatttaataa

SEQ ID NO: 4094912 - DNA, 17 bp, Homo sapiens
tggattatttaataaca

SEQ ID NO: 4094913 - DNA, 18 bp, Homo sapiens
tggattatttaataacat

SEQ ID NO: 4094914 - DNA, 20 bp, Homo sapiens
tggattatttaataacatta

SEQ ID NO: 4094915 - DNA, 23 bp, Homo sapiens
tggattatttaataacattacct

SEQ ID NO: 4094916 - DNA, 13 bp, Homo sapiens
tggattcatcagc

SEQ ID NO: 4094917 - DNA, 23 bp, Homo sapiens
tggattcattctcataattccta

SEQ ID NO: 4094918 - DNA, 14 bp, Homo sapiens
tggattcattgtct

SEQ ID NO: 4094919 - DNA, 14 bp, Homo sapiens
tggattcctgtttc

SEQ ID NO: 4094920 - DNA, 12 bp, Homo sapiens
tggattctcaga

SEQ ID NO: 4094921 - DNA, 15 bp, Homo sapiens
tggattctcagatat

SEQ ID NO: 4094922 - DNA, 14 bp, Homo sapiens
tggattctgaatct

SEQ ID NO: 4094923 - DNA, 22 bp, Homo sapiens
tggattctgggaggcaagaaaa

SEQ ID NO: 4094924 - DNA, 17 bp, Homo sapiens
tggattcttgttttgct

SEQ ID NO: 4094925 - DNA, 21 bp, Homo sapiens
tggattgcacgtggcctcttg

SEQ ID NO: 4094926 - DNA, 17 bp, Homo sapiens
tggattggattatttaa

SEQ ID NO: 4094927 - DNA, 21 bp, Homo sapiens
tggattggattatttaataac

SEQ ID NO: 4094928 - DNA, 23 bp, Homo sapiens
tggattggattatttaataacat

SEQ ID NO: 4094929 - DNA, 20 bp, Homo sapiens
tggatttccttctaacatgt

SEQ ID NO: 4094930 - DNA, 22 bp, Homo sapiens
tggatttcctttatactgtgaa

SEQ ID NO: 4094931 - DNA, 14 bp, Homo sapiens
tggatttgacattg

SEQ ID NO: 4094932 - DNA, 17 bp, Homo sapiens
tggatttgattcatttt

SEQ ID NO: 4094933 - DNA, 18 bp, Homo sapiens
tggatttgcctgtgccac

SEQ ID NO: 4094934 - DNA, 19 bp, Homo sapiens
tggattttcctgaaagtgt

SEQ ID NO: 4094935 - DNA, 15 bp, Homo sapiens
tggattttctactgt

SEQ ID NO: 4094936 - DNA, 22 bp, Homo sapiens
tggattttttattattattcaa

SEQ ID NO: 4094937 - DNA, 22 bp, Homo sapiens
tggatttttttgtcattaaaat

SEQ ID NO: 4094938 - DNA, 22 bp, Homo sapiens
tggcaaaaaggagccttttgct

SEQ ID NO: 4094939 - DNA, 22 bp, Homo sapiens
tggcaaaaatgcaacaaatgaa

SEQ ID NO: 4094940 - DNA, 15 bp, Homo sapiens
tggcaaaagccttgt

SEQ ID NO: 4094941 - DNA, 17 bp, Homo sapiens
tggcaaagctgttcttc

SEQ ID NO: 4094942 - DNA, 19 bp, Homo sapiens
tggcaaagctgttcttcct

SEQ ID NO: 4094943 - DNA, 20 bp, Homo sapiens
tggcaaagctgttcttcctg

SEQ ID NO: 4094944 - DNA, 17 bp, Homo sapiens
tggcaaagtttaaatgt

SEQ ID NO: 4094945 - DNA, 11 bp, Homo sapiens
tggcaaatgca

SEQ ID NO: 4094946 - DNA, 17 bp, Homo sapiens
tggcaaattaacttgag

SEQ ID NO: 4094947 - DNA, 15 bp, Homo sapiens
tggcaacagatctgg

SEQ ID NO: 4094948 - DNA, 17 bp, Homo sapiens
tggcaacagatctggaa

SEQ ID NO: 4094949 - DNA, 18 bp, Homo sapiens
tggcaacagatctggaac

SEQ ID NO: 4094950 - DNA, 14 bp, Homo sapiens
tggcaacaggacag

SEQ ID NO: 4094951 - DNA, 20 bp, Homo sapiens
tggcaacaggacagagttca

SEQ ID NO: 4094952 - DNA, 13 bp, Homo sapiens
tggcaagagcccc

SEQ ID NO: 4094953 - DNA, 22 bp, Homo sapiens
tggcaagagggtgacagcttcc

SEQ ID NO: 4094954 - DNA, 19 bp, Homo sapiens
tggcaagagtgtggaggct

SEQ ID NO: 4094955 - DNA, 16 bp, Homo sapiens
tggcaagtcacatgcg

SEQ ID NO: 4094956 - DNA, 19 bp, Homo sapiens
tggcaatagggtagaatga

SEQ ID NO: 4094957 - DNA, 18 bp, Homo sapiens
tggcaatagtgtgttctg

SEQ ID NO: 4094958 - DNA, 16 bp, Homo sapiens
tggcaatataatcttt

SEQ ID NO: 4094959 - DNA, 21 bp, Homo sapiens
tggcaatgcttaaactaaata

SEQ ID NO: 4094960 - DNA, 14 bp, Homo sapiens
tggcaattgtctat

SEQ ID NO: 4094961 - DNA, 16 bp, Homo sapiens
tggcaattgtctattt

SEQ ID NO: 4094962 - DNA, 18 bp, Homo sapiens
tggcaattttatgttttt

SEQ ID NO: 4094963 - DNA, 15 bp, Homo sapiens
tggcacagggcagtg

SEQ ID NO: 4094964 - DNA, 15 bp, Homo sapiens
tggcacatgccacct

SEQ ID NO: 4094965 - DNA, 18 bp, Homo sapiens
tggcaccactgcactcca

SEQ ID NO: 4094966 - DNA, 14 bp, Homo sapiens
tggcaccagacacc

SEQ ID NO: 4094967 - DNA, 21 bp, Homo sapiens
tggcaccagacacccaggact

SEQ ID NO: 4094968 - DNA, 19 bp, Homo sapiens
tggcaccagatgcaacctc

SEQ ID NO: 4094969 - DNA, 16 bp, Homo sapiens
tgctggtgccagggtg

SEQ ID NO: 4094970 - DNA, 13 bp, Homo sapiens
tgctggtttattt

SEQ ID NO: 4094971 - DNA, 14 bp, Homo sapiens
tgctggttttccta

SEQ ID NO: 4094972 - DNA, 15 bp, Homo sapiens
tgctgtacatctatt

SEQ ID NO: 4094973 - DNA, 15 bp, Homo sapiens
tgctgtatatgcaat

SEQ ID NO: 4094974 - DNA, 21 bp, Homo sapiens
tgctgtcattgcttcttctga

SEQ ID NO: 4094975 - DNA, 16 bp, Homo sapiens
tgctgtccctccccct

SEQ ID NO: 4094976 - DNA, 16 bp, Homo sapiens
tgctgtcttccccacc

SEQ ID NO: 4094977 - DNA, 22 bp, Homo sapiens
tgctgtgaaccctggggcctga

SEQ ID NO: 4094978 - DNA, 18 bp, Homo sapiens
tgctgtgaccatttataa

SEQ ID NO: 4094979 - DNA, 13 bp, Homo sapiens
tgctgtgaggctg

SEQ ID NO: 4094980 - DNA, 14 bp, Homo sapiens
tgctgtgaggctgt

SEQ ID NO: 4094981 - DNA, 16 bp, Homo sapiens
tgctgtgaggctgtcc

SEQ ID NO: 4094982 - DNA, 18 bp, Homo sapiens
tgctgtgaggctgtcctg

SEQ ID NO: 4094983 - DNA, 20 bp, Homo sapiens
tgctgtgccatgctgggcca

SEQ ID NO: 4094984 - DNA, 14 bp, Homo sapiens
tgctgtgcgtggaa

SEQ ID NO: 4094985 - DNA, 16 bp, Homo sapiens
tgctgtgggcagcacc

SEQ ID NO: 4094986 - DNA, 14 bp, Homo sapiens
tgctgtggtgggga

SEQ ID NO: 4094987 - DNA, 13 bp, Homo sapiens
tgctgtgtttgct

SEQ ID NO: 4094988 - DNA, 14 bp, Homo sapiens
tgctgttactgtta

SEQ ID NO: 4094989 - DNA, 20 bp, Homo sapiens
tgctgttatgtctgtttaag

SEQ ID NO: 4094990 - DNA, 14 bp, Homo sapiens
tgctgttctcagga

SEQ ID NO: 4094991 - DNA, 13 bp, Homo sapiens
tgctgtttcacaa

SEQ ID NO: 4094992 - DNA, 23 bp, Homo sapiens
tgctgttttaaacattaatagca

SEQ ID NO: 4094993 - DNA, 17 bp, Homo sapiens
tgcttaaaaatcattga

SEQ ID NO: 4094994 - DNA, 12 bp, Homo sapiens
tgcttaaacaaa

SEQ ID NO: 4094995 - DNA, 15 bp, Homo sapiens
tgcttaaatttctta

SEQ ID NO: 4094996 - DNA, 15 bp, Homo sapiens
tgcttaataaattgt

SEQ ID NO: 4094997 - DNA, 14 bp, Homo sapiens
tgcttacattttta

SEQ ID NO: 4094998 - DNA, 15 bp, Homo sapiens
tgcttacatttttac

SEQ ID NO: 4094999 - DNA, 14 bp, Homo sapiens
tgcttagaaaagaa

SEQ ID NO: 4095000 - DNA, 19 bp, Homo sapiens
tgcttagctgccttgagct

SEQ ID NO: 4095001 - DNA, 15 bp, Homo sapiens
tgcttcaattaataa

SEQ ID NO: 4095002 - DNA, 19 bp, Homo sapiens
tgcttcattcaatattgac

SEQ ID NO: 4095003 - DNA, 17 bp, Homo sapiens
tgcttcattttggagct

SEQ ID NO: 4095004 - DNA, 13 bp, Homo sapiens
tgcttcccagagg

SEQ ID NO: 4095005 - DNA, 18 bp, Homo sapiens
tgcttcccagagggagca

SEQ ID NO: 4095006 - DNA, 11 bp, Homo sapiens
tgcttcctgat

SEQ ID NO: 4095007 - DNA, 15 bp, Homo sapiens
tgcttcctgatgctg

SEQ ID NO: 4095008 - DNA, 18 bp, Homo sapiens
tgcttctcatcccaacct

SEQ ID NO: 4095009 - DNA, 10 bp, Homo sapiens
tgcttctcta

SEQ ID NO: 4095010 - DNA, 16 bp, Homo sapiens
tgcttctctacagact

SEQ ID NO: 4095011 - DNA, 15 bp, Homo sapiens
tgcttctctccttgc

SEQ ID NO: 4095012 - DNA, 22 bp, Homo sapiens
tgcttctgaactcaagctgcgt

SEQ ID NO: 4095013 - DNA, 13 bp, Homo sapiens
tgcttctggaaac

SEQ ID NO: 4095014 - DNA, 17 bp, Homo sapiens
tgcttctgtagtactcc

SEQ ID NO: 4095015 - DNA, 18 bp, Homo sapiens
tgcttgaaattactgtgt

SEQ ID NO: 4095016 - DNA, 20 bp, Homo sapiens
tgcttgaccgtactctcaca

SEQ ID NO: 4095017 - DNA, 18 bp, Homo sapiens
tgcttgagaatcctctcc

SEQ ID NO: 4095018 - DNA, 13 bp, Homo sapiens
tgcttgagcccag

SEQ ID NO: 4095019 - DNA, 21 bp, Homo sapiens
tgcttgataggaattcatctt

SEQ ID NO: 4095020 - DNA, 13 bp, Homo sapiens
tgcttgatccaga

SEQ ID NO: 4095021 - DNA, 15 bp, Homo sapiens
tgcttgatccagaag

SEQ ID NO: 4095022 - DNA, 20 bp, Homo sapiens
tgcttgatgaagcaaggaag

SEQ ID NO: 4095023 - DNA, 16 bp, Homo sapiens
tgcttgcaggaggcca

SEQ ID NO: 4095024 - DNA, 23 bp, Homo sapiens
tgcttgcccaagtcacacagcta

SEQ ID NO: 4095025 - DNA, 15 bp, Homo sapiens
tgcttgctttgaagt

SEQ ID NO: 4095026 - DNA, 16 bp, Homo sapiens
tgcttggtctgtttga

SEQ ID NO: 4095027 - DNA, 14 bp, Homo sapiens
tgcttggtgctggt

SEQ ID NO: 4095028 - DNA, 17 bp, Homo sapiens
tgcttggtgctggttta

SEQ ID NO: 4095029 - DNA, 18 bp, Homo sapiens
tgcttggtgctggtttat

SEQ ID NO: 4095030 - DNA, 20 bp, Homo sapiens
tgcttgtcgctttctcagtg

SEQ ID NO: 4095031 - DNA, 12 bp, Homo sapiens
tgcttgtgttaa

SEQ ID NO: 4095032 - DNA, 20 bp, Homo sapiens
tgctttaaagggcctgcctg

SEQ ID NO: 4095033 - DNA, 21 bp, Homo sapiens
tgctttaaagggcctgcctgg

SEQ ID NO: 4095034 - DNA, 17 bp, Homo sapiens
tgctttattccagaatg

SEQ ID NO: 4095035 - DNA, 16 bp, Homo sapiens
tgctttattgcttttt

SEQ ID NO: 4095036 - DNA, 16 bp, Homo sapiens
tgctttcctgggcctt

SEQ ID NO: 4095037 - DNA, 19 bp, Homo sapiens
tgctttctatgctgtttgt

SEQ ID NO: 4095038 - DNA, 12 bp, Homo sapiens
tgctttctgaaa

SEQ ID NO: 4095039 - DNA, 23 bp, Homo sapiens
tgctttctgaaattcacagaagc

SEQ ID NO: 4095040 - DNA, 14 bp, Homo sapiens
tgctttcttaccta

SEQ ID NO: 4095041 - DNA, 16 bp, Homo sapiens
tgctttgaagtagctc

SEQ ID NO: 4095042 - DNA, 18 bp, Homo sapiens
tgctttgatttacagcaa

SEQ ID NO: 4095043 - DNA, 22 bp, Homo sapiens
tgctttgatttacagcaagtag

SEQ ID NO: 4095044 - DNA, 14 bp, Homo sapiens
tgctttgcacagga

SEQ ID NO: 4095045 - DNA, 13 bp, Homo sapiens
tgctttgcctcta

SEQ ID NO: 4095046 - DNA, 12 bp, Homo sapiens
tgctttgctctt

SEQ ID NO: 4095047 - DNA, 16 bp, Homo sapiens
tgctttggctgagggg

SEQ ID NO: 4095048 - DNA, 18 bp, Homo sapiens
tgctttggtctgtgttca

SEQ ID NO: 4095049 - DNA, 15 bp, Homo sapiens
tgctttgtctcctct

SEQ ID NO: 4095050 - DNA, 18 bp, Homo sapiens
tgcttttatatggcccag

SEQ ID NO: 4095051 - DNA, 21 bp, Homo sapiens
tgcttttatatggcccagcct

SEQ ID NO: 4095052 - DNA, 15 bp, Homo sapiens
tgcttttattttgaa

SEQ ID NO: 4095053 - DNA, 21 bp, Homo sapiens
tgcttttattttgaaaagctt

SEQ ID NO: 4095054 - DNA, 14 bp, Homo sapiens
tgcttttctgtcct

SEQ ID NO: 4095055 - DNA, 16 bp, Homo sapiens
tgcttttctgtcctgg

SEQ ID NO: 4095056 - DNA, 23 bp, Homo sapiens
tgctttttaatattgatatgctt

SEQ ID NO: 4095057 - DNA, 13 bp, Homo sapiens
tgctttttaccta

SEQ ID NO: 4095058 - DNA, 13 bp, Homo sapiens
tgctttttctaat

SEQ ID NO: 4095059 - DNA, 13 bp, Homo sapiens
tgcttttttgtat

SEQ ID NO: 4095060 - DNA, 15 bp, Homo sapiens
tgctttttttggcct

SEQ ID NO: 4095061 - DNA, 17 bp, Homo sapiens
tgcttttttttccttct

SEQ ID NO: 4095062 - DNA, 20 bp, Homo sapiens
tggaaaaaaacataaaaagc

SEQ ID NO: 4095063 - DNA, 21 bp, Homo sapiens
tggaaaaaaacataaaaagca

SEQ ID NO: 4095064 - DNA, 11 bp, Homo sapiens
tggaaaaagac

SEQ ID NO: 4095065 - DNA, 19 bp, Homo sapiens
tggaaaaatggttgatgga

SEQ ID NO: 4095066 - DNA, 21 bp, Homo sapiens
tggaaaaatggttgatggaaa

SEQ ID NO: 4095067 - DNA, 16 bp, Homo sapiens
tggaaaaattccagaa

SEQ ID NO: 4095068 - DNA, 20 bp, Homo sapiens
tggaaaactgtgttgccaca

SEQ ID NO: 4095069 - DNA, 12 bp, Homo sapiens
tggaaaagaaga

SEQ ID NO: 4095070 - DNA, 16 bp, Homo sapiens
tggaaaagaggagttt

SEQ ID NO: 4095071 - DNA, 16 bp, Homo sapiens
tggaaaaggaagacta

SEQ ID NO: 4095072 - DNA, 16 bp, Homo sapiens
tggaaaagtgtccttc

SEQ ID NO: 4095073 - DNA, 17 bp, Homo sapiens
tggaaacattacagttc

SEQ ID NO: 4095074 - DNA, 14 bp, Homo sapiens
tgctctcctcatct

SEQ ID NO: 4095075 - DNA, 16 bp, Homo sapiens
tgctctcctcatctcc

SEQ ID NO: 4095076 - DNA, 14 bp, Homo sapiens
tgctctctgtgacc

SEQ ID NO: 4095077 - DNA, 17 bp, Homo sapiens
tgctctgaaatctcctt

SEQ ID NO: 4095078 - DNA, 19 bp, Homo sapiens
tgctctgacgtagaaagat

SEQ ID NO: 4095079 - DNA, 18 bp, Homo sapiens
tgctctgcatgttacata

SEQ ID NO: 4095080 - DNA, 12 bp, Homo sapiens
tgctctgcctca

SEQ ID NO: 4095081 - DNA, 13 bp, Homo sapiens
tgctctgcctcag

SEQ ID NO: 4095082 - DNA, 15 bp, Homo sapiens
tgctctgctgatgac

SEQ ID NO: 4095083 - DNA, 16 bp, Homo sapiens
tgctctggaagagagg

SEQ ID NO: 4095084 - DNA, 18 bp, Homo sapiens
tgctctggttgtttctgt

SEQ ID NO: 4095085 - DNA, 11 bp, Homo sapiens
tgctctgtccc

SEQ ID NO: 4095086 - DNA, 20 bp, Homo sapiens
tgctctgtcccccaggctgg

SEQ ID NO: 4095087 - DNA, 22 bp, Homo sapiens
tgctctgtcccccaggctggag

SEQ ID NO: 4095088 - DNA, 19 bp, Homo sapiens
tgctctgtgttcccagagg

SEQ ID NO: 4095089 - DNA, 20 bp, Homo sapiens
tgctcttaagaaactatgaa

SEQ ID NO: 4095090 - DNA, 17 bp, Homo sapiens
tgctcttagtcccaagc

SEQ ID NO: 4095091 - DNA, 16 bp, Homo sapiens
tgctcttggctgaccc

SEQ ID NO: 4095092 - DNA, 17 bp, Homo sapiens
tgctcttggctgacccc

SEQ ID NO: 4095093 - DNA, 21 bp, Homo sapiens
tgctcttgtcccacgtgtctt

SEQ ID NO: 4095094 - DNA, 23 bp, Homo sapiens
tgctctttcccccttccatctct

SEQ ID NO: 4095095 - DNA, 18 bp, Homo sapiens
tgctctttctctgccagt

SEQ ID NO: 4095096 - DNA, 20 bp, Homo sapiens
tgctctttgacaactaaaat

SEQ ID NO: 4095097 - DNA, 13 bp, Homo sapiens
tgctcttttcctg

SEQ ID NO: 4095098 - DNA, 14 bp, Homo sapiens
tgctcttttcctgg

SEQ ID NO: 4095099 - DNA, 14 bp, Homo sapiens
tgctgaacacacac

SEQ ID NO: 4095100 - DNA, 22 bp, Homo sapiens
tgctgaagggaccttgaagggt

SEQ ID NO: 4095101 - DNA, 16 bp, Homo sapiens
tgctgaagtccggaac

SEQ ID NO: 4095102 - DNA, 21 bp, Homo sapiens
tgctgaccaattgtgctgcca

SEQ ID NO: 4095103 - DNA, 14 bp, Homo sapiens
tgctgacggccagg

SEQ ID NO: 4095104 - DNA, 17 bp, Homo sapiens
tgctgacggccagggag

SEQ ID NO: 4095105 - DNA, 20 bp, Homo sapiens
tgctgacggccagggagaag

SEQ ID NO: 4095106 - DNA, 21 bp, Homo sapiens
tgctgactgtactcctcccag

SEQ ID NO: 4095107 - DNA, 14 bp, Homo sapiens
tgctgagagccccc

SEQ ID NO: 4095108 - DNA, 17 bp, Homo sapiens
tgctgagagcccccacc

SEQ ID NO: 4095109 - DNA, 19 bp, Homo sapiens
tgctgagattgcagatgtg

SEQ ID NO: 4095110 - DNA, 23 bp, Homo sapiens
tgctgagggtgtttcttcctgca

SEQ ID NO: 4095111 - DNA, 21 bp, Homo sapiens
tgctgagtcatctgttagggc

SEQ ID NO: 4095112 - DNA, 21 bp, Homo sapiens
tgctgatcatcgccagaggtg

SEQ ID NO: 4095113 - DNA, 21 bp, Homo sapiens
tgctgatgaactcttaatcaa

SEQ ID NO: 4095114 - DNA, 19 bp, Homo sapiens
tgctgatggcttgacatgt

SEQ ID NO: 4095115 - DNA, 24 bp, Homo sapiens
tgctgatggcttgacatgtgcaat

SEQ ID NO: 4095116 - DNA, 17 bp, Homo sapiens
tgctgattctcccgttc

SEQ ID NO: 4095117 - DNA, 16 bp, Homo sapiens
tgctgcaaacttaatg

SEQ ID NO: 4095118 - DNA, 14 bp, Homo sapiens
tgctgcacccaact

SEQ ID NO: 4095119 - DNA, 18 bp, Homo sapiens
tgctgcacccaactactg

SEQ ID NO: 4095120 - DNA, 24 bp, Homo sapiens
tgctgcacccaactactgagctga

SEQ ID NO: 4095121 - DNA, 16 bp, Homo sapiens
tgctgcaccctgcgcc

SEQ ID NO: 4095122 - DNA, 20 bp, Homo sapiens
tgctgcaccctgcgcctcca

SEQ ID NO: 4095123 - DNA, 12 bp, Homo sapiens
tgctgcagagat

SEQ ID NO: 4095124 - DNA, 20 bp, Homo sapiens
tgctgcagcctgcccctaga

SEQ ID NO: 4095125 - DNA, 18 bp, Homo sapiens
tgctgcagtcatctactt

SEQ ID NO: 4095126 - DNA, 19 bp, Homo sapiens
tgctgccacacttcaggct

SEQ ID NO: 4095127 - DNA, 20 bp, Homo sapiens
tgctgccagtaccagcccca

SEQ ID NO: 4095128 - DNA, 14 bp, Homo sapiens
tgctgccccagctg

SEQ ID NO: 4095129 - DNA, 15 bp, Homo sapiens
tgctgccccagctga

SEQ ID NO: 4095130 - DNA, 14 bp, Homo sapiens
tgctgcccccaccc

SEQ ID NO: 4095131 - DNA, 15 bp, Homo sapiens
tgctgcccccacccc

SEQ ID NO: 4095132 - DNA, 19 bp, Homo sapiens
tgctgcctctttccctagg

SEQ ID NO: 4095133 - DNA, 14 bp, Homo sapiens
tgctgcctgaatcc

SEQ ID NO: 4095134 - DNA, 20 bp, Homo sapiens
tgctgcctgctgagatgagg

SEQ ID NO: 4095135 - DNA, 15 bp, Homo sapiens
tgctgccttgcttct

SEQ ID NO: 4095136 - DNA, 17 bp, Homo sapiens
tgctgcgcaccaatgcc

SEQ ID NO: 4095137 - DNA, 21 bp, Homo sapiens
tgctgcgcaccaatgcccagc

SEQ ID NO: 4095138 - DNA, 20 bp, Homo sapiens
tgctgcgcccttaccttccc

SEQ ID NO: 4095139 - DNA, 20 bp, Homo sapiens
tgctgcgcctgcaggcagag

SEQ ID NO: 4095140 - DNA, 22 bp, Homo sapiens
tgctgcgcctgcaggcagagct

SEQ ID NO: 4095141 - DNA, 22 bp, Homo sapiens
tgctgctaccgccctgggctgg

SEQ ID NO: 4095142 - DNA, 13 bp, Homo sapiens
tgctgctccgccc

SEQ ID NO: 4095143 - DNA, 16 bp, Homo sapiens
tgctgctccgcccgct

SEQ ID NO: 4095144 - DNA, 13 bp, Homo sapiens
tgctgctgctgca

SEQ ID NO: 4095145 - DNA, 14 bp, Homo sapiens
tgctgctgctgcac

SEQ ID NO: 4095146 - DNA, 17 bp, Homo sapiens
tgctgctgctgcgccct

SEQ ID NO: 4095147 - DNA, 11 bp, Homo sapiens
tgctgctggcc

SEQ ID NO: 4095148 - DNA, 15 bp, Homo sapiens
tgctggaagcccagc

SEQ ID NO: 4095149 - DNA, 17 bp, Homo sapiens
tgctggaattctaacaa

SEQ ID NO: 4095150 - DNA, 14 bp, Homo sapiens
tgctggagaggtta

SEQ ID NO: 4095151 - DNA, 20 bp, Homo sapiens
tgctggagtttcatgtacaa

SEQ ID NO: 4095152 - DNA, 17 bp, Homo sapiens
tgctggatattttcaaa

SEQ ID NO: 4095153 - DNA, 19 bp, Homo sapiens
tgctggcacttagtaggtc

SEQ ID NO: 4095154 - DNA, 18 bp, Homo sapiens
tgctggcatcaagaggtg

SEQ ID NO: 4095155 - DNA, 19 bp, Homo sapiens
tgctggccaaatagcaaag

SEQ ID NO: 4095156 - DNA, 12 bp, Homo sapiens
tgctggccagca

SEQ ID NO: 4095157 - DNA, 17 bp, Homo sapiens
tgctggccagcaccctc

SEQ ID NO: 4095158 - DNA, 18 bp, Homo sapiens
tgctggccagcaccctct

SEQ ID NO: 4095159 - DNA, 19 bp, Homo sapiens
tgctggccagcaccctctc

SEQ ID NO: 4095160 - DNA, 22 bp, Homo sapiens
tgctggccagcaccctctcctg

SEQ ID NO: 4095161 - DNA, 18 bp, Homo sapiens
tgctggcccagggcccag

SEQ ID NO: 4095162 - DNA, 21 bp, Homo sapiens
tgctggcccagggcccagagc

SEQ ID NO: 4095163 - DNA, 14 bp, Homo sapiens
tgctggcctggatc

SEQ ID NO: 4095164 - DNA, 16 bp, Homo sapiens
tgctggcctggatctc

SEQ ID NO: 4095165 - DNA, 14 bp, Homo sapiens
tgctggcttccagc

SEQ ID NO: 4095166 - DNA, 16 bp, Homo sapiens
tgctgggaagggaggg

SEQ ID NO: 4095167 - DNA, 22 bp, Homo sapiens
tgctgggaccagagccagatgc

SEQ ID NO: 4095168 - DNA, 21 bp, Homo sapiens
tgctgggctccccccagtggg

SEQ ID NO: 4095169 - DNA, 13 bp, Homo sapiens
tgctgggctgggc

SEQ ID NO: 4095170 - DNA, 14 bp, Homo sapiens
tgctggggcagggg

SEQ ID NO: 4095171 - DNA, 10 bp, Homo sapiens
tgctggggct

SEQ ID NO: 4095172 - DNA, 20 bp, Homo sapiens
tgctggggctcacggggcct

SEQ ID NO: 4095173 - DNA, 14 bp, Homo sapiens
tgctgggggaatga

SEQ ID NO: 4095174 - DNA, 15 bp, Homo sapiens
tgctgggggaatgag

SEQ ID NO: 4095175 - DNA, 18 bp, Homo sapiens
tgctggtatatggcttca

SEQ ID NO: 4095176 - DNA, 19 bp, Homo sapiens
tgctggtcccggggccagc

SEQ ID NO: 4095177 - DNA, 20 bp, Homo sapiens
tggactcagggcagcgccag

SEQ ID NO: 4095178 - DNA, 14 bp, Homo sapiens
tggactctcaggga

SEQ ID NO: 4095179 - DNA, 14 bp, Homo sapiens
tggactctgcatcc

SEQ ID NO: 4095180 - DNA, 16 bp, Homo sapiens
tggactctgcatccca

SEQ ID NO: 4095181 - DNA, 18 bp, Homo sapiens
tggactctgcatcccagc

SEQ ID NO: 4095182 - DNA, 20 bp, Homo sapiens
tggactctgcatcccagcac

SEQ ID NO: 4095183 - DNA, 17 bp, Homo sapiens
tggactcttctcggctc

SEQ ID NO: 4095184 - DNA, 20 bp, Homo sapiens
tggactcttctcggctcagg

SEQ ID NO: 4095185 - DNA, 18 bp, Homo sapiens
tggactgaagcctgcagg

SEQ ID NO: 4095186 - DNA, 13 bp, Homo sapiens
tggactgacattt

SEQ ID NO: 4095187 - DNA, 14 bp, Homo sapiens
tggactgcagaagc

SEQ ID NO: 4095188 - DNA, 21 bp, Homo sapiens
tggactggaggcccctggagc

SEQ ID NO: 4095189 - DNA, 22 bp, Homo sapiens
tggactggaggtgggcatgcca

SEQ ID NO: 4095190 - DNA, 16 bp, Homo sapiens
tggactggcccctggg

SEQ ID NO: 4095191 - DNA, 22 bp, Homo sapiens
tggactggctagagtcctcact

SEQ ID NO: 4095192 - DNA, 16 bp, Homo sapiens
tggactgggaggaggg

SEQ ID NO: 4095193 - DNA, 13 bp, Homo sapiens
tggactgggaggt

SEQ ID NO: 4095194 - DNA, 21 bp, Homo sapiens
tggactgggttgcgtcctgac

SEQ ID NO: 4095195 - DNA, 20 bp, Homo sapiens
tggactgtgatgccacacag

SEQ ID NO: 4095196 - DNA, 16 bp, Homo sapiens
tggactgttgccacca

SEQ ID NO: 4095197 - DNA, 20 bp, Homo sapiens
tggacttgtatatttgtaca

SEQ ID NO: 4095198 - DNA, 22 bp, Homo sapiens
tggactttggttctctccagga

SEQ ID NO: 4095199 - DNA, 19 bp, Homo sapiens
tggacttttcgttaacatt

SEQ ID NO: 4095200 - DNA, 21 bp, Homo sapiens
tggacttttcgttaacattga

SEQ ID NO: 4095201 - DNA, 22 bp, Homo sapiens
tggacttttcgttaacattgac

SEQ ID NO: 4095202 - DNA, 23 bp, Homo sapiens
tggagaacgccagtctcccaggc

SEQ ID NO: 4095203 - DNA, 14 bp, Homo sapiens
tggagaactagaga

SEQ ID NO: 4095204 - DNA, 22 bp, Homo sapiens
tggagaactgggatttgaaccc

SEQ ID NO: 4095205 - DNA, 16 bp, Homo sapiens
tggagaagctcaccca

SEQ ID NO: 4095206 - DNA, 21 bp, Homo sapiens
tggagaatactttgcttcata

SEQ ID NO: 4095207 - DNA, 18 bp, Homo sapiens
tggagaccagggagcctt

SEQ ID NO: 4095208 - DNA, 19 bp, Homo sapiens
tggagaccagggagccttt

SEQ ID NO: 4095209 - DNA, 18 bp, Homo sapiens
tggagaccctgccacagc

SEQ ID NO: 4095210 - DNA, 20 bp, Homo sapiens
tggagaccctgccacagcca

SEQ ID NO: 4095211 - DNA, 12 bp, Homo sapiens
tggagacgtgga

SEQ ID NO: 4095212 - DNA, 20 bp, Homo sapiens
tggagacgtggaacctctgt

SEQ ID NO: 4095213 - DNA, 23 bp, Homo sapiens
tggagacgtggaacctctgtctc

SEQ ID NO: 4095214 - DNA, 24 bp, Homo sapiens
tggagacgtggaacctctgtctca

SEQ ID NO: 4095215 - DNA, 13 bp, Homo sapiens
tggagactcctgc

SEQ ID NO: 4095216 - DNA, 18 bp, Homo sapiens
tggagactcctgccctgt

SEQ ID NO: 4095217 - DNA, 19 bp, Homo sapiens
tggagactgatggccaggc

SEQ ID NO: 4095218 - DNA, 17 bp, Homo sapiens
tggagactgtctcaaga

SEQ ID NO: 4095219 - DNA, 11 bp, Homo sapiens
tggagagctgg

SEQ ID NO: 4095220 - DNA, 13 bp, Homo sapiens
tggagaggcggcc

SEQ ID NO: 4095221 - DNA, 15 bp, Homo sapiens
tggagaggcggcctc

SEQ ID NO: 4095222 - DNA, 20 bp, Homo sapiens
tggagagggacagcccactg

SEQ ID NO: 4095223 - DNA, 22 bp, Homo sapiens
tggagaggttataggtcactcc

SEQ ID NO: 4095224 - DNA, 16 bp, Homo sapiens
tggagagtttcctgaa

SEQ ID NO: 4095225 - DNA, 22 bp, Homo sapiens
tggagatattataagggagagc

SEQ ID NO: 4095226 - DNA, 14 bp, Homo sapiens
tggagatgcagagg

SEQ ID NO: 4095227 - DNA, 15 bp, Homo sapiens
tggagcaaaaggcag

SEQ ID NO: 4095228 - DNA, 19 bp, Homo sapiens
tggagcaaaaggcagctca

SEQ ID NO: 4095229 - DNA, 15 bp, Homo sapiens
tggagcaaagctgat

SEQ ID NO: 4095230 - DNA, 20 bp, Homo sapiens
tggagcacatgttactgctt

SEQ ID NO: 4095231 - DNA, 13 bp, Homo sapiens
tggagcagaccac

SEQ ID NO: 4095232 - DNA, 17 bp, Homo sapiens
tggagcagaccaccccg

SEQ ID NO: 4095233 - DNA, 17 bp, Homo sapiens
tggagcatgggcctggc

SEQ ID NO: 4095234 - DNA, 14 bp, Homo sapiens
tggagccagggagc

SEQ ID NO: 4095235 - DNA, 14 bp, Homo sapiens
tggagcccagggca

SEQ ID NO: 4095236 - DNA, 17 bp, Homo sapiens
tggagccccatcggcca

SEQ ID NO: 4095237 - DNA, 22 bp, Homo sapiens
tggagcccccagatagagctgg

SEQ ID NO: 4095238 - DNA, 16 bp, Homo sapiens
tggagcccccagcaga

SEQ ID NO: 4095239 - DNA, 13 bp, Homo sapiens
tggagccccttcg

SEQ ID NO: 4095240 - DNA, 19 bp, Homo sapiens
tggagcctttgaataaaaa

SEQ ID NO: 4095241 - DNA, 18 bp, Homo sapiens
tggagcggggcccacccg

SEQ ID NO: 4095242 - DNA, 22 bp, Homo sapiens
tggagctcagccccgagctgtc

SEQ ID NO: 4095243 - DNA, 20 bp, Homo sapiens
tggagctgaagacctaaagt

SEQ ID NO: 4095244 - DNA, 12 bp, Homo sapiens
tggagctgtcat

SEQ ID NO: 4095245 - DNA, 13 bp, Homo sapiens
tggagctgtcatc

SEQ ID NO: 4095246 - DNA, 14 bp, Homo sapiens
tggagctgtcatca

SEQ ID NO: 4095247 - DNA, 14 bp, Homo sapiens
tggagcttttttcc

SEQ ID NO: 4095248 - DNA, 14 bp, Homo sapiens
tggaggaaagcaac

SEQ ID NO: 4095249 - DNA, 13 bp, Homo sapiens
tggaggaaggatt

SEQ ID NO: 4095250 - DNA, 21 bp, Homo sapiens
tggaggaaggggggttgcagt

SEQ ID NO: 4095251 - DNA, 16 bp, Homo sapiens
tggaggaattcagctc

SEQ ID NO: 4095252 - DNA, 16 bp, Homo sapiens
tggaggaggaaggcaa

SEQ ID NO: 4095253 - DNA, 21 bp, Homo sapiens
tggaggaggaaggcaagaggg

SEQ ID NO: 4095254 - DNA, 18 bp, Homo sapiens
tggaggaggcctgtccca

SEQ ID NO: 4095255 - DNA, 19 bp, Homo sapiens
tggaggaggcctgtcccaa

SEQ ID NO: 4095256 - DNA, 13 bp, Homo sapiens
tggaggattgcta

SEQ ID NO: 4095257 - DNA, 13 bp, Homo sapiens
tggaggcacttta

SEQ ID NO: 4095258 - DNA, 12 bp, Homo sapiens
tggaggcccagt

SEQ ID NO: 4095259 - DNA, 15 bp, Homo sapiens
tggaggcccagttca

SEQ ID NO: 4095260 - DNA, 17 bp, Homo sapiens
tggaggcccctggagcc

SEQ ID NO: 4095261 - DNA, 14 bp, Homo sapiens
tggaggcctcaggt

SEQ ID NO: 4095262 - DNA, 17 bp, Homo sapiens
tggaggccttccagctg

SEQ ID NO: 4095263 - DNA, 15 bp, Homo sapiens
tggagggcacagccc

SEQ ID NO: 4095264 - DNA, 16 bp, Homo sapiens
tggagggcacagccct

SEQ ID NO: 4095265 - DNA, 11 bp, Homo sapiens
tggaggggtgt

SEQ ID NO: 4095266 - DNA, 23 bp, Homo sapiens
tggaggggtgtggctccttccca

SEQ ID NO: 4095267 - DNA, 20 bp, Homo sapiens
tggaggtcacagctggatct

SEQ ID NO: 4095268 - DNA, 22 bp, Homo sapiens
tggaggtgagatcacagcctcc

SEQ ID NO: 4095269 - DNA, 18 bp, Homo sapiens
tggaggtgggcatgccac

SEQ ID NO: 4095270 - DNA, 16 bp, Homo sapiens
tggaggttaaggcata

SEQ ID NO: 4095271 - DNA, 21 bp, Homo sapiens
tggaggttctcagagccaagt

SEQ ID NO: 4095272 - DNA, 23 bp, Homo sapiens
tggaggttctcagagccaagtcc

SEQ ID NO: 4095273 - DNA, 15 bp, Homo sapiens
tggaggttgaagcca

SEQ ID NO: 4095274 - DNA, 17 bp, Homo sapiens
tggaggttgaagccaag

SEQ ID NO: 4095275 - DNA, 14 bp, Homo sapiens
tggagtatatgtca

SEQ ID NO: 4095276 - DNA, 18 bp, Homo sapiens
tggagtcagatgagcaag

SEQ ID NO: 4095277 - DNA, 19 bp, Homo sapiens
tggagtcccctcacctcct

SEQ ID NO: 4095278 - DNA, 15 bp, Homo sapiens
tggagtctccctctg

SEQ ID NO: 4095279 - DNA, 17 bp, Homo sapiens
tggagtctggagtgggc

SEQ ID NO: 4095280 - DNA, 18 bp, Homo sapiens
tggaaacattacagttca

SEQ ID NO: 4095281 - DNA, 22 bp, Homo sapiens
tggaaactgctaaattctatgt

SEQ ID NO: 4095282 - DNA, 16 bp, Homo sapiens
tggaaagaatctaata

SEQ ID NO: 4095283 - DNA, 22 bp, Homo sapiens
tggaaagacgtttttgtgctgt

SEQ ID NO: 4095284 - DNA, 17 bp, Homo sapiens
tggaaagaggctctgga

SEQ ID NO: 4095285 - DNA, 14 bp, Homo sapiens
tggaaagcactttt

SEQ ID NO: 4095286 - DNA, 14 bp, Homo sapiens
tggaaaggggagag

SEQ ID NO: 4095287 - DNA, 17 bp, Homo sapiens
tggaaaggggagagcct

SEQ ID NO: 4095288 - DNA, 20 bp, Homo sapiens
tggaaagtacactctgctgt

SEQ ID NO: 4095289 - DNA, 21 bp, Homo sapiens
tggaaatagaaagaagccata

SEQ ID NO: 4095290 - DNA, 17 bp, Homo sapiens
tggaaatattttgataa

SEQ ID NO: 4095291 - DNA, 23 bp, Homo sapiens
tggaaatttgttataatgaatga

SEQ ID NO: 4095292 - DNA, 22 bp, Homo sapiens
tggaacacctaccaaaaaataa

SEQ ID NO: 4095293 - DNA, 17 bp, Homo sapiens
tggaacacggccacatc

SEQ ID NO: 4095294 - DNA, 19 bp, Homo sapiens
tggaacatggctagccttt

SEQ ID NO: 4095295 - DNA, 23 bp, Homo sapiens
tggaaccagccccatcagaacct

SEQ ID NO: 4095296 - DNA, 17 bp, Homo sapiens
tggaacctcagcctggc

SEQ ID NO: 4095297 - DNA, 13 bp, Homo sapiens
tggaacctctgtc

SEQ ID NO: 4095298 - DNA, 16 bp, Homo sapiens
tggaacctctgtctca

SEQ ID NO: 4095299 - DNA, 22 bp, Homo sapiens
tggaaccttgctgtcctgatct

SEQ ID NO: 4095300 - DNA, 23 bp, Homo sapiens
tggaaccttgctgtcctgatctg

SEQ ID NO: 4095301 - DNA, 17 bp, Homo sapiens
tggaacgctaatgaaac

SEQ ID NO: 4095302 - DNA, 18 bp, Homo sapiens
tggaacgctaatgaaaca

SEQ ID NO: 4095303 - DNA, 17 bp, Homo sapiens
tggaactacattactgt

SEQ ID NO: 4095304 - DNA, 23 bp, Homo sapiens
tggaactcagctgtctgtggctt

SEQ ID NO: 4095305 - DNA, 17 bp, Homo sapiens
tggaactcctggccttt

SEQ ID NO: 4095306 - DNA, 18 bp, Homo sapiens
tggaagaaaaaaatcttc

SEQ ID NO: 4095307 - DNA, 15 bp, Homo sapiens
tggaagaagggagaa

SEQ ID NO: 4095308 - DNA, 19 bp, Homo sapiens
tggaagaagggagaagaaa

SEQ ID NO: 4095309 - DNA, 23 bp, Homo sapiens
tggaagcatgtagactgtgccag

SEQ ID NO: 4095310 - DNA, 18 bp, Homo sapiens
tggaagctaatttgcatt

SEQ ID NO: 4095311 - DNA, 17 bp, Homo sapiens
tggaagctaccagagct

SEQ ID NO: 4095312 - DNA, 12 bp, Homo sapiens
tggaaggaacat

SEQ ID NO: 4095313 - DNA, 22 bp, Homo sapiens
tggaaggaccacattttatatt

SEQ ID NO: 4095314 - DNA, 23 bp, Homo sapiens
tggaaggatgggatgggttccag

SEQ ID NO: 4095315 - DNA, 15 bp, Homo sapiens
tggaaggcccagcac

SEQ ID NO: 4095316 - DNA, 12 bp, Homo sapiens
tggaagggctgg

SEQ ID NO: 4095317 - DNA, 18 bp, Homo sapiens
tggaaggggccttgctga

SEQ ID NO: 4095318 - DNA, 18 bp, Homo sapiens
tggaagggttctggctgc

SEQ ID NO: 4095319 - DNA, 15 bp, Homo sapiens
tggaagggtttgtgg

SEQ ID NO: 4095320 - DNA, 19 bp, Homo sapiens
tggaaggtctattggccaa

SEQ ID NO: 4095321 - DNA, 20 bp, Homo sapiens
tggaaggtttggtgtgtgga

SEQ ID NO: 4095322 - DNA, 16 bp, Homo sapiens
tggaagtggttctatg

SEQ ID NO: 4095323 - DNA, 13 bp, Homo sapiens
tggaagttttcag

SEQ ID NO: 4095324 - DNA, 14 bp, Homo sapiens
tggaagttttgcat

SEQ ID NO: 4095325 - DNA, 15 bp, Homo sapiens
tggaataatttgtaa

SEQ ID NO: 4095326 - DNA, 15 bp, Homo sapiens
tggaatacagtgtta

SEQ ID NO: 4095327 - DNA, 22 bp, Homo sapiens
tggaatacagtgttattttctt

SEQ ID NO: 4095328 - DNA, 18 bp, Homo sapiens
tggaatataaggaaagca

SEQ ID NO: 4095329 - DNA, 18 bp, Homo sapiens
tggaatctacaagccaaa

SEQ ID NO: 4095330 - DNA, 18 bp, Homo sapiens
tggaatgagtgtgcatgg

SEQ ID NO: 4095331 - DNA, 19 bp, Homo sapiens
tggaatgagtgtgcatgga

SEQ ID NO: 4095332 - DNA, 13 bp, Homo sapiens
tggaatgccttgg

SEQ ID NO: 4095333 - DNA, 16 bp, Homo sapiens
tggaatgctgtgttaa

SEQ ID NO: 4095334 - DNA, 22 bp, Homo sapiens
tggaatggtacatgtcttccat

SEQ ID NO: 4095335 - DNA, 14 bp, Homo sapiens
tggaatgtaatcaa

SEQ ID NO: 4095336 - DNA, 20 bp, Homo sapiens
tggaatgtgcccctggccca

SEQ ID NO: 4095337 - DNA, 22 bp, Homo sapiens
tggaatgtttttccctccccag

SEQ ID NO: 4095338 - DNA, 20 bp, Homo sapiens
tggaattaaccatttaataa

SEQ ID NO: 4095339 - DNA, 20 bp, Homo sapiens
tggaattaacctggtgctgg

SEQ ID NO: 4095340 - DNA, 16 bp, Homo sapiens
tggaattgatttgcat

SEQ ID NO: 4095341 - DNA, 17 bp, Homo sapiens
tggaattgatttgcatt

SEQ ID NO: 4095342 - DNA, 22 bp, Homo sapiens
tggaattgatttgcattgaaca

SEQ ID NO: 4095343 - DNA, 18 bp, Homo sapiens
tggaattgcttaccaaag

SEQ ID NO: 4095344 - DNA, 19 bp, Homo sapiens
tggaatttaccagttaatt

SEQ ID NO: 4095345 - DNA, 16 bp, Homo sapiens
tggaatttgcctgctg

SEQ ID NO: 4095346 - DNA, 16 bp, Homo sapiens
tggaatttgtaacctc

SEQ ID NO: 4095347 - DNA, 21 bp, Homo sapiens
tggacaaacctagaattttct

SEQ ID NO: 4095348 - DNA, 18 bp, Homo sapiens
tggacaaactggagtctg

SEQ ID NO: 4095349 - DNA, 17 bp, Homo sapiens
tggacaagccaacttgt

SEQ ID NO: 4095350 - DNA, 21 bp, Homo sapiens
tggacaataaacatctgagca

SEQ ID NO: 4095351 - DNA, 20 bp, Homo sapiens
tggacacattggaatgcctt

SEQ ID NO: 4095352 - DNA, 21 bp, Homo sapiens
tggacacattggaatgccttg

SEQ ID NO: 4095353 - DNA, 22 bp, Homo sapiens
tggacaccccttatccaggact

SEQ ID NO: 4095354 - DNA, 15 bp, Homo sapiens
tggacactcagacct

SEQ ID NO: 4095355 - DNA, 21 bp, Homo sapiens
tggacactccagtgccagcaa

SEQ ID NO: 4095356 - DNA, 23 bp, Homo sapiens
tggacacttaatactaccttgaa

SEQ ID NO: 4095357 - DNA, 19 bp, Homo sapiens
tggacagcgatgaggggac

SEQ ID NO: 4095358 - DNA, 15 bp, Homo sapiens
tggacagctgataaa

SEQ ID NO: 4095359 - DNA, 20 bp, Homo sapiens
tggacagctgataaatttaa

SEQ ID NO: 4095360 - DNA, 17 bp, Homo sapiens
tggacaggagtcagtgt

SEQ ID NO: 4095361 - DNA, 20 bp, Homo sapiens
tggacaggagtcagtgtctg

SEQ ID NO: 4095362 - DNA, 13 bp, Homo sapiens
tggacaggcccag

SEQ ID NO: 4095363 - DNA, 22 bp, Homo sapiens
tggacaggcccagcgcggccag

SEQ ID NO: 4095364 - DNA, 20 bp, Homo sapiens
tggacatgcaggttggcaaa

SEQ ID NO: 4095365 - DNA, 17 bp, Homo sapiens
tggaccaacctgctctg

SEQ ID NO: 4095366 - DNA, 22 bp, Homo sapiens
tggaccaacctgctctgtcccc

SEQ ID NO: 4095367 - DNA, 22 bp, Homo sapiens
tggaccatagtcgggatgtcag

SEQ ID NO: 4095368 - DNA, 22 bp, Homo sapiens
tggaccatgccagattctgcct

SEQ ID NO: 4095369 - DNA, 18 bp, Homo sapiens
tggaccctgtcttctggg

SEQ ID NO: 4095370 - DNA, 18 bp, Homo sapiens
tggaccgtggacaggccc

SEQ ID NO: 4095371 - DNA, 19 bp, Homo sapiens
tggaccgtggacaggccca

SEQ ID NO: 4095372 - DNA, 13 bp, Homo sapiens
tggacctaacatt

SEQ ID NO: 4095373 - DNA, 17 bp, Homo sapiens
tggacctaacattcgat

SEQ ID NO: 4095374 - DNA, 23 bp, Homo sapiens
tggacctgggaacgactggactg

SEQ ID NO: 4095375 - DNA, 16 bp, Homo sapiens
tggacctggggagtgg

SEQ ID NO: 4095376 - DNA, 16 bp, Homo sapiens
tggaccttaggccttc

SEQ ID NO: 4095377 - DNA, 17 bp, Homo sapiens
tggaccttaggccttcc

SEQ ID NO: 4095378 - DNA, 15 bp, Homo sapiens
tggaccttttaaagt

SEQ ID NO: 4095379 - DNA, 23 bp, Homo sapiens
tggacgcaccggcctggctgcag

SEQ ID NO: 4095380 - DNA, 20 bp, Homo sapiens
tggacggcaggctcactgcc

SEQ ID NO: 4095381 - DNA, 15 bp, Homo sapiens
tggactattgtgcca

SEQ ID NO: 4095382 - DNA, 14 bp, Homo sapiens
ttaaatgtatacta

SEQ ID NO: 4095383 - DNA, 13 bp, Homo sapiens
ttaaatgtattta

SEQ ID NO: 4095384 - DNA, 12 bp, Homo sapiens
ttaaatgtgaat

SEQ ID NO: 4095385 - DNA, 20 bp, Homo sapiens
ttaaatgttatgactatgta

SEQ ID NO: 4095386 - DNA, 15 bp, Homo sapiens
ttaaattatgtttta

SEQ ID NO: 4095387 - DNA, 23 bp, Homo sapiens
ttaaattatgttttaaacacatg

SEQ ID NO: 4095388 - DNA, 14 bp, Homo sapiens
ttaaattctgagac

SEQ ID NO: 4095389 - DNA, 18 bp, Homo sapiens
ttaaattctgagacatgt

SEQ ID NO: 4095390 - DNA, 13 bp, Homo sapiens
ttaaattgtttca

SEQ ID NO: 4095391 - DNA, 17 bp, Homo sapiens
ttaaatttcttatgtga

SEQ ID NO: 4095392 - DNA, 14 bp, Homo sapiens
ttaaatttgtaagt

SEQ ID NO: 4095393 - DNA, 15 bp, Homo sapiens
ttaaattttgagttc

SEQ ID NO: 4095394 - DNA, 20 bp, Homo sapiens
ttaaattttgagttctacat

SEQ ID NO: 4095395 - DNA, 19 bp, Homo sapiens
ttaaattttttttacattt

SEQ ID NO: 4095396 - DNA, 14 bp, Homo sapiens
ttaacaaactaaaa

SEQ ID NO: 4095397 - DNA, 18 bp, Homo sapiens
ttaacaaactaaaaatat

SEQ ID NO: 4095398 - DNA, 19 bp, Homo sapiens
ttaacaaactaaaaatatt

SEQ ID NO: 4095399 - DNA, 18 bp, Homo sapiens
ttaacaaatatgctaatt

SEQ ID NO: 4095400 - DNA, 12 bp, Homo sapiens
ttaacaaggaat

SEQ ID NO: 4095401 - DNA, 19 bp, Homo sapiens
ttaacaataactactgtgt

SEQ ID NO: 4095402 - DNA, 20 bp, Homo sapiens
ttaacaataactactgtgtt

SEQ ID NO: 4095403 - DNA, 21 bp, Homo sapiens
ttaacaataactactgtgttc

SEQ ID NO: 4095404 - DNA, 23 bp, Homo sapiens
ttaacaatttctgtccttcagat

SEQ ID NO: 4095405 - DNA, 14 bp, Homo sapiens
ttaacagagacaga

SEQ ID NO: 4095406 - DNA, 15 bp, Homo sapiens
ttaacagtcatttaa

SEQ ID NO: 4095407 - DNA, 14 bp, Homo sapiens
ttaacagttttcca

SEQ ID NO: 4095408 - DNA, 17 bp, Homo sapiens
ttaacagttttccatga

SEQ ID NO: 4095409 - DNA, 20 bp, Homo sapiens
ttaacattgaccaagaactg

SEQ ID NO: 4095410 - DNA, 21 bp, Homo sapiens
ttaacattgaccaagaactgc

SEQ ID NO: 4095411 - DNA, 19 bp, Homo sapiens
ttaaccatttaataaagaa

SEQ ID NO: 4095412 - DNA, 21 bp, Homo sapiens
ttaacccttcatcttcctgtg

SEQ ID NO: 4095413 - DNA, 12 bp, Homo sapiens
ttaacctctgca

SEQ ID NO: 4095414 - DNA, 17 bp, Homo sapiens
ttaacctttccgctgtc

SEQ ID NO: 4095415 - DNA, 19 bp, Homo sapiens
ttaacctttccgctgtcgc

SEQ ID NO: 4095416 - DNA, 17 bp, Homo sapiens
ttaacggctccaggatt

SEQ ID NO: 4095417 - DNA, 23 bp, Homo sapiens
ttaactaatctattgggttcatt

SEQ ID NO: 4095418 - DNA, 14 bp, Homo sapiens
ttaactacatttat

SEQ ID NO: 4095419 - DNA, 16 bp, Homo sapiens
ttaactacatttatga

SEQ ID NO: 4095420 - DNA, 18 bp, Homo sapiens
ttaactactatattgatt

SEQ ID NO: 4095421 - DNA, 19 bp, Homo sapiens
ttaactactatattgattg

SEQ ID NO: 4095422 - DNA, 20 bp, Homo sapiens
ttaactactatattgattgt

SEQ ID NO: 4095423 - DNA, 15 bp, Homo sapiens
ttaactagaatttat

SEQ ID NO: 4095424 - DNA, 17 bp, Homo sapiens
ttaactagacacagata

SEQ ID NO: 4095425 - DNA, 21 bp, Homo sapiens
ttaactatatgtgaaacattt

SEQ ID NO: 4095426 - DNA, 16 bp, Homo sapiens
ttaactatgacagata

SEQ ID NO: 4095427 - DNA, 20 bp, Homo sapiens
ttaactatgacagatatatt

SEQ ID NO: 4095428 - DNA, 16 bp, Homo sapiens
ttaactgaacaatggc

SEQ ID NO: 4095429 - DNA, 19 bp, Homo sapiens
ttaactgtgtatgtacata

SEQ ID NO: 4095430 - DNA, 18 bp, Homo sapiens
ttaacttaacattctgta

SEQ ID NO: 4095431 - DNA, 16 bp, Homo sapiens
ttaactttaagactga

SEQ ID NO: 4095432 - DNA, 18 bp, Homo sapiens
ttaactttatcacattat

SEQ ID NO: 4095433 - DNA, 21 bp, Homo sapiens
ttaagaaaagtattttgaagt

SEQ ID NO: 4095434 - DNA, 23 bp, Homo sapiens
ttaagaaaagtattttgaagttt

SEQ ID NO: 4095435 - DNA, 17 bp, Homo sapiens
ttaagaaaatacaataa

SEQ ID NO: 4095436 - DNA, 18 bp, Homo sapiens
ttaagaaaatacaataaa

SEQ ID NO: 4095437 - DNA, 12 bp, Homo sapiens
ttaagaaacctt

SEQ ID NO: 4095438 - DNA, 21 bp, Homo sapiens
ttaagaaaccttgctctcctc

SEQ ID NO: 4095439 - DNA, 11 bp, Homo sapiens
ttaagaagctg

SEQ ID NO: 4095440 - DNA, 20 bp, Homo sapiens
ttaagaagctgttgtacatt

SEQ ID NO: 4095441 - DNA, 21 bp, Homo sapiens
ttaagaagctgttgtacattt

SEQ ID NO: 4095442 - DNA, 12 bp, Homo sapiens
ttaagaaggcaa

SEQ ID NO: 4095443 - DNA, 20 bp, Homo sapiens
ttaagaatatgtttccttgt

SEQ ID NO: 4095444 - DNA, 21 bp, Homo sapiens
ttaagaattgaccatctgctt

SEQ ID NO: 4095445 - DNA, 22 bp, Homo sapiens
ttaagacacttccgtcacatcc

SEQ ID NO: 4095446 - DNA, 17 bp, Homo sapiens
ttaagactgaatgtttt

SEQ ID NO: 4095447 - DNA, 15 bp, Homo sapiens
ttaagagaaacttta

SEQ ID NO: 4095448 - DNA, 21 bp, Homo sapiens
ttaagagaaactttatacatt

SEQ ID NO: 4095449 - DNA, 18 bp, Homo sapiens
ttaagagataattcttaa

SEQ ID NO: 4095450 - DNA, 23 bp, Homo sapiens
ttaagagcagaacagatctttta

SEQ ID NO: 4095451 - DNA, 15 bp, Homo sapiens
ttaagatacaaatta

SEQ ID NO: 4095452 - DNA, 20 bp, Homo sapiens
ttaagatacaaattaatttt

SEQ ID NO: 4095453 - DNA, 22 bp, Homo sapiens
ttaagatacagtgtaggcattt

SEQ ID NO: 4095454 - DNA, 17 bp, Homo sapiens
ttaagatagtgtaactt

SEQ ID NO: 4095455 - DNA, 20 bp, Homo sapiens
ttaagatttttctcaaagtt

SEQ ID NO: 4095456 - DNA, 17 bp, Homo sapiens
ttaagcactacataaac

SEQ ID NO: 4095457 - DNA, 13 bp, Homo sapiens
ttaagcattacca

SEQ ID NO: 4095458 - DNA, 20 bp, Homo sapiens
ttaagcattgggtgggtaaa

SEQ ID NO: 4095459 - DNA, 14 bp, Homo sapiens
ttaagcattgtttg

SEQ ID NO: 4095460 - DNA, 19 bp, Homo sapiens
ttaagcctcatatttaaag

SEQ ID NO: 4095461 - DNA, 11 bp, Homo sapiens
ttaagctgcag

SEQ ID NO: 4095462 - DNA, 14 bp, Homo sapiens
ttaaggaaactctt

SEQ ID NO: 4095463 - DNA, 20 bp, Homo sapiens
ttaaggaaactcttatctca

SEQ ID NO: 4095464 - DNA, 14 bp, Homo sapiens
ttaaggaatttgat

SEQ ID NO: 4095465 - DNA, 15 bp, Homo sapiens
ttaaggccacatcca

SEQ ID NO: 4095466 - DNA, 15 bp, Homo sapiens
ttaagggaaagaaaa

SEQ ID NO: 4095467 - DNA, 21 bp, Homo sapiens
ttaagggatggaaaaggaaga

SEQ ID NO: 4095468 - DNA, 19 bp, Homo sapiens
ttaagggcatgccttgtgc

SEQ ID NO: 4095469 - DNA, 17 bp, Homo sapiens
ttaagtactatgtatca

SEQ ID NO: 4095470 - DNA, 19 bp, Homo sapiens
ttaagtctaaatatttcct

SEQ ID NO: 4095471 - DNA, 17 bp, Homo sapiens
ttaagtgcgtgtgtaga

SEQ ID NO: 4095472 - DNA, 22 bp, Homo sapiens
ttaagttatagtgaatactgct

SEQ ID NO: 4095473 - DNA, 18 bp, Homo sapiens
ttaagttgctgatgaact

SEQ ID NO: 4095474 - DNA, 15 bp, Homo sapiens
ttaagtttcaaactt

SEQ ID NO: 4095475 - DNA, 16 bp, Homo sapiens
ttaagtttcaaactta

SEQ ID NO: 4095476 - DNA, 16 bp, Homo sapiens
ttaataaaataattct

SEQ ID NO: 4095477 - DNA, 14 bp, Homo sapiens
ttaataaagaaata

SEQ ID NO: 4095478 - DNA, 21 bp, Homo sapiens
ttaataaagaaatatttacct

SEQ ID NO: 4095479 - DNA, 23 bp, Homo sapiens
ttaataaagaaatatttacctaa

SEQ ID NO: 4095480 - DNA, 16 bp, Homo sapiens
ttaataacattacctt

SEQ ID NO: 4095481 - DNA, 20 bp, Homo sapiens
ttaatagaaataaattccta

SEQ ID NO: 4095482 - DNA, 19 bp, Homo sapiens
ttaatagaatataattatc

SEQ ID NO: 4095483 - DNA, 16 bp, Homo sapiens
ttaatagcagcctttc

SEQ ID NO: 4095484 - DNA, 18 bp, Homo sapiens
ttaatagtttgtctattt

SEQ ID NO: 4095485 - DNA, 19 bp, Homo sapiens
ttaatagtttgtctatttt

SEQ ID NO: 4095486 - DNA, 19 bp, Homo sapiens
ttaatatccctacatgtat

SEQ ID NO: 4095487 - DNA, 16 bp, Homo sapiens
ttaatatgaaaactta

SEQ ID NO: 4095488 - DNA, 12 bp, Homo sapiens
ttaatatggatt

SEQ ID NO: 4095489 - DNA, 13 bp, Homo sapiens
ttaatattattat

SEQ ID NO: 4095490 - DNA, 16 bp, Homo sapiens
ttaatattgtattgct

SEQ ID NO: 4095491 - DNA, 16 bp, Homo sapiens
ttaatatttaacatta

SEQ ID NO: 4095492 - DNA, 12 bp, Homo sapiens
ttaatcaaaggc

SEQ ID NO: 4095493 - DNA, 20 bp, Homo sapiens
ttaatcaagatttttttcct

SEQ ID NO: 4095494 - DNA, 17 bp, Homo sapiens
ttaatcaagttgaattg

SEQ ID NO: 4095495 - DNA, 20 bp, Homo sapiens
ttaatcacctctctgtagtt

SEQ ID NO: 4095496 - DNA, 21 bp, Homo sapiens
ttaatcatctataaagaagaa

SEQ ID NO: 4095497 - DNA, 15 bp, Homo sapiens
ttaatcctgtaccaa

SEQ ID NO: 4095498 - DNA, 17 bp, Homo sapiens
ttaatcctgtaccaaat

SEQ ID NO: 4095499 - DNA, 22 bp, Homo sapiens
ttaatcctgtaccaaatctgac

SEQ ID NO: 4095500 - DNA, 16 bp, Homo sapiens
ttaatctgaaattcta

SEQ ID NO: 4095501 - DNA, 18 bp, Homo sapiens
ttaatctgaaattctaaa

SEQ ID NO: 4095502 - DNA, 13 bp, Homo sapiens
ttaatctgtgtgt

SEQ ID NO: 4095503 - DNA, 18 bp, Homo sapiens
ttaatctgtgtgtatatt

SEQ ID NO: 4095504 - DNA, 21 bp, Homo sapiens
ttaatctttctttacctgaga

SEQ ID NO: 4095505 - DNA, 23 bp, Homo sapiens
ttaatctttctttacctgagacc

SEQ ID NO: 4095506 - DNA, 15 bp, Homo sapiens
ttaatgaaaatgtca

SEQ ID NO: 4095507 - DNA, 20 bp, Homo sapiens
ttaatgaaagactgtacaaa

SEQ ID NO: 4095508 - DNA, 16 bp, Homo sapiens
ttaatgagccatcact

SEQ ID NO: 4095509 - DNA, 24 bp, Homo sapiens
ttaatgagccatcactagaagaaa

SEQ ID NO: 4095510 - DNA, 18 bp, Homo sapiens
ttaatgcatctagattat

SEQ ID NO: 4095511 - DNA, 23 bp, Homo sapiens
ttaatgccgatatactctagatg

SEQ ID NO: 4095512 - DNA, 15 bp, Homo sapiens
ttaatgcgatttctt

SEQ ID NO: 4095513 - DNA, 12 bp, Homo sapiens
ttaatggttttt

SEQ ID NO: 4095514 - DNA, 20 bp, Homo sapiens
ttaatgtaaagaacttaaat

SEQ ID NO: 4095515 - DNA, 15 bp, Homo sapiens
ttaatgtttattcct

SEQ ID NO: 4095516 - DNA, 17 bp, Homo sapiens
ttaatgtttattcctga

SEQ ID NO: 4095517 - DNA, 15 bp, Homo sapiens
ttaattaaacattgt

SEQ ID NO: 4095518 - DNA, 16 bp, Homo sapiens
ttaattaaacattgtg

SEQ ID NO: 4095519 - DNA, 16 bp, Homo sapiens
ttaattaaatgtattt

SEQ ID NO: 4095520 - DNA, 21 bp, Homo sapiens
ttaattaatttgattaacaaa

SEQ ID NO: 4095521 - DNA, 19 bp, Homo sapiens
ttaattaggggttgctaag

SEQ ID NO: 4095522 - DNA, 18 bp, Homo sapiens
ttaattattaactacatt

SEQ ID NO: 4095523 - DNA, 17 bp, Homo sapiens
ttaattcacctatgtta

SEQ ID NO: 4095524 - DNA, 17 bp, Homo sapiens
ttaattccaattatatg

SEQ ID NO: 4095525 - DNA, 20 bp, Homo sapiens
ttaattgaaactagttattt

SEQ ID NO: 4095526 - DNA, 13 bp, Homo sapiens
ttaattgttgttt

SEQ ID NO: 4095527 - DNA, 15 bp, Homo sapiens
ttaatttatgagttt

SEQ ID NO: 4095528 - DNA, 18 bp, Homo sapiens
ttaatttatgagtttttg

SEQ ID NO: 4095529 - DNA, 20 bp, Homo sapiens
ttaatttcctttttgacact

SEQ ID NO: 4095530 - DNA, 22 bp, Homo sapiens
ttaatttcctttttgacactga

SEQ ID NO: 4095531 - DNA, 16 bp, Homo sapiens
ttaattttcacaaaat

SEQ ID NO: 4095532 - DNA, 13 bp, Homo sapiens
ttaattttcagta

SEQ ID NO: 4095533 - DNA, 17 bp, Homo sapiens
ttaatttttaattgaaa

SEQ ID NO: 4095534 - DNA, 20 bp, Homo sapiens
ttacaaaagaaataccttga

SEQ ID NO: 4095535 - DNA, 13 bp, Homo sapiens
ttacaaaagatgt

SEQ ID NO: 4095536 - DNA, 14 bp, Homo sapiens
ttacaaactgcaat

SEQ ID NO: 4095537 - DNA, 19 bp, Homo sapiens
ttacaacttgattttttca

SEQ ID NO: 4095538 - DNA, 20 bp, Homo sapiens
ttacaacttgattttttcaa

SEQ ID NO: 4095539 - DNA, 22 bp, Homo sapiens
ttacaatattatgaaatttcac

SEQ ID NO: 4095540 - DNA, 12 bp, Homo sapiens
ttacaatcaaag

SEQ ID NO: 4095541 - DNA, 17 bp, Homo sapiens
ttacaatcattgctgaa

SEQ ID NO: 4095542 - DNA, 22 bp, Homo sapiens
ttacaatcattgctgaaaatgg

SEQ ID NO: 4095543 - DNA, 16 bp, Homo sapiens
ttacacaattcttacc

SEQ ID NO: 4095544 - DNA, 20 bp, Homo sapiens
ttacacaattcttaccctgt

SEQ ID NO: 4095545 - DNA, 16 bp, Homo sapiens
ttacacactcaggcct

SEQ ID NO: 4095546 - DNA, 20 bp, Homo sapiens
ttacacagaaatgctgctgg

SEQ ID NO: 4095547 - DNA, 23 bp, Homo sapiens
ttacacagaaatgctgctggcca

SEQ ID NO: 4095548 - DNA, 18 bp, Homo sapiens
ttacacatctcagaccct

SEQ ID NO: 4095549 - DNA, 17 bp, Homo sapiens
ttacacatcttcaacag

SEQ ID NO: 4095550 - DNA, 14 bp, Homo sapiens
ttacacattaagta

SEQ ID NO: 4095551 - DNA, 16 bp, Homo sapiens
ttacacatttgtacag

SEQ ID NO: 4095552 - DNA, 17 bp, Homo sapiens
ttacacatttgtacaga

SEQ ID NO: 4095553 - DNA, 14 bp, Homo sapiens
ttacactctttgta

SEQ ID NO: 4095554 - DNA, 17 bp, Homo sapiens
ttacagagaggagaaac

SEQ ID NO: 4095555 - DNA, 16 bp, Homo sapiens
ttacagattgcctcct

SEQ ID NO: 4095556 - DNA, 17 bp, Homo sapiens
ttacagattgcctcctt

SEQ ID NO: 4095557 - DNA, 20 bp, Homo sapiens
ttacagcaagtagataaata

SEQ ID NO: 4095558 - DNA, 23 bp, Homo sapiens
ttacagccaagtgccaaatgctc

SEQ ID NO: 4095559 - DNA, 17 bp, Homo sapiens
ttacagcctcacttgaa

SEQ ID NO: 4095560 - DNA, 17 bp, Homo sapiens
ttacaggcaccgagaat

SEQ ID NO: 4095561 - DNA, 19 bp, Homo sapiens
ttacagtgaccttttcttc

SEQ ID NO: 4095562 - DNA, 19 bp, Homo sapiens
ttacataacggaaagtttt

SEQ ID NO: 4095563 - DNA, 14 bp, Homo sapiens
ttacatctgtgcag

SEQ ID NO: 4095564 - DNA, 21 bp, Homo sapiens
ttacatctgtgcagggctggt

SEQ ID NO: 4095565 - DNA, 13 bp, Homo sapiens
ttacatgcatttg

SEQ ID NO: 4095566 - DNA, 13 bp, Homo sapiens
ttacatgtgttta

SEQ ID NO: 4095567 - DNA, 16 bp, Homo sapiens
ttacatgttttaaaga

SEQ ID NO: 4095568 - DNA, 19 bp, Homo sapiens
ttacattattatcaacaat

SEQ ID NO: 4095569 - DNA, 20 bp, Homo sapiens
ttacattgcctgactaaaat

SEQ ID NO: 4095570 - DNA, 21 bp, Homo sapiens
ttacattgcctgactaaaatg

SEQ ID NO: 4095571 - DNA, 13 bp, Homo sapiens
ttacattgtaaat

SEQ ID NO: 4095572 - DNA, 15 bp, Homo sapiens
ttacatttcgatgtt

SEQ ID NO: 4095573 - DNA, 17 bp, Homo sapiens
ttacatttctatcagta

SEQ ID NO: 4095574 - DNA, 15 bp, Homo sapiens
ttacatttttacaat

SEQ ID NO: 4095575 - DNA, 15 bp, Homo sapiens
ttacatttttattta

SEQ ID NO: 4095576 - DNA, 18 bp, Homo sapiens
ttacatttttatttatga

SEQ ID NO: 4095577 - DNA, 22 bp, Homo sapiens
ttacatttttatttatgaagtt

SEQ ID NO: 4095578 - DNA, 21 bp, Homo sapiens
ttacattttttgggcagcaat

SEQ ID NO: 4095579 - DNA, 18 bp, Homo sapiens
ttaccacacatctatgat

SEQ ID NO: 4095580 - DNA, 20 bp, Homo sapiens
ttaccacacatctatgatat

SEQ ID NO: 4095581 - DNA, 12 bp, Homo sapiens
ttaccactcagg

SEQ ID NO: 4095582 - DNA, 23 bp, Homo sapiens
ttaccactctaccaaataatttc

SEQ ID NO: 4095583 - DNA, 18 bp, Homo sapiens
ttaccactggtaacatgt

SEQ ID NO: 4095584 - DNA, 19 bp, Homo sapiens
ttaccactggtaacatgtg

SEQ ID NO: 4095585 - DNA, 15 bp, Homo sapiens
ttaccagacaaaaaa

SEQ ID NO: 4095586 - DNA, 20 bp, Homo sapiens
ttaccagacaaaaaaattta

SEQ ID NO: 4095587 - DNA, 22 bp, Homo sapiens
ttaccagagacgcccagcccca

SEQ ID NO: 4095588 - DNA, 18 bp, Homo sapiens
tgttttttaaaaaagcct

SEQ ID NO: 4095589 - DNA, 20 bp, Homo sapiens
tgttttttaagatagtgtaa

SEQ ID NO: 4095590 - DNA, 17 bp, Homo sapiens
tgttttttagatcaaat

SEQ ID NO: 4095591 - DNA, 17 bp, Homo sapiens
tgttttttatgaagtgc

SEQ ID NO: 4095592 - DNA, 13 bp, Homo sapiens
tgttttttccttt

SEQ ID NO: 4095593 - DNA, 22 bp, Homo sapiens
tgttttttctttttttttaagt

SEQ ID NO: 4095594 - DNA, 16 bp, Homo sapiens
tgttttttgaaaacat

SEQ ID NO: 4095595 - DNA, 15 bp, Homo sapiens
tgttttttgccacag

SEQ ID NO: 4095596 - DNA, 19 bp, Homo sapiens
tgttttttgccacagcttt

SEQ ID NO: 4095597 - DNA, 18 bp, Homo sapiens
ttaaaaaaaaagatctgt

SEQ ID NO: 4095598 - DNA, 12 bp, Homo sapiens
ttaaaaaaatca

SEQ ID NO: 4095599 - DNA, 17 bp, Homo sapiens
ttaaaaaaatcacaaaa

SEQ ID NO: 4095600 - DNA, 20 bp, Homo sapiens
ttaaaaaaattggttggaga

SEQ ID NO: 4095601 - DNA, 23 bp, Homo sapiens
ttaaaaaagcctggtttttctca

SEQ ID NO: 4095602 - DNA, 21 bp, Homo sapiens
ttaaaaaatatttattaaata

SEQ ID NO: 4095603 - DNA, 16 bp, Homo sapiens
ttaaaaaatgaaatcc

SEQ ID NO: 4095604 - DNA, 12 bp, Homo sapiens
ttaaaaaatgtc

SEQ ID NO: 4095605 - DNA, 13 bp, Homo sapiens
ttaaaaaatgtcc

SEQ ID NO: 4095606 - DNA, 16 bp, Homo sapiens
ttaaaaaatgtccatg

SEQ ID NO: 4095607 - DNA, 14 bp, Homo sapiens
ttaaaaagaaatct

SEQ ID NO: 4095608 - DNA, 16 bp, Homo sapiens
ttaaaaagaatgacgt

SEQ ID NO: 4095609 - DNA, 12 bp, Homo sapiens
ttaaaaaggaac

SEQ ID NO: 4095610 - DNA, 16 bp, Homo sapiens
ttaaaaatatttcaga

SEQ ID NO: 4095611 - DNA, 17 bp, Homo sapiens
ttaaaaatatttcagat

SEQ ID NO: 4095612 - DNA, 13 bp, Homo sapiens
ttaaaacaatttt

SEQ ID NO: 4095613 - DNA, 18 bp, Homo sapiens
ttaaaacactttcaaaac

SEQ ID NO: 4095614 - DNA, 22 bp, Homo sapiens
ttaaaacagtatttattttgta

SEQ ID NO: 4095615 - DNA, 23 bp, Homo sapiens
ttaaaacagtatttattttgtaa

SEQ ID NO: 4095616 - DNA, 16 bp, Homo sapiens
ttaaaacgaaaataaa

SEQ ID NO: 4095617 - DNA, 15 bp, Homo sapiens
ttaaaacttgtaatt

SEQ ID NO: 4095618 - DNA, 14 bp, Homo sapiens
ttaaaataaaatga

SEQ ID NO: 4095619 - DNA, 15 bp, Homo sapiens
ttaaaataaaatgaa

SEQ ID NO: 4095620 - DNA, 13 bp, Homo sapiens
ttaaaataaattc

SEQ ID NO: 4095621 - DNA, 21 bp, Homo sapiens
ttaaaatagaaattttgtaag

SEQ ID NO: 4095622 - DNA, 23 bp, Homo sapiens
ttaaaataggggatatttaaggt

SEQ ID NO: 4095623 - DNA, 12 bp, Homo sapiens
ttaaaatatttt

SEQ ID NO: 4095624 - DNA, 14 bp, Homo sapiens
ttaaaatattttat

SEQ ID NO: 4095625 - DNA, 21 bp, Homo sapiens
ttaaaatggtttgtcctgatg

SEQ ID NO: 4095626 - DNA, 23 bp, Homo sapiens
ttaaaatggtttttgcctaaaat

SEQ ID NO: 4095627 - DNA, 16 bp, Homo sapiens
ttaaaattaagtagaa

SEQ ID NO: 4095628 - DNA, 12 bp, Homo sapiens
ttaaaattcagt

SEQ ID NO: 4095629 - DNA, 21 bp, Homo sapiens
ttaaaattcagtttttgtatc

SEQ ID NO: 4095630 - DNA, 23 bp, Homo sapiens
ttaaaattcagtttttgtatctt

SEQ ID NO: 4095631 - DNA, 13 bp, Homo sapiens
ttaaaattcatgt

SEQ ID NO: 4095632 - DNA, 17 bp, Homo sapiens
ttaaaattccattatct

SEQ ID NO: 4095633 - DNA, 16 bp, Homo sapiens
ttaaaattgttaccac

SEQ ID NO: 4095634 - DNA, 19 bp, Homo sapiens
ttaaaatttatcttaagtt

SEQ ID NO: 4095635 - DNA, 16 bp, Homo sapiens
ttaaacacaggctgtc

SEQ ID NO: 4095636 - DNA, 13 bp, Homo sapiens
ttaaacacctcct

SEQ ID NO: 4095637 - DNA, 16 bp, Homo sapiens
ttaaacacctcctcat

SEQ ID NO: 4095638 - DNA, 17 bp, Homo sapiens
ttaaacacctgacacat

SEQ ID NO: 4095639 - DNA, 12 bp, Homo sapiens
ttaaacagatga

SEQ ID NO: 4095640 - DNA, 14 bp, Homo sapiens
ttaaacagcagtgt

SEQ ID NO: 4095641 - DNA, 12 bp, Homo sapiens
ttaaacataata

SEQ ID NO: 4095642 - DNA, 19 bp, Homo sapiens
ttaaacataataaatcaca

SEQ ID NO: 4095643 - DNA, 19 bp, Homo sapiens
ttaaacattaatagcagcc

SEQ ID NO: 4095644 - DNA, 13 bp, Homo sapiens
ttaaacattgaag

SEQ ID NO: 4095645 - DNA, 20 bp, Homo sapiens
ttaaaccctggatcagtcct

SEQ ID NO: 4095646 - DNA, 23 bp, Homo sapiens
ttaaacctggaatctacaagcca

SEQ ID NO: 4095647 - DNA, 14 bp, Homo sapiens
ttaaactcagggac

SEQ ID NO: 4095648 - DNA, 16 bp, Homo sapiens
ttaaactcagggacag

SEQ ID NO: 4095649 - DNA, 22 bp, Homo sapiens
ttaaactcagggacagagccat

SEQ ID NO: 4095650 - DNA, 21 bp, Homo sapiens
ttaaactgtgtggactgtgat

SEQ ID NO: 4095651 - DNA, 16 bp, Homo sapiens
ttaaacttataaatca

SEQ ID NO: 4095652 - DNA, 18 bp, Homo sapiens
ttaaacttttaattcatt

SEQ ID NO: 4095653 - DNA, 23 bp, Homo sapiens
ttaaagaataaagtccaaagtca

SEQ ID NO: 4095654 - DNA, 14 bp, Homo sapiens
ttaaagagaggtta

SEQ ID NO: 4095655 - DNA, 17 bp, Homo sapiens
ttaaagatgaactctga

SEQ ID NO: 4095656 - DNA, 18 bp, Homo sapiens
ttaaagatgaactctgaa

SEQ ID NO: 4095657 - DNA, 21 bp, Homo sapiens
ttaaagcagagggactttgta

SEQ ID NO: 4095658 - DNA, 22 bp, Homo sapiens
ttaaagcattgctgttatgtct

SEQ ID NO: 4095659 - DNA, 22 bp, Homo sapiens
ttaaagcattgcttttattttg

SEQ ID NO: 4095660 - DNA, 14 bp, Homo sapiens
ttaaagcctcctca

SEQ ID NO: 4095661 - DNA, 21 bp, Homo sapiens
ttaaaggacaggaggaggaga

SEQ ID NO: 4095662 - DNA, 21 bp, Homo sapiens
ttaaaggggcagaaaaactct

SEQ ID NO: 4095663 - DNA, 22 bp, Homo sapiens
ttaaagtaattgttccagagac

SEQ ID NO: 4095664 - DNA, 12 bp, Homo sapiens
ttaaagtgactt

SEQ ID NO: 4095665 - DNA, 14 bp, Homo sapiens
ttaaagttggaatt

SEQ ID NO: 4095666 - DNA, 14 bp, Homo sapiens
ttaaagtttaaagt

SEQ ID NO: 4095667 - DNA, 11 bp, Homo sapiens
ttaaataaaag

SEQ ID NO: 4095668 - DNA, 13 bp, Homo sapiens
ttaaataaaagct

SEQ ID NO: 4095669 - DNA, 15 bp, Homo sapiens
ttaaataaaatcaat

SEQ ID NO: 4095670 - DNA, 20 bp, Homo sapiens
ttaaataaaattgaaagtaa

SEQ ID NO: 4095671 - DNA, 13 bp, Homo sapiens
ttaaataaagtta

SEQ ID NO: 4095672 - DNA, 15 bp, Homo sapiens
ttaaataatatggct

SEQ ID NO: 4095673 - DNA, 16 bp, Homo sapiens
ttaaatacagacacta

SEQ ID NO: 4095674 - DNA, 16 bp, Homo sapiens
ttaaatactgtgcaga

SEQ ID NO: 4095675 - DNA, 21 bp, Homo sapiens
ttaaatactgtgcagaataat

SEQ ID NO: 4095676 - DNA, 18 bp, Homo sapiens
ttaaatagttatataatt

SEQ ID NO: 4095677 - DNA, 13 bp, Homo sapiens
ttaaatataattc

SEQ ID NO: 4095678 - DNA, 18 bp, Homo sapiens
ttaaatataattctgtaa

SEQ ID NO: 4095679 - DNA, 20 bp, Homo sapiens
ttaaatataattctgtaaat

SEQ ID NO: 4095680 - DNA, 17 bp, Homo sapiens
ttaaatatagattagaa

SEQ ID NO: 4095681 - DNA, 18 bp, Homo sapiens
ttaaatatagattagaaa

SEQ ID NO: 4095682 - DNA, 14 bp, Homo sapiens
ttaaatatctttta

SEQ ID NO: 4095683 - DNA, 21 bp, Homo sapiens
ttaaatatcttttatgtttga

SEQ ID NO: 4095684 - DNA, 13 bp, Homo sapiens
ttaaatatgtata

SEQ ID NO: 4095685 - DNA, 20 bp, Homo sapiens
ttaaatattagttaatggat

SEQ ID NO: 4095686 - DNA, 14 bp, Homo sapiens
ttaaatcagaataa

SEQ ID NO: 4095687 - DNA, 13 bp, Homo sapiens
ttaaatcatgtat

SEQ ID NO: 4095688 - DNA, 15 bp, Homo sapiens
ttaaatccaataaaa

SEQ ID NO: 4095689 - DNA, 20 bp, Homo sapiens
ttaaatgcaagtgcctagat

SEQ ID NO: 4095690 - DNA, 17 bp, Homo sapiens
ttaaatgcaataatttt

SEQ ID NO: 4095691 - DNA, 12 bp, Homo sapiens
ttaaatgtatac

SEQ ID NO: 4095692 - DNA, 18 bp, Homo sapiens
tgtttaaatcatgtatgt

SEQ ID NO: 4095693 - DNA, 19 bp, Homo sapiens
tgtttaaatcatgtatgtt

SEQ ID NO: 4095694 - DNA, 21 bp, Homo sapiens
tgtttaaatcatgtatgttat

SEQ ID NO: 4095695 - DNA, 21 bp, Homo sapiens
tgtttaagaaaagtattttga

SEQ ID NO: 4095696 - DNA, 20 bp, Homo sapiens
tgtttaatctgttatgtact

SEQ ID NO: 4095697 - DNA, 19 bp, Homo sapiens
tgtttaatttttatttctt

SEQ ID NO: 4095698 - DNA, 14 bp, Homo sapiens
tgtttacgtttgat

SEQ ID NO: 4095699 - DNA, 17 bp, Homo sapiens
tgtttactatgtgccag

SEQ ID NO: 4095700 - DNA, 16 bp, Homo sapiens
tgtttataatctgaag

SEQ ID NO: 4095701 - DNA, 18 bp, Homo sapiens
tgtttataatctgaagat

SEQ ID NO: 4095702 - DNA, 21 bp, Homo sapiens
tgtttatatacagtacacaga

SEQ ID NO: 4095703 - DNA, 19 bp, Homo sapiens
tgtttatcagatacatcac

SEQ ID NO: 4095704 - DNA, 22 bp, Homo sapiens
tgtttatcagatacatcactgc

SEQ ID NO: 4095705 - DNA, 23 bp, Homo sapiens
tgtttatcagatacatcactgct

SEQ ID NO: 4095706 - DNA, 21 bp, Homo sapiens
tgtttatgagccagacaaatg

SEQ ID NO: 4095707 - DNA, 21 bp, Homo sapiens
tgtttatgcaaggaaggaaag

SEQ ID NO: 4095708 - DNA, 13 bp, Homo sapiens
tgtttatggcctc

SEQ ID NO: 4095709 - DNA, 23 bp, Homo sapiens
tgtttatgttcttatagaataaa

SEQ ID NO: 4095710 - DNA, 19 bp, Homo sapiens
tgtttattcatccagcagt

SEQ ID NO: 4095711 - DNA, 17 bp, Homo sapiens
tgtttattcttccagaa

SEQ ID NO: 4095712 - DNA, 18 bp, Homo sapiens
tgtttattcttccagaat

SEQ ID NO: 4095713 - DNA, 24 bp, Homo sapiens
tgtttatttatagagtgtacttaa

SEQ ID NO: 4095714 - DNA, 15 bp, Homo sapiens
tgtttatttatcagt

SEQ ID NO: 4095715 - DNA, 23 bp, Homo sapiens
tgtttatttttcttgtctttatt

SEQ ID NO: 4095716 - DNA, 10 bp, Homo sapiens
tgtttcaaga

SEQ ID NO: 4095717 - DNA, 16 bp, Homo sapiens
tgtttcaagaacctgg

SEQ ID NO: 4095718 - DNA, 14 bp, Homo sapiens
tgtttcagaccccc

SEQ ID NO: 4095719 - DNA, 19 bp, Homo sapiens
tgtttcagctaagggaaga

SEQ ID NO: 4095720 - DNA, 22 bp, Homo sapiens
tgtttcagctaagggaagacat

SEQ ID NO: 4095721 - DNA, 23 bp, Homo sapiens
tgtttcagctaagggaagacatt

SEQ ID NO: 4095722 - DNA, 15 bp, Homo sapiens
tgtttcatccttccc

SEQ ID NO: 4095723 - DNA, 22 bp, Homo sapiens
tgtttcccataattttcttcat

SEQ ID NO: 4095724 - DNA, 15 bp, Homo sapiens
tgtttcccttgcttt

SEQ ID NO: 4095725 - DNA, 23 bp, Homo sapiens
tgtttccttgtttatcagataca

SEQ ID NO: 4095726 - DNA, 17 bp, Homo sapiens
tgtttctagctaaataa

SEQ ID NO: 4095727 - DNA, 18 bp, Homo sapiens
tgtttctagctaaataaa

SEQ ID NO: 4095728 - DNA, 16 bp, Homo sapiens
tgtttctatctgattt

SEQ ID NO: 4095729 - DNA, 15 bp, Homo sapiens
tgtttctctgctgtt

SEQ ID NO: 4095730 - DNA, 22 bp, Homo sapiens
tgtttctctgttgtaagaatag

SEQ ID NO: 4095731 - DNA, 14 bp, Homo sapiens
tgtttctgaaaatt

SEQ ID NO: 4095732 - DNA, 16 bp, Homo sapiens
tgtttctgcagccctt

SEQ ID NO: 4095733 - DNA, 22 bp, Homo sapiens
tgtttctgcagcccttgggcag

SEQ ID NO: 4095734 - DNA, 23 bp, Homo sapiens
tgtttctgcagcccttgggcagt

SEQ ID NO: 4095735 - DNA, 22 bp, Homo sapiens
tgtttctgcatagcgaaataaa

SEQ ID NO: 4095736 - DNA, 16 bp, Homo sapiens
tgtttctgttccaaat

SEQ ID NO: 4095737 - DNA, 17 bp, Homo sapiens
tgtttcttccaaagcac

SEQ ID NO: 4095738 - DNA, 13 bp, Homo sapiens
tgtttcttcctgc

SEQ ID NO: 4095739 - DNA, 22 bp, Homo sapiens
tgtttgaaatgaggtctgttta

SEQ ID NO: 4095740 - DNA, 14 bp, Homo sapiens
tgtttgacacctct

SEQ ID NO: 4095741 - DNA, 19 bp, Homo sapiens
tgtttgatgctatttatgc

SEQ ID NO: 4095742 - DNA, 14 bp, Homo sapiens
tgtttgcaagcagg

SEQ ID NO: 4095743 - DNA, 20 bp, Homo sapiens
tgtttgccttctacttttaa

SEQ ID NO: 4095744 - DNA, 23 bp, Homo sapiens
tgtttgctgccttgctcctagca

SEQ ID NO: 4095745 - DNA, 20 bp, Homo sapiens
tgtttgcttattgttccaag

SEQ ID NO: 4095746 - DNA, 23 bp, Homo sapiens
tgtttgcttattgttccaagaca

SEQ ID NO: 4095747 - DNA, 20 bp, Homo sapiens
tgtttggaatgttagaatga

SEQ ID NO: 4095748 - DNA, 19 bp, Homo sapiens
tgtttggatgtaatttagg

SEQ ID NO: 4095749 - DNA, 18 bp, Homo sapiens
tgtttggatttcctttat

SEQ ID NO: 4095750 - DNA, 16 bp, Homo sapiens
tgtttggcaaggaaag

SEQ ID NO: 4095751 - DNA, 15 bp, Homo sapiens
tgtttggcacccaaa

SEQ ID NO: 4095752 - DNA, 19 bp, Homo sapiens
tgtttggcttataaacaca

SEQ ID NO: 4095753 - DNA, 15 bp, Homo sapiens
tgtttggtttacatt

SEQ ID NO: 4095754 - DNA, 18 bp, Homo sapiens
tgtttgtaaataagagat

SEQ ID NO: 4095755 - DNA, 19 bp, Homo sapiens
tgtttgtaaataagagatt

SEQ ID NO: 4095756 - DNA, 18 bp, Homo sapiens
tgtttgtcacaagtggtg

SEQ ID NO: 4095757 - DNA, 14 bp, Homo sapiens
tgtttgtctcttct

SEQ ID NO: 4095758 - DNA, 13 bp, Homo sapiens
tgtttgtggcctc

SEQ ID NO: 4095759 - DNA, 18 bp, Homo sapiens
tgtttgtttttgctttct

SEQ ID NO: 4095760 - DNA, 12 bp, Homo sapiens
tgttttaaaaaa

SEQ ID NO: 4095761 - DNA, 13 bp, Homo sapiens
tgttttaaattct

SEQ ID NO: 4095762 - DNA, 22 bp, Homo sapiens
tgttttaaatttatttcaaaaa

SEQ ID NO: 4095763 - DNA, 18 bp, Homo sapiens
tgttttaagcaaatgcat

SEQ ID NO: 4095764 - DNA, 17 bp, Homo sapiens
tgttttaataaacagta

SEQ ID NO: 4095765 - DNA, 23 bp, Homo sapiens
tgttttaatttaaacacctcctc

SEQ ID NO: 4095766 - DNA, 13 bp, Homo sapiens
tgttttacaatgt

SEQ ID NO: 4095767 - DNA, 21 bp, Homo sapiens
tgttttacctgttctgaaatg

SEQ ID NO: 4095768 - DNA, 19 bp, Homo sapiens
tgttttataaaattttgct

SEQ ID NO: 4095769 - DNA, 15 bp, Homo sapiens
tgttttataagttca

SEQ ID NO: 4095770 - DNA, 22 bp, Homo sapiens
tgttttataagttcacaaaatg

SEQ ID NO: 4095771 - DNA, 23 bp, Homo sapiens
tgttttattatttctattaaata

SEQ ID NO: 4095772 - DNA, 16 bp, Homo sapiens
tgttttatttatcaaa

SEQ ID NO: 4095773 - DNA, 14 bp, Homo sapiens
tgttttattttcaa

SEQ ID NO: 4095774 - DNA, 22 bp, Homo sapiens
tgttttattttcaaatctggtc

SEQ ID NO: 4095775 - DNA, 16 bp, Homo sapiens
tgttttcccacgagga

SEQ ID NO: 4095776 - DNA, 12 bp, Homo sapiens
tgttttctgaat

SEQ ID NO: 4095777 - DNA, 16 bp, Homo sapiens
tgttttctgactaatt

SEQ ID NO: 4095778 - DNA, 17 bp, Homo sapiens
tgttttctgtttgtaaa

SEQ ID NO: 4095779 - DNA, 20 bp, Homo sapiens
tgttttctgtttgtaaatta

SEQ ID NO: 4095780 - DNA, 12 bp, Homo sapiens
tgttttcttcaa

SEQ ID NO: 4095781 - DNA, 13 bp, Homo sapiens
tgttttcttcaac

SEQ ID NO: 4095782 - DNA, 20 bp, Homo sapiens
tgttttctttctttaaatgt

SEQ ID NO: 4095783 - DNA, 17 bp, Homo sapiens
tgttttgacggatgatt

SEQ ID NO: 4095784 - DNA, 12 bp, Homo sapiens
tgttttgcactt

SEQ ID NO: 4095785 - DNA, 14 bp, Homo sapiens
tgttttgcactttt

SEQ ID NO: 4095786 - DNA, 16 bp, Homo sapiens
tgttttggtagattaa

SEQ ID NO: 4095787 - DNA, 15 bp, Homo sapiens
tgttttggttaataa

SEQ ID NO: 4095788 - DNA, 18 bp, Homo sapiens
tgttttgtatatacagtt

SEQ ID NO: 4095789 - DNA, 12 bp, Homo sapiens
tgttttgttaat

SEQ ID NO: 4095790 - DNA, 13 bp, Homo sapiens
tgtttttcatgaa

SEQ ID NO: 4095791 - DNA, 21 bp, Homo sapiens
tgtttttgaatttaaataaag

SEQ ID NO: 4095792 - DNA, 14 bp, Homo sapiens
tgtttttgctttct

SEQ ID NO: 4095793 - DNA, 14 bp, Homo sapiens
tgtttttgggaaga

SEQ ID NO: 4095794 - DNA, 13 bp, Homo sapiens
tgtttttgtattt

SEQ ID NO: 4095795 - DNA, 19 bp, Homo sapiens
tgttcagctcccccaggct

SEQ ID NO: 4095796 - DNA, 18 bp, Homo sapiens
tgttcaggaagtccttat

SEQ ID NO: 4095797 - DNA, 19 bp, Homo sapiens
tgttcatcatcctaagcta

SEQ ID NO: 4095798 - DNA, 14 bp, Homo sapiens
tgttcattgtaatg

SEQ ID NO: 4095799 - DNA, 22 bp, Homo sapiens
tgttcattgtaatgttactgat

SEQ ID NO: 4095800 - DNA, 20 bp, Homo sapiens
tgttccaaattcagtttcat

SEQ ID NO: 4095801 - DNA, 22 bp, Homo sapiens
tgttccaaattcagtttcataa

SEQ ID NO: 4095802 - DNA, 11 bp, Homo sapiens
tgttccaagac

SEQ ID NO: 4095803 - DNA, 20 bp, Homo sapiens
tgttccaagacattgtcaat

SEQ ID NO: 4095804 - DNA, 18 bp, Homo sapiens
tgttccaatgtcaatgtg

SEQ ID NO: 4095805 - DNA, 14 bp, Homo sapiens
tgttccagcagttt

SEQ ID NO: 4095806 - DNA, 14 bp, Homo sapiens
tgttccagctcttt

SEQ ID NO: 4095807 - DNA, 18 bp, Homo sapiens
tgttccagtaatctaata

SEQ ID NO: 4095808 - DNA, 14 bp, Homo sapiens
tgttcccagaggca

SEQ ID NO: 4095809 - DNA, 21 bp, Homo sapiens
tgttcccagtagttataaagt

SEQ ID NO: 4095810 - DNA, 22 bp, Homo sapiens
tgttccccactgacagcctccc

SEQ ID NO: 4095811 - DNA, 18 bp, Homo sapiens
tgttccccatggccactt

SEQ ID NO: 4095812 - DNA, 15 bp, Homo sapiens
tgttcccctcactgg

SEQ ID NO: 4095813 - DNA, 21 bp, Homo sapiens
tgttcccctcactggatgaaa

SEQ ID NO: 4095814 - DNA, 14 bp, Homo sapiens
tgttccctctgctc

SEQ ID NO: 4095815 - DNA, 18 bp, Homo sapiens
tgttccctctgctcctgg

SEQ ID NO: 4095816 - DNA, 15 bp, Homo sapiens
tgttcctacagcccc

SEQ ID NO: 4095817 - DNA, 15 bp, Homo sapiens
tgttcctccctccca

SEQ ID NO: 4095818 - DNA, 19 bp, Homo sapiens
tgttcctggcagtttaaaa

SEQ ID NO: 4095819 - DNA, 17 bp, Homo sapiens
tgttcctggctgatgat

SEQ ID NO: 4095820 - DNA, 22 bp, Homo sapiens
tgttcctggctgatgatccaga

SEQ ID NO: 4095821 - DNA, 20 bp, Homo sapiens
tgttcgcatggtcacacact

SEQ ID NO: 4095822 - DNA, 15 bp, Homo sapiens
tgttcgggtgtgggt

SEQ ID NO: 4095823 - DNA, 10 bp, Homo sapiens
tgttctaagg

SEQ ID NO: 4095824 - DNA, 11 bp, Homo sapiens
tgttctaaggg

SEQ ID NO: 4095825 - DNA, 13 bp, Homo sapiens
tgttctacatggc

SEQ ID NO: 4095826 - DNA, 21 bp, Homo sapiens
tgttctattaatcacctctct

SEQ ID NO: 4095827 - DNA, 15 bp, Homo sapiens
tgttctcacagtgtg

SEQ ID NO: 4095828 - DNA, 14 bp, Homo sapiens
tgttctccaggctt

SEQ ID NO: 4095829 - DNA, 20 bp, Homo sapiens
tgttctccattttcaagctg

SEQ ID NO: 4095830 - DNA, 21 bp, Homo sapiens
tgttctccgggtgtggcctca

SEQ ID NO: 4095831 - DNA, 14 bp, Homo sapiens
tgttctcttcttca

SEQ ID NO: 4095832 - DNA, 17 bp, Homo sapiens
tgttctgaaatgttctt

SEQ ID NO: 4095833 - DNA, 18 bp, Homo sapiens
tgttctgaaatgttctta

SEQ ID NO: 4095834 - DNA, 13 bp, Homo sapiens
tgttctgacatta

SEQ ID NO: 4095835 - DNA, 22 bp, Homo sapiens
tgttctgctccataccttttct

SEQ ID NO: 4095836 - DNA, 20 bp, Homo sapiens
tgttctgctcctgcttttct

SEQ ID NO: 4095837 - DNA, 24 bp, Homo sapiens
tgttctgctcctgcttttctgtcc

SEQ ID NO: 4095838 - DNA, 22 bp, Homo sapiens
tgttctgctttatcttttcata

SEQ ID NO: 4095839 - DNA, 16 bp, Homo sapiens
tgttctggcctcagac

SEQ ID NO: 4095840 - DNA, 12 bp, Homo sapiens
tgttctggggga

SEQ ID NO: 4095841 - DNA, 19 bp, Homo sapiens
tgttctgtggttcctctgc

SEQ ID NO: 4095842 - DNA, 18 bp, Homo sapiens
tgttcttatagaataaaa

SEQ ID NO: 4095843 - DNA, 23 bp, Homo sapiens
tgttcttatagaataaaagctgt

SEQ ID NO: 4095844 - DNA, 15 bp, Homo sapiens
tgttctttaggagat

SEQ ID NO: 4095845 - DNA, 22 bp, Homo sapiens
tgttctttggaaagtacactct

SEQ ID NO: 4095846 - DNA, 13 bp, Homo sapiens
tgttctttgggga

SEQ ID NO: 4095847 - DNA, 20 bp, Homo sapiens
tgttcttttaaatgattgaa

SEQ ID NO: 4095848 - DNA, 13 bp, Homo sapiens
tgttctttttaga

SEQ ID NO: 4095849 - DNA, 13 bp, Homo sapiens
tgttgaatacttt

SEQ ID NO: 4095850 - DNA, 22 bp, Homo sapiens
tgttgaatgcccacaggcaaat

SEQ ID NO: 4095851 - DNA, 23 bp, Homo sapiens
tgttgagaatcccaaatttgatt

SEQ ID NO: 4095852 - DNA, 13 bp, Homo sapiens
tgttgagctgttt

SEQ ID NO: 4095853 - DNA, 18 bp, Homo sapiens
tgttgaggggtcccctct

SEQ ID NO: 4095854 - DNA, 19 bp, Homo sapiens
tgttgaggtggtctgaatg

SEQ ID NO: 4095855 - DNA, 20 bp, Homo sapiens
tgttgaggtggtctgaatgt

SEQ ID NO: 4095856 - DNA, 23 bp, Homo sapiens
tgttgaggtggtctgaatgttct

SEQ ID NO: 4095857 - DNA, 22 bp, Homo sapiens
tgttgagttagttaagttgggt

SEQ ID NO: 4095858 - DNA, 14 bp, Homo sapiens
tgttgatcttacaa

SEQ ID NO: 4095859 - DNA, 18 bp, Homo sapiens
tgttgattttctgttgta

SEQ ID NO: 4095860 - DNA, 17 bp, Homo sapiens
tgttgcaagatgtgaat

SEQ ID NO: 4095861 - DNA, 20 bp, Homo sapiens
tgttgcaattaggattttga

SEQ ID NO: 4095862 - DNA, 14 bp, Homo sapiens
tgttgcatgtttga

SEQ ID NO: 4095863 - DNA, 20 bp, Homo sapiens
tgttgcatttccagctgtgc

SEQ ID NO: 4095864 - DNA, 16 bp, Homo sapiens
tgttgccttcatcttc

SEQ ID NO: 4095865 - DNA, 21 bp, Homo sapiens
tgttgctcaaatctattcaga

SEQ ID NO: 4095866 - DNA, 15 bp, Homo sapiens
tgttgctctaggaag

SEQ ID NO: 4095867 - DNA, 14 bp, Homo sapiens
tgttgcttctcagg

SEQ ID NO: 4095868 - DNA, 16 bp, Homo sapiens
tgttgcttctcaggct

SEQ ID NO: 4095869 - DNA, 18 bp, Homo sapiens
tgttgctttcttacctac

SEQ ID NO: 4095870 - DNA, 21 bp, Homo sapiens
tgttggaaaagaatacagaaa

SEQ ID NO: 4095871 - DNA, 13 bp, Homo sapiens
tgttggagtgagg

SEQ ID NO: 4095872 - DNA, 16 bp, Homo sapiens
tgttggagtgtttcta

SEQ ID NO: 4095873 - DNA, 15 bp, Homo sapiens
tgttggctaatgaag

SEQ ID NO: 4095874 - DNA, 15 bp, Homo sapiens
tgttggctatttgaa

SEQ ID NO: 4095875 - DNA, 20 bp, Homo sapiens
tgttggctatttgaaatact

SEQ ID NO: 4095876 - DNA, 18 bp, Homo sapiens
tgttggggaaaccttcat

SEQ ID NO: 4095877 - DNA, 17 bp, Homo sapiens
tgttgggggggaccctg

SEQ ID NO: 4095878 - DNA, 17 bp, Homo sapiens
tgttggggttgacattt

SEQ ID NO: 4095879 - DNA, 17 bp, Homo sapiens
tgttggtcagaggagtg

SEQ ID NO: 4095880 - DNA, 13 bp, Homo sapiens
tgttgtaattctt

SEQ ID NO: 4095881 - DNA, 15 bp, Homo sapiens
tgttgtaattcttca

SEQ ID NO: 4095882 - DNA, 19 bp, Homo sapiens
tgttgtaattcttcagttg

SEQ ID NO: 4095883 - DNA, 13 bp, Homo sapiens
tgttgtacattta

SEQ ID NO: 4095884 - DNA, 14 bp, Homo sapiens
tgttgtacatttat

SEQ ID NO: 4095885 - DNA, 15 bp, Homo sapiens
tgttgtctcttctcc

SEQ ID NO: 4095886 - DNA, 15 bp, Homo sapiens
tgttgtcttcagcag

SEQ ID NO: 4095887 - DNA, 13 bp, Homo sapiens
tgttgtgaatgtt

SEQ ID NO: 4095888 - DNA, 14 bp, Homo sapiens
tgttgtgatgtatt

SEQ ID NO: 4095889 - DNA, 13 bp, Homo sapiens
tgttgtgtgtgca

SEQ ID NO: 4095890 - DNA, 13 bp, Homo sapiens
tgttgtgttcctg

SEQ ID NO: 4095891 - DNA, 17 bp, Homo sapiens
tgttgtgttcctggctg

SEQ ID NO: 4095892 - DNA, 21 bp, Homo sapiens
tgttgttaatgaaaatgtcag

SEQ ID NO: 4095893 - DNA, 22 bp, Homo sapiens
tgttgttttctgggggaaaaag

SEQ ID NO: 4095894 - DNA, 14 bp, Homo sapiens
tgtttaaaataaaa

SEQ ID NO: 4095895 - DNA, 19 bp, Homo sapiens
tgtttaaaataaaatgaaa

SEQ ID NO: 4095896 - DNA, 14 bp, Homo sapiens
tgtttaaagaataa

SEQ ID NO: 4095897 - DNA, 18 bp, Homo sapiens
tgtttaaagaataaagtc

SEQ ID NO: 4095898 - DNA, 12 bp, Homo sapiens
tgtgtcagagtg

SEQ ID NO: 4095899 - DNA, 19 bp, Homo sapiens
tgtgtcccatgatccctgt

SEQ ID NO: 4095900 - DNA, 16 bp, Homo sapiens
tgtgtcccccccaggc

SEQ ID NO: 4095901 - DNA, 17 bp, Homo sapiens
tgtgtcccctcactctg

SEQ ID NO: 4095902 - DNA, 22 bp, Homo sapiens
tgtgtcccctcactctgtcagc

SEQ ID NO: 4095903 - DNA, 17 bp, Homo sapiens
tgtgtccctcttctctt

SEQ ID NO: 4095904 - DNA, 15 bp, Homo sapiens
tgtgtccggcccagt

SEQ ID NO: 4095905 - DNA, 21 bp, Homo sapiens
tgtgtcctccaggagcttctt

SEQ ID NO: 4095906 - DNA, 14 bp, Homo sapiens
tgtgtctcttttct

SEQ ID NO: 4095907 - DNA, 24 bp, Homo sapiens
tgtgtctgtatttcatgtggctgt

SEQ ID NO: 4095908 - DNA, 16 bp, Homo sapiens
tgtgtcttaattatta

SEQ ID NO: 4095909 - DNA, 20 bp, Homo sapiens
tgtgtctttatagatgtaca

SEQ ID NO: 4095910 - DNA, 10 bp, Homo sapiens
tgtgtctttt

SEQ ID NO: 4095911 - DNA, 22 bp, Homo sapiens
tgtgtgaatgaacactcttttg

SEQ ID NO: 4095912 - DNA, 12 bp, Homo sapiens
tgtgtgaatgtg

SEQ ID NO: 4095913 - DNA, 17 bp, Homo sapiens
tgtgtgagcaagcattt

SEQ ID NO: 4095914 - DNA, 14 bp, Homo sapiens
tgtgtgagttgagt

SEQ ID NO: 4095915 - DNA, 17 bp, Homo sapiens
tgtgtggactcaagtcc

SEQ ID NO: 4095916 - DNA, 21 bp, Homo sapiens
tgtgtgtactcactgaagcct

SEQ ID NO: 4095917 - DNA, 14 bp, Homo sapiens
tgtgtgtggcaggg

SEQ ID NO: 4095918 - DNA, 19 bp, Homo sapiens
tgtgtgtgggctgtgagtg

SEQ ID NO: 4095919 - DNA, 21 bp, Homo sapiens
tgtgtgtggtccatgcccact

SEQ ID NO: 4095920 - DNA, 15 bp, Homo sapiens
tgtgtgtgtatgtga

SEQ ID NO: 4095921 - DNA, 14 bp, Homo sapiens
tgtgtgtgtatgtt

SEQ ID NO: 4095922 - DNA, 16 bp, Homo sapiens
tgtgtgtgtgtatgtg

SEQ ID NO: 4095923 - DNA, 19 bp, Homo sapiens
tgtgttaccctcctgtaaa

SEQ ID NO: 4095924 - DNA, 15 bp, Homo sapiens
tgtgttcccagaggc

SEQ ID NO: 4095925 - DNA, 14 bp, Homo sapiens
tgtgttctgctcca

SEQ ID NO: 4095926 - DNA, 14 bp, Homo sapiens
tgtgttgcattatt

SEQ ID NO: 4095927 - DNA, 24 bp, Homo sapiens
tgtgttgcattattcatttagtga

SEQ ID NO: 4095928 - DNA, 16 bp, Homo sapiens
tgtgttgccctggcat

SEQ ID NO: 4095929 - DNA, 15 bp, Homo sapiens
tgtgttgctatcctg

SEQ ID NO: 4095930 - DNA, 13 bp, Homo sapiens
tgtgttgtctcta

SEQ ID NO: 4095931 - DNA, 14 bp, Homo sapiens
tgtgtttatttcac

SEQ ID NO: 4095932 - DNA, 15 bp, Homo sapiens
tgtgtttctaaaact

SEQ ID NO: 4095933 - DNA, 18 bp, Homo sapiens
tgtgtttctaaaactatg

SEQ ID NO: 4095934 - DNA, 20 bp, Homo sapiens
tgtgtttctatgtgacaatt

SEQ ID NO: 4095935 - DNA, 16 bp, Homo sapiens
tgtgtttgctcccctt

SEQ ID NO: 4095936 - DNA, 15 bp, Homo sapiens
tgtgtttgcttaaac

SEQ ID NO: 4095937 - DNA, 14 bp, Homo sapiens
tgtgtttgttccta

SEQ ID NO: 4095938 - DNA, 17 bp, Homo sapiens
tgtgttttcataataaa

SEQ ID NO: 4095939 - DNA, 23 bp, Homo sapiens
tgtgttttctgaataacatttgt

SEQ ID NO: 4095940 - DNA, 16 bp, Homo sapiens
tgtgttttggttaata

SEQ ID NO: 4095941 - DNA, 13 bp, Homo sapiens
tgtgtttttgaaa

SEQ ID NO: 4095942 - DNA, 21 bp, Homo sapiens
tgtgtttttgctatcacacag

SEQ ID NO: 4095943 - DNA, 23 bp, Homo sapiens
tgttaaaattatcaatatctaat

SEQ ID NO: 4095944 - DNA, 20 bp, Homo sapiens
tgttaaacagtagttgtatt

SEQ ID NO: 4095945 - DNA, 20 bp, Homo sapiens
tgttaaatactgtgcagaat

SEQ ID NO: 4095946 - DNA, 14 bp, Homo sapiens
tgttaaatttgtaa

SEQ ID NO: 4095947 - DNA, 17 bp, Homo sapiens
tgttaaatttgtaagtt

SEQ ID NO: 4095948 - DNA, 18 bp, Homo sapiens
tgttaaatttgtaagttt

SEQ ID NO: 4095949 - DNA, 16 bp, Homo sapiens
tgttaaccagaataaa

SEQ ID NO: 4095950 - DNA, 17 bp, Homo sapiens
tgttaacctcagtgtca

SEQ ID NO: 4095951 - DNA, 19 bp, Homo sapiens
tgttaacctcagtgtcatt

SEQ ID NO: 4095952 - DNA, 16 bp, Homo sapiens
tgttaactatgacaga

SEQ ID NO: 4095953 - DNA, 17 bp, Homo sapiens
tgttaactcttgtctat

SEQ ID NO: 4095954 - DNA, 18 bp, Homo sapiens
tgttaagcagctaaattt

SEQ ID NO: 4095955 - DNA, 14 bp, Homo sapiens
tgttaaggaaactc

SEQ ID NO: 4095956 - DNA, 20 bp, Homo sapiens
tgttaaggacttctgcagct

SEQ ID NO: 4095957 - DNA, 22 bp, Homo sapiens
tgttaaggttgaactttgccaa

SEQ ID NO: 4095958 - DNA, 17 bp, Homo sapiens
tgttaagttatagtgaa

SEQ ID NO: 4095959 - DNA, 13 bp, Homo sapiens
tgttaatgctttt

SEQ ID NO: 4095960 - DNA, 20 bp, Homo sapiens
tgttaattcagcactgattt

SEQ ID NO: 4095961 - DNA, 19 bp, Homo sapiens
tgttacataagataaatgt

SEQ ID NO: 4095962 - DNA, 12 bp, Homo sapiens
tgttacatcaca

SEQ ID NO: 4095963 - DNA, 19 bp, Homo sapiens
tgttaccactggtaacatg

SEQ ID NO: 4095964 - DNA, 18 bp, Homo sapiens
tgttaccatgtcactgtg

SEQ ID NO: 4095965 - DNA, 17 bp, Homo sapiens
tgttaccgcctgtctct

SEQ ID NO: 4095966 - DNA, 15 bp, Homo sapiens
tgttacctgtgtgct

SEQ ID NO: 4095967 - DNA, 18 bp, Homo sapiens
tgttactattttctacaa

SEQ ID NO: 4095968 - DNA, 13 bp, Homo sapiens
tgttactctggtt

SEQ ID NO: 4095969 - DNA, 15 bp, Homo sapiens
tgttactctggttct

SEQ ID NO: 4095970 - DNA, 14 bp, Homo sapiens
tgttactgcttcat

SEQ ID NO: 4095971 - DNA, 15 bp, Homo sapiens
tgttactgcttcatt

SEQ ID NO: 4095972 - DNA, 14 bp, Homo sapiens
tgttactgtaattc

SEQ ID NO: 4095973 - DNA, 14 bp, Homo sapiens
tgttacttccttat

SEQ ID NO: 4095974 - DNA, 14 bp, Homo sapiens
tgttagtagaaatt

SEQ ID NO: 4095975 - DNA, 11 bp, Homo sapiens
tgttagttata

SEQ ID NO: 4095976 - DNA, 18 bp, Homo sapiens
tgttagttctagctctat

SEQ ID NO: 4095977 - DNA, 17 bp, Homo sapiens
tgttagtttacaatatt

SEQ ID NO: 4095978 - DNA, 20 bp, Homo sapiens
tgttatcaaaactttctttt

SEQ ID NO: 4095979 - DNA, 13 bp, Homo sapiens
tgttatcaaactt

SEQ ID NO: 4095980 - DNA, 17 bp, Homo sapiens
tgttatgactatgtaaa

SEQ ID NO: 4095981 - DNA, 21 bp, Homo sapiens
tgttatgatattgtttaaaat

SEQ ID NO: 4095982 - DNA, 21 bp, Homo sapiens
tgttatgatttccttcaatgt

SEQ ID NO: 4095983 - DNA, 20 bp, Homo sapiens
tgttatgtactagtgttctg

SEQ ID NO: 4095984 - DNA, 13 bp, Homo sapiens
tgttattcctagt

SEQ ID NO: 4095985 - DNA, 24 bp, Homo sapiens
tgttattcctagtggatgactgtt

SEQ ID NO: 4095986 - DNA, 13 bp, Homo sapiens
tgttattgttgaa

SEQ ID NO: 4095987 - DNA, 13 bp, Homo sapiens
tgttatttcttcc

SEQ ID NO: 4095988 - DNA, 21 bp, Homo sapiens
tgttatttttgtttcttccaa

SEQ ID NO: 4095989 - DNA, 19 bp, Homo sapiens
tgttcaaaaaaacactagt

SEQ ID NO: 4095990 - DNA, 13 bp, Homo sapiens
tgttcaaacaata

SEQ ID NO: 4095991 - DNA, 18 bp, Homo sapiens
tgttcaaagccacattat

SEQ ID NO: 4095992 - DNA, 20 bp, Homo sapiens
tgttcaaagccacattattt

SEQ ID NO: 4095993 - DNA, 22 bp, Homo sapiens
tgttcaaagccacattatttct

SEQ ID NO: 4095994 - DNA, 17 bp, Homo sapiens
tgttcacgcaacttgaa

SEQ ID NO: 4095995 - DNA, 18 bp, Homo sapiens
tgttcacgcaacttgaaa

SEQ ID NO: 4095996 - DNA, 15 bp, Homo sapiens
tgttcacgctcaccc

SEQ ID NO: 4095997 - DNA, 18 bp, Homo sapiens
tgttcactgaaggtgatt

SEQ ID NO: 4095998 - DNA, 18 bp, Homo sapiens
tgttcactggacacttca

SEQ ID NO: 4095999 - DNA, 14 bp, Homo sapiens
tgttcagcactgtc

SEQ ID NO: 4096000 - DNA, 15 bp, Homo sapiens
tgttcagcactgtcc

SEQ ID NO: 4096001 - DNA, 12 bp, Homo sapiens
tgttcagctccc

SEQ ID NO: 4096002 - DNA, 21 bp, Homo sapiens
tgtgcctttctttgcctctgc

SEQ ID NO: 4096003 - DNA, 19 bp, Homo sapiens
tgtgcgcataggcctgctt

SEQ ID NO: 4096004 - DNA, 14 bp, Homo sapiens
tgtgctacagatga

SEQ ID NO: 4096005 - DNA, 15 bp, Homo sapiens
tgtgctatcaatgag

SEQ ID NO: 4096006 - DNA, 20 bp, Homo sapiens
tgtgctgcgcctgcaggcag

SEQ ID NO: 4096007 - DNA, 18 bp, Homo sapiens
tgtgctggaattctaaca

SEQ ID NO: 4096008 - DNA, 11 bp, Homo sapiens
tgtgctggggg

SEQ ID NO: 4096009 - DNA, 14 bp, Homo sapiens
tgtgctgggtgcct

SEQ ID NO: 4096010 - DNA, 17 bp, Homo sapiens
tgtgctgtggaagcaac

SEQ ID NO: 4096011 - DNA, 15 bp, Homo sapiens
tgtgctgtgggcagc

SEQ ID NO: 4096012 - DNA, 21 bp, Homo sapiens
tgtgctgtgggcagcaccctc

SEQ ID NO: 4096013 - DNA, 22 bp, Homo sapiens
tgtgctgtgtttaatcagggga

SEQ ID NO: 4096014 - DNA, 15 bp, Homo sapiens
tgtgctgtgtttgct

SEQ ID NO: 4096015 - DNA, 13 bp, Homo sapiens
tgtgcttatgttt

SEQ ID NO: 4096016 - DNA, 17 bp, Homo sapiens
tgtgctttgcattccta

SEQ ID NO: 4096017 - DNA, 22 bp, Homo sapiens
tgtgctttgctcttgtcccacg

SEQ ID NO: 4096018 - DNA, 14 bp, Homo sapiens
tgtgcttttcctga

SEQ ID NO: 4096019 - DNA, 23 bp, Homo sapiens
tgtggaaagtgaatttgaatgaa

SEQ ID NO: 4096020 - DNA, 19 bp, Homo sapiens
tgtggaacataaaaaggac

SEQ ID NO: 4096021 - DNA, 18 bp, Homo sapiens
tgtggaatgagtgtgcat

SEQ ID NO: 4096022 - DNA, 15 bp, Homo sapiens
tgtggactgtgatgc

SEQ ID NO: 4096023 - DNA, 19 bp, Homo sapiens
tgtggagaccctgccacag

SEQ ID NO: 4096024 - DNA, 18 bp, Homo sapiens
tgtggagcaaaaggcagc

SEQ ID NO: 4096025 - DNA, 21 bp, Homo sapiens
tgtggagcaaaaggcagctca

SEQ ID NO: 4096026 - DNA, 14 bp, Homo sapiens
tgtggaggaaggat

SEQ ID NO: 4096027 - DNA, 23 bp, Homo sapiens
tgtggatgacacaatccctgggg

SEQ ID NO: 4096028 - DNA, 17 bp, Homo sapiens
tgtggattctgaggccc

SEQ ID NO: 4096029 - DNA, 22 bp, Homo sapiens
tgtggattctgaggccctgccc

SEQ ID NO: 4096030 - DNA, 19 bp, Homo sapiens
tgtggcaaaatatggtttg

SEQ ID NO: 4096031 - DNA, 17 bp, Homo sapiens
tgtggcaaggaaaaaca

SEQ ID NO: 4096032 - DNA, 17 bp, Homo sapiens
tgtggcaatctgtgggc

SEQ ID NO: 4096033 - DNA, 22 bp, Homo sapiens
tgtggcagagagagagaaagag

SEQ ID NO: 4096034 - DNA, 11 bp, Homo sapiens
tgtggcagtgg

SEQ ID NO: 4096035 - DNA, 12 bp, Homo sapiens
tgtggcagtggt

SEQ ID NO: 4096036 - DNA, 21 bp, Homo sapiens
tgtggcatctttgccttgggc

SEQ ID NO: 4096037 - DNA, 15 bp, Homo sapiens
tgtggcattgaaatg

SEQ ID NO: 4096038 - DNA, 16 bp, Homo sapiens
tgtggccacttatttc

SEQ ID NO: 4096039 - DNA, 21 bp, Homo sapiens
tgtggccccaccgagctggag

SEQ ID NO: 4096040 - DNA, 19 bp, Homo sapiens
tgtggccccttttactttt

SEQ ID NO: 4096041 - DNA, 16 bp, Homo sapiens
tgtggccctggccact

SEQ ID NO: 4096042 - DNA, 18 bp, Homo sapiens
tgtggccctggctctgct

SEQ ID NO: 4096043 - DNA, 11 bp, Homo sapiens
tgtggcctcag

SEQ ID NO: 4096044 - DNA, 20 bp, Homo sapiens
tgtggccttccatttatatg

SEQ ID NO: 4096045 - DNA, 16 bp, Homo sapiens
tgtggcgtctccctcg

SEQ ID NO: 4096046 - DNA, 10 bp, Homo sapiens
tgtggctcac

SEQ ID NO: 4096047 - DNA, 12 bp, Homo sapiens
tgtggctccaca

SEQ ID NO: 4096048 - DNA, 13 bp, Homo sapiens
tgtggctgaggag

SEQ ID NO: 4096049 - DNA, 12 bp, Homo sapiens
tgtggctggctc

SEQ ID NO: 4096050 - DNA, 17 bp, Homo sapiens
tgtggctggctctacct

SEQ ID NO: 4096051 - DNA, 22 bp, Homo sapiens
tgtggctggctctaccttcctg

SEQ ID NO: 4096052 - DNA, 21 bp, Homo sapiens
tgtggctgggggcaggagggc

SEQ ID NO: 4096053 - DNA, 12 bp, Homo sapiens
tgtggcttctgg

SEQ ID NO: 4096054 - DNA, 21 bp, Homo sapiens
tgtgggagggagcagacagga

SEQ ID NO: 4096055 - DNA, 17 bp, Homo sapiens
tgtgggcactggcccag

SEQ ID NO: 4096056 - DNA, 17 bp, Homo sapiens
tgtgggcagcaccctcc

SEQ ID NO: 4096057 - DNA, 21 bp, Homo sapiens
tgtgggcatttcttgcgagcc

SEQ ID NO: 4096058 - DNA, 19 bp, Homo sapiens
tgtgggcctcaaggacttg

SEQ ID NO: 4096059 - DNA, 21 bp, Homo sapiens
tgtgggcctcaaggacttgaa

SEQ ID NO: 4096060 - DNA, 19 bp, Homo sapiens
tgtgggctggtgccccaca

SEQ ID NO: 4096061 - DNA, 20 bp, Homo sapiens
tgtgggctggtgccccacag

SEQ ID NO: 4096062 - DNA, 16 bp, Homo sapiens
tgtgggcttgaccagg

SEQ ID NO: 4096063 - DNA, 13 bp, Homo sapiens
tgtggggaaaggg

SEQ ID NO: 4096064 - DNA, 16 bp, Homo sapiens
tgtgggggtggccatc

SEQ ID NO: 4096065 - DNA, 17 bp, Homo sapiens
tgtgggggtggccatcc

SEQ ID NO: 4096066 - DNA, 20 bp, Homo sapiens
tgtgggggtggccatccctg

SEQ ID NO: 4096067 - DNA, 15 bp, Homo sapiens
tgtggggtgaaaagt

SEQ ID NO: 4096068 - DNA, 12 bp, Homo sapiens
tgtggggtgggg

SEQ ID NO: 4096069 - DNA, 13 bp, Homo sapiens
tgtggggtggggt

SEQ ID NO: 4096070 - DNA, 14 bp, Homo sapiens
tgtgggtggaaggg

SEQ ID NO: 4096071 - DNA, 22 bp, Homo sapiens
tgtgggtggaagggctgggtgt

SEQ ID NO: 4096072 - DNA, 21 bp, Homo sapiens
tgtgggtgtcctgcctgtctg

SEQ ID NO: 4096073 - DNA, 14 bp, Homo sapiens
tgtggtagaaacaa

SEQ ID NO: 4096074 - DNA, 22 bp, Homo sapiens
tgtggtagggacttaaaaaact

SEQ ID NO: 4096075 - DNA, 11 bp, Homo sapiens
tgtggtctcag

SEQ ID NO: 4096076 - DNA, 14 bp, Homo sapiens
tgtggtctcaggat

SEQ ID NO: 4096077 - DNA, 15 bp, Homo sapiens
tgtggtctcaggata

SEQ ID NO: 4096078 - DNA, 18 bp, Homo sapiens
tgtggtgaggggctttct

SEQ ID NO: 4096079 - DNA, 19 bp, Homo sapiens
tgtggtgaggggctttctc

SEQ ID NO: 4096080 - DNA, 14 bp, Homo sapiens
tgtggtggggagag

SEQ ID NO: 4096081 - DNA, 12 bp, Homo sapiens
tgtggtgtaaag

SEQ ID NO: 4096082 - DNA, 16 bp, Homo sapiens
tgtggtgtaaagctgg

SEQ ID NO: 4096083 - DNA, 19 bp, Homo sapiens
tgtggtgtaaagctggccc

SEQ ID NO: 4096084 - DNA, 20 bp, Homo sapiens
tgtggtgtaaagctggccct

SEQ ID NO: 4096085 - DNA, 21 bp, Homo sapiens
tgtggttacagtgcagacagg

SEQ ID NO: 4096086 - DNA, 13 bp, Homo sapiens
tgtggttcctctg

SEQ ID NO: 4096087 - DNA, 17 bp, Homo sapiens
tgtggttcctctgctca

SEQ ID NO: 4096088 - DNA, 15 bp, Homo sapiens
tgtggttctatttta

SEQ ID NO: 4096089 - DNA, 15 bp, Homo sapiens
tgtgtaaatatatgt

SEQ ID NO: 4096090 - DNA, 20 bp, Homo sapiens
tgtgtaaatatgtacatttg

SEQ ID NO: 4096091 - DNA, 22 bp, Homo sapiens
tgtgtaaatatgtacatttgtc

SEQ ID NO: 4096092 - DNA, 19 bp, Homo sapiens
tgtgtaacctcttcacctt

SEQ ID NO: 4096093 - DNA, 15 bp, Homo sapiens
tgtgtaattcaaaag

SEQ ID NO: 4096094 - DNA, 17 bp, Homo sapiens
tgtgtacaagttgttat

SEQ ID NO: 4096095 - DNA, 17 bp, Homo sapiens
tgtgtacaatgtacaca

SEQ ID NO: 4096096 - DNA, 13 bp, Homo sapiens
tgtgtagcctatg

SEQ ID NO: 4096097 - DNA, 12 bp, Homo sapiens
tgtgtagccttt

SEQ ID NO: 4096098 - DNA, 14 bp, Homo sapiens
tgtgtaggctgggg

SEQ ID NO: 4096099 - DNA, 21 bp, Homo sapiens
tgtgtatattgagaatccctt

SEQ ID NO: 4096100 - DNA, 18 bp, Homo sapiens
tgtgtatgagtgtgaatg

SEQ ID NO: 4096101 - DNA, 15 bp, Homo sapiens
tgtgtatgtacatat

SEQ ID NO: 4096102 - DNA, 16 bp, Homo sapiens
tgtgtatttcttatac

SEQ ID NO: 4096103 - DNA, 23 bp, Homo sapiens
tgtgtcacaatgagattgaattt

SEQ ID NO: 4096104 - DNA, 14 bp, Homo sapiens
tgtgtcacttgtgc

SEQ ID NO: 4096105 - DNA, 16 bp, Homo sapiens
tgtgtcacttgtgctt

SEQ ID NO: 4096106 - DNA, 22 bp, Homo sapiens
tgtgaactcaccctgggagcca

SEQ ID NO: 4096107 - DNA, 19 bp, Homo sapiens
tgtgaactgactttaagta

SEQ ID NO: 4096108 - DNA, 23 bp, Homo sapiens
tgtgaagacccagcaggaagcca

SEQ ID NO: 4096109 - DNA, 10 bp, Homo sapiens
tgtgaagcca

SEQ ID NO: 4096110 - DNA, 20 bp, Homo sapiens
tgtgaagccaattcagacag

SEQ ID NO: 4096111 - DNA, 21 bp, Homo sapiens
tgtgaagccaattcagacagg

SEQ ID NO: 4096112 - DNA, 14 bp, Homo sapiens
tgtgaaggaccctt

SEQ ID NO: 4096113 - DNA, 13 bp, Homo sapiens
tgtgaaggcccaa

SEQ ID NO: 4096114 - DNA, 14 bp, Homo sapiens
tgtgaagttacatg

SEQ ID NO: 4096115 - DNA, 20 bp, Homo sapiens
tgtgaagttacatgcataaa

SEQ ID NO: 4096116 - DNA, 20 bp, Homo sapiens
tgtgaagtttaattgtctca

SEQ ID NO: 4096117 - DNA, 17 bp, Homo sapiens
tgtgaatacaattaaag

SEQ ID NO: 4096118 - DNA, 14 bp, Homo sapiens
tgtgaatattttca

SEQ ID NO: 4096119 - DNA, 14 bp, Homo sapiens
tgtgaatgaacact

SEQ ID NO: 4096120 - DNA, 17 bp, Homo sapiens
tgtgaatgaacactctt

SEQ ID NO: 4096121 - DNA, 23 bp, Homo sapiens
tgtgaatgaacactcttttgctt

SEQ ID NO: 4096122 - DNA, 22 bp, Homo sapiens
tgtgaatggattggattattta

SEQ ID NO: 4096123 - DNA, 15 bp, Homo sapiens
tgtgaatgtgggcac

SEQ ID NO: 4096124 - DNA, 16 bp, Homo sapiens
tgtgaattattgacac

SEQ ID NO: 4096125 - DNA, 17 bp, Homo sapiens
tgtgaattattgacact

SEQ ID NO: 4096126 - DNA, 20 bp, Homo sapiens
tgtgaattattgacactgaa

SEQ ID NO: 4096127 - DNA, 13 bp, Homo sapiens
tgtgaattcagat

SEQ ID NO: 4096128 - DNA, 14 bp, Homo sapiens
tgtgaattcagatt

SEQ ID NO: 4096129 - DNA, 16 bp, Homo sapiens
tgtgaatttttaagct

SEQ ID NO: 4096130 - DNA, 19 bp, Homo sapiens
tgtgacaggaaagccctcc

SEQ ID NO: 4096131 - DNA, 22 bp, Homo sapiens
tgtgacaggaaagccctccccc

SEQ ID NO: 4096132 - DNA, 23 bp, Homo sapiens
tgtgacaggaaagccctccccct

SEQ ID NO: 4096133 - DNA, 15 bp, Homo sapiens
tgtgacagggccagt

SEQ ID NO: 4096134 - DNA, 22 bp, Homo sapiens
tgtgacagggccagtggggcct

SEQ ID NO: 4096135 - DNA, 13 bp, Homo sapiens
tgtgacagtgttg

SEQ ID NO: 4096136 - DNA, 16 bp, Homo sapiens
tgtgacatggtgcctg

SEQ ID NO: 4096137 - DNA, 22 bp, Homo sapiens
tgtgacatggtgcctgagaggc

SEQ ID NO: 4096138 - DNA, 14 bp, Homo sapiens
tgtgacatgtaaca

SEQ ID NO: 4096139 - DNA, 22 bp, Homo sapiens
tgtgacatttggagagggggcc

SEQ ID NO: 4096140 - DNA, 15 bp, Homo sapiens
tgtgacattttacat

SEQ ID NO: 4096141 - DNA, 16 bp, Homo sapiens
tgtgacccccagctcc

SEQ ID NO: 4096142 - DNA, 16 bp, Homo sapiens
tgtgaccctctgaatg

SEQ ID NO: 4096143 - DNA, 13 bp, Homo sapiens
tgtgactcttact

SEQ ID NO: 4096144 - DNA, 12 bp, Homo sapiens
tgtgactttttt

SEQ ID NO: 4096145 - DNA, 21 bp, Homo sapiens
tgtgagaagccagccagaggc

SEQ ID NO: 4096146 - DNA, 14 bp, Homo sapiens
tgtgagaatcaaaa

SEQ ID NO: 4096147 - DNA, 14 bp, Homo sapiens
tgtgagacccccac

SEQ ID NO: 4096148 - DNA, 15 bp, Homo sapiens
tgtgagacccccaca

SEQ ID NO: 4096149 - DNA, 19 bp, Homo sapiens
tgtgagacccccacacctc

SEQ ID NO: 4096150 - DNA, 13 bp, Homo sapiens
tgtgagagaaagt

SEQ ID NO: 4096151 - DNA, 16 bp, Homo sapiens
tgtgagaggtttgact

SEQ ID NO: 4096152 - DNA, 16 bp, Homo sapiens
tgtgagccaccgctgc

SEQ ID NO: 4096153 - DNA, 19 bp, Homo sapiens
tgtgagccaccgtgcctgg

SEQ ID NO: 4096154 - DNA, 14 bp, Homo sapiens
tgtgagcccctggt

SEQ ID NO: 4096155 - DNA, 14 bp, Homo sapiens
tgtgagctcttccc

SEQ ID NO: 4096156 - DNA, 13 bp, Homo sapiens
tgtgaggagctgc

SEQ ID NO: 4096157 - DNA, 14 bp, Homo sapiens
tgtgaggagctgct

SEQ ID NO: 4096158 - DNA, 12 bp, Homo sapiens
tgtgaggcagga

SEQ ID NO: 4096159 - DNA, 14 bp, Homo sapiens
tgtgaggcaggaga

SEQ ID NO: 4096160 - DNA, 14 bp, Homo sapiens
tgtgaggctgtcct

SEQ ID NO: 4096161 - DNA, 17 bp, Homo sapiens
tgtgagggacatgctca

SEQ ID NO: 4096162 - DNA, 15 bp, Homo sapiens
tgtgagtaaatattg

SEQ ID NO: 4096163 - DNA, 14 bp, Homo sapiens
tgtgagtgtgacag

SEQ ID NO: 4096164 - DNA, 16 bp, Homo sapiens
tgtgagttctccctgt

SEQ ID NO: 4096165 - DNA, 19 bp, Homo sapiens
tgtgagtttaccttgtata

SEQ ID NO: 4096166 - DNA, 21 bp, Homo sapiens
tgtgagtttaccttgtatact

SEQ ID NO: 4096167 - DNA, 22 bp, Homo sapiens
tgtgagtttaccttgtatactg

SEQ ID NO: 4096168 - DNA, 23 bp, Homo sapiens
tgtgagtttaccttgtatactgt

SEQ ID NO: 4096169 - DNA, 18 bp, Homo sapiens
tgtgataaggatcagaac

SEQ ID NO: 4096170 - DNA, 16 bp, Homo sapiens
tgtgatatataagtgt

SEQ ID NO: 4096171 - DNA, 17 bp, Homo sapiens
tgtgatatgtctgctga

SEQ ID NO: 4096172 - DNA, 14 bp, Homo sapiens
tgtgatctgggcat

SEQ ID NO: 4096173 - DNA, 18 bp, Homo sapiens
tgtgatgcttataataaa

SEQ ID NO: 4096174 - DNA, 15 bp, Homo sapiens
tgtgatgtgaagcca

SEQ ID NO: 4096175 - DNA, 14 bp, Homo sapiens
tgtgattctgttta

SEQ ID NO: 4096176 - DNA, 14 bp, Homo sapiens
tgtgattggcctgt

SEQ ID NO: 4096177 - DNA, 14 bp, Homo sapiens
tgtgatttctttaa

SEQ ID NO: 4096178 - DNA, 19 bp, Homo sapiens
tgtgatttctttaaaagaa

SEQ ID NO: 4096179 - DNA, 17 bp, Homo sapiens
tgtgatttttataatac

SEQ ID NO: 4096180 - DNA, 18 bp, Homo sapiens
tgtgatttttataataca

SEQ ID NO: 4096181 - DNA, 11 bp, Homo sapiens
tgtgatttttt

SEQ ID NO: 4096182 - DNA, 15 bp, Homo sapiens
tgtgcaatagaaata

SEQ ID NO: 4096183 - DNA, 16 bp, Homo sapiens
tgtgcaatagaaatag

SEQ ID NO: 4096184 - DNA, 16 bp, Homo sapiens
tgtgcacaggcagagc

SEQ ID NO: 4096185 - DNA, 16 bp, Homo sapiens
tgtgcacccggcctgg

SEQ ID NO: 4096186 - DNA, 17 bp, Homo sapiens
tgtgcacccggcctgga

SEQ ID NO: 4096187 - DNA, 21 bp, Homo sapiens
tgtgcacgagtgggaaggact

SEQ ID NO: 4096188 - DNA, 13 bp, Homo sapiens
tgtgcactgccca

SEQ ID NO: 4096189 - DNA, 20 bp, Homo sapiens
tgtgcagaataatggaaaca

SEQ ID NO: 4096190 - DNA, 20 bp, Homo sapiens
tgtgcagcgcagctggactc

SEQ ID NO: 4096191 - DNA, 17 bp, Homo sapiens
tgtgcagggctggtttg

SEQ ID NO: 4096192 - DNA, 19 bp, Homo sapiens
tgtgcagggctggtttgtt

SEQ ID NO: 4096193 - DNA, 15 bp, Homo sapiens
tgtgccaataaccaa

SEQ ID NO: 4096194 - DNA, 16 bp, Homo sapiens
tgtgccaataaccaag

SEQ ID NO: 4096195 - DNA, 21 bp, Homo sapiens
tgtgccagggcaatgatgaat

SEQ ID NO: 4096196 - DNA, 10 bp, Homo sapiens
tgtgccatca

SEQ ID NO: 4096197 - DNA, 23 bp, Homo sapiens
tgtgccatctgtacatattactg

SEQ ID NO: 4096198 - DNA, 21 bp, Homo sapiens
tgtgcccacatcccaggcttc

SEQ ID NO: 4096199 - DNA, 14 bp, Homo sapiens
tgtgcctcccagct

SEQ ID NO: 4096200 - DNA, 13 bp, Homo sapiens
tgtgcctctggga

SEQ ID NO: 4096201 - DNA, 17 bp, Homo sapiens
tgtgcctggccccagcc

SEQ ID NO: 4096202 - DNA, 23 bp, Homo sapiens
tgtgcctggccccagcctgggcc

SEQ ID NO: 4096203 - DNA, 15 bp, Homo sapiens
tgtgcctggcctctg

SEQ ID NO: 4096204 - DNA, 17 bp, Homo sapiens
tgtgcctggcctctgcc

SEQ ID NO: 4096205 - DNA, 16 bp, Homo sapiens
tgtgccttcagctgtt

SEQ ID NO: 4096206 - DNA, 10 bp, Homo sapiens
tgtgcctttc

SEQ ID NO: 4096207 - DNA, 13 bp, Homo sapiens
tgtgcctttcttt

SEQ ID NO: 4096208 - DNA, 14 bp, Homo sapiens
tgtgcctttctttg

SEQ ID NO: 4096209 - DNA, 20 bp, Homo sapiens
tgtgcctttctttgcctctg

SEQ ID NO: 4096210 - DNA, 20 bp, Homo sapiens
ttccctcacctttcccatct

SEQ ID NO: 4096211 - DNA, 22 bp, Homo sapiens
ttccctcaggttctattttctt

SEQ ID NO: 4096212 - DNA, 13 bp, Homo sapiens
ttccctccctgct

SEQ ID NO: 4096213 - DNA, 19 bp, Homo sapiens
ttccctcctagctctccca

SEQ ID NO: 4096214 - DNA, 19 bp, Homo sapiens
ttccctcggagttcttctt

SEQ ID NO: 4096215 - DNA, 14 bp, Homo sapiens
ttccctctccctgt

SEQ ID NO: 4096216 - DNA, 16 bp, Homo sapiens
ttccctctcctgccca

SEQ ID NO: 4096217 - DNA, 13 bp, Homo sapiens
ttccctctctcag

SEQ ID NO: 4096218 - DNA, 19 bp, Homo sapiens
ttccctctctcagcacagc

SEQ ID NO: 4096219 - DNA, 22 bp, Homo sapiens
ttccctctctcagcacagcctg

SEQ ID NO: 4096220 - DNA, 22 bp, Homo sapiens
ttccctctgagaattccaagga

SEQ ID NO: 4096221 - DNA, 15 bp, Homo sapiens
ttccctctgctcagc

SEQ ID NO: 4096222 - DNA, 16 bp, Homo sapiens
ttccctgcagacctca

SEQ ID NO: 4096223 - DNA, 16 bp, Homo sapiens
ttccctgcttccagga

SEQ ID NO: 4096224 - DNA, 17 bp, Homo sapiens
ttccctgctttgcatct

SEQ ID NO: 4096225 - DNA, 13 bp, Homo sapiens
ttccctgggctgc

SEQ ID NO: 4096226 - DNA, 23 bp, Homo sapiens
ttccctgggctgccaccagcccc

SEQ ID NO: 4096227 - DNA, 12 bp, Homo sapiens
ttccctgttctt

SEQ ID NO: 4096228 - DNA, 16 bp, Homo sapiens
ttccctgttcttcctc

SEQ ID NO: 4096229 - DNA, 14 bp, Homo sapiens
ttcccttacaaggt

SEQ ID NO: 4096230 - DNA, 21 bp, Homo sapiens
ttcccttagtgactcttgaag

SEQ ID NO: 4096231 - DNA, 13 bp, Homo sapiens
ttcccttctctca

SEQ ID NO: 4096232 - DNA, 14 bp, Homo sapiens
ttcccttgctttgt

SEQ ID NO: 4096233 - DNA, 16 bp, Homo sapiens
ttcccttggcctcaga

SEQ ID NO: 4096234 - DNA, 15 bp, Homo sapiens
ttccctttccttcca

SEQ ID NO: 4096235 - DNA, 14 bp, Homo sapiens
ttccctttgacttc

SEQ ID NO: 4096236 - DNA, 21 bp, Homo sapiens
ttccctttgacttcagctgcc

SEQ ID NO: 4096237 - DNA, 18 bp, Homo sapiens
ttccgagatccccagggc

SEQ ID NO: 4096238 - DNA, 21 bp, Homo sapiens
ttccgagatccccagggcagc

SEQ ID NO: 4096239 - DNA, 18 bp, Homo sapiens
ttccgccaatctggccct

SEQ ID NO: 4096240 - DNA, 12 bp, Homo sapiens
ttccgctgaggg

SEQ ID NO: 4096241 - DNA, 17 bp, Homo sapiens
ttccggtagggaggcag

SEQ ID NO: 4096242 - DNA, 14 bp, Homo sapiens
ttccgtcacatccc

SEQ ID NO: 4096243 - DNA, 17 bp, Homo sapiens
ttccgtgaaaacggagc

SEQ ID NO: 4096244 - DNA, 17 bp, Homo sapiens
ttccgtttgcttttgtt

SEQ ID NO: 4096245 - DNA, 14 bp, Homo sapiens
ttcctaacacagca

SEQ ID NO: 4096246 - DNA, 15 bp, Homo sapiens
ttcctaacaggatga

SEQ ID NO: 4096247 - DNA, 14 bp, Homo sapiens
ttcctaacttttca

SEQ ID NO: 4096248 - DNA, 20 bp, Homo sapiens
ttcctaatcactcagagcag

SEQ ID NO: 4096249 - DNA, 20 bp, Homo sapiens
ttcctacaacttaatggaaa

SEQ ID NO: 4096250 - DNA, 17 bp, Homo sapiens
ttcctacagcactactg

SEQ ID NO: 4096251 - DNA, 23 bp, Homo sapiens
ttcctacagcactactgggtgtc

SEQ ID NO: 4096252 - DNA, 18 bp, Homo sapiens
ttcctacagccccttttt

SEQ ID NO: 4096253 - DNA, 17 bp, Homo sapiens
ttcctacccaaccactc

SEQ ID NO: 4096254 - DNA, 23 bp, Homo sapiens
ttcctacccacacctctgccaga

SEQ ID NO: 4096255 - DNA, 17 bp, Homo sapiens
ttcctaggtccaagccc

SEQ ID NO: 4096256 - DNA, 23 bp, Homo sapiens
ttcctatgcccaggtaccaccct

SEQ ID NO: 4096257 - DNA, 18 bp, Homo sapiens
ttcctattgtcattaaag

SEQ ID NO: 4096258 - DNA, 20 bp, Homo sapiens
ttcctcaaattttttgactt

SEQ ID NO: 4096259 - DNA, 23 bp, Homo sapiens
ttcctcacacccctgtcccaccc

SEQ ID NO: 4096260 - DNA, 15 bp, Homo sapiens
ttcctcagctgcctc

SEQ ID NO: 4096261 - DNA, 16 bp, Homo sapiens
ttcctcagcttatctc

SEQ ID NO: 4096262 - DNA, 19 bp, Homo sapiens
ttcctcagcttatctcttt

SEQ ID NO: 4096263 - DNA, 18 bp, Homo sapiens
ttcctcatccaccccatc

SEQ ID NO: 4096264 - DNA, 13 bp, Homo sapiens
ttcctccatccta

SEQ ID NO: 4096265 - DNA, 13 bp, Homo sapiens
ttcctcctcaggc

SEQ ID NO: 4096266 - DNA, 15 bp, Homo sapiens
ttcctcctctgccta

SEQ ID NO: 4096267 - DNA, 11 bp, Homo sapiens
ttcctcctgga

SEQ ID NO: 4096268 - DNA, 13 bp, Homo sapiens
ttcctcgcttctt

SEQ ID NO: 4096269 - DNA, 22 bp, Homo sapiens
ttcctctaggcaagcaggacct

SEQ ID NO: 4096270 - DNA, 23 bp, Homo sapiens
ttcctctaggcaagcaggacctg

SEQ ID NO: 4096271 - DNA, 15 bp, Homo sapiens
ttcctctccactgcc

SEQ ID NO: 4096272 - DNA, 14 bp, Homo sapiens
ttcctctctccaga

SEQ ID NO: 4096273 - DNA, 13 bp, Homo sapiens
ttcctctgagccc

SEQ ID NO: 4096274 - DNA, 12 bp, Homo sapiens
ttcctctgctcc

SEQ ID NO: 4096275 - DNA, 13 bp, Homo sapiens
ttcctctgctccc

SEQ ID NO: 4096276 - DNA, 14 bp, Homo sapiens
ttcctctggccgca

SEQ ID NO: 4096277 - DNA, 12 bp, Homo sapiens
ttcctctgggaa

SEQ ID NO: 4096278 - DNA, 12 bp, Homo sapiens
ttcctgaaagaa

SEQ ID NO: 4096279 - DNA, 17 bp, Homo sapiens
ttcctgaaagaaacagt

SEQ ID NO: 4096280 - DNA, 18 bp, Homo sapiens
ttcctgaaagaaacagtt

SEQ ID NO: 4096281 - DNA, 16 bp, Homo sapiens
ttcctgaagaaccagt

SEQ ID NO: 4096282 - DNA, 14 bp, Homo sapiens
ttcctgaaggggga

SEQ ID NO: 4096283 - DNA, 14 bp, Homo sapiens
ttcctgaatgaaat

SEQ ID NO: 4096284 - DNA, 16 bp, Homo sapiens
ttcctgacttgagtgt

SEQ ID NO: 4096285 - DNA, 17 bp, Homo sapiens
ttcctgataataattga

SEQ ID NO: 4096286 - DNA, 23 bp, Homo sapiens
ttcctgatgctgggcaatgaggc

SEQ ID NO: 4096287 - DNA, 17 bp, Homo sapiens
ttcctgcagccccagaa

SEQ ID NO: 4096288 - DNA, 15 bp, Homo sapiens
ttcctgccctgtcca

SEQ ID NO: 4096289 - DNA, 14 bp, Homo sapiens
ttcctgcccttccc

SEQ ID NO: 4096290 - DNA, 18 bp, Homo sapiens
ttcctgcccttccctctg

SEQ ID NO: 4096291 - DNA, 23 bp, Homo sapiens
ttcctgcccttccctctgggcac

SEQ ID NO: 4096292 - DNA, 16 bp, Homo sapiens
ttcctgcgtcctcctc

SEQ ID NO: 4096293 - DNA, 19 bp, Homo sapiens
ttcctgcgtcctcctcacc

SEQ ID NO: 4096294 - DNA, 16 bp, Homo sapiens
ttcctgctacaggagg

SEQ ID NO: 4096295 - DNA, 22 bp, Homo sapiens
ttcctggagttttgatttggtg

SEQ ID NO: 4096296 - DNA, 20 bp, Homo sapiens
ttcctggcaatagtgtgttc

SEQ ID NO: 4096297 - DNA, 22 bp, Homo sapiens
ttcctggcaatagtgtgttctg

SEQ ID NO: 4096298 - DNA, 11 bp, Homo sapiens
ttcctggctga

SEQ ID NO: 4096299 - DNA, 20 bp, Homo sapiens
ttcctggttttgtacactgc

SEQ ID NO: 4096300 - DNA, 22 bp, Homo sapiens
ttcctggttttgtacactgctg

SEQ ID NO: 4096301 - DNA, 14 bp, Homo sapiens
ttcctgtaacaggt

SEQ ID NO: 4096302 - DNA, 15 bp, Homo sapiens
ttcctgtccagctcc

SEQ ID NO: 4096303 - DNA, 22 bp, Homo sapiens
ttcctgtccagctccaacctgc

SEQ ID NO: 4096304 - DNA, 18 bp, Homo sapiens
ttcctgtccccaaaatgt

SEQ ID NO: 4096305 - DNA, 20 bp, Homo sapiens
ttcctgtccccaaaatgtga

SEQ ID NO: 4096306 - DNA, 13 bp, Homo sapiens
ttcctgtccctga

SEQ ID NO: 4096307 - DNA, 20 bp, Homo sapiens
ttcctgtgggtgttctttcc

SEQ ID NO: 4096308 - DNA, 19 bp, Homo sapiens
ttcctgtttcagacccccc

SEQ ID NO: 4096309 - DNA, 21 bp, Homo sapiens
ttcctgtttcagaccccccca

SEQ ID NO: 4096310 - DNA, 15 bp, Homo sapiens
ttccttaaactgtgt

SEQ ID NO: 4096311 - DNA, 23 bp, Homo sapiens
ttccttatgtatcagtgtccttt

SEQ ID NO: 4096312 - DNA, 20 bp, Homo sapiens
ttccttatttgcttcattgt

SEQ ID NO: 4096313 - DNA, 15 bp, Homo sapiens
ttccttcattcatag

SEQ ID NO: 4096314 - DNA, 15 bp, Homo sapiens
ttccagaaaggatat

SEQ ID NO: 4096315 - DNA, 18 bp, Homo sapiens
ttccagaagaagagaagc

SEQ ID NO: 4096316 - DNA, 22 bp, Homo sapiens
ttccagaagaagagaagctgct

SEQ ID NO: 4096317 - DNA, 20 bp, Homo sapiens
ttccagaatgctgaactcct

SEQ ID NO: 4096318 - DNA, 19 bp, Homo sapiens
ttccagaatgctgtacatc

SEQ ID NO: 4096319 - DNA, 17 bp, Homo sapiens
ttccagagagtggctcc

SEQ ID NO: 4096320 - DNA, 18 bp, Homo sapiens
ttccagagagtggctcct

SEQ ID NO: 4096321 - DNA, 20 bp, Homo sapiens
ttccagagagtggctcctcc

SEQ ID NO: 4096322 - DNA, 15 bp, Homo sapiens
ttccagcaataagaa

SEQ ID NO: 4096323 - DNA, 20 bp, Homo sapiens
ttccagcaataagaaatgaa

SEQ ID NO: 4096324 - DNA, 14 bp, Homo sapiens
ttccagcaattctc

SEQ ID NO: 4096325 - DNA, 16 bp, Homo sapiens
ttccagcagaagacaa

SEQ ID NO: 4096326 - DNA, 22 bp, Homo sapiens
ttccagcagaagacaaaaagac

SEQ ID NO: 4096327 - DNA, 11 bp, Homo sapiens
ttccagctgct

SEQ ID NO: 4096328 - DNA, 17 bp, Homo sapiens
ttccagcttcaggcacc

SEQ ID NO: 4096329 - DNA, 22 bp, Homo sapiens
ttccagcttcaggcaccagcat

SEQ ID NO: 4096330 - DNA, 21 bp, Homo sapiens
ttccaggaaactccacatctg

SEQ ID NO: 4096331 - DNA, 14 bp, Homo sapiens
ttccaggaattcct

SEQ ID NO: 4096332 - DNA, 16 bp, Homo sapiens
ttccaggcaccctcag

SEQ ID NO: 4096333 - DNA, 17 bp, Homo sapiens
ttccaggcccgaagcat

SEQ ID NO: 4096334 - DNA, 21 bp, Homo sapiens
ttccaggctaaacatccaata

SEQ ID NO: 4096335 - DNA, 23 bp, Homo sapiens
ttccaggcttccctgacttgctt

SEQ ID NO: 4096336 - DNA, 18 bp, Homo sapiens
ttccaggggaacctgcca

SEQ ID NO: 4096337 - DNA, 14 bp, Homo sapiens
ttccagtctcaaaa

SEQ ID NO: 4096338 - DNA, 20 bp, Homo sapiens
ttccagtttattccagagct

SEQ ID NO: 4096339 - DNA, 21 bp, Homo sapiens
ttccagtttctgtaaggtctt

SEQ ID NO: 4096340 - DNA, 17 bp, Homo sapiens
ttccataaggaatgtag

SEQ ID NO: 4096341 - DNA, 19 bp, Homo sapiens
ttccataatgtataaagaa

SEQ ID NO: 4096342 - DNA, 12 bp, Homo sapiens
ttccataattat

SEQ ID NO: 4096343 - DNA, 17 bp, Homo sapiens
ttccatagcaacaggaa

SEQ ID NO: 4096344 - DNA, 18 bp, Homo sapiens
ttccataggacatactgc

SEQ ID NO: 4096345 - DNA, 22 bp, Homo sapiens
ttccataggacatactgcatgt

SEQ ID NO: 4096346 - DNA, 15 bp, Homo sapiens
ttccatatcctggtg

SEQ ID NO: 4096347 - DNA, 15 bp, Homo sapiens
ttccatatggatttt

SEQ ID NO: 4096348 - DNA, 20 bp, Homo sapiens
ttccatatggattttctatt

SEQ ID NO: 4096349 - DNA, 13 bp, Homo sapiens
ttccatcatttta

SEQ ID NO: 4096350 - DNA, 19 bp, Homo sapiens
ttccatccacctttcccaa

SEQ ID NO: 4096351 - DNA, 21 bp, Homo sapiens
ttccatccatctttccatcca

SEQ ID NO: 4096352 - DNA, 21 bp, Homo sapiens
ttccatccattacctccatcc

SEQ ID NO: 4096353 - DNA, 22 bp, Homo sapiens
ttccatccattacctccatcca

SEQ ID NO: 4096354 - DNA, 15 bp, Homo sapiens
ttccatccctacccc

SEQ ID NO: 4096355 - DNA, 17 bp, Homo sapiens
ttccatcccttcctgaa

SEQ ID NO: 4096356 - DNA, 13 bp, Homo sapiens
ttccatgaaaacg

SEQ ID NO: 4096357 - DNA, 15 bp, Homo sapiens
ttccatgaaaacgtt

SEQ ID NO: 4096358 - DNA, 16 bp, Homo sapiens
ttccatgaaggcagag

SEQ ID NO: 4096359 - DNA, 15 bp, Homo sapiens
ttccatgaatgtatc

SEQ ID NO: 4096360 - DNA, 15 bp, Homo sapiens
ttccatgcctgaggg

SEQ ID NO: 4096361 - DNA, 22 bp, Homo sapiens
ttccatgcctgagggtggagac

SEQ ID NO: 4096362 - DNA, 14 bp, Homo sapiens
ttccatgtgccttt

SEQ ID NO: 4096363 - DNA, 22 bp, Homo sapiens
ttccatgtgcctttctttgcct

SEQ ID NO: 4096364 - DNA, 15 bp, Homo sapiens
ttccattagcatttg

SEQ ID NO: 4096365 - DNA, 23 bp, Homo sapiens
ttccattatacatcaattggaaa

SEQ ID NO: 4096366 - DNA, 15 bp, Homo sapiens
ttccattatgattct

SEQ ID NO: 4096367 - DNA, 18 bp, Homo sapiens
ttccattttcccccacta

SEQ ID NO: 4096368 - DNA, 16 bp, Homo sapiens
ttcccaataaaagtga

SEQ ID NO: 4096369 - DNA, 15 bp, Homo sapiens
ttcccacatctttcc

SEQ ID NO: 4096370 - DNA, 15 bp, Homo sapiens
ttcccaccaaggtct

SEQ ID NO: 4096371 - DNA, 14 bp, Homo sapiens
ttcccacccagcct

SEQ ID NO: 4096372 - DNA, 20 bp, Homo sapiens
ttcccacccctacacacaca

SEQ ID NO: 4096373 - DNA, 14 bp, Homo sapiens
ttcccacgaggaat

SEQ ID NO: 4096374 - DNA, 23 bp, Homo sapiens
ttcccacgtcttcttgctgcagc

SEQ ID NO: 4096375 - DNA, 12 bp, Homo sapiens
ttcccaggaccc

SEQ ID NO: 4096376 - DNA, 18 bp, Homo sapiens
ttcccaggttctgtttat

SEQ ID NO: 4096377 - DNA, 12 bp, Homo sapiens
ttcccataataa

SEQ ID NO: 4096378 - DNA, 17 bp, Homo sapiens
ttcccataataaagcaa

SEQ ID NO: 4096379 - DNA, 15 bp, Homo sapiens
ttcccataattttct

SEQ ID NO: 4096380 - DNA, 16 bp, Homo sapiens
ttcccataattttctt

SEQ ID NO: 4096381 - DNA, 18 bp, Homo sapiens
ttcccataattttcttca

SEQ ID NO: 4096382 - DNA, 15 bp, Homo sapiens
ttcccatgactgcac

SEQ ID NO: 4096383 - DNA, 14 bp, Homo sapiens
ttcccatttcttcc

SEQ ID NO: 4096384 - DNA, 19 bp, Homo sapiens
ttccccaccgcagtcacca

SEQ ID NO: 4096385 - DNA, 23 bp, Homo sapiens
ttccccactgacagcctcccacc

SEQ ID NO: 4096386 - DNA, 12 bp, Homo sapiens
ttccccagcatc

SEQ ID NO: 4096387 - DNA, 18 bp, Homo sapiens
ttccccagcatcactccc

SEQ ID NO: 4096388 - DNA, 20 bp, Homo sapiens
ttccccagcatcactcccca

SEQ ID NO: 4096389 - DNA, 18 bp, Homo sapiens
ttccccaggggaaaatga

SEQ ID NO: 4096390 - DNA, 23 bp, Homo sapiens
ttccccataactcaatggcctaa

SEQ ID NO: 4096391 - DNA, 15 bp, Homo sapiens
ttccccatctgggtc

SEQ ID NO: 4096392 - DNA, 18 bp, Homo sapiens
ttccccatcttctaaacc

SEQ ID NO: 4096393 - DNA, 11 bp, Homo sapiens
ttccccatggg

SEQ ID NO: 4096394 - DNA, 18 bp, Homo sapiens
ttcccccaacctcagact

SEQ ID NO: 4096395 - DNA, 19 bp, Homo sapiens
ttcccccaccagctgcagc

SEQ ID NO: 4096396 - DNA, 18 bp, Homo sapiens
ttcccccactactgcagc

SEQ ID NO: 4096397 - DNA, 23 bp, Homo sapiens
ttcccccagcaacgcccctccaa

SEQ ID NO: 4096398 - DNA, 21 bp, Homo sapiens
ttcccccagtacctccaagca

SEQ ID NO: 4096399 - DNA, 18 bp, Homo sapiens
ttccccccactctcccca

SEQ ID NO: 4096400 - DNA, 19 bp, Homo sapiens
ttcccccgagctcttggcc

SEQ ID NO: 4096401 - DNA, 19 bp, Homo sapiens
ttcccctcactggatgaaa

SEQ ID NO: 4096402 - DNA, 15 bp, Homo sapiens
ttcccctctgctgct

SEQ ID NO: 4096403 - DNA, 18 bp, Homo sapiens
ttcccctctgctgctgtc

SEQ ID NO: 4096404 - DNA, 17 bp, Homo sapiens
ttccccttactctcaca

SEQ ID NO: 4096405 - DNA, 13 bp, Homo sapiens
ttccccttccttc

SEQ ID NO: 4096406 - DNA, 17 bp, Homo sapiens
ttcccctttccccactc

SEQ ID NO: 4096407 - DNA, 14 bp, Homo sapiens
ttcccctttcctgt

SEQ ID NO: 4096408 - DNA, 15 bp, Homo sapiens
ttcccctttcctgtc

SEQ ID NO: 4096409 - DNA, 19 bp, Homo sapiens
ttcccctttcctgtcccac

SEQ ID NO: 4096410 - DNA, 16 bp, Homo sapiens
ttccccttttgccaat

SEQ ID NO: 4096411 - DNA, 14 bp, Homo sapiens
ttcccgtttctcca

SEQ ID NO: 4096412 - DNA, 15 bp, Homo sapiens
ttcccgtttctccac

SEQ ID NO: 4096413 - DNA, 19 bp, Homo sapiens
ttccctaaaatacatttaa

SEQ ID NO: 4096414 - DNA, 22 bp, Homo sapiens
ttccctaaaatacatttaaaac

SEQ ID NO: 4096415 - DNA, 15 bp, Homo sapiens
ttccctacctcaggc

SEQ ID NO: 4096416 - DNA, 21 bp, Homo sapiens
ttccctcaccttggcaccaga

SEQ ID NO: 4096417 - DNA, 17 bp, Homo sapiens
ttcagtccaataggtgt

SEQ ID NO: 4096418 - DNA, 19 bp, Homo sapiens
ttcagtgaaaagattttat

SEQ ID NO: 4096419 - DNA, 19 bp, Homo sapiens
ttcagtggcttcccagctc

SEQ ID NO: 4096420 - DNA, 16 bp, Homo sapiens
ttcagtgtagttaatt

SEQ ID NO: 4096421 - DNA, 19 bp, Homo sapiens
ttcagtgtagttaatttat

SEQ ID NO: 4096422 - DNA, 16 bp, Homo sapiens
ttcagtgtcccaggca

SEQ ID NO: 4096423 - DNA, 18 bp, Homo sapiens
ttcagtgtcccaggcagc

SEQ ID NO: 4096424 - DNA, 18 bp, Homo sapiens
ttcagtgttacctgtgtg

SEQ ID NO: 4096425 - DNA, 16 bp, Homo sapiens
ttcagttgatcactgg

SEQ ID NO: 4096426 - DNA, 18 bp, Homo sapiens
ttcagttgatcactggca

SEQ ID NO: 4096427 - DNA, 15 bp, Homo sapiens
ttcagtttttgtatc

SEQ ID NO: 4096428 - DNA, 12 bp, Homo sapiens
ttcataaatgaa

SEQ ID NO: 4096429 - DNA, 15 bp, Homo sapiens
ttcataaatgaattt

SEQ ID NO: 4096430 - DNA, 12 bp, Homo sapiens
ttcataaccaac

SEQ ID NO: 4096431 - DNA, 16 bp, Homo sapiens
ttcataaccaacaata

SEQ ID NO: 4096432 - DNA, 13 bp, Homo sapiens
ttcataattaaaa

SEQ ID NO: 4096433 - DNA, 15 bp, Homo sapiens
ttcatagctccttgg

SEQ ID NO: 4096434 - DNA, 20 bp, Homo sapiens
ttcatagggaaaggttttgt

SEQ ID NO: 4096435 - DNA, 21 bp, Homo sapiens
ttcatagggaaaggttttgta

SEQ ID NO: 4096436 - DNA, 22 bp, Homo sapiens
ttcatagggaaaggttttgtat

SEQ ID NO: 4096437 - DNA, 17 bp, Homo sapiens
ttcatagtaacttctta

SEQ ID NO: 4096438 - DNA, 19 bp, Homo sapiens
ttcatagttcagaatttag

SEQ ID NO: 4096439 - DNA, 18 bp, Homo sapiens
ttcatatgttgctcagtc

SEQ ID NO: 4096440 - DNA, 21 bp, Homo sapiens
ttcatcaatatccctcttgta

SEQ ID NO: 4096441 - DNA, 13 bp, Homo sapiens
ttcatcagcattt

SEQ ID NO: 4096442 - DNA, 18 bp, Homo sapiens
ttcatcatcctaagctat

SEQ ID NO: 4096443 - DNA, 21 bp, Homo sapiens
ttcatcatcctaagctattca

SEQ ID NO: 4096444 - DNA, 19 bp, Homo sapiens
ttcatcattccctctcatc

SEQ ID NO: 4096445 - DNA, 20 bp, Homo sapiens
ttcatcattccctctcatct

SEQ ID NO: 4096446 - DNA, 20 bp, Homo sapiens
ttcatccaacttatgttttt

SEQ ID NO: 4096447 - DNA, 20 bp, Homo sapiens
ttcatccaatcctcactggg

SEQ ID NO: 4096448 - DNA, 16 bp, Homo sapiens
ttcatccagagttctt

SEQ ID NO: 4096449 - DNA, 15 bp, Homo sapiens
ttcatccagcagtgt

SEQ ID NO: 4096450 - DNA, 22 bp, Homo sapiens
ttcatccaggcccaactgtgag

SEQ ID NO: 4096451 - DNA, 23 bp, Homo sapiens
ttcatccagtttgttctccgggt

SEQ ID NO: 4096452 - DNA, 16 bp, Homo sapiens
ttcatcctattgttga

SEQ ID NO: 4096453 - DNA, 12 bp, Homo sapiens
ttcatcctttca

SEQ ID NO: 4096454 - DNA, 15 bp, Homo sapiens
ttcatcctttcactt

SEQ ID NO: 4096455 - DNA, 20 bp, Homo sapiens
ttcatcctttcacttctttc

SEQ ID NO: 4096456 - DNA, 22 bp, Homo sapiens
ttcatctcccacctagcagcac

SEQ ID NO: 4096457 - DNA, 11 bp, Homo sapiens
ttcatctggtt

SEQ ID NO: 4096458 - DNA, 21 bp, Homo sapiens
ttcatcttttgaggcttctgt

SEQ ID NO: 4096459 - DNA, 17 bp, Homo sapiens
ttcatgatttcatttca

SEQ ID NO: 4096460 - DNA, 23 bp, Homo sapiens
ttcatgatttcatttcaactgtt

SEQ ID NO: 4096461 - DNA, 19 bp, Homo sapiens
ttcatgccaccatggccag

SEQ ID NO: 4096462 - DNA, 16 bp, Homo sapiens
ttcatgcctttcatag

SEQ ID NO: 4096463 - DNA, 18 bp, Homo sapiens
ttcatgcctttgtaagtt

SEQ ID NO: 4096464 - DNA, 21 bp, Homo sapiens
ttcatgcctttgtaagttatt

SEQ ID NO: 4096465 - DNA, 17 bp, Homo sapiens
ttcatgctcagccctga

SEQ ID NO: 4096466 - DNA, 18 bp, Homo sapiens
ttcatgtaatcctcaaga

SEQ ID NO: 4096467 - DNA, 17 bp, Homo sapiens
ttcatgtacaagatgaa

SEQ ID NO: 4096468 - DNA, 20 bp, Homo sapiens
ttcatgtagagaaaagcaca

SEQ ID NO: 4096469 - DNA, 16 bp, Homo sapiens
ttcatgtgcctctgcg

SEQ ID NO: 4096470 - DNA, 20 bp, Homo sapiens
ttcatgtgggatcccatctt

SEQ ID NO: 4096471 - DNA, 22 bp, Homo sapiens
ttcatgtgggatcccatctttt

SEQ ID NO: 4096472 - DNA, 13 bp, Homo sapiens
ttcattattggaa

SEQ ID NO: 4096473 - DNA, 20 bp, Homo sapiens
ttcattattggaattaacct

SEQ ID NO: 4096474 - DNA, 15 bp, Homo sapiens
ttcattattttgtgg

SEQ ID NO: 4096475 - DNA, 21 bp, Homo sapiens
ttcattcaatattgacatttg

SEQ ID NO: 4096476 - DNA, 21 bp, Homo sapiens
ttcattccattgcctagctct

SEQ ID NO: 4096477 - DNA, 18 bp, Homo sapiens
ttcattctcataattcct

SEQ ID NO: 4096478 - DNA, 12 bp, Homo sapiens
ttcattctgcat

SEQ ID NO: 4096479 - DNA, 14 bp, Homo sapiens
ttcattctgcattg

SEQ ID NO: 4096480 - DNA, 18 bp, Homo sapiens
ttcattgagttggttact

SEQ ID NO: 4096481 - DNA, 22 bp, Homo sapiens
ttcattgagttggttacttcat

SEQ ID NO: 4096482 - DNA, 17 bp, Homo sapiens
ttcattgtaatgttact

SEQ ID NO: 4096483 - DNA, 20 bp, Homo sapiens
ttcattgtaatgttactgat

SEQ ID NO: 4096484 - DNA, 13 bp, Homo sapiens
ttcatttaaaatg

SEQ ID NO: 4096485 - DNA, 17 bp, Homo sapiens
ttcatttaaaatgatta

SEQ ID NO: 4096486 - DNA, 19 bp, Homo sapiens
ttcatttagtcatgtgacc

SEQ ID NO: 4096487 - DNA, 15 bp, Homo sapiens
ttcatttcaactgtt

SEQ ID NO: 4096488 - DNA, 18 bp, Homo sapiens
ttcatttcttgtcaatta

SEQ ID NO: 4096489 - DNA, 17 bp, Homo sapiens
ttcattttcatcactgg

SEQ ID NO: 4096490 - DNA, 14 bp, Homo sapiens
ttcattttcctgtt

SEQ ID NO: 4096491 - DNA, 23 bp, Homo sapiens
ttcattttctgacatgcattgtt

SEQ ID NO: 4096492 - DNA, 23 bp, Homo sapiens
ttcatttttttcactggagttac

SEQ ID NO: 4096493 - DNA, 21 bp, Homo sapiens
ttccaaaaagattttcagaaa

SEQ ID NO: 4096494 - DNA, 12 bp, Homo sapiens
ttccaaaataat

SEQ ID NO: 4096495 - DNA, 16 bp, Homo sapiens
ttccaaaattcttatt

SEQ ID NO: 4096496 - DNA, 22 bp, Homo sapiens
ttccaaagagtagaattgcatt

SEQ ID NO: 4096497 - DNA, 20 bp, Homo sapiens
ttccaaagcagagagcatta

SEQ ID NO: 4096498 - DNA, 16 bp, Homo sapiens
ttccaaagctttatta

SEQ ID NO: 4096499 - DNA, 17 bp, Homo sapiens
ttccaaatgcaatttga

SEQ ID NO: 4096500 - DNA, 14 bp, Homo sapiens
ttccaaattcagtt

SEQ ID NO: 4096501 - DNA, 12 bp, Homo sapiens
ttccaacaccac

SEQ ID NO: 4096502 - DNA, 19 bp, Homo sapiens
ttccaacaccacagacaca

SEQ ID NO: 4096503 - DNA, 12 bp, Homo sapiens
ttccaagacatt

SEQ ID NO: 4096504 - DNA, 14 bp, Homo sapiens
ttccaagacattgt

SEQ ID NO: 4096505 - DNA, 20 bp, Homo sapiens
ttccaagacattgtcaataa

SEQ ID NO: 4096506 - DNA, 15 bp, Homo sapiens
ttccaagcttcatat

SEQ ID NO: 4096507 - DNA, 14 bp, Homo sapiens
ttccaatcttgctt

SEQ ID NO: 4096508 - DNA, 16 bp, Homo sapiens
ttccaatcttgctttg

SEQ ID NO: 4096509 - DNA, 22 bp, Homo sapiens
ttccacaccttttattgacaca

SEQ ID NO: 4096510 - DNA, 16 bp, Homo sapiens
ttccacagttgccacc

SEQ ID NO: 4096511 - DNA, 17 bp, Homo sapiens
ttccacagttgccacca

SEQ ID NO: 4096512 - DNA, 21 bp, Homo sapiens
ttccacagttgccaccacctc

SEQ ID NO: 4096513 - DNA, 14 bp, Homo sapiens
ttccaccaggccgt

SEQ ID NO: 4096514 - DNA, 19 bp, Homo sapiens
ttccacgatgaaaaacttc

SEQ ID NO: 4096515 - DNA, 18 bp, Homo sapiens
ttccactaaaaatattgt

SEQ ID NO: 4096516 - DNA, 18 bp, Homo sapiens
ttccactacacctggctg

SEQ ID NO: 4096517 - DNA, 14 bp, Homo sapiens
ttccacttcttcct

SEQ ID NO: 4096518 - DNA, 15 bp, Homo sapiens
ttccacttcttcctt

SEQ ID NO: 4096519 - DNA, 20 bp, Homo sapiens
ttccacttcttcctttctct

SEQ ID NO: 4096520 - DNA, 16 bp, Homo sapiens
ttcaataaagcattta

SEQ ID NO: 4096521 - DNA, 17 bp, Homo sapiens
ttcaatatattgaactt

SEQ ID NO: 4096522 - DNA, 18 bp, Homo sapiens
ttcaatatattgaacttt

SEQ ID NO: 4096523 - DNA, 11 bp, Homo sapiens
ttcaatattta

SEQ ID NO: 4096524 - DNA, 22 bp, Homo sapiens
ttcaatccagagagcttaaatt

SEQ ID NO: 4096525 - DNA, 20 bp, Homo sapiens
ttcaatgacttctaatttat

SEQ ID NO: 4096526 - DNA, 17 bp, Homo sapiens
ttcacagctcctcccac

SEQ ID NO: 4096527 - DNA, 23 bp, Homo sapiens
ttcacaggggttcccttctctca

SEQ ID NO: 4096528 - DNA, 20 bp, Homo sapiens
ttcacagttctttgggccag

SEQ ID NO: 4096529 - DNA, 21 bp, Homo sapiens
ttcacagttctttgggccaga

SEQ ID NO: 4096530 - DNA, 18 bp, Homo sapiens
ttcacccatcttatcaag

SEQ ID NO: 4096531 - DNA, 21 bp, Homo sapiens
ttcaccccctgagatcccctg

SEQ ID NO: 4096532 - DNA, 12 bp, Homo sapiens
ttcacctctatc

SEQ ID NO: 4096533 - DNA, 14 bp, Homo sapiens
ttcacctctatcca

SEQ ID NO: 4096534 - DNA, 18 bp, Homo sapiens
ttcacctgggccctggag

SEQ ID NO: 4096535 - DNA, 22 bp, Homo sapiens
ttcacctgtttttaagctgttt

SEQ ID NO: 4096536 - DNA, 14 bp, Homo sapiens
ttcacgcccttggc

SEQ ID NO: 4096537 - DNA, 15 bp, Homo sapiens
ttcacgctcacccag

SEQ ID NO: 4096538 - DNA, 13 bp, Homo sapiens
ttcactaaagcag

SEQ ID NO: 4096539 - DNA, 14 bp, Homo sapiens
ttcactaaagcagt

SEQ ID NO: 4096540 - DNA, 18 bp, Homo sapiens
ttcactatcttcttcaaa

SEQ ID NO: 4096541 - DNA, 20 bp, Homo sapiens
ttcactatttttatttatat

SEQ ID NO: 4096542 - DNA, 15 bp, Homo sapiens
ttcactcaagcactg

SEQ ID NO: 4096543 - DNA, 13 bp, Homo sapiens
ttcactctctgaa

SEQ ID NO: 4096544 - DNA, 16 bp, Homo sapiens
ttcactgagctcccca

SEQ ID NO: 4096545 - DNA, 18 bp, Homo sapiens
ttcactgagctccccaga

SEQ ID NO: 4096546 - DNA, 15 bp, Homo sapiens
ttcactgctggctgc

SEQ ID NO: 4096547 - DNA, 16 bp, Homo sapiens
ttcactgctggctgcc

SEQ ID NO: 4096548 - DNA, 17 bp, Homo sapiens
ttcactggagttacatt

SEQ ID NO: 4096549 - DNA, 22 bp, Homo sapiens
ttcactggcccctactttgtgg

SEQ ID NO: 4096550 - DNA, 16 bp, Homo sapiens
ttcactgtataaatag

SEQ ID NO: 4096551 - DNA, 18 bp, Homo sapiens
ttcactgtataaatagga

SEQ ID NO: 4096552 - DNA, 19 bp, Homo sapiens
ttcactgtataaataggag

SEQ ID NO: 4096553 - DNA, 22 bp, Homo sapiens
ttcactgtataaataggagagg

SEQ ID NO: 4096554 - DNA, 23 bp, Homo sapiens
ttcactgtataaataggagagga

SEQ ID NO: 4096555 - DNA, 16 bp, Homo sapiens
ttcactgtctttaatt

SEQ ID NO: 4096556 - DNA, 22 bp, Homo sapiens
ttcacttagaacctttctgtgt

SEQ ID NO: 4096557 - DNA, 20 bp, Homo sapiens
ttcacttcgggctgtgtaaa

SEQ ID NO: 4096558 - DNA, 22 bp, Homo sapiens
ttcacttctttcccttcctcca

SEQ ID NO: 4096559 - DNA, 15 bp, Homo sapiens
ttcacttgcactggg

SEQ ID NO: 4096560 - DNA, 17 bp, Homo sapiens
ttcactttcaaaaacat

SEQ ID NO: 4096561 - DNA, 19 bp, Homo sapiens
ttcactttcacatagatgt

SEQ ID NO: 4096562 - DNA, 17 bp, Homo sapiens
ttcacttttgttctgct

SEQ ID NO: 4096563 - DNA, 14 bp, Homo sapiens
ttcagaaaaagaaa

SEQ ID NO: 4096564 - DNA, 20 bp, Homo sapiens
ttcagaaattggaacagaat

SEQ ID NO: 4096565 - DNA, 16 bp, Homo sapiens
ttcagaacctcttccc

SEQ ID NO: 4096566 - DNA, 11 bp, Homo sapiens
ttcagaagacc

SEQ ID NO: 4096567 - DNA, 16 bp, Homo sapiens
ttcagaagcaagccag

SEQ ID NO: 4096568 - DNA, 18 bp, Homo sapiens
ttcagaagcaagccagac

SEQ ID NO: 4096569 - DNA, 17 bp, Homo sapiens
ttcagaattaaactttt

SEQ ID NO: 4096570 - DNA, 13 bp, Homo sapiens
ttcagaatttagt

SEQ ID NO: 4096571 - DNA, 15 bp, Homo sapiens
ttcagacccctgcct

SEQ ID NO: 4096572 - DNA, 18 bp, Homo sapiens
ttcagacccctgcctgga

SEQ ID NO: 4096573 - DNA, 20 bp, Homo sapiens
ttcagactcccattcctgaa

SEQ ID NO: 4096574 - DNA, 21 bp, Homo sapiens
ttcagactcccattcctgaag

SEQ ID NO: 4096575 - DNA, 14 bp, Homo sapiens
ttcagagccaagcc

SEQ ID NO: 4096576 - DNA, 17 bp, Homo sapiens
ttcagagccaagcctta

SEQ ID NO: 4096577 - DNA, 21 bp, Homo sapiens
ttcagagccaagccttaaact

SEQ ID NO: 4096578 - DNA, 22 bp, Homo sapiens
ttcagagccaagccttaaactg

SEQ ID NO: 4096579 - DNA, 21 bp, Homo sapiens
ttcagagtacgtcctgcctgg

SEQ ID NO: 4096580 - DNA, 22 bp, Homo sapiens
ttcagagtacgtcctgcctggc

SEQ ID NO: 4096581 - DNA, 23 bp, Homo sapiens
ttcagagtacgtcctgcctggca

SEQ ID NO: 4096582 - DNA, 16 bp, Homo sapiens
ttcagatatatttttc

SEQ ID NO: 4096583 - DNA, 14 bp, Homo sapiens
ttcagatatcaaaa

SEQ ID NO: 4096584 - DNA, 19 bp, Homo sapiens
ttcagatatcaaaattcta

SEQ ID NO: 4096585 - DNA, 18 bp, Homo sapiens
ttcagatcactgaattta

SEQ ID NO: 4096586 - DNA, 13 bp, Homo sapiens
ttcagattgtctt

SEQ ID NO: 4096587 - DNA, 12 bp, Homo sapiens
ttcagatttggc

SEQ ID NO: 4096588 - DNA, 14 bp, Homo sapiens
ttcagcacccccac

SEQ ID NO: 4096589 - DNA, 15 bp, Homo sapiens
ttcagcactgtccct

SEQ ID NO: 4096590 - DNA, 16 bp, Homo sapiens
ttcagcactgtccctt

SEQ ID NO: 4096591 - DNA, 12 bp, Homo sapiens
ttcagcaggcag

SEQ ID NO: 4096592 - DNA, 23 bp, Homo sapiens
ttcagcatccgcaggtgctggtc

SEQ ID NO: 4096593 - DNA, 21 bp, Homo sapiens
ttcagccatcaacaagagttg

SEQ ID NO: 4096594 - DNA, 15 bp, Homo sapiens
ttcagcccccagccc

SEQ ID NO: 4096595 - DNA, 11 bp, Homo sapiens
ttcagcctggc

SEQ ID NO: 4096596 - DNA, 13 bp, Homo sapiens
ttcagcctggcct

SEQ ID NO: 4096597 - DNA, 16 bp, Homo sapiens
ttcagcctggcctgcc

SEQ ID NO: 4096598 - DNA, 20 bp, Homo sapiens
ttcagctaagggaagacatt

SEQ ID NO: 4096599 - DNA, 17 bp, Homo sapiens
ttcagctatacctgcac

SEQ ID NO: 4096600 - DNA, 18 bp, Homo sapiens
ttcagctcccccaggctg

SEQ ID NO: 4096601 - DNA, 13 bp, Homo sapiens
ttcagctcttttt

SEQ ID NO: 4096602 - DNA, 23 bp, Homo sapiens
ttcagctgcctgaaacagccatg

SEQ ID NO: 4096603 - DNA, 21 bp, Homo sapiens
ttcaggatactctgtcagatg

SEQ ID NO: 4096604 - DNA, 14 bp, Homo sapiens
ttcaggcaccagca

SEQ ID NO: 4096605 - DNA, 15 bp, Homo sapiens
ttcaggctcttctcc

SEQ ID NO: 4096606 - DNA, 21 bp, Homo sapiens
ttcaggcttcctgcaattttc

SEQ ID NO: 4096607 - DNA, 22 bp, Homo sapiens
ttcaggcttcctgcaattttct

SEQ ID NO: 4096608 - DNA, 23 bp, Homo sapiens
ttcagggccagtcctcctgggag

SEQ ID NO: 4096609 - DNA, 23 bp, Homo sapiens
ttcaggggactcagccctgaggt

SEQ ID NO: 4096610 - DNA, 15 bp, Homo sapiens
ttcaggggctggggg

SEQ ID NO: 4096611 - DNA, 15 bp, Homo sapiens
ttcagggtttaatag

SEQ ID NO: 4096612 - DNA, 20 bp, Homo sapiens
ttcaggtcccacgtctggcc

SEQ ID NO: 4096613 - DNA, 17 bp, Homo sapiens
ttcaggtgacatgtgaa

SEQ ID NO: 4096614 - DNA, 20 bp, Homo sapiens
ttcaggtggatgaggagaca

SEQ ID NO: 4096615 - DNA, 20 bp, Homo sapiens
ttcaggttatcgaaataaca

SEQ ID NO: 4096616 - DNA, 21 bp, Homo sapiens
ttcaggttatcgaaataacaa

SEQ ID NO: 4096617 - DNA, 24 bp, Homo sapiens
ttcaggttatcgaaataacaatgt

SEQ ID NO: 4096618 - DNA, 22 bp, Homo sapiens
ttcagtaaacaacttgtacttg

SEQ ID NO: 4096619 - DNA, 19 bp, Homo sapiens
ttcagtaaacataaagcca

SEQ ID NO: 4096620 - DNA, 22 bp, Homo sapiens
ttcagtaccctctcagctccag

SEQ ID NO: 4096621 - DNA, 16 bp, Homo sapiens
ttcagtataatttaac

SEQ ID NO: 4096622 - DNA, 20 bp, Homo sapiens
ttcagtcagaaaactttaaa

SEQ ID NO: 4096623 - DNA, 16 bp, Homo sapiens
ttagctgcacggcatt

SEQ ID NO: 4096624 - DNA, 13 bp, Homo sapiens
ttagctgtaacag

SEQ ID NO: 4096625 - DNA, 12 bp, Homo sapiens
ttagctttgtgt

SEQ ID NO: 4096626 - DNA, 18 bp, Homo sapiens
ttagctttttaaaacatt

SEQ ID NO: 4096627 - DNA, 15 bp, Homo sapiens
ttaggaacagcagtg

SEQ ID NO: 4096628 - DNA, 22 bp, Homo sapiens
ttaggaacagcagtgttctcac

SEQ ID NO: 4096629 - DNA, 23 bp, Homo sapiens
ttaggaacagcagtgttctcaca

SEQ ID NO: 4096630 - DNA, 17 bp, Homo sapiens
ttaggaacttcagagat

SEQ ID NO: 4096631 - DNA, 15 bp, Homo sapiens
ttaggaagagaaacc

SEQ ID NO: 4096632 - DNA, 19 bp, Homo sapiens
ttaggaattaagttatctt

SEQ ID NO: 4096633 - DNA, 13 bp, Homo sapiens
ttaggactagaag

SEQ ID NO: 4096634 - DNA, 19 bp, Homo sapiens
ttaggagggagttatctaa

SEQ ID NO: 4096635 - DNA, 14 bp, Homo sapiens
ttaggatttaacag

SEQ ID NO: 4096636 - DNA, 21 bp, Homo sapiens
ttaggatttaacagtcattta

SEQ ID NO: 4096637 - DNA, 15 bp, Homo sapiens
ttaggcagattgaaa

SEQ ID NO: 4096638 - DNA, 17 bp, Homo sapiens
ttaggccagcaacgctt

SEQ ID NO: 4096639 - DNA, 15 bp, Homo sapiens
ttaggcgtgggctga

SEQ ID NO: 4096640 - DNA, 23 bp, Homo sapiens
ttaggcgtgggctgaccaggctt

SEQ ID NO: 4096641 - DNA, 14 bp, Homo sapiens
ttagggcttttatt

SEQ ID NO: 4096642 - DNA, 17 bp, Homo sapiens
ttagggcttttattttt

SEQ ID NO: 4096643 - DNA, 14 bp, Homo sapiens
ttagggtacattta

SEQ ID NO: 4096644 - DNA, 15 bp, Homo sapiens
ttagggtacatttat

SEQ ID NO: 4096645 - DNA, 21 bp, Homo sapiens
ttagggtgaaccacttcattc

SEQ ID NO: 4096646 - DNA, 22 bp, Homo sapiens
ttaggtaaccttatatttacaa

SEQ ID NO: 4096647 - DNA, 17 bp, Homo sapiens
ttaggtaatttttttca

SEQ ID NO: 4096648 - DNA, 14 bp, Homo sapiens
ttaggtagaaaaac

SEQ ID NO: 4096649 - DNA, 15 bp, Homo sapiens
ttaggtagaaaaaca

SEQ ID NO: 4096650 - DNA, 19 bp, Homo sapiens
ttaggtccctcactccaca

SEQ ID NO: 4096651 - DNA, 16 bp, Homo sapiens
ttagtaaatgtctttg

SEQ ID NO: 4096652 - DNA, 17 bp, Homo sapiens
ttagtaaatgtctttgt

SEQ ID NO: 4096653 - DNA, 21 bp, Homo sapiens
ttagtaaatgtctttgtaagt

SEQ ID NO: 4096654 - DNA, 13 bp, Homo sapiens
ttagtagcatgtt

SEQ ID NO: 4096655 - DNA, 15 bp, Homo sapiens
ttagtaggtcctcaa

SEQ ID NO: 4096656 - DNA, 17 bp, Homo sapiens
ttagtatctaacatgta

SEQ ID NO: 4096657 - DNA, 23 bp, Homo sapiens
ttagtatctaacatgtatcccaa

SEQ ID NO: 4096658 - DNA, 22 bp, Homo sapiens
ttagtatttatttaatgttatg

SEQ ID NO: 4096659 - DNA, 18 bp, Homo sapiens
ttagtcatccaacaagaa

SEQ ID NO: 4096660 - DNA, 22 bp, Homo sapiens
ttagtctcagtttgtgtgtctt

SEQ ID NO: 4096661 - DNA, 13 bp, Homo sapiens
ttagtcttctcat

SEQ ID NO: 4096662 - DNA, 18 bp, Homo sapiens
ttagtcttctcatagcat

SEQ ID NO: 4096663 - DNA, 23 bp, Homo sapiens
ttagtggatttttttgtcattaa

SEQ ID NO: 4096664 - DNA, 16 bp, Homo sapiens
ttagtgggccagggct

SEQ ID NO: 4096665 - DNA, 14 bp, Homo sapiens
ttagtgtcacttac

SEQ ID NO: 4096666 - DNA, 14 bp, Homo sapiens
ttagttaatggatt

SEQ ID NO: 4096667 - DNA, 20 bp, Homo sapiens
ttagttataaatagccttca

SEQ ID NO: 4096668 - DNA, 22 bp, Homo sapiens
ttagttctagctctatttactt

SEQ ID NO: 4096669 - DNA, 15 bp, Homo sapiens
ttagttctttgttat

SEQ ID NO: 4096670 - DNA, 19 bp, Homo sapiens
ttagttctttttgccagtt

SEQ ID NO: 4096671 - DNA, 19 bp, Homo sapiens
ttagttgacaacctagaat

SEQ ID NO: 4096672 - DNA, 17 bp, Homo sapiens
ttagttggctggaaact

SEQ ID NO: 4096673 - DNA, 12 bp, Homo sapiens
ttagtttacaat

SEQ ID NO: 4096674 - DNA, 15 bp, Homo sapiens
ttagtttacaatatt

SEQ ID NO: 4096675 - DNA, 17 bp, Homo sapiens
ttagttttagttgcaga

SEQ ID NO: 4096676 - DNA, 18 bp, Homo sapiens
ttagttttgcttttagtt

SEQ ID NO: 4096677 - DNA, 12 bp, Homo sapiens
ttataaacacat

SEQ ID NO: 4096678 - DNA, 21 bp, Homo sapiens
ttataaacagacaatatgtga

SEQ ID NO: 4096679 - DNA, 15 bp, Homo sapiens
ttataaatatattta

SEQ ID NO: 4096680 - DNA, 21 bp, Homo sapiens
ttataaatcatattgatgaaa

SEQ ID NO: 4096681 - DNA, 23 bp, Homo sapiens
ttataaatcatattgatgaaaag

SEQ ID NO: 4096682 - DNA, 17 bp, Homo sapiens
ttataacagcattcttg

SEQ ID NO: 4096683 - DNA, 15 bp, Homo sapiens
ttataaccccagcct

SEQ ID NO: 4096684 - DNA, 20 bp, Homo sapiens
ttataactcatcataaaata

SEQ ID NO: 4096685 - DNA, 13 bp, Homo sapiens
ttataacttaaaa

SEQ ID NO: 4096686 - DNA, 14 bp, Homo sapiens
ttataagcagattt

SEQ ID NO: 4096687 - DNA, 16 bp, Homo sapiens
ttataagcagatttaa

SEQ ID NO: 4096688 - DNA, 12 bp, Homo sapiens
ttataagcattg

SEQ ID NO: 4096689 - DNA, 17 bp, Homo sapiens
ttataagcattgaaatt

SEQ ID NO: 4096690 - DNA, 14 bp, Homo sapiens
ttataagggagagc

SEQ ID NO: 4096691 - DNA, 21 bp, Homo sapiens
ttataagggagagctgagcca

SEQ ID NO: 4096692 - DNA, 21 bp, Homo sapiens
ttataaggtagtactgatttt

SEQ ID NO: 4096693 - DNA, 22 bp, Homo sapiens
ttataaggtagtactgatttta

SEQ ID NO: 4096694 - DNA, 17 bp, Homo sapiens
ttataagtgaagtgata

SEQ ID NO: 4096695 - DNA, 17 bp, Homo sapiens
ttataagttcacaaaat

SEQ ID NO: 4096696 - DNA, 17 bp, Homo sapiens
ttataataaaaggaaaa

SEQ ID NO: 4096697 - DNA, 18 bp, Homo sapiens
ttataataaaggactgta

SEQ ID NO: 4096698 - DNA, 19 bp, Homo sapiens
ttataataaaggactgtaa

SEQ ID NO: 4096699 - DNA, 15 bp, Homo sapiens
ttataataatgttaa

SEQ ID NO: 4096700 - DNA, 11 bp, Homo sapiens
ttataatagca

SEQ ID NO: 4096701 - DNA, 20 bp, Homo sapiens
ttataatcttccatacttct

SEQ ID NO: 4096702 - DNA, 16 bp, Homo sapiens
ttataatttttttcaa

SEQ ID NO: 4096703 - DNA, 15 bp, Homo sapiens
ttatacaatatcatc

SEQ ID NO: 4096704 - DNA, 21 bp, Homo sapiens
ttatacagctgtattgtctga

SEQ ID NO: 4096705 - DNA, 14 bp, Homo sapiens
ttatacattagtaa

SEQ ID NO: 4096706 - DNA, 16 bp, Homo sapiens
ttatacattagtaaat

SEQ ID NO: 4096707 - DNA, 23 bp, Homo sapiens
ttatacattagtaaatgtctttg

SEQ ID NO: 4096708 - DNA, 19 bp, Homo sapiens
ttatacctcaaactatctg

SEQ ID NO: 4096709 - DNA, 21 bp, Homo sapiens
ttatacgctggcaacacagag

SEQ ID NO: 4096710 - DNA, 11 bp, Homo sapiens
ttatactaact

SEQ ID NO: 4096711 - DNA, 12 bp, Homo sapiens
ttatactaagaa

SEQ ID NO: 4096712 - DNA, 17 bp, Homo sapiens
ttatactgaatataaaa

SEQ ID NO: 4096713 - DNA, 22 bp, Homo sapiens
ttatactgtacttaataaattc

SEQ ID NO: 4096714 - DNA, 16 bp, Homo sapiens
ttatactgtgaagtta

SEQ ID NO: 4096715 - DNA, 20 bp, Homo sapiens
ttatagaataaaagctgtgg

SEQ ID NO: 4096716 - DNA, 23 bp, Homo sapiens
ttatagaataaaagctgtggaat

SEQ ID NO: 4096717 - DNA, 23 bp, Homo sapiens
ttatagaatatttattacctctg

SEQ ID NO: 4096718 - DNA, 21 bp, Homo sapiens
ttatagagaatgatgataaca

SEQ ID NO: 4096719 - DNA, 23 bp, Homo sapiens
ttataggccagggcatgtgtatg

SEQ ID NO: 4096720 - DNA, 21 bp, Homo sapiens
ttatagtgaatactgctacag

SEQ ID NO: 4096721 - DNA, 13 bp, Homo sapiens
ttatataaatgta

SEQ ID NO: 4096722 - DNA, 22 bp, Homo sapiens
ttatataattcactcaagcact

SEQ ID NO: 4096723 - DNA, 19 bp, Homo sapiens
ttatatacctggcttttac

SEQ ID NO: 4096724 - DNA, 23 bp, Homo sapiens
ttatatacctggcttttacttta

SEQ ID NO: 4096725 - DNA, 21 bp, Homo sapiens
ttatatagggatcaaccagct

SEQ ID NO: 4096726 - DNA, 17 bp, Homo sapiens
ttaccaggtgagaagtg

SEQ ID NO: 4096727 - DNA, 14 bp, Homo sapiens
ttaccagttgcctt

SEQ ID NO: 4096728 - DNA, 15 bp, Homo sapiens
ttaccatcatctctg

SEQ ID NO: 4096729 - DNA, 20 bp, Homo sapiens
ttaccatgagaagagggcct

SEQ ID NO: 4096730 - DNA, 21 bp, Homo sapiens
ttacccagtgggacagaggag

SEQ ID NO: 4096731 - DNA, 15 bp, Homo sapiens
ttaccctcaaatgct

SEQ ID NO: 4096732 - DNA, 15 bp, Homo sapiens
ttaccctctttgctg

SEQ ID NO: 4096733 - DNA, 17 bp, Homo sapiens
ttacccttccctgcact

SEQ ID NO: 4096734 - DNA, 16 bp, Homo sapiens
ttacctaaacagatat

SEQ ID NO: 4096735 - DNA, 17 bp, Homo sapiens
ttacctaaacagatata

SEQ ID NO: 4096736 - DNA, 21 bp, Homo sapiens
ttacctaaacagatataaatg

SEQ ID NO: 4096737 - DNA, 11 bp, Homo sapiens
ttacctaaaga

SEQ ID NO: 4096738 - DNA, 15 bp, Homo sapiens
ttacctaaagtattt

SEQ ID NO: 4096739 - DNA, 16 bp, Homo sapiens
ttacctaaagtatttt

SEQ ID NO: 4096740 - DNA, 17 bp, Homo sapiens
ttacctaccacagtgtc

SEQ ID NO: 4096741 - DNA, 21 bp, Homo sapiens
ttacctaccacagtgtctgta

SEQ ID NO: 4096742 - DNA, 18 bp, Homo sapiens
ttacctccaacagaacta

SEQ ID NO: 4096743 - DNA, 23 bp, Homo sapiens
ttacctccaacagaactaaatgt

SEQ ID NO: 4096744 - DNA, 13 bp, Homo sapiens
ttacctccatcca

SEQ ID NO: 4096745 - DNA, 21 bp, Homo sapiens
ttacctctgatacctcaaccc

SEQ ID NO: 4096746 - DNA, 20 bp, Homo sapiens
ttacctcttaacaatttctg

SEQ ID NO: 4096747 - DNA, 20 bp, Homo sapiens
ttacctgacctcttgctgtc

SEQ ID NO: 4096748 - DNA, 18 bp, Homo sapiens
ttacctgggcattcttgt

SEQ ID NO: 4096749 - DNA, 18 bp, Homo sapiens
ttacctgtatacagtgca

SEQ ID NO: 4096750 - DNA, 13 bp, Homo sapiens
ttacctgtcacat

SEQ ID NO: 4096751 - DNA, 15 bp, Homo sapiens
ttaccttgaaatgct

SEQ ID NO: 4096752 - DNA, 16 bp, Homo sapiens
ttacgctttgattcat

SEQ ID NO: 4096753 - DNA, 17 bp, Homo sapiens
ttacgtgtttaaaaaaa

SEQ ID NO: 4096754 - DNA, 17 bp, Homo sapiens
ttacgtttgttattcct

SEQ ID NO: 4096755 - DNA, 19 bp, Homo sapiens
ttacgtttgttattcctag

SEQ ID NO: 4096756 - DNA, 18 bp, Homo sapiens
ttactaaacatatgattt

SEQ ID NO: 4096757 - DNA, 16 bp, Homo sapiens
ttactaatgtaaaatg

SEQ ID NO: 4096758 - DNA, 14 bp, Homo sapiens
ttactacaaaattt

SEQ ID NO: 4096759 - DNA, 13 bp, Homo sapiens
ttactacagttgt

SEQ ID NO: 4096760 - DNA, 17 bp, Homo sapiens
ttactacctcctctcct

SEQ ID NO: 4096761 - DNA, 17 bp, Homo sapiens
ttactaggtaacttcat

SEQ ID NO: 4096762 - DNA, 19 bp, Homo sapiens
ttactaggtaacttcatat

SEQ ID NO: 4096763 - DNA, 19 bp, Homo sapiens
ttactatgtgccagttcct

SEQ ID NO: 4096764 - DNA, 22 bp, Homo sapiens
ttactatgtgccagttcctgta

SEQ ID NO: 4096765 - DNA, 21 bp, Homo sapiens
ttactcagggttcatctgtcc

SEQ ID NO: 4096766 - DNA, 22 bp, Homo sapiens
ttactcagggttcatctgtcca

SEQ ID NO: 4096767 - DNA, 18 bp, Homo sapiens
ttactctgcctacagaac

SEQ ID NO: 4096768 - DNA, 12 bp, Homo sapiens
ttactgaccagc

SEQ ID NO: 4096769 - DNA, 17 bp, Homo sapiens
ttactgagcttctctgt

SEQ ID NO: 4096770 - DNA, 18 bp, Homo sapiens
ttactgagcttctctgtg

SEQ ID NO: 4096771 - DNA, 18 bp, Homo sapiens
ttactgatcatgcattgt

SEQ ID NO: 4096772 - DNA, 19 bp, Homo sapiens
ttactgatcatgcattgtt

SEQ ID NO: 4096773 - DNA, 18 bp, Homo sapiens
ttactggaattcttctgc

SEQ ID NO: 4096774 - DNA, 18 bp, Homo sapiens
ttactgtaacctgttgct

SEQ ID NO: 4096775 - DNA, 15 bp, Homo sapiens
ttactgtaattcctc

SEQ ID NO: 4096776 - DNA, 13 bp, Homo sapiens
ttactgtcaataa

SEQ ID NO: 4096777 - DNA, 15 bp, Homo sapiens
ttactgtcaataaac

SEQ ID NO: 4096778 - DNA, 18 bp, Homo sapiens
ttactgtcaataaacagc

SEQ ID NO: 4096779 - DNA, 23 bp, Homo sapiens
ttactgtcgtatttttgaaaaat

SEQ ID NO: 4096780 - DNA, 14 bp, Homo sapiens
ttactgtggaggaa

SEQ ID NO: 4096781 - DNA, 18 bp, Homo sapiens
ttactgtggaggaaggat

SEQ ID NO: 4096782 - DNA, 20 bp, Homo sapiens
ttactgtggaggaaggattg

SEQ ID NO: 4096783 - DNA, 15 bp, Homo sapiens
ttactgttgcattta

SEQ ID NO: 4096784 - DNA, 19 bp, Homo sapiens
ttactgttgcatttacttt

SEQ ID NO: 4096785 - DNA, 16 bp, Homo sapiens
ttactgtttatttctg

SEQ ID NO: 4096786 - DNA, 16 bp, Homo sapiens
ttacttaatcaaaact

SEQ ID NO: 4096787 - DNA, 13 bp, Homo sapiens
ttacttacctaaa

SEQ ID NO: 4096788 - DNA, 15 bp, Homo sapiens
ttacttcctatcaag

SEQ ID NO: 4096789 - DNA, 16 bp, Homo sapiens
ttacttctaatcttaa

SEQ ID NO: 4096790 - DNA, 23 bp, Homo sapiens
ttacttcttatacatttgataaa

SEQ ID NO: 4096791 - DNA, 13 bp, Homo sapiens
ttacttcttctct

SEQ ID NO: 4096792 - DNA, 14 bp, Homo sapiens
ttacttgcttctct

SEQ ID NO: 4096793 - DNA, 15 bp, Homo sapiens
ttacttgcttctcta

SEQ ID NO: 4096794 - DNA, 21 bp, Homo sapiens
ttacttgtctttctggggttt

SEQ ID NO: 4096795 - DNA, 17 bp, Homo sapiens
ttactttaattactgga

SEQ ID NO: 4096796 - DNA, 11 bp, Homo sapiens
ttactttctgt

SEQ ID NO: 4096797 - DNA, 12 bp, Homo sapiens
ttactttgtaat

SEQ ID NO: 4096798 - DNA, 23 bp, Homo sapiens
ttacttttataataaaaggaaaa

SEQ ID NO: 4096799 - DNA, 15 bp, Homo sapiens
ttagaaaacaaaatt

SEQ ID NO: 4096800 - DNA, 22 bp, Homo sapiens
ttagaaaatgacttatttctgc

SEQ ID NO: 4096801 - DNA, 12 bp, Homo sapiens
ttagaaaatgtg

SEQ ID NO: 4096802 - DNA, 13 bp, Homo sapiens
ttagaaaatgtgt

SEQ ID NO: 4096803 - DNA, 16 bp, Homo sapiens
ttagaaactgatttct

SEQ ID NO: 4096804 - DNA, 19 bp, Homo sapiens
ttagaaataaatgtacctg

SEQ ID NO: 4096805 - DNA, 11 bp, Homo sapiens
ttagaaatata

SEQ ID NO: 4096806 - DNA, 18 bp, Homo sapiens
ttagaaatcaagcataaa

SEQ ID NO: 4096807 - DNA, 18 bp, Homo sapiens
ttagaaatgaccaatatt

SEQ ID NO: 4096808 - DNA, 13 bp, Homo sapiens
ttagaataaattc

SEQ ID NO: 4096809 - DNA, 21 bp, Homo sapiens
ttagaatcagccttgaaacat

SEQ ID NO: 4096810 - DNA, 22 bp, Homo sapiens
ttagaatccaaacttggatttt

SEQ ID NO: 4096811 - DNA, 12 bp, Homo sapiens
ttagaattattt

SEQ ID NO: 4096812 - DNA, 13 bp, Homo sapiens
ttagaattattta

SEQ ID NO: 4096813 - DNA, 18 bp, Homo sapiens
ttagactttagaaataaa

SEQ ID NO: 4096814 - DNA, 19 bp, Homo sapiens
ttagagagggaccatgtgt

SEQ ID NO: 4096815 - DNA, 15 bp, Homo sapiens
ttagaggcattgtta

SEQ ID NO: 4096816 - DNA, 15 bp, Homo sapiens
ttagagtttctgttt

SEQ ID NO: 4096817 - DNA, 18 bp, Homo sapiens
ttagagtttctgtttgat

SEQ ID NO: 4096818 - DNA, 14 bp, Homo sapiens
ttagatataacact

SEQ ID NO: 4096819 - DNA, 17 bp, Homo sapiens
ttagatataacactatg

SEQ ID NO: 4096820 - DNA, 17 bp, Homo sapiens
ttagatgtgccaataac

SEQ ID NO: 4096821 - DNA, 18 bp, Homo sapiens
ttagcaaggtcatttctt

SEQ ID NO: 4096822 - DNA, 12 bp, Homo sapiens
ttagcagacagg

SEQ ID NO: 4096823 - DNA, 21 bp, Homo sapiens
ttagcagcagcctttaatgca

SEQ ID NO: 4096824 - DNA, 16 bp, Homo sapiens
ttagcagtttgctttg

SEQ ID NO: 4096825 - DNA, 15 bp, Homo sapiens
ttagccaggatcatg

SEQ ID NO: 4096826 - DNA, 19 bp, Homo sapiens
ttagccaggtaatgtgaat

SEQ ID NO: 4096827 - DNA, 13 bp, Homo sapiens
ttagccgggcgtg

SEQ ID NO: 4096828 - DNA, 21 bp, Homo sapiens
ttagcggcaaacctttccccc

SEQ ID NO: 4096829 - DNA, 15 bp, Homo sapiens
ttagctctattgata

SEQ ID NO: 4096830 - DNA, 16 bp, Homo sapiens
ttatatatgaaaacta

SEQ ID NO: 4096831 - DNA, 20 bp, Homo sapiens
ttatatatttataactcatc

SEQ ID NO: 4096832 - DNA, 16 bp, Homo sapiens
ttatatcatgcaaaat

SEQ ID NO: 4096833 - DNA, 20 bp, Homo sapiens
ttatatcatgcaaaatatgt

SEQ ID NO: 4096834 - DNA, 22 bp, Homo sapiens
ttatatctgtggtcttcaaatt

SEQ ID NO: 4096835 - DNA, 16 bp, Homo sapiens
ttatatgtacatgaga

SEQ ID NO: 4096836 - DNA, 21 bp, Homo sapiens
ttatattatccataggtttct

SEQ ID NO: 4096837 - DNA, 20 bp, Homo sapiens
ttatattgaagacaatttga

SEQ ID NO: 4096838 - DNA, 20 bp, Homo sapiens
ttatattgtttttgtattta

SEQ ID NO: 4096839 - DNA, 18 bp, Homo sapiens
ttatatttatgtgtctgt

SEQ ID NO: 4096840 - DNA, 13 bp, Homo sapiens
ttatatttattgt

SEQ ID NO: 4096841 - DNA, 23 bp, Homo sapiens
ttatatttccctaaaatacattt

SEQ ID NO: 4096842 - DNA, 12 bp, Homo sapiens
ttatatttcctt

SEQ ID NO: 4096843 - DNA, 14 bp, Homo sapiens
ttatatttccttta

SEQ ID NO: 4096844 - DNA, 18 bp, Homo sapiens
ttatatttggcccaaact

SEQ ID NO: 4096845 - DNA, 15 bp, Homo sapiens
ttatcaaaactttct

SEQ ID NO: 4096846 - DNA, 14 bp, Homo sapiens
ttatcagatacatc

SEQ ID NO: 4096847 - DNA, 13 bp, Homo sapiens
ttatcagtttcca

SEQ ID NO: 4096848 - DNA, 19 bp, Homo sapiens
ttatcataagaatttttca

SEQ ID NO: 4096849 - DNA, 12 bp, Homo sapiens
ttatcattttca

SEQ ID NO: 4096850 - DNA, 16 bp, Homo sapiens
ttatcattttcaaaat

SEQ ID NO: 4096851 - DNA, 21 bp, Homo sapiens
ttatccacaattattggcaaa

SEQ ID NO: 4096852 - DNA, 15 bp, Homo sapiens
ttatccctcacctgt

SEQ ID NO: 4096853 - DNA, 14 bp, Homo sapiens
ttatccctctcttc

SEQ ID NO: 4096854 - DNA, 23 bp, Homo sapiens
ttatccctctcttccccttccct

SEQ ID NO: 4096855 - DNA, 16 bp, Homo sapiens
ttatcctctggtttaa

SEQ ID NO: 4096856 - DNA, 22 bp, Homo sapiens
ttatcctgaactcttctgcaaa

SEQ ID NO: 4096857 - DNA, 19 bp, Homo sapiens
ttatcgaaataacaatgtt

SEQ ID NO: 4096858 - DNA, 21 bp, Homo sapiens
ttatcgaaataacaatgttaa

SEQ ID NO: 4096859 - DNA, 14 bp, Homo sapiens
ttatcggaagcagt

SEQ ID NO: 4096860 - DNA, 14 bp, Homo sapiens
ttatcgggaacagt

SEQ ID NO: 4096861 - DNA, 17 bp, Homo sapiens
ttatcgggaacagtgtt

SEQ ID NO: 4096862 - DNA, 23 bp, Homo sapiens
ttatcgggaacagtgtttcccat

SEQ ID NO: 4096863 - DNA, 16 bp, Homo sapiens
ttatcgggagcagtgt

SEQ ID NO: 4096864 - DNA, 19 bp, Homo sapiens
ttatcgggagcagtgtctt

SEQ ID NO: 4096865 - DNA, 21 bp, Homo sapiens
ttatcgggagcagtgtcttcc

SEQ ID NO: 4096866 - DNA, 15 bp, Homo sapiens
ttatctaaaagaaat

SEQ ID NO: 4096867 - DNA, 15 bp, Homo sapiens
ttatctaaattaaag

SEQ ID NO: 4096868 - DNA, 18 bp, Homo sapiens
ttatctatagctaagtac

SEQ ID NO: 4096869 - DNA, 22 bp, Homo sapiens
ttatctcagtcatgcataaata

SEQ ID NO: 4096870 - DNA, 14 bp, Homo sapiens
ttatctctatttaa

SEQ ID NO: 4096871 - DNA, 15 bp, Homo sapiens
ttatctctatttaat

SEQ ID NO: 4096872 - DNA, 18 bp, Homo sapiens
ttatctgtgcgtgaaaca

SEQ ID NO: 4096873 - DNA, 19 bp, Homo sapiens
ttatctgtttaaagcatat

SEQ ID NO: 4096874 - DNA, 20 bp, Homo sapiens
ttatcttatgaataagcact

SEQ ID NO: 4096875 - DNA, 18 bp, Homo sapiens
ttatgaaaggtttacatt

SEQ ID NO: 4096876 - DNA, 13 bp, Homo sapiens
ttatgaaatttca

SEQ ID NO: 4096877 - DNA, 21 bp, Homo sapiens
ttatgaagaattgccaatctt

SEQ ID NO: 4096878 - DNA, 23 bp, Homo sapiens
ttatgaagatgggggcctctttc

SEQ ID NO: 4096879 - DNA, 20 bp, Homo sapiens
ttatgaagtttaaaacagta

SEQ ID NO: 4096880 - DNA, 19 bp, Homo sapiens
ttatgaatatttataacag

SEQ ID NO: 4096881 - DNA, 17 bp, Homo sapiens
ttatgatattgtttaaa

SEQ ID NO: 4096882 - DNA, 20 bp, Homo sapiens
ttatgatggttttaaacttt

SEQ ID NO: 4096883 - DNA, 15 bp, Homo sapiens
ttatgatttaataaa

SEQ ID NO: 4096884 - DNA, 17 bp, Homo sapiens
ttatgatttaataaaat

SEQ ID NO: 4096885 - DNA, 20 bp, Homo sapiens
ttatgatttaataaaataat

SEQ ID NO: 4096886 - DNA, 17 bp, Homo sapiens
ttatgcaaggaaggaaa

SEQ ID NO: 4096887 - DNA, 22 bp, Homo sapiens
ttatgcaaggaaggaaagaaag

SEQ ID NO: 4096888 - DNA, 15 bp, Homo sapiens
ttatgctgatttatt

SEQ ID NO: 4096889 - DNA, 14 bp, Homo sapiens
ttatgcttccagaa

SEQ ID NO: 4096890 - DNA, 23 bp, Homo sapiens
ttatggaattgatttgcattgaa

SEQ ID NO: 4096891 - DNA, 16 bp, Homo sapiens
ttatggcagaagggaa

SEQ ID NO: 4096892 - DNA, 17 bp, Homo sapiens
ttatgggtcctgcaatt

SEQ ID NO: 4096893 - DNA, 20 bp, Homo sapiens
ttatggttacttcttctctt

SEQ ID NO: 4096894 - DNA, 20 bp, Homo sapiens
ttatgtactagtgttctgtt

SEQ ID NO: 4096895 - DNA, 16 bp, Homo sapiens
ttatgtagtaattgac

SEQ ID NO: 4096896 - DNA, 22 bp, Homo sapiens
ttatgtataaacataagttgca

SEQ ID NO: 4096897 - DNA, 20 bp, Homo sapiens
ttatgtatcttagttacatt

SEQ ID NO: 4096898 - DNA, 17 bp, Homo sapiens
ttatgtctatttaagcc

SEQ ID NO: 4096899 - DNA, 14 bp, Homo sapiens
ttatgtctgtttaa

SEQ ID NO: 4096900 - DNA, 17 bp, Homo sapiens
ttatgtctgtttaagaa

SEQ ID NO: 4096901 - DNA, 21 bp, Homo sapiens
ttatgtgaaatgctttctgta

SEQ ID NO: 4096902 - DNA, 23 bp, Homo sapiens
ttatgtgaatgatctctctgaat

SEQ ID NO: 4096903 - DNA, 13 bp, Homo sapiens
ttatgtgagagaa

SEQ ID NO: 4096904 - DNA, 17 bp, Homo sapiens
ttatgttcttatagaat

SEQ ID NO: 4096905 - DNA, 18 bp, Homo sapiens
ttatgttcttatagaata

SEQ ID NO: 4096906 - DNA, 21 bp, Homo sapiens
ttatgttgttcaaatgcattt

SEQ ID NO: 4096907 - DNA, 12 bp, Homo sapiens
ttatgtttgaat

SEQ ID NO: 4096908 - DNA, 13 bp, Homo sapiens
ttatgtttgaata

SEQ ID NO: 4096909 - DNA, 16 bp, Homo sapiens
ttatgttttgtttctg

SEQ ID NO: 4096910 - DNA, 19 bp, Homo sapiens
ttatgttttgtttctgaaa

SEQ ID NO: 4096911 - DNA, 12 bp, Homo sapiens
ttattaaataaa

SEQ ID NO: 4096912 - DNA, 15 bp, Homo sapiens
ttattaaataaaatc

SEQ ID NO: 4096913 - DNA, 16 bp, Homo sapiens
ttattaaataaaatca

SEQ ID NO: 4096914 - DNA, 19 bp, Homo sapiens
ttattaacaaattatgtta

SEQ ID NO: 4096915 - DNA, 16 bp, Homo sapiens
ttattaactacattta

SEQ ID NO: 4096916 - DNA, 18 bp, Homo sapiens
ttattaactacatttatg

SEQ ID NO: 4096917 - DNA, 23 bp, Homo sapiens
ttattaagatggattctcagata

SEQ ID NO: 4096918 - DNA, 20 bp, Homo sapiens
ttattaatatgagttactga

SEQ ID NO: 4096919 - DNA, 18 bp, Homo sapiens
ttattaatttttaaggat

SEQ ID NO: 4096920 - DNA, 20 bp, Homo sapiens
ttattaccccctccttcaga

SEQ ID NO: 4096921 - DNA, 16 bp, Homo sapiens
ttattagggagaaaat

SEQ ID NO: 4096922 - DNA, 18 bp, Homo sapiens
ttattagggagaaaattc

SEQ ID NO: 4096923 - DNA, 13 bp, Homo sapiens
ttattatctttaa

SEQ ID NO: 4096924 - DNA, 13 bp, Homo sapiens
ttattatgaagaa

SEQ ID NO: 4096925 - DNA, 14 bp, Homo sapiens
ttattatgaagaat

SEQ ID NO: 4096926 - DNA, 15 bp, Homo sapiens
ttattatgaagaatt

SEQ ID NO: 4096927 - DNA, 14 bp, Homo sapiens
ttattattattaaa

SEQ ID NO: 4096928 - DNA, 16 bp, Homo sapiens
ttattcacatatatca

SEQ ID NO: 4096929 - DNA, 12 bp, Homo sapiens
ttattcatttaa

SEQ ID NO: 4096930 - DNA, 18 bp, Homo sapiens
ttattcatttaaaatgat

SEQ ID NO: 4096931 - DNA, 17 bp, Homo sapiens
ttattccagaatgctgt

SEQ ID NO: 4096932 - DNA, 12 bp, Homo sapiens
ttattccatcaa

SEQ ID NO: 4096933 - DNA, 13 bp, Homo sapiens
ttattccatcaat

SEQ ID NO: 4096934 - DNA, 15 bp, Homo sapiens
ttattccatcaataa

SEQ ID NO: 4096935 - DNA, 15 bp, Homo sapiens
ttattcgccatctga

SEQ ID NO: 4096936 - DNA, 20 bp, Homo sapiens
ttattctaagccctttgcca

SEQ ID NO: 4096937 - DNA, 13 bp, Homo sapiens
ttattctagatta

SEQ ID NO: 4096938 - DNA, 15 bp, Homo sapiens
ttattgacactgaac

SEQ ID NO: 4096939 - DNA, 15 bp, Homo sapiens
ttattgcgctgctac

SEQ ID NO: 4096940 - DNA, 18 bp, Homo sapiens
ttattgctagtatttgaa

SEQ ID NO: 4096941 - DNA, 12 bp, Homo sapiens
ttattggctgct

SEQ ID NO: 4096942 - DNA, 21 bp, Homo sapiens
ttattgtaagttgtacaaatg

SEQ ID NO: 4096943 - DNA, 23 bp, Homo sapiens
ttattgtaagttgtacaaatgta

SEQ ID NO: 4096944 - DNA, 14 bp, Homo sapiens
ttattgtacctctc

SEQ ID NO: 4096945 - DNA, 15 bp, Homo sapiens
ttattgtacctctct

SEQ ID NO: 4096946 - DNA, 12 bp, Homo sapiens
ttattgttgaac

SEQ ID NO: 4096947 - DNA, 15 bp, Homo sapiens
ttatttaaataaaat

SEQ ID NO: 4096948 - DNA, 23 bp, Homo sapiens
ttatttaacagctgaattatcta

SEQ ID NO: 4096949 - DNA, 10 bp, Homo sapiens
ttatttaata

SEQ ID NO: 4096950 - DNA, 13 bp, Homo sapiens
ttatttaataaca

SEQ ID NO: 4096951 - DNA, 16 bp, Homo sapiens
ttatttaatgttatgt

SEQ ID NO: 4096952 - DNA, 18 bp, Homo sapiens
ttatttaattaaatgtat

SEQ ID NO: 4096953 - DNA, 19 bp, Homo sapiens
ttatttaattaaatgtatt

SEQ ID NO: 4096954 - DNA, 20 bp, Homo sapiens
ttatttacagatgaatgtat

SEQ ID NO: 4096955 - DNA, 17 bp, Homo sapiens
ttatttacccctcccct

SEQ ID NO: 4096956 - DNA, 21 bp, Homo sapiens
ttatttactgagcttctctgt

SEQ ID NO: 4096957 - DNA, 12 bp, Homo sapiens
ttatttactttt

SEQ ID NO: 4096958 - DNA, 18 bp, Homo sapiens
ttatttagacaagagatg

SEQ ID NO: 4096959 - DNA, 14 bp, Homo sapiens
ttatttatcaaaat

SEQ ID NO: 4096960 - DNA, 14 bp, Homo sapiens
ttatttatcagtga

SEQ ID NO: 4096961 - DNA, 15 bp, Homo sapiens
ttatttattaagatg

SEQ ID NO: 4096962 - DNA, 14 bp, Homo sapiens
ttatttattactgt

SEQ ID NO: 4096963 - DNA, 17 bp, Homo sapiens
ttatttattactgtccc

SEQ ID NO: 4096964 - DNA, 23 bp, Homo sapiens
ttatttcaaaatatacattcaaa

SEQ ID NO: 4096965 - DNA, 20 bp, Homo sapiens
ttatttcactatcttcttca

SEQ ID NO: 4096966 - DNA, 14 bp, Homo sapiens
ttatttcacttgat

SEQ ID NO: 4096967 - DNA, 18 bp, Homo sapiens
ttatttccactaaaaata

SEQ ID NO: 4096968 - DNA, 21 bp, Homo sapiens
ttatttccatcatgtcagagc

SEQ ID NO: 4096969 - DNA, 15 bp, Homo sapiens
ttatttcctgattac

SEQ ID NO: 4096970 - DNA, 22 bp, Homo sapiens
ttatttctagaagcacatgtgt

SEQ ID NO: 4096971 - DNA, 14 bp, Homo sapiens
ttatttctcctttt

SEQ ID NO: 4096972 - DNA, 14 bp, Homo sapiens
ttatttctctgatt

SEQ ID NO: 4096973 - DNA, 16 bp, Homo sapiens
ttatttctctgatttg

SEQ ID NO: 4096974 - DNA, 17 bp, Homo sapiens
ttatttctgctctggaa

SEQ ID NO: 4096975 - DNA, 16 bp, Homo sapiens
ttatttgctaagcata

SEQ ID NO: 4096976 - DNA, 19 bp, Homo sapiens
ttatttgctaagcatattt

SEQ ID NO: 4096977 - DNA, 15 bp, Homo sapiens
ttatttgctgttaac

SEQ ID NO: 4096978 - DNA, 23 bp, Homo sapiens
ttatttggaaccttgttttggac

SEQ ID NO: 4096979 - DNA, 18 bp, Homo sapiens
ttatttgttgttttctgg

SEQ ID NO: 4096980 - DNA, 12 bp, Homo sapiens
ttattttataat

SEQ ID NO: 4096981 - DNA, 13 bp, Homo sapiens
ttattttatttgt

SEQ ID NO: 4096982 - DNA, 16 bp, Homo sapiens
ttattttcaaatctgg

SEQ ID NO: 4096983 - DNA, 22 bp, Homo sapiens
ttattttcccctatcatttatt

SEQ ID NO: 4096984 - DNA, 12 bp, Homo sapiens
ttattttctaca

SEQ ID NO: 4096985 - DNA, 17 bp, Homo sapiens
ttattttctttgaaatt

SEQ ID NO: 4096986 - DNA, 18 bp, Homo sapiens
ttattttcttttgaattg

SEQ ID NO: 4096987 - DNA, 21 bp, Homo sapiens
ttattttgaaaagcttcttaa

SEQ ID NO: 4096988 - DNA, 13 bp, Homo sapiens
ttattttggatat

SEQ ID NO: 4096989 - DNA, 12 bp, Homo sapiens
ttattttgtaat

SEQ ID NO: 4096990 - DNA, 14 bp, Homo sapiens
ttattttgtaatta

SEQ ID NO: 4096991 - DNA, 19 bp, Homo sapiens
ttattttgtgctcatttaa

SEQ ID NO: 4096992 - DNA, 16 bp, Homo sapiens
ttatttttaaaaagaa

SEQ ID NO: 4096993 - DNA, 14 bp, Homo sapiens
ttatttttaaaata

SEQ ID NO: 4096994 - DNA, 12 bp, Homo sapiens
ttatttttatac

SEQ ID NO: 4096995 - DNA, 14 bp, Homo sapiens
ttatttttcaagga

SEQ ID NO: 4096996 - DNA, 10 bp, Homo sapiens
ttatttttct

SEQ ID NO: 4096997 - DNA, 22 bp, Homo sapiens
ttatttttctaaggttctcata

SEQ ID NO: 4096998 - DNA, 12 bp, Homo sapiens
ttatttttgcca

SEQ ID NO: 4096999 - DNA, 18 bp, Homo sapiens
ttattttttaagtattta

SEQ ID NO: 4097000 - DNA, 20 bp, Homo sapiens
ttattttttcttttgtaatt

SEQ ID NO: 4097001 - DNA, 18 bp, Homo sapiens
ttcaaaaaaacactagtt

SEQ ID NO: 4097002 - DNA, 23 bp, Homo sapiens
ttcaaaaagagagattctccatt

SEQ ID NO: 4097003 - DNA, 16 bp, Homo sapiens
ttcaaaacaaacagat

SEQ ID NO: 4097004 - DNA, 19 bp, Homo sapiens
ttcaaaaccaaggaagcag

SEQ ID NO: 4097005 - DNA, 21 bp, Homo sapiens
ttcaaaataagtatttctgat

SEQ ID NO: 4097006 - DNA, 17 bp, Homo sapiens
ttcaaaatccttccaaa

SEQ ID NO: 4097007 - DNA, 16 bp, Homo sapiens
ttcaaaatggagggaa

SEQ ID NO: 4097008 - DNA, 13 bp, Homo sapiens
ttcaaactgtgaa

SEQ ID NO: 4097009 - DNA, 19 bp, Homo sapiens
ttcaaacttactattttga

SEQ ID NO: 4097010 - DNA, 16 bp, Homo sapiens
ttcaaactttcacttt

SEQ ID NO: 4097011 - DNA, 17 bp, Homo sapiens
ttcaaactttcactttg

SEQ ID NO: 4097012 - DNA, 12 bp, Homo sapiens
ttcaaatacaaa

SEQ ID NO: 4097013 - DNA, 15 bp, Homo sapiens
ttcaaatacaaagta

SEQ ID NO: 4097014 - DNA, 15 bp, Homo sapiens
ttcaaatccttccaa

SEQ ID NO: 4097015 - DNA, 17 bp, Homo sapiens
ttcaaatccttccaaaa

SEQ ID NO: 4097016 - DNA, 23 bp, Homo sapiens
ttcaaatccttccaaaaattatt

SEQ ID NO: 4097017 - DNA, 14 bp, Homo sapiens
ttcaaatgcatttt

SEQ ID NO: 4097018 - DNA, 16 bp, Homo sapiens
ttcaacatcaatgttc

SEQ ID NO: 4097019 - DNA, 15 bp, Homo sapiens
ttcaacatcctgcca

SEQ ID NO: 4097020 - DNA, 21 bp, Homo sapiens
ttcaacatcctgccagcccca

SEQ ID NO: 4097021 - DNA, 20 bp, Homo sapiens
ttcaaccattccccatggga

SEQ ID NO: 4097022 - DNA, 14 bp, Homo sapiens
ttcaacgcagccct

SEQ ID NO: 4097023 - DNA, 19 bp, Homo sapiens
ttcaacgcagccctgcttt

SEQ ID NO: 4097024 - DNA, 13 bp, Homo sapiens
ttcaactgctttg

SEQ ID NO: 4097025 - DNA, 15 bp, Homo sapiens
ttcaactgtcttcct

SEQ ID NO: 4097026 - DNA, 19 bp, Homo sapiens
ttcaactgtcttcctcaaa

SEQ ID NO: 4097027 - DNA, 23 bp, Homo sapiens
ttcaactgtgctcttgttttgtc

SEQ ID NO: 4097028 - DNA, 14 bp, Homo sapiens
ttcaagaaaataaa

SEQ ID NO: 4097029 - DNA, 13 bp, Homo sapiens
ttcaagaaaggaa

SEQ ID NO: 4097030 - DNA, 16 bp, Homo sapiens
ttcaaggagaatatga

SEQ ID NO: 4097031 - DNA, 16 bp, Homo sapiens
ttcaaggcttccactg

SEQ ID NO: 4097032 - DNA, 16 bp, Homo sapiens
ttcaagtaattgtgaa

SEQ ID NO: 4097033 - DNA, 24 bp, Homo sapiens
ttcaagtgccttttgctgcgcacc

SEQ ID NO: 4097034 - DNA, 12 bp, Homo sapiens
ttcaagttgtaa

SEQ ID NO: 4097035 - DNA, 19 bp, Homo sapiens
ttcaagttgtaaaaatgaa

SEQ ID NO: 4097036 - DNA, 20 bp, Homo sapiens
ttcaagttttgggtatgttt

SEQ ID NO: 4097037 - DNA, 14 bp, Homo sapiens
tgccagtggatccc

SEQ ID NO: 4097038 - DNA, 16 bp, Homo sapiens
tgccagtggggcctga

SEQ ID NO: 4097039 - DNA, 16 bp, Homo sapiens
tgccagttttccctgg

SEQ ID NO: 4097040 - DNA, 18 bp, Homo sapiens
tgccagttttccctggaa

SEQ ID NO: 4097041 - DNA, 19 bp, Homo sapiens
tgccataaatatttctcaa

SEQ ID NO: 4097042 - DNA, 16 bp, Homo sapiens
tgccatcatgcctgac

SEQ ID NO: 4097043 - DNA, 17 bp, Homo sapiens
tgccatctagccagccc

SEQ ID NO: 4097044 - DNA, 18 bp, Homo sapiens
tgccatctagccagcccc

SEQ ID NO: 4097045 - DNA, 23 bp, Homo sapiens
tgccatctgtacatattactgtt

SEQ ID NO: 4097046 - DNA, 17 bp, Homo sapiens
tgccatgacagaggctg

SEQ ID NO: 4097047 - DNA, 15 bp, Homo sapiens
tgccatgatctgtat

SEQ ID NO: 4097048 - DNA, 20 bp, Homo sapiens
tgccatgggcttcactgtat

SEQ ID NO: 4097049 - DNA, 15 bp, Homo sapiens
tgccatgtgaagagg

SEQ ID NO: 4097050 - DNA, 16 bp, Homo sapiens
tgccattatccctgaa

SEQ ID NO: 4097051 - DNA, 23 bp, Homo sapiens
tgccattatccctgaatccccct

SEQ ID NO: 4097052 - DNA, 15 bp, Homo sapiens
tgccattccactcca

SEQ ID NO: 4097053 - DNA, 14 bp, Homo sapiens
tgccatttaaaaag

SEQ ID NO: 4097054 - DNA, 17 bp, Homo sapiens
tgccatttaaaaagttg

SEQ ID NO: 4097055 - DNA, 18 bp, Homo sapiens
tgccatttcagtggcttc

SEQ ID NO: 4097056 - DNA, 22 bp, Homo sapiens
tgccatttggtgtggattttct

SEQ ID NO: 4097057 - DNA, 21 bp, Homo sapiens
tgcccaagaatagatgctgac

SEQ ID NO: 4097058 - DNA, 23 bp, Homo sapiens
tgcccaagaatagatgctgactg

SEQ ID NO: 4097059 - DNA, 18 bp, Homo sapiens
tgcccaagcccaggccac

SEQ ID NO: 4097060 - DNA, 19 bp, Homo sapiens
tgcccaagggcctcccacc

SEQ ID NO: 4097061 - DNA, 22 bp, Homo sapiens
tgcccaagtcacacagctagtg

SEQ ID NO: 4097062 - DNA, 16 bp, Homo sapiens
tgcccaattggaggaa

SEQ ID NO: 4097063 - DNA, 14 bp, Homo sapiens
tgcccaccattccc

SEQ ID NO: 4097064 - DNA, 14 bp, Homo sapiens
tgcccaccccctgc

SEQ ID NO: 4097065 - DNA, 15 bp, Homo sapiens
tgcccaccccctgcc

SEQ ID NO: 4097066 - DNA, 12 bp, Homo sapiens
tgcccacccctc

SEQ ID NO: 4097067 - DNA, 21 bp, Homo sapiens
tgcccacccctcactccccag

SEQ ID NO: 4097068 - DNA, 22 bp, Homo sapiens
tgcccacccctcactccccagg

SEQ ID NO: 4097069 - DNA, 14 bp, Homo sapiens
tgcccacctgccca

SEQ ID NO: 4097070 - DNA, 19 bp, Homo sapiens
tgcccactcctgctctgct

SEQ ID NO: 4097071 - DNA, 17 bp, Homo sapiens
tgcccactgctggtgcc

SEQ ID NO: 4097072 - DNA, 18 bp, Homo sapiens
tgcccactgctggtgcca

SEQ ID NO: 4097073 - DNA, 20 bp, Homo sapiens
tgcccactgctggtgccagg

SEQ ID NO: 4097074 - DNA, 22 bp, Homo sapiens
tgcccactgctggtgccagggt

SEQ ID NO: 4097075 - DNA, 17 bp, Homo sapiens
tgcccagaacttccctg

SEQ ID NO: 4097076 - DNA, 16 bp, Homo sapiens
tgcccagatcagccag

SEQ ID NO: 4097077 - DNA, 20 bp, Homo sapiens
tgcccagatcagccagaagc

SEQ ID NO: 4097078 - DNA, 12 bp, Homo sapiens
tgcccagcaggg

SEQ ID NO: 4097079 - DNA, 16 bp, Homo sapiens
tgcccagcctctttcc

SEQ ID NO: 4097080 - DNA, 17 bp, Homo sapiens
tgcccagcctctttccc

SEQ ID NO: 4097081 - DNA, 17 bp, Homo sapiens
tgcccaggtaccaccct

SEQ ID NO: 4097082 - DNA, 18 bp, Homo sapiens
tgcccaggtaccaccctt

SEQ ID NO: 4097083 - DNA, 19 bp, Homo sapiens
tgcccaggtaccacccttc

SEQ ID NO: 4097084 - DNA, 20 bp, Homo sapiens
tgcccaggtaccacccttca

SEQ ID NO: 4097085 - DNA, 18 bp, Homo sapiens
tgcccaggtcaccaagca

SEQ ID NO: 4097086 - DNA, 12 bp, Homo sapiens
tgcccagtgttg

SEQ ID NO: 4097087 - DNA, 21 bp, Homo sapiens
tgcccagtgttgtttgtaaat

SEQ ID NO: 4097088 - DNA, 22 bp, Homo sapiens
tgcccatcatgtggccccaccc

SEQ ID NO: 4097089 - DNA, 15 bp, Homo sapiens
tgcccatcctgactg

SEQ ID NO: 4097090 - DNA, 14 bp, Homo sapiens
tgcccatcctgcca

SEQ ID NO: 4097091 - DNA, 19 bp, Homo sapiens
tgcccattcaccaaaatta

SEQ ID NO: 4097092 - DNA, 20 bp, Homo sapiens
tgccccaaacaaatatgcaa

SEQ ID NO: 4097093 - DNA, 23 bp, Homo sapiens
tgccccaaatggattcctgtttc

SEQ ID NO: 4097094 - DNA, 21 bp, Homo sapiens
tgccccacacggactcccggg

SEQ ID NO: 4097095 - DNA, 22 bp, Homo sapiens
tgccccacacggactcccgggc

SEQ ID NO: 4097096 - DNA, 13 bp, Homo sapiens
tgccccacactcc

SEQ ID NO: 4097097 - DNA, 11 bp, Homo sapiens
tgccccacagc

SEQ ID NO: 4097098 - DNA, 18 bp, Homo sapiens
tgccccaccccacctcca

SEQ ID NO: 4097099 - DNA, 21 bp, Homo sapiens
tgccccacgctgtggccctgg

SEQ ID NO: 4097100 - DNA, 13 bp, Homo sapiens
tgccccagcccag

SEQ ID NO: 4097101 - DNA, 20 bp, Homo sapiens
tgccccaggaccagctcagg

SEQ ID NO: 4097102 - DNA, 20 bp, Homo sapiens
tgccccagggagtccagggt

SEQ ID NO: 4097103 - DNA, 21 bp, Homo sapiens
tgccccagggagtccagggtt

SEQ ID NO: 4097104 - DNA, 20 bp, Homo sapiens
tgccccatccagacctggct

SEQ ID NO: 4097105 - DNA, 15 bp, Homo sapiens
tgccccattccttgc

SEQ ID NO: 4097106 - DNA, 22 bp, Homo sapiens
tgcccccaccccggggaccctg

SEQ ID NO: 4097107 - DNA, 23 bp, Homo sapiens
tgcccccaccccggggaccctgt

SEQ ID NO: 4097108 - DNA, 14 bp, Homo sapiens
tgcccccagccccg

SEQ ID NO: 4097109 - DNA, 23 bp, Homo sapiens
tgccccccatgaggaaggaacag

SEQ ID NO: 4097110 - DNA, 15 bp, Homo sapiens
tgccccccgccctca

SEQ ID NO: 4097111 - DNA, 18 bp, Homo sapiens
tgcccccggccccctggt

SEQ ID NO: 4097112 - DNA, 15 bp, Homo sapiens
tgccccctctcactt

SEQ ID NO: 4097113 - DNA, 16 bp, Homo sapiens
tgccccctgctggctc

SEQ ID NO: 4097114 - DNA, 14 bp, Homo sapiens
tgccccggaggaag

SEQ ID NO: 4097115 - DNA, 19 bp, Homo sapiens
tgccccgtctacagctccc

SEQ ID NO: 4097116 - DNA, 20 bp, Homo sapiens
tgcccctaatctctgtagga

SEQ ID NO: 4097117 - DNA, 14 bp, Homo sapiens
tgcccctcaccttg

SEQ ID NO: 4097118 - DNA, 16 bp, Homo sapiens
tgcccctcaccttggg

SEQ ID NO: 4097119 - DNA, 15 bp, Homo sapiens
tgcccctcccaaccc

SEQ ID NO: 4097120 - DNA, 12 bp, Homo sapiens
tgcccctccccc

SEQ ID NO: 4097121 - DNA, 16 bp, Homo sapiens
tgcccctcccttcaac

SEQ ID NO: 4097122 - DNA, 12 bp, Homo sapiens
tgcccctctcac

SEQ ID NO: 4097123 - DNA, 14 bp, Homo sapiens
tgcccctggctttg

SEQ ID NO: 4097124 - DNA, 15 bp, Homo sapiens
tgcccctggctttgc

SEQ ID NO: 4097125 - DNA, 17 bp, Homo sapiens
tgcccctggctttgcct

SEQ ID NO: 4097126 - DNA, 18 bp, Homo sapiens
tgcccctggctttgcctc

SEQ ID NO: 4097127 - DNA, 21 bp, Homo sapiens
tgcccctggctttgcctcttc

SEQ ID NO: 4097128 - DNA, 21 bp, Homo sapiens
tgccccttaaacacaggctgt

SEQ ID NO: 4097129 - DNA, 16 bp, Homo sapiens
tgccccttcttgggcc

SEQ ID NO: 4097130 - DNA, 12 bp, Homo sapiens
tgccccttggct

SEQ ID NO: 4097131 - DNA, 20 bp, Homo sapiens
tgcccgaaactaagccaggc

SEQ ID NO: 4097132 - DNA, 23 bp, Homo sapiens
tgcccgaaactaagccaggcctg

SEQ ID NO: 4097133 - DNA, 15 bp, Homo sapiens
tgcccgactgactgg

SEQ ID NO: 4097134 - DNA, 12 bp, Homo sapiens
tgcccgccagtg

SEQ ID NO: 4097135 - DNA, 23 bp, Homo sapiens
tgcccggagattggacggcctga

SEQ ID NO: 4097136 - DNA, 21 bp, Homo sapiens
tgcccgggaaggtcaccagca

SEQ ID NO: 4097137 - DNA, 20 bp, Homo sapiens
tgcccgggcgcggccagccc

SEQ ID NO: 4097138 - DNA, 22 bp, Homo sapiens
tgcccgggcgcggccagccccg

SEQ ID NO: 4097139 - DNA, 19 bp, Homo sapiens
tgcccgtgtagtccccaac

SEQ ID NO: 4097140 - DNA, 21 bp, Homo sapiens
tgctaaaattctatagagata

SEQ ID NO: 4097141 - DNA, 15 bp, Homo sapiens
tgctaaattttcagt

SEQ ID NO: 4097142 - DNA, 21 bp, Homo sapiens
tgctaaattttcagtagggct

SEQ ID NO: 4097143 - DNA, 18 bp, Homo sapiens
tgctaagtaaatctcttc

SEQ ID NO: 4097144 - DNA, 20 bp, Homo sapiens
tgctaagtaaatctcttctg

SEQ ID NO: 4097145 - DNA, 13 bp, Homo sapiens
tgctaataaactg

SEQ ID NO: 4097146 - DNA, 14 bp, Homo sapiens
tgctaataaactgt

SEQ ID NO: 4097147 - DNA, 16 bp, Homo sapiens
tgctaatcaaagccag

SEQ ID NO: 4097148 - DNA, 17 bp, Homo sapiens
tgctaatcaaagccagg

SEQ ID NO: 4097149 - DNA, 20 bp, Homo sapiens
tgctaatcaaagccagggtc

SEQ ID NO: 4097150 - DNA, 21 bp, Homo sapiens
tgctaatcaaagccagggtct

SEQ ID NO: 4097151 - DNA, 23 bp, Homo sapiens
tgctaatcagggaggtcattttg

SEQ ID NO: 4097152 - DNA, 23 bp, Homo sapiens
tgctaatcatgtgggtgagccag

SEQ ID NO: 4097153 - DNA, 17 bp, Homo sapiens
tgctaattaaaaagtta

SEQ ID NO: 4097154 - DNA, 22 bp, Homo sapiens
tgctaattttctcaaaagcatt

SEQ ID NO: 4097155 - DNA, 18 bp, Homo sapiens
tgctacctcccttgcctt

SEQ ID NO: 4097156 - DNA, 18 bp, Homo sapiens
tgctactgcactccagcc

SEQ ID NO: 4097157 - DNA, 18 bp, Homo sapiens
tgctagaagctgtctagg

SEQ ID NO: 4097158 - DNA, 17 bp, Homo sapiens
tgctagaggttgcagca

SEQ ID NO: 4097159 - DNA, 14 bp, Homo sapiens
tgctagataaaagc

SEQ ID NO: 4097160 - DNA, 22 bp, Homo sapiens
tgctagcagtaaaagatgaagt

SEQ ID NO: 4097161 - DNA, 20 bp, Homo sapiens
tgctagcccttcaagtgcac

SEQ ID NO: 4097162 - DNA, 22 bp, Homo sapiens
tgctagcttgacacagtcagca

SEQ ID NO: 4097163 - DNA, 14 bp, Homo sapiens
tgctaggtctcgga

SEQ ID NO: 4097164 - DNA, 22 bp, Homo sapiens
tgctaggtctcggactaagcct

SEQ ID NO: 4097165 - DNA, 14 bp, Homo sapiens
tgctagtatttgaa

SEQ ID NO: 4097166 - DNA, 16 bp, Homo sapiens
tgctagtatttgaatt

SEQ ID NO: 4097167 - DNA, 20 bp, Homo sapiens
tgctagtatttgaattaaaa

SEQ ID NO: 4097168 - DNA, 23 bp, Homo sapiens
tgctagtatttgaattaaaactt

SEQ ID NO: 4097169 - DNA, 22 bp, Homo sapiens
tgctataatcattagttttaga

SEQ ID NO: 4097170 - DNA, 18 bp, Homo sapiens
tgctatagagcctacctg

SEQ ID NO: 4097171 - DNA, 13 bp, Homo sapiens
tgctatcaatgag

SEQ ID NO: 4097172 - DNA, 20 bp, Homo sapiens
tgctatccccatctccctgc

SEQ ID NO: 4097173 - DNA, 20 bp, Homo sapiens
tgctatctggaggccttcca

SEQ ID NO: 4097174 - DNA, 23 bp, Homo sapiens
tgctatctggaggccttccagct

SEQ ID NO: 4097175 - DNA, 13 bp, Homo sapiens
tgctatgaatgat

SEQ ID NO: 4097176 - DNA, 16 bp, Homo sapiens
tgctatgttactattt

SEQ ID NO: 4097177 - DNA, 16 bp, Homo sapiens
tgctattgacaagtca

SEQ ID NO: 4097178 - DNA, 13 bp, Homo sapiens
tgctatttatgca

SEQ ID NO: 4097179 - DNA, 23 bp, Homo sapiens
tgctcaacagcatatgggtggga

SEQ ID NO: 4097180 - DNA, 14 bp, Homo sapiens
tgctcaagaagaca

SEQ ID NO: 4097181 - DNA, 19 bp, Homo sapiens
tgctcaataaacacttgta

SEQ ID NO: 4097182 - DNA, 13 bp, Homo sapiens
tgctcaccagccc

SEQ ID NO: 4097183 - DNA, 14 bp, Homo sapiens
tgctcaccagccct

SEQ ID NO: 4097184 - DNA, 18 bp, Homo sapiens
tgctcaccagccctgcag

SEQ ID NO: 4097185 - DNA, 20 bp, Homo sapiens
tgctcaccagccctgcagcc

SEQ ID NO: 4097186 - DNA, 23 bp, Homo sapiens
tgctcaccgcccatcagggttct

SEQ ID NO: 4097187 - DNA, 20 bp, Homo sapiens
tgctcagaacttgctgctgt

SEQ ID NO: 4097188 - DNA, 20 bp, Homo sapiens
tgctcagcagtgagagcaga

SEQ ID NO: 4097189 - DNA, 12 bp, Homo sapiens
tgctcagccaag

SEQ ID NO: 4097190 - DNA, 13 bp, Homo sapiens
tgctcagccctga

SEQ ID NO: 4097191 - DNA, 22 bp, Homo sapiens
tgctcagccctgactggtgcta

SEQ ID NO: 4097192 - DNA, 13 bp, Homo sapiens
tgctcagctccta

SEQ ID NO: 4097193 - DNA, 15 bp, Homo sapiens
tgctcagctcctacc

SEQ ID NO: 4097194 - DNA, 19 bp, Homo sapiens
tgctcagctcctacctctg

SEQ ID NO: 4097195 - DNA, 14 bp, Homo sapiens
tgctcagtctccct

SEQ ID NO: 4097196 - DNA, 19 bp, Homo sapiens
tgctcattcttgaggagca

SEQ ID NO: 4097197 - DNA, 18 bp, Homo sapiens
tgctcatttaagtttcaa

SEQ ID NO: 4097198 - DNA, 15 bp, Homo sapiens
tgctcattttctggt

SEQ ID NO: 4097199 - DNA, 14 bp, Homo sapiens
tgctccaaatataa

SEQ ID NO: 4097200 - DNA, 14 bp, Homo sapiens
tgctccaccacatc

SEQ ID NO: 4097201 - DNA, 16 bp, Homo sapiens
tgctccaccagcagca

SEQ ID NO: 4097202 - DNA, 17 bp, Homo sapiens
tgctccacccttggcct

SEQ ID NO: 4097203 - DNA, 19 bp, Homo sapiens
tgctccacccttggcctgt

SEQ ID NO: 4097204 - DNA, 20 bp, Homo sapiens
tgctccacgaagccttaagc

SEQ ID NO: 4097205 - DNA, 12 bp, Homo sapiens
tgctccagctct

SEQ ID NO: 4097206 - DNA, 13 bp, Homo sapiens
tgctccagctctg

SEQ ID NO: 4097207 - DNA, 14 bp, Homo sapiens
tgctccaggcctgc

SEQ ID NO: 4097208 - DNA, 19 bp, Homo sapiens
tgctccataccttttctct

SEQ ID NO: 4097209 - DNA, 22 bp, Homo sapiens
tgctccatttataaccccagcc

SEQ ID NO: 4097210 - DNA, 23 bp, Homo sapiens
tgctccatttataaccccagcct

SEQ ID NO: 4097211 - DNA, 15 bp, Homo sapiens
tgctcccagcagccc

SEQ ID NO: 4097212 - DNA, 12 bp, Homo sapiens
tgctcccagcct

SEQ ID NO: 4097213 - DNA, 15 bp, Homo sapiens
tgctcccagcctgct

SEQ ID NO: 4097214 - DNA, 16 bp, Homo sapiens
tgctcccagcctgctg

SEQ ID NO: 4097215 - DNA, 22 bp, Homo sapiens
tgctcccatcattccttctggc

SEQ ID NO: 4097216 - DNA, 13 bp, Homo sapiens
tgctccccacagc

SEQ ID NO: 4097217 - DNA, 19 bp, Homo sapiens
tgctccccacagcgtccct

SEQ ID NO: 4097218 - DNA, 23 bp, Homo sapiens
tgctccccacagcgtccctggcg

SEQ ID NO: 4097219 - DNA, 22 bp, Homo sapiens
tgctccccagccctggctctgc

SEQ ID NO: 4097220 - DNA, 15 bp, Homo sapiens
tgctcccccttttcc

SEQ ID NO: 4097221 - DNA, 15 bp, Homo sapiens
tgctccctcagcctc

SEQ ID NO: 4097222 - DNA, 15 bp, Homo sapiens
tgctccctcccctgc

SEQ ID NO: 4097223 - DNA, 17 bp, Homo sapiens
tgctccctcccctgccc

SEQ ID NO: 4097224 - DNA, 15 bp, Homo sapiens
tgctccctgctttgg

SEQ ID NO: 4097225 - DNA, 12 bp, Homo sapiens
tgctccctgtgt

SEQ ID NO: 4097226 - DNA, 12 bp, Homo sapiens
tgctcccttcaa

SEQ ID NO: 4097227 - DNA, 15 bp, Homo sapiens
tgctcccttcagccc

SEQ ID NO: 4097228 - DNA, 20 bp, Homo sapiens
tgctccgccatggtgtcccg

SEQ ID NO: 4097229 - DNA, 18 bp, Homo sapiens
tgctccgctgctccttgg

SEQ ID NO: 4097230 - DNA, 13 bp, Homo sapiens
tgctcctagcaga

SEQ ID NO: 4097231 - DNA, 18 bp, Homo sapiens
tgctcctagcagacagaa

SEQ ID NO: 4097232 - DNA, 13 bp, Homo sapiens
tgctcctcctgcc

SEQ ID NO: 4097233 - DNA, 16 bp, Homo sapiens
tgctcctcctgccctg

SEQ ID NO: 4097234 - DNA, 13 bp, Homo sapiens
tgctcctgctttt

SEQ ID NO: 4097235 - DNA, 21 bp, Homo sapiens
tgctcctgcttttctgtcctg

SEQ ID NO: 4097236 - DNA, 12 bp, Homo sapiens
tgctccttggct

SEQ ID NO: 4097237 - DNA, 17 bp, Homo sapiens
tgctccttggcttacct

SEQ ID NO: 4097238 - DNA, 19 bp, Homo sapiens
tgctccttggcttacctga

SEQ ID NO: 4097239 - DNA, 23 bp, Homo sapiens
tgctcgccctcctttctgtgccc

SEQ ID NO: 4097240 - DNA, 13 bp, Homo sapiens
tgctcgccctgcg

SEQ ID NO: 4097241 - DNA, 13 bp, Homo sapiens
tgctctaggaaga

SEQ ID NO: 4097242 - DNA, 18 bp, Homo sapiens
tgctctagtgggacagcc

SEQ ID NO: 4097243 - DNA, 23 bp, Homo sapiens
tgccctaagcccccagggcctcc

SEQ ID NO: 4097244 - DNA, 13 bp, Homo sapiens
tgccctaagggac

SEQ ID NO: 4097245 - DNA, 17 bp, Homo sapiens
tgccctactgggagact

SEQ ID NO: 4097246 - DNA, 20 bp, Homo sapiens
tgccctagcccagactctga

SEQ ID NO: 4097247 - DNA, 16 bp, Homo sapiens
tgccctagctgacccc

SEQ ID NO: 4097248 - DNA, 18 bp, Homo sapiens
tgccctctctgagtctgg

SEQ ID NO: 4097249 - DNA, 16 bp, Homo sapiens
tgccctgcccccacga

SEQ ID NO: 4097250 - DNA, 15 bp, Homo sapiens
tgccctgctttgcaa

SEQ ID NO: 4097251 - DNA, 17 bp, Homo sapiens
tgccctggctgctgccc

SEQ ID NO: 4097252 - DNA, 18 bp, Homo sapiens
tgccctggtgaatcacct

SEQ ID NO: 4097253 - DNA, 19 bp, Homo sapiens
tgccctggtgaatcacctg

SEQ ID NO: 4097254 - DNA, 22 bp, Homo sapiens
tgccctggtgaatcacctggct

SEQ ID NO: 4097255 - DNA, 23 bp, Homo sapiens
tgccctggtgaatcacctggctg

SEQ ID NO: 4097256 - DNA, 12 bp, Homo sapiens
tgccctggtgct

SEQ ID NO: 4097257 - DNA, 16 bp, Homo sapiens
tgccctggtgctgcca

SEQ ID NO: 4097258 - DNA, 20 bp, Homo sapiens
tgccctggtgctgccacact

SEQ ID NO: 4097259 - DNA, 19 bp, Homo sapiens
tgccctgtcaggaggcaga

SEQ ID NO: 4097260 - DNA, 18 bp, Homo sapiens
tgccctgtccctgtcccc

SEQ ID NO: 4097261 - DNA, 15 bp, Homo sapiens
tgccctgtgtacttc

SEQ ID NO: 4097262 - DNA, 17 bp, Homo sapiens
tgccctgttcatgtgcc

SEQ ID NO: 4097263 - DNA, 17 bp, Homo sapiens
tgcccttcacagtgttt

SEQ ID NO: 4097264 - DNA, 18 bp, Homo sapiens
tgcccttctcaagacttt

SEQ ID NO: 4097265 - DNA, 19 bp, Homo sapiens
tgcccttctcaagacttta

SEQ ID NO: 4097266 - DNA, 13 bp, Homo sapiens
tgccgcagacggg

SEQ ID NO: 4097267 - DNA, 18 bp, Homo sapiens
tgccgctacctccctccc

SEQ ID NO: 4097268 - DNA, 12 bp, Homo sapiens
tgccgctgcacc

SEQ ID NO: 4097269 - DNA, 15 bp, Homo sapiens
tgccgctgcaccacg

SEQ ID NO: 4097270 - DNA, 16 bp, Homo sapiens
tgccgctgtataaagc

SEQ ID NO: 4097271 - DNA, 16 bp, Homo sapiens
tgccggatacaaactg

SEQ ID NO: 4097272 - DNA, 17 bp, Homo sapiens
tgccggcccccaggaca

SEQ ID NO: 4097273 - DNA, 22 bp, Homo sapiens
tgccgggctgagggcctgctgg

SEQ ID NO: 4097274 - DNA, 18 bp, Homo sapiens
tgccgggtgcagcatctg

SEQ ID NO: 4097275 - DNA, 19 bp, Homo sapiens
tgccgggttctagtctcct

SEQ ID NO: 4097276 - DNA, 16 bp, Homo sapiens
tgccggtcgggcagcc

SEQ ID NO: 4097277 - DNA, 18 bp, Homo sapiens
tgccggtcgggcagccag

SEQ ID NO: 4097278 - DNA, 17 bp, Homo sapiens
tgccgtgtattttttaa

SEQ ID NO: 4097279 - DNA, 19 bp, Homo sapiens
tgccgtgtgagtgtgacag

SEQ ID NO: 4097280 - DNA, 14 bp, Homo sapiens
tgcctaaaatataa

SEQ ID NO: 4097281 - DNA, 21 bp, Homo sapiens
tgcctaataaacatccttcaa

SEQ ID NO: 4097282 - DNA, 16 bp, Homo sapiens
tgcctacaaccatccc

SEQ ID NO: 4097283 - DNA, 17 bp, Homo sapiens
tgcctacagaacttcag

SEQ ID NO: 4097284 - DNA, 13 bp, Homo sapiens
tgcctacagccag

SEQ ID NO: 4097285 - DNA, 15 bp, Homo sapiens
tgcctacagccaggt

SEQ ID NO: 4097286 - DNA, 21 bp, Homo sapiens
tgcctagacttcccaacagcc

SEQ ID NO: 4097287 - DNA, 20 bp, Homo sapiens
tgcctagattaggtagactt

SEQ ID NO: 4097288 - DNA, 17 bp, Homo sapiens
tgcctagcaagctggcc

SEQ ID NO: 4097289 - DNA, 16 bp, Homo sapiens
tgcctagcagagtgct

SEQ ID NO: 4097290 - DNA, 13 bp, Homo sapiens
tgcctcaatgcca

SEQ ID NO: 4097291 - DNA, 21 bp, Homo sapiens
tgcctcagactccgccctcct

SEQ ID NO: 4097292 - DNA, 18 bp, Homo sapiens
tgcctcagcctcccgagt

SEQ ID NO: 4097293 - DNA, 15 bp, Homo sapiens
tgcctcagctgaccc

SEQ ID NO: 4097294 - DNA, 19 bp, Homo sapiens
tgcctcagctgacccggcc

SEQ ID NO: 4097295 - DNA, 22 bp, Homo sapiens
tgcctcccaaggtcctctcagt

SEQ ID NO: 4097296 - DNA, 16 bp, Homo sapiens
tgcctcccacttcact

SEQ ID NO: 4097297 - DNA, 17 bp, Homo sapiens
tgcctcccacttcactg

SEQ ID NO: 4097298 - DNA, 22 bp, Homo sapiens
tgcctccccatttcccatctgc

SEQ ID NO: 4097299 - DNA, 23 bp, Homo sapiens
tgcctccccatttcccatctgca

SEQ ID NO: 4097300 - DNA, 16 bp, Homo sapiens
tgcctcctcgttcctt

SEQ ID NO: 4097301 - DNA, 13 bp, Homo sapiens
tgcctcctgggaa

SEQ ID NO: 4097302 - DNA, 18 bp, Homo sapiens
tgcctcctgtggggaaag

SEQ ID NO: 4097303 - DNA, 13 bp, Homo sapiens
tgcctcgaaacac

SEQ ID NO: 4097304 - DNA, 21 bp, Homo sapiens
tgcctcgaaacacagaaacct

SEQ ID NO: 4097305 - DNA, 20 bp, Homo sapiens
tgcctcggcctcccaaagtg

SEQ ID NO: 4097306 - DNA, 19 bp, Homo sapiens
tgcctctcccgcaccaggc

SEQ ID NO: 4097307 - DNA, 16 bp, Homo sapiens
tgcctctctggaaaga

SEQ ID NO: 4097308 - DNA, 23 bp, Homo sapiens
tgcctctctggaaagaggctctg

SEQ ID NO: 4097309 - DNA, 15 bp, Homo sapiens
tgcctctgcagtctc

SEQ ID NO: 4097310 - DNA, 22 bp, Homo sapiens
tgcctctgccaaaggatgtgat

SEQ ID NO: 4097311 - DNA, 19 bp, Homo sapiens
tgcctctgcggggcagggc

SEQ ID NO: 4097312 - DNA, 14 bp, Homo sapiens
tgcctctgggactg

SEQ ID NO: 4097313 - DNA, 14 bp, Homo sapiens
tgcctcttctttgt

SEQ ID NO: 4097314 - DNA, 14 bp, Homo sapiens
tgcctctttcctgt

SEQ ID NO: 4097315 - DNA, 18 bp, Homo sapiens
tgcctctttcctgttgtt

SEQ ID NO: 4097316 - DNA, 12 bp, Homo sapiens
tgcctgaaacag

SEQ ID NO: 4097317 - DNA, 15 bp, Homo sapiens
tgcctgacactgagc

SEQ ID NO: 4097318 - DNA, 17 bp, Homo sapiens
tgcctgacactgagccc

SEQ ID NO: 4097319 - DNA, 17 bp, Homo sapiens
tgcctgaccccttgctc

SEQ ID NO: 4097320 - DNA, 21 bp, Homo sapiens
tgcctgaccccttgctccctt

SEQ ID NO: 4097321 - DNA, 16 bp, Homo sapiens
tgcctgactaattttt

SEQ ID NO: 4097322 - DNA, 13 bp, Homo sapiens
tgcctgagaggca

SEQ ID NO: 4097323 - DNA, 14 bp, Homo sapiens
tgcctgagaggcag

SEQ ID NO: 4097324 - DNA, 17 bp, Homo sapiens
tgcctgagaggcaggca

SEQ ID NO: 4097325 - DNA, 15 bp, Homo sapiens
tgcctgaggggcagc

SEQ ID NO: 4097326 - DNA, 16 bp, Homo sapiens
tgcctgaggtctgtac

SEQ ID NO: 4097327 - DNA, 16 bp, Homo sapiens
tgcctgcagagagaag

SEQ ID NO: 4097328 - DNA, 15 bp, Homo sapiens
tgcctgccagctgca

SEQ ID NO: 4097329 - DNA, 20 bp, Homo sapiens
tgcctgccccaaacaaatat

SEQ ID NO: 4097330 - DNA, 12 bp, Homo sapiens
tgcctgccccgc

SEQ ID NO: 4097331 - DNA, 23 bp, Homo sapiens
tgcctgccctgtcaggaggcaga

SEQ ID NO: 4097332 - DNA, 14 bp, Homo sapiens
tgcctgcgcctgct

SEQ ID NO: 4097333 - DNA, 15 bp, Homo sapiens
tgcctgctgggctcc

SEQ ID NO: 4097334 - DNA, 23 bp, Homo sapiens
tgcctgctgggctccccccagtg

SEQ ID NO: 4097335 - DNA, 19 bp, Homo sapiens
tgcctgcttggcccggccg

SEQ ID NO: 4097336 - DNA, 22 bp, Homo sapiens
tgcctggagagggtctcgctgt

SEQ ID NO: 4097337 - DNA, 14 bp, Homo sapiens
tgcctggagtgctg

SEQ ID NO: 4097338 - DNA, 16 bp, Homo sapiens
tgcctggagtgctgtg

SEQ ID NO: 4097339 - DNA, 20 bp, Homo sapiens
tgcctggcacttactggtcc

SEQ ID NO: 4097340 - DNA, 14 bp, Homo sapiens
tgcctggccagatt

SEQ ID NO: 4097341 - DNA, 12 bp, Homo sapiens
tgcctggccagg

SEQ ID NO: 4097342 - DNA, 13 bp, Homo sapiens
tgcctggccccag

SEQ ID NO: 4097343 - DNA, 19 bp, Homo sapiens
tgcctggccccagcctggg

SEQ ID NO: 4097344 - DNA, 20 bp, Homo sapiens
tgcctggccccagcctgggc

SEQ ID NO: 4097345 - DNA, 21 bp, Homo sapiens
tgcctggccccagcctgggcc

SEQ ID NO: 4097346 - DNA, 13 bp, Homo sapiens
tgcctggcctctg

SEQ ID NO: 4097347 - DNA, 16 bp, Homo sapiens
tgcctgggaatgtatt

SEQ ID NO: 4097348 - DNA, 14 bp, Homo sapiens
tgcctgggcccgga

SEQ ID NO: 4097349 - DNA, 21 bp, Homo sapiens
tgcctgggcccggaagggctt

SEQ ID NO: 4097350 - DNA, 22 bp, Homo sapiens
tgcctgggcccggaagggcttt

SEQ ID NO: 4097351 - DNA, 21 bp, Homo sapiens
tgcctgggggagttttcctct

SEQ ID NO: 4097352 - DNA, 19 bp, Homo sapiens
tgcctggtggtcagatgca

SEQ ID NO: 4097353 - DNA, 21 bp, Homo sapiens
tgcctggtggtcagatgcagg

SEQ ID NO: 4097354 - DNA, 15 bp, Homo sapiens
tgcctgtaaacatag

SEQ ID NO: 4097355 - DNA, 15 bp, Homo sapiens
tgcctgtagcagtga

SEQ ID NO: 4097356 - DNA, 15 bp, Homo sapiens
tgcctgtccagcctg

SEQ ID NO: 4097357 - DNA, 18 bp, Homo sapiens
tgcctgtccagcctgggc

SEQ ID NO: 4097358 - DNA, 19 bp, Homo sapiens
tgcctgtccagcctgggca

SEQ ID NO: 4097359 - DNA, 15 bp, Homo sapiens
tgcctgtctggctca

SEQ ID NO: 4097360 - DNA, 11 bp, Homo sapiens
tgcctgtgcca

SEQ ID NO: 4097361 - DNA, 14 bp, Homo sapiens
tgcctgtgccaata

SEQ ID NO: 4097362 - DNA, 15 bp, Homo sapiens
tgccttaaaatggaa

SEQ ID NO: 4097363 - DNA, 18 bp, Homo sapiens
tgccttaaacctacctcc

SEQ ID NO: 4097364 - DNA, 16 bp, Homo sapiens
tgccttaggcctacct

SEQ ID NO: 4097365 - DNA, 13 bp, Homo sapiens
tgccttcagctct

SEQ ID NO: 4097366 - DNA, 13 bp, Homo sapiens
tgccttcagctgt

SEQ ID NO: 4097367 - DNA, 18 bp, Homo sapiens
tgccttcatcttcactgc

SEQ ID NO: 4097368 - DNA, 17 bp, Homo sapiens
tgccttccctagcttta

SEQ ID NO: 4097369 - DNA, 23 bp, Homo sapiens
tgccttcctttctccaggaccaa

SEQ ID NO: 4097370 - DNA, 20 bp, Homo sapiens
tgccttcgttaactgtgtat

SEQ ID NO: 4097371 - DNA, 22 bp, Homo sapiens
tgccttcgttaactgtgtatgt

SEQ ID NO: 4097372 - DNA, 16 bp, Homo sapiens
tgccttctacttttaa

SEQ ID NO: 4097373 - DNA, 14 bp, Homo sapiens
tgccttctcctctc

SEQ ID NO: 4097374 - DNA, 17 bp, Homo sapiens
tgccttctccttcccca

SEQ ID NO: 4097375 - DNA, 15 bp, Homo sapiens
tgccttctgaaatgt

SEQ ID NO: 4097376 - DNA, 14 bp, Homo sapiens
tgccttcttcaccc

SEQ ID NO: 4097377 - DNA, 16 bp, Homo sapiens
tgccttcttcacccag

SEQ ID NO: 4097378 - DNA, 17 bp, Homo sapiens
tgccttcttcacccagc

SEQ ID NO: 4097379 - DNA, 14 bp, Homo sapiens
tgccttctttgaag

SEQ ID NO: 4097380 - DNA, 17 bp, Homo sapiens
tgccttctttgaagaag

SEQ ID NO: 4097381 - DNA, 18 bp, Homo sapiens
tgccttgaacctgtgagt

SEQ ID NO: 4097382 - DNA, 19 bp, Homo sapiens
tgccttgaacctgtgagta

SEQ ID NO: 4097383 - DNA, 15 bp, Homo sapiens
tgccttgcagccaca

SEQ ID NO: 4097384 - DNA, 19 bp, Homo sapiens
tgccttgcccactcctgct

SEQ ID NO: 4097385 - DNA, 20 bp, Homo sapiens
tgccttgctgtttgtcctga

SEQ ID NO: 4097386 - DNA, 13 bp, Homo sapiens
tgccttggagagg

SEQ ID NO: 4097387 - DNA, 18 bp, Homo sapiens
tgccttggcctcccaaag

SEQ ID NO: 4097388 - DNA, 16 bp, Homo sapiens
tgccttgggccttgct

SEQ ID NO: 4097389 - DNA, 17 bp, Homo sapiens
tgccttgggccttgctg

SEQ ID NO: 4097390 - DNA, 15 bp, Homo sapiens
tgccttgggctgctc

SEQ ID NO: 4097391 - DNA, 15 bp, Homo sapiens
tgccttgtgctgtta

SEQ ID NO: 4097392 - DNA, 23 bp, Homo sapiens
tgccttgtttgagtttttcctcc

SEQ ID NO: 4097393 - DNA, 20 bp, Homo sapiens
tgccttgttttttgtttgtt

SEQ ID NO: 4097394 - DNA, 17 bp, Homo sapiens
tgcctttctgggagcag

SEQ ID NO: 4097395 - DNA, 19 bp, Homo sapiens
tgcctttctgggagcagaa

SEQ ID NO: 4097396 - DNA, 21 bp, Homo sapiens
tgcctttctgggagcagaaac

SEQ ID NO: 4097397 - DNA, 18 bp, Homo sapiens
tgcctttcttctgccctt

SEQ ID NO: 4097398 - DNA, 14 bp, Homo sapiens
tgcctttctttgcc

SEQ ID NO: 4097399 - DNA, 15 bp, Homo sapiens
tgcctttctttgcct

SEQ ID NO: 4097400 - DNA, 17 bp, Homo sapiens
tgcctttctttgcctct

SEQ ID NO: 4097401 - DNA, 19 bp, Homo sapiens
tgcctttctttgcctctgc

SEQ ID NO: 4097402 - DNA, 15 bp, Homo sapiens
tgcctttgagacagt

SEQ ID NO: 4097403 - DNA, 19 bp, Homo sapiens
tgcctttgagacagtttct

SEQ ID NO: 4097404 - DNA, 12 bp, Homo sapiens
tgcctttggcct

SEQ ID NO: 4097405 - DNA, 13 bp, Homo sapiens
tgcctttgtaagt

SEQ ID NO: 4097406 - DNA, 14 bp, Homo sapiens
tgccttttatccca

SEQ ID NO: 4097407 - DNA, 15 bp, Homo sapiens
tgccttttgcagaag

SEQ ID NO: 4097408 - DNA, 19 bp, Homo sapiens
tgccttttgcagaagaggg

SEQ ID NO: 4097409 - DNA, 14 bp, Homo sapiens
tgccttttgctgcg

SEQ ID NO: 4097410 - DNA, 15 bp, Homo sapiens
tgccttttgctgcgc

SEQ ID NO: 4097411 - DNA, 18 bp, Homo sapiens
tgccttttgctgcgcacc

SEQ ID NO: 4097412 - DNA, 14 bp, Homo sapiens
tgccttttgtgtga

SEQ ID NO: 4097413 - DNA, 16 bp, Homo sapiens
tgcgatcttcagagca

SEQ ID NO: 4097414 - DNA, 17 bp, Homo sapiens
tgcgcaccaatgcccag

SEQ ID NO: 4097415 - DNA, 21 bp, Homo sapiens
tgcgcaccaatgcccagcagg

SEQ ID NO: 4097416 - DNA, 15 bp, Homo sapiens
tgcgccagtcctgct

SEQ ID NO: 4097417 - DNA, 13 bp, Homo sapiens
tgcgcctcagccc

SEQ ID NO: 4097418 - DNA, 15 bp, Homo sapiens
tgcgcctcagccctc

SEQ ID NO: 4097419 - DNA, 16 bp, Homo sapiens
tgcgcctgcaggcaga

SEQ ID NO: 4097420 - DNA, 20 bp, Homo sapiens
tgcgcctgcaggcagagctg

SEQ ID NO: 4097421 - DNA, 18 bp, Homo sapiens
tgcgctctcaagaccaga

SEQ ID NO: 4097422 - DNA, 17 bp, Homo sapiens
tgcgctttattgcccat

SEQ ID NO: 4097423 - DNA, 18 bp, Homo sapiens
tgcgctttattgcccatg

SEQ ID NO: 4097424 - DNA, 15 bp, Homo sapiens
tgcggacaagtttta

SEQ ID NO: 4097425 - DNA, 17 bp, Homo sapiens
tgcggaggagctgcctg

SEQ ID NO: 4097426 - DNA, 19 bp, Homo sapiens
tgcggaggagctgcctgct

SEQ ID NO: 4097427 - DNA, 23 bp, Homo sapiens
tgcggatggacactaatgcagcc

SEQ ID NO: 4097428 - DNA, 16 bp, Homo sapiens
tgcggccccaggaggg

SEQ ID NO: 4097429 - DNA, 16 bp, Homo sapiens
tgcgggctgaggccag

SEQ ID NO: 4097430 - DNA, 18 bp, Homo sapiens
tgcgggctgaggccagag

SEQ ID NO: 4097431 - DNA, 21 bp, Homo sapiens
tgcgggtgaacaaagcagcca

SEQ ID NO: 4097432 - DNA, 22 bp, Homo sapiens
tgcgggtgaacaaagcagccac

SEQ ID NO: 4097433 - DNA, 23 bp, Homo sapiens
tgcgggtgaacaaagcagccacg

SEQ ID NO: 4097434 - DNA, 15 bp, Homo sapiens
tgcggtagccagcac

SEQ ID NO: 4097435 - DNA, 18 bp, Homo sapiens
tgcggtagccagcacaca

SEQ ID NO: 4097436 - DNA, 21 bp, Homo sapiens
tgcggtggctcacgcctgtaa

SEQ ID NO: 4097437 - DNA, 19 bp, Homo sapiens
tgcggttataaaaaatggt

SEQ ID NO: 4097438 - DNA, 20 bp, Homo sapiens
tgcggttataaaaaatggtt

SEQ ID NO: 4097439 - DNA, 22 bp, Homo sapiens
tgcggttataaaaaatggttca

SEQ ID NO: 4097440 - DNA, 21 bp, Homo sapiens
tgcggtttgttggatcttcaa

SEQ ID NO: 4097441 - DNA, 15 bp, Homo sapiens
tgcgtacgtttcctg

SEQ ID NO: 4097442 - DNA, 20 bp, Homo sapiens
tgcgtacgtttcctgagaag

SEQ ID NO: 4097443 - DNA, 14 bp, Homo sapiens
tgcgtatgtctgtt

SEQ ID NO: 4097444 - DNA, 20 bp, Homo sapiens
tgcgtgaatgtatgtaatgt

SEQ ID NO: 4097445 - DNA, 14 bp, Homo sapiens
tgcgtgacaataaa

SEQ ID NO: 4097446 - DNA, 15 bp, Homo sapiens
tgcgtgacaataaaa

SEQ ID NO: 4097447 - DNA, 22 bp, Homo sapiens
tgcgtgacaataaaacattaat

SEQ ID NO: 4097448 - DNA, 12 bp, Homo sapiens
tgcgtgtgtaga

SEQ ID NO: 4097449 - DNA, 19 bp, Homo sapiens
tgcgtgtgtagagttaaga

SEQ ID NO: 4097450 - DNA, 21 bp, Homo sapiens
tgcatttagaactttctgctt

SEQ ID NO: 4097451 - DNA, 16 bp, Homo sapiens
tgcatttatatgtacc

SEQ ID NO: 4097452 - DNA, 14 bp, Homo sapiens
tgcatttccagctg

SEQ ID NO: 4097453 - DNA, 13 bp, Homo sapiens
tgcatttcctgac

SEQ ID NO: 4097454 - DNA, 14 bp, Homo sapiens
tgcatttcctgaca

SEQ ID NO: 4097455 - DNA, 19 bp, Homo sapiens
tgcatttctgaatagaaat

SEQ ID NO: 4097456 - DNA, 16 bp, Homo sapiens
tgcatttgtaaatgct

SEQ ID NO: 4097457 - DNA, 18 bp, Homo sapiens
tgcatttgttcagctccc

SEQ ID NO: 4097458 - DNA, 13 bp, Homo sapiens
tgcattttgctat

SEQ ID NO: 4097459 - DNA, 17 bp, Homo sapiens
tgcattttgctattgta

SEQ ID NO: 4097460 - DNA, 18 bp, Homo sapiens
tgcattttgctattgtaa

SEQ ID NO: 4097461 - DNA, 23 bp, Homo sapiens
tgcattttggagagtttcctgaa

SEQ ID NO: 4097462 - DNA, 19 bp, Homo sapiens
tgcatttttattaaagcat

SEQ ID NO: 4097463 - DNA, 21 bp, Homo sapiens
tgcatttttattaaagcattt

SEQ ID NO: 4097464 - DNA, 17 bp, Homo sapiens
tgcatttttgtgaaatg

SEQ ID NO: 4097465 - DNA, 22 bp, Homo sapiens
tgccaaaaccaggcctctgctg

SEQ ID NO: 4097466 - DNA, 23 bp, Homo sapiens
tgccaaaaccaggcctctgctgc

SEQ ID NO: 4097467 - DNA, 17 bp, Homo sapiens
tgccaaacaaaaaggtt

SEQ ID NO: 4097468 - DNA, 19 bp, Homo sapiens
tgccaaaggatgtgatata

SEQ ID NO: 4097469 - DNA, 17 bp, Homo sapiens
tgccaaatatgtcctgg

SEQ ID NO: 4097470 - DNA, 15 bp, Homo sapiens
tgccaaatgctgggg

SEQ ID NO: 4097471 - DNA, 23 bp, Homo sapiens
tgccaaattttggccaaagtgtt

SEQ ID NO: 4097472 - DNA, 21 bp, Homo sapiens
tgccaacaccacagaaatggg

SEQ ID NO: 4097473 - DNA, 22 bp, Homo sapiens
tgccaaggccagagtggcctgg

SEQ ID NO: 4097474 - DNA, 12 bp, Homo sapiens
tgccaaggcctc

SEQ ID NO: 4097475 - DNA, 20 bp, Homo sapiens
tgccaaggcctccctcaggc

SEQ ID NO: 4097476 - DNA, 23 bp, Homo sapiens
tgccaagtcatagccataaatga

SEQ ID NO: 4097477 - DNA, 19 bp, Homo sapiens
tgccaagtggggatggggc

SEQ ID NO: 4097478 - DNA, 18 bp, Homo sapiens
tgccaataaaagttttct

SEQ ID NO: 4097479 - DNA, 13 bp, Homo sapiens
tgccaataaccaa

SEQ ID NO: 4097480 - DNA, 18 bp, Homo sapiens
tgccaatattaaatctgc

SEQ ID NO: 4097481 - DNA, 15 bp, Homo sapiens
tgccaatcttgtttt

SEQ ID NO: 4097482 - DNA, 17 bp, Homo sapiens
tgccaatcttgttttaa

SEQ ID NO: 4097483 - DNA, 20 bp, Homo sapiens
tgccaatgaggtctgaaatg

SEQ ID NO: 4097484 - DNA, 18 bp, Homo sapiens
tgccacaatgcagttctg

SEQ ID NO: 4097485 - DNA, 13 bp, Homo sapiens
tgccacacagagt

SEQ ID NO: 4097486 - DNA, 14 bp, Homo sapiens
tgccacaccctccc

SEQ ID NO: 4097487 - DNA, 12 bp, Homo sapiens
tgccacacttca

SEQ ID NO: 4097488 - DNA, 13 bp, Homo sapiens
tgccacacttcag

SEQ ID NO: 4097489 - DNA, 23 bp, Homo sapiens
tgccacacttcaggctcttctcc

SEQ ID NO: 4097490 - DNA, 14 bp, Homo sapiens
tgccacagccagag

SEQ ID NO: 4097491 - DNA, 22 bp, Homo sapiens
tgccacagctggagctctcaaa

SEQ ID NO: 4097492 - DNA, 18 bp, Homo sapiens
tgccacatacaggtgctc

SEQ ID NO: 4097493 - DNA, 23 bp, Homo sapiens
tgccacatttctgatcagaggtg

SEQ ID NO: 4097494 - DNA, 21 bp, Homo sapiens
tgccaccaaaagtgctcccca

SEQ ID NO: 4097495 - DNA, 16 bp, Homo sapiens
tgccaccacctctgtg

SEQ ID NO: 4097496 - DNA, 22 bp, Homo sapiens
tgccaccacctctgtggcattg

SEQ ID NO: 4097497 - DNA, 17 bp, Homo sapiens
tgccacccaccagggcg

SEQ ID NO: 4097498 - DNA, 19 bp, Homo sapiens
tgccacccactcaggattg

SEQ ID NO: 4097499 - DNA, 14 bp, Homo sapiens
tgccaccccaccct

SEQ ID NO: 4097500 - DNA, 19 bp, Homo sapiens
tgccaccccaccctccctg

SEQ ID NO: 4097501 - DNA, 21 bp, Homo sapiens
tgccaccccaccctccctgga

SEQ ID NO: 4097502 - DNA, 18 bp, Homo sapiens
tgccacccctgtccagat

SEQ ID NO: 4097503 - DNA, 13 bp, Homo sapiens
tgccaccctcaca

SEQ ID NO: 4097504 - DNA, 17 bp, Homo sapiens
tgccaccctcacacaca

SEQ ID NO: 4097505 - DNA, 14 bp, Homo sapiens
tgccacgctttgct

SEQ ID NO: 4097506 - DNA, 15 bp, Homo sapiens
tgccacgtggtcact

SEQ ID NO: 4097507 - DNA, 17 bp, Homo sapiens
tgccacgtggtcactgt

SEQ ID NO: 4097508 - DNA, 18 bp, Homo sapiens
tgccacgtggtcactgtg

SEQ ID NO: 4097509 - DNA, 21 bp, Homo sapiens
tgccacgtggtcactgtgcac

SEQ ID NO: 4097510 - DNA, 14 bp, Homo sapiens
tgccacgttccaca

SEQ ID NO: 4097511 - DNA, 20 bp, Homo sapiens
tgccacgttccacagttgcc

SEQ ID NO: 4097512 - DNA, 19 bp, Homo sapiens
tgccactaaactacattgt

SEQ ID NO: 4097513 - DNA, 14 bp, Homo sapiens
tgccactcctccct

SEQ ID NO: 4097514 - DNA, 16 bp, Homo sapiens
tgccactcctccctcc

SEQ ID NO: 4097515 - DNA, 19 bp, Homo sapiens
tgccactgcccgagctggt

SEQ ID NO: 4097516 - DNA, 20 bp, Homo sapiens
tgccactgcccgagctggtg

SEQ ID NO: 4097517 - DNA, 15 bp, Homo sapiens
tgccacttcctttta

SEQ ID NO: 4097518 - DNA, 19 bp, Homo sapiens
tgccagaaacagtgggagc

SEQ ID NO: 4097519 - DNA, 22 bp, Homo sapiens
tgccagaaacagtgggagccct

SEQ ID NO: 4097520 - DNA, 18 bp, Homo sapiens
tgccagaagatcccctca

SEQ ID NO: 4097521 - DNA, 20 bp, Homo sapiens
tgccagaagatcccctcagg

SEQ ID NO: 4097522 - DNA, 20 bp, Homo sapiens
tgccagattctgcctctctg

SEQ ID NO: 4097523 - DNA, 22 bp, Homo sapiens
tgccagcaatgacatctcaggg

SEQ ID NO: 4097524 - DNA, 20 bp, Homo sapiens
tgccagcagccccgtctgcc

SEQ ID NO: 4097525 - DNA, 13 bp, Homo sapiens
tgccagcccagaa

SEQ ID NO: 4097526 - DNA, 15 bp, Homo sapiens
tgccagcccagaaca

SEQ ID NO: 4097527 - DNA, 16 bp, Homo sapiens
tgccagcccagaacac

SEQ ID NO: 4097528 - DNA, 15 bp, Homo sapiens
tgccagcccagaggc

SEQ ID NO: 4097529 - DNA, 19 bp, Homo sapiens
tgccagccgtgatgctcag

SEQ ID NO: 4097530 - DNA, 17 bp, Homo sapiens
tgccagctcagtcccat

SEQ ID NO: 4097531 - DNA, 14 bp, Homo sapiens
tgccagctgtgtcc

SEQ ID NO: 4097532 - DNA, 14 bp, Homo sapiens
tgccagcttctctc

SEQ ID NO: 4097533 - DNA, 18 bp, Homo sapiens
tgccagcttctctctcca

SEQ ID NO: 4097534 - DNA, 20 bp, Homo sapiens
tgccagcttctctctccagg

SEQ ID NO: 4097535 - DNA, 22 bp, Homo sapiens
tgccagcttctctctccagggt

SEQ ID NO: 4097536 - DNA, 23 bp, Homo sapiens
tgccaggactccccaggccaggc

SEQ ID NO: 4097537 - DNA, 17 bp, Homo sapiens
tgccaggagcaatggga

SEQ ID NO: 4097538 - DNA, 19 bp, Homo sapiens
tgccaggagcaatgggact

SEQ ID NO: 4097539 - DNA, 16 bp, Homo sapiens
tgccaggcaggggtgg

SEQ ID NO: 4097540 - DNA, 19 bp, Homo sapiens
tgccaggccagagggcagt

SEQ ID NO: 4097541 - DNA, 18 bp, Homo sapiens
tgccaggccagcctccga

SEQ ID NO: 4097542 - DNA, 11 bp, Homo sapiens
tgccagggagc

SEQ ID NO: 4097543 - DNA, 17 bp, Homo sapiens
tgccagggcccacccca

SEQ ID NO: 4097544 - DNA, 18 bp, Homo sapiens
tgccagggcccaccccag

SEQ ID NO: 4097545 - DNA, 22 bp, Homo sapiens
tgccaggtgaaggaggctccag

SEQ ID NO: 4097546 - DNA, 14 bp, Homo sapiens
tgccaggtgagaaa

SEQ ID NO: 4097547 - DNA, 24 bp, Homo sapiens
tgccagtaacacaggccaccctgt

SEQ ID NO: 4097548 - DNA, 23 bp, Homo sapiens
tgccagtaccagccccaccctgt

SEQ ID NO: 4097549 - DNA, 17 bp, Homo sapiens
tgccagtcaagaagaaa

SEQ ID NO: 4097550 - DNA, 17 bp, Homo sapiens
tgccagtgacagacagg

SEQ ID NO: 4097551 - DNA, 15 bp, Homo sapiens
tgccagtgcagccac

SEQ ID NO: 4097552 - DNA, 14 bp, Homo sapiens
tgccagtgctggtc

SEQ ID NO: 4097553 - DNA, 21 bp, Homo sapiens
tgcaggagagagcagcactcc

SEQ ID NO: 4097554 - DNA, 19 bp, Homo sapiens
tgcaggagtgtcctgccca

SEQ ID NO: 4097555 - DNA, 14 bp, Homo sapiens
tgcaggataataat

SEQ ID NO: 4097556 - DNA, 21 bp, Homo sapiens
tgcaggattctcaccagctgt

SEQ ID NO: 4097557 - DNA, 15 bp, Homo sapiens
tgcaggcagagctgg

SEQ ID NO: 4097558 - DNA, 19 bp, Homo sapiens
tgcaggcagagctggagcc

SEQ ID NO: 4097559 - DNA, 10 bp, Homo sapiens
tgcaggcagg

SEQ ID NO: 4097560 - DNA, 19 bp, Homo sapiens
tgcaggctgagccactctc

SEQ ID NO: 4097561 - DNA, 20 bp, Homo sapiens
tgcagggcagccccacaact

SEQ ID NO: 4097562 - DNA, 13 bp, Homo sapiens
tgcagggcagtca

SEQ ID NO: 4097563 - DNA, 15 bp, Homo sapiens
tgcagggccactgga

SEQ ID NO: 4097564 - DNA, 17 bp, Homo sapiens
tgcagggccactggaag

SEQ ID NO: 4097565 - DNA, 19 bp, Homo sapiens
tgcagggctaaggccccca

SEQ ID NO: 4097566 - DNA, 12 bp, Homo sapiens
tgcagggctggt

SEQ ID NO: 4097567 - DNA, 18 bp, Homo sapiens
tgcagggctggtttgttc

SEQ ID NO: 4097568 - DNA, 19 bp, Homo sapiens
tgcagggctggtttgttct

SEQ ID NO: 4097569 - DNA, 13 bp, Homo sapiens
tgcaggggtgacg

SEQ ID NO: 4097570 - DNA, 14 bp, Homo sapiens
tgcaggggtgacgg

SEQ ID NO: 4097571 - DNA, 12 bp, Homo sapiens
tgcaggtgggca

SEQ ID NO: 4097572 - DNA, 20 bp, Homo sapiens
tgcaggtgggcactggagca

SEQ ID NO: 4097573 - DNA, 21 bp, Homo sapiens
tgcaggtgggcactggagcat

SEQ ID NO: 4097574 - DNA, 16 bp, Homo sapiens
tgcaggtgtcctgagc

SEQ ID NO: 4097575 - DNA, 13 bp, Homo sapiens
tgcagtaaatctt

SEQ ID NO: 4097576 - DNA, 14 bp, Homo sapiens
tgcagtaaatcttt

SEQ ID NO: 4097577 - DNA, 16 bp, Homo sapiens
tgcagtagagtcatct

SEQ ID NO: 4097578 - DNA, 19 bp, Homo sapiens
tgcagtagagtcatctcca

SEQ ID NO: 4097579 - DNA, 22 bp, Homo sapiens
tgcagtagagtcatctccatca

SEQ ID NO: 4097580 - DNA, 21 bp, Homo sapiens
tgcagtcagtcatgatggcac

SEQ ID NO: 4097581 - DNA, 13 bp, Homo sapiens
tgcagtgaattgt

SEQ ID NO: 4097582 - DNA, 17 bp, Homo sapiens
tgcagtgatatggcaga

SEQ ID NO: 4097583 - DNA, 20 bp, Homo sapiens
tgcagtgatatggcagaaga

SEQ ID NO: 4097584 - DNA, 21 bp, Homo sapiens
tgcagtgatatggcagaagac

SEQ ID NO: 4097585 - DNA, 18 bp, Homo sapiens
tgcagtggcgtgatcttg

SEQ ID NO: 4097586 - DNA, 14 bp, Homo sapiens
tgcagtgtgaaaag

SEQ ID NO: 4097587 - DNA, 21 bp, Homo sapiens
tgcagttcccccaacctcaga

SEQ ID NO: 4097588 - DNA, 18 bp, Homo sapiens
tgcagttggactctcagg

SEQ ID NO: 4097589 - DNA, 12 bp, Homo sapiens
tgcagtttccaa

SEQ ID NO: 4097590 - DNA, 13 bp, Homo sapiens
tgcagtttcctgg

SEQ ID NO: 4097591 - DNA, 14 bp, Homo sapiens
tgcagtttcctgga

SEQ ID NO: 4097592 - DNA, 19 bp, Homo sapiens
tgcagtttgagacaggaga

SEQ ID NO: 4097593 - DNA, 20 bp, Homo sapiens
tgcataaaagggtcaaacct

SEQ ID NO: 4097594 - DNA, 23 bp, Homo sapiens
tgcataaaagggtcaaacctgta

SEQ ID NO: 4097595 - DNA, 14 bp, Homo sapiens
tgcataaatatgca

SEQ ID NO: 4097596 - DNA, 19 bp, Homo sapiens
tgcataataagctaaagag

SEQ ID NO: 4097597 - DNA, 18 bp, Homo sapiens
tgcataatgataaaataa

SEQ ID NO: 4097598 - DNA, 19 bp, Homo sapiens
tgcataggctcttaagcag

SEQ ID NO: 4097599 - DNA, 20 bp, Homo sapiens
tgcatagtaccaatcatttt

SEQ ID NO: 4097600 - DNA, 22 bp, Homo sapiens
tgcatagtaccaatcattttaa

SEQ ID NO: 4097601 - DNA, 22 bp, Homo sapiens
tgcatatttatccaaaatgtgt

SEQ ID NO: 4097602 - DNA, 16 bp, Homo sapiens
tgcatattttgagaaa

SEQ ID NO: 4097603 - DNA, 18 bp, Homo sapiens
tgcatattttgagaaact

SEQ ID NO: 4097604 - DNA, 19 bp, Homo sapiens
tgcatcactgggtgttgat

SEQ ID NO: 4097605 - DNA, 16 bp, Homo sapiens
tgcatcatccttgcag

SEQ ID NO: 4097606 - DNA, 19 bp, Homo sapiens
tgcatcccagcacctgcct

SEQ ID NO: 4097607 - DNA, 20 bp, Homo sapiens
tgcatcccagcacctgcctc

SEQ ID NO: 4097608 - DNA, 24 bp, Homo sapiens
tgcatcccgtacctcttcccatga

SEQ ID NO: 4097609 - DNA, 18 bp, Homo sapiens
tgcatctagcctcaagct

SEQ ID NO: 4097610 - DNA, 13 bp, Homo sapiens
tgcatctcagccc

SEQ ID NO: 4097611 - DNA, 19 bp, Homo sapiens
tgcatctcctcccgccctt

SEQ ID NO: 4097612 - DNA, 19 bp, Homo sapiens
tgcatctgggattcccacc

SEQ ID NO: 4097613 - DNA, 20 bp, Homo sapiens
tgcatgaagagaagcaattt

SEQ ID NO: 4097614 - DNA, 23 bp, Homo sapiens
tgcatgaagagaagcaattttgg

SEQ ID NO: 4097615 - DNA, 11 bp, Homo sapiens
tgcatgaagca

SEQ ID NO: 4097616 - DNA, 18 bp, Homo sapiens
tgcatgattttgtaaccc

SEQ ID NO: 4097617 - DNA, 14 bp, Homo sapiens
tgcatgccctctct

SEQ ID NO: 4097618 - DNA, 20 bp, Homo sapiens
tgcatggacctaacattcga

SEQ ID NO: 4097619 - DNA, 13 bp, Homo sapiens
tgcatggaggccc

SEQ ID NO: 4097620 - DNA, 17 bp, Homo sapiens
tgcatgggtgaagggag

SEQ ID NO: 4097621 - DNA, 16 bp, Homo sapiens
tgcattaaattcacaa

SEQ ID NO: 4097622 - DNA, 20 bp, Homo sapiens
tgcattaaattcacaaactt

SEQ ID NO: 4097623 - DNA, 21 bp, Homo sapiens
tgcattaaattcacaaacttt

SEQ ID NO: 4097624 - DNA, 11 bp, Homo sapiens
tgcattacaga

SEQ ID NO: 4097625 - DNA, 12 bp, Homo sapiens
tgcattacagag

SEQ ID NO: 4097626 - DNA, 17 bp, Homo sapiens
tgcattacagagaggag

SEQ ID NO: 4097627 - DNA, 18 bp, Homo sapiens
tgcattacagagaggaga

SEQ ID NO: 4097628 - DNA, 22 bp, Homo sapiens
tgcattacagagaggagaaaca

SEQ ID NO: 4097629 - DNA, 23 bp, Homo sapiens
tgcattacagagaggagaaacac

SEQ ID NO: 4097630 - DNA, 20 bp, Homo sapiens
tgcattagaaatagacagta

SEQ ID NO: 4097631 - DNA, 23 bp, Homo sapiens
tgcattagaaattagctgtgtga

SEQ ID NO: 4097632 - DNA, 15 bp, Homo sapiens
tgcattagtaacttt

SEQ ID NO: 4097633 - DNA, 23 bp, Homo sapiens
tgcattattcatttagtgagtta

SEQ ID NO: 4097634 - DNA, 14 bp, Homo sapiens
tgcattcaaattaa

SEQ ID NO: 4097635 - DNA, 11 bp, Homo sapiens
tgcattcattt

SEQ ID NO: 4097636 - DNA, 12 bp, Homo sapiens
tgcattccagaa

SEQ ID NO: 4097637 - DNA, 17 bp, Homo sapiens
tgcattccagaatcttg

SEQ ID NO: 4097638 - DNA, 18 bp, Homo sapiens
tgcattccagctgtcact

SEQ ID NO: 4097639 - DNA, 18 bp, Homo sapiens
tgcattcctttgtcttca

SEQ ID NO: 4097640 - DNA, 20 bp, Homo sapiens
tgcattcctttgtcttcaaa

SEQ ID NO: 4097641 - DNA, 21 bp, Homo sapiens
tgcattcgttgtgttttttaa

SEQ ID NO: 4097642 - DNA, 13 bp, Homo sapiens
tgcattctatcgt

SEQ ID NO: 4097643 - DNA, 23 bp, Homo sapiens
tgcattctatcgttattataaat

SEQ ID NO: 4097644 - DNA, 14 bp, Homo sapiens
tgcattctattgcc

SEQ ID NO: 4097645 - DNA, 15 bp, Homo sapiens
tgcattctattgcct

SEQ ID NO: 4097646 - DNA, 16 bp, Homo sapiens
tgcattctattgcctt

SEQ ID NO: 4097647 - DNA, 18 bp, Homo sapiens
tgcattgaacacaaactg

SEQ ID NO: 4097648 - DNA, 22 bp, Homo sapiens
tgcattgaacacaaactgtaaa

SEQ ID NO: 4097649 - DNA, 13 bp, Homo sapiens
tgcattgaatata

SEQ ID NO: 4097650 - DNA, 16 bp, Homo sapiens
tgcattgaatatatta

SEQ ID NO: 4097651 - DNA, 22 bp, Homo sapiens
tgcattgaccgcgactaatttc

SEQ ID NO: 4097652 - DNA, 18 bp, Homo sapiens
tgcattgccgctgtataa

SEQ ID NO: 4097653 - DNA, 17 bp, Homo sapiens
tgcattgtgattggcct

SEQ ID NO: 4097654 - DNA, 19 bp, Homo sapiens
tgcattgttggctatttga

SEQ ID NO: 4097655 - DNA, 23 bp, Homo sapiens
tgcattgttggctatttgaaata

SEQ ID NO: 4097656 - DNA, 12 bp, Homo sapiens
tgcaccagagca

SEQ ID NO: 4097657 - DNA, 18 bp, Homo sapiens
tgcacccacccaggagtg

SEQ ID NO: 4097658 - DNA, 14 bp, Homo sapiens
tgcacccacgtgca

SEQ ID NO: 4097659 - DNA, 20 bp, Homo sapiens
tgcacccatgggctctgaca

SEQ ID NO: 4097660 - DNA, 22 bp, Homo sapiens
tgcacccctgagccagcagggc

SEQ ID NO: 4097661 - DNA, 19 bp, Homo sapiens
tgcaccccttctctcctcc

SEQ ID NO: 4097662 - DNA, 15 bp, Homo sapiens
tgcacccggcctgga

SEQ ID NO: 4097663 - DNA, 23 bp, Homo sapiens
tgcacccggcctggatgccagct

SEQ ID NO: 4097664 - DNA, 21 bp, Homo sapiens
tgcaccctgcgcctccagagg

SEQ ID NO: 4097665 - DNA, 15 bp, Homo sapiens
tgcaccctggggcct

SEQ ID NO: 4097666 - DNA, 13 bp, Homo sapiens
tgcacctgtcccc

SEQ ID NO: 4097667 - DNA, 17 bp, Homo sapiens
tgcacctgtccccaccc

SEQ ID NO: 4097668 - DNA, 17 bp, Homo sapiens
tgcacgtggagagctgg

SEQ ID NO: 4097669 - DNA, 20 bp, Homo sapiens
tgcacgtggagagctggtgc

SEQ ID NO: 4097670 - DNA, 21 bp, Homo sapiens
tgcacgtggagagctggtgcc

SEQ ID NO: 4097671 - DNA, 17 bp, Homo sapiens
tgcacgtggcctcttga

SEQ ID NO: 4097672 - DNA, 19 bp, Homo sapiens
tgcacgtggcctcttgagc

SEQ ID NO: 4097673 - DNA, 19 bp, Homo sapiens
tgcacgttcataaccaaca

SEQ ID NO: 4097674 - DNA, 18 bp, Homo sapiens
tgcactaaagccagcctg

SEQ ID NO: 4097675 - DNA, 20 bp, Homo sapiens
tgcactaaagccagcctgac

SEQ ID NO: 4097676 - DNA, 22 bp, Homo sapiens
tgcactaaagccagcctgacct

SEQ ID NO: 4097677 - DNA, 16 bp, Homo sapiens
tgcactaaatgaatct

SEQ ID NO: 4097678 - DNA, 23 bp, Homo sapiens
tgcactaagagaaaattgcacta

SEQ ID NO: 4097679 - DNA, 15 bp, Homo sapiens
tgcactactgacatg

SEQ ID NO: 4097680 - DNA, 15 bp, Homo sapiens
tgcactccagcctgg

SEQ ID NO: 4097681 - DNA, 16 bp, Homo sapiens
tgcactccagcctggg

SEQ ID NO: 4097682 - DNA, 15 bp, Homo sapiens
tgcactctaaactgc

SEQ ID NO: 4097683 - DNA, 20 bp, Homo sapiens
tgcactgaaaacttagccag

SEQ ID NO: 4097684 - DNA, 21 bp, Homo sapiens
tgcactgaaaacttagccaga

SEQ ID NO: 4097685 - DNA, 22 bp, Homo sapiens
tgcactgaataaagcacgtgca

SEQ ID NO: 4097686 - DNA, 17 bp, Homo sapiens
tgcactgagagggcaag

SEQ ID NO: 4097687 - DNA, 14 bp, Homo sapiens
tgcactgagggcca

SEQ ID NO: 4097688 - DNA, 19 bp, Homo sapiens
tgcactgagggccacacta

SEQ ID NO: 4097689 - DNA, 17 bp, Homo sapiens
tgcactgatgctgcccc

SEQ ID NO: 4097690 - DNA, 21 bp, Homo sapiens
tgcactgatgctgcccctcat

SEQ ID NO: 4097691 - DNA, 21 bp, Homo sapiens
tgcactgcccatggacaggct

SEQ ID NO: 4097692 - DNA, 23 bp, Homo sapiens
tgcactgccctgttcatgtgcct

SEQ ID NO: 4097693 - DNA, 16 bp, Homo sapiens
tgcactggggagcccg

SEQ ID NO: 4097694 - DNA, 22 bp, Homo sapiens
tgcacttgacctcatctcccga

SEQ ID NO: 4097695 - DNA, 17 bp, Homo sapiens
tgcacttggggcacagg

SEQ ID NO: 4097696 - DNA, 21 bp, Homo sapiens
tgcacttgtgattatttatta

SEQ ID NO: 4097697 - DNA, 19 bp, Homo sapiens
tgcactttctaatgtttct

SEQ ID NO: 4097698 - DNA, 21 bp, Homo sapiens
tgcacttttctaaactaggct

SEQ ID NO: 4097699 - DNA, 15 bp, Homo sapiens
tgcagaaaaagaaaa

SEQ ID NO: 4097700 - DNA, 17 bp, Homo sapiens
tgcagaaaaagaaaaaa

SEQ ID NO: 4097701 - DNA, 22 bp, Homo sapiens
tgcagaaaaagaaaaaaactat

SEQ ID NO: 4097702 - DNA, 24 bp, Homo sapiens
tgcagaacatcgatatgtatatca

SEQ ID NO: 4097703 - DNA, 15 bp, Homo sapiens
tgcagaactcccaag

SEQ ID NO: 4097704 - DNA, 15 bp, Homo sapiens
tgcagaagagggtgt

SEQ ID NO: 4097705 - DNA, 20 bp, Homo sapiens
tgcagaagagggtgtgtttg

SEQ ID NO: 4097706 - DNA, 14 bp, Homo sapiens
tgcagaataatgga

SEQ ID NO: 4097707 - DNA, 15 bp, Homo sapiens
tgcagaataatggaa

SEQ ID NO: 4097708 - DNA, 21 bp, Homo sapiens
tgcagaataatggaaacatta

SEQ ID NO: 4097709 - DNA, 17 bp, Homo sapiens
tgcagacaatcttctgt

SEQ ID NO: 4097710 - DNA, 21 bp, Homo sapiens
tgcagacagaagtctcctcaa

SEQ ID NO: 4097711 - DNA, 13 bp, Homo sapiens
tgcagacaggcca

SEQ ID NO: 4097712 - DNA, 22 bp, Homo sapiens
tgcagacagggggccagaacac

SEQ ID NO: 4097713 - DNA, 15 bp, Homo sapiens
tgcagactcagtttg

SEQ ID NO: 4097714 - DNA, 13 bp, Homo sapiens
tgcagagaagctg

SEQ ID NO: 4097715 - DNA, 13 bp, Homo sapiens
tgcagagagaagc

SEQ ID NO: 4097716 - DNA, 15 bp, Homo sapiens
tgcagagagaagcct

SEQ ID NO: 4097717 - DNA, 15 bp, Homo sapiens
tgcagagagccattt

SEQ ID NO: 4097718 - DNA, 21 bp, Homo sapiens
tgcagagagccattttgtgaa

SEQ ID NO: 4097719 - DNA, 23 bp, Homo sapiens
tgcagagcacctttgcacaggat

SEQ ID NO: 4097720 - DNA, 19 bp, Homo sapiens
tgcagagccttctcagaag

SEQ ID NO: 4097721 - DNA, 20 bp, Homo sapiens
tgcagagccttctcagaagc

SEQ ID NO: 4097722 - DNA, 15 bp, Homo sapiens
tgcagaggtcagact

SEQ ID NO: 4097723 - DNA, 17 bp, Homo sapiens
tgcagataactttgact

SEQ ID NO: 4097724 - DNA, 15 bp, Homo sapiens
tgcagatgaaatgtt

SEQ ID NO: 4097725 - DNA, 19 bp, Homo sapiens
tgcagatgaaatgttctgt

SEQ ID NO: 4097726 - DNA, 18 bp, Homo sapiens
tgcagatgagcagtcaca

SEQ ID NO: 4097727 - DNA, 20 bp, Homo sapiens
tgcagatgagcagtcacact

SEQ ID NO: 4097728 - DNA, 14 bp, Homo sapiens
tgcagcacctccag

SEQ ID NO: 4097729 - DNA, 16 bp, Homo sapiens
tgcagcacctccaggc

SEQ ID NO: 4097730 - DNA, 23 bp, Homo sapiens
tgcagcaggaatatatgtgtgcc

SEQ ID NO: 4097731 - DNA, 14 bp, Homo sapiens
tgcagcaggagtgg

SEQ ID NO: 4097732 - DNA, 13 bp, Homo sapiens
tgcagcatgacct

SEQ ID NO: 4097733 - DNA, 22 bp, Homo sapiens
tgcagcatgacctgtgaccagc

SEQ ID NO: 4097734 - DNA, 19 bp, Homo sapiens
tgcagcatgagactttctg

SEQ ID NO: 4097735 - DNA, 19 bp, Homo sapiens
tgcagcatggggtttttat

SEQ ID NO: 4097736 - DNA, 19 bp, Homo sapiens
tgcagccacgattggagaa

SEQ ID NO: 4097737 - DNA, 20 bp, Homo sapiens
tgcagccacgattggagaat

SEQ ID NO: 4097738 - DNA, 16 bp, Homo sapiens
tgcagcccaccagacg

SEQ ID NO: 4097739 - DNA, 12 bp, Homo sapiens
tgcagcccatgc

SEQ ID NO: 4097740 - DNA, 18 bp, Homo sapiens
tgcagcccatgcccacct

SEQ ID NO: 4097741 - DNA, 21 bp, Homo sapiens
tgcagcccatgcccacctgcc

SEQ ID NO: 4097742 - DNA, 17 bp, Homo sapiens
tgcagcccttgggcagt

SEQ ID NO: 4097743 - DNA, 17 bp, Homo sapiens
tgcagccggcacagggt

SEQ ID NO: 4097744 - DNA, 19 bp, Homo sapiens
tgcagccggcacagggtct

SEQ ID NO: 4097745 - DNA, 22 bp, Homo sapiens
tgcagcctaaagtacagcctgg

SEQ ID NO: 4097746 - DNA, 20 bp, Homo sapiens
tgcagcctcatactcctggg

SEQ ID NO: 4097747 - DNA, 15 bp, Homo sapiens
tgcagcctggctggt

SEQ ID NO: 4097748 - DNA, 18 bp, Homo sapiens
tgcagcctggctggtcct

SEQ ID NO: 4097749 - DNA, 15 bp, Homo sapiens
tgcagccttctccat

SEQ ID NO: 4097750 - DNA, 23 bp, Homo sapiens
tgcagcctttgcctccccggctc

SEQ ID NO: 4097751 - DNA, 20 bp, Homo sapiens
tgcagctatgcgcaatgtgg

SEQ ID NO: 4097752 - DNA, 16 bp, Homo sapiens
tgcagctgatgttgga

SEQ ID NO: 4097753 - DNA, 15 bp, Homo sapiens
tgcagctgattttaa

SEQ ID NO: 4097754 - DNA, 13 bp, Homo sapiens
tgcagctttatgt

SEQ ID NO: 4097755 - DNA, 15 bp, Homo sapiens
tgcagctttatgttc

SEQ ID NO: 4097756 - DNA, 20 bp, Homo sapiens
tgcaggacaggaggcggccc

SEQ ID NO: 4097757 - DNA, 16 bp, Homo sapiens
tgcaggagagagcagc

SEQ ID NO: 4097758 - DNA, 17 bp, Homo sapiens
tgattgtctagtgagga

SEQ ID NO: 4097759 - DNA, 21 bp, Homo sapiens
tgattgtggaatggagattca

SEQ ID NO: 4097760 - DNA, 20 bp, Homo sapiens
tgatttaataaaataattct

SEQ ID NO: 4097761 - DNA, 21 bp, Homo sapiens
tgatttaataaaataattcta

SEQ ID NO: 4097762 - DNA, 16 bp, Homo sapiens
tgatttacagcaagta

SEQ ID NO: 4097763 - DNA, 19 bp, Homo sapiens
tgatttacagcaagtagat

SEQ ID NO: 4097764 - DNA, 22 bp, Homo sapiens
tgatttacatatattatttatt

SEQ ID NO: 4097765 - DNA, 16 bp, Homo sapiens
tgatttaggagaagcc

SEQ ID NO: 4097766 - DNA, 22 bp, Homo sapiens
tgatttaggagaagccaggaat

SEQ ID NO: 4097767 - DNA, 21 bp, Homo sapiens
tgatttaggtagccttgtgtt

SEQ ID NO: 4097768 - DNA, 19 bp, Homo sapiens
tgatttcaggatactctgt

SEQ ID NO: 4097769 - DNA, 23 bp, Homo sapiens
tgatttcaggatactctgtcaga

SEQ ID NO: 4097770 - DNA, 17 bp, Homo sapiens
tgatttcatttcaactg

SEQ ID NO: 4097771 - DNA, 16 bp, Homo sapiens
tgatttccttcaatgt

SEQ ID NO: 4097772 - DNA, 19 bp, Homo sapiens
tgatttccttgaatgtggc

SEQ ID NO: 4097773 - DNA, 21 bp, Homo sapiens
tgatttcttcagaattagatg

SEQ ID NO: 4097774 - DNA, 19 bp, Homo sapiens
tgatttgaagaacatgtga

SEQ ID NO: 4097775 - DNA, 15 bp, Homo sapiens
tgatttgatgtgact

SEQ ID NO: 4097776 - DNA, 17 bp, Homo sapiens
tgatttgatgtgacttt

SEQ ID NO: 4097777 - DNA, 13 bp, Homo sapiens
tgatttgcattga

SEQ ID NO: 4097778 - DNA, 15 bp, Homo sapiens
tgatttgcattgaac

SEQ ID NO: 4097779 - DNA, 22 bp, Homo sapiens
tgattttaaaggcagagaagtt

SEQ ID NO: 4097780 - DNA, 19 bp, Homo sapiens
tgattttaacaataactac

SEQ ID NO: 4097781 - DNA, 14 bp, Homo sapiens
tgattttaatttta

SEQ ID NO: 4097782 - DNA, 16 bp, Homo sapiens
tgattttatctgtgaa

SEQ ID NO: 4097783 - DNA, 16 bp, Homo sapiens
tgattttcatttcatg

SEQ ID NO: 4097784 - DNA, 13 bp, Homo sapiens
tgattttctgttg

SEQ ID NO: 4097785 - DNA, 16 bp, Homo sapiens
tgattttgtaaagttg

SEQ ID NO: 4097786 - DNA, 22 bp, Homo sapiens
tgatttttctaaccttgaatgc

SEQ ID NO: 4097787 - DNA, 14 bp, Homo sapiens
tgatttttgttgat

SEQ ID NO: 4097788 - DNA, 13 bp, Homo sapiens
tgattttttgcat

SEQ ID NO: 4097789 - DNA, 17 bp, Homo sapiens
tgatttttttaaacata

SEQ ID NO: 4097790 - DNA, 21 bp, Homo sapiens
tgatttttttaatagtgcttt

SEQ ID NO: 4097791 - DNA, 21 bp, Homo sapiens
tgatttttttttttttttcct

SEQ ID NO: 4097792 - DNA, 12 bp, Homo sapiens
tgcaaaaaatag

SEQ ID NO: 4097793 - DNA, 12 bp, Homo sapiens
tgcaaaaatgga

SEQ ID NO: 4097794 - DNA, 14 bp, Homo sapiens
tgcaaaacctttga

SEQ ID NO: 4097795 - DNA, 13 bp, Homo sapiens
tgcaaaatcactt

SEQ ID NO: 4097796 - DNA, 12 bp, Homo sapiens
tgcaaaatggaa

SEQ ID NO: 4097797 - DNA, 14 bp, Homo sapiens
tgcaaaatttccag

SEQ ID NO: 4097798 - DNA, 17 bp, Homo sapiens
tgcaaaccgttaggaaa

SEQ ID NO: 4097799 - DNA, 16 bp, Homo sapiens
tgcaaagaaaatcaga

SEQ ID NO: 4097800 - DNA, 12 bp, Homo sapiens
tgcaaagatctg

SEQ ID NO: 4097801 - DNA, 13 bp, Homo sapiens
tgcaaatataaac

SEQ ID NO: 4097802 - DNA, 16 bp, Homo sapiens
tgcaaatataaacatc

SEQ ID NO: 4097803 - DNA, 20 bp, Homo sapiens
tgcaaatgggagctgagcag

SEQ ID NO: 4097804 - DNA, 13 bp, Homo sapiens
tgcaacaaaattc

SEQ ID NO: 4097805 - DNA, 12 bp, Homo sapiens
tgcaacaaatga

SEQ ID NO: 4097806 - DNA, 13 bp, Homo sapiens
tgcaacaaatgaa

SEQ ID NO: 4097807 - DNA, 20 bp, Homo sapiens
tgcaacaaatgaattttcca

SEQ ID NO: 4097808 - DNA, 23 bp, Homo sapiens
tgcaacatttacagtccttcaaa

SEQ ID NO: 4097809 - DNA, 13 bp, Homo sapiens
tgcaaccactgca

SEQ ID NO: 4097810 - DNA, 16 bp, Homo sapiens
tgcaacccaaggactg

SEQ ID NO: 4097811 - DNA, 18 bp, Homo sapiens
tgcaacctcaccttcctg

SEQ ID NO: 4097812 - DNA, 16 bp, Homo sapiens
tgcaacctctgcctcc

SEQ ID NO: 4097813 - DNA, 19 bp, Homo sapiens
tgcaactggagttccttat

SEQ ID NO: 4097814 - DNA, 13 bp, Homo sapiens
tgcaacttcagtt

SEQ ID NO: 4097815 - DNA, 15 bp, Homo sapiens
tgcaacttcatgtca

SEQ ID NO: 4097816 - DNA, 18 bp, Homo sapiens
tgcaacttccgctgaggg

SEQ ID NO: 4097817 - DNA, 21 bp, Homo sapiens
tgcaacttccgctgaggggtc

SEQ ID NO: 4097818 - DNA, 16 bp, Homo sapiens
tgcaagatgtgaatta

SEQ ID NO: 4097819 - DNA, 13 bp, Homo sapiens
tgcaagccaggga

SEQ ID NO: 4097820 - DNA, 13 bp, Homo sapiens
tgcaaggaccagg

SEQ ID NO: 4097821 - DNA, 15 bp, Homo sapiens
tgcaagggggacaca

SEQ ID NO: 4097822 - DNA, 22 bp, Homo sapiens
tgcaaggtggcctttgtgctgc

SEQ ID NO: 4097823 - DNA, 23 bp, Homo sapiens
tgcaagtcagtccaggatgctaa

SEQ ID NO: 4097824 - DNA, 17 bp, Homo sapiens
tgcaagttagggtctat

SEQ ID NO: 4097825 - DNA, 21 bp, Homo sapiens
tgcaagttatattagtgaaga

SEQ ID NO: 4097826 - DNA, 20 bp, Homo sapiens
tgcaataaatctgacccagt

SEQ ID NO: 4097827 - DNA, 16 bp, Homo sapiens
tgcaataacttctata

SEQ ID NO: 4097828 - DNA, 17 bp, Homo sapiens
tgcaataacttctatat

SEQ ID NO: 4097829 - DNA, 18 bp, Homo sapiens
tgcaataacttctgacct

SEQ ID NO: 4097830 - DNA, 21 bp, Homo sapiens
tgcaataagaatttagggaga

SEQ ID NO: 4097831 - DNA, 14 bp, Homo sapiens
tgcaatagagactg

SEQ ID NO: 4097832 - DNA, 16 bp, Homo sapiens
tgcaatagagactgta

SEQ ID NO: 4097833 - DNA, 14 bp, Homo sapiens
tgcaatatttgaat

SEQ ID NO: 4097834 - DNA, 14 bp, Homo sapiens
tgcaatcagacaag

SEQ ID NO: 4097835 - DNA, 21 bp, Homo sapiens
tgcaatgaaaggtactatatt

SEQ ID NO: 4097836 - DNA, 13 bp, Homo sapiens
tgcaatggatttt

SEQ ID NO: 4097837 - DNA, 21 bp, Homo sapiens
tgcaatgtcacaacctctctg

SEQ ID NO: 4097838 - DNA, 16 bp, Homo sapiens
tgcaatgtgctactga

SEQ ID NO: 4097839 - DNA, 13 bp, Homo sapiens
tgcaattcccctc

SEQ ID NO: 4097840 - DNA, 22 bp, Homo sapiens
tgcaattgtaggggtgtgtgtg

SEQ ID NO: 4097841 - DNA, 22 bp, Homo sapiens
tgcaatttgtttaaagaataaa

SEQ ID NO: 4097842 - DNA, 22 bp, Homo sapiens
tgcaattttataaggacttcct

SEQ ID NO: 4097843 - DNA, 23 bp, Homo sapiens
tgcaattttctaagcaatttctt

SEQ ID NO: 4097844 - DNA, 15 bp, Homo sapiens
tgcacaagaatggat

SEQ ID NO: 4097845 - DNA, 17 bp, Homo sapiens
tgcacaattttgataaa

SEQ ID NO: 4097846 - DNA, 17 bp, Homo sapiens
tgcacacacctccgaga

SEQ ID NO: 4097847 - DNA, 17 bp, Homo sapiens
tgcacactccaggcctc

SEQ ID NO: 4097848 - DNA, 16 bp, Homo sapiens
tgcacactccatctcc

SEQ ID NO: 4097849 - DNA, 19 bp, Homo sapiens
tgcacactccatctcctgc

SEQ ID NO: 4097850 - DNA, 21 bp, Homo sapiens
tgcacacttgtgtgtgggctg

SEQ ID NO: 4097851 - DNA, 23 bp, Homo sapiens
tgcacacttgtgtgtgggctgtg

SEQ ID NO: 4097852 - DNA, 19 bp, Homo sapiens
tgcacagatggatttgcct

SEQ ID NO: 4097853 - DNA, 23 bp, Homo sapiens
tgcacagatggatttgcctgtgc

SEQ ID NO: 4097854 - DNA, 16 bp, Homo sapiens
tgcacagcggcccctg

SEQ ID NO: 4097855 - DNA, 12 bp, Homo sapiens
tgcacagctgtc

SEQ ID NO: 4097856 - DNA, 13 bp, Homo sapiens
tgcacagctgtcc

SEQ ID NO: 4097857 - DNA, 19 bp, Homo sapiens
tgcacagtgcatctcagcc

SEQ ID NO: 4097858 - DNA, 15 bp, Homo sapiens
tgcacatgaaagttt

SEQ ID NO: 4097859 - DNA, 23 bp, Homo sapiens
tgcacatgattgtataagcatgc

SEQ ID NO: 4097860 - DNA, 13 bp, Homo sapiens
tgcacatttattt

SEQ ID NO: 4097861 - DNA, 23 bp, Homo sapiens
tgatctacttcatagctccttgg

SEQ ID NO: 4097862 - DNA, 21 bp, Homo sapiens
tgatctccatatgttacacta

SEQ ID NO: 4097863 - DNA, 22 bp, Homo sapiens
tgatctctactaccacaaggaa

SEQ ID NO: 4097864 - DNA, 12 bp, Homo sapiens
tgatctctccac

SEQ ID NO: 4097865 - DNA, 15 bp, Homo sapiens
tgatctctctagctt

SEQ ID NO: 4097866 - DNA, 18 bp, Homo sapiens
tgatctggacagaacatt

SEQ ID NO: 4097867 - DNA, 19 bp, Homo sapiens
tgatctgggcattttcctc

SEQ ID NO: 4097868 - DNA, 15 bp, Homo sapiens
tgatctgtatttaat

SEQ ID NO: 4097869 - DNA, 22 bp, Homo sapiens
tgatctgtatttaatggttttt

SEQ ID NO: 4097870 - DNA, 20 bp, Homo sapiens
tgatctgtgatagttcaccc

SEQ ID NO: 4097871 - DNA, 21 bp, Homo sapiens
tgatctgtgatagttcacccc

SEQ ID NO: 4097872 - DNA, 15 bp, Homo sapiens
tgatcttcttcatcc

SEQ ID NO: 4097873 - DNA, 20 bp, Homo sapiens
tgatcttctttataattcta

SEQ ID NO: 4097874 - DNA, 15 bp, Homo sapiens
tgatcttgcattcat

SEQ ID NO: 4097875 - DNA, 17 bp, Homo sapiens
tgatcttgcattcattt

SEQ ID NO: 4097876 - DNA, 18 bp, Homo sapiens
tgatcttgcctgtctggc

SEQ ID NO: 4097877 - DNA, 15 bp, Homo sapiens
tgatcttttaaagtg

SEQ ID NO: 4097878 - DNA, 13 bp, Homo sapiens
tgatgaaagctga

SEQ ID NO: 4097879 - DNA, 15 bp, Homo sapiens
tgatgaaagctgatt

SEQ ID NO: 4097880 - DNA, 19 bp, Homo sapiens
tgatgaaagctgattactg

SEQ ID NO: 4097881 - DNA, 23 bp, Homo sapiens
tgatgaagcaaggaagatataca

SEQ ID NO: 4097882 - DNA, 24 bp, Homo sapiens
tgatgaagcaaggaagatatacat

SEQ ID NO: 4097883 - DNA, 20 bp, Homo sapiens
tgatgaatcaatgaaaaatg

SEQ ID NO: 4097884 - DNA, 19 bp, Homo sapiens
tgatgactttctgttttct

SEQ ID NO: 4097885 - DNA, 23 bp, Homo sapiens
tgatgagagaatggagacagagt

SEQ ID NO: 4097886 - DNA, 19 bp, Homo sapiens
tgatgatccagaacagtgg

SEQ ID NO: 4097887 - DNA, 15 bp, Homo sapiens
tgatgatgctgtgac

SEQ ID NO: 4097888 - DNA, 17 bp, Homo sapiens
tgatgattaaacacctg

SEQ ID NO: 4097889 - DNA, 16 bp, Homo sapiens
tgatgattttcatttc

SEQ ID NO: 4097890 - DNA, 18 bp, Homo sapiens
tgatgattttcctttttc

SEQ ID NO: 4097891 - DNA, 18 bp, Homo sapiens
tgatgccacacagagtgg

SEQ ID NO: 4097892 - DNA, 14 bp, Homo sapiens
tgatgccaggacac

SEQ ID NO: 4097893 - DNA, 15 bp, Homo sapiens
tgatgccgtgatcct

SEQ ID NO: 4097894 - DNA, 14 bp, Homo sapiens
tgatgcgccttgct

SEQ ID NO: 4097895 - DNA, 16 bp, Homo sapiens
tgatgctaaataggag

SEQ ID NO: 4097896 - DNA, 18 bp, Homo sapiens
tgatgctatttatgcaag

SEQ ID NO: 4097897 - DNA, 15 bp, Homo sapiens
tgatgctccctcccc

SEQ ID NO: 4097898 - DNA, 19 bp, Homo sapiens
tgatgctctttcccaccca

SEQ ID NO: 4097899 - DNA, 14 bp, Homo sapiens
tgatgctgagattc

SEQ ID NO: 4097900 - DNA, 14 bp, Homo sapiens
tgatgctggagagg

SEQ ID NO: 4097901 - DNA, 20 bp, Homo sapiens
tgatgctgtgctatgaattt

SEQ ID NO: 4097902 - DNA, 18 bp, Homo sapiens
tgatgctgttctcttctt

SEQ ID NO: 4097903 - DNA, 17 bp, Homo sapiens
tgatggaggtatttgaa

SEQ ID NO: 4097904 - DNA, 19 bp, Homo sapiens
tgatggcaacagatctgga

SEQ ID NO: 4097905 - DNA, 20 bp, Homo sapiens
tgatggcagccatagtgcat

SEQ ID NO: 4097906 - DNA, 18 bp, Homo sapiens
tgatggcttgacatgtgc

SEQ ID NO: 4097907 - DNA, 13 bp, Homo sapiens
tgatgggaaaata

SEQ ID NO: 4097908 - DNA, 17 bp, Homo sapiens
tgatgggaaaatatttc

SEQ ID NO: 4097909 - DNA, 24 bp, Homo sapiens
tgatggggcaagggcacaagtcct

SEQ ID NO: 4097910 - DNA, 16 bp, Homo sapiens
tgatggggctcagatg

SEQ ID NO: 4097911 - DNA, 23 bp, Homo sapiens
tgatgtaatctctctgcagctgc

SEQ ID NO: 4097912 - DNA, 14 bp, Homo sapiens
tgatgtatatgttt

SEQ ID NO: 4097913 - DNA, 20 bp, Homo sapiens
tgatgtattctagctaatgt

SEQ ID NO: 4097914 - DNA, 11 bp, Homo sapiens
tgatgtcccag

SEQ ID NO: 4097915 - DNA, 14 bp, Homo sapiens
tgatgtcccagtgc

SEQ ID NO: 4097916 - DNA, 22 bp, Homo sapiens
tgatgtgaagataatttgcata

SEQ ID NO: 4097917 - DNA, 14 bp, Homo sapiens
tgatgtgaagccaa

SEQ ID NO: 4097918 - DNA, 22 bp, Homo sapiens
tgatgtgaagccaattcagaca

SEQ ID NO: 4097919 - DNA, 16 bp, Homo sapiens
tgatgtgacaataata

SEQ ID NO: 4097920 - DNA, 17 bp, Homo sapiens
tgatgtgacaataatat

SEQ ID NO: 4097921 - DNA, 18 bp, Homo sapiens
tgatgtgacaataatatt

SEQ ID NO: 4097922 - DNA, 20 bp, Homo sapiens
tgatgtgttgccactttcca

SEQ ID NO: 4097923 - DNA, 14 bp, Homo sapiens
tgatgtgtttattt

SEQ ID NO: 4097924 - DNA, 10 bp, Homo sapiens
tgatgttaac

SEQ ID NO: 4097925 - DNA, 22 bp, Homo sapiens
tgatgttaaccagaataaagtt

SEQ ID NO: 4097926 - DNA, 11 bp, Homo sapiens
tgatgtttgtg

SEQ ID NO: 4097927 - DNA, 19 bp, Homo sapiens
tgatgtttgtggcctcaga

SEQ ID NO: 4097928 - DNA, 20 bp, Homo sapiens
tgatgtttgtggcctcagaa

SEQ ID NO: 4097929 - DNA, 12 bp, Homo sapiens
tgatgttttcag

SEQ ID NO: 4097930 - DNA, 17 bp, Homo sapiens
tgattaaacacctgaca

SEQ ID NO: 4097931 - DNA, 19 bp, Homo sapiens
tgattaaacacctgacaca

SEQ ID NO: 4097932 - DNA, 21 bp, Homo sapiens
tgattaaacacctgacacatc

SEQ ID NO: 4097933 - DNA, 17 bp, Homo sapiens
tgattaacaaatatgct

SEQ ID NO: 4097934 - DNA, 13 bp, Homo sapiens
tgattaagatttt

SEQ ID NO: 4097935 - DNA, 21 bp, Homo sapiens
tgattaattcaccttccagtg

SEQ ID NO: 4097936 - DNA, 16 bp, Homo sapiens
tgattagctttgtgtt

SEQ ID NO: 4097937 - DNA, 22 bp, Homo sapiens
tgattcaaagtgttgtgttcct

SEQ ID NO: 4097938 - DNA, 23 bp, Homo sapiens
tgattcaaagtgttgtgttcctg

SEQ ID NO: 4097939 - DNA, 18 bp, Homo sapiens
tgattcagaaaatgttct

SEQ ID NO: 4097940 - DNA, 18 bp, Homo sapiens
tgattcatagtaacttct

SEQ ID NO: 4097941 - DNA, 14 bp, Homo sapiens
tgattcattttcct

SEQ ID NO: 4097942 - DNA, 17 bp, Homo sapiens
tgattcattttcctgtt

SEQ ID NO: 4097943 - DNA, 19 bp, Homo sapiens
tgattcattttcctgttca

SEQ ID NO: 4097944 - DNA, 23 bp, Homo sapiens
tgattcattttcctgttcagtga

SEQ ID NO: 4097945 - DNA, 19 bp, Homo sapiens
tgattccactacacctggc

SEQ ID NO: 4097946 - DNA, 21 bp, Homo sapiens
tgattccactacacctggctg

SEQ ID NO: 4097947 - DNA, 23 bp, Homo sapiens
tgattccactacacctggctgag

SEQ ID NO: 4097948 - DNA, 16 bp, Homo sapiens
tgattccatccacctt

SEQ ID NO: 4097949 - DNA, 11 bp, Homo sapiens
tgattcctggt

SEQ ID NO: 4097950 - DNA, 22 bp, Homo sapiens
tgattctatttatatgtacatg

SEQ ID NO: 4097951 - DNA, 23 bp, Homo sapiens
tgattctttaatagaagttttat

SEQ ID NO: 4097952 - DNA, 14 bp, Homo sapiens
tgattgacacacag

SEQ ID NO: 4097953 - DNA, 15 bp, Homo sapiens
tgattgacctgctcc

SEQ ID NO: 4097954 - DNA, 17 bp, Homo sapiens
tgattgaggagctgcac

SEQ ID NO: 4097955 - DNA, 15 bp, Homo sapiens
tgattgcacagaatt

SEQ ID NO: 4097956 - DNA, 12 bp, Homo sapiens
tgattgcagctt

SEQ ID NO: 4097957 - DNA, 13 bp, Homo sapiens
tgattgctgccat

SEQ ID NO: 4097958 - DNA, 20 bp, Homo sapiens
tgattgctgccataattcta

SEQ ID NO: 4097959 - DNA, 14 bp, Homo sapiens
tgattggattattc

SEQ ID NO: 4097960 - DNA, 17 bp, Homo sapiens
tgattggtgcaaccctt

SEQ ID NO: 4097961 - DNA, 21 bp, Homo sapiens
tgattggtgcaacccttaccc

SEQ ID NO: 4097962 - DNA, 17 bp, Homo sapiens
tgattgtataagcatgc

SEQ ID NO: 4097963 - DNA, 21 bp, Homo sapiens
tgattgtcctttaaaaaagaa

SEQ ID NO: 4097964 - DNA, 16 bp, Homo sapiens
tgagtaacatttgctg

SEQ ID NO: 4097965 - DNA, 13 bp, Homo sapiens
tgagtaagagctg

SEQ ID NO: 4097966 - DNA, 17 bp, Homo sapiens
tgagtaagagctggtgt

SEQ ID NO: 4097967 - DNA, 17 bp, Homo sapiens
tgagtaatcaatacaga

SEQ ID NO: 4097968 - DNA, 17 bp, Homo sapiens
tgagtaatggtgtagaa

SEQ ID NO: 4097969 - DNA, 18 bp, Homo sapiens
tgagtaatggtgtagaac

SEQ ID NO: 4097970 - DNA, 20 bp, Homo sapiens
tgagtaatgtgactaaagga

SEQ ID NO: 4097971 - DNA, 17 bp, Homo sapiens
tgagtacaaatgcctta

SEQ ID NO: 4097972 - DNA, 21 bp, Homo sapiens
tgagtacaaatgccttaaaat

SEQ ID NO: 4097973 - DNA, 16 bp, Homo sapiens
tgagtaccaggggctg

SEQ ID NO: 4097974 - DNA, 23 bp, Homo sapiens
tgagtaggcggcgatttttgtat

SEQ ID NO: 4097975 - DNA, 19 bp, Homo sapiens
tgagtataaaaacttgaaa

SEQ ID NO: 4097976 - DNA, 15 bp, Homo sapiens
tgagtatttggtcca

SEQ ID NO: 4097977 - DNA, 18 bp, Homo sapiens
tgagtcacctgctccaga

SEQ ID NO: 4097978 - DNA, 17 bp, Homo sapiens
tgagtccattctcccag

SEQ ID NO: 4097979 - DNA, 22 bp, Homo sapiens
tgagtccattctcccaggtacc

SEQ ID NO: 4097980 - DNA, 16 bp, Homo sapiens
tgagtcccctccagga

SEQ ID NO: 4097981 - DNA, 12 bp, Homo sapiens
tgagtcctccag

SEQ ID NO: 4097982 - DNA, 15 bp, Homo sapiens
tgagtcctccagaac

SEQ ID NO: 4097983 - DNA, 17 bp, Homo sapiens
tgagtcctccagaactc

SEQ ID NO: 4097984 - DNA, 23 bp, Homo sapiens
tgagtcctccagaactcttcctc

SEQ ID NO: 4097985 - DNA, 18 bp, Homo sapiens
tgagtcttcatgttccca

SEQ ID NO: 4097986 - DNA, 20 bp, Homo sapiens
tgagtgaaaatttttacatt

SEQ ID NO: 4097987 - DNA, 15 bp, Homo sapiens
tgagtgaataaatgt

SEQ ID NO: 4097988 - DNA, 15 bp, Homo sapiens
tgagtgatcctccaa

SEQ ID NO: 4097989 - DNA, 21 bp, Homo sapiens
tgagtgattgacacacagcac

SEQ ID NO: 4097990 - DNA, 22 bp, Homo sapiens
tgagtgattgacacacagcact

SEQ ID NO: 4097991 - DNA, 15 bp, Homo sapiens
tgagtgccttttgca

SEQ ID NO: 4097992 - DNA, 17 bp, Homo sapiens
tgagtggccagccagtg

SEQ ID NO: 4097993 - DNA, 15 bp, Homo sapiens
tgagtgggagaaggc

SEQ ID NO: 4097994 - DNA, 22 bp, Homo sapiens
tgagtggggttatctctgtgtt

SEQ ID NO: 4097995 - DNA, 16 bp, Homo sapiens
tgagtgtgcatggagg

SEQ ID NO: 4097996 - DNA, 15 bp, Homo sapiens
tgagtgtgtgtgtgc

SEQ ID NO: 4097997 - DNA, 18 bp, Homo sapiens
tgagtgtgtgtgtgcatg

SEQ ID NO: 4097998 - DNA, 21 bp, Homo sapiens
tgagtgttcctttttaaatgt

SEQ ID NO: 4097999 - DNA, 22 bp, Homo sapiens
tgagtgtttttactacagttgt

SEQ ID NO: 4098000 - DNA, 15 bp, Homo sapiens
tgagttactgaaggt

SEQ ID NO: 4098001 - DNA, 15 bp, Homo sapiens
tgagttatgatgtaa

SEQ ID NO: 4098002 - DNA, 22 bp, Homo sapiens
tgagttattccttgatcatttt

SEQ ID NO: 4098003 - DNA, 17 bp, Homo sapiens
tgagttggggtctggca

SEQ ID NO: 4098004 - DNA, 19 bp, Homo sapiens
tgagttggggtctggcagc

SEQ ID NO: 4098005 - DNA, 14 bp, Homo sapiens
tgagtttaaagcaa

SEQ ID NO: 4098006 - DNA, 11 bp, Homo sapiens
tgagtttccta

SEQ ID NO: 4098007 - DNA, 16 bp, Homo sapiens
tgagtttgagctgcct

SEQ ID NO: 4098008 - DNA, 17 bp, Homo sapiens
tgagtttttcctcccag

SEQ ID NO: 4098009 - DNA, 18 bp, Homo sapiens
tgagtttttcctcccagt

SEQ ID NO: 4098010 - DNA, 20 bp, Homo sapiens
tgataaaagggcaaatctgc

SEQ ID NO: 4098011 - DNA, 19 bp, Homo sapiens
tgataaaataaataatttt

SEQ ID NO: 4098012 - DNA, 14 bp, Homo sapiens
tgataaactgacga

SEQ ID NO: 4098013 - DNA, 15 bp, Homo sapiens
tgataaatttaatcc

SEQ ID NO: 4098014 - DNA, 18 bp, Homo sapiens
tgataacacttaaaattg

SEQ ID NO: 4098015 - DNA, 17 bp, Homo sapiens
tgataacttggggaggc

SEQ ID NO: 4098016 - DNA, 19 bp, Homo sapiens
tgataacttggggaggcaa

SEQ ID NO: 4098017 - DNA, 20 bp, Homo sapiens
tgataaggatcagaacagca

SEQ ID NO: 4098018 - DNA, 12 bp, Homo sapiens
tgataagtaaat

SEQ ID NO: 4098019 - DNA, 19 bp, Homo sapiens
tgataagttcctttccttt

SEQ ID NO: 4098020 - DNA, 23 bp, Homo sapiens
tgataagttcctttccttttctt

SEQ ID NO: 4098021 - DNA, 13 bp, Homo sapiens
tgataatgttaaa

SEQ ID NO: 4098022 - DNA, 13 bp, Homo sapiens
tgatacataataa

SEQ ID NO: 4098023 - DNA, 22 bp, Homo sapiens
tgatacatccaaagcagacagc

SEQ ID NO: 4098024 - DNA, 19 bp, Homo sapiens
tgataccagttcagacact

SEQ ID NO: 4098025 - DNA, 13 bp, Homo sapiens
tgatacccagagc

SEQ ID NO: 4098026 - DNA, 15 bp, Homo sapiens
tgatacgatgcttca

SEQ ID NO: 4098027 - DNA, 21 bp, Homo sapiens
tgatactatcatactactgaa

SEQ ID NO: 4098028 - DNA, 16 bp, Homo sapiens
tgatacttcatttaaa

SEQ ID NO: 4098029 - DNA, 15 bp, Homo sapiens
tgatagggaactggg

SEQ ID NO: 4098030 - DNA, 19 bp, Homo sapiens
tgatataaatcagattctt

SEQ ID NO: 4098031 - DNA, 15 bp, Homo sapiens
tgatataaattctgt

SEQ ID NO: 4098032 - DNA, 17 bp, Homo sapiens
tgatataaattctgtgg

SEQ ID NO: 4098033 - DNA, 14 bp, Homo sapiens
tgatatacaaagtg

SEQ ID NO: 4098034 - DNA, 19 bp, Homo sapiens
tgatatatttaaaaatatt

SEQ ID NO: 4098035 - DNA, 18 bp, Homo sapiens
tgatatggcagaagacac

SEQ ID NO: 4098036 - DNA, 23 bp, Homo sapiens
tgatattaaaggagttaagagta

SEQ ID NO: 4098037 - DNA, 15 bp, Homo sapiens
tgatattaatcaaaa

SEQ ID NO: 4098038 - DNA, 18 bp, Homo sapiens
tgatattgacactgtccc

SEQ ID NO: 4098039 - DNA, 17 bp, Homo sapiens
tgatattgtttaaaatt

SEQ ID NO: 4098040 - DNA, 15 bp, Homo sapiens
tgatatttcttgctt

SEQ ID NO: 4098041 - DNA, 16 bp, Homo sapiens
tgatatttcttgcttt

SEQ ID NO: 4098042 - DNA, 17 bp, Homo sapiens
tgatatttgcattgagg

SEQ ID NO: 4098043 - DNA, 23 bp, Homo sapiens
tgatattttcaacgcagccctgc

SEQ ID NO: 4098044 - DNA, 15 bp, Homo sapiens
tgatcaaattcattt

SEQ ID NO: 4098045 - DNA, 17 bp, Homo sapiens
tgatcaaattcattttt

SEQ ID NO: 4098046 - DNA, 18 bp, Homo sapiens
tgatcaagtcctttgtga

SEQ ID NO: 4098047 - DNA, 21 bp, Homo sapiens
tgatcaataaaatgtgatttt

SEQ ID NO: 4098048 - DNA, 19 bp, Homo sapiens
tgatcacccaatgcatcac

SEQ ID NO: 4098049 - DNA, 20 bp, Homo sapiens
tgatcagaggtgtacactaa

SEQ ID NO: 4098050 - DNA, 17 bp, Homo sapiens
tgatcagctgtttgtca

SEQ ID NO: 4098051 - DNA, 21 bp, Homo sapiens
tgatcatagctcactgcagcc

SEQ ID NO: 4098052 - DNA, 18 bp, Homo sapiens
tgatcatcgccagaggtg

SEQ ID NO: 4098053 - DNA, 20 bp, Homo sapiens
tgatcatcgccagaggtgct

SEQ ID NO: 4098054 - DNA, 17 bp, Homo sapiens
tgatcatgcattgttga

SEQ ID NO: 4098055 - DNA, 17 bp, Homo sapiens
tgatcattttcccccca

SEQ ID NO: 4098056 - DNA, 21 bp, Homo sapiens
tgatcattttccccccactct

SEQ ID NO: 4098057 - DNA, 18 bp, Homo sapiens
tgatccatccatctccag

SEQ ID NO: 4098058 - DNA, 20 bp, Homo sapiens
tgatccctgtgttgtctcta

SEQ ID NO: 4098059 - DNA, 21 bp, Homo sapiens
tgatccctgttacccagagaa

SEQ ID NO: 4098060 - DNA, 19 bp, Homo sapiens
tgatccgcctacctcagcc

SEQ ID NO: 4098061 - DNA, 21 bp, Homo sapiens
tgatcctagtgtctttaaata

SEQ ID NO: 4098062 - DNA, 17 bp, Homo sapiens
tgatcctctattttgtg

SEQ ID NO: 4098063 - DNA, 13 bp, Homo sapiens
tgatcctgcggag

SEQ ID NO: 4098064 - DNA, 18 bp, Homo sapiens
tgatcctggaggcccagt

SEQ ID NO: 4098065 - DNA, 15 bp, Homo sapiens
tgatcgtgctaaatt

SEQ ID NO: 4098066 - DNA, 22 bp, Homo sapiens
tgatcgtgctaaattttcagta

SEQ ID NO: 4098067 - DNA, 14 bp, Homo sapiens
tgagcctgagcaga

SEQ ID NO: 4098068 - DNA, 18 bp, Homo sapiens
tgagcctgcccgctgcaa

SEQ ID NO: 4098069 - DNA, 20 bp, Homo sapiens
tgagcctgcccgctgcaatg

SEQ ID NO: 4098070 - DNA, 17 bp, Homo sapiens
tgagcctgctggaagcc

SEQ ID NO: 4098071 - DNA, 21 bp, Homo sapiens
tgagcctgtgggtccccactc

SEQ ID NO: 4098072 - DNA, 16 bp, Homo sapiens
tgagccttcagagtac

SEQ ID NO: 4098073 - DNA, 15 bp, Homo sapiens
tgagcgggaggcaga

SEQ ID NO: 4098074 - DNA, 16 bp, Homo sapiens
tgagcgggaggcagag

SEQ ID NO: 4098075 - DNA, 15 bp, Homo sapiens
tgagctattttcctc

SEQ ID NO: 4098076 - DNA, 18 bp, Homo sapiens
tgagctattttcctctgg

SEQ ID NO: 4098077 - DNA, 19 bp, Homo sapiens
tgagctattttcctctggc

SEQ ID NO: 4098078 - DNA, 20 bp, Homo sapiens
tgagctccccagatctccca

SEQ ID NO: 4098079 - DNA, 16 bp, Homo sapiens
tgagctcctgctgcgg

SEQ ID NO: 4098080 - DNA, 21 bp, Homo sapiens
tgagctgatataaattctgtg

SEQ ID NO: 4098081 - DNA, 15 bp, Homo sapiens
tgagctgccttccct

SEQ ID NO: 4098082 - DNA, 15 bp, Homo sapiens
tgagctggccaggcc

SEQ ID NO: 4098083 - DNA, 17 bp, Homo sapiens
tgagctggccaggccct

SEQ ID NO: 4098084 - DNA, 19 bp, Homo sapiens
tgagcttcggttctccaga

SEQ ID NO: 4098085 - DNA, 15 bp, Homo sapiens
tgagcttctctgtga

SEQ ID NO: 4098086 - DNA, 16 bp, Homo sapiens
tgagcttctctgtgaa

SEQ ID NO: 4098087 - DNA, 20 bp, Homo sapiens
tgaggaaatccattgtttaa

SEQ ID NO: 4098088 - DNA, 18 bp, Homo sapiens
tgaggaagacaagcattt

SEQ ID NO: 4098089 - DNA, 19 bp, Homo sapiens
tgaggacatggcttctgaa

SEQ ID NO: 4098090 - DNA, 16 bp, Homo sapiens
tgaggaccgctgataa

SEQ ID NO: 4098091 - DNA, 20 bp, Homo sapiens
tgaggaccgctgataagcat

SEQ ID NO: 4098092 - DNA, 21 bp, Homo sapiens
tgaggaccgctgataagcatt

SEQ ID NO: 4098093 - DNA, 19 bp, Homo sapiens
tgaggagcattaaggtatt

SEQ ID NO: 4098094 - DNA, 14 bp, Homo sapiens
tgaggagccccagc

SEQ ID NO: 4098095 - DNA, 16 bp, Homo sapiens
tgaggagccccagcta

SEQ ID NO: 4098096 - DNA, 13 bp, Homo sapiens
tgaggagctgctg

SEQ ID NO: 4098097 - DNA, 16 bp, Homo sapiens
tgaggagctgctggct

SEQ ID NO: 4098098 - DNA, 17 bp, Homo sapiens
tgaggagctgctggctt

SEQ ID NO: 4098099 - DNA, 13 bp, Homo sapiens
tgaggagctgggg

SEQ ID NO: 4098100 - DNA, 18 bp, Homo sapiens
tgaggaggaaaaggaaaa

SEQ ID NO: 4098101 - DNA, 23 bp, Homo sapiens
tgaggaggatgtccctgggccag

SEQ ID NO: 4098102 - DNA, 21 bp, Homo sapiens
tgaggaggccttgggctctgc

SEQ ID NO: 4098103 - DNA, 12 bp, Homo sapiens
tgaggaggggag

SEQ ID NO: 4098104 - DNA, 22 bp, Homo sapiens
tgaggaggggagggtaaataaa

SEQ ID NO: 4098105 - DNA, 13 bp, Homo sapiens
tgaggagggtggg

SEQ ID NO: 4098106 - DNA, 17 bp, Homo sapiens
tgaggagggtgggggag

SEQ ID NO: 4098107 - DNA, 19 bp, Homo sapiens
tgaggaggttcactgagct

SEQ ID NO: 4098108 - DNA, 21 bp, Homo sapiens
tgaggatgtagagagaacagg

SEQ ID NO: 4098109 - DNA, 19 bp, Homo sapiens
tgaggattatgggtcctgc

SEQ ID NO: 4098110 - DNA, 20 bp, Homo sapiens
tgaggattattgatagtact

SEQ ID NO: 4098111 - DNA, 14 bp, Homo sapiens
tgaggcaagagaat

SEQ ID NO: 4098112 - DNA, 16 bp, Homo sapiens
tgaggcaatgtcagga

SEQ ID NO: 4098113 - DNA, 17 bp, Homo sapiens
tgaggcaatgtcaggaa

SEQ ID NO: 4098114 - DNA, 13 bp, Homo sapiens
tgaggcagccttg

SEQ ID NO: 4098115 - DNA, 17 bp, Homo sapiens
tgaggcagccttgggga

SEQ ID NO: 4098116 - DNA, 13 bp, Homo sapiens
tgaggccacactc

SEQ ID NO: 4098117 - DNA, 20 bp, Homo sapiens
tgaggccacactcagcacaa

SEQ ID NO: 4098118 - DNA, 12 bp, Homo sapiens
tgaggccaggag

SEQ ID NO: 4098119 - DNA, 23 bp, Homo sapiens
tgaggccagggctgatggtctta

SEQ ID NO: 4098120 - DNA, 16 bp, Homo sapiens
tgaggccatctcagga

SEQ ID NO: 4098121 - DNA, 22 bp, Homo sapiens
tgaggccatctcaggagatgga

SEQ ID NO: 4098122 - DNA, 16 bp, Homo sapiens
tgaggccctgggctgg

SEQ ID NO: 4098123 - DNA, 21 bp, Homo sapiens
tgaggccctgggctgggtgct

SEQ ID NO: 4098124 - DNA, 19 bp, Homo sapiens
tgaggcctggactttcctg

SEQ ID NO: 4098125 - DNA, 14 bp, Homo sapiens
tgaggcctggccag

SEQ ID NO: 4098126 - DNA, 16 bp, Homo sapiens
tgaggcctggccaggc

SEQ ID NO: 4098127 - DNA, 14 bp, Homo sapiens
tgaggcggaggctg

SEQ ID NO: 4098128 - DNA, 15 bp, Homo sapiens
tgaggcggaggctgt

SEQ ID NO: 4098129 - DNA, 19 bp, Homo sapiens
tgaggcggaggctgtgctc

SEQ ID NO: 4098130 - DNA, 13 bp, Homo sapiens
tgaggctgtcctg

SEQ ID NO: 4098131 - DNA, 19 bp, Homo sapiens
tgaggcttctccttctcct

SEQ ID NO: 4098132 - DNA, 14 bp, Homo sapiens
tgaggctttgtgtt

SEQ ID NO: 4098133 - DNA, 20 bp, Homo sapiens
tgagggacatgctcacctct

SEQ ID NO: 4098134 - DNA, 18 bp, Homo sapiens
tgagggactggaaccagg

SEQ ID NO: 4098135 - DNA, 14 bp, Homo sapiens
tgagggcagtgcaa

SEQ ID NO: 4098136 - DNA, 15 bp, Homo sapiens
tgagggcccagagca

SEQ ID NO: 4098137 - DNA, 17 bp, Homo sapiens
tgagggcccagagcagg

SEQ ID NO: 4098138 - DNA, 18 bp, Homo sapiens
tgagggcccagagcagga

SEQ ID NO: 4098139 - DNA, 21 bp, Homo sapiens
tgagggcccagagcaggaagc

SEQ ID NO: 4098140 - DNA, 15 bp, Homo sapiens
tgagggcctgctgga

SEQ ID NO: 4098141 - DNA, 13 bp, Homo sapiens
tgagggctgccag

SEQ ID NO: 4098142 - DNA, 14 bp, Homo sapiens
tgagggctgccagc

SEQ ID NO: 4098143 - DNA, 21 bp, Homo sapiens
tgagggctgccagcagccccg

SEQ ID NO: 4098144 - DNA, 14 bp, Homo sapiens
tgaggggagccagg

SEQ ID NO: 4098145 - DNA, 11 bp, Homo sapiens
tgaggggagga

SEQ ID NO: 4098146 - DNA, 18 bp, Homo sapiens
tgaggggcagcctgcctt

SEQ ID NO: 4098147 - DNA, 13 bp, Homo sapiens
tgaggggctttct

SEQ ID NO: 4098148 - DNA, 14 bp, Homo sapiens
tgaggggctttctc

SEQ ID NO: 4098149 - DNA, 16 bp, Homo sapiens
tgaggggctttctctt

SEQ ID NO: 4098150 - DNA, 15 bp, Homo sapiens
tgaggggtctcggat

SEQ ID NO: 4098151 - DNA, 16 bp, Homo sapiens
tgaggggtctcggatg

SEQ ID NO: 4098152 - DNA, 12 bp, Homo sapiens
tgagggtcttct

SEQ ID NO: 4098153 - DNA, 23 bp, Homo sapiens
tgaggtagaaatgcaagggggac

SEQ ID NO: 4098154 - DNA, 15 bp, Homo sapiens
tgaggtcccaggaag

SEQ ID NO: 4098155 - DNA, 19 bp, Homo sapiens
tgaggtcccaggcagagaa

SEQ ID NO: 4098156 - DNA, 13 bp, Homo sapiens
tgaggtccttatg

SEQ ID NO: 4098157 - DNA, 14 bp, Homo sapiens
tgaggtctgtttaa

SEQ ID NO: 4098158 - DNA, 19 bp, Homo sapiens
tgaggtcttttgacatgtg

SEQ ID NO: 4098159 - DNA, 20 bp, Homo sapiens
tgaggtcttttgacatgtgg

SEQ ID NO: 4098160 - DNA, 16 bp, Homo sapiens
tgaggtgaaagggagc

SEQ ID NO: 4098161 - DNA, 15 bp, Homo sapiens
tgaggtgctatgttc

SEQ ID NO: 4098162 - DNA, 22 bp, Homo sapiens
tgaggtggtctgaatgttctga

SEQ ID NO: 4098163 - DNA, 16 bp, Homo sapiens
tgaggtgtctggcctg

SEQ ID NO: 4098164 - DNA, 21 bp, Homo sapiens
tgaggtgtctggcctgaggtc

SEQ ID NO: 4098165 - DNA, 20 bp, Homo sapiens
tgaggtgtgcctggcctctg

SEQ ID NO: 4098166 - DNA, 22 bp, Homo sapiens
tgaggttaaacggtgcccatcc

SEQ ID NO: 4098167 - DNA, 15 bp, Homo sapiens
tgaggttcctctgcc

SEQ ID NO: 4098168 - DNA, 17 bp, Homo sapiens
tgaggttctgagaccag

SEQ ID NO: 4098169 - DNA, 16 bp, Homo sapiens
tgaggtttttaaatat

SEQ ID NO: 4098170 - DNA, 23 bp, Homo sapiens
tgagtaaatattgaggctttgtg

SEQ ID NO: 4098171 - DNA, 19 bp, Homo sapiens
tgagaatttaaaaataaga

SEQ ID NO: 4098172 - DNA, 22 bp, Homo sapiens
tgagaatttctaaaaagattag

SEQ ID NO: 4098173 - DNA, 21 bp, Homo sapiens
tgagacacggagcccagccct

SEQ ID NO: 4098174 - DNA, 22 bp, Homo sapiens
tgagacagggtcttgctctgtc

SEQ ID NO: 4098175 - DNA, 15 bp, Homo sapiens
tgagacagtttctta

SEQ ID NO: 4098176 - DNA, 21 bp, Homo sapiens
tgagacagtttcttagctttt

SEQ ID NO: 4098177 - DNA, 18 bp, Homo sapiens
tgagaccactgagtacca

SEQ ID NO: 4098178 - DNA, 22 bp, Homo sapiens
tgagaccagtgtatcaggtcag

SEQ ID NO: 4098179 - DNA, 13 bp, Homo sapiens
tgagacccccaca

SEQ ID NO: 4098180 - DNA, 15 bp, Homo sapiens
tgagaccctgtctct

SEQ ID NO: 4098181 - DNA, 19 bp, Homo sapiens
tgagactcaaaaaaacaaa

SEQ ID NO: 4098182 - DNA, 17 bp, Homo sapiens
tgagactcacaggaagg

SEQ ID NO: 4098183 - DNA, 15 bp, Homo sapiens
tgagactgccccacg

SEQ ID NO: 4098184 - DNA, 12 bp, Homo sapiens
tgagacttccaa

SEQ ID NO: 4098185 - DNA, 15 bp, Homo sapiens
tgagactttctgctg

SEQ ID NO: 4098186 - DNA, 22 bp, Homo sapiens
tgagagaagccacgctgtcctc

SEQ ID NO: 4098187 - DNA, 16 bp, Homo sapiens
tgagagaattggctca

SEQ ID NO: 4098188 - DNA, 16 bp, Homo sapiens
tgagagagatgggagc

SEQ ID NO: 4098189 - DNA, 21 bp, Homo sapiens
tgagagagatgggagctcctc

SEQ ID NO: 4098190 - DNA, 22 bp, Homo sapiens
tgagagagatgggagctcctct

SEQ ID NO: 4098191 - DNA, 15 bp, Homo sapiens
tgagagcccagaggt

SEQ ID NO: 4098192 - DNA, 19 bp, Homo sapiens
tgagagcgaggctgagcct

SEQ ID NO: 4098193 - DNA, 23 bp, Homo sapiens
tgagaggatgaatgtatgtgcac

SEQ ID NO: 4098194 - DNA, 19 bp, Homo sapiens
tgagaggcagctatctgca

SEQ ID NO: 4098195 - DNA, 12 bp, Homo sapiens
tgagaggcaggc

SEQ ID NO: 4098196 - DNA, 22 bp, Homo sapiens
tgagagggcaatctttgccttt

SEQ ID NO: 4098197 - DNA, 19 bp, Homo sapiens
tgagaggggagagctgaac

SEQ ID NO: 4098198 - DNA, 21 bp, Homo sapiens
tgagaggggagagctgaacag

SEQ ID NO: 4098199 - DNA, 14 bp, Homo sapiens
tgagaggtttgact

SEQ ID NO: 4098200 - DNA, 22 bp, Homo sapiens
tgagaggtttgactagatgatg

SEQ ID NO: 4098201 - DNA, 23 bp, Homo sapiens
tgagagtatttaggcagattgaa

SEQ ID NO: 4098202 - DNA, 21 bp, Homo sapiens
tgagagtcagctctctgccct

SEQ ID NO: 4098203 - DNA, 19 bp, Homo sapiens
tgagagtctagcactcatt

SEQ ID NO: 4098204 - DNA, 21 bp, Homo sapiens
tgagagtctagcactcatttt

SEQ ID NO: 4098205 - DNA, 16 bp, Homo sapiens
tgagagtgtctctgat

SEQ ID NO: 4098206 - DNA, 18 bp, Homo sapiens
tgagataatatctgtgag

SEQ ID NO: 4098207 - DNA, 17 bp, Homo sapiens
tgagatcacagcctcca

SEQ ID NO: 4098208 - DNA, 19 bp, Homo sapiens
tgagatcacagcctccagg

SEQ ID NO: 4098209 - DNA, 18 bp, Homo sapiens
tgagatcactgactctga

SEQ ID NO: 4098210 - DNA, 12 bp, Homo sapiens
tgagatcccctg

SEQ ID NO: 4098211 - DNA, 16 bp, Homo sapiens
tgagatcccctgagcc

SEQ ID NO: 4098212 - DNA, 21 bp, Homo sapiens
tgagatctaagcctttccata

SEQ ID NO: 4098213 - DNA, 23 bp, Homo sapiens
tgagatctaagcctttccataag

SEQ ID NO: 4098214 - DNA, 17 bp, Homo sapiens
tgagatgagaggggaga

SEQ ID NO: 4098215 - DNA, 12 bp, Homo sapiens
tgagatgctgta

SEQ ID NO: 4098216 - DNA, 23 bp, Homo sapiens
tgagatggccagtttgaagcctg

SEQ ID NO: 4098217 - DNA, 15 bp, Homo sapiens
tgagatttcctcctg

SEQ ID NO: 4098218 - DNA, 17 bp, Homo sapiens
tgagattttttattgct

SEQ ID NO: 4098219 - DNA, 19 bp, Homo sapiens
tgagattttttattgctag

SEQ ID NO: 4098220 - DNA, 21 bp, Homo sapiens
tgagcaagatcttgtctccac

SEQ ID NO: 4098221 - DNA, 21 bp, Homo sapiens
tgagcaaggagcacaagccac

SEQ ID NO: 4098222 - DNA, 20 bp, Homo sapiens
tgagcaccacacccagtggg

SEQ ID NO: 4098223 - DNA, 17 bp, Homo sapiens
tgagcaccgtcatggct

SEQ ID NO: 4098224 - DNA, 21 bp, Homo sapiens
tgagcaccgtgtcaagctgct

SEQ ID NO: 4098225 - DNA, 22 bp, Homo sapiens
tgagcaccgtgtcaagctgctc

SEQ ID NO: 4098226 - DNA, 12 bp, Homo sapiens
tgagcacctgct

SEQ ID NO: 4098227 - DNA, 21 bp, Homo sapiens
tgagcacctgcttcatgctca

SEQ ID NO: 4098228 - DNA, 15 bp, Homo sapiens
tgagcacttagcagg

SEQ ID NO: 4098229 - DNA, 15 bp, Homo sapiens
tgagcagcctctgga

SEQ ID NO: 4098230 - DNA, 16 bp, Homo sapiens
tgagcagtcacactgt

SEQ ID NO: 4098231 - DNA, 20 bp, Homo sapiens
tgagcagtcgcctgcctgca

SEQ ID NO: 4098232 - DNA, 15 bp, Homo sapiens
tgagcagtgagcaga

SEQ ID NO: 4098233 - DNA, 23 bp, Homo sapiens
tgagcagtgagttacagcgagag

SEQ ID NO: 4098234 - DNA, 12 bp, Homo sapiens
tgagcagtggct

SEQ ID NO: 4098235 - DNA, 15 bp, Homo sapiens
tgagcagtggctggt

SEQ ID NO: 4098236 - DNA, 22 bp, Homo sapiens
tgagcagtggctggtccagggc

SEQ ID NO: 4098237 - DNA, 19 bp, Homo sapiens
tgagcatgacagcctgcag

SEQ ID NO: 4098238 - DNA, 14 bp, Homo sapiens
tgagcatgatggga

SEQ ID NO: 4098239 - DNA, 17 bp, Homo sapiens
tgagccacagaccacct

SEQ ID NO: 4098240 - DNA, 19 bp, Homo sapiens
tgagccacagaccacctgc

SEQ ID NO: 4098241 - DNA, 15 bp, Homo sapiens
tgagccaccgtgcct

SEQ ID NO: 4098242 - DNA, 17 bp, Homo sapiens
tgagccaccgtgcctgg

SEQ ID NO: 4098243 - DNA, 18 bp, Homo sapiens
tgagccaccgtgcctggc

SEQ ID NO: 4098244 - DNA, 19 bp, Homo sapiens
tgagccaccgtgcctggcc

SEQ ID NO: 4098245 - DNA, 20 bp, Homo sapiens
tgagccaccgtgcctggcca

SEQ ID NO: 4098246 - DNA, 12 bp, Homo sapiens
tgagccagcagg

SEQ ID NO: 4098247 - DNA, 14 bp, Homo sapiens
tgagccagcagggc

SEQ ID NO: 4098248 - DNA, 18 bp, Homo sapiens
tgagccaggcctgggtct

SEQ ID NO: 4098249 - DNA, 20 bp, Homo sapiens
tgagccaggtaatgagggac

SEQ ID NO: 4098250 - DNA, 21 bp, Homo sapiens
tgagccagttgtcctatggac

SEQ ID NO: 4098251 - DNA, 13 bp, Homo sapiens
tgagcccagagaa

SEQ ID NO: 4098252 - DNA, 15 bp, Homo sapiens
tgagcccagagaaca

SEQ ID NO: 4098253 - DNA, 16 bp, Homo sapiens
tgagcccagagaacag

SEQ ID NO: 4098254 - DNA, 12 bp, Homo sapiens
tgagcccagctg

SEQ ID NO: 4098255 - DNA, 13 bp, Homo sapiens
tgagcccagctgc

SEQ ID NO: 4098256 - DNA, 15 bp, Homo sapiens
tgagcccagctgcct

SEQ ID NO: 4098257 - DNA, 20 bp, Homo sapiens
tgagcccagctgcctggaga

SEQ ID NO: 4098258 - DNA, 21 bp, Homo sapiens
tgagcccagctgcctggagag

SEQ ID NO: 4098259 - DNA, 17 bp, Homo sapiens
tgagcccagctgggtca

SEQ ID NO: 4098260 - DNA, 21 bp, Homo sapiens
tgagcccagctgggtcaggca

SEQ ID NO: 4098261 - DNA, 11 bp, Homo sapiens
tgagccccacc

SEQ ID NO: 4098262 - DNA, 19 bp, Homo sapiens
tgagccccagggtgcccag

SEQ ID NO: 4098263 - DNA, 21 bp, Homo sapiens
tgagccccagggtgcccagaa

SEQ ID NO: 4098264 - DNA, 12 bp, Homo sapiens
tgagccctggct

SEQ ID NO: 4098265 - DNA, 13 bp, Homo sapiens
tgagccctgggga

SEQ ID NO: 4098266 - DNA, 20 bp, Homo sapiens
tgagccctggggactgttcc

SEQ ID NO: 4098267 - DNA, 24 bp, Homo sapiens
tgagcccttcggaggaccagggct

SEQ ID NO: 4098268 - DNA, 16 bp, Homo sapiens
tgagccgggcccctgg

SEQ ID NO: 4098269 - DNA, 17 bp, Homo sapiens
tgagccgggcccctggg

SEQ ID NO: 4098270 - DNA, 19 bp, Homo sapiens
tgagccgtgaactgtgcat

SEQ ID NO: 4098271 - DNA, 15 bp, Homo sapiens
tgagcctcctgtgcc

SEQ ID NO: 4098272 - DNA, 14 bp, Homo sapiens
tgagcctctgctcc

SEQ ID NO: 4098273 - DNA, 17 bp, Homo sapiens
tgagcctctgctcccca

SEQ ID NO: 4098274 - DNA, 23 bp, Homo sapiens
tgacctctcagggcctggcaggc

SEQ ID NO: 4098275 - DNA, 17 bp, Homo sapiens
tgacctcttgctgtctc

SEQ ID NO: 4098276 - DNA, 21 bp, Homo sapiens
tgacctcttgctgtctctgct

SEQ ID NO: 4098277 - DNA, 23 bp, Homo sapiens
tgacctcttgctgtctctgctcg

SEQ ID NO: 4098278 - DNA, 21 bp, Homo sapiens
tgacctgaccccattcctgat

SEQ ID NO: 4098279 - DNA, 13 bp, Homo sapiens
tgacctggtcagg

SEQ ID NO: 4098280 - DNA, 12 bp, Homo sapiens
tgacctgtcacc

SEQ ID NO: 4098281 - DNA, 16 bp, Homo sapiens
tgaccttccttcctgt

SEQ ID NO: 4098282 - DNA, 18 bp, Homo sapiens
tgacctttgacctcggtg

SEQ ID NO: 4098283 - DNA, 17 bp, Homo sapiens
tgaccttttatgtagta

SEQ ID NO: 4098284 - DNA, 18 bp, Homo sapiens
tgaccttttcttcatttt

SEQ ID NO: 4098285 - DNA, 16 bp, Homo sapiens
tgacgattccttctct

SEQ ID NO: 4098286 - DNA, 21 bp, Homo sapiens
tgacgattccttctctgaaca

SEQ ID NO: 4098287 - DNA, 18 bp, Homo sapiens
tgacgctgcatgagacat

SEQ ID NO: 4098288 - DNA, 19 bp, Homo sapiens
tgacggatgattggattat

SEQ ID NO: 4098289 - DNA, 19 bp, Homo sapiens
tgacggccagggagaagct

SEQ ID NO: 4098290 - DNA, 21 bp, Homo sapiens
tgacggctgggtgtttcagtt

SEQ ID NO: 4098291 - DNA, 19 bp, Homo sapiens
tgacggtcccacactggtg

SEQ ID NO: 4098292 - DNA, 23 bp, Homo sapiens
tgacggtcccacactggtgactg

SEQ ID NO: 4098293 - DNA, 23 bp, Homo sapiens
tgacgtcactttttggccatgta

SEQ ID NO: 4098294 - DNA, 23 bp, Homo sapiens
tgacgtggagcggggtatgaaga

SEQ ID NO: 4098295 - DNA, 17 bp, Homo sapiens
tgactaaagagagaatg

SEQ ID NO: 4098296 - DNA, 14 bp, Homo sapiens
tgactaaagctatg

SEQ ID NO: 4098297 - DNA, 22 bp, Homo sapiens
tgactaattagggtacatttat

SEQ ID NO: 4098298 - DNA, 18 bp, Homo sapiens
tgactagggattcaggct

SEQ ID NO: 4098299 - DNA, 20 bp, Homo sapiens
tgactagggattcaggctgc

SEQ ID NO: 4098300 - DNA, 21 bp, Homo sapiens
tgactagggattcaggctgct

SEQ ID NO: 4098301 - DNA, 23 bp, Homo sapiens
tgactagggattcaggctgcttg

SEQ ID NO: 4098302 - DNA, 20 bp, Homo sapiens
tgactagtacaaattataaa

SEQ ID NO: 4098303 - DNA, 14 bp, Homo sapiens
tgactcaacatgtt

SEQ ID NO: 4098304 - DNA, 22 bp, Homo sapiens
tgactcaagaagtgaagaatgc

SEQ ID NO: 4098305 - DNA, 18 bp, Homo sapiens
tgactcaattatttgcat

SEQ ID NO: 4098306 - DNA, 21 bp, Homo sapiens
tgactcacaggccctggagaa

SEQ ID NO: 4098307 - DNA, 23 bp, Homo sapiens
tgactcatggcagctgtttctca

SEQ ID NO: 4098308 - DNA, 22 bp, Homo sapiens
tgactcccccagtccccttccc

SEQ ID NO: 4098309 - DNA, 15 bp, Homo sapiens
tgactccctgtgggg

SEQ ID NO: 4098310 - DNA, 16 bp, Homo sapiens
tgactccctgtggggg

SEQ ID NO: 4098311 - DNA, 20 bp, Homo sapiens
tgactcctacctgccctgga

SEQ ID NO: 4098312 - DNA, 19 bp, Homo sapiens
tgactcctctggctttccc

SEQ ID NO: 4098313 - DNA, 20 bp, Homo sapiens
tgactcctctggctttccca

SEQ ID NO: 4098314 - DNA, 14 bp, Homo sapiens
tgactctaaatgca

SEQ ID NO: 4098315 - DNA, 19 bp, Homo sapiens
tgactctaagctcagtgct

SEQ ID NO: 4098316 - DNA, 14 bp, Homo sapiens
tgactctccactcc

SEQ ID NO: 4098317 - DNA, 13 bp, Homo sapiens
tgactctgccccc

SEQ ID NO: 4098318 - DNA, 14 bp, Homo sapiens
tgactctgccccct

SEQ ID NO: 4098319 - DNA, 15 bp, Homo sapiens
tgactctgccccctg

SEQ ID NO: 4098320 - DNA, 22 bp, Homo sapiens
tgactctggcaaagcttttaga

SEQ ID NO: 4098321 - DNA, 19 bp, Homo sapiens
tgactgaagatgcagctca

SEQ ID NO: 4098322 - DNA, 17 bp, Homo sapiens
tgactgatgattttcct

SEQ ID NO: 4098323 - DNA, 17 bp, Homo sapiens
tgactgcacccagctcc

SEQ ID NO: 4098324 - DNA, 18 bp, Homo sapiens
tgactgcccattcaccaa

SEQ ID NO: 4098325 - DNA, 16 bp, Homo sapiens
tgactgcgatcttcag

SEQ ID NO: 4098326 - DNA, 20 bp, Homo sapiens
tgactgctccccagccctgg

SEQ ID NO: 4098327 - DNA, 23 bp, Homo sapiens
tgactgctccccagccctggctc

SEQ ID NO: 4098328 - DNA, 12 bp, Homo sapiens
tgactgggctgg

SEQ ID NO: 4098329 - DNA, 17 bp, Homo sapiens
tgactgggctgggtttg

SEQ ID NO: 4098330 - DNA, 22 bp, Homo sapiens
tgactgggctgggtttgctgtc

SEQ ID NO: 4098331 - DNA, 17 bp, Homo sapiens
tgactggggtgggaggt

SEQ ID NO: 4098332 - DNA, 19 bp, Homo sapiens
tgactgtaccacagacaca

SEQ ID NO: 4098333 - DNA, 15 bp, Homo sapiens
tgactgtagccacag

SEQ ID NO: 4098334 - DNA, 19 bp, Homo sapiens
tgactgtagccacagctgc

SEQ ID NO: 4098335 - DNA, 16 bp, Homo sapiens
tgactgtttggcttat

SEQ ID NO: 4098336 - DNA, 18 bp, Homo sapiens
tgactgtttggcttataa

SEQ ID NO: 4098337 - DNA, 16 bp, Homo sapiens
tgacttaatgtgatta

SEQ ID NO: 4098338 - DNA, 13 bp, Homo sapiens
tgacttatagtac

SEQ ID NO: 4098339 - DNA, 17 bp, Homo sapiens
tgacttatagtacatga

SEQ ID NO: 4098340 - DNA, 13 bp, Homo sapiens
tgacttatttctg

SEQ ID NO: 4098341 - DNA, 19 bp, Homo sapiens
tgacttcagctgcctgaaa

SEQ ID NO: 4098342 - DNA, 22 bp, Homo sapiens
tgacttcagctgcctgaaacag

SEQ ID NO: 4098343 - DNA, 16 bp, Homo sapiens
tgacttcatctggggt

SEQ ID NO: 4098344 - DNA, 19 bp, Homo sapiens
tgacttcatggaatggaca

SEQ ID NO: 4098345 - DNA, 21 bp, Homo sapiens
tgacttcatggaatggacatc

SEQ ID NO: 4098346 - DNA, 19 bp, Homo sapiens
tgacttctaatttatatta

SEQ ID NO: 4098347 - DNA, 14 bp, Homo sapiens
tgacttctccaggt

SEQ ID NO: 4098348 - DNA, 23 bp, Homo sapiens
tgacttctccaggtctcacgggc

SEQ ID NO: 4098349 - DNA, 19 bp, Homo sapiens
tgacttgtttgtcttccat

SEQ ID NO: 4098350 - DNA, 14 bp, Homo sapiens
tgactttgcccagg

SEQ ID NO: 4098351 - DNA, 17 bp, Homo sapiens
tgactttgcttgctttg

SEQ ID NO: 4098352 - DNA, 16 bp, Homo sapiens
tgactttgtctctcct

SEQ ID NO: 4098353 - DNA, 16 bp, Homo sapiens
tgactttttgtttctt

SEQ ID NO: 4098354 - DNA, 18 bp, Homo sapiens
tgactttttttggtataa

SEQ ID NO: 4098355 - DNA, 17 bp, Homo sapiens
tgagaaaaagctcctgt

SEQ ID NO: 4098356 - DNA, 16 bp, Homo sapiens
tgagaaaacttctttt

SEQ ID NO: 4098357 - DNA, 17 bp, Homo sapiens
tgagaaaacttctttta

SEQ ID NO: 4098358 - DNA, 21 bp, Homo sapiens
tgagaaaattgaaataaagct

SEQ ID NO: 4098359 - DNA, 11 bp, Homo sapiens
tgagaaactgc

SEQ ID NO: 4098360 - DNA, 12 bp, Homo sapiens
tgagaaagaaag

SEQ ID NO: 4098361 - DNA, 17 bp, Homo sapiens
tgagaaatatggacact

SEQ ID NO: 4098362 - DNA, 21 bp, Homo sapiens
tgagaaatatggacacttaat

SEQ ID NO: 4098363 - DNA, 14 bp, Homo sapiens
tgagaaatcctgga

SEQ ID NO: 4098364 - DNA, 14 bp, Homo sapiens
tgagaaatgaaata

SEQ ID NO: 4098365 - DNA, 14 bp, Homo sapiens
tgagaaatgttaaa

SEQ ID NO: 4098366 - DNA, 17 bp, Homo sapiens
tgagaagaagtggctgc

SEQ ID NO: 4098367 - DNA, 15 bp, Homo sapiens
tgagaagagggcctg

SEQ ID NO: 4098368 - DNA, 20 bp, Homo sapiens
tgagaagagggcctgtggga

SEQ ID NO: 4098369 - DNA, 21 bp, Homo sapiens
tgagaagagggcctgtgggag

SEQ ID NO: 4098370 - DNA, 23 bp, Homo sapiens
tgagaagagggcctgtgggagcc

SEQ ID NO: 4098371 - DNA, 20 bp, Homo sapiens
tgagaagcggtcatgagcac

SEQ ID NO: 4098372 - DNA, 11 bp, Homo sapiens
tgagaagtact

SEQ ID NO: 4098373 - DNA, 20 bp, Homo sapiens
tgagaatcccaaatttgatt

SEQ ID NO: 4098374 - DNA, 21 bp, Homo sapiens
tgagaatcctctcctttctta

SEQ ID NO: 4098375 - DNA, 12 bp, Homo sapiens
tgagaatctacc

SEQ ID NO: 4098376 - DNA, 21 bp, Homo sapiens
tgacacagtcagcatgcttcc

SEQ ID NO: 4098377 - DNA, 16 bp, Homo sapiens
tgacaccaaagccacc

SEQ ID NO: 4098378 - DNA, 22 bp, Homo sapiens
tgacaccagaaagccctcttgg

SEQ ID NO: 4098379 - DNA, 16 bp, Homo sapiens
tgacacccaccctgtg

SEQ ID NO: 4098380 - DNA, 13 bp, Homo sapiens
tgacaccccctcc

SEQ ID NO: 4098381 - DNA, 23 bp, Homo sapiens
tgacaccccctccccgcccctgt

SEQ ID NO: 4098382 - DNA, 18 bp, Homo sapiens
tgacaccctggcctgaac

SEQ ID NO: 4098383 - DNA, 10 bp, Homo sapiens
tgacactgaa

SEQ ID NO: 4098384 - DNA, 19 bp, Homo sapiens
tgacactgaaagttttgta

SEQ ID NO: 4098385 - DNA, 18 bp, Homo sapiens
tgacactgtccctctttg

SEQ ID NO: 4098386 - DNA, 23 bp, Homo sapiens
tgacacttcagagagctggtagt

SEQ ID NO: 4098387 - DNA, 24 bp, Homo sapiens
tgacacttcagagagctggtagtt

SEQ ID NO: 4098388 - DNA, 20 bp, Homo sapiens
tgacactttgccagaaagca

SEQ ID NO: 4098389 - DNA, 13 bp, Homo sapiens
tgacagaaagcag

SEQ ID NO: 4098390 - DNA, 18 bp, Homo sapiens
tgacagaccacatcttta

SEQ ID NO: 4098391 - DNA, 18 bp, Homo sapiens
tgacagagcaagactctg

SEQ ID NO: 4098392 - DNA, 16 bp, Homo sapiens
tgacagagcctgcccc

SEQ ID NO: 4098393 - DNA, 20 bp, Homo sapiens
tgacagagcctgccccagcg

SEQ ID NO: 4098394 - DNA, 23 bp, Homo sapiens
tgacagagcctgccccagcgctg

SEQ ID NO: 4098395 - DNA, 14 bp, Homo sapiens
tgacagaggctgca

SEQ ID NO: 4098396 - DNA, 16 bp, Homo sapiens
tgacagaggctgcacc

SEQ ID NO: 4098397 - DNA, 21 bp, Homo sapiens
tgacagatatatttaagcctt

SEQ ID NO: 4098398 - DNA, 22 bp, Homo sapiens
tgacagatatatttaagcctta

SEQ ID NO: 4098399 - DNA, 14 bp, Homo sapiens
tgacagccagaact

SEQ ID NO: 4098400 - DNA, 11 bp, Homo sapiens
tgacagcccct

SEQ ID NO: 4098401 - DNA, 12 bp, Homo sapiens
tgacagctgcaa

SEQ ID NO: 4098402 - DNA, 19 bp, Homo sapiens
tgacaggaaagccctcccc

SEQ ID NO: 4098403 - DNA, 11 bp, Homo sapiens
tgacagggcca

SEQ ID NO: 4098404 - DNA, 12 bp, Homo sapiens
tgacagggccag

SEQ ID NO: 4098405 - DNA, 22 bp, Homo sapiens
tgacagggccagtggggcctgt

SEQ ID NO: 4098406 - DNA, 22 bp, Homo sapiens
tgacagtattatacgctggcaa

SEQ ID NO: 4098407 - DNA, 22 bp, Homo sapiens
tgacagtcatcatcagggcctg

SEQ ID NO: 4098408 - DNA, 14 bp, Homo sapiens
tgacagtgccttct

SEQ ID NO: 4098409 - DNA, 17 bp, Homo sapiens
tgacagtttttctgttt

SEQ ID NO: 4098410 - DNA, 15 bp, Homo sapiens
tgacatcacagcagc

SEQ ID NO: 4098411 - DNA, 16 bp, Homo sapiens
tgacatcacagcagcc

SEQ ID NO: 4098412 - DNA, 23 bp, Homo sapiens
tgacatcagttcctttgtgtgta

SEQ ID NO: 4098413 - DNA, 17 bp, Homo sapiens
tgacatcctttctttta

SEQ ID NO: 4098414 - DNA, 14 bp, Homo sapiens
tgacatctcagggg

SEQ ID NO: 4098415 - DNA, 18 bp, Homo sapiens
tgacatctcaggggccag

SEQ ID NO: 4098416 - DNA, 12 bp, Homo sapiens
tgacatgcattg

SEQ ID NO: 4098417 - DNA, 16 bp, Homo sapiens
tgacatggtgcctgag

SEQ ID NO: 4098418 - DNA, 13 bp, Homo sapiens
tgacatgtaacag

SEQ ID NO: 4098419 - DNA, 16 bp, Homo sapiens
tgacatgtagcttctt

SEQ ID NO: 4098420 - DNA, 12 bp, Homo sapiens
tgacatgtgaaa

SEQ ID NO: 4098421 - DNA, 15 bp, Homo sapiens
tgacatgtgaaacct

SEQ ID NO: 4098422 - DNA, 16 bp, Homo sapiens
tgacatgtgaaacctt

SEQ ID NO: 4098423 - DNA, 21 bp, Homo sapiens
tgacatgtgaaacctttttta

SEQ ID NO: 4098424 - DNA, 21 bp, Homo sapiens
tgacatgtggaaagtgaattt

SEQ ID NO: 4098425 - DNA, 18 bp, Homo sapiens
tgacatgtggggccaggt

SEQ ID NO: 4098426 - DNA, 19 bp, Homo sapiens
tgacatgtggggccaggtc

SEQ ID NO: 4098427 - DNA, 14 bp, Homo sapiens
tgacattaacaaat

SEQ ID NO: 4098428 - DNA, 19 bp, Homo sapiens
tgacattaacaaataaaaa

SEQ ID NO: 4098429 - DNA, 13 bp, Homo sapiens
tgacattaacagt

SEQ ID NO: 4098430 - DNA, 21 bp, Homo sapiens
tgacattaacagttttccatg

SEQ ID NO: 4098431 - DNA, 15 bp, Homo sapiens
tgacatttagaactt

SEQ ID NO: 4098432 - DNA, 16 bp, Homo sapiens
tgacatttagaacttt

SEQ ID NO: 4098433 - DNA, 19 bp, Homo sapiens
tgacatttagaactttaag

SEQ ID NO: 4098434 - DNA, 19 bp, Homo sapiens
tgacatttagtccctcaag

SEQ ID NO: 4098435 - DNA, 16 bp, Homo sapiens
tgacatttatatattg

SEQ ID NO: 4098436 - DNA, 22 bp, Homo sapiens
tgacatttgggagacatgtgac

SEQ ID NO: 4098437 - DNA, 15 bp, Homo sapiens
tgacattttacatta

SEQ ID NO: 4098438 - DNA, 19 bp, Homo sapiens
tgaccaaatatcaccagga

SEQ ID NO: 4098439 - DNA, 18 bp, Homo sapiens
tgaccaagaactgcatgg

SEQ ID NO: 4098440 - DNA, 19 bp, Homo sapiens
tgaccaagaactgcatgga

SEQ ID NO: 4098441 - DNA, 20 bp, Homo sapiens
tgaccaagttataaatcaat

SEQ ID NO: 4098442 - DNA, 18 bp, Homo sapiens
tgaccaattgtgctgcca

SEQ ID NO: 4098443 - DNA, 17 bp, Homo sapiens
tgaccacagcacagcca

SEQ ID NO: 4098444 - DNA, 13 bp, Homo sapiens
tgaccacccacca

SEQ ID NO: 4098445 - DNA, 21 bp, Homo sapiens
tgaccaccttctgtccccagc

SEQ ID NO: 4098446 - DNA, 15 bp, Homo sapiens
tgaccactctgtctt

SEQ ID NO: 4098447 - DNA, 11 bp, Homo sapiens
tgaccagaagc

SEQ ID NO: 4098448 - DNA, 15 bp, Homo sapiens
tgaccagaagccttg

SEQ ID NO: 4098449 - DNA, 16 bp, Homo sapiens
tgaccaggatcccaag

SEQ ID NO: 4098450 - DNA, 22 bp, Homo sapiens
tgaccaggatcccaagcctcct

SEQ ID NO: 4098451 - DNA, 22 bp, Homo sapiens
tgaccaggcacctcccctcccg

SEQ ID NO: 4098452 - DNA, 17 bp, Homo sapiens
tgaccagggatgctggg

SEQ ID NO: 4098453 - DNA, 19 bp, Homo sapiens
tgaccagggatgctgggct

SEQ ID NO: 4098454 - DNA, 20 bp, Homo sapiens
tgaccagggatgctgggctg

SEQ ID NO: 4098455 - DNA, 23 bp, Homo sapiens
tgaccagtgataatgccccaagg

SEQ ID NO: 4098456 - DNA, 19 bp, Homo sapiens
tgaccagtggctatggcct

SEQ ID NO: 4098457 - DNA, 18 bp, Homo sapiens
tgaccatcttcataattt

SEQ ID NO: 4098458 - DNA, 18 bp, Homo sapiens
tgacccagccccttgaga

SEQ ID NO: 4098459 - DNA, 16 bp, Homo sapiens
tgacccagtgccccca

SEQ ID NO: 4098460 - DNA, 18 bp, Homo sapiens
tgaccccagaaaagcata

SEQ ID NO: 4098461 - DNA, 14 bp, Homo sapiens
tgacccccagctcc

SEQ ID NO: 4098462 - DNA, 14 bp, Homo sapiens
tgacccccttcctg

SEQ ID NO: 4098463 - DNA, 20 bp, Homo sapiens
tgacccggcctctctgcccc

SEQ ID NO: 4098464 - DNA, 17 bp, Homo sapiens
tgaccctactcccttgc

SEQ ID NO: 4098465 - DNA, 15 bp, Homo sapiens
tgaccctgatgaaaa

SEQ ID NO: 4098466 - DNA, 15 bp, Homo sapiens
tgaccgtactctcac

SEQ ID NO: 4098467 - DNA, 20 bp, Homo sapiens
tgaccgtactctcacatgtg

SEQ ID NO: 4098468 - DNA, 16 bp, Homo sapiens
tgacctaaattagata

SEQ ID NO: 4098469 - DNA, 17 bp, Homo sapiens
tgacctcaatttcaatt

SEQ ID NO: 4098470 - DNA, 23 bp, Homo sapiens
tgacctcaatttcaattttgtct

SEQ ID NO: 4098471 - DNA, 16 bp, Homo sapiens
tgacctcactcagaag

SEQ ID NO: 4098472 - DNA, 14 bp, Homo sapiens
tgacctcactgtga

SEQ ID NO: 4098473 - DNA, 18 bp, Homo sapiens
tgacctccgcccctgccc

SEQ ID NO: 4098474 - DNA, 17 bp, Homo sapiens
tgacctcgacgttgcct

SEQ ID NO: 4098475 - DNA, 20 bp, Homo sapiens
tgacctctagccctgcccgg

SEQ ID NO: 4098476 - DNA, 13 bp, Homo sapiens
tgacctctcaggg

SEQ ID NO: 4098477 - DNA, 14 bp, Homo sapiens
tgacctctcagggc

SEQ ID NO: 4098478 - DNA, 17 bp, Homo sapiens
tgacctctcagggcctg

SEQ ID NO: 4098479 - DNA, 14 bp, Homo sapiens
tgaagtatactttt

SEQ ID NO: 4098480 - DNA, 23 bp, Homo sapiens
tgaagtcacccctttctgtccca

SEQ ID NO: 4098481 - DNA, 17 bp, Homo sapiens
tgaagtgagcacagcct

SEQ ID NO: 4098482 - DNA, 18 bp, Homo sapiens
tgaagtgagcacagccta

SEQ ID NO: 4098483 - DNA, 16 bp, Homo sapiens
tgaagtgcgtgaatgt

SEQ ID NO: 4098484 - DNA, 17 bp, Homo sapiens
tgaagtgcgtgaatgta

SEQ ID NO: 4098485 - DNA, 15 bp, Homo sapiens
tgaagttgttttttt

SEQ ID NO: 4098486 - DNA, 17 bp, Homo sapiens
tgaagtttacattttta

SEQ ID NO: 4098487 - DNA, 14 bp, Homo sapiens
tgaagttttacatt

SEQ ID NO: 4098488 - DNA, 22 bp, Homo sapiens
tgaagtttttttgctgctgcct

SEQ ID NO: 4098489 - DNA, 15 bp, Homo sapiens
tgaataaaaatgcac

SEQ ID NO: 4098490 - DNA, 15 bp, Homo sapiens
tgaataaactgaata

SEQ ID NO: 4098491 - DNA, 16 bp, Homo sapiens
tgaataaactgaatat

SEQ ID NO: 4098492 - DNA, 14 bp, Homo sapiens
tgaataaagaatgc

SEQ ID NO: 4098493 - DNA, 17 bp, Homo sapiens
tgaataaagcacgtgca

SEQ ID NO: 4098494 - DNA, 15 bp, Homo sapiens
tgaataaatgtcttg

SEQ ID NO: 4098495 - DNA, 21 bp, Homo sapiens
tgaataaattctataggaaca

SEQ ID NO: 4098496 - DNA, 12 bp, Homo sapiens
tgaatacaatta

SEQ ID NO: 4098497 - DNA, 15 bp, Homo sapiens
tgaatacaattaaag

SEQ ID NO: 4098498 - DNA, 18 bp, Homo sapiens
tgaatacaattaaaggtc

SEQ ID NO: 4098499 - DNA, 19 bp, Homo sapiens
tgaatacagggcatgcatt

SEQ ID NO: 4098500 - DNA, 14 bp, Homo sapiens
tgaatactgctaca

SEQ ID NO: 4098501 - DNA, 20 bp, Homo sapiens
tgaatacttactataatttg

SEQ ID NO: 4098502 - DNA, 16 bp, Homo sapiens
tgaatactttttacaa

SEQ ID NO: 4098503 - DNA, 12 bp, Homo sapiens
tgaatagaaatg

SEQ ID NO: 4098504 - DNA, 23 bp, Homo sapiens
tgaatatatttaagcaacatctt

SEQ ID NO: 4098505 - DNA, 21 bp, Homo sapiens
tgaatatctattaatatatgt

SEQ ID NO: 4098506 - DNA, 19 bp, Homo sapiens
tgaatatggacaagaggta

SEQ ID NO: 4098507 - DNA, 19 bp, Homo sapiens
tgaatatttatatttcact

SEQ ID NO: 4098508 - DNA, 20 bp, Homo sapiens
tgaatattttatctttcctt

SEQ ID NO: 4098509 - DNA, 14 bp, Homo sapiens
tgaatattttggaa

SEQ ID NO: 4098510 - DNA, 13 bp, Homo sapiens
tgaatcaatgaaa

SEQ ID NO: 4098511 - DNA, 20 bp, Homo sapiens
tgaatcacctggctgagcag

SEQ ID NO: 4098512 - DNA, 22 bp, Homo sapiens
tgaatcagtataaacaaagtta

SEQ ID NO: 4098513 - DNA, 21 bp, Homo sapiens
tgaatcagtttttaaaatatt

SEQ ID NO: 4098514 - DNA, 14 bp, Homo sapiens
tgaatcatgagcct

SEQ ID NO: 4098515 - DNA, 18 bp, Homo sapiens
tgaatcatgagcctgctg

SEQ ID NO: 4098516 - DNA, 21 bp, Homo sapiens
tgaatcccccttgccacccca

SEQ ID NO: 4098517 - DNA, 17 bp, Homo sapiens
tgaatctcgttcccaaa

SEQ ID NO: 4098518 - DNA, 18 bp, Homo sapiens
tgaatctggtgttgggga

SEQ ID NO: 4098519 - DNA, 13 bp, Homo sapiens
tgaatgaaaacat

SEQ ID NO: 4098520 - DNA, 16 bp, Homo sapiens
tgaatgaaagattaaa

SEQ ID NO: 4098521 - DNA, 19 bp, Homo sapiens
tgaatgactccactgtttt

SEQ ID NO: 4098522 - DNA, 14 bp, Homo sapiens
tgaatgagaatcta

SEQ ID NO: 4098523 - DNA, 18 bp, Homo sapiens
tgaatgaggtcccaggca

SEQ ID NO: 4098524 - DNA, 19 bp, Homo sapiens
tgaatgaggtcccaggcag

SEQ ID NO: 4098525 - DNA, 15 bp, Homo sapiens
tgaatgatctctctg

SEQ ID NO: 4098526 - DNA, 13 bp, Homo sapiens
tgaatgcctcctg

SEQ ID NO: 4098527 - DNA, 16 bp, Homo sapiens
tgaatgcctcctgtgg

SEQ ID NO: 4098528 - DNA, 13 bp, Homo sapiens
tgaatgctgccac

SEQ ID NO: 4098529 - DNA, 21 bp, Homo sapiens
tgaatggattggattatttaa

SEQ ID NO: 4098530 - DNA, 23 bp, Homo sapiens
tgaatggattggattatttaata

SEQ ID NO: 4098531 - DNA, 19 bp, Homo sapiens
tgaatggcaatgttttgct

SEQ ID NO: 4098532 - DNA, 18 bp, Homo sapiens
tgaatgggacagagttga

SEQ ID NO: 4098533 - DNA, 21 bp, Homo sapiens
tgaatggttccatgcctgagg

SEQ ID NO: 4098534 - DNA, 22 bp, Homo sapiens
tgaatggttccatgcctgaggg

SEQ ID NO: 4098535 - DNA, 20 bp, Homo sapiens
tgaatggttttcaaaataaa

SEQ ID NO: 4098536 - DNA, 16 bp, Homo sapiens
tgaatgtatcaggaaa

SEQ ID NO: 4098537 - DNA, 18 bp, Homo sapiens
tgaatgtatgtgcactgt

SEQ ID NO: 4098538 - DNA, 15 bp, Homo sapiens
tgaatgtatttattt

SEQ ID NO: 4098539 - DNA, 19 bp, Homo sapiens
tgaatgtatttatttggga

SEQ ID NO: 4098540 - DNA, 18 bp, Homo sapiens
tgaatgtcaaacagtgcc

SEQ ID NO: 4098541 - DNA, 20 bp, Homo sapiens
tgaatgtcaaacagtgccaa

SEQ ID NO: 4098542 - DNA, 14 bp, Homo sapiens
tgaatgttaagaat

SEQ ID NO: 4098543 - DNA, 15 bp, Homo sapiens
tgaatgttctgacat

SEQ ID NO: 4098544 - DNA, 20 bp, Homo sapiens
tgaatgttctgacattaaca

SEQ ID NO: 4098545 - DNA, 21 bp, Homo sapiens
tgaatgttctgacattaacag

SEQ ID NO: 4098546 - DNA, 15 bp, Homo sapiens
tgaattaaataaata

SEQ ID NO: 4098547 - DNA, 16 bp, Homo sapiens
tgaattaaattaggaa

SEQ ID NO: 4098548 - DNA, 19 bp, Homo sapiens
tgaattaatatccctacat

SEQ ID NO: 4098549 - DNA, 22 bp, Homo sapiens
tgaattaatatccctacatgta

SEQ ID NO: 4098550 - DNA, 13 bp, Homo sapiens
tgaattattgaca

SEQ ID NO: 4098551 - DNA, 17 bp, Homo sapiens
tgaattcagattttaaa

SEQ ID NO: 4098552 - DNA, 15 bp, Homo sapiens
tgaattcccttttaa

SEQ ID NO: 4098553 - DNA, 13 bp, Homo sapiens
tgaattgactacc

SEQ ID NO: 4098554 - DNA, 16 bp, Homo sapiens
tgaattgcctgcagag

SEQ ID NO: 4098555 - DNA, 22 bp, Homo sapiens
tgaattgcctgcagagagaagc

SEQ ID NO: 4098556 - DNA, 13 bp, Homo sapiens
tgaatttaaataa

SEQ ID NO: 4098557 - DNA, 14 bp, Homo sapiens
tgaatttaaatata

SEQ ID NO: 4098558 - DNA, 13 bp, Homo sapiens
tgaatttctaaaa

SEQ ID NO: 4098559 - DNA, 20 bp, Homo sapiens
tgaatttggcctgcactaat

SEQ ID NO: 4098560 - DNA, 15 bp, Homo sapiens
tgaatttttctcttc

SEQ ID NO: 4098561 - DNA, 18 bp, Homo sapiens
tgaatttttttgtaataa

SEQ ID NO: 4098562 - DNA, 17 bp, Homo sapiens
tgacaaaactaaccttg

SEQ ID NO: 4098563 - DNA, 15 bp, Homo sapiens
tgacaaaagtaaatg

SEQ ID NO: 4098564 - DNA, 18 bp, Homo sapiens
tgacaaaatttgttgaaa

SEQ ID NO: 4098565 - DNA, 16 bp, Homo sapiens
tgacaaccactggtct

SEQ ID NO: 4098566 - DNA, 21 bp, Homo sapiens
tgacaacctccattctatttt

SEQ ID NO: 4098567 - DNA, 13 bp, Homo sapiens
tgacaactaaaat

SEQ ID NO: 4098568 - DNA, 20 bp, Homo sapiens
tgacaactgcacatgaaagt

SEQ ID NO: 4098569 - DNA, 22 bp, Homo sapiens
tgacaactgtctaactttagaa

SEQ ID NO: 4098570 - DNA, 12 bp, Homo sapiens
tgacaactgtga

SEQ ID NO: 4098571 - DNA, 15 bp, Homo sapiens
tgacaagcactgcta

SEQ ID NO: 4098572 - DNA, 14 bp, Homo sapiens
tgacaataaaacat

SEQ ID NO: 4098573 - DNA, 18 bp, Homo sapiens
tgacaattttgtacaaat

SEQ ID NO: 4098574 - DNA, 17 bp, Homo sapiens
tgacacaagtggacctt

SEQ ID NO: 4098575 - DNA, 17 bp, Homo sapiens
tgacacaatccctgggg

SEQ ID NO: 4098576 - DNA, 22 bp, Homo sapiens
tgacacaatccctggggctgtg

SEQ ID NO: 4098577 - DNA, 13 bp, Homo sapiens
tgacacacagcac

SEQ ID NO: 4098578 - DNA, 15 bp, Homo sapiens
tgacacacagcactc

SEQ ID NO: 4098579 - DNA, 16 bp, Homo sapiens
tgacacacagcactct

SEQ ID NO: 4098580 - DNA, 19 bp, Homo sapiens
tgacacacagcactctcta

SEQ ID NO: 4098581 - DNA, 12 bp, Homo sapiens
tgacacactaac

SEQ ID NO: 4098582 - DNA, 15 bp, Homo sapiens
tgacacagtcagcat

SEQ ID NO: 4098583 - DNA, 12 bp, Homo sapiens
tgaacacacaca

SEQ ID NO: 4098584 - DNA, 17 bp, Homo sapiens
tgaacacaggcagcttt

SEQ ID NO: 4098585 - DNA, 23 bp, Homo sapiens
tgaacacaggcagctttctagaa

SEQ ID NO: 4098586 - DNA, 18 bp, Homo sapiens
tgaacactggcaacaaca

SEQ ID NO: 4098587 - DNA, 16 bp, Homo sapiens
tgaacagaagctctta

SEQ ID NO: 4098588 - DNA, 18 bp, Homo sapiens
tgaacatacttcaaaaat

SEQ ID NO: 4098589 - DNA, 19 bp, Homo sapiens
tgaacatacttcaaaaata

SEQ ID NO: 4098590 - DNA, 22 bp, Homo sapiens
tgaacatacttcaaaaataatg

SEQ ID NO: 4098591 - DNA, 20 bp, Homo sapiens
tgaacatccctttttcaatg

SEQ ID NO: 4098592 - DNA, 20 bp, Homo sapiens
tgaacatgtttaatgggtat

SEQ ID NO: 4098593 - DNA, 18 bp, Homo sapiens
tgaaccaagatctataaa

SEQ ID NO: 4098594 - DNA, 22 bp, Homo sapiens
tgaaccagagggtgtggctttc

SEQ ID NO: 4098595 - DNA, 16 bp, Homo sapiens
tgaaccagctcatctc

SEQ ID NO: 4098596 - DNA, 21 bp, Homo sapiens
tgaaccatcattataaacgtg

SEQ ID NO: 4098597 - DNA, 21 bp, Homo sapiens
tgaacccaggacgcttctgaa

SEQ ID NO: 4098598 - DNA, 22 bp, Homo sapiens
tgaacccccgccatccttcacc

SEQ ID NO: 4098599 - DNA, 22 bp, Homo sapiens
tgaacccgggacgcaggggttg

SEQ ID NO: 4098600 - DNA, 13 bp, Homo sapiens
tgaaccctccagg

SEQ ID NO: 4098601 - DNA, 21 bp, Homo sapiens
tgaaccctggggcctgactgc

SEQ ID NO: 4098602 - DNA, 17 bp, Homo sapiens
tgaacctacctgccttg

SEQ ID NO: 4098603 - DNA, 20 bp, Homo sapiens
tgaacctttttttttgaaac

SEQ ID NO: 4098604 - DNA, 16 bp, Homo sapiens
tgaactaataaaagca

SEQ ID NO: 4098605 - DNA, 21 bp, Homo sapiens
tgaactatgtcgatgcacagt

SEQ ID NO: 4098606 - DNA, 22 bp, Homo sapiens
tgaactcagatctgtctgatag

SEQ ID NO: 4098607 - DNA, 21 bp, Homo sapiens
tgaactctacgccactccaca

SEQ ID NO: 4098608 - DNA, 11 bp, Homo sapiens
tgaactctcaa

SEQ ID NO: 4098609 - DNA, 16 bp, Homo sapiens
tgaactctgaactttg

SEQ ID NO: 4098610 - DNA, 13 bp, Homo sapiens
tgaactctggtgc

SEQ ID NO: 4098611 - DNA, 16 bp, Homo sapiens
tgaactctgttccccc

SEQ ID NO: 4098612 - DNA, 17 bp, Homo sapiens
tgaactctgttccccca

SEQ ID NO: 4098613 - DNA, 14 bp, Homo sapiens
tgaactcttaatca

SEQ ID NO: 4098614 - DNA, 15 bp, Homo sapiens
tgaactcttaatcaa

SEQ ID NO: 4098615 - DNA, 22 bp, Homo sapiens
tgaactctttctggcctgcctt

SEQ ID NO: 4098616 - DNA, 23 bp, Homo sapiens
tgaactctttctggcctgccttc

SEQ ID NO: 4098617 - DNA, 13 bp, Homo sapiens
tgaactgaagttt

SEQ ID NO: 4098618 - DNA, 16 bp, Homo sapiens
tgaactgctttcaagt

SEQ ID NO: 4098619 - DNA, 21 bp, Homo sapiens
tgaactggcaattgtctattt

SEQ ID NO: 4098620 - DNA, 17 bp, Homo sapiens
tgaacttgcattgtgat

SEQ ID NO: 4098621 - DNA, 16 bp, Homo sapiens
tgaacttttgtactga

SEQ ID NO: 4098622 - DNA, 21 bp, Homo sapiens
tgaagaaacagagtggcctcc

SEQ ID NO: 4098623 - DNA, 14 bp, Homo sapiens
tgaagaatacagtt

SEQ ID NO: 4098624 - DNA, 15 bp, Homo sapiens
tgaagaatacagtta

SEQ ID NO: 4098625 - DNA, 16 bp, Homo sapiens
tgaagaatatttaaga

SEQ ID NO: 4098626 - DNA, 17 bp, Homo sapiens
tgaagaatatttaagaa

SEQ ID NO: 4098627 - DNA, 11 bp, Homo sapiens
tgaagaattaa

SEQ ID NO: 4098628 - DNA, 20 bp, Homo sapiens
tgaagaattgccaatcttgt

SEQ ID NO: 4098629 - DNA, 13 bp, Homo sapiens
tgaagacaatttg

SEQ ID NO: 4098630 - DNA, 21 bp, Homo sapiens
tgaagacaatttgatacataa

SEQ ID NO: 4098631 - DNA, 14 bp, Homo sapiens
tgaagaccagagca

SEQ ID NO: 4098632 - DNA, 22 bp, Homo sapiens
tgaagacccagcaggaagccag

SEQ ID NO: 4098633 - DNA, 16 bp, Homo sapiens
tgaagacctaaagtgc

SEQ ID NO: 4098634 - DNA, 18 bp, Homo sapiens
tgaagacctaaagtgctt

SEQ ID NO: 4098635 - DNA, 22 bp, Homo sapiens
tgaagagagatatatctgaaaa

SEQ ID NO: 4098636 - DNA, 17 bp, Homo sapiens
tgaagagctggggagaa

SEQ ID NO: 4098637 - DNA, 15 bp, Homo sapiens
tgaagagcttgcttt

SEQ ID NO: 4098638 - DNA, 18 bp, Homo sapiens
tgaagaggaacagtgtgg

SEQ ID NO: 4098639 - DNA, 13 bp, Homo sapiens
tgaagaggaaggg

SEQ ID NO: 4098640 - DNA, 15 bp, Homo sapiens
tgaagagtatccttc

SEQ ID NO: 4098641 - DNA, 19 bp, Homo sapiens
tgaagagtatccttccttc

SEQ ID NO: 4098642 - DNA, 16 bp, Homo sapiens
tgaagagtattaatgt

SEQ ID NO: 4098643 - DNA, 21 bp, Homo sapiens
tgaagataagtgtatttttca

SEQ ID NO: 4098644 - DNA, 19 bp, Homo sapiens
tgaagatctgagatttttt

SEQ ID NO: 4098645 - DNA, 13 bp, Homo sapiens
tgaagatgatcat

SEQ ID NO: 4098646 - DNA, 22 bp, Homo sapiens
tgaagatgcaatcagacaagtg

SEQ ID NO: 4098647 - DNA, 18 bp, Homo sapiens
tgaagatggtttcaattc

SEQ ID NO: 4098648 - DNA, 23 bp, Homo sapiens
tgaagatggtttcaattcagatt

SEQ ID NO: 4098649 - DNA, 19 bp, Homo sapiens
tgaagattctcctgtgcta

SEQ ID NO: 4098650 - DNA, 22 bp, Homo sapiens
tgaagattcttaaaaattgaat

SEQ ID NO: 4098651 - DNA, 18 bp, Homo sapiens
tgaagcaaagcaccagct

SEQ ID NO: 4098652 - DNA, 14 bp, Homo sapiens
tgaagcaaatcaga

SEQ ID NO: 4098653 - DNA, 15 bp, Homo sapiens
tgaagcaaatcagaa

SEQ ID NO: 4098654 - DNA, 21 bp, Homo sapiens
tgaagcaacgataaaattaca

SEQ ID NO: 4098655 - DNA, 14 bp, Homo sapiens
tgaagcaaggaaga

SEQ ID NO: 4098656 - DNA, 21 bp, Homo sapiens
tgaagcaaggaagatatacat

SEQ ID NO: 4098657 - DNA, 23 bp, Homo sapiens
tgaagcacctactatgtgctggg

SEQ ID NO: 4098658 - DNA, 19 bp, Homo sapiens
tgaagcagctttaaacaaa

SEQ ID NO: 4098659 - DNA, 17 bp, Homo sapiens
tgaagcagtcttgctct

SEQ ID NO: 4098660 - DNA, 18 bp, Homo sapiens
tgaagcattctccccagt

SEQ ID NO: 4098661 - DNA, 14 bp, Homo sapiens
tgaagccaaagaaa

SEQ ID NO: 4098662 - DNA, 11 bp, Homo sapiens
tgaagccagct

SEQ ID NO: 4098663 - DNA, 16 bp, Homo sapiens
tgaagccgactctggc

SEQ ID NO: 4098664 - DNA, 18 bp, Homo sapiens
tgaagccgactctggccc

SEQ ID NO: 4098665 - DNA, 19 bp, Homo sapiens
tgaagccgactctggccct

SEQ ID NO: 4098666 - DNA, 23 bp, Homo sapiens
tgaagcctgcgttggtccagagc

SEQ ID NO: 4098667 - DNA, 12 bp, Homo sapiens
tgaagcctgtgc

SEQ ID NO: 4098668 - DNA, 19 bp, Homo sapiens
tgaagcctgtgcctcccag

SEQ ID NO: 4098669 - DNA, 15 bp, Homo sapiens
tgaagctaagattta

SEQ ID NO: 4098670 - DNA, 14 bp, Homo sapiens
tgaagcttgactcc

SEQ ID NO: 4098671 - DNA, 22 bp, Homo sapiens
tgaagcttggaggtcacagctg

SEQ ID NO: 4098672 - DNA, 22 bp, Homo sapiens
tgaaggaagccaaatttatcaa

SEQ ID NO: 4098673 - DNA, 20 bp, Homo sapiens
tgaaggactggattggccaa

SEQ ID NO: 4098674 - DNA, 21 bp, Homo sapiens
tgaaggaggctccaggcagca

SEQ ID NO: 4098675 - DNA, 17 bp, Homo sapiens
tgaaggaggtgagggat

SEQ ID NO: 4098676 - DNA, 23 bp, Homo sapiens
tgaaggcccaagagcagagtctg

SEQ ID NO: 4098677 - DNA, 15 bp, Homo sapiens
tgaaggccctgctga

SEQ ID NO: 4098678 - DNA, 20 bp, Homo sapiens
tgaagggaccttgaagggta

SEQ ID NO: 4098679 - DNA, 19 bp, Homo sapiens
tgaagggagagccagctcc

SEQ ID NO: 4098680 - DNA, 14 bp, Homo sapiens
tgaagggccagagc

SEQ ID NO: 4098681 - DNA, 21 bp, Homo sapiens
tgaaggtctcctaaaactggg

SEQ ID NO: 4098682 - DNA, 23 bp, Homo sapiens
tgaaggtctcctaaaactgggat

SEQ ID NO: 4098683 - DNA, 15 bp, Homo sapiens
tgaaggtgctgacgg

SEQ ID NO: 4098684 - DNA, 15 bp, Homo sapiens
tgaaggttaggattt

SEQ ID NO: 4098685 - DNA, 19 bp, Homo sapiens
tcttcctggacaggccagg

SEQ ID NO: 4098686 - DNA, 22 bp, Homo sapiens
tcttcctgtgaagtttaattgt

SEQ ID NO: 4098687 - DNA, 9 bp, Homo sapiens
tcttccttg

SEQ ID NO: 4098688 - DNA, 18 bp, Homo sapiens
tcttccttgatgtttggg

SEQ ID NO: 4098689 - DNA, 16 bp, Homo sapiens
tcttcctttctctttc

SEQ ID NO: 4098690 - DNA, 20 bp, Homo sapiens
tcttcggccgagctggtttc

SEQ ID NO: 4098691 - DNA, 13 bp, Homo sapiens
tcttctaaacttc

SEQ ID NO: 4098692 - DNA, 16 bp, Homo sapiens
tcttctacaaccagag

SEQ ID NO: 4098693 - DNA, 18 bp, Homo sapiens
tcttctcatagcattaac

SEQ ID NO: 4098694 - DNA, 19 bp, Homo sapiens
tcttctcatagcattaact

SEQ ID NO: 4098695 - DNA, 15 bp, Homo sapiens
tcttctccagatttt

SEQ ID NO: 4098696 - DNA, 13 bp, Homo sapiens
tcttctcccccat

SEQ ID NO: 4098697 - DNA, 21 bp, Homo sapiens
tcttctccccttccatttctg

SEQ ID NO: 4098698 - DNA, 14 bp, Homo sapiens
tcttctcggctcag

SEQ ID NO: 4098699 - DNA, 15 bp, Homo sapiens
tcttctcggctcagg

SEQ ID NO: 4098700 - DNA, 17 bp, Homo sapiens
tcttctcggctcaggct

SEQ ID NO: 4098701 - DNA, 12 bp, Homo sapiens
tcttctctctgc

SEQ ID NO: 4098702 - DNA, 17 bp, Homo sapiens
tcttctctctgctctga

SEQ ID NO: 4098703 - DNA, 20 bp, Homo sapiens
tcttctgcccaattggagga

SEQ ID NO: 4098704 - DNA, 15 bp, Homo sapiens
tcttctgctccaccc

SEQ ID NO: 4098705 - DNA, 22 bp, Homo sapiens
tcttctgctccacccttggcct

SEQ ID NO: 4098706 - DNA, 23 bp, Homo sapiens
tcttctgctccacccttggcctg

SEQ ID NO: 4098707 - DNA, 15 bp, Homo sapiens
tcttctgctcttttc

SEQ ID NO: 4098708 - DNA, 13 bp, Homo sapiens
tcttctggctcaa

SEQ ID NO: 4098709 - DNA, 18 bp, Homo sapiens
tcttctggctcaaaaaga

SEQ ID NO: 4098710 - DNA, 21 bp, Homo sapiens
tcttctggctcaaaaagagaa

SEQ ID NO: 4098711 - DNA, 17 bp, Homo sapiens
tcttctgggcacagtgg

SEQ ID NO: 4098712 - DNA, 20 bp, Homo sapiens
tcttctggggcaggctgggc

SEQ ID NO: 4098713 - DNA, 22 bp, Homo sapiens
tcttctggggcaggctgggcca

SEQ ID NO: 4098714 - DNA, 14 bp, Homo sapiens
tcttctgtatttct

SEQ ID NO: 4098715 - DNA, 22 bp, Homo sapiens
tcttctgtatttctaggcacaa

SEQ ID NO: 4098716 - DNA, 22 bp, Homo sapiens
tcttctgtatttttttttctaa

SEQ ID NO: 4098717 - DNA, 12 bp, Homo sapiens
tcttctgtccct

SEQ ID NO: 4098718 - DNA, 13 bp, Homo sapiens
tcttctgtccctg

SEQ ID NO: 4098719 - DNA, 15 bp, Homo sapiens
tcttcttcaaataca

SEQ ID NO: 4098720 - DNA, 20 bp, Homo sapiens
tcttcttcaaatacaaagta

SEQ ID NO: 4098721 - DNA, 16 bp, Homo sapiens
tcttcttcagaagaca

SEQ ID NO: 4098722 - DNA, 15 bp, Homo sapiens
tcttcttcttcagaa

SEQ ID NO: 4098723 - DNA, 16 bp, Homo sapiens
tcttcttgctgcagcc

SEQ ID NO: 4098724 - DNA, 22 bp, Homo sapiens
tcttctttgtgcctttggcctg

SEQ ID NO: 4098725 - DNA, 14 bp, Homo sapiens
tcttgaaagctgtg

SEQ ID NO: 4098726 - DNA, 21 bp, Homo sapiens
tcttgaaattaagaaggcaaa

SEQ ID NO: 4098727 - DNA, 22 bp, Homo sapiens
tcttgaatggcaatgttttgct

SEQ ID NO: 4098728 - DNA, 19 bp, Homo sapiens
tcttgaatgtggtctcagg

SEQ ID NO: 4098729 - DNA, 18 bp, Homo sapiens
tcttgaatttctaaaaaa

SEQ ID NO: 4098730 - DNA, 19 bp, Homo sapiens
tcttgactcatggcagctg

SEQ ID NO: 4098731 - DNA, 15 bp, Homo sapiens
tcttgactctaaatg

SEQ ID NO: 4098732 - DNA, 18 bp, Homo sapiens
tcttgactctaaatgcag

SEQ ID NO: 4098733 - DNA, 15 bp, Homo sapiens
tcttgactttctgat

SEQ ID NO: 4098734 - DNA, 16 bp, Homo sapiens
tcttgactttctgatt

SEQ ID NO: 4098735 - DNA, 16 bp, Homo sapiens
tcttgagatgtcttct

SEQ ID NO: 4098736 - DNA, 22 bp, Homo sapiens
tcttgagcagtggctggtccag

SEQ ID NO: 4098737 - DNA, 15 bp, Homo sapiens
tcttgaggagcatta

SEQ ID NO: 4098738 - DNA, 15 bp, Homo sapiens
tcttgaggccaggag

SEQ ID NO: 4098739 - DNA, 14 bp, Homo sapiens
tcttgagggagctt

SEQ ID NO: 4098740 - DNA, 14 bp, Homo sapiens
tcttgatctctctt

SEQ ID NO: 4098741 - DNA, 13 bp, Homo sapiens
tcttgatcttaaa

SEQ ID NO: 4098742 - DNA, 16 bp, Homo sapiens
tcttgatcttaaagat

SEQ ID NO: 4098743 - DNA, 13 bp, Homo sapiens
tcttgatgtgaag

SEQ ID NO: 4098744 - DNA, 16 bp, Homo sapiens
tcttgcaacttcagtt

SEQ ID NO: 4098745 - DNA, 22 bp, Homo sapiens
tcttgcataggctcttaagcag

SEQ ID NO: 4098746 - DNA, 15 bp, Homo sapiens
tcttgccacatttct

SEQ ID NO: 4098747 - DNA, 16 bp, Homo sapiens
tcttgccactgtactc

SEQ ID NO: 4098748 - DNA, 13 bp, Homo sapiens
tcttgcccatcct

SEQ ID NO: 4098749 - DNA, 19 bp, Homo sapiens
tcttgctcccttcagcccc

SEQ ID NO: 4098750 - DNA, 13 bp, Homo sapiens
tcttgctgcagcc

SEQ ID NO: 4098751 - DNA, 23 bp, Homo sapiens
tcttgctggctacgcctcttctg

SEQ ID NO: 4098752 - DNA, 22 bp, Homo sapiens
tcttgctggttgtcatttttgc

SEQ ID NO: 4098753 - DNA, 13 bp, Homo sapiens
tcttgctgtctct

SEQ ID NO: 4098754 - DNA, 16 bp, Homo sapiens
tcttgctgtctctgct

SEQ ID NO: 4098755 - DNA, 17 bp, Homo sapiens
tcttgctgtctctgctc

SEQ ID NO: 4098756 - DNA, 13 bp, Homo sapiens
tcttgcttgtcat

SEQ ID NO: 4098757 - DNA, 15 bp, Homo sapiens
tcttggagctgtgag

SEQ ID NO: 4098758 - DNA, 17 bp, Homo sapiens
tcttggcaaaagccttg

SEQ ID NO: 4098759 - DNA, 21 bp, Homo sapiens
tcttggcaaaagccttgtgta

SEQ ID NO: 4098760 - DNA, 17 bp, Homo sapiens
tcttggcaatattcctt

SEQ ID NO: 4098761 - DNA, 13 bp, Homo sapiens
tcttggcccctgt

SEQ ID NO: 4098762 - DNA, 18 bp, Homo sapiens
tcttggcccctgtgtgag

SEQ ID NO: 4098763 - DNA, 15 bp, Homo sapiens
tcttggcctttgcat

SEQ ID NO: 4098764 - DNA, 15 bp, Homo sapiens
tcttggctgacccct

SEQ ID NO: 4098765 - DNA, 17 bp, Homo sapiens
tcttggctgacccctct

SEQ ID NO: 4098766 - DNA, 20 bp, Homo sapiens
tcttgggccccagaccccag

SEQ ID NO: 4098767 - DNA, 16 bp, Homo sapiens
tcttggggcaagactg

SEQ ID NO: 4098768 - DNA, 15 bp, Homo sapiens
tcttgggtgggtgaa

SEQ ID NO: 4098769 - DNA, 17 bp, Homo sapiens
tcttggtcagatttgaa

SEQ ID NO: 4098770 - DNA, 16 bp, Homo sapiens
tcttggtgctctgtgt

SEQ ID NO: 4098771 - DNA, 14 bp, Homo sapiens
tcttggtgtaattt

SEQ ID NO: 4098772 - DNA, 22 bp, Homo sapiens
tcttgtaagtcatctacttaat

SEQ ID NO: 4098773 - DNA, 16 bp, Homo sapiens
tcttgtcaattatgtt

SEQ ID NO: 4098774 - DNA, 15 bp, Homo sapiens
tcttgtcacaataaa

SEQ ID NO: 4098775 - DNA, 16 bp, Homo sapiens
tcttgtcacaataaat

SEQ ID NO: 4098776 - DNA, 13 bp, Homo sapiens
tcttgtcctagct

SEQ ID NO: 4098777 - DNA, 12 bp, Homo sapiens
tcttgtctctgg

SEQ ID NO: 4098778 - DNA, 13 bp, Homo sapiens
tcttgtctctggg

SEQ ID NO: 4098779 - DNA, 14 bp, Homo sapiens
tcttgtctctgggc

SEQ ID NO: 4098780 - DNA, 14 bp, Homo sapiens
tcttgtctgaggga

SEQ ID NO: 4098781 - DNA, 15 bp, Homo sapiens
tcttgtgaaggcagg

SEQ ID NO: 4098782 - DNA, 13 bp, Homo sapiens
tcttgtgaagttg

SEQ ID NO: 4098783 - DNA, 21 bp, Homo sapiens
tcttgtggtgtaaagctggcc

SEQ ID NO: 4098784 - DNA, 22 bp, Homo sapiens
tcttgtgtttccacagcctgca

SEQ ID NO: 4098785 - DNA, 15 bp, Homo sapiens
tcttgttagaaaaca

SEQ ID NO: 4098786 - DNA, 21 bp, Homo sapiens
tcttgttgctcaaaaaatgag

SEQ ID NO: 4098787 - DNA, 22 bp, Homo sapiens
tcttgttgctcaaaaaatgagc

SEQ ID NO: 4098788 - DNA, 16 bp, Homo sapiens
tcttgttttgcttccc

SEQ ID NO: 4098789 - DNA, 19 bp, Homo sapiens
tctgttgcaattaggattt

SEQ ID NO: 4098790 - DNA, 15 bp, Homo sapiens
tctgttgtaagaata

SEQ ID NO: 4098791 - DNA, 13 bp, Homo sapiens
tctgtttaaagtg

SEQ ID NO: 4098792 - DNA, 13 bp, Homo sapiens
tctgtttaagaaa

SEQ ID NO: 4098793 - DNA, 20 bp, Homo sapiens
tctgtttattcttccagaat

SEQ ID NO: 4098794 - DNA, 14 bp, Homo sapiens
tctgtttgattctt

SEQ ID NO: 4098795 - DNA, 13 bp, Homo sapiens
tctgtttgctgtg

SEQ ID NO: 4098796 - DNA, 19 bp, Homo sapiens
tctgtttgtaaattatttg

SEQ ID NO: 4098797 - DNA, 21 bp, Homo sapiens
tctgtttgtttcaagaacctg

SEQ ID NO: 4098798 - DNA, 18 bp, Homo sapiens
tctgttttctgtttgtaa

SEQ ID NO: 4098799 - DNA, 18 bp, Homo sapiens
tctgttttgtatcttaaa

SEQ ID NO: 4098800 - DNA, 19 bp, Homo sapiens
tcttaaaatatatttcaga

SEQ ID NO: 4098801 - DNA, 20 bp, Homo sapiens
tcttaaaatatatttcagat

SEQ ID NO: 4098802 - DNA, 23 bp, Homo sapiens
tcttaaaccaacctttaaaattg

SEQ ID NO: 4098803 - DNA, 15 bp, Homo sapiens
tcttaaatatctttt

SEQ ID NO: 4098804 - DNA, 13 bp, Homo sapiens
tcttaaatcagaa

SEQ ID NO: 4098805 - DNA, 16 bp, Homo sapiens
tcttaaatcagaataa

SEQ ID NO: 4098806 - DNA, 19 bp, Homo sapiens
tcttaaatcagaataaatt

SEQ ID NO: 4098807 - DNA, 23 bp, Homo sapiens
tcttaaatcagaataaattaata

SEQ ID NO: 4098808 - DNA, 22 bp, Homo sapiens
tcttaaatgctcattttctggt

SEQ ID NO: 4098809 - DNA, 13 bp, Homo sapiens
tcttaacaaacca

SEQ ID NO: 4098810 - DNA, 22 bp, Homo sapiens
tcttaacaaaccaacatctttg

SEQ ID NO: 4098811 - DNA, 19 bp, Homo sapiens
tcttaacaatttctgtcct

SEQ ID NO: 4098812 - DNA, 21 bp, Homo sapiens
tcttaagcagcatggaaaaat

SEQ ID NO: 4098813 - DNA, 21 bp, Homo sapiens
tcttaagccttttgctcacaa

SEQ ID NO: 4098814 - DNA, 23 bp, Homo sapiens
tcttaaggattgtgatattttta

SEQ ID NO: 4098815 - DNA, 14 bp, Homo sapiens
tcttaatctgtgtg

SEQ ID NO: 4098816 - DNA, 15 bp, Homo sapiens
tcttaattaatttga

SEQ ID NO: 4098817 - DNA, 22 bp, Homo sapiens
tcttaccctgtacatatgtaaa

SEQ ID NO: 4098818 - DNA, 15 bp, Homo sapiens
tcttaccgacaagca

SEQ ID NO: 4098819 - DNA, 15 bp, Homo sapiens
tcttactaatgtaaa

SEQ ID NO: 4098820 - DNA, 20 bp, Homo sapiens
tcttactaatgtaaaatgat

SEQ ID NO: 4098821 - DNA, 14 bp, Homo sapiens
tcttagaaatactt

SEQ ID NO: 4098822 - DNA, 13 bp, Homo sapiens
tcttagagccttt

SEQ ID NO: 4098823 - DNA, 23 bp, Homo sapiens
tcttagagccttttatctgcaga

SEQ ID NO: 4098824 - DNA, 15 bp, Homo sapiens
tcttagatgtatata

SEQ ID NO: 4098825 - DNA, 18 bp, Homo sapiens
tcttagctactgtatgca

SEQ ID NO: 4098826 - DNA, 20 bp, Homo sapiens
tcttagctactgtatgcaaa

SEQ ID NO: 4098827 - DNA, 17 bp, Homo sapiens
tcttaggggagagcttt

SEQ ID NO: 4098828 - DNA, 15 bp, Homo sapiens
tcttaggtcagatgg

SEQ ID NO: 4098829 - DNA, 14 bp, Homo sapiens
tcttagtgcctgag

SEQ ID NO: 4098830 - DNA, 18 bp, Homo sapiens
tcttagtgcctgagagta

SEQ ID NO: 4098831 - DNA, 15 bp, Homo sapiens
tcttagttctcactg

SEQ ID NO: 4098832 - DNA, 16 bp, Homo sapiens
tcttagttctcactgt

SEQ ID NO: 4098833 - DNA, 16 bp, Homo sapiens
tcttatacgcttttct

SEQ ID NO: 4098834 - DNA, 14 bp, Homo sapiens
tcttatagaataaa

SEQ ID NO: 4098835 - DNA, 19 bp, Homo sapiens
tcttatagaatatttatta

SEQ ID NO: 4098836 - DNA, 23 bp, Homo sapiens
tcttatcaaggactctggtttct

SEQ ID NO: 4098837 - DNA, 22 bp, Homo sapiens
tcttatctcagtcatgcataaa

SEQ ID NO: 4098838 - DNA, 15 bp, Homo sapiens
tcttatgcaaaatgg

SEQ ID NO: 4098839 - DNA, 16 bp, Homo sapiens
tcttatgcaaaatgga

SEQ ID NO: 4098840 - DNA, 17 bp, Homo sapiens
tcttatgcaaaatggaa

SEQ ID NO: 4098841 - DNA, 15 bp, Homo sapiens
tcttatggaattgat

SEQ ID NO: 4098842 - DNA, 21 bp, Homo sapiens
tcttatgtgacattaacaaat

SEQ ID NO: 4098843 - DNA, 17 bp, Homo sapiens
tcttattaaagtattct

SEQ ID NO: 4098844 - DNA, 15 bp, Homo sapiens
tcttattcctctagg

SEQ ID NO: 4098845 - DNA, 12 bp, Homo sapiens
tcttattttgca

SEQ ID NO: 4098846 - DNA, 22 bp, Homo sapiens
tcttattttgcattccagaatc

SEQ ID NO: 4098847 - DNA, 14 bp, Homo sapiens
tcttcaaactttca

SEQ ID NO: 4098848 - DNA, 17 bp, Homo sapiens
tcttcaaatacaaagta

SEQ ID NO: 4098849 - DNA, 23 bp, Homo sapiens
tcttcaaatacaaagtaaataca

SEQ ID NO: 4098850 - DNA, 22 bp, Homo sapiens
tcttcaaatccttccaaaaatt

SEQ ID NO: 4098851 - DNA, 24 bp, Homo sapiens
tcttcaacatcaatgttcattgta

SEQ ID NO: 4098852 - DNA, 22 bp, Homo sapiens
tcttcaacatcctgccagcccc

SEQ ID NO: 4098853 - DNA, 20 bp, Homo sapiens
tcttcaacatgctccaaata

SEQ ID NO: 4098854 - DNA, 22 bp, Homo sapiens
tcttcaacatgctccaaatata

SEQ ID NO: 4098855 - DNA, 12 bp, Homo sapiens
tcttcaaccagt

SEQ ID NO: 4098856 - DNA, 13 bp, Homo sapiens
tcttcacaaaatc

SEQ ID NO: 4098857 - DNA, 14 bp, Homo sapiens
tcttcaccaggtgc

SEQ ID NO: 4098858 - DNA, 16 bp, Homo sapiens
tcttcacctgttatgt

SEQ ID NO: 4098859 - DNA, 14 bp, Homo sapiens
tcttcactccccct

SEQ ID NO: 4098860 - DNA, 15 bp, Homo sapiens
tcttcactgcaattt

SEQ ID NO: 4098861 - DNA, 13 bp, Homo sapiens
tcttcagaagaca

SEQ ID NO: 4098862 - DNA, 19 bp, Homo sapiens
tcttcagcgtaaaatggtg

SEQ ID NO: 4098863 - DNA, 19 bp, Homo sapiens
tcttcaggaaaataaatat

SEQ ID NO: 4098864 - DNA, 13 bp, Homo sapiens
tcttcaggcctcc

SEQ ID NO: 4098865 - DNA, 14 bp, Homo sapiens
tcttcaggcctccc

SEQ ID NO: 4098866 - DNA, 18 bp, Homo sapiens
tcttcaggcctccctctc

SEQ ID NO: 4098867 - DNA, 16 bp, Homo sapiens
tcttcaggctctgccc

SEQ ID NO: 4098868 - DNA, 17 bp, Homo sapiens
tcttcaggcttcctgca

SEQ ID NO: 4098869 - DNA, 16 bp, Homo sapiens
tcttcagggccagtcc

SEQ ID NO: 4098870 - DNA, 22 bp, Homo sapiens
tcttcagttggttgtgtctttt

SEQ ID NO: 4098871 - DNA, 23 bp, Homo sapiens
tcttcatatcatcacaacattat

SEQ ID NO: 4098872 - DNA, 14 bp, Homo sapiens
tcttcatgttccca

SEQ ID NO: 4098873 - DNA, 22 bp, Homo sapiens
tcttcattttggtttatttttg

SEQ ID NO: 4098874 - DNA, 21 bp, Homo sapiens
tcttccaaagcagagagcatt

SEQ ID NO: 4098875 - DNA, 20 bp, Homo sapiens
tcttccaaagtaaaattgct

SEQ ID NO: 4098876 - DNA, 17 bp, Homo sapiens
tcttccagtttctgtaa

SEQ ID NO: 4098877 - DNA, 14 bp, Homo sapiens
tcttccatgatttt

SEQ ID NO: 4098878 - DNA, 16 bp, Homo sapiens
tcttccatgtatcttt

SEQ ID NO: 4098879 - DNA, 17 bp, Homo sapiens
tcttcccataataaagc

SEQ ID NO: 4098880 - DNA, 18 bp, Homo sapiens
tcttcccataataaagca

SEQ ID NO: 4098881 - DNA, 20 bp, Homo sapiens
tcttcccataataaagcaat

SEQ ID NO: 4098882 - DNA, 13 bp, Homo sapiens
tcttccccaggaa

SEQ ID NO: 4098883 - DNA, 15 bp, Homo sapiens
tcttccccttccctt

SEQ ID NO: 4098884 - DNA, 13 bp, Homo sapiens
tcttccctgcttt

SEQ ID NO: 4098885 - DNA, 18 bp, Homo sapiens
tcttccctggtaagaaaa

SEQ ID NO: 4098886 - DNA, 20 bp, Homo sapiens
tcttccctggtaagaaaaag

SEQ ID NO: 4098887 - DNA, 15 bp, Homo sapiens
tcttccggagatgta

SEQ ID NO: 4098888 - DNA, 16 bp, Homo sapiens
tcttccggagatgtag

SEQ ID NO: 4098889 - DNA, 19 bp, Homo sapiens
tcttccggagatgtagcaa

SEQ ID NO: 4098890 - DNA, 13 bp, Homo sapiens
tcttcctagaatt

SEQ ID NO: 4098891 - DNA, 14 bp, Homo sapiens
tcttcctcagctgg

SEQ ID NO: 4098892 - DNA, 16 bp, Homo sapiens
tgaaaaaaacttcatt

SEQ ID NO: 4098893 - DNA, 17 bp, Homo sapiens
tgaaaaacaacaacaca

SEQ ID NO: 4098894 - DNA, 19 bp, Homo sapiens
tgaaaacatggtagaattg

SEQ ID NO: 4098895 - DNA, 16 bp, Homo sapiens
tgaaaacgttttattg

SEQ ID NO: 4098896 - DNA, 19 bp, Homo sapiens
tgaaaacgttttattgtgt

SEQ ID NO: 4098897 - DNA, 17 bp, Homo sapiens
tgaaaactctttgctgc

SEQ ID NO: 4098898 - DNA, 13 bp, Homo sapiens
tgaaaactggaat

SEQ ID NO: 4098899 - DNA, 23 bp, Homo sapiens
tgaaaactggaataagaagcaaa

SEQ ID NO: 4098900 - DNA, 23 bp, Homo sapiens
tgaaaagaggggaccagaagcca

SEQ ID NO: 4098901 - DNA, 16 bp, Homo sapiens
tgaaaagatgtacctg

SEQ ID NO: 4098902 - DNA, 16 bp, Homo sapiens
tgaaaagattttattt

SEQ ID NO: 4098903 - DNA, 17 bp, Homo sapiens
tgaaaagattttattta

SEQ ID NO: 4098904 - DNA, 19 bp, Homo sapiens
tgaaaagctattagccagg

SEQ ID NO: 4098905 - DNA, 16 bp, Homo sapiens
tgaaaagcttcttaat

SEQ ID NO: 4098906 - DNA, 20 bp, Homo sapiens
tgaaaagtatcactctaaaa

SEQ ID NO: 4098907 - DNA, 23 bp, Homo sapiens
tgaaaagttcagggaccgtccag

SEQ ID NO: 4098908 - DNA, 12 bp, Homo sapiens
tgaaaatacaac

SEQ ID NO: 4098909 - DNA, 21 bp, Homo sapiens
tgaaaatgaatatctattaat

SEQ ID NO: 4098910 - DNA, 23 bp, Homo sapiens
tgaaaatgaatatctattaatat

SEQ ID NO: 4098911 - DNA, 18 bp, Homo sapiens
tgaaaatgtcagaaacca

SEQ ID NO: 4098912 - DNA, 12 bp, Homo sapiens
tgaaaatgtgtt

SEQ ID NO: 4098913 - DNA, 17 bp, Homo sapiens
tgaaaatgtgtttgctg

SEQ ID NO: 4098914 - DNA, 22 bp, Homo sapiens
tgaaaatgtttaagtattaact

SEQ ID NO: 4098915 - DNA, 13 bp, Homo sapiens
tgaaaatgttttt

SEQ ID NO: 4098916 - DNA, 18 bp, Homo sapiens
tgaaaattccagaaagga

SEQ ID NO: 4098917 - DNA, 13 bp, Homo sapiens
tgaaaattgtatt

SEQ ID NO: 4098918 - DNA, 13 bp, Homo sapiens
tgaaaatttgaga

SEQ ID NO: 4098919 - DNA, 22 bp, Homo sapiens
tgaaaatttgagactatttaaa

SEQ ID NO: 4098920 - DNA, 22 bp, Homo sapiens
tgaaaattttaaaaatacatat

SEQ ID NO: 4098921 - DNA, 18 bp, Homo sapiens
tgaaaattttacttccat

SEQ ID NO: 4098922 - DNA, 15 bp, Homo sapiens
tgaaacaacttggaa

SEQ ID NO: 4098923 - DNA, 17 bp, Homo sapiens
tgaaacaagaagccaca

SEQ ID NO: 4098924 - DNA, 17 bp, Homo sapiens
tgaaacacaccaggctg

SEQ ID NO: 4098925 - DNA, 15 bp, Homo sapiens
tgaaacacagctgtt

SEQ ID NO: 4098926 - DNA, 18 bp, Homo sapiens
tgaaacacagctgttctt

SEQ ID NO: 4098927 - DNA, 19 bp, Homo sapiens
tgaaacacagctgttcttc

SEQ ID NO: 4098928 - DNA, 14 bp, Homo sapiens
tgaaacagatttca

SEQ ID NO: 4098929 - DNA, 14 bp, Homo sapiens
tgaaaccattttcc

SEQ ID NO: 4098930 - DNA, 19 bp, Homo sapiens
tgaaacctagtactgcccc

SEQ ID NO: 4098931 - DNA, 17 bp, Homo sapiens
tgaaaccttttttaaga

SEQ ID NO: 4098932 - DNA, 19 bp, Homo sapiens
tgaaaccttttttaagatt

SEQ ID NO: 4098933 - DNA, 20 bp, Homo sapiens
tgaaaccttttttaagattt

SEQ ID NO: 4098934 - DNA, 23 bp, Homo sapiens
tgaaaccttttttaagatttttc

SEQ ID NO: 4098935 - DNA, 20 bp, Homo sapiens
tgaaacgctcctttgtgtgt

SEQ ID NO: 4098936 - DNA, 16 bp, Homo sapiens
tgaaactcacaaatga

SEQ ID NO: 4098937 - DNA, 14 bp, Homo sapiens
tgaaactttcattc

SEQ ID NO: 4098938 - DNA, 23 bp, Homo sapiens
tgaaactttcattccttcagatt

SEQ ID NO: 4098939 - DNA, 20 bp, Homo sapiens
tgaaagaaagctgagaagaa

SEQ ID NO: 4098940 - DNA, 15 bp, Homo sapiens
tgaaagactgtacaa

SEQ ID NO: 4098941 - DNA, 19 bp, Homo sapiens
tgaaagactgtacaaagta

SEQ ID NO: 4098942 - DNA, 16 bp, Homo sapiens
tgaaagatgatcattt

SEQ ID NO: 4098943 - DNA, 20 bp, Homo sapiens
tgaaagcagggaatttctat

SEQ ID NO: 4098944 - DNA, 20 bp, Homo sapiens
tgaaagctgagaactcctga

SEQ ID NO: 4098945 - DNA, 18 bp, Homo sapiens
tgaaaggatgtggaagag

SEQ ID NO: 4098946 - DNA, 16 bp, Homo sapiens
tgaaaggcctcaagaa

SEQ ID NO: 4098947 - DNA, 19 bp, Homo sapiens
tgaaaggcctcaagaacaa

SEQ ID NO: 4098948 - DNA, 20 bp, Homo sapiens
tgaaagggagctatcaggaa

SEQ ID NO: 4098949 - DNA, 14 bp, Homo sapiens
tgaaaggtactata

SEQ ID NO: 4098950 - DNA, 17 bp, Homo sapiens
tgaaaggttttttttca

SEQ ID NO: 4098951 - DNA, 23 bp, Homo sapiens
tgaaagtacatttggagacacaa

SEQ ID NO: 4098952 - DNA, 18 bp, Homo sapiens
tgaaagttttcagaacct

SEQ ID NO: 4098953 - DNA, 18 bp, Homo sapiens
tgaaataaattctgattc

SEQ ID NO: 4098954 - DNA, 19 bp, Homo sapiens
tgaaataaattctgattct

SEQ ID NO: 4098955 - DNA, 12 bp, Homo sapiens
tgaaataatcag

SEQ ID NO: 4098956 - DNA, 21 bp, Homo sapiens
tgaaataatcagtgactgaaa

SEQ ID NO: 4098957 - DNA, 16 bp, Homo sapiens
tgaaatagtctgtgtg

SEQ ID NO: 4098958 - DNA, 11 bp, Homo sapiens
tgaaatataat

SEQ ID NO: 4098959 - DNA, 12 bp, Homo sapiens
tgaaatatgcat

SEQ ID NO: 4098960 - DNA, 20 bp, Homo sapiens
tgaaatccttgactggacct

SEQ ID NO: 4098961 - DNA, 15 bp, Homo sapiens
tgaaatctgctagaa

SEQ ID NO: 4098962 - DNA, 19 bp, Homo sapiens
tgaaatctgctagaaagtt

SEQ ID NO: 4098963 - DNA, 20 bp, Homo sapiens
tgaaatctgctagaaagtta

SEQ ID NO: 4098964 - DNA, 21 bp, Homo sapiens
tgaaatgagcacctccattaa

SEQ ID NO: 4098965 - DNA, 17 bp, Homo sapiens
tgaaatgaggtctgttt

SEQ ID NO: 4098966 - DNA, 15 bp, Homo sapiens
tgaaatgattggaat

SEQ ID NO: 4098967 - DNA, 20 bp, Homo sapiens
tgaaatgcatcaggtccttt

SEQ ID NO: 4098968 - DNA, 13 bp, Homo sapiens
tgaaatgtgaagg

SEQ ID NO: 4098969 - DNA, 21 bp, Homo sapiens
tgaaatgttagtcattgttat

SEQ ID NO: 4098970 - DNA, 21 bp, Homo sapiens
tgaaatgtttggattctctta

SEQ ID NO: 4098971 - DNA, 20 bp, Homo sapiens
tgaaattaacacaaaggaag

SEQ ID NO: 4098972 - DNA, 23 bp, Homo sapiens
tgaaattactacaaaatttgaaa

SEQ ID NO: 4098973 - DNA, 14 bp, Homo sapiens
tgaaattactgtgt

SEQ ID NO: 4098974 - DNA, 23 bp, Homo sapiens
tgaaattagggcccaattaataa

SEQ ID NO: 4098975 - DNA, 18 bp, Homo sapiens
tgaaattatagtttcaag

SEQ ID NO: 4098976 - DNA, 21 bp, Homo sapiens
tgaaattatgtatgtttacat

SEQ ID NO: 4098977 - DNA, 23 bp, Homo sapiens
tgaaattatgtatgtttacatat

SEQ ID NO: 4098978 - DNA, 22 bp, Homo sapiens
tgaaattatgtgacattttaca

SEQ ID NO: 4098979 - DNA, 21 bp, Homo sapiens
tgaaattcacagaagcctagg

SEQ ID NO: 4098980 - DNA, 17 bp, Homo sapiens
tgaaattccagcaataa

SEQ ID NO: 4098981 - DNA, 21 bp, Homo sapiens
tgaaattccagcaataagaaa

SEQ ID NO: 4098982 - DNA, 22 bp, Homo sapiens
tgaaattccagcaataagaaat

SEQ ID NO: 4098983 - DNA, 13 bp, Homo sapiens
tgaaattctaaag

SEQ ID NO: 4098984 - DNA, 18 bp, Homo sapiens
tgaaattgtgaactcatt

SEQ ID NO: 4098985 - DNA, 21 bp, Homo sapiens
tgaaatttattcacatatatc

SEQ ID NO: 4098986 - DNA, 14 bp, Homo sapiens
tgaaatttgcaaaa

SEQ ID NO: 4098987 - DNA, 19 bp, Homo sapiens
tgaaattttaaaaattgtt

SEQ ID NO: 4098988 - DNA, 18 bp, Homo sapiens
tgaaattttgcaaatata

SEQ ID NO: 4098989 - DNA, 19 bp, Homo sapiens
tgaaattttgcaaatataa

SEQ ID NO: 4098990 - DNA, 15 bp, Homo sapiens
tgaaatttttattaa

SEQ ID NO: 4098991 - DNA, 17 bp, Homo sapiens
tgaacaaagcagccacg

SEQ ID NO: 4098992 - DNA, 23 bp, Homo sapiens
tgaacaagatgtgggccttgcaa

SEQ ID NO: 4098993 - DNA, 18 bp, Homo sapiens
tgaacacaaactgtaaat

SEQ ID NO: 4098994 - DNA, 15 bp, Homo sapiens
tctttaaaagaatga

SEQ ID NO: 4098995 - DNA, 17 bp, Homo sapiens
tctttaaaagaatgact

SEQ ID NO: 4098996 - DNA, 15 bp, Homo sapiens
tctttaaaagagaga

SEQ ID NO: 4098997 - DNA, 23 bp, Homo sapiens
tctttaaaagagagagagagaaa

SEQ ID NO: 4098998 - DNA, 16 bp, Homo sapiens
tctttaaaaggaaaga

SEQ ID NO: 4098999 - DNA, 14 bp, Homo sapiens
tctttaaatagata

SEQ ID NO: 4099000 - DNA, 16 bp, Homo sapiens
tctttaaatgttttat

SEQ ID NO: 4099001 - DNA, 19 bp, Homo sapiens
tctttaagggcatgccttg

SEQ ID NO: 4099002 - DNA, 15 bp, Homo sapiens
tctttaatcttcagt

SEQ ID NO: 4099003 - DNA, 14 bp, Homo sapiens
tctttacaagcagg

SEQ ID NO: 4099004 - DNA, 18 bp, Homo sapiens
tctttacctgagaccagt

SEQ ID NO: 4099005 - DNA, 15 bp, Homo sapiens
tctttacttcatgga

SEQ ID NO: 4099006 - DNA, 23 bp, Homo sapiens
tctttatcaagcaacattcttgt

SEQ ID NO: 4099007 - DNA, 20 bp, Homo sapiens
tctttcaagggctttcctgt

SEQ ID NO: 4099008 - DNA, 14 bp, Homo sapiens
tctttcacagctcc

SEQ ID NO: 4099009 - DNA, 18 bp, Homo sapiens
tctttcacagctcctccc

SEQ ID NO: 4099010 - DNA, 19 bp, Homo sapiens
tctttcacagctcctccca

SEQ ID NO: 4099011 - DNA, 14 bp, Homo sapiens
tctttcacttgaaa

SEQ ID NO: 4099012 - DNA, 20 bp, Homo sapiens
tctttcaggggggttgtgag

SEQ ID NO: 4099013 - DNA, 13 bp, Homo sapiens
tctttccaggctt

SEQ ID NO: 4099014 - DNA, 19 bp, Homo sapiens
tctttccattatgattctt

SEQ ID NO: 4099015 - DNA, 12 bp, Homo sapiens
tctttccctgcg

SEQ ID NO: 4099016 - DNA, 16 bp, Homo sapiens
tctttcctatttcagt

SEQ ID NO: 4099017 - DNA, 24 bp, Homo sapiens
tctttcctatttcagtgttacctg

SEQ ID NO: 4099018 - DNA, 14 bp, Homo sapiens
tctttcctcaagta

SEQ ID NO: 4099019 - DNA, 15 bp, Homo sapiens
tctttcctccaccca

SEQ ID NO: 4099020 - DNA, 15 bp, Homo sapiens
tctttcctccccctg

SEQ ID NO: 4099021 - DNA, 15 bp, Homo sapiens
tctttcgtcaccctt

SEQ ID NO: 4099022 - DNA, 16 bp, Homo sapiens
tctttctagtggtctt

SEQ ID NO: 4099023 - DNA, 22 bp, Homo sapiens
tctttctagtggtctttgtaag

SEQ ID NO: 4099024 - DNA, 21 bp, Homo sapiens
tctttctccaaagttatccag

SEQ ID NO: 4099025 - DNA, 18 bp, Homo sapiens
tctttctctcttccctca

SEQ ID NO: 4099026 - DNA, 11 bp, Homo sapiens
tctttctctgc

SEQ ID NO: 4099027 - DNA, 12 bp, Homo sapiens
tctttctctgcc

SEQ ID NO: 4099028 - DNA, 15 bp, Homo sapiens
tctttctctgccagt

SEQ ID NO: 4099029 - DNA, 10 bp, Homo sapiens
tctttctgta

SEQ ID NO: 4099030 - DNA, 20 bp, Homo sapiens
tctttctgtcttgttaatgc

SEQ ID NO: 4099031 - DNA, 10 bp, Homo sapiens
tctttcttcc

SEQ ID NO: 4099032 - DNA, 17 bp, Homo sapiens
tctttctttacctgaga

SEQ ID NO: 4099033 - DNA, 13 bp, Homo sapiens
tctttgaaagctt

SEQ ID NO: 4099034 - DNA, 23 bp, Homo sapiens
tctttgaagaaggtggacctttt

SEQ ID NO: 4099035 - DNA, 22 bp, Homo sapiens
tctttgacaattcctagataaa

SEQ ID NO: 4099036 - DNA, 23 bp, Homo sapiens
tctttgagaactgcttctaagat

SEQ ID NO: 4099037 - DNA, 14 bp, Homo sapiens
tctttgagtaatgt

SEQ ID NO: 4099038 - DNA, 16 bp, Homo sapiens
tctttgagtaatgtga

SEQ ID NO: 4099039 - DNA, 13 bp, Homo sapiens
tctttgataatgt

SEQ ID NO: 4099040 - DNA, 14 bp, Homo sapiens
tctttgataatgtt

SEQ ID NO: 4099041 - DNA, 13 bp, Homo sapiens
tctttgcccttta

SEQ ID NO: 4099042 - DNA, 17 bp, Homo sapiens
tctttgcctctgcagtc

SEQ ID NO: 4099043 - DNA, 14 bp, Homo sapiens
tctttgccttctct

SEQ ID NO: 4099044 - DNA, 13 bp, Homo sapiens
tctttgctgcaga

SEQ ID NO: 4099045 - DNA, 16 bp, Homo sapiens
tctttggaaagtacac

SEQ ID NO: 4099046 - DNA, 17 bp, Homo sapiens
tctttggaaggagtgag

SEQ ID NO: 4099047 - DNA, 24 bp, Homo sapiens
tctttggaaggagtgagatcattt

SEQ ID NO: 4099048 - DNA, 14 bp, Homo sapiens
tctttggcagttgc

SEQ ID NO: 4099049 - DNA, 14 bp, Homo sapiens
tctttggctcccct

SEQ ID NO: 4099050 - DNA, 16 bp, Homo sapiens
tctttgggccagacat

SEQ ID NO: 4099051 - DNA, 13 bp, Homo sapiens
tctttgtaagagt

SEQ ID NO: 4099052 - DNA, 19 bp, Homo sapiens
tctttgtaagagtgtagaa

SEQ ID NO: 4099053 - DNA, 24 bp, Homo sapiens
tctttgtaagagtgtagaagcatt

SEQ ID NO: 4099054 - DNA, 12 bp, Homo sapiens
tctttgtaagtc

SEQ ID NO: 4099055 - DNA, 17 bp, Homo sapiens
tctttgtaagtcagtgt

SEQ ID NO: 4099056 - DNA, 21 bp, Homo sapiens
tctttgtaagtcagtgttgag

SEQ ID NO: 4099057 - DNA, 16 bp, Homo sapiens
tctttgtatcttccat

SEQ ID NO: 4099058 - DNA, 16 bp, Homo sapiens
tctttgtgacaggaaa

SEQ ID NO: 4099059 - DNA, 23 bp, Homo sapiens
tctttgtgacaggaaagccctcc

SEQ ID NO: 4099060 - DNA, 16 bp, Homo sapiens
tctttgtgcctttggc

SEQ ID NO: 4099061 - DNA, 14 bp, Homo sapiens
tctttgtggtttct

SEQ ID NO: 4099062 - DNA, 17 bp, Homo sapiens
tctttgttacttcctta

SEQ ID NO: 4099063 - DNA, 18 bp, Homo sapiens
tctttgttggaaaagaat

SEQ ID NO: 4099064 - DNA, 19 bp, Homo sapiens
tcttttaatgcttcattca

SEQ ID NO: 4099065 - DNA, 21 bp, Homo sapiens
tcttttatctgtttaaagcat

SEQ ID NO: 4099066 - DNA, 13 bp, Homo sapiens
tcttttatgtttg

SEQ ID NO: 4099067 - DNA, 15 bp, Homo sapiens
tcttttatgtttgaa

SEQ ID NO: 4099068 - DNA, 21 bp, Homo sapiens
tcttttatgtttgaatatgga

SEQ ID NO: 4099069 - DNA, 17 bp, Homo sapiens
tcttttcccctttcctg

SEQ ID NO: 4099070 - DNA, 13 bp, Homo sapiens
tcttttcctcgct

SEQ ID NO: 4099071 - DNA, 15 bp, Homo sapiens
tcttttcctgttgta

SEQ ID NO: 4099072 - DNA, 13 bp, Homo sapiens
tcttttctctgtg

SEQ ID NO: 4099073 - DNA, 23 bp, Homo sapiens
tcttttctgcatcatctgtagat

SEQ ID NO: 4099074 - DNA, 13 bp, Homo sapiens
tcttttcttttta

SEQ ID NO: 4099075 - DNA, 14 bp, Homo sapiens
tcttttgaattgtt

SEQ ID NO: 4099076 - DNA, 15 bp, Homo sapiens
tcttttgaattgttt

SEQ ID NO: 4099077 - DNA, 15 bp, Homo sapiens
tcttttgacatgtgg

SEQ ID NO: 4099078 - DNA, 17 bp, Homo sapiens
tcttttgacatgtggaa

SEQ ID NO: 4099079 - DNA, 17 bp, Homo sapiens
tcttttgctactaagtt

SEQ ID NO: 4099080 - DNA, 12 bp, Homo sapiens
tcttttggttat

SEQ ID NO: 4099081 - DNA, 18 bp, Homo sapiens
tcttttggttattctaag

SEQ ID NO: 4099082 - DNA, 11 bp, Homo sapiens
tctttttaatt

SEQ ID NO: 4099083 - DNA, 21 bp, Homo sapiens
tctttttaattattttaaaat

SEQ ID NO: 4099084 - DNA, 12 bp, Homo sapiens
tctttttacata

SEQ ID NO: 4099085 - DNA, 20 bp, Homo sapiens
tctttttacataactgcctt

SEQ ID NO: 4099086 - DNA, 19 bp, Homo sapiens
tctttttacctttcataca

SEQ ID NO: 4099087 - DNA, 15 bp, Homo sapiens
tctttttcctcctgg

SEQ ID NO: 4099088 - DNA, 19 bp, Homo sapiens
tctttttggtaataacaaa

SEQ ID NO: 4099089 - DNA, 17 bp, Homo sapiens
tcttttttaataaacta

SEQ ID NO: 4099090 - DNA, 19 bp, Homo sapiens
tcttttttaataaactact

SEQ ID NO: 4099091 - DNA, 15 bp, Homo sapiens
tcttttttagcataa

SEQ ID NO: 4099092 - DNA, 13 bp, Homo sapiens
tcttttttataac

SEQ ID NO: 4099093 - DNA, 13 bp, Homo sapiens
tcttttttcaaaa

SEQ ID NO: 4099094 - DNA, 17 bp, Homo sapiens
tcttttttcaaaagaaa

SEQ ID NO: 4099095 - DNA, 13 bp, Homo sapiens
tcttttttcgttt

SEQ ID NO: 4099096 - DNA, 15 bp, Homo sapiens
tctttttttttaagt

SEQ ID NO: 4099097 - DNA, 20 bp, Homo sapiens
tctttttttttaagttctta

SEQ ID NO: 4099098 - DNA, 22 bp, Homo sapiens
tctttttttttttttttgaaag

SEQ ID NO: 4099099 - DNA, 13 bp, Homo sapiens
tctgggagaggat

SEQ ID NO: 4099100 - DNA, 15 bp, Homo sapiens
tctgggagaggattt

SEQ ID NO: 4099101 - DNA, 18 bp, Homo sapiens
tctgggagtcacacagtg

SEQ ID NO: 4099102 - DNA, 21 bp, Homo sapiens
tctgggcattttcctcctctg

SEQ ID NO: 4099103 - DNA, 22 bp, Homo sapiens
tctgggctcctggaaccaatcc

SEQ ID NO: 4099104 - DNA, 14 bp, Homo sapiens
tctgggctctttcc

SEQ ID NO: 4099105 - DNA, 23 bp, Homo sapiens
tctgggctgtaacgtggcactgg

SEQ ID NO: 4099106 - DNA, 14 bp, Homo sapiens
tctggggaccccaa

SEQ ID NO: 4099107 - DNA, 22 bp, Homo sapiens
tctggggaccccaacctcagag

SEQ ID NO: 4099108 - DNA, 17 bp, Homo sapiens
tctggggagctggacag

SEQ ID NO: 4099109 - DNA, 19 bp, Homo sapiens
tctggggcaggctgggcca

SEQ ID NO: 4099110 - DNA, 13 bp, Homo sapiens
tctggggccctgg

SEQ ID NO: 4099111 - DNA, 14 bp, Homo sapiens
tctggggccctggg

SEQ ID NO: 4099112 - DNA, 18 bp, Homo sapiens
tctggggccctgggcctc

SEQ ID NO: 4099113 - DNA, 15 bp, Homo sapiens
tctggggctctggga

SEQ ID NO: 4099114 - DNA, 16 bp, Homo sapiens
tctggggctctgggat

SEQ ID NO: 4099115 - DNA, 18 bp, Homo sapiens
tctgggggaaaaagccat

SEQ ID NO: 4099116 - DNA, 13 bp, Homo sapiens
tctgggtggcctc

SEQ ID NO: 4099117 - DNA, 14 bp, Homo sapiens
tctgggtttttctt

SEQ ID NO: 4099118 - DNA, 23 bp, Homo sapiens
tctggtcaaagaaagaaagttta

SEQ ID NO: 4099119 - DNA, 18 bp, Homo sapiens
tctggtcatttcccccaa

SEQ ID NO: 4099120 - DNA, 17 bp, Homo sapiens
tctggtgctcctgcatc

SEQ ID NO: 4099121 - DNA, 17 bp, Homo sapiens
tctggtgtgtggtgagg

SEQ ID NO: 4099122 - DNA, 16 bp, Homo sapiens
tctggttgatttgtaa

SEQ ID NO: 4099123 - DNA, 15 bp, Homo sapiens
tctggttgtttctgt

SEQ ID NO: 4099124 - DNA, 17 bp, Homo sapiens
tctggttgtttctgttc

SEQ ID NO: 4099125 - DNA, 14 bp, Homo sapiens
tctgtaaaactaag

SEQ ID NO: 4099126 - DNA, 12 bp, Homo sapiens
tctgtaaataac

SEQ ID NO: 4099127 - DNA, 13 bp, Homo sapiens
tctgtaaggtctt

SEQ ID NO: 4099128 - DNA, 19 bp, Homo sapiens
tctgtaggcagcagagaga

SEQ ID NO: 4099129 - DNA, 19 bp, Homo sapiens
tctgtagtactccttaaga

SEQ ID NO: 4099130 - DNA, 15 bp, Homo sapiens
tctgtagtcatttac

SEQ ID NO: 4099131 - DNA, 16 bp, Homo sapiens
tctgtatagaaatcta

SEQ ID NO: 4099132 - DNA, 19 bp, Homo sapiens
tctgtatcggagacagtga

SEQ ID NO: 4099133 - DNA, 18 bp, Homo sapiens
tctgtatttaatggtttt

SEQ ID NO: 4099134 - DNA, 15 bp, Homo sapiens
tctgtatttcatgtg

SEQ ID NO: 4099135 - DNA, 15 bp, Homo sapiens
tctgtcacaccagcc

SEQ ID NO: 4099136 - DNA, 20 bp, Homo sapiens
tctgtcagccagccgccctg

SEQ ID NO: 4099137 - DNA, 15 bp, Homo sapiens
tctgtccaaaggagg

SEQ ID NO: 4099138 - DNA, 19 bp, Homo sapiens
tctgtccaaaggaggctgg

SEQ ID NO: 4099139 - DNA, 13 bp, Homo sapiens
tctgtccaaggaa

SEQ ID NO: 4099140 - DNA, 21 bp, Homo sapiens
tctgtccagctggggccagag

SEQ ID NO: 4099141 - DNA, 18 bp, Homo sapiens
tctgtccatggcctttct

SEQ ID NO: 4099142 - DNA, 14 bp, Homo sapiens
tctgtcccacccct

SEQ ID NO: 4099143 - DNA, 13 bp, Homo sapiens
tctgtcccccagg

SEQ ID NO: 4099144 - DNA, 17 bp, Homo sapiens
tctgtcccccaggctgg

SEQ ID NO: 4099145 - DNA, 15 bp, Homo sapiens
tctgtccctgttaga

SEQ ID NO: 4099146 - DNA, 14 bp, Homo sapiens
tctgtcccttgctg

SEQ ID NO: 4099147 - DNA, 15 bp, Homo sapiens
tctgtccgtggaaaa

SEQ ID NO: 4099148 - DNA, 21 bp, Homo sapiens
tctgtcctcagccttgccaga

SEQ ID NO: 4099149 - DNA, 21 bp, Homo sapiens
tctgtcctgggcatgggtcca

SEQ ID NO: 4099150 - DNA, 19 bp, Homo sapiens
tctgtccttttggcactga

SEQ ID NO: 4099151 - DNA, 21 bp, Homo sapiens
tctgtccttttggcactgaga

SEQ ID NO: 4099152 - DNA, 22 bp, Homo sapiens
tctgtctacaaatataagattt

SEQ ID NO: 4099153 - DNA, 21 bp, Homo sapiens
tctgtctcaaaaaataaaaat

SEQ ID NO: 4099154 - DNA, 19 bp, Homo sapiens
tctgtctcatcctcctgga

SEQ ID NO: 4099155 - DNA, 20 bp, Homo sapiens
tctgtctcatcctcctggaa

SEQ ID NO: 4099156 - DNA, 13 bp, Homo sapiens
tctgtctggtcca

SEQ ID NO: 4099157 - DNA, 18 bp, Homo sapiens
tctgtcttgttaatgctt

SEQ ID NO: 4099158 - DNA, 14 bp, Homo sapiens
tctgtgaaatataa

SEQ ID NO: 4099159 - DNA, 20 bp, Homo sapiens
tctgtgaaatataattgtac

SEQ ID NO: 4099160 - DNA, 20 bp, Homo sapiens
tctgtgaaatgctggcattt

SEQ ID NO: 4099161 - DNA, 14 bp, Homo sapiens
tctgtgaagagcaa

SEQ ID NO: 4099162 - DNA, 22 bp, Homo sapiens
tctgtgaagaggaacagtgtgg

SEQ ID NO: 4099163 - DNA, 15 bp, Homo sapiens
tctgtgaatacaatt

SEQ ID NO: 4099164 - DNA, 21 bp, Homo sapiens
tctgtgaatacaattaaaggt

SEQ ID NO: 4099165 - DNA, 14 bp, Homo sapiens
tctgtgatcattta

SEQ ID NO: 4099166 - DNA, 20 bp, Homo sapiens
tctgtgatgacattccctgc

SEQ ID NO: 4099167 - DNA, 14 bp, Homo sapiens
tctgtgcagggctg

SEQ ID NO: 4099168 - DNA, 21 bp, Homo sapiens
tctgtgccagggcagcatttt

SEQ ID NO: 4099169 - DNA, 18 bp, Homo sapiens
tctgtgcctgcactgaga

SEQ ID NO: 4099170 - DNA, 22 bp, Homo sapiens
tctgtgccttcttttgattatg

SEQ ID NO: 4099171 - DNA, 14 bp, Homo sapiens
tctgtgcctttcta

SEQ ID NO: 4099172 - DNA, 22 bp, Homo sapiens
tctgtgcgtgaaacacaccagg

SEQ ID NO: 4099173 - DNA, 14 bp, Homo sapiens
tctgtggctggctc

SEQ ID NO: 4099174 - DNA, 13 bp, Homo sapiens
tctgtgggcccct

SEQ ID NO: 4099175 - DNA, 15 bp, Homo sapiens
tctgtgggcccctca

SEQ ID NO: 4099176 - DNA, 20 bp, Homo sapiens
tctgtgggctacatgctggg

SEQ ID NO: 4099177 - DNA, 23 bp, Homo sapiens
tctgtgggctacatgctggggtc

SEQ ID NO: 4099178 - DNA, 16 bp, Homo sapiens
tctgtggttcctctgc

SEQ ID NO: 4099179 - DNA, 17 bp, Homo sapiens
tctgtggttcctctgct

SEQ ID NO: 4099180 - DNA, 19 bp, Homo sapiens
tctgtggttcctctgctca

SEQ ID NO: 4099181 - DNA, 15 bp, Homo sapiens
tctgtgtcatttctt

SEQ ID NO: 4099182 - DNA, 16 bp, Homo sapiens
tctgtgtcatttcttc

SEQ ID NO: 4099183 - DNA, 15 bp, Homo sapiens
tctgtgtccttccct

SEQ ID NO: 4099184 - DNA, 17 bp, Homo sapiens
tctgtgtccttccctgc

SEQ ID NO: 4099185 - DNA, 11 bp, Homo sapiens
tctgtgtctct

SEQ ID NO: 4099186 - DNA, 12 bp, Homo sapiens
tctgtgtctctt

SEQ ID NO: 4099187 - DNA, 21 bp, Homo sapiens
tctgtgtctttcacagctcct

SEQ ID NO: 4099188 - DNA, 15 bp, Homo sapiens
tctgtgtgaatgtgg

SEQ ID NO: 4099189 - DNA, 15 bp, Homo sapiens
tctgttaaaatctat

SEQ ID NO: 4099190 - DNA, 18 bp, Homo sapiens
tctgttaaggttgaactt

SEQ ID NO: 4099191 - DNA, 14 bp, Homo sapiens
tctgttagggcctt

SEQ ID NO: 4099192 - DNA, 12 bp, Homo sapiens
tctgttccaaat

SEQ ID NO: 4099193 - DNA, 22 bp, Homo sapiens
tctgttccaaattcagtttcat

SEQ ID NO: 4099194 - DNA, 17 bp, Homo sapiens
tctgttccatgcaactg

SEQ ID NO: 4099195 - DNA, 20 bp, Homo sapiens
tctgttccccatggccactt

SEQ ID NO: 4099196 - DNA, 13 bp, Homo sapiens
tctgttctagttt

SEQ ID NO: 4099197 - DNA, 20 bp, Homo sapiens
tctgttctagttttttactt

SEQ ID NO: 4099198 - DNA, 14 bp, Homo sapiens
tctgttctggggga

SEQ ID NO: 4099199 - DNA, 14 bp, Homo sapiens
tctgttcttgctac

SEQ ID NO: 4099200 - DNA, 12 bp, Homo sapiens
tctgttgaagtt

SEQ ID NO: 4099201 - DNA, 21 bp, Homo sapiens
tctgttgattactactttaag

SEQ ID NO: 4099202 - DNA, 15 bp, Homo sapiens
tctgttgcaattagg

SEQ ID NO: 4099203 - DNA, 21 bp, Homo sapiens
tctgcctgccagctgcactga

SEQ ID NO: 4099204 - DNA, 22 bp, Homo sapiens
tctgcctgccagctgcactgat

SEQ ID NO: 4099205 - DNA, 14 bp, Homo sapiens
tctgcctgccccgc

SEQ ID NO: 4099206 - DNA, 16 bp, Homo sapiens
tctgccttaaaaccaa

SEQ ID NO: 4099207 - DNA, 20 bp, Homo sapiens
tctgccttaaaaccaaagag

SEQ ID NO: 4099208 - DNA, 10 bp, Homo sapiens
tctgcctttg

SEQ ID NO: 4099209 - DNA, 14 bp, Homo sapiens
tctgcctttgacat

SEQ ID NO: 4099210 - DNA, 20 bp, Homo sapiens
tctgcctttgacatttaatt

SEQ ID NO: 4099211 - DNA, 23 bp, Homo sapiens
tctgcctttgacatttaatttag

SEQ ID NO: 4099212 - DNA, 11 bp, Homo sapiens
tctgccttttc

SEQ ID NO: 4099213 - DNA, 17 bp, Homo sapiens
tctgcggggcagggcct

SEQ ID NO: 4099214 - DNA, 14 bp, Homo sapiens
tctgctaataaaac

SEQ ID NO: 4099215 - DNA, 13 bp, Homo sapiens
tctgctagaaagt

SEQ ID NO: 4099216 - DNA, 20 bp, Homo sapiens
tctgctaggcgctggggaga

SEQ ID NO: 4099217 - DNA, 21 bp, Homo sapiens
tctgctaggcgctggggagac

SEQ ID NO: 4099218 - DNA, 14 bp, Homo sapiens
tctgctatatataa

SEQ ID NO: 4099219 - DNA, 20 bp, Homo sapiens
tctgctcaccgcccatcagg

SEQ ID NO: 4099220 - DNA, 17 bp, Homo sapiens
tctgctcagccaagctt

SEQ ID NO: 4099221 - DNA, 10 bp, Homo sapiens
tctgctccac

SEQ ID NO: 4099222 - DNA, 17 bp, Homo sapiens
tctgctccacccttggc

SEQ ID NO: 4099223 - DNA, 18 bp, Homo sapiens
tctgctccacccttggcc

SEQ ID NO: 4099224 - DNA, 19 bp, Homo sapiens
tctgctccacccttggcct

SEQ ID NO: 4099225 - DNA, 14 bp, Homo sapiens
tctgctccagctct

SEQ ID NO: 4099226 - DNA, 15 bp, Homo sapiens
tctgctccagctctg

SEQ ID NO: 4099227 - DNA, 20 bp, Homo sapiens
tctgctccagctctggcatg

SEQ ID NO: 4099228 - DNA, 16 bp, Homo sapiens
tctgctccataccttt

SEQ ID NO: 4099229 - DNA, 22 bp, Homo sapiens
tctgctcctggagcctttgaat

SEQ ID NO: 4099230 - DNA, 19 bp, Homo sapiens
tctgctcgccctcctttct

SEQ ID NO: 4099231 - DNA, 12 bp, Homo sapiens
tctgctctggaa

SEQ ID NO: 4099232 - DNA, 19 bp, Homo sapiens
tctgctctttctctgccag

SEQ ID NO: 4099233 - DNA, 20 bp, Homo sapiens
tctgctctttctctgccagt

SEQ ID NO: 4099234 - DNA, 16 bp, Homo sapiens
tctgctcttttcctgg

SEQ ID NO: 4099235 - DNA, 18 bp, Homo sapiens
tctgctgagttggcctgg

SEQ ID NO: 4099236 - DNA, 22 bp, Homo sapiens
tctgctgagttggcctggccat

SEQ ID NO: 4099237 - DNA, 13 bp, Homo sapiens
tctgctgcccctg

SEQ ID NO: 4099238 - DNA, 15 bp, Homo sapiens
tctgctgcccctgca

SEQ ID NO: 4099239 - DNA, 23 bp, Homo sapiens
tctgctggcatcaagaggtggga

SEQ ID NO: 4099240 - DNA, 20 bp, Homo sapiens
tctgctggcccagccaaacc

SEQ ID NO: 4099241 - DNA, 18 bp, Homo sapiens
tctgctgggagttctaga

SEQ ID NO: 4099242 - DNA, 20 bp, Homo sapiens
tctgctggtcacttcttctg

SEQ ID NO: 4099243 - DNA, 21 bp, Homo sapiens
tctgctggtcacttcttctgt

SEQ ID NO: 4099244 - DNA, 14 bp, Homo sapiens
tctgcttctctcac

SEQ ID NO: 4099245 - DNA, 13 bp, Homo sapiens
tctgcttttatta

SEQ ID NO: 4099246 - DNA, 15 bp, Homo sapiens
tctgcttttctgccc

SEQ ID NO: 4099247 - DNA, 21 bp, Homo sapiens
tctgcttttctgccctggctg

SEQ ID NO: 4099248 - DNA, 23 bp, Homo sapiens
tctgctttttaaagaatgctctt

SEQ ID NO: 4099249 - DNA, 15 bp, Homo sapiens
tctggaaactaccag

SEQ ID NO: 4099250 - DNA, 15 bp, Homo sapiens
tctggaaagaggctc

SEQ ID NO: 4099251 - DNA, 22 bp, Homo sapiens
tctggaacccagactcagacat

SEQ ID NO: 4099252 - DNA, 15 bp, Homo sapiens
tctggaacctcagcc

SEQ ID NO: 4099253 - DNA, 18 bp, Homo sapiens
tctggaacctcagcctgg

SEQ ID NO: 4099254 - DNA, 19 bp, Homo sapiens
tctggaacctcagcctggc

SEQ ID NO: 4099255 - DNA, 21 bp, Homo sapiens
tctggaacctcagcctggcca

SEQ ID NO: 4099256 - DNA, 13 bp, Homo sapiens
tctggaagaaaaa

SEQ ID NO: 4099257 - DNA, 14 bp, Homo sapiens
tctggaagaaaaaa

SEQ ID NO: 4099258 - DNA, 18 bp, Homo sapiens
tctggaataaagttgcag

SEQ ID NO: 4099259 - DNA, 20 bp, Homo sapiens
tctggaatattgtgattctg

SEQ ID NO: 4099260 - DNA, 16 bp, Homo sapiens
tctggaatgtaatcaa

SEQ ID NO: 4099261 - DNA, 12 bp, Homo sapiens
tctggacaagcc

SEQ ID NO: 4099262 - DNA, 20 bp, Homo sapiens
tctggacagcagaagcctcc

SEQ ID NO: 4099263 - DNA, 17 bp, Homo sapiens
tctggacagccagtgac

SEQ ID NO: 4099264 - DNA, 19 bp, Homo sapiens
tctggacggcaggctcact

SEQ ID NO: 4099265 - DNA, 23 bp, Homo sapiens
tctggacggcaggctcactgcca

SEQ ID NO: 4099266 - DNA, 17 bp, Homo sapiens
tctggactgaagcctgc

SEQ ID NO: 4099267 - DNA, 21 bp, Homo sapiens
tctggactgaagcctgcagga

SEQ ID NO: 4099268 - DNA, 14 bp, Homo sapiens
tctggactggctag

SEQ ID NO: 4099269 - DNA, 22 bp, Homo sapiens
tctggagaggttataggtcact

SEQ ID NO: 4099270 - DNA, 18 bp, Homo sapiens
tctggaggaaagggagga

SEQ ID NO: 4099271 - DNA, 19 bp, Homo sapiens
tctggaggccttccagctg

SEQ ID NO: 4099272 - DNA, 23 bp, Homo sapiens
tctggaggccttccagctgctgt

SEQ ID NO: 4099273 - DNA, 18 bp, Homo sapiens
tctggaggggagagcttt

SEQ ID NO: 4099274 - DNA, 21 bp, Homo sapiens
tctggaggggagagctttgtg

SEQ ID NO: 4099275 - DNA, 14 bp, Homo sapiens
tctggagtgggcag

SEQ ID NO: 4099276 - DNA, 20 bp, Homo sapiens
tctggataggagcctgctgg

SEQ ID NO: 4099277 - DNA, 21 bp, Homo sapiens
tctggattctgaatctcaaga

SEQ ID NO: 4099278 - DNA, 19 bp, Homo sapiens
tctggcaaaaaggagcctt

SEQ ID NO: 4099279 - DNA, 21 bp, Homo sapiens
tctggcaaagcttttagaaat

SEQ ID NO: 4099280 - DNA, 18 bp, Homo sapiens
tctggcattagaattatt

SEQ ID NO: 4099281 - DNA, 19 bp, Homo sapiens
tctggccaggatggagggg

SEQ ID NO: 4099282 - DNA, 18 bp, Homo sapiens
tctggccaggcactgcct

SEQ ID NO: 4099283 - DNA, 21 bp, Homo sapiens
tctggccatatttactacctt

SEQ ID NO: 4099284 - DNA, 21 bp, Homo sapiens
tctggccccacaccagcccca

SEQ ID NO: 4099285 - DNA, 14 bp, Homo sapiens
tctggccctggccc

SEQ ID NO: 4099286 - DNA, 15 bp, Homo sapiens
tctggccctggccct

SEQ ID NO: 4099287 - DNA, 24 bp, Homo sapiens
tctggcccttacacactcaggcct

SEQ ID NO: 4099288 - DNA, 15 bp, Homo sapiens
tctggcctcagacca

SEQ ID NO: 4099289 - DNA, 19 bp, Homo sapiens
tctggcctctgctgaatgc

SEQ ID NO: 4099290 - DNA, 16 bp, Homo sapiens
tctggctagaggccag

SEQ ID NO: 4099291 - DNA, 17 bp, Homo sapiens
tctggctagaggccagc

SEQ ID NO: 4099292 - DNA, 19 bp, Homo sapiens
tctggctcctcaaacagta

SEQ ID NO: 4099293 - DNA, 17 bp, Homo sapiens
tctggctcctttacaaa

SEQ ID NO: 4099294 - DNA, 21 bp, Homo sapiens
tctggctgccccaacctgctg

SEQ ID NO: 4099295 - DNA, 21 bp, Homo sapiens
tctggctgtctagaatgtgga

SEQ ID NO: 4099296 - DNA, 15 bp, Homo sapiens
tctggcttccaggta

SEQ ID NO: 4099297 - DNA, 22 bp, Homo sapiens
tctggcttccaggtatctccag

SEQ ID NO: 4099298 - DNA, 24 bp, Homo sapiens
tctggcttccaggtatctccagga

SEQ ID NO: 4099299 - DNA, 15 bp, Homo sapiens
tctggctttcccagg

SEQ ID NO: 4099300 - DNA, 23 bp, Homo sapiens
tctggctttctccgactgctagg

SEQ ID NO: 4099301 - DNA, 20 bp, Homo sapiens
tctggctttttcctctgagc

SEQ ID NO: 4099302 - DNA, 22 bp, Homo sapiens
tctggctttttcctctgagccc

SEQ ID NO: 4099303 - DNA, 22 bp, Homo sapiens
tctgggaacttgcgagtccaag

SEQ ID NO: 4099304 - DNA, 13 bp, Homo sapiens
tctgggacctcag

SEQ ID NO: 4099305 - DNA, 13 bp, Homo sapiens
tctgacatattat

SEQ ID NO: 4099306 - DNA, 16 bp, Homo sapiens
tctgacattaacagtt

SEQ ID NO: 4099307 - DNA, 18 bp, Homo sapiens
tctgacattaacagtttt

SEQ ID NO: 4099308 - DNA, 23 bp, Homo sapiens
tctgacccagtgcccccactgac

SEQ ID NO: 4099309 - DNA, 16 bp, Homo sapiens
tctgaccctctggaaa

SEQ ID NO: 4099310 - DNA, 17 bp, Homo sapiens
tctgacccttctacatt

SEQ ID NO: 4099311 - DNA, 14 bp, Homo sapiens
tctgactactttgc

SEQ ID NO: 4099312 - DNA, 16 bp, Homo sapiens
tctgactcttccccag

SEQ ID NO: 4099313 - DNA, 13 bp, Homo sapiens
tctgactgacatg

SEQ ID NO: 4099314 - DNA, 20 bp, Homo sapiens
tctgagacccttttctcagg

SEQ ID NO: 4099315 - DNA, 22 bp, Homo sapiens
tctgagacccttttctcaggac

SEQ ID NO: 4099316 - DNA, 13 bp, Homo sapiens
tctgagactcaca

SEQ ID NO: 4099317 - DNA, 15 bp, Homo sapiens
tctgagaggctctcc

SEQ ID NO: 4099318 - DNA, 16 bp, Homo sapiens
tctgagaggctctccg

SEQ ID NO: 4099319 - DNA, 21 bp, Homo sapiens
tctgagagtgaaaccatgact

SEQ ID NO: 4099320 - DNA, 19 bp, Homo sapiens
tctgagatgctcactttat

SEQ ID NO: 4099321 - DNA, 21 bp, Homo sapiens
tctgagatgctcactttatta

SEQ ID NO: 4099322 - DNA, 14 bp, Homo sapiens
tctgagatgtggag

SEQ ID NO: 4099323 - DNA, 18 bp, Homo sapiens
tctgagatgtggagactg

SEQ ID NO: 4099324 - DNA, 21 bp, Homo sapiens
tctgagatttttttgtgtatg

SEQ ID NO: 4099325 - DNA, 14 bp, Homo sapiens
tctgagcagtgcct

SEQ ID NO: 4099326 - DNA, 19 bp, Homo sapiens
tctgagcagtgcctcttgt

SEQ ID NO: 4099327 - DNA, 20 bp, Homo sapiens
tctgagccagtgctttaatg

SEQ ID NO: 4099328 - DNA, 13 bp, Homo sapiens
tctgagcccagct

SEQ ID NO: 4099329 - DNA, 17 bp, Homo sapiens
tctgagcccagctgcct

SEQ ID NO: 4099330 - DNA, 18 bp, Homo sapiens
tctgagctgcagcctggc

SEQ ID NO: 4099331 - DNA, 16 bp, Homo sapiens
tctgagctggcctctc

SEQ ID NO: 4099332 - DNA, 18 bp, Homo sapiens
tctgagtccactgctcca

SEQ ID NO: 4099333 - DNA, 13 bp, Homo sapiens
tctgagtgaacct

SEQ ID NO: 4099334 - DNA, 20 bp, Homo sapiens
tctgagtgaacctgtataag

SEQ ID NO: 4099335 - DNA, 24 bp, Homo sapiens
tctgagtgtttttactacagttgt

SEQ ID NO: 4099336 - DNA, 15 bp, Homo sapiens
tctgagtttaccatt

SEQ ID NO: 4099337 - DNA, 15 bp, Homo sapiens
tctgagtttcattct

SEQ ID NO: 4099338 - DNA, 22 bp, Homo sapiens
tctgagtttcattctcctgcct

SEQ ID NO: 4099339 - DNA, 13 bp, Homo sapiens
tctgataaactga

SEQ ID NO: 4099340 - DNA, 15 bp, Homo sapiens
tctgatattaatcaa

SEQ ID NO: 4099341 - DNA, 17 bp, Homo sapiens
tctgatattaatcaaaa

SEQ ID NO: 4099342 - DNA, 22 bp, Homo sapiens
tctgatattccatgaatgtatc

SEQ ID NO: 4099343 - DNA, 22 bp, Homo sapiens
tctgatcagaggtgtacactaa

SEQ ID NO: 4099344 - DNA, 15 bp, Homo sapiens
tctgatcttgtgctc

SEQ ID NO: 4099345 - DNA, 18 bp, Homo sapiens
tctgatggaccttctaga

SEQ ID NO: 4099346 - DNA, 22 bp, Homo sapiens
tctgatggccttaatttccttt

SEQ ID NO: 4099347 - DNA, 20 bp, Homo sapiens
tctgatgtctctaaagcact

SEQ ID NO: 4099348 - DNA, 15 bp, Homo sapiens
tctgattagctttgt

SEQ ID NO: 4099349 - DNA, 17 bp, Homo sapiens
tctgattagctttgtgt

SEQ ID NO: 4099350 - DNA, 20 bp, Homo sapiens
tctgattcttctaaattaaa

SEQ ID NO: 4099351 - DNA, 13 bp, Homo sapiens
tctgattggctca

SEQ ID NO: 4099352 - DNA, 21 bp, Homo sapiens
tctgattttgtgcaaaagctt

SEQ ID NO: 4099353 - DNA, 19 bp, Homo sapiens
tctgcaaaggtggcaatgc

SEQ ID NO: 4099354 - DNA, 20 bp, Homo sapiens
tctgcaagcacatctgcatt

SEQ ID NO: 4099355 - DNA, 21 bp, Homo sapiens
tctgcaatgggcactgggatg

SEQ ID NO: 4099356 - DNA, 12 bp, Homo sapiens
tctgcaatttgt

SEQ ID NO: 4099357 - DNA, 19 bp, Homo sapiens
tctgcaatttgtttaaaga

SEQ ID NO: 4099358 - DNA, 19 bp, Homo sapiens
tctgcacacacctccgaga

SEQ ID NO: 4099359 - DNA, 22 bp, Homo sapiens
tctgcacacacctccgagacag

SEQ ID NO: 4099360 - DNA, 10 bp, Homo sapiens
tctgcacaga

SEQ ID NO: 4099361 - DNA, 21 bp, Homo sapiens
tctgcacccctctgccctcat

SEQ ID NO: 4099362 - DNA, 23 bp, Homo sapiens
tctgcaccctggggcctggacct

SEQ ID NO: 4099363 - DNA, 20 bp, Homo sapiens
tctgcactactgacatgtgg

SEQ ID NO: 4099364 - DNA, 21 bp, Homo sapiens
tctgcactactgacatgtggg

SEQ ID NO: 4099365 - DNA, 18 bp, Homo sapiens
tctgcactctaaactgca

SEQ ID NO: 4099366 - DNA, 22 bp, Homo sapiens
tctgcagaacatcgatatgtat

SEQ ID NO: 4099367 - DNA, 20 bp, Homo sapiens
tctgcagcatgacctgtgac

SEQ ID NO: 4099368 - DNA, 19 bp, Homo sapiens
tctgcagcccttgggcagt

SEQ ID NO: 4099369 - DNA, 21 bp, Homo sapiens
tctgcagcccttgggcagttc

SEQ ID NO: 4099370 - DNA, 22 bp, Homo sapiens
tctgcagctatgcgcaatgtgg

SEQ ID NO: 4099371 - DNA, 13 bp, Homo sapiens
tctgcagctgccg

SEQ ID NO: 4099372 - DNA, 15 bp, Homo sapiens
tctgcagtaaatctt

SEQ ID NO: 4099373 - DNA, 16 bp, Homo sapiens
tctgcagtaaatcttt

SEQ ID NO: 4099374 - DNA, 16 bp, Homo sapiens
tctgcagtctcatttc

SEQ ID NO: 4099375 - DNA, 21 bp, Homo sapiens
tctgcatcccagcacctgcct

SEQ ID NO: 4099376 - DNA, 20 bp, Homo sapiens
tctgcattatctatgcagca

SEQ ID NO: 4099377 - DNA, 21 bp, Homo sapiens
tctgcattcatttttatagca

SEQ ID NO: 4099378 - DNA, 10 bp, Homo sapiens
tctgcatttt

SEQ ID NO: 4099379 - DNA, 17 bp, Homo sapiens
tctgccaccatcctgct

SEQ ID NO: 4099380 - DNA, 15 bp, Homo sapiens
tctgccacccactca

SEQ ID NO: 4099381 - DNA, 16 bp, Homo sapiens
tctgccacccactcag

SEQ ID NO: 4099382 - DNA, 18 bp, Homo sapiens
tctgccacccactcagga

SEQ ID NO: 4099383 - DNA, 20 bp, Homo sapiens
tctgccagaagatcccctca

SEQ ID NO: 4099384 - DNA, 21 bp, Homo sapiens
tctgccagaagatcccctcag

SEQ ID NO: 4099385 - DNA, 15 bp, Homo sapiens
tctgccagaatactg

SEQ ID NO: 4099386 - DNA, 12 bp, Homo sapiens
tctgccagggag

SEQ ID NO: 4099387 - DNA, 16 bp, Homo sapiens
tctgccagtggatccc

SEQ ID NO: 4099388 - DNA, 18 bp, Homo sapiens
tctgcccagcttttcatt

SEQ ID NO: 4099389 - DNA, 12 bp, Homo sapiens
tctgccccaccc

SEQ ID NO: 4099390 - DNA, 15 bp, Homo sapiens
tctgccccagcccag

SEQ ID NO: 4099391 - DNA, 14 bp, Homo sapiens
tctgccccctgctg

SEQ ID NO: 4099392 - DNA, 17 bp, Homo sapiens
tctgcccctcccaaccc

SEQ ID NO: 4099393 - DNA, 14 bp, Homo sapiens
tctgcccctccccc

SEQ ID NO: 4099394 - DNA, 18 bp, Homo sapiens
tctgcccctcccccaacc

SEQ ID NO: 4099395 - DNA, 21 bp, Homo sapiens
tctgccctcattactgggcct

SEQ ID NO: 4099396 - DNA, 23 bp, Homo sapiens
tctgccctggattggttggcaaa

SEQ ID NO: 4099397 - DNA, 14 bp, Homo sapiens
tctgccctggctgc

SEQ ID NO: 4099398 - DNA, 16 bp, Homo sapiens
tctgcccttcacccca

SEQ ID NO: 4099399 - DNA, 18 bp, Homo sapiens
tctgccctttcctaggcc

SEQ ID NO: 4099400 - DNA, 19 bp, Homo sapiens
tctgccggcccccaggaca

SEQ ID NO: 4099401 - DNA, 20 bp, Homo sapiens
tctgccggtcgggcagccag

SEQ ID NO: 4099402 - DNA, 21 bp, Homo sapiens
tctgccggtcgggcagccagc

SEQ ID NO: 4099403 - DNA, 15 bp, Homo sapiens
tctgcctccaccctc

SEQ ID NO: 4099404 - DNA, 20 bp, Homo sapiens
tctgcctccaccctcctcct

SEQ ID NO: 4099405 - DNA, 20 bp, Homo sapiens
tctgcctccatgctgcagtg

SEQ ID NO: 4099406 - DNA, 13 bp, Homo sapiens
tctgcctcgctca

SEQ ID NO: 4099407 - DNA, 12 bp, Homo sapiens
tctgcctctctg

SEQ ID NO: 4099408 - DNA, 14 bp, Homo sapiens
tctctacagtgcca

SEQ ID NO: 4099409 - DNA, 15 bp, Homo sapiens
tctctactggagtgg

SEQ ID NO: 4099410 - DNA, 22 bp, Homo sapiens
tctctagaattttaagtgcttt

SEQ ID NO: 4099411 - DNA, 12 bp, Homo sapiens
tctctatgtact

SEQ ID NO: 4099412 - DNA, 17 bp, Homo sapiens
tctctattccccaccct

SEQ ID NO: 4099413 - DNA, 18 bp, Homo sapiens
tctctattctctgcaatt

SEQ ID NO: 4099414 - DNA, 21 bp, Homo sapiens
tctctattggaggtgagatca

SEQ ID NO: 4099415 - DNA, 14 bp, Homo sapiens
tctctcaaattgtc

SEQ ID NO: 4099416 - DNA, 13 bp, Homo sapiens
tctctcacccatc

SEQ ID NO: 4099417 - DNA, 17 bp, Homo sapiens
tctctcagagcatctgg

SEQ ID NO: 4099418 - DNA, 18 bp, Homo sapiens
tctctcaggagcacaggc

SEQ ID NO: 4099419 - DNA, 22 bp, Homo sapiens
tctctcaggagcacaggcagct

SEQ ID NO: 4099420 - DNA, 15 bp, Homo sapiens
tctctccaggaaggt

SEQ ID NO: 4099421 - DNA, 15 bp, Homo sapiens
tctctccctccttct

SEQ ID NO: 4099422 - DNA, 11 bp, Homo sapiens
tctctccctgc

SEQ ID NO: 4099423 - DNA, 13 bp, Homo sapiens
tctctcctggctg

SEQ ID NO: 4099424 - DNA, 17 bp, Homo sapiens
tctctcctggctgggcc

SEQ ID NO: 4099425 - DNA, 22 bp, Homo sapiens
tctctcctggctgggccatcct

SEQ ID NO: 4099426 - DNA, 15 bp, Homo sapiens
tctctcggctcccca

SEQ ID NO: 4099427 - DNA, 20 bp, Homo sapiens
tctctcgtaactggtttcat

SEQ ID NO: 4099428 - DNA, 14 bp, Homo sapiens
tctctctgcccaac

SEQ ID NO: 4099429 - DNA, 15 bp, Homo sapiens
tctctctggggccct

SEQ ID NO: 4099430 - DNA, 12 bp, Homo sapiens
tctctctgtgaa

SEQ ID NO: 4099431 - DNA, 13 bp, Homo sapiens
tctctctgtgaat

SEQ ID NO: 4099432 - DNA, 20 bp, Homo sapiens
tctctctgtgaatacaatta

SEQ ID NO: 4099433 - DNA, 23 bp, Homo sapiens
tctctctgtgaatacaattaaag

SEQ ID NO: 4099434 - DNA, 14 bp, Homo sapiens
tctctcttccctca

SEQ ID NO: 4099435 - DNA, 18 bp, Homo sapiens
tctctcttgtcctcttct

SEQ ID NO: 4099436 - DNA, 17 bp, Homo sapiens
tctctctttatacagct

SEQ ID NO: 4099437 - DNA, 12 bp, Homo sapiens
tctctgagactg

SEQ ID NO: 4099438 - DNA, 14 bp, Homo sapiens
tctctgatcttgtg

SEQ ID NO: 4099439 - DNA, 14 bp, Homo sapiens
tctctgcaatttgt

SEQ ID NO: 4099440 - DNA, 23 bp, Homo sapiens
tctctgcaatttgtttaaagaat

SEQ ID NO: 4099441 - DNA, 15 bp, Homo sapiens
tctctgcagacttcc

SEQ ID NO: 4099442 - DNA, 14 bp, Homo sapiens
tctctgcagatgtg

SEQ ID NO: 4099443 - DNA, 21 bp, Homo sapiens
tctctgccagtgacagacagg

SEQ ID NO: 4099444 - DNA, 12 bp, Homo sapiens
tctctgctccac

SEQ ID NO: 4099445 - DNA, 17 bp, Homo sapiens
tctctgctccaccacat

SEQ ID NO: 4099446 - DNA, 16 bp, Homo sapiens
tctctggggcagatcc

SEQ ID NO: 4099447 - DNA, 22 bp, Homo sapiens
tctctggggcagatccccactg

SEQ ID NO: 4099448 - DNA, 18 bp, Homo sapiens
tctctggggccctgggcc

SEQ ID NO: 4099449 - DNA, 14 bp, Homo sapiens
tctctgtcccttgc

SEQ ID NO: 4099450 - DNA, 16 bp, Homo sapiens
tctctgtcccttgctg

SEQ ID NO: 4099451 - DNA, 19 bp, Homo sapiens
tctctgtcccttgctgtat

SEQ ID NO: 4099452 - DNA, 20 bp, Homo sapiens
tctctgtcccttgctgtatg

SEQ ID NO: 4099453 - DNA, 22 bp, Homo sapiens
tctctgtgaacgatttagaaag

SEQ ID NO: 4099454 - DNA, 23 bp, Homo sapiens
tctctgtgaacgatttagaaaga

SEQ ID NO: 4099455 - DNA, 14 bp, Homo sapiens
tctctgtgaataca

SEQ ID NO: 4099456 - DNA, 18 bp, Homo sapiens
tctctgtgaatacaatta

SEQ ID NO: 4099457 - DNA, 19 bp, Homo sapiens
tctctgtgaatacaattaa

SEQ ID NO: 4099458 - DNA, 20 bp, Homo sapiens
tctctgtgaatacaattaaa

SEQ ID NO: 4099459 - DNA, 16 bp, Homo sapiens
tctcttagaaatactt

SEQ ID NO: 4099460 - DNA, 17 bp, Homo sapiens
tctcttatagaatattt

SEQ ID NO: 4099461 - DNA, 21 bp, Homo sapiens
tctcttatagaatatttatta

SEQ ID NO: 4099462 - DNA, 14 bp, Homo sapiens
tctcttcaggttct

SEQ ID NO: 4099463 - DNA, 15 bp, Homo sapiens
tctcttccaggcagc

SEQ ID NO: 4099464 - DNA, 18 bp, Homo sapiens
tctcttccaggcagccgc

SEQ ID NO: 4099465 - DNA, 11 bp, Homo sapiens
tctcttctcca

SEQ ID NO: 4099466 - DNA, 13 bp, Homo sapiens
tctcttctccact

SEQ ID NO: 4099467 - DNA, 14 bp, Homo sapiens
tctcttctccactg

SEQ ID NO: 4099468 - DNA, 15 bp, Homo sapiens
tctcttctccactgg

SEQ ID NO: 4099469 - DNA, 16 bp, Homo sapiens
tctcttctccactgga

SEQ ID NO: 4099470 - DNA, 13 bp, Homo sapiens
tctcttctgctcc

SEQ ID NO: 4099471 - DNA, 20 bp, Homo sapiens
tctcttgaaaagttcaggga

SEQ ID NO: 4099472 - DNA, 23 bp, Homo sapiens
tctcttgaaaagttcagggaccg

SEQ ID NO: 4099473 - DNA, 18 bp, Homo sapiens
tctcttgaggccaggagt

SEQ ID NO: 4099474 - DNA, 22 bp, Homo sapiens
tctcttgagggagcttagccaa

SEQ ID NO: 4099475 - DNA, 13 bp, Homo sapiens
tctcttgctttct

SEQ ID NO: 4099476 - DNA, 18 bp, Homo sapiens
tctcttgtcctcttctgc

SEQ ID NO: 4099477 - DNA, 19 bp, Homo sapiens
tctctttaaaaggaaagaa

SEQ ID NO: 4099478 - DNA, 16 bp, Homo sapiens
tctctttaatcttcag

SEQ ID NO: 4099479 - DNA, 17 bp, Homo sapiens
tctctttaatcttcagt

SEQ ID NO: 4099480 - DNA, 17 bp, Homo sapiens
tctctttagtataattg

SEQ ID NO: 4099481 - DNA, 22 bp, Homo sapiens
tctctttcacattgtttgctgc

SEQ ID NO: 4099482 - DNA, 14 bp, Homo sapiens
tctctttctctctt

SEQ ID NO: 4099483 - DNA, 20 bp, Homo sapiens
tctcttttcccctttcctgt

SEQ ID NO: 4099484 - DNA, 21 bp, Homo sapiens
tctcttttcctgttgtattga

SEQ ID NO: 4099485 - DNA, 12 bp, Homo sapiens
tctcttttctct

SEQ ID NO: 4099486 - DNA, 16 bp, Homo sapiens
tctcttttctctttct

SEQ ID NO: 4099487 - DNA, 13 bp, Homo sapiens
tctcttttctttc

SEQ ID NO: 4099488 - DNA, 22 bp, Homo sapiens
tctctttttggtaataacaaac

SEQ ID NO: 4099489 - DNA, 18 bp, Homo sapiens
tctgaaaatataaccagc

SEQ ID NO: 4099490 - DNA, 14 bp, Homo sapiens
tctgaaaatgtatg

SEQ ID NO: 4099491 - DNA, 12 bp, Homo sapiens
tctgaaactggc

SEQ ID NO: 4099492 - DNA, 13 bp, Homo sapiens
tctgaaactggct

SEQ ID NO: 4099493 - DNA, 14 bp, Homo sapiens
tctgaaatctcctt

SEQ ID NO: 4099494 - DNA, 12 bp, Homo sapiens
tctgaaattcta

SEQ ID NO: 4099495 - DNA, 13 bp, Homo sapiens
tctgaactctcaa

SEQ ID NO: 4099496 - DNA, 13 bp, Homo sapiens
tctgaactttgga

SEQ ID NO: 4099497 - DNA, 22 bp, Homo sapiens
tctgaagagtatccttccttca

SEQ ID NO: 4099498 - DNA, 14 bp, Homo sapiens
tctgaagcttgact

SEQ ID NO: 4099499 - DNA, 16 bp, Homo sapiens
tctgaagcttgactcc

SEQ ID NO: 4099500 - DNA, 22 bp, Homo sapiens
tctgaagcttgactcccaagtt

SEQ ID NO: 4099501 - DNA, 17 bp, Homo sapiens
tctgaataaagtgtaac

SEQ ID NO: 4099502 - DNA, 18 bp, Homo sapiens
tctgaataaagtgtaaca

SEQ ID NO: 4099503 - DNA, 16 bp, Homo sapiens
tctgaatagaaatggg

SEQ ID NO: 4099504 - DNA, 13 bp, Homo sapiens
tctgaatcctaag

SEQ ID NO: 4099505 - DNA, 13 bp, Homo sapiens
tctgaatgctgct

SEQ ID NO: 4099506 - DNA, 13 bp, Homo sapiens
tctgaatgttctg

SEQ ID NO: 4099507 - DNA, 16 bp, Homo sapiens
tctgaatgttctgaca

SEQ ID NO: 4099508 - DNA, 15 bp, Homo sapiens
tctgaattctgccct

SEQ ID NO: 4099509 - DNA, 12 bp, Homo sapiens
tctgaatttatt

SEQ ID NO: 4099510 - DNA, 16 bp, Homo sapiens
tctgacagaaagcaga

SEQ ID NO: 4099511 - DNA, 20 bp, Homo sapiens
tctgacagtttttctgtttt

SEQ ID NO: 4099512 - DNA, 23 bp, Homo sapiens
tctcataggaaaagtacatttaa

SEQ ID NO: 4099513 - DNA, 24 bp, Homo sapiens
tctcataggaaaagtacatttaat

SEQ ID NO: 4099514 - DNA, 14 bp, Homo sapiens
tctcatcctcctgg

SEQ ID NO: 4099515 - DNA, 17 bp, Homo sapiens
tctcatcttgacagagc

SEQ ID NO: 4099516 - DNA, 22 bp, Homo sapiens
tctcatcttgacagagcctgcc

SEQ ID NO: 4099517 - DNA, 16 bp, Homo sapiens
tctcatgaggggagag

SEQ ID NO: 4099518 - DNA, 20 bp, Homo sapiens
tctcatgaggggagaggaga

SEQ ID NO: 4099519 - DNA, 13 bp, Homo sapiens
tctcatgctgccc

SEQ ID NO: 4099520 - DNA, 20 bp, Homo sapiens
tctcattacccacccgacct

SEQ ID NO: 4099521 - DNA, 18 bp, Homo sapiens
tctcattccgttgtctgt

SEQ ID NO: 4099522 - DNA, 12 bp, Homo sapiens
tctcattcttgt

SEQ ID NO: 4099523 - DNA, 15 bp, Homo sapiens
tctcattgcttacaa

SEQ ID NO: 4099524 - DNA, 24 bp, Homo sapiens
tctccaaatgagatctaagccttt

SEQ ID NO: 4099525 - DNA, 17 bp, Homo sapiens
tctccaaggatcctctc

SEQ ID NO: 4099526 - DNA, 18 bp, Homo sapiens
tctccaaggatcctctcc

SEQ ID NO: 4099527 - DNA, 17 bp, Homo sapiens
tctccaagtctcagtgg

SEQ ID NO: 4099528 - DNA, 16 bp, Homo sapiens
tctccaagtctctctg

SEQ ID NO: 4099529 - DNA, 18 bp, Homo sapiens
tctccaagtctctctgtg

SEQ ID NO: 4099530 - DNA, 20 bp, Homo sapiens
tctccaagtctctctgtgaa

SEQ ID NO: 4099531 - DNA, 21 bp, Homo sapiens
tctccactaaatgagctcctg

SEQ ID NO: 4099532 - DNA, 23 bp, Homo sapiens
tctccactccatgtttgcaatgc

SEQ ID NO: 4099533 - DNA, 15 bp, Homo sapiens
tctccagaatgtaag

SEQ ID NO: 4099534 - DNA, 20 bp, Homo sapiens
tctccagaatgtaagaaaac

SEQ ID NO: 4099535 - DNA, 19 bp, Homo sapiens
tctccagatgtttccagac

SEQ ID NO: 4099536 - DNA, 13 bp, Homo sapiens
tctccagccagca

SEQ ID NO: 4099537 - DNA, 15 bp, Homo sapiens
tctccagccagcaat

SEQ ID NO: 4099538 - DNA, 12 bp, Homo sapiens
tctccagctgcc

SEQ ID NO: 4099539 - DNA, 19 bp, Homo sapiens
tctccagctgcctgggccc

SEQ ID NO: 4099540 - DNA, 21 bp, Homo sapiens
tctccagctgggctctgcaat

SEQ ID NO: 4099541 - DNA, 22 bp, Homo sapiens
tctccaggaaggtagcccagca

SEQ ID NO: 4099542 - DNA, 13 bp, Homo sapiens
tctccaggaccaa

SEQ ID NO: 4099543 - DNA, 13 bp, Homo sapiens
tctccaggtgctc

SEQ ID NO: 4099544 - DNA, 14 bp, Homo sapiens
tctccaggtgctca

SEQ ID NO: 4099545 - DNA, 18 bp, Homo sapiens
tctccagtttgcacctgt

SEQ ID NO: 4099546 - DNA, 15 bp, Homo sapiens
tctccagttttcagt

SEQ ID NO: 4099547 - DNA, 15 bp, Homo sapiens
tctccatatgttaca

SEQ ID NO: 4099548 - DNA, 18 bp, Homo sapiens
tctccatcatatgcctga

SEQ ID NO: 4099549 - DNA, 12 bp, Homo sapiens
tctccatggccc

SEQ ID NO: 4099550 - DNA, 21 bp, Homo sapiens
tctccatggccctgtcccagg

SEQ ID NO: 4099551 - DNA, 19 bp, Homo sapiens
tctcccaagaaacctgact

SEQ ID NO: 4099552 - DNA, 22 bp, Homo sapiens
tctcccacatgaggccatctca

SEQ ID NO: 4099553 - DNA, 14 bp, Homo sapiens
tctcccaccctgta

SEQ ID NO: 4099554 - DNA, 14 bp, Homo sapiens
tctcccacgtggga

SEQ ID NO: 4099555 - DNA, 16 bp, Homo sapiens
tctcccacgtgggaga

SEQ ID NO: 4099556 - DNA, 22 bp, Homo sapiens
tctcccagtgaactcctgccag

SEQ ID NO: 4099557 - DNA, 22 bp, Homo sapiens
tctcccatttcaggaatttaaa

SEQ ID NO: 4099558 - DNA, 16 bp, Homo sapiens
tctccccagcccagag

SEQ ID NO: 4099559 - DNA, 17 bp, Homo sapiens
tctccccagcccagaga

SEQ ID NO: 4099560 - DNA, 18 bp, Homo sapiens
tctccccagcccagagac

SEQ ID NO: 4099561 - DNA, 12 bp, Homo sapiens
tctccccagtgt

SEQ ID NO: 4099562 - DNA, 13 bp, Homo sapiens
tctcccccaccct

SEQ ID NO: 4099563 - DNA, 21 bp, Homo sapiens
tctcccccacccttgttccag

SEQ ID NO: 4099564 - DNA, 15 bp, Homo sapiens
tctccccctcctcca

SEQ ID NO: 4099565 - DNA, 20 bp, Homo sapiens
tctccccctcctccagggaa

SEQ ID NO: 4099566 - DNA, 16 bp, Homo sapiens
tctcccctccagcctt

SEQ ID NO: 4099567 - DNA, 20 bp, Homo sapiens
tctcccggaggttgggtggg

SEQ ID NO: 4099568 - DNA, 18 bp, Homo sapiens
tctccctcccctgccatt

SEQ ID NO: 4099569 - DNA, 23 bp, Homo sapiens
tctccctcgacagcgcccctgct

SEQ ID NO: 4099570 - DNA, 12 bp, Homo sapiens
tctccctctgat

SEQ ID NO: 4099571 - DNA, 20 bp, Homo sapiens
tctccctggctccctcctcc

SEQ ID NO: 4099572 - DNA, 17 bp, Homo sapiens
tctcccttcctctctcc

SEQ ID NO: 4099573 - DNA, 19 bp, Homo sapiens
tctcccttcctctctcctt

SEQ ID NO: 4099574 - DNA, 18 bp, Homo sapiens
tctccctttatgtatctc

SEQ ID NO: 4099575 - DNA, 17 bp, Homo sapiens
tctccgactgctaggga

SEQ ID NO: 4099576 - DNA, 18 bp, Homo sapiens
tctccgggtgtggcctca

SEQ ID NO: 4099577 - DNA, 20 bp, Homo sapiens
tctccgttccatctgggctt

SEQ ID NO: 4099578 - DNA, 14 bp, Homo sapiens
tctcctactcctga

SEQ ID NO: 4099579 - DNA, 22 bp, Homo sapiens
tctcctcccgcccttccatgtg

SEQ ID NO: 4099580 - DNA, 13 bp, Homo sapiens
tctcctccctcag

SEQ ID NO: 4099581 - DNA, 21 bp, Homo sapiens
tctcctcgtccatcagggatc

SEQ ID NO: 4099582 - DNA, 13 bp, Homo sapiens
tctcctctctgag

SEQ ID NO: 4099583 - DNA, 16 bp, Homo sapiens
tctcctctctgggcct

SEQ ID NO: 4099584 - DNA, 16 bp, Homo sapiens
tctcctcttttatctt

SEQ ID NO: 4099585 - DNA, 14 bp, Homo sapiens
tctcctgactttta

SEQ ID NO: 4099586 - DNA, 12 bp, Homo sapiens
tctcctgccctg

SEQ ID NO: 4099587 - DNA, 20 bp, Homo sapiens
tctcctgcctgtagcagtga

SEQ ID NO: 4099588 - DNA, 22 bp, Homo sapiens
tctcctgcctgtagcagtgaga

SEQ ID NO: 4099589 - DNA, 23 bp, Homo sapiens
tctcctgctcaccacctgcctct

SEQ ID NO: 4099590 - DNA, 18 bp, Homo sapiens
tctcctgggccgttacat

SEQ ID NO: 4099591 - DNA, 22 bp, Homo sapiens
tctcctgggggtggcaggcaca

SEQ ID NO: 4099592 - DNA, 22 bp, Homo sapiens
tctcctgtataaccccaccttg

SEQ ID NO: 4099593 - DNA, 15 bp, Homo sapiens
tctcctgtgcccaca

SEQ ID NO: 4099594 - DNA, 16 bp, Homo sapiens
tctcctgtgcccacat

SEQ ID NO: 4099595 - DNA, 17 bp, Homo sapiens
tctcctgtgcccacatc

SEQ ID NO: 4099596 - DNA, 19 bp, Homo sapiens
tctcctgtttattcccatc

SEQ ID NO: 4099597 - DNA, 20 bp, Homo sapiens
tctcctgtttattcccatct

SEQ ID NO: 4099598 - DNA, 17 bp, Homo sapiens
tctccttagtcttctca

SEQ ID NO: 4099599 - DNA, 19 bp, Homo sapiens
tctccttagtcttctcata

SEQ ID NO: 4099600 - DNA, 15 bp, Homo sapiens
tctccttagttggct

SEQ ID NO: 4099601 - DNA, 21 bp, Homo sapiens
tctccttcccatttctctaca

SEQ ID NO: 4099602 - DNA, 19 bp, Homo sapiens
tctccttctaaaaacttct

SEQ ID NO: 4099603 - DNA, 22 bp, Homo sapiens
tctccttgccccccgccctcat

SEQ ID NO: 4099604 - DNA, 19 bp, Homo sapiens
tctcctttgcactgagggc

SEQ ID NO: 4099605 - DNA, 22 bp, Homo sapiens
tctcctttgctgaggcctccag

SEQ ID NO: 4099606 - DNA, 19 bp, Homo sapiens
tctccttttcctctctccc

SEQ ID NO: 4099607 - DNA, 14 bp, Homo sapiens
tctcgatctcctga

SEQ ID NO: 4099608 - DNA, 19 bp, Homo sapiens
tctcggctcaggctctgct

SEQ ID NO: 4099609 - DNA, 20 bp, Homo sapiens
tctcggctcaggctctgctg

SEQ ID NO: 4099610 - DNA, 20 bp, Homo sapiens
tctcgtgagtcatttaaatg

SEQ ID NO: 4099611 - DNA, 18 bp, Homo sapiens
tctcgtgggagagccatc

SEQ ID NO: 4099612 - DNA, 13 bp, Homo sapiens
tctctaacttatt

SEQ ID NO: 4099613 - DNA, 22 bp, Homo sapiens
tctctaacttcaaggcccatat

SEQ ID NO: 4099614 - DNA, 20 bp, Homo sapiens
tctctacagacttctccaga

SEQ ID NO: 4099615 - DNA, 23 bp, Homo sapiens
tctagctagaaatatgattttat

SEQ ID NO: 4099616 - DNA, 16 bp, Homo sapiens
tctagctctctaggcc

SEQ ID NO: 4099617 - DNA, 13 bp, Homo sapiens
tctaggatgtgga

SEQ ID NO: 4099618 - DNA, 18 bp, Homo sapiens
tctaggtctcctcagggt

SEQ ID NO: 4099619 - DNA, 17 bp, Homo sapiens
tctaggtggagttgaaa

SEQ ID NO: 4099620 - DNA, 19 bp, Homo sapiens
tctaggtggagttgaaaga

SEQ ID NO: 4099621 - DNA, 19 bp, Homo sapiens
tctagtaagatgcactgaa

SEQ ID NO: 4099622 - DNA, 20 bp, Homo sapiens
tctagtctcctttgcactga

SEQ ID NO: 4099623 - DNA, 14 bp, Homo sapiens
tctagtcttggcca

SEQ ID NO: 4099624 - DNA, 18 bp, Homo sapiens
tctagtgaggaagacaag

SEQ ID NO: 4099625 - DNA, 24 bp, Homo sapiens
tctagtgggacagcccagagcctg

SEQ ID NO: 4099626 - DNA, 23 bp, Homo sapiens
tctagtggtctttgtaagagtgt

SEQ ID NO: 4099627 - DNA, 20 bp, Homo sapiens
tctataaagaagaacttgca

SEQ ID NO: 4099628 - DNA, 15 bp, Homo sapiens
tctataaagaaggat

SEQ ID NO: 4099629 - DNA, 15 bp, Homo sapiens
tctatacatctctcc

SEQ ID NO: 4099630 - DNA, 18 bp, Homo sapiens
tctatacatctctcccca

SEQ ID NO: 4099631 - DNA, 16 bp, Homo sapiens
tctataccaaccaaac

SEQ ID NO: 4099632 - DNA, 21 bp, Homo sapiens
tctataggaacatatgaaaat

SEQ ID NO: 4099633 - DNA, 22 bp, Homo sapiens
tctatcaagtcaatcatttctc

SEQ ID NO: 4099634 - DNA, 20 bp, Homo sapiens
tctatcagtacttttattaa

SEQ ID NO: 4099635 - DNA, 20 bp, Homo sapiens
tctatcatggaatatttata

SEQ ID NO: 4099636 - DNA, 18 bp, Homo sapiens
tctatccaaatctgaaga

SEQ ID NO: 4099637 - DNA, 20 bp, Homo sapiens
tctatcgagtttgcaatgtc

SEQ ID NO: 4099638 - DNA, 14 bp, Homo sapiens
tctatctaaatgat

SEQ ID NO: 4099639 - DNA, 12 bp, Homo sapiens
tctatctcatct

SEQ ID NO: 4099640 - DNA, 18 bp, Homo sapiens
tctatggttatgaaagaa

SEQ ID NO: 4099641 - DNA, 14 bp, Homo sapiens
tctatgttaaatac

SEQ ID NO: 4099642 - DNA, 18 bp, Homo sapiens
tctatgttaaatactgtg

SEQ ID NO: 4099643 - DNA, 20 bp, Homo sapiens
tctatgttaaatactgtgca

SEQ ID NO: 4099644 - DNA, 14 bp, Homo sapiens
tctattaaagtgac

SEQ ID NO: 4099645 - DNA, 20 bp, Homo sapiens
tctattaaagtgactttcta

SEQ ID NO: 4099646 - DNA, 12 bp, Homo sapiens
tctattaatata

SEQ ID NO: 4099647 - DNA, 13 bp, Homo sapiens
tctattaatatat

SEQ ID NO: 4099648 - DNA, 12 bp, Homo sapiens
tctattattatg

SEQ ID NO: 4099649 - DNA, 14 bp, Homo sapiens
tctattattatgaa

SEQ ID NO: 4099650 - DNA, 16 bp, Homo sapiens
tctattcagacaagca

SEQ ID NO: 4099651 - DNA, 17 bp, Homo sapiens
tctattctctgcaattt

SEQ ID NO: 4099652 - DNA, 13 bp, Homo sapiens
tctattctgtcag

SEQ ID NO: 4099653 - DNA, 17 bp, Homo sapiens
tctattctgtgttgcat

SEQ ID NO: 4099654 - DNA, 21 bp, Homo sapiens
tctattgccttctttgaagaa

SEQ ID NO: 4099655 - DNA, 16 bp, Homo sapiens
tctattgcttcaccat

SEQ ID NO: 4099656 - DNA, 15 bp, Homo sapiens
tctattgggttcatt

SEQ ID NO: 4099657 - DNA, 22 bp, Homo sapiens
tctattgggttcattattggaa

SEQ ID NO: 4099658 - DNA, 13 bp, Homo sapiens
tctatttatatgt

SEQ ID NO: 4099659 - DNA, 14 bp, Homo sapiens
tctatttatgcctt

SEQ ID NO: 4099660 - DNA, 16 bp, Homo sapiens
tctatttattaatatt

SEQ ID NO: 4099661 - DNA, 15 bp, Homo sapiens
tctatttatttactg

SEQ ID NO: 4099662 - DNA, 22 bp, Homo sapiens
tctatttatttactgagcttct

SEQ ID NO: 4099663 - DNA, 16 bp, Homo sapiens
tctatttcatgttttt

SEQ ID NO: 4099664 - DNA, 20 bp, Homo sapiens
tctattttactttgtacttg

SEQ ID NO: 4099665 - DNA, 15 bp, Homo sapiens
tctattttggattgt

SEQ ID NO: 4099666 - DNA, 18 bp, Homo sapiens
tctattttggattgtata

SEQ ID NO: 4099667 - DNA, 20 bp, Homo sapiens
tctatttttatcatgaattc

SEQ ID NO: 4099668 - DNA, 13 bp, Homo sapiens
tctatttttgtct

SEQ ID NO: 4099669 - DNA, 19 bp, Homo sapiens
tctatttttttaactgaaa

SEQ ID NO: 4099670 - DNA, 21 bp, Homo sapiens
tctatttttttaactgaaaat

SEQ ID NO: 4099671 - DNA, 15 bp, Homo sapiens
tctcaaaaatacaaa

SEQ ID NO: 4099672 - DNA, 18 bp, Homo sapiens
tctcaaaagcatttatca

SEQ ID NO: 4099673 - DNA, 18 bp, Homo sapiens
tctcaaacttgtggcctc

SEQ ID NO: 4099674 - DNA, 16 bp, Homo sapiens
tctcaaagtaaggctg

SEQ ID NO: 4099675 - DNA, 17 bp, Homo sapiens
tctcaagagggcactgg

SEQ ID NO: 4099676 - DNA, 22 bp, Homo sapiens
tctcaagatgggggcagggctg

SEQ ID NO: 4099677 - DNA, 23 bp, Homo sapiens
tctcaagggctagcatccctgag

SEQ ID NO: 4099678 - DNA, 18 bp, Homo sapiens
tctcaataatataataat

SEQ ID NO: 4099679 - DNA, 23 bp, Homo sapiens
tctcaatcctaatttctcctccc

SEQ ID NO: 4099680 - DNA, 13 bp, Homo sapiens
tctcacagtgtgg

SEQ ID NO: 4099681 - DNA, 20 bp, Homo sapiens
tctcacagtgtggggcagcc

SEQ ID NO: 4099682 - DNA, 12 bp, Homo sapiens
tctcaccaggaa

SEQ ID NO: 4099683 - DNA, 15 bp, Homo sapiens
tctcaccaggaaggg

SEQ ID NO: 4099684 - DNA, 16 bp, Homo sapiens
tctcacccataaacag

SEQ ID NO: 4099685 - DNA, 20 bp, Homo sapiens
tctcacccattatctggaat

SEQ ID NO: 4099686 - DNA, 15 bp, Homo sapiens
tctcaccccatccca

SEQ ID NO: 4099687 - DNA, 19 bp, Homo sapiens
tctcacccccatccctggg

SEQ ID NO: 4099688 - DNA, 20 bp, Homo sapiens
tctcacctccgaactgttca

SEQ ID NO: 4099689 - DNA, 15 bp, Homo sapiens
tctcactagtgccaa

SEQ ID NO: 4099690 - DNA, 14 bp, Homo sapiens
tctcactcctagga

SEQ ID NO: 4099691 - DNA, 14 bp, Homo sapiens
tctcactgaactcc

SEQ ID NO: 4099692 - DNA, 13 bp, Homo sapiens
tctcactgttctg

SEQ ID NO: 4099693 - DNA, 15 bp, Homo sapiens
tctcacttagtcctt

SEQ ID NO: 4099694 - DNA, 11 bp, Homo sapiens
tctcagaaagt

SEQ ID NO: 4099695 - DNA, 21 bp, Homo sapiens
tctcagaaagtgcctgacaca

SEQ ID NO: 4099696 - DNA, 17 bp, Homo sapiens
tctcagaccctttagcc

SEQ ID NO: 4099697 - DNA, 16 bp, Homo sapiens
tctcagactgcatgta

SEQ ID NO: 4099698 - DNA, 15 bp, Homo sapiens
tctcagagcatctgg

SEQ ID NO: 4099699 - DNA, 17 bp, Homo sapiens
tctcagagcatctggct

SEQ ID NO: 4099700 - DNA, 13 bp, Homo sapiens
tctcagagccaag

SEQ ID NO: 4099701 - DNA, 15 bp, Homo sapiens
tctcagaggcctgct

SEQ ID NO: 4099702 - DNA, 22 bp, Homo sapiens
tctcagcacagcctggggaggg

SEQ ID NO: 4099703 - DNA, 12 bp, Homo sapiens
tctcagcctcct

SEQ ID NO: 4099704 - DNA, 18 bp, Homo sapiens
tctcagcctcctgagcct

SEQ ID NO: 4099705 - DNA, 19 bp, Homo sapiens
tctcagcctcctgagcctg

SEQ ID NO: 4099706 - DNA, 21 bp, Homo sapiens
tctcagctgccaaccctcccg

SEQ ID NO: 4099707 - DNA, 15 bp, Homo sapiens
tctcaggagatggag

SEQ ID NO: 4099708 - DNA, 16 bp, Homo sapiens
tctcaggagatggagg

SEQ ID NO: 4099709 - DNA, 22 bp, Homo sapiens
tctcaggagatggagggcttgg

SEQ ID NO: 4099710 - DNA, 11 bp, Homo sapiens
tctcagggcag

SEQ ID NO: 4099711 - DNA, 14 bp, Homo sapiens
tctcagtcatgcat

SEQ ID NO: 4099712 - DNA, 23 bp, Homo sapiens
tctcagtgcttcttactattaag

SEQ ID NO: 4099713 - DNA, 22 bp, Homo sapiens
tctcagtgttgagccttttccc

SEQ ID NO: 4099714 - DNA, 19 bp, Homo sapiens
tctcagtgttttggactcc

SEQ ID NO: 4099715 - DNA, 16 bp, Homo sapiens
tctcagttctctccct

SEQ ID NO: 4099716 - DNA, 13 bp, Homo sapiens
tctcagtttcact

SEQ ID NO: 4099717 - DNA, 15 bp, Homo sapiens
tctcataattttgca

SEQ ID NO: 4099718 - DNA, 20 bp, Homo sapiens
tctcatagcattaactaatc

SEQ ID NO: 4099719 - DNA, 16 bp, Homo sapiens
tcgtgctactgcactc

SEQ ID NO: 4099720 - DNA, 22 bp, Homo sapiens
tcgtgctactgcactccagcct

SEQ ID NO: 4099721 - DNA, 20 bp, Homo sapiens
tcgtggctttggcagtgttt

SEQ ID NO: 4099722 - DNA, 17 bp, Homo sapiens
tcgttaaaaagttgttt

SEQ ID NO: 4099723 - DNA, 15 bp, Homo sapiens
tcgttaactgtgtat

SEQ ID NO: 4099724 - DNA, 20 bp, Homo sapiens
tcgtttgtttgtttgtttaa

SEQ ID NO: 4099725 - DNA, 16 bp, Homo sapiens
tcgtttttcagcaccc

SEQ ID NO: 4099726 - DNA, 17 bp, Homo sapiens
tctaaaaaacattttta

SEQ ID NO: 4099727 - DNA, 15 bp, Homo sapiens
tctaaaaataaagct

SEQ ID NO: 4099728 - DNA, 13 bp, Homo sapiens
tctaaaacaaaat

SEQ ID NO: 4099729 - DNA, 16 bp, Homo sapiens
tctaaaacaaaatctg

SEQ ID NO: 4099730 - DNA, 21 bp, Homo sapiens
tctaaaactatggttcccaat

SEQ ID NO: 4099731 - DNA, 23 bp, Homo sapiens
tctaaaactatggttcccaataa

SEQ ID NO: 4099732 - DNA, 17 bp, Homo sapiens
tctaaaagcagaaaata

SEQ ID NO: 4099733 - DNA, 14 bp, Homo sapiens
tctaaaagctctgt

SEQ ID NO: 4099734 - DNA, 14 bp, Homo sapiens
tctaaaattacata

SEQ ID NO: 4099735 - DNA, 16 bp, Homo sapiens
tctaaacaaaattgca

SEQ ID NO: 4099736 - DNA, 18 bp, Homo sapiens
tctaaacaaaattgcaat

SEQ ID NO: 4099737 - DNA, 14 bp, Homo sapiens
tctaaactgcaaac

SEQ ID NO: 4099738 - DNA, 17 bp, Homo sapiens
tctaaacttccccatct

SEQ ID NO: 4099739 - DNA, 15 bp, Homo sapiens
tctaaagagcactta

SEQ ID NO: 4099740 - DNA, 22 bp, Homo sapiens
tctaaagatcaagtgggccttg

SEQ ID NO: 4099741 - DNA, 17 bp, Homo sapiens
tctaaagctgaatgtca

SEQ ID NO: 4099742 - DNA, 19 bp, Homo sapiens
tctaaatctatttattaat

SEQ ID NO: 4099743 - DNA, 12 bp, Homo sapiens
tctaacaagtca

SEQ ID NO: 4099744 - DNA, 17 bp, Homo sapiens
tctaaccacagctcctt

SEQ ID NO: 4099745 - DNA, 20 bp, Homo sapiens
tctaaccacagctccttttc

SEQ ID NO: 4099746 - DNA, 16 bp, Homo sapiens
tctaacccaactgact

SEQ ID NO: 4099747 - DNA, 18 bp, Homo sapiens
tctaacccccagctgggt

SEQ ID NO: 4099748 - DNA, 22 bp, Homo sapiens
tctaaccccctctgctctgtcc

SEQ ID NO: 4099749 - DNA, 12 bp, Homo sapiens
tctaaccttgaa

SEQ ID NO: 4099750 - DNA, 20 bp, Homo sapiens
tctaaccttgaatgctgcca

SEQ ID NO: 4099751 - DNA, 22 bp, Homo sapiens
tctaaccttgaatgctgccagt

SEQ ID NO: 4099752 - DNA, 14 bp, Homo sapiens
tctaactcagaatt

SEQ ID NO: 4099753 - DNA, 18 bp, Homo sapiens
tctaactcagaattattt

SEQ ID NO: 4099754 - DNA, 13 bp, Homo sapiens
tctaactttagaa

SEQ ID NO: 4099755 - DNA, 21 bp, Homo sapiens
tctaagatagtaacaatgaag

SEQ ID NO: 4099756 - DNA, 16 bp, Homo sapiens
tctaagccagttttca

SEQ ID NO: 4099757 - DNA, 17 bp, Homo sapiens
tctaagcctttccataa

SEQ ID NO: 4099758 - DNA, 18 bp, Homo sapiens
tctaagcctttccataag

SEQ ID NO: 4099759 - DNA, 16 bp, Homo sapiens
tctaagctcagtgctc

SEQ ID NO: 4099760 - DNA, 15 bp, Homo sapiens
tctaaggtctatcaa

SEQ ID NO: 4099761 - DNA, 19 bp, Homo sapiens
tctaagtacatatgtagat

SEQ ID NO: 4099762 - DNA, 17 bp, Homo sapiens
tctaatatcattcacta

SEQ ID NO: 4099763 - DNA, 15 bp, Homo sapiens
tctaatccttttcct

SEQ ID NO: 4099764 - DNA, 18 bp, Homo sapiens
tctaatccttttccttat

SEQ ID NO: 4099765 - DNA, 14 bp, Homo sapiens
tctaatctgagctg

SEQ ID NO: 4099766 - DNA, 14 bp, Homo sapiens
tctaatgcttgttt

SEQ ID NO: 4099767 - DNA, 20 bp, Homo sapiens
tctaatgcttgtttatgata

SEQ ID NO: 4099768 - DNA, 19 bp, Homo sapiens
tctaattcccattttgcaa

SEQ ID NO: 4099769 - DNA, 21 bp, Homo sapiens
tctaattcccattttgcaaaa

SEQ ID NO: 4099770 - DNA, 22 bp, Homo sapiens
tctaattcccattttgcaaaat

SEQ ID NO: 4099771 - DNA, 19 bp, Homo sapiens
tctaatttcaaaaatataa

SEQ ID NO: 4099772 - DNA, 20 bp, Homo sapiens
tctaatttcaaaaatataac

SEQ ID NO: 4099773 - DNA, 22 bp, Homo sapiens
tctaatttcaaaaatataactt

SEQ ID NO: 4099774 - DNA, 13 bp, Homo sapiens
tctacaaccagag

SEQ ID NO: 4099775 - DNA, 23 bp, Homo sapiens
tctacaaccagagccccccacaa

SEQ ID NO: 4099776 - DNA, 23 bp, Homo sapiens
tctacaagccaaaagtccctccc

SEQ ID NO: 4099777 - DNA, 17 bp, Homo sapiens
tctacaagtatatgtga

SEQ ID NO: 4099778 - DNA, 15 bp, Homo sapiens
tctacaatgtgaact

SEQ ID NO: 4099779 - DNA, 13 bp, Homo sapiens
tctacacagcctg

SEQ ID NO: 4099780 - DNA, 16 bp, Homo sapiens
tctacacagcctggac

SEQ ID NO: 4099781 - DNA, 18 bp, Homo sapiens
tctacagacttctccaga

SEQ ID NO: 4099782 - DNA, 23 bp, Homo sapiens
tctacagctaatcagcattctca

SEQ ID NO: 4099783 - DNA, 12 bp, Homo sapiens
tctacagctccc

SEQ ID NO: 4099784 - DNA, 15 bp, Homo sapiens
tctacagctccccca

SEQ ID NO: 4099785 - DNA, 20 bp, Homo sapiens
tctacagctcccccagctcc

SEQ ID NO: 4099786 - DNA, 12 bp, Homo sapiens
tctacagtggtt

SEQ ID NO: 4099787 - DNA, 23 bp, Homo sapiens
tctacatactttcatcctgactc

SEQ ID NO: 4099788 - DNA, 19 bp, Homo sapiens
tctacatggctttgataat

SEQ ID NO: 4099789 - DNA, 16 bp, Homo sapiens
tctaccagttggcaga

SEQ ID NO: 4099790 - DNA, 15 bp, Homo sapiens
tctacccatattaca

SEQ ID NO: 4099791 - DNA, 15 bp, Homo sapiens
tctaccctcccaccc

SEQ ID NO: 4099792 - DNA, 19 bp, Homo sapiens
tctaccctggcactataat

SEQ ID NO: 4099793 - DNA, 21 bp, Homo sapiens
tctacctaatgtctcactgtt

SEQ ID NO: 4099794 - DNA, 15 bp, Homo sapiens
tctacctcaggcagc

SEQ ID NO: 4099795 - DNA, 12 bp, Homo sapiens
tctacctgccct

SEQ ID NO: 4099796 - DNA, 22 bp, Homo sapiens
tctacctgtacacattcctgca

SEQ ID NO: 4099797 - DNA, 15 bp, Homo sapiens
tctactaaaaatgca

SEQ ID NO: 4099798 - DNA, 12 bp, Homo sapiens
tctactcctgcc

SEQ ID NO: 4099799 - DNA, 14 bp, Homo sapiens
tctactcctgcctc

SEQ ID NO: 4099800 - DNA, 19 bp, Homo sapiens
tctactccttgtaaagact

SEQ ID NO: 4099801 - DNA, 19 bp, Homo sapiens
tctactctgtcttaaatga

SEQ ID NO: 4099802 - DNA, 15 bp, Homo sapiens
tctactctttttgtt

SEQ ID NO: 4099803 - DNA, 22 bp, Homo sapiens
tctactgaggtgctatgttctt

SEQ ID NO: 4099804 - DNA, 20 bp, Homo sapiens
tctactgtaagaagagccat

SEQ ID NO: 4099805 - DNA, 19 bp, Homo sapiens
tctagaaccacttcctgct

SEQ ID NO: 4099806 - DNA, 18 bp, Homo sapiens
tctagaacttgaccccct

SEQ ID NO: 4099807 - DNA, 18 bp, Homo sapiens
tctagaagtttcccttcc

SEQ ID NO: 4099808 - DNA, 20 bp, Homo sapiens
tctagaagtttcccttcctc

SEQ ID NO: 4099809 - DNA, 16 bp, Homo sapiens
tctagaatgtggattt

SEQ ID NO: 4099810 - DNA, 23 bp, Homo sapiens
tctagaattataagtcacaaaga

SEQ ID NO: 4099811 - DNA, 19 bp, Homo sapiens
tctagaatttatcacactt

SEQ ID NO: 4099812 - DNA, 17 bp, Homo sapiens
tctagacaagatattgt

SEQ ID NO: 4099813 - DNA, 18 bp, Homo sapiens
tctagacaagatattgta

SEQ ID NO: 4099814 - DNA, 15 bp, Homo sapiens
tctagacactttttc

SEQ ID NO: 4099815 - DNA, 21 bp, Homo sapiens
tctagagaagtggactggagg

SEQ ID NO: 4099816 - DNA, 15 bp, Homo sapiens
tctagagcagggatt

SEQ ID NO: 4099817 - DNA, 23 bp, Homo sapiens
tctagaggtcaggacggctcctc

SEQ ID NO: 4099818 - DNA, 23 bp, Homo sapiens
tctagatgaagttttacattgtt

SEQ ID NO: 4099819 - DNA, 23 bp, Homo sapiens
tctagcaatcacaacactggctg

SEQ ID NO: 4099820 - DNA, 15 bp, Homo sapiens
tctagcacttccttg

SEQ ID NO: 4099821 - DNA, 17 bp, Homo sapiens
tctagcacttccttgcc

SEQ ID NO: 4099822 - DNA, 12 bp, Homo sapiens
tcgaaataacaa

SEQ ID NO: 4099823 - DNA, 21 bp, Homo sapiens
tcgaaatagatatcctctccc

SEQ ID NO: 4099824 - DNA, 17 bp, Homo sapiens
tcgaatcttaatttatt

SEQ ID NO: 4099825 - DNA, 18 bp, Homo sapiens
tcgacagggcctggagcc

SEQ ID NO: 4099826 - DNA, 16 bp, Homo sapiens
tcgacataccccactg

SEQ ID NO: 4099827 - DNA, 19 bp, Homo sapiens
tcgacataccccactgggc

SEQ ID NO: 4099828 - DNA, 19 bp, Homo sapiens
tcgacccagaatggagcct

SEQ ID NO: 4099829 - DNA, 20 bp, Homo sapiens
tcgacccagaatggagcctg

SEQ ID NO: 4099830 - DNA, 15 bp, Homo sapiens
tcgagaccatcctgg

SEQ ID NO: 4099831 - DNA, 16 bp, Homo sapiens
tcgagaccatcctggc

SEQ ID NO: 4099832 - DNA, 18 bp, Homo sapiens
tcgagaccatcctggcta

SEQ ID NO: 4099833 - DNA, 19 bp, Homo sapiens
tcgagaccatcctggctaa

SEQ ID NO: 4099834 - DNA, 17 bp, Homo sapiens
tcgagcagtcctgcctc

SEQ ID NO: 4099835 - DNA, 13 bp, Homo sapiens
tcgagcccagatg

SEQ ID NO: 4099836 - DNA, 19 bp, Homo sapiens
tcgagctccccccaggtct

SEQ ID NO: 4099837 - DNA, 14 bp, Homo sapiens
tcgaggagtaacaa

SEQ ID NO: 4099838 - DNA, 15 bp, Homo sapiens
tcgaggcctgaagcc

SEQ ID NO: 4099839 - DNA, 22 bp, Homo sapiens
tcgagttggcaaaatggggttt

SEQ ID NO: 4099840 - DNA, 22 bp, Homo sapiens
tcgatatgtatatcattctaca

SEQ ID NO: 4099841 - DNA, 12 bp, Homo sapiens
tcgatctcctga

SEQ ID NO: 4099842 - DNA, 18 bp, Homo sapiens
tcgatgcgttcactccaa

SEQ ID NO: 4099843 - DNA, 23 bp, Homo sapiens
tcgattgaaggtgacctctgccc

SEQ ID NO: 4099844 - DNA, 15 bp, Homo sapiens
tcgatttctccagga

SEQ ID NO: 4099845 - DNA, 12 bp, Homo sapiens
tcgcacactggg

SEQ ID NO: 4099846 - DNA, 21 bp, Homo sapiens
tcgcaccactgtgtatttaac

SEQ ID NO: 4099847 - DNA, 17 bp, Homo sapiens
tcgcaccattctcctgc

SEQ ID NO: 4099848 - DNA, 19 bp, Homo sapiens
tcgcacccccctgttctaa

SEQ ID NO: 4099849 - DNA, 17 bp, Homo sapiens
tcgcacctgtgctggag

SEQ ID NO: 4099850 - DNA, 18 bp, Homo sapiens
tcgcacctgtgctggagc

SEQ ID NO: 4099851 - DNA, 19 bp, Homo sapiens
tcgcagaccagagctgtct

SEQ ID NO: 4099852 - DNA, 21 bp, Homo sapiens
tcgcagaccagagctgtctga

SEQ ID NO: 4099853 - DNA, 19 bp, Homo sapiens
tcgcatggtcacacactga

SEQ ID NO: 4099854 - DNA, 13 bp, Homo sapiens
tcgcatttgtcaa

SEQ ID NO: 4099855 - DNA, 15 bp, Homo sapiens
tcgcatttgtcaatg

SEQ ID NO: 4099856 - DNA, 15 bp, Homo sapiens
tcgccaacatggtga

SEQ ID NO: 4099857 - DNA, 12 bp, Homo sapiens
tcgcccagcagg

SEQ ID NO: 4099858 - DNA, 11 bp, Homo sapiens
tcgcccaggag

SEQ ID NO: 4099859 - DNA, 12 bp, Homo sapiens
tcgcccaggaga

SEQ ID NO: 4099860 - DNA, 19 bp, Homo sapiens
tcgcccaggctggagtgca

SEQ ID NO: 4099861 - DNA, 15 bp, Homo sapiens
tcgccccagatcacc

SEQ ID NO: 4099862 - DNA, 20 bp, Homo sapiens
tcgccccagcaggtgctgac

SEQ ID NO: 4099863 - DNA, 20 bp, Homo sapiens
tcgccccaggccctccctga

SEQ ID NO: 4099864 - DNA, 18 bp, Homo sapiens
tcgccctcctttctgtgc

SEQ ID NO: 4099865 - DNA, 13 bp, Homo sapiens
tcgccctggcagg

SEQ ID NO: 4099866 - DNA, 17 bp, Homo sapiens
tcgccctggcaggcagg

SEQ ID NO: 4099867 - DNA, 17 bp, Homo sapiens
tcgcctcggatcagctg

SEQ ID NO: 4099868 - DNA, 21 bp, Homo sapiens
tcgcctgacaaccactggtct

SEQ ID NO: 4099869 - DNA, 13 bp, Homo sapiens
tcgcctgcctgca

SEQ ID NO: 4099870 - DNA, 19 bp, Homo sapiens
tcgcctgcctgcagcaggc

SEQ ID NO: 4099871 - DNA, 18 bp, Homo sapiens
tcgcctgtcacccccact

SEQ ID NO: 4099872 - DNA, 19 bp, Homo sapiens
tcgcctgtcacccccactc

SEQ ID NO: 4099873 - DNA, 19 bp, Homo sapiens
tcgcctgtggagctcagcc

SEQ ID NO: 4099874 - DNA, 21 bp, Homo sapiens
tcgcctgtggagctcagcccc

SEQ ID NO: 4099875 - DNA, 19 bp, Homo sapiens
tcgccttccacctctggga

SEQ ID NO: 4099876 - DNA, 22 bp, Homo sapiens
tcgcctttcagcaggcagcctt

SEQ ID NO: 4099877 - DNA, 15 bp, Homo sapiens
tcgcgggcagcgggc

SEQ ID NO: 4099878 - DNA, 16 bp, Homo sapiens
tcgctgacttcatgga

SEQ ID NO: 4099879 - DNA, 18 bp, Homo sapiens
tcgctgtaccctttaaga

SEQ ID NO: 4099880 - DNA, 15 bp, Homo sapiens
tcgctgtcactggct

SEQ ID NO: 4099881 - DNA, 14 bp, Homo sapiens
tcggaacagcagat

SEQ ID NO: 4099882 - DNA, 19 bp, Homo sapiens
tcggaacccaagcttagaa

SEQ ID NO: 4099883 - DNA, 20 bp, Homo sapiens
tcggaacccaagcttagaac

SEQ ID NO: 4099884 - DNA, 13 bp, Homo sapiens
tcggaagcagtgc

SEQ ID NO: 4099885 - DNA, 19 bp, Homo sapiens
tcggacaagacccccagca

SEQ ID NO: 4099886 - DNA, 21 bp, Homo sapiens
tcggacagcccatctgcctgt

SEQ ID NO: 4099887 - DNA, 22 bp, Homo sapiens
tcggactaagcctacctgctct

SEQ ID NO: 4099888 - DNA, 15 bp, Homo sapiens
tcggagacagtgatc

SEQ ID NO: 4099889 - DNA, 21 bp, Homo sapiens
tcggagacagtgatctccata

SEQ ID NO: 4099890 - DNA, 14 bp, Homo sapiens
tcggagagcagcag

SEQ ID NO: 4099891 - DNA, 17 bp, Homo sapiens
tcggaggccccactgat

SEQ ID NO: 4099892 - DNA, 19 bp, Homo sapiens
tcggaggccccactgatgc

SEQ ID NO: 4099893 - DNA, 15 bp, Homo sapiens
tcggaggctgggccc

SEQ ID NO: 4099894 - DNA, 14 bp, Homo sapiens
tcggatcagctgag

SEQ ID NO: 4099895 - DNA, 16 bp, Homo sapiens
tcggatgacaccctgg

SEQ ID NO: 4099896 - DNA, 21 bp, Homo sapiens
tcggatgacaccctggcctga

SEQ ID NO: 4099897 - DNA, 20 bp, Homo sapiens
tcggatggaccaacctgctc

SEQ ID NO: 4099898 - DNA, 13 bp, Homo sapiens
tcggattttttcc

SEQ ID NO: 4099899 - DNA, 13 bp, Homo sapiens
tcggccctgccca

SEQ ID NO: 4099900 - DNA, 17 bp, Homo sapiens
tcggccgagctggtttc

SEQ ID NO: 4099901 - DNA, 12 bp, Homo sapiens
tcggcctcccaa

SEQ ID NO: 4099902 - DNA, 23 bp, Homo sapiens
tcggcttgtgggctggtgcccca

SEQ ID NO: 4099903 - DNA, 15 bp, Homo sapiens
tcgggaacagtgttt

SEQ ID NO: 4099904 - DNA, 14 bp, Homo sapiens
tcgggaagcagcca

SEQ ID NO: 4099905 - DNA, 13 bp, Homo sapiens
tcgggagcaccca

SEQ ID NO: 4099906 - DNA, 20 bp, Homo sapiens
tcgggagcacccagagcacc

SEQ ID NO: 4099907 - DNA, 14 bp, Homo sapiens
tcgggagcagtgtc

SEQ ID NO: 4099908 - DNA, 15 bp, Homo sapiens
tcgggagcagtgtct

SEQ ID NO: 4099909 - DNA, 16 bp, Homo sapiens
tcgggagcagtgtctt

SEQ ID NO: 4099910 - DNA, 23 bp, Homo sapiens
tcgggagcagtgtcttccataat

SEQ ID NO: 4099911 - DNA, 15 bp, Homo sapiens
tcgggcaccagccag

SEQ ID NO: 4099912 - DNA, 14 bp, Homo sapiens
tcgggccacagggc

SEQ ID NO: 4099913 - DNA, 20 bp, Homo sapiens
tcgggccccacctgcagctc

SEQ ID NO: 4099914 - DNA, 22 bp, Homo sapiens
tcgggccccatcctcatccctg

SEQ ID NO: 4099915 - DNA, 23 bp, Homo sapiens
tcgggccccatcctcatccctga

SEQ ID NO: 4099916 - DNA, 16 bp, Homo sapiens
tcgggccgaggcccag

SEQ ID NO: 4099917 - DNA, 21 bp, Homo sapiens
tcgtataacacaatatgaata

SEQ ID NO: 4099918 - DNA, 17 bp, Homo sapiens
tcgtccaccccccacac

SEQ ID NO: 4099919 - DNA, 20 bp, Homo sapiens
tcgtccaccccccacacaca

SEQ ID NO: 4099920 - DNA, 21 bp, Homo sapiens
tcgtccaccccccacacacac

SEQ ID NO: 4099921 - DNA, 18 bp, Homo sapiens
tcgtcgagctccccccag

SEQ ID NO: 4099922 - DNA, 19 bp, Homo sapiens
tcgtgagtcatttaaatgt

SEQ ID NO: 4099923 - DNA, 15 bp, Homo sapiens
tcgtgcactctgcta

SEQ ID NO: 4099924 - DNA, 18 bp, Homo sapiens
tcgtgcctgggggagaga

SEQ ID NO: 4099925 - DNA, 20 bp, Homo sapiens
tccttagaacattttaattc

SEQ ID NO: 4099926 - DNA, 15 bp, Homo sapiens
tccttagccctgtct

SEQ ID NO: 4099927 - DNA, 24 bp, Homo sapiens
tccttagggttttctctctatttc

SEQ ID NO: 4099928 - DNA, 17 bp, Homo sapiens
tccttagtcttctcata

SEQ ID NO: 4099929 - DNA, 18 bp, Homo sapiens
tccttagtcttctcatag

SEQ ID NO: 4099930 - DNA, 22 bp, Homo sapiens
tccttagtcttctcatagcatt

SEQ ID NO: 4099931 - DNA, 18 bp, Homo sapiens
tccttatagacacttgct

SEQ ID NO: 4099932 - DNA, 15 bp, Homo sapiens
tccttatcagagcta

SEQ ID NO: 4099933 - DNA, 18 bp, Homo sapiens
tccttatgtcctgtcata

SEQ ID NO: 4099934 - DNA, 19 bp, Homo sapiens
tccttatttgccttctact

SEQ ID NO: 4099935 - DNA, 15 bp, Homo sapiens
tccttcaaaatcctt

SEQ ID NO: 4099936 - DNA, 19 bp, Homo sapiens
tccttcaaaatccttccaa

SEQ ID NO: 4099937 - DNA, 20 bp, Homo sapiens
tccttcaacaaggcttgctg

SEQ ID NO: 4099938 - DNA, 20 bp, Homo sapiens
tccttcaagaactctgggct

SEQ ID NO: 4099939 - DNA, 14 bp, Homo sapiens
tccttcaccagagc

SEQ ID NO: 4099940 - DNA, 15 bp, Homo sapiens
tccttcaccagagcc

SEQ ID NO: 4099941 - DNA, 24 bp, Homo sapiens
tccttcatttccaccaggccgtgc

SEQ ID NO: 4099942 - DNA, 15 bp, Homo sapiens
tccttccaaagaatt

SEQ ID NO: 4099943 - DNA, 15 bp, Homo sapiens
tccttccatcaaata

SEQ ID NO: 4099944 - DNA, 14 bp, Homo sapiens
tccttcccacccct

SEQ ID NO: 4099945 - DNA, 20 bp, Homo sapiens
tccttcccacccctacacac

SEQ ID NO: 4099946 - DNA, 15 bp, Homo sapiens
tccttcccactctgt

SEQ ID NO: 4099947 - DNA, 14 bp, Homo sapiens
tccttccccaggat

SEQ ID NO: 4099948 - DNA, 15 bp, Homo sapiens
tccttccctctctga

SEQ ID NO: 4099949 - DNA, 19 bp, Homo sapiens
tccttccctctctgatgtc

SEQ ID NO: 4099950 - DNA, 17 bp, Homo sapiens
tccttcccttttctgtt

SEQ ID NO: 4099951 - DNA, 16 bp, Homo sapiens
tccttcctatgcccag

SEQ ID NO: 4099952 - DNA, 17 bp, Homo sapiens
tccttcctatgcccagg

SEQ ID NO: 4099953 - DNA, 17 bp, Homo sapiens
tccttcctggcctgaga

SEQ ID NO: 4099954 - DNA, 12 bp, Homo sapiens
tccttctctggg

SEQ ID NO: 4099955 - DNA, 14 bp, Homo sapiens
tccttctctgggtc

SEQ ID NO: 4099956 - DNA, 16 bp, Homo sapiens
tccttcttgtagtagt

SEQ ID NO: 4099957 - DNA, 13 bp, Homo sapiens
tccttctttgata

SEQ ID NO: 4099958 - DNA, 19 bp, Homo sapiens
tccttctttgataatgtta

SEQ ID NO: 4099959 - DNA, 22 bp, Homo sapiens
tccttctttgataatgttaaat

SEQ ID NO: 4099960 - DNA, 17 bp, Homo sapiens
tccttgagacacggagc

SEQ ID NO: 4099961 - DNA, 22 bp, Homo sapiens
tccttgcacccctcactctggc

SEQ ID NO: 4099962 - DNA, 24 bp, Homo sapiens
tccttgcacccctcactctggcct

SEQ ID NO: 4099963 - DNA, 13 bp, Homo sapiens
tccttgcgcctca

SEQ ID NO: 4099964 - DNA, 18 bp, Homo sapiens
tccttgcgcctcagccct

SEQ ID NO: 4099965 - DNA, 23 bp, Homo sapiens
tccttgcgcctcagccctcagtt

SEQ ID NO: 4099966 - DNA, 18 bp, Homo sapiens
tccttggattttcctgaa

SEQ ID NO: 4099967 - DNA, 22 bp, Homo sapiens
tccttggattttcctgaaagtg

SEQ ID NO: 4099968 - DNA, 18 bp, Homo sapiens
tccttgggtcattgacct

SEQ ID NO: 4099969 - DNA, 20 bp, Homo sapiens
tccttgggtcattgacctct

SEQ ID NO: 4099970 - DNA, 22 bp, Homo sapiens
tccttgggtcattgacctctca

SEQ ID NO: 4099971 - DNA, 16 bp, Homo sapiens
tccttggtctttgtat

SEQ ID NO: 4099972 - DNA, 17 bp, Homo sapiens
tccttggtctttgtatc

SEQ ID NO: 4099973 - DNA, 19 bp, Homo sapiens
tccttgtaaaatattttca

SEQ ID NO: 4099974 - DNA, 15 bp, Homo sapiens
tccttgtccacccac

SEQ ID NO: 4099975 - DNA, 16 bp, Homo sapiens
tccttgtccacccacc

SEQ ID NO: 4099976 - DNA, 23 bp, Homo sapiens
tccttgtcccgtctggacctggg

SEQ ID NO: 4099977 - DNA, 16 bp, Homo sapiens
tccttgttggtcagag

SEQ ID NO: 4099978 - DNA, 17 bp, Homo sapiens
tccttgttgtttgcttt

SEQ ID NO: 4099979 - DNA, 13 bp, Homo sapiens
tccttgtttatca

SEQ ID NO: 4099980 - DNA, 21 bp, Homo sapiens
tcctttaaaaaaatttaagtg

SEQ ID NO: 4099981 - DNA, 15 bp, Homo sapiens
tcctttaaaaaagaa

SEQ ID NO: 4099982 - DNA, 18 bp, Homo sapiens
tcctttaaaaaagaaaag

SEQ ID NO: 4099983 - DNA, 16 bp, Homo sapiens
tcctttaaagatgaac

SEQ ID NO: 4099984 - DNA, 21 bp, Homo sapiens
tcctttacaaaagaaatacct

SEQ ID NO: 4099985 - DNA, 22 bp, Homo sapiens
tcctttacaaaagaaatacctt

SEQ ID NO: 4099986 - DNA, 23 bp, Homo sapiens
tcctttaggagggagttatctaa

SEQ ID NO: 4099987 - DNA, 16 bp, Homo sapiens
tcctttaggtaagaag

SEQ ID NO: 4099988 - DNA, 14 bp, Homo sapiens
tcctttatactgtg

SEQ ID NO: 4099989 - DNA, 15 bp, Homo sapiens
tcctttatgtgaatt

SEQ ID NO: 4099990 - DNA, 16 bp, Homo sapiens
tcctttatgtgaattt

SEQ ID NO: 4099991 - DNA, 17 bp, Homo sapiens
tcctttatgtgaatttt

SEQ ID NO: 4099992 - DNA, 20 bp, Homo sapiens
tcctttatgtgaatttttaa

SEQ ID NO: 4099993 - DNA, 20 bp, Homo sapiens
tcctttcacaaccttctgtg

SEQ ID NO: 4099994 - DNA, 16 bp, Homo sapiens
tcctttctccagccag

SEQ ID NO: 4099995 - DNA, 13 bp, Homo sapiens
tcctttctctttc

SEQ ID NO: 4099996 - DNA, 13 bp, Homo sapiens
tcctttctgccca

SEQ ID NO: 4099997 - DNA, 13 bp, Homo sapiens
tcctttctgtgcc

SEQ ID NO: 4099998 - DNA, 16 bp, Homo sapiens
tcctttctgtgcccta

SEQ ID NO: 4099999 - DNA, 17 bp, Homo sapiens
tcctttctgtgccctac

SEQ ID NO: 4100000 - DNA, 13 bp, Homo sapiens
tcctttcttttcc

SEQ ID NO: 4100001 - DNA, 22 bp, Homo sapiens
tcctttgatcagtataattttt

SEQ ID NO: 4100002 - DNA, 17 bp, Homo sapiens
tcctttgcagggcagcc

SEQ ID NO: 4100003 - DNA, 18 bp, Homo sapiens
tcctttgcagggcagccc

SEQ ID NO: 4100004 - DNA, 17 bp, Homo sapiens
tcctttgcgcctgtgac

SEQ ID NO: 4100005 - DNA, 21 bp, Homo sapiens
tcctttgtcttcaaactgtga

SEQ ID NO: 4100006 - DNA, 15 bp, Homo sapiens
tcctttgtgaatatt

SEQ ID NO: 4100007 - DNA, 17 bp, Homo sapiens
tcctttgtgcttagtta

SEQ ID NO: 4100008 - DNA, 22 bp, Homo sapiens
tcctttgtgtgtgtgtcagctg

SEQ ID NO: 4100009 - DNA, 16 bp, Homo sapiens
tcctttgttctgagca

SEQ ID NO: 4100010 - DNA, 12 bp, Homo sapiens
tccttttaactg

SEQ ID NO: 4100011 - DNA, 15 bp, Homo sapiens
tccttttataggtga

SEQ ID NO: 4100012 - DNA, 22 bp, Homo sapiens
tccttttcccctacagaatttt

SEQ ID NO: 4100013 - DNA, 15 bp, Homo sapiens
tccttttccctgctt

SEQ ID NO: 4100014 - DNA, 11 bp, Homo sapiens
tccttttccta

SEQ ID NO: 4100015 - DNA, 13 bp, Homo sapiens
tccttttctttaa

SEQ ID NO: 4100016 - DNA, 15 bp, Homo sapiens
tccttttgggaagaa

SEQ ID NO: 4100017 - DNA, 18 bp, Homo sapiens
tccttttgtgtacagtgt

SEQ ID NO: 4100018 - DNA, 14 bp, Homo sapiens
tcctttttaaatgt

SEQ ID NO: 4100019 - DNA, 17 bp, Homo sapiens
tcctttttaaatgtgaa

SEQ ID NO: 4100020 - DNA, 19 bp, Homo sapiens
tcctttttaaatgtgaatt

SEQ ID NO: 4100021 - DNA, 18 bp, Homo sapiens
tcctttttccatcatttt

SEQ ID NO: 4100022 - DNA, 14 bp, Homo sapiens
tcctttttctttat

SEQ ID NO: 4100023 - DNA, 19 bp, Homo sapiens
tcctttttctttataaact

SEQ ID NO: 4100024 - DNA, 14 bp, Homo sapiens
tccttttttataca

SEQ ID NO: 4100025 - DNA, 13 bp, Homo sapiens
tcgaaacacagaa

SEQ ID NO: 4100026 - DNA, 18 bp, Homo sapiens
tcgaaacacagaaacctt

SEQ ID NO: 4100027 - DNA, 13 bp, Homo sapiens
tcgaaactgccaa

SEQ ID NO: 4100028 - DNA, 18 bp, Homo sapiens
tcctgaggctttggattt

SEQ ID NO: 4100029 - DNA, 15 bp, Homo sapiens
tcctgaggggcatct

SEQ ID NO: 4100030 - DNA, 19 bp, Homo sapiens
tcctgaggggcatctgccc

SEQ ID NO: 4100031 - DNA, 20 bp, Homo sapiens
tcctgaggggcatctgcccc

SEQ ID NO: 4100032 - DNA, 19 bp, Homo sapiens
tcctgagggtccccacctg

SEQ ID NO: 4100033 - DNA, 15 bp, Homo sapiens
tcctgagtggtgcca

SEQ ID NO: 4100034 - DNA, 17 bp, Homo sapiens
tcctgataataattgat

SEQ ID NO: 4100035 - DNA, 21 bp, Homo sapiens
tcctgattggtttctcttctc

SEQ ID NO: 4100036 - DNA, 17 bp, Homo sapiens
tcctgcaattctacagt

SEQ ID NO: 4100037 - DNA, 17 bp, Homo sapiens
tcctgcagccccagaag

SEQ ID NO: 4100038 - DNA, 19 bp, Homo sapiens
tcctgcagccccagaagaa

SEQ ID NO: 4100039 - DNA, 20 bp, Homo sapiens
tcctgccacatggagccccc

SEQ ID NO: 4100040 - DNA, 21 bp, Homo sapiens
tcctgccagccccacacagct

SEQ ID NO: 4100041 - DNA, 13 bp, Homo sapiens
tcctgccaggcac

SEQ ID NO: 4100042 - DNA, 12 bp, Homo sapiens
tcctgccatcct

SEQ ID NO: 4100043 - DNA, 14 bp, Homo sapiens
tcctgccatcctca

SEQ ID NO: 4100044 - DNA, 14 bp, Homo sapiens
tcctgcccagtgtt

SEQ ID NO: 4100045 - DNA, 19 bp, Homo sapiens
tcctgcccagtgttgtttg

SEQ ID NO: 4100046 - DNA, 13 bp, Homo sapiens
tcctgcccatgtg

SEQ ID NO: 4100047 - DNA, 14 bp, Homo sapiens
tcctgccccacact

SEQ ID NO: 4100048 - DNA, 19 bp, Homo sapiens
tcctgccccacactccccg

SEQ ID NO: 4100049 - DNA, 14 bp, Homo sapiens
tcctgccccaggcc

SEQ ID NO: 4100050 - DNA, 20 bp, Homo sapiens
tcctgcccctttcaggccta

SEQ ID NO: 4100051 - DNA, 22 bp, Homo sapiens
tcctgcccctttcaggcctaca

SEQ ID NO: 4100052 - DNA, 22 bp, Homo sapiens
tcctgccctgtgatatgtctgc

SEQ ID NO: 4100053 - DNA, 14 bp, Homo sapiens
tcctgcccttccct

SEQ ID NO: 4100054 - DNA, 15 bp, Homo sapiens
tcctgcccttccctc

SEQ ID NO: 4100055 - DNA, 18 bp, Homo sapiens
tcctgcccttccctctgg

SEQ ID NO: 4100056 - DNA, 22 bp, Homo sapiens
tcctgcccttccctctgggcac

SEQ ID NO: 4100057 - DNA, 21 bp, Homo sapiens
tcctgccgcagacgggcacag

SEQ ID NO: 4100058 - DNA, 22 bp, Homo sapiens
tcctgccgcagacgggcacaga

SEQ ID NO: 4100059 - DNA, 18 bp, Homo sapiens
tcctgcctcagccttcca

SEQ ID NO: 4100060 - DNA, 14 bp, Homo sapiens
tcctgcctcatgcg

SEQ ID NO: 4100061 - DNA, 20 bp, Homo sapiens
tcctgcctgagtttccagcc

SEQ ID NO: 4100062 - DNA, 12 bp, Homo sapiens
tcctgcctggca

SEQ ID NO: 4100063 - DNA, 21 bp, Homo sapiens
tcctgcctggcacttactggt

SEQ ID NO: 4100064 - DNA, 12 bp, Homo sapiens
tcctgcctggcc

SEQ ID NO: 4100065 - DNA, 19 bp, Homo sapiens
tcctgcctgtctgccccag

SEQ ID NO: 4100066 - DNA, 20 bp, Homo sapiens
tcctgcctgtctgccccagc

SEQ ID NO: 4100067 - DNA, 21 bp, Homo sapiens
tcctgcgaccttgcaacctca

SEQ ID NO: 4100068 - DNA, 13 bp, Homo sapiens
tcctgcgccctgt

SEQ ID NO: 4100069 - DNA, 13 bp, Homo sapiens
tcctgcgtcctcc

SEQ ID NO: 4100070 - DNA, 14 bp, Homo sapiens
tcctgcgtcctcct

SEQ ID NO: 4100071 - DNA, 16 bp, Homo sapiens
tcctgcgtcctcctca

SEQ ID NO: 4100072 - DNA, 19 bp, Homo sapiens
tcctgctacaacttcagca

SEQ ID NO: 4100073 - DNA, 16 bp, Homo sapiens
tcctgctacaggaggg

SEQ ID NO: 4100074 - DNA, 22 bp, Homo sapiens
tcctgctcaactctacccctgc

SEQ ID NO: 4100075 - DNA, 23 bp, Homo sapiens
tcctgctcaactctacccctgct

SEQ ID NO: 4100076 - DNA, 18 bp, Homo sapiens
tcctgctcaccacctgcc

SEQ ID NO: 4100077 - DNA, 21 bp, Homo sapiens
tcctgctgcaccctgcgcctc

SEQ ID NO: 4100078 - DNA, 20 bp, Homo sapiens
tcctgcttttctgtcctggg

SEQ ID NO: 4100079 - DNA, 21 bp, Homo sapiens
tcctgcttttctgtcctgggc

SEQ ID NO: 4100080 - DNA, 16 bp, Homo sapiens
tcctggaaaagaagaa

SEQ ID NO: 4100081 - DNA, 21 bp, Homo sapiens
tcctggaaccttgctgtcctg

SEQ ID NO: 4100082 - DNA, 15 bp, Homo sapiens
tcctggacaggccag

SEQ ID NO: 4100083 - DNA, 16 bp, Homo sapiens
tcctggagaagcctcg

SEQ ID NO: 4100084 - DNA, 18 bp, Homo sapiens
tcctggagcctttgaata

SEQ ID NO: 4100085 - DNA, 22 bp, Homo sapiens
tcctggcaatagtgtgttctga

SEQ ID NO: 4100086 - DNA, 22 bp, Homo sapiens
tcctggcactaccaaaggacac

SEQ ID NO: 4100087 - DNA, 20 bp, Homo sapiens
tcctggcagtttaaaaaaat

SEQ ID NO: 4100088 - DNA, 20 bp, Homo sapiens
tcctggccagatggcccgga

SEQ ID NO: 4100089 - DNA, 14 bp, Homo sapiens
tcctggcctatccg

SEQ ID NO: 4100090 - DNA, 23 bp, Homo sapiens
tcctggcctatccgctgccagcc

SEQ ID NO: 4100091 - DNA, 16 bp, Homo sapiens
tcctggccttttgtgg

SEQ ID NO: 4100092 - DNA, 24 bp, Homo sapiens
tcctggctacatcccagcctgtgg

SEQ ID NO: 4100093 - DNA, 19 bp, Homo sapiens
tcctgggcatgggtccagg

SEQ ID NO: 4100094 - DNA, 20 bp, Homo sapiens
tcctgggcatgggtccaggg

SEQ ID NO: 4100095 - DNA, 23 bp, Homo sapiens
tcctgggcatgggtccagggcct

SEQ ID NO: 4100096 - DNA, 12 bp, Homo sapiens
tcctgggcctgc

SEQ ID NO: 4100097 - DNA, 15 bp, Homo sapiens
tcctgggcctgcccc

SEQ ID NO: 4100098 - DNA, 20 bp, Homo sapiens
tcctgggcttttgttttgct

SEQ ID NO: 4100099 - DNA, 23 bp, Homo sapiens
tcctgggcttttgttttgctttt

SEQ ID NO: 4100100 - DNA, 23 bp, Homo sapiens
tcctggggtataaaactttcctc

SEQ ID NO: 4100101 - DNA, 16 bp, Homo sapiens
tcctgtacactgaata

SEQ ID NO: 4100102 - DNA, 21 bp, Homo sapiens
tcctgtacactgaatatttat

SEQ ID NO: 4100103 - DNA, 14 bp, Homo sapiens
tcctgtataagcac

SEQ ID NO: 4100104 - DNA, 22 bp, Homo sapiens
tcctgtataatctctctcctgt

SEQ ID NO: 4100105 - DNA, 16 bp, Homo sapiens
tcctgtccagctccaa

SEQ ID NO: 4100106 - DNA, 17 bp, Homo sapiens
tcctgtccccaaaatgt

SEQ ID NO: 4100107 - DNA, 19 bp, Homo sapiens
tcctgtccccaaaatgtga

SEQ ID NO: 4100108 - DNA, 18 bp, Homo sapiens
tcctgtcccttctcttaa

SEQ ID NO: 4100109 - DNA, 17 bp, Homo sapiens
tcctgtcccttgacctt

SEQ ID NO: 4100110 - DNA, 24 bp, Homo sapiens
tcctgtcctgctcattatgccact

SEQ ID NO: 4100111 - DNA, 18 bp, Homo sapiens
tcctgtctttaaggaaaa

SEQ ID NO: 4100112 - DNA, 18 bp, Homo sapiens
tcctgtgacatgtaacag

SEQ ID NO: 4100113 - DNA, 20 bp, Homo sapiens
tcctgtgcctggccccagcc

SEQ ID NO: 4100114 - DNA, 20 bp, Homo sapiens
tcctgtggctttgttttctt

SEQ ID NO: 4100115 - DNA, 12 bp, Homo sapiens
tcctgtgtcctg

SEQ ID NO: 4100116 - DNA, 15 bp, Homo sapiens
tcctgttaagagata

SEQ ID NO: 4100117 - DNA, 15 bp, Homo sapiens
tcctgttcagtgaga

SEQ ID NO: 4100118 - DNA, 19 bp, Homo sapiens
tcctgttgttgttaatgaa

SEQ ID NO: 4100119 - DNA, 12 bp, Homo sapiens
tcctgtttcaga

SEQ ID NO: 4100120 - DNA, 20 bp, Homo sapiens
tcctgtttttctgggtggcc

SEQ ID NO: 4100121 - DNA, 12 bp, Homo sapiens
tccttaaaaatc

SEQ ID NO: 4100122 - DNA, 19 bp, Homo sapiens
tccttaaaaatcacactgt

SEQ ID NO: 4100123 - DNA, 15 bp, Homo sapiens
tccttaaactgtgtg

SEQ ID NO: 4100124 - DNA, 13 bp, Homo sapiens
tccttaagaacac

SEQ ID NO: 4100125 - DNA, 21 bp, Homo sapiens
tccttaagtatatcatgtaaa

SEQ ID NO: 4100126 - DNA, 17 bp, Homo sapiens
tccttaatccagctgat

SEQ ID NO: 4100127 - DNA, 17 bp, Homo sapiens
tccttacctcttccgga

SEQ ID NO: 4100128 - DNA, 20 bp, Homo sapiens
tccttacgctttgtcacaca

SEQ ID NO: 4100129 - DNA, 19 bp, Homo sapiens
tccttagaaaaaaaattat

SEQ ID NO: 4100130 - DNA, 17 bp, Homo sapiens
cgtcccagcatccctgg

SEQ ID NO: 4100131 - DNA, 19 bp, Homo sapiens
cgtcccagcatccctggag

SEQ ID NO: 4100132 - DNA, 11 bp, Homo sapiens
cgtccctggcg

SEQ ID NO: 4100133 - DNA, 17 bp, Homo sapiens
cgtcgaggggctctcag

SEQ ID NO: 4100134 - DNA, 21 bp, Homo sapiens
cgtctaaccacagctcctttt

SEQ ID NO: 4100135 - DNA, 14 bp, Homo sapiens
cgtctacagctccc

SEQ ID NO: 4100136 - DNA, 17 bp, Homo sapiens
cgtctacagctccccca

SEQ ID NO: 4100137 - DNA, 23 bp, Homo sapiens
cgtctcaaaaaaaaaaaaatgca

SEQ ID NO: 4100138 - DNA, 12 bp, Homo sapiens
cgtctcctccct

SEQ ID NO: 4100139 - DNA, 13 bp, Homo sapiens
cgtctcctccctc

SEQ ID NO: 4100140 - DNA, 13 bp, Homo sapiens
cgtctctttttgg

SEQ ID NO: 4100141 - DNA, 22 bp, Homo sapiens
cgtcttggtgtaatttgaagat

SEQ ID NO: 4100142 - DNA, 18 bp, Homo sapiens
cgtctttcccaaaggcat

SEQ ID NO: 4100143 - DNA, 18 bp, Homo sapiens
cgtgaaaacggagctgaa

SEQ ID NO: 4100144 - DNA, 24 bp, Homo sapiens
cgtgaaacacaccaggctgtgggc

SEQ ID NO: 4100145 - DNA, 22 bp, Homo sapiens
cgtgaactctggtgctcctgca

SEQ ID NO: 4100146 - DNA, 16 bp, Homo sapiens
cgtgacagtgcctggg

SEQ ID NO: 4100147 - DNA, 12 bp, Homo sapiens
cgtgagccaggt

SEQ ID NO: 4100148 - DNA, 21 bp, Homo sapiens
cgtgagccaggtaatgaggga

SEQ ID NO: 4100149 - DNA, 22 bp, Homo sapiens
cgtgagctggggactcagggac

SEQ ID NO: 4100150 - DNA, 20 bp, Homo sapiens
cgtgatccatccatctccag

SEQ ID NO: 4100151 - DNA, 17 bp, Homo sapiens
cgtgcacgtggagagct

SEQ ID NO: 4100152 - DNA, 22 bp, Homo sapiens
cgtgccaggagcaatgggactg

SEQ ID NO: 4100153 - DNA, 21 bp, Homo sapiens
cgtgccagtcaagaagaaaaa

SEQ ID NO: 4100154 - DNA, 19 bp, Homo sapiens
cgtgcccaggggcccacag

SEQ ID NO: 4100155 - DNA, 19 bp, Homo sapiens
cgtgcctccttccacctcc

SEQ ID NO: 4100156 - DNA, 15 bp, Homo sapiens
cgtgccttcagctct

SEQ ID NO: 4100157 - DNA, 19 bp, Homo sapiens
cgtgcgtgttttctgactg

SEQ ID NO: 4100158 - DNA, 19 bp, Homo sapiens
cgtgctcgccccagcaggt

SEQ ID NO: 4100159 - DNA, 18 bp, Homo sapiens
cgtggaacctctgtctca

SEQ ID NO: 4100160 - DNA, 13 bp, Homo sapiens
cgtggacaggccc

SEQ ID NO: 4100161 - DNA, 15 bp, Homo sapiens
cgtggacaggcccag

SEQ ID NO: 4100162 - DNA, 15 bp, Homo sapiens
cgtggagccagggag

SEQ ID NO: 4100163 - DNA, 18 bp, Homo sapiens
cgtggatgcgcagtgcct

SEQ ID NO: 4100164 - DNA, 17 bp, Homo sapiens
cgtggattgcacgtggc

SEQ ID NO: 4100165 - DNA, 15 bp, Homo sapiens
cgtggcactagaatg

SEQ ID NO: 4100166 - DNA, 22 bp, Homo sapiens
cgtgggagacaagaaatccctg

SEQ ID NO: 4100167 - DNA, 16 bp, Homo sapiens
cgtggtatgtctgcca

SEQ ID NO: 4100168 - DNA, 14 bp, Homo sapiens
cgtggtccagctct

SEQ ID NO: 4100169 - DNA, 19 bp, Homo sapiens
cgtggtggcggtggctgcc

SEQ ID NO: 4100170 - DNA, 21 bp, Homo sapiens
cgtggtggcggtggctgcccc

SEQ ID NO: 4100171 - DNA, 22 bp, Homo sapiens
cgtgtagctatggaagttgcat

SEQ ID NO: 4100172 - DNA, 14 bp, Homo sapiens
cgtgtcaagctgct

SEQ ID NO: 4100173 - DNA, 18 bp, Homo sapiens
cgtgtcaatttccctcag

SEQ ID NO: 4100174 - DNA, 15 bp, Homo sapiens
cgtgtccagcacaga

SEQ ID NO: 4100175 - DNA, 13 bp, Homo sapiens
cgtgtcttccact

SEQ ID NO: 4100176 - DNA, 15 bp, Homo sapiens
cgtgtgagtgtgaca

SEQ ID NO: 4100177 - DNA, 20 bp, Homo sapiens
cgtgtgagtgtgacagggcc

SEQ ID NO: 4100178 - DNA, 12 bp, Homo sapiens
cgtgtggatctt

SEQ ID NO: 4100179 - DNA, 20 bp, Homo sapiens
cgtgtgtaaatatgtacatt

SEQ ID NO: 4100180 - DNA, 18 bp, Homo sapiens
cgtgtttgtctcttctgg

SEQ ID NO: 4100181 - DNA, 20 bp, Homo sapiens
cgttaacctttttgtaaata

SEQ ID NO: 4100182 - DNA, 19 bp, Homo sapiens
cgttaactgtgtatgtaca

SEQ ID NO: 4100183 - DNA, 20 bp, Homo sapiens
cgttaagggaaggaactctg

SEQ ID NO: 4100184 - DNA, 23 bp, Homo sapiens
cgttacatctgtgcagggctggt

SEQ ID NO: 4100185 - DNA, 18 bp, Homo sapiens
cgttaggatactgcctcc

SEQ ID NO: 4100186 - DNA, 17 bp, Homo sapiens
cgttattataaatgtta

SEQ ID NO: 4100187 - DNA, 13 bp, Homo sapiens
cgttcactccaat

SEQ ID NO: 4100188 - DNA, 16 bp, Homo sapiens
cgttccacagttgcca

SEQ ID NO: 4100189 - DNA, 17 bp, Homo sapiens
cgttccacagttgccac

SEQ ID NO: 4100190 - DNA, 16 bp, Homo sapiens
cgttccatctgggctt

SEQ ID NO: 4100191 - DNA, 20 bp, Homo sapiens
cgttcctattgtcattaaag

SEQ ID NO: 4100192 - DNA, 16 bp, Homo sapiens
cgttcctttcttttcc

SEQ ID NO: 4100193 - DNA, 12 bp, Homo sapiens
cgttctgctgcc

SEQ ID NO: 4100194 - DNA, 12 bp, Homo sapiens
cgttctgtgcac

SEQ ID NO: 4100195 - DNA, 20 bp, Homo sapiens
cgttgcttgaaattactgtg

SEQ ID NO: 4100196 - DNA, 15 bp, Homo sapiens
cgttggtccagagcg

SEQ ID NO: 4100197 - DNA, 17 bp, Homo sapiens
cgttgtctgtggatggt

SEQ ID NO: 4100198 - DNA, 18 bp, Homo sapiens
cgttgttgtggaagcatg

SEQ ID NO: 4100199 - DNA, 16 bp, Homo sapiens
cgtttctccttttcct

SEQ ID NO: 4100200 - DNA, 19 bp, Homo sapiens
cgtttgtttgtttgtttaa

SEQ ID NO: 4100201 - DNA, 12 bp, Homo sapiens
cgttttattgtg

SEQ ID NO: 4100202 - DNA, 18 bp, Homo sapiens
cgttttattgtgttttta

SEQ ID NO: 4100203 - DNA, 18 bp, Homo sapiens
cgtttttgtgctgtgggc

SEQ ID NO: 4100204 - DNA, 16 bp, Homo sapiens
ctaaaaagattagcaa

SEQ ID NO: 4100205 - DNA, 21 bp, Homo sapiens
ctaaaaatagacttaaatctc

SEQ ID NO: 4100206 - DNA, 13 bp, Homo sapiens
ctaaaaatccaga

SEQ ID NO: 4100207 - DNA, 23 bp, Homo sapiens
ctaaaactgggattaagaaacct

SEQ ID NO: 4100208 - DNA, 15 bp, Homo sapiens
ctaaaagcaaatcta

SEQ ID NO: 4100209 - DNA, 12 bp, Homo sapiens
ctaaaagcacct

SEQ ID NO: 4100210 - DNA, 15 bp, Homo sapiens
ctaaaagtaaacatt

SEQ ID NO: 4100211 - DNA, 15 bp, Homo sapiens
ctaaaatataatttt

SEQ ID NO: 4100212 - DNA, 23 bp, Homo sapiens
ctaaaatgattttatctgtgaat

SEQ ID NO: 4100213 - DNA, 12 bp, Homo sapiens
ctaaaatgcttc

SEQ ID NO: 4100214 - DNA, 18 bp, Homo sapiens
ctaaaattccactgcgtt

SEQ ID NO: 4100215 - DNA, 20 bp, Homo sapiens
ctaaacaaaattgcaatttc

SEQ ID NO: 4100216 - DNA, 19 bp, Homo sapiens
ctaaacaatgctgatttgg

SEQ ID NO: 4100217 - DNA, 17 bp, Homo sapiens
ctaaacatatgatttca

SEQ ID NO: 4100218 - DNA, 16 bp, Homo sapiens
ctaaaccaaggactga

SEQ ID NO: 4100219 - DNA, 19 bp, Homo sapiens
ctaaaccaaggactgagca

SEQ ID NO: 4100220 - DNA, 20 bp, Homo sapiens
ctaaaccaaggactgagcac

SEQ ID NO: 4100221 - DNA, 19 bp, Homo sapiens
ctaaacccaatccaaatgg

SEQ ID NO: 4100222 - DNA, 14 bp, Homo sapiens
ctaaacccaatgac

SEQ ID NO: 4100223 - DNA, 15 bp, Homo sapiens
ctaaacggattccaa

SEQ ID NO: 4100224 - DNA, 17 bp, Homo sapiens
ctaaacggattccaaag

SEQ ID NO: 4100225 - DNA, 22 bp, Homo sapiens
ctaaactccttcctggcctgag

SEQ ID NO: 4100226 - DNA, 16 bp, Homo sapiens
ctaaactgcaaacaga

SEQ ID NO: 4100227 - DNA, 19 bp, Homo sapiens
ctaaagagcacttactgta

SEQ ID NO: 4100228 - DNA, 19 bp, Homo sapiens
ctaaagagcccttgcctcc

SEQ ID NO: 4100229 - DNA, 22 bp, Homo sapiens
ctaaagagcccttgcctcccca

SEQ ID NO: 4100230 - DNA, 16 bp, Homo sapiens
ctaaagctatgttaca

SEQ ID NO: 4100231 - DNA, 17 bp, Homo sapiens
ctaaaggatagatcaaa

SEQ ID NO: 4100232 - DNA, 19 bp, Homo sapiens
ctaaaggatagatcaaagt

SEQ ID NO: 4100233 - DNA, 13 bp, Homo sapiens
tcctccaagtgcc

SEQ ID NO: 4100234 - DNA, 17 bp, Homo sapiens
tcctccaagtgccccct

SEQ ID NO: 4100235 - DNA, 21 bp, Homo sapiens
tcctccaagtgccccctcacc

SEQ ID NO: 4100236 - DNA, 12 bp, Homo sapiens
tcctccagaact

SEQ ID NO: 4100237 - DNA, 13 bp, Homo sapiens
tcctccagaactc

SEQ ID NO: 4100238 - DNA, 19 bp, Homo sapiens
tcctccaggagcttcttgt

SEQ ID NO: 4100239 - DNA, 17 bp, Homo sapiens
tcctccaggcctgcctc

SEQ ID NO: 4100240 - DNA, 23 bp, Homo sapiens
tcctccagggaaggtggccacag

SEQ ID NO: 4100241 - DNA, 19 bp, Homo sapiens
tcctccagggctcaacact

SEQ ID NO: 4100242 - DNA, 16 bp, Homo sapiens
tcctccatactcagga

SEQ ID NO: 4100243 - DNA, 15 bp, Homo sapiens
tcctccatcctcctc

SEQ ID NO: 4100244 - DNA, 21 bp, Homo sapiens
tcctcccaatttcagactccc

SEQ ID NO: 4100245 - DNA, 13 bp, Homo sapiens
tcctcccaggcgc

SEQ ID NO: 4100246 - DNA, 14 bp, Homo sapiens
tcctcccagtgaga

SEQ ID NO: 4100247 - DNA, 23 bp, Homo sapiens
tcctcccagtgagactgccccac

SEQ ID NO: 4100248 - DNA, 13 bp, Homo sapiens
tcctcccatcccc

SEQ ID NO: 4100249 - DNA, 21 bp, Homo sapiens
tcctccccacttgtccgctgg

SEQ ID NO: 4100250 - DNA, 15 bp, Homo sapiens
tcctccccctgcaac

SEQ ID NO: 4100251 - DNA, 18 bp, Homo sapiens
tcctcccgcccttccatg

SEQ ID NO: 4100252 - DNA, 19 bp, Homo sapiens
tcctcccgcccttccatgt

SEQ ID NO: 4100253 - DNA, 19 bp, Homo sapiens
tcctccctcatggctctgg

SEQ ID NO: 4100254 - DNA, 19 bp, Homo sapiens
tcctcccttccttttccct

SEQ ID NO: 4100255 - DNA, 22 bp, Homo sapiens
tcctcccttccttttccctgct

SEQ ID NO: 4100256 - DNA, 15 bp, Homo sapiens
tcctccgtagggtct

SEQ ID NO: 4100257 - DNA, 16 bp, Homo sapiens
tcctccgtagggtctt

SEQ ID NO: 4100258 - DNA, 14 bp, Homo sapiens
tcctccgtccagcc

SEQ ID NO: 4100259 - DNA, 18 bp, Homo sapiens
tcctcctcttcaccaggt

SEQ ID NO: 4100260 - DNA, 12 bp, Homo sapiens
tcctcctgccct

SEQ ID NO: 4100261 - DNA, 17 bp, Homo sapiens
tcctcctgcctcagcct

SEQ ID NO: 4100262 - DNA, 21 bp, Homo sapiens
tcctcctggaaccttgctgtc

SEQ ID NO: 4100263 - DNA, 13 bp, Homo sapiens
tcctcctgggagc

SEQ ID NO: 4100264 - DNA, 14 bp, Homo sapiens
tcctcctttttcca

SEQ ID NO: 4100265 - DNA, 15 bp, Homo sapiens
tcctcgcctgacaac

SEQ ID NO: 4100266 - DNA, 24 bp, Homo sapiens
tcctcgcctgacaaccactggtct

SEQ ID NO: 4100267 - DNA, 21 bp, Homo sapiens
tcctctaagccactcttccaa

SEQ ID NO: 4100268 - DNA, 19 bp, Homo sapiens
tcctctacttaatgagata

SEQ ID NO: 4100269 - DNA, 17 bp, Homo sapiens
tcctctagaagccaagg

SEQ ID NO: 4100270 - DNA, 18 bp, Homo sapiens
tcctctagaagccaaggg

SEQ ID NO: 4100271 - DNA, 19 bp, Homo sapiens
tcctctagaagccaaggga

SEQ ID NO: 4100272 - DNA, 22 bp, Homo sapiens
tcctctagaagccaagggaaag

SEQ ID NO: 4100273 - DNA, 21 bp, Homo sapiens
tcctctagtaagatgcactga

SEQ ID NO: 4100274 - DNA, 14 bp, Homo sapiens
tcctctatcctggg

SEQ ID NO: 4100275 - DNA, 12 bp, Homo sapiens
tcctctattttg

SEQ ID NO: 4100276 - DNA, 14 bp, Homo sapiens
tcctctcagtgttt

SEQ ID NO: 4100277 - DNA, 17 bp, Homo sapiens
tcctctcagttctctcc

SEQ ID NO: 4100278 - DNA, 13 bp, Homo sapiens
tcctctccactcc

SEQ ID NO: 4100279 - DNA, 12 bp, Homo sapiens
tcctctccactg

SEQ ID NO: 4100280 - DNA, 16 bp, Homo sapiens
tcctctccactgcctt

SEQ ID NO: 4100281 - DNA, 17 bp, Homo sapiens
tcctctccactgccttc

SEQ ID NO: 4100282 - DNA, 17 bp, Homo sapiens
tcctctcccatccttga

SEQ ID NO: 4100283 - DNA, 14 bp, Homo sapiens
tcctctccccagcc

SEQ ID NO: 4100284 - DNA, 18 bp, Homo sapiens
tcctctccccagcccaga

SEQ ID NO: 4100285 - DNA, 21 bp, Homo sapiens
tcctctccccagcccagagac

SEQ ID NO: 4100286 - DNA, 21 bp, Homo sapiens
tcctctccccctcctccaggg

SEQ ID NO: 4100287 - DNA, 16 bp, Homo sapiens
tcctctcccctccagc

SEQ ID NO: 4100288 - DNA, 17 bp, Homo sapiens
tcctctcccctccagcc

SEQ ID NO: 4100289 - DNA, 20 bp, Homo sapiens
tcctctccgcagttcctgtc

SEQ ID NO: 4100290 - DNA, 15 bp, Homo sapiens
tcctctcctggagga

SEQ ID NO: 4100291 - DNA, 14 bp, Homo sapiens
tcctctctccagat

SEQ ID NO: 4100292 - DNA, 17 bp, Homo sapiens
tcctctctgagactgct

SEQ ID NO: 4100293 - DNA, 14 bp, Homo sapiens
tcctctctgggcct

SEQ ID NO: 4100294 - DNA, 13 bp, Homo sapiens
tcctctgagccca

SEQ ID NO: 4100295 - DNA, 16 bp, Homo sapiens
tcctctgagcccagct

SEQ ID NO: 4100296 - DNA, 20 bp, Homo sapiens
tcctctgagcccagctgcct

SEQ ID NO: 4100297 - DNA, 15 bp, Homo sapiens
tcctctgatacccag

SEQ ID NO: 4100298 - DNA, 11 bp, Homo sapiens
tcctctgcctg

SEQ ID NO: 4100299 - DNA, 22 bp, Homo sapiens
tcctctgcctgccccgccccca

SEQ ID NO: 4100300 - DNA, 19 bp, Homo sapiens
tcctctgcttgcctggaga

SEQ ID NO: 4100301 - DNA, 17 bp, Homo sapiens
tcctctggacggcaggc

SEQ ID NO: 4100302 - DNA, 17 bp, Homo sapiens
tcctctggccgcagagg

SEQ ID NO: 4100303 - DNA, 14 bp, Homo sapiens
tcctctggctttcc

SEQ ID NO: 4100304 - DNA, 17 bp, Homo sapiens
tcctctggctttcccag

SEQ ID NO: 4100305 - DNA, 19 bp, Homo sapiens
tcctctggctttcccagga

SEQ ID NO: 4100306 - DNA, 22 bp, Homo sapiens
tcctctgtcagtcacagccacc

SEQ ID NO: 4100307 - DNA, 14 bp, Homo sapiens
tcctctgtctgccc

SEQ ID NO: 4100308 - DNA, 18 bp, Homo sapiens
tcctctgtctgcccttca

SEQ ID NO: 4100309 - DNA, 16 bp, Homo sapiens
tcctcttaactgtggt

SEQ ID NO: 4100310 - DNA, 18 bp, Homo sapiens
tcctcttcaccaggtgca

SEQ ID NO: 4100311 - DNA, 13 bp, Homo sapiens
tcctcttcagaac

SEQ ID NO: 4100312 - DNA, 15 bp, Homo sapiens
tcctcttctgctctt

SEQ ID NO: 4100313 - DNA, 19 bp, Homo sapiens
tcctcttctgctcttttcc

SEQ ID NO: 4100314 - DNA, 13 bp, Homo sapiens
tcctcttctgggc

SEQ ID NO: 4100315 - DNA, 21 bp, Homo sapiens
tcctcttgattcctggtttga

SEQ ID NO: 4100316 - DNA, 13 bp, Homo sapiens
tcctcttgctcaa

SEQ ID NO: 4100317 - DNA, 19 bp, Homo sapiens
tcctcttgtcctacaatga

SEQ ID NO: 4100318 - DNA, 17 bp, Homo sapiens
tcctgaaacaacttgga

SEQ ID NO: 4100319 - DNA, 17 bp, Homo sapiens
tcctgaaacgctccttt

SEQ ID NO: 4100320 - DNA, 18 bp, Homo sapiens
tcctgaaagaaacagtta

SEQ ID NO: 4100321 - DNA, 21 bp, Homo sapiens
tcctgaaagaaacagttaact

SEQ ID NO: 4100322 - DNA, 22 bp, Homo sapiens
tcctgaaccatgtggataactt

SEQ ID NO: 4100323 - DNA, 13 bp, Homo sapiens
tcctgaagaacca

SEQ ID NO: 4100324 - DNA, 18 bp, Homo sapiens
tcctgaagaaccagtccc

SEQ ID NO: 4100325 - DNA, 23 bp, Homo sapiens
tcctgaagaaccagtccccccac

SEQ ID NO: 4100326 - DNA, 19 bp, Homo sapiens
tcctgaagggggacactcc

SEQ ID NO: 4100327 - DNA, 22 bp, Homo sapiens
tcctgacggcgcccccagtgtg

SEQ ID NO: 4100328 - DNA, 22 bp, Homo sapiens
tcctgactcctacctgccctgg

SEQ ID NO: 4100329 - DNA, 16 bp, Homo sapiens
tcctgactctgccccc

SEQ ID NO: 4100330 - DNA, 17 bp, Homo sapiens
tcctgactgggctgggt

SEQ ID NO: 4100331 - DNA, 23 bp, Homo sapiens
tcctgactgggctgggtttgctg

SEQ ID NO: 4100332 - DNA, 17 bp, Homo sapiens
tcctgacttgagtgttc

SEQ ID NO: 4100333 - DNA, 13 bp, Homo sapiens
tcctgacttttaa

SEQ ID NO: 4100334 - DNA, 13 bp, Homo sapiens
tcctgagcctgtg

SEQ ID NO: 4100335 - DNA, 19 bp, Homo sapiens
tcctgagcctgtgggtccc

SEQ ID NO: 4100336 - DNA, 15 bp, Homo sapiens
tccgagacagtccag

SEQ ID NO: 4100337 - DNA, 16 bp, Homo sapiens
tccgagacagtccagt

SEQ ID NO: 4100338 - DNA, 17 bp, Homo sapiens
tccgagacagtccagtg

SEQ ID NO: 4100339 - DNA, 13 bp, Homo sapiens
tccgagagggaga

SEQ ID NO: 4100340 - DNA, 15 bp, Homo sapiens
tccgagagggagaga

SEQ ID NO: 4100341 - DNA, 19 bp, Homo sapiens
tccgagatccccagggcag

SEQ ID NO: 4100342 - DNA, 13 bp, Homo sapiens
tccgagtgtgttt

SEQ ID NO: 4100343 - DNA, 16 bp, Homo sapiens
tccgcactttccactt

SEQ ID NO: 4100344 - DNA, 15 bp, Homo sapiens
tccgcagaagccctg

SEQ ID NO: 4100345 - DNA, 18 bp, Homo sapiens
tccgcaggtgctggtccc

SEQ ID NO: 4100346 - DNA, 15 bp, Homo sapiens
tccgcatcacctcac

SEQ ID NO: 4100347 - DNA, 13 bp, Homo sapiens
tccgccagcctcc

SEQ ID NO: 4100348 - DNA, 14 bp, Homo sapiens
tccgccagcctcct

SEQ ID NO: 4100349 - DNA, 16 bp, Homo sapiens
tccgccctcctcgggc

SEQ ID NO: 4100350 - DNA, 16 bp, Homo sapiens
tccgccttctcccaca

SEQ ID NO: 4100351 - DNA, 19 bp, Homo sapiens
tccgcggagcccttggccc

SEQ ID NO: 4100352 - DNA, 13 bp, Homo sapiens
tccgctgctcctt

SEQ ID NO: 4100353 - DNA, 16 bp, Homo sapiens
tccgctgtcgccccag

SEQ ID NO: 4100354 - DNA, 18 bp, Homo sapiens
tccggacactcctagaga

SEQ ID NO: 4100355 - DNA, 12 bp, Homo sapiens
tccggactggtg

SEQ ID NO: 4100356 - DNA, 16 bp, Homo sapiens
tccggactggtgccct

SEQ ID NO: 4100357 - DNA, 16 bp, Homo sapiens
tccggccatactgcct

SEQ ID NO: 4100358 - DNA, 21 bp, Homo sapiens
tccggcttgacctgtttctct

SEQ ID NO: 4100359 - DNA, 14 bp, Homo sapiens
tccgggtcttccta

SEQ ID NO: 4100360 - DNA, 20 bp, Homo sapiens
tccgggtgtggcctcagccc

SEQ ID NO: 4100361 - DNA, 18 bp, Homo sapiens
tccggtagggaggcagcc

SEQ ID NO: 4100362 - DNA, 19 bp, Homo sapiens
tccggtagggaggcagcct

SEQ ID NO: 4100363 - DNA, 17 bp, Homo sapiens
tccgtagggtctttctt

SEQ ID NO: 4100364 - DNA, 22 bp, Homo sapiens
tccgtaggtagatgtgtaacct

SEQ ID NO: 4100365 - DNA, 17 bp, Homo sapiens
tccgtccggtgtgtcag

SEQ ID NO: 4100366 - DNA, 22 bp, Homo sapiens
tccgtgaactctggtgctcctg

SEQ ID NO: 4100367 - DNA, 18 bp, Homo sapiens
tccgtgatccatccatct

SEQ ID NO: 4100368 - DNA, 20 bp, Homo sapiens
tccgtgatccatccatctcc

SEQ ID NO: 4100369 - DNA, 13 bp, Homo sapiens
tccgttctgttct

SEQ ID NO: 4100370 - DNA, 21 bp, Homo sapiens
tccgtttgatttgtcactgct

SEQ ID NO: 4100371 - DNA, 17 bp, Homo sapiens
tcctaaaacacctggta

SEQ ID NO: 4100372 - DNA, 15 bp, Homo sapiens
tcctaaatgcagtga

SEQ ID NO: 4100373 - DNA, 14 bp, Homo sapiens
tcctaacaggatga

SEQ ID NO: 4100374 - DNA, 15 bp, Homo sapiens
tcctaagaaatatgt

SEQ ID NO: 4100375 - DNA, 19 bp, Homo sapiens
tcctaagaaatatgtgaga

SEQ ID NO: 4100376 - DNA, 16 bp, Homo sapiens
tcctaagagtgctggg

SEQ ID NO: 4100377 - DNA, 14 bp, Homo sapiens
tcctaagcctaaaa

SEQ ID NO: 4100378 - DNA, 21 bp, Homo sapiens
tcctaagctattcagtaataa

SEQ ID NO: 4100379 - DNA, 23 bp, Homo sapiens
tcctaattttaaataatttctac

SEQ ID NO: 4100380 - DNA, 18 bp, Homo sapiens
tcctacaacttaatggaa

SEQ ID NO: 4100381 - DNA, 18 bp, Homo sapiens
tcctacaagagcagcctg

SEQ ID NO: 4100382 - DNA, 19 bp, Homo sapiens
tcctacacttgagagaaaa

SEQ ID NO: 4100383 - DNA, 20 bp, Homo sapiens
tcctacagcactactgggtg

SEQ ID NO: 4100384 - DNA, 17 bp, Homo sapiens
tcctacagccccttttt

SEQ ID NO: 4100385 - DNA, 14 bp, Homo sapiens
tcctacatcttctt

SEQ ID NO: 4100386 - DNA, 22 bp, Homo sapiens
tcctaccagttgccctagccca

SEQ ID NO: 4100387 - DNA, 21 bp, Homo sapiens
tcctacccacacctctgccag

SEQ ID NO: 4100388 - DNA, 22 bp, Homo sapiens
tcctacccacacctctgccaga

SEQ ID NO: 4100389 - DNA, 22 bp, Homo sapiens
tcctacctctgtgccagggcag

SEQ ID NO: 4100390 - DNA, 12 bp, Homo sapiens
tcctactcctga

SEQ ID NO: 4100391 - DNA, 17 bp, Homo sapiens
tcctagagaacgcagcc

SEQ ID NO: 4100392 - DNA, 15 bp, Homo sapiens
tcctagataaaaaga

SEQ ID NO: 4100393 - DNA, 14 bp, Homo sapiens
tcctagcccttccc

SEQ ID NO: 4100394 - DNA, 21 bp, Homo sapiens
tcctagcctgtgcctctggga

SEQ ID NO: 4100395 - DNA, 22 bp, Homo sapiens
tcctagcttgggaggcttcccc

SEQ ID NO: 4100396 - DNA, 19 bp, Homo sapiens
tcctaggagagccaacctc

SEQ ID NO: 4100397 - DNA, 16 bp, Homo sapiens
tcctaggatgtcatgt

SEQ ID NO: 4100398 - DNA, 16 bp, Homo sapiens
tcctaggcccaggcct

SEQ ID NO: 4100399 - DNA, 17 bp, Homo sapiens
tcctaggcccaggcctg

SEQ ID NO: 4100400 - DNA, 20 bp, Homo sapiens
tcctaggcccaggcctgggt

SEQ ID NO: 4100401 - DNA, 19 bp, Homo sapiens
tcctaggggaacagaccag

SEQ ID NO: 4100402 - DNA, 23 bp, Homo sapiens
tcctaggggaacagaccagtgac

SEQ ID NO: 4100403 - DNA, 21 bp, Homo sapiens
tcctaggtcatgcctcctccc

SEQ ID NO: 4100404 - DNA, 14 bp, Homo sapiens
tcctaggtccaagc

SEQ ID NO: 4100405 - DNA, 22 bp, Homo sapiens
tcctagtggatgactgttgatg

SEQ ID NO: 4100406 - DNA, 20 bp, Homo sapiens
tcctataatataataaatat

SEQ ID NO: 4100407 - DNA, 23 bp, Homo sapiens
tcctatattgttttcagtgtaca

SEQ ID NO: 4100408 - DNA, 16 bp, Homo sapiens
tcctatgcccaggtac

SEQ ID NO: 4100409 - DNA, 21 bp, Homo sapiens
tcctatggacaacttatttaa

SEQ ID NO: 4100410 - DNA, 16 bp, Homo sapiens
tcctattaaaacacag

SEQ ID NO: 4100411 - DNA, 19 bp, Homo sapiens
tcctattaaaacacagctt

SEQ ID NO: 4100412 - DNA, 15 bp, Homo sapiens
tcctattctcaccag

SEQ ID NO: 4100413 - DNA, 18 bp, Homo sapiens
tcctatttgccatgggct

SEQ ID NO: 4100414 - DNA, 18 bp, Homo sapiens
tcctatttggggcttgca

SEQ ID NO: 4100415 - DNA, 14 bp, Homo sapiens
tcctcaaacaacac

SEQ ID NO: 4100416 - DNA, 20 bp, Homo sapiens
tcctcaaacgacagaggagc

SEQ ID NO: 4100417 - DNA, 19 bp, Homo sapiens
tcctcacacaccctgaggt

SEQ ID NO: 4100418 - DNA, 13 bp, Homo sapiens
tcctcacacccct

SEQ ID NO: 4100419 - DNA, 12 bp, Homo sapiens
tcctcacctctg

SEQ ID NO: 4100420 - DNA, 15 bp, Homo sapiens
tcctcacctctggac

SEQ ID NO: 4100421 - DNA, 16 bp, Homo sapiens
tcctcacctctggact

SEQ ID NO: 4100422 - DNA, 13 bp, Homo sapiens
tcctcactcccag

SEQ ID NO: 4100423 - DNA, 19 bp, Homo sapiens
tcctcagctgcctcctgcg

SEQ ID NO: 4100424 - DNA, 15 bp, Homo sapiens
tcctcagctggttac

SEQ ID NO: 4100425 - DNA, 16 bp, Homo sapiens
tcctcaggcacacagc

SEQ ID NO: 4100426 - DNA, 17 bp, Homo sapiens
tcctcaggcacacagct

SEQ ID NO: 4100427 - DNA, 23 bp, Homo sapiens
tcctcataaaaagcaaaacaaaa

SEQ ID NO: 4100428 - DNA, 17 bp, Homo sapiens
tcctcatccaccccatc

SEQ ID NO: 4100429 - DNA, 18 bp, Homo sapiens
tcctcatccaccccatcc

SEQ ID NO: 4100430 - DNA, 14 bp, Homo sapiens
tcctcatcccgtgt

SEQ ID NO: 4100431 - DNA, 14 bp, Homo sapiens
tcctcatccctgac

SEQ ID NO: 4100432 - DNA, 22 bp, Homo sapiens
tcctcatctgagaggctctccg

SEQ ID NO: 4100433 - DNA, 18 bp, Homo sapiens
tcctcatgttactcagtg

SEQ ID NO: 4100434 - DNA, 23 bp, Homo sapiens
tcctcattccctcgtctttccca

SEQ ID NO: 4100435 - DNA, 14 bp, Homo sapiens
tcctcattcctgaa

SEQ ID NO: 4100436 - DNA, 17 bp, Homo sapiens
tcctccaaaggccccct

SEQ ID NO: 4100437 - DNA, 17 bp, Homo sapiens
tcctccaaatctcttgc

SEQ ID NO: 4100438 - DNA, 14 bp, Homo sapiens
tcctccaaggacag

SEQ ID NO: 4100439 - DNA, 13 bp, Homo sapiens
tccctccagtgaa

SEQ ID NO: 4100440 - DNA, 16 bp, Homo sapiens
tccctccatttttctc

SEQ ID NO: 4100441 - DNA, 16 bp, Homo sapiens
tccctcccccccatgc

SEQ ID NO: 4100442 - DNA, 14 bp, Homo sapiens
tccctcccccttgt

SEQ ID NO: 4100443 - DNA, 14 bp, Homo sapiens
tccctcccctgccc

SEQ ID NO: 4100444 - DNA, 15 bp, Homo sapiens
tccctcccctgccct

SEQ ID NO: 4100445 - DNA, 14 bp, Homo sapiens
tccctcccttgctg

SEQ ID NO: 4100446 - DNA, 15 bp, Homo sapiens
tccctcccttgctga

SEQ ID NO: 4100447 - DNA, 18 bp, Homo sapiens
tccctcccttgctgaaca

SEQ ID NO: 4100448 - DNA, 19 bp, Homo sapiens
tccctccggcttgacctgt

SEQ ID NO: 4100449 - DNA, 15 bp, Homo sapiens
tccctcctagctctc

SEQ ID NO: 4100450 - DNA, 16 bp, Homo sapiens
tccctcctagctctcc

SEQ ID NO: 4100451 - DNA, 14 bp, Homo sapiens
tccctcctccaggc

SEQ ID NO: 4100452 - DNA, 17 bp, Homo sapiens
tccctcctccaggcctg

SEQ ID NO: 4100453 - DNA, 16 bp, Homo sapiens
tccctcgacagcgccc

SEQ ID NO: 4100454 - DNA, 23 bp, Homo sapiens
tccctcgacagcgcccctgctgt

SEQ ID NO: 4100455 - DNA, 21 bp, Homo sapiens
tccctcgggaagcagccagct

SEQ ID NO: 4100456 - DNA, 13 bp, Homo sapiens
tccctctatttat

SEQ ID NO: 4100457 - DNA, 12 bp, Homo sapiens
tccctctccctg

SEQ ID NO: 4100458 - DNA, 17 bp, Homo sapiens
tccctctcctgcccaga

SEQ ID NO: 4100459 - DNA, 13 bp, Homo sapiens
tccctctctcagc

SEQ ID NO: 4100460 - DNA, 16 bp, Homo sapiens
tccctctctcagcaca

SEQ ID NO: 4100461 - DNA, 21 bp, Homo sapiens
tccctctctcagcacagcctg

SEQ ID NO: 4100462 - DNA, 17 bp, Homo sapiens
tccctctctcccatttc

SEQ ID NO: 4100463 - DNA, 16 bp, Homo sapiens
tccctctctcttctgc

SEQ ID NO: 4100464 - DNA, 12 bp, Homo sapiens
tccctctctgat

SEQ ID NO: 4100465 - DNA, 15 bp, Homo sapiens
tccctctcttcccct

SEQ ID NO: 4100466 - DNA, 22 bp, Homo sapiens
tccctctgagaattccaaggag

SEQ ID NO: 4100467 - DNA, 17 bp, Homo sapiens
tccctctgattggtttt

SEQ ID NO: 4100468 - DNA, 14 bp, Homo sapiens
tccctctgctcagc

SEQ ID NO: 4100469 - DNA, 18 bp, Homo sapiens
tccctctgctcagccaag

SEQ ID NO: 4100470 - DNA, 15 bp, Homo sapiens
tccctcttcactccc

SEQ ID NO: 4100471 - DNA, 16 bp, Homo sapiens
tccctcttcactcccc

SEQ ID NO: 4100472 - DNA, 16 bp, Homo sapiens
tccctcttctaaccca

SEQ ID NO: 4100473 - DNA, 12 bp, Homo sapiens
tccctcttgtaa

SEQ ID NO: 4100474 - DNA, 22 bp, Homo sapiens
tccctcttgtaagtcatctact

SEQ ID NO: 4100475 - DNA, 22 bp, Homo sapiens
tccctctttggcagttgcatta

SEQ ID NO: 4100476 - DNA, 18 bp, Homo sapiens
tccctctttggctcccct

SEQ ID NO: 4100477 - DNA, 14 bp, Homo sapiens
tccctgacccgtct

SEQ ID NO: 4100478 - DNA, 14 bp, Homo sapiens
tccctgactggcca

SEQ ID NO: 4100479 - DNA, 14 bp, Homo sapiens
tccctgacttgctt

SEQ ID NO: 4100480 - DNA, 21 bp, Homo sapiens
tccctgagtgcgggctgaggc

SEQ ID NO: 4100481 - DNA, 18 bp, Homo sapiens
tccctgattgacctgctc

SEQ ID NO: 4100482 - DNA, 22 bp, Homo sapiens
tccctgcactaaagccagcctg

SEQ ID NO: 4100483 - DNA, 16 bp, Homo sapiens
tccctgccacatacag

SEQ ID NO: 4100484 - DNA, 22 bp, Homo sapiens
tccctgccaccaggcactgcct

SEQ ID NO: 4100485 - DNA, 14 bp, Homo sapiens
tccctgcccctccc

SEQ ID NO: 4100486 - DNA, 18 bp, Homo sapiens
tccctgcccctcccttca

SEQ ID NO: 4100487 - DNA, 15 bp, Homo sapiens
tccctgcctggcccc

SEQ ID NO: 4100488 - DNA, 17 bp, Homo sapiens
tccctgcgcctgtgatg

SEQ ID NO: 4100489 - DNA, 21 bp, Homo sapiens
tccctgcgcctgtgatgctgg

SEQ ID NO: 4100490 - DNA, 22 bp, Homo sapiens
tccctgctcttgcagttgctct

SEQ ID NO: 4100491 - DNA, 14 bp, Homo sapiens
tccctgctgtgcca

SEQ ID NO: 4100492 - DNA, 13 bp, Homo sapiens
tccctgctttgca

SEQ ID NO: 4100493 - DNA, 17 bp, Homo sapiens
tccctgctttgcatctt

SEQ ID NO: 4100494 - DNA, 18 bp, Homo sapiens
tccctggaaggacatcca

SEQ ID NO: 4100495 - DNA, 22 bp, Homo sapiens
tccctggagtgtggctgaggag

SEQ ID NO: 4100496 - DNA, 15 bp, Homo sapiens
tccctggctctcaga

SEQ ID NO: 4100497 - DNA, 18 bp, Homo sapiens
tccctggctctcagaagg

SEQ ID NO: 4100498 - DNA, 19 bp, Homo sapiens
tccctggctctcagaaggt

SEQ ID NO: 4100499 - DNA, 20 bp, Homo sapiens
tccctggctctcagaaggta

SEQ ID NO: 4100500 - DNA, 20 bp, Homo sapiens
tccctgggacacagacccag

SEQ ID NO: 4100501 - DNA, 22 bp, Homo sapiens
tccctgggacacagacccagga

SEQ ID NO: 4100502 - DNA, 23 bp, Homo sapiens
tccctgggacacagacccaggac

SEQ ID NO: 4100503 - DNA, 13 bp, Homo sapiens
tccctgtaatatt

SEQ ID NO: 4100504 - DNA, 21 bp, Homo sapiens
tccctgtccctctagtgcctt

SEQ ID NO: 4100505 - DNA, 21 bp, Homo sapiens
tccctgtggcactcagggagc

SEQ ID NO: 4100506 - DNA, 11 bp, Homo sapiens
tccctgtgggg

SEQ ID NO: 4100507 - DNA, 21 bp, Homo sapiens
tccctgtgggggtggccatcc

SEQ ID NO: 4100508 - DNA, 23 bp, Homo sapiens
tccctgtgggggtggccatccct

SEQ ID NO: 4100509 - DNA, 16 bp, Homo sapiens
tccctgtgtcatttca

SEQ ID NO: 4100510 - DNA, 22 bp, Homo sapiens
tccctgtgtccacctgtgggtg

SEQ ID NO: 4100511 - DNA, 17 bp, Homo sapiens
tccctgttccccagaga

SEQ ID NO: 4100512 - DNA, 21 bp, Homo sapiens
tccctgttcttcctccagctg

SEQ ID NO: 4100513 - DNA, 21 bp, Homo sapiens
tccctgtttaatatttaaaca

SEQ ID NO: 4100514 - DNA, 19 bp, Homo sapiens
tccctgttttcccacgagg

SEQ ID NO: 4100515 - DNA, 22 bp, Homo sapiens
tcccttaaaattaccagacaaa

SEQ ID NO: 4100516 - DNA, 22 bp, Homo sapiens
tcccttcaaccattccccatgg

SEQ ID NO: 4100517 - DNA, 13 bp, Homo sapiens
tcccttcagcccc

SEQ ID NO: 4100518 - DNA, 18 bp, Homo sapiens
tcccttcagcccccagcc

SEQ ID NO: 4100519 - DNA, 19 bp, Homo sapiens
tcccttcagcccccagccc

SEQ ID NO: 4100520 - DNA, 16 bp, Homo sapiens
tcccttcagtaccctc

SEQ ID NO: 4100521 - DNA, 15 bp, Homo sapiens
tcccttccacctgct

SEQ ID NO: 4100522 - DNA, 19 bp, Homo sapiens
tcccttccagtttattcca

SEQ ID NO: 4100523 - DNA, 17 bp, Homo sapiens
tcccttcccacatgcct

SEQ ID NO: 4100524 - DNA, 12 bp, Homo sapiens
tcccttcccctc

SEQ ID NO: 4100525 - DNA, 13 bp, Homo sapiens
tcccttcctccat

SEQ ID NO: 4100526 - DNA, 15 bp, Homo sapiens
tcccttctcttccag

SEQ ID NO: 4100527 - DNA, 15 bp, Homo sapiens
tcccttgcaggggtc

SEQ ID NO: 4100528 - DNA, 16 bp, Homo sapiens
tcccttgctgaacaca

SEQ ID NO: 4100529 - DNA, 19 bp, Homo sapiens
tcccttgctgaacacacac

SEQ ID NO: 4100530 - DNA, 20 bp, Homo sapiens
tcccttgctgaacacacaca

SEQ ID NO: 4100531 - DNA, 12 bp, Homo sapiens
tcccttggcctc

SEQ ID NO: 4100532 - DNA, 13 bp, Homo sapiens
tccctttccctac

SEQ ID NO: 4100533 - DNA, 16 bp, Homo sapiens
tccctttccctacctt

SEQ ID NO: 4100534 - DNA, 13 bp, Homo sapiens
tccctttcccttc

SEQ ID NO: 4100535 - DNA, 14 bp, Homo sapiens
tccctttccttcca

SEQ ID NO: 4100536 - DNA, 23 bp, Homo sapiens
tccctttccttccatccctaccc

SEQ ID NO: 4100537 - DNA, 17 bp, Homo sapiens
tccctttcttggccagt

SEQ ID NO: 4100538 - DNA, 16 bp, Homo sapiens
tcccttttctgttcta

SEQ ID NO: 4100539 - DNA, 12 bp, Homo sapiens
tcccttttgcta

SEQ ID NO: 4100540 - DNA, 21 bp, Homo sapiens
tccgaactgttcaagtgtccc

SEQ ID NO: 4100541 - DNA, 18 bp, Homo sapiens
tccgaccacttccagggg

SEQ ID NO: 4100542 - DNA, 17 bp, Homo sapiens
tccgaccctcatggccc

SEQ ID NO: 4100543 - DNA, 22 bp, Homo sapiens
tcccccaaaggcatcccagcct

SEQ ID NO: 4100544 - DNA, 23 bp, Homo sapiens
tcccccaaaggcatcccagcctg

SEQ ID NO: 4100545 - DNA, 17 bp, Homo sapiens
tcccccaacccccaccc

SEQ ID NO: 4100546 - DNA, 11 bp, Homo sapiens
tcccccagcaa

SEQ ID NO: 4100547 - DNA, 12 bp, Homo sapiens
tcccccagcctc

SEQ ID NO: 4100548 - DNA, 13 bp, Homo sapiens
tcccccatctccc

SEQ ID NO: 4100549 - DNA, 17 bp, Homo sapiens
tcccccatctcccaccc

SEQ ID NO: 4100550 - DNA, 18 bp, Homo sapiens
tcccccccatgcactgtg

SEQ ID NO: 4100551 - DNA, 16 bp, Homo sapiens
tcccccgtttctcctt

SEQ ID NO: 4100552 - DNA, 14 bp, Homo sapiens
tccccctacccacc

SEQ ID NO: 4100553 - DNA, 16 bp, Homo sapiens
tccccctcagcaagcc

SEQ ID NO: 4100554 - DNA, 11 bp, Homo sapiens
tccccctgcaa

SEQ ID NO: 4100555 - DNA, 12 bp, Homo sapiens
tccccctgcaac

SEQ ID NO: 4100556 - DNA, 21 bp, Homo sapiens
tccccctgcaacttccgctga

SEQ ID NO: 4100557 - DNA, 17 bp, Homo sapiens
tccccctggcactggtt

SEQ ID NO: 4100558 - DNA, 13 bp, Homo sapiens
tccccctgtgcat

SEQ ID NO: 4100559 - DNA, 13 bp, Homo sapiens
tcccccttgccac

SEQ ID NO: 4100560 - DNA, 16 bp, Homo sapiens
tcccccttgccacccc

SEQ ID NO: 4100561 - DNA, 23 bp, Homo sapiens
tcccccttgccaccccaccctcc

SEQ ID NO: 4100562 - DNA, 11 bp, Homo sapiens
tccccctttct

SEQ ID NO: 4100563 - DNA, 16 bp, Homo sapiens
tccccctttcttcctc

SEQ ID NO: 4100564 - DNA, 18 bp, Homo sapiens
tccccgcccctgtggccc

SEQ ID NO: 4100565 - DNA, 18 bp, Homo sapiens
tccccgcttctgcctgca

SEQ ID NO: 4100566 - DNA, 15 bp, Homo sapiens
tccccggacatactc

SEQ ID NO: 4100567 - DNA, 14 bp, Homo sapiens
tccccgttcctgac

SEQ ID NO: 4100568 - DNA, 17 bp, Homo sapiens
tccccgttcctgacatc

SEQ ID NO: 4100569 - DNA, 18 bp, Homo sapiens
tcccctcactctgtcagc

SEQ ID NO: 4100570 - DNA, 12 bp, Homo sapiens
tcccctcactgg

SEQ ID NO: 4100571 - DNA, 20 bp, Homo sapiens
tcccctccacatcccagcag

SEQ ID NO: 4100572 - DNA, 14 bp, Homo sapiens
tcccctccaggaag

SEQ ID NO: 4100573 - DNA, 13 bp, Homo sapiens
tcccctccaggag

SEQ ID NO: 4100574 - DNA, 19 bp, Homo sapiens
tcccctccaggagggacca

SEQ ID NO: 4100575 - DNA, 14 bp, Homo sapiens
tcccctcccagtcc

SEQ ID NO: 4100576 - DNA, 15 bp, Homo sapiens
tcccctccctctgtc

SEQ ID NO: 4100577 - DNA, 15 bp, Homo sapiens
tcccctccctggctc

SEQ ID NO: 4100578 - DNA, 16 bp, Homo sapiens
tcccctccctggctcc

SEQ ID NO: 4100579 - DNA, 19 bp, Homo sapiens
tcccctccctggctcccat

SEQ ID NO: 4100580 - DNA, 16 bp, Homo sapiens
tcccctccggactggt

SEQ ID NO: 4100581 - DNA, 18 bp, Homo sapiens
tcccctccggactggtgc

SEQ ID NO: 4100582 - DNA, 21 bp, Homo sapiens
tcccctccggactggtgccct

SEQ ID NO: 4100583 - DNA, 16 bp, Homo sapiens
tcccctccttccctca

SEQ ID NO: 4100584 - DNA, 14 bp, Homo sapiens
tcccctccttctcc

SEQ ID NO: 4100585 - DNA, 20 bp, Homo sapiens
tcccctctgctgctgtccct

SEQ ID NO: 4100586 - DNA, 22 bp, Homo sapiens
tcccctctggcttgacagcatg

SEQ ID NO: 4100587 - DNA, 17 bp, Homo sapiens
tcccctcttcccttcaa

SEQ ID NO: 4100588 - DNA, 18 bp, Homo sapiens
tcccctcttcccttcaac

SEQ ID NO: 4100589 - DNA, 13 bp, Homo sapiens
tcccctgccattt

SEQ ID NO: 4100590 - DNA, 13 bp, Homo sapiens
tcccctgccctgg

SEQ ID NO: 4100591 - DNA, 17 bp, Homo sapiens
tcccctgccctggtcca

SEQ ID NO: 4100592 - DNA, 18 bp, Homo sapiens
tcccctgcggtcaggctg

SEQ ID NO: 4100593 - DNA, 17 bp, Homo sapiens
tcccctgtgccagccca

SEQ ID NO: 4100594 - DNA, 19 bp, Homo sapiens
tcccctgtgccagcccaga

SEQ ID NO: 4100595 - DNA, 15 bp, Homo sapiens
tccccttccatttct

SEQ ID NO: 4100596 - DNA, 14 bp, Homo sapiens
tccccttcctgttt

SEQ ID NO: 4100597 - DNA, 21 bp, Homo sapiens
tccccttcctgtttcagaccc

SEQ ID NO: 4100598 - DNA, 12 bp, Homo sapiens
tcccctttcctg

SEQ ID NO: 4100599 - DNA, 21 bp, Homo sapiens
tcccgaagaatgaacccaaga

SEQ ID NO: 4100600 - DNA, 21 bp, Homo sapiens
tcccgcacatggtgtgggggg

SEQ ID NO: 4100601 - DNA, 23 bp, Homo sapiens
tcccgcatcaaggtcagcatgag

SEQ ID NO: 4100602 - DNA, 22 bp, Homo sapiens
tcccgcccttccatgtgccttt

SEQ ID NO: 4100603 - DNA, 17 bp, Homo sapiens
tcccgcctcagggccag

SEQ ID NO: 4100604 - DNA, 19 bp, Homo sapiens
tcccgcctcagggccaggc

SEQ ID NO: 4100605 - DNA, 17 bp, Homo sapiens
tcccgcctccctctcag

SEQ ID NO: 4100606 - DNA, 21 bp, Homo sapiens
tcccgcctcttcttcttcaga

SEQ ID NO: 4100607 - DNA, 15 bp, Homo sapiens
tcccgcgcctttccg

SEQ ID NO: 4100608 - DNA, 23 bp, Homo sapiens
tcccgcgggttccgcaggcagac

SEQ ID NO: 4100609 - DNA, 20 bp, Homo sapiens
tcccgctcagccctccctgc

SEQ ID NO: 4100610 - DNA, 13 bp, Homo sapiens
tcccgctgctgct

SEQ ID NO: 4100611 - DNA, 12 bp, Homo sapiens
tcccggagcctg

SEQ ID NO: 4100612 - DNA, 16 bp, Homo sapiens
tcccggagcctgtgca

SEQ ID NO: 4100613 - DNA, 14 bp, Homo sapiens
tcccggccctgcct

SEQ ID NO: 4100614 - DNA, 15 bp, Homo sapiens
tcccggccctgcctg

SEQ ID NO: 4100615 - DNA, 17 bp, Homo sapiens
tcccgggccacgcccca

SEQ ID NO: 4100616 - DNA, 19 bp, Homo sapiens
tcccgggccacgccccagc

SEQ ID NO: 4100617 - DNA, 21 bp, Homo sapiens
tcccgggccacgccccagccc

SEQ ID NO: 4100618 - DNA, 22 bp, Homo sapiens
tcccgggccacgccccagcccg

SEQ ID NO: 4100619 - DNA, 16 bp, Homo sapiens
tcccggggccagcact

SEQ ID NO: 4100620 - DNA, 21 bp, Homo sapiens
tcccggggccagcacttccat

SEQ ID NO: 4100621 - DNA, 14 bp, Homo sapiens
tcccggggctccac

SEQ ID NO: 4100622 - DNA, 19 bp, Homo sapiens
tcccggttcagacccctgc

SEQ ID NO: 4100623 - DNA, 17 bp, Homo sapiens
tcccgtctggacctggg

SEQ ID NO: 4100624 - DNA, 20 bp, Homo sapiens
tcccgtttctccacctagac

SEQ ID NO: 4100625 - DNA, 16 bp, Homo sapiens
tccctaaaatacattt

SEQ ID NO: 4100626 - DNA, 16 bp, Homo sapiens
tccctaaactttggcc

SEQ ID NO: 4100627 - DNA, 23 bp, Homo sapiens
tccctaccccagggccctggcca

SEQ ID NO: 4100628 - DNA, 22 bp, Homo sapiens
tccctaccgagtctcttctcca

SEQ ID NO: 4100629 - DNA, 23 bp, Homo sapiens
tccctaccgagtctcttctccac

SEQ ID NO: 4100630 - DNA, 15 bp, Homo sapiens
tccctacctcaggca

SEQ ID NO: 4100631 - DNA, 13 bp, Homo sapiens
tccctagactgca

SEQ ID NO: 4100632 - DNA, 19 bp, Homo sapiens
tccctagagggttcctgta

SEQ ID NO: 4100633 - DNA, 20 bp, Homo sapiens
tccctagagggttcctgtag

SEQ ID NO: 4100634 - DNA, 20 bp, Homo sapiens
tccctagctttagaccctgg

SEQ ID NO: 4100635 - DNA, 14 bp, Homo sapiens
tccctatggaaaga

SEQ ID NO: 4100636 - DNA, 18 bp, Homo sapiens
tccctcaacaagggagag

SEQ ID NO: 4100637 - DNA, 13 bp, Homo sapiens
tccctcacctgta

SEQ ID NO: 4100638 - DNA, 20 bp, Homo sapiens
tccctcactccacagagtga

SEQ ID NO: 4100639 - DNA, 20 bp, Homo sapiens
tccctcactgaaggacctga

SEQ ID NO: 4100640 - DNA, 18 bp, Homo sapiens
tccctcagcctcagagga

SEQ ID NO: 4100641 - DNA, 18 bp, Homo sapiens
tccctcagctctctggga

SEQ ID NO: 4100642 - DNA, 14 bp, Homo sapiens
tccctcaggctctg

SEQ ID NO: 4100643 - DNA, 15 bp, Homo sapiens
tccctcatggctctg

SEQ ID NO: 4100644 - DNA, 21 bp, Homo sapiens
tccctccaccccacagaacct

SEQ ID NO: 4100645 - DNA, 13 bp, Homo sapiens
tccctccacctca

SEQ ID NO: 4100646 - DNA, 11 bp, Homo sapiens
tccctccagaa

SEQ ID NO: 4100647 - DNA, 14 bp, Homo sapiens
tcccagccaccccg

SEQ ID NO: 4100648 - DNA, 24 bp, Homo sapiens
tcccagccaccccgggctctctgc

SEQ ID NO: 4100649 - DNA, 13 bp, Homo sapiens
tcccagcctgctg

SEQ ID NO: 4100650 - DNA, 11 bp, Homo sapiens
tcccagcctgg

SEQ ID NO: 4100651 - DNA, 12 bp, Homo sapiens
tcccagcctggg

SEQ ID NO: 4100652 - DNA, 14 bp, Homo sapiens
tcccagcctgtggt

SEQ ID NO: 4100653 - DNA, 15 bp, Homo sapiens
tcccagcctgtggtt

SEQ ID NO: 4100654 - DNA, 16 bp, Homo sapiens
tcccagctactcggga

SEQ ID NO: 4100655 - DNA, 16 bp, Homo sapiens
tcccagctacttggga

SEQ ID NO: 4100656 - DNA, 19 bp, Homo sapiens
tcccagctacttgggaggc

SEQ ID NO: 4100657 - DNA, 20 bp, Homo sapiens
tcccagcttaaatcctagca

SEQ ID NO: 4100658 - DNA, 16 bp, Homo sapiens
tcccaggaccctgaag

SEQ ID NO: 4100659 - DNA, 18 bp, Homo sapiens
tcccaggagatgggtcca

SEQ ID NO: 4100660 - DNA, 18 bp, Homo sapiens
tcccaggcgccccttccc

SEQ ID NO: 4100661 - DNA, 18 bp, Homo sapiens
tcccaggcttcaccctga

SEQ ID NO: 4100662 - DNA, 14 bp, Homo sapiens
tcccagggaaggac

SEQ ID NO: 4100663 - DNA, 12 bp, Homo sapiens
tcccagggctgg

SEQ ID NO: 4100664 - DNA, 15 bp, Homo sapiens
tcccagggctggctc

SEQ ID NO: 4100665 - DNA, 17 bp, Homo sapiens
tcccagggctggctctg

SEQ ID NO: 4100666 - DNA, 20 bp, Homo sapiens
tcccagggctggctctgcac

SEQ ID NO: 4100667 - DNA, 21 bp, Homo sapiens
tcccagggctggctctgcact

SEQ ID NO: 4100668 - DNA, 20 bp, Homo sapiens
tcccaggggtctccctggct

SEQ ID NO: 4100669 - DNA, 16 bp, Homo sapiens
tcccaggtaccagctg

SEQ ID NO: 4100670 - DNA, 17 bp, Homo sapiens
tcccaggtaccagctgc

SEQ ID NO: 4100671 - DNA, 15 bp, Homo sapiens
tcccaggttccagca

SEQ ID NO: 4100672 - DNA, 19 bp, Homo sapiens
tcccagtattctcagagca

SEQ ID NO: 4100673 - DNA, 16 bp, Homo sapiens
tcccagtcctccagac

SEQ ID NO: 4100674 - DNA, 20 bp, Homo sapiens
tcccagtgaactcctgccag

SEQ ID NO: 4100675 - DNA, 15 bp, Homo sapiens
tcccagtgacacttc

SEQ ID NO: 4100676 - DNA, 19 bp, Homo sapiens
tcccagtgacacttcagag

SEQ ID NO: 4100677 - DNA, 20 bp, Homo sapiens
tcccagtgacacttcagaga

SEQ ID NO: 4100678 - DNA, 22 bp, Homo sapiens
tcccagtgacacttcagagagc

SEQ ID NO: 4100679 - DNA, 19 bp, Homo sapiens
tcccagtgagactgcccca

SEQ ID NO: 4100680 - DNA, 15 bp, Homo sapiens
tcccagttcaggagt

SEQ ID NO: 4100681 - DNA, 23 bp, Homo sapiens
tcccagttcaggagtcccaagga

SEQ ID NO: 4100682 - DNA, 23 bp, Homo sapiens
tcccagttggggaagccaggtga

SEQ ID NO: 4100683 - DNA, 13 bp, Homo sapiens
tcccagttttgtt

SEQ ID NO: 4100684 - DNA, 15 bp, Homo sapiens
tcccatcttccaagg

SEQ ID NO: 4100685 - DNA, 14 bp, Homo sapiens
tcccatgactgcac

SEQ ID NO: 4100686 - DNA, 16 bp, Homo sapiens
tcccatgatccctgtg

SEQ ID NO: 4100687 - DNA, 19 bp, Homo sapiens
tcccatgatccctgtgttg

SEQ ID NO: 4100688 - DNA, 14 bp, Homo sapiens
tcccatggacactc

SEQ ID NO: 4100689 - DNA, 15 bp, Homo sapiens
tcccatggacactcc

SEQ ID NO: 4100690 - DNA, 20 bp, Homo sapiens
tcccatggacactccagtgc

SEQ ID NO: 4100691 - DNA, 21 bp, Homo sapiens
tcccatggacactccagtgcc

SEQ ID NO: 4100692 - DNA, 23 bp, Homo sapiens
tcccatgggcagaggaccaggct

SEQ ID NO: 4100693 - DNA, 10 bp, Homo sapiens
tcccatgtgg

SEQ ID NO: 4100694 - DNA, 17 bp, Homo sapiens
tcccattcctgaagaac

SEQ ID NO: 4100695 - DNA, 15 bp, Homo sapiens
tcccatttccttgga

SEQ ID NO: 4100696 - DNA, 20 bp, Homo sapiens
tcccatttccttggaggcca

SEQ ID NO: 4100697 - DNA, 21 bp, Homo sapiens
tcccatttccttggaggccac

SEQ ID NO: 4100698 - DNA, 23 bp, Homo sapiens
tcccatttctaaagctgaatgtc

SEQ ID NO: 4100699 - DNA, 16 bp, Homo sapiens
tcccatttctcactga

SEQ ID NO: 4100700 - DNA, 14 bp, Homo sapiens
tcccatttcttccc

SEQ ID NO: 4100701 - DNA, 13 bp, Homo sapiens
tcccattttgcaa

SEQ ID NO: 4100702 - DNA, 20 bp, Homo sapiens
tcccattttggaagttttca

SEQ ID NO: 4100703 - DNA, 18 bp, Homo sapiens
tcccattttggaatttgc

SEQ ID NO: 4100704 - DNA, 22 bp, Homo sapiens
tccccaaccctaggttccctgt

SEQ ID NO: 4100705 - DNA, 22 bp, Homo sapiens
tccccaaccgtgtctgtctggc

SEQ ID NO: 4100706 - DNA, 15 bp, Homo sapiens
tccccaagcccacca

SEQ ID NO: 4100707 - DNA, 16 bp, Homo sapiens
tccccaattctcccct

SEQ ID NO: 4100708 - DNA, 17 bp, Homo sapiens
tccccacagcgtccctg

SEQ ID NO: 4100709 - DNA, 19 bp, Homo sapiens
tccccacagcgtccctggc

SEQ ID NO: 4100710 - DNA, 19 bp, Homo sapiens
tccccacatcgcacactgg

SEQ ID NO: 4100711 - DNA, 13 bp, Homo sapiens
tccccacccctgc

SEQ ID NO: 4100712 - DNA, 14 bp, Homo sapiens
tccccacccctgcc

SEQ ID NO: 4100713 - DNA, 22 bp, Homo sapiens
tccccacccctgcccccagccc

SEQ ID NO: 4100714 - DNA, 15 bp, Homo sapiens
tccccaccctccact

SEQ ID NO: 4100715 - DNA, 19 bp, Homo sapiens
tccccaccctccactcagc

SEQ ID NO: 4100716 - DNA, 23 bp, Homo sapiens
tccccacggggcctcgggacctc

SEQ ID NO: 4100717 - DNA, 19 bp, Homo sapiens
tccccagaactctgcctgc

SEQ ID NO: 4100718 - DNA, 23 bp, Homo sapiens
tccccagacccttcttgcctgct

SEQ ID NO: 4100719 - DNA, 19 bp, Homo sapiens
tccccagagaggcactcag

SEQ ID NO: 4100720 - DNA, 19 bp, Homo sapiens
tccccagcatcactcccca

SEQ ID NO: 4100721 - DNA, 18 bp, Homo sapiens
tccccagccctggctctg

SEQ ID NO: 4100722 - DNA, 14 bp, Homo sapiens
tccccagccctgtc

SEQ ID NO: 4100723 - DNA, 18 bp, Homo sapiens
tccccagccctgtcctgg

SEQ ID NO: 4100724 - DNA, 22 bp, Homo sapiens
tccccagccctgtcctggttcc

SEQ ID NO: 4100725 - DNA, 20 bp, Homo sapiens
tccccagcccttcctctgct

SEQ ID NO: 4100726 - DNA, 21 bp, Homo sapiens
tccccagcccttcctctgctc

SEQ ID NO: 4100727 - DNA, 22 bp, Homo sapiens
tccccagcgtcccagtctctgg

SEQ ID NO: 4100728 - DNA, 14 bp, Homo sapiens
tccccaggccaggc

SEQ ID NO: 4100729 - DNA, 19 bp, Homo sapiens
tccccaggccaggccacca

SEQ ID NO: 4100730 - DNA, 15 bp, Homo sapiens
tccccagggagctct

SEQ ID NO: 4100731 - DNA, 17 bp, Homo sapiens
tccccagggagctctgg

SEQ ID NO: 4100732 - DNA, 19 bp, Homo sapiens
tccccagggagctctgggg

SEQ ID NO: 4100733 - DNA, 20 bp, Homo sapiens
tccccagggagctctgggga

SEQ ID NO: 4100734 - DNA, 15 bp, Homo sapiens
tccccaggggagttg

SEQ ID NO: 4100735 - DNA, 17 bp, Homo sapiens
tccccaggggtcccagc

SEQ ID NO: 4100736 - DNA, 22 bp, Homo sapiens
tccccaggggtcccagccaccc

SEQ ID NO: 4100737 - DNA, 18 bp, Homo sapiens
tccccaggtgtgtgcttt

SEQ ID NO: 4100738 - DNA, 22 bp, Homo sapiens
tccccagtctctcttaaagttg

SEQ ID NO: 4100739 - DNA, 17 bp, Homo sapiens
tccccataactcaatgg

SEQ ID NO: 4100740 - DNA, 16 bp, Homo sapiens
tccccatcaggtagct

SEQ ID NO: 4100741 - DNA, 17 bp, Homo sapiens
tccccatccccaccagc

SEQ ID NO: 4100742 - DNA, 18 bp, Homo sapiens
tccccatccccaccagct

SEQ ID NO: 4100743 - DNA, 20 bp, Homo sapiens
tccccatgccacgttccaca

SEQ ID NO: 4100744 - DNA, 22 bp, Homo sapiens
tccccatgcctagcagagtgct

SEQ ID NO: 4100745 - DNA, 16 bp, Homo sapiens
tccccatggagccagc

SEQ ID NO: 4100746 - DNA, 16 bp, Homo sapiens
tccccatttcccatct

SEQ ID NO: 4100747 - DNA, 17 bp, Homo sapiens
tccccatttcccatctg

SEQ ID NO: 4100748 - DNA, 20 bp, Homo sapiens
tccccatttcccatctgcac

SEQ ID NO: 4100749 - DNA, 17 bp, Homo sapiens
tccccatttctgcctcg

SEQ ID NO: 4100750 - DNA, 13 bp, Homo sapiens
tccatgcccactg

SEQ ID NO: 4100751 - DNA, 16 bp, Homo sapiens
tccatgcccactgctg

SEQ ID NO: 4100752 - DNA, 12 bp, Homo sapiens
tccatgcctgag

SEQ ID NO: 4100753 - DNA, 15 bp, Homo sapiens
tccatgcctgagggt

SEQ ID NO: 4100754 - DNA, 16 bp, Homo sapiens
tccatggccctgtccc

SEQ ID NO: 4100755 - DNA, 20 bp, Homo sapiens
tccatggccctgtcccaggc

SEQ ID NO: 4100756 - DNA, 13 bp, Homo sapiens
tccatggcctttc

SEQ ID NO: 4100757 - DNA, 18 bp, Homo sapiens
tccatggcctttctaata

SEQ ID NO: 4100758 - DNA, 15 bp, Homo sapiens
tccatgggagccagc

SEQ ID NO: 4100759 - DNA, 13 bp, Homo sapiens
tccatgtactgta

SEQ ID NO: 4100760 - DNA, 20 bp, Homo sapiens
tccatgtactgtagtttttc

SEQ ID NO: 4100761 - DNA, 20 bp, Homo sapiens
tccatgtgcacccggcctgg

SEQ ID NO: 4100762 - DNA, 21 bp, Homo sapiens
tccatgtgcacccggcctgga

SEQ ID NO: 4100763 - DNA, 16 bp, Homo sapiens
tccatgtgcctttctt

SEQ ID NO: 4100764 - DNA, 22 bp, Homo sapiens
tccatgtgcctttctttgcctc

SEQ ID NO: 4100765 - DNA, 16 bp, Homo sapiens
tccatgttctattttt

SEQ ID NO: 4100766 - DNA, 17 bp, Homo sapiens
tccatgtttgcaatgct

SEQ ID NO: 4100767 - DNA, 14 bp, Homo sapiens
tccattacctccat

SEQ ID NO: 4100768 - DNA, 14 bp, Homo sapiens
tccattaggatttg

SEQ ID NO: 4100769 - DNA, 17 bp, Homo sapiens
tccattaggccagcaac

SEQ ID NO: 4100770 - DNA, 13 bp, Homo sapiens
tccattatcttat

SEQ ID NO: 4100771 - DNA, 15 bp, Homo sapiens
tccattatgattctt

SEQ ID NO: 4100772 - DNA, 14 bp, Homo sapiens
tccattatttatat

SEQ ID NO: 4100773 - DNA, 16 bp, Homo sapiens
tccattcatccttcca

SEQ ID NO: 4100774 - DNA, 20 bp, Homo sapiens
tccattcatccttccatcca

SEQ ID NO: 4100775 - DNA, 18 bp, Homo sapiens
tccattgcctagctcttt

SEQ ID NO: 4100776 - DNA, 20 bp, Homo sapiens
tccattgggcacagtccaga

SEQ ID NO: 4100777 - DNA, 17 bp, Homo sapiens
tccatttatatatgaaa

SEQ ID NO: 4100778 - DNA, 19 bp, Homo sapiens
tccatttatatatgaaaac

SEQ ID NO: 4100779 - DNA, 23 bp, Homo sapiens
tccatttatatatgaaaactata

SEQ ID NO: 4100780 - DNA, 12 bp, Homo sapiens
tccatttgagaa

SEQ ID NO: 4100781 - DNA, 23 bp, Homo sapiens
tccatttgcctttctgggagcag

SEQ ID NO: 4100782 - DNA, 14 bp, Homo sapiens
tccattttccccca

SEQ ID NO: 4100783 - DNA, 17 bp, Homo sapiens
tccattttcccccacta

SEQ ID NO: 4100784 - DNA, 22 bp, Homo sapiens
tccattttcttattgcgctgct

SEQ ID NO: 4100785 - DNA, 14 bp, Homo sapiens
tcccaaaaaactac

SEQ ID NO: 4100786 - DNA, 23 bp, Homo sapiens
tcccaaagaactacccccttttc

SEQ ID NO: 4100787 - DNA, 12 bp, Homo sapiens
tcccaaaggcat

SEQ ID NO: 4100788 - DNA, 13 bp, Homo sapiens
tcccaagcctcct

SEQ ID NO: 4100789 - DNA, 13 bp, Homo sapiens
tcccaagctaggc

SEQ ID NO: 4100790 - DNA, 16 bp, Homo sapiens
tcccaagctcagaggc

SEQ ID NO: 4100791 - DNA, 13 bp, Homo sapiens
tcccaaggaaagc

SEQ ID NO: 4100792 - DNA, 17 bp, Homo sapiens
tcccaaggtcctctcag
